United States Patent 11,492,591 (UNIVERSAL DONOR STEM CELLS AND RELATED METHODS) - sequence listing, part 24

SEQ ID NO: 774697 - DNA, 20 bp, Artificial
  CRISPR gRNA sequence
atccacattcatcctgtggt

SEQ ID NO: 774698 - DNA, 20 bp, Artificial
  CRISPR gRNA sequence
atcctgtggtatctgcacat

SEQ ID NO: 774699 - DNA, 20 bp, Artificial
  CRISPR gRNA sequence
tggtatctgcacatggacag

SEQ ID NO: 774700 - DNA, 20 bp, Artificial
  CRISPR gRNA sequence
cacatggacagacaggctca

SEQ ID NO: 774701 - DNA, 20 bp, Artificial
  CRISPR gRNA sequence
acgcttgttcacacacacaa

SEQ ID NO: 774702 - DNA, 20 bp, Artificial
  CRISPR gRNA sequence
gttcacacacacaagacgta

SEQ ID NO: 774703 - DNA, 20 bp, Artificial
  CRISPR gRNA sequence
ttcacacacacaagacgtag

SEQ ID NO: 774704 - DNA, 20 bp, Artificial
  CRISPR gRNA sequence
acacacacaagacgtagact

SEQ ID NO: 774705 - DNA, 20 bp, Artificial
  CRISPR gRNA sequence
aaggtcacacacagacaaat

SEQ ID NO: 774706 - DNA, 20 bp, Artificial
  CRISPR gRNA sequence
cacacacacactcgttctgt

SEQ ID NO: 774707 - DNA, 20 bp, Artificial
  CRISPR gRNA sequence
gttctgtcactagaaagtga

SEQ ID NO: 774708 - DNA, 20 bp, Artificial
  CRISPR gRNA sequence
tgtcactagaaagtgacact

SEQ ID NO: 774709 - DNA, 20 bp, Artificial
  CRISPR gRNA sequence
tcactagaaagtgacactct

SEQ ID NO: 774710 - DNA, 20 bp, Artificial
  CRISPR gRNA sequence
gaaagtgacactctattgac

SEQ ID NO: 774711 - DNA, 20 bp, Artificial
  CRISPR gRNA sequence
tattgacatcaaagacagca

SEQ ID NO: 774712 - DNA, 20 bp, Artificial
  CRISPR gRNA sequence
ttgacatcaaagacagcaac

SEQ ID NO: 774713 - DNA, 20 bp, Artificial
  CRISPR gRNA sequence
acatcaaagacagcaacata

SEQ ID NO: 774714 - DNA, 20 bp, Artificial
  CRISPR gRNA sequence
acctgcattctcctcctcac

SEQ ID NO: 774715 - DNA, 20 bp, Artificial
  CRISPR gRNA sequence
cattctcctcctcacagctc

SEQ ID NO: 774716 - DNA, 20 bp, Artificial
  CRISPR gRNA sequence
tcctcctcacagctctgttt

SEQ ID NO: 774717 - DNA, 20 bp, Artificial
  CRISPR gRNA sequence
ctcctcacagctctgtttga

SEQ ID NO: 774718 - DNA, 20 bp, Artificial
  CRISPR gRNA sequence
ctcacagctctgtttgatct

SEQ ID NO: 774719 - DNA, 20 bp, Artificial
  CRISPR gRNA sequence
acagctctgtttgatctttc

SEQ ID NO: 774720 - DNA, 20 bp, Artificial
  CRISPR gRNA sequence
tgtttgatctttctccagca

SEQ ID NO: 774721 - DNA, 20 bp, Artificial
  CRISPR gRNA sequence
tttgatctttctccagcaca

SEQ ID NO: 774722 - DNA, 20 bp, Artificial
  CRISPR gRNA sequence
gatctttctccagcacacga

SEQ ID NO: 774723 - DNA, 20 bp, Artificial
  CRISPR gRNA sequence
atctttctccagcacacgaa

SEQ ID NO: 774724 - DNA, 20 bp, Artificial
  CRISPR gRNA sequence
tctccagcacacgaaagcca

SEQ ID NO: 774725 - DNA, 20 bp, Artificial
  CRISPR gRNA sequence
ctccagcacacgaaagccag

SEQ ID NO: 774726 - DNA, 20 bp, Artificial
  CRISPR gRNA sequence
tccagcacacgaaagccagg

SEQ ID NO: 774727 - DNA, 20 bp, Artificial
  CRISPR gRNA sequence
cagcacacgaaagccagggc

SEQ ID NO: 774728 - DNA, 20 bp, Artificial
  CRISPR gRNA sequence
tggggggaatgtcataggct

SEQ ID NO: 774729 - DNA, 20 bp, Artificial
  CRISPR gRNA sequence
gggggaatgtcataggctgc

SEQ ID NO: 774730 - DNA, 20 bp, Artificial
  CRISPR gRNA sequence
ccctgagaggaaaagtagca

SEQ ID NO: 774731 - DNA, 20 bp, Artificial
  CRISPR gRNA sequence
agaggaaaagtagcaacagt

SEQ ID NO: 774732 - DNA, 20 bp, Artificial
  CRISPR gRNA sequence
tcatgcctggccccatgtcc

SEQ ID NO: 774733 - DNA, 20 bp, Artificial
  CRISPR gRNA sequence
gccccatgtcccggaggaca

SEQ ID NO: 774734 - DNA, 20 bp, Artificial
  CRISPR gRNA sequence
gctccaagtgtgaacagggg

SEQ ID NO: 774735 - DNA, 20 bp, Artificial
  CRISPR gRNA sequence
caagtgtgaacaggggctcc

SEQ ID NO: 774736 - DNA, 20 bp, Artificial
  CRISPR gRNA sequence
ccaccctcactgggccctaa

SEQ ID NO: 774737 - DNA, 20 bp, Artificial
  CRISPR gRNA sequence
actgggccctaacactatga

SEQ ID NO: 774738 - DNA, 20 bp, Artificial
  CRISPR gRNA sequence
ggccctaacactatgaataa

SEQ ID NO: 774739 - DNA, 20 bp, Artificial
  CRISPR gRNA sequence
acactatgaataaagctcac

SEQ ID NO: 774740 - DNA, 20 bp, Artificial
  CRISPR gRNA sequence
tgaataaagctcacttaagt

SEQ ID NO: 774741 - DNA, 20 bp, Artificial
  CRISPR gRNA sequence
acttaagttcctacagtccc

SEQ ID NO: 774742 - DNA, 20 bp, Artificial
  CRISPR gRNA sequence
aagttcctacagtcccttcg

SEQ ID NO: 774743 - DNA, 20 bp, Artificial
  CRISPR gRNA sequence
agttcctacagtcccttcgc

SEQ ID NO: 774744 - DNA, 20 bp, Artificial
  CRISPR gRNA sequence
ctacagtcccttcgccatac

SEQ ID NO: 774745 - DNA, 20 bp, Artificial
  CRISPR gRNA sequence
cagtcccttcgccatacact

SEQ ID NO: 774746 - DNA, 20 bp, Artificial
  CRISPR gRNA sequence
cgccatacactccccaaacc

SEQ ID NO: 774747 - DNA, 20 bp, Artificial
  CRISPR gRNA sequence
gccatacactccccaaaccc

SEQ ID NO: 774748 - DNA, 20 bp, Artificial
  CRISPR gRNA sequence
cccaaaccctgatacaaccc

SEQ ID NO: 774749 - DNA, 20 bp, Artificial
  CRISPR gRNA sequence
atacaaccctggctgatgtg

SEQ ID NO: 774750 - DNA, 20 bp, Artificial
  CRISPR gRNA sequence
gctgatgtggacacgcctca

SEQ ID NO: 774751 - DNA, 20 bp, Artificial
  CRISPR gRNA sequence
atgtggacacgcctcaacca

SEQ ID NO: 774752 - DNA, 20 bp, Artificial
  CRISPR gRNA sequence
aaccaggaagggctgaagag

SEQ ID NO: 774753 - DNA, 20 bp, Artificial
  CRISPR gRNA sequence
aagagcctgtggttgaattg

SEQ ID NO: 774754 - DNA, 20 bp, Artificial
  CRISPR gRNA sequence
tggttgaattgatgctcaag

SEQ ID NO: 774755 - DNA, 20 bp, Artificial
  CRISPR gRNA sequence
aattgatgctcaagtacctt

SEQ ID NO: 774756 - DNA, 20 bp, Artificial
  CRISPR gRNA sequence
atgctcaagtaccttctatg

SEQ ID NO: 774757 - DNA, 20 bp, Artificial
  CRISPR gRNA sequence
aagtaccttctatggctccc

SEQ ID NO: 774758 - DNA, 20 bp, Artificial
  CRISPR gRNA sequence
ctatggctccctagtgactt

SEQ ID NO: 774759 - DNA, 20 bp, Artificial
  CRISPR gRNA sequence
tatggctccctagtgacttt

SEQ ID NO: 774760 - DNA, 20 bp, Artificial
  CRISPR gRNA sequence
tggctccctagtgactttag

SEQ ID NO: 774761 - DNA, 20 bp, Artificial
  CRISPR gRNA sequence
cctagtgactttagaataat

SEQ ID NO: 774762 - DNA, 20 bp, Artificial
  CRISPR gRNA sequence
gtgactttagaataatgctt

SEQ ID NO: 774763 - DNA, 20 bp, Artificial
  CRISPR gRNA sequence
tagaataatgcttcaagctt

SEQ ID NO: 774764 - DNA, 20 bp, Artificial
  CRISPR gRNA sequence
agaataatgcttcaagcttc

SEQ ID NO: 774765 - DNA, 20 bp, Artificial
  CRISPR gRNA sequence
gaataatgcttcaagcttca

SEQ ID NO: 774766 - DNA, 20 bp, Artificial
  CRISPR gRNA sequence
caagcttcaagcgtgattca

SEQ ID NO: 774767 - DNA, 20 bp, Artificial
  CRISPR gRNA sequence
aagcttcaagcgtgattcaa

SEQ ID NO: 774768 - DNA, 20 bp, Artificial
  CRISPR gRNA sequence
caagcgtgattcaaggacct

SEQ ID NO: 774769 - DNA, 20 bp, Artificial
  CRISPR gRNA sequence
aagcgtgattcaaggacctc

SEQ ID NO: 774770 - DNA, 20 bp, Artificial
  CRISPR gRNA sequence
aaggacctctagaagttggc

SEQ ID NO: 774771 - DNA, 20 bp, Artificial
  CRISPR gRNA sequence
tagaagttggctgctgctta

SEQ ID NO: 774772 - DNA, 20 bp, Artificial
  CRISPR gRNA sequence
gaagttggctgctgcttacc

SEQ ID NO: 774773 - DNA, 20 bp, Artificial
  CRISPR gRNA sequence
gctgctgcttaccctcccct

SEQ ID NO: 774774 - DNA, 20 bp, Artificial
  CRISPR gRNA sequence
ctgcttaccctcccctaagt

SEQ ID NO: 774775 - DNA, 20 bp, Artificial
  CRISPR gRNA sequence
cttaccctcccctaagtttt

SEQ ID NO: 774776 - DNA, 20 bp, Artificial
  CRISPR gRNA sequence
accctcccctaagttttcta

SEQ ID NO: 774777 - DNA, 20 bp, Artificial
  CRISPR gRNA sequence
ccctcccctaagttttctaa

SEQ ID NO: 774778 - DNA, 20 bp, Artificial
  CRISPR gRNA sequence
ccctaagttttctaattcta

SEQ ID NO: 774779 - DNA, 20 bp, Artificial
  CRISPR gRNA sequence
agttttctaattctactgta

SEQ ID NO: 774780 - DNA, 20 bp, Artificial
  CRISPR gRNA sequence
tctaattctactgtaggagc

SEQ ID NO: 774781 - DNA, 20 bp, Artificial
  CRISPR gRNA sequence
ctaattctactgtaggagcc

SEQ ID NO: 774782 - DNA, 20 bp, Artificial
  CRISPR gRNA sequence
taattctactgtaggagcct

SEQ ID NO: 774783 - DNA, 20 bp, Artificial
  CRISPR gRNA sequence
attctactgtaggagcctca

SEQ ID NO: 774784 - DNA, 20 bp, Artificial
  CRISPR gRNA sequence
tactgtaggagcctcagctt

SEQ ID NO: 774785 - DNA, 20 bp, Artificial
  CRISPR gRNA sequence
ctgtaggagcctcagcttca

SEQ ID NO: 774786 - DNA, 20 bp, Artificial
  CRISPR gRNA sequence
taggagcctcagcttcagcc

SEQ ID NO: 774787 - DNA, 20 bp, Artificial
  CRISPR gRNA sequence
agcttcagccaaactggtgt

SEQ ID NO: 774788 - DNA, 20 bp, Artificial
  CRISPR gRNA sequence
cagccaaactggtgtcctaa

SEQ ID NO: 774789 - DNA, 20 bp, Artificial
  CRISPR gRNA sequence
agccaaactggtgtcctaac

SEQ ID NO: 774790 - DNA, 20 bp, Artificial
  CRISPR gRNA sequence
gtgtcctaaccattctctcc

SEQ ID NO: 774791 - DNA, 20 bp, Artificial
  CRISPR gRNA sequence
accattctctccagaagcaa

SEQ ID NO: 774792 - DNA, 20 bp, Artificial
  CRISPR gRNA sequence
tctccagaagcaactggctc

SEQ ID NO: 774793 - DNA, 20 bp, Artificial
  CRISPR gRNA sequence
tccagaagcaactggctcct

SEQ ID NO: 774794 - DNA, 20 bp, Artificial
  CRISPR gRNA sequence
cagaagcaactggctccttc

SEQ ID NO: 774795 - DNA, 20 bp, Artificial
  CRISPR gRNA sequence
gctccttccagcctctgcac

SEQ ID NO: 774796 - DNA, 20 bp, Artificial
  CRISPR gRNA sequence
cttccagcctctgcactaat

SEQ ID NO: 774797 - DNA, 20 bp, Artificial
  CRISPR gRNA sequence
ccagcctctgcactaatgct

SEQ ID NO: 774798 - DNA, 20 bp, Artificial
  CRISPR gRNA sequence
cagcctctgcactaatgcta

SEQ ID NO: 774799 - DNA, 20 bp, Artificial
  CRISPR gRNA sequence
tgcactaatgctatcagttt

SEQ ID NO: 774800 - DNA, 20 bp, Artificial
  CRISPR gRNA sequence
cactaatgctatcagtttcc

SEQ ID NO: 774801 - DNA, 20 bp, Artificial
  CRISPR gRNA sequence
atgctatcagtttcccaaat

SEQ ID NO: 774802 - DNA, 20 bp, Artificial
  CRISPR gRNA sequence
tcagtttcccaaattctctg

SEQ ID NO: 774803 - DNA, 20 bp, Artificial
  CRISPR gRNA sequence
cccaaattctctgcttagct

SEQ ID NO: 774804 - DNA, 20 bp, Artificial
  CRISPR gRNA sequence
ccaaattctctgcttagctc

SEQ ID NO: 774805 - DNA, 20 bp, Artificial
  CRISPR gRNA sequence
tctgcttagctcaatattca

SEQ ID NO: 774806 - DNA, 20 bp, Artificial
  CRISPR gRNA sequence
tgcttagctcaatattcacc

SEQ ID NO: 774807 - DNA, 20 bp, Artificial
  CRISPR gRNA sequence
cttagctcaatattcacctc

SEQ ID NO: 774808 - DNA, 20 bp, Artificial
  CRISPR gRNA sequence
agctcaatattcacctcctc

SEQ ID NO: 774809 - DNA, 20 bp, Artificial
  CRISPR gRNA sequence
gctcaatattcacctcctcc

SEQ ID NO: 774810 - DNA, 20 bp, Artificial
  CRISPR gRNA sequence
aatattcacctcctccagag

SEQ ID NO: 774811 - DNA, 20 bp, Artificial
  CRISPR gRNA sequence
acctcctccagaggccctct

SEQ ID NO: 774812 - DNA, 20 bp, Artificial
  CRISPR gRNA sequence
ctccagaggccctcttttga

SEQ ID NO: 774813 - DNA, 20 bp, Artificial
  CRISPR gRNA sequence
cagaggccctcttttgactg

SEQ ID NO: 774814 - DNA, 20 bp, Artificial
  CRISPR gRNA sequence
ttttgactgcttcagcccta

SEQ ID NO: 774815 - DNA, 20 bp, Artificial
  CRISPR gRNA sequence
ttgactgcttcagccctacc

SEQ ID NO: 774816 - DNA, 20 bp, Artificial
  CRISPR gRNA sequence
tgactgcttcagccctacct

SEQ ID NO: 774817 - DNA, 20 bp, Artificial
  CRISPR gRNA sequence
gactgcttcagccctacctg

SEQ ID NO: 774818 - DNA, 20 bp, Artificial
  CRISPR gRNA sequence
actgcttcagccctacctgg

SEQ ID NO: 774819 - DNA, 20 bp, Artificial
  CRISPR gRNA sequence
cttcagccctacctggtgac

SEQ ID NO: 774820 - DNA, 20 bp, Artificial
  CRISPR gRNA sequence
cagccctacctggtgacatc

SEQ ID NO: 774821 - DNA, 20 bp, Artificial
  CRISPR gRNA sequence
agccctacctggtgacatct

SEQ ID NO: 774822 - DNA, 20 bp, Artificial
  CRISPR gRNA sequence
cctggtgacatctcccattc

SEQ ID NO: 774823 - DNA, 20 bp, Artificial
  CRISPR gRNA sequence
gtgacatctcccattctatg

SEQ ID NO: 774824 - DNA, 20 bp, Artificial
  CRISPR gRNA sequence
ccattctatggatcagaagg

SEQ ID NO: 774825 - DNA, 20 bp, Artificial
  CRISPR gRNA sequence
tatggatcagaaggcagcaa

SEQ ID NO: 774826 - DNA, 20 bp, Artificial
  CRISPR gRNA sequence
tggatcagaaggcagcaaac

SEQ ID NO: 774827 - DNA, 20 bp, Artificial
  CRISPR gRNA sequence
cagcccatgggccaaagctg

SEQ ID NO: 774828 - DNA, 20 bp, Artificial
  CRISPR gRNA sequence
gcttgtggcctgtttttgta

SEQ ID NO: 774829 - DNA, 20 bp, Artificial
  CRISPR gRNA sequence
gtggcctgtttttgtacagt

SEQ ID NO: 774830 - DNA, 20 bp, Artificial
  CRISPR gRNA sequence
tggcctgtttttgtacagtc

SEQ ID NO: 774831 - DNA, 20 bp, Artificial
  CRISPR gRNA sequence
tttttgtacagtccacaaac

SEQ ID NO: 774832 - DNA, 20 bp, Artificial
  CRISPR gRNA sequence
ttgtacagtccacaaactag

SEQ ID NO: 774833 - DNA, 20 bp, Artificial
  CRISPR gRNA sequence
tgtacagtccacaaactagt

SEQ ID NO: 774834 - DNA, 20 bp, Artificial
  CRISPR gRNA sequence
gtacagtccacaaactagtg

SEQ ID NO: 774835 - DNA, 20 bp, Artificial
  CRISPR gRNA sequence
tacagtccacaaactagtga

SEQ ID NO: 774836 - DNA, 20 bp, Artificial
  CRISPR gRNA sequence
gtgatggtttttacatttgt

SEQ ID NO: 774837 - DNA, 20 bp, Artificial
  CRISPR gRNA sequence
ttacatttgtaaagggttac

SEQ ID NO: 774838 - DNA, 20 bp, Artificial
  CRISPR gRNA sequence
tacatttgtaaagggttacc

SEQ ID NO: 774839 - DNA, 20 bp, Artificial
  CRISPR gRNA sequence
acatttgtaaagggttacca

SEQ ID NO: 774840 - DNA, 20 bp, Artificial
  CRISPR gRNA sequence
catttgtaaagggttaccaa

SEQ ID NO: 774841 - DNA, 20 bp, Artificial
  CRISPR gRNA sequence
gtaaagggttaccaaaaaaa

SEQ ID NO: 774842 - DNA, 20 bp, Artificial
  CRISPR gRNA sequence
taaagggttaccaaaaaaag

SEQ ID NO: 774843 - DNA, 20 bp, Artificial
  CRISPR gRNA sequence
ccaaaaaaagatgggggaag

SEQ ID NO: 774844 - DNA, 20 bp, Artificial
  CRISPR gRNA sequence
aaaacatttactccctggcc

SEQ ID NO: 774845 - DNA, 20 bp, Artificial
  CRISPR gRNA sequence
actccctggccatttacaga

SEQ ID NO: 774846 - DNA, 20 bp, Artificial
  CRISPR gRNA sequence
ctccctggccatttacagaa

SEQ ID NO: 774847 - DNA, 20 bp, Artificial
  CRISPR gRNA sequence
cctggccatttacagaaaat

SEQ ID NO: 774848 - DNA, 20 bp, Artificial
  CRISPR gRNA sequence
gccatttacagaaaatgttc

SEQ ID NO: 774849 - DNA, 20 bp, Artificial
  CRISPR gRNA sequence
acagaaaatgttcgctgagt

SEQ ID NO: 774850 - DNA, 20 bp, Artificial
  CRISPR gRNA sequence
cagaaaatgttcgctgagtc

SEQ ID NO: 774851 - DNA, 20 bp, Artificial
  CRISPR gRNA sequence
gctgagtcctacatacagat

SEQ ID NO: 774852 - DNA, 20 bp, Artificial
  CRISPR gRNA sequence
agtcctacatacagatgagg

SEQ ID NO: 774853 - DNA, 20 bp, Artificial
  CRISPR gRNA sequence
catacagatgaggtcactga

SEQ ID NO: 774854 - DNA, 20 bp, Artificial
  CRISPR gRNA sequence
acggggctggagtgagggct

SEQ ID NO: 774855 - DNA, 20 bp, Artificial
  CRISPR gRNA sequence
gagtgagggcttggagtttc

SEQ ID NO: 774856 - DNA, 20 bp, Artificial
  CRISPR gRNA sequence
ggagtttccccaaggagtca

SEQ ID NO: 774857 - DNA, 20 bp, Artificial
  CRISPR gRNA sequence
gagtttccccaaggagtcag

SEQ ID NO: 774858 - DNA, 20 bp, Artificial
  CRISPR gRNA sequence
ccccaaggagtcaggtaggt

SEQ ID NO: 774859 - DNA, 20 bp, Artificial
  CRISPR gRNA sequence
cccaaggagtcaggtaggtc

SEQ ID NO: 774860 - DNA, 20 bp, Artificial
  CRISPR gRNA sequence
caggggccttgccaggggga

SEQ ID NO: 774861 - DNA, 20 bp, Artificial
  CRISPR gRNA sequence
gccagggggatattaacatg

SEQ ID NO: 774862 - DNA, 20 bp, Artificial
  CRISPR gRNA sequence
ccagggggatattaacatga

SEQ ID NO: 774863 - DNA, 20 bp, Artificial
  CRISPR gRNA sequence
acatgaaacactgaggcccc

SEQ ID NO: 774864 - DNA, 20 bp, Artificial
  CRISPR gRNA sequence
aggcccctcctcttagagct

SEQ ID NO: 774865 - DNA, 20 bp, Artificial
  CRISPR gRNA sequence
ctcttagagctgtcacgtca

SEQ ID NO: 774866 - DNA, 20 bp, Artificial
  CRISPR gRNA sequence
ttagagctgtcacgtcaaga

SEQ ID NO: 774867 - DNA, 20 bp, Artificial
  CRISPR gRNA sequence
agagctgtcacgtcaagagg

SEQ ID NO: 774868 - DNA, 20 bp, Artificial
  CRISPR gRNA sequence
gagctgtcacgtcaagaggg

SEQ ID NO: 774869 - DNA, 20 bp, Artificial
  CRISPR gRNA sequence
tcacgtcaagagggatgaag

SEQ ID NO: 774870 - DNA, 20 bp, Artificial
  CRISPR gRNA sequence
aggacccaaagctgggtagg

SEQ ID NO: 774871 - DNA, 20 bp, Artificial
  CRISPR gRNA sequence
ggtagggccaggagctgttc

SEQ ID NO: 774872 - DNA, 20 bp, Artificial
  CRISPR gRNA sequence
ttctgagcacagcctgtgtg

SEQ ID NO: 774873 - DNA, 20 bp, Artificial
  CRISPR gRNA sequence
tgagcacagcctgtgtgact

SEQ ID NO: 774874 - DNA, 20 bp, Artificial
  CRISPR gRNA sequence
agcacagcctgtgtgactcc

SEQ ID NO: 774875 - DNA, 20 bp, Artificial
  CRISPR gRNA sequence
tgtgactccatcttacatac

SEQ ID NO: 774876 - DNA, 20 bp, Artificial
  CRISPR gRNA sequence
catcttacataccatcctct

SEQ ID NO: 774877 - DNA, 20 bp, Artificial
  CRISPR gRNA sequence
acataccatcctctagccca

SEQ ID NO: 774878 - DNA, 20 bp, Artificial
  CRISPR gRNA sequence
cataccatcctctagcccag

SEQ ID NO: 774879 - DNA, 20 bp, Artificial
  CRISPR gRNA sequence
tagcccagcccctgcaccca

SEQ ID NO: 774880 - DNA, 20 bp, Artificial
  CRISPR gRNA sequence
gcccagcccctgcacccagc

SEQ ID NO: 774881 - DNA, 20 bp, Artificial
  CRISPR gRNA sequence
cacccagctgggtcctaggg

SEQ ID NO: 774882 - DNA, 20 bp, Artificial
  CRISPR gRNA sequence
ggtcctagggagaagtcttg

SEQ ID NO: 774883 - DNA, 20 bp, Artificial
  CRISPR gRNA sequence
gggagaagtcttgagaggaa

SEQ ID NO: 774884 - DNA, 20 bp, Artificial
  CRISPR gRNA sequence
gagaggaaaagcctgacaaa

SEQ ID NO: 774885 - DNA, 20 bp, Artificial
  CRISPR gRNA sequence
agaggaaaagcctgacaaaa

SEQ ID NO: 774886 - DNA, 20 bp, Artificial
  CRISPR gRNA sequence
acaaaagacagtgctgcttt

SEQ ID NO: 774887 - DNA, 20 bp, Artificial
  CRISPR gRNA sequence
ctttcctttgctgtctggag

SEQ ID NO: 774888 - DNA, 20 bp, Artificial
  CRISPR gRNA sequence
tcctttgctgtctggagacg

SEQ ID NO: 774889 - DNA, 20 bp, Artificial
  CRISPR gRNA sequence
cctttgctgtctggagacga

SEQ ID NO: 774890 - DNA, 20 bp, Artificial
  CRISPR gRNA sequence
ctttgctgtctggagacgat

SEQ ID NO: 774891 - DNA, 20 bp, Artificial
  CRISPR gRNA sequence
tgctgtctggagacgatgca

SEQ ID NO: 774892 - DNA, 20 bp, Artificial
  CRISPR gRNA sequence
gctgtctggagacgatgcac

SEQ ID NO: 774893 - DNA, 20 bp, Artificial
  CRISPR gRNA sequence
ctgtctggagacgatgcaca

SEQ ID NO: 774894 - DNA, 20 bp, Artificial
  CRISPR gRNA sequence
tctggagacgatgcacaccc

SEQ ID NO: 774895 - DNA, 20 bp, Artificial
  CRISPR gRNA sequence
gagacgatgcacacccaggg

SEQ ID NO: 774896 - DNA, 20 bp, Artificial
  CRISPR gRNA sequence
agcagcttctgcaggaggcc

SEQ ID NO: 774897 - DNA, 20 bp, Artificial
  CRISPR gRNA sequence
ctgcaggaggccctgtcagt

SEQ ID NO: 774898 - DNA, 20 bp, Artificial
  CRISPR gRNA sequence
tgcaggaggccctgtcagtg

SEQ ID NO: 774899 - DNA, 20 bp, Artificial
  CRISPR gRNA sequence
caggaggccctgtcagtgca

SEQ ID NO: 774900 - DNA, 20 bp, Artificial
  CRISPR gRNA sequence
tcagtgcagtgcgcggtgct

SEQ ID NO: 774901 - DNA, 20 bp, Artificial
  CRISPR gRNA sequence
tggaccctttggcggcagag

SEQ ID NO: 774902 - DNA, 20 bp, Artificial
  CRISPR gRNA sequence
tggcggcagagaccccagca

SEQ ID NO: 774903 - DNA, 20 bp, Artificial
  CRISPR gRNA sequence
ggcggcagagaccccagcat

SEQ ID NO: 774904 - DNA, 20 bp, Artificial
  CRISPR gRNA sequence
gcggcagagaccccagcata

SEQ ID NO: 774905 - DNA, 20 bp, Artificial
  CRISPR gRNA sequence
gtgcatggatctgcagatgt

SEQ ID NO: 774906 - DNA, 20 bp, Artificial
  CRISPR gRNA sequence
cagatgtcaccttcaatagg

SEQ ID NO: 774907 - DNA, 20 bp, Artificial
  CRISPR gRNA sequence
caataggcactgctggcaaa

SEQ ID NO: 774908 - DNA, 20 bp, Artificial
  CRISPR gRNA sequence
aataggcactgctggcaaaa

SEQ ID NO: 774909 - DNA, 20 bp, Artificial
  CRISPR gRNA sequence
ctggcaaaactgctgctctg

SEQ ID NO: 774910 - DNA, 20 bp, Artificial
  CRISPR gRNA sequence
gcaaaactgctgctctggcc

SEQ ID NO: 774911 - DNA, 20 bp, Artificial
  CRISPR gRNA sequence
ctgctctggccattggaagc

SEQ ID NO: 774912 - DNA, 20 bp, Artificial
  CRISPR gRNA sequence
ctctggccattggaagcaca

SEQ ID NO: 774913 - DNA, 20 bp, Artificial
  CRISPR gRNA sequence
tggccattggaagcacaggg

SEQ ID NO: 774914 - DNA, 20 bp, Artificial
  CRISPR gRNA sequence
gccattggaagcacagggat

SEQ ID NO: 774915 - DNA, 20 bp, Artificial
  CRISPR gRNA sequence
gaagcacagggatccatcac

SEQ ID NO: 774916 - DNA, 20 bp, Artificial
  CRISPR gRNA sequence
atgtggccaagagggcccat

SEQ ID NO: 774917 - DNA, 20 bp, Artificial
  CRISPR gRNA sequence
aaaaacaataaccaccctgg

SEQ ID NO: 774918 - DNA, 20 bp, Artificial
  CRISPR gRNA sequence
gaaatcccatcatggggctc

SEQ ID NO: 774919 - DNA, 20 bp, Artificial
  CRISPR gRNA sequence
tgacagcagaggagggggca

SEQ ID NO: 774920 - DNA, 20 bp, Artificial
  CRISPR gRNA sequence
acagcagaggagggggcaga

SEQ ID NO: 774921 - DNA, 20 bp, Artificial
  CRISPR gRNA sequence
aagcagagggtctctatgtt

SEQ ID NO: 774922 - DNA, 20 bp, Artificial
  CRISPR gRNA sequence
tatgttcccccttaactggt

SEQ ID NO: 774923 - DNA, 20 bp, Artificial
  CRISPR gRNA sequence
tgttcccccttaactggtgg

SEQ ID NO: 774924 - DNA, 20 bp, Artificial
  CRISPR gRNA sequence
ccccttaactggtggtgtcc

SEQ ID NO: 774925 - DNA, 20 bp, Artificial
  CRISPR gRNA sequence
aactggtggtgtccctggaa

SEQ ID NO: 774926 - DNA, 20 bp, Artificial
  CRISPR gRNA sequence
actggtggtgtccctggaac

SEQ ID NO: 774927 - DNA, 20 bp, Artificial
  CRISPR gRNA sequence
gtggtgtccctggaacacaa

SEQ ID NO: 774928 - DNA, 20 bp, Artificial
  CRISPR gRNA sequence
gaacacaaattacatttgcc

SEQ ID NO: 774929 - DNA, 20 bp, Artificial
  CRISPR gRNA sequence
catttgccctgttcacccaa

SEQ ID NO: 774930 - DNA, 20 bp, Artificial
  CRISPR gRNA sequence
gccctgttcacccaagaaag

SEQ ID NO: 774931 - DNA, 20 bp, Artificial
  CRISPR gRNA sequence
ccctgttcacccaagaaagg

SEQ ID NO: 774932 - DNA, 20 bp, Artificial
  CRISPR gRNA sequence
ttcacccaagaaaggacagg

SEQ ID NO: 774933 - DNA, 20 bp, Artificial
  CRISPR gRNA sequence
acccaagaaaggacaggctc

SEQ ID NO: 774934 - DNA, 20 bp, Artificial
  CRISPR gRNA sequence
aggccacgtctctagggctt

SEQ ID NO: 774935 - DNA, 20 bp, Artificial
  CRISPR gRNA sequence
tagggcttgctccataaatc

SEQ ID NO: 774936 - DNA, 20 bp, Artificial
  CRISPR gRNA sequence
gggcttgctccataaatccc

SEQ ID NO: 774937 - DNA, 20 bp, Artificial
  CRISPR gRNA sequence
gctccataaatccccctcca

SEQ ID NO: 774938 - DNA, 20 bp, Artificial
  CRISPR gRNA sequence
ctccataaatccccctccaa

SEQ ID NO: 774939 - DNA, 20 bp, Artificial
  CRISPR gRNA sequence
cataaatccccctccaagag

SEQ ID NO: 774940 - DNA, 20 bp, Artificial
  CRISPR gRNA sequence
caagaggctctgcacagcac

SEQ ID NO: 774941 - DNA, 20 bp, Artificial
  CRISPR gRNA sequence
tgcacagcacacaacttcac

SEQ ID NO: 774942 - DNA, 20 bp, Artificial
  CRISPR gRNA sequence
cacagcacacaacttcacta

SEQ ID NO: 774943 - DNA, 20 bp, Artificial
  CRISPR gRNA sequence
cactaacttcatcaggtacg

SEQ ID NO: 774944 - DNA, 20 bp, Artificial
  CRISPR gRNA sequence
actaacttcatcaggtacgg

SEQ ID NO: 774945 - DNA, 20 bp, Artificial
  CRISPR gRNA sequence
acttcatcaggtacgggaga

SEQ ID NO: 774946 - DNA, 20 bp, Artificial
  CRISPR gRNA sequence
catcaggtacgggagagacc

SEQ ID NO: 774947 - DNA, 20 bp, Artificial
  CRISPR gRNA sequence
atcaggtacgggagagacca

SEQ ID NO: 774948 - DNA, 20 bp, Artificial
  CRISPR gRNA sequence
gaggactgaaagtctgaatc

SEQ ID NO: 774949 - DNA, 20 bp, Artificial
  CRISPR gRNA sequence
aaagtctgaatcccagaatg

SEQ ID NO: 774950 - DNA, 20 bp, Artificial
  CRISPR gRNA sequence
aatcccagaatgtttgacat

SEQ ID NO: 774951 - DNA, 20 bp, Artificial
  CRISPR gRNA sequence
gacatgatacaaagctgccc

SEQ ID NO: 774952 - DNA, 20 bp, Artificial
  CRISPR gRNA sequence
acatgatacaaagctgcccg

SEQ ID NO: 774953 - DNA, 20 bp, Artificial
  CRISPR gRNA sequence
cccgaagcaaaatacaggcc

SEQ ID NO: 774954 - DNA, 20 bp, Artificial
  CRISPR gRNA sequence
caaagtaggccagacctgct

SEQ ID NO: 774955 - DNA, 20 bp, Artificial
  CRISPR gRNA sequence
ctctaacagaaacaggaggc

SEQ ID NO: 774956 - DNA, 20 bp, Artificial
  CRISPR gRNA sequence
taacagaaacaggaggctgg

SEQ ID NO: 774957 - DNA, 20 bp, Artificial
  CRISPR gRNA sequence
acagaaacaggaggctggct

SEQ ID NO: 774958 - DNA, 20 bp, Artificial
  CRISPR gRNA sequence
gctggtgggaaggagaggaa

SEQ ID NO: 774959 - DNA, 20 bp, Artificial
  CRISPR gRNA sequence
gtgggaaggagaggaaatta

SEQ ID NO: 774960 - DNA, 20 bp, Artificial
  CRISPR gRNA sequence
ggctgagaggccaaagttgg

SEQ ID NO: 774961 - DNA, 20 bp, Artificial
  CRISPR gRNA sequence
agaggccaaagttggattct

SEQ ID NO: 774962 - DNA, 20 bp, Artificial
  CRISPR gRNA sequence
gattctgatcatggctcatc

SEQ ID NO: 774963 - DNA, 20 bp, Artificial
  CRISPR gRNA sequence
tgatcatggctcatctcctc

SEQ ID NO: 774964 - DNA, 20 bp, Artificial
  CRISPR gRNA sequence
atcatggctcatctcctcac

SEQ ID NO: 774965 - DNA, 20 bp, Artificial
  CRISPR gRNA sequence
atctcctcactgcagggcac

SEQ ID NO: 774966 - DNA, 20 bp, Artificial
  CRISPR gRNA sequence
ctcactgcagggcactggag

SEQ ID NO: 774967 - DNA, 20 bp, Artificial
  CRISPR gRNA sequence
actgcagggcactggagccc

SEQ ID NO: 774968 - DNA, 20 bp, Artificial
  CRISPR gRNA sequence
cagggcactggagcccaggt

SEQ ID NO: 774969 - DNA, 20 bp, Artificial
  CRISPR gRNA sequence
gagcccaggtctacagaccc

SEQ ID NO: 774970 - DNA, 20 bp, Artificial
  CRISPR gRNA sequence
cagacccacggaggagttta

SEQ ID NO: 774971 - DNA, 20 bp, Artificial
  CRISPR gRNA sequence
agagaggcagcgaaccctcc

SEQ ID NO: 774972 - DNA, 20 bp, Artificial
  CRISPR gRNA sequence
gagaggcagcgaaccctcca

SEQ ID NO: 774973 - DNA, 20 bp, Artificial
  CRISPR gRNA sequence
cagagttatgtgcaaactgc

SEQ ID NO: 774974 - DNA, 20 bp, Artificial
  CRISPR gRNA sequence
tgtgcaaactgctgcattga

SEQ ID NO: 774975 - DNA, 20 bp, Artificial
  CRISPR gRNA sequence
ctgcattgatcatttatcca

SEQ ID NO: 774976 - DNA, 20 bp, Artificial
  CRISPR gRNA sequence
cattgatcatttatccaatt

SEQ ID NO: 774977 - DNA, 20 bp, Artificial
  CRISPR gRNA sequence
atcatttatccaattttcaa

SEQ ID NO: 774978 - DNA, 20 bp, Artificial
  CRISPR gRNA sequence
atccaattttcaaagaaggg

SEQ ID NO: 774979 - DNA, 20 bp, Artificial
  CRISPR gRNA sequence
tccaattttcaaagaagggt

SEQ ID NO: 774980 - DNA, 20 bp, Artificial
  CRISPR gRNA sequence
tcaaagaagggtctgacccc

SEQ ID NO: 774981 - DNA, 20 bp, Artificial
  CRISPR gRNA sequence
caaagaagggtctgaccccc

SEQ ID NO: 774982 - DNA, 20 bp, Artificial
  CRISPR gRNA sequence
aaagaagggtctgaccccca

SEQ ID NO: 774983 - DNA, 20 bp, Artificial
  CRISPR gRNA sequence
acccccaaagattgagagcc

SEQ ID NO: 774984 - DNA, 20 bp, Artificial
  CRISPR gRNA sequence
agagccgctgtgccagtctg

SEQ ID NO: 774985 - DNA, 20 bp, Artificial
  CRISPR gRNA sequence
tgccagtctgtgaccttggg

SEQ ID NO: 774986 - DNA, 20 bp, Artificial
  CRISPR gRNA sequence
tgaccttgggaaagttcccc

SEQ ID NO: 774987 - DNA, 20 bp, Artificial
  CRISPR gRNA sequence
gggaaagttcccccttctct

SEQ ID NO: 774988 - DNA, 20 bp, Artificial
  CRISPR gRNA sequence
ggaaagttcccccttctctg

SEQ ID NO: 774989 - DNA, 20 bp, Artificial
  CRISPR gRNA sequence
ccccttctctgtggacctca

SEQ ID NO: 774990 - DNA, 20 bp, Artificial
  CRISPR gRNA sequence
ctctgtggacctcagtttct

SEQ ID NO: 774991 - DNA, 20 bp, Artificial
  CRISPR gRNA sequence
tctgtggacctcagtttctt

SEQ ID NO: 774992 - DNA, 20 bp, Artificial
  CRISPR gRNA sequence
tgtggacctcagtttcttcg

SEQ ID NO: 774993 - DNA, 20 bp, Artificial
  CRISPR gRNA sequence
tggacctcagtttcttcgtc

SEQ ID NO: 774994 - DNA, 20 bp, Artificial
  CRISPR gRNA sequence
agtttcttcgtctgtgaaat

SEQ ID NO: 774995 - DNA, 20 bp, Artificial
  CRISPR gRNA sequence
cttcgtctgtgaaatgtgct

SEQ ID NO: 774996 - DNA, 20 bp, Artificial
  CRISPR gRNA sequence
ttcgtctgtgaaatgtgctt

SEQ ID NO: 774997 - DNA, 20 bp, Artificial
  CRISPR gRNA sequence
cgtctgtgaaatgtgcttgg

SEQ ID NO: 774998 - DNA, 20 bp, Artificial
  CRISPR gRNA sequence
gtctgtgaaatgtgcttggc

SEQ ID NO: 774999 - DNA, 20 bp, Artificial
  CRISPR gRNA sequence
tgaaatgtgcttggcaacaa

SEQ ID NO: 775000 - DNA, 20 bp, Artificial
  CRISPR gRNA sequence
ggcaacaatggcctcaatga

SEQ ID NO: 775001 - DNA, 20 bp, Artificial
  CRISPR gRNA sequence
gcaacaatggcctcaatgaa

SEQ ID NO: 775002 - DNA, 20 bp, Artificial
  CRISPR gRNA sequence
aatgaaatcactttattttt

SEQ ID NO: 775003 - DNA, 20 bp, Artificial
  CRISPR gRNA sequence
tatttttattttatttattt

SEQ ID NO: 775004 - DNA, 20 bp, Artificial
  CRISPR gRNA sequence
atttttattttatttatttt

SEQ ID NO: 775005 - DNA, 20 bp, Artificial
  CRISPR gRNA sequence
tttttattttatttattttt

SEQ ID NO: 775006 - DNA, 20 bp, Artificial
  CRISPR gRNA sequence
ttattttatttattttttga

SEQ ID NO: 775007 - DNA, 20 bp, Artificial
  CRISPR gRNA sequence
tattttatttattttttgag

SEQ ID NO: 775008 - DNA, 20 bp, Artificial
  CRISPR gRNA sequence
attttatttattttttgaga

SEQ ID NO: 775009 - DNA, 20 bp, Artificial
  CRISPR gRNA sequence
ttttatttattttttgagac

SEQ ID NO: 775010 - DNA, 20 bp, Artificial
  CRISPR gRNA sequence
tatttattttttgagacagt

SEQ ID NO: 775011 - DNA, 20 bp, Artificial
  CRISPR gRNA sequence
atttattttttgagacagtg

SEQ ID NO: 775012 - DNA, 20 bp, Artificial
  CRISPR gRNA sequence
tttattttttgagacagtgt

SEQ ID NO: 775013 - DNA, 20 bp, Artificial
  CRISPR gRNA sequence
attttttgagacagtgtctt

SEQ ID NO: 775014 - DNA, 20 bp, Artificial
  CRISPR gRNA sequence
ttttttgagacagtgtcttg

SEQ ID NO: 775015 - DNA, 20 bp, Artificial
  CRISPR gRNA sequence
tttgagacagtgtcttgctc

SEQ ID NO: 775016 - DNA, 20 bp, Artificial
  CRISPR gRNA sequence
ttgagacagtgtcttgctct

SEQ ID NO: 775017 - DNA, 20 bp, Artificial
  CRISPR gRNA sequence
tgagacagtgtcttgctctg

SEQ ID NO: 775018 - DNA, 20 bp, Artificial
  CRISPR gRNA sequence
gagacagtgtcttgctctgt

SEQ ID NO: 775019 - DNA, 20 bp, Artificial
  CRISPR gRNA sequence
agacagtgtcttgctctgtc

SEQ ID NO: 775020 - DNA, 20 bp, Artificial
  CRISPR gRNA sequence
gctctgtcacccaggctgga

SEQ ID NO: 775021 - DNA, 20 bp, Artificial
  CRISPR gRNA sequence
ctctgtcacccaggctggag

SEQ ID NO: 775022 - DNA, 20 bp, Artificial
  CRISPR gRNA sequence
tgtcacccaggctggagtgc

SEQ ID NO: 775023 - DNA, 20 bp, Artificial
  CRISPR gRNA sequence
tcacccaggctggagtgcag

SEQ ID NO: 775024 - DNA, 20 bp, Artificial
  CRISPR gRNA sequence
gagtgcagtgacactgtctc

SEQ ID NO: 775025 - DNA, 20 bp, Artificial
  CRISPR gRNA sequence
tctcggctcactgcaacctc

SEQ ID NO: 775026 - DNA, 20 bp, Artificial
  CRISPR gRNA sequence
ggctcactgcaacctccgcc

SEQ ID NO: 775027 - DNA, 20 bp, Artificial
  CRISPR gRNA sequence
actgcaacctccgcctccca

SEQ ID NO: 775028 - DNA, 20 bp, Artificial
  CRISPR gRNA sequence
caacctccgcctcccaggtt

SEQ ID NO: 775029 - DNA, 20 bp, Artificial
  CRISPR gRNA sequence
cgcctcccaggttcaagcaa

SEQ ID NO: 775030 - DNA, 20 bp, Artificial
  CRISPR gRNA sequence
ccaggttcaagcaattctct

SEQ ID NO: 775031 - DNA, 20 bp, Artificial
  CRISPR gRNA sequence
aagcaattctcttgccccag

SEQ ID NO: 775032 - DNA, 20 bp, Artificial
  CRISPR gRNA sequence
tcttgccccagcctcccaag

SEQ ID NO: 775033 - DNA, 20 bp, Artificial
  CRISPR gRNA sequence
ttgccccagcctcccaagta

SEQ ID NO: 775034 - DNA, 20 bp, Artificial
  CRISPR gRNA sequence
gccccagcctcccaagtagc

SEQ ID NO: 775035 - DNA, 20 bp, Artificial
  CRISPR gRNA sequence
ccccagcctcccaagtagct

SEQ ID NO: 775036 - DNA, 20 bp, Artificial
  CRISPR gRNA sequence
ccaagtagctgggaccacag

SEQ ID NO: 775037 - DNA, 20 bp, Artificial
  CRISPR gRNA sequence
ggaccacaggtgcatgccac

SEQ ID NO: 775038 - DNA, 20 bp, Artificial
  CRISPR gRNA sequence
atttttgtgttttcagtaga

SEQ ID NO: 775039 - DNA, 20 bp, Artificial
  CRISPR gRNA sequence
ttgtgttttcagtagagaca

SEQ ID NO: 775040 - DNA, 20 bp, Artificial
  CRISPR gRNA sequence
tgtgttttcagtagagacag

SEQ ID NO: 775041 - DNA, 20 bp, Artificial
  CRISPR gRNA sequence
gtgttttcagtagagacagg

SEQ ID NO: 775042 - DNA, 20 bp, Artificial
  CRISPR gRNA sequence
tgttttcagtagagacaggg

SEQ ID NO: 775043 - DNA, 20 bp, Artificial
  CRISPR gRNA sequence
tcagtagagacagggtttca

SEQ ID NO: 775044 - DNA, 20 bp, Artificial
  CRISPR gRNA sequence
cagtagagacagggtttcac

SEQ ID NO: 775045 - DNA, 20 bp, Artificial
  CRISPR gRNA sequence
agtagagacagggtttcacc

SEQ ID NO: 775046 - DNA, 20 bp, Artificial
  CRISPR gRNA sequence
caccatgctgatcaggctgg

SEQ ID NO: 775047 - DNA, 20 bp, Artificial
  CRISPR gRNA sequence
accatgctgatcaggctggt

SEQ ID NO: 775048 - DNA, 20 bp, Artificial
  CRISPR gRNA sequence
atcaggctggtctcgaactc

SEQ ID NO: 775049 - DNA, 20 bp, Artificial
  CRISPR gRNA sequence
gtctcgaactcctgacctca

SEQ ID NO: 775050 - DNA, 20 bp, Artificial
  CRISPR gRNA sequence
gaactcctgacctcaagtga

SEQ ID NO: 775051 - DNA, 20 bp, Artificial
  CRISPR gRNA sequence
ctgacctcaagtgatccacc

SEQ ID NO: 775052 - DNA, 20 bp, Artificial
  CRISPR gRNA sequence
acctcaagtgatccacccgc

SEQ ID NO: 775053 - DNA, 20 bp, Artificial
  CRISPR gRNA sequence
aagtgatccacccgccttgg

SEQ ID NO: 775054 - DNA, 20 bp, Artificial
  CRISPR gRNA sequence
ggcctcccaaagtgctggga

SEQ ID NO: 775055 - DNA, 20 bp, Artificial
  CRISPR gRNA sequence
gcctcccaaagtgctgggat

SEQ ID NO: 775056 - DNA, 20 bp, Artificial
  CRISPR gRNA sequence
ccaaagtgctgggattacag

SEQ ID NO: 775057 - DNA, 20 bp, Artificial
  CRISPR gRNA sequence
ggattacaggtgtgagccac

SEQ ID NO: 775058 - DNA, 20 bp, Artificial
  CRISPR gRNA sequence
caggtgtgagccaccatgcc

SEQ ID NO: 775059 - DNA, 20 bp, Artificial
  CRISPR gRNA sequence
aatttttttgaaatcacttt

SEQ ID NO: 775060 - DNA, 20 bp, Artificial
  CRISPR gRNA sequence
ttttgaaatcactttaaatg

SEQ ID NO: 775061 - DNA, 20 bp, Artificial
  CRISPR gRNA sequence
tttgaaatcactttaaatgt

SEQ ID NO: 775062 - DNA, 20 bp, Artificial
  CRISPR gRNA sequence
ttgaaatcactttaaatgtt

SEQ ID NO: 775063 - DNA, 20 bp, Artificial
  CRISPR gRNA sequence
tgaaatcactttaaatgtta

SEQ ID NO: 775064 - DNA, 20 bp, Artificial
  CRISPR gRNA sequence
gaaatcactttaaatgttag

SEQ ID NO: 775065 - DNA, 20 bp, Artificial
  CRISPR gRNA sequence
aaatcactttaaatgttagc

SEQ ID NO: 775066 - DNA, 20 bp, Artificial
  CRISPR gRNA sequence
taaatgttagctactcaagt

SEQ ID NO: 775067 - DNA, 20 bp, Artificial
  CRISPR gRNA sequence
aaatgttagctactcaagtt

SEQ ID NO: 775068 - DNA, 20 bp, Artificial
  CRISPR gRNA sequence
aatgttagctactcaagttt

SEQ ID NO: 775069 - DNA, 20 bp, Artificial
  CRISPR gRNA sequence
gctactcaagtttaaaatag

SEQ ID NO: 775070 - DNA, 20 bp, Artificial
  CRISPR gRNA sequence
ctcaagtttaaaatagagaa

SEQ ID NO: 775071 - DNA, 20 bp, Artificial
  CRISPR gRNA sequence
aagtttaaaatagagaattt

SEQ ID NO: 775072 - DNA, 20 bp, Artificial
  CRISPR gRNA sequence
aaaatagagaattttctctt

SEQ ID NO: 775073 - DNA, 20 bp, Artificial
  CRISPR gRNA sequence
aaatagagaattttctctta

SEQ ID NO: 775074 - DNA, 20 bp, Artificial
  CRISPR gRNA sequence
tctcttaggtgagataaaca

SEQ ID NO: 775075 - DNA, 20 bp, Artificial
  CRISPR gRNA sequence
ctcttaggtgagataaacat

SEQ ID NO: 775076 - DNA, 20 bp, Artificial
  CRISPR gRNA sequence
tcttaggtgagataaacatt

SEQ ID NO: 775077 - DNA, 20 bp, Artificial
  CRISPR gRNA sequence
ttaggtgagataaacattct

SEQ ID NO: 775078 - DNA, 20 bp, Artificial
  CRISPR gRNA sequence
aggtgagataaacattctct

SEQ ID NO: 775079 - DNA, 20 bp, Artificial
  CRISPR gRNA sequence
ggtgagataaacattctctt

SEQ ID NO: 775080 - DNA, 20 bp, Artificial
  CRISPR gRNA sequence
tctttgcaatcacatttata

SEQ ID NO: 775081 - DNA, 20 bp, Artificial
  CRISPR gRNA sequence
tttgcaatcacatttatact

SEQ ID NO: 775082 - DNA, 20 bp, Artificial
  CRISPR gRNA sequence
tgcaatcacatttatactca

SEQ ID NO: 775083 - DNA, 20 bp, Artificial
  CRISPR gRNA sequence
gcaatcacatttatactcat

SEQ ID NO: 775084 - DNA, 20 bp, Artificial
  CRISPR gRNA sequence
caatcacatttatactcata

SEQ ID NO: 775085 - DNA, 20 bp, Artificial
  CRISPR gRNA sequence
atactcataagtcctttctg

SEQ ID NO: 775086 - DNA, 20 bp, Artificial
  CRISPR gRNA sequence
tactcataagtcctttctgc

SEQ ID NO: 775087 - DNA, 20 bp, Artificial
  CRISPR gRNA sequence
ataagtcctttctgcacagc

SEQ ID NO: 775088 - DNA, 20 bp, Artificial
  CRISPR gRNA sequence
tctgcacagcatcgcaaata

SEQ ID NO: 775089 - DNA, 20 bp, Artificial
  CRISPR gRNA sequence
ctgcacagcatcgcaaatat

SEQ ID NO: 775090 - DNA, 20 bp, Artificial
  CRISPR gRNA sequence
tgcacagcatcgcaaatatc

SEQ ID NO: 775091 - DNA, 20 bp, Artificial
  CRISPR gRNA sequence
cacagcatcgcaaatatcca

SEQ ID NO: 775092 - DNA, 20 bp, Artificial
  CRISPR gRNA sequence
agcccagggtgcaaatgacc

SEQ ID NO: 775093 - DNA, 20 bp, Artificial
  CRISPR gRNA sequence
atccttcaaggccttctcag

SEQ ID NO: 775094 - DNA, 20 bp, Artificial
  CRISPR gRNA sequence
tccttcaaggccttctcagc

SEQ ID NO: 775095 - DNA, 20 bp, Artificial
  CRISPR gRNA sequence
caaggccttctcagctccca

SEQ ID NO: 775096 - DNA, 20 bp, Artificial
  CRISPR gRNA sequence
aaggccttctcagctcccat

SEQ ID NO: 775097 - DNA, 20 bp, Artificial
  CRISPR gRNA sequence
ctcagctcccatttgcccct

SEQ ID NO: 775098 - DNA, 20 bp, Artificial
  CRISPR gRNA sequence
tcagctcccatttgcccctg

SEQ ID NO: 775099 - DNA, 20 bp, Artificial
  CRISPR gRNA sequence
agctcccatttgcccctgga

SEQ ID NO: 775100 - DNA, 20 bp, Artificial
  CRISPR gRNA sequence
ccatttgcccctggaggtgt

SEQ ID NO: 775101 - DNA, 20 bp, Artificial
  CRISPR gRNA sequence
gcccctggaggtgtcctcac

SEQ ID NO: 775102 - DNA, 20 bp, Artificial
  CRISPR gRNA sequence
cccctggaggtgtcctcact

SEQ ID NO: 775103 - DNA, 20 bp, Artificial
  CRISPR gRNA sequence
gaggtgtcctcactaccacc

SEQ ID NO: 775104 - DNA, 20 bp, Artificial
  CRISPR gRNA sequence
actaccaccctccctcctct

SEQ ID NO: 775105 - DNA, 20 bp, Artificial
  CRISPR gRNA sequence
ccaccctccctcctctgaaa

SEQ ID NO: 775106 - DNA, 20 bp, Artificial
  CRISPR gRNA sequence
cctcctctgaaagcttcata

SEQ ID NO: 775107 - DNA, 20 bp, Artificial
  CRISPR gRNA sequence
ctctgaaagcttcatatcct

SEQ ID NO: 775108 - DNA, 20 bp, Artificial
  CRISPR gRNA sequence
tgaaagcttcatatcctctg

SEQ ID NO: 775109 - DNA, 20 bp, Artificial
  CRISPR gRNA sequence
aaagcttcatatcctctgcc

SEQ ID NO: 775110 - DNA, 20 bp, Artificial
  CRISPR gRNA sequence
catatcctctgccaagatca

SEQ ID NO: 775111 - DNA, 20 bp, Artificial
  CRISPR gRNA sequence
atatcctctgccaagatcac

SEQ ID NO: 775112 - DNA, 20 bp, Artificial
  CRISPR gRNA sequence
tgccaagatcactctatctt

SEQ ID NO: 775113 - DNA, 20 bp, Artificial
  CRISPR gRNA sequence
ccaagatcactctatcttct

SEQ ID NO: 775114 - DNA, 20 bp, Artificial
  CRISPR gRNA sequence
tatcttctatttcttctttt

SEQ ID NO: 775115 - DNA, 20 bp, Artificial
  CRISPR gRNA sequence
tcttctatttcttcttttcg

SEQ ID NO: 775116 - DNA, 20 bp, Artificial
  CRISPR gRNA sequence
ctatttcttcttttcgcctg

SEQ ID NO: 775117 - DNA, 20 bp, Artificial
  CRISPR gRNA sequence
tatttcttcttttcgcctgt

SEQ ID NO: 775118 - DNA, 20 bp, Artificial
  CRISPR gRNA sequence
tttcttcttttcgcctgtga

SEQ ID NO: 775119 - DNA, 20 bp, Artificial
  CRISPR gRNA sequence
cttcttttcgcctgtgaaca

SEQ ID NO: 775120 - DNA, 20 bp, Artificial
  CRISPR gRNA sequence
ttcttttcgcctgtgaacag

SEQ ID NO: 775121 - DNA, 20 bp, Artificial
  CRISPR gRNA sequence
cttttcgcctgtgaacagca

SEQ ID NO: 775122 - DNA, 20 bp, Artificial
  CRISPR gRNA sequence
ttttcgcctgtgaacagcat

SEQ ID NO: 775123 - DNA, 20 bp, Artificial
  CRISPR gRNA sequence
ttcgcctgtgaacagcattt

SEQ ID NO: 775124 - DNA, 20 bp, Artificial
  CRISPR gRNA sequence
tcgcctgtgaacagcatttt

SEQ ID NO: 775125 - DNA, 20 bp, Artificial
  CRISPR gRNA sequence
cgcctgtgaacagcattttc

SEQ ID NO: 775126 - DNA, 20 bp, Artificial
  CRISPR gRNA sequence
gcctgtgaacagcattttca

SEQ ID NO: 775127 - DNA, 20 bp, Artificial
  CRISPR gRNA sequence
tgaacagcattttcaccacc

SEQ ID NO: 775128 - DNA, 20 bp, Artificial
  CRISPR gRNA sequence
tcaccaccaaaccatatgct

SEQ ID NO: 775129 - DNA, 20 bp, Artificial
  CRISPR gRNA sequence
caccaccaaaccatatgctg

SEQ ID NO: 775130 - DNA, 20 bp, Artificial
  CRISPR gRNA sequence
accaccaaaccatatgctgt

SEQ ID NO: 775131 - DNA, 20 bp, Artificial
  CRISPR gRNA sequence
ttctctaaaaggtcaaggac

SEQ ID NO: 775132 - DNA, 20 bp, Artificial
  CRISPR gRNA sequence
tctaaaaggtcaaggacatg

SEQ ID NO: 775133 - DNA, 20 bp, Artificial
  CRISPR gRNA sequence
taaaaggtcaaggacatgtc

SEQ ID NO: 775134 - DNA, 20 bp, Artificial
  CRISPR gRNA sequence
aaaggtcaaggacatgtctc

SEQ ID NO: 775135 - DNA, 20 bp, Artificial
  CRISPR gRNA sequence
agaacattcaagagctcagg

SEQ ID NO: 775136 - DNA, 20 bp, Artificial
  CRISPR gRNA sequence
aagagctcagggcagctact

SEQ ID NO: 775137 - DNA, 20 bp, Artificial
  CRISPR gRNA sequence
agggcagctactctctcctg

SEQ ID NO: 775138 - DNA, 20 bp, Artificial
  CRISPR gRNA sequence
ctctctcctggagagcacag

SEQ ID NO: 775139 - DNA, 20 bp, Artificial
  CRISPR gRNA sequence
tctcctggagagcacaggaa

SEQ ID NO: 775140 - DNA, 20 bp, Artificial
  CRISPR gRNA sequence
tcctggagagcacaggaagg

SEQ ID NO: 775141 - DNA, 20 bp, Artificial
  CRISPR gRNA sequence
ctggagagcacaggaaggga

SEQ ID NO: 775142 - DNA, 20 bp, Artificial
  CRISPR gRNA sequence
gagagcacaggaagggagtg

SEQ ID NO: 775143 - DNA, 20 bp, Artificial
  CRISPR gRNA sequence
tccatcttggggaaggggtg

SEQ ID NO: 775144 - DNA, 20 bp, Artificial
  CRISPR gRNA sequence
ccatcttggggaaggggtgg

SEQ ID NO: 775145 - DNA, 20 bp, Artificial
  CRISPR gRNA sequence
catcttggggaaggggtggg

SEQ ID NO: 775146 - DNA, 20 bp, Artificial
  CRISPR gRNA sequence
ggggaaggggtgggcagaag

SEQ ID NO: 775147 - DNA, 20 bp, Artificial
  CRISPR gRNA sequence
gggaaggggtgggcagaagg

SEQ ID NO: 775148 - DNA, 20 bp, Artificial
  CRISPR gRNA sequence
gccagaaggaaacacgtaag

SEQ ID NO: 775149 - DNA, 20 bp, Artificial
  CRISPR gRNA sequence
ccagaaggaaacacgtaaga

SEQ ID NO: 775150 - DNA, 20 bp, Artificial
  CRISPR gRNA sequence
aactccaagcagacgatgtg

SEQ ID NO: 775151 - DNA, 20 bp, Artificial
  CRISPR gRNA sequence
caagcagacgatgtgacggg

SEQ ID NO: 775152 - DNA, 20 bp, Artificial
  CRISPR gRNA sequence
gctccgagcttgtcagaagt

SEQ ID NO: 775153 - DNA, 20 bp, Artificial
  CRISPR gRNA sequence
cgagcttgtcagaagtgggg

SEQ ID NO: 775154 - DNA, 20 bp, Artificial
  CRISPR gRNA sequence
gtcagaagtggggaccacat

SEQ ID NO: 775155 - DNA, 20 bp, Artificial
  CRISPR gRNA sequence
tcagaagtggggaccacata

SEQ ID NO: 775156 - DNA, 20 bp, Artificial
  CRISPR gRNA sequence
aagagggagaggacaggaat

SEQ ID NO: 775157 - DNA, 20 bp, Artificial
  CRISPR gRNA sequence
aggtgcatgcagacctggaa

SEQ ID NO: 775158 - DNA, 20 bp, Artificial
  CRISPR gRNA sequence
gaaacttggggtgagatcag

SEQ ID NO: 775159 - DNA, 20 bp, Artificial
  CRISPR gRNA sequence
ggggtgagatcagaacttgg

SEQ ID NO: 775160 - DNA, 20 bp, Artificial
  CRISPR gRNA sequence
gggtgagatcagaacttgga

SEQ ID NO: 775161 - DNA, 20 bp, Artificial
  CRISPR gRNA sequence
ggatgggctgaggggcagat

SEQ ID NO: 775162 - DNA, 20 bp, Artificial
  CRISPR gRNA sequence
gatgggctgaggggcagatg

SEQ ID NO: 775163 - DNA, 20 bp, Artificial
  CRISPR gRNA sequence
aggggcagatggaagtcatc

SEQ ID NO: 775164 - DNA, 20 bp, Artificial
  CRISPR gRNA sequence
ctgtcctgacctcactgtgc

SEQ ID NO: 775165 - DNA, 20 bp, Artificial
  CRISPR gRNA sequence
tcctgacctcactgtgcacc

SEQ ID NO: 775166 - DNA, 20 bp, Artificial
  CRISPR gRNA sequence
acctcactgtgcaccagggc

SEQ ID NO: 775167 - DNA, 20 bp, Artificial
  CRISPR gRNA sequence
actgtgcaccagggcgaggt

SEQ ID NO: 775168 - DNA, 20 bp, Artificial
  CRISPR gRNA sequence
tgcaccagggcgaggtccct

SEQ ID NO: 775169 - DNA, 20 bp, Artificial
  CRISPR gRNA sequence
ggaaagctcagttggccagg

SEQ ID NO: 775170 - DNA, 20 bp, Artificial
  CRISPR gRNA sequence
agttggccagggagagatac

SEQ ID NO: 775171 - DNA, 20 bp, Artificial
  CRISPR gRNA sequence
gccagggagagatactgaag

SEQ ID NO: 775172 - DNA, 20 bp, Artificial
  CRISPR gRNA sequence
aagagccagactgagcacgt

SEQ ID NO: 775173 - DNA, 20 bp, Artificial
  CRISPR gRNA sequence
agcacgtcggcccaggaagt

SEQ ID NO: 775174 - DNA, 20 bp, Artificial
  CRISPR gRNA sequence
accagaggcctctcagggcc

SEQ ID NO: 775175 - DNA, 20 bp, Artificial
  CRISPR gRNA sequence
tcagggccaaacacagatgg

SEQ ID NO: 775176 - DNA, 20 bp, Artificial
  CRISPR gRNA sequence
agggccaaacacagatggag

SEQ ID NO: 775177 - DNA, 20 bp, Artificial
  CRISPR gRNA sequence
cggctcttgacctcaaccct

SEQ ID NO: 775178 - DNA, 20 bp, Artificial
  CRISPR gRNA sequence
ttgacctcaaccctcttcac

SEQ ID NO: 775179 - DNA, 20 bp, Artificial
  CRISPR gRNA sequence
gacctcaaccctcttcacac

SEQ ID NO: 775180 - DNA, 20 bp, Artificial
  CRISPR gRNA sequence
acctcaaccctcttcacacc

SEQ ID NO: 775181 - DNA, 20 bp, Artificial
  CRISPR gRNA sequence
aaccctcttcacaccctcag

SEQ ID NO: 775182 - DNA, 20 bp, Artificial
  CRISPR gRNA sequence
ttcacaccctcaggcacaag

SEQ ID NO: 775183 - DNA, 20 bp, Artificial
  CRISPR gRNA sequence
cacaccctcaggcacaagag

SEQ ID NO: 775184 - DNA, 20 bp, Artificial
  CRISPR gRNA sequence
acaccctcaggcacaagagg

SEQ ID NO: 775185 - DNA, 20 bp, Artificial
  CRISPR gRNA sequence
aggcacaagaggtgcccacg

SEQ ID NO: 775186 - DNA, 20 bp, Artificial
  CRISPR gRNA sequence
gaacctggaaaccagagact

SEQ ID NO: 775187 - DNA, 20 bp, Artificial
  CRISPR gRNA sequence
gaaaccagagactaacaatc

SEQ ID NO: 775188 - DNA, 20 bp, Artificial
  CRISPR gRNA sequence
acaatcactaaaggggtggc

SEQ ID NO: 775189 - DNA, 20 bp, Artificial
  CRISPR gRNA sequence
aaggggtggcctctatctgg

SEQ ID NO: 775190 - DNA, 20 bp, Artificial
  CRISPR gRNA sequence
tatctggtgtttgaccacac

SEQ ID NO: 775191 - DNA, 20 bp, Artificial
  CRISPR gRNA sequence
tctggtgtttgaccacacgg

SEQ ID NO: 775192 - DNA, 20 bp, Artificial
  CRISPR gRNA sequence
gtgtttgaccacacgggggc

SEQ ID NO: 775193 - DNA, 20 bp, Artificial
  CRISPR gRNA sequence
gaccacacgggggcagcaga

SEQ ID NO: 775194 - DNA, 20 bp, Artificial
  CRISPR gRNA sequence
accacacgggggcagcagag

SEQ ID NO: 775195 - DNA, 20 bp, Artificial
  CRISPR gRNA sequence
cccatccaacggctgcctgg

SEQ ID NO: 775196 - DNA, 20 bp, Artificial
  CRISPR gRNA sequence
cctgggtggagcgcaagtct

SEQ ID NO: 775197 - DNA, 20 bp, Artificial
  CRISPR gRNA sequence
ggtggagcgcaagtctgcag

SEQ ID NO: 775198 - DNA, 20 bp, Artificial
  CRISPR gRNA sequence
caggaagaagagctgacgtt

SEQ ID NO: 775199 - DNA, 20 bp, Artificial
  CRISPR gRNA sequence
acgttgactcaggtgttggg

SEQ ID NO: 775200 - DNA, 20 bp, Artificial
  CRISPR gRNA sequence
actcaggtgttggggactaa

SEQ ID NO: 775201 - DNA, 20 bp, Artificial
  CRISPR gRNA sequence
aggtgttggggactaactag

SEQ ID NO: 775202 - DNA, 20 bp, Artificial
  CRISPR gRNA sequence
gggactaactagggagggcc

SEQ ID NO: 775203 - DNA, 20 bp, Artificial
  CRISPR gRNA sequence
actagggagggccagctgtc

SEQ ID NO: 775204 - DNA, 20 bp, Artificial
  CRISPR gRNA sequence
gggagggccagctgtcactc

SEQ ID NO: 775205 - DNA, 20 bp, Artificial
  CRISPR gRNA sequence
tcactcaggcttcagaatca

SEQ ID NO: 775206 - DNA, 20 bp, Artificial
  CRISPR gRNA sequence
aggcttcagaatcagatggc

SEQ ID NO: 775207 - DNA, 20 bp, Artificial
  CRISPR gRNA sequence
cagaatcagatggcgcccac

SEQ ID NO: 775208 - DNA, 20 bp, Artificial
  CRISPR gRNA sequence
agaatcagatggcgcccact

SEQ ID NO: 775209 - DNA, 20 bp, Artificial
  CRISPR gRNA sequence
acccagaataccttcctacc

SEQ ID NO: 775210 - DNA, 20 bp, Artificial
  CRISPR gRNA sequence
cctaccactcagaggagttc

SEQ ID NO: 775211 - DNA, 20 bp, Artificial
  CRISPR gRNA sequence
ctaccactcagaggagttcc

SEQ ID NO: 775212 - DNA, 20 bp, Artificial
  CRISPR gRNA sequence
ccactcagaggagttcctgc

SEQ ID NO: 775213 - DNA, 20 bp, Artificial
  CRISPR gRNA sequence
agaggagttcctgctggaaa

SEQ ID NO: 775214 - DNA, 20 bp, Artificial
  CRISPR gRNA sequence
ctgctggaaagcacacccac

SEQ ID NO: 775215 - DNA, 20 bp, Artificial
  CRISPR gRNA sequence
ctggaaagcacacccacacc

SEQ ID NO: 775216 - DNA, 20 bp, Artificial
  CRISPR gRNA sequence
gaaagcacacccacaccaag

SEQ ID NO: 775217 - DNA, 20 bp, Artificial
  CRISPR gRNA sequence
ggccacaccttgtggctgcc

SEQ ID NO: 775218 - DNA, 20 bp, Artificial
  CRISPR gRNA sequence
gtggctgccccagaattcct

SEQ ID NO: 775219 - DNA, 20 bp, Artificial
  CRISPR gRNA sequence
tggctgccccagaattcctg

SEQ ID NO: 775220 - DNA, 20 bp, Artificial
  CRISPR gRNA sequence
ccccagaattcctgcccatg

SEQ ID NO: 775221 - DNA, 20 bp, Artificial
  CRISPR gRNA sequence
ctgcccatgcctccaaattt

SEQ ID NO: 775222 - DNA, 20 bp, Artificial
  CRISPR gRNA sequence
cccatgcctccaaatttcgg

SEQ ID NO: 775223 - DNA, 20 bp, Artificial
  CRISPR gRNA sequence
caaatttcgggcaggtacct

SEQ ID NO: 775224 - DNA, 20 bp, Artificial
  CRISPR gRNA sequence
cgggcaggtaccttgtcctc

SEQ ID NO: 775225 - DNA, 20 bp, Artificial
  CRISPR gRNA sequence
gggcaggtaccttgtcctct

SEQ ID NO: 775226 - DNA, 20 bp, Artificial
  CRISPR gRNA sequence
gtcctctgcataagaagcat

SEQ ID NO: 775227 - DNA, 20 bp, Artificial
  CRISPR gRNA sequence
tcctctgcataagaagcata

SEQ ID NO: 775228 - DNA, 20 bp, Artificial
  CRISPR gRNA sequence
tgcataagaagcataagtgc

SEQ ID NO: 775229 - DNA, 20 bp, Artificial
  CRISPR gRNA sequence
cataagaagcataagtgcca

SEQ ID NO: 775230 - DNA, 20 bp, Artificial
  CRISPR gRNA sequence
ttaggaaggcaaacattata

SEQ ID NO: 775231 - DNA, 20 bp, Artificial
  CRISPR gRNA sequence
aggaaggcaaacattataaa

SEQ ID NO: 775232 - DNA, 20 bp, Artificial
  CRISPR gRNA sequence
ggaaggcaaacattataaat

SEQ ID NO: 775233 - DNA, 20 bp, Artificial
  CRISPR gRNA sequence
taaatggttcttatcagctc

SEQ ID NO: 775234 - DNA, 20 bp, Artificial
  CRISPR gRNA sequence
ttatcagctcgagtccctta

SEQ ID NO: 775235 - DNA, 20 bp, Artificial
  CRISPR gRNA sequence
atcagctcgagtcccttaag

SEQ ID NO: 775236 - DNA, 20 bp, Artificial
  CRISPR gRNA sequence
tcagctcgagtcccttaagg

SEQ ID NO: 775237 - DNA, 20 bp, Artificial
  CRISPR gRNA sequence
gagtcccttaaggacttgtg

SEQ ID NO: 775238 - DNA, 20 bp, Artificial
  CRISPR gRNA sequence
aaggacttgtggggaagagt

SEQ ID NO: 775239 - DNA, 20 bp, Artificial
  CRISPR gRNA sequence
aggacttgtggggaagagtg

SEQ ID NO: 775240 - DNA, 20 bp, Artificial
  CRISPR gRNA sequence
gtggggaagagtgtgagcac

SEQ ID NO: 775241 - DNA, 20 bp, Artificial
  CRISPR gRNA sequence
tggggaagagtgtgagcacc

SEQ ID NO: 775242 - DNA, 20 bp, Artificial
  CRISPR gRNA sequence
aagtctatgaaagggatttt

SEQ ID NO: 775243 - DNA, 20 bp, Artificial
  CRISPR gRNA sequence
tgaaagggattttgaaagtc

SEQ ID NO: 775244 - DNA, 20 bp, Artificial
  CRISPR gRNA sequence
tgaaagtcttctggccaccc

SEQ ID NO: 775245 - DNA, 20 bp, Artificial
  CRISPR gRNA sequence
gaaagtcttctggccaccca

SEQ ID NO: 775246 - DNA, 20 bp, Artificial
  CRISPR gRNA sequence
aaagtcttctggccacccaa

SEQ ID NO: 775247 - DNA, 20 bp, Artificial
  CRISPR gRNA sequence
ctggccacccaaacctatgg

SEQ ID NO: 775248 - DNA, 20 bp, Artificial
  CRISPR gRNA sequence
tggccacccaaacctatgga

SEQ ID NO: 775249 - DNA, 20 bp, Artificial
  CRISPR gRNA sequence
gccacccaaacctatggaaa

SEQ ID NO: 775250 - DNA, 20 bp, Artificial
  CRISPR gRNA sequence
tggaaattccacgttagggt

SEQ ID NO: 775251 - DNA, 20 bp, Artificial
  CRISPR gRNA sequence
cacgttagggtccagtaaag

SEQ ID NO: 775252 - DNA, 20 bp, Artificial
  CRISPR gRNA sequence
gggtccagtaaagagggagt

SEQ ID NO: 775253 - DNA, 20 bp, Artificial
  CRISPR gRNA sequence
ctcgctccgtccttccccag

SEQ ID NO: 775254 - DNA, 20 bp, Artificial
  CRISPR gRNA sequence
gctccgtccttccccagctg

SEQ ID NO: 775255 - DNA, 20 bp, Artificial
  CRISPR gRNA sequence
cgtccttccccagctgttca

SEQ ID NO: 775256 - DNA, 20 bp, Artificial
  CRISPR gRNA sequence
ccccagctgttcatctgccc

SEQ ID NO: 775257 - DNA, 20 bp, Artificial
  CRISPR gRNA sequence
cccagctgttcatctgccct

SEQ ID NO: 775258 - DNA, 20 bp, Artificial
  CRISPR gRNA sequence
ttcatctgcccttacctgtg

SEQ ID NO: 775259 - DNA, 20 bp, Artificial
  CRISPR gRNA sequence
atctgcccttacctgtgatg

SEQ ID NO: 775260 - DNA, 20 bp, Artificial
  CRISPR gRNA sequence
cccttacctgtgatggtgac

SEQ ID NO: 775261 - DNA, 20 bp, Artificial
  CRISPR gRNA sequence
acctgtgatggtgacagagc

SEQ ID NO: 775262 - DNA, 20 bp, Artificial
  CRISPR gRNA sequence
cctgtgatggtgacagagcc

SEQ ID NO: 775263 - DNA, 20 bp, Artificial
  CRISPR gRNA sequence
tgatggtgacagagccgtgc

SEQ ID NO: 775264 - DNA, 20 bp, Artificial
  CRISPR gRNA sequence
ctgcagcacggggttgcgca

SEQ ID NO: 775265 - DNA, 20 bp, Artificial
  CRISPR gRNA sequence
cagcacggggttgcgcacca

SEQ ID NO: 775266 - DNA, 20 bp, Artificial
  CRISPR gRNA sequence
cgcaccaggcagctgtaggt

SEQ ID NO: 775267 - DNA, 20 bp, Artificial
  CRISPR gRNA sequence
taggtgccattcgcacccag

SEQ ID NO: 775268 - DNA, 20 bp, Artificial
  CRISPR gRNA sequence
gcacccagcaccacccgcag

SEQ ID NO: 775269 - DNA, 20 bp, Artificial
  CRISPR gRNA sequence
tgcacatcaaacaagccctg

SEQ ID NO: 775270 - DNA, 20 bp, Artificial
  CRISPR gRNA sequence
ctcgttggccatctgcgacg

SEQ ID NO: 775271 - DNA, 20 bp, Artificial
  CRISPR gRNA sequence
gttggccatctgcgacgtgg

SEQ ID NO: 775272 - DNA, 20 bp, Artificial
  CRISPR gRNA sequence
gccatctgcgacgtggtcac

SEQ ID NO: 775273 - DNA, 20 bp, Artificial
  CRISPR gRNA sequence
cgacgtggtcacgttgccag

SEQ ID NO: 775274 - DNA, 20 bp, Artificial
  CRISPR gRNA sequence
ccagtcaggggcacaccctg

SEQ ID NO: 775275 - DNA, 20 bp, Artificial
  CRISPR gRNA sequence
cccatcctgccagaacacct

SEQ ID NO: 775276 - DNA, 20 bp, Artificial
  CRISPR gRNA sequence
ccagaacacctcagcctcag

SEQ ID NO: 775277 - DNA, 20 bp, Artificial
  CRISPR gRNA sequence
agcctcagggtagccccggt

SEQ ID NO: 775278 - DNA, 20 bp, Artificial
  CRISPR gRNA sequence
agggtagccccggtagctgg

SEQ ID NO: 775279 - DNA, 20 bp, Artificial
  CRISPR gRNA sequence
gagcacgtgatggtcaccgt

SEQ ID NO: 775280 - DNA, 20 bp, Artificial
  CRISPR gRNA sequence
gccgcaggtccttgttgggc

SEQ ID NO: 775281 - DNA, 20 bp, Artificial
  CRISPR gRNA sequence
gttgggctccagggtcatgc

SEQ ID NO: 775282 - DNA, 20 bp, Artificial
  CRISPR gRNA sequence
ttgggctccagggtcatgct

SEQ ID NO: 775283 - DNA, 20 bp, Artificial
  CRISPR gRNA sequence
ggctccagggtcatgctggg

SEQ ID NO: 775284 - DNA, 20 bp, Artificial
  CRISPR gRNA sequence
cagggtcatgctgggcttcg

SEQ ID NO: 775285 - DNA, 20 bp, Artificial
  CRISPR gRNA sequence
ggcttcgagtagggagctgg

SEQ ID NO: 775286 - DNA, 20 bp, Artificial
  CRISPR gRNA sequence
cgagtagggagctggaggtg

SEQ ID NO: 775287 - DNA, 20 bp, Artificial
  CRISPR gRNA sequence
gagtagggagctggaggtga

SEQ ID NO: 775288 - DNA, 20 bp, Artificial
  CRISPR gRNA sequence
gaggtgacagagggcagggg

SEQ ID NO: 775289 - DNA, 20 bp, Artificial
  CRISPR gRNA sequence
agtacaggaatcagcactgg

SEQ ID NO: 775290 - DNA, 20 bp, Artificial
  CRISPR gRNA sequence
gggttctgggagcagtggtg

SEQ ID NO: 775291 - DNA, 20 bp, Artificial
  CRISPR gRNA sequence
tgggagcagtggtgcagcag

SEQ ID NO: 775292 - DNA, 20 bp, Artificial
  CRISPR gRNA sequence
ggagcagtggtgcagcagag

SEQ ID NO: 775293 - DNA, 20 bp, Artificial
  CRISPR gRNA sequence
cagagggaatggagggtgaa

SEQ ID NO: 775294 - DNA, 20 bp, Artificial
  CRISPR gRNA sequence
ctggtgctcaccggccacct

SEQ ID NO: 775295 - DNA, 20 bp, Artificial
  CRISPR gRNA sequence
gtgctcaccggccacctgca

SEQ ID NO: 775296 - DNA, 20 bp, Artificial
  CRISPR gRNA sequence
accggccacctgcaggctga

SEQ ID NO: 775297 - DNA, 20 bp, Artificial
  CRISPR gRNA sequence
caggctgacggcagcgctgc

SEQ ID NO: 775298 - DNA, 20 bp, Artificial
  CRISPR gRNA sequence
acggcagcgctgccgaaatc

SEQ ID NO: 775299 - DNA, 20 bp, Artificial
  CRISPR gRNA sequence
ccgaaatcccggatgctcac

SEQ ID NO: 775300 - DNA, 20 bp, Artificial
  CRISPR gRNA sequence
acgaagcaggtgaagctgcc

SEQ ID NO: 775301 - DNA, 20 bp, Artificial
  CRISPR gRNA sequence
ccctcgtccgccacacgcac

SEQ ID NO: 775302 - DNA, 20 bp, Artificial
  CRISPR gRNA sequence
gtccgccacacgcacgcgct

SEQ ID NO: 775303 - DNA, 20 bp, Artificial
  CRISPR gRNA sequence
cagcctcagggatgcattgc

SEQ ID NO: 775304 - DNA, 20 bp, Artificial
  CRISPR gRNA sequence
agggatgcattgccttgtgc

SEQ ID NO: 775305 - DNA, 20 bp, Artificial
  CRISPR gRNA sequence
ccttgtgccagcaggtccgg

SEQ ID NO: 775306 - DNA, 20 bp, Artificial
  CRISPR gRNA sequence
gtgccagcaggtccgggaag

SEQ ID NO: 775307 - DNA, 20 bp, Artificial
  CRISPR gRNA sequence
tgccagcaggtccgggaaga

SEQ ID NO: 775308 - DNA, 20 bp, Artificial
  CRISPR gRNA sequence
gcataggcgctgccctggtc

SEQ ID NO: 775309 - DNA, 20 bp, Artificial
  CRISPR gRNA sequence
ccctggtcccggccttcggt

SEQ ID NO: 775310 - DNA, 20 bp, Artificial
  CRISPR gRNA sequence
gtcccggccttcggtgaaac

SEQ ID NO: 775311 - DNA, 20 bp, Artificial
  CRISPR gRNA sequence
cggtgaaactgtgcaccagc

SEQ ID NO: 775312 - DNA, 20 bp, Artificial
  CRISPR gRNA sequence
ggtgaaactgtgcaccagct

SEQ ID NO: 775313 - DNA, 20 bp, Artificial
  CRISPR gRNA sequence
tgcaccagctgtttggtgtc

SEQ ID NO: 775314 - DNA, 20 bp, Artificial
  CRISPR gRNA sequence
tttggtgtctgtcagctgcc

SEQ ID NO: 775315 - DNA, 20 bp, Artificial
  CRISPR gRNA sequence
ggtgtctgtcagctgccaga

SEQ ID NO: 775316 - DNA, 20 bp, Artificial
  CRISPR gRNA sequence
gtgtctgtcagctgccagat

SEQ ID NO: 775317 - DNA, 20 bp, Artificial
  CRISPR gRNA sequence
tcagctgccagatgaggttg

SEQ ID NO: 775318 - DNA, 20 bp, Artificial
  CRISPR gRNA sequence
ccagatgaggttgagctgtg

SEQ ID NO: 775319 - DNA, 20 bp, Artificial
  CRISPR gRNA sequence
agctgtgccaggctgaagcc

SEQ ID NO: 775320 - DNA, 20 bp, Artificial
  CRISPR gRNA sequence
tgccaggctgaagccaggct

SEQ ID NO: 775321 - DNA, 20 bp, Artificial
  CRISPR gRNA sequence
aagccaggctcgggggagaa

SEQ ID NO: 775322 - DNA, 20 bp, Artificial
  CRISPR gRNA sequence
gggggagaaggagcagcgca

SEQ ID NO: 775323 - DNA, 20 bp, Artificial
  CRISPR gRNA sequence
gggccaccaccgggtcctca

SEQ ID NO: 775324 - DNA, 20 bp, Artificial
  CRISPR gRNA sequence
agggacctggacctccacgg

SEQ ID NO: 775325 - DNA, 20 bp, Artificial
  CRISPR gRNA sequence
gacctccacggctcctgggg

SEQ ID NO: 775326 - DNA, 20 bp, Artificial
  CRISPR gRNA sequence
cacggctcctgggggcgggg

SEQ ID NO: 775327 - DNA, 20 bp, Artificial
  CRISPR gRNA sequence
ctgggggcggggtcagaggg

SEQ ID NO: 775328 - DNA, 20 bp, Artificial
  CRISPR gRNA sequence
ggggcggggtcagaggggca

SEQ ID NO: 775329 - DNA, 20 bp, Artificial
  CRISPR gRNA sequence
tctaggctaccacccgagtc

SEQ ID NO: 775330 - DNA, 20 bp, Artificial
  CRISPR gRNA sequence
taggctaccacccgagtccc

SEQ ID NO: 775331 - DNA, 20 bp, Artificial
  CRISPR gRNA sequence
ggctaccacccgagtccccc

SEQ ID NO: 775332 - DNA, 20 bp, Artificial
  CRISPR gRNA sequence
ccacccgagtcccccaaact

SEQ ID NO: 775333 - DNA, 20 bp, Artificial
  CRISPR gRNA sequence
ttcccccatcaattcccaga

SEQ ID NO: 775334 - DNA, 20 bp, Artificial
  CRISPR gRNA sequence
cccccatcaattcccagacc

SEQ ID NO: 775335 - DNA, 20 bp, Artificial
  CRISPR gRNA sequence
ccccatcaattcccagaccc

SEQ ID NO: 775336 - DNA, 20 bp, Artificial
  CRISPR gRNA sequence
ccagaccctgttccatcttc

SEQ ID NO: 775337 - DNA, 20 bp, Artificial
  CRISPR gRNA sequence
ttccatcttcctattttctt

SEQ ID NO: 775338 - DNA, 20 bp, Artificial
  CRISPR gRNA sequence
catcttcctattttcttctt

SEQ ID NO: 775339 - DNA, 20 bp, Artificial
  CRISPR gRNA sequence
cctattttcttcttagatgc

SEQ ID NO: 775340 - DNA, 20 bp, Artificial
  CRISPR gRNA sequence
ctattttcttcttagatgca

SEQ ID NO: 775341 - DNA, 20 bp, Artificial
  CRISPR gRNA sequence
ttttcttcttagatgcaaaa

SEQ ID NO: 775342 - DNA, 20 bp, Artificial
  CRISPR gRNA sequence
tcttcttagatgcaaaagca

SEQ ID NO: 775343 - DNA, 20 bp, Artificial
  CRISPR gRNA sequence
cttcttagatgcaaaagcag

SEQ ID NO: 775344 - DNA, 20 bp, Artificial
  CRISPR gRNA sequence
ttcttagatgcaaaagcaga

SEQ ID NO: 775345 - DNA, 20 bp, Artificial
  CRISPR gRNA sequence
cttagatgcaaaagcagatt

SEQ ID NO: 775346 - DNA, 20 bp, Artificial
  CRISPR gRNA sequence
ttagatgcaaaagcagatta

SEQ ID NO: 775347 - DNA, 20 bp, Artificial
  CRISPR gRNA sequence
agatgcaaaagcagattaag

SEQ ID NO: 775348 - DNA, 20 bp, Artificial
  CRISPR gRNA sequence
gatgcaaaagcagattaagt

SEQ ID NO: 775349 - DNA, 20 bp, Artificial
  CRISPR gRNA sequence
agtctgaggactctcagata

SEQ ID NO: 775350 - DNA, 20 bp, Artificial
  CRISPR gRNA sequence
aggactctcagatatggagt

SEQ ID NO: 775351 - DNA, 20 bp, Artificial
  CRISPR gRNA sequence
tcagatatggagtctcccca

SEQ ID NO: 775352 - DNA, 20 bp, Artificial
  CRISPR gRNA sequence
agatatggagtctccccaat

SEQ ID NO: 775353 - DNA, 20 bp, Artificial
  CRISPR gRNA sequence
cccaatcttctgagaacaat

SEQ ID NO: 775354 - DNA, 20 bp, Artificial
  CRISPR gRNA sequence
ctgagaacaatcacagcagg

SEQ ID NO: 775355 - DNA, 20 bp, Artificial
  CRISPR gRNA sequence
tgagaacaatcacagcaggt

SEQ ID NO: 775356 - DNA, 20 bp, Artificial
  CRISPR gRNA sequence
agaacaatcacagcaggtgg

SEQ ID NO: 775357 - DNA, 20 bp, Artificial
  CRISPR gRNA sequence
ggcctgaccagaccaatccc

SEQ ID NO: 775358 - DNA, 20 bp, Artificial
  CRISPR gRNA sequence
gcctgaccagaccaatccca

SEQ ID NO: 775359 - DNA, 20 bp, Artificial
  CRISPR gRNA sequence
accagaccaatcccagggcc

SEQ ID NO: 775360 - DNA, 20 bp, Artificial
  CRISPR gRNA sequence
gggcaggtgactctcaccag

SEQ ID NO: 775361 - DNA, 20 bp, Artificial
  CRISPR gRNA sequence
tcaccagctccagccctggt

SEQ ID NO: 775362 - DNA, 20 bp, Artificial
  CRISPR gRNA sequence
accagctccagccctggtga

SEQ ID NO: 775363 - DNA, 20 bp, Artificial
  CRISPR gRNA sequence
cagccctggtgaatcctgcc

SEQ ID NO: 775364 - DNA, 20 bp, Artificial
  CRISPR gRNA sequence
gtgaatcctgccatcaggac

SEQ ID NO: 775365 - DNA, 20 bp, Artificial
  CRISPR gRNA sequence
ccatcaggactcctttcctt

SEQ ID NO: 775366 - DNA, 20 bp, Artificial
  CRISPR gRNA sequence
ctttccttcgcccacccctc

SEQ ID NO: 775367 - DNA, 20 bp, Artificial
  CRISPR gRNA sequence
tccttcgcccacccctctgc

SEQ ID NO: 775368 - DNA, 20 bp, Artificial
  CRISPR gRNA sequence
ccttcgcccacccctctgct

SEQ ID NO: 775369 - DNA, 20 bp, Artificial
  CRISPR gRNA sequence
cttcgcccacccctctgctg

SEQ ID NO: 775370 - DNA, 20 bp, Artificial
  CRISPR gRNA sequence
cgcccacccctctgctgacc

SEQ ID NO: 775371 - DNA, 20 bp, Artificial
  CRISPR gRNA sequence
gcccacccctctgctgaccc

SEQ ID NO: 775372 - DNA, 20 bp, Artificial
  CRISPR gRNA sequence
tgctgacccagatgtggctc

SEQ ID NO: 775373 - DNA, 20 bp, Artificial
  CRISPR gRNA sequence
ctgacccagatgtggctcca

SEQ ID NO: 775374 - DNA, 20 bp, Artificial
  CRISPR gRNA sequence
acccagatgtggctccattc

SEQ ID NO: 775375 - DNA, 20 bp, Artificial
  CRISPR gRNA sequence
cattcttcccagaggcttcc

SEQ ID NO: 775376 - DNA, 20 bp, Artificial
  CRISPR gRNA sequence
ttcccagaggcttccagagc

SEQ ID NO: 775377 - DNA, 20 bp, Artificial
  CRISPR gRNA sequence
cccagaggcttccagagcct

SEQ ID NO: 775378 - DNA, 20 bp, Artificial
  CRISPR gRNA sequence
ccagaggcttccagagcctt

SEQ ID NO: 775379 - DNA, 20 bp, Artificial
  CRISPR gRNA sequence
ccagagccttgaagtcagga

SEQ ID NO: 775380 - DNA, 20 bp, Artificial
  CRISPR gRNA sequence
cagagccttgaagtcaggag

SEQ ID NO: 775381 - DNA, 20 bp, Artificial
  CRISPR gRNA sequence
gaagtcaggagagccttaag

SEQ ID NO: 775382 - DNA, 20 bp, Artificial
  CRISPR gRNA sequence
aagtcaggagagccttaaga

SEQ ID NO: 775383 - DNA, 20 bp, Artificial
  CRISPR gRNA sequence
aagaaggcctgtgatttctc

SEQ ID NO: 775384 - DNA, 20 bp, Artificial
  CRISPR gRNA sequence
agaaggcctgtgatttctcc

SEQ ID NO: 775385 - DNA, 20 bp, Artificial
  CRISPR gRNA sequence
tgatttctccgcccccaacc

SEQ ID NO: 775386 - DNA, 20 bp, Artificial
  CRISPR gRNA sequence
ctccgcccccaacccctcca

SEQ ID NO: 775387 - DNA, 20 bp, Artificial
  CRISPR gRNA sequence
tccgcccccaacccctccag

SEQ ID NO: 775388 - DNA, 20 bp, Artificial
  CRISPR gRNA sequence
cgcccccaacccctccagtg

SEQ ID NO: 775389 - DNA, 20 bp, Artificial
  CRISPR gRNA sequence
cagtgaacatccccacctcc

SEQ ID NO: 775390 - DNA, 20 bp, Artificial
  CRISPR gRNA sequence
cccgttatctttctccctat

SEQ ID NO: 775391 - DNA, 20 bp, Artificial
  CRISPR gRNA sequence
tctttctccctatcattagg

SEQ ID NO: 775392 - DNA, 20 bp, Artificial
  CRISPR gRNA sequence
tctccctatcattaggaggc

SEQ ID NO: 775393 - DNA, 20 bp, Artificial
  CRISPR gRNA sequence
ctccctatcattaggaggca

SEQ ID NO: 775394 - DNA, 20 bp, Artificial
  CRISPR gRNA sequence
tccctatcattaggaggcaa

SEQ ID NO: 775395 - DNA, 20 bp, Artificial
  CRISPR gRNA sequence
cctatcattaggaggcaact

SEQ ID NO: 775396 - DNA, 20 bp, Artificial
  CRISPR gRNA sequence
tcattaggaggcaacttgct

SEQ ID NO: 775397 - DNA, 20 bp, Artificial
  CRISPR gRNA sequence
ggaggcaacttgctgttctg

SEQ ID NO: 775398 - DNA, 20 bp, Artificial
  CRISPR gRNA sequence
gctgttctgggagattgaag

SEQ ID NO: 775399 - DNA, 20 bp, Artificial
  CRISPR gRNA sequence
ctgttctgggagattgaagg

SEQ ID NO: 775400 - DNA, 20 bp, Artificial
  CRISPR gRNA sequence
ttctgggagattgaaggtgg

SEQ ID NO: 775401 - DNA, 20 bp, Artificial
  CRISPR gRNA sequence
tgggagattgaaggtggggc

SEQ ID NO: 775402 - DNA, 20 bp, Artificial
  CRISPR gRNA sequence
ggagattgaaggtggggcca

SEQ ID NO: 775403 - DNA, 20 bp, Artificial
  CRISPR gRNA sequence
aaggtggggccagattcgga

SEQ ID NO: 775404 - DNA, 20 bp, Artificial
  CRISPR gRNA sequence
ggagctcccaacccctgccg

SEQ ID NO: 775405 - DNA, 20 bp, Artificial
  CRISPR gRNA sequence
ccaacccctgccgacagaag

SEQ ID NO: 775406 - DNA, 20 bp, Artificial
  CRISPR gRNA sequence
ccgacagaagcagaaccccc

SEQ ID NO: 775407 - DNA, 20 bp, Artificial
  CRISPR gRNA sequence
ccccaaggggacatttaagc

SEQ ID NO: 775408 - DNA, 20 bp, Artificial
  CRISPR gRNA sequence
aagcaaagcaacctgtgggg

SEQ ID NO: 775409 - DNA, 20 bp, Artificial
  CRISPR gRNA sequence
agcaaagcaacctgtggggc

SEQ ID NO: 775410 - DNA, 20 bp, Artificial
  CRISPR gRNA sequence
tggggcttctctggggtgtg

SEQ ID NO: 775411 - DNA, 20 bp, Artificial
  CRISPR gRNA sequence
ctctggggtgtgatggtgac

SEQ ID NO: 775412 - DNA, 20 bp, Artificial
  CRISPR gRNA sequence
tctggggtgtgatggtgaca

SEQ ID NO: 775413 - DNA, 20 bp, Artificial
  CRISPR gRNA sequence
tggggtgtgatggtgacaga

SEQ ID NO: 775414 - DNA, 20 bp, Artificial
  CRISPR gRNA sequence
gggtgtgatggtgacagagc

SEQ ID NO: 775415 - DNA, 20 bp, Artificial
  CRISPR gRNA sequence
tgcgcatcctgctgcagcac

SEQ ID NO: 775416 - DNA, 20 bp, Artificial
  CRISPR gRNA sequence
ctgcagcacggggttgcgca

SEQ ID NO: 775417 - DNA, 20 bp, Artificial
  CRISPR gRNA sequence
cagcacggggttgcgcacca

SEQ ID NO: 775418 - DNA, 20 bp, Artificial
  CRISPR gRNA sequence
cgcaccaggcagctgtaggt

SEQ ID NO: 775419 - DNA, 20 bp, Artificial
  CRISPR gRNA sequence
taggtgccatttgcacccag

SEQ ID NO: 775420 - DNA, 20 bp, Artificial
  CRISPR gRNA sequence
gcacccagcaccacccgcag

SEQ ID NO: 775421 - DNA, 20 bp, Artificial
  CRISPR gRNA sequence
cacccagcaccacccgcagg

SEQ ID NO: 775422 - DNA, 20 bp, Artificial
  CRISPR gRNA sequence
tgcacatcaaacaagccctg

SEQ ID NO: 775423 - DNA, 20 bp, Artificial
  CRISPR gRNA sequence
ctcgttggccatctgcgacg

SEQ ID NO: 775424 - DNA, 20 bp, Artificial
  CRISPR gRNA sequence
gttggccatctgcgacgtgg

SEQ ID NO: 775425 - DNA, 20 bp, Artificial
  CRISPR gRNA sequence
gccatctgcgacgtggtcac

SEQ ID NO: 775426 - DNA, 20 bp, Artificial
  CRISPR gRNA sequence
cgacgtggtcacgttgccag

SEQ ID NO: 775427 - DNA, 20 bp, Artificial
  CRISPR gRNA sequence
ccagtcaggggcacaccctg

SEQ ID NO: 775428 - DNA, 20 bp, Artificial
  CRISPR gRNA sequence
cccatcctgccagaacacct

SEQ ID NO: 775429 - DNA, 20 bp, Artificial
  CRISPR gRNA sequence
ccagaacacctcagcctcag

SEQ ID NO: 775430 - DNA, 20 bp, Artificial
  CRISPR gRNA sequence
agcctcagggtagccctggt

SEQ ID NO: 775431 - DNA, 20 bp, Artificial
  CRISPR gRNA sequence
agggtagccctggtagctgg

SEQ ID NO: 775432 - DNA, 20 bp, Artificial
  CRISPR gRNA sequence
gtagctggagcacgtgatgg

SEQ ID NO: 775433 - DNA, 20 bp, Artificial
  CRISPR gRNA sequence
gagcacgtgatggtcaccgt

SEQ ID NO: 775434 - DNA, 20 bp, Artificial
  CRISPR gRNA sequence
gccgcaggtccttgttgggc

SEQ ID NO: 775435 - DNA, 20 bp, Artificial
  CRISPR gRNA sequence
gttgggctccagggtcatgc

SEQ ID NO: 775436 - DNA, 20 bp, Artificial
  CRISPR gRNA sequence
ttgggctccagggtcatgct

SEQ ID NO: 775437 - DNA, 20 bp, Artificial
  CRISPR gRNA sequence
ggctccagggtcatgctggg

SEQ ID NO: 775438 - DNA, 20 bp, Artificial
  CRISPR gRNA sequence
cagggtcatgctgggcttcg

SEQ ID NO: 775439 - DNA, 20 bp, Artificial
  CRISPR gRNA sequence
ggcttcgagtagggagctgg

SEQ ID NO: 775440 - DNA, 20 bp, Artificial
  CRISPR gRNA sequence
cgagtagggagctggaggtg

SEQ ID NO: 775441 - DNA, 20 bp, Artificial
  CRISPR gRNA sequence
gagtagggagctggaggtga

SEQ ID NO: 775442 - DNA, 20 bp, Artificial
  CRISPR gRNA sequence
gaggtgacagagggcagggg

SEQ ID NO: 775443 - DNA, 20 bp, Artificial
  CRISPR gRNA sequence
agtacaggaatcagcactgg

SEQ ID NO: 775444 - DNA, 20 bp, Artificial
  CRISPR gRNA sequence
gggttctgggagcagtggtg

SEQ ID NO: 775445 - DNA, 20 bp, Artificial
  CRISPR gRNA sequence
tgggagcagtggtgcagcag

SEQ ID NO: 775446 - DNA, 20 bp, Artificial
  CRISPR gRNA sequence
ggagcagtggtgcagcaggg

SEQ ID NO: 775447 - DNA, 20 bp, Artificial
  CRISPR gRNA sequence
cagggggaatggagggtgaa

SEQ ID NO: 775448 - DNA, 20 bp, Artificial
  CRISPR gRNA sequence
aggggaaggcgtccccctcc

SEQ ID NO: 775449 - DNA, 20 bp, Artificial
  CRISPR gRNA sequence
ctggtgctcaccggccacct

SEQ ID NO: 775450 - DNA, 20 bp, Artificial
  CRISPR gRNA sequence
gtgctcaccggccacctgca

SEQ ID NO: 775451 - DNA, 20 bp, Artificial
  CRISPR gRNA sequence
accggccacctgcaggctga

SEQ ID NO: 775452 - DNA, 20 bp, Artificial
  CRISPR gRNA sequence
caggctgacggcagcgctgc

SEQ ID NO: 775453 - DNA, 20 bp, Artificial
  CRISPR gRNA sequence
acggcagcgctgccgaaatc

SEQ ID NO: 775454 - DNA, 20 bp, Artificial
  CRISPR gRNA sequence
ccgaaatcccggatgctcac

SEQ ID NO: 775455 - DNA, 20 bp, Artificial
  CRISPR gRNA sequence
acgaagcaggtgaagctgcc

SEQ ID NO: 775456 - DNA, 20 bp, Artificial
  CRISPR gRNA sequence
ccctcgtccgccacacgcac

SEQ ID NO: 775457 - DNA, 20 bp, Artificial
  CRISPR gRNA sequence
gtccgccacacgcacgcgct

SEQ ID NO: 775458 - DNA, 20 bp, Artificial
  CRISPR gRNA sequence
cagcctcagggatgcgttgc

SEQ ID NO: 775459 - DNA, 20 bp, Artificial
  CRISPR gRNA sequence
agggatgcgttgccctgtgc

SEQ ID NO: 775460 - DNA, 20 bp, Artificial
  CRISPR gRNA sequence
ccctgtgccagcaggtccgg

SEQ ID NO: 775461 - DNA, 20 bp, Artificial
  CRISPR gRNA sequence
tgccagcaggtccgggaaga

SEQ ID NO: 775462 - DNA, 20 bp, Artificial
  CRISPR gRNA sequence
gcataggcgctgccctggtc

SEQ ID NO: 775463 - DNA, 20 bp, Artificial
  CRISPR gRNA sequence
ccctggtcctggccctcagc

SEQ ID NO: 775464 - DNA, 20 bp, Artificial
  CRISPR gRNA sequence
gtcctggccctcagcaaagc

SEQ ID NO: 775465 - DNA, 20 bp, Artificial
  CRISPR gRNA sequence
gccctcagcaaagctgtgca

SEQ ID NO: 775466 - DNA, 20 bp, Artificial
  CRISPR gRNA sequence
agcaaagctgtgcaccagct

SEQ ID NO: 775467 - DNA, 20 bp, Artificial
  CRISPR gRNA sequence
tgcaccagctgtttggtatc

SEQ ID NO: 775468 - DNA, 20 bp, Artificial
  CRISPR gRNA sequence
tttggtatctgtcagctgcc

SEQ ID NO: 775469 - DNA, 20 bp, Artificial
  CRISPR gRNA sequence
ggtatctgtcagctgccaga

SEQ ID NO: 775470 - DNA, 20 bp, Artificial
  CRISPR gRNA sequence
gtatctgtcagctgccagat

SEQ ID NO: 775471 - DNA, 20 bp, Artificial
  CRISPR gRNA sequence
tcagctgccagatgaggttg

SEQ ID NO: 775472 - DNA, 20 bp, Artificial
  CRISPR gRNA sequence
ccagatgaggttgagctgtg

SEQ ID NO: 775473 - DNA, 20 bp, Artificial
  CRISPR gRNA sequence
agctgtgccaggctgaagcc

SEQ ID NO: 775474 - DNA, 20 bp, Artificial
  CRISPR gRNA sequence
tgccaggctgaagccaggct

SEQ ID NO: 775475 - DNA, 20 bp, Artificial
  CRISPR gRNA sequence
aagccaggctcaggggagaa

SEQ ID NO: 775476 - DNA, 20 bp, Artificial
  CRISPR gRNA sequence
aggggagaaggagcagcaca

SEQ ID NO: 775477 - DNA, 20 bp, Artificial
  CRISPR gRNA sequence
ggtcttcagggacctggacc

SEQ ID NO: 775478 - DNA, 20 bp, Artificial
  CRISPR gRNA sequence
cagggacctggacctccagg

SEQ ID NO: 775479 - DNA, 20 bp, Artificial
  CRISPR gRNA sequence
agggacctggacctccaggg

SEQ ID NO: 775480 - DNA, 20 bp, Artificial
  CRISPR gRNA sequence
gacctccagggctcctgggg

SEQ ID NO: 775481 - DNA, 20 bp, Artificial
  CRISPR gRNA sequence
cagggctcctgggggtaggg

SEQ ID NO: 775482 - DNA, 20 bp, Artificial
  CRISPR gRNA sequence
ctgggggtagggggagtgga

SEQ ID NO: 775483 - DNA, 20 bp, Artificial
  CRISPR gRNA sequence
ggggtagggggagtggagaa

SEQ ID NO: 775484 - DNA, 20 bp, Artificial
  CRISPR gRNA sequence
aggaggggtgggcctcccta

SEQ ID NO: 775485 - DNA, 20 bp, Artificial
  CRISPR gRNA sequence
cctagtcccgctccctgccc

SEQ ID NO: 775486 - DNA, 20 bp, Artificial
  CRISPR gRNA sequence
gtcccgctccctgcccctgc

SEQ ID NO: 775487 - DNA, 20 bp, Artificial
  CRISPR gRNA sequence
cctgcccctgctaaccccag

SEQ ID NO: 775488 - DNA, 20 bp, Artificial
  CRISPR gRNA sequence
cccctgctaaccccaggccc

SEQ ID NO: 775489 - DNA, 20 bp, Artificial
  CRISPR gRNA sequence
ctaaccccaggccctgtcca

SEQ ID NO: 775490 - DNA, 20 bp, Artificial
  CRISPR gRNA sequence
accccaggccctgtccaccc

SEQ ID NO: 775491 - DNA, 20 bp, Artificial
  CRISPR gRNA sequence
tccacccctccttttaggcc

SEQ ID NO: 775492 - DNA, 20 bp, Artificial
  CRISPR gRNA sequence
cttttaggcctgagacccaa

SEQ ID NO: 775493 - DNA, 20 bp, Artificial
  CRISPR gRNA sequence
ttaggcctgagacccaaagt

SEQ ID NO: 775494 - DNA, 20 bp, Artificial
  CRISPR gRNA sequence
taggcctgagacccaaagta

SEQ ID NO: 775495 - DNA, 20 bp, Artificial
  CRISPR gRNA sequence
aggcctgagacccaaagtaa

SEQ ID NO: 775496 - DNA, 20 bp, Artificial
  CRISPR gRNA sequence
ggcctgagacccaaagtaat

SEQ ID NO: 775497 - DNA, 20 bp, Artificial
  CRISPR gRNA sequence
agacccaaagtaatttattg

SEQ ID NO: 775498 - DNA, 20 bp, Artificial
  CRISPR gRNA sequence
attgtcttaggacctcattc

SEQ ID NO: 775499 - DNA, 20 bp, Artificial
  CRISPR gRNA sequence
ttgtcttaggacctcattca

SEQ ID NO: 775500 - DNA, 20 bp, Artificial
  CRISPR gRNA sequence
tcttaggacctcattcagtc

SEQ ID NO: 775501 - DNA, 20 bp, Artificial
  CRISPR gRNA sequence
aggacctcattcagtcaaga

SEQ ID NO: 775502 - DNA, 20 bp, Artificial
  CRISPR gRNA sequence
ggacctcattcagtcaagaa

SEQ ID NO: 775503 - DNA, 20 bp, Artificial
  CRISPR gRNA sequence
attcagtcaagaatatagtc

SEQ ID NO: 775504 - DNA, 20 bp, Artificial
  CRISPR gRNA sequence
agtcaagaatatagtcagca

SEQ ID NO: 775505 - DNA, 20 bp, Artificial
  CRISPR gRNA sequence
caggtgccaagcataaaagt

SEQ ID NO: 775506 - DNA, 20 bp, Artificial
  CRISPR gRNA sequence
cggtcacatccccacagaac

SEQ ID NO: 775507 - DNA, 20 bp, Artificial
  CRISPR gRNA sequence
acattttaatgggagagaga

SEQ ID NO: 775508 - DNA, 20 bp, Artificial
  CRISPR gRNA sequence
cattttaatgggagagagag

SEQ ID NO: 775509 - DNA, 20 bp, Artificial
  CRISPR gRNA sequence
taatgggagagagagacaaa

SEQ ID NO: 775510 - DNA, 20 bp, Artificial
  CRISPR gRNA sequence
aatgggagagagagacaaat

SEQ ID NO: 775511 - DNA, 20 bp, Artificial
  CRISPR gRNA sequence
atgggagagagagacaaatg

SEQ ID NO: 775512 - DNA, 20 bp, Artificial
  CRISPR gRNA sequence
tcgtcagcatgtgactaagg

SEQ ID NO: 775513 - DNA, 20 bp, Artificial
  CRISPR gRNA sequence
gtcagcatgtgactaaggta

SEQ ID NO: 775514 - DNA, 20 bp, Artificial
  CRISPR gRNA sequence
aggtatgtgaggaaaaggag

SEQ ID NO: 775515 - DNA, 20 bp, Artificial
  CRISPR gRNA sequence
gtaagtaaagcaacagcttt

SEQ ID NO: 775516 - DNA, 20 bp, Artificial
  CRISPR gRNA sequence
ttcaaaaatctggcaggtac

SEQ ID NO: 775517 - DNA, 20 bp, Artificial
  CRISPR gRNA sequence
tcaaaaatctggcaggtact

SEQ ID NO: 775518 - DNA, 20 bp, Artificial
  CRISPR gRNA sequence
caaaaatctggcaggtactt

SEQ ID NO: 775519 - DNA, 20 bp, Artificial
  CRISPR gRNA sequence
aaaaatctggcaggtacttt

SEQ ID NO: 775520 - DNA, 20 bp, Artificial
  CRISPR gRNA sequence
gcaggtactttacacctgcc

SEQ ID NO: 775521 - DNA, 20 bp, Artificial
  CRISPR gRNA sequence
tacacctgcctgcaccatgt

SEQ ID NO: 775522 - DNA, 20 bp, Artificial
  CRISPR gRNA sequence
acacctgcctgcaccatgtg

SEQ ID NO: 775523 - DNA, 20 bp, Artificial
  CRISPR gRNA sequence
cacctgcctgcaccatgtgc

SEQ ID NO: 775524 - DNA, 20 bp, Artificial
  CRISPR gRNA sequence
cctgcaccatgtgcatttcc

SEQ ID NO: 775525 - DNA, 20 bp, Artificial
  CRISPR gRNA sequence
caccatgtgcatttccccat

SEQ ID NO: 775526 - DNA, 20 bp, Artificial
  CRISPR gRNA sequence
ccccatgagcgtaagtaatg

SEQ ID NO: 775527 - DNA, 20 bp, Artificial
  CRISPR gRNA sequence
cccatgagcgtaagtaatgt

SEQ ID NO: 775528 - DNA, 20 bp, Artificial
  CRISPR gRNA sequence
taaattggggagtccaaaaa

SEQ ID NO: 775529 - DNA, 20 bp, Artificial
  CRISPR gRNA sequence
gggagtccaaaaaagtatcc

SEQ ID NO: 775530 - DNA, 20 bp, Artificial
  CRISPR gRNA sequence
ctctggaggagagagaatca

SEQ ID NO: 775531 - DNA, 20 bp, Artificial
  CRISPR gRNA sequence
tctggaggagagagaatcac

SEQ ID NO: 775532 - DNA, 20 bp, Artificial
  CRISPR gRNA sequence
tggaggagagagaatcacaa

SEQ ID NO: 775533 - DNA, 20 bp, Artificial
  CRISPR gRNA sequence
gaggagagagaatcacaagt

SEQ ID NO: 775534 - DNA, 20 bp, Artificial
  CRISPR gRNA sequence
tttctttttttctttttttt

SEQ ID NO: 775535 - DNA, 20 bp, Artificial
  CRISPR gRNA sequence
ttctttttttcttttttttt

SEQ ID NO: 775536 - DNA, 20 bp, Artificial
  CRISPR gRNA sequence
tctttttttctttttttttc

SEQ ID NO: 775537 - DNA, 20 bp, Artificial
  CRISPR gRNA sequence
ctttttttctttttttttct

SEQ ID NO: 775538 - DNA, 20 bp, Artificial
  CRISPR gRNA sequence
tttttttctttttttttctt

SEQ ID NO: 775539 - DNA, 20 bp, Artificial
  CRISPR gRNA sequence
tttttctttttttttctttt

SEQ ID NO: 775540 - DNA, 20 bp, Artificial
  CRISPR gRNA sequence
ttttctttttttttcttttc

SEQ ID NO: 775541 - DNA, 20 bp, Artificial
  CRISPR gRNA sequence
tttctttttttttcttttcc

SEQ ID NO: 775542 - DNA, 20 bp, Artificial
  CRISPR gRNA sequence
ttctttttttttcttttcct

SEQ ID NO: 775543 - DNA, 20 bp, Artificial
  CRISPR gRNA sequence
tctttttttttcttttccta

SEQ ID NO: 775544 - DNA, 20 bp, Artificial
  CRISPR gRNA sequence
ctttttttttcttttcctaa

SEQ ID NO: 775545 - DNA, 20 bp, Artificial
  CRISPR gRNA sequence
tttttttttcttttcctaac

SEQ ID NO: 775546 - DNA, 20 bp, Artificial
  CRISPR gRNA sequence
tttttttcttttcctaacga

SEQ ID NO: 775547 - DNA, 20 bp, Artificial
  CRISPR gRNA sequence
ttttttcttttcctaacgaa

SEQ ID NO: 775548 - DNA, 20 bp, Artificial
  CRISPR gRNA sequence
tttttcttttcctaacgaaa

SEQ ID NO: 775549 - DNA, 20 bp, Artificial
  CRISPR gRNA sequence
ttttcttttcctaacgaaac

SEQ ID NO: 775550 - DNA, 20 bp, Artificial
  CRISPR gRNA sequence
tttcttttcctaacgaaaca

SEQ ID NO: 775551 - DNA, 20 bp, Artificial
  CRISPR gRNA sequence
ttcttttcctaacgaaacac

SEQ ID NO: 775552 - DNA, 20 bp, Artificial
  CRISPR gRNA sequence
tcttttcctaacgaaacacg

SEQ ID NO: 775553 - DNA, 20 bp, Artificial
  CRISPR gRNA sequence
cttttcctaacgaaacacga

SEQ ID NO: 775554 - DNA, 20 bp, Artificial
  CRISPR gRNA sequence
ttttcctaacgaaacacgat

SEQ ID NO: 775555 - DNA, 20 bp, Artificial
  CRISPR gRNA sequence
ttcctaacgaaacacgattt

SEQ ID NO: 775556 - DNA, 20 bp, Artificial
  CRISPR gRNA sequence
tcctaacgaaacacgatttg

SEQ ID NO: 775557 - DNA, 20 bp, Artificial
  CRISPR gRNA sequence
cctaacgaaacacgatttgt

SEQ ID NO: 775558 - DNA, 20 bp, Artificial
  CRISPR gRNA sequence
ctaacgaaacacgatttgtt

SEQ ID NO: 775559 - DNA, 20 bp, Artificial
  CRISPR gRNA sequence
acgaaacacgatttgttttt

SEQ ID NO: 775560 - DNA, 20 bp, Artificial
  CRISPR gRNA sequence
gtttttatacaagaaagaat

SEQ ID NO: 775561 - DNA, 20 bp, Artificial
  CRISPR gRNA sequence
tttttatacaagaaagaata

SEQ ID NO: 775562 - DNA, 20 bp, Artificial
  CRISPR gRNA sequence
ttatacaagaaagaataccc

SEQ ID NO: 775563 - DNA, 20 bp, Artificial
  CRISPR gRNA sequence
tatacaagaaagaatacccg

SEQ ID NO: 775564 - DNA, 20 bp, Artificial
  CRISPR gRNA sequence
atacaagaaagaatacccgt

SEQ ID NO: 775565 - DNA, 20 bp, Artificial
  CRISPR gRNA sequence
tacaagaaagaatacccgta

SEQ ID NO: 775566 - DNA, 20 bp, Artificial
  CRISPR gRNA sequence
taaatatggtggtgaggcac

SEQ ID NO: 775567 - DNA, 20 bp, Artificial
  CRISPR gRNA sequence
aaatatggtggtgaggcaca

SEQ ID NO: 775568 - DNA, 20 bp, Artificial
  CRISPR gRNA sequence
aatatggtggtgaggcacat

SEQ ID NO: 775569 - DNA, 20 bp, Artificial
  CRISPR gRNA sequence
tttaaagcaattaagctgaa

SEQ ID NO: 775570 - DNA, 20 bp, Artificial
  CRISPR gRNA sequence
taaagcaattaagctgaaat

SEQ ID NO: 775571 - DNA, 20 bp, Artificial
  CRISPR gRNA sequence
aaagcaattaagctgaaatt

SEQ ID NO: 775572 - DNA, 20 bp, Artificial
  CRISPR gRNA sequence
aagcaattaagctgaaattt

SEQ ID NO: 775573 - DNA, 20 bp, Artificial
  CRISPR gRNA sequence
agctgaaatttatagggaat

SEQ ID NO: 775574 - DNA, 20 bp, Artificial
  CRISPR gRNA sequence
aaatttatagggaatgaaaa

SEQ ID NO: 775575 - DNA, 20 bp, Artificial
  CRISPR gRNA sequence
atagggaatgaaaaagagct

SEQ ID NO: 775576 - DNA, 20 bp, Artificial
  CRISPR gRNA sequence
tagggaatgaaaaagagctg

SEQ ID NO: 775577 - DNA, 20 bp, Artificial
  CRISPR gRNA sequence
acatacagagaaccccgtag

SEQ ID NO: 775578 - DNA, 20 bp, Artificial
  CRISPR gRNA sequence
aggcaagactggccttgctg

SEQ ID NO: 775579 - DNA, 20 bp, Artificial
  CRISPR gRNA sequence
gccttgctgtgtgaaaatat

SEQ ID NO: 775580 - DNA, 20 bp, Artificial
  CRISPR gRNA sequence
gctgtgtgaaaatatcgggg

SEQ ID NO: 775581 - DNA, 20 bp, Artificial
  CRISPR gRNA sequence
ctgtgtgaaaatatcgggga

SEQ ID NO: 775582 - DNA, 20 bp, Artificial
  CRISPR gRNA sequence
tgtgaaaatatcggggagcg

SEQ ID NO: 775583 - DNA, 20 bp, Artificial
  CRISPR gRNA sequence
atgggagggcatgtcccacc

SEQ ID NO: 775584 - DNA, 20 bp, Artificial
  CRISPR gRNA sequence
gaagagaccagtgaggaatc

SEQ ID NO: 775585 - DNA, 20 bp, Artificial
  CRISPR gRNA sequence
aagagaccagtgaggaatct

SEQ ID NO: 775586 - DNA, 20 bp, Artificial
  CRISPR gRNA sequence
actttttctatgagtaatgg

SEQ ID NO: 775587 - DNA, 20 bp, Artificial
  CRISPR gRNA sequence
tttctatgagtaatgggaat

SEQ ID NO: 775588 - DNA, 20 bp, Artificial
  CRISPR gRNA sequence
ttctatgagtaatgggaatc

SEQ ID NO: 775589 - DNA, 20 bp, Artificial
  CRISPR gRNA sequence
tctatgagtaatgggaatca

SEQ ID NO: 775590 - DNA, 20 bp, Artificial
  CRISPR gRNA sequence
ctatgagtaatgggaatcac

SEQ ID NO: 775591 - DNA, 20 bp, Artificial
  CRISPR gRNA sequence
tatgagtaatgggaatcact

SEQ ID NO: 775592 - DNA, 20 bp, Artificial
  CRISPR gRNA sequence
tgagtaatgggaatcactgg

SEQ ID NO: 775593 - DNA, 20 bp, Artificial
  CRISPR gRNA sequence
gggagtgttttaatcacgca

SEQ ID NO: 775594 - DNA, 20 bp, Artificial
  CRISPR gRNA sequence
taatcacgcataatctgagt

SEQ ID NO: 775595 - DNA, 20 bp, Artificial
  CRISPR gRNA sequence
aatcacgcataatctgagta

SEQ ID NO: 775596 - DNA, 20 bp, Artificial
  CRISPR gRNA sequence
atcacgcataatctgagtag

SEQ ID NO: 775597 - DNA, 20 bp, Artificial
  CRISPR gRNA sequence
agtagcaatgcttaaaactc

SEQ ID NO: 775598 - DNA, 20 bp, Artificial
  CRISPR gRNA sequence
aaaactcactctagctcctc

SEQ ID NO: 775599 - DNA, 20 bp, Artificial
  CRISPR gRNA sequence
aaactcactctagctcctct

SEQ ID NO: 775600 - DNA, 20 bp, Artificial
  CRISPR gRNA sequence
actctagctcctctgtggag

SEQ ID NO: 775601 - DNA, 20 bp, Artificial
  CRISPR gRNA sequence
tagctcctctgtggagactg

SEQ ID NO: 775602 - DNA, 20 bp, Artificial
  CRISPR gRNA sequence
gctcctctgtggagactgga

SEQ ID NO: 775603 - DNA, 20 bp, Artificial
  CRISPR gRNA sequence
ctctgtggagactggactgt

SEQ ID NO: 775604 - DNA, 20 bp, Artificial
  CRISPR gRNA sequence
tgtggagactggactgtggc

SEQ ID NO: 775605 - DNA, 20 bp, Artificial
  CRISPR gRNA sequence
tggagactggactgtggcag

SEQ ID NO: 775606 - DNA, 20 bp, Artificial
  CRISPR gRNA sequence
gactgtggcagggcaagggg

SEQ ID NO: 775607 - DNA, 20 bp, Artificial
  CRISPR gRNA sequence
tggcagggcaagggggaggc

SEQ ID NO: 775608 - DNA, 20 bp, Artificial
  CRISPR gRNA sequence
ggggcggtttcagctgtccc

SEQ ID NO: 775609 - DNA, 20 bp, Artificial
  CRISPR gRNA sequence
cagctgtccctgtaagaggt

SEQ ID NO: 775610 - DNA, 20 bp, Artificial
  CRISPR gRNA sequence
agctgtccctgtaagaggtg

SEQ ID NO: 775611 - DNA, 20 bp, Artificial
  CRISPR gRNA sequence
tccctgtaagaggtgagggt

SEQ ID NO: 775612 - DNA, 20 bp, Artificial
  CRISPR gRNA sequence
taagaggtgagggtggtgtg

SEQ ID NO: 775613 - DNA, 20 bp, Artificial
  CRISPR gRNA sequence
caaagggtggtagtagagaa

SEQ ID NO: 775614 - DNA, 20 bp, Artificial
  CRISPR gRNA sequence
aaagggtggtagtagagaag

SEQ ID NO: 775615 - DNA, 20 bp, Artificial
  CRISPR gRNA sequence
aaggtttatttaggagggaa

SEQ ID NO: 775616 - DNA, 20 bp, Artificial
  CRISPR gRNA sequence
atttaggagggaatcaacag

SEQ ID NO: 775617 - DNA, 20 bp, Artificial
  CRISPR gRNA sequence
tttaggagggaatcaacagg

SEQ ID NO: 775618 - DNA, 20 bp, Artificial
  CRISPR gRNA sequence
aggagggaatcaacaggact

SEQ ID NO: 775619 - DNA, 20 bp, Artificial
  CRISPR gRNA sequence
ggagggaatcaacaggactt

SEQ ID NO: 775620 - DNA, 20 bp, Artificial
  CRISPR gRNA sequence
gctgatgagtcagaagtgag

SEQ ID NO: 775621 - DNA, 20 bp, Artificial
  CRISPR gRNA sequence
ctgatgagtcagaagtgagg

SEQ ID NO: 775622 - DNA, 20 bp, Artificial
  CRISPR gRNA sequence
atgagtcagaagtgagggga

SEQ ID NO: 775623 - DNA, 20 bp, Artificial
  CRISPR gRNA sequence
aggtcaggcgttcgagacca

SEQ ID NO: 775624 - DNA, 20 bp, Artificial
  CRISPR gRNA sequence
gagaccagcctagcagatat

SEQ ID NO: 775625 - DNA, 20 bp, Artificial
  CRISPR gRNA sequence
gcagatatggtgaaacccca

SEQ ID NO: 775626 - DNA, 20 bp, Artificial
  CRISPR gRNA sequence
tactaaaaaatagccagggg

SEQ ID NO: 775627 - DNA, 20 bp, Artificial
  CRISPR gRNA sequence
ctaaaaaatagccaggggtg

SEQ ID NO: 775628 - DNA, 20 bp, Artificial
  CRISPR gRNA sequence
aaaaatagccaggggtggtg

SEQ ID NO: 775629 - DNA, 20 bp, Artificial
  CRISPR gRNA sequence
taatcccagctactcaggag

SEQ ID NO: 775630 - DNA, 20 bp, Artificial
  CRISPR gRNA sequence
ctcaggaggctgaggcagga

SEQ ID NO: 775631 - DNA, 20 bp, Artificial
  CRISPR gRNA sequence
aggaggctgaggcaggagaa

SEQ ID NO: 775632 - DNA, 20 bp, Artificial
  CRISPR gRNA sequence
aggcaggagaattgcttgaa

SEQ ID NO: 775633 - DNA, 20 bp, Artificial
  CRISPR gRNA sequence
cttgaacctgggaggtggag

SEQ ID NO: 775634 - DNA, 20 bp, Artificial
  CRISPR gRNA sequence
gaacctgggaggtggaggtt

SEQ ID NO: 775635 - DNA, 20 bp, Artificial
  CRISPR gRNA sequence
aacctgggaggtggaggttg

SEQ ID NO: 775636 - DNA, 20 bp, Artificial
  CRISPR gRNA sequence
ggaggtggaggttgcagtga

SEQ ID NO: 775637 - DNA, 20 bp, Artificial
  CRISPR gRNA sequence
cagtgagccgagatcgcgcc

SEQ ID NO: 775638 - DNA, 20 bp, Artificial
  CRISPR gRNA sequence
cactccatccttggcaacag

SEQ ID NO: 775639 - DNA, 20 bp, Artificial
  CRISPR gRNA sequence
catccttggcaacagagcaa

SEQ ID NO: 775640 - DNA, 20 bp, Artificial
  CRISPR gRNA sequence
ggcaacagagcaagacccca

SEQ ID NO: 775641 - DNA, 20 bp, Artificial
  CRISPR gRNA sequence
gcaacagagcaagaccccat

SEQ ID NO: 775642 - DNA, 20 bp, Artificial
  CRISPR gRNA sequence
aaaaaaaaaaaaagaggagg

SEQ ID NO: 775643 - DNA, 20 bp, Artificial
  CRISPR gRNA sequence
gcactaccattctccggtaa

SEQ ID NO: 775644 - DNA, 20 bp, Artificial
  CRISPR gRNA sequence
ccattctccggtaatggtta

SEQ ID NO: 775645 - DNA, 20 bp, Artificial
  CRISPR gRNA sequence
tccggtaatggttagattgt

SEQ ID NO: 775646 - DNA, 20 bp, Artificial
  CRISPR gRNA sequence
cggtaatggttagattgtgt

SEQ ID NO: 775647 - DNA, 20 bp, Artificial
  CRISPR gRNA sequence
gattgtgtgcttcgagcact

SEQ ID NO: 775648 - DNA, 20 bp, Artificial
  CRISPR gRNA sequence
tgtgcttcgagcactagcaa

SEQ ID NO: 775649 - DNA, 20 bp, Artificial
  CRISPR gRNA sequence
cgagcactagcaaagcaggc

SEQ ID NO: 775650 - DNA, 20 bp, Artificial
  CRISPR gRNA sequence
gagcactagcaaagcaggca

SEQ ID NO: 775651 - DNA, 20 bp, Artificial
  CRISPR gRNA sequence
gcaaagcaggcacactcaaa

SEQ ID NO: 775652 - DNA, 20 bp, Artificial
  CRISPR gRNA sequence
aaaatgtgggaagatcaacc

SEQ ID NO: 775653 - DNA, 20 bp, Artificial
  CRISPR gRNA sequence
gaaacaatgctaattgaata

SEQ ID NO: 775654 - DNA, 20 bp, Artificial
  CRISPR gRNA sequence
aaacaatgctaattgaatac

SEQ ID NO: 775655 - DNA, 20 bp, Artificial
  CRISPR gRNA sequence
attgaatacagcactcatta

SEQ ID NO: 775656 - DNA, 20 bp, Artificial
  CRISPR gRNA sequence
aatacagcactcattaaagg

SEQ ID NO: 775657 - DNA, 20 bp, Artificial
  CRISPR gRNA sequence
attaaaggtttcctgcattt

SEQ ID NO: 775658 - DNA, 20 bp, Artificial
  CRISPR gRNA sequence
aaggtttcctgcatttagaa

SEQ ID NO: 775659 - DNA, 20 bp, Artificial
  CRISPR gRNA sequence
cctgcatttagaaaaataac

SEQ ID NO: 775660 - DNA, 20 bp, Artificial
  CRISPR gRNA sequence
ctgcatttagaaaaataaca

SEQ ID NO: 775661 - DNA, 20 bp, Artificial
  CRISPR gRNA sequence
catttagaaaaataacattg

SEQ ID NO: 775662 - DNA, 20 bp, Artificial
  CRISPR gRNA sequence
agaaaaataacattgacttt

SEQ ID NO: 775663 - DNA, 20 bp, Artificial
  CRISPR gRNA sequence
gaaaaataacattgacttta

SEQ ID NO: 775664 - DNA, 20 bp, Artificial
  CRISPR gRNA sequence
actttatggttattattttt

SEQ ID NO: 775665 - DNA, 20 bp, Artificial
  CRISPR gRNA sequence
tatggttattatttttattg

SEQ ID NO: 775666 - DNA, 20 bp, Artificial
  CRISPR gRNA sequence
atggttattatttttattgt

SEQ ID NO: 775667 - DNA, 20 bp, Artificial
  CRISPR gRNA sequence
tggttattatttttattgtg

SEQ ID NO: 775668 - DNA, 20 bp, Artificial
  CRISPR gRNA sequence
ttatttttattgtgaatcat

SEQ ID NO: 775669 - DNA, 20 bp, Artificial
  CRISPR gRNA sequence
tttttattgtgaatcatact

SEQ ID NO: 775670 - DNA, 20 bp, Artificial
  CRISPR gRNA sequence
ttattgtgaatcatactcag

SEQ ID NO: 775671 - DNA, 20 bp, Artificial
  CRISPR gRNA sequence
tattgtgaatcatactcagt

SEQ ID NO: 775672 - DNA, 20 bp, Artificial
  CRISPR gRNA sequence
attgtgaatcatactcagta

SEQ ID NO: 775673 - DNA, 20 bp, Artificial
  CRISPR gRNA sequence
ttgtgaatcatactcagtat

SEQ ID NO: 775674 - DNA, 20 bp, Artificial
  CRISPR gRNA sequence
tgaatcatactcagtatcat

SEQ ID NO: 775675 - DNA, 20 bp, Artificial
  CRISPR gRNA sequence
agtatcataatctttgcagt

SEQ ID NO: 775676 - DNA, 20 bp, Artificial
  CRISPR gRNA sequence
tgcagtacctagagatctct

SEQ ID NO: 775677 - DNA, 20 bp, Artificial
  CRISPR gRNA sequence
gcagtacctagagatctcta

SEQ ID NO: 775678 - DNA, 20 bp, Artificial
  CRISPR gRNA sequence
cagtacctagagatctctaa

SEQ ID NO: 775679 - DNA, 20 bp, Artificial
  CRISPR gRNA sequence
gagatctctaaagttcttaa

SEQ ID NO: 775680 - DNA, 20 bp, Artificial
  CRISPR gRNA sequence
taaagttcttaagctagcct

SEQ ID NO: 775681 - DNA, 20 bp, Artificial
  CRISPR gRNA sequence
aagttcttaagctagccttg

SEQ ID NO: 775682 - DNA, 20 bp, Artificial
  CRISPR gRNA sequence
ttaagctagccttggatctc

SEQ ID NO: 775683 - DNA, 20 bp, Artificial
  CRISPR gRNA sequence
aagctagccttggatctctt

SEQ ID NO: 775684 - DNA, 20 bp, Artificial
  CRISPR gRNA sequence
agctagccttggatctcttg

SEQ ID NO: 775685 - DNA, 20 bp, Artificial
  CRISPR gRNA sequence
gccttggatctcttgctgaa

SEQ ID NO: 775686 - DNA, 20 bp, Artificial
  CRISPR gRNA sequence
ggatctcttgctgaaacccc

SEQ ID NO: 775687 - DNA, 20 bp, Artificial
  CRISPR gRNA sequence
gatctcttgctgaaacccct

SEQ ID NO: 775688 - DNA, 20 bp, Artificial
  CRISPR gRNA sequence
ttgctgaaacccctggtgcc

SEQ ID NO: 775689 - DNA, 20 bp, Artificial
  CRISPR gRNA sequence
gctgaaacccctggtgcccc

SEQ ID NO: 775690 - DNA, 20 bp, Artificial
  CRISPR gRNA sequence
ctgaaacccctggtgcccca

SEQ ID NO: 775691 - DNA, 20 bp, Artificial
  CRISPR gRNA sequence
aaacccctggtgccccaggc

SEQ ID NO: 775692 - DNA, 20 bp, Artificial
  CRISPR gRNA sequence
gtgccccaggccagttctca

SEQ ID NO: 775693 - DNA, 20 bp, Artificial
  CRISPR gRNA sequence
tcatgccctgtcagtcgaac

SEQ ID NO: 775694 - DNA, 20 bp, Artificial
  CRISPR gRNA sequence
atgccctgtcagtcgaacca

SEQ ID NO: 775695 - DNA, 20 bp, Artificial
  CRISPR gRNA sequence
tcagtcgaaccagggtgccc

SEQ ID NO: 775696 - DNA, 20 bp, Artificial
  CRISPR gRNA sequence
ggaggggacatttgggggaa

SEQ ID NO: 775697 - DNA, 20 bp, Artificial
  CRISPR gRNA sequence
gaggggacatttgggggaat

SEQ ID NO: 775698 - DNA, 20 bp, Artificial
  CRISPR gRNA sequence
gggggaatgaaacctggtaa

SEQ ID NO: 775699 - DNA, 20 bp, Artificial
  CRISPR gRNA sequence
ggggaatgaaacctggtaag

SEQ ID NO: 775700 - DNA, 20 bp, Artificial
  CRISPR gRNA sequence
gtaagtcacccagacaaaac

SEQ ID NO: 775701 - DNA, 20 bp, Artificial
  CRISPR gRNA sequence
tcttgctctagagaaatcag

SEQ ID NO: 775702 - DNA, 20 bp, Artificial
  CRISPR gRNA sequence
cttgctctagagaaatcaga

SEQ ID NO: 775703 - DNA, 20 bp, Artificial
  CRISPR gRNA sequence
ttgctctagagaaatcagag

SEQ ID NO: 775704 - DNA, 20 bp, Artificial
  CRISPR gRNA sequence
gctctagagaaatcagagca

SEQ ID NO: 775705 - DNA, 20 bp, Artificial
  CRISPR gRNA sequence
ctctagagaaatcagagcag

SEQ ID NO: 775706 - DNA, 20 bp, Artificial
  CRISPR gRNA sequence
tagagaaatcagagcagccg

SEQ ID NO: 775707 - DNA, 20 bp, Artificial
  CRISPR gRNA sequence
gagaaatcagagcagccgtg

SEQ ID NO: 775708 - DNA, 20 bp, Artificial
  CRISPR gRNA sequence
ctttatggccacaagatggc

SEQ ID NO: 775709 - DNA, 20 bp, Artificial
  CRISPR gRNA sequence
tttatggccacaagatggcg

SEQ ID NO: 775710 - DNA, 20 bp, Artificial
  CRISPR gRNA sequence
tatggccacaagatggcgcc

SEQ ID NO: 775711 - DNA, 20 bp, Artificial
  CRISPR gRNA sequence
atggccacaagatggcgcca

SEQ ID NO: 775712 - DNA, 20 bp, Artificial
  CRISPR gRNA sequence
tggccacaagatggcgccag

SEQ ID NO: 775713 - DNA, 20 bp, Artificial
  CRISPR gRNA sequence
agctttgtcttccccacgga

SEQ ID NO: 775714 - DNA, 20 bp, Artificial
  CRISPR gRNA sequence
tgtcttccccacggaggaag

SEQ ID NO: 775715 - DNA, 20 bp, Artificial
  CRISPR gRNA sequence
gtcttccccacggaggaagc

SEQ ID NO: 775716 - DNA, 20 bp, Artificial
  CRISPR gRNA sequence
tcttccccacggaggaagcc

SEQ ID NO: 775717 - DNA, 20 bp, Artificial
  CRISPR gRNA sequence
ccccacggaggaagccgtct

SEQ ID NO: 775718 - DNA, 20 bp, Artificial
  CRISPR gRNA sequence
cccacggaggaagccgtctc

SEQ ID NO: 775719 - DNA, 20 bp, Artificial
  CRISPR gRNA sequence
agagcagagatgctgatgag

SEQ ID NO: 775720 - DNA, 20 bp, Artificial
  CRISPR gRNA sequence
atgagaatttgaaatgtgat

SEQ ID NO: 775721 - DNA, 20 bp, Artificial
  CRISPR gRNA sequence
gaaatgtgatgaggatattg

SEQ ID NO: 775722 - DNA, 20 bp, Artificial
  CRISPR gRNA sequence
aaatgtgatgaggatattgt

SEQ ID NO: 775723 - DNA, 20 bp, Artificial
  CRISPR gRNA sequence
ttattaaagtagctattatt

SEQ ID NO: 775724 - DNA, 20 bp, Artificial
  CRISPR gRNA sequence
ttaaagtagctattattatt

SEQ ID NO: 775725 - DNA, 20 bp, Artificial
  CRISPR gRNA sequence
aagtagctattattattgag

SEQ ID NO: 775726 - DNA, 20 bp, Artificial
  CRISPR gRNA sequence
ttattattgagtgcttcctg

SEQ ID NO: 775727 - DNA, 20 bp, Artificial
  CRISPR gRNA sequence
ttattgagtgcttcctgtgt

SEQ ID NO: 775728 - DNA, 20 bp, Artificial
  CRISPR gRNA sequence
ttgagtgcttcctgtgtgcc

SEQ ID NO: 775729 - DNA, 20 bp, Artificial
  CRISPR gRNA sequence
agtgcttcctgtgtgccaag

SEQ ID NO: 775730 - DNA, 20 bp, Artificial
  CRISPR gRNA sequence
cctgtgtgccaagcaccgtg

SEQ ID NO: 775731 - DNA, 20 bp, Artificial
  CRISPR gRNA sequence
ctgtgtgccaagcaccgtgt

SEQ ID NO: 775732 - DNA, 20 bp, Artificial
  CRISPR gRNA sequence
tgtgccaagcaccgtgtggg

SEQ ID NO: 775733 - DNA, 20 bp, Artificial
  CRISPR gRNA sequence
attctacacagttattgggc

SEQ ID NO: 775734 - DNA, 20 bp, Artificial
  CRISPR gRNA sequence
ttctacacagttattgggca

SEQ ID NO: 775735 - DNA, 20 bp, Artificial
  CRISPR gRNA sequence
tacacagttattgggcacct

SEQ ID NO: 775736 - DNA, 20 bp, Artificial
  CRISPR gRNA sequence
cacagttattgggcacctac

SEQ ID NO: 775737 - DNA, 20 bp, Artificial
  CRISPR gRNA sequence
ttgggcacctactatgcaac

SEQ ID NO: 775738 - DNA, 20 bp, Artificial
  CRISPR gRNA sequence
ggcacctactatgcaacagc

SEQ ID NO: 775739 - DNA, 20 bp, Artificial
  CRISPR gRNA sequence
ctatgcaacagccgctctgg

SEQ ID NO: 775740 - DNA, 20 bp, Artificial
  CRISPR gRNA sequence
tgcaacagccgctctggccc

SEQ ID NO: 775741 - DNA, 20 bp, Artificial
  CRISPR gRNA sequence
tggccctgagatggaccctg

SEQ ID NO: 775742 - DNA, 20 bp, Artificial
  CRISPR gRNA sequence
gccctgagatggaccctgct

SEQ ID NO: 775743 - DNA, 20 bp, Artificial
  CRISPR gRNA sequence
agatggaccctgctctttga

SEQ ID NO: 775744 - DNA, 20 bp, Artificial
  CRISPR gRNA sequence
ctctttgaacagggaggaag

SEQ ID NO: 775745 - DNA, 20 bp, Artificial
  CRISPR gRNA sequence
tttgaacagggaggaagcaa

SEQ ID NO: 775746 - DNA, 20 bp, Artificial
  CRISPR gRNA sequence
tgaacagggaggaagcaagc

SEQ ID NO: 775747 - DNA, 20 bp, Artificial
  CRISPR gRNA sequence
gaacagggaggaagcaagca

SEQ ID NO: 775748 - DNA, 20 bp, Artificial
  CRISPR gRNA sequence
aacagggaggaagcaagcaa

SEQ ID NO: 775749 - DNA, 20 bp, Artificial
  CRISPR gRNA sequence
ggcagaataacgcagggagg

SEQ ID NO: 775750 - DNA, 20 bp, Artificial
  CRISPR gRNA sequence
ttttatacaagggagctagg

SEQ ID NO: 775751 - DNA, 20 bp, Artificial
  CRISPR gRNA sequence
tatacaagggagctaggaga

SEQ ID NO: 775752 - DNA, 20 bp, Artificial
  CRISPR gRNA sequence
atacaagggagctaggagag

SEQ ID NO: 775753 - DNA, 20 bp, Artificial
  CRISPR gRNA sequence
tacaagggagctaggagagc

SEQ ID NO: 775754 - DNA, 20 bp, Artificial
  CRISPR gRNA sequence
ggagagccttgagaggaggt

SEQ ID NO: 775755 - DNA, 20 bp, Artificial
  CRISPR gRNA sequence
gagaggaggtgacattgagc

SEQ ID NO: 775756 - DNA, 20 bp, Artificial
  CRISPR gRNA sequence
agaggaggtgacattgagca

SEQ ID NO: 775757 - DNA, 20 bp, Artificial
  CRISPR gRNA sequence
agcaaagacctccacaaaat

SEQ ID NO: 775758 - DNA, 20 bp, Artificial
  CRISPR gRNA sequence
cacaaaatatgggatccagt

SEQ ID NO: 775759 - DNA, 20 bp, Artificial
  CRISPR gRNA sequence
aggggcagaaagttccaggc

SEQ ID NO: 775760 - DNA, 20 bp, Artificial
  CRISPR gRNA sequence
ggggcagaaagttccaggca

SEQ ID NO: 775761 - DNA, 20 bp, Artificial
  CRISPR gRNA sequence
caggcagaggaaagagcaag

SEQ ID NO: 775762 - DNA, 20 bp, Artificial
  CRISPR gRNA sequence
ggagggggcgcacacagtgt

SEQ ID NO: 775763 - DNA, 20 bp, Artificial
  CRISPR gRNA sequence
aagaaatagcacgatctcat

SEQ ID NO: 775764 - DNA, 20 bp, Artificial
  CRISPR gRNA sequence
atttagcactcatgttccca

SEQ ID NO: 775765 - DNA, 20 bp, Artificial
  CRISPR gRNA sequence
agcactcatgttcccatttt

SEQ ID NO: 775766 - DNA, 20 bp, Artificial
  CRISPR gRNA sequence
gcactcatgttcccatttta

SEQ ID NO: 775767 - DNA, 20 bp, Artificial
  CRISPR gRNA sequence
atgttcccattttacagaca

SEQ ID NO: 775768 - DNA, 20 bp, Artificial
  CRISPR gRNA sequence
ccattttacagacaaggaaa

SEQ ID NO: 775769 - DNA, 20 bp, Artificial
  CRISPR gRNA sequence
tacagacaaggaaatggagg

SEQ ID NO: 775770 - DNA, 20 bp, Artificial
  CRISPR gRNA sequence
acagacaaggaaatggaggc

SEQ ID NO: 775771 - DNA, 20 bp, Artificial
  CRISPR gRNA sequence
cagacaaggaaatggaggct

SEQ ID NO: 775772 - DNA, 20 bp, Artificial
  CRISPR gRNA sequence
agaacagtaacgtgagttgc

SEQ ID NO: 775773 - DNA, 20 bp, Artificial
  CRISPR gRNA sequence
cctactggatcccacaggtg

SEQ ID NO: 775774 - DNA, 20 bp, Artificial
  CRISPR gRNA sequence
ctggatcccacaggtggaag

SEQ ID NO: 775775 - DNA, 20 bp, Artificial
  CRISPR gRNA sequence
gatcccacaggtggaagtaa

SEQ ID NO: 775776 - DNA, 20 bp, Artificial
  CRISPR gRNA sequence
ctagccagagctggcttggc

SEQ ID NO: 775777 - DNA, 20 bp, Artificial
  CRISPR gRNA sequence
gccagagctggcttggcagg

SEQ ID NO: 775778 - DNA, 20 bp, Artificial
  CRISPR gRNA sequence
gcttggcaggacccctaaca

SEQ ID NO: 775779 - DNA, 20 bp, Artificial
  CRISPR gRNA sequence
ggcaggacccctaacaggcg

SEQ ID NO: 775780 - DNA, 20 bp, Artificial
  CRISPR gRNA sequence
gcaggacccctaacaggcgt

SEQ ID NO: 775781 - DNA, 20 bp, Artificial
  CRISPR gRNA sequence
acaggcgtgggcaccccctc

SEQ ID NO: 775782 - DNA, 20 bp, Artificial
  CRISPR gRNA sequence
cccaactgccacaatcactg

SEQ ID NO: 775783 - DNA, 20 bp, Artificial
  CRISPR gRNA sequence
ccacaatcactgtccctccc

SEQ ID NO: 775784 - DNA, 20 bp, Artificial
  CRISPR gRNA sequence
tccctcccctcccgtcccca

SEQ ID NO: 775785 - DNA, 20 bp, Artificial
  CRISPR gRNA sequence
ccctcccgtccccatgctgc

SEQ ID NO: 775786 - DNA, 20 bp, Artificial
  CRISPR gRNA sequence
ccgtccccatgctgctaccc

SEQ ID NO: 775787 - DNA, 20 bp, Artificial
  CRISPR gRNA sequence
ctaccctcacctgtgaggca

SEQ ID NO: 775788 - DNA, 20 bp, Artificial
  CRISPR gRNA sequence
ccctcacctgtgaggcagaa

SEQ ID NO: 775789 - DNA, 20 bp, Artificial
  CRISPR gRNA sequence
acctgtgaggcagaaccaca

SEQ ID NO: 775790 - DNA, 20 bp, Artificial
  CRISPR gRNA sequence
tgaggcagaaccacagtgct

SEQ ID NO: 775791 - DNA, 20 bp, Artificial
  CRISPR gRNA sequence
ccagggctgcacccacatgc

SEQ ID NO: 775792 - DNA, 20 bp, Artificial
  CRISPR gRNA sequence
cacccacatgcacacccatg

SEQ ID NO: 775793 - DNA, 20 bp, Artificial
  CRISPR gRNA sequence
ccccgccgacgcagcatctt

SEQ ID NO: 775794 - DNA, 20 bp, Artificial
  CRISPR gRNA sequence
cctgtgaggcggctgacagc

SEQ ID NO: 775795 - DNA, 20 bp, Artificial
  CRISPR gRNA sequence
ctgtgaggcggctgacagct

SEQ ID NO: 775796 - DNA, 20 bp, Artificial
  CRISPR gRNA sequence
tgaggcggctgacagctggg

SEQ ID NO: 775797 - DNA, 20 bp, Artificial
  CRISPR gRNA sequence
acagctgggctccccgtggt

SEQ ID NO: 775798 - DNA, 20 bp, Artificial
  CRISPR gRNA sequence
ggctccccgtggtggaaggc

SEQ ID NO: 775799 - DNA, 20 bp, Artificial
  CRISPR gRNA sequence
cccgtggtggaaggctgccc

SEQ ID NO: 775800 - DNA, 20 bp, Artificial
  CRISPR gRNA sequence
cccctgcctgggagaaagag

SEQ ID NO: 775801 - DNA, 20 bp, Artificial
  CRISPR gRNA sequence
cctgggagaaagaggacgca

SEQ ID NO: 775802 - DNA, 20 bp, Artificial
  CRISPR gRNA sequence
ggagaaagaggacgcaaggc

SEQ ID NO: 775803 - DNA, 20 bp, Artificial
  CRISPR gRNA sequence
tgtctccaaaggttctcccc

SEQ ID NO: 775804 - DNA, 20 bp, Artificial
  CRISPR gRNA sequence
gtctccaaaggttctcccca

SEQ ID NO: 775805 - DNA, 20 bp, Artificial
  CRISPR gRNA sequence
tctccaaaggttctccccag

SEQ ID NO: 775806 - DNA, 20 bp, Artificial
  CRISPR gRNA sequence
caaaggttctccccagacca

SEQ ID NO: 775807 - DNA, 20 bp, Artificial
  CRISPR gRNA sequence
tccccagaccatctcttgcc

SEQ ID NO: 775808 - DNA, 20 bp, Artificial
  CRISPR gRNA sequence
cccagaccatctcttgcctc

SEQ ID NO: 775809 - DNA, 20 bp, Artificial
  CRISPR gRNA sequence
ttgcctcatctctcctggac

SEQ ID NO: 775810 - DNA, 20 bp, Artificial
  CRISPR gRNA sequence
gcctcatctctcctggacca

SEQ ID NO: 775811 - DNA, 20 bp, Artificial
  CRISPR gRNA sequence
cctcatctctcctggaccag

SEQ ID NO: 775812 - DNA, 20 bp, Artificial
  CRISPR gRNA sequence
atctctcctggaccagagtg

SEQ ID NO: 775813 - DNA, 20 bp, Artificial
  CRISPR gRNA sequence
tcctggaccagagtggggaa

SEQ ID NO: 775814 - DNA, 20 bp, Artificial
  CRISPR gRNA sequence
ctggaccagagtggggaagg

SEQ ID NO: 775815 - DNA, 20 bp, Artificial
  CRISPR gRNA sequence
gaccagagtggggaaggctg

SEQ ID NO: 775816 - DNA, 20 bp, Artificial
  CRISPR gRNA sequence
caactgcccactgggaggtc

SEQ ID NO: 775817 - DNA, 20 bp, Artificial
  CRISPR gRNA sequence
cccactgggaggtcctcatt

SEQ ID NO: 775818 - DNA, 20 bp, Artificial
  CRISPR gRNA sequence
ggaggtcctcattcccatat

SEQ ID NO: 775819 - DNA, 20 bp, Artificial
  CRISPR gRNA sequence
attcccatatcccaccgggc

SEQ ID NO: 775820 - DNA, 20 bp, Artificial
  CRISPR gRNA sequence
ccatatcccaccgggccccc

SEQ ID NO: 775821 - DNA, 20 bp, Artificial
  CRISPR gRNA sequence
ctgaggaatcttggtgacag

SEQ ID NO: 775822 - DNA, 20 bp, Artificial
  CRISPR gRNA sequence
aggaatcttggtgacagatg

SEQ ID NO: 775823 - DNA, 20 bp, Artificial
  CRISPR gRNA sequence
ggtgacagatgcttggcagg

SEQ ID NO: 775824 - DNA, 20 bp, Artificial
  CRISPR gRNA sequence
gtgacagatgcttggcaggg

SEQ ID NO: 775825 - DNA, 20 bp, Artificial
  CRISPR gRNA sequence
ggcagggagtccctggggag

SEQ ID NO: 775826 - DNA, 20 bp, Artificial
  CRISPR gRNA sequence
gcagggagtccctggggagg

SEQ ID NO: 775827 - DNA, 20 bp, Artificial
  CRISPR gRNA sequence
gggaggcctgacagggaaga

SEQ ID NO: 775828 - DNA, 20 bp, Artificial
  CRISPR gRNA sequence
acagggaagatggggtaggg

SEQ ID NO: 775829 - DNA, 20 bp, Artificial
  CRISPR gRNA sequence
ggatccaccctttcagctaa

SEQ ID NO: 775830 - DNA, 20 bp, Artificial
  CRISPR gRNA sequence
tcagctaagatgttagtatc

SEQ ID NO: 775831 - DNA, 20 bp, Artificial
  CRISPR gRNA sequence
cagctaagatgttagtatcc

SEQ ID NO: 775832 - DNA, 20 bp, Artificial
  CRISPR gRNA sequence
agctaagatgttagtatcca

SEQ ID NO: 775833 - DNA, 20 bp, Artificial
  CRISPR gRNA sequence
agatgttagtatccaaatat

SEQ ID NO: 775834 - DNA, 20 bp, Artificial
  CRISPR gRNA sequence
gtatccaaatataaggaaga

SEQ ID NO: 775835 - DNA, 20 bp, Artificial
  CRISPR gRNA sequence
gcttgctctggggctaggat

SEQ ID NO: 775836 - DNA, 20 bp, Artificial
  CRISPR gRNA sequence
gctctggggctaggatgtgt

SEQ ID NO: 775837 - DNA, 20 bp, Artificial
  CRISPR gRNA sequence
ctctggggctaggatgtgtg

SEQ ID NO: 775838 - DNA, 20 bp, Artificial
  CRISPR gRNA sequence
tggggctaggatgtgtgcag

SEQ ID NO: 775839 - DNA, 20 bp, Artificial
  CRISPR gRNA sequence
gggctaggatgtgtgcagat

SEQ ID NO: 775840 - DNA, 20 bp, Artificial
  CRISPR gRNA sequence
ggatgtgtgcagatcaattt

SEQ ID NO: 775841 - DNA, 20 bp, Artificial
  CRISPR gRNA sequence
ggcagacagtagctggtagg

SEQ ID NO: 775842 - DNA, 20 bp, Artificial
  CRISPR gRNA sequence
gcagacagtagctggtaggg

SEQ ID NO: 775843 - DNA, 20 bp, Artificial
  CRISPR gRNA sequence
gtagggcagagcaggagctc

SEQ ID NO: 775844 - DNA, 20 bp, Artificial
  CRISPR gRNA sequence
ctgtgggggccagacttaga

SEQ ID NO: 775845 - DNA, 20 bp, Artificial
  CRISPR gRNA sequence
tgggggccagacttagagat

SEQ ID NO: 775846 - DNA, 20 bp, Artificial
  CRISPR gRNA sequence
agagatgggctgacaggtgt

SEQ ID NO: 775847 - DNA, 20 bp, Artificial
  CRISPR gRNA sequence
gagatgggctgacaggtgtg

SEQ ID NO: 775848 - DNA, 20 bp, Artificial
  CRISPR gRNA sequence
acaggtgtgaaatgtatcct

SEQ ID NO: 775849 - DNA, 20 bp, Artificial
  CRISPR gRNA sequence
aaggcagttgagagccactg

SEQ ID NO: 775850 - DNA, 20 bp, Artificial
  CRISPR gRNA sequence
agagccactgaagcttcctg

SEQ ID NO: 775851 - DNA, 20 bp, Artificial
  CRISPR gRNA sequence
aagcttcctgaataagggaa

SEQ ID NO: 775852 - DNA, 20 bp, Artificial
  CRISPR gRNA sequence
cctgaataagggaaatacac

SEQ ID NO: 775853 - DNA, 20 bp, Artificial
  CRISPR gRNA sequence
ctgaataagggaaatacacg

SEQ ID NO: 775854 - DNA, 20 bp, Artificial
  CRISPR gRNA sequence
aataagggaaatacacggtc

SEQ ID NO: 775855 - DNA, 20 bp, Artificial
  CRISPR gRNA sequence
agcttcatgaagattaatct

SEQ ID NO: 775856 - DNA, 20 bp, Artificial
  CRISPR gRNA sequence
catgaagattaatctgacag

SEQ ID NO: 775857 - DNA, 20 bp, Artificial
  CRISPR gRNA sequence
atgaagattaatctgacagc

SEQ ID NO: 775858 - DNA, 20 bp, Artificial
  CRISPR gRNA sequence
atctgacagcacctccaccc

SEQ ID NO: 775859 - DNA, 20 bp, Artificial
  CRISPR gRNA sequence
acagcacctccacccgctat

SEQ ID NO: 775860 - DNA, 20 bp, Artificial
  CRISPR gRNA sequence
cacccgctatctgatgggag

SEQ ID NO: 775861 - DNA, 20 bp, Artificial
  CRISPR gRNA sequence
tctgatgggagggtatgttt

SEQ ID NO: 775862 - DNA, 20 bp, Artificial
  CRISPR gRNA sequence
atgggagggtatgtttcagc

SEQ ID NO: 775863 - DNA, 20 bp, Artificial
  CRISPR gRNA sequence
cagccagatcaagcagggct

SEQ ID NO: 775864 - DNA, 20 bp, Artificial
  CRISPR gRNA sequence
agccagatcaagcagggctt

SEQ ID NO: 775865 - DNA, 20 bp, Artificial
  CRISPR gRNA sequence
tgagagaccagtgaggaatt

SEQ ID NO: 775866 - DNA, 20 bp, Artificial
  CRISPR gRNA sequence
gagagaccagtgaggaattt

SEQ ID NO: 775867 - DNA, 20 bp, Artificial
  CRISPR gRNA sequence
agagaccagtgaggaatttg

SEQ ID NO: 775868 - DNA, 20 bp, Artificial
  CRISPR gRNA sequence
gggtttttctatgagtaatg

SEQ ID NO: 775869 - DNA, 20 bp, Artificial
  CRISPR gRNA sequence
ggtttttctatgagtaatgg

SEQ ID NO: 775870 - DNA, 20 bp, Artificial
  CRISPR gRNA sequence
ttctatgagtaatgggaatc

SEQ ID NO: 775871 - DNA, 20 bp, Artificial
  CRISPR gRNA sequence
tctatgagtaatgggaatca

SEQ ID NO: 775872 - DNA, 20 bp, Artificial
  CRISPR gRNA sequence
ctatgagtaatgggaatcac

SEQ ID NO: 775873 - DNA, 20 bp, Artificial
  CRISPR gRNA sequence
tatgagtaatgggaatcact

SEQ ID NO: 775874 - DNA, 20 bp, Artificial
  CRISPR gRNA sequence
tgagtaatgggaatcactgg

SEQ ID NO: 775875 - DNA, 20 bp, Artificial
  CRISPR gRNA sequence
gggagcattttaatcacaca

SEQ ID NO: 775876 - DNA, 20 bp, Artificial
  CRISPR gRNA sequence
taatcacacataatctaggt

SEQ ID NO: 775877 - DNA, 20 bp, Artificial
  CRISPR gRNA sequence
aatcacacataatctaggta

SEQ ID NO: 775878 - DNA, 20 bp, Artificial
  CRISPR gRNA sequence
atcacacataatctaggtaa

SEQ ID NO: 775879 - DNA, 20 bp, Artificial
  CRISPR gRNA sequence
ggtaacaatgtttaaaaccc

SEQ ID NO: 775880 - DNA, 20 bp, Artificial
  CRISPR gRNA sequence
aaaacccactctagctcctc

SEQ ID NO: 775881 - DNA, 20 bp, Artificial
  CRISPR gRNA sequence
aaacccactctagctcctca

SEQ ID NO: 775882 - DNA, 20 bp, Artificial
  CRISPR gRNA sequence
tagctcctcagcatagactg

SEQ ID NO: 775883 - DNA, 20 bp, Artificial
  CRISPR gRNA sequence
gctcctcagcatagactgga

SEQ ID NO: 775884 - DNA, 20 bp, Artificial
  CRISPR gRNA sequence
ctcagcatagactggattgt

SEQ ID NO: 775885 - DNA, 20 bp, Artificial
  CRISPR gRNA sequence
agcatagactggattgtatc

SEQ ID NO: 775886 - DNA, 20 bp, Artificial
  CRISPR gRNA sequence
gattgtatcagggcaaggga

SEQ ID NO: 775887 - DNA, 20 bp, Artificial
  CRISPR gRNA sequence
tatcagggcaagggagaggc

SEQ ID NO: 775888 - DNA, 20 bp, Artificial
  CRISPR gRNA sequence
agaggctatttcaggctgag

SEQ ID NO: 775889 - DNA, 20 bp, Artificial
  CRISPR gRNA sequence
tttcaggctgagtgcagtgg

SEQ ID NO: 775890 - DNA, 20 bp, Artificial
  CRISPR gRNA sequence
caggctgagtgcagtggctc

SEQ ID NO: 775891 - DNA, 20 bp, Artificial
  CRISPR gRNA sequence
aggctgagtgcagtggctca

SEQ ID NO: 775892 - DNA, 20 bp, Artificial
  CRISPR gRNA sequence
agtgcagtggctcatgcctg

SEQ ID NO: 775893 - DNA, 20 bp, Artificial
  CRISPR gRNA sequence
atgcctgtaatcccagcact

SEQ ID NO: 775894 - DNA, 20 bp, Artificial
  CRISPR gRNA sequence
taatcccagcactttgggag

SEQ ID NO: 775895 - DNA, 20 bp, Artificial
  CRISPR gRNA sequence
tgggaggctgaggcaggcga

SEQ ID NO: 775896 - DNA, 20 bp, Artificial
  CRISPR gRNA sequence
gggaggctgaggcaggcgaa

SEQ ID NO: 775897 - DNA, 20 bp, Artificial
  CRISPR gRNA sequence
ggaggctgaggcaggcgaat

SEQ ID NO: 775898 - DNA, 20 bp, Artificial
  CRISPR gRNA sequence
aggcaggcgaatcacttgaa

SEQ ID NO: 775899 - DNA, 20 bp, Artificial
  CRISPR gRNA sequence
gaagtcaggagtttgtgacc

SEQ ID NO: 775900 - DNA, 20 bp, Artificial
  CRISPR gRNA sequence
aagtcaggagtttgtgaccg

SEQ ID NO: 775901 - DNA, 20 bp, Artificial
  CRISPR gRNA sequence
gtgaccggtttgaacaacat

SEQ ID NO: 775902 - DNA, 20 bp, Artificial
  CRISPR gRNA sequence
tgaccggtttgaacaacatg

SEQ ID NO: 775903 - DNA, 20 bp, Artificial
  CRISPR gRNA sequence
gaacaacatggtgaaacccc

SEQ ID NO: 775904 - DNA, 20 bp, Artificial
  CRISPR gRNA sequence
aacaacatggtgaaacccca

SEQ ID NO: 775905 - DNA, 20 bp, Artificial
  CRISPR gRNA sequence
tactaaaaatacaaataatt

SEQ ID NO: 775906 - DNA, 20 bp, Artificial
  CRISPR gRNA sequence
ctaaaaatacaaataattag

SEQ ID NO: 775907 - DNA, 20 bp, Artificial
  CRISPR gRNA sequence
aaaatacaaataattagctg

SEQ ID NO: 775908 - DNA, 20 bp, Artificial
  CRISPR gRNA sequence
gctgggcatggtggtgggca

SEQ ID NO: 775909 - DNA, 20 bp, Artificial
  CRISPR gRNA sequence
ggcatggtggtgggcacctg

SEQ ID NO: 775910 - DNA, 20 bp, Artificial
  CRISPR gRNA sequence
taatcccagctacttgggag

SEQ ID NO: 775911 - DNA, 20 bp, Artificial
  CRISPR gRNA sequence
cttgggagggtgaggcagga

SEQ ID NO: 775912 - DNA, 20 bp, Artificial
  CRISPR gRNA sequence
gggagggtgaggcaggagaa

SEQ ID NO: 775913 - DNA, 20 bp, Artificial
  CRISPR gRNA sequence
ggagggtgaggcaggagaat

SEQ ID NO: 775914 - DNA, 20 bp, Artificial
  CRISPR gRNA sequence
ctagaacccaggaggcagag

SEQ ID NO: 775915 - DNA, 20 bp, Artificial
  CRISPR gRNA sequence
gaacccaggaggcagaggtt

SEQ ID NO: 775916 - DNA, 20 bp, Artificial
  CRISPR gRNA sequence
cagtaagccaagattgcacc

SEQ ID NO: 775917 - DNA, 20 bp, Artificial
  CRISPR gRNA sequence
caccactgcactccagactg

SEQ ID NO: 775918 - DNA, 20 bp, Artificial
  CRISPR gRNA sequence
cactccagactgggtgacag

SEQ ID NO: 775919 - DNA, 20 bp, Artificial
  CRISPR gRNA sequence
cagactgggtgacagagcca

SEQ ID NO: 775920 - DNA, 20 bp, Artificial
  CRISPR gRNA sequence
ggtgacagagccagactcga

SEQ ID NO: 775921 - DNA, 20 bp, Artificial
  CRISPR gRNA sequence
gatctcaaaaaataaaaata

SEQ ID NO: 775922 - DNA, 20 bp, Artificial
  CRISPR gRNA sequence
aaaaaataaaaataaaaaaa

SEQ ID NO: 775923 - DNA, 20 bp, Artificial
  CRISPR gRNA sequence
atatagccatccctgtagga

SEQ ID NO: 775924 - DNA, 20 bp, Artificial
  CRISPR gRNA sequence
taggaaggtatagtggtgga

SEQ ID NO: 775925 - DNA, 20 bp, Artificial
  CRISPR gRNA sequence
ggtaaaagtgacagtatctg

SEQ ID NO: 775926 - DNA, 20 bp, Artificial
  CRISPR gRNA sequence
aggacttgggtagagagaaa

SEQ ID NO: 775927 - DNA, 20 bp, Artificial
  CRISPR gRNA sequence
gggtagagagaaagagcagt

SEQ ID NO: 775928 - DNA, 20 bp, Artificial
  CRISPR gRNA sequence
ggtagagagaaagagcagtc

SEQ ID NO: 775929 - DNA, 20 bp, Artificial
  CRISPR gRNA sequence
gccgtggttttgagcctcag

SEQ ID NO: 775930 - DNA, 20 bp, Artificial
  CRISPR gRNA sequence
tgagcctcagtgacagggtg

SEQ ID NO: 775931 - DNA, 20 bp, Artificial
  CRISPR gRNA sequence
gagcctcagtgacagggtgg

SEQ ID NO: 775932 - DNA, 20 bp, Artificial
  CRISPR gRNA sequence
agcctcagtgacagggtgga

SEQ ID NO: 775933 - DNA, 20 bp, Artificial
  CRISPR gRNA sequence
agtgacagggtggagcattc

SEQ ID NO: 775934 - DNA, 20 bp, Artificial
  CRISPR gRNA sequence
actgaggcagagaaaatgga

SEQ ID NO: 775935 - DNA, 20 bp, Artificial
  CRISPR gRNA sequence
aggcagagaaaatggaaggg

SEQ ID NO: 775936 - DNA, 20 bp, Artificial
  CRISPR gRNA sequence
agtatagcttgtgtgaaatc

SEQ ID NO: 775937 - DNA, 20 bp, Artificial
  CRISPR gRNA sequence
gtgtgaaatcagcagtattt

SEQ ID NO: 775938 - DNA, 20 bp, Artificial
  CRISPR gRNA sequence
tgtgaaatcagcagtatttg

SEQ ID NO: 775939 - DNA, 20 bp, Artificial
  CRISPR gRNA sequence
gcaaagaagcttctaggaca

SEQ ID NO: 775940 - DNA, 20 bp, Artificial
  CRISPR gRNA sequence
caaagaagcttctaggacag

SEQ ID NO: 775941 - DNA, 20 bp, Artificial
  CRISPR gRNA sequence
ctaggacagagttttaggag

SEQ ID NO: 775942 - DNA, 20 bp, Artificial
  CRISPR gRNA sequence
taggacagagttttaggagg

SEQ ID NO: 775943 - DNA, 20 bp, Artificial
  CRISPR gRNA sequence
ggacagagttttaggaggcg

SEQ ID NO: 775944 - DNA, 20 bp, Artificial
  CRISPR gRNA sequence
taggaggcgactaggtgtat

SEQ ID NO: 775945 - DNA, 20 bp, Artificial
  CRISPR gRNA sequence
aggaggcgactaggtgtatg

SEQ ID NO: 775946 - DNA, 20 bp, Artificial
  CRISPR gRNA sequence
ggaggcgactaggtgtatga

SEQ ID NO: 775947 - DNA, 20 bp, Artificial
  CRISPR gRNA sequence
ggtgtatgagtgtgggaatg

SEQ ID NO: 775948 - DNA, 20 bp, Artificial
  CRISPR gRNA sequence
gctagcttaacacatctgta

SEQ ID NO: 775949 - DNA, 20 bp, Artificial
  CRISPR gRNA sequence
ctagcttaacacatctgtat

SEQ ID NO: 775950 - DNA, 20 bp, Artificial
  CRISPR gRNA sequence
gcttaacacatctgtattga

SEQ ID NO: 775951 - DNA, 20 bp, Artificial
  CRISPR gRNA sequence
aacacatctgtattgagtga

SEQ ID NO: 775952 - DNA, 20 bp, Artificial
  CRISPR gRNA sequence
acacatctgtattgagtgac

SEQ ID NO: 775953 - DNA, 20 bp, Artificial
  CRISPR gRNA sequence
tattgagtgaccaagacaga

SEQ ID NO: 775954 - DNA, 20 bp, Artificial
  CRISPR gRNA sequence
agtgaccaagacagatcaga

SEQ ID NO: 775955 - DNA, 20 bp, Artificial
  CRISPR gRNA sequence
ggggatgacctcaaggctgg

SEQ ID NO: 775956 - DNA, 20 bp, Artificial
  CRISPR gRNA sequence
gggatgacctcaaggctgga

SEQ ID NO: 775957 - DNA, 20 bp, Artificial
  CRISPR gRNA sequence
aaggctggagtcaggactga

SEQ ID NO: 775958 - DNA, 20 bp, Artificial
  CRISPR gRNA sequence
gagtcaggactgagtaagag

SEQ ID NO: 775959 - DNA, 20 bp, Artificial
  CRISPR gRNA sequence
agtaagaggcaagtctgtgg

SEQ ID NO: 775960 - DNA, 20 bp, Artificial
  CRISPR gRNA sequence
tggctgcaggtcaggcctga

SEQ ID NO: 775961 - DNA, 20 bp, Artificial
  CRISPR gRNA sequence
caggtcaggcctgagctggg

SEQ ID NO: 775962 - DNA, 20 bp, Artificial
  CRISPR gRNA sequence
agctggggatgagaagggca

SEQ ID NO: 775963 - DNA, 20 bp, Artificial
  CRISPR gRNA sequence
gggatgagaagggcagacat

SEQ ID NO: 775964 - DNA, 20 bp, Artificial
  CRISPR gRNA sequence
aatccagccctgctcccaat

SEQ ID NO: 775965 - DNA, 20 bp, Artificial
  CRISPR gRNA sequence
ctcccaatcccagccaccct

SEQ ID NO: 775966 - DNA, 20 bp, Artificial
  CRISPR gRNA sequence
ccaatcccagccaccctcca

SEQ ID NO: 775967 - DNA, 20 bp, Artificial
  CRISPR gRNA sequence
caggctgcacacaccttgtc

SEQ ID NO: 775968 - DNA, 20 bp, Artificial
  CRISPR gRNA sequence
cacacaccttgtccctgagt

SEQ ID NO: 775969 - DNA, 20 bp, Artificial
  CRISPR gRNA sequence
gtccctgagtcccacagctg

SEQ ID NO: 775970 - DNA, 20 bp, Artificial
  CRISPR gRNA sequence
tccctgagtcccacagctgc

SEQ ID NO: 775971 - DNA, 20 bp, Artificial
  CRISPR gRNA sequence
agtcccacagctgctgccta

SEQ ID NO: 775972 - DNA, 20 bp, Artificial
  CRISPR gRNA sequence
ctgcctaaacatttgtgcca

SEQ ID NO: 775973 - DNA, 20 bp, Artificial
  CRISPR gRNA sequence
cctaaacatttgtgccatgt

SEQ ID NO: 775974 - DNA, 20 bp, Artificial
  CRISPR gRNA sequence
aacatttgtgccatgtcctg

SEQ ID NO: 775975 - DNA, 20 bp, Artificial
  CRISPR gRNA sequence
gtgccatgtcctgatcaagc

SEQ ID NO: 775976 - DNA, 20 bp, Artificial
  CRISPR gRNA sequence
tgccatgtcctgatcaagcc

SEQ ID NO: 775977 - DNA, 20 bp, Artificial
  CRISPR gRNA sequence
atcaagccacatctatgcca

SEQ ID NO: 775978 - DNA, 20 bp, Artificial
  CRISPR gRNA sequence
tgccaaccaacactgatcaa

SEQ ID NO: 775979 - DNA, 20 bp, Artificial
  CRISPR gRNA sequence
atcaacaagaatagaaatga

SEQ ID NO: 775980 - DNA, 20 bp, Artificial
  CRISPR gRNA sequence
cacgtcctcctaataccctg

SEQ ID NO: 775981 - DNA, 20 bp, Artificial
  CRISPR gRNA sequence
acgtcctcctaataccctgg

SEQ ID NO: 775982 - DNA, 20 bp, Artificial
  CRISPR gRNA sequence
ctaataccctgggagatagg

SEQ ID NO: 775983 - DNA, 20 bp, Artificial
  CRISPR gRNA sequence
ataccctgggagataggctg

SEQ ID NO: 775984 - DNA, 20 bp, Artificial
  CRISPR gRNA sequence
ggagataggctgtaacactt

SEQ ID NO: 775985 - DNA, 20 bp, Artificial
  CRISPR gRNA sequence
taacacttggtcctattttt

SEQ ID NO: 775986 - DNA, 20 bp, Artificial
  CRISPR gRNA sequence
ggtcctatttttgcaggact

SEQ ID NO: 775987 - DNA, 20 bp, Artificial
  CRISPR gRNA sequence
gtcctatttttgcaggactt

SEQ ID NO: 775988 - DNA, 20 bp, Artificial
  CRISPR gRNA sequence
tttttgcaggactttaaaaa

SEQ ID NO: 775989 - DNA, 20 bp, Artificial
  CRISPR gRNA sequence
ttgcaggactttaaaaaatt

SEQ ID NO: 775990 - DNA, 20 bp, Artificial
  CRISPR gRNA sequence
tgcaggactttaaaaaatta

SEQ ID NO: 775991 - DNA, 20 bp, Artificial
  CRISPR gRNA sequence
gcaggactttaaaaaattaa

SEQ ID NO: 775992 - DNA, 20 bp, Artificial
  CRISPR gRNA sequence
caggactttaaaaaattaaa

SEQ ID NO: 775993 - DNA, 20 bp, Artificial
  CRISPR gRNA sequence
taaaaaattaaagcccatgg

SEQ ID NO: 775994 - DNA, 20 bp, Artificial
  CRISPR gRNA sequence
aaaaaattaaagcccatggc

SEQ ID NO: 775995 - DNA, 20 bp, Artificial
  CRISPR gRNA sequence
aaaaattaaagcccatggct

SEQ ID NO: 775996 - DNA, 20 bp, Artificial
  CRISPR gRNA sequence
aagcccatggctgggtgtgg

SEQ ID NO: 775997 - DNA, 20 bp, Artificial
  CRISPR gRNA sequence
ggtgtggtggctcatgcctg

SEQ ID NO: 775998 - DNA, 20 bp, Artificial
  CRISPR gRNA sequence
atgcctgtaatcccagcact

SEQ ID NO: 775999 - DNA, 20 bp, Artificial
  CRISPR gRNA sequence
taatcccagcactttgggag

SEQ ID NO: 776000 - DNA, 20 bp, Artificial
  CRISPR gRNA sequence
tgggaggccgaggtgggtgg

SEQ ID NO: 776001 - DNA, 20 bp, Artificial
  CRISPR gRNA sequence
gggaggccgaggtgggtgga

SEQ ID NO: 776002 - DNA, 20 bp, Artificial
  CRISPR gRNA sequence
ggaggccgaggtgggtggat

SEQ ID NO: 776003 - DNA, 20 bp, Artificial
  CRISPR gRNA sequence
gagaccagcctgaccaacat

SEQ ID NO: 776004 - DNA, 20 bp, Artificial
  CRISPR gRNA sequence
agaccagcctgaccaacatg

SEQ ID NO: 776005 - DNA, 20 bp, Artificial
  CRISPR gRNA sequence
accaacatggtgaaaccctg

SEQ ID NO: 776006 - DNA, 20 bp, Artificial
  CRISPR gRNA sequence
tgtctactaaaaatataaac

SEQ ID NO: 776007 - DNA, 20 bp, Artificial
  CRISPR gRNA sequence
ctaaaaatataaacattagc

SEQ ID NO: 776008 - DNA, 20 bp, Artificial
  CRISPR gRNA sequence
aaaatataaacattagctgg

SEQ ID NO: 776009 - DNA, 20 bp, Artificial
  CRISPR gRNA sequence
gctgggcgtggtggctcagg

SEQ ID NO: 776010 - DNA, 20 bp, Artificial
  CRISPR gRNA sequence
ggcgtggtggctcaggcctg

SEQ ID NO: 776011 - DNA, 20 bp, Artificial
  CRISPR gRNA sequence
aggcctgtaataccagctac

SEQ ID NO: 776012 - DNA, 20 bp, Artificial
  CRISPR gRNA sequence
taataccagctactcaggag

SEQ ID NO: 776013 - DNA, 20 bp, Artificial
  CRISPR gRNA sequence
ctcaggaggctgaggcagga

SEQ ID NO: 776014 - DNA, 20 bp, Artificial
  CRISPR gRNA sequence
aggaggctgaggcaggagaa

SEQ ID NO: 776015 - DNA, 20 bp, Artificial
  CRISPR gRNA sequence
aggcaggagaattgcttgaa

SEQ ID NO: 776016 - DNA, 20 bp, Artificial
  CRISPR gRNA sequence
cttgaacccaggaggcggag

SEQ ID NO: 776017 - DNA, 20 bp, Artificial
  CRISPR gRNA sequence
gaacccaggaggcggaggtt

SEQ ID NO: 776018 - DNA, 20 bp, Artificial
  CRISPR gRNA sequence
aacccaggaggcggaggttg

SEQ ID NO: 776019 - DNA, 20 bp, Artificial
  CRISPR gRNA sequence
tagtgagtggaaatcgcgcc

SEQ ID NO: 776020 - DNA, 20 bp, Artificial
  CRISPR gRNA sequence
tactccagtctgggcgatac

SEQ ID NO: 776021 - DNA, 20 bp, Artificial
  CRISPR gRNA sequence
cagtctgggcgatactgcaa

SEQ ID NO: 776022 - DNA, 20 bp, Artificial
  CRISPR gRNA sequence
ggcgatactgcaagactctg

SEQ ID NO: 776023 - DNA, 20 bp, Artificial
  CRISPR gRNA sequence
caagactctgtctcaaaaaa

SEQ ID NO: 776024 - DNA, 20 bp, Artificial
  CRISPR gRNA sequence
tgtctcaaaaaaaaaaaaaa

SEQ ID NO: 776025 - DNA, 20 bp, Artificial
  CRISPR gRNA sequence
tctcaaaaaaaaaaaaaaaa

SEQ ID NO: 776026 - DNA, 20 bp, Artificial
  CRISPR gRNA sequence
aaaaaaaaaaaaaaaaaaat

SEQ ID NO: 776027 - DNA, 20 bp, Artificial
  CRISPR gRNA sequence
aagcccagataagtgacttt

SEQ ID NO: 776028 - DNA, 20 bp, Artificial
  CRISPR gRNA sequence
tgttaatgtcaagtaatttg

SEQ ID NO: 776029 - DNA, 20 bp, Artificial
  CRISPR gRNA sequence
gttaatgtcaagtaatttgc

SEQ ID NO: 776030 - DNA, 20 bp, Artificial
  CRISPR gRNA sequence
ttaatgtcaagtaatttgcc

SEQ ID NO: 776031 - DNA, 20 bp, Artificial
  CRISPR gRNA sequence
atgtcaagtaatttgccagt

SEQ ID NO: 776032 - DNA, 20 bp, Artificial
  CRISPR gRNA sequence
gccagtcagcacagccaaaa

SEQ ID NO: 776033 - DNA, 20 bp, Artificial
  CRISPR gRNA sequence
ccagtcagcacagccaaaaa

SEQ ID NO: 776034 - DNA, 20 bp, Artificial
  CRISPR gRNA sequence
tgctacacctttccaccctt

SEQ ID NO: 776035 - DNA, 20 bp, Artificial
  CRISPR gRNA sequence
ctacacctttccacccttcc

SEQ ID NO: 776036 - DNA, 20 bp, Artificial
  CRISPR gRNA sequence
cacctttccacccttccacg

SEQ ID NO: 776037 - DNA, 20 bp, Artificial
  CRISPR gRNA sequence
tccacccttccacggagcaa

SEQ ID NO: 776038 - DNA, 20 bp, Artificial
  CRISPR gRNA sequence
ccacccttccacggagcaaa

SEQ ID NO: 776039 - DNA, 20 bp, Artificial
  CRISPR gRNA sequence
cacccttccacggagcaaac

SEQ ID NO: 776040 - DNA, 20 bp, Artificial
  CRISPR gRNA sequence
ccacggagcaaacctcatca

SEQ ID NO: 776041 - DNA, 20 bp, Artificial
  CRISPR gRNA sequence
cacggagcaaacctcatcaa

SEQ ID NO: 776042 - DNA, 20 bp, Artificial
  CRISPR gRNA sequence
atcaacagctgctagcctca

SEQ ID NO: 776043 - DNA, 20 bp, Artificial
  CRISPR gRNA sequence
ctagcctcaattccattcca

SEQ ID NO: 776044 - DNA, 20 bp, Artificial
  CRISPR gRNA sequence
gcctcaattccattccaggc

SEQ ID NO: 776045 - DNA, 20 bp, Artificial
  CRISPR gRNA sequence
aattccattccaggcgccca

SEQ ID NO: 776046 - DNA, 20 bp, Artificial
  CRISPR gRNA sequence
cattccaggcgcccagcctc

SEQ ID NO: 776047 - DNA, 20 bp, Artificial
  CRISPR gRNA sequence
caggcgcccagcctcaatcc

SEQ ID NO: 776048 - DNA, 20 bp, Artificial
  CRISPR gRNA sequence
aatccttccaatcccagcca

SEQ ID NO: 776049 - DNA, 20 bp, Artificial
  CRISPR gRNA sequence
ccaatcccagccaggcacac

SEQ ID NO: 776050 - DNA, 20 bp, Artificial
  CRISPR gRNA sequence
caatcccagccaggcacacc

SEQ ID NO: 776051 - DNA, 20 bp, Artificial
  CRISPR gRNA sequence
cactcctacacacacacacc

SEQ ID NO: 776052 - DNA, 20 bp, Artificial
  CRISPR gRNA sequence
ctacacacacacacccccag

SEQ ID NO: 776053 - DNA, 20 bp, Artificial
  CRISPR gRNA sequence
cacacacacacccccagcag

SEQ ID NO: 776054 - DNA, 20 bp, Artificial
  CRISPR gRNA sequence
ggccaagggagtccctcagc

SEQ ID NO: 776055 - DNA, 20 bp, Artificial
  CRISPR gRNA sequence
agccaaaccatgtgcatcct

SEQ ID NO: 776056 - DNA, 20 bp, Artificial
  CRISPR gRNA sequence
gccagccccccttctctccc

SEQ ID NO: 776057 - DNA, 20 bp, Artificial
  CRISPR gRNA sequence
ctctcccagctgtctacagt

SEQ ID NO: 776058 - DNA, 20 bp, Artificial
  CRISPR gRNA sequence
tctcccagctgtctacagtg

SEQ ID NO: 776059 - DNA, 20 bp, Artificial
  CRISPR gRNA sequence
tcccagctgtctacagtggg

SEQ ID NO: 776060 - DNA, 20 bp, Artificial
  CRISPR gRNA sequence
ccagctgtctacagtgggga

SEQ ID NO: 776061 - DNA, 20 bp, Artificial
  CRISPR gRNA sequence
tctacagtggggaagccctg

SEQ ID NO: 776062 - DNA, 20 bp, Artificial
  CRISPR gRNA sequence
cagtggggaagccctgagca

SEQ ID NO: 776063 - DNA, 20 bp, Artificial
  CRISPR gRNA sequence
agcagccacttcctttccag

SEQ ID NO: 776064 - DNA, 20 bp, Artificial
  CRISPR gRNA sequence
cctttccagacgcttccggc

SEQ ID NO: 776065 - DNA, 20 bp, Artificial
  CRISPR gRNA sequence
ctttccagacgcttccggcc

SEQ ID NO: 776066 - DNA, 20 bp, Artificial
  CRISPR gRNA sequence
tccagacgcttccggcctca

SEQ ID NO: 776067 - DNA, 20 bp, Artificial
  CRISPR gRNA sequence
ccagacgcttccggcctcaa

SEQ ID NO: 776068 - DNA, 20 bp, Artificial
  CRISPR gRNA sequence
cagacgcttccggcctcaaa

SEQ ID NO: 776069 - DNA, 20 bp, Artificial
  CRISPR gRNA sequence
ccggcctcaaagccttactg

SEQ ID NO: 776070 - DNA, 20 bp, Artificial
  CRISPR gRNA sequence
cggcctcaaagccttactgc

SEQ ID NO: 776071 - DNA, 20 bp, Artificial
  CRISPR gRNA sequence
aaagccttactgcctgctga

SEQ ID NO: 776072 - DNA, 20 bp, Artificial
  CRISPR gRNA sequence
actgcctgctgagtcagcag

SEQ ID NO: 776073 - DNA, 20 bp, Artificial
  CRISPR gRNA sequence
ctgcctgctgagtcagcagc

SEQ ID NO: 776074 - DNA, 20 bp, Artificial
  CRISPR gRNA sequence
cctgctgagtcagcagcctt

SEQ ID NO: 776075 - DNA, 20 bp, Artificial
  CRISPR gRNA sequence
ctgagtcagcagccttcccc

SEQ ID NO: 776076 - DNA, 20 bp, Artificial
  CRISPR gRNA sequence
agtcagcagccttccccggc

SEQ ID NO: 776077 - DNA, 20 bp, Artificial
  CRISPR gRNA sequence
ccccggctccattcataaag

SEQ ID NO: 776078 - DNA, 20 bp, Artificial
  CRISPR gRNA sequence
cccggctccattcataaagc

SEQ ID NO: 776079 - DNA, 20 bp, Artificial
  CRISPR gRNA sequence
cattcataaagcacctttgg

SEQ ID NO: 776080 - DNA, 20 bp, Artificial
  CRISPR gRNA sequence
ataaagcacctttggcaggc

SEQ ID NO: 776081 - DNA, 20 bp, Artificial
  CRISPR gRNA sequence
tggcaggcaccacatcctgc

SEQ ID NO: 776082 - DNA, 20 bp, Artificial
  CRISPR gRNA sequence
ggcaggcaccacatcctgcc

SEQ ID NO: 776083 - DNA, 20 bp, Artificial
  CRISPR gRNA sequence
gcaggcaccacatcctgccc

SEQ ID NO: 776084 - DNA, 20 bp, Artificial
  CRISPR gRNA sequence
ccccacaagggccaccctga

SEQ ID NO: 776085 - DNA, 20 bp, Artificial
  CRISPR gRNA sequence
aggcccacaggaagatccag

SEQ ID NO: 776086 - DNA, 20 bp, Artificial
  CRISPR gRNA sequence
cctgcaggacctgcccaacc

SEQ ID NO: 776087 - DNA, 20 bp, Artificial
  CRISPR gRNA sequence
caggacctgcccaacccctg

SEQ ID NO: 776088 - DNA, 20 bp, Artificial
  CRISPR gRNA sequence
cccaacccctgcgggaagca

SEQ ID NO: 776089 - DNA, 20 bp, Artificial
  CRISPR gRNA sequence
cgggaagcaccagggctaag

SEQ ID NO: 776090 - DNA, 20 bp, Artificial
  CRISPR gRNA sequence
aggatgaacgaacgcccaga

SEQ ID NO: 776091 - DNA, 20 bp, Artificial
  CRISPR gRNA sequence
cacatctccctgcctctctt

SEQ ID NO: 776092 - DNA, 20 bp, Artificial
  CRISPR gRNA sequence
cctgcctctctttaacccca

SEQ ID NO: 776093 - DNA, 20 bp, Artificial
  CRISPR gRNA sequence
cctctctttaaccccagaca

SEQ ID NO: 776094 - DNA, 20 bp, Artificial
  CRISPR gRNA sequence
tctttaaccccagacagaac

SEQ ID NO: 776095 - DNA, 20 bp, Artificial
  CRISPR gRNA sequence
tttaaccccagacagaacca

SEQ ID NO: 776096 - DNA, 20 bp, Artificial
  CRISPR gRNA sequence
taaccccagacagaaccaag

SEQ ID NO: 776097 - DNA, 20 bp, Artificial
  CRISPR gRNA sequence
aaccccagacagaaccaagg

SEQ ID NO: 776098 - DNA, 20 bp, Artificial
  CRISPR gRNA sequence
accccagacagaaccaaggc

SEQ ID NO: 776099 - DNA, 20 bp, Artificial
  CRISPR gRNA sequence
tgggttcttcctgggccgcc

SEQ ID NO: 776100 - DNA, 20 bp, Artificial
  CRISPR gRNA sequence
ttcctgggccgcctccctca

SEQ ID NO: 776101 - DNA, 20 bp, Artificial
  CRISPR gRNA sequence
cctgggccgcctccctcact

SEQ ID NO: 776102 - DNA, 20 bp, Artificial
  CRISPR gRNA sequence
ctgggccgcctccctcactc

SEQ ID NO: 776103 - DNA, 20 bp, Artificial
  CRISPR gRNA sequence
ggccgcctccctcactctcc

SEQ ID NO: 776104 - DNA, 20 bp, Artificial
  CRISPR gRNA sequence
cctcactctccacactgctt

SEQ ID NO: 776105 - DNA, 20 bp, Artificial
  CRISPR gRNA sequence
actctccacactgcttctca

SEQ ID NO: 776106 - DNA, 20 bp, Artificial
  CRISPR gRNA sequence
tccacactgcttctcaagct

SEQ ID NO: 776107 - DNA, 20 bp, Artificial
  CRISPR gRNA sequence
cacactgcttctcaagcttc

SEQ ID NO: 776108 - DNA, 20 bp, Artificial
  CRISPR gRNA sequence
cttctcaagcttccatctcc

SEQ ID NO: 776109 - DNA, 20 bp, Artificial
  CRISPR gRNA sequence
ctcaagcttccatctcccac

SEQ ID NO: 776110 - DNA, 20 bp, Artificial
  CRISPR gRNA sequence
tcaagcttccatctcccacc

SEQ ID NO: 776111 - DNA, 20 bp, Artificial
  CRISPR gRNA sequence
aagcttccatctcccaccct

SEQ ID NO: 776112 - DNA, 20 bp, Artificial
  CRISPR gRNA sequence
ccatctcccaccctgaccca

SEQ ID NO: 776113 - DNA, 20 bp, Artificial
  CRISPR gRNA sequence
catctcccaccctgacccat

SEQ ID NO: 776114 - DNA, 20 bp, Artificial
  CRISPR gRNA sequence
ccaccctgacccatcacccc

SEQ ID NO: 776115 - DNA, 20 bp, Artificial
  CRISPR gRNA sequence
acccatcacccccctcactg

SEQ ID NO: 776116 - DNA, 20 bp, Artificial
  CRISPR gRNA sequence
actggccctgcttgctcctc

SEQ ID NO: 776117 - DNA, 20 bp, Artificial
  CRISPR gRNA sequence
gccctgcttgctcctctctt

SEQ ID NO: 776118 - DNA, 20 bp, Artificial
  CRISPR gRNA sequence
cttgctcctctctttccctg

SEQ ID NO: 776119 - DNA, 20 bp, Artificial
  CRISPR gRNA sequence
gctcctctctttccctgcca

SEQ ID NO: 776120 - DNA, 20 bp, Artificial
  CRISPR gRNA sequence
ctcctctctttccctgccag

SEQ ID NO: 776121 - DNA, 20 bp, Artificial
  CRISPR gRNA sequence
ctctctttccctgccagccc

SEQ ID NO: 776122 - DNA, 20 bp, Artificial
  CRISPR gRNA sequence
tctttccctgccagccccat

SEQ ID NO: 776123 - DNA, 20 bp, Artificial
  CRISPR gRNA sequence
tttccctgccagccccattc

SEQ ID NO: 776124 - DNA, 20 bp, Artificial
  CRISPR gRNA sequence
tccctgccagccccattctc

SEQ ID NO: 776125 - DNA, 20 bp, Artificial
  CRISPR gRNA sequence
ccctgccagccccattctct

SEQ ID NO: 776126 - DNA, 20 bp, Artificial
  CRISPR gRNA sequence
cctgccagccccattctcta

SEQ ID NO: 776127 - DNA, 20 bp, Artificial
  CRISPR gRNA sequence
ccagccccattctctaaggt

SEQ ID NO: 776128 - DNA, 20 bp, Artificial
  CRISPR gRNA sequence
tctaaggtgccttctcttag

SEQ ID NO: 776129 - DNA, 20 bp, Artificial
  CRISPR gRNA sequence
taaggtgccttctcttagga

SEQ ID NO: 776130 - DNA, 20 bp, Artificial
  CRISPR gRNA sequence
aggtgccttctcttaggacc

SEQ ID NO: 776131 - DNA, 20 bp, Artificial
  CRISPR gRNA sequence
ctcttaggacctaagacagg

SEQ ID NO: 776132 - DNA, 20 bp, Artificial
  CRISPR gRNA sequence
tcttaggacctaagacagga

SEQ ID NO: 776133 - DNA, 20 bp, Artificial
  CRISPR gRNA sequence
ttaggacctaagacaggaat

SEQ ID NO: 776134 - DNA, 20 bp, Artificial
  CRISPR gRNA sequence
aggacctaagacaggaatct

SEQ ID NO: 776135 - DNA, 20 bp, Artificial
  CRISPR gRNA sequence
ggacctaagacaggaatctg

SEQ ID NO: 776136 - DNA, 20 bp, Artificial
  CRISPR gRNA sequence
agacaggaatctgctcatgt

SEQ ID NO: 776137 - DNA, 20 bp, Artificial
  CRISPR gRNA sequence
ctcatgtccctcccctgctc

SEQ ID NO: 776138 - DNA, 20 bp, Artificial
  CRISPR gRNA sequence
atgtccctcccctgctcaag

SEQ ID NO: 776139 - DNA, 20 bp, Artificial
  CRISPR gRNA sequence
ccctgctcaagaacttccca

SEQ ID NO: 776140 - DNA, 20 bp, Artificial
  CRISPR gRNA sequence
ctcaagaacttcccatggct

SEQ ID NO: 776141 - DNA, 20 bp, Artificial
  CRISPR gRNA sequence
aagaacttcccatggctccc

SEQ ID NO: 776142 - DNA, 20 bp, Artificial
  CRISPR gRNA sequence
cccatggctccccattcact

SEQ ID NO: 776143 - DNA, 20 bp, Artificial
  CRISPR gRNA sequence
ccatggctccccattcacta

SEQ ID NO: 776144 - DNA, 20 bp, Artificial
  CRISPR gRNA sequence
cccattcactatagaagtca

SEQ ID NO: 776145 - DNA, 20 bp, Artificial
  CRISPR gRNA sequence
actatagaagtcagacccca

SEQ ID NO: 776146 - DNA, 20 bp, Artificial
  CRISPR gRNA sequence
tagaagtcagaccccattcc

SEQ ID NO: 776147 - DNA, 20 bp, Artificial
  CRISPR gRNA sequence
ctctgcctggtactcaagac

SEQ ID NO: 776148 - DNA, 20 bp, Artificial
  CRISPR gRNA sequence
tgcctggtactcaagactct

SEQ ID NO: 776149 - DNA, 20 bp, Artificial
  CRISPR gRNA sequence
cctggtactcaagactcttc

SEQ ID NO: 776150 - DNA, 20 bp, Artificial
  CRISPR gRNA sequence
gtactcaagactcttcatat

SEQ ID NO: 776151 - DNA, 20 bp, Artificial
  CRISPR gRNA sequence
aagactcttcatataattgt

SEQ ID NO: 776152 - DNA, 20 bp, Artificial
  CRISPR gRNA sequence
ttcatataattgtctccttc

SEQ ID NO: 776153 - DNA, 20 bp, Artificial
  CRISPR gRNA sequence
catataattgtctccttcat

SEQ ID NO: 776154 - DNA, 20 bp, Artificial
  CRISPR gRNA sequence
atataattgtctccttcata

SEQ ID NO: 776155 - DNA, 20 bp, Artificial
  CRISPR gRNA sequence
tctccttcatatatcaggct

SEQ ID NO: 776156 - DNA, 20 bp, Artificial
  CRISPR gRNA sequence
cttcatatatcaggctaatt

SEQ ID NO: 776157 - DNA, 20 bp, Artificial
  CRISPR gRNA sequence
catatatcaggctaattcct

SEQ ID NO: 776158 - DNA, 20 bp, Artificial
  CRISPR gRNA sequence
atatatcaggctaattcctg

SEQ ID NO: 776159 - DNA, 20 bp, Artificial
  CRISPR gRNA sequence
attcctgccactctgggcag

SEQ ID NO: 776160 - DNA, 20 bp, Artificial
  CRISPR gRNA sequence
ctgccactctgggcaggtac

SEQ ID NO: 776161 - DNA, 20 bp, Artificial
  CRISPR gRNA sequence
ccactctgggcaggtacagg

SEQ ID NO: 776162 - DNA, 20 bp, Artificial
  CRISPR gRNA sequence
tgggcaggtacagggagcag

SEQ ID NO: 776163 - DNA, 20 bp, Artificial
  CRISPR gRNA sequence
ggcaggtacagggagcagag

SEQ ID NO: 776164 - DNA, 20 bp, Artificial
  CRISPR gRNA sequence
ccctgatcagacctacccag

SEQ ID NO: 776165 - DNA, 20 bp, Artificial
  CRISPR gRNA sequence
atcagacctacccaggctct

SEQ ID NO: 776166 - DNA, 20 bp, Artificial
  CRISPR gRNA sequence
cccaggctctcccagggccg

SEQ ID NO: 776167 - DNA, 20 bp, Artificial
  CRISPR gRNA sequence
tcccagggccgagctgcgct

SEQ ID NO: 776168 - DNA, 20 bp, Artificial
  CRISPR gRNA sequence
ccagggccgagctgcgcttc

SEQ ID NO: 776169 - DNA, 20 bp, Artificial
  CRISPR gRNA sequence
cgcttccctccagagggaag

SEQ ID NO: 776170 - DNA, 20 bp, Artificial
  CRISPR gRNA sequence
ccctccagagggaagatgag

SEQ ID NO: 776171 - DNA, 20 bp, Artificial
  CRISPR gRNA sequence
cctccagagggaagatgagg

SEQ ID NO: 776172 - DNA, 20 bp, Artificial
  CRISPR gRNA sequence
cagagggaagatgagggact

SEQ ID NO: 776173 - DNA, 20 bp, Artificial
  CRISPR gRNA sequence
ccagggctgcgccctggact

SEQ ID NO: 776174 - DNA, 20 bp, Artificial
  CRISPR gRNA sequence
cagggctgcgccctggactt

SEQ ID NO: 776175 - DNA, 20 bp, Artificial
  CRISPR gRNA sequence
cgccctggacttgctccctt

SEQ ID NO: 776176 - DNA, 20 bp, Artificial
  CRISPR gRNA sequence
gacttgctccctttcattcc

SEQ ID NO: 776177 - DNA, 20 bp, Artificial
  CRISPR gRNA sequence
gctccctttcattcctttcc

SEQ ID NO: 776178 - DNA, 20 bp, Artificial
  CRISPR gRNA sequence
ctccctttcattcctttcct

SEQ ID NO: 776179 - DNA, 20 bp, Artificial
  CRISPR gRNA sequence
cctttcattcctttcctaga

SEQ ID NO: 776180 - DNA, 20 bp, Artificial
  CRISPR gRNA sequence
tcattcctttcctagactct

SEQ ID NO: 776181 - DNA, 20 bp, Artificial
  CRISPR gRNA sequence
cattcctttcctagactctg

SEQ ID NO: 776182 - DNA, 20 bp, Artificial
  CRISPR gRNA sequence
attcctttcctagactctgg

SEQ ID NO: 776183 - DNA, 20 bp, Artificial
  CRISPR gRNA sequence
ctttcctagactctggatcc

SEQ ID NO: 776184 - DNA, 20 bp, Artificial
  CRISPR gRNA sequence
tcctagactctggatcctgg

SEQ ID NO: 776185 - DNA, 20 bp, Artificial
  CRISPR gRNA sequence
cctagactctggatcctgga

SEQ ID NO: 776186 - DNA, 20 bp, Artificial
  CRISPR gRNA sequence
ctagactctggatcctggaa

SEQ ID NO: 776187 - DNA, 20 bp, Artificial
  CRISPR gRNA sequence
gactctggatcctggaaacc

SEQ ID NO: 776188 - DNA, 20 bp, Artificial
  CRISPR gRNA sequence
tggatcctggaaacctgccc

SEQ ID NO: 776189 - DNA, 20 bp, Artificial
  CRISPR gRNA sequence
gatcctggaaacctgccctg

SEQ ID NO: 776190 - DNA, 20 bp, Artificial
  CRISPR gRNA sequence
gaaacctgccctggagagaa

SEQ ID NO: 776191 - DNA, 20 bp, Artificial
  CRISPR gRNA sequence
ccctggagagaagcagtttg

SEQ ID NO: 776192 - DNA, 20 bp, Artificial
  CRISPR gRNA sequence
gagagaagcagtttgacagc

SEQ ID NO: 776193 - DNA, 20 bp, Artificial
  CRISPR gRNA sequence
gacagcccagaagcaaagag

SEQ ID NO: 776194 - DNA, 20 bp, Artificial
  CRISPR gRNA sequence
acagcccagaagcaaagaga

SEQ ID NO: 776195 - DNA, 20 bp, Artificial
  CRISPR gRNA sequence
cgctgacagctgggcctgga

SEQ ID NO: 776196 - DNA, 20 bp, Artificial
  CRISPR gRNA sequence
acagctgggcctggaggagc

SEQ ID NO: 776197 - DNA, 20 bp, Artificial
  CRISPR gRNA sequence
ggcctggaggagctgaggac

SEQ ID NO: 776198 - DNA, 20 bp, Artificial
  CRISPR gRNA sequence
gaggagctgaggacaggaga

SEQ ID NO: 776199 - DNA, 20 bp, Artificial
  CRISPR gRNA sequence
aggacaggagaaagagacag

SEQ ID NO: 776200 - DNA, 20 bp, Artificial
  CRISPR gRNA sequence
agaaaggaagtgctccctgg

SEQ ID NO: 776201 - DNA, 20 bp, Artificial
  CRISPR gRNA sequence
cctggagaatgggagagtgt

SEQ ID NO: 776202 - DNA, 20 bp, Artificial
  CRISPR gRNA sequence
gagaatgggagagtgtcctg

SEQ ID NO: 776203 - DNA, 20 bp, Artificial
  CRISPR gRNA sequence
tgaacacagagctggtcggc

SEQ ID NO: 776204 - DNA, 20 bp, Artificial
  CRISPR gRNA sequence
gtcggcccgggacccagagc

SEQ ID NO: 776205 - DNA, 20 bp, Artificial
  CRISPR gRNA sequence
atgctgcctgcgtaccaccc

SEQ ID NO: 776206 - DNA, 20 bp, Artificial
  CRISPR gRNA sequence
cctgcgtaccaccccctcca

SEQ ID NO: 776207 - DNA, 20 bp, Artificial
  CRISPR gRNA sequence
cgtaccaccccctccaccca

SEQ ID NO: 776208 - DNA, 20 bp, Artificial
  CRISPR gRNA sequence
cacccatgttttccacaaag

SEQ ID NO: 776209 - DNA, 20 bp, Artificial
  CRISPR gRNA sequence
tccacaaaggggaatctcat

SEQ ID NO: 776210 - DNA, 20 bp, Artificial
  CRISPR gRNA sequence
ccacaaaggggaatctcatc

SEQ ID NO: 776211 - DNA, 20 bp, Artificial
  CRISPR gRNA sequence
cacaaaggggaatctcatcc

SEQ ID NO: 776212 - DNA, 20 bp, Artificial
  CRISPR gRNA sequence
atccccagccgggacctgcc

SEQ ID NO: 776213 - DNA, 20 bp, Artificial
  CRISPR gRNA sequence
ccctggagtcagcatgtgcc

SEQ ID NO: 776214 - DNA, 20 bp, Artificial
  CRISPR gRNA sequence
gagtcagcatgtgccacccg

SEQ ID NO: 776215 - DNA, 20 bp, Artificial
  CRISPR gRNA sequence
ccagtgcccactcctcgtcc

SEQ ID NO: 776216 - DNA, 20 bp, Artificial
  CRISPR gRNA sequence
ctcgtccttctccttcctgc

SEQ ID NO: 776217 - DNA, 20 bp, Artificial
  CRISPR gRNA sequence
gtccttctccttcctgctct

SEQ ID NO: 776218 - DNA, 20 bp, Artificial
  CRISPR gRNA sequence
ctccttcctgctctatccca

SEQ ID NO: 776219 - DNA, 20 bp, Artificial
  CRISPR gRNA sequence
tccttcctgctctatcccaa

SEQ ID NO: 776220 - DNA, 20 bp, Artificial
  CRISPR gRNA sequence
cttcctgctctatcccaaaa

SEQ ID NO: 776221 - DNA, 20 bp, Artificial
  CRISPR gRNA sequence
cctgctctatcccaaaacca

SEQ ID NO: 776222 - DNA, 20 bp, Artificial
  CRISPR gRNA sequence
ctgctctatcccaaaaccac

SEQ ID NO: 776223 - DNA, 20 bp, Artificial
  CRISPR gRNA sequence
ctctatcccaaaaccacaga

SEQ ID NO: 776224 - DNA, 20 bp, Artificial
  CRISPR gRNA sequence
tatcccaaaaccacagagca

SEQ ID NO: 776225 - DNA, 20 bp, Artificial
  CRISPR gRNA sequence
tcccaaaaccacagagcacc

SEQ ID NO: 776226 - DNA, 20 bp, Artificial
  CRISPR gRNA sequence
cggctttcacagagcagcag

SEQ ID NO: 776227 - DNA, 20 bp, Artificial
  CRISPR gRNA sequence
ggctttcacagagcagcagg

SEQ ID NO: 776228 - DNA, 20 bp, Artificial
  CRISPR gRNA sequence
tcacagagcagcaggagaga

SEQ ID NO: 776229 - DNA, 20 bp, Artificial
  CRISPR gRNA sequence
cacagagcagcaggagagag

SEQ ID NO: 776230 - DNA, 20 bp, Artificial
  CRISPR gRNA sequence
acagagcagcaggagagagg

SEQ ID NO: 776231 - DNA, 20 bp, Artificial
  CRISPR gRNA sequence
tcctcagcctaaggtacagc

SEQ ID NO: 776232 - DNA, 20 bp, Artificial
  CRISPR gRNA sequence
agcctaaggtacagcaaggg

SEQ ID NO: 776233 - DNA, 20 bp, Artificial
  CRISPR gRNA sequence
aggtacagcaagggcatcca

SEQ ID NO: 776234 - DNA, 20 bp, Artificial
  CRISPR gRNA sequence
cagaagcagggccacaggga

SEQ ID NO: 776235 - DNA, 20 bp, Artificial
  CRISPR gRNA sequence
ccaagagatgacccaagatg

SEQ ID NO: 776236 - DNA, 20 bp, Artificial
  CRISPR gRNA sequence
agaaagctacaacaaatcca

SEQ ID NO: 776237 - DNA, 20 bp, Artificial
  CRISPR gRNA sequence
caacaaatccagactgcacc

SEQ ID NO: 776238 - DNA, 20 bp, Artificial
  CRISPR gRNA sequence
cacctgggctcagggccaaa

SEQ ID NO: 776239 - DNA, 20 bp, Artificial
  CRISPR gRNA sequence
ggctcagggccaaaatgccc

SEQ ID NO: 776240 - DNA, 20 bp, Artificial
  CRISPR gRNA sequence
agggccaaaatgccctgggc

SEQ ID NO: 776241 - DNA, 20 bp, Artificial
  CRISPR gRNA sequence
ggcctggggatgcccaagag

SEQ ID NO: 776242 - DNA, 20 bp, Artificial
  CRISPR gRNA sequence
gggatgcccaagagggtctc

SEQ ID NO: 776243 - DNA, 20 bp, Artificial
  CRISPR gRNA sequence
cttgccccccaccataatca

SEQ ID NO: 776244 - DNA, 20 bp, Artificial
  CRISPR gRNA sequence
gccccccaccataatcaccc

SEQ ID NO: 776245 - DNA, 20 bp, Artificial
  CRISPR gRNA sequence
ccccccaccataatcaccca

SEQ ID NO: 776246 - DNA, 20 bp, Artificial
  CRISPR gRNA sequence
cacttcctcctaacccccta

SEQ ID NO: 776247 - DNA, 20 bp, Artificial
  CRISPR gRNA sequence
cctcctaaccccctacttcc

SEQ ID NO: 776248 - DNA, 20 bp, Artificial
  CRISPR gRNA sequence
ctcctaaccccctacttcct

SEQ ID NO: 776249 - DNA, 20 bp, Artificial
  CRISPR gRNA sequence
ctaaccccctacttcctccc

SEQ ID NO: 776250 - DNA, 20 bp, Artificial
  CRISPR gRNA sequence
accccctacttcctcccaat

SEQ ID NO: 776251 - DNA, 20 bp, Artificial
  CRISPR gRNA sequence
cttcctcccaatccccgcag

SEQ ID NO: 776252 - DNA, 20 bp, Artificial
  CRISPR gRNA sequence
cctcccaatccccgcagggg

SEQ ID NO: 776253 - DNA, 20 bp, Artificial
  CRISPR gRNA sequence
ctcccaatccccgcaggggc

SEQ ID NO: 776254 - DNA, 20 bp, Artificial
  CRISPR gRNA sequence
ccaatccccgcaggggctcc

SEQ ID NO: 776255 - DNA, 20 bp, Artificial
  CRISPR gRNA sequence
cttgggcaacacttcccaca

SEQ ID NO: 776256 - DNA, 20 bp, Artificial
  CRISPR gRNA sequence
gggcaacacttcccacaaag

SEQ ID NO: 776257 - DNA, 20 bp, Artificial
  CRISPR gRNA sequence
ggcaacacttcccacaaagg

SEQ ID NO: 776258 - DNA, 20 bp, Artificial
  CRISPR gRNA sequence
cccacaaagggacaaaaagg

SEQ ID NO: 776259 - DNA, 20 bp, Artificial
  CRISPR gRNA sequence
ccacaaagggacaaaaaggg

SEQ ID NO: 776260 - DNA, 20 bp, Artificial
  CRISPR gRNA sequence
tgaaaatgtcagacaagtcc

SEQ ID NO: 776261 - DNA, 20 bp, Artificial
  CRISPR gRNA sequence
aaaatgtcagacaagtccct

SEQ ID NO: 776262 - DNA, 20 bp, Artificial
  CRISPR gRNA sequence
gatccagctatgcctgaagc

SEQ ID NO: 776263 - DNA, 20 bp, Artificial
  CRISPR gRNA sequence
tgcctgaagcaagctgcaga

SEQ ID NO: 776264 - DNA, 20 bp, Artificial
  CRISPR gRNA sequence
aagcaagctgcagacctaga

SEQ ID NO: 776265 - DNA, 20 bp, Artificial
  CRISPR gRNA sequence
cagacctagaccgcccagat

SEQ ID NO: 776266 - DNA, 20 bp, Artificial
  CRISPR gRNA sequence
gaccgcccagatatttgagc

SEQ ID NO: 776267 - DNA, 20 bp, Artificial
  CRISPR gRNA sequence
gagccaatcattttttttcc

SEQ ID NO: 776268 - DNA, 20 bp, Artificial
  CRISPR gRNA sequence
agccaatcattttttttccc

SEQ ID NO: 776269 - DNA, 20 bp, Artificial
  CRISPR gRNA sequence
tttttcccttaaaccagttt

SEQ ID NO: 776270 - DNA, 20 bp, Artificial
  CRISPR gRNA sequence
ttttcccttaaaccagtttg

SEQ ID NO: 776271 - DNA, 20 bp, Artificial
  CRISPR gRNA sequence
tttcccttaaaccagtttga

SEQ ID NO: 776272 - DNA, 20 bp, Artificial
  CRISPR gRNA sequence
ttcccttaaaccagtttgaa

SEQ ID NO: 776273 - DNA, 20 bp, Artificial
  CRISPR gRNA sequence
tcccttaaaccagtttgaac

SEQ ID NO: 776274 - DNA, 20 bp, Artificial
  CRISPR gRNA sequence
cccttaaaccagtttgaact

SEQ ID NO: 776275 - DNA, 20 bp, Artificial
  CRISPR gRNA sequence
ccttaaaccagtttgaacta

SEQ ID NO: 776276 - DNA, 20 bp, Artificial
  CRISPR gRNA sequence
aaaccagtttgaactaagtt

SEQ ID NO: 776277 - DNA, 20 bp, Artificial
  CRISPR gRNA sequence
aaccagtttgaactaagttt

SEQ ID NO: 776278 - DNA, 20 bp, Artificial
  CRISPR gRNA sequence
gaactaagtttctattgtct

SEQ ID NO: 776279 - DNA, 20 bp, Artificial
  CRISPR gRNA sequence
aactaagtttctattgtctg

SEQ ID NO: 776280 - DNA, 20 bp, Artificial
  CRISPR gRNA sequence
agtttctattgtctgcaacc

SEQ ID NO: 776281 - DNA, 20 bp, Artificial
  CRISPR gRNA sequence
ctattgtctgcaaccgaagg

SEQ ID NO: 776282 - DNA, 20 bp, Artificial
  CRISPR gRNA sequence
tattgtctgcaaccgaagga

SEQ ID NO: 776283 - DNA, 20 bp, Artificial
  CRISPR gRNA sequence
ttgtctgcaaccgaaggagt

SEQ ID NO: 776284 - DNA, 20 bp, Artificial
  CRISPR gRNA sequence
tctgcaaccgaaggagtcct

SEQ ID NO: 776285 - DNA, 20 bp, Artificial
  CRISPR gRNA sequence
caaccgaaggagtccttgaa

SEQ ID NO: 776286 - DNA, 20 bp, Artificial
  CRISPR gRNA sequence
gaatccacatgcattcatgt

SEQ ID NO: 776287 - DNA, 20 bp, Artificial
  CRISPR gRNA sequence
aatccacatgcattcatgtc

SEQ ID NO: 776288 - DNA, 20 bp, Artificial
  CRISPR gRNA sequence
atgtctttagtaattcattt

SEQ ID NO: 776289 - DNA, 20 bp, Artificial
  CRISPR gRNA sequence
tagtaattcatttcactact

SEQ ID NO: 776290 - DNA, 20 bp, Artificial
  CRISPR gRNA sequence
agtaattcatttcactactt

SEQ ID NO: 776291 - DNA, 20 bp, Artificial
  CRISPR gRNA sequence
gtaattcatttcactactta

SEQ ID NO: 776292 - DNA, 20 bp, Artificial
  CRISPR gRNA sequence
atttcactacttacggagtt

SEQ ID NO: 776293 - DNA, 20 bp, Artificial
  CRISPR gRNA sequence
cactacttacggagttcctg

SEQ ID NO: 776294 - DNA, 20 bp, Artificial
  CRISPR gRNA sequence
actacttacggagttcctgg

SEQ ID NO: 776295 - DNA, 20 bp, Artificial
  CRISPR gRNA sequence
cttacggagttcctggtagg

SEQ ID NO: 776296 - DNA, 20 bp, Artificial
  CRISPR gRNA sequence
acggagttcctggtagggac

SEQ ID NO: 776297 - DNA, 20 bp, Artificial
  CRISPR gRNA sequence
cggagttcctggtagggacg

SEQ ID NO: 776298 - DNA, 20 bp, Artificial
  CRISPR gRNA sequence
ctggtagggacgtactaggg

SEQ ID NO: 776299 - DNA, 20 bp, Artificial
  CRISPR gRNA sequence
gtagggacgtactaggggca

SEQ ID NO: 776300 - DNA, 20 bp, Artificial
  CRISPR gRNA sequence
ggggcagagagataactaag

SEQ ID NO: 776301 - DNA, 20 bp, Artificial
  CRISPR gRNA sequence
aggtacacgtctgtcctcaa

SEQ ID NO: 776302 - DNA, 20 bp, Artificial
  CRISPR gRNA sequence
tcctcaaggagcagattcta

SEQ ID NO: 776303 - DNA, 20 bp, Artificial
  CRISPR gRNA sequence
aaggagcagattctaatagg

SEQ ID NO: 776304 - DNA, 20 bp, Artificial
  CRISPR gRNA sequence
taatagggaagggggacatg

SEQ ID NO: 776305 - DNA, 20 bp, Artificial
  CRISPR gRNA sequence
atagggaagggggacatgca

SEQ ID NO: 776306 - DNA, 20 bp, Artificial
  CRISPR gRNA sequence
gatcactgcagtttggtata

SEQ ID NO: 776307 - DNA, 20 bp, Artificial
  CRISPR gRNA sequence
cagtttggtatagtatacta

SEQ ID NO: 776308 - DNA, 20 bp, Artificial
  CRISPR gRNA sequence
ggtatagtatactatttatg

SEQ ID NO: 776309 - DNA, 20 bp, Artificial
  CRISPR gRNA sequence
gtatagtatactatttatga

SEQ ID NO: 776310 - DNA, 20 bp, Artificial
  CRISPR gRNA sequence
tttatgatatggtcagggcg

SEQ ID NO: 776311 - DNA, 20 bp, Artificial
  CRISPR gRNA sequence
atgatatggtcagggcgaat

SEQ ID NO: 776312 - DNA, 20 bp, Artificial
  CRISPR gRNA sequence
tgatatggtcagggcgaatt

SEQ ID NO: 776313 - DNA, 20 bp, Artificial
  CRISPR gRNA sequence
gaggcacctcagaggcatga

SEQ ID NO: 776314 - DNA, 20 bp, Artificial
  CRISPR gRNA sequence
agaggcatgataaccccaga

SEQ ID NO: 776315 - DNA, 20 bp, Artificial
  CRISPR gRNA sequence
aaaagtcatgagcagctccc

SEQ ID NO: 776316 - DNA, 20 bp, Artificial
  CRISPR gRNA sequence
cccaggtagccgcgctggga

SEQ ID NO: 776317 - DNA, 20 bp, Artificial
  CRISPR gRNA sequence
ggaaaggtaaccctttcctg

SEQ ID NO: 776318 - DNA, 20 bp, Artificial
  CRISPR gRNA sequence
tcctgaactccagagacccg

SEQ ID NO: 776319 - DNA, 20 bp, Artificial
  CRISPR gRNA sequence
cctgaactccagagacccgt

SEQ ID NO: 776320 - DNA, 20 bp, Artificial
  CRISPR gRNA sequence
ctgaactccagagacccgtc

SEQ ID NO: 776321 - DNA, 20 bp, Artificial
  CRISPR gRNA sequence
aactccagagacccgtcctc

SEQ ID NO: 776322 - DNA, 20 bp, Artificial
  CRISPR gRNA sequence
cagagacccgtcctcctgac

SEQ ID NO: 776323 - DNA, 20 bp, Artificial
  CRISPR gRNA sequence
ctgacactgcctgtctgccc

SEQ ID NO: 776324 - DNA, 20 bp, Artificial
  CRISPR gRNA sequence
acactgcctgtctgcccctc

SEQ ID NO: 776325 - DNA, 20 bp, Artificial
  CRISPR gRNA sequence
cctgtctgcccctcagccag

SEQ ID NO: 776326 - DNA, 20 bp, Artificial
  CRISPR gRNA sequence
tctgcccctcagccagatca

SEQ ID NO: 776327 - DNA, 20 bp, Artificial
  CRISPR gRNA sequence
cccctcagccagatcaccct

SEQ ID NO: 776328 - DNA, 20 bp, Artificial
  CRISPR gRNA sequence
agccagatcaccctggaatt

SEQ ID NO: 776329 - DNA, 20 bp, Artificial
  CRISPR gRNA sequence
gaattctagaaaatgagccc

SEQ ID NO: 776330 - DNA, 20 bp, Artificial
  CRISPR gRNA sequence
tagaaaatgagcccaaagtg

SEQ ID NO: 776331 - DNA, 20 bp, Artificial
  CRISPR gRNA sequence
gaaaatgagcccaaagtgtg

SEQ ID NO: 776332 - DNA, 20 bp, Artificial
  CRISPR gRNA sequence
tggtcccagctctgacactt

SEQ ID NO: 776333 - DNA, 20 bp, Artificial
  CRISPR gRNA sequence
gtcccagctctgacactttg

SEQ ID NO: 776334 - DNA, 20 bp, Artificial
  CRISPR gRNA sequence
tgacactttgttatgcaatc

SEQ ID NO: 776335 - DNA, 20 bp, Artificial
  CRISPR gRNA sequence
acactttgttatgcaatctt

SEQ ID NO: 776336 - DNA, 20 bp, Artificial
  CRISPR gRNA sequence
tgttatgcaatcttaactag

SEQ ID NO: 776337 - DNA, 20 bp, Artificial
  CRISPR gRNA sequence
gttatgcaatcttaactagg

SEQ ID NO: 776338 - DNA, 20 bp, Artificial
  CRISPR gRNA sequence
ttatgcaatcttaactaggc

SEQ ID NO: 776339 - DNA, 20 bp, Artificial
  CRISPR gRNA sequence
tgcaatcttaactaggcaac

SEQ ID NO: 776340 - DNA, 20 bp, Artificial
  CRISPR gRNA sequence
aactaggcaacttctctgag

SEQ ID NO: 776341 - DNA, 20 bp, Artificial
  CRISPR gRNA sequence
actaggcaacttctctgagc

SEQ ID NO: 776342 - DNA, 20 bp, Artificial
  CRISPR gRNA sequence
ggcaacttctctgagctcag

SEQ ID NO: 776343 - DNA, 20 bp, Artificial
  CRISPR gRNA sequence
ctctgagctcagtgttccta

SEQ ID NO: 776344 - DNA, 20 bp, Artificial
  CRISPR gRNA sequence
tctgagctcagtgttcctac

SEQ ID NO: 776345 - DNA, 20 bp, Artificial
  CRISPR gRNA sequence
tgagctcagtgttcctacct

SEQ ID NO: 776346 - DNA, 20 bp, Artificial
  CRISPR gRNA sequence
agctcagtgttcctacctat

SEQ ID NO: 776347 - DNA, 20 bp, Artificial
  CRISPR gRNA sequence
agtgttcctacctataaaag

SEQ ID NO: 776348 - DNA, 20 bp, Artificial
  CRISPR gRNA sequence
ctacctataaaagaaaagct

SEQ ID NO: 776349 - DNA, 20 bp, Artificial
  CRISPR gRNA sequence
cctataaaagaaaagctttg

SEQ ID NO: 776350 - DNA, 20 bp, Artificial
  CRISPR gRNA sequence
taaaagaaaagctttgtgga

SEQ ID NO: 776351 - DNA, 20 bp, Artificial
  CRISPR gRNA sequence
tgtggatgctagtggaactt

SEQ ID NO: 776352 - DNA, 20 bp, Artificial
  CRISPR gRNA sequence
gtggatgctagtggaacttt

SEQ ID NO: 776353 - DNA, 20 bp, Artificial
  CRISPR gRNA sequence
tggatgctagtggaacttta

SEQ ID NO: 776354 - DNA, 20 bp, Artificial
  CRISPR gRNA sequence
gtggaactttatcagtactt

SEQ ID NO: 776355 - DNA, 20 bp, Artificial
  CRISPR gRNA sequence
tatcagtacttgaagctttc

SEQ ID NO: 776356 - DNA, 20 bp, Artificial
  CRISPR gRNA sequence
atcagtacttgaagctttca

SEQ ID NO: 776357 - DNA, 20 bp, Artificial
  CRISPR gRNA sequence
tcagtacttgaagctttcag

SEQ ID NO: 776358 - DNA, 20 bp, Artificial
  CRISPR gRNA sequence
gaagctttcagggactatat

SEQ ID NO: 776359 - DNA, 20 bp, Artificial
  CRISPR gRNA sequence
aagctttcagggactatatc

SEQ ID NO: 776360 - DNA, 20 bp, Artificial
  CRISPR gRNA sequence
tcagggactatatccttaag

SEQ ID NO: 776361 - DNA, 20 bp, Artificial
  CRISPR gRNA sequence
cagggactatatccttaagg

SEQ ID NO: 776362 - DNA, 20 bp, Artificial
  CRISPR gRNA sequence
agggactatatccttaaggc

SEQ ID NO: 776363 - DNA, 20 bp, Artificial
  CRISPR gRNA sequence
tatccttaaggcttaaccag

SEQ ID NO: 776364 - DNA, 20 bp, Artificial
  CRISPR gRNA sequence
aaggcttaaccagttcacag

SEQ ID NO: 776365 - DNA, 20 bp, Artificial
  CRISPR gRNA sequence
aggcttaaccagttcacagc

SEQ ID NO: 776366 - DNA, 20 bp, Artificial
  CRISPR gRNA sequence
aaccagttcacagccacaca

SEQ ID NO: 776367 - DNA, 20 bp, Artificial
  CRISPR gRNA sequence
accagttcacagccacacag

SEQ ID NO: 776368 - DNA, 20 bp, Artificial
  CRISPR gRNA sequence
acagccacacagttcccact

SEQ ID NO: 776369 - DNA, 20 bp, Artificial
  CRISPR gRNA sequence
ccactgaaatgcacaaagtg

SEQ ID NO: 776370 - DNA, 20 bp, Artificial
  CRISPR gRNA sequence
aaatgcacaaagtgactgtg

SEQ ID NO: 776371 - DNA, 20 bp, Artificial
  CRISPR gRNA sequence
tggcagaaactgctagttgt

SEQ ID NO: 776372 - DNA, 20 bp, Artificial
  CRISPR gRNA sequence
ctagttgttgtccacttaca

SEQ ID NO: 776373 - DNA, 20 bp, Artificial
  CRISPR gRNA sequence
gttgttgtccacttacaccc

SEQ ID NO: 776374 - DNA, 20 bp, Artificial
  CRISPR gRNA sequence
ttgtccacttacacccattt

SEQ ID NO: 776375 - DNA, 20 bp, Artificial
  CRISPR gRNA sequence
tccacttacacccattttct

SEQ ID NO: 776376 - DNA, 20 bp, Artificial
  CRISPR gRNA sequence
acacccattttctccctttt

SEQ ID NO: 776377 - DNA, 20 bp, Artificial
  CRISPR gRNA sequence
cacccattttctcccttttt

SEQ ID NO: 776378 - DNA, 20 bp, Artificial
  CRISPR gRNA sequence
tctccctttttaagagacag

SEQ ID NO: 776379 - DNA, 20 bp, Artificial
  CRISPR gRNA sequence
ctccctttttaagagacagg

SEQ ID NO: 776380 - DNA, 20 bp, Artificial
  CRISPR gRNA sequence
tccctttttaagagacaggg

SEQ ID NO: 776381 - DNA, 20 bp, Artificial
  CRISPR gRNA sequence
cctttttaagagacagggtc

SEQ ID NO: 776382 - DNA, 20 bp, Artificial
  CRISPR gRNA sequence
tttaagagacagggtcccgc

SEQ ID NO: 776383 - DNA, 20 bp, Artificial
  CRISPR gRNA sequence
ttaagagacagggtcccgct

SEQ ID NO: 776384 - DNA, 20 bp, Artificial
  CRISPR gRNA sequence
taagagacagggtcccgctc

SEQ ID NO: 776385 - DNA, 20 bp, Artificial
  CRISPR gRNA sequence
aagagacagggtcccgctct

SEQ ID NO: 776386 - DNA, 20 bp, Artificial
  CRISPR gRNA sequence
agagacagggtcccgctctg

SEQ ID NO: 776387 - DNA, 20 bp, Artificial
  CRISPR gRNA sequence
tgtcacccaggctggagtgg

SEQ ID NO: 776388 - DNA, 20 bp, Artificial
  CRISPR gRNA sequence
tcacccaggctggagtggta

SEQ ID NO: 776389 - DNA, 20 bp, Artificial
  CRISPR gRNA sequence
gagtggtaccatcatagttc

SEQ ID NO: 776390 - DNA, 20 bp, Artificial
  CRISPR gRNA sequence
agtggtgcaatcagaaccca

SEQ ID NO: 776391 - DNA, 20 bp, Artificial
  CRISPR gRNA sequence
cacccttgtaactcctgggc

SEQ ID NO: 776392 - DNA, 20 bp, Artificial
  CRISPR gRNA sequence
gtaactcctgggctcaagtg

SEQ ID NO: 776393 - DNA, 20 bp, Artificial
  CRISPR gRNA sequence
taactcctgggctcaagtga

SEQ ID NO: 776394 - DNA, 20 bp, Artificial
  CRISPR gRNA sequence
ctgggctcaagtgatcctcc

SEQ ID NO: 776395 - DNA, 20 bp, Artificial
  CRISPR gRNA sequence
ggctcaagtgatcctcctgc

SEQ ID NO: 776396 - DNA, 20 bp, Artificial
  CRISPR gRNA sequence
aagtgatcctcctgcctcag

SEQ ID NO: 776397 - DNA, 20 bp, Artificial
  CRISPR gRNA sequence
ctgcctcagcctcccgagta

SEQ ID NO: 776398 - DNA, 20 bp, Artificial
  CRISPR gRNA sequence
cctcagcctcccgagtaaca

SEQ ID NO: 776399 - DNA, 20 bp, Artificial
  CRISPR gRNA sequence
agcctcccgagtaacaggga

SEQ ID NO: 776400 - DNA, 20 bp, Artificial
  CRISPR gRNA sequence
ccgagtaacagggactacag

SEQ ID NO: 776401 - DNA, 20 bp, Artificial
  CRISPR gRNA sequence
caggtgctgccagcacaccc

SEQ ID NO: 776402 - DNA, 20 bp, Artificial
  CRISPR gRNA sequence
ccagcacacccagctctccc

SEQ ID NO: 776403 - DNA, 20 bp, Artificial
  CRISPR gRNA sequence
tccccttcttccatagcatt

SEQ ID NO: 776404 - DNA, 20 bp, Artificial
  CRISPR gRNA sequence
cccttcttccatagcatttt

SEQ ID NO: 776405 - DNA, 20 bp, Artificial
  CRISPR gRNA sequence
cttccatagcatttttagtt

SEQ ID NO: 776406 - DNA, 20 bp, Artificial
  CRISPR gRNA sequence
ttccatagcatttttagtta

SEQ ID NO: 776407 - DNA, 20 bp, Artificial
  CRISPR gRNA sequence
ccatagcatttttagttagg

SEQ ID NO: 776408 - DNA, 20 bp, Artificial
  CRISPR gRNA sequence
catagcatttttagttaggc

SEQ ID NO: 776409 - DNA, 20 bp, Artificial
  CRISPR gRNA sequence
ttagttaggcacacggccac

SEQ ID NO: 776410 - DNA, 20 bp, Artificial
  CRISPR gRNA sequence
tagttaggcacacggccact

SEQ ID NO: 776411 - DNA, 20 bp, Artificial
  CRISPR gRNA sequence
agttaggcacacggccactc

SEQ ID NO: 776412 - DNA, 20 bp, Artificial
  CRISPR gRNA sequence
gttaggcacacggccactca

SEQ ID NO: 776413 - DNA, 20 bp, Artificial
  CRISPR gRNA sequence
ggcacacggccactcagcta

SEQ ID NO: 776414 - DNA, 20 bp, Artificial
  CRISPR gRNA sequence
agctaacgactgcagatccc

SEQ ID NO: 776415 - DNA, 20 bp, Artificial
  CRISPR gRNA sequence
acgactgcagatcccagcct

SEQ ID NO: 776416 - DNA, 20 bp, Artificial
  CRISPR gRNA sequence
cagatcccagccttacttgc

SEQ ID NO: 776417 - DNA, 20 bp, Artificial
  CRISPR gRNA sequence
acttgcagctgagtgtggcc

SEQ ID NO: 776418 - DNA, 20 bp, Artificial
  CRISPR gRNA sequence
cttgcagctgagtgtggcca

SEQ ID NO: 776419 - DNA, 20 bp, Artificial
  CRISPR gRNA sequence
gcagctgagtgtggccatgc

SEQ ID NO: 776420 - DNA, 20 bp, Artificial
  CRISPR gRNA sequence
cagctgagtgtggccatgca

SEQ ID NO: 776421 - DNA, 20 bp, Artificial
  CRISPR gRNA sequence
agtgtggccatgcaatgtgt

SEQ ID NO: 776422 - DNA, 20 bp, Artificial
  CRISPR gRNA sequence
atgtgtacagcttctgggtc

SEQ ID NO: 776423 - DNA, 20 bp, Artificial
  CRISPR gRNA sequence
ctgggtcatgccctgaaaga

SEQ ID NO: 776424 - DNA, 20 bp, Artificial
  CRISPR gRNA sequence
tgggtcatgccctgaaagag

SEQ ID NO: 776425 - DNA, 20 bp, Artificial
  CRISPR gRNA sequence
ggtcatgccctgaaagagag

SEQ ID NO: 776426 - DNA, 20 bp, Artificial
  CRISPR gRNA sequence
aaagagagaagcatgccctc

SEQ ID NO: 776427 - DNA, 20 bp, Artificial
  CRISPR gRNA sequence
ccctccctttcccctccccc

SEQ ID NO: 776428 - DNA, 20 bp, Artificial
  CRISPR gRNA sequence
cctttcccctcccccttccc

SEQ ID NO: 776429 - DNA, 20 bp, Artificial
  CRISPR gRNA sequence
tcccctcccccttcccactg

SEQ ID NO: 776430 - DNA, 20 bp, Artificial
  CRISPR gRNA sequence
cccctcccccttcccactgg

SEQ ID NO: 776431 - DNA, 20 bp, Artificial
  CRISPR gRNA sequence
ccctcccccttcccactggc

SEQ ID NO: 776432 - DNA, 20 bp, Artificial
  CRISPR gRNA sequence
ccccttcccactggctggaa

SEQ ID NO: 776433 - DNA, 20 bp, Artificial
  CRISPR gRNA sequence
cccactggctggaacataga

SEQ ID NO: 776434 - DNA, 20 bp, Artificial
  CRISPR gRNA sequence
ccactggctggaacatagat

SEQ ID NO: 776435 - DNA, 20 bp, Artificial
  CRISPR gRNA sequence
gctggaacatagatgtggtg

SEQ ID NO: 776436 - DNA, 20 bp, Artificial
  CRISPR gRNA sequence
gaacatagatgtggtgtgtg

SEQ ID NO: 776437 - DNA, 20 bp, Artificial
  CRISPR gRNA sequence
ccaaaggcaacaccctgagg

SEQ ID NO: 776438 - DNA, 20 bp, Artificial
  CRISPR gRNA sequence
aggacggcagagcagcagac

SEQ ID NO: 776439 - DNA, 20 bp, Artificial
  CRISPR gRNA sequence
agggactgtagtatcagccc

SEQ ID NO: 776440 - DNA, 20 bp, Artificial
  CRISPR gRNA sequence
tagtatcagccctggatata

SEQ ID NO: 776441 - DNA, 20 bp, Artificial
  CRISPR gRNA sequence
gatatacccagatggtcaca

SEQ ID NO: 776442 - DNA, 20 bp, Artificial
  CRISPR gRNA sequence
ttccagcataagtcattgct

SEQ ID NO: 776443 - DNA, 20 bp, Artificial
  CRISPR gRNA sequence
ccagcataagtcattgctat

SEQ ID NO: 776444 - DNA, 20 bp, Artificial
  CRISPR gRNA sequence
cagcataagtcattgctatt

SEQ ID NO: 776445 - DNA, 20 bp, Artificial
  CRISPR gRNA sequence
ctattttgggcctttcttac

SEQ ID NO: 776446 - DNA, 20 bp, Artificial
  CRISPR gRNA sequence
ttttgggcctttcttacagc

SEQ ID NO: 776447 - DNA, 20 bp, Artificial
  CRISPR gRNA sequence
tgggcctttcttacagcatc

SEQ ID NO: 776448 - DNA, 20 bp, Artificial
  CRISPR gRNA sequence
gggcctttcttacagcatct

SEQ ID NO: 776449 - DNA, 20 bp, Artificial
  CRISPR gRNA sequence
ggcctttcttacagcatctg

SEQ ID NO: 776450 - DNA, 20 bp, Artificial
  CRISPR gRNA sequence
tcttacagcatctgaactaa

SEQ ID NO: 776451 - DNA, 20 bp, Artificial
  CRISPR gRNA sequence
cttacagcatctgaactaac

SEQ ID NO: 776452 - DNA, 20 bp, Artificial
  CRISPR gRNA sequence
ttacagcatctgaactaact

SEQ ID NO: 776453 - DNA, 20 bp, Artificial
  CRISPR gRNA sequence
acagcatctgaactaactaa

SEQ ID NO: 776454 - DNA, 20 bp, Artificial
  CRISPR gRNA sequence
cagcatctgaactaactaag

SEQ ID NO: 776455 - DNA, 20 bp, Artificial
  CRISPR gRNA sequence
aactaactaaggagccatcc

SEQ ID NO: 776456 - DNA, 20 bp, Artificial
  CRISPR gRNA sequence
actaaggagccatcccaccc

SEQ ID NO: 776457 - DNA, 20 bp, Artificial
  CRISPR gRNA sequence
aggagccatcccacccttac

SEQ ID NO: 776458 - DNA, 20 bp, Artificial
  CRISPR gRNA sequence
actttccctccttctcttcc

SEQ ID NO: 776459 - DNA, 20 bp, Artificial
  CRISPR gRNA sequence
ctttccctccttctcttccc

SEQ ID NO: 776460 - DNA, 20 bp, Artificial
  CRISPR gRNA sequence
tccctccttctcttccccgt

SEQ ID NO: 776461 - DNA, 20 bp, Artificial
  CRISPR gRNA sequence
ccctccttctcttccccgtc

SEQ ID NO: 776462 - DNA, 20 bp, Artificial
  CRISPR gRNA sequence
cctccttctcttccccgtct

SEQ ID NO: 776463 - DNA, 20 bp, Artificial
  CRISPR gRNA sequence
cttctcttccccgtctccgt

SEQ ID NO: 776464 - DNA, 20 bp, Artificial
  CRISPR gRNA sequence
ctcttccccgtctccgtacc

SEQ ID NO: 776465 - DNA, 20 bp, Artificial
  CRISPR gRNA sequence
tcttccccgtctccgtaccc

SEQ ID NO: 776466 - DNA, 20 bp, Artificial
  CRISPR gRNA sequence
ttccccgtctccgtacccga

SEQ ID NO: 776467 - DNA, 20 bp, Artificial
  CRISPR gRNA sequence
ccccgtctccgtacccgatg

SEQ ID NO: 776468 - DNA, 20 bp, Artificial
  CRISPR gRNA sequence
cccgtctccgtacccgatga

SEQ ID NO: 776469 - DNA, 20 bp, Artificial
  CRISPR gRNA sequence
cgtacccgatgagcattgcc

SEQ ID NO: 776470 - DNA, 20 bp, Artificial
  CRISPR gRNA sequence
ccactgctcagagccacaaa

SEQ ID NO: 776471 - DNA, 20 bp, Artificial
  CRISPR gRNA sequence
ctcagagccacaaaaggaaa

SEQ ID NO: 776472 - DNA, 20 bp, Artificial
  CRISPR gRNA sequence
agagccacaaaaggaaacca

SEQ ID NO: 776473 - DNA, 20 bp, Artificial
  CRISPR gRNA sequence
aaataggtatctcaaaatac

SEQ ID NO: 776474 - DNA, 20 bp, Artificial
  CRISPR gRNA sequence
aaaatacgaacaggagacta

SEQ ID NO: 776475 - DNA, 20 bp, Artificial
  CRISPR gRNA sequence
tctcatcagagtcaccgagt

SEQ ID NO: 776476 - DNA, 20 bp, Artificial
  CRISPR gRNA sequence
atcagagtcaccgagtgatg

SEQ ID NO: 776477 - DNA, 20 bp, Artificial
  CRISPR gRNA sequence
agcccagctttggacaaatg

SEQ ID NO: 776478 - DNA, 20 bp, Artificial
  CRISPR gRNA sequence
tggacaaatgtcaagggtag

SEQ ID NO: 776479 - DNA, 20 bp, Artificial
  CRISPR gRNA sequence
ggacaaatgtcaagggtaga

SEQ ID NO: 776480 - DNA, 20 bp, Artificial
  CRISPR gRNA sequence
gacaaatgtcaagggtagaa

SEQ ID NO: 776481 - DNA, 20 bp, Artificial
  CRISPR gRNA sequence
ggggactgtttgtattgagg

SEQ ID NO: 776482 - DNA, 20 bp, Artificial
  CRISPR gRNA sequence
gggactgtttgtattgaggg

SEQ ID NO: 776483 - DNA, 20 bp, Artificial
  CRISPR gRNA sequence
tttgtattgagggaggggct

SEQ ID NO: 776484 - DNA, 20 bp, Artificial
  CRISPR gRNA sequence
gtattgagggaggggctgaa

SEQ ID NO: 776485 - DNA, 20 bp, Artificial
  CRISPR gRNA sequence
tattgagggaggggctgaag

SEQ ID NO: 776486 - DNA, 20 bp, Artificial
  CRISPR gRNA sequence
agggaggggctgaaggtgtc

SEQ ID NO: 776487 - DNA, 20 bp, Artificial
  CRISPR gRNA sequence
aaggtgtcaagagggcactg

SEQ ID NO: 776488 - DNA, 20 bp, Artificial
  CRISPR gRNA sequence
aaggcttgagcaatgggcaa

SEQ ID NO: 776489 - DNA, 20 bp, Artificial
  CRISPR gRNA sequence
gagcaatgggcaaacatgga

SEQ ID NO: 776490 - DNA, 20 bp, Artificial
  CRISPR gRNA sequence
agcaatgggcaaacatggac

SEQ ID NO: 776491 - DNA, 20 bp, Artificial
  CRISPR gRNA sequence
gagatgaagcacgtggaggg

SEQ ID NO: 776492 - DNA, 20 bp, Artificial
  CRISPR gRNA sequence
ctactgagctcgactatgga

SEQ ID NO: 776493 - DNA, 20 bp, Artificial
  CRISPR gRNA sequence
ctgagctcgactatggatca

SEQ ID NO: 776494 - DNA, 20 bp, Artificial
  CRISPR gRNA sequence
agctcgactatggatcatcc

SEQ ID NO: 776495 - DNA, 20 bp, Artificial
  CRISPR gRNA sequence
gactatggatcatccacacc

SEQ ID NO: 776496 - DNA, 20 bp, Artificial
  CRISPR gRNA sequence
tggatcatccacaccaaaat

SEQ ID NO: 776497 - DNA, 20 bp, Artificial
  CRISPR gRNA sequence
tggactcccagacacactga

SEQ ID NO: 776498 - DNA, 20 bp, Artificial
  CRISPR gRNA sequence
ccagacacactgagctgcag

SEQ ID NO: 776499 - DNA, 20 bp, Artificial
  CRISPR gRNA sequence
agctgcagctcagaacagag

SEQ ID NO: 776500 - DNA, 20 bp, Artificial
  CRISPR gRNA sequence
cagctcagaacagagggaca

SEQ ID NO: 776501 - DNA, 20 bp, Artificial
  CRISPR gRNA sequence
agaacagagggacatggcag

SEQ ID NO: 776502 - DNA, 20 bp, Artificial
  CRISPR gRNA sequence
gtgcagtggtggtgacagaa

SEQ ID NO: 776503 - DNA, 20 bp, Artificial
  CRISPR gRNA sequence
agggagatgatgccatgaga

SEQ ID NO: 776504 - DNA, 20 bp, Artificial
  CRISPR gRNA sequence
tggggaaactgcagaaatta

SEQ ID NO: 776505 - DNA, 20 bp, Artificial
  CRISPR gRNA sequence
gggaaactgcagaaattaat

SEQ ID NO: 776506 - DNA, 20 bp, Artificial
  CRISPR gRNA sequence
cagaaattaatgatcaagta

SEQ ID NO: 776507 - DNA, 20 bp, Artificial
  CRISPR gRNA sequence
atgatcaagtatcagaacag

SEQ ID NO: 776508 - DNA, 20 bp, Artificial
  CRISPR gRNA sequence
tccctgcccctccccccacc

SEQ ID NO: 776509 - DNA, 20 bp, Artificial
  CRISPR gRNA sequence
ccctgcccctccccccaccc

SEQ ID NO: 776510 - DNA, 20 bp, Artificial
  CRISPR gRNA sequence
cctgcccctccccccaccca

SEQ ID NO: 776511 - DNA, 20 bp, Artificial
  CRISPR gRNA sequence
cccctccccccacccaccgc

SEQ ID NO: 776512 - DNA, 20 bp, Artificial
  CRISPR gRNA sequence
cccccacccaccgcatacac

SEQ ID NO: 776513 - DNA, 20 bp, Artificial
  CRISPR gRNA sequence
tgtttgccctcccgtgatgg

SEQ ID NO: 776514 - DNA, 20 bp, Artificial
  CRISPR gRNA sequence
tttgccctcccgtgatgggc

SEQ ID NO: 776515 - DNA, 20 bp, Artificial
  CRISPR gRNA sequence
gccctcccgtgatgggcacc

SEQ ID NO: 776516 - DNA, 20 bp, Artificial
  CRISPR gRNA sequence
ccctcccgtgatgggcaccc

SEQ ID NO: 776517 - DNA, 20 bp, Artificial
  CRISPR gRNA sequence
ccgtgatgggcacccatggc

SEQ ID NO: 776518 - DNA, 20 bp, Artificial
  CRISPR gRNA sequence
catgggctatccacttgctt

SEQ ID NO: 776519 - DNA, 20 bp, Artificial
  CRISPR gRNA sequence
tccacttgcttttggacagc

SEQ ID NO: 776520 - DNA, 20 bp, Artificial
  CRISPR gRNA sequence
gcttttggacagcgttcatc

SEQ ID NO: 776521 - DNA, 20 bp, Artificial
  CRISPR gRNA sequence
cttttggacagcgttcatcg

SEQ ID NO: 776522 - DNA, 20 bp, Artificial
  CRISPR gRNA sequence
ttggacagcgttcatcggtg

SEQ ID NO: 776523 - DNA, 20 bp, Artificial
  CRISPR gRNA sequence
tggacagcgttcatcggtga

SEQ ID NO: 776524 - DNA, 20 bp, Artificial
  CRISPR gRNA sequence
ggacagcgttcatcggtgag

SEQ ID NO: 776525 - DNA, 20 bp, Artificial
  CRISPR gRNA sequence
gacagcgttcatcggtgaga

SEQ ID NO: 776526 - DNA, 20 bp, Artificial
  CRISPR gRNA sequence
atcggtgagaagctctacct

SEQ ID NO: 776527 - DNA, 20 bp, Artificial
  CRISPR gRNA sequence
taccttatacttagcccaaa

SEQ ID NO: 776528 - DNA, 20 bp, Artificial
  CRISPR gRNA sequence
ccttatacttagcccaaatt

SEQ ID NO: 776529 - DNA, 20 bp, Artificial
  CRISPR gRNA sequence
atacttagcccaaatttgtc

SEQ ID NO: 776530 - DNA, 20 bp, Artificial
  CRISPR gRNA sequence
tacttagcccaaatttgtct

SEQ ID NO: 776531 - DNA, 20 bp, Artificial
  CRISPR gRNA sequence
agcccaaatttgtctcccaa

SEQ ID NO: 776532 - DNA, 20 bp, Artificial
  CRISPR gRNA sequence
gcccaaatttgtctcccaat

SEQ ID NO: 776533 - DNA, 20 bp, Artificial
  CRISPR gRNA sequence
gtctcccaatacagcccaca

SEQ ID NO: 776534 - DNA, 20 bp, Artificial
  CRISPR gRNA sequence
tctcccaatacagcccacaa

SEQ ID NO: 776535 - DNA, 20 bp, Artificial
  CRISPR gRNA sequence
ccaatacagcccacaacagt

SEQ ID NO: 776536 - DNA, 20 bp, Artificial
  CRISPR gRNA sequence
atgtgaccccttggaccaca

SEQ ID NO: 776537 - DNA, 20 bp, Artificial
  CRISPR gRNA sequence
ggaccacacagaatgagtct

SEQ ID NO: 776538 - DNA, 20 bp, Artificial
  CRISPR gRNA sequence
gaccacacagaatgagtctg

SEQ ID NO: 776539 - DNA, 20 bp, Artificial
  CRISPR gRNA sequence
cccccttccttatcaaagcc

SEQ ID NO: 776540 - DNA, 20 bp, Artificial
  CRISPR gRNA sequence
ccttatcaaagccctgcaag

SEQ ID NO: 776541 - DNA, 20 bp, Artificial
  CRISPR gRNA sequence
cttatcaaagccctgcaagt

SEQ ID NO: 776542 - DNA, 20 bp, Artificial
  CRISPR gRNA sequence
atcaaagccctgcaagtatt

SEQ ID NO: 776543 - DNA, 20 bp, Artificial
  CRISPR gRNA sequence
tcaaagccctgcaagtattt

SEQ ID NO: 776544 - DNA, 20 bp, Artificial
  CRISPR gRNA sequence
caagtatttgatcttccttg

SEQ ID NO: 776545 - DNA, 20 bp, Artificial
  CRISPR gRNA sequence
gatcttccttgacgaagtca

SEQ ID NO: 776546 - DNA, 20 bp, Artificial
  CRISPR gRNA sequence
atcttccttgacgaagtcac

SEQ ID NO: 776547 - DNA, 20 bp, Artificial
  CRISPR gRNA sequence
ccttgacgaagtcaccattg

SEQ ID NO: 776548 - DNA, 20 bp, Artificial
  CRISPR gRNA sequence
cttgacgaagtcaccattga

SEQ ID NO: 776549 - DNA, 20 bp, Artificial
  CRISPR gRNA sequence
gacgaagtcaccattgagca

SEQ ID NO: 776550 - DNA, 20 bp, Artificial
  CRISPR gRNA sequence
acgaagtcaccattgagcag

SEQ ID NO: 776551 - DNA, 20 bp, Artificial
  CRISPR gRNA sequence
agcagccatgtcacaccatt

SEQ ID NO: 776552 - DNA, 20 bp, Artificial
  CRISPR gRNA sequence
accaaaataacccaaaataa

SEQ ID NO: 776553 - DNA, 20 bp, Artificial
  CRISPR gRNA sequence
tcaaatctgtagccaaccat

SEQ ID NO: 776554 - DNA, 20 bp, Artificial
  CRISPR gRNA sequence
tagccaaccatcagaagtca

SEQ ID NO: 776555 - DNA, 20 bp, Artificial
  CRISPR gRNA sequence
acactcattgctgctaatcc

SEQ ID NO: 776556 - DNA, 20 bp, Artificial
  CRISPR gRNA sequence
attgctgctaatccacacct

SEQ ID NO: 776557 - DNA, 20 bp, Artificial
  CRISPR gRNA sequence
ctgctaatccacacctctgc

SEQ ID NO: 776558 - DNA, 20 bp, Artificial
  CRISPR gRNA sequence
ctaatccacacctctgccat

SEQ ID NO: 776559 - DNA, 20 bp, Artificial
  CRISPR gRNA sequence
atccacacctctgccatcct

SEQ ID NO: 776560 - DNA, 20 bp, Artificial
  CRISPR gRNA sequence
tgccatcctcttctgatgga

SEQ ID NO: 776561 - DNA, 20 bp, Artificial
  CRISPR gRNA sequence
ccatcctcttctgatggagt

SEQ ID NO: 776562 - DNA, 20 bp, Artificial
  CRISPR gRNA sequence
ttctgatggagttcagaatg

SEQ ID NO: 776563 - DNA, 20 bp, Artificial
  CRISPR gRNA sequence
ctgatggagttcagaatggg

SEQ ID NO: 776564 - DNA, 20 bp, Artificial
  CRISPR gRNA sequence
tgatggagttcagaatgggg

SEQ ID NO: 776565 - DNA, 20 bp, Artificial
  CRISPR gRNA sequence
atggagttcagaatggggag

SEQ ID NO: 776566 - DNA, 20 bp, Artificial
  CRISPR gRNA sequence
agaatggggaggagttttac

SEQ ID NO: 776567 - DNA, 20 bp, Artificial
  CRISPR gRNA sequence
tacaggatatttcatttgtt

SEQ ID NO: 776568 - DNA, 20 bp, Artificial
  CRISPR gRNA sequence
acaggatatttcatttgtta

SEQ ID NO: 776569 - DNA, 20 bp, Artificial
  CRISPR gRNA sequence
caggatatttcatttgttac

SEQ ID NO: 776570 - DNA, 20 bp, Artificial
  CRISPR gRNA sequence
catttgttactattccattt

SEQ ID NO: 776571 - DNA, 20 bp, Artificial
  CRISPR gRNA sequence
atttgttactattccatttc

SEQ ID NO: 776572 - DNA, 20 bp, Artificial
  CRISPR gRNA sequence
gttactattccatttcaccc

SEQ ID NO: 776573 - DNA, 20 bp, Artificial
  CRISPR gRNA sequence
ttactattccatttcaccca

SEQ ID NO: 776574 - DNA, 20 bp, Artificial
  CRISPR gRNA sequence
ctattccatttcacccagtt

SEQ ID NO: 776575 - DNA, 20 bp, Artificial
  CRISPR gRNA sequence
ttccatttcacccagttaaa

SEQ ID NO: 776576 - DNA, 20 bp, Artificial
  CRISPR gRNA sequence
catttcacccagttaaactg

SEQ ID NO: 776577 - DNA, 20 bp, Artificial
  CRISPR gRNA sequence
cacccagttaaactgagtcc

SEQ ID NO: 776578 - DNA, 20 bp, Artificial
  CRISPR gRNA sequence
acccagttaaactgagtcca

SEQ ID NO: 776579 - DNA, 20 bp, Artificial
  CRISPR gRNA sequence
aactgagtccattcctccaa

SEQ ID NO: 776580 - DNA, 20 bp, Artificial
  CRISPR gRNA sequence
agtccattcctccaactgcc

SEQ ID NO: 776581 - DNA, 20 bp, Artificial
  CRISPR gRNA sequence
ctccaactgccacaacattt

SEQ ID NO: 776582 - DNA, 20 bp, Artificial
  CRISPR gRNA sequence
caactgccacaacatttttt

SEQ ID NO: 776583 - DNA, 20 bp, Artificial
  CRISPR gRNA sequence
ccacaacatttttttcattg

SEQ ID NO: 776584 - DNA, 20 bp, Artificial
  CRISPR gRNA sequence
ttttcattgttgtaaaatat

SEQ ID NO: 776585 - DNA, 20 bp, Artificial
  CRISPR gRNA sequence
tttcattgttgtaaaatata

SEQ ID NO: 776586 - DNA, 20 bp, Artificial
  CRISPR gRNA sequence
ttcattgttgtaaaatatat

SEQ ID NO: 776587 - DNA, 20 bp, Artificial
  CRISPR gRNA sequence
tcattgttgtaaaatatata

SEQ ID NO: 776588 - DNA, 20 bp, Artificial
  CRISPR gRNA sequence
cattgttgtaaaatatatat

SEQ ID NO: 776589 - DNA, 20 bp, Artificial
  CRISPR gRNA sequence
attgttgtaaaatatatata

SEQ ID NO: 776590 - DNA, 20 bp, Artificial
  CRISPR gRNA sequence
ttgtaaaatatatataacat

SEQ ID NO: 776591 - DNA, 20 bp, Artificial
  CRISPR gRNA sequence
taaaatatatataacatgaa

SEQ ID NO: 776592 - DNA, 20 bp, Artificial
  CRISPR gRNA sequence
gccattttatccaggtttaa

SEQ ID NO: 776593 - DNA, 20 bp, Artificial
  CRISPR gRNA sequence
tatccaggtttaagtgtata

SEQ ID NO: 776594 - DNA, 20 bp, Artificial
  CRISPR gRNA sequence
atccaggtttaagtgtataa

SEQ ID NO: 776595 - DNA, 20 bp, Artificial
  CRISPR gRNA sequence
tccaggtttaagtgtataag

SEQ ID NO: 776596 - DNA, 20 bp, Artificial
  CRISPR gRNA sequence
aagtgtataagtcggcagca

SEQ ID NO: 776597 - DNA, 20 bp, Artificial
  CRISPR gRNA sequence
agtgtataagtcggcagcat

SEQ ID NO: 776598 - DNA, 20 bp, Artificial
  CRISPR gRNA sequence
actatatttacaatgctgtg

SEQ ID NO: 776599 - DNA, 20 bp, Artificial
  CRISPR gRNA sequence
tatttacaatgctgtgtaac

SEQ ID NO: 776600 - DNA, 20 bp, Artificial
  CRISPR gRNA sequence
acaatgctgtgtaaccctgt

SEQ ID NO: 776601 - DNA, 20 bp, Artificial
  CRISPR gRNA sequence
caatgctgtgtaaccctgtc

SEQ ID NO: 776602 - DNA, 20 bp, Artificial
  CRISPR gRNA sequence
tgtaaccctgtcgtgatctt

SEQ ID NO: 776603 - DNA, 20 bp, Artificial
  CRISPR gRNA sequence
tcgtgatcttttgaagtact

SEQ ID NO: 776604 - DNA, 20 bp, Artificial
  CRISPR gRNA sequence
ttgaagtactcttttgactg

SEQ ID NO: 776605 - DNA, 20 bp, Artificial
  CRISPR gRNA sequence
tgaagtactcttttgactgt

SEQ ID NO: 776606 - DNA, 20 bp, Artificial
  CRISPR gRNA sequence
gaagtactcttttgactgtt

SEQ ID NO: 776607 - DNA, 20 bp, Artificial
  CRISPR gRNA sequence
aagtactcttttgactgttc

SEQ ID NO: 776608 - DNA, 20 bp, Artificial
  CRISPR gRNA sequence
ttttgactgttctggtgcat

SEQ ID NO: 776609 - DNA, 20 bp, Artificial
  CRISPR gRNA sequence
ttgactgttctggtgcatag

SEQ ID NO: 776610 - DNA, 20 bp, Artificial
  CRISPR gRNA sequence
tgactgttctggtgcataga

SEQ ID NO: 776611 - DNA, 20 bp, Artificial
  CRISPR gRNA sequence
gactgttctggtgcatagac

SEQ ID NO: 776612 - DNA, 20 bp, Artificial
  CRISPR gRNA sequence
actgttctggtgcatagaca

SEQ ID NO: 776613 - DNA, 20 bp, Artificial
  CRISPR gRNA sequence
ttctggtgcatagacaatgc

SEQ ID NO: 776614 - DNA, 20 bp, Artificial
  CRISPR gRNA sequence
tggtgcatagacaatgctca

SEQ ID NO: 776615 - DNA, 20 bp, Artificial
  CRISPR gRNA sequence
gtgcatagacaatgctcaat

SEQ ID NO: 776616 - DNA, 20 bp, Artificial
  CRISPR gRNA sequence
aataatttgttggtggatta

SEQ ID NO: 776617 - DNA, 20 bp, Artificial
  CRISPR gRNA sequence
gttggtggattaaaaaaaga

SEQ ID NO: 776618 - DNA, 20 bp, Artificial
  CRISPR gRNA sequence
ttggtggattaaaaaaagaa

SEQ ID NO: 776619 - DNA, 20 bp, Artificial
  CRISPR gRNA sequence
gtggattaaaaaaagaatga

SEQ ID NO: 776620 - DNA, 20 bp, Artificial
  CRISPR gRNA sequence
aaaaaagaatgaatgaatat

SEQ ID NO: 776621 - DNA, 20 bp, Artificial
  CRISPR gRNA sequence
aaaaggttactctcctctct

SEQ ID NO: 776622 - DNA, 20 bp, Artificial
  CRISPR gRNA sequence
ctctcctctctctgctggtg

SEQ ID NO: 776623 - DNA, 20 bp, Artificial
  CRISPR gRNA sequence
tcctctctctgctggtgtct

SEQ ID NO: 776624 - DNA, 20 bp, Artificial
  CRISPR gRNA sequence
ctctctctgctggtgtctgg

SEQ ID NO: 776625 - DNA, 20 bp, Artificial
  CRISPR gRNA sequence
tctctgctggtgtctgggtg

SEQ ID NO: 776626 - DNA, 20 bp, Artificial
  CRISPR gRNA sequence
tctgctggtgtctgggtgtc

SEQ ID NO: 776627 - DNA, 20 bp, Artificial
  CRISPR gRNA sequence
tgctggtgtctgggtgtcat

SEQ ID NO: 776628 - DNA, 20 bp, Artificial
  CRISPR gRNA sequence
ctggtgtctgggtgtcatca

SEQ ID NO: 776629 - DNA, 20 bp, Artificial
  CRISPR gRNA sequence
gtgtctgggtgtcatcaagg

SEQ ID NO: 776630 - DNA, 20 bp, Artificial
  CRISPR gRNA sequence
ggtgtcatcaaggtcctcag

SEQ ID NO: 776631 - DNA, 20 bp, Artificial
  CRISPR gRNA sequence
agggagaggacaggaatagg

SEQ ID NO: 776632 - DNA, 20 bp, Artificial
  CRISPR gRNA sequence
tccctggatgatcaatgtcc

SEQ ID NO: 776633 - DNA, 20 bp, Artificial
  CRISPR gRNA sequence
gatgatcaatgtccatccac

SEQ ID NO: 776634 - DNA, 20 bp, Artificial
  CRISPR gRNA sequence
agtacaccggggttaggagt

SEQ ID NO: 776635 - DNA, 20 bp, Artificial
  CRISPR gRNA sequence
ggagtgttcctacctgtgct

SEQ ID NO: 776636 - DNA, 20 bp, Artificial
  CRISPR gRNA sequence
ctacctgtgctgctacccag

SEQ ID NO: 776637 - DNA, 20 bp, Artificial
  CRISPR gRNA sequence
cctgtgctgctacccagctc

SEQ ID NO: 776638 - DNA, 20 bp, Artificial
  CRISPR gRNA sequence
tgctgctacccagctcccat

SEQ ID NO: 776639 - DNA, 20 bp, Artificial
  CRISPR gRNA sequence
ctacccagctcccatctacc

SEQ ID NO: 776640 - DNA, 20 bp, Artificial
  CRISPR gRNA sequence
cccagctcccatctacccat

SEQ ID NO: 776641 - DNA, 20 bp, Artificial
  CRISPR gRNA sequence
ccatctacccatctcatccc

SEQ ID NO: 776642 - DNA, 20 bp, Artificial
  CRISPR gRNA sequence
cccatctcatccccagggct

SEQ ID NO: 776643 - DNA, 20 bp, Artificial
  CRISPR gRNA sequence
atccccagggctgtcatgag

SEQ ID NO: 776644 - DNA, 20 bp, Artificial
  CRISPR gRNA sequence
tcatgagaagcttcactgct

SEQ ID NO: 776645 - DNA, 20 bp, Artificial
  CRISPR gRNA sequence
cactgcttctggctggggac

SEQ ID NO: 776646 - DNA, 20 bp, Artificial
  CRISPR gRNA sequence
actgcttctggctggggacc

SEQ ID NO: 776647 - DNA, 20 bp, Artificial
  CRISPR gRNA sequence
cttctggctggggaccaatc

SEQ ID NO: 776648 - DNA, 20 bp, Artificial
  CRISPR gRNA sequence
ctggctggggaccaatcaac

SEQ ID NO: 776649 - DNA, 20 bp, Artificial
  CRISPR gRNA sequence
tggctggggaccaatcaact

SEQ ID NO: 776650 - DNA, 20 bp, Artificial
  CRISPR gRNA sequence
gctggggaccaatcaactgg

SEQ ID NO: 776651 - DNA, 20 bp, Artificial
  CRISPR gRNA sequence
gggaccaatcaactggagaa

SEQ ID NO: 776652 - DNA, 20 bp, Artificial
  CRISPR gRNA sequence
gagaagaacaagaaaagaag

SEQ ID NO: 776653 - DNA, 20 bp, Artificial
  CRISPR gRNA sequence
tcaaaaccccagtgaagcca

SEQ ID NO: 776654 - DNA, 20 bp, Artificial
  CRISPR gRNA sequence
caaaaccccagtgaagccat

SEQ ID NO: 776655 - DNA, 20 bp, Artificial
  CRISPR gRNA sequence
aaaaccccagtgaagccatg

SEQ ID NO: 776656 - DNA, 20 bp, Artificial
  CRISPR gRNA sequence
ctagtgggctcttcttcaag

SEQ ID NO: 776657 - DNA, 20 bp, Artificial
  CRISPR gRNA sequence
gtgggctcttcttcaagtgc

SEQ ID NO: 776658 - DNA, 20 bp, Artificial
  CRISPR gRNA sequence
ttcttcaagtgctcattggt

SEQ ID NO: 776659 - DNA, 20 bp, Artificial
  CRISPR gRNA sequence
cttcaagtgctcattggttc

SEQ ID NO: 776660 - DNA, 20 bp, Artificial
  CRISPR gRNA sequence
ttcaagtgctcattggttcc

SEQ ID NO: 776661 - DNA, 20 bp, Artificial
  CRISPR gRNA sequence
caagtgctcattggttccag

SEQ ID NO: 776662 - DNA, 20 bp, Artificial
  CRISPR gRNA sequence
aagtgctcattggttccagg

SEQ ID NO: 776663 - DNA, 20 bp, Artificial
  CRISPR gRNA sequence
attggttccaggactttgtc

SEQ ID NO: 776664 - DNA, 20 bp, Artificial
  CRISPR gRNA sequence
gttccaggactttgtcaagg

SEQ ID NO: 776665 - DNA, 20 bp, Artificial
  CRISPR gRNA sequence
caggactttgtcaaggatta

SEQ ID NO: 776666 - DNA, 20 bp, Artificial
  CRISPR gRNA sequence
tgtcaaggattaagaacaag

SEQ ID NO: 776667 - DNA, 20 bp, Artificial
  CRISPR gRNA sequence
gtcaaggattaagaacaaga

SEQ ID NO: 776668 - DNA, 20 bp, Artificial
  CRISPR gRNA sequence
tcaaggattaagaacaagat

SEQ ID NO: 776669 - DNA, 20 bp, Artificial
  CRISPR gRNA sequence
agaacaagattatcgatctg

SEQ ID NO: 776670 - DNA, 20 bp, Artificial
  CRISPR gRNA sequence
tcgatctgttgttcccataa

SEQ ID NO: 776671 - DNA, 20 bp, Artificial
  CRISPR gRNA sequence
ttgttcccataatctaccat

SEQ ID NO: 776672 - DNA, 20 bp, Artificial
  CRISPR gRNA sequence
ttcccataatctaccatctt

SEQ ID NO: 776673 - DNA, 20 bp, Artificial
  CRISPR gRNA sequence
ccataatctaccatcttccc

SEQ ID NO: 776674 - DNA, 20 bp, Artificial
  CRISPR gRNA sequence
ccatcttccccataaaactg

SEQ ID NO: 776675 - DNA, 20 bp, Artificial
  CRISPR gRNA sequence
ccccataaaactggttattt

SEQ ID NO: 776676 - DNA, 20 bp, Artificial
  CRISPR gRNA sequence
cccataaaactggttatttc

SEQ ID NO: 776677 - DNA, 20 bp, Artificial
  CRISPR gRNA sequence
gttatttccctgtctcaagt

SEQ ID NO: 776678 - DNA, 20 bp, Artificial
  CRISPR gRNA sequence
tttccctgtctcaagtcttc

SEQ ID NO: 776679 - DNA, 20 bp, Artificial
  CRISPR gRNA sequence
ccctgtctcaagtcttctgg

SEQ ID NO: 776680 - DNA, 20 bp, Artificial
  CRISPR gRNA sequence
cctgtctcaagtcttctggc

SEQ ID NO: 776681 - DNA, 20 bp, Artificial
  CRISPR gRNA sequence
tctcaagtcttctggcattt

SEQ ID NO: 776682 - DNA, 20 bp, Artificial
  CRISPR gRNA sequence
aagtcttctggcatttgttc

SEQ ID NO: 776683 - DNA, 20 bp, Artificial
  CRISPR gRNA sequence
ctggcatttgttcatttatt

SEQ ID NO: 776684 - DNA, 20 bp, Artificial
  CRISPR gRNA sequence
tggcatttgttcatttattc

SEQ ID NO: 776685 - DNA, 20 bp, Artificial
  CRISPR gRNA sequence
gcatttgttcatttattcat

SEQ ID NO: 776686 - DNA, 20 bp, Artificial
  CRISPR gRNA sequence
gttcatttattcattcaaca

SEQ ID NO: 776687 - DNA, 20 bp, Artificial
  CRISPR gRNA sequence
ttcatttattcattcaacaa

SEQ ID NO: 776688 - DNA, 20 bp, Artificial
  CRISPR gRNA sequence
atttattcattcaacaaatg

SEQ ID NO: 776689 - DNA, 20 bp, Artificial
  CRISPR gRNA sequence
attcattcaacaaatgctta

SEQ ID NO: 776690 - DNA, 20 bp, Artificial
  CRISPR gRNA sequence
ttcattcaacaaatgcttat

SEQ ID NO: 776691 - DNA, 20 bp, Artificial
  CRISPR gRNA sequence
attcaacaaatgcttattca

SEQ ID NO: 776692 - DNA, 20 bp, Artificial
  CRISPR gRNA sequence
aacaaatgcttattcatgat

SEQ ID NO: 776693 - DNA, 20 bp, Artificial
  CRISPR gRNA sequence
attcatgatccacatgccag

SEQ ID NO: 776694 - DNA, 20 bp, Artificial
  CRISPR gRNA sequence
ttcatgatccacatgccagg

SEQ ID NO: 776695 - DNA, 20 bp, Artificial
  CRISPR gRNA sequence
atgatccacatgccaggcat

SEQ ID NO: 776696 - DNA, 20 bp, Artificial
  CRISPR gRNA sequence
gccatgcatgcaatatgaat

SEQ ID NO: 776697 - DNA, 20 bp, Artificial
  CRISPR gRNA sequence
aactacaggggttctcattc

SEQ ID NO: 776698 - DNA, 20 bp, Artificial
  CRISPR gRNA sequence
caggggttctcattctcaag

SEQ ID NO: 776699 - DNA, 20 bp, Artificial
  CRISPR gRNA sequence
tcattctcaagttgggaggt

SEQ ID NO: 776700 - DNA, 20 bp, Artificial
  CRISPR gRNA sequence
attctcaagttgggaggtat

SEQ ID NO: 776701 - DNA, 20 bp, Artificial
  CRISPR gRNA sequence
tcaagttgggaggtatgttt

SEQ ID NO: 776702 - DNA, 20 bp, Artificial
  CRISPR gRNA sequence
aagttgggaggtatgtttat

SEQ ID NO: 776703 - DNA, 20 bp, Artificial
  CRISPR gRNA sequence
ggaggtatgtttattattat

SEQ ID NO: 776704 - DNA, 20 bp, Artificial
  CRISPR gRNA sequence
attattatgcttcaaaagtt

SEQ ID NO: 776705 - DNA, 20 bp, Artificial
  CRISPR gRNA sequence
ttattatgcttcaaaagtta

SEQ ID NO: 776706 - DNA, 20 bp, Artificial
  CRISPR gRNA sequence
ttatgcttcaaaagttaccc

SEQ ID NO: 776707 - DNA, 20 bp, Artificial
  CRISPR gRNA sequence
tgcttcaaaagttacccatg

SEQ ID NO: 776708 - DNA, 20 bp, Artificial
  CRISPR gRNA sequence
caaaagttacccatgttata

SEQ ID NO: 776709 - DNA, 20 bp, Artificial
  CRISPR gRNA sequence
aaaagttacccatgttatat

SEQ ID NO: 776710 - DNA, 20 bp, Artificial
  CRISPR gRNA sequence
cccatgttatatatattatt

SEQ ID NO: 776711 - DNA, 20 bp, Artificial
  CRISPR gRNA sequence
tatatattattttgctttta

SEQ ID NO: 776712 - DNA, 20 bp, Artificial
  CRISPR gRNA sequence
ttttgcttttatcaaataat

SEQ ID NO: 776713 - DNA, 20 bp, Artificial
  CRISPR gRNA sequence
tgcttttatcaaataataat

SEQ ID NO: 776714 - DNA, 20 bp, Artificial
  CRISPR gRNA sequence
gcttttatcaaataataata

SEQ ID NO: 776715 - DNA, 20 bp, Artificial
  CRISPR gRNA sequence
cttttatcaaataataataa

SEQ ID NO: 776716 - DNA, 20 bp, Artificial
  CRISPR gRNA sequence
ttatcaaataataataacat

SEQ ID NO: 776717 - DNA, 20 bp, Artificial
  CRISPR gRNA sequence
tatcaaataataataacata

SEQ ID NO: 776718 - DNA, 20 bp, Artificial
  CRISPR gRNA sequence
atcaaataataataacatag

SEQ ID NO: 776719 - DNA, 20 bp, Artificial
  CRISPR gRNA sequence
tcaaataataataacatagg

SEQ ID NO: 776720 - DNA, 20 bp, Artificial
  CRISPR gRNA sequence
tgttgaaagccatgcaccag

SEQ ID NO: 776721 - DNA, 20 bp, Artificial
  CRISPR gRNA sequence
gttgaaagccatgcaccagg

SEQ ID NO: 776722 - DNA, 20 bp, Artificial
  CRISPR gRNA sequence
ttgaaagccatgcaccaggc

SEQ ID NO: 776723 - DNA, 20 bp, Artificial
  CRISPR gRNA sequence
aaagccatgcaccaggctct

SEQ ID NO: 776724 - DNA, 20 bp, Artificial
  CRISPR gRNA sequence
tgttctaaatgcttttacac

SEQ ID NO: 776725 - DNA, 20 bp, Artificial
  CRISPR gRNA sequence
ttctaaatgcttttacacat

SEQ ID NO: 776726 - DNA, 20 bp, Artificial
  CRISPR gRNA sequence
taaatgcttttacacatatt

SEQ ID NO: 776727 - DNA, 20 bp, Artificial
  CRISPR gRNA sequence
aatgcttttacacatattaa

SEQ ID NO: 776728 - DNA, 20 bp, Artificial
  CRISPR gRNA sequence
ttacacatattaactcattt

SEQ ID NO: 776729 - DNA, 20 bp, Artificial
  CRISPR gRNA sequence
tacacatattaactcattta

SEQ ID NO: 776730 - DNA, 20 bp, Artificial
  CRISPR gRNA sequence
acacatattaactcatttaa

SEQ ID NO: 776731 - DNA, 20 bp, Artificial
  CRISPR gRNA sequence
cacatattaactcatttaag

SEQ ID NO: 776732 - DNA, 20 bp, Artificial
  CRISPR gRNA sequence
actcatttaagcttcccaac

SEQ ID NO: 776733 - DNA, 20 bp, Artificial
  CRISPR gRNA sequence
atttaagcttcccaacaatt

SEQ ID NO: 776734 - DNA, 20 bp, Artificial
  CRISPR gRNA sequence
aagcttcccaacaattctgt

SEQ ID NO: 776735 - DNA, 20 bp, Artificial
  CRISPR gRNA sequence
agcttcccaacaattctgtg

SEQ ID NO: 776736 - DNA, 20 bp, Artificial
  CRISPR gRNA sequence
cccaacaattctgtgaagta

SEQ ID NO: 776737 - DNA, 20 bp, Artificial
  CRISPR gRNA sequence
ccaacaattctgtgaagtag

SEQ ID NO: 776738 - DNA, 20 bp, Artificial
  CRISPR gRNA sequence
tgtgaagtaggtactattat

SEQ ID NO: 776739 - DNA, 20 bp, Artificial
  CRISPR gRNA sequence
tgaagtaggtactattatta

SEQ ID NO: 776740 - DNA, 20 bp, Artificial
  CRISPR gRNA sequence
ttattatcctatttcaccga

SEQ ID NO: 776741 - DNA, 20 bp, Artificial
  CRISPR gRNA sequence
ttatcctatttcaccgagga

SEQ ID NO: 776742 - DNA, 20 bp, Artificial
  CRISPR gRNA sequence
tcctatttcaccgaggagta

SEQ ID NO: 776743 - DNA, 20 bp, Artificial
  CRISPR gRNA sequence
tttcaccgaggagtaaattc

SEQ ID NO: 776744 - DNA, 20 bp, Artificial
  CRISPR gRNA sequence
caccgaggagtaaattcagg

SEQ ID NO: 776745 - DNA, 20 bp, Artificial
  CRISPR gRNA sequence
accgaggagtaaattcaggg

SEQ ID NO: 776746 - DNA, 20 bp, Artificial
  CRISPR gRNA sequence
agggatggagagatttaata

SEQ ID NO: 776747 - DNA, 20 bp, Artificial
  CRISPR gRNA sequence
aataacttgctcaagattac

SEQ ID NO: 776748 - DNA, 20 bp, Artificial
  CRISPR gRNA sequence
ataacttgctcaagattaca

SEQ ID NO: 776749 - DNA, 20 bp, Artificial
  CRISPR gRNA sequence
gctcaagattacagagctgc

SEQ ID NO: 776750 - DNA, 20 bp, Artificial
  CRISPR gRNA sequence
ctcaagattacagagctgct

SEQ ID NO: 776751 - DNA, 20 bp, Artificial
  CRISPR gRNA sequence
aagattacagagctgctaaa

SEQ ID NO: 776752 - DNA, 20 bp, Artificial
  CRISPR gRNA sequence
cagagctgctaaatggcata

SEQ ID NO: 776753 - DNA, 20 bp, Artificial
  CRISPR gRNA sequence
ctaaatggcatatttaaaat

SEQ ID NO: 776754 - DNA, 20 bp, Artificial
  CRISPR gRNA sequence
aatggcatatttaaaatccc

SEQ ID NO: 776755 - DNA, 20 bp, Artificial
  CRISPR gRNA sequence
aaaatcccacattttcatat

SEQ ID NO: 776756 - DNA, 20 bp, Artificial
  CRISPR gRNA sequence
aaatcccacattttcatatt

SEQ ID NO: 776757 - DNA, 20 bp, Artificial
  CRISPR gRNA sequence
tcatattaaaaatagaaaaa

SEQ ID NO: 776758 - DNA, 20 bp, Artificial
  CRISPR gRNA sequence
catattaaaaatagaaaaaa

SEQ ID NO: 776759 - DNA, 20 bp, Artificial
  CRISPR gRNA sequence
atattaaaaatagaaaaaag

SEQ ID NO: 776760 - DNA, 20 bp, Artificial
  CRISPR gRNA sequence
aaaatagaaaaaaggtttag

SEQ ID NO: 776761 - DNA, 20 bp, Artificial
  CRISPR gRNA sequence
aggaaacaaatatatcatta

SEQ ID NO: 776762 - DNA, 20 bp, Artificial
  CRISPR gRNA sequence
ggaaacaaatatatcattaa

SEQ ID NO: 776763 - DNA, 20 bp, Artificial
  CRISPR gRNA sequence
aaatagaatatgaccagttt

SEQ ID NO: 776764 - DNA, 20 bp, Artificial
  CRISPR gRNA sequence
tttggtacacatttatacaa

SEQ ID NO: 776765 - DNA, 20 bp, Artificial
  CRISPR gRNA sequence
ttggtacacatttatacaag

SEQ ID NO: 776766 - DNA, 20 bp, Artificial
  CRISPR gRNA sequence
tggtacacatttatacaagg

SEQ ID NO: 776767 - DNA, 20 bp, Artificial
  CRISPR gRNA sequence
ggtacacatttatacaaggt

SEQ ID NO: 776768 - DNA, 20 bp, Artificial
  CRISPR gRNA sequence
gtacacatttatacaaggta

SEQ ID NO: 776769 - DNA, 20 bp, Artificial
  CRISPR gRNA sequence
atacaaggtattgtgggaat

SEQ ID NO: 776770 - DNA, 20 bp, Artificial
  CRISPR gRNA sequence
tacaaggtattgtgggaatg

SEQ ID NO: 776771 - DNA, 20 bp, Artificial
  CRISPR gRNA sequence
tgggaatggacgaggcagta

SEQ ID NO: 776772 - DNA, 20 bp, Artificial
  CRISPR gRNA sequence
aaacctggatgaaagggtca

SEQ ID NO: 776773 - DNA, 20 bp, Artificial
  CRISPR gRNA sequence
aacctggatgaaagggtcaa

SEQ ID NO: 776774 - DNA, 20 bp, Artificial
  CRISPR gRNA sequence
gatgaaagggtcaagccatt

SEQ ID NO: 776775 - DNA, 20 bp, Artificial
  CRISPR gRNA sequence
actgggggctggggaggctc

SEQ ID NO: 776776 - DNA, 20 bp, Artificial
  CRISPR gRNA sequence
ggggctggggaggctcagta

SEQ ID NO: 776777 - DNA, 20 bp, Artificial
  CRISPR gRNA sequence
gggaggctcagtaaggactg

SEQ ID NO: 776778 - DNA, 20 bp, Artificial
  CRISPR gRNA sequence
agtaaggactgcacagagga

SEQ ID NO: 776779 - DNA, 20 bp, Artificial
  CRISPR gRNA sequence
cacagaggaggagacatctc

SEQ ID NO: 776780 - DNA, 20 bp, Artificial
  CRISPR gRNA sequence
ggctatctggcggaggggac

SEQ ID NO: 776781 - DNA, 20 bp, Artificial
  CRISPR gRNA sequence
tctggcggaggggacagcat

SEQ ID NO: 776782 - DNA, 20 bp, Artificial
  CRISPR gRNA sequence
gcggaggggacagcatgaaa

SEQ ID NO: 776783 - DNA, 20 bp, Artificial
  CRISPR gRNA sequence
tgggaagatgggactccagg

SEQ ID NO: 776784 - DNA, 20 bp, Artificial
  CRISPR gRNA sequence
ggaagatgggactccaggag

SEQ ID NO: 776785 - DNA, 20 bp, Artificial
  CRISPR gRNA sequence
caggagaggctgagactcag

SEQ ID NO: 776786 - DNA, 20 bp, Artificial
  CRISPR gRNA sequence
agactcaggagaggaggcaa

SEQ ID NO: 776787 - DNA, 20 bp, Artificial
  CRISPR gRNA sequence
aggagaggaggcaagggagg

SEQ ID NO: 776788 - DNA, 20 bp, Artificial
  CRISPR gRNA sequence
ggattgaatctgtgcacagc

SEQ ID NO: 776789 - DNA, 20 bp, Artificial
  CRISPR gRNA sequence
aatctgtgcacagcaggaaa

SEQ ID NO: 776790 - DNA, 20 bp, Artificial
  CRISPR gRNA sequence
tgcacagcaggaaactgtgg

SEQ ID NO: 776791 - DNA, 20 bp, Artificial
  CRISPR gRNA sequence
tggaatactgtgacccacgt

SEQ ID NO: 776792 - DNA, 20 bp, Artificial
  CRISPR gRNA sequence
tgacccacgtgtccaaccct

SEQ ID NO: 776793 - DNA, 20 bp, Artificial
  CRISPR gRNA sequence
ttctaccctagactggcctg

SEQ ID NO: 776794 - DNA, 20 bp, Artificial
  CRISPR gRNA sequence
ctaccctagactggcctgaa

SEQ ID NO: 776795 - DNA, 20 bp, Artificial
  CRISPR gRNA sequence
taccctagactggcctgaaa

SEQ ID NO: 776796 - DNA, 20 bp, Artificial
  CRISPR gRNA sequence
ccctagactggcctgaaata

SEQ ID NO: 776797 - DNA, 20 bp, Artificial
  CRISPR gRNA sequence
gactggcctgaaatatccct

SEQ ID NO: 776798 - DNA, 20 bp, Artificial
  CRISPR gRNA sequence
gcctgaaatatccctgacag

SEQ ID NO: 776799 - DNA, 20 bp, Artificial
  CRISPR gRNA sequence
aaatatccctgacagcttct

SEQ ID NO: 776800 - DNA, 20 bp, Artificial
  CRISPR gRNA sequence
acagcttctcagagattctg

SEQ ID NO: 776801 - DNA, 20 bp, Artificial
  CRISPR gRNA sequence
ctcagagattctgtctccaa

SEQ ID NO: 776802 - DNA, 20 bp, Artificial
  CRISPR gRNA sequence
tcagagattctgtctccaag

SEQ ID NO: 776803 - DNA, 20 bp, Artificial
  CRISPR gRNA sequence
agagattctgtctccaagtt

SEQ ID NO: 776804 - DNA, 20 bp, Artificial
  CRISPR gRNA sequence
tgtctccaagttcaccccac

SEQ ID NO: 776805 - DNA, 20 bp, Artificial
  CRISPR gRNA sequence
tctccaagttcaccccacac

SEQ ID NO: 776806 - DNA, 20 bp, Artificial
  CRISPR gRNA sequence
caagttcaccccacaccagg

SEQ ID NO: 776807 - DNA, 20 bp, Artificial
  CRISPR gRNA sequence
accccacaccaggacaggca

SEQ ID NO: 776808 - DNA, 20 bp, Artificial
  CRISPR gRNA sequence
aaacagatgagcacctcccc

SEQ ID NO: 776809 - DNA, 20 bp, Artificial
  CRISPR gRNA sequence
cccgtatggcctaaacttca

SEQ ID NO: 776810 - DNA, 20 bp, Artificial
  CRISPR gRNA sequence
aacttcaattccttcttaac

SEQ ID NO: 776811 - DNA, 20 bp, Artificial
  CRISPR gRNA sequence
caattccttcttaacatctt

SEQ ID NO: 776812 - DNA, 20 bp, Artificial
  CRISPR gRNA sequence
aattccttcttaacatcttc

SEQ ID NO: 776813 - DNA, 20 bp, Artificial
  CRISPR gRNA sequence
cttcttaacatcttctgctc

SEQ ID NO: 776814 - DNA, 20 bp, Artificial
  CRISPR gRNA sequence
cttaacatcttctgctcctt

SEQ ID NO: 776815 - DNA, 20 bp, Artificial
  CRISPR gRNA sequence
ttaacatcttctgctccttc

SEQ ID NO: 776816 - DNA, 20 bp, Artificial
  CRISPR gRNA sequence
aacatcttctgctccttctt

SEQ ID NO: 776817 - DNA, 20 bp, Artificial
  CRISPR gRNA sequence
acatcttctgctccttcttt

SEQ ID NO: 776818 - DNA, 20 bp, Artificial
  CRISPR gRNA sequence
ctgctccttctttccttgac

SEQ ID NO: 776819 - DNA, 20 bp, Artificial
  CRISPR gRNA sequence
tgctccttctttccttgaca

SEQ ID NO: 776820 - DNA, 20 bp, Artificial
  CRISPR gRNA sequence
ctccttctttccttgacaaa

SEQ ID NO: 776821 - DNA, 20 bp, Artificial
  CRISPR gRNA sequence
cttctttccttgacaaagag

SEQ ID NO: 776822 - DNA, 20 bp, Artificial
  CRISPR gRNA sequence
ctttccttgacaaagaggca

SEQ ID NO: 776823 - DNA, 20 bp, Artificial
  CRISPR gRNA sequence
tttccttgacaaagaggcaa

SEQ ID NO: 776824 - DNA, 20 bp, Artificial
  CRISPR gRNA sequence
tccttgacaaagaggcaaat

SEQ ID NO: 776825 - DNA, 20 bp, Artificial
  CRISPR gRNA sequence
ccttgacaaagaggcaaatt

SEQ ID NO: 776826 - DNA, 20 bp, Artificial
  CRISPR gRNA sequence
cttgacaaagaggcaaattc

SEQ ID NO: 776827 - DNA, 20 bp, Artificial
  CRISPR gRNA sequence
gacaaagaggcaaattcaat

SEQ ID NO: 776828 - DNA, 20 bp, Artificial
  CRISPR gRNA sequence
acaaagaggcaaattcaatg

SEQ ID NO: 776829 - DNA, 20 bp, Artificial
  CRISPR gRNA sequence
aatgccgagcagatcgtctc

SEQ ID NO: 776830 - DNA, 20 bp, Artificial
  CRISPR gRNA sequence
cgtctttggtagctagtctt

SEQ ID NO: 776831 - DNA, 20 bp, Artificial
  CRISPR gRNA sequence
tggtagctagtcttaacaca

SEQ ID NO: 776832 - DNA, 20 bp, Artificial
  CRISPR gRNA sequence
ggtagctagtcttaacacag

SEQ ID NO: 776833 - DNA, 20 bp, Artificial
  CRISPR gRNA sequence
gtagctagtcttaacacagt

SEQ ID NO: 776834 - DNA, 20 bp, Artificial
  CRISPR gRNA sequence
gtcttaacacagttattttg

SEQ ID NO: 776835 - DNA, 20 bp, Artificial
  CRISPR gRNA sequence
aacacagttattttgctcca

SEQ ID NO: 776836 - DNA, 20 bp, Artificial
  CRISPR gRNA sequence
acacagttattttgctccat

SEQ ID NO: 776837 - DNA, 20 bp, Artificial
  CRISPR gRNA sequence
ttttgctccatgtcctttat

SEQ ID NO: 776838 - DNA, 20 bp, Artificial
  CRISPR gRNA sequence
tgctccatgtcctttattct

SEQ ID NO: 776839 - DNA, 20 bp, Artificial
  CRISPR gRNA sequence
gctccatgtcctttattcta

SEQ ID NO: 776840 - DNA, 20 bp, Artificial
  CRISPR gRNA sequence
ctccatgtcctttattctac

SEQ ID NO: 776841 - DNA, 20 bp, Artificial
  CRISPR gRNA sequence
catgtcctttattctacagt

SEQ ID NO: 776842 - DNA, 20 bp, Artificial
  CRISPR gRNA sequence
tattctacagtgcccttctc

SEQ ID NO: 776843 - DNA, 20 bp, Artificial
  CRISPR gRNA sequence
attctacagtgcccttctct

SEQ ID NO: 776844 - DNA, 20 bp, Artificial
  CRISPR gRNA sequence
ttctacagtgcccttctctt

SEQ ID NO: 776845 - DNA, 20 bp, Artificial
  CRISPR gRNA sequence
tacagtgcccttctcttggt

SEQ ID NO: 776846 - DNA, 20 bp, Artificial
  CRISPR gRNA sequence
cagtgcccttctcttggtct

SEQ ID NO: 776847 - DNA, 20 bp, Artificial
  CRISPR gRNA sequence
ctcttggtctatgctggccc

SEQ ID NO: 776848 - DNA, 20 bp, Artificial
  CRISPR gRNA sequence
tcttggtctatgctggcccc

SEQ ID NO: 776849 - DNA, 20 bp, Artificial
  CRISPR gRNA sequence
ttggtctatgctggcccctt

SEQ ID NO: 776850 - DNA, 20 bp, Artificial
  CRISPR gRNA sequence
ggtctatgctggccccttct

SEQ ID NO: 776851 - DNA, 20 bp, Artificial
  CRISPR gRNA sequence
gtctatgctggccccttctg

SEQ ID NO: 776852 - DNA, 20 bp, Artificial
  CRISPR gRNA sequence
tgctggccccttctggtagc

SEQ ID NO: 776853 - DNA, 20 bp, Artificial
  CRISPR gRNA sequence
gccccttctggtagcaaggc

SEQ ID NO: 776854 - DNA, 20 bp, Artificial
  CRISPR gRNA sequence
ctggtagcaaggctccgcac

SEQ ID NO: 776855 - DNA, 20 bp, Artificial
  CRISPR gRNA sequence
tggtagcaaggctccgcact

SEQ ID NO: 776856 - DNA, 20 bp, Artificial
  CRISPR gRNA sequence
gtagcaaggctccgcactcc

SEQ ID NO: 776857 - DNA, 20 bp, Artificial
  CRISPR gRNA sequence
cgcactcctgcagggagccc

SEQ ID NO: 776858 - DNA, 20 bp, Artificial
  CRISPR gRNA sequence
ctgcagggagcccagtccat

SEQ ID NO: 776859 - DNA, 20 bp, Artificial
  CRISPR gRNA sequence
cagggagcccagtccatgct

SEQ ID NO: 776860 - DNA, 20 bp, Artificial
  CRISPR gRNA sequence
tactggtggagctgtcctcc

SEQ ID NO: 776861 - DNA, 20 bp, Artificial
  CRISPR gRNA sequence
gtggagctgtcctcccagcc

SEQ ID NO: 776862 - DNA, 20 bp, Artificial
  CRISPR gRNA sequence
tcctcccagcctagggcctg

SEQ ID NO: 776863 - DNA, 20 bp, Artificial
  CRISPR gRNA sequence
ccagcctagggcctgggcat

SEQ ID NO: 776864 - DNA, 20 bp, Artificial
  CRISPR gRNA sequence
gggcctgggcatgttacaag

SEQ ID NO: 776865 - DNA, 20 bp, Artificial
  CRISPR gRNA sequence
ggcatgttacaagacctggc

SEQ ID NO: 776866 - DNA, 20 bp, Artificial
  CRISPR gRNA sequence
caagacctggctcatggaga

SEQ ID NO: 776867 - DNA, 20 bp, Artificial
  CRISPR gRNA sequence
gctcatggagaaacctgccc

SEQ ID NO: 776868 - DNA, 20 bp, Artificial
  CRISPR gRNA sequence
atggagaaacctgccctgcc

SEQ ID NO: 776869 - DNA, 20 bp, Artificial
  CRISPR gRNA sequence
ccctgcccccactcagtgat

SEQ ID NO: 776870 - DNA, 20 bp, Artificial
  CRISPR gRNA sequence
cccccactcagtgattagtt

SEQ ID NO: 776871 - DNA, 20 bp, Artificial
  CRISPR gRNA sequence
agtgattagttcgagaatga

SEQ ID NO: 776872 - DNA, 20 bp, Artificial
  CRISPR gRNA sequence
gttcgagaatgagctgtaag

SEQ ID NO: 776873 - DNA, 20 bp, Artificial
  CRISPR gRNA sequence
gagaatgagctgtaagccaa

SEQ ID NO: 776874 - DNA, 20 bp, Artificial
  CRISPR gRNA sequence
taagccaagccacacccaat

SEQ ID NO: 776875 - DNA, 20 bp, Artificial
  CRISPR gRNA sequence
ccccagagccttgctgctgc

SEQ ID NO: 776876 - DNA, 20 bp, Artificial
  CRISPR gRNA sequence
cccagagccttgctgctgca

SEQ ID NO: 776877 - DNA, 20 bp, Artificial
  CRISPR gRNA sequence
gctgctgcagccatcaaaaa

SEQ ID NO: 776878 - DNA, 20 bp, Artificial
  CRISPR gRNA sequence
ctgctgcagccatcaaaaaa

SEQ ID NO: 776879 - DNA, 20 bp, Artificial
  CRISPR gRNA sequence
ctgcagccatcaaaaaagac

SEQ ID NO: 776880 - DNA, 20 bp, Artificial
  CRISPR gRNA sequence
cagccatcaaaaaagactct

SEQ ID NO: 776881 - DNA, 20 bp, Artificial
  CRISPR gRNA sequence
tttcttgttgagattactaa

SEQ ID NO: 776882 - DNA, 20 bp, Artificial
  CRISPR gRNA sequence
tcttgttgagattactaaga

SEQ ID NO: 776883 - DNA, 20 bp, Artificial
  CRISPR gRNA sequence
cttgttgagattactaagaa

SEQ ID NO: 776884 - DNA, 20 bp, Artificial
  CRISPR gRNA sequence
ttgttgagattactaagaag

SEQ ID NO: 776885 - DNA, 20 bp, Artificial
  CRISPR gRNA sequence
gttgagattactaagaagga

SEQ ID NO: 776886 - DNA, 20 bp, Artificial
  CRISPR gRNA sequence
ttgagattactaagaaggat

SEQ ID NO: 776887 - DNA, 20 bp, Artificial
  CRISPR gRNA sequence
agattactaagaaggatacg

SEQ ID NO: 776888 - DNA, 20 bp, Artificial
  CRISPR gRNA sequence
ctaagaaggatacggtctgg

SEQ ID NO: 776889 - DNA, 20 bp, Artificial
  CRISPR gRNA sequence
agaaggatacggtctgggac

SEQ ID NO: 776890 - DNA, 20 bp, Artificial
  CRISPR gRNA sequence
ggactgttagcaataaatgt

SEQ ID NO: 776891 - DNA, 20 bp, Artificial
  CRISPR gRNA sequence
ttagcaataaatgtgtctgc

SEQ ID NO: 776892 - DNA, 20 bp, Artificial
  CRISPR gRNA sequence
gcaataaatgtgtctgctac

SEQ ID NO: 776893 - DNA, 20 bp, Artificial
  CRISPR gRNA sequence
ctaccaacaatctaaagaat

SEQ ID NO: 776894 - DNA, 20 bp, Artificial
  CRISPR gRNA sequence
ccaacaatctaaagaattga

SEQ ID NO: 776895 - DNA, 20 bp, Artificial
  CRISPR gRNA sequence
aagaattgatccaaacaaat

SEQ ID NO: 776896 - DNA, 20 bp, Artificial
  CRISPR gRNA sequence
atccaaacaaatgaacagag

SEQ ID NO: 776897 - DNA, 20 bp, Artificial
  CRISPR gRNA sequence
gaaggatatagagccctaaa

SEQ ID NO: 776898 - DNA, 20 bp, Artificial
  CRISPR gRNA sequence
aaaccatcatttaagcccct

SEQ ID NO: 776899 - DNA, 20 bp, Artificial
  CRISPR gRNA sequence
aagcccctattcctgaagca

SEQ ID NO: 776900 - DNA, 20 bp, Artificial
  CRISPR gRNA sequence
agcccctattcctgaagcaa

SEQ ID NO: 776901 - DNA, 20 bp, Artificial
  CRISPR gRNA sequence
ttcctgaagcaagctgcaca

SEQ ID NO: 776902 - DNA, 20 bp, Artificial
  CRISPR gRNA sequence
ctgaagcaagctgcacacat

SEQ ID NO: 776903 - DNA, 20 bp, Artificial
  CRISPR gRNA sequence
aagcaagctgcacacataga

SEQ ID NO: 776904 - DNA, 20 bp, Artificial
  CRISPR gRNA sequence
cacacatagactgcctaggt

SEQ ID NO: 776905 - DNA, 20 bp, Artificial
  CRISPR gRNA sequence
cctaggtacttaaacaagtc

SEQ ID NO: 776906 - DNA, 20 bp, Artificial
  CRISPR gRNA sequence
ggtacttaaacaagtctttt

SEQ ID NO: 776907 - DNA, 20 bp, Artificial
  CRISPR gRNA sequence
aaacaagtcttttttttttt

SEQ ID NO: 776908 - DNA, 20 bp, Artificial
  CRISPR gRNA sequence
aacaagtctttttttttttt

SEQ ID NO: 776909 - DNA, 20 bp, Artificial
  CRISPR gRNA sequence
ttttttttttcttaaatgtg

SEQ ID NO: 776910 - DNA, 20 bp, Artificial
  CRISPR gRNA sequence
tttttttttcttaaatgtgc

SEQ ID NO: 776911 - DNA, 20 bp, Artificial
  CRISPR gRNA sequence
ttttttttcttaaatgtgct

SEQ ID NO: 776912 - DNA, 20 bp, Artificial
  CRISPR gRNA sequence
tttttttcttaaatgtgctt

SEQ ID NO: 776913 - DNA, 20 bp, Artificial
  CRISPR gRNA sequence
ttttttcttaaatgtgcttg

SEQ ID NO: 776914 - DNA, 20 bp, Artificial
  CRISPR gRNA sequence
tttttcttaaatgtgcttga

SEQ ID NO: 776915 - DNA, 20 bp, Artificial
  CRISPR gRNA sequence
ttttcttaaatgtgcttgag

SEQ ID NO: 776916 - DNA, 20 bp, Artificial
  CRISPR gRNA sequence
tttcttaaatgtgcttgagc

SEQ ID NO: 776917 - DNA, 20 bp, Artificial
  CRISPR gRNA sequence
ttcttaaatgtgcttgagct

SEQ ID NO: 776918 - DNA, 20 bp, Artificial
  CRISPR gRNA sequence
tcttaaatgtgcttgagcta

SEQ ID NO: 776919 - DNA, 20 bp, Artificial
  CRISPR gRNA sequence
cttaaatgtgcttgagctag

SEQ ID NO: 776920 - DNA, 20 bp, Artificial
  CRISPR gRNA sequence
ttaaatgtgcttgagctagt

SEQ ID NO: 776921 - DNA, 20 bp, Artificial
  CRISPR gRNA sequence
aaatgtgcttgagctagttt

SEQ ID NO: 776922 - DNA, 20 bp, Artificial
  CRISPR gRNA sequence
aatgtgcttgagctagtttt

SEQ ID NO: 776923 - DNA, 20 bp, Artificial
  CRISPR gRNA sequence
gagctagttttctattatct

SEQ ID NO: 776924 - DNA, 20 bp, Artificial
  CRISPR gRNA sequence
agctagttttctattatctg

SEQ ID NO: 776925 - DNA, 20 bp, Artificial
  CRISPR gRNA sequence
gttttctattatctgtaact

SEQ ID NO: 776926 - DNA, 20 bp, Artificial
  CRISPR gRNA sequence
tctattatctgtaactgaag

SEQ ID NO: 776927 - DNA, 20 bp, Artificial
  CRISPR gRNA sequence
ctattatctgtaactgaagg

SEQ ID NO: 776928 - DNA, 20 bp, Artificial
  CRISPR gRNA sequence
tattatctgtaactgaagga

SEQ ID NO: 776929 - DNA, 20 bp, Artificial
  CRISPR gRNA sequence
ttatctgtaactgaaggact

SEQ ID NO: 776930 - DNA, 20 bp, Artificial
  CRISPR gRNA sequence
tctgtaactgaaggactcct

SEQ ID NO: 776931 - DNA, 20 bp, Artificial
  CRISPR gRNA sequence
taactgaaggactcctcaaa

SEQ ID NO: 776932 - DNA, 20 bp, Artificial
  CRISPR gRNA sequence
aaggactcctcaaatatgtc

SEQ ID NO: 776933 - DNA, 20 bp, Artificial
  CRISPR gRNA sequence
ctcaaatatgtctgctatat

SEQ ID NO: 776934 - DNA, 20 bp, Artificial
  CRISPR gRNA sequence
aaatatgtctgctatatctt

SEQ ID NO: 776935 - DNA, 20 bp, Artificial
  CRISPR gRNA sequence
ctatatcttcactatctcca

SEQ ID NO: 776936 - DNA, 20 bp, Artificial
  CRISPR gRNA sequence
tatcttcactatctccattt

SEQ ID NO: 776937 - DNA, 20 bp, Artificial
  CRISPR gRNA sequence
cactatctccatttctctct

SEQ ID NO: 776938 - DNA, 20 bp, Artificial
  CRISPR gRNA sequence
actatctccatttctctcta

SEQ ID NO: 776939 - DNA, 20 bp, Artificial
  CRISPR gRNA sequence
tctccatttctctctacccc

SEQ ID NO: 776940 - DNA, 20 bp, Artificial
  CRISPR gRNA sequence
catttctctctacccctgct

SEQ ID NO: 776941 - DNA, 20 bp, Artificial
  CRISPR gRNA sequence
ctctctacccctgcttctct

SEQ ID NO: 776942 - DNA, 20 bp, Artificial
  CRISPR gRNA sequence
tctctacccctgcttctctt

SEQ ID NO: 776943 - DNA, 20 bp, Artificial
  CRISPR gRNA sequence
tctacccctgcttctcttcc

SEQ ID NO: 776944 - DNA, 20 bp, Artificial
  CRISPR gRNA sequence
tacccctgcttctcttcctg

SEQ ID NO: 776945 - DNA, 20 bp, Artificial
  CRISPR gRNA sequence
cccctgcttctcttcctggt

SEQ ID NO: 776946 - DNA, 20 bp, Artificial
  CRISPR gRNA sequence
cttctcttcctggtcttcca

SEQ ID NO: 776947 - DNA, 20 bp, Artificial
  CRISPR gRNA sequence
ctcttcctggtcttccaagt

SEQ ID NO: 776948 - DNA, 20 bp, Artificial
  CRISPR gRNA sequence
tcttcctggtcttccaagtc

SEQ ID NO: 776949 - DNA, 20 bp, Artificial
  CRISPR gRNA sequence
ttcctggtcttccaagtcac

SEQ ID NO: 776950 - DNA, 20 bp, Artificial
  CRISPR gRNA sequence
cctggtcttccaagtcacca

SEQ ID NO: 776951 - DNA, 20 bp, Artificial
  CRISPR gRNA sequence
ctggtcttccaagtcaccat

SEQ ID NO: 776952 - DNA, 20 bp, Artificial
  CRISPR gRNA sequence
gtcttccaagtcaccatcat

SEQ ID NO: 776953 - DNA, 20 bp, Artificial
  CRISPR gRNA sequence
ccaagtcaccatcatctctt

SEQ ID NO: 776954 - DNA, 20 bp, Artificial
  CRISPR gRNA sequence
caagtcaccatcatctcttg

SEQ ID NO: 776955 - DNA, 20 bp, Artificial
  CRISPR gRNA sequence
ttgcctggataactataaaa

SEQ ID NO: 776956 - DNA, 20 bp, Artificial
  CRISPR gRNA sequence
gcctggataactataaaagc

SEQ ID NO: 776957 - DNA, 20 bp, Artificial
  CRISPR gRNA sequence
cctggataactataaaagcc

SEQ ID NO: 776958 - DNA, 20 bp, Artificial
  CRISPR gRNA sequence
gataactataaaagcctctt

SEQ ID NO: 776959 - DNA, 20 bp, Artificial
  CRISPR gRNA sequence
taaaagcctcttcaccagtc

SEQ ID NO: 776960 - DNA, 20 bp, Artificial
  CRISPR gRNA sequence
ttcaccagtctgttcacctt

SEQ ID NO: 776961 - DNA, 20 bp, Artificial
  CRISPR gRNA sequence
caccagtctgttcaccttct

SEQ ID NO: 776962 - DNA, 20 bp, Artificial
  CRISPR gRNA sequence
accagtctgttcaccttctc

SEQ ID NO: 776963 - DNA, 20 bp, Artificial
  CRISPR gRNA sequence
ttcaccttctctagttcccc

SEQ ID NO: 776964 - DNA, 20 bp, Artificial
  CRISPR gRNA sequence
accttctctagttcccccac

SEQ ID NO: 776965 - DNA, 20 bp, Artificial
  CRISPR gRNA sequence
ctctagttcccccacccaat

SEQ ID NO: 776966 - DNA, 20 bp, Artificial
  CRISPR gRNA sequence
tctagttcccccacccaatt

SEQ ID NO: 776967 - DNA, 20 bp, Artificial
  CRISPR gRNA sequence
tagttcccccacccaattct

SEQ ID NO: 776968 - DNA, 20 bp, Artificial
  CRISPR gRNA sequence
gttcccccacccaattctgt

SEQ ID NO: 776969 - DNA, 20 bp, Artificial
  CRISPR gRNA sequence
ccccacccaattctgttctc

SEQ ID NO: 776970 - DNA, 20 bp, Artificial
  CRISPR gRNA sequence
tgttctccaatctatactct

SEQ ID NO: 776971 - DNA, 20 bp, Artificial
  CRISPR gRNA sequence
ttctccaatctatactctat

SEQ ID NO: 776972 - DNA, 20 bp, Artificial
  CRISPR gRNA sequence
tccaatctatactctataca

SEQ ID NO: 776973 - DNA, 20 bp, Artificial
  CRISPR gRNA sequence
caatctatactctatacaac

SEQ ID NO: 776974 - DNA, 20 bp, Artificial
  CRISPR gRNA sequence
tactctatacaacagccaga

SEQ ID NO: 776975 - DNA, 20 bp, Artificial
  CRISPR gRNA sequence
tatacaacagccagaataat

SEQ ID NO: 776976 - DNA, 20 bp, Artificial
  CRISPR gRNA sequence
tacaacagccagaataattg

SEQ ID NO: 776977 - DNA, 20 bp, Artificial
  CRISPR gRNA sequence
ctattaatataaaagcataa

SEQ ID NO: 776978 - DNA, 20 bp, Artificial
  CRISPR gRNA sequence
ttaatataaaagcataaatt

SEQ ID NO: 776979 - DNA, 20 bp, Artificial
  CRISPR gRNA sequence
atataaaagcataaattata

SEQ ID NO: 776980 - DNA, 20 bp, Artificial
  CRISPR gRNA sequence
tatcactgccttcaatagtt

SEQ ID NO: 776981 - DNA, 20 bp, Artificial
  CRISPR gRNA sequence
ccttcaatagttaatcatag

SEQ ID NO: 776982 - DNA, 20 bp, Artificial
  CRISPR gRNA sequence
caatagttaatcatagggct

SEQ ID NO: 776983 - DNA, 20 bp, Artificial
  CRISPR gRNA sequence
aatagttaatcatagggctg

SEQ ID NO: 776984 - DNA, 20 bp, Artificial
  CRISPR gRNA sequence
atcatagggctgttcacttt

SEQ ID NO: 776985 - DNA, 20 bp, Artificial
  CRISPR gRNA sequence
ttcactttccttgtgataag

SEQ ID NO: 776986 - DNA, 20 bp, Artificial
  CRISPR gRNA sequence
actttccttgtgataagatc

SEQ ID NO: 776987 - DNA, 20 bp, Artificial
  CRISPR gRNA sequence
tccttgtgataagatcgcag

SEQ ID NO: 776988 - DNA, 20 bp, Artificial
  CRISPR gRNA sequence
ccttgtgataagatcgcagc

SEQ ID NO: 776989 - DNA, 20 bp, Artificial
  CRISPR gRNA sequence
cttgtgataagatcgcagct

SEQ ID NO: 776990 - DNA, 20 bp, Artificial
  CRISPR gRNA sequence
gtgataagatcgcagctcct

SEQ ID NO: 776991 - DNA, 20 bp, Artificial
  CRISPR gRNA sequence
tgataagatcgcagctcctc

SEQ ID NO: 776992 - DNA, 20 bp, Artificial
  CRISPR gRNA sequence
ctccatagcctacagagccc

SEQ ID NO: 776993 - DNA, 20 bp, Artificial
  CRISPR gRNA sequence
catagcctacagagccccat

SEQ ID NO: 776994 - DNA, 20 bp, Artificial
  CRISPR gRNA sequence
cagagccccatctgccctgg

SEQ ID NO: 776995 - DNA, 20 bp, Artificial
  CRISPR gRNA sequence
ccctggccctgcccacctgc

SEQ ID NO: 776996 - DNA, 20 bp, Artificial
  CRISPR gRNA sequence
gccctgcccacctgcccagc

SEQ ID NO: 776997 - DNA, 20 bp, Artificial
  CRISPR gRNA sequence
cccacctgcccagcctcacc

SEQ ID NO: 776998 - DNA, 20 bp, Artificial
  CRISPR gRNA sequence
cccagcctcacctcttccta

SEQ ID NO: 776999 - DNA, 20 bp, Artificial
  CRISPR gRNA sequence
acctcttcctacttgcccct

SEQ ID NO: 777000 - DNA, 20 bp, Artificial
  CRISPR gRNA sequence
ttcctacttgcccctcacca

SEQ ID NO: 777001 - DNA, 20 bp, Artificial
  CRISPR gRNA sequence
cctacttgcccctcaccaca

SEQ ID NO: 777002 - DNA, 20 bp, Artificial
  CRISPR gRNA sequence
ctacttgcccctcaccacag

SEQ ID NO: 777003 - DNA, 20 bp, Artificial
  CRISPR gRNA sequence
cttgcccctcaccacagtgg

SEQ ID NO: 777004 - DNA, 20 bp, Artificial
  CRISPR gRNA sequence
gcccctcaccacagtgggct

SEQ ID NO: 777005 - DNA, 20 bp, Artificial
  CRISPR gRNA sequence
cccctcaccacagtgggctg

SEQ ID NO: 777006 - DNA, 20 bp, Artificial
  CRISPR gRNA sequence
accacagtgggctgcttcca

SEQ ID NO: 777007 - DNA, 20 bp, Artificial
  CRISPR gRNA sequence
cttccagttcctacaacata

SEQ ID NO: 777008 - DNA, 20 bp, Artificial
  CRISPR gRNA sequence
ccagttcctacaacatagga

SEQ ID NO: 777009 - DNA, 20 bp, Artificial
  CRISPR gRNA sequence
cagttcctacaacataggac

SEQ ID NO: 777010 - DNA, 20 bp, Artificial
  CRISPR gRNA sequence
ctacaacataggactccctt

SEQ ID NO: 777011 - DNA, 20 bp, Artificial
  CRISPR gRNA sequence
caacataggactccctttcc

SEQ ID NO: 777012 - DNA, 20 bp, Artificial
  CRISPR gRNA sequence
cctttcctacctcacagtgt

SEQ ID NO: 777013 - DNA, 20 bp, Artificial
  CRISPR gRNA sequence
tcctacctcacagtgttgct

SEQ ID NO: 777014 - DNA, 20 bp, Artificial
  CRISPR gRNA sequence
cctacctcacagtgttgctg

SEQ ID NO: 777015 - DNA, 20 bp, Artificial
  CRISPR gRNA sequence
ctacctcacagtgttgctgc

SEQ ID NO: 777016 - DNA, 20 bp, Artificial
  CRISPR gRNA sequence
cctcacagtgttgctgcaaa

SEQ ID NO: 777017 - DNA, 20 bp, Artificial
  CRISPR gRNA sequence
acagtgttgctgcaaataca

SEQ ID NO: 777018 - DNA, 20 bp, Artificial
  CRISPR gRNA sequence
ctgcaaatacagtttcttct

SEQ ID NO: 777019 - DNA, 20 bp, Artificial
  CRISPR gRNA sequence
caaatacagtttcttcttcc

SEQ ID NO: 777020 - DNA, 20 bp, Artificial
  CRISPR gRNA sequence
cttcttcctagatgacatgg

SEQ ID NO: 777021 - DNA, 20 bp, Artificial
  CRISPR gRNA sequence
ttcttcctagatgacatggg

SEQ ID NO: 777022 - DNA, 20 bp, Artificial
  CRISPR gRNA sequence
cttcctagatgacatgggtg

SEQ ID NO: 777023 - DNA, 20 bp, Artificial
  CRISPR gRNA sequence
ttcctagatgacatgggtgc

SEQ ID NO: 777024 - DNA, 20 bp, Artificial
  CRISPR gRNA sequence
cctagatgacatgggtgctt

SEQ ID NO: 777025 - DNA, 20 bp, Artificial
  CRISPR gRNA sequence
ctagatgacatgggtgcttt

SEQ ID NO: 777026 - DNA, 20 bp, Artificial
  CRISPR gRNA sequence
gatgacatgggtgctttaag

SEQ ID NO: 777027 - DNA, 20 bp, Artificial
  CRISPR gRNA sequence
taagactcatgttgaaattt

SEQ ID NO: 777028 - DNA, 20 bp, Artificial
  CRISPR gRNA sequence
aagactcatgttgaaattta

SEQ ID NO: 777029 - DNA, 20 bp, Artificial
  CRISPR gRNA sequence
agactcatgttgaaatttaa

SEQ ID NO: 777030 - DNA, 20 bp, Artificial
  CRISPR gRNA sequence
atgttgaaatttaattgcca

SEQ ID NO: 777031 - DNA, 20 bp, Artificial
  CRISPR gRNA sequence
aaatttaattgccactgtaa

SEQ ID NO: 777032 - DNA, 20 bp, Artificial
  CRISPR gRNA sequence
aattgccactgtaacagtat

SEQ ID NO: 777033 - DNA, 20 bp, Artificial
  CRISPR gRNA sequence
attgccactgtaacagtatt

SEQ ID NO: 777034 - DNA, 20 bp, Artificial
  CRISPR gRNA sequence
ccactgtaacagtattaaga

SEQ ID NO: 777035 - DNA, 20 bp, Artificial
  CRISPR gRNA sequence
taacagtattaagaggtggg

SEQ ID NO: 777036 - DNA, 20 bp, Artificial
  CRISPR gRNA sequence
agaggtggggcctgtaagaa

SEQ ID NO: 777037 - DNA, 20 bp, Artificial
  CRISPR gRNA sequence
taagaagtgaagagattaat

SEQ ID NO: 777038 - DNA, 20 bp, Artificial
  CRISPR gRNA sequence
atgctgttatcacaggaaaa

SEQ ID NO: 777039 - DNA, 20 bp, Artificial
  CRISPR gRNA sequence
ttatcacaggaaaagtgggc

SEQ ID NO: 777040 - DNA, 20 bp, Artificial
  CRISPR gRNA sequence
tcacaggaaaagtgggctcc

SEQ ID NO: 777041 - DNA, 20 bp, Artificial
  CRISPR gRNA sequence
ctgataaaagcgtaagtgct

SEQ ID NO: 777042 - DNA, 20 bp, Artificial
  CRISPR gRNA sequence
ataaaagcgtaagtgctgcc

SEQ ID NO: 777043 - DNA, 20 bp, Artificial
  CRISPR gRNA sequence
cccccatactgtctgtactg

SEQ ID NO: 777044 - DNA, 20 bp, Artificial
  CRISPR gRNA sequence
tctgtactgcacgctcacat

SEQ ID NO: 777045 - DNA, 20 bp, Artificial
  CRISPR gRNA sequence
tactgcacgctcacatgccc

SEQ ID NO: 777046 - DNA, 20 bp, Artificial
  CRISPR gRNA sequence
cacgctcacatgcccttcca

SEQ ID NO: 777047 - DNA, 20 bp, Artificial
  CRISPR gRNA sequence
acatgcccttccacaatagg

SEQ ID NO: 777048 - DNA, 20 bp, Artificial
  CRISPR gRNA sequence
ccacaataggataatgcagc

SEQ ID NO: 777049 - DNA, 20 bp, Artificial
  CRISPR gRNA sequence
cacaataggataatgcagca

SEQ ID NO: 777050 - DNA, 20 bp, Artificial
  CRISPR gRNA sequence
gccagatgccagcaccatgc

SEQ ID NO: 777051 - DNA, 20 bp, Artificial
  CRISPR gRNA sequence
ggacttcccagtctccagaa

SEQ ID NO: 777052 - DNA, 20 bp, Artificial
  CRISPR gRNA sequence
gacttcccagtctccagaac

SEQ ID NO: 777053 - DNA, 20 bp, Artificial
  CRISPR gRNA sequence
cccagtctccagaactacaa

SEQ ID NO: 777054 - DNA, 20 bp, Artificial
  CRISPR gRNA sequence
ccagtctccagaactacaag

SEQ ID NO: 777055 - DNA, 20 bp, Artificial
  CRISPR gRNA sequence
cagaactacaagccaaataa

SEQ ID NO: 777056 - DNA, 20 bp, Artificial
  CRISPR gRNA sequence
caagccaaataacctttttt

SEQ ID NO: 777057 - DNA, 20 bp, Artificial
  CRISPR gRNA sequence
tttttctttatatattaccc

SEQ ID NO: 777058 - DNA, 20 bp, Artificial
  CRISPR gRNA sequence
ttttctttatatattaccca

SEQ ID NO: 777059 - DNA, 20 bp, Artificial
  CRISPR gRNA sequence
tttctttatatattacccag

SEQ ID NO: 777060 - DNA, 20 bp, Artificial
  CRISPR gRNA sequence
ttctttatatattacccagg

SEQ ID NO: 777061 - DNA, 20 bp, Artificial
  CRISPR gRNA sequence
tctttatatattacccaggc

SEQ ID NO: 777062 - DNA, 20 bp, Artificial
  CRISPR gRNA sequence
ctttatatattacccaggct

SEQ ID NO: 777063 - DNA, 20 bp, Artificial
  CRISPR gRNA sequence
tttatatattacccaggctg

SEQ ID NO: 777064 - DNA, 20 bp, Artificial
  CRISPR gRNA sequence
tatatattacccaggctgtg

SEQ ID NO: 777065 - DNA, 20 bp, Artificial
  CRISPR gRNA sequence
atatattacccaggctgtgg

SEQ ID NO: 777066 - DNA, 20 bp, Artificial
  CRISPR gRNA sequence
tatattacccaggctgtggt

SEQ ID NO: 777067 - DNA, 20 bp, Artificial
  CRISPR gRNA sequence
cccaggctgtggtattctgt

SEQ ID NO: 777068 - DNA, 20 bp, Artificial
  CRISPR gRNA sequence
tggtattctgttatagcagt

SEQ ID NO: 777069 - DNA, 20 bp, Artificial
  CRISPR gRNA sequence
tgttatagcagtaaaacatg

SEQ ID NO: 777070 - DNA, 20 bp, Artificial
  CRISPR gRNA sequence
ttatagcagtaaaacatgga

SEQ ID NO: 777071 - DNA, 20 bp, Artificial
  CRISPR gRNA sequence
tagcagtaaaacatggacta

SEQ ID NO: 777072 - DNA, 20 bp, Artificial
  CRISPR gRNA sequence
agataaaaggtaacacctcc

SEQ ID NO: 777073 - DNA, 20 bp, Artificial
  CRISPR gRNA sequence
catattctgagggtcacctt

SEQ ID NO: 777074 - DNA, 20 bp, Artificial
  CRISPR gRNA sequence
tgagggtcaccttgacagaa

SEQ ID NO: 777075 - DNA, 20 bp, Artificial
  CRISPR gRNA sequence
agggtcaccttgacagaaaa

SEQ ID NO: 777076 - DNA, 20 bp, Artificial
  CRISPR gRNA sequence
gacagaaaagccaggtaaga

SEQ ID NO: 777077 - DNA, 20 bp, Artificial
  CRISPR gRNA sequence
acagaaaagccaggtaagag

SEQ ID NO: 777078 - DNA, 20 bp, Artificial
  CRISPR gRNA sequence
ccactctaagaaggaccctg

SEQ ID NO: 777079 - DNA, 20 bp, Artificial
  CRISPR gRNA sequence
taagaaggaccctgtcattc

SEQ ID NO: 777080 - DNA, 20 bp, Artificial
  CRISPR gRNA sequence
agaaggaccctgtcattcat

SEQ ID NO: 777081 - DNA, 20 bp, Artificial
  CRISPR gRNA sequence
tcattcattgcacccagtct

SEQ ID NO: 777082 - DNA, 20 bp, Artificial
  CRISPR gRNA sequence
attgcacccagtctgttttc

SEQ ID NO: 777083 - DNA, 20 bp, Artificial
  CRISPR gRNA sequence
cacccagtctgttttcttca

SEQ ID NO: 777084 - DNA, 20 bp, Artificial
  CRISPR gRNA sequence
ttttcttcatgatatatgag

SEQ ID NO: 777085 - DNA, 20 bp, Artificial
  CRISPR gRNA sequence
tcttcatgatatatgagaac

SEQ ID NO: 777086 - DNA, 20 bp, Artificial
  CRISPR gRNA sequence
cttcatgatatatgagaacc

SEQ ID NO: 777087 - DNA, 20 bp, Artificial
  CRISPR gRNA sequence
ttcatgatatatgagaacct

SEQ ID NO: 777088 - DNA, 20 bp, Artificial
  CRISPR gRNA sequence
catgatatatgagaacctcc

SEQ ID NO: 777089 - DNA, 20 bp, Artificial
  CRISPR gRNA sequence
atgatatatgagaacctccc

SEQ ID NO: 777090 - DNA, 20 bp, Artificial
  CRISPR gRNA sequence
cctgagaaggaaccacatct

SEQ ID NO: 777091 - DNA, 20 bp, Artificial
  CRISPR gRNA sequence
agaaggaaccacatctgctt

SEQ ID NO: 777092 - DNA, 20 bp, Artificial
  CRISPR gRNA sequence
ctttatttaactattgcatc

SEQ ID NO: 777093 - DNA, 20 bp, Artificial
  CRISPR gRNA sequence
tatttaactattgcatcctt

SEQ ID NO: 777094 - DNA, 20 bp, Artificial
  CRISPR gRNA sequence
atttaactattgcatcctta

SEQ ID NO: 777095 - DNA, 20 bp, Artificial
  CRISPR gRNA sequence
tttaactattgcatccttaa

SEQ ID NO: 777096 - DNA, 20 bp, Artificial
  CRISPR gRNA sequence
aactattgcatccttaattc

SEQ ID NO: 777097 - DNA, 20 bp, Artificial
  CRISPR gRNA sequence
actattgcatccttaattct

SEQ ID NO: 777098 - DNA, 20 bp, Artificial
  CRISPR gRNA sequence
ttgcatccttaattctagca

SEQ ID NO: 777099 - DNA, 20 bp, Artificial
  CRISPR gRNA sequence
catccttaattctagcaatg

SEQ ID NO: 777100 - DNA, 20 bp, Artificial
  CRISPR gRNA sequence
aattctagcaatggcttggc

SEQ ID NO: 777101 - DNA, 20 bp, Artificial
  CRISPR gRNA sequence
attctagcaatggcttggca

SEQ ID NO: 777102 - DNA, 20 bp, Artificial
  CRISPR gRNA sequence
tagcaatggcttggcacata

SEQ ID NO: 777103 - DNA, 20 bp, Artificial
  CRISPR gRNA sequence
gcaatggcttggcacataat

SEQ ID NO: 777104 - DNA, 20 bp, Artificial
  CRISPR gRNA sequence
ggcacataatgggttctcaa

SEQ ID NO: 777105 - DNA, 20 bp, Artificial
  CRISPR gRNA sequence
gcacataatgggttctcaat

SEQ ID NO: 777106 - DNA, 20 bp, Artificial
  CRISPR gRNA sequence
tcaatgcacgattcaatgag

SEQ ID NO: 777107 - DNA, 20 bp, Artificial
  CRISPR gRNA sequence
aatgcacgattcaatgagtg

SEQ ID NO: 777108 - DNA, 20 bp, Artificial
  CRISPR gRNA sequence
aatgagtgaacgaatgaatg

SEQ ID NO: 777109 - DNA, 20 bp, Artificial
  CRISPR gRNA sequence
agatagagagatggatagat

SEQ ID NO: 777110 - DNA, 20 bp, Artificial
  CRISPR gRNA sequence
gatagagagatggatagata

SEQ ID NO: 777111 - DNA, 20 bp, Artificial
  CRISPR gRNA sequence
gtatatggggaaaggatctg

SEQ ID NO: 777112 - DNA, 20 bp, Artificial
  CRISPR gRNA sequence
tatatggggaaaggatctgg

SEQ ID NO: 777113 - DNA, 20 bp, Artificial
  CRISPR gRNA sequence
gatgcctgagagtgaatgca

SEQ ID NO: 777114 - DNA, 20 bp, Artificial
  CRISPR gRNA sequence
agagtgaatgcaactctgga

SEQ ID NO: 777115 - DNA, 20 bp, Artificial
  CRISPR gRNA sequence
tggagtgtcagaataagggt

SEQ ID NO: 777116 - DNA, 20 bp, Artificial
  CRISPR gRNA sequence
gagtgtcagaataagggtga

SEQ ID NO: 777117 - DNA, 20 bp, Artificial
  CRISPR gRNA sequence
gctactgttttctacttgat

SEQ ID NO: 777118 - DNA, 20 bp, Artificial
  CRISPR gRNA sequence
ctactgttttctacttgata

SEQ ID NO: 777119 - DNA, 20 bp, Artificial
  CRISPR gRNA sequence
ctgttttctacttgatacac

SEQ ID NO: 777120 - DNA, 20 bp, Artificial
  CRISPR gRNA sequence
ttttctacttgatacacttc

SEQ ID NO: 777121 - DNA, 20 bp, Artificial
  CRISPR gRNA sequence
tctacttgatacacttctct

SEQ ID NO: 777122 - DNA, 20 bp, Artificial
  CRISPR gRNA sequence
ctacttgatacacttctctg

SEQ ID NO: 777123 - DNA, 20 bp, Artificial
  CRISPR gRNA sequence
tacttgatacacttctctgt

SEQ ID NO: 777124 - DNA, 20 bp, Artificial
  CRISPR gRNA sequence
cttgatacacttctctgttt

SEQ ID NO: 777125 - DNA, 20 bp, Artificial
  CRISPR gRNA sequence
gatacacttctctgttttta

SEQ ID NO: 777126 - DNA, 20 bp, Artificial
  CRISPR gRNA sequence
atacacttctctgtttttaa

SEQ ID NO: 777127 - DNA, 20 bp, Artificial
  CRISPR gRNA sequence
ctctgtttttaactatgaac

SEQ ID NO: 777128 - DNA, 20 bp, Artificial
  CRISPR gRNA sequence
tctgtttttaactatgaaca

SEQ ID NO: 777129 - DNA, 20 bp, Artificial
  CRISPR gRNA sequence
tgtttttaactatgaacatg

SEQ ID NO: 777130 - DNA, 20 bp, Artificial
  CRISPR gRNA sequence
tttttaactatgaacatgta

SEQ ID NO: 777131 - DNA, 20 bp, Artificial
  CRISPR gRNA sequence
ttaactatgaacatgtaaat

SEQ ID NO: 777132 - DNA, 20 bp, Artificial
  CRISPR gRNA sequence
taactatgaacatgtaaatt

SEQ ID NO: 777133 - DNA, 20 bp, Artificial
  CRISPR gRNA sequence
aactatgaacatgtaaattc

SEQ ID NO: 777134 - DNA, 20 bp, Artificial
  CRISPR gRNA sequence
actatgaacatgtaaattct

SEQ ID NO: 777135 - DNA, 20 bp, Artificial
  CRISPR gRNA sequence
tgaacatgtaaattcttttg

SEQ ID NO: 777136 - DNA, 20 bp, Artificial
  CRISPR gRNA sequence
ttttgcaattaacgaaaaaa

SEQ ID NO: 777137 - DNA, 20 bp, Artificial
  CRISPR gRNA sequence
ttgcaattaacgaaaaaagg

SEQ ID NO: 777138 - DNA, 20 bp, Artificial
  CRISPR gRNA sequence
tgcaattaacgaaaaaagga

SEQ ID NO: 777139 - DNA, 20 bp, Artificial
  CRISPR gRNA sequence
gcaattaacgaaaaaaggaa

SEQ ID NO: 777140 - DNA, 20 bp, Artificial
  CRISPR gRNA sequence
caattaacgaaaaaaggaaa

SEQ ID NO: 777141 - DNA, 20 bp, Artificial
  CRISPR gRNA sequence
acgaaaaaaggaaaacagca

SEQ ID NO: 777142 - DNA, 20 bp, Artificial
  CRISPR gRNA sequence
gactttagaccaggctctgt

SEQ ID NO: 777143 - DNA, 20 bp, Artificial
  CRISPR gRNA sequence
tagaccaggctctgtcactc

SEQ ID NO: 777144 - DNA, 20 bp, Artificial
  CRISPR gRNA sequence
agaccaggctctgtcactca

SEQ ID NO: 777145 - DNA, 20 bp, Artificial
  CRISPR gRNA sequence
gaccaggctctgtcactcac

SEQ ID NO: 777146 - DNA, 20 bp, Artificial
  CRISPR gRNA sequence
tgtcactcacttgccaggct

SEQ ID NO: 777147 - DNA, 20 bp, Artificial
  CRISPR gRNA sequence
tcactcacttgccaggctcc

SEQ ID NO: 777148 - DNA, 20 bp, Artificial
  CRISPR gRNA sequence
acttgccaggctccctaggc

SEQ ID NO: 777149 - DNA, 20 bp, Artificial
  CRISPR gRNA sequence
gccaggctccctaggccaaa

SEQ ID NO: 777150 - DNA, 20 bp, Artificial
  CRISPR gRNA sequence
ccaggctccctaggccaaac

SEQ ID NO: 777151 - DNA, 20 bp, Artificial
  CRISPR gRNA sequence
cctaggccaaaccccttgcc

SEQ ID NO: 777152 - DNA, 20 bp, Artificial
  CRISPR gRNA sequence
ggccaaaccccttgcctttc

SEQ ID NO: 777153 - DNA, 20 bp, Artificial
  CRISPR gRNA sequence
gcctttctgggtcttcatct

SEQ ID NO: 777154 - DNA, 20 bp, Artificial
  CRISPR gRNA sequence
cctttctgggtcttcatctc

SEQ ID NO: 777155 - DNA, 20 bp, Artificial
  CRISPR gRNA sequence
tctgggtcttcatctcctca

SEQ ID NO: 777156 - DNA, 20 bp, Artificial
  CRISPR gRNA sequence
ctgggtcttcatctcctcaa

SEQ ID NO: 777157 - DNA, 20 bp, Artificial
  CRISPR gRNA sequence
tgggtcttcatctcctcaac

SEQ ID NO: 777158 - DNA, 20 bp, Artificial
  CRISPR gRNA sequence
ggtcttcatctcctcaacca

SEQ ID NO: 777159 - DNA, 20 bp, Artificial
  CRISPR gRNA sequence
catctcctcaaccatcaaag

SEQ ID NO: 777160 - DNA, 20 bp, Artificial
  CRISPR gRNA sequence
atctcctcaaccatcaaagg

SEQ ID NO: 777161 - DNA, 20 bp, Artificial
  CRISPR gRNA sequence
ctcaaccatcaaagggtcct

SEQ ID NO: 777162 - DNA, 20 bp, Artificial
  CRISPR gRNA sequence
aaccatcaaagggtcctgac

SEQ ID NO: 777163 - DNA, 20 bp, Artificial
  CRISPR gRNA sequence
accaccatcccatgctgtga

SEQ ID NO: 777164 - DNA, 20 bp, Artificial
  CRISPR gRNA sequence
tgaccatatcgcatgttggg

SEQ ID NO: 777165 - DNA, 20 bp, Artificial
  CRISPR gRNA sequence
ggctggtgtaatcacaagaa

SEQ ID NO: 777166 - DNA, 20 bp, Artificial
  CRISPR gRNA sequence
gtgtaatcacaagaagcttc

SEQ ID NO: 777167 - DNA, 20 bp, Artificial
  CRISPR gRNA sequence
catggaagaagttagcacta

SEQ ID NO: 777168 - DNA, 20 bp, Artificial
  CRISPR gRNA sequence
atggaagaagttagcactag

SEQ ID NO: 777169 - DNA, 20 bp, Artificial
  CRISPR gRNA sequence
gcactagtgtttaagaagat

SEQ ID NO: 777170 - DNA, 20 bp, Artificial
  CRISPR gRNA sequence
gtgtttaagaagatgacttt

SEQ ID NO: 777171 - DNA, 20 bp, Artificial
  CRISPR gRNA sequence
aagaagatgactttggagtt

SEQ ID NO: 777172 - DNA, 20 bp, Artificial
  CRISPR gRNA sequence
agaagatgactttggagttg

SEQ ID NO: 777173 - DNA, 20 bp, Artificial
  CRISPR gRNA sequence
tggagttggagagacaggtt

SEQ ID NO: 777174 - DNA, 20 bp, Artificial
  CRISPR gRNA sequence
ggagttggagagacaggttc

SEQ ID NO: 777175 - DNA, 20 bp, Artificial
  CRISPR gRNA sequence
gagttggagagacaggttca

SEQ ID NO: 777176 - DNA, 20 bp, Artificial
  CRISPR gRNA sequence
gagagacaggttcaaatcca

SEQ ID NO: 777177 - DNA, 20 bp, Artificial
  CRISPR gRNA sequence
aaatccagactctgtcactt

SEQ ID NO: 777178 - DNA, 20 bp, Artificial
  CRISPR gRNA sequence
tgtcacttcctagtaatgaa

SEQ ID NO: 777179 - DNA, 20 bp, Artificial
  CRISPR gRNA sequence
tcacttcctagtaatgaaac

SEQ ID NO: 777180 - DNA, 20 bp, Artificial
  CRISPR gRNA sequence
cctagtaatgaaactttatg

SEQ ID NO: 777181 - DNA, 20 bp, Artificial
  CRISPR gRNA sequence
ctagtaatgaaactttatga

SEQ ID NO: 777182 - DNA, 20 bp, Artificial
  CRISPR gRNA sequence
gtaatgaaactttatgaaaa

SEQ ID NO: 777183 - DNA, 20 bp, Artificial
  CRISPR gRNA sequence
tatgaaaatatcctctctga

SEQ ID NO: 777184 - DNA, 20 bp, Artificial
  CRISPR gRNA sequence
atgaaaatatcctctctgag

SEQ ID NO: 777185 - DNA, 20 bp, Artificial
  CRISPR gRNA sequence
tgaaaatatcctctctgagc

SEQ ID NO: 777186 - DNA, 20 bp, Artificial
  CRISPR gRNA sequence
tctgagcctcagtttgctca

SEQ ID NO: 777187 - DNA, 20 bp, Artificial
  CRISPR gRNA sequence
tgagcctcagtttgctcatt

SEQ ID NO: 777188 - DNA, 20 bp, Artificial
  CRISPR gRNA sequence
agcctcagtttgctcatttg

SEQ ID NO: 777189 - DNA, 20 bp, Artificial
  CRISPR gRNA sequence
agtttgctcatttgtaaaat

SEQ ID NO: 777190 - DNA, 20 bp, Artificial
  CRISPR gRNA sequence
gctcatttgtaaaatgggga

SEQ ID NO: 777191 - DNA, 20 bp, Artificial
  CRISPR gRNA sequence
ctcatttgtaaaatggggat

SEQ ID NO: 777192 - DNA, 20 bp, Artificial
  CRISPR gRNA sequence
atttgtaaaatggggattat

SEQ ID NO: 777193 - DNA, 20 bp, Artificial
  CRISPR gRNA sequence
gtaaaatggggattataaac

SEQ ID NO: 777194 - DNA, 20 bp, Artificial
  CRISPR gRNA sequence
taaaatggggattataaacc

SEQ ID NO: 777195 - DNA, 20 bp, Artificial
  CRISPR gRNA sequence
taaaccttaccctcatagga

SEQ ID NO: 777196 - DNA, 20 bp, Artificial
  CRISPR gRNA sequence
accctcataggatgattata

SEQ ID NO: 777197 - DNA, 20 bp, Artificial
  CRISPR gRNA sequence
ccctcataggatgattatag

SEQ ID NO: 777198 - DNA, 20 bp, Artificial
  CRISPR gRNA sequence
ataggatgattataggactc

SEQ ID NO: 777199 - DNA, 20 bp, Artificial
  CRISPR gRNA sequence
taggactcaatgagcaaaat

SEQ ID NO: 777200 - DNA, 20 bp, Artificial
  CRISPR gRNA sequence
aatgagcaaaattatcaaaa

SEQ ID NO: 777201 - DNA, 20 bp, Artificial
  CRISPR gRNA sequence
tcaaaactgacctagttaat

SEQ ID NO: 777202 - DNA, 20 bp, Artificial
  CRISPR gRNA sequence
acctagttaatactaggtgc

SEQ ID NO: 777203 - DNA, 20 bp, Artificial
  CRISPR gRNA sequence
gttaatactaggtgctctat

SEQ ID NO: 777204 - DNA, 20 bp, Artificial
  CRISPR gRNA sequence
atactaggtgctctataaat

SEQ ID NO: 777205 - DNA, 20 bp, Artificial
  CRISPR gRNA sequence
ggtgctctataaatgggcag

SEQ ID NO: 777206 - DNA, 20 bp, Artificial
  CRISPR gRNA sequence
tataaatgggcagcagcctc

SEQ ID NO: 777207 - DNA, 20 bp, Artificial
  CRISPR gRNA sequence
taaatgggcagcagcctcag

SEQ ID NO: 777208 - DNA, 20 bp, Artificial
  CRISPR gRNA sequence
agaaaagagatgggagggtc

SEQ ID NO: 777209 - DNA, 20 bp, Artificial
  CRISPR gRNA sequence
gagttccctgggaacagcct

SEQ ID NO: 777210 - DNA, 20 bp, Artificial
  CRISPR gRNA sequence
cctgggaacagcctccctgt

SEQ ID NO: 777211 - DNA, 20 bp, Artificial
  CRISPR gRNA sequence
ggaacagcctccctgtttgc

SEQ ID NO: 777212 - DNA, 20 bp, Artificial
  CRISPR gRNA sequence
cctgtttgccttcctttttc

SEQ ID NO: 777213 - DNA, 20 bp, Artificial
  CRISPR gRNA sequence
tttgccttcctttttcctga

SEQ ID NO: 777214 - DNA, 20 bp, Artificial
  CRISPR gRNA sequence
gccttcctttttcctgataa

SEQ ID NO: 777215 - DNA, 20 bp, Artificial
  CRISPR gRNA sequence
ccttcctttttcctgataat

SEQ ID NO: 777216 - DNA, 20 bp, Artificial
  CRISPR gRNA sequence
cctttttcctgataatctga

SEQ ID NO: 777217 - DNA, 20 bp, Artificial
  CRISPR gRNA sequence
ctttttcctgataatctgag

SEQ ID NO: 777218 - DNA, 20 bp, Artificial
  CRISPR gRNA sequence
tttcctgataatctgagtca

SEQ ID NO: 777219 - DNA, 20 bp, Artificial
  CRISPR gRNA sequence
ttcctgataatctgagtcag

SEQ ID NO: 777220 - DNA, 20 bp, Artificial
  CRISPR gRNA sequence
tcctgataatctgagtcagt

SEQ ID NO: 777221 - DNA, 20 bp, Artificial
  CRISPR gRNA sequence
cctgataatctgagtcagtt

SEQ ID NO: 777222 - DNA, 20 bp, Artificial
  CRISPR gRNA sequence
ctgataatctgagtcagttt

SEQ ID NO: 777223 - DNA, 20 bp, Artificial
  CRISPR gRNA sequence
ataatctgagtcagtttggg

SEQ ID NO: 777224 - DNA, 20 bp, Artificial
  CRISPR gRNA sequence
agtcagtttgggccttttat

SEQ ID NO: 777225 - DNA, 20 bp, Artificial
  CRISPR gRNA sequence
gggccttttatgttcaaggc

SEQ ID NO: 777226 - DNA, 20 bp, Artificial
  CRISPR gRNA sequence
ggccttttatgttcaaggct

SEQ ID NO: 777227 - DNA, 20 bp, Artificial
  CRISPR gRNA sequence
ttatgttcaaggctgtccac

SEQ ID NO: 777228 - DNA, 20 bp, Artificial
  CRISPR gRNA sequence
tatgttcaaggctgtccact

SEQ ID NO: 777229 - DNA, 20 bp, Artificial
  CRISPR gRNA sequence
atgttcaaggctgtccactg

SEQ ID NO: 777230 - DNA, 20 bp, Artificial
  CRISPR gRNA sequence
tgttcaaggctgtccactgg

SEQ ID NO: 777231 - DNA, 20 bp, Artificial
  CRISPR gRNA sequence
aaggctgtccactgggcacc

SEQ ID NO: 777232 - DNA, 20 bp, Artificial
  CRISPR gRNA sequence
tccactgggcaccactcccc

SEQ ID NO: 777233 - DNA, 20 bp, Artificial
  CRISPR gRNA sequence
ggcaccactccccagtcccg

SEQ ID NO: 777234 - DNA, 20 bp, Artificial
  CRISPR gRNA sequence
cccagtcccgtgatcccacc

SEQ ID NO: 777235 - DNA, 20 bp, Artificial
  CRISPR gRNA sequence
ttcctctccaagcgatttct

SEQ ID NO: 777236 - DNA, 20 bp, Artificial
  CRISPR gRNA sequence
cctctccaagcgatttctgt

SEQ ID NO: 777237 - DNA, 20 bp, Artificial
  CRISPR gRNA sequence
ctctccaagcgatttctgtg

SEQ ID NO: 777238 - DNA, 20 bp, Artificial
  CRISPR gRNA sequence
tccaagcgatttctgtgtga

SEQ ID NO: 777239 - DNA, 20 bp, Artificial
  CRISPR gRNA sequence
caagcgatttctgtgtgagt

SEQ ID NO: 777240 - DNA, 20 bp, Artificial
  CRISPR gRNA sequence
ctgtgtgagtcaggacagta

SEQ ID NO: 777241 - DNA, 20 bp, Artificial
  CRISPR gRNA sequence
tgtgtgagtcaggacagtag

SEQ ID NO: 777242 - DNA, 20 bp, Artificial
  CRISPR gRNA sequence
tgtgagtcaggacagtagta

SEQ ID NO: 777243 - DNA, 20 bp, Artificial
  CRISPR gRNA sequence
gccagcaaagcagggctaag

SEQ ID NO: 777244 - DNA, 20 bp, Artificial
  CRISPR gRNA sequence
aggtctccctggaactagag

SEQ ID NO: 777245 - DNA, 20 bp, Artificial
  CRISPR gRNA sequence
cctggaactagaggcatgtg

SEQ ID NO: 777246 - DNA, 20 bp, Artificial
  CRISPR gRNA sequence
gaactagaggcatgtgcagg

SEQ ID NO: 777247 - DNA, 20 bp, Artificial
  CRISPR gRNA sequence
gaggcatgtgcaggggctgc

SEQ ID NO: 777248 - DNA, 20 bp, Artificial
  CRISPR gRNA sequence
caaaactgacctatacatgc

SEQ ID NO: 777249 - DNA, 20 bp, Artificial
  CRISPR gRNA sequence
acctatacatgcatgtggaa

SEQ ID NO: 777250 - DNA, 20 bp, Artificial
  CRISPR gRNA sequence
tacatgcatgtggaaatgtg

SEQ ID NO: 777251 - DNA, 20 bp, Artificial
  CRISPR gRNA sequence
aaaaaagtgaaagctacatt

SEQ ID NO: 777252 - DNA, 20 bp, Artificial
  CRISPR gRNA sequence
cattgggcccagaggaggtc

SEQ ID NO: 777253 - DNA, 20 bp, Artificial
  CRISPR gRNA sequence
ggcccagaggaggtccagcc

SEQ ID NO: 777254 - DNA, 20 bp, Artificial
  CRISPR gRNA sequence
cgggtcagacactggcaggc

SEQ ID NO: 777255 - DNA, 20 bp, Artificial
  CRISPR gRNA sequence
gggtcagacactggcaggcc

SEQ ID NO: 777256 - DNA, 20 bp, Artificial
  CRISPR gRNA sequence
gcaggcccagggcacacaca

SEQ ID NO: 777257 - DNA, 20 bp, Artificial
  CRISPR gRNA sequence
cattcactcaatatctgctg

SEQ ID NO: 777258 - DNA, 20 bp, Artificial
  CRISPR gRNA sequence
actcaatatctgctgagtcc

SEQ ID NO: 777259 - DNA, 20 bp, Artificial
  CRISPR gRNA sequence
aatatctgctgagtcctgct

SEQ ID NO: 777260 - DNA, 20 bp, Artificial
  CRISPR gRNA sequence
ctgagtcctgctaggtgccc

SEQ ID NO: 777261 - DNA, 20 bp, Artificial
  CRISPR gRNA sequence
agtcctgctaggtgcccacc

SEQ ID NO: 777262 - DNA, 20 bp, Artificial
  CRISPR gRNA sequence
ctaggtgcccacctaaacat

SEQ ID NO: 777263 - DNA, 20 bp, Artificial
  CRISPR gRNA sequence
ggtgcccacctaaacatatc

SEQ ID NO: 777264 - DNA, 20 bp, Artificial
  CRISPR gRNA sequence
aacatatctggaaatcctat

SEQ ID NO: 777265 - DNA, 20 bp, Artificial
  CRISPR gRNA sequence
gaaatcctatcctttccaga

SEQ ID NO: 777266 - DNA, 20 bp, Artificial
  CRISPR gRNA sequence
tcctttccagaagcctttcc

SEQ ID NO: 777267 - DNA, 20 bp, Artificial
  CRISPR gRNA sequence
tccagaagcctttccagact

SEQ ID NO: 777268 - DNA, 20 bp, Artificial
  CRISPR gRNA sequence
ccagaagcctttccagactg

SEQ ID NO: 777269 - DNA, 20 bp, Artificial
  CRISPR gRNA sequence
cagaagcctttccagactgc

SEQ ID NO: 777270 - DNA, 20 bp, Artificial
  CRISPR gRNA sequence
tccagactgcactcaaggaa

SEQ ID NO: 777271 - DNA, 20 bp, Artificial
  CRISPR gRNA sequence
ccagactgcactcaaggaag

SEQ ID NO: 777272 - DNA, 20 bp, Artificial
  CRISPR gRNA sequence
cagactgcactcaaggaagg

SEQ ID NO: 777273 - DNA, 20 bp, Artificial
  CRISPR gRNA sequence
cactcaaggaagggtgcatt

SEQ ID NO: 777274 - DNA, 20 bp, Artificial
  CRISPR gRNA sequence
aaggaagggtgcattttctc

SEQ ID NO: 777275 - DNA, 20 bp, Artificial
  CRISPR gRNA sequence
tctccagatgtgatctgcct

SEQ ID NO: 777276 - DNA, 20 bp, Artificial
  CRISPR gRNA sequence
ctccagatgtgatctgccta

SEQ ID NO: 777277 - DNA, 20 bp, Artificial
  CRISPR gRNA sequence
tccagatgtgatctgcctaa

SEQ ID NO: 777278 - DNA, 20 bp, Artificial
  CRISPR gRNA sequence
cagatgtgatctgcctaaat

SEQ ID NO: 777279 - DNA, 20 bp, Artificial
  CRISPR gRNA sequence
cctaaatgcctccttgcctc

SEQ ID NO: 777280 - DNA, 20 bp, Artificial
  CRISPR gRNA sequence
aatgcctccttgcctccaaa

SEQ ID NO: 777281 - DNA, 20 bp, Artificial
  CRISPR gRNA sequence
cttgcctccaaattcctttg

SEQ ID NO: 777282 - DNA, 20 bp, Artificial
  CRISPR gRNA sequence
gcctccaaattcctttggtt

SEQ ID NO: 777283 - DNA, 20 bp, Artificial
  CRISPR gRNA sequence
cctccaaattcctttggttt

SEQ ID NO: 777284 - DNA, 20 bp, Artificial
  CRISPR gRNA sequence
caaattcctttggtttctac

SEQ ID NO: 777285 - DNA, 20 bp, Artificial
  CRISPR gRNA sequence
ctttggtttctaccctgaaa

SEQ ID NO: 777286 - DNA, 20 bp, Artificial
  CRISPR gRNA sequence
tggtttctaccctgaaagag

SEQ ID NO: 777287 - DNA, 20 bp, Artificial
  CRISPR gRNA sequence
ggtttctaccctgaaagagg

SEQ ID NO: 777288 - DNA, 20 bp, Artificial
  CRISPR gRNA sequence
gtttctaccctgaaagaggc

SEQ ID NO: 777289 - DNA, 20 bp, Artificial
  CRISPR gRNA sequence
ctaccctgaaagaggctcag

SEQ ID NO: 777290 - DNA, 20 bp, Artificial
  CRISPR gRNA sequence
taccctgaaagaggctcagc

SEQ ID NO: 777291 - DNA, 20 bp, Artificial
  CRISPR gRNA sequence
ccctgaaagaggctcagctt

SEQ ID NO: 777292 - DNA, 20 bp, Artificial
  CRISPR gRNA sequence
aaagaggctcagcttagcag

SEQ ID NO: 777293 - DNA, 20 bp, Artificial
  CRISPR gRNA sequence
agcttagcagaacaactctg

SEQ ID NO: 777294 - DNA, 20 bp, Artificial
  CRISPR gRNA sequence
agcagaacaactctgccgac

SEQ ID NO: 777295 - DNA, 20 bp, Artificial
  CRISPR gRNA sequence
gcagaacaactctgccgacc

SEQ ID NO: 777296 - DNA, 20 bp, Artificial
  CRISPR gRNA sequence
tgccgacccctctccatcta

SEQ ID NO: 777297 - DNA, 20 bp, Artificial
  CRISPR gRNA sequence
ccgacccctctccatctaag

SEQ ID NO: 777298 - DNA, 20 bp, Artificial
  CRISPR gRNA sequence
tccatctaagcaccagaccc

SEQ ID NO: 777299 - DNA, 20 bp, Artificial
  CRISPR gRNA sequence
catctaagcaccagacccct

SEQ ID NO: 777300 - DNA, 20 bp, Artificial
  CRISPR gRNA sequence
agcaccagacccctctcgga

SEQ ID NO: 777301 - DNA, 20 bp, Artificial
  CRISPR gRNA sequence
tcggagtgtagcaatctcca

SEQ ID NO: 777302 - DNA, 20 bp, Artificial
  CRISPR gRNA sequence
ggagtgtagcaatctccacc

SEQ ID NO: 777303 - DNA, 20 bp, Artificial
  CRISPR gRNA sequence
caccagtcctcagagctaga

SEQ ID NO: 777304 - DNA, 20 bp, Artificial
  CRISPR gRNA sequence
agagctagaaggcctcttac

SEQ ID NO: 777305 - DNA, 20 bp, Artificial
  CRISPR gRNA sequence
gaaggcctcttacggtacac

SEQ ID NO: 777306 - DNA, 20 bp, Artificial
  CRISPR gRNA sequence
ttacggtacacctggtccag

SEQ ID NO: 777307 - DNA, 20 bp, Artificial
  CRISPR gRNA sequence
acggtacacctggtccagcg

SEQ ID NO: 777308 - DNA, 20 bp, Artificial
  CRISPR gRNA sequence
cggtacacctggtccagcgc

SEQ ID NO: 777309 - DNA, 20 bp, Artificial
  CRISPR gRNA sequence
gtccagcgcctagctccagg

SEQ ID NO: 777310 - DNA, 20 bp, Artificial
  CRISPR gRNA sequence
gctccaggcccattgtacag

SEQ ID NO: 777311 - DNA, 20 bp, Artificial
  CRISPR gRNA sequence
caggcccattgtacagatgg

SEQ ID NO: 777312 - DNA, 20 bp, Artificial
  CRISPR gRNA sequence
tacagatggaaatctggacc

SEQ ID NO: 777313 - DNA, 20 bp, Artificial
  CRISPR gRNA sequence
gacccagagtggtggccggc

SEQ ID NO: 777314 - DNA, 20 bp, Artificial
  CRISPR gRNA sequence
gccaagggcccacactcaat

SEQ ID NO: 777315 - DNA, 20 bp, Artificial
  CRISPR gRNA sequence
aattatcagccaccagcaga

SEQ ID NO: 777316 - DNA, 20 bp, Artificial
  CRISPR gRNA sequence
tcagccaccagcagaagtga

SEQ ID NO: 777317 - DNA, 20 bp, Artificial
  CRISPR gRNA sequence
agagccagctgatgctccta

SEQ ID NO: 777318 - DNA, 20 bp, Artificial
  CRISPR gRNA sequence
atgctcctatctctcttcct

SEQ ID NO: 777319 - DNA, 20 bp, Artificial
  CRISPR gRNA sequence
ctatctctcttcctcactta

SEQ ID NO: 777320 - DNA, 20 bp, Artificial
  CRISPR gRNA sequence
tctctcttcctcacttattg

SEQ ID NO: 777321 - DNA, 20 bp, Artificial
  CRISPR gRNA sequence
tcttcctcacttattgaatg

SEQ ID NO: 777322 - DNA, 20 bp, Artificial
  CRISPR gRNA sequence
ttcctcacttattgaatgga

SEQ ID NO: 777323 - DNA, 20 bp, Artificial
  CRISPR gRNA sequence
cctcacttattgaatggaat

SEQ ID NO: 777324 - DNA, 20 bp, Artificial
  CRISPR gRNA sequence
ctcacttattgaatggaatc

SEQ ID NO: 777325 - DNA, 20 bp, Artificial
  CRISPR gRNA sequence
acttattgaatggaatcacc

SEQ ID NO: 777326 - DNA, 20 bp, Artificial
  CRISPR gRNA sequence
attgaatggaatcaccaggc

SEQ ID NO: 777327 - DNA, 20 bp, Artificial
  CRISPR gRNA sequence
ttgaatggaatcaccaggct

SEQ ID NO: 777328 - DNA, 20 bp, Artificial
  CRISPR gRNA sequence
aatggaatcaccaggctgcc

SEQ ID NO: 777329 - DNA, 20 bp, Artificial
  CRISPR gRNA sequence
ccttgcctgcccagggtaca

SEQ ID NO: 777330 - DNA, 20 bp, Artificial
  CRISPR gRNA sequence
gcctgcccagggtacagcat

SEQ ID NO: 777331 - DNA, 20 bp, Artificial
  CRISPR gRNA sequence
cctgcccagggtacagcatg

SEQ ID NO: 777332 - DNA, 20 bp, Artificial
  CRISPR gRNA sequence
cccagggtacagcatgagct

SEQ ID NO: 777333 - DNA, 20 bp, Artificial
  CRISPR gRNA sequence
agaagccagcagccttgggt

SEQ ID NO: 777334 - DNA, 20 bp, Artificial
  CRISPR gRNA sequence
gggtttcaatcctgacaccg

SEQ ID NO: 777335 - DNA, 20 bp, Artificial
  CRISPR gRNA sequence
ggtttcaatcctgacaccga

SEQ ID NO: 777336 - DNA, 20 bp, Artificial
  CRISPR gRNA sequence
caatcctgacaccgatgcct

SEQ ID NO: 777337 - DNA, 20 bp, Artificial
  CRISPR gRNA sequence
aatcctgacaccgatgcctt

SEQ ID NO: 777338 - DNA, 20 bp, Artificial
  CRISPR gRNA sequence
acaccgatgccttgctgaac

SEQ ID NO: 777339 - DNA, 20 bp, Artificial
  CRISPR gRNA sequence
gctgaacacatgaccaagtt

SEQ ID NO: 777340 - DNA, 20 bp, Artificial
  CRISPR gRNA sequence
ctgaacacatgaccaagttt

SEQ ID NO: 777341 - DNA, 20 bp, Artificial
  CRISPR gRNA sequence
aacacatgaccaagtttaaa

SEQ ID NO: 777342 - DNA, 20 bp, Artificial
  CRISPR gRNA sequence
aaatgacttaacctatttga

SEQ ID NO: 777343 - DNA, 20 bp, Artificial
  CRISPR gRNA sequence
aatgacttaacctatttgag

SEQ ID NO: 777344 - DNA, 20 bp, Artificial
  CRISPR gRNA sequence
aacctatttgagacccaatt

SEQ ID NO: 777345 - DNA, 20 bp, Artificial
  CRISPR gRNA sequence
acctatttgagacccaattc

SEQ ID NO: 777346 - DNA, 20 bp, Artificial
  CRISPR gRNA sequence
tttgagacccaattccaaat

SEQ ID NO: 777347 - DNA, 20 bp, Artificial
  CRISPR gRNA sequence
gagacccaattccaaatctc

SEQ ID NO: 777348 - DNA, 20 bp, Artificial
  CRISPR gRNA sequence
agacccaattccaaatctct

SEQ ID NO: 777349 - DNA, 20 bp, Artificial
  CRISPR gRNA sequence
caaatctctaaaatgggggt

SEQ ID NO: 777350 - DNA, 20 bp, Artificial
  CRISPR gRNA sequence
taaaatgggggtaacaatcc

SEQ ID NO: 777351 - DNA, 20 bp, Artificial
  CRISPR gRNA sequence
aaatgggggtaacaatccct

SEQ ID NO: 777352 - DNA, 20 bp, Artificial
  CRISPR gRNA sequence
ccccacagggctgctgtgag

SEQ ID NO: 777353 - DNA, 20 bp, Artificial
  CRISPR gRNA sequence
ctgtgagaataaaataagac

SEQ ID NO: 777354 - DNA, 20 bp, Artificial
  CRISPR gRNA sequence
tgagaataaaataagacaat

SEQ ID NO: 777355 - DNA, 20 bp, Artificial
  CRISPR gRNA sequence
aggaaagtgcccagtaccaa

SEQ ID NO: 777356 - DNA, 20 bp, Artificial
  CRISPR gRNA sequence
ggaaagtgcccagtaccaaa

SEQ ID NO: 777357 - DNA, 20 bp, Artificial
  CRISPR gRNA sequence
cagtaataattattattatt

SEQ ID NO: 777358 - DNA, 20 bp, Artificial
  CRISPR gRNA sequence
ttattattgctgttattatt

SEQ ID NO: 777359 - DNA, 20 bp, Artificial
  CRISPR gRNA sequence
ttattgctgttattattgcc

SEQ ID NO: 777360 - DNA, 20 bp, Artificial
  CRISPR gRNA sequence
ttgctgttattattgccgca

SEQ ID NO: 777361 - DNA, 20 bp, Artificial
  CRISPR gRNA sequence
ctgttattattgccgcaagc

SEQ ID NO: 777362 - DNA, 20 bp, Artificial
  CRISPR gRNA sequence
ttattattgccgcaagcatg

SEQ ID NO: 777363 - DNA, 20 bp, Artificial
  CRISPR gRNA sequence
ttattgccgcaagcatgggg

SEQ ID NO: 777364 - DNA, 20 bp, Artificial
  CRISPR gRNA sequence
ttgccgcaagcatggggaca

SEQ ID NO: 777365 - DNA, 20 bp, Artificial
  CRISPR gRNA sequence
ccgcaagcatggggacaagg

SEQ ID NO: 777366 - DNA, 20 bp, Artificial
  CRISPR gRNA sequence
ctagatggggcctctgcact

SEQ ID NO: 777367 - DNA, 20 bp, Artificial
  CRISPR gRNA sequence
gatggggcctctgcactgag

SEQ ID NO: 777368 - DNA, 20 bp, Artificial
  CRISPR gRNA sequence
tgcactgagcgaacactttg

SEQ ID NO: 777369 - DNA, 20 bp, Artificial
  CRISPR gRNA sequence
cactgagcgaacactttgcc

SEQ ID NO: 777370 - DNA, 20 bp, Artificial
  CRISPR gRNA sequence
agcgaacactttgcccctac

SEQ ID NO: 777371 - DNA, 20 bp, Artificial
  CRISPR gRNA sequence
tgcccctaccccactctccc

SEQ ID NO: 777372 - DNA, 20 bp, Artificial
  CRISPR gRNA sequence
gcccctaccccactctccct

SEQ ID NO: 777373 - DNA, 20 bp, Artificial
  CRISPR gRNA sequence
cccctaccccactctccctg

SEQ ID NO: 777374 - DNA, 20 bp, Artificial
  CRISPR gRNA sequence
ccccactctccctggccaag

SEQ ID NO: 777375 - DNA, 20 bp, Artificial
  CRISPR gRNA sequence
tccctggccaagacctcctc

SEQ ID NO: 777376 - DNA, 20 bp, Artificial
  CRISPR gRNA sequence
cctggccaagacctcctctg

SEQ ID NO: 777377 - DNA, 20 bp, Artificial
  CRISPR gRNA sequence
gccaagacctcctctgtcag

SEQ ID NO: 777378 - DNA, 20 bp, Artificial
  CRISPR gRNA sequence
ctctgtcaggccacacatct

SEQ ID NO: 777379 - DNA, 20 bp, Artificial
  CRISPR gRNA sequence
tgtcaggccacacatctggg

SEQ ID NO: 777380 - DNA, 20 bp, Artificial
  CRISPR gRNA sequence
tcaggccacacatctgggcc

SEQ ID NO: 777381 - DNA, 20 bp, Artificial
  CRISPR gRNA sequence
ggcctctgggaccattactc

SEQ ID NO: 777382 - DNA, 20 bp, Artificial
  CRISPR gRNA sequence
tgggaccattactccttctg

SEQ ID NO: 777383 - DNA, 20 bp, Artificial
  CRISPR gRNA sequence
ggaccattactccttctgta

SEQ ID NO: 777384 - DNA, 20 bp, Artificial
  CRISPR gRNA sequence
ctccttctgtatccctactt

SEQ ID NO: 777385 - DNA, 20 bp, Artificial
  CRISPR gRNA sequence
cttctgtatccctacttttc

SEQ ID NO: 777386 - DNA, 20 bp, Artificial
  CRISPR gRNA sequence
ctgtatccctacttttcacc

SEQ ID NO: 777387 - DNA, 20 bp, Artificial
  CRISPR gRNA sequence
tgtatccctacttttcacct

SEQ ID NO: 777388 - DNA, 20 bp, Artificial
  CRISPR gRNA sequence
tatccctacttttcacctag

SEQ ID NO: 777389 - DNA, 20 bp, Artificial
  CRISPR gRNA sequence
cttttcacctagagccctat

SEQ ID NO: 777390 - DNA, 20 bp, Artificial
  CRISPR gRNA sequence
ttcacctagagccctatcag

SEQ ID NO: 777391 - DNA, 20 bp, Artificial
  CRISPR gRNA sequence
tcacctagagccctatcagt

SEQ ID NO: 777392 - DNA, 20 bp, Artificial
  CRISPR gRNA sequence
cacctagagccctatcagtg

SEQ ID NO: 777393 - DNA, 20 bp, Artificial
  CRISPR gRNA sequence
acctagagccctatcagtgc

SEQ ID NO: 777394 - DNA, 20 bp, Artificial
  CRISPR gRNA sequence
gagccctatcagtgccccag

SEQ ID NO: 777395 - DNA, 20 bp, Artificial
  CRISPR gRNA sequence
tcagtgccccagctccaaag

SEQ ID NO: 777396 - DNA, 20 bp, Artificial
  CRISPR gRNA sequence
caaagtagcaaatgcacaac

SEQ ID NO: 777397 - DNA, 20 bp, Artificial
  CRISPR gRNA sequence
gactccatctctggctctga

SEQ ID NO: 777398 - DNA, 20 bp, Artificial
  CRISPR gRNA sequence
catctctggctctgactcat

SEQ ID NO: 777399 - DNA, 20 bp, Artificial
  CRISPR gRNA sequence
tggctctgactcattctagt

SEQ ID NO: 777400 - DNA, 20 bp, Artificial
  CRISPR gRNA sequence
gctctgactcattctagtgg

SEQ ID NO: 777401 - DNA, 20 bp, Artificial
  CRISPR gRNA sequence
tgactcattctagtggtcct

SEQ ID NO: 777402 - DNA, 20 bp, Artificial
  CRISPR gRNA sequence
actcattctagtggtcctgg

SEQ ID NO: 777403 - DNA, 20 bp, Artificial
  CRISPR gRNA sequence
attctagtggtcctgggccc

SEQ ID NO: 777404 - DNA, 20 bp, Artificial
  CRISPR gRNA sequence
tagtggtcctgggccccttc

SEQ ID NO: 777405 - DNA, 20 bp, Artificial
  CRISPR gRNA sequence
gtggtcctgggccccttcct

SEQ ID NO: 777406 - DNA, 20 bp, Artificial
  CRISPR gRNA sequence
ggccccttcctcttcgcaga

SEQ ID NO: 777407 - DNA, 20 bp, Artificial
  CRISPR gRNA sequence
cctcttcgcagatgcttggt

SEQ ID NO: 777408 - DNA, 20 bp, Artificial
  CRISPR gRNA sequence
ctcttcgcagatgcttggtc

SEQ ID NO: 777409 - DNA, 20 bp, Artificial
  CRISPR gRNA sequence
ttcgcagatgcttggtcaca

SEQ ID NO: 777410 - DNA, 20 bp, Artificial
  CRISPR gRNA sequence
cgcagatgcttggtcacagt

SEQ ID NO: 777411 - DNA, 20 bp, Artificial
  CRISPR gRNA sequence
gcagatgcttggtcacagtt

SEQ ID NO: 777412 - DNA, 20 bp, Artificial
  CRISPR gRNA sequence
ggtcacagttccaagtacca

SEQ ID NO: 777413 - DNA, 20 bp, Artificial
  CRISPR gRNA sequence
gtcacagttccaagtaccat

SEQ ID NO: 777414 - DNA, 20 bp, Artificial
  CRISPR gRNA sequence
caagtaccatgagctcctac

SEQ ID NO: 777415 - DNA, 20 bp, Artificial
  CRISPR gRNA sequence
ctaccgtcctgctgccatag

SEQ ID NO: 777416 - DNA, 20 bp, Artificial
  CRISPR gRNA sequence
ccgtcctgctgccatagccc

SEQ ID NO: 777417 - DNA, 20 bp, Artificial
  CRISPR gRNA sequence
ctgccatagcccctagcaca

SEQ ID NO: 777418 - DNA, 20 bp, Artificial
  CRISPR gRNA sequence
ccatagcccctagcacagag

SEQ ID NO: 777419 - DNA, 20 bp, Artificial
  CRISPR gRNA sequence
gcacagagcattcccacagg

SEQ ID NO: 777420 - DNA, 20 bp, Artificial
  CRISPR gRNA sequence
ccacagggacacattccaat

SEQ ID NO: 777421 - DNA, 20 bp, Artificial
  CRISPR gRNA sequence
caatgtctcccacaaggcag

SEQ ID NO: 777422 - DNA, 20 bp, Artificial
  CRISPR gRNA sequence
ccacaaggcagccccagttc

SEQ ID NO: 777423 - DNA, 20 bp, Artificial
  CRISPR gRNA sequence
ctaggagcctgcattgcctc

SEQ ID NO: 777424 - DNA, 20 bp, Artificial
  CRISPR gRNA sequence
ggagcctgcattgcctctag

SEQ ID NO: 777425 - DNA, 20 bp, Artificial
  CRISPR gRNA sequence
cattgcctctagggtaactt

SEQ ID NO: 777426 - DNA, 20 bp, Artificial
  CRISPR gRNA sequence
cctctagggtaacttgggac

SEQ ID NO: 777427 - DNA, 20 bp, Artificial
  CRISPR gRNA sequence
tagggtaacttgggacccct

SEQ ID NO: 777428 - DNA, 20 bp, Artificial
  CRISPR gRNA sequence
gggtaacttgggacccctgc

SEQ ID NO: 777429 - DNA, 20 bp, Artificial
  CRISPR gRNA sequence
gggacccctgcctcccagag

SEQ ID NO: 777430 - DNA, 20 bp, Artificial
  CRISPR gRNA sequence
ggacccctgcctcccagaga

SEQ ID NO: 777431 - DNA, 20 bp, Artificial
  CRISPR gRNA sequence
cctcccagagacagtatctc

SEQ ID NO: 777432 - DNA, 20 bp, Artificial
  CRISPR gRNA sequence
ccagagacagtatctctccc

SEQ ID NO: 777433 - DNA, 20 bp, Artificial
  CRISPR gRNA sequence
tccctgctccaaggctccca

SEQ ID NO: 777434 - DNA, 20 bp, Artificial
  CRISPR gRNA sequence
cctgctccaaggctcccagc

SEQ ID NO: 777435 - DNA, 20 bp, Artificial
  CRISPR gRNA sequence
ctccaaggctcccagcaaga

SEQ ID NO: 777436 - DNA, 20 bp, Artificial
  CRISPR gRNA sequence
caaggctcccagcaagaaat

SEQ ID NO: 777437 - DNA, 20 bp, Artificial
  CRISPR gRNA sequence
ccagcaagaaatgcttctca

SEQ ID NO: 777438 - DNA, 20 bp, Artificial
  CRISPR gRNA sequence
ctcactccacttcccgcaga

SEQ ID NO: 777439 - DNA, 20 bp, Artificial
  CRISPR gRNA sequence
tcactccacttcccgcagat

SEQ ID NO: 777440 - DNA, 20 bp, Artificial
  CRISPR gRNA sequence
actccacttcccgcagatta

SEQ ID NO: 777441 - DNA, 20 bp, Artificial
  CRISPR gRNA sequence
cacttcccgcagattaagct

SEQ ID NO: 777442 - DNA, 20 bp, Artificial
  CRISPR gRNA sequence
cccgcagattaagctcccta

SEQ ID NO: 777443 - DNA, 20 bp, Artificial
  CRISPR gRNA sequence
ccgcagattaagctccctat

SEQ ID NO: 777444 - DNA, 20 bp, Artificial
  CRISPR gRNA sequence
agctccctatgcctagagaa

SEQ ID NO: 777445 - DNA, 20 bp, Artificial
  CRISPR gRNA sequence
cctatgcctagagaaggtca

SEQ ID NO: 777446 - DNA, 20 bp, Artificial
  CRISPR gRNA sequence
tgcctagagaaggtcagatt

SEQ ID NO: 777447 - DNA, 20 bp, Artificial
  CRISPR gRNA sequence
gagaaggtcagattcccaat

SEQ ID NO: 777448 - DNA, 20 bp, Artificial
  CRISPR gRNA sequence
ccaatggcataaggtgtgtg

SEQ ID NO: 777449 - DNA, 20 bp, Artificial
  CRISPR gRNA sequence
attctctggaccacaaagag

SEQ ID NO: 777450 - DNA, 20 bp, Artificial
  CRISPR gRNA sequence
tctggaccacaaagagaaag

SEQ ID NO: 777451 - DNA, 20 bp, Artificial
  CRISPR gRNA sequence
tggaccacaaagagaaagaa

SEQ ID NO: 777452 - DNA, 20 bp, Artificial
  CRISPR gRNA sequence
gaccacaaagagaaagaaag

SEQ ID NO: 777453 - DNA, 20 bp, Artificial
  CRISPR gRNA sequence
gctgggagcactggtcagaa

SEQ ID NO: 777454 - DNA, 20 bp, Artificial
  CRISPR gRNA sequence
ggagcactggtcagaactgg

SEQ ID NO: 777455 - DNA, 20 bp, Artificial
  CRISPR gRNA sequence
gtcagaactggagggtggag

SEQ ID NO: 777456 - DNA, 20 bp, Artificial
  CRISPR gRNA sequence
gagggtggagggggaactcc

SEQ ID NO: 777457 - DNA, 20 bp, Artificial
  CRISPR gRNA sequence
ctggaagccccagcatgata

SEQ ID NO: 777458 - DNA, 20 bp, Artificial
  CRISPR gRNA sequence
gaagccccagcatgataaag

SEQ ID NO: 777459 - DNA, 20 bp, Artificial
  CRISPR gRNA sequence
tggaagagaagaactctcag

SEQ ID NO: 777460 - DNA, 20 bp, Artificial
  CRISPR gRNA sequence
gaagagaagaactctcagca

SEQ ID NO: 777461 - DNA, 20 bp, Artificial
  CRISPR gRNA sequence
tcagcaaaggccctgactat

SEQ ID NO: 777462 - DNA, 20 bp, Artificial
  CRISPR gRNA sequence
agcaaaggccctgactatgc

SEQ ID NO: 777463 - DNA, 20 bp, Artificial
  CRISPR gRNA sequence
actatgctgtgaaggccact

SEQ ID NO: 777464 - DNA, 20 bp, Artificial
  CRISPR gRNA sequence
tgctgtgaaggccactagtc

SEQ ID NO: 777465 - DNA, 20 bp, Artificial
  CRISPR gRNA sequence
tgaaggccactagtcactgg

SEQ ID NO: 777466 - DNA, 20 bp, Artificial
  CRISPR gRNA sequence
gtcactgggtcacccaggtc

SEQ ID NO: 777467 - DNA, 20 bp, Artificial
  CRISPR gRNA sequence
ggtcacccaggtcaggcctg

SEQ ID NO: 777468 - DNA, 20 bp, Artificial
  CRISPR gRNA sequence
ccccttctctggttccccag

SEQ ID NO: 777469 - DNA, 20 bp, Artificial
  CRISPR gRNA sequence
ctctggttccccagatgagt

SEQ ID NO: 777470 - DNA, 20 bp, Artificial
  CRISPR gRNA sequence
tctggttccccagatgagtc

SEQ ID NO: 777471 - DNA, 20 bp, Artificial
  CRISPR gRNA sequence
tggttccccagatgagtctt

SEQ ID NO: 777472 - DNA, 20 bp, Artificial
  CRISPR gRNA sequence
gttccccagatgagtcttcc

SEQ ID NO: 777473 - DNA, 20 bp, Artificial
  CRISPR gRNA sequence
cccagatgagtcttccctga

SEQ ID NO: 777474 - DNA, 20 bp, Artificial
  CRISPR gRNA sequence
ccctgacttactaaggagac

SEQ ID NO: 777475 - DNA, 20 bp, Artificial
  CRISPR gRNA sequence
cctgacttactaaggagacc

SEQ ID NO: 777476 - DNA, 20 bp, Artificial
  CRISPR gRNA sequence
acttactaaggagacccttg

SEQ ID NO: 777477 - DNA, 20 bp, Artificial
  CRISPR gRNA sequence
actaaggagacccttggcac

SEQ ID NO: 777478 - DNA, 20 bp, Artificial
  CRISPR gRNA sequence
ctaaggagacccttggcaca

SEQ ID NO: 777479 - DNA, 20 bp, Artificial
  CRISPR gRNA sequence
aggagacccttggcacatct

SEQ ID NO: 777480 - DNA, 20 bp, Artificial
  CRISPR gRNA sequence
ggcacatcttaccgggctcc

SEQ ID NO: 777481 - DNA, 20 bp, Artificial
  CRISPR gRNA sequence
gcacatcttaccgggctcca

SEQ ID NO: 777482 - DNA, 20 bp, Artificial
  CRISPR gRNA sequence
accgggctccagaaagaggg

SEQ ID NO: 777483 - DNA, 20 bp, Artificial
  CRISPR gRNA sequence
ccgggctccagaaagagggg

SEQ ID NO: 777484 - DNA, 20 bp, Artificial
  CRISPR gRNA sequence
cagaaagaggggtaaaacct

SEQ ID NO: 777485 - DNA, 20 bp, Artificial
  CRISPR gRNA sequence
tgcctacctccagagcagca

SEQ ID NO: 777486 - DNA, 20 bp, Artificial
  CRISPR gRNA sequence
cctccagagcagcagaaaaa

SEQ ID NO: 777487 - DNA, 20 bp, Artificial
  CRISPR gRNA sequence
cagagcagcagaaaaagcca

SEQ ID NO: 777488 - DNA, 20 bp, Artificial
  CRISPR gRNA sequence
tggaagcagacaacagccca

SEQ ID NO: 777489 - DNA, 20 bp, Artificial
  CRISPR gRNA sequence
gaagcagacaacagcccagc

SEQ ID NO: 777490 - DNA, 20 bp, Artificial
  CRISPR gRNA sequence
caccatttgccggctgtgtg

SEQ ID NO: 777491 - DNA, 20 bp, Artificial
  CRISPR gRNA sequence
gccggctgtgtgtctttggg

SEQ ID NO: 777492 - DNA, 20 bp, Artificial
  CRISPR gRNA sequence
ccggctgtgtgtctttgggc

SEQ ID NO: 777493 - DNA, 20 bp, Artificial
  CRISPR gRNA sequence
tgtgtctttgggcatgtgac

SEQ ID NO: 777494 - DNA, 20 bp, Artificial
  CRISPR gRNA sequence
tgggcatgtgacttaccctt

SEQ ID NO: 777495 - DNA, 20 bp, Artificial
  CRISPR gRNA sequence
gggcatgtgacttacccttt

SEQ ID NO: 777496 - DNA, 20 bp, Artificial
  CRISPR gRNA sequence
ggcatgtgacttaccctttc

SEQ ID NO: 777497 - DNA, 20 bp, Artificial
  CRISPR gRNA sequence
accctttctgggcctcagtt

SEQ ID NO: 777498 - DNA, 20 bp, Artificial
  CRISPR gRNA sequence
ccctttctgggcctcagttt

SEQ ID NO: 777499 - DNA, 20 bp, Artificial
  CRISPR gRNA sequence
tctgggcctcagtttcccca

SEQ ID NO: 777500 - DNA, 20 bp, Artificial
  CRISPR gRNA sequence
ctgggcctcagtttccccaa

SEQ ID NO: 777501 - DNA, 20 bp, Artificial
  CRISPR gRNA sequence
tgggcctcagtttccccaac

SEQ ID NO: 777502 - DNA, 20 bp, Artificial
  CRISPR gRNA sequence
ggcctcagtttccccaactg

SEQ ID NO: 777503 - DNA, 20 bp, Artificial
  CRISPR gRNA sequence
agtttccccaactgtacaat

SEQ ID NO: 777504 - DNA, 20 bp, Artificial
  CRISPR gRNA sequence
ccccaactgtacaatggtgt

SEQ ID NO: 777505 - DNA, 20 bp, Artificial
  CRISPR gRNA sequence
cccaactgtacaatggtgtt

SEQ ID NO: 777506 - DNA, 20 bp, Artificial
  CRISPR gRNA sequence
tacaatggtgttaatgatac

SEQ ID NO: 777507 - DNA, 20 bp, Artificial
  CRISPR gRNA sequence
atgataccctacctcatagg

SEQ ID NO: 777508 - DNA, 20 bp, Artificial
  CRISPR gRNA sequence
cctcataggattactatgag

SEQ ID NO: 777509 - DNA, 20 bp, Artificial
  CRISPR gRNA sequence
ataggattactatgaggatt

SEQ ID NO: 777510 - DNA, 20 bp, Artificial
  CRISPR gRNA sequence
ctatgaggattacatgagat

SEQ ID NO: 777511 - DNA, 20 bp, Artificial
  CRISPR gRNA sequence
tgaggattacatgagataat

SEQ ID NO: 777512 - DNA, 20 bp, Artificial
  CRISPR gRNA sequence
catgagataatgtctattta

SEQ ID NO: 777513 - DNA, 20 bp, Artificial
  CRISPR gRNA sequence
tttagcctccagcacaaccc

SEQ ID NO: 777514 - DNA, 20 bp, Artificial
  CRISPR gRNA sequence
agcctccagcacaaccctac

SEQ ID NO: 777515 - DNA, 20 bp, Artificial
  CRISPR gRNA sequence
gcctccagcacaaccctacc

SEQ ID NO: 777516 - DNA, 20 bp, Artificial
  CRISPR gRNA sequence
cagcacaaccctacccactc

SEQ ID NO: 777517 - DNA, 20 bp, Artificial
  CRISPR gRNA sequence
cccactcccaaacctgaaaa

SEQ ID NO: 777518 - DNA, 20 bp, Artificial
  CRISPR gRNA sequence
ccaaacctgaaaacccaatg

SEQ ID NO: 777519 - DNA, 20 bp, Artificial
  CRISPR gRNA sequence
aaaacccaatgctcctatct

SEQ ID NO: 777520 - DNA, 20 bp, Artificial
  CRISPR gRNA sequence
ctatctggcacactgcaagg

SEQ ID NO: 777521 - DNA, 20 bp, Artificial
  CRISPR gRNA sequence
tctggcacactgcaagggcg

SEQ ID NO: 777522 - DNA, 20 bp, Artificial
  CRISPR gRNA sequence
gcacactgcaagggcggtag

SEQ ID NO: 777523 - DNA, 20 bp, Artificial
  CRISPR gRNA sequence
caagggcggtagaactgggg

SEQ ID NO: 777524 - DNA, 20 bp, Artificial
  CRISPR gRNA sequence
ggggtggcaggcaagggttg

SEQ ID NO: 777525 - DNA, 20 bp, Artificial
  CRISPR gRNA sequence
cataactgtacacgtggccc

SEQ ID NO: 777526 - DNA, 20 bp, Artificial
  CRISPR gRNA sequence
tacacgtggcccccttccag

SEQ ID NO: 777527 - DNA, 20 bp, Artificial
  CRISPR gRNA sequence
ccaggtgtggggtccattct

SEQ ID NO: 777528 - DNA, 20 bp, Artificial
  CRISPR gRNA sequence
caggtgtggggtccattctg

SEQ ID NO: 777529 - DNA, 20 bp, Artificial
  CRISPR gRNA sequence
tgagccaacaagaccaaagg

SEQ ID NO: 777530 - DNA, 20 bp, Artificial
  CRISPR gRNA sequence
agccaacaagaccaaaggca

SEQ ID NO: 777531 - DNA, 20 bp, Artificial
  CRISPR gRNA sequence
ctcaaaaatcatgtggacca

SEQ ID NO: 777532 - DNA, 20 bp, Artificial
  CRISPR gRNA sequence
tcaaaaatcatgtggaccag

SEQ ID NO: 777533 - DNA, 20 bp, Artificial
  CRISPR gRNA sequence
aaaaatcatgtggaccagtc

SEQ ID NO: 777534 - DNA, 20 bp, Artificial
  CRISPR gRNA sequence
acccctctccccctccccta

SEQ ID NO: 777535 - DNA, 20 bp, Artificial
  CRISPR gRNA sequence
tccccctcccctaggccctg

SEQ ID NO: 777536 - DNA, 20 bp, Artificial
  CRISPR gRNA sequence
cccctcccctaggccctggg

SEQ ID NO: 777537 - DNA, 20 bp, Artificial
  CRISPR gRNA sequence
ccctaggccctgggtgtgcc

SEQ ID NO: 777538 - DNA, 20 bp, Artificial
  CRISPR gRNA sequence
ggccctgggtgtgccctccc

SEQ ID NO: 777539 - DNA, 20 bp, Artificial
  CRISPR gRNA sequence
ggtgtgccctcccccttttg

SEQ ID NO: 777540 - DNA, 20 bp, Artificial
  CRISPR gRNA sequence
ccccttttgctggtggactt

SEQ ID NO: 777541 - DNA, 20 bp, Artificial
  CRISPR gRNA sequence
ttgctggtggacttccctaa

SEQ ID NO: 777542 - DNA, 20 bp, Artificial
  CRISPR gRNA sequence
tgctggtggacttccctaac

SEQ ID NO: 777543 - DNA, 20 bp, Artificial
  CRISPR gRNA sequence
gctggtggacttccctaaca

SEQ ID NO: 777544 - DNA, 20 bp, Artificial
  CRISPR gRNA sequence
ctggtggacttccctaacac

SEQ ID NO: 777545 - DNA, 20 bp, Artificial
  CRISPR gRNA sequence
gtggacttccctaacactcc

SEQ ID NO: 777546 - DNA, 20 bp, Artificial
  CRISPR gRNA sequence
ccctaacactcctgccctgg

SEQ ID NO: 777547 - DNA, 20 bp, Artificial
  CRISPR gRNA sequence
cctaacactcctgccctggg

SEQ ID NO: 777548 - DNA, 20 bp, Artificial
  CRISPR gRNA sequence
acactcctgccctggggatg

SEQ ID NO: 777549 - DNA, 20 bp, Artificial
  CRISPR gRNA sequence
ctgccctggggatgtgggaa

SEQ ID NO: 777550 - DNA, 20 bp, Artificial
  CRISPR gRNA sequence
ccctggggatgtgggaaaag

SEQ ID NO: 777551 - DNA, 20 bp, Artificial
  CRISPR gRNA sequence
gggatgtgggaaaaggacaa

SEQ ID NO: 777552 - DNA, 20 bp, Artificial
  CRISPR gRNA sequence
agaggataagctcatgggca

SEQ ID NO: 777553 - DNA, 20 bp, Artificial
  CRISPR gRNA sequence
atgggcagtaacgtcatcct

SEQ ID NO: 777554 - DNA, 20 bp, Artificial
  CRISPR gRNA sequence
cttgccatttttcctctttc

SEQ ID NO: 777555 - DNA, 20 bp, Artificial
  CRISPR gRNA sequence
gccatttttcctctttccct

SEQ ID NO: 777556 - DNA, 20 bp, Artificial
  CRISPR gRNA sequence
ccatttttcctctttccctg

SEQ ID NO: 777557 - DNA, 20 bp, Artificial
  CRISPR gRNA sequence
ttcctctttccctgacccta

SEQ ID NO: 777558 - DNA, 20 bp, Artificial
  CRISPR gRNA sequence
tcctctttccctgaccctat

SEQ ID NO: 777559 - DNA, 20 bp, Artificial
  CRISPR gRNA sequence
cctctttccctgaccctatg

SEQ ID NO: 777560 - DNA, 20 bp, Artificial
  CRISPR gRNA sequence
ctctttccctgaccctatga

SEQ ID NO: 777561 - DNA, 20 bp, Artificial
  CRISPR gRNA sequence
tttccctgaccctatgactc

SEQ ID NO: 777562 - DNA, 20 bp, Artificial
  CRISPR gRNA sequence
tccctgaccctatgactcag

SEQ ID NO: 777563 - DNA, 20 bp, Artificial
  CRISPR gRNA sequence
ccctgaccctatgactcaga

SEQ ID NO: 777564 - DNA, 20 bp, Artificial
  CRISPR gRNA sequence
cctgaccctatgactcagat

SEQ ID NO: 777565 - DNA, 20 bp, Artificial
  CRISPR gRNA sequence
accctatgactcagatccac

SEQ ID NO: 777566 - DNA, 20 bp, Artificial
  CRISPR gRNA sequence
tgactcagatccacagctta

SEQ ID NO: 777567 - DNA, 20 bp, Artificial
  CRISPR gRNA sequence
agatccacagcttaacagcc

SEQ ID NO: 777568 - DNA, 20 bp, Artificial
  CRISPR gRNA sequence
aacagcccccatgtggtcat

SEQ ID NO: 777569 - DNA, 20 bp, Artificial
  CRISPR gRNA sequence
acagcccccatgtggtcata

SEQ ID NO: 777570 - DNA, 20 bp, Artificial
  CRISPR gRNA sequence
agaggctgcttggatttggt

SEQ ID NO: 777571 - DNA, 20 bp, Artificial
  CRISPR gRNA sequence
cttggatttggtcatttttc

SEQ ID NO: 777572 - DNA, 20 bp, Artificial
  CRISPR gRNA sequence
ggatttggtcatttttctgc

SEQ ID NO: 777573 - DNA, 20 bp, Artificial
  CRISPR gRNA sequence
gatttggtcatttttctgca

SEQ ID NO: 777574 - DNA, 20 bp, Artificial
  CRISPR gRNA sequence
ggtcatttttctgcacagac

SEQ ID NO: 777575 - DNA, 20 bp, Artificial
  CRISPR gRNA sequence
gtcatttttctgcacagacc

SEQ ID NO: 777576 - DNA, 20 bp, Artificial
  CRISPR gRNA sequence
ttctgcacagaccccaaacc

SEQ ID NO: 777577 - DNA, 20 bp, Artificial
  CRISPR gRNA sequence
tctgcacagaccccaaaccc

SEQ ID NO: 777578 - DNA, 20 bp, Artificial
  CRISPR gRNA sequence
ctgcacagaccccaaacccc

SEQ ID NO: 777579 - DNA, 20 bp, Artificial
  CRISPR gRNA sequence
tgcacagaccccaaaccccg

SEQ ID NO: 777580 - DNA, 20 bp, Artificial
  CRISPR gRNA sequence
cacagaccccaaaccccgta

SEQ ID NO: 777581 - DNA, 20 bp, Artificial
  CRISPR gRNA sequence
gttctacaacattttctagg

SEQ ID NO: 777582 - DNA, 20 bp, Artificial
  CRISPR gRNA sequence
ttctacaacattttctagga

SEQ ID NO: 777583 - DNA, 20 bp, Artificial
  CRISPR gRNA sequence
tacaacattttctaggagtc

SEQ ID NO: 777584 - DNA, 20 bp, Artificial
  CRISPR gRNA sequence
caacattttctaggagtctc

SEQ ID NO: 777585 - DNA, 20 bp, Artificial
  CRISPR gRNA sequence
tctaggagtctctttaggtg

SEQ ID NO: 777586 - DNA, 20 bp, Artificial
  CRISPR gRNA sequence
ctaggagtctctttaggtgc

SEQ ID NO: 777587 - DNA, 20 bp, Artificial
  CRISPR gRNA sequence
taggagtctctttaggtgct

SEQ ID NO: 777588 - DNA, 20 bp, Artificial
  CRISPR gRNA sequence
ggagtctctttaggtgctgt

SEQ ID NO: 777589 - DNA, 20 bp, Artificial
  CRISPR gRNA sequence
tttaggtgctgtggaattcc

SEQ ID NO: 777590 - DNA, 20 bp, Artificial
  CRISPR gRNA sequence
taggtgctgtggaattccaa

SEQ ID NO: 777591 - DNA, 20 bp, Artificial
  CRISPR gRNA sequence
aggtgctgtggaattccaac

SEQ ID NO: 777592 - DNA, 20 bp, Artificial
  CRISPR gRNA sequence
ggtgctgtggaattccaact

SEQ ID NO: 777593 - DNA, 20 bp, Artificial
  CRISPR gRNA sequence
tggaattccaactcacagct

SEQ ID NO: 777594 - DNA, 20 bp, Artificial
  CRISPR gRNA sequence
caactcacagctctcttatc

SEQ ID NO: 777595 - DNA, 20 bp, Artificial
  CRISPR gRNA sequence
acagctctcttatcacactg

SEQ ID NO: 777596 - DNA, 20 bp, Artificial
  CRISPR gRNA sequence
tcttatcacactgcatctct

SEQ ID NO: 777597 - DNA, 20 bp, Artificial
  CRISPR gRNA sequence
ttatcacactgcatctctga

SEQ ID NO: 777598 - DNA, 20 bp, Artificial
  CRISPR gRNA sequence
atcacactgcatctctgact

SEQ ID NO: 777599 - DNA, 20 bp, Artificial
  CRISPR gRNA sequence
tcacactgcatctctgactc

SEQ ID NO: 777600 - DNA, 20 bp, Artificial
  CRISPR gRNA sequence
catctctgactccaaacagc

SEQ ID NO: 777601 - DNA, 20 bp, Artificial
  CRISPR gRNA sequence
tgactccaaacagcattgtc

SEQ ID NO: 777602 - DNA, 20 bp, Artificial
  CRISPR gRNA sequence
actccaaacagcattgtcca

SEQ ID NO: 777603 - DNA, 20 bp, Artificial
  CRISPR gRNA sequence
caaacagcattgtccagctc

SEQ ID NO: 777604 - DNA, 20 bp, Artificial
  CRISPR gRNA sequence
tccagctccttgtcaaactc

SEQ ID NO: 777605 - DNA, 20 bp, Artificial
  CRISPR gRNA sequence
cttgtcaaactcaaatccta

SEQ ID NO: 777606 - DNA, 20 bp, Artificial
  CRISPR gRNA sequence
gtcaaactcaaatcctactc

SEQ ID NO: 777607 - DNA, 20 bp, Artificial
  CRISPR gRNA sequence
tcaaactcaaatcctactcc

SEQ ID NO: 777608 - DNA, 20 bp, Artificial
  CRISPR gRNA sequence
aaatcctactccaaagaaca

SEQ ID NO: 777609 - DNA, 20 bp, Artificial
  CRISPR gRNA sequence
ctccaaagaacaaagattta

SEQ ID NO: 777610 - DNA, 20 bp, Artificial
  CRISPR gRNA sequence
caaagaacaaagatttaccc

SEQ ID NO: 777611 - DNA, 20 bp, Artificial
  CRISPR gRNA sequence
acccctccagagaaagccaa

SEQ ID NO: 777612 - DNA, 20 bp, Artificial
  CRISPR gRNA sequence
cccctccagagaaagccaaa

SEQ ID NO: 777613 - DNA, 20 bp, Artificial
  CRISPR gRNA sequence
cagagaaagccaaagtttaa

SEQ ID NO: 777614 - DNA, 20 bp, Artificial
  CRISPR gRNA sequence
aatgatggaattctcacagg

SEQ ID NO: 777615 - DNA, 20 bp, Artificial
  CRISPR gRNA sequence
atgatggaattctcacagga

SEQ ID NO: 777616 - DNA, 20 bp, Artificial
  CRISPR gRNA sequence
tcacaggaagtttcagaagt

SEQ ID NO: 777617 - DNA, 20 bp, Artificial
  CRISPR gRNA sequence
acaggaagtttcagaagtca

SEQ ID NO: 777618 - DNA, 20 bp, Artificial
  CRISPR gRNA sequence
cagaagtcaacctaataagg

SEQ ID NO: 777619 - DNA, 20 bp, Artificial
  CRISPR gRNA sequence
agaagtcaacctaataagga

SEQ ID NO: 777620 - DNA, 20 bp, Artificial
  CRISPR gRNA sequence
ataaggacacagacacccca

SEQ ID NO: 777621 - DNA, 20 bp, Artificial
  CRISPR gRNA sequence
ctttgaagggaccacacttc

SEQ ID NO: 777622 - DNA, 20 bp, Artificial
  CRISPR gRNA sequence
tgaagggaccacacttctat

SEQ ID NO: 777623 - DNA, 20 bp, Artificial
  CRISPR gRNA sequence
gaagggaccacacttctata

SEQ ID NO: 777624 - DNA, 20 bp, Artificial
  CRISPR gRNA sequence
aagggaccacacttctataa

SEQ ID NO: 777625 - DNA, 20 bp, Artificial
  CRISPR gRNA sequence
ctataactgtcctttccata

SEQ ID NO: 777626 - DNA, 20 bp, Artificial
  CRISPR gRNA sequence
tataactgtcctttccataa

SEQ ID NO: 777627 - DNA, 20 bp, Artificial
  CRISPR gRNA sequence
taactgtcctttccataaat

SEQ ID NO: 777628 - DNA, 20 bp, Artificial
  CRISPR gRNA sequence
tcctttccataaatattaaa

SEQ ID NO: 777629 - DNA, 20 bp, Artificial
  CRISPR gRNA sequence
tccataaatattaaagcacc

SEQ ID NO: 777630 - DNA, 20 bp, Artificial
  CRISPR gRNA sequence
ccataaatattaaagcaccg

SEQ ID NO: 777631 - DNA, 20 bp, Artificial
  CRISPR gRNA sequence
cataaatattaaagcaccga

SEQ ID NO: 777632 - DNA, 20 bp, Artificial
  CRISPR gRNA sequence
aagcaccgaagccagctgtc

SEQ ID NO: 777633 - DNA, 20 bp, Artificial
  CRISPR gRNA sequence
tcaggtatatgaacatgaga

SEQ ID NO: 777634 - DNA, 20 bp, Artificial
  CRISPR gRNA sequence
agccaaccctccatcgggtg

SEQ ID NO: 777635 - DNA, 20 bp, Artificial
  CRISPR gRNA sequence
catcgggtggtgcctggaca

SEQ ID NO: 777636 - DNA, 20 bp, Artificial
  CRISPR gRNA sequence
gacagagctgaagaggggac

SEQ ID NO: 777637 - DNA, 20 bp, Artificial
  CRISPR gRNA sequence
aagaggggacaggaaggaaa

SEQ ID NO: 777638 - DNA, 20 bp, Artificial
  CRISPR gRNA sequence
agattccaacaccccttctc

SEQ ID NO: 777639 - DNA, 20 bp, Artificial
  CRISPR gRNA sequence
caacaccccttctcacctga

SEQ ID NO: 777640 - DNA, 20 bp, Artificial
  CRISPR gRNA sequence
ctcacctgagacttgcatta

SEQ ID NO: 777641 - DNA, 20 bp, Artificial
  CRISPR gRNA sequence
tcacctgagacttgcattaa

SEQ ID NO: 777642 - DNA, 20 bp, Artificial
  CRISPR gRNA sequence
acctgagacttgcattaaca

SEQ ID NO: 777643 - DNA, 20 bp, Artificial
  CRISPR gRNA sequence
agacttgcattaacacaggc

SEQ ID NO: 777644 - DNA, 20 bp, Artificial
  CRISPR gRNA sequence
gcattaacacaggctcctta

SEQ ID NO: 777645 - DNA, 20 bp, Artificial
  CRISPR gRNA sequence
cattaacacaggctccttac

SEQ ID NO: 777646 - DNA, 20 bp, Artificial
  CRISPR gRNA sequence
acacaggctccttacctctg

SEQ ID NO: 777647 - DNA, 20 bp, Artificial
  CRISPR gRNA sequence
cttacctctgacaagctcat

SEQ ID NO: 777648 - DNA, 20 bp, Artificial
  CRISPR gRNA sequence
acctctgacaagctcatgtc

SEQ ID NO: 777649 - DNA, 20 bp, Artificial
  CRISPR gRNA sequence
cctctgacaagctcatgtct

SEQ ID NO: 777650 - DNA, 20 bp, Artificial
  CRISPR gRNA sequence
tgacaagctcatgtctcaca

SEQ ID NO: 777651 - DNA, 20 bp, Artificial
  CRISPR gRNA sequence
acaagctcatgtctcacagc

SEQ ID NO: 777652 - DNA, 20 bp, Artificial
  CRISPR gRNA sequence
atgtctcacagcacaggagt

SEQ ID NO: 777653 - DNA, 20 bp, Artificial
  CRISPR gRNA sequence
acagcacaggagtctagagt

SEQ ID NO: 777654 - DNA, 20 bp, Artificial
  CRISPR gRNA sequence
gagtaagctggaaagcttac

SEQ ID NO: 777655 - DNA, 20 bp, Artificial
  CRISPR gRNA sequence
gaaagcttactgcaggcagg

SEQ ID NO: 777656 - DNA, 20 bp, Artificial
  CRISPR gRNA sequence
actgcaggcaggagaaacca

SEQ ID NO: 777657 - DNA, 20 bp, Artificial
  CRISPR gRNA sequence
ctgcaggcaggagaaaccac

SEQ ID NO: 777658 - DNA, 20 bp, Artificial
  CRISPR gRNA sequence
caggcaggagaaaccaccag

SEQ ID NO: 777659 - DNA, 20 bp, Artificial
  CRISPR gRNA sequence
caaaggtcagtcatgggacc

SEQ ID NO: 777660 - DNA, 20 bp, Artificial
  CRISPR gRNA sequence
actgcatcactgaggccact

SEQ ID NO: 777661 - DNA, 20 bp, Artificial
  CRISPR gRNA sequence
catcactgaggccacttaat

SEQ ID NO: 777662 - DNA, 20 bp, Artificial
  CRISPR gRNA sequence
aggccacttaatgcaggaac

SEQ ID NO: 777663 - DNA, 20 bp, Artificial
  CRISPR gRNA sequence
aatgcaggaacgaagctctc

SEQ ID NO: 777664 - DNA, 20 bp, Artificial
  CRISPR gRNA sequence
atgcaggaacgaagctctct

SEQ ID NO: 777665 - DNA, 20 bp, Artificial
  CRISPR gRNA sequence
tctcccgccagcgtcccctt

SEQ ID NO: 777666 - DNA, 20 bp, Artificial
  CRISPR gRNA sequence
tcccgccagcgtccccttgc

SEQ ID NO: 777667 - DNA, 20 bp, Artificial
  CRISPR gRNA sequence
ccgccagcgtccccttgcca

SEQ ID NO: 777668 - DNA, 20 bp, Artificial
  CRISPR gRNA sequence
gccatacaacccctcagaac

SEQ ID NO: 777669 - DNA, 20 bp, Artificial
  CRISPR gRNA sequence
ccatacaacccctcagaaca

SEQ ID NO: 777670 - DNA, 20 bp, Artificial
  CRISPR gRNA sequence
agaacaaaaactgaggtcca

SEQ ID NO: 777671 - DNA, 20 bp, Artificial
  CRISPR gRNA sequence
aggtccacagggctgaccca

SEQ ID NO: 777672 - DNA, 20 bp, Artificial
  CRISPR gRNA sequence
acccaaagtcatgaaggaaa

SEQ ID NO: 777673 - DNA, 20 bp, Artificial
  CRISPR gRNA sequence
cattcacatcaggatactcc

SEQ ID NO: 777674 - DNA, 20 bp, Artificial
  CRISPR gRNA sequence
attcacatcaggatactcca

SEQ ID NO: 777675 - DNA, 20 bp, Artificial
  CRISPR gRNA sequence
acatcaggatactccagtaa

SEQ ID NO: 777676 - DNA, 20 bp, Artificial
  CRISPR gRNA sequence
cagtaagctgacggtgacgt

SEQ ID NO: 777677 - DNA, 20 bp, Artificial
  CRISPR gRNA sequence
acggtgacgtatgtaaattt

SEQ ID NO: 777678 - DNA, 20 bp, Artificial
  CRISPR gRNA sequence
ccacggtcaacagttaccct

SEQ ID NO: 777679 - DNA, 20 bp, Artificial
  CRISPR gRNA sequence
cacggtcaacagttacccta

SEQ ID NO: 777680 - DNA, 20 bp, Artificial
  CRISPR gRNA sequence
ccctaagtgttagtgcttaa

SEQ ID NO: 777681 - DNA, 20 bp, Artificial
  CRISPR gRNA sequence
agtgttagtgcttaatctca

SEQ ID NO: 777682 - DNA, 20 bp, Artificial
  CRISPR gRNA sequence
gtgcttaatctcaagaactc

SEQ ID NO: 777683 - DNA, 20 bp, Artificial
  CRISPR gRNA sequence
aatctcaagaactccagata

SEQ ID NO: 777684 - DNA, 20 bp, Artificial
  CRISPR gRNA sequence
atctcaagaactccagatat

SEQ ID NO: 777685 - DNA, 20 bp, Artificial
  CRISPR gRNA sequence
aagaactccagatatcagga

SEQ ID NO: 777686 - DNA, 20 bp, Artificial
  CRISPR gRNA sequence
cagatatcaggaaaatgtac

SEQ ID NO: 777687 - DNA, 20 bp, Artificial
  CRISPR gRNA sequence
acccaaaatactcccttgaa

SEQ ID NO: 777688 - DNA, 20 bp, Artificial
  CRISPR gRNA sequence
ccttgaaatgagccacttca

SEQ ID NO: 777689 - DNA, 20 bp, Artificial
  CRISPR gRNA sequence
gaaatgagccacttcatacc

SEQ ID NO: 777690 - DNA, 20 bp, Artificial
  CRISPR gRNA sequence
aaatgagccacttcataccc

SEQ ID NO: 777691 - DNA, 20 bp, Artificial
  CRISPR gRNA sequence
cataccctacagccccatag

SEQ ID NO: 777692 - DNA, 20 bp, Artificial
  CRISPR gRNA sequence
ataccctacagccccatagc

SEQ ID NO: 777693 - DNA, 20 bp, Artificial
  CRISPR gRNA sequence
cagccccatagccctccatc

SEQ ID NO: 777694 - DNA, 20 bp, Artificial
  CRISPR gRNA sequence
catcctgccctgcactcaga

SEQ ID NO: 777695 - DNA, 20 bp, Artificial
  CRISPR gRNA sequence
ccctgcactcagatcagctc

SEQ ID NO: 777696 - DNA, 20 bp, Artificial
  CRISPR gRNA sequence
cactcagatcagctcaaccc

SEQ ID NO: 777697 - DNA, 20 bp, Artificial
  CRISPR gRNA sequence
agatcagctcaacccatcgg

SEQ ID NO: 777698 - DNA, 20 bp, Artificial
  CRISPR gRNA sequence
aacccatcggacaggtttag

SEQ ID NO: 777699 - DNA, 20 bp, Artificial
  CRISPR gRNA sequence
agacttcaagtttagacttc

SEQ ID NO: 777700 - DNA, 20 bp, Artificial
  CRISPR gRNA sequence
gacttcaagtttagacttca

SEQ ID NO: 777701 - DNA, 20 bp, Artificial
  CRISPR gRNA sequence
caagtttagacttcagttcc

SEQ ID NO: 777702 - DNA, 20 bp, Artificial
  CRISPR gRNA sequence
aagtttagacttcagttccc

SEQ ID NO: 777703 - DNA, 20 bp, Artificial
  CRISPR gRNA sequence
agacttcagttcccctcagc

SEQ ID NO: 777704 - DNA, 20 bp, Artificial
  CRISPR gRNA sequence
gacttcagttcccctcagcc

SEQ ID NO: 777705 - DNA, 20 bp, Artificial
  CRISPR gRNA sequence
cagttcccctcagcctcaaa

SEQ ID NO: 777706 - DNA, 20 bp, Artificial
  CRISPR gRNA sequence
agttcccctcagcctcaaac

SEQ ID NO: 777707 - DNA, 20 bp, Artificial
  CRISPR gRNA sequence
ccctcagcctcaaactgtcc

SEQ ID NO: 777708 - DNA, 20 bp, Artificial
  CRISPR gRNA sequence
agcctcaaactgtcccacct

SEQ ID NO: 777709 - DNA, 20 bp, Artificial
  CRISPR gRNA sequence
aaactgtcccacctatttgc

SEQ ID NO: 777710 - DNA, 20 bp, Artificial
  CRISPR gRNA sequence
tcccacctatttgcagtccc

SEQ ID NO: 777711 - DNA, 20 bp, Artificial
  CRISPR gRNA sequence
tttgcagtcccccacactac

SEQ ID NO: 777712 - DNA, 20 bp, Artificial
  CRISPR gRNA sequence
gcagtcccccacactacaag

SEQ ID NO: 777713 - DNA, 20 bp, Artificial
  CRISPR gRNA sequence
cagtcccccacactacaagg

SEQ ID NO: 777714 - DNA, 20 bp, Artificial
  CRISPR gRNA sequence
caaggaaggctgcacagcat

SEQ ID NO: 777715 - DNA, 20 bp, Artificial
  CRISPR gRNA sequence
cacagcatcagatttcctag

SEQ ID NO: 777716 - DNA, 20 bp, Artificial
  CRISPR gRNA sequence
cctagggacttctgggaggc

SEQ ID NO: 777717 - DNA, 20 bp, Artificial
  CRISPR gRNA sequence
ctagggacttctgggaggcc

SEQ ID NO: 777718 - DNA, 20 bp, Artificial
  CRISPR gRNA sequence
gggacttctgggaggccaga

SEQ ID NO: 777719 - DNA, 20 bp, Artificial
  CRISPR gRNA sequence
ctgggaggccagagggaact

SEQ ID NO: 777720 - DNA, 20 bp, Artificial
  CRISPR gRNA sequence
tgggaggccagagggaacta

SEQ ID NO: 777721 - DNA, 20 bp, Artificial
  CRISPR gRNA sequence
ggaggccagagggaactaga

SEQ ID NO: 777722 - DNA, 20 bp, Artificial
  CRISPR gRNA sequence
gaggaggccgcactaaataa

SEQ ID NO: 777723 - DNA, 20 bp, Artificial
  CRISPR gRNA sequence
aataaagaactctcttaaag

SEQ ID NO: 777724 - DNA, 20 bp, Artificial
  CRISPR gRNA sequence
tcttaaagacaaagcagctt

SEQ ID NO: 777725 - DNA, 20 bp, Artificial
  CRISPR gRNA sequence
ttaaagacaaagcagcttca

SEQ ID NO: 777726 - DNA, 20 bp, Artificial
  CRISPR gRNA sequence
aaagacaaagcagcttcatt

SEQ ID NO: 777727 - DNA, 20 bp, Artificial
  CRISPR gRNA sequence
aagacaaagcagcttcatta

SEQ ID NO: 777728 - DNA, 20 bp, Artificial
  CRISPR gRNA sequence
cattactttctaatatagaa

SEQ ID NO: 777729 - DNA, 20 bp, Artificial
  CRISPR gRNA sequence
attactttctaatatagaaa

SEQ ID NO: 777730 - DNA, 20 bp, Artificial
  CRISPR gRNA sequence
ctttctaatatagaaactaa

SEQ ID NO: 777731 - DNA, 20 bp, Artificial
  CRISPR gRNA sequence
tctaatatagaaactaactg

SEQ ID NO: 777732 - DNA, 20 bp, Artificial
  CRISPR gRNA sequence
ctaatatagaaactaactgc

SEQ ID NO: 777733 - DNA, 20 bp, Artificial
  CRISPR gRNA sequence
taatatagaaactaactgct

SEQ ID NO: 777734 - DNA, 20 bp, Artificial
  CRISPR gRNA sequence
atatagaaactaactgctga

SEQ ID NO: 777735 - DNA, 20 bp, Artificial
  CRISPR gRNA sequence
actgctgaagacatgcttat

SEQ ID NO: 777736 - DNA, 20 bp, Artificial
  CRISPR gRNA sequence
ctgaagacatgcttataaga

SEQ ID NO: 777737 - DNA, 20 bp, Artificial
  CRISPR gRNA sequence
aagacatgcttataagaaaa

SEQ ID NO: 777738 - DNA, 20 bp, Artificial
  CRISPR gRNA sequence
ataagaaaaggaccccgggc

SEQ ID NO: 777739 - DNA, 20 bp, Artificial
  CRISPR gRNA sequence
taagaaaaggaccccgggct

SEQ ID NO: 777740 - DNA, 20 bp, Artificial
  CRISPR gRNA sequence
taatgaagagatcagactca

SEQ ID NO: 777741 - DNA, 20 bp, Artificial
  CRISPR gRNA sequence
aatgaagagatcagactcat

SEQ ID NO: 777742 - DNA, 20 bp, Artificial
  CRISPR gRNA sequence
atgaagagatcagactcatt

SEQ ID NO: 777743 - DNA, 20 bp, Artificial
  CRISPR gRNA sequence
atttacaattatccacatcc

SEQ ID NO: 777744 - DNA, 20 bp, Artificial
  CRISPR gRNA sequence
acaattatccacatccaatt

SEQ ID NO: 777745 - DNA, 20 bp, Artificial
  CRISPR gRNA sequence
caattatccacatccaattt

SEQ ID NO: 777746 - DNA, 20 bp, Artificial
  CRISPR gRNA sequence
tccacatccaatttgaaggt

SEQ ID NO: 777747 - DNA, 20 bp, Artificial
  CRISPR gRNA sequence
gaaggtaaatcgtttttcta

SEQ ID NO: 777748 - DNA, 20 bp, Artificial
  CRISPR gRNA sequence
aaggtaaatcgtttttctaa

SEQ ID NO: 777749 - DNA, 20 bp, Artificial
  CRISPR gRNA sequence
ttctaaattaagacaactaa

SEQ ID NO: 777750 - DNA, 20 bp, Artificial
  CRISPR gRNA sequence
tctaaattaagacaactaac

SEQ ID NO: 777751 - DNA, 20 bp, Artificial
  CRISPR gRNA sequence
ctaaattaagacaactaaca

SEQ ID NO: 777752 - DNA, 20 bp, Artificial
  CRISPR gRNA sequence
taaattaagacaactaacac

SEQ ID NO: 777753 - DNA, 20 bp, Artificial
  CRISPR gRNA sequence
aattaagacaactaacaccc

SEQ ID NO: 777754 - DNA, 20 bp, Artificial
  CRISPR gRNA sequence
agacaactaacaccccccca

SEQ ID NO: 777755 - DNA, 20 bp, Artificial
  CRISPR gRNA sequence
acacccccccacccgccaca

SEQ ID NO: 777756 - DNA, 20 bp, Artificial
  CRISPR gRNA sequence
ttttgctttactatttgctt

SEQ ID NO: 777757 - DNA, 20 bp, Artificial
  CRISPR gRNA sequence
tttgctttactatttgctta

SEQ ID NO: 777758 - DNA, 20 bp, Artificial
  CRISPR gRNA sequence
ttgctttactatttgcttaa

SEQ ID NO: 777759 - DNA, 20 bp, Artificial
  CRISPR gRNA sequence
tgctttactatttgcttaat

SEQ ID NO: 777760 - DNA, 20 bp, Artificial
  CRISPR gRNA sequence
gctttactatttgcttaatg

SEQ ID NO: 777761 - DNA, 20 bp, Artificial
  CRISPR gRNA sequence
ctttactatttgcttaatgt

SEQ ID NO: 777762 - DNA, 20 bp, Artificial
  CRISPR gRNA sequence
tactatttgcttaatgtttt

SEQ ID NO: 777763 - DNA, 20 bp, Artificial
  CRISPR gRNA sequence
actatttgcttaatgttttc

SEQ ID NO: 777764 - DNA, 20 bp, Artificial
  CRISPR gRNA sequence
ctatttgcttaatgttttcc

SEQ ID NO: 777765 - DNA, 20 bp, Artificial
  CRISPR gRNA sequence
tttgcttaatgttttccctc

SEQ ID NO: 777766 - DNA, 20 bp, Artificial
  CRISPR gRNA sequence
gcttaatgttttccctcagt

SEQ ID NO: 777767 - DNA, 20 bp, Artificial
  CRISPR gRNA sequence
cttaatgttttccctcagtg

SEQ ID NO: 777768 - DNA, 20 bp, Artificial
  CRISPR gRNA sequence
aatgttttccctcagtgata

SEQ ID NO: 777769 - DNA, 20 bp, Artificial
  CRISPR gRNA sequence
atgttttccctcagtgatag

SEQ ID NO: 777770 - DNA, 20 bp, Artificial
  CRISPR gRNA sequence
tccctcagtgatagatccca

SEQ ID NO: 777771 - DNA, 20 bp, Artificial
  CRISPR gRNA sequence
ccctcagtgatagatcccat

SEQ ID NO: 777772 - DNA, 20 bp, Artificial
  CRISPR gRNA sequence
cctcagtgatagatcccata

SEQ ID NO: 777773 - DNA, 20 bp, Artificial
  CRISPR gRNA sequence
agtgatagatcccatatctg

SEQ ID NO: 777774 - DNA, 20 bp, Artificial
  CRISPR gRNA sequence
agtcatctatcacgcttttc

SEQ ID NO: 777775 - DNA, 20 bp, Artificial
  CRISPR gRNA sequence
tcacgcttttctcattagag

SEQ ID NO: 777776 - DNA, 20 bp, Artificial
  CRISPR gRNA sequence
ttctcattagagcaggtttg

SEQ ID NO: 777777 - DNA, 20 bp, Artificial
  CRISPR gRNA sequence
tctcattagagcaggtttgg

SEQ ID NO: 777778 - DNA, 20 bp, Artificial
  CRISPR gRNA sequence
ctcattagagcaggtttggc

SEQ ID NO: 777779 - DNA, 20 bp, Artificial
  CRISPR gRNA sequence
tcattagagcaggtttggct

SEQ ID NO: 777780 - DNA, 20 bp, Artificial
  CRISPR gRNA sequence
attagagcaggtttggctta

SEQ ID NO: 777781 - DNA, 20 bp, Artificial
  CRISPR gRNA sequence
gagcaggtttggcttagaaa

SEQ ID NO: 777782 - DNA, 20 bp, Artificial
  CRISPR gRNA sequence
ggcttagaaataaatcccct

SEQ ID NO: 777783 - DNA, 20 bp, Artificial
  CRISPR gRNA sequence
gcttagaaataaatcccctg

SEQ ID NO: 777784 - DNA, 20 bp, Artificial
  CRISPR gRNA sequence
agaaataaatcccctgcctt

SEQ ID NO: 777785 - DNA, 20 bp, Artificial
  CRISPR gRNA sequence
gaaataaatcccctgcctta

SEQ ID NO: 777786 - DNA, 20 bp, Artificial
  CRISPR gRNA sequence
ccttaggctgccaaacctgc

SEQ ID NO: 777787 - DNA, 20 bp, Artificial
  CRISPR gRNA sequence
aggctgccaaacctgccaat

SEQ ID NO: 777788 - DNA, 20 bp, Artificial
  CRISPR gRNA sequence
ggctgccaaacctgccaatt

SEQ ID NO: 777789 - DNA, 20 bp, Artificial
  CRISPR gRNA sequence
ccaaacctgccaattcgcta

SEQ ID NO: 777790 - DNA, 20 bp, Artificial
  CRISPR gRNA sequence
ccaattcgctagctaaacgg

SEQ ID NO: 777791 - DNA, 20 bp, Artificial
  CRISPR gRNA sequence
gctagctaaacggtcgcagg

SEQ ID NO: 777792 - DNA, 20 bp, Artificial
  CRISPR gRNA sequence
gctaaacggtcgcagggagg

SEQ ID NO: 777793 - DNA, 20 bp, Artificial
  CRISPR gRNA sequence
aacggtcgcagggagggccc

SEQ ID NO: 777794 - DNA, 20 bp, Artificial
  CRISPR gRNA sequence
ggcgctggaattcaatcccc

SEQ ID NO: 777795 - DNA, 20 bp, Artificial
  CRISPR gRNA sequence
gaattcaatcccctcccttc

SEQ ID NO: 777796 - DNA, 20 bp, Artificial
  CRISPR gRNA sequence
aatcccctcccttctagtgt

SEQ ID NO: 777797 - DNA, 20 bp, Artificial
  CRISPR gRNA sequence
ccttctagtgtgcccccact

SEQ ID NO: 777798 - DNA, 20 bp, Artificial
  CRISPR gRNA sequence
ctagtgtgcccccactcggg

SEQ ID NO: 777799 - DNA, 20 bp, Artificial
  CRISPR gRNA sequence
tagtgtgcccccactcgggg

SEQ ID NO: 777800 - DNA, 20 bp, Artificial
  CRISPR gRNA sequence
gtgtgcccccactcggggtc

SEQ ID NO: 777801 - DNA, 20 bp, Artificial
  CRISPR gRNA sequence
ggggtccccacctccctcca

SEQ ID NO: 777802 - DNA, 20 bp, Artificial
  CRISPR gRNA sequence
cctccaccgtcgcccgcatc

SEQ ID NO: 777803 - DNA, 20 bp, Artificial
  CRISPR gRNA sequence
caccgtcgcccgcatctcct

SEQ ID NO: 777804 - DNA, 20 bp, Artificial
  CRISPR gRNA sequence
ctctccatcccacctcaccc

SEQ ID NO: 777805 - DNA, 20 bp, Artificial
  CRISPR gRNA sequence
tccatcccacctcacccccc

SEQ ID NO: 777806 - DNA, 20 bp, Artificial
  CRISPR gRNA sequence
catcccacctcaccccccac

SEQ ID NO: 777807 - DNA, 20 bp, Artificial
  CRISPR gRNA sequence
accccccacctccctgaggc

SEQ ID NO: 777808 - DNA, 20 bp, Artificial
  CRISPR gRNA sequence
cctgaggcttcccaagccca

SEQ ID NO: 777809 - DNA, 20 bp, Artificial
  CRISPR gRNA sequence
aggcttcccaagcccaaact

SEQ ID NO: 777810 - DNA, 20 bp, Artificial
  CRISPR gRNA sequence
cccaagcccaaactgcccat

SEQ ID NO: 777811 - DNA, 20 bp, Artificial
  CRISPR gRNA sequence
ccaagcccaaactgcccatc

SEQ ID NO: 777812 - DNA, 20 bp, Artificial
  CRISPR gRNA sequence
cccatcccaattccctcccc

SEQ ID NO: 777813 - DNA, 20 bp, Artificial
  CRISPR gRNA sequence
cctccccacccccaacacct

SEQ ID NO: 777814 - DNA, 20 bp, Artificial
  CRISPR gRNA sequence
cccacccccaacacctattc

SEQ ID NO: 777815 - DNA, 20 bp, Artificial
  CRISPR gRNA sequence
ttcaccccgtggcccctgcc

SEQ ID NO: 777816 - DNA, 20 bp, Artificial
  CRISPR gRNA sequence
accccgtggcccctgccagc

SEQ ID NO: 777817 - DNA, 20 bp, Artificial
  CRISPR gRNA sequence
ccagccgtctctacctgtcc

SEQ ID NO: 777818 - DNA, 20 bp, Artificial
  CRISPR gRNA sequence
tacctgtccttcccggaatc

SEQ ID NO: 777819 - DNA, 20 bp, Artificial
  CRISPR gRNA sequence
cctgtccttcccggaatctg

SEQ ID NO: 777820 - DNA, 20 bp, Artificial
  CRISPR gRNA sequence
tccttcccggaatctgaccc

SEQ ID NO: 777821 - DNA, 20 bp, Artificial
  CRISPR gRNA sequence
cccggaatctgacccctcat

SEQ ID NO: 777822 - DNA, 20 bp, Artificial
  CRISPR gRNA sequence
ccggaatctgacccctcatg

SEQ ID NO: 777823 - DNA, 20 bp, Artificial
  CRISPR gRNA sequence
acccctcatgctgcccacgg

SEQ ID NO: 777824 - DNA, 20 bp, Artificial
  CRISPR gRNA sequence
atgctgcccacggctgcctg

SEQ ID NO: 777825 - DNA, 20 bp, Artificial
  CRISPR gRNA sequence
cccacggctgcctgtggaag

SEQ ID NO: 777826 - DNA, 20 bp, Artificial
  CRISPR gRNA sequence
cctgtggaagtgcaccagtc

SEQ ID NO: 777827 - DNA, 20 bp, Artificial
  CRISPR gRNA sequence
tggaagtgcaccagtcgccc

SEQ ID NO: 777828 - DNA, 20 bp, Artificial
  CRISPR gRNA sequence
cgccctgctgggccctgcag

SEQ ID NO: 777829 - DNA, 20 bp, Artificial
  CRISPR gRNA sequence
gccctgctgggccctgcaga

SEQ ID NO: 777830 - DNA, 20 bp, Artificial
  CRISPR gRNA sequence
ctgggccctgcagagtggac

SEQ ID NO: 777831 - DNA, 20 bp, Artificial
  CRISPR gRNA sequence
ggccctgcagagtggacacg

SEQ ID NO: 777832 - DNA, 20 bp, Artificial
  CRISPR gRNA sequence
cagagtggacacgcctaacc

SEQ ID NO: 777833 - DNA, 20 bp, Artificial
  CRISPR gRNA sequence
accactcgccttccctcccc

SEQ ID NO: 777834 - DNA, 20 bp, Artificial
  CRISPR gRNA sequence
gccttccctccccgccgctc

SEQ ID NO: 777835 - DNA, 20 bp, Artificial
  CRISPR gRNA sequence
ccctccccgccgctcccctc

SEQ ID NO: 777836 - DNA, 20 bp, Artificial
  CRISPR gRNA sequence
cctccccgccgctcccctcc

SEQ ID NO: 777837 - DNA, 20 bp, Artificial
  CRISPR gRNA sequence
cccgccgctcccctcccgga

SEQ ID NO: 777838 - DNA, 20 bp, Artificial
  CRISPR gRNA sequence
ccctcccggagctgggcgtt

SEQ ID NO: 777839 - DNA, 20 bp, Artificial
  CRISPR gRNA sequence
ccggagctgggcgttttcct

SEQ ID NO: 777840 - DNA, 20 bp, Artificial
  CRISPR gRNA sequence
ggcgttttcctctgcaggac

SEQ ID NO: 777841 - DNA, 20 bp, Artificial
  CRISPR gRNA sequence
tcctctgcaggacccgagac

SEQ ID NO: 777842 - DNA, 20 bp, Artificial
  CRISPR gRNA sequence
cctctgcaggacccgagacc

SEQ ID NO: 777843 - DNA, 20 bp, Artificial
  CRISPR gRNA sequence
ctctgcaggacccgagaccc

SEQ ID NO: 777844 - DNA, 20 bp, Artificial
  CRISPR gRNA sequence
tgcaggacccgagaccccgc

SEQ ID NO: 777845 - DNA, 20 bp, Artificial
  CRISPR gRNA sequence
caggacccgagaccccgcta

SEQ ID NO: 777846 - DNA, 20 bp, Artificial
  CRISPR gRNA sequence
acctcccagcgccggccggt

SEQ ID NO: 777847 - DNA, 20 bp, Artificial
  CRISPR gRNA sequence
ccagcgccggccggtggctt

SEQ ID NO: 777848 - DNA, 20 bp, Artificial
  CRISPR gRNA sequence
cgttaagcttcaacacggga

SEQ ID NO: 777849 - DNA, 20 bp, Artificial
  CRISPR gRNA sequence
gttaagcttcaacacgggac

SEQ ID NO: 777850 - DNA, 20 bp, Artificial
  CRISPR gRNA sequence
agcttcaacacgggacagat

SEQ ID NO: 777851 - DNA, 20 bp, Artificial
  CRISPR gRNA sequence
caacacgggacagatctgcc

SEQ ID NO: 777852 - DNA, 20 bp, Artificial
  CRISPR gRNA sequence
aacacgggacagatctgccc

SEQ ID NO: 777853 - DNA, 20 bp, Artificial
  CRISPR gRNA sequence
cccccatgcccgctccagac

SEQ ID NO: 777854 - DNA, 20 bp, Artificial
  CRISPR gRNA sequence
cagacccggggcctgcaaaa

SEQ ID NO: 777855 - DNA, 20 bp, Artificial
  CRISPR gRNA sequence
caaaagcgcattcacccacc

SEQ ID NO: 777856 - DNA, 20 bp, Artificial
  CRISPR gRNA sequence
acccacccggcccggtccgc

SEQ ID NO: 777857 - DNA, 20 bp, Artificial
  CRISPR gRNA sequence
ccggggtctgcaggtccgac

SEQ ID NO: 777858 - DNA, 20 bp, Artificial
  CRISPR gRNA sequence
cggggtctgcaggtccgacg

SEQ ID NO: 777859 - DNA, 20 bp, Artificial
  CRISPR gRNA sequence
caggtccgacggcgcccggg

SEQ ID NO: 777860 - DNA, 20 bp, Artificial
  CRISPR gRNA sequence
tcaacccgaggaaagggggg

SEQ ID NO: 777861 - DNA, 20 bp, Artificial
  CRISPR gRNA sequence
aacccgaggaaaggggggcg

SEQ ID NO: 777862 - DNA, 20 bp, Artificial
  CRISPR gRNA sequence
tccgcgggccccacagccca

SEQ ID NO: 777863 - DNA, 20 bp, Artificial
  CRISPR gRNA sequence
cgcgggccccacagcccagg

SEQ ID NO: 777864 - DNA, 20 bp, Artificial
  CRISPR gRNA sequence
ccgggactcctgtgcgaggg

SEQ ID NO: 777865 - DNA, 20 bp, Artificial
  CRISPR gRNA sequence
ctgtgcgaggggggccgccc

SEQ ID NO: 777866 - DNA, 20 bp, Artificial
  CRISPR gRNA sequence
tgcgaggggggccgcccgga

SEQ ID NO: 777867 - DNA, 20 bp, Artificial
  CRISPR gRNA sequence
ggggagggcaggggagcagg

SEQ ID NO: 777868 - DNA, 20 bp, Artificial
  CRISPR gRNA sequence
ctcagctcctgcagccctga

SEQ ID NO: 777869 - DNA, 20 bp, Artificial
  CRISPR gRNA sequence
agctcctgcagccctgagcg

SEQ ID NO: 777870 - DNA, 20 bp, Artificial
  CRISPR gRNA sequence
ctgcagccctgagcgggaac

SEQ ID NO: 777871 - DNA, 20 bp, Artificial
  CRISPR gRNA sequence
cagccctgagcgggaacgtg

SEQ ID NO: 777872 - DNA, 20 bp, Artificial
  CRISPR gRNA sequence
agcgggaacgtgcggacctc

SEQ ID NO: 777873 - DNA, 20 bp, Artificial
  CRISPR gRNA sequence
cgcgggatccaggcccggcc

SEQ ID NO: 777874 - DNA, 20 bp, Artificial
  CRISPR gRNA sequence
accgcgccgcgccgactctg

SEQ ID NO: 777875 - DNA, 20 bp, Artificial
  CRISPR gRNA sequence
tgggactcagggacgcggcc

SEQ ID NO: 777876 - DNA, 20 bp, Artificial
  CRISPR gRNA sequence
ggactcagggacgcggccca

SEQ ID NO: 777877 - DNA, 20 bp, Artificial
  CRISPR gRNA sequence
agggacgcggcccagcctgg

SEQ ID NO: 777878 - DNA, 20 bp, Artificial
  CRISPR gRNA sequence
gctcagtcgccgccgcagcg

SEQ ID NO: 777879 - DNA, 20 bp, Artificial
  CRISPR gRNA sequence
agtcgccgccgcagcgaggc

SEQ ID NO: 777880 - DNA, 20 bp, Artificial
  CRISPR gRNA sequence
aggcccggaaaggcggctcc

SEQ ID NO: 777881 - DNA, 20 bp, Artificial
  CRISPR gRNA sequence
cggtgcgtccctgaggccgg

SEQ ID NO: 777882 - DNA, 20 bp, Artificial
  CRISPR gRNA sequence
aggccggattggccccgcgg

SEQ ID NO: 777883 - DNA, 20 bp, Artificial
  CRISPR gRNA sequence
gccccgcggtggcggctgct

SEQ ID NO: 777884 - DNA, 20 bp, Artificial
  CRISPR gRNA sequence
ctgaccgaggcctgagccag

SEQ ID NO: 777885 - DNA, 20 bp, Artificial
  CRISPR gRNA sequence
accgaggcctgagccagccc

SEQ ID NO: 777886 - DNA, 20 bp, Artificial
  CRISPR gRNA sequence
agccagcccgctgggcagag

SEQ ID NO: 777887 - DNA, 20 bp, Artificial
  CRISPR gRNA sequence
ggcagagcacacggcctggc

SEQ ID NO: 777888 - DNA, 20 bp, Artificial
  CRISPR gRNA sequence
gcccccgcccccgccccgcc

SEQ ID NO: 777889 - DNA, 20 bp, Artificial
  CRISPR gRNA sequence
aaaaccaaaactttccaaat

SEQ ID NO: 777890 - DNA, 20 bp, Artificial
  CRISPR gRNA sequence
ccaaaactttccaaataagc

SEQ ID NO: 777891 - DNA, 20 bp, Artificial
  CRISPR gRNA sequence
caaaactttccaaataagcc

SEQ ID NO: 777892 - DNA, 20 bp, Artificial
  CRISPR gRNA sequence
caaataagccaggctttcgt

SEQ ID NO: 777893 - DNA, 20 bp, Artificial
  CRISPR gRNA sequence
ccaggctttcgtcagttcct

SEQ ID NO: 777894 - DNA, 20 bp, Artificial
  CRISPR gRNA sequence
tttcgtcagttcctcagaac

SEQ ID NO: 777895 - DNA, 20 bp, Artificial
  CRISPR gRNA sequence
cagttcctcagaactagttc

SEQ ID NO: 777896 - DNA, 20 bp, Artificial
  CRISPR gRNA sequence
tttgactcactctcatgtta

SEQ ID NO: 777897 - DNA, 20 bp, Artificial
  CRISPR gRNA sequence
ctcatgttacggcaaacctt

SEQ ID NO: 777898 - DNA, 20 bp, Artificial
  CRISPR gRNA sequence
atatcttaacgccaaatttt

SEQ ID NO: 777899 - DNA, 20 bp, Artificial
  CRISPR gRNA sequence
ttacccatcctcatatgtcc

SEQ ID NO: 777900 - DNA, 20 bp, Artificial
  CRISPR gRNA sequence
ccatcctcatatgtcccagc

SEQ ID NO: 777901 - DNA, 20 bp, Artificial
  CRISPR gRNA sequence
cctcatatgtcccagctaga

SEQ ID NO: 777902 - DNA, 20 bp, Artificial
  CRISPR gRNA sequence
gtcccagctagaaagaatcc

SEQ ID NO: 777903 - DNA, 20 bp, Artificial
  CRISPR gRNA sequence
tcccagctagaaagaatcct

SEQ ID NO: 777904 - DNA, 20 bp, Artificial
  CRISPR gRNA sequence
agctagaaagaatcctgggt

SEQ ID NO: 777905 - DNA, 20 bp, Artificial
  CRISPR gRNA sequence
ctagaaagaatcctgggttg

SEQ ID NO: 777906 - DNA, 20 bp, Artificial
  CRISPR gRNA sequence
gattgttttgtttttccttt

SEQ ID NO: 777907 - DNA, 20 bp, Artificial
  CRISPR gRNA sequence
ttccttttggctgttcattt

SEQ ID NO: 777908 - DNA, 20 bp, Artificial
  CRISPR gRNA sequence
cttttggctgttcattttgg

SEQ ID NO: 777909 - DNA, 20 bp, Artificial
  CRISPR gRNA sequence
ttcattttggtggctactat

SEQ ID NO: 777910 - DNA, 20 bp, Artificial
  CRISPR gRNA sequence
tcattttggtggctactata

SEQ ID NO: 777911 - DNA, 20 bp, Artificial
  CRISPR gRNA sequence
ataaggaaatctaacacaaa

SEQ ID NO: 777912 - DNA, 20 bp, Artificial
  CRISPR gRNA sequence
tacttttgcatctttacttg

SEQ ID NO: 777913 - DNA, 20 bp, Artificial
  CRISPR gRNA sequence
cttttgcatctttacttgtg

SEQ ID NO: 777914 - DNA, 20 bp, Artificial
  CRISPR gRNA sequence
catctttacttgtggagctg

SEQ ID NO: 777915 - DNA, 20 bp, Artificial
  CRISPR gRNA sequence
tttacttgtggagctgtggc

SEQ ID NO: 777916 - DNA, 20 bp, Artificial
  CRISPR gRNA sequence
gctgtggcaagtcctcatgt

SEQ ID NO: 777917 - DNA, 20 bp, Artificial
  CRISPR gRNA sequence
caagtcctcatgtgagtaac

SEQ ID NO: 777918 - DNA, 20 bp, Artificial
  CRISPR gRNA sequence
gtcctcatgtgagtaacgag

SEQ ID NO: 777919 - DNA, 20 bp, Artificial
  CRISPR gRNA sequence
tcctcatgtgagtaacgagt

SEQ ID NO: 777920 - DNA, 20 bp, Artificial
  CRISPR gRNA sequence
atgtgagtaacgagtgggtt

SEQ ID NO: 777921 - DNA, 20 bp, Artificial
  CRISPR gRNA sequence
actctcatactattatgttg

SEQ ID NO: 777922 - DNA, 20 bp, Artificial
  CRISPR gRNA sequence
attatgttgtggaccatgat

SEQ ID NO: 777923 - DNA, 20 bp, Artificial
  CRISPR gRNA sequence
ttatgttgtggaccatgatg

SEQ ID NO: 777924 - DNA, 20 bp, Artificial
  CRISPR gRNA sequence
gtggaccatgatgaggctgc

SEQ ID NO: 777925 - DNA, 20 bp, Artificial
  CRISPR gRNA sequence
tggaccatgatgaggctgcc

SEQ ID NO: 777926 - DNA, 20 bp, Artificial
  CRISPR gRNA sequence
ggaccatgatgaggctgcca

SEQ ID NO: 777927 - DNA, 20 bp, Artificial
  CRISPR gRNA sequence
ccatgatgaggctgccaggg

SEQ ID NO: 777928 - DNA, 20 bp, Artificial
  CRISPR gRNA sequence
catgatgaggctgccagggt

SEQ ID NO: 777929 - DNA, 20 bp, Artificial
  CRISPR gRNA sequence
atgatgaggctgccagggtg

SEQ ID NO: 777930 - DNA, 20 bp, Artificial
  CRISPR gRNA sequence
tgatgaggctgccagggtgg

SEQ ID NO: 777931 - DNA, 20 bp, Artificial
  CRISPR gRNA sequence
tgaggctgccagggtggggg

SEQ ID NO: 777932 - DNA, 20 bp, Artificial
  CRISPR gRNA sequence
gaggctgccagggtggggga

SEQ ID NO: 777933 - DNA, 20 bp, Artificial
  CRISPR gRNA sequence
aggctgccagggtgggggaa

SEQ ID NO: 777934 - DNA, 20 bp, Artificial
  CRISPR gRNA sequence
ctgccagggtgggggaaggg

SEQ ID NO: 777935 - DNA, 20 bp, Artificial
  CRISPR gRNA sequence
accttctctccacaccattt

SEQ ID NO: 777936 - DNA, 20 bp, Artificial
  CRISPR gRNA sequence
ccttctctccacaccatttg

SEQ ID NO: 777937 - DNA, 20 bp, Artificial
  CRISPR gRNA sequence
ctctccacaccatttgaggc

SEQ ID NO: 777938 - DNA, 20 bp, Artificial
  CRISPR gRNA sequence
ctccacaccatttgaggcaa

SEQ ID NO: 777939 - DNA, 20 bp, Artificial
  CRISPR gRNA sequence
aggcaagagacattctgcct

SEQ ID NO: 777940 - DNA, 20 bp, Artificial
  CRISPR gRNA sequence
tctgcctcagaaattgtgct

SEQ ID NO: 777941 - DNA, 20 bp, Artificial
  CRISPR gRNA sequence
ctgcctcagaaattgtgctg

SEQ ID NO: 777942 - DNA, 20 bp, Artificial
  CRISPR gRNA sequence
tgcctcagaaattgtgctga

SEQ ID NO: 777943 - DNA, 20 bp, Artificial
  CRISPR gRNA sequence
gcctcagaaattgtgctgag

SEQ ID NO: 777944 - DNA, 20 bp, Artificial
  CRISPR gRNA sequence
ttgtgctgaggggcacaaat

SEQ ID NO: 777945 - DNA, 20 bp, Artificial
  CRISPR gRNA sequence
aagctaatgtcctcctgccc

SEQ ID NO: 777946 - DNA, 20 bp, Artificial
  CRISPR gRNA sequence
tgcatattgttcttgttgct

SEQ ID NO: 777947 - DNA, 20 bp, Artificial
  CRISPR gRNA sequence
ttcttgttgctcagttttat

SEQ ID NO: 777948 - DNA, 20 bp, Artificial
  CRISPR gRNA sequence
tcttgttgctcagttttata

SEQ ID NO: 777949 - DNA, 20 bp, Artificial
  CRISPR gRNA sequence
gttgctcagttttataaggt

SEQ ID NO: 777950 - DNA, 20 bp, Artificial
  CRISPR gRNA sequence
aaaataatataactattctt

SEQ ID NO: 777951 - DNA, 20 bp, Artificial
  CRISPR gRNA sequence
ctattcttaagattgtctct

SEQ ID NO: 777952 - DNA, 20 bp, Artificial
  CRISPR gRNA sequence
cttaagattgtctctcagct

SEQ ID NO: 777953 - DNA, 20 bp, Artificial
  CRISPR gRNA sequence
taagattgtctctcagctta

SEQ ID NO: 777954 - DNA, 20 bp, Artificial
  CRISPR gRNA sequence
gtctctcagcttagagtttt

SEQ ID NO: 777955 - DNA, 20 bp, Artificial
  CRISPR gRNA sequence
ctctcagcttagagttttcg

SEQ ID NO: 777956 - DNA, 20 bp, Artificial
  CRISPR gRNA sequence
tctcagcttagagttttcgg

SEQ ID NO: 777957 - DNA, 20 bp, Artificial
  CRISPR gRNA sequence
tagagttttcggaggcttaa

SEQ ID NO: 777958 - DNA, 20 bp, Artificial
  CRISPR gRNA sequence
ttttcggaggcttaatggtg

SEQ ID NO: 777959 - DNA, 20 bp, Artificial
  CRISPR gRNA sequence
tctgtttgtgattatccatt

SEQ ID NO: 777960 - DNA, 20 bp, Artificial
  CRISPR gRNA sequence
gtttgtgattatccatttag

SEQ ID NO: 777961 - DNA, 20 bp, Artificial
  CRISPR gRNA sequence
gtgattatccatttagcaga

SEQ ID NO: 777962 - DNA, 20 bp, Artificial
  CRISPR gRNA sequence
ttagcagacggtgatccctc

SEQ ID NO: 777963 - DNA, 20 bp, Artificial
  CRISPR gRNA sequence
tagcagacggtgatccctcc

SEQ ID NO: 777964 - DNA, 20 bp, Artificial
  CRISPR gRNA sequence
agacggtgatccctccaggc

SEQ ID NO: 777965 - DNA, 20 bp, Artificial
  CRISPR gRNA sequence
ccaggctggcctttgtttac

SEQ ID NO: 777966 - DNA, 20 bp, Artificial
  CRISPR gRNA sequence
tttgtttacaagctatgcct

SEQ ID NO: 777967 - DNA, 20 bp, Artificial
  CRISPR gRNA sequence
tgtttacaagctatgcctaa

SEQ ID NO: 777968 - DNA, 20 bp, Artificial
  CRISPR gRNA sequence
gtttacaagctatgcctaag

SEQ ID NO: 777969 - DNA, 20 bp, Artificial
  CRISPR gRNA sequence
tacaagctatgcctaagagg

SEQ ID NO: 777970 - DNA, 20 bp, Artificial
  CRISPR gRNA sequence
tatgcctaagaggcagctgt

SEQ ID NO: 777971 - DNA, 20 bp, Artificial
  CRISPR gRNA sequence
gcctaagaggcagctgttgg

SEQ ID NO: 777972 - DNA, 20 bp, Artificial
  CRISPR gRNA sequence
ctaagaggcagctgttggtg

SEQ ID NO: 777973 - DNA, 20 bp, Artificial
  CRISPR gRNA sequence
taagaggcagctgttggtgg

SEQ ID NO: 777974 - DNA, 20 bp, Artificial
  CRISPR gRNA sequence
aagaggcagctgttggtgga

SEQ ID NO: 777975 - DNA, 20 bp, Artificial
  CRISPR gRNA sequence
agaggcagctgttggtggag

SEQ ID NO: 777976 - DNA, 20 bp, Artificial
  CRISPR gRNA sequence
gaggcagctgttggtggagg

SEQ ID NO: 777977 - DNA, 20 bp, Artificial
  CRISPR gRNA sequence
actattatcttaataactta

SEQ ID NO: 777978 - DNA, 20 bp, Artificial
  CRISPR gRNA sequence
tattatcttaataacttata

SEQ ID NO: 777979 - DNA, 20 bp, Artificial
  CRISPR gRNA sequence
attatcttaataacttatag

SEQ ID NO: 777980 - DNA, 20 bp, Artificial
  CRISPR gRNA sequence
aggtaatcattattgaacaa

SEQ ID NO: 777981 - DNA, 20 bp, Artificial
  CRISPR gRNA sequence
tattgaacaaaagcatgatt

SEQ ID NO: 777982 - DNA, 20 bp, Artificial
  CRISPR gRNA sequence
attgaacaaaagcatgattt

SEQ ID NO: 777983 - DNA, 20 bp, Artificial
  CRISPR gRNA sequence
ttgaacaaaagcatgatttg

SEQ ID NO: 777984 - DNA, 20 bp, Artificial
  CRISPR gRNA sequence
aaagcatgatttggggacta

SEQ ID NO: 777985 - DNA, 20 bp, Artificial
  CRISPR gRNA sequence
catgatttggggactatgga

SEQ ID NO: 777986 - DNA, 20 bp, Artificial
  CRISPR gRNA sequence
atgatttggggactatggaa

SEQ ID NO: 777987 - DNA, 20 bp, Artificial
  CRISPR gRNA sequence
ttctttccatataaaatgat

SEQ ID NO: 777988 - DNA, 20 bp, Artificial
  CRISPR gRNA sequence
catataaaatgatcagcgaa

SEQ ID NO: 777989 - DNA, 20 bp, Artificial
  CRISPR gRNA sequence
atataaaatgatcagcgaaa

SEQ ID NO: 777990 - DNA, 20 bp, Artificial
  CRISPR gRNA sequence
taaaatgatcagcgaaaagg

SEQ ID NO: 777991 - DNA, 20 bp, Artificial
  CRISPR gRNA sequence
gaaaaggtagaaaaattaaa

SEQ ID NO: 777992 - DNA, 20 bp, Artificial
  CRISPR gRNA sequence
gctattgattgctcaccgcc

SEQ ID NO: 777993 - DNA, 20 bp, Artificial
  CRISPR gRNA sequence
gctcaccgcctggatgcact

SEQ ID NO: 777994 - DNA, 20 bp, Artificial
  CRISPR gRNA sequence
caccgcctggatgcactgag

SEQ ID NO: 777995 - DNA, 20 bp, Artificial
  CRISPR gRNA sequence
cgcctggatgcactgagtag

SEQ ID NO: 777996 - DNA, 20 bp, Artificial
  CRISPR gRNA sequence
cctggatgcactgagtagaa

SEQ ID NO: 777997 - DNA, 20 bp, Artificial
  CRISPR gRNA sequence
atgcactgagtagaagagca

SEQ ID NO: 777998 - DNA, 20 bp, Artificial
  CRISPR gRNA sequence
tgcactgagtagaagagcaa

SEQ ID NO: 777999 - DNA, 20 bp, Artificial
  CRISPR gRNA sequence
gagtagaagagcaaaggcaa

SEQ ID NO: 778000 - DNA, 20 bp, Artificial
  CRISPR gRNA sequence
agtagaagagcaaaggcaat

SEQ ID NO: 778001 - DNA, 20 bp, Artificial
  CRISPR gRNA sequence
gcaaaggcaatgggttcatg

SEQ ID NO: 778002 - DNA, 20 bp, Artificial
  CRISPR gRNA sequence
aaaggcaatgggttcatgtg

SEQ ID NO: 778003 - DNA, 20 bp, Artificial
  CRISPR gRNA sequence
aaggcaatgggttcatgtgg

SEQ ID NO: 778004 - DNA, 20 bp, Artificial
  CRISPR gRNA sequence
aggcaatgggttcatgtgga

SEQ ID NO: 778005 - DNA, 20 bp, Artificial
  CRISPR gRNA sequence
ggcaatgggttcatgtggag

SEQ ID NO: 778006 - DNA, 20 bp, Artificial
  CRISPR gRNA sequence
atgggttcatgtggagggga

SEQ ID NO: 778007 - DNA, 20 bp, Artificial
  CRISPR gRNA sequence
gggttcatgtggaggggatg

SEQ ID NO: 778008 - DNA, 20 bp, Artificial
  CRISPR gRNA sequence
ggttcatgtggaggggatgg

SEQ ID NO: 778009 - DNA, 20 bp, Artificial
  CRISPR gRNA sequence
tcatgtggaggggatggagg

SEQ ID NO: 778010 - DNA, 20 bp, Artificial
  CRISPR gRNA sequence
atgtggaggggatggaggtg

SEQ ID NO: 778011 - DNA, 20 bp, Artificial
  CRISPR gRNA sequence
gtggaggggatggaggtgga

SEQ ID NO: 778012 - DNA, 20 bp, Artificial
  CRISPR gRNA sequence
tggaggggatggaggtggag

SEQ ID NO: 778013 - DNA, 20 bp, Artificial
  CRISPR gRNA sequence
gggatggaggtggagaggct

SEQ ID NO: 778014 - DNA, 20 bp, Artificial
  CRISPR gRNA sequence
gaggtggagaggctaagcct

SEQ ID NO: 778015 - DNA, 20 bp, Artificial
  CRISPR gRNA sequence
tggagaggctaagcctgagt

SEQ ID NO: 778016 - DNA, 20 bp, Artificial
  CRISPR gRNA sequence
gagtgagattaccaactaat

SEQ ID NO: 778017 - DNA, 20 bp, Artificial
  CRISPR gRNA sequence
agtgagattaccaactaatc

SEQ ID NO: 778018 - DNA, 20 bp, Artificial
  CRISPR gRNA sequence
cttttaacccaaaaatacta

SEQ ID NO: 778019 - DNA, 20 bp, Artificial
  CRISPR gRNA sequence
cccaaaaatactatggctct

SEQ ID NO: 778020 - DNA, 20 bp, Artificial
  CRISPR gRNA sequence
ccaaaaatactatggctctg

SEQ ID NO: 778021 - DNA, 20 bp, Artificial
  CRISPR gRNA sequence
caaaaatactatggctctga

SEQ ID NO: 778022 - DNA, 20 bp, Artificial
  CRISPR gRNA sequence
aaaaatactatggctctgag

SEQ ID NO: 778023 - DNA, 20 bp, Artificial
  CRISPR gRNA sequence
aatactatggctctgagggg

SEQ ID NO: 778024 - DNA, 20 bp, Artificial
  CRISPR gRNA sequence
atactatggctctgaggggc

SEQ ID NO: 778025 - DNA, 20 bp, Artificial
  CRISPR gRNA sequence
tactatggctctgaggggca

SEQ ID NO: 778026 - DNA, 20 bp, Artificial
  CRISPR gRNA sequence
ggctctgaggggcagggaat

SEQ ID NO: 778027 - DNA, 20 bp, Artificial
  CRISPR gRNA sequence
ctctgaggggcagggaatga

SEQ ID NO: 778028 - DNA, 20 bp, Artificial
  CRISPR gRNA sequence
agacctaaattgacaaaatg

SEQ ID NO: 778029 - DNA, 20 bp, Artificial
  CRISPR gRNA sequence
acctaaattgacaaaatgca

SEQ ID NO: 778030 - DNA, 20 bp, Artificial
  CRISPR gRNA sequence
aaatgcagagtaaaaatatt

SEQ ID NO: 778031 - DNA, 20 bp, Artificial
  CRISPR gRNA sequence
agagtaaaaatattcagtgt

SEQ ID NO: 778032 - DNA, 20 bp, Artificial
  CRISPR gRNA sequence
gtaaaaatattcagtgtgag

SEQ ID NO: 778033 - DNA, 20 bp, Artificial
  CRISPR gRNA sequence
tattcagtgtgagcagtaat

SEQ ID NO: 778034 - DNA, 20 bp, Artificial
  CRISPR gRNA sequence
cagtgtgagcagtaatgaga

SEQ ID NO: 778035 - DNA, 20 bp, Artificial
  CRISPR gRNA sequence
cagtaatgagacagttgtat

SEQ ID NO: 778036 - DNA, 20 bp, Artificial
  CRISPR gRNA sequence
agtaatgagacagttgtatc

SEQ ID NO: 778037 - DNA, 20 bp, Artificial
  CRISPR gRNA sequence
gtaatgagacagttgtatca

SEQ ID NO: 778038 - DNA, 20 bp, Artificial
  CRISPR gRNA sequence
agttgtatcagggtcaaata

SEQ ID NO: 778039 - DNA, 20 bp, Artificial
  CRISPR gRNA sequence
ttgtatcagggtcaaatacg

SEQ ID NO: 778040 - DNA, 20 bp, Artificial
  CRISPR gRNA sequence
atcagggtcaaatacggagt

SEQ ID NO: 778041 - DNA, 20 bp, Artificial
  CRISPR gRNA sequence
ggtcaaatacggagttggcc

SEQ ID NO: 778042 - DNA, 20 bp, Artificial
  CRISPR gRNA sequence
agttggcctggatgtcctcc

SEQ ID NO: 778043 - DNA, 20 bp, Artificial
  CRISPR gRNA sequence
tgtcctccaagctcctttcc

SEQ ID NO: 778044 - DNA, 20 bp, Artificial
  CRISPR gRNA sequence
ccaagctcctttccaagcct

SEQ ID NO: 778045 - DNA, 20 bp, Artificial
  CRISPR gRNA sequence
ttccaagcctaagattctgt

SEQ ID NO: 778046 - DNA, 20 bp, Artificial
  CRISPR gRNA sequence
caagcctaagattctgtgag

SEQ ID NO: 778047 - DNA, 20 bp, Artificial
  CRISPR gRNA sequence
tgtgagtggatgaacaatcc

SEQ ID NO: 778048 - DNA, 20 bp, Artificial
  CRISPR gRNA sequence
ggtcctgctgctcttgccac

SEQ ID NO: 778049 - DNA, 20 bp, Artificial
  CRISPR gRNA sequence
tctatttgccttcattattt

SEQ ID NO: 778050 - DNA, 20 bp, Artificial
  CRISPR gRNA sequence
ctatttgccttcattatttg

SEQ ID NO: 778051 - DNA, 20 bp, Artificial
  CRISPR gRNA sequence
atttgaggtctccccatcat

SEQ ID NO: 778052 - DNA, 20 bp, Artificial
  CRISPR gRNA sequence
tttgaggtctccccatcatc

SEQ ID NO: 778053 - DNA, 20 bp, Artificial
  CRISPR gRNA sequence
ctctttgttgtctgctgctt

SEQ ID NO: 778054 - DNA, 20 bp, Artificial
  CRISPR gRNA sequence
tctttgttgtctgctgcttc

SEQ ID NO: 778055 - DNA, 20 bp, Artificial
  CRISPR gRNA sequence
ctttgttgtctgctgcttca

SEQ ID NO: 778056 - DNA, 20 bp, Artificial
  CRISPR gRNA sequence
gcttcagggtgtcttctccc

SEQ ID NO: 778057 - DNA, 20 bp, Artificial
  CRISPR gRNA sequence
tctccccagatttctcctgt

SEQ ID NO: 778058 - DNA, 20 bp, Artificial
  CRISPR gRNA sequence
cccagatttctcctgttggt

SEQ ID NO: 778059 - DNA, 20 bp, Artificial
  CRISPR gRNA sequence
ggtgagcttttccattgaac

SEQ ID NO: 778060 - DNA, 20 bp, Artificial
  CRISPR gRNA sequence
tgagcttttccattgaactg

SEQ ID NO: 778061 - DNA, 20 bp, Artificial
  CRISPR gRNA sequence
cattgaactggagctcctca

SEQ ID NO: 778062 - DNA, 20 bp, Artificial
  CRISPR gRNA sequence
attgaactggagctcctcac

SEQ ID NO: 778063 - DNA, 20 bp, Artificial
  CRISPR gRNA sequence
aactggagctcctcacaggc

SEQ ID NO: 778064 - DNA, 20 bp, Artificial
  CRISPR gRNA sequence
tggagctcctcacaggcaag

SEQ ID NO: 778065 - DNA, 20 bp, Artificial
  CRISPR gRNA sequence
caggcaagaagcacaccttt

SEQ ID NO: 778066 - DNA, 20 bp, Artificial
  CRISPR gRNA sequence
aggcaagaagcacaccttta

SEQ ID NO: 778067 - DNA, 20 bp, Artificial
  CRISPR gRNA sequence
gcacacctttaaggttctct

SEQ ID NO: 778068 - DNA, 20 bp, Artificial
  CRISPR gRNA sequence
tttaaggttctctgagtccc

SEQ ID NO: 778069 - DNA, 20 bp, Artificial
  CRISPR gRNA sequence
ttctctgagtcccaagttcc

SEQ ID NO: 778070 - DNA, 20 bp, Artificial
  CRISPR gRNA sequence
tgagtcccaagttcctagtg

SEQ ID NO: 778071 - DNA, 20 bp, Artificial
  CRISPR gRNA sequence
caagttcctagtgcagtacc

SEQ ID NO: 778072 - DNA, 20 bp, Artificial
  CRISPR gRNA sequence
gcagtacctggcaatacaca

SEQ ID NO: 778073 - DNA, 20 bp, Artificial
  CRISPR gRNA sequence
cagtacctggcaatacacat

SEQ ID NO: 778074 - DNA, 20 bp, Artificial
  CRISPR gRNA sequence
tggcaatacacataggtgct

SEQ ID NO: 778075 - DNA, 20 bp, Artificial
  CRISPR gRNA sequence
caatacacataggtgcttag

SEQ ID NO: 778076 - DNA, 20 bp, Artificial
  CRISPR gRNA sequence
aatacacataggtgcttagt

SEQ ID NO: 778077 - DNA, 20 bp, Artificial
  CRISPR gRNA sequence
gtgcttgccgaattgttgaa

SEQ ID NO: 778078 - DNA, 20 bp, Artificial
  CRISPR gRNA sequence
ggatttatttgatgaaatgt

SEQ ID NO: 778079 - DNA, 20 bp, Artificial
  CRISPR gRNA sequence
gatttatttgatgaaatgtc

SEQ ID NO: 778080 - DNA, 20 bp, Artificial
  CRISPR gRNA sequence
tttatttgatgaaatgtcag

SEQ ID NO: 778081 - DNA, 20 bp, Artificial
  CRISPR gRNA sequence
tgaaatgtcaggagaatcac

SEQ ID NO: 778082 - DNA, 20 bp, Artificial
  CRISPR gRNA sequence
gaaatgaaatgttcgtgtaa

SEQ ID NO: 778083 - DNA, 20 bp, Artificial
  CRISPR gRNA sequence
tgaaatgttcgtgtaatgga

SEQ ID NO: 778084 - DNA, 20 bp, Artificial
  CRISPR gRNA sequence
gaaatgttcgtgtaatggac

SEQ ID NO: 778085 - DNA, 20 bp, Artificial
  CRISPR gRNA sequence
aaatgttcgtgtaatggaca

SEQ ID NO: 778086 - DNA, 20 bp, Artificial
  CRISPR gRNA sequence
aatgttcgtgtaatggacag

SEQ ID NO: 778087 - DNA, 20 bp, Artificial
  CRISPR gRNA sequence
atgttcgtgtaatggacagg

SEQ ID NO: 778088 - DNA, 20 bp, Artificial
  CRISPR gRNA sequence
ttcgtgtaatggacaggggg

SEQ ID NO: 778089 - DNA, 20 bp, Artificial
  CRISPR gRNA sequence
taatggacagggggaagttt

SEQ ID NO: 778090 - DNA, 20 bp, Artificial
  CRISPR gRNA sequence
aatggacagggggaagtttg

SEQ ID NO: 778091 - DNA, 20 bp, Artificial
  CRISPR gRNA sequence
agtttgaggttgatttgaaa

SEQ ID NO: 778092 - DNA, 20 bp, Artificial
  CRISPR gRNA sequence
gtttgaggttgatttgaaaa

SEQ ID NO: 778093 - DNA, 20 bp, Artificial
  CRISPR gRNA sequence
ttgaggttgatttgaaaaag

SEQ ID NO: 778094 - DNA, 20 bp, Artificial
  CRISPR gRNA sequence
ggttgatttgaaaaaggaga

SEQ ID NO: 778095 - DNA, 20 bp, Artificial
  CRISPR gRNA sequence
tgatttgaaaaaggagatgg

SEQ ID NO: 778096 - DNA, 20 bp, Artificial
  CRISPR gRNA sequence
atttgaaaaaggagatggta

SEQ ID NO: 778097 - DNA, 20 bp, Artificial
  CRISPR gRNA sequence
gaaaaaggagatggtagaga

SEQ ID NO: 778098 - DNA, 20 bp, Artificial
  CRISPR gRNA sequence
agatggtagagacagtatta

SEQ ID NO: 778099 - DNA, 20 bp, Artificial
  CRISPR gRNA sequence
gatggtagagacagtattat

SEQ ID NO: 778100 - DNA, 20 bp, Artificial
  CRISPR gRNA sequence
cagtattatgggtcatgctt

SEQ ID NO: 778101 - DNA, 20 bp, Artificial
  CRISPR gRNA sequence
gtattatgggtcatgcttca

SEQ ID NO: 778102 - DNA, 20 bp, Artificial
  CRISPR gRNA sequence
ttatttgctttacaatacat

SEQ ID NO: 778103 - DNA, 20 bp, Artificial
  CRISPR gRNA sequence
ttgctttacaatacattgga

SEQ ID NO: 778104 - DNA, 20 bp, Artificial
  CRISPR gRNA sequence
acaatacattggacagcaac

SEQ ID NO: 778105 - DNA, 20 bp, Artificial
  CRISPR gRNA sequence
atacattggacagcaaccag

SEQ ID NO: 778106 - DNA, 20 bp, Artificial
  CRISPR gRNA sequence
tgtcttaattgttgcatacg

SEQ ID NO: 778107 - DNA, 20 bp, Artificial
  CRISPR gRNA sequence
gtcttaattgttgcatacgt

SEQ ID NO: 778108 - DNA, 20 bp, Artificial
  CRISPR gRNA sequence
catacgtgggttactctgta

SEQ ID NO: 778109 - DNA, 20 bp, Artificial
  CRISPR gRNA sequence
atacgtgggttactctgtaa

SEQ ID NO: 778110 - DNA, 20 bp, Artificial
  CRISPR gRNA sequence
tacgtgggttactctgtaaa

SEQ ID NO: 778111 - DNA, 20 bp, Artificial
  CRISPR gRNA sequence
acgtgggttactctgtaaag

SEQ ID NO: 778112 - DNA, 20 bp, Artificial
  CRISPR gRNA sequence
actctgtaaaggggcaactg

SEQ ID NO: 778113 - DNA, 20 bp, Artificial
  CRISPR gRNA sequence
tgccacaccctgctccactg

SEQ ID NO: 778114 - DNA, 20 bp, Artificial
  CRISPR gRNA sequence
acaccctgctccactgtagc

SEQ ID NO: 778115 - DNA, 20 bp, Artificial
  CRISPR gRNA sequence
caccctgctccactgtagct

SEQ ID NO: 778116 - DNA, 20 bp, Artificial
  CRISPR gRNA sequence
ataaccttcaaatcaactca

SEQ ID NO: 778117 - DNA, 20 bp, Artificial
  CRISPR gRNA sequence
caaatcaactcacagaattc

SEQ ID NO: 778118 - DNA, 20 bp, Artificial
  CRISPR gRNA sequence
aaatcaactcacagaattcc

SEQ ID NO: 778119 - DNA, 20 bp, Artificial
  CRISPR gRNA sequence
caactcacagaattccagga

SEQ ID NO: 778120 - DNA, 20 bp, Artificial
  CRISPR gRNA sequence
cacagaattccaggacagac

SEQ ID NO: 778121 - DNA, 20 bp, Artificial
  CRISPR gRNA sequence
cagaattccaggacagacaa

SEQ ID NO: 778122 - DNA, 20 bp, Artificial
  CRISPR gRNA sequence
ggacagacaagagcatctga

SEQ ID NO: 778123 - DNA, 20 bp, Artificial
  CRISPR gRNA sequence
gacagacaagagcatctgaa

SEQ ID NO: 778124 - DNA, 20 bp, Artificial
  CRISPR gRNA sequence
agagcatctgaaaggttatc

SEQ ID NO: 778125 - DNA, 20 bp, Artificial
  CRISPR gRNA sequence
tctgaaaggttatctagccc

SEQ ID NO: 778126 - DNA, 20 bp, Artificial
  CRISPR gRNA sequence
cagtcacctctgatgccttc

SEQ ID NO: 778127 - DNA, 20 bp, Artificial
  CRISPR gRNA sequence
agctgtctctaacacacctg

SEQ ID NO: 778128 - DNA, 20 bp, Artificial
  CRISPR gRNA sequence
gctgtctctaacacacctgt

SEQ ID NO: 778129 - DNA, 20 bp, Artificial
  CRISPR gRNA sequence
cacacctgtgggctgacttc

SEQ ID NO: 778130 - DNA, 20 bp, Artificial
  CRISPR gRNA sequence
gtgggctgacttccagttct

SEQ ID NO: 778131 - DNA, 20 bp, Artificial
  CRISPR gRNA sequence
cttccagttcttagtcttca

SEQ ID NO: 778132 - DNA, 20 bp, Artificial
  CRISPR gRNA sequence
tgatgaactgcccctgcttt

SEQ ID NO: 778133 - DNA, 20 bp, Artificial
  CRISPR gRNA sequence
gatgaactgcccctgctttg

SEQ ID NO: 778134 - DNA, 20 bp, Artificial
  CRISPR gRNA sequence
atgaactgcccctgctttga

SEQ ID NO: 778135 - DNA, 20 bp, Artificial
  CRISPR gRNA sequence
gggattttcctccattgcct

SEQ ID NO: 778136 - DNA, 20 bp, Artificial
  CRISPR gRNA sequence
attttcctccattgcctcag

SEQ ID NO: 778137 - DNA, 20 bp, Artificial
  CRISPR gRNA sequence
ttgcctcagaagtactgccc

SEQ ID NO: 778138 - DNA, 20 bp, Artificial
  CRISPR gRNA sequence
tgcctcagaagtactgccct

SEQ ID NO: 778139 - DNA, 20 bp, Artificial
  CRISPR gRNA sequence
gcctcagaagtactgccctg

SEQ ID NO: 778140 - DNA, 20 bp, Artificial
  CRISPR gRNA sequence
cctcagaagtactgccctgg

SEQ ID NO: 778141 - DNA, 20 bp, Artificial
  CRISPR gRNA sequence
tcagaagtactgccctgggg

SEQ ID NO: 778142 - DNA, 20 bp, Artificial
  CRISPR gRNA sequence
cttgtctctgcctttttcac

SEQ ID NO: 778143 - DNA, 20 bp, Artificial
  CRISPR gRNA sequence
tgttcctgctctccaaattt

SEQ ID NO: 778144 - DNA, 20 bp, Artificial
  CRISPR gRNA sequence
gttcctgctctccaaatttt

SEQ ID NO: 778145 - DNA, 20 bp, Artificial
  CRISPR gRNA sequence
ccaaattttgggacgttcct

SEQ ID NO: 778146 - DNA, 20 bp, Artificial
  CRISPR gRNA sequence
ttttgggacgttcctgagtt

SEQ ID NO: 778147 - DNA, 20 bp, Artificial
  CRISPR gRNA sequence
ttcttttatattctccccat

SEQ ID NO: 778148 - DNA, 20 bp, Artificial
  CRISPR gRNA sequence
tttatattctccccatcaga

SEQ ID NO: 778149 - DNA, 20 bp, Artificial
  CRISPR gRNA sequence
attaactaacatttccatat

SEQ ID NO: 778150 - DNA, 20 bp, Artificial
  CRISPR gRNA sequence
agaaataacttccttatctt

SEQ ID NO: 778151 - DNA, 20 bp, Artificial
  CRISPR gRNA sequence
ctaaattttgtcccaaactc

SEQ ID NO: 778152 - DNA, 20 bp, Artificial
  CRISPR gRNA sequence
actctggacctacaattttt

SEQ ID NO: 778153 - DNA, 20 bp, Artificial
  CRISPR gRNA sequence
tggaatgcttatgccttgcc

SEQ ID NO: 778154 - DNA, 20 bp, Artificial
  CRISPR gRNA sequence
tactgtcttccctctaaaat

SEQ ID NO: 778155 - DNA, 20 bp, Artificial
  CRISPR gRNA sequence
ctgccacccttcctccccca

SEQ ID NO: 778156 - DNA, 20 bp, Artificial
  CRISPR gRNA sequence
tggctccaatattgtcttgc

SEQ ID NO: 778157 - DNA, 20 bp, Artificial
  CRISPR gRNA sequence
ccaatattgtcttgccagtc

SEQ ID NO: 778158 - DNA, 20 bp, Artificial
  CRISPR gRNA sequence
ccagtctggtcttaaaacca

SEQ ID NO: 778159 - DNA, 20 bp, Artificial
  CRISPR gRNA sequence
ttctctttgtctcttgtgca

SEQ ID NO: 778160 - DNA, 20 bp, Artificial
  CRISPR gRNA sequence
gtctcttgtgcatggctgat

SEQ ID NO: 778161 - DNA, 20 bp, Artificial
  CRISPR gRNA sequence
tcttgtgcatggctgatcag

SEQ ID NO: 778162 - DNA, 20 bp, Artificial
  CRISPR gRNA sequence
tgcttcctttttctgacctg

SEQ ID NO: 778163 - DNA, 20 bp, Artificial
  CRISPR gRNA sequence
tcctttttctgacctgaagt

SEQ ID NO: 778164 - DNA, 20 bp, Artificial
  CRISPR gRNA sequence
cctttttctgacctgaagtt

SEQ ID NO: 778165 - DNA, 20 bp, Artificial
  CRISPR gRNA sequence
ctttttctgacctgaagtta

SEQ ID NO: 778166 - DNA, 20 bp, Artificial
  CRISPR gRNA sequence
gggccttgttaccaaacatc

SEQ ID NO: 778167 - DNA, 20 bp, Artificial
  CRISPR gRNA sequence
accaaacatctagatgaata

SEQ ID NO: 778168 - DNA, 20 bp, Artificial
  CRISPR gRNA sequence
aatacagtgaccccctaatt

SEQ ID NO: 778169 - DNA, 20 bp, Artificial
  CRISPR gRNA sequence
tacagtgaccccctaattga

SEQ ID NO: 778170 - DNA, 20 bp, Artificial
  CRISPR gRNA sequence
acagtgaccccctaattgag

SEQ ID NO: 778171 - DNA, 20 bp, Artificial
  CRISPR gRNA sequence
tctatactcaaaaaaaaaat

SEQ ID NO: 778172 - DNA, 20 bp, Artificial
  CRISPR gRNA sequence
aaattagatgtaatcttttt

SEQ ID NO: 778173 - DNA, 20 bp, Artificial
  CRISPR gRNA sequence
atctttttcagatactcctt

SEQ ID NO: 778174 - DNA, 20 bp, Artificial
  CRISPR gRNA sequence
actcctttggtattgtcact

SEQ ID NO: 778175 - DNA, 20 bp, Artificial
  CRISPR gRNA sequence
ggtattgtcacttagttttt

SEQ ID NO: 778176 - DNA, 20 bp, Artificial
  CRISPR gRNA sequence
gactgccactatttcccgat

SEQ ID NO: 778177 - DNA, 20 bp, Artificial
  CRISPR gRNA sequence
tgccactatttcccgattgg

SEQ ID NO: 778178 - DNA, 20 bp, Artificial
  CRISPR gRNA sequence
tcccgattggcagctctgcc

SEQ ID NO: 778179 - DNA, 20 bp, Artificial
  CRISPR gRNA sequence
tggcagctctgcctggcatt

SEQ ID NO: 778180 - DNA, 20 bp, Artificial
  CRISPR gRNA sequence
gctcttgacattctcaacct

SEQ ID NO: 778181 - DNA, 20 bp, Artificial
  CRISPR gRNA sequence
acattctcaacctaagtgtc

SEQ ID NO: 778182 - DNA, 20 bp, Artificial
  CRISPR gRNA sequence
ctcaacctaagtgtccagcc

SEQ ID NO: 778183 - DNA, 20 bp, Artificial
  CRISPR gRNA sequence
gcctgtgcatttgcacctct

SEQ ID NO: 778184 - DNA, 20 bp, Artificial
  CRISPR gRNA sequence
gcacctctgagactgcttct

SEQ ID NO: 778185 - DNA, 20 bp, Artificial
  CRISPR gRNA sequence
ctctgagactgcttctgagt

SEQ ID NO: 778186 - DNA, 20 bp, Artificial
  CRISPR gRNA sequence
gtcagctatgcactgccctt

SEQ ID NO: 778187 - DNA, 20 bp, Artificial
  CRISPR gRNA sequence
ctatgcactgccctttagaa

SEQ ID NO: 778188 - DNA, 20 bp, Artificial
  CRISPR gRNA sequence
gcttcaaccccaaatcctac

SEQ ID NO: 778189 - DNA, 20 bp, Artificial
  CRISPR gRNA sequence
caaatcctaccagtgcttca

SEQ ID NO: 778190 - DNA, 20 bp, Artificial
  CRISPR gRNA sequence
aaatcctaccagtgcttcaa

SEQ ID NO: 778191 - DNA, 20 bp, Artificial
  CRISPR gRNA sequence
ctaccagtgcttcaaaggcc

SEQ ID NO: 778192 - DNA, 20 bp, Artificial
  CRISPR gRNA sequence
cagttcaaatcctacccctc

SEQ ID NO: 778193 - DNA, 20 bp, Artificial
  CRISPR gRNA sequence
agttcaaatcctacccctct

SEQ ID NO: 778194 - DNA, 20 bp, Artificial
  CRISPR gRNA sequence
tcaaatcctacccctctggg

SEQ ID NO: 778195 - DNA, 20 bp, Artificial
  CRISPR gRNA sequence
ctgggaagtctcccttcctt

SEQ ID NO: 778196 - DNA, 20 bp, Artificial
  CRISPR gRNA sequence
cccttcctttagtcaacttc

SEQ ID NO: 778197 - DNA, 20 bp, Artificial
  CRISPR gRNA sequence
ccttcctttagtcaacttct

SEQ ID NO: 778198 - DNA, 20 bp, Artificial
  CRISPR gRNA sequence
cttcctttagtcaacttcta

SEQ ID NO: 778199 - DNA, 20 bp, Artificial
  CRISPR gRNA sequence
ttttatcacttgttttacat

SEQ ID NO: 778200 - DNA, 20 bp, Artificial
  CRISPR gRNA sequence
ttttactatttttcatgtgt

SEQ ID NO: 778201 - DNA, 20 bp, Artificial
  CRISPR gRNA sequence
ttactatttttcatgtgtga

SEQ ID NO: 778202 - DNA, 20 bp, Artificial
  CRISPR gRNA sequence
gagttttaaccttccaatta

SEQ ID NO: 778203 - DNA, 20 bp, Artificial
  CRISPR gRNA sequence
aattatggtacaatgtcttt

SEQ ID NO: 778204 - DNA, 20 bp, Artificial
  CRISPR gRNA sequence
attatggtacaatgtcttta

SEQ ID NO: 778205 - DNA, 20 bp, Artificial
  CRISPR gRNA sequence
ttatggtacaatgtctttaa

SEQ ID NO: 778206 - DNA, 20 bp, Artificial
  CRISPR gRNA sequence
ggtacaatgtctttaagggc

SEQ ID NO: 778207 - DNA, 20 bp, Artificial
  CRISPR gRNA sequence
gtacaatgtctttaagggca

SEQ ID NO: 778208 - DNA, 20 bp, Artificial
  CRISPR gRNA sequence
tacaatgtctttaagggcaa

SEQ ID NO: 778209 - DNA, 20 bp, Artificial
  CRISPR gRNA sequence
taagggcaagggccctttct

SEQ ID NO: 778210 - DNA, 20 bp, Artificial
  CRISPR gRNA sequence
agggcaagggccctttctta

SEQ ID NO: 778211 - DNA, 20 bp, Artificial
  CRISPR gRNA sequence
gggcaagggccctttcttag

SEQ ID NO: 778212 - DNA, 20 bp, Artificial
  CRISPR gRNA sequence
tctcacaactttctaatata

SEQ ID NO: 778213 - DNA, 20 bp, Artificial
  CRISPR gRNA sequence
ctcacaactttctaatataa

SEQ ID NO: 778214 - DNA, 20 bp, Artificial
  CRISPR gRNA sequence
ctaatataaaggcttataaa

SEQ ID NO: 778215 - DNA, 20 bp, Artificial
  CRISPR gRNA sequence
atataaaggcttataaaaag

SEQ ID NO: 778216 - DNA, 20 bp, Artificial
  CRISPR gRNA sequence
tataaaggcttataaaaagt

SEQ ID NO: 778217 - DNA, 20 bp, Artificial
  CRISPR gRNA sequence
tgtttattgcttaaaaaatt

SEQ ID NO: 778218 - DNA, 20 bp, Artificial
  CRISPR gRNA sequence
cttaaatgctctattaaatt

SEQ ID NO: 778219 - DNA, 20 bp, Artificial
  CRISPR gRNA sequence
aaatgctctattaaattgag

SEQ ID NO: 778220 - DNA, 20 bp, Artificial
  CRISPR gRNA sequence
ctctattaaattgagtagaa

SEQ ID NO: 778221 - DNA, 20 bp, Artificial
  CRISPR gRNA sequence
attgagtagaatagcatctt

SEQ ID NO: 778222 - DNA, 20 bp, Artificial
  CRISPR gRNA sequence
ttgagtagaatagcatctta

SEQ ID NO: 778223 - DNA, 20 bp, Artificial
  CRISPR gRNA sequence
gaatagcatcttaaggctac

SEQ ID NO: 778224 - DNA, 20 bp, Artificial
  CRISPR gRNA sequence
tagcatcttaaggctactgg

SEQ ID NO: 778225 - DNA, 20 bp, Artificial
  CRISPR gRNA sequence
ctggtagtctatctatgcca

SEQ ID NO: 778226 - DNA, 20 bp, Artificial
  CRISPR gRNA sequence
tagtctatctatgccacaga

SEQ ID NO: 778227 - DNA, 20 bp, Artificial
  CRISPR gRNA sequence
tatctatgccacagatggtt

SEQ ID NO: 778228 - DNA, 20 bp, Artificial
  CRISPR gRNA sequence
tctatgccacagatggttta

SEQ ID NO: 778229 - DNA, 20 bp, Artificial
  CRISPR gRNA sequence
aattactcatatacctatga

SEQ ID NO: 778230 - DNA, 20 bp, Artificial
  CRISPR gRNA sequence
tactcatatacctatgacag

SEQ ID NO: 778231 - DNA, 20 bp, Artificial
  CRISPR gRNA sequence
ctcatatacctatgacagca

SEQ ID NO: 778232 - DNA, 20 bp, Artificial
  CRISPR gRNA sequence
tacctatgacagcagagtac

SEQ ID NO: 778233 - DNA, 20 bp, Artificial
  CRISPR gRNA sequence
gacagcagagtactggctgt

SEQ ID NO: 778234 - DNA, 20 bp, Artificial
  CRISPR gRNA sequence
cccaaaactcaaatacctat

SEQ ID NO: 778235 - DNA, 20 bp, Artificial
  CRISPR gRNA sequence
ccaaaactcaaatacctatt

SEQ ID NO: 778236 - DNA, 20 bp, Artificial
  CRISPR gRNA sequence
caaatacctattgggtttgt

SEQ ID NO: 778237 - DNA, 20 bp, Artificial
  CRISPR gRNA sequence
aaatacctattgggtttgtc

SEQ ID NO: 778238 - DNA, 20 bp, Artificial
  CRISPR gRNA sequence
gtttgtcaggcaacaaaaat

SEQ ID NO: 778239 - DNA, 20 bp, Artificial
  CRISPR gRNA sequence
gcaacaaaaataagtgaatc

SEQ ID NO: 778240 - DNA, 20 bp, Artificial
  CRISPR gRNA sequence
caaaaataagtgaatccagc

SEQ ID NO: 778241 - DNA, 20 bp, Artificial
  CRISPR gRNA sequence
aaaaataagtgaatccagct

SEQ ID NO: 778242 - DNA, 20 bp, Artificial
  CRISPR gRNA sequence
tccagctaggtctaatacaa

SEQ ID NO: 778243 - DNA, 20 bp, Artificial
  CRISPR gRNA sequence
aggtctaatacaatggaaaa

SEQ ID NO: 778244 - DNA, 20 bp, Artificial
  CRISPR gRNA sequence
tctaatacaatggaaaatgg

SEQ ID NO: 778245 - DNA, 20 bp, Artificial
  CRISPR gRNA sequence
ctaatacaatggaaaatggt

SEQ ID NO: 778246 - DNA, 20 bp, Artificial
  CRISPR gRNA sequence
caatggaaaatggtaggacc

SEQ ID NO: 778247 - DNA, 20 bp, Artificial
  CRISPR gRNA sequence
aatggaaaatggtaggacct

SEQ ID NO: 778248 - DNA, 20 bp, Artificial
  CRISPR gRNA sequence
atggaaaatggtaggacctg

SEQ ID NO: 778249 - DNA, 20 bp, Artificial
  CRISPR gRNA sequence
aactctgcataacttgccca

SEQ ID NO: 778250 - DNA, 20 bp, Artificial
  CRISPR gRNA sequence
actctgcataacttgcccaa

SEQ ID NO: 778251 - DNA, 20 bp, Artificial
  CRISPR gRNA sequence
tgcccaaaggcattcaaatt

SEQ ID NO: 778252 - DNA, 20 bp, Artificial
  CRISPR gRNA sequence
attcaaattcagattatgtt

SEQ ID NO: 778253 - DNA, 20 bp, Artificial
  CRISPR gRNA sequence
cagacattgctaattacaat

SEQ ID NO: 778254 - DNA, 20 bp, Artificial
  CRISPR gRNA sequence
gctaattacaattagtgtct

SEQ ID NO: 778255 - DNA, 20 bp, Artificial
  CRISPR gRNA sequence
caattagtgtcttagacact

SEQ ID NO: 778256 - DNA, 20 bp, Artificial
  CRISPR gRNA sequence
ttagacacttggcttcaaaa

SEQ ID NO: 778257 - DNA, 20 bp, Artificial
  CRISPR gRNA sequence
gacacttggcttcaaaacag

SEQ ID NO: 778258 - DNA, 20 bp, Artificial
  CRISPR gRNA sequence
cttggcttcaaaacagtggt

SEQ ID NO: 778259 - DNA, 20 bp, Artificial
  CRISPR gRNA sequence
cttcaaaacagtggttagtt

SEQ ID NO: 778260 - DNA, 20 bp, Artificial
  CRISPR gRNA sequence
ttcaaaacagtggttagttc

SEQ ID NO: 778261 - DNA, 20 bp, Artificial
  CRISPR gRNA sequence
agtggttagttcaggtattt

SEQ ID NO: 778262 - DNA, 20 bp, Artificial
  CRISPR gRNA sequence
ttcaggtatttcagatcaat

SEQ ID NO: 778263 - DNA, 20 bp, Artificial
  CRISPR gRNA sequence
tcaggtatttcagatcaatt

SEQ ID NO: 778264 - DNA, 20 bp, Artificial
  CRISPR gRNA sequence
caattgggtatgcatttatc

SEQ ID NO: 778265 - DNA, 20 bp, Artificial
  CRISPR gRNA sequence
aattgggtatgcatttatct

SEQ ID NO: 778266 - DNA, 20 bp, Artificial
  CRISPR gRNA sequence
tgcatttatctaggtcttca

SEQ ID NO: 778267 - DNA, 20 bp, Artificial
  CRISPR gRNA sequence
tttatctaggtcttcatgga

SEQ ID NO: 778268 - DNA, 20 bp, Artificial
  CRISPR gRNA sequence
tctaggtcttcatggatagc

SEQ ID NO: 778269 - DNA, 20 bp, Artificial
  CRISPR gRNA sequence
ctaggtcttcatggatagcc

SEQ ID NO: 778270 - DNA, 20 bp, Artificial
  CRISPR gRNA sequence
catggatagccgggctctac

SEQ ID NO: 778271 - DNA, 20 bp, Artificial
  CRISPR gRNA sequence
agccgggctctactagacac

SEQ ID NO: 778272 - DNA, 20 bp, Artificial
  CRISPR gRNA sequence
gccgggctctactagacact

SEQ ID NO: 778273 - DNA, 20 bp, Artificial
  CRISPR gRNA sequence
cgggctctactagacactgg

SEQ ID NO: 778274 - DNA, 20 bp, Artificial
  CRISPR gRNA sequence
ggctctactagacactggga

SEQ ID NO: 778275 - DNA, 20 bp, Artificial
  CRISPR gRNA sequence
gctctactagacactgggag

SEQ ID NO: 778276 - DNA, 20 bp, Artificial
  CRISPR gRNA sequence
ctctactagacactgggaga

SEQ ID NO: 778277 - DNA, 20 bp, Artificial
  CRISPR gRNA sequence
tactagacactgggagaggg

SEQ ID NO: 778278 - DNA, 20 bp, Artificial
  CRISPR gRNA sequence
ctagacactgggagagggaa

SEQ ID NO: 778279 - DNA, 20 bp, Artificial
  CRISPR gRNA sequence
tagacactgggagagggaag

SEQ ID NO: 778280 - DNA, 20 bp, Artificial
  CRISPR gRNA sequence
tgggagagggaagaggcaaa

SEQ ID NO: 778281 - DNA, 20 bp, Artificial
  CRISPR gRNA sequence
gggagagggaagaggcaaat

SEQ ID NO: 778282 - DNA, 20 bp, Artificial
  CRISPR gRNA sequence
agggaagaggcaaatgggat

SEQ ID NO: 778283 - DNA, 20 bp, Artificial
  CRISPR gRNA sequence
agaggcaaatgggataagac

SEQ ID NO: 778284 - DNA, 20 bp, Artificial
  CRISPR gRNA sequence
ggcaaatgggataagactgg

SEQ ID NO: 778285 - DNA, 20 bp, Artificial
  CRISPR gRNA sequence
aagactggcagtatttaaca

SEQ ID NO: 778286 - DNA, 20 bp, Artificial
  CRISPR gRNA sequence
gcagtatttaacaaagaatg

SEQ ID NO: 778287 - DNA, 20 bp, Artificial
  CRISPR gRNA sequence
attttacaaacatgatcctt

SEQ ID NO: 778288 - DNA, 20 bp, Artificial
  CRISPR gRNA sequence
ttttacaaacatgatccttt

SEQ ID NO: 778289 - DNA, 20 bp, Artificial
  CRISPR gRNA sequence
acaaacatgatcctttaggc

SEQ ID NO: 778290 - DNA, 20 bp, Artificial
  CRISPR gRNA sequence
aggctggttattgttacaca

SEQ ID NO: 778291 - DNA, 20 bp, Artificial
  CRISPR gRNA sequence
ggctggttattgttacacaa

SEQ ID NO: 778292 - DNA, 20 bp, Artificial
  CRISPR gRNA sequence
tacacaaaggaatgatttgc

SEQ ID NO: 778293 - DNA, 20 bp, Artificial
  CRISPR gRNA sequence
acacaaaggaatgatttgct

SEQ ID NO: 778294 - DNA, 20 bp, Artificial
  CRISPR gRNA sequence
aatgatttgctaggattctt

SEQ ID NO: 778295 - DNA, 20 bp, Artificial
  CRISPR gRNA sequence
ggattcttgagatacttcca

SEQ ID NO: 778296 - DNA, 20 bp, Artificial
  CRISPR gRNA sequence
tctatgcctcacttattgca

SEQ ID NO: 778297 - DNA, 20 bp, Artificial
  CRISPR gRNA sequence
gcctcacttattgcacagac

SEQ ID NO: 778298 - DNA, 20 bp, Artificial
  CRISPR gRNA sequence
ctcacttattgcacagacca

SEQ ID NO: 778299 - DNA, 20 bp, Artificial
  CRISPR gRNA sequence
cagaccagagaattccataa

SEQ ID NO: 778300 - DNA, 20 bp, Artificial
  CRISPR gRNA sequence
agagaattccataaaagcac

SEQ ID NO: 778301 - DNA, 20 bp, Artificial
  CRISPR gRNA sequence
tcttatttacccttgtatac

SEQ ID NO: 778302 - DNA, 20 bp, Artificial
  CRISPR gRNA sequence
ttatttacccttgtatacta

SEQ ID NO: 778303 - DNA, 20 bp, Artificial
  CRISPR gRNA sequence
tacccttgtatactagagct

SEQ ID NO: 778304 - DNA, 20 bp, Artificial
  CRISPR gRNA sequence
gtatactagagcttggcaca

SEQ ID NO: 778305 - DNA, 20 bp, Artificial
  CRISPR gRNA sequence
cttggcacatagtaaatacc

SEQ ID NO: 778306 - DNA, 20 bp, Artificial
  CRISPR gRNA sequence
caagtaaatgttttgaataa

SEQ ID NO: 778307 - DNA, 20 bp, Artificial
  CRISPR gRNA sequence
taaatgttttgaataaaaga

SEQ ID NO: 778308 - DNA, 20 bp, Artificial
  CRISPR gRNA sequence
aatgttttgaataaaagaaa

SEQ ID NO: 778309 - DNA, 20 bp, Artificial
  CRISPR gRNA sequence
ataaaagaaagagataatta

SEQ ID NO: 778310 - DNA, 20 bp, Artificial
  CRISPR gRNA sequence
gaaagagataattaaagctt

SEQ ID NO: 778311 - DNA, 20 bp, Artificial
  CRISPR gRNA sequence
attatttgtatttcatctat

SEQ ID NO: 778312 - DNA, 20 bp, Artificial
  CRISPR gRNA sequence
ttgtatttcatctatcagtt

SEQ ID NO: 778313 - DNA, 20 bp, Artificial
  CRISPR gRNA sequence
ttcatctatcagtttggaaa

SEQ ID NO: 778314 - DNA, 20 bp, Artificial
  CRISPR gRNA sequence
agtttggaaatagatctcca

SEQ ID NO: 778315 - DNA, 20 bp, Artificial
  CRISPR gRNA sequence
tggaaatagatctccacaga

SEQ ID NO: 778316 - DNA, 20 bp, Artificial
  CRISPR gRNA sequence
aaatagatctccacagacag

SEQ ID NO: 778317 - DNA, 20 bp, Artificial
  CRISPR gRNA sequence
atctccacagacagtagaaa

SEQ ID NO: 778318 - DNA, 20 bp, Artificial
  CRISPR gRNA sequence
ccacagacagtagaaatggc

SEQ ID NO: 778319 - DNA, 20 bp, Artificial
  CRISPR gRNA sequence
cagtagaaatggcaagaaac

SEQ ID NO: 778320 - DNA, 20 bp, Artificial
  CRISPR gRNA sequence
agtagaaatggcaagaaact

SEQ ID NO: 778321 - DNA, 20 bp, Artificial
  CRISPR gRNA sequence
atggcaagaaactaggccta

SEQ ID NO: 778322 - DNA, 20 bp, Artificial
  CRISPR gRNA sequence
aaactaggcctatagcaacc

SEQ ID NO: 778323 - DNA, 20 bp, Artificial
  CRISPR gRNA sequence
ctaggcctatagcaaccaag

SEQ ID NO: 778324 - DNA, 20 bp, Artificial
  CRISPR gRNA sequence
caaccaagaagtgaaactgc

SEQ ID NO: 778325 - DNA, 20 bp, Artificial
  CRISPR gRNA sequence
tctgtttacgaacttatcct

SEQ ID NO: 778326 - DNA, 20 bp, Artificial
  CRISPR gRNA sequence
gaacttatcctcagaattta

SEQ ID NO: 778327 - DNA, 20 bp, Artificial
  CRISPR gRNA sequence
agatgtttccttgatttctc

SEQ ID NO: 778328 - DNA, 20 bp, Artificial
  CRISPR gRNA sequence
gtttccttgatttctctgga

SEQ ID NO: 778329 - DNA, 20 bp, Artificial
  CRISPR gRNA sequence
tacaacttcctaatgcaatt

SEQ ID NO: 778330 - DNA, 20 bp, Artificial
  CRISPR gRNA sequence
gtaaattgatacttcttatg

SEQ ID NO: 778331 - DNA, 20 bp, Artificial
  CRISPR gRNA sequence
gatacttcttatgtagaaat

SEQ ID NO: 778332 - DNA, 20 bp, Artificial
  CRISPR gRNA sequence
acttcttatgtagaaataag

SEQ ID NO: 778333 - DNA, 20 bp, Artificial
  CRISPR gRNA sequence
tatgtagaaataagcagaat

SEQ ID NO: 778334 - DNA, 20 bp, Artificial
  CRISPR gRNA sequence
tagaaataagcagaataagc

SEQ ID NO: 778335 - DNA, 20 bp, Artificial
  CRISPR gRNA sequence
agaaataagcagaataagct

SEQ ID NO: 778336 - DNA, 20 bp, Artificial
  CRISPR gRNA sequence
ataagcagaataagctgggc

SEQ ID NO: 778337 - DNA, 20 bp, Artificial
  CRISPR gRNA sequence
taagcagaataagctgggca

SEQ ID NO: 778338 - DNA, 20 bp, Artificial
  CRISPR gRNA sequence
gcagaataagctgggcaagg

SEQ ID NO: 778339 - DNA, 20 bp, Artificial
  CRISPR gRNA sequence
ggcaaggtagcccacaacta

SEQ ID NO: 778340 - DNA, 20 bp, Artificial
  CRISPR gRNA sequence
gtagcccacaactatagtcc

SEQ ID NO: 778341 - DNA, 20 bp, Artificial
  CRISPR gRNA sequence
caactatagtcccagctact

SEQ ID NO: 778342 - DNA, 20 bp, Artificial
  CRISPR gRNA sequence
aactatagtcccagctactt

SEQ ID NO: 778343 - DNA, 20 bp, Artificial
  CRISPR gRNA sequence
ctatagtcccagctacttgg

SEQ ID NO: 778344 - DNA, 20 bp, Artificial
  CRISPR gRNA sequence
tatagtcccagctacttggg

SEQ ID NO: 778345 - DNA, 20 bp, Artificial
  CRISPR gRNA sequence
gtcccagctacttgggaggc

SEQ ID NO: 778346 - DNA, 20 bp, Artificial
  CRISPR gRNA sequence
tcccagctacttgggaggct

SEQ ID NO: 778347 - DNA, 20 bp, Artificial
  CRISPR gRNA sequence
cccagctacttgggaggctg

SEQ ID NO: 778348 - DNA, 20 bp, Artificial
  CRISPR gRNA sequence
agctacttgggaggctgggg

SEQ ID NO: 778349 - DNA, 20 bp, Artificial
  CRISPR gRNA sequence
gctacttgggaggctggggc

SEQ ID NO: 778350 - DNA, 20 bp, Artificial
  CRISPR gRNA sequence
tacttgggaggctggggcag

SEQ ID NO: 778351 - DNA, 20 bp, Artificial
  CRISPR gRNA sequence
acttgggaggctggggcagg

SEQ ID NO: 778352 - DNA, 20 bp, Artificial
  CRISPR gRNA sequence
tggggcaggaggatcacttg

SEQ ID NO: 778353 - DNA, 20 bp, Artificial
  CRISPR gRNA sequence
gcaggaggatcacttgaagc

SEQ ID NO: 778354 - DNA, 20 bp, Artificial
  CRISPR gRNA sequence
aggaggatcacttgaagcca

SEQ ID NO: 778355 - DNA, 20 bp, Artificial
  CRISPR gRNA sequence
cttgaagccagagtttgctt

SEQ ID NO: 778356 - DNA, 20 bp, Artificial
  CRISPR gRNA sequence
ttgaagccagagtttgcttg

SEQ ID NO: 778357 - DNA, 20 bp, Artificial
  CRISPR gRNA sequence
agccagagtttgcttgaggc

SEQ ID NO: 778358 - DNA, 20 bp, Artificial
  CRISPR gRNA sequence
gccagagtttgcttgaggcc

SEQ ID NO: 778359 - DNA, 20 bp, Artificial
  CRISPR gRNA sequence
ttgcttgaggccaggaattc

SEQ ID NO: 778360 - DNA, 20 bp, Artificial
  CRISPR gRNA sequence
tgcttgaggccaggaattcg

SEQ ID NO: 778361 - DNA, 20 bp, Artificial
  CRISPR gRNA sequence
aggccaggaattcgaggctg

SEQ ID NO: 778362 - DNA, 20 bp, Artificial
  CRISPR gRNA sequence
tctatgatcacacctgtgaa

SEQ ID NO: 778363 - DNA, 20 bp, Artificial
  CRISPR gRNA sequence
tgtgaatagccactacactc

SEQ ID NO: 778364 - DNA, 20 bp, Artificial
  CRISPR gRNA sequence
gtgaatagccactacactcc

SEQ ID NO: 778365 - DNA, 20 bp, Artificial
  CRISPR gRNA sequence
atagccactacactccaggc

SEQ ID NO: 778366 - DNA, 20 bp, Artificial
  CRISPR gRNA sequence
tagccactacactccaggct

SEQ ID NO: 778367 - DNA, 20 bp, Artificial
  CRISPR gRNA sequence
tacactccaggctaggcaat

SEQ ID NO: 778368 - DNA, 20 bp, Artificial
  CRISPR gRNA sequence
ctccaggctaggcaatgagt

SEQ ID NO: 778369 - DNA, 20 bp, Artificial
  CRISPR gRNA sequence
gctaggcaatgagtgagacc

SEQ ID NO: 778370 - DNA, 20 bp, Artificial
  CRISPR gRNA sequence
tgagtgagacctagtctcta

SEQ ID NO: 778371 - DNA, 20 bp, Artificial
  CRISPR gRNA sequence
aaaaaaaaaaaaaaaaaaaa

SEQ ID NO: 778372 - DNA, 20 bp, Artificial
  CRISPR gRNA sequence
aaaaaaaaaaaagacaaaat

SEQ ID NO: 778373 - DNA, 20 bp, Artificial
  CRISPR gRNA sequence
gacaaaataagatcaaaatt

SEQ ID NO: 778374 - DNA, 20 bp, Artificial
  CRISPR gRNA sequence
gagtatgaactgataaatac

SEQ ID NO: 778375 - DNA, 20 bp, Artificial
  CRISPR gRNA sequence
agtatgaactgataaataca

SEQ ID NO: 778376 - DNA, 20 bp, Artificial
  CRISPR gRNA sequence
atgaactgataaatacaagg

SEQ ID NO: 778377 - DNA, 20 bp, Artificial
  CRISPR gRNA sequence
ctgataaatacaaggtagac

SEQ ID NO: 778378 - DNA, 20 bp, Artificial
  CRISPR gRNA sequence
aggtagacaagaaatatcct

SEQ ID NO: 778379 - DNA, 20 bp, Artificial
  CRISPR gRNA sequence
gtagacaagaaatatcctga

SEQ ID NO: 778380 - DNA, 20 bp, Artificial
  CRISPR gRNA sequence
tagacaagaaatatcctgag

SEQ ID NO: 778381 - DNA, 20 bp, Artificial
  CRISPR gRNA sequence
tgagaggcgcaatcgttctg

SEQ ID NO: 778382 - DNA, 20 bp, Artificial
  CRISPR gRNA sequence
tcgttctgcagacatttgct

SEQ ID NO: 778383 - DNA, 20 bp, Artificial
  CRISPR gRNA sequence
cgttctgcagacatttgctt

SEQ ID NO: 778384 - DNA, 20 bp, Artificial
  CRISPR gRNA sequence
tctgcagacatttgcttggg

SEQ ID NO: 778385 - DNA, 20 bp, Artificial
  CRISPR gRNA sequence
agacatttgcttgggaagct

SEQ ID NO: 778386 - DNA, 20 bp, Artificial
  CRISPR gRNA sequence
gacatttgcttgggaagctc

SEQ ID NO: 778387 - DNA, 20 bp, Artificial
  CRISPR gRNA sequence
acatttgcttgggaagctca

SEQ ID NO: 778388 - DNA, 20 bp, Artificial
  CRISPR gRNA sequence
catttgcttgggaagctcag

SEQ ID NO: 778389 - DNA, 20 bp, Artificial
  CRISPR gRNA sequence
tttgcttgggaagctcaggg

SEQ ID NO: 778390 - DNA, 20 bp, Artificial
  CRISPR gRNA sequence
ttgcttgggaagctcagggg

SEQ ID NO: 778391 - DNA, 20 bp, Artificial
  CRISPR gRNA sequence
agctcaggggaggatttatg

SEQ ID NO: 778392 - DNA, 20 bp, Artificial
  CRISPR gRNA sequence
gctcaggggaggatttatga

SEQ ID NO: 778393 - DNA, 20 bp, Artificial
  CRISPR gRNA sequence
tcaggggaggatttatgaag

SEQ ID NO: 778394 - DNA, 20 bp, Artificial
  CRISPR gRNA sequence
caggggaggatttatgaagg

SEQ ID NO: 778395 - DNA, 20 bp, Artificial
  CRISPR gRNA sequence
gggaggatttatgaaggagg

SEQ ID NO: 778396 - DNA, 20 bp, Artificial
  CRISPR gRNA sequence
tttatgaaggaggtagccct

SEQ ID NO: 778397 - DNA, 20 bp, Artificial
  CRISPR gRNA sequence
tgaaggaggtagccctgagt

SEQ ID NO: 778398 - DNA, 20 bp, Artificial
  CRISPR gRNA sequence
cctgagtgagtcttaaaaaa

SEQ ID NO: 778399 - DNA, 20 bp, Artificial
  CRISPR gRNA sequence
ctgagtgagtcttaaaaaat

SEQ ID NO: 778400 - DNA, 20 bp, Artificial
  CRISPR gRNA sequence
agtgagtcttaaaaaatggg

SEQ ID NO: 778401 - DNA, 20 bp, Artificial
  CRISPR gRNA sequence
aaaaatgggtagacttttac

SEQ ID NO: 778402 - DNA, 20 bp, Artificial
  CRISPR gRNA sequence
aaaatgggtagacttttacc

SEQ ID NO: 778403 - DNA, 20 bp, Artificial
  CRISPR gRNA sequence
tgggtagacttttaccaggc

SEQ ID NO: 778404 - DNA, 20 bp, Artificial
  CRISPR gRNA sequence
acttttaccaggcaagatct

SEQ ID NO: 778405 - DNA, 20 bp, Artificial
  CRISPR gRNA sequence
taccaggcaagatcttagtg

SEQ ID NO: 778406 - DNA, 20 bp, Artificial
  CRISPR gRNA sequence
aggcaagatcttagtgaagt

SEQ ID NO: 778407 - DNA, 20 bp, Artificial
  CRISPR gRNA sequence
aagatcttagtgaagttagt

SEQ ID NO: 778408 - DNA, 20 bp, Artificial
  CRISPR gRNA sequence
gatcttagtgaagttagtga

SEQ ID NO: 778409 - DNA, 20 bp, Artificial
  CRISPR gRNA sequence
atcttagtgaagttagtgag

SEQ ID NO: 778410 - DNA, 20 bp, Artificial
  CRISPR gRNA sequence
cttagtgaagttagtgagag

SEQ ID NO: 778411 - DNA, 20 bp, Artificial
  CRISPR gRNA sequence
agtgaagttagtgagaggag

SEQ ID NO: 778412 - DNA, 20 bp, Artificial
  CRISPR gRNA sequence
tagtgagaggagtggtcata

SEQ ID NO: 778413 - DNA, 20 bp, Artificial
  CRISPR gRNA sequence
agtgagaggagtggtcatat

SEQ ID NO: 778414 - DNA, 20 bp, Artificial
  CRISPR gRNA sequence
agtggtcatataggaattca

SEQ ID NO: 778415 - DNA, 20 bp, Artificial
  CRISPR gRNA sequence
gtggtcatataggaattcat

SEQ ID NO: 778416 - DNA, 20 bp, Artificial
  CRISPR gRNA sequence
ataggaattcatgggatttt

SEQ ID NO: 778417 - DNA, 20 bp, Artificial
  CRISPR gRNA sequence
ttcatgggatttttagacca

SEQ ID NO: 778418 - DNA, 20 bp, Artificial
  CRISPR gRNA sequence
ccaaagattaccaccctcat

SEQ ID NO: 778419 - DNA, 20 bp, Artificial
  CRISPR gRNA sequence
tgataatgacgatgaatgtg

SEQ ID NO: 778420 - DNA, 20 bp, Artificial
  CRISPR gRNA sequence
aagaatgtttaccacttgca

SEQ ID NO: 778421 - DNA, 20 bp, Artificial
  CRISPR gRNA sequence
atttttcacataccttgtcc

SEQ ID NO: 778422 - DNA, 20 bp, Artificial
  CRISPR gRNA sequence
taccttgtccaagttcccac

SEQ ID NO: 778423 - DNA, 20 bp, Artificial
  CRISPR gRNA sequence
gcatttctgttcactacctg

SEQ ID NO: 778424 - DNA, 20 bp, Artificial
  CRISPR gRNA sequence
tctgttcactacctgtggtt

SEQ ID NO: 778425 - DNA, 20 bp, Artificial
  CRISPR gRNA sequence
tcactacctgtggtttggtc

SEQ ID NO: 778426 - DNA, 20 bp, Artificial
  CRISPR gRNA sequence
actacctgtggtttggtcaa

SEQ ID NO: 778427 - DNA, 20 bp, Artificial
  CRISPR gRNA sequence
tgtggtttggtcaagagacc

SEQ ID NO: 778428 - DNA, 20 bp, Artificial
  CRISPR gRNA sequence
tggtcaagagacccagatat

SEQ ID NO: 778429 - DNA, 20 bp, Artificial
  CRISPR gRNA sequence
gtcaagagacccagatatta

SEQ ID NO: 778430 - DNA, 20 bp, Artificial
  CRISPR gRNA sequence
ttagagaacgtgttgatttc

SEQ ID NO: 778431 - DNA, 20 bp, Artificial
  CRISPR gRNA sequence
taactccgcccaataacatt

SEQ ID NO: 778432 - DNA, 20 bp, Artificial
  CRISPR gRNA sequence
caataacattaagatgaaaa

SEQ ID NO: 778433 - DNA, 20 bp, Artificial
  CRISPR gRNA sequence
aacattaagatgaaaatgga

SEQ ID NO: 778434 - DNA, 20 bp, Artificial
  CRISPR gRNA sequence
gatgaaaatggatagccaca

SEQ ID NO: 778435 - DNA, 20 bp, Artificial
  CRISPR gRNA sequence
atgaaaatggatagccacat

SEQ ID NO: 778436 - DNA, 20 bp, Artificial
  CRISPR gRNA sequence
aatggatagccacataggaa

SEQ ID NO: 778437 - DNA, 20 bp, Artificial
  CRISPR gRNA sequence
cagacatcaataaacatatt

SEQ ID NO: 778438 - DNA, 20 bp, Artificial
  CRISPR gRNA sequence
taaacatatttagaaaacac

SEQ ID NO: 778439 - DNA, 20 bp, Artificial
  CRISPR gRNA sequence
aaaacacaagtgaattttaa

SEQ ID NO: 778440 - DNA, 20 bp, Artificial
  CRISPR gRNA sequence
aaacacaagtgaattttaaa

SEQ ID NO: 778441 - DNA, 20 bp, Artificial
  CRISPR gRNA sequence
aacacaagtgaattttaaaa

SEQ ID NO: 778442 - DNA, 20 bp, Artificial
  CRISPR gRNA sequence
acacaagtgaattttaaaag

SEQ ID NO: 778443 - DNA, 20 bp, Artificial
  CRISPR gRNA sequence
acaagtgaattttaaaaggg

SEQ ID NO: 778444 - DNA, 20 bp, Artificial
  CRISPR gRNA sequence
aattttaaaaggggagactt

SEQ ID NO: 778445 - DNA, 20 bp, Artificial
  CRISPR gRNA sequence
ttttaaaaggggagacttaa

SEQ ID NO: 778446 - DNA, 20 bp, Artificial
  CRISPR gRNA sequence
tttaaaaggggagacttaag

SEQ ID NO: 778447 - DNA, 20 bp, Artificial
  CRISPR gRNA sequence
aaaaggggagacttaagagg

SEQ ID NO: 778448 - DNA, 20 bp, Artificial
  CRISPR gRNA sequence
gggagacttaagaggtggca

SEQ ID NO: 778449 - DNA, 20 bp, Artificial
  CRISPR gRNA sequence
acatgttcgtttttgtctcc

SEQ ID NO: 778450 - DNA, 20 bp, Artificial
  CRISPR gRNA sequence
atgttcgtttttgtctcctg

SEQ ID NO: 778451 - DNA, 20 bp, Artificial
  CRISPR gRNA sequence
cgtttttgtctcctggagaa

SEQ ID NO: 778452 - DNA, 20 bp, Artificial
  CRISPR gRNA sequence
tttgtctcctggagaaaagt

SEQ ID NO: 778453 - DNA, 20 bp, Artificial
  CRISPR gRNA sequence
aagtcagcacaatgctcatt

SEQ ID NO: 778454 - DNA, 20 bp, Artificial
  CRISPR gRNA sequence
caatgctcattcagctacat

SEQ ID NO: 778455 - DNA, 20 bp, Artificial
  CRISPR gRNA sequence
ctacataagtgtttctgtta

SEQ ID NO: 778456 - DNA, 20 bp, Artificial
  CRISPR gRNA sequence
tgtttctgttacagctcttt

SEQ ID NO: 778457 - DNA, 20 bp, Artificial
  CRISPR gRNA sequence
agctctttcagtccaccatt

SEQ ID NO: 778458 - DNA, 20 bp, Artificial
  CRISPR gRNA sequence
tctttcagtccaccattcgg

SEQ ID NO: 778459 - DNA, 20 bp, Artificial
  CRISPR gRNA sequence
ctttcagtccaccattcggc

SEQ ID NO: 778460 - DNA, 20 bp, Artificial
  CRISPR gRNA sequence
ctgaattcttgtcccttgtc

SEQ ID NO: 778461 - DNA, 20 bp, Artificial
  CRISPR gRNA sequence
gtcccttgtccagaaaaaat

SEQ ID NO: 778462 - DNA, 20 bp, Artificial
  CRISPR gRNA sequence
tcccttgtccagaaaaaatg

SEQ ID NO: 778463 - DNA, 20 bp, Artificial
  CRISPR gRNA sequence
tccagaaaaaatgaggtatg

SEQ ID NO: 778464 - DNA, 20 bp, Artificial
  CRISPR gRNA sequence
aaatgaggtatgtggacaac

SEQ ID NO: 778465 - DNA, 20 bp, Artificial
  CRISPR gRNA sequence
atgaggtatgtggacaactg

SEQ ID NO: 778466 - DNA, 20 bp, Artificial
  CRISPR gRNA sequence
tgaggtatgtggacaactgg

SEQ ID NO: 778467 - DNA, 20 bp, Artificial
  CRISPR gRNA sequence
gaggtatgtggacaactgga

SEQ ID NO: 778468 - DNA, 20 bp, Artificial
  CRISPR gRNA sequence
tatgtggacaactggagggt

SEQ ID NO: 778469 - DNA, 20 bp, Artificial
  CRISPR gRNA sequence
tggacaactggagggtgagc

SEQ ID NO: 778470 - DNA, 20 bp, Artificial
  CRISPR gRNA sequence
ggacaactggagggtgagca

SEQ ID NO: 778471 - DNA, 20 bp, Artificial
  CRISPR gRNA sequence
caactggagggtgagcaagg

SEQ ID NO: 778472 - DNA, 20 bp, Artificial
  CRISPR gRNA sequence
actggagggtgagcaaggcg

SEQ ID NO: 778473 - DNA, 20 bp, Artificial
  CRISPR gRNA sequence
tggagggtgagcaaggcgga

SEQ ID NO: 778474 - DNA, 20 bp, Artificial
  CRISPR gRNA sequence
ggagggtgagcaaggcggag

SEQ ID NO: 778475 - DNA, 20 bp, Artificial
  CRISPR gRNA sequence
agggtgagcaaggcggagag

SEQ ID NO: 778476 - DNA, 20 bp, Artificial
  CRISPR gRNA sequence
aggcggagaggagcttcgtt

SEQ ID NO: 778477 - DNA, 20 bp, Artificial
  CRISPR gRNA sequence
agaggagcttcgttgagtga

SEQ ID NO: 778478 - DNA, 20 bp, Artificial
  CRISPR gRNA sequence
agcttcgttgagtgacagaa

SEQ ID NO: 778479 - DNA, 20 bp, Artificial
  CRISPR gRNA sequence
ttgagtgacagaacagcttt

SEQ ID NO: 778480 - DNA, 20 bp, Artificial
  CRISPR gRNA sequence
tgagtgacagaacagctttc

SEQ ID NO: 778481 - DNA, 20 bp, Artificial
  CRISPR gRNA sequence
agtgacagaacagctttcag

SEQ ID NO: 778482 - DNA, 20 bp, Artificial
  CRISPR gRNA sequence
aacagctttcaggagaccca

SEQ ID NO: 778483 - DNA, 20 bp, Artificial
  CRISPR gRNA sequence
agctttcaggagacccaaag

SEQ ID NO: 778484 - DNA, 20 bp, Artificial
  CRISPR gRNA sequence
gctttcaggagacccaaagt

SEQ ID NO: 778485 - DNA, 20 bp, Artificial
  CRISPR gRNA sequence
ttcaggagacccaaagtggg

SEQ ID NO: 778486 - DNA, 20 bp, Artificial
  CRISPR gRNA sequence
aagtgggtagcacttttcca

SEQ ID NO: 778487 - DNA, 20 bp, Artificial
  CRISPR gRNA sequence
agtgggtagcacttttccat

SEQ ID NO: 778488 - DNA, 20 bp, Artificial
  CRISPR gRNA sequence
gggtagcacttttccatagg

SEQ ID NO: 778489 - DNA, 20 bp, Artificial
  CRISPR gRNA sequence
ggtagcacttttccataggc

SEQ ID NO: 778490 - DNA, 20 bp, Artificial
  CRISPR gRNA sequence
cttttccataggcaggaaat

SEQ ID NO: 778491 - DNA, 20 bp, Artificial
  CRISPR gRNA sequence
ggaaatgagtgttcaactct

SEQ ID NO: 778492 - DNA, 20 bp, Artificial
  CRISPR gRNA sequence
aatgagtgttcaactctcag

SEQ ID NO: 778493 - DNA, 20 bp, Artificial
  CRISPR gRNA sequence
tgagtgttcaactctcagca

SEQ ID NO: 778494 - DNA, 20 bp, Artificial
  CRISPR gRNA sequence
agtgttcaactctcagcaga

SEQ ID NO: 778495 - DNA, 20 bp, Artificial
  CRISPR gRNA sequence
gtgttcaactctcagcagag

SEQ ID NO: 778496 - DNA, 20 bp, Artificial
  CRISPR gRNA sequence
gttcaactctcagcagagag

SEQ ID NO: 778497 - DNA, 20 bp, Artificial
  CRISPR gRNA sequence
agcagagaggagacccacaa

SEQ ID NO: 778498 - DNA, 20 bp, Artificial
  CRISPR gRNA sequence
gagaggagacccacaatgga

SEQ ID NO: 778499 - DNA, 20 bp, Artificial
  CRISPR gRNA sequence
caatggatagctccttacca

SEQ ID NO: 778500 - DNA, 20 bp, Artificial
  CRISPR gRNA sequence
aatggatagctccttaccac

SEQ ID NO: 778501 - DNA, 20 bp, Artificial
  CRISPR gRNA sequence
ggatagctccttaccacagg

SEQ ID NO: 778502 - DNA, 20 bp, Artificial
  CRISPR gRNA sequence
gatagctccttaccacaggc

SEQ ID NO: 778503 - DNA, 20 bp, Artificial
  CRISPR gRNA sequence
ttaccacaggcaggtcatcc

SEQ ID NO: 778504 - DNA, 20 bp, Artificial
  CRISPR gRNA sequence
accacaggcaggtcatccca

SEQ ID NO: 778505 - DNA, 20 bp, Artificial
  CRISPR gRNA sequence
cacaggcaggtcatcccaga

SEQ ID NO: 778506 - DNA, 20 bp, Artificial
  CRISPR gRNA sequence
acaggcaggtcatcccagag

SEQ ID NO: 778507 - DNA, 20 bp, Artificial
  CRISPR gRNA sequence
gcaggtcatcccagagaggt

SEQ ID NO: 778508 - DNA, 20 bp, Artificial
  CRISPR gRNA sequence
caggtcatcccagagaggtg

SEQ ID NO: 778509 - DNA, 20 bp, Artificial
  CRISPR gRNA sequence
ggtcatcccagagaggtgag

SEQ ID NO: 778510 - DNA, 20 bp, Artificial
  CRISPR gRNA sequence
ccagagaggtgaggagacac

SEQ ID NO: 778511 - DNA, 20 bp, Artificial
  CRISPR gRNA sequence
agaggtgaggagacacaagc

SEQ ID NO: 778512 - DNA, 20 bp, Artificial
  CRISPR gRNA sequence
gaggtgaggagacacaagcc

SEQ ID NO: 778513 - DNA, 20 bp, Artificial
  CRISPR gRNA sequence
gaggagacacaagccaggca

SEQ ID NO: 778514 - DNA, 20 bp, Artificial
  CRISPR gRNA sequence
gagacacaagccaggcacag

SEQ ID NO: 778515 - DNA, 20 bp, Artificial
  CRISPR gRNA sequence
gtggctcacgcctgtaatcc

SEQ ID NO: 778516 - DNA, 20 bp, Artificial
  CRISPR gRNA sequence
cgcctgtaatcccagcactt

SEQ ID NO: 778517 - DNA, 20 bp, Artificial
  CRISPR gRNA sequence
gcctgtaatcccagcacttt

SEQ ID NO: 778518 - DNA, 20 bp, Artificial
  CRISPR gRNA sequence
ctgtaatcccagcactttgg

SEQ ID NO: 778519 - DNA, 20 bp, Artificial
  CRISPR gRNA sequence
tgtaatcccagcactttggg

SEQ ID NO: 778520 - DNA, 20 bp, Artificial
  CRISPR gRNA sequence
tcccagcactttgggaggcc

SEQ ID NO: 778521 - DNA, 20 bp, Artificial
  CRISPR gRNA sequence
cccagcactttgggaggccg

SEQ ID NO: 778522 - DNA, 20 bp, Artificial
  CRISPR gRNA sequence
agcactttgggaggccgagg

SEQ ID NO: 778523 - DNA, 20 bp, Artificial
  CRISPR gRNA sequence
gcactttgggaggccgaggc

SEQ ID NO: 778524 - DNA, 20 bp, Artificial
  CRISPR gRNA sequence
ctttgggaggccgaggcggg

SEQ ID NO: 778525 - DNA, 20 bp, Artificial
  CRISPR gRNA sequence
ggccgaggcgggtggatcac

SEQ ID NO: 778526 - DNA, 20 bp, Artificial
  CRISPR gRNA sequence
gccgaggcgggtggatcacg

SEQ ID NO: 778527 - DNA, 20 bp, Artificial
  CRISPR gRNA sequence
aggcgggtggatcacgaggt

SEQ ID NO: 778528 - DNA, 20 bp, Artificial
  CRISPR gRNA sequence
gcgggtggatcacgaggtca

SEQ ID NO: 778529 - DNA, 20 bp, Artificial
  CRISPR gRNA sequence
ggatcacgaggtcagagttc

SEQ ID NO: 778530 - DNA, 20 bp, Artificial
  CRISPR gRNA sequence
acgaggtcagagttcgagac

SEQ ID NO: 778531 - DNA, 20 bp, Artificial
  CRISPR gRNA sequence
gtcagagttcgagaccagct

SEQ ID NO: 778532 - DNA, 20 bp, Artificial
  CRISPR gRNA sequence
agttcgagaccagcttggcc

SEQ ID NO: 778533 - DNA, 20 bp, Artificial
  CRISPR gRNA sequence
cgagaccagcttggccaaga

SEQ ID NO: 778534 - DNA, 20 bp, Artificial
  CRISPR gRNA sequence
ctactaaaaatatgaaaaat

SEQ ID NO: 778535 - DNA, 20 bp, Artificial
  CRISPR gRNA sequence
taaaaatatgaaaaattagc

SEQ ID NO: 778536 - DNA, 20 bp, Artificial
  CRISPR gRNA sequence
aaaaatatgaaaaattagcc

SEQ ID NO: 778537 - DNA, 20 bp, Artificial
  CRISPR gRNA sequence
tatgaaaaattagccaggtg

SEQ ID NO: 778538 - DNA, 20 bp, Artificial
  CRISPR gRNA sequence
gttgtgcacgcctgttgtcc

SEQ ID NO: 778539 - DNA, 20 bp, Artificial
  CRISPR gRNA sequence
cgcctgttgtcccagttact

SEQ ID NO: 778540 - DNA, 20 bp, Artificial
  CRISPR gRNA sequence
gcctgttgtcccagttactc

SEQ ID NO: 778541 - DNA, 20 bp, Artificial
  CRISPR gRNA sequence
ctgttgtcccagttactcag

SEQ ID NO: 778542 - DNA, 20 bp, Artificial
  CRISPR gRNA sequence
tgttgtcccagttactcagg

SEQ ID NO: 778543 - DNA, 20 bp, Artificial
  CRISPR gRNA sequence
tcccagttactcaggaggct

SEQ ID NO: 778544 - DNA, 20 bp, Artificial
  CRISPR gRNA sequence
cccagttactcaggaggctg

SEQ ID NO: 778545 - DNA, 20 bp, Artificial
  CRISPR gRNA sequence
agttactcaggaggctgagg

SEQ ID NO: 778546 - DNA, 20 bp, Artificial
  CRISPR gRNA sequence
gttactcaggaggctgaggc

SEQ ID NO: 778547 - DNA, 20 bp, Artificial
  CRISPR gRNA sequence
tactcaggaggctgaggcag

SEQ ID NO: 778548 - DNA, 20 bp, Artificial
  CRISPR gRNA sequence
gcaggagaatcacttgaacc

SEQ ID NO: 778549 - DNA, 20 bp, Artificial
  CRISPR gRNA sequence
caggagaatcacttgaaccc

SEQ ID NO: 778550 - DNA, 20 bp, Artificial
  CRISPR gRNA sequence
ggagaatcacttgaacccgg

SEQ ID NO: 778551 - DNA, 20 bp, Artificial
  CRISPR gRNA sequence
gagaatcacttgaacccggg

SEQ ID NO: 778552 - DNA, 20 bp, Artificial
  CRISPR gRNA sequence
aatcacttgaacccgggagg

SEQ ID NO: 778553 - DNA, 20 bp, Artificial
  CRISPR gRNA sequence
tcacttgaacccgggaggcg

SEQ ID NO: 778554 - DNA, 20 bp, Artificial
  CRISPR gRNA sequence
cacttgaacccgggaggcgg

SEQ ID NO: 778555 - DNA, 20 bp, Artificial
  CRISPR gRNA sequence
aacccgggaggcggaggatg

SEQ ID NO: 778556 - DNA, 20 bp, Artificial
  CRISPR gRNA sequence
cgggaggcggaggatgcagt

SEQ ID NO: 778557 - DNA, 20 bp, Artificial
  CRISPR gRNA sequence
ggcggaggatgcagtgagcc

SEQ ID NO: 778558 - DNA, 20 bp, Artificial
  CRISPR gRNA sequence
aagatcacaccactgcactc

SEQ ID NO: 778559 - DNA, 20 bp, Artificial
  CRISPR gRNA sequence
cacaccactgcactccagcc

SEQ ID NO: 778560 - DNA, 20 bp, Artificial
  CRISPR gRNA sequence
acaccactgcactccagcct

SEQ ID NO: 778561 - DNA, 20 bp, Artificial
  CRISPR gRNA sequence
cactgcactccagcctgggt

SEQ ID NO: 778562 - DNA, 20 bp, Artificial
  CRISPR gRNA sequence
ctgcactccagcctgggtga

SEQ ID NO: 778563 - DNA, 20 bp, Artificial
  CRISPR gRNA sequence
gcactccagcctgggtgaga

SEQ ID NO: 778564 - DNA, 20 bp, Artificial
  CRISPR gRNA sequence
tccagcctgggtgagagagc

SEQ ID NO: 778565 - DNA, 20 bp, Artificial
  CRISPR gRNA sequence
aaaaaaaaaaaaaaaaaaaa

SEQ ID NO: 778566 - DNA, 20 bp, Artificial
  CRISPR gRNA sequence
aaaaaaaaaaaaaaaaagaa

SEQ ID NO: 778567 - DNA, 20 bp, Artificial
  CRISPR gRNA sequence
aaaaaaaaaaaaagaaaaga

SEQ ID NO: 778568 - DNA, 20 bp, Artificial
  CRISPR gRNA sequence
aaaaaaaaagaaaagaaaga

SEQ ID NO: 778569 - DNA, 20 bp, Artificial
  CRISPR gRNA sequence
aaaaagaaaagaaagaaaga

SEQ ID NO: 778570 - DNA, 20 bp, Artificial
  CRISPR gRNA sequence
aaagaaaagaaagaaagaaa

SEQ ID NO: 778571 - DNA, 20 bp, Artificial
  CRISPR gRNA sequence
aagaaaagaaagaaagaaag

SEQ ID NO: 778572 - DNA, 20 bp, Artificial
  CRISPR gRNA sequence
gaaaagaaagaaagaaagag

SEQ ID NO: 778573 - DNA, 20 bp, Artificial
  CRISPR gRNA sequence
agaaagaaagaggagatctg

SEQ ID NO: 778574 - DNA, 20 bp, Artificial
  CRISPR gRNA sequence
agaaagaggagatctgaagt

SEQ ID NO: 778575 - DNA, 20 bp, Artificial
  CRISPR gRNA sequence
aagtgagcaactgcttcccc

SEQ ID NO: 778576 - DNA, 20 bp, Artificial
  CRISPR gRNA sequence
gagcaactgcttcccctagc

SEQ ID NO: 778577 - DNA, 20 bp, Artificial
  CRISPR gRNA sequence
caactgcttcccctagctgg

SEQ ID NO: 778578 - DNA, 20 bp, Artificial
  CRISPR gRNA sequence
ggtagtcccaatgtctgttc

SEQ ID NO: 778579 - DNA, 20 bp, Artificial
  CRISPR gRNA sequence
tcccaatgtctgttcaagtc

SEQ ID NO: 778580 - DNA, 20 bp, Artificial
  CRISPR gRNA sequence
atgtctgttcaagtctggct

SEQ ID NO: 778581 - DNA, 20 bp, Artificial
  CRISPR gRNA sequence
tgttcaagtctggctgagtc

SEQ ID NO: 778582 - DNA, 20 bp, Artificial
  CRISPR gRNA sequence
gttcaagtctggctgagtcc

SEQ ID NO: 778583 - DNA, 20 bp, Artificial
  CRISPR gRNA sequence
ttcaagtctggctgagtcca

SEQ ID NO: 778584 - DNA, 20 bp, Artificial
  CRISPR gRNA sequence
tttgtttgttttgttttttt

SEQ ID NO: 778585 - DNA, 20 bp, Artificial
  CRISPR gRNA sequence
tttgttttgtttttttgaga

SEQ ID NO: 778586 - DNA, 20 bp, Artificial
  CRISPR gRNA sequence
tgttttgtttttttgagacg

SEQ ID NO: 778587 - DNA, 20 bp, Artificial
  CRISPR gRNA sequence
acggagtctcactctgtcac

SEQ ID NO: 778588 - DNA, 20 bp, Artificial
  CRISPR gRNA sequence
cggagtctcactctgtcacc

SEQ ID NO: 778589 - DNA, 20 bp, Artificial
  CRISPR gRNA sequence
ggagtctcactctgtcacca

SEQ ID NO: 778590 - DNA, 20 bp, Artificial
  CRISPR gRNA sequence
tctcactctgtcaccagggc

SEQ ID NO: 778591 - DNA, 20 bp, Artificial
  CRISPR gRNA sequence
tcactctgtcaccagggctg

SEQ ID NO: 778592 - DNA, 20 bp, Artificial
  CRISPR gRNA sequence
ctgtcaccagggctggagtg

SEQ ID NO: 778593 - DNA, 20 bp, Artificial
  CRISPR gRNA sequence
tcaccagggctggagtgcag

SEQ ID NO: 778594 - DNA, 20 bp, Artificial
  CRISPR gRNA sequence
ggagtgcagtggcgcaatct

SEQ ID NO: 778595 - DNA, 20 bp, Artificial
  CRISPR gRNA sequence
tcactgcaacctctgcctcc

SEQ ID NO: 778596 - DNA, 20 bp, Artificial
  CRISPR gRNA sequence
cactgcaacctctgcctccc

SEQ ID NO: 778597 - DNA, 20 bp, Artificial
  CRISPR gRNA sequence
aacctctgcctcccgggttc

SEQ ID NO: 778598 - DNA, 20 bp, Artificial
  CRISPR gRNA sequence
ttcaagcgattctcctgctt

SEQ ID NO: 778599 - DNA, 20 bp, Artificial
  CRISPR gRNA sequence
ttctcctgcttcagcctccc

SEQ ID NO: 778600 - DNA, 20 bp, Artificial
  CRISPR gRNA sequence
tcctgcttcagcctcccgag

SEQ ID NO: 778601 - DNA, 20 bp, Artificial
  CRISPR gRNA sequence
gcttcagcctcccgagtagc

SEQ ID NO: 778602 - DNA, 20 bp, Artificial
  CRISPR gRNA sequence
ctcccgagtagctggtatta

SEQ ID NO: 778603 - DNA, 20 bp, Artificial
  CRISPR gRNA sequence
cagacacccaccactacatc

SEQ ID NO: 778604 - DNA, 20 bp, Artificial
  CRISPR gRNA sequence
cagctaattttttgtatttt

SEQ ID NO: 778605 - DNA, 20 bp, Artificial
  CRISPR gRNA sequence
ctaattttttgtatttttag

SEQ ID NO: 778606 - DNA, 20 bp, Artificial
  CRISPR gRNA sequence
aattttttgtatttttagta

SEQ ID NO: 778607 - DNA, 20 bp, Artificial
  CRISPR gRNA sequence
ttttgtatttttagtagaga

SEQ ID NO: 778608 - DNA, 20 bp, Artificial
  CRISPR gRNA sequence
tttgtatttttagtagagac

SEQ ID NO: 778609 - DNA, 20 bp, Artificial
  CRISPR gRNA sequence
ttgtatttttagtagagacg

SEQ ID NO: 778610 - DNA, 20 bp, Artificial
  CRISPR gRNA sequence
gagacggggtttcgccatgt

SEQ ID NO: 778611 - DNA, 20 bp, Artificial
  CRISPR gRNA sequence
cggggtttcgccatgttggc

SEQ ID NO: 778612 - DNA, 20 bp, Artificial
  CRISPR gRNA sequence
ggggtttcgccatgttggcc

SEQ ID NO: 778613 - DNA, 20 bp, Artificial
  CRISPR gRNA sequence
tttcgccatgttggccaggc

SEQ ID NO: 778614 - DNA, 20 bp, Artificial
  CRISPR gRNA sequence
acctcgtgattttcctgcct

SEQ ID NO: 778615 - DNA, 20 bp, Artificial
  CRISPR gRNA sequence
ttttcctgcctcggcctccc

SEQ ID NO: 778616 - DNA, 20 bp, Artificial
  CRISPR gRNA sequence
tgcctcggcctcccaagtgc

SEQ ID NO: 778617 - DNA, 20 bp, Artificial
  CRISPR gRNA sequence
gcctcggcctcccaagtgct

SEQ ID NO: 778618 - DNA, 20 bp, Artificial
  CRISPR gRNA sequence
cctcccaagtgctgggatta

SEQ ID NO: 778619 - DNA, 20 bp, Artificial
  CRISPR gRNA sequence
ctcccaagtgctgggattac

SEQ ID NO: 778620 - DNA, 20 bp, Artificial
  CRISPR gRNA sequence
agtgctgggattacaggcat

SEQ ID NO: 778621 - DNA, 20 bp, Artificial
  CRISPR gRNA sequence
gattacaggcatgagccact

SEQ ID NO: 778622 - DNA, 20 bp, Artificial
  CRISPR gRNA sequence
caggcatgagccactgagcc

SEQ ID NO: 778623 - DNA, 20 bp, Artificial
  CRISPR gRNA sequence
atgagccactgagcccggtc

SEQ ID NO: 778624 - DNA, 20 bp, Artificial
  CRISPR gRNA sequence
ccactgagcccggtcgagtc

SEQ ID NO: 778625 - DNA, 20 bp, Artificial
  CRISPR gRNA sequence
cactgagcccggtcgagtcc

SEQ ID NO: 778626 - DNA, 20 bp, Artificial
  CRISPR gRNA sequence
actgagcccggtcgagtcca

SEQ ID NO: 778627 - DNA, 20 bp, Artificial
  CRISPR gRNA sequence
ggtcgagtccagggttttta

SEQ ID NO: 778628 - DNA, 20 bp, Artificial
  CRISPR gRNA sequence
gtcgagtccagggtttttac

SEQ ID NO: 778629 - DNA, 20 bp, Artificial
  CRISPR gRNA sequence
gtccagggtttttacaggct

SEQ ID NO: 778630 - DNA, 20 bp, Artificial
  CRISPR gRNA sequence
cagggtttttacaggctcag

SEQ ID NO: 778631 - DNA, 20 bp, Artificial
  CRISPR gRNA sequence
agggtttttacaggctcaga

SEQ ID NO: 778632 - DNA, 20 bp, Artificial
  CRISPR gRNA sequence
gggtttttacaggctcagaa

SEQ ID NO: 778633 - DNA, 20 bp, Artificial
  CRISPR gRNA sequence
gtttttacaggctcagaagg

SEQ ID NO: 778634 - DNA, 20 bp, Artificial
  CRISPR gRNA sequence
tttttacaggctcagaaggg

SEQ ID NO: 778635 - DNA, 20 bp, Artificial
  CRISPR gRNA sequence
ttacaggctcagaagggagg

SEQ ID NO: 778636 - DNA, 20 bp, Artificial
  CRISPR gRNA sequence
acaggctcagaagggaggaa

SEQ ID NO: 778637 - DNA, 20 bp, Artificial
  CRISPR gRNA sequence
gggaggaagagtgtgctgat

SEQ ID NO: 778638 - DNA, 20 bp, Artificial
  CRISPR gRNA sequence
agagtgtgctgattggccca

SEQ ID NO: 778639 - DNA, 20 bp, Artificial
  CRISPR gRNA sequence
gagtgtgctgattggcccat

SEQ ID NO: 778640 - DNA, 20 bp, Artificial
  CRISPR gRNA sequence
tgtgctgattggcccatggg

SEQ ID NO: 778641 - DNA, 20 bp, Artificial
  CRISPR gRNA sequence
gattggcccatgggcagcca

SEQ ID NO: 778642 - DNA, 20 bp, Artificial
  CRISPR gRNA sequence
tggcccatgggcagccatgg

SEQ ID NO: 778643 - DNA, 20 bp, Artificial
  CRISPR gRNA sequence
ggcccatgggcagccatgga

SEQ ID NO: 778644 - DNA, 20 bp, Artificial
  CRISPR gRNA sequence
gcccatgggcagccatggaa

SEQ ID NO: 778645 - DNA, 20 bp, Artificial
  CRISPR gRNA sequence
tgggcagccatggaagggcc

SEQ ID NO: 778646 - DNA, 20 bp, Artificial
  CRISPR gRNA sequence
gccatggaagggcccagaaa

SEQ ID NO: 778647 - DNA, 20 bp, Artificial
  CRISPR gRNA sequence
gggcccagaaaaagcactgt

SEQ ID NO: 778648 - DNA, 20 bp, Artificial
  CRISPR gRNA sequence
agcactgtaagttcttaccc

SEQ ID NO: 778649 - DNA, 20 bp, Artificial
  CRISPR gRNA sequence
gcactgtaagttcttacccc

SEQ ID NO: 778650 - DNA, 20 bp, Artificial
  CRISPR gRNA sequence
taagttcttaccccaggctg

SEQ ID NO: 778651 - DNA, 20 bp, Artificial
  CRISPR gRNA sequence
ctgtggactccacccacaat

SEQ ID NO: 778652 - DNA, 20 bp, Artificial
  CRISPR gRNA sequence
tccacccacaattggcaacc

SEQ ID NO: 778653 - DNA, 20 bp, Artificial
  CRISPR gRNA sequence
acaattggcaacctggctcc

SEQ ID NO: 778654 - DNA, 20 bp, Artificial
  CRISPR gRNA sequence
caattggcaacctggctccc

SEQ ID NO: 778655 - DNA, 20 bp, Artificial
  CRISPR gRNA sequence
gcaacctggctcccaggctt

SEQ ID NO: 778656 - DNA, 20 bp, Artificial
  CRISPR gRNA sequence
caacctggctcccaggcttt

SEQ ID NO: 778657 - DNA, 20 bp, Artificial
  CRISPR gRNA sequence
cccaggctttgggccatccc

SEQ ID NO: 778658 - DNA, 20 bp, Artificial
  CRISPR gRNA sequence
tttgggccatccctggcttg

SEQ ID NO: 778659 - DNA, 20 bp, Artificial
  CRISPR gRNA sequence
ttgggccatccctggcttga

SEQ ID NO: 778660 - DNA, 20 bp, Artificial
  CRISPR gRNA sequence
gccatccctggcttgaaggt

SEQ ID NO: 778661 - DNA, 20 bp, Artificial
  CRISPR gRNA sequence
ccatccctggcttgaaggtt

SEQ ID NO: 778662 - DNA, 20 bp, Artificial
  CRISPR gRNA sequence
gcttgaaggttgggtttcac

SEQ ID NO: 778663 - DNA, 20 bp, Artificial
  CRISPR gRNA sequence
cttgaaggttgggtttcacc

SEQ ID NO: 778664 - DNA, 20 bp, Artificial
  CRISPR gRNA sequence
ttgaaggttgggtttcacca

SEQ ID NO: 778665 - DNA, 20 bp, Artificial
  CRISPR gRNA sequence
ggacctaacccctttccgcc

SEQ ID NO: 778666 - DNA, 20 bp, Artificial
  CRISPR gRNA sequence
gacctaacccctttccgcca

SEQ ID NO: 778667 - DNA, 20 bp, Artificial
  CRISPR gRNA sequence
aacatgctgtccatgatgcc

SEQ ID NO: 778668 - DNA, 20 bp, Artificial
  CRISPR gRNA sequence
acatgctgtccatgatgccc

SEQ ID NO: 778669 - DNA, 20 bp, Artificial
  CRISPR gRNA sequence
atgcccaggctgttcgtgcc

SEQ ID NO: 778670 - DNA, 20 bp, Artificial
  CRISPR gRNA sequence
tgcccaggctgttcgtgccg

SEQ ID NO: 778671 - DNA, 20 bp, Artificial
  CRISPR gRNA sequence
gcccaggctgttcgtgccga

SEQ ID NO: 778672 - DNA, 20 bp, Artificial
  CRISPR gRNA sequence
cccaggctgttcgtgccgag

SEQ ID NO: 778673 - DNA, 20 bp, Artificial
  CRISPR gRNA sequence
ttcgtgccgaggggtgcctg

SEQ ID NO: 778674 - DNA, 20 bp, Artificial
  CRISPR gRNA sequence
tcgtgccgaggggtgcctgc

SEQ ID NO: 778675 - DNA, 20 bp, Artificial
  CRISPR gRNA sequence
ggtgcctgcaggcctgccct

SEQ ID NO: 778676 - DNA, 20 bp, Artificial
  CRISPR gRNA sequence
ggcctgccctgagccaccct

SEQ ID NO: 778677 - DNA, 20 bp, Artificial
  CRISPR gRNA sequence
agccaccctcagcccctgct

SEQ ID NO: 778678 - DNA, 20 bp, Artificial
  CRISPR gRNA sequence
cagcctccctctgtgcttgt

SEQ ID NO: 778679 - DNA, 20 bp, Artificial
  CRISPR gRNA sequence
gcttgtcagcacccaacatc

SEQ ID NO: 778680 - DNA, 20 bp, Artificial
  CRISPR gRNA sequence
tgtcagcacccaacatctgg

SEQ ID NO: 778681 - DNA, 20 bp, Artificial
  CRISPR gRNA sequence
tcagcacccaacatctggaa

SEQ ID NO: 778682 - DNA, 20 bp, Artificial
  CRISPR gRNA sequence
cagcacccaacatctggaag

SEQ ID NO: 778683 - DNA, 20 bp, Artificial
  CRISPR gRNA sequence
cccaacatctggaagaggtc

SEQ ID NO: 778684 - DNA, 20 bp, Artificial
  CRISPR gRNA sequence
ccaacatctggaagaggtcg

SEQ ID NO: 778685 - DNA, 20 bp, Artificial
  CRISPR gRNA sequence
acatctggaagaggtcgagg

SEQ ID NO: 778686 - DNA, 20 bp, Artificial
  CRISPR gRNA sequence
tctggaagaggtcgaggcag

SEQ ID NO: 778687 - DNA, 20 bp, Artificial
  CRISPR gRNA sequence
ctggaagaggtcgaggcagc

SEQ ID NO: 778688 - DNA, 20 bp, Artificial
  CRISPR gRNA sequence
tggaagaggtcgaggcagca

SEQ ID NO: 778689 - DNA, 20 bp, Artificial
  CRISPR gRNA sequence
ggaagaggtcgaggcagcag

SEQ ID NO: 778690 - DNA, 20 bp, Artificial
  CRISPR gRNA sequence
gaagaggtcgaggcagcagg

SEQ ID NO: 778691 - DNA, 20 bp, Artificial
  CRISPR gRNA sequence
aggtcgaggcagcagggggc

SEQ ID NO: 778692 - DNA, 20 bp, Artificial
  CRISPR gRNA sequence
gcagcagggggctagtgtgt

SEQ ID NO: 778693 - DNA, 20 bp, Artificial
  CRISPR gRNA sequence
tagtgtgtcagtaccatcct

SEQ ID NO: 778694 - DNA, 20 bp, Artificial
  CRISPR gRNA sequence
atcctgagcacccacatgcc

SEQ ID NO: 778695 - DNA, 20 bp, Artificial
  CRISPR gRNA sequence
tgagcacccacatgcctggc

SEQ ID NO: 778696 - DNA, 20 bp, Artificial
  CRISPR gRNA sequence
gagcacccacatgcctggcc

SEQ ID NO: 778697 - DNA, 20 bp, Artificial
  CRISPR gRNA sequence
catgcctggccgggttgtga

SEQ ID NO: 778698 - DNA, 20 bp, Artificial
  CRISPR gRNA sequence
ggccgggttgtgacagcacc

SEQ ID NO: 778699 - DNA, 20 bp, Artificial
  CRISPR gRNA sequence
gccgggttgtgacagcacct

SEQ ID NO: 778700 - DNA, 20 bp, Artificial
  CRISPR gRNA sequence
gttgtgacagcacctaggct

SEQ ID NO: 778701 - DNA, 20 bp, Artificial
  CRISPR gRNA sequence
ggccacaactttgcttcacc

SEQ ID NO: 778702 - DNA, 20 bp, Artificial
  CRISPR gRNA sequence
cacaactttgcttcacccag

SEQ ID NO: 778703 - DNA, 20 bp, Artificial
  CRISPR gRNA sequence
aactttgcttcacccagtag

SEQ ID NO: 778704 - DNA, 20 bp, Artificial
  CRISPR gRNA sequence
actttgcttcacccagtagc

SEQ ID NO: 778705 - DNA, 20 bp, Artificial
  CRISPR gRNA sequence
cttcacccagtagcaggtgc

SEQ ID NO: 778706 - DNA, 20 bp, Artificial
  CRISPR gRNA sequence
ttcacccagtagcaggtgcc

SEQ ID NO: 778707 - DNA, 20 bp, Artificial
  CRISPR gRNA sequence
cacccagtagcaggtgccag

SEQ ID NO: 778708 - DNA, 20 bp, Artificial
  CRISPR gRNA sequence
ccagtagcaggtgccaggag

SEQ ID NO: 778709 - DNA, 20 bp, Artificial
  CRISPR gRNA sequence
cagtagcaggtgccaggagt

SEQ ID NO: 778710 - DNA, 20 bp, Artificial
  CRISPR gRNA sequence
tagcaggtgccaggagtggg

SEQ ID NO: 778711 - DNA, 20 bp, Artificial
  CRISPR gRNA sequence
gcaggtgccaggagtgggaa

SEQ ID NO: 778712 - DNA, 20 bp, Artificial
  CRISPR gRNA sequence
caggtgccaggagtgggaag

SEQ ID NO: 778713 - DNA, 20 bp, Artificial
  CRISPR gRNA sequence
tgccaggagtgggaagaggc

SEQ ID NO: 778714 - DNA, 20 bp, Artificial
  CRISPR gRNA sequence
gccaggagtgggaagaggcc

SEQ ID NO: 778715 - DNA, 20 bp, Artificial
  CRISPR gRNA sequence
ccaggagtgggaagaggcca

SEQ ID NO: 778716 - DNA, 20 bp, Artificial
  CRISPR gRNA sequence
aggagtgggaagaggccagg

SEQ ID NO: 778717 - DNA, 20 bp, Artificial
  CRISPR gRNA sequence
agtgggaagaggccagggag

SEQ ID NO: 778718 - DNA, 20 bp, Artificial
  CRISPR gRNA sequence
gtgggaagaggccagggagt

SEQ ID NO: 778719 - DNA, 20 bp, Artificial
  CRISPR gRNA sequence
gggaagaggccagggagtgg

SEQ ID NO: 778720 - DNA, 20 bp, Artificial
  CRISPR gRNA sequence
aagaggccagggagtgggag

SEQ ID NO: 778721 - DNA, 20 bp, Artificial
  CRISPR gRNA sequence
agaggccagggagtgggagc

SEQ ID NO: 778722 - DNA, 20 bp, Artificial
  CRISPR gRNA sequence
agcaggcactttcaaccttg

SEQ ID NO: 778723 - DNA, 20 bp, Artificial
  CRISPR gRNA sequence
gcaggcactttcaaccttgt

SEQ ID NO: 778724 - DNA, 20 bp, Artificial
  CRISPR gRNA sequence
aggcactttcaaccttgtgg

SEQ ID NO: 778725 - DNA, 20 bp, Artificial
  CRISPR gRNA sequence
cactttcaaccttgtgggag

SEQ ID NO: 778726 - DNA, 20 bp, Artificial
  CRISPR gRNA sequence
actttcaaccttgtgggagc

SEQ ID NO: 778727 - DNA, 20 bp, Artificial
  CRISPR gRNA sequence
ctttcaaccttgtgggagca

SEQ ID NO: 778728 - DNA, 20 bp, Artificial
  CRISPR gRNA sequence
tttcaaccttgtgggagcag

SEQ ID NO: 778729 - DNA, 20 bp, Artificial
  CRISPR gRNA sequence
tgtgggagcaggggacttcc

SEQ ID NO: 778730 - DNA, 20 bp, Artificial
  CRISPR gRNA sequence
gtgggagcaggggacttcct

SEQ ID NO: 778731 - DNA, 20 bp, Artificial
  CRISPR gRNA sequence
aggggacttcctgggcccct

SEQ ID NO: 778732 - DNA, 20 bp, Artificial
  CRISPR gRNA sequence
gggacttcctgggcccctga

SEQ ID NO: 778733 - DNA, 20 bp, Artificial
  CRISPR gRNA sequence
ttcctgggcccctgagagta

SEQ ID NO: 778734 - DNA, 20 bp, Artificial
  CRISPR gRNA sequence
cctgggcccctgagagtaca

SEQ ID NO: 778735 - DNA, 20 bp, Artificial
  CRISPR gRNA sequence
cctgagagtacagagatgcc

SEQ ID NO: 778736 - DNA, 20 bp, Artificial
  CRISPR gRNA sequence
ctgagagtacagagatgcct

SEQ ID NO: 778737 - DNA, 20 bp, Artificial
  CRISPR gRNA sequence
agtacagagatgcctgggtc

SEQ ID NO: 778738 - DNA, 20 bp, Artificial
  CRISPR gRNA sequence
tacagagatgcctgggtcca

SEQ ID NO: 778739 - DNA, 20 bp, Artificial
  CRISPR gRNA sequence
cctgggtccagagccactgc

SEQ ID NO: 778740 - DNA, 20 bp, Artificial
  CRISPR gRNA sequence
ctgggtccagagccactgct

SEQ ID NO: 778741 - DNA, 20 bp, Artificial
  CRISPR gRNA sequence
ggtccagagccactgctggg

SEQ ID NO: 778742 - DNA, 20 bp, Artificial
  CRISPR gRNA sequence
gagccactgctgggcagcta

SEQ ID NO: 778743 - DNA, 20 bp, Artificial
  CRISPR gRNA sequence
agccactgctgggcagctac

SEQ ID NO: 778744 - DNA, 20 bp, Artificial
  CRISPR gRNA sequence
gccactgctgggcagctaca

SEQ ID NO: 778745 - DNA, 20 bp, Artificial
  CRISPR gRNA sequence
ccactgctgggcagctacag

SEQ ID NO: 778746 - DNA, 20 bp, Artificial
  CRISPR gRNA sequence
tgggcagctacaggggtgcc

SEQ ID NO: 778747 - DNA, 20 bp, Artificial
  CRISPR gRNA sequence
gggcagctacaggggtgcct

SEQ ID NO: 778748 - DNA, 20 bp, Artificial
  CRISPR gRNA sequence
gcagctacaggggtgcctgg

SEQ ID NO: 778749 - DNA, 20 bp, Artificial
  CRISPR gRNA sequence
caggggtgcctgggagcatg

SEQ ID NO: 778750 - DNA, 20 bp, Artificial
  CRISPR gRNA sequence
cggttcccaccccgccaact

SEQ ID NO: 778751 - DNA, 20 bp, Artificial
  CRISPR gRNA sequence
cccaccccgccaactcagta

SEQ ID NO: 778752 - DNA, 20 bp, Artificial
  CRISPR gRNA sequence
ccaccccgccaactcagtac

SEQ ID NO: 778753 - DNA, 20 bp, Artificial
  CRISPR gRNA sequence
caccccgccaactcagtacg

SEQ ID NO: 778754 - DNA, 20 bp, Artificial
  CRISPR gRNA sequence
cccgccaactcagtacgggg

SEQ ID NO: 778755 - DNA, 20 bp, Artificial
  CRISPR gRNA sequence
ccgccaactcagtacggggc

SEQ ID NO: 778756 - DNA, 20 bp, Artificial
  CRISPR gRNA sequence
gcgggactcccacctgttct

SEQ ID NO: 778757 - DNA, 20 bp, Artificial
  CRISPR gRNA sequence
ccacctgttcttggcctccc

SEQ ID NO: 778758 - DNA, 20 bp, Artificial
  CRISPR gRNA sequence
tggccacacctccactgctg

SEQ ID NO: 778759 - DNA, 20 bp, Artificial
  CRISPR gRNA sequence
actgctgcagctgctctaaa

SEQ ID NO: 778760 - DNA, 20 bp, Artificial
  CRISPR gRNA sequence
ctgctgcagctgctctaaac

SEQ ID NO: 778761 - DNA, 20 bp, Artificial
  CRISPR gRNA sequence
ctgcagctgctctaaacggg

SEQ ID NO: 778762 - DNA, 20 bp, Artificial
  CRISPR gRNA sequence
gcagctgctgccatcactgt

SEQ ID NO: 778763 - DNA, 20 bp, Artificial
  CRISPR gRNA sequence
tatgattgtgccactgactc

SEQ ID NO: 778764 - DNA, 20 bp, Artificial
  CRISPR gRNA sequence
ttgtgccactgactccagcc

SEQ ID NO: 778765 - DNA, 20 bp, Artificial
  CRISPR gRNA sequence
tgtgccactgactccagcct

SEQ ID NO: 778766 - DNA, 20 bp, Artificial
  CRISPR gRNA sequence
actgactccagcctgggcaa

SEQ ID NO: 778767 - DNA, 20 bp, Artificial
  CRISPR gRNA sequence
actccagcctgggcaacaga

SEQ ID NO: 778768 - DNA, 20 bp, Artificial
  CRISPR gRNA sequence
tccagcctgggcaacagaaa

SEQ ID NO: 778769 - DNA, 20 bp, Artificial
  CRISPR gRNA sequence
gcaacagaaagagacctata

SEQ ID NO: 778770 - DNA, 20 bp, Artificial
  CRISPR gRNA sequence
gacctatatggtatgttaaa

SEQ ID NO: 778771 - DNA, 20 bp, Artificial
  CRISPR gRNA sequence
ttaaatggtaatgactgctt

SEQ ID NO: 778772 - DNA, 20 bp, Artificial
  CRISPR gRNA sequence
taaatggtaatgactgcttt

SEQ ID NO: 778773 - DNA, 20 bp, Artificial
  CRISPR gRNA sequence
aaatggtaatgactgctttg

SEQ ID NO: 778774 - DNA, 20 bp, Artificial
  CRISPR gRNA sequence
aatggtaatgactgctttgg

SEQ ID NO: 778775 - DNA, 20 bp, Artificial
  CRISPR gRNA sequence
tggtaatgactgctttgggg

SEQ ID NO: 778776 - DNA, 20 bp, Artificial
  CRISPR gRNA sequence
atgactgctttgggggagaa

SEQ ID NO: 778777 - DNA, 20 bp, Artificial
  CRISPR gRNA sequence
ttgggggagaaaagatgact

SEQ ID NO: 778778 - DNA, 20 bp, Artificial
  CRISPR gRNA sequence
tgggggagaaaagatgacta

SEQ ID NO: 778779 - DNA, 20 bp, Artificial
  CRISPR gRNA sequence
aaaagatgactaaggattgt

SEQ ID NO: 778780 - DNA, 20 bp, Artificial
  CRISPR gRNA sequence
aaagatgactaaggattgtt

SEQ ID NO: 778781 - DNA, 20 bp, Artificial
  CRISPR gRNA sequence
ctaaggattgttgggaatgc

SEQ ID NO: 778782 - DNA, 20 bp, Artificial
  CRISPR gRNA sequence
taaggattgttgggaatgct

SEQ ID NO: 778783 - DNA, 20 bp, Artificial
  CRISPR gRNA sequence
aaggattgttgggaatgctg

SEQ ID NO: 778784 - DNA, 20 bp, Artificial
  CRISPR gRNA sequence
gattgttgggaatgctgggg

SEQ ID NO: 778785 - DNA, 20 bp, Artificial
  CRISPR gRNA sequence
attgttgggaatgctggggt

SEQ ID NO: 778786 - DNA, 20 bp, Artificial
  CRISPR gRNA sequence
ttgttgggaatgctggggta

SEQ ID NO: 778787 - DNA, 20 bp, Artificial
  CRISPR gRNA sequence
tgggaatgctggggtagggt

SEQ ID NO: 778788 - DNA, 20 bp, Artificial
  CRISPR gRNA sequence
ggaatgctggggtagggttg

SEQ ID NO: 778789 - DNA, 20 bp, Artificial
  CRISPR gRNA sequence
gtgctcttgcaattttacat

SEQ ID NO: 778790 - DNA, 20 bp, Artificial
  CRISPR gRNA sequence
tcttgcaattttacataaga

SEQ ID NO: 778791 - DNA, 20 bp, Artificial
  CRISPR gRNA sequence
aattttacataagacagtct

SEQ ID NO: 778792 - DNA, 20 bp, Artificial
  CRISPR gRNA sequence
attttacataagacagtctc

SEQ ID NO: 778793 - DNA, 20 bp, Artificial
  CRISPR gRNA sequence
tttacataagacagtctcag

SEQ ID NO: 778794 - DNA, 20 bp, Artificial
  CRISPR gRNA sequence
ctcaggagaaaaaacaatga

SEQ ID NO: 778795 - DNA, 20 bp, Artificial
  CRISPR gRNA sequence
gaaaaaacaatgaaagtgtc

SEQ ID NO: 778796 - DNA, 20 bp, Artificial
  CRISPR gRNA sequence
aaaaaacaatgaaagtgtcc

SEQ ID NO: 778797 - DNA, 20 bp, Artificial
  CRISPR gRNA sequence
aaacaatgaaagtgtccggg

SEQ ID NO: 778798 - DNA, 20 bp, Artificial
  CRISPR gRNA sequence
acaatgaaagtgtccgggta

SEQ ID NO: 778799 - DNA, 20 bp, Artificial
  CRISPR gRNA sequence
caatgaaagtgtccgggtag

SEQ ID NO: 778800 - DNA, 20 bp, Artificial
  CRISPR gRNA sequence
aatgaaagtgtccgggtaga

SEQ ID NO: 778801 - DNA, 20 bp, Artificial
  CRISPR gRNA sequence
gggtagagggacatgtacac

SEQ ID NO: 778802 - DNA, 20 bp, Artificial
  CRISPR gRNA sequence
tagagggacatgtacactgg

SEQ ID NO: 778803 - DNA, 20 bp, Artificial
  CRISPR gRNA sequence
gggacatgtacactggcagc

SEQ ID NO: 778804 - DNA, 20 bp, Artificial
  CRISPR gRNA sequence
ggacatgtacactggcagca

SEQ ID NO: 778805 - DNA, 20 bp, Artificial
  CRISPR gRNA sequence
ctggcagcaaggtcttccct

SEQ ID NO: 778806 - DNA, 20 bp, Artificial
  CRISPR gRNA sequence
tggcagcaaggtcttccctt

SEQ ID NO: 778807 - DNA, 20 bp, Artificial
  CRISPR gRNA sequence
ggcagcaaggtcttccctta

SEQ ID NO: 778808 - DNA, 20 bp, Artificial
  CRISPR gRNA sequence
caaggtcttcccttagggat

SEQ ID NO: 778809 - DNA, 20 bp, Artificial
  CRISPR gRNA sequence
tcccttagggattggatctg

SEQ ID NO: 778810 - DNA, 20 bp, Artificial
  CRISPR gRNA sequence
cttagggattggatctgcgg

SEQ ID NO: 778811 - DNA, 20 bp, Artificial
  CRISPR gRNA sequence
tagggattggatctgcggaa

SEQ ID NO: 778812 - DNA, 20 bp, Artificial
  CRISPR gRNA sequence
agggattggatctgcggaag

SEQ ID NO: 778813 - DNA, 20 bp, Artificial
  CRISPR gRNA sequence
gatctgcggaagaggccaca

SEQ ID NO: 778814 - DNA, 20 bp, Artificial
  CRISPR gRNA sequence
atctgcggaagaggccacac

SEQ ID NO: 778815 - DNA, 20 bp, Artificial
  CRISPR gRNA sequence
cggaagaggccacacaggcc

SEQ ID NO: 778816 - DNA, 20 bp, Artificial
  CRISPR gRNA sequence
aagaggccacacaggcctgg

SEQ ID NO: 778817 - DNA, 20 bp, Artificial
  CRISPR gRNA sequence
aggccacacaggcctggaag

SEQ ID NO: 778818 - DNA, 20 bp, Artificial
  CRISPR gRNA sequence
ggccacacaggcctggaagc

SEQ ID NO: 778819 - DNA, 20 bp, Artificial
  CRISPR gRNA sequence
acaggcctggaagcaggctt

SEQ ID NO: 778820 - DNA, 20 bp, Artificial
  CRISPR gRNA sequence
caggcctggaagcaggctta

SEQ ID NO: 778821 - DNA, 20 bp, Artificial
  CRISPR gRNA sequence
gaagcaggcttaaggccatt

SEQ ID NO: 778822 - DNA, 20 bp, Artificial
  CRISPR gRNA sequence
aagcaggcttaaggccattc

SEQ ID NO: 778823 - DNA, 20 bp, Artificial
  CRISPR gRNA sequence
aggcttaaggccattcaggc

SEQ ID NO: 778824 - DNA, 20 bp, Artificial
  CRISPR gRNA sequence
ggcttaaggccattcaggct

SEQ ID NO: 778825 - DNA, 20 bp, Artificial
  CRISPR gRNA sequence
gccattcaggctaggaattc

SEQ ID NO: 778826 - DNA, 20 bp, Artificial
  CRISPR gRNA sequence
ctaggaattccagtgtttca

SEQ ID NO: 778827 - DNA, 20 bp, Artificial
  CRISPR gRNA sequence
gaattccagtgtttcaaaga

SEQ ID NO: 778828 - DNA, 20 bp, Artificial
  CRISPR gRNA sequence
gtttcaaagacagactgcaa

SEQ ID NO: 778829 - DNA, 20 bp, Artificial
  CRISPR gRNA sequence
caaagacagactgcaatgga

SEQ ID NO: 778830 - DNA, 20 bp, Artificial
  CRISPR gRNA sequence
agacagactgcaatggatgg

SEQ ID NO: 778831 - DNA, 20 bp, Artificial
  CRISPR gRNA sequence
agactgcaatggatggcggt

SEQ ID NO: 778832 - DNA, 20 bp, Artificial
  CRISPR gRNA sequence
ctgcaatggatggcggttgg

SEQ ID NO: 778833 - DNA, 20 bp, Artificial
  CRISPR gRNA sequence
tgcaatggatggcggttggt

SEQ ID NO: 778834 - DNA, 20 bp, Artificial
  CRISPR gRNA sequence
gatggcggttggtaggtcaa

SEQ ID NO: 778835 - DNA, 20 bp, Artificial
  CRISPR gRNA sequence
ggttggtaggtcaaaagctc

SEQ ID NO: 778836 - DNA, 20 bp, Artificial
  CRISPR gRNA sequence
aagctccagataacatctct

SEQ ID NO: 778837 - DNA, 20 bp, Artificial
  CRISPR gRNA sequence
ccctgcgaacaccttactct

SEQ ID NO: 778838 - DNA, 20 bp, Artificial
  CRISPR gRNA sequence
cctgcgaacaccttactctc

SEQ ID NO: 778839 - DNA, 20 bp, Artificial
  CRISPR gRNA sequence
ctgcgaacaccttactctcg

SEQ ID NO: 778840 - DNA, 20 bp, Artificial
  CRISPR gRNA sequence
gcgaacaccttactctcggg

SEQ ID NO: 778841 - DNA, 20 bp, Artificial
  CRISPR gRNA sequence
aacaccttactctcggggag

SEQ ID NO: 778842 - DNA, 20 bp, Artificial
  CRISPR gRNA sequence
acaccttactctcggggaga

SEQ ID NO: 778843 - DNA, 20 bp, Artificial
  CRISPR gRNA sequence
cttactctcggggagaagga

SEQ ID NO: 778844 - DNA, 20 bp, Artificial
  CRISPR gRNA sequence
ttactctcggggagaaggat

SEQ ID NO: 778845 - DNA, 20 bp, Artificial
  CRISPR gRNA sequence
ctcggggagaaggatgggca

SEQ ID NO: 778846 - DNA, 20 bp, Artificial
  CRISPR gRNA sequence
ggggagaaggatgggcacag

SEQ ID NO: 778847 - DNA, 20 bp, Artificial
  CRISPR gRNA sequence
gggagaaggatgggcacagt

SEQ ID NO: 778848 - DNA, 20 bp, Artificial
  CRISPR gRNA sequence
tgggcacagtgggtccttta

SEQ ID NO: 778849 - DNA, 20 bp, Artificial
  CRISPR gRNA sequence
acagtgggtcctttaaagca

SEQ ID NO: 778850 - DNA, 20 bp, Artificial
  CRISPR gRNA sequence
cagtgggtcctttaaagcat

SEQ ID NO: 778851 - DNA, 20 bp, Artificial
  CRISPR gRNA sequence
agtgggtcctttaaagcatg

SEQ ID NO: 778852 - DNA, 20 bp, Artificial
  CRISPR gRNA sequence
gtcctttaaagcatggggtc

SEQ ID NO: 778853 - DNA, 20 bp, Artificial
  CRISPR gRNA sequence
tcctttaaagcatggggtcc

SEQ ID NO: 778854 - DNA, 20 bp, Artificial
  CRISPR gRNA sequence
ttaaagcatggggtccagga

SEQ ID NO: 778855 - DNA, 20 bp, Artificial
  CRISPR gRNA sequence
taaagcatggggtccaggac

SEQ ID NO: 778856 - DNA, 20 bp, Artificial
  CRISPR gRNA sequence
aaagcatggggtccaggaca

SEQ ID NO: 778857 - DNA, 20 bp, Artificial
  CRISPR gRNA sequence
aagcatggggtccaggacag

SEQ ID NO: 778858 - DNA, 20 bp, Artificial
  CRISPR gRNA sequence
aggacaggggcctcttgtct

SEQ ID NO: 778859 - DNA, 20 bp, Artificial
  CRISPR gRNA sequence
gtcttggctgttgaaaaaac

SEQ ID NO: 778860 - DNA, 20 bp, Artificial
  CRISPR gRNA sequence
tcttggctgttgaaaaaact

SEQ ID NO: 778861 - DNA, 20 bp, Artificial
  CRISPR gRNA sequence
aaaaaactgggttttacact

SEQ ID NO: 778862 - DNA, 20 bp, Artificial
  CRISPR gRNA sequence
tttacactgagtgaaatgct

SEQ ID NO: 778863 - DNA, 20 bp, Artificial
  CRISPR gRNA sequence
tgagtgaaatgctgagccat

SEQ ID NO: 778864 - DNA, 20 bp, Artificial
  CRISPR gRNA sequence
gtgaaatgctgagccatcgg

SEQ ID NO: 778865 - DNA, 20 bp, Artificial
  CRISPR gRNA sequence
tgaaatgctgagccatcgga

SEQ ID NO: 778866 - DNA, 20 bp, Artificial
  CRISPR gRNA sequence
ctgagccatcggaaggtttt

SEQ ID NO: 778867 - DNA, 20 bp, Artificial
  CRISPR gRNA sequence
cggaaggttttaagaaaata

SEQ ID NO: 778868 - DNA, 20 bp, Artificial
  CRISPR gRNA sequence
ttattttttaaaaaccactc

SEQ ID NO: 778869 - DNA, 20 bp, Artificial
  CRISPR gRNA sequence
tttaaaaaccactctggctg

SEQ ID NO: 778870 - DNA, 20 bp, Artificial
  CRISPR gRNA sequence
tctggctgcagaatcaactg

SEQ ID NO: 778871 - DNA, 20 bp, Artificial
  CRISPR gRNA sequence
ctggctgcagaatcaactgc

SEQ ID NO: 778872 - DNA, 20 bp, Artificial
  CRISPR gRNA sequence
gctgcagaatcaactgcagg

SEQ ID NO: 778873 - DNA, 20 bp, Artificial
  CRISPR gRNA sequence
ctgcagaatcaactgcagga

SEQ ID NO: 778874 - DNA, 20 bp, Artificial
  CRISPR gRNA sequence
caactgcaggaaggcaaaac

SEQ ID NO: 778875 - DNA, 20 bp, Artificial
  CRISPR gRNA sequence
ggaaggcaaaactggaatca

SEQ ID NO: 778876 - DNA, 20 bp, Artificial
  CRISPR gRNA sequence
aaaactggaatcatagcatc

SEQ ID NO: 778877 - DNA, 20 bp, Artificial
  CRISPR gRNA sequence
gaatcatagcatccagttgt

SEQ ID NO: 778878 - DNA, 20 bp, Artificial
  CRISPR gRNA sequence
atccagttgtcagactaatg

SEQ ID NO: 778879 - DNA, 20 bp, Artificial
  CRISPR gRNA sequence
actaatgcagaaatcaccat

SEQ ID NO: 778880 - DNA, 20 bp, Artificial
  CRISPR gRNA sequence
gacaatgactctgaccgata

SEQ ID NO: 778881 - DNA, 20 bp, Artificial
  CRISPR gRNA sequence
aatgactctgaccgatatgg

SEQ ID NO: 778882 - DNA, 20 bp, Artificial
  CRISPR gRNA sequence
gactctgaccgatatggaag

SEQ ID NO: 778883 - DNA, 20 bp, Artificial
  CRISPR gRNA sequence
tctgaccgatatggaagcag

SEQ ID NO: 778884 - DNA, 20 bp, Artificial
  CRISPR gRNA sequence
tgaccgatatggaagcagtg

SEQ ID NO: 778885 - DNA, 20 bp, Artificial
  CRISPR gRNA sequence
gaccgatatggaagcagtgg

SEQ ID NO: 778886 - DNA, 20 bp, Artificial
  CRISPR gRNA sequence
cgatatggaagcagtggagg

SEQ ID NO: 778887 - DNA, 20 bp, Artificial
  CRISPR gRNA sequence
atggaagcagtggaggtggt

SEQ ID NO: 778888 - DNA, 20 bp, Artificial
  CRISPR gRNA sequence
gcagtggaggtggtgagaaa

SEQ ID NO: 778889 - DNA, 20 bp, Artificial
  CRISPR gRNA sequence
tggaggtggtgagaaatggt

SEQ ID NO: 778890 - DNA, 20 bp, Artificial
  CRISPR gRNA sequence
ggtgagaaatggtcagattc

SEQ ID NO: 778891 - DNA, 20 bp, Artificial
  CRISPR gRNA sequence
tcagattctggatatatttg

SEQ ID NO: 778892 - DNA, 20 bp, Artificial
  CRISPR gRNA sequence
cagattctggatatatttga

SEQ ID NO: 778893 - DNA, 20 bp, Artificial
  CRISPR gRNA sequence
attctggatatatttgaagg

SEQ ID NO: 778894 - DNA, 20 bp, Artificial
  CRISPR gRNA sequence
ttctggatatatttgaagga

SEQ ID NO: 778895 - DNA, 20 bp, Artificial
  CRISPR gRNA sequence
tctggatatatttgaaggaa

SEQ ID NO: 778896 - DNA, 20 bp, Artificial
  CRISPR gRNA sequence
atatttgaaggaagggccaa

SEQ ID NO: 778897 - DNA, 20 bp, Artificial
  CRISPR gRNA sequence
tatttgaaggaagggccaat

SEQ ID NO: 778898 - DNA, 20 bp, Artificial
  CRISPR gRNA sequence
atttgaaggaagggccaata

SEQ ID NO: 778899 - DNA, 20 bp, Artificial
  CRISPR gRNA sequence
gaaggaagggccaatagggt

SEQ ID NO: 778900 - DNA, 20 bp, Artificial
  CRISPR gRNA sequence
aatagggttggttaatgaat

SEQ ID NO: 778901 - DNA, 20 bp, Artificial
  CRISPR gRNA sequence
gttggttaatgaatcagatg

SEQ ID NO: 778902 - DNA, 20 bp, Artificial
  CRISPR gRNA sequence
tggttaatgaatcagatgta

SEQ ID NO: 778903 - DNA, 20 bp, Artificial
  CRISPR gRNA sequence
taatgaatcagatgtagagt

SEQ ID NO: 778904 - DNA, 20 bp, Artificial
  CRISPR gRNA sequence
aatcagatgtagagtgagaa

SEQ ID NO: 778905 - DNA, 20 bp, Artificial
  CRISPR gRNA sequence
agatgtagagtgagaaaaga

SEQ ID NO: 778906 - DNA, 20 bp, Artificial
  CRISPR gRNA sequence
gatgtagagtgagaaaagaa

SEQ ID NO: 778907 - DNA, 20 bp, Artificial
  CRISPR gRNA sequence
agtgagaaaagaaaggactc

SEQ ID NO: 778908 - DNA, 20 bp, Artificial
  CRISPR gRNA sequence
aaaggactcaagatgactcc

SEQ ID NO: 778909 - DNA, 20 bp, Artificial
  CRISPR gRNA sequence
aaggactcaagatgactcca

SEQ ID NO: 778910 - DNA, 20 bp, Artificial
  CRISPR gRNA sequence
ttcttgtccttcacctcaat

SEQ ID NO: 778911 - DNA, 20 bp, Artificial
  CRISPR gRNA sequence
ttgtccttcacctcaataag

SEQ ID NO: 778912 - DNA, 20 bp, Artificial
  CRISPR gRNA sequence
gtccttcacctcaataagtg

SEQ ID NO: 778913 - DNA, 20 bp, Artificial
  CRISPR gRNA sequence
tccttcacctcaataagtgg

SEQ ID NO: 778914 - DNA, 20 bp, Artificial
  CRISPR gRNA sequence
tcacctcaataagtggagga

SEQ ID NO: 778915 - DNA, 20 bp, Artificial
  CRISPR gRNA sequence
acctcaataagtggaggatg

SEQ ID NO: 778916 - DNA, 20 bp, Artificial
  CRISPR gRNA sequence
tcaataagtggaggatggag

SEQ ID NO: 778917 - DNA, 20 bp, Artificial
  CRISPR gRNA sequence
aataagtggaggatggagca

SEQ ID NO: 778918 - DNA, 20 bp, Artificial
  CRISPR gRNA sequence
ataagtggaggatggagcag

SEQ ID NO: 778919 - DNA, 20 bp, Artificial
  CRISPR gRNA sequence
agtggaggatggagcagagg

SEQ ID NO: 778920 - DNA, 20 bp, Artificial
  CRISPR gRNA sequence
gtggaggatggagcagagga

SEQ ID NO: 778921 - DNA, 20 bp, Artificial
  CRISPR gRNA sequence
aggatggagcagaggaaggc

SEQ ID NO: 778922 - DNA, 20 bp, Artificial
  CRISPR gRNA sequence
ggagcagaggaaggcaagac

SEQ ID NO: 778923 - DNA, 20 bp, Artificial
  CRISPR gRNA sequence
gcagaggaaggcaagactag

SEQ ID NO: 778924 - DNA, 20 bp, Artificial
  CRISPR gRNA sequence
cagaggaaggcaagactaga

SEQ ID NO: 778925 - DNA, 20 bp, Artificial
  CRISPR gRNA sequence
gcaagactagaaggtaaaaa

SEQ ID NO: 778926 - DNA, 20 bp, Artificial
  CRISPR gRNA sequence
agactagaaggtaaaaatag

SEQ ID NO: 778927 - DNA, 20 bp, Artificial
  CRISPR gRNA sequence
tagaaggtaaaaatagcagt

SEQ ID NO: 778928 - DNA, 20 bp, Artificial
  CRISPR gRNA sequence
aaggtaaaaatagcagtgag

SEQ ID NO: 778929 - DNA, 20 bp, Artificial
  CRISPR gRNA sequence
aggtaaaaatagcagtgaga

SEQ ID NO: 778930 - DNA, 20 bp, Artificial
  CRISPR gRNA sequence
gcagtgagaaggctctgcta

SEQ ID NO: 778931 - DNA, 20 bp, Artificial
  CRISPR gRNA sequence
agaaggctctgctatggtat

SEQ ID NO: 778932 - DNA, 20 bp, Artificial
  CRISPR gRNA sequence
aggctctgctatggtataag

SEQ ID NO: 778933 - DNA, 20 bp, Artificial
  CRISPR gRNA sequence
atggtataagaagaaatgat

SEQ ID NO: 778934 - DNA, 20 bp, Artificial
  CRISPR gRNA sequence
gtataagaagaaatgataag

SEQ ID NO: 778935 - DNA, 20 bp, Artificial
  CRISPR gRNA sequence
aaatgataagaagctgaatt

SEQ ID NO: 778936 - DNA, 20 bp, Artificial
  CRISPR gRNA sequence
aatgataagaagctgaatta

SEQ ID NO: 778937 - DNA, 20 bp, Artificial
  CRISPR gRNA sequence
aagaagctgaattaaggtga

SEQ ID NO: 778938 - DNA, 20 bp, Artificial
  CRISPR gRNA sequence
aagctgaattaaggtgatgg

SEQ ID NO: 778939 - DNA, 20 bp, Artificial
  CRISPR gRNA sequence
ctgaattaaggtgatggcag

SEQ ID NO: 778940 - DNA, 20 bp, Artificial
  CRISPR gRNA sequence
tgaattaaggtgatggcagt

SEQ ID NO: 778941 - DNA, 20 bp, Artificial
  CRISPR gRNA sequence
gaattaaggtgatggcagtg

SEQ ID NO: 778942 - DNA, 20 bp, Artificial
  CRISPR gRNA sequence
ttaaggtgatggcagtgggg

SEQ ID NO: 778943 - DNA, 20 bp, Artificial
  CRISPR gRNA sequence
aggtgatggcagtggggtgg

SEQ ID NO: 778944 - DNA, 20 bp, Artificial
  CRISPR gRNA sequence
gatggcagtggggtggaaga

SEQ ID NO: 778945 - DNA, 20 bp, Artificial
  CRISPR gRNA sequence
atggcagtggggtggaagaa

SEQ ID NO: 778946 - DNA, 20 bp, Artificial
  CRISPR gRNA sequence
ggcagtggggtggaagaaag

SEQ ID NO: 778947 - DNA, 20 bp, Artificial
  CRISPR gRNA sequence
cagtggggtggaagaaagga

SEQ ID NO: 778948 - DNA, 20 bp, Artificial
  CRISPR gRNA sequence
aaggagagccaccatgcaaa

SEQ ID NO: 778949 - DNA, 20 bp, Artificial
  CRISPR gRNA sequence
gccaccatgcaaaaagtatc

SEQ ID NO: 778950 - DNA, 20 bp, Artificial
  CRISPR gRNA sequence
ccaccatgcaaaaagtatcc

SEQ ID NO: 778951 - DNA, 20 bp, Artificial
  CRISPR gRNA sequence
accatgcaaaaagtatccag

SEQ ID NO: 778952 - DNA, 20 bp, Artificial
  CRISPR gRNA sequence
ccatgcaaaaagtatccagg

SEQ ID NO: 778953 - DNA, 20 bp, Artificial
  CRISPR gRNA sequence
catgcaaaaagtatccagga

SEQ ID NO: 778954 - DNA, 20 bp, Artificial
  CRISPR gRNA sequence
tgcaaaaagtatccaggagg

SEQ ID NO: 778955 - DNA, 20 bp, Artificial
  CRISPR gRNA sequence
tatccaggagggagaattaa

SEQ ID NO: 778956 - DNA, 20 bp, Artificial
  CRISPR gRNA sequence
atccaggagggagaattaac

SEQ ID NO: 778957 - DNA, 20 bp, Artificial
  CRISPR gRNA sequence
ggagggagaattaacaggac

SEQ ID NO: 778958 - DNA, 20 bp, Artificial
  CRISPR gRNA sequence
gagggagaattaacaggact

SEQ ID NO: 778959 - DNA, 20 bp, Artificial
  CRISPR gRNA sequence
agggagaattaacaggacta

SEQ ID NO: 778960 - DNA, 20 bp, Artificial
  CRISPR gRNA sequence
gggagaattaacaggactag

SEQ ID NO: 778961 - DNA, 20 bp, Artificial
  CRISPR gRNA sequence
gaattaacaggactagggga

SEQ ID NO: 778962 - DNA, 20 bp, Artificial
  CRISPR gRNA sequence
aattaacaggactaggggat

SEQ ID NO: 778963 - DNA, 20 bp, Artificial
  CRISPR gRNA sequence
aggggatgggccatatttgc

SEQ ID NO: 778964 - DNA, 20 bp, Artificial
  CRISPR gRNA sequence
atgggccatatttgcaagat

SEQ ID NO: 778965 - DNA, 20 bp, Artificial
  CRISPR gRNA sequence
tatttgcaagatgagaaatg

SEQ ID NO: 778966 - DNA, 20 bp, Artificial
  CRISPR gRNA sequence
tttgcaagatgagaaatgca

SEQ ID NO: 778967 - DNA, 20 bp, Artificial
  CRISPR gRNA sequence
ttgcaagatgagaaatgcag

SEQ ID NO: 778968 - DNA, 20 bp, Artificial
  CRISPR gRNA sequence
gatgagaaatgcagaggtct

SEQ ID NO: 778969 - DNA, 20 bp, Artificial
  CRISPR gRNA sequence
aatgcagaggtctaagattc

SEQ ID NO: 778970 - DNA, 20 bp, Artificial
  CRISPR gRNA sequence
gaggtctaagattctagctt

SEQ ID NO: 778971 - DNA, 20 bp, Artificial
  CRISPR gRNA sequence
aggtctaagattctagctta

SEQ ID NO: 778972 - DNA, 20 bp, Artificial
  CRISPR gRNA sequence
tctaagattctagcttaagg

SEQ ID NO: 778973 - DNA, 20 bp, Artificial
  CRISPR gRNA sequence
ctaagattctagcttaaggt

SEQ ID NO: 778974 - DNA, 20 bp, Artificial
  CRISPR gRNA sequence
aaggtgggtgttgctactat

SEQ ID NO: 778975 - DNA, 20 bp, Artificial
  CRISPR gRNA sequence
tgttgctactattagcataa

SEQ ID NO: 778976 - DNA, 20 bp, Artificial
  CRISPR gRNA sequence
gttgctactattagcataat

SEQ ID NO: 778977 - DNA, 20 bp, Artificial
  CRISPR gRNA sequence
tattagcataataggaaaac

SEQ ID NO: 778978 - DNA, 20 bp, Artificial
  CRISPR gRNA sequence
attagcataataggaaaaca

SEQ ID NO: 778979 - DNA, 20 bp, Artificial
  CRISPR gRNA sequence
taataggaaaacaaggcaca

SEQ ID NO: 778980 - DNA, 20 bp, Artificial
  CRISPR gRNA sequence
agacttttcaaaatttgtcc

SEQ ID NO: 778981 - DNA, 20 bp, Artificial
  CRISPR gRNA sequence
gacttttcaaaatttgtcca

SEQ ID NO: 778982 - DNA, 20 bp, Artificial
  CRISPR gRNA sequence
tcaaaatttgtccaaggtgt

SEQ ID NO: 778983 - DNA, 20 bp, Artificial
  CRISPR gRNA sequence
aaaatttgtccaaggtgtta

SEQ ID NO: 778984 - DNA, 20 bp, Artificial
  CRISPR gRNA sequence
aaatttgtccaaggtgttag

SEQ ID NO: 778985 - DNA, 20 bp, Artificial
  CRISPR gRNA sequence
aggcttacaatttgtaaaac

SEQ ID NO: 778986 - DNA, 20 bp, Artificial
  CRISPR gRNA sequence
ggcttacaatttgtaaaacc

SEQ ID NO: 778987 - DNA, 20 bp, Artificial
  CRISPR gRNA sequence
tgtaaaaccaggattaaacc

SEQ ID NO: 778988 - DNA, 20 bp, Artificial
  CRISPR gRNA sequence
aacccagatgtgtctgattt

SEQ ID NO: 778989 - DNA, 20 bp, Artificial
  CRISPR gRNA sequence
cccagatgtgtctgatttta

SEQ ID NO: 778990 - DNA, 20 bp, Artificial
  CRISPR gRNA sequence
tgtgtctgattttagagcct

SEQ ID NO: 778991 - DNA, 20 bp, Artificial
  CRISPR gRNA sequence
tgcataaaccatattttccc

SEQ ID NO: 778992 - DNA, 20 bp, Artificial
  CRISPR gRNA sequence
cataaaccatattttcccca

SEQ ID NO: 778993 - DNA, 20 bp, Artificial
  CRISPR gRNA sequence
ataaaccatattttccccag

SEQ ID NO: 778994 - DNA, 20 bp, Artificial
  CRISPR gRNA sequence
aaaccatattttccccagag

SEQ ID NO: 778995 - DNA, 20 bp, Artificial
  CRISPR gRNA sequence
aaccatattttccccagagg

SEQ ID NO: 778996 - DNA, 20 bp, Artificial
  CRISPR gRNA sequence
tattttccccagaggaggat

SEQ ID NO: 778997 - DNA, 20 bp, Artificial
  CRISPR gRNA sequence
tttccccagaggaggattag

SEQ ID NO: 778998 - DNA, 20 bp, Artificial
  CRISPR gRNA sequence
ttccccagaggaggattagt

SEQ ID NO: 778999 - DNA, 20 bp, Artificial
  CRISPR gRNA sequence
ccagaggaggattagtagga

SEQ ID NO: 779000 - DNA, 20 bp, Artificial
  CRISPR gRNA sequence
cagaggaggattagtaggaa

SEQ ID NO: 779001 - DNA, 20 bp, Artificial
  CRISPR gRNA sequence
aggaggattagtaggaaagg

SEQ ID NO: 779002 - DNA, 20 bp, Artificial
  CRISPR gRNA sequence
ttagtaggaaaggaagctgc

SEQ ID NO: 779003 - DNA, 20 bp, Artificial
  CRISPR gRNA sequence
taggaaaggaagctgctggt

SEQ ID NO: 779004 - DNA, 20 bp, Artificial
  CRISPR gRNA sequence
aaaggaagctgctggttgga

SEQ ID NO: 779005 - DNA, 20 bp, Artificial
  CRISPR gRNA sequence
ctggttggaaagtatcttta

SEQ ID NO: 779006 - DNA, 20 bp, Artificial
  CRISPR gRNA sequence
gttggaaagtatctttatag

SEQ ID NO: 779007 - DNA, 20 bp, Artificial
  CRISPR gRNA sequence
ttatagcagtgtctgttcct

SEQ ID NO: 779008 - DNA, 20 bp, Artificial
  CRISPR gRNA sequence
gtctgttcctcggtttgctc

SEQ ID NO: 779009 - DNA, 20 bp, Artificial
  CRISPR gRNA sequence
tctgttcctcggtttgctca

SEQ ID NO: 779010 - DNA, 20 bp, Artificial
  CRISPR gRNA sequence
ctgttcctcggtttgctcaa

SEQ ID NO: 779011 - DNA, 20 bp, Artificial
  CRISPR gRNA sequence
tgttcctcggtttgctcaag

SEQ ID NO: 779012 - DNA, 20 bp, Artificial
  CRISPR gRNA sequence
cctcggtttgctcaagggga

SEQ ID NO: 779013 - DNA, 20 bp, Artificial
  CRISPR gRNA sequence
tgctcaaggggacagtgtgc

SEQ ID NO: 779014 - DNA, 20 bp, Artificial
  CRISPR gRNA sequence
gctcaaggggacagtgtgcc

SEQ ID NO: 779015 - DNA, 20 bp, Artificial
  CRISPR gRNA sequence
aaggggacagtgtgccagga

SEQ ID NO: 779016 - DNA, 20 bp, Artificial
  CRISPR gRNA sequence
gtgtgccaggaaagtccccg

SEQ ID NO: 779017 - DNA, 20 bp, Artificial
  CRISPR gRNA sequence
tgccaggaaagtccccgtgg

SEQ ID NO: 779018 - DNA, 20 bp, Artificial
  CRISPR gRNA sequence
gccaggaaagtccccgtgga

SEQ ID NO: 779019 - DNA, 20 bp, Artificial
  CRISPR gRNA sequence
ccaggaaagtccccgtggaa

SEQ ID NO: 779020 - DNA, 20 bp, Artificial
  CRISPR gRNA sequence
gaaagtccccgtggaagggc

SEQ ID NO: 779021 - DNA, 20 bp, Artificial
  CRISPR gRNA sequence
aaagtccccgtggaagggca

SEQ ID NO: 779022 - DNA, 20 bp, Artificial
  CRISPR gRNA sequence
gtccccgtggaagggcaagg

SEQ ID NO: 779023 - DNA, 20 bp, Artificial
  CRISPR gRNA sequence
cccgtggaagggcaaggaag

SEQ ID NO: 779024 - DNA, 20 bp, Artificial
  CRISPR gRNA sequence
ccgtggaagggcaaggaaga

SEQ ID NO: 779025 - DNA, 20 bp, Artificial
  CRISPR gRNA sequence
cgtggaagggcaaggaagaa

SEQ ID NO: 779026 - DNA, 20 bp, Artificial
  CRISPR gRNA sequence
gtggaagggcaaggaagaag

SEQ ID NO: 779027 - DNA, 20 bp, Artificial
  CRISPR gRNA sequence
gaagggcaaggaagaagggg

SEQ ID NO: 779028 - DNA, 20 bp, Artificial
  CRISPR gRNA sequence
caaggaagaaggggaagtta

SEQ ID NO: 779029 - DNA, 20 bp, Artificial
  CRISPR gRNA sequence
gaagaaggggaagttaaagc

SEQ ID NO: 779030 - DNA, 20 bp, Artificial
  CRISPR gRNA sequence
gaaggggaagttaaagccag

SEQ ID NO: 779031 - DNA, 20 bp, Artificial
  CRISPR gRNA sequence
ggggaagttaaagccagtgg

SEQ ID NO: 779032 - DNA, 20 bp, Artificial
  CRISPR gRNA sequence
gggaagttaaagccagtggc

SEQ ID NO: 779033 - DNA, 20 bp, Artificial
  CRISPR gRNA sequence
aagccagtggcaggtgatcc

SEQ ID NO: 779034 - DNA, 20 bp, Artificial
  CRISPR gRNA sequence
ccaagaatcttttctgttgc

SEQ ID NO: 779035 - DNA, 20 bp, Artificial
  CRISPR gRNA sequence
aagaatcttttctgttgcta

SEQ ID NO: 779036 - DNA, 20 bp, Artificial
  CRISPR gRNA sequence
tcctttcatgctctaaaaat

SEQ ID NO: 779037 - DNA, 20 bp, Artificial
  CRISPR gRNA sequence
ctttcatgctctaaaaataa

SEQ ID NO: 779038 - DNA, 20 bp, Artificial
  CRISPR gRNA sequence
tgctctaaaaataagagtgc

SEQ ID NO: 779039 - DNA, 20 bp, Artificial
  CRISPR gRNA sequence
ctaaaaataagagtgctggc

SEQ ID NO: 779040 - DNA, 20 bp, Artificial
  CRISPR gRNA sequence
ataagagtgctggcaagtgc

SEQ ID NO: 779041 - DNA, 20 bp, Artificial
  CRISPR gRNA sequence
taagagtgctggcaagtgcc

SEQ ID NO: 779042 - DNA, 20 bp, Artificial
  CRISPR gRNA sequence
ctggcaagtgccaggcctgt

SEQ ID NO: 779043 - DNA, 20 bp, Artificial
  CRISPR gRNA sequence
aagtgccaggcctgttggtg

SEQ ID NO: 779044 - DNA, 20 bp, Artificial
  CRISPR gRNA sequence
caggcctgttggtgcagctt

SEQ ID NO: 779045 - DNA, 20 bp, Artificial
  CRISPR gRNA sequence
gcttaagatgatacctttct

SEQ ID NO: 779046 - DNA, 20 bp, Artificial
  CRISPR gRNA sequence
ggatatatatgcatctgaat

SEQ ID NO: 779047 - DNA, 20 bp, Artificial
  CRISPR gRNA sequence
gatatatatgcatctgaata

SEQ ID NO: 779048 - DNA, 20 bp, Artificial
  CRISPR gRNA sequence
atatatgcatctgaataagg

SEQ ID NO: 779049 - DNA, 20 bp, Artificial
  CRISPR gRNA sequence
tatatgcatctgaataagga

SEQ ID NO: 779050 - DNA, 20 bp, Artificial
  CRISPR gRNA sequence
gaataaggaaggctatcttc

SEQ ID NO: 779051 - DNA, 20 bp, Artificial
  CRISPR gRNA sequence
aggaaggctatcttctggtc

SEQ ID NO: 779052 - DNA, 20 bp, Artificial
  CRISPR gRNA sequence
ggctatcttctggtcaagct

SEQ ID NO: 779053 - DNA, 20 bp, Artificial
  CRISPR gRNA sequence
gctatcttctggtcaagcta

SEQ ID NO: 779054 - DNA, 20 bp, Artificial
  CRISPR gRNA sequence
gtcaagctaaggtatgccat

SEQ ID NO: 779055 - DNA, 20 bp, Artificial
  CRISPR gRNA sequence
atgccatgagcatttccctg

SEQ ID NO: 779056 - DNA, 20 bp, Artificial
  CRISPR gRNA sequence
catgagcatttccctgtgga

SEQ ID NO: 779057 - DNA, 20 bp, Artificial
  CRISPR gRNA sequence
aaagcacttaattctgttcc

SEQ ID NO: 779058 - DNA, 20 bp, Artificial
  CRISPR gRNA sequence
tcccagttgttacctgctgt

SEQ ID NO: 779059 - DNA, 20 bp, Artificial
  CRISPR gRNA sequence
tccctttctaaaataaaaac

SEQ ID NO: 779060 - DNA, 20 bp, Artificial
  CRISPR gRNA sequence
ctaaaataaaaacaagaata

SEQ ID NO: 779061 - DNA, 20 bp, Artificial
  CRISPR gRNA sequence
aaacaagaatacagctcact

SEQ ID NO: 779062 - DNA, 20 bp, Artificial
  CRISPR gRNA sequence
aacaagaatacagctcactg

SEQ ID NO: 779063 - DNA, 20 bp, Artificial
  CRISPR gRNA sequence
gaggaccttacatttccctc

SEQ ID NO: 779064 - DNA, 20 bp, Artificial
  CRISPR gRNA sequence
catttctcttctccttttta

SEQ ID NO: 779065 - DNA, 20 bp, Artificial
  CRISPR gRNA sequence
ctttttatagcactcttctt

SEQ ID NO: 779066 - DNA, 20 bp, Artificial
  CRISPR gRNA sequence
ttttatagcactcttcttga

SEQ ID NO: 779067 - DNA, 20 bp, Artificial
  CRISPR gRNA sequence
ttatagcactcttcttgaga

SEQ ID NO: 779068 - DNA, 20 bp, Artificial
  CRISPR gRNA sequence
attctcttttgaacctattc

SEQ ID NO: 779069 - DNA, 20 bp, Artificial
  CRISPR gRNA sequence
ctcactgatactgtgcttgt

SEQ ID NO: 779070 - DNA, 20 bp, Artificial
  CRISPR gRNA sequence
tcactgatactgtgcttgtc

SEQ ID NO: 779071 - DNA, 20 bp, Artificial
  CRISPR gRNA sequence
tactgctaaatgcaactctc

SEQ ID NO: 779072 - DNA, 20 bp, Artificial
  CRISPR gRNA sequence
ctgctaaatgcaactctcaa

SEQ ID NO: 779073 - DNA, 20 bp, Artificial
  CRISPR gRNA sequence
atgcaactctcaagagtatt

SEQ ID NO: 779074 - DNA, 20 bp, Artificial
  CRISPR gRNA sequence
ctctactgatcactcctttg

SEQ ID NO: 779075 - DNA, 20 bp, Artificial
  CRISPR gRNA sequence
tagcactgtgttttaaaata

SEQ ID NO: 779076 - DNA, 20 bp, Artificial
  CRISPR gRNA sequence
agcactgtgttttaaaatat

SEQ ID NO: 779077 - DNA, 20 bp, Artificial
  CRISPR gRNA sequence
atataggttttattattatt

SEQ ID NO: 779078 - DNA, 20 bp, Artificial
  CRISPR gRNA sequence
tataggttttattattattt

SEQ ID NO: 779079 - DNA, 20 bp, Artificial
  CRISPR gRNA sequence
gttttattattatttaggta

SEQ ID NO: 779080 - DNA, 20 bp, Artificial
  CRISPR gRNA sequence
tattattatttaggtatggt

SEQ ID NO: 779081 - DNA, 20 bp, Artificial
  CRISPR gRNA sequence
attattatttaggtatggtg

SEQ ID NO: 779082 - DNA, 20 bp, Artificial
  CRISPR gRNA sequence
gtatggtgaggccaatatat

SEQ ID NO: 779083 - DNA, 20 bp, Artificial
  CRISPR gRNA sequence
tatggtgaggccaatatatc

SEQ ID NO: 779084 - DNA, 20 bp, Artificial
  CRISPR gRNA sequence
gaaatgactgtcgttgaaaa

SEQ ID NO: 779085 - DNA, 20 bp, Artificial
  CRISPR gRNA sequence
aaaaaagtatgttgtactca

SEQ ID NO: 779086 - DNA, 20 bp, Artificial
  CRISPR gRNA sequence
atgttgtactcacagatccc

SEQ ID NO: 779087 - DNA, 20 bp, Artificial
  CRISPR gRNA sequence
gttgtactcacagatcccaa

SEQ ID NO: 779088 - DNA, 20 bp, Artificial
  CRISPR gRNA sequence
gtactcacagatcccaagag

SEQ ID NO: 779089 - DNA, 20 bp, Artificial
  CRISPR gRNA sequence
tactcacagatcccaagaga

SEQ ID NO: 779090 - DNA, 20 bp, Artificial
  CRISPR gRNA sequence
actcacagatcccaagagaa

SEQ ID NO: 779091 - DNA, 20 bp, Artificial
  CRISPR gRNA sequence
ctcacagatcccaagagaag

SEQ ID NO: 779092 - DNA, 20 bp, Artificial
  CRISPR gRNA sequence
tcacagatcccaagagaagg

SEQ ID NO: 779093 - DNA, 20 bp, Artificial
  CRISPR gRNA sequence
cacagatcccaagagaaggg

SEQ ID NO: 779094 - DNA, 20 bp, Artificial
  CRISPR gRNA sequence
ggggggcacaccatgccaca

SEQ ID NO: 779095 - DNA, 20 bp, Artificial
  CRISPR gRNA sequence
gggggcacaccatgccacaa

SEQ ID NO: 779096 - DNA, 20 bp, Artificial
  CRISPR gRNA sequence
ggggcacaccatgccacaaa

SEQ ID NO: 779097 - DNA, 20 bp, Artificial
  CRISPR gRNA sequence
ccatgccacaaagggccaca

SEQ ID NO: 779098 - DNA, 20 bp, Artificial
  CRISPR gRNA sequence
catgccacaaagggccacat

SEQ ID NO: 779099 - DNA, 20 bp, Artificial
  CRISPR gRNA sequence
atgccacaaagggccacatg

SEQ ID NO: 779100 - DNA, 20 bp, Artificial
  CRISPR gRNA sequence
ccacaaagggccacatgggg

SEQ ID NO: 779101 - DNA, 20 bp, Artificial
  CRISPR gRNA sequence
agggccacatggggaagcac

SEQ ID NO: 779102 - DNA, 20 bp, Artificial
  CRISPR gRNA sequence
gggccacatggggaagcacc

SEQ ID NO: 779103 - DNA, 20 bp, Artificial
  CRISPR gRNA sequence
ggccacatggggaagcacca

SEQ ID NO: 779104 - DNA, 20 bp, Artificial
  CRISPR gRNA sequence
acatggggaagcaccagggt

SEQ ID NO: 779105 - DNA, 20 bp, Artificial
  CRISPR gRNA sequence
ggggaagcaccagggtcagc

SEQ ID NO: 779106 - DNA, 20 bp, Artificial
  CRISPR gRNA sequence
gggaagcaccagggtcagcc

SEQ ID NO: 779107 - DNA, 20 bp, Artificial
  CRISPR gRNA sequence
gaagcaccagggtcagccag

SEQ ID NO: 779108 - DNA, 20 bp, Artificial
  CRISPR gRNA sequence
aagcaccagggtcagccagg

SEQ ID NO: 779109 - DNA, 20 bp, Artificial
  CRISPR gRNA sequence
caccagggtcagccaggagg

SEQ ID NO: 779110 - DNA, 20 bp, Artificial
  CRISPR gRNA sequence
accagggtcagccaggaggt

SEQ ID NO: 779111 - DNA, 20 bp, Artificial
  CRISPR gRNA sequence
agggtcagccaggaggtggg

SEQ ID NO: 779112 - DNA, 20 bp, Artificial
  CRISPR gRNA sequence
gggtcagccaggaggtgggt

SEQ ID NO: 779113 - DNA, 20 bp, Artificial
  CRISPR gRNA sequence
ggtcagccaggaggtgggtg

SEQ ID NO: 779114 - DNA, 20 bp, Artificial
  CRISPR gRNA sequence
gtcagccaggaggtgggtgg

SEQ ID NO: 779115 - DNA, 20 bp, Artificial
  CRISPR gRNA sequence
tcagccaggaggtgggtggg

SEQ ID NO: 779116 - DNA, 20 bp, Artificial
  CRISPR gRNA sequence
gaggtgggtggggggtgcgc

SEQ ID NO: 779117 - DNA, 20 bp, Artificial
  CRISPR gRNA sequence
ggtgcgcaagatctttattg

SEQ ID NO: 779118 - DNA, 20 bp, Artificial
  CRISPR gRNA sequence
gatctttattgtggtttcaa

SEQ ID NO: 779119 - DNA, 20 bp, Artificial
  CRISPR gRNA sequence
atctttattgtggtttcaac

SEQ ID NO: 779120 - DNA, 20 bp, Artificial
  CRISPR gRNA sequence
tttattgtggtttcaacagg

SEQ ID NO: 779121 - DNA, 20 bp, Artificial
  CRISPR gRNA sequence
gtggtttcaacaggaagaaa

SEQ ID NO: 779122 - DNA, 20 bp, Artificial
  CRISPR gRNA sequence
tggtttcaacaggaagaaat

SEQ ID NO: 779123 - DNA, 20 bp, Artificial
  CRISPR gRNA sequence
tcaacaggaagaaatgggtg

SEQ ID NO: 779124 - DNA, 20 bp, Artificial
  CRISPR gRNA sequence
acaggaagaaatgggtgaag

SEQ ID NO: 779125 - DNA, 20 bp, Artificial
  CRISPR gRNA sequence
caggaagaaatgggtgaagc

SEQ ID NO: 779126 - DNA, 20 bp, Artificial
  CRISPR gRNA sequence
aggaagaaatgggtgaagca

SEQ ID NO: 779127 - DNA, 20 bp, Artificial
  CRISPR gRNA sequence
agaaatgggtgaagcagggt

SEQ ID NO: 779128 - DNA, 20 bp, Artificial
  CRISPR gRNA sequence
aatgggtgaagcagggtgag

SEQ ID NO: 779129 - DNA, 20 bp, Artificial
  CRISPR gRNA sequence
tgaagcagggtgagtggatt

SEQ ID NO: 779130 - DNA, 20 bp, Artificial
  CRISPR gRNA sequence
gaagcagggtgagtggattt

SEQ ID NO: 779131 - DNA, 20 bp, Artificial
  CRISPR gRNA sequence
agggtgagtggatttaggat

SEQ ID NO: 779132 - DNA, 20 bp, Artificial
  CRISPR gRNA sequence
ttagctgatataaataattt

SEQ ID NO: 779133 - DNA, 20 bp, Artificial
  CRISPR gRNA sequence
gctgatataaataatttcag

SEQ ID NO: 779134 - DNA, 20 bp, Artificial
  CRISPR gRNA sequence
ctgatataaataatttcagc

SEQ ID NO: 779135 - DNA, 20 bp, Artificial
  CRISPR gRNA sequence
taaataatttcagcaggctc

SEQ ID NO: 779136 - DNA, 20 bp, Artificial
  CRISPR gRNA sequence
aaataatttcagcaggctct

SEQ ID NO: 779137 - DNA, 20 bp, Artificial
  CRISPR gRNA sequence
aataatttcagcaggctctg

SEQ ID NO: 779138 - DNA, 20 bp, Artificial
  CRISPR gRNA sequence
tttcagcaggctctggggca

SEQ ID NO: 779139 - DNA, 20 bp, Artificial
  CRISPR gRNA sequence
ttcagcaggctctggggcat

SEQ ID NO: 779140 - DNA, 20 bp, Artificial
  CRISPR gRNA sequence
tcagcaggctctggggcata

SEQ ID NO: 779141 - DNA, 20 bp, Artificial
  CRISPR gRNA sequence
cagcaggctctggggcatag

SEQ ID NO: 779142 - DNA, 20 bp, Artificial
  CRISPR gRNA sequence
tggggcataggggctgtccc

SEQ ID NO: 779143 - DNA, 20 bp, Artificial
  CRISPR gRNA sequence
aggggctgtccctagtcttc

SEQ ID NO: 779144 - DNA, 20 bp, Artificial
  CRISPR gRNA sequence
gtccctagtcttctggtact

SEQ ID NO: 779145 - DNA, 20 bp, Artificial
  CRISPR gRNA sequence
agtcttctggtacttggccc

SEQ ID NO: 779146 - DNA, 20 bp, Artificial
  CRISPR gRNA sequence
gtcttctggtacttggccct

SEQ ID NO: 779147 - DNA, 20 bp, Artificial
  CRISPR gRNA sequence
tcttctggtacttggccctg

SEQ ID NO: 779148 - DNA, 20 bp, Artificial
  CRISPR gRNA sequence
tacttggccctggggtgatt

SEQ ID NO: 779149 - DNA, 20 bp, Artificial
  CRISPR gRNA sequence
acttggccctggggtgatta

SEQ ID NO: 779150 - DNA, 20 bp, Artificial
  CRISPR gRNA sequence
tggccctggggtgattaagg

SEQ ID NO: 779151 - DNA, 20 bp, Artificial
  CRISPR gRNA sequence
gggtgattaaggcagttgca

SEQ ID NO: 779152 - DNA, 20 bp, Artificial
  CRISPR gRNA sequence
ttaaggcagttgcatagtgt

SEQ ID NO: 779153 - DNA, 20 bp, Artificial
  CRISPR gRNA sequence
taaggcagttgcatagtgtt

SEQ ID NO: 779154 - DNA, 20 bp, Artificial
  CRISPR gRNA sequence
gcatagtgttgggaatgtga

SEQ ID NO: 779155 - DNA, 20 bp, Artificial
  CRISPR gRNA sequence
tgtgaaagcccccaataaat

SEQ ID NO: 779156 - DNA, 20 bp, Artificial
  CRISPR gRNA sequence
gtgaaagcccccaataaatg

SEQ ID NO: 779157 - DNA, 20 bp, Artificial
  CRISPR gRNA sequence
aaagcccccaataaatgagg

SEQ ID NO: 779158 - DNA, 20 bp, Artificial
  CRISPR gRNA sequence
cccaataaatgaggcagttg

SEQ ID NO: 779159 - DNA, 20 bp, Artificial
  CRISPR gRNA sequence
ccaataaatgaggcagttgt

SEQ ID NO: 779160 - DNA, 20 bp, Artificial
  CRISPR gRNA sequence
aaatgaggcagttgtgggta

SEQ ID NO: 779161 - DNA, 20 bp, Artificial
  CRISPR gRNA sequence
aatgaggcagttgtgggtat

SEQ ID NO: 779162 - DNA, 20 bp, Artificial
  CRISPR gRNA sequence
tgtgggtatgggctctgaaa

SEQ ID NO: 779163 - DNA, 20 bp, Artificial
  CRISPR gRNA sequence
gtgggtatgggctctgaaat

SEQ ID NO: 779164 - DNA, 20 bp, Artificial
  CRISPR gRNA sequence
gtatgggctctgaaatgggt

SEQ ID NO: 779165 - DNA, 20 bp, Artificial
  CRISPR gRNA sequence
atgggttggtttgcatttga

SEQ ID NO: 779166 - DNA, 20 bp, Artificial
  CRISPR gRNA sequence
tgggttggtttgcatttgaa

SEQ ID NO: 779167 - DNA, 20 bp, Artificial
  CRISPR gRNA sequence
gcatttgaaaggtgtgctca

SEQ ID NO: 779168 - DNA, 20 bp, Artificial
  CRISPR gRNA sequence
catttgaaaggtgtgctcat

SEQ ID NO: 779169 - DNA, 20 bp, Artificial
  CRISPR gRNA sequence
tgaaaggtgtgctcatgggc

SEQ ID NO: 779170 - DNA, 20 bp, Artificial
  CRISPR gRNA sequence
aaggtgtgctcatgggcaag

SEQ ID NO: 779171 - DNA, 20 bp, Artificial
  CRISPR gRNA sequence
gcaagtggtttactctctct

SEQ ID NO: 779172 - DNA, 20 bp, Artificial
  CRISPR gRNA sequence
aagtggtttactctctctta

SEQ ID NO: 779173 - DNA, 20 bp, Artificial
  CRISPR gRNA sequence
agtggtttactctctcttag

SEQ ID NO: 779174 - DNA, 20 bp, Artificial
  CRISPR gRNA sequence
gtttactctctcttagaggt

SEQ ID NO: 779175 - DNA, 20 bp, Artificial
  CRISPR gRNA sequence
tctctcttagaggttagaat

SEQ ID NO: 779176 - DNA, 20 bp, Artificial
  CRISPR gRNA sequence
aggttagaattggctaaccc

SEQ ID NO: 779177 - DNA, 20 bp, Artificial
  CRISPR gRNA sequence
ggttagaattggctaaccct

SEQ ID NO: 779178 - DNA, 20 bp, Artificial
  CRISPR gRNA sequence
ttagaattggctaaccctgg

SEQ ID NO: 779179 - DNA, 20 bp, Artificial
  CRISPR gRNA sequence
gaattggctaaccctgggag

SEQ ID NO: 779180 - DNA, 20 bp, Artificial
  CRISPR gRNA sequence
ttggctaaccctgggagcgg

SEQ ID NO: 779181 - DNA, 20 bp, Artificial
  CRISPR gRNA sequence
cctgggagcggcagtccctt

SEQ ID NO: 779182 - DNA, 20 bp, Artificial
  CRISPR gRNA sequence
ctgggagcggcagtcccttc

SEQ ID NO: 779183 - DNA, 20 bp, Artificial
  CRISPR gRNA sequence
tgggagcggcagtcccttca

SEQ ID NO: 779184 - DNA, 20 bp, Artificial
  CRISPR gRNA sequence
agcggcagtcccttcagggt

SEQ ID NO: 779185 - DNA, 20 bp, Artificial
  CRISPR gRNA sequence
gcagtcccttcagggtcagc

SEQ ID NO: 779186 - DNA, 20 bp, Artificial
  CRISPR gRNA sequence
cagtcccttcagggtcagca

SEQ ID NO: 779187 - DNA, 20 bp, Artificial
  CRISPR gRNA sequence
cttcagggtcagcaaggccc

SEQ ID NO: 779188 - DNA, 20 bp, Artificial
  CRISPR gRNA sequence
ttcagggtcagcaaggcccc

SEQ ID NO: 779189 - DNA, 20 bp, Artificial
  CRISPR gRNA sequence
cagcaaggccccaggtgtca

SEQ ID NO: 779190 - DNA, 20 bp, Artificial
  CRISPR gRNA sequence
ggccccaggtgtcaaagcat

SEQ ID NO: 779191 - DNA, 20 bp, Artificial
  CRISPR gRNA sequence
ggtgtcaaagcatcagaata

SEQ ID NO: 779192 - DNA, 20 bp, Artificial
  CRISPR gRNA sequence
aatacagaaaataaaatgca

SEQ ID NO: 779193 - DNA, 20 bp, Artificial
  CRISPR gRNA sequence
ttcctttcaatcttctctgc

SEQ ID NO: 779194 - DNA, 20 bp, Artificial
  CRISPR gRNA sequence
gctggtgaccgctcttcaca

SEQ ID NO: 779195 - DNA, 20 bp, Artificial
  CRISPR gRNA sequence
tcacaaagatctataaatgt

SEQ ID NO: 779196 - DNA, 20 bp, Artificial
  CRISPR gRNA sequence
tgttggaataccccatgtct

SEQ ID NO: 779197 - DNA, 20 bp, Artificial
  CRISPR gRNA sequence
ataccccatgtctcagtcct

SEQ ID NO: 779198 - DNA, 20 bp, Artificial
  CRISPR gRNA sequence
taccccatgtctcagtcctt

SEQ ID NO: 779199 - DNA, 20 bp, Artificial
  CRISPR gRNA sequence
ctctctttcctatctctctg

SEQ ID NO: 779200 - DNA, 20 bp, Artificial
  CRISPR gRNA sequence
tctctttcctatctctctgt

SEQ ID NO: 779201 - DNA, 20 bp, Artificial
  CRISPR gRNA sequence
tctctgtaggtgatgtaatg

SEQ ID NO: 779202 - DNA, 20 bp, Artificial
  CRISPR gRNA sequence
gcctactaaacacctccact

SEQ ID NO: 779203 - DNA, 20 bp, Artificial
  CRISPR gRNA sequence
acctccacttggctatctaa

SEQ ID NO: 779204 - DNA, 20 bp, Artificial
  CRISPR gRNA sequence
cctccacttggctatctaat

SEQ ID NO: 779205 - DNA, 20 bp, Artificial
  CRISPR gRNA sequence
tccttaatttgcttctcccc

SEQ ID NO: 779206 - DNA, 20 bp, Artificial
  CRISPR gRNA sequence
gccttctccattttaataaa

SEQ ID NO: 779207 - DNA, 20 bp, Artificial
  CRISPR gRNA sequence
aaacagcatctccattgcct

SEQ ID NO: 779208 - DNA, 20 bp, Artificial
  CRISPR gRNA sequence
ctccattgccttagtgactc

SEQ ID NO: 779209 - DNA, 20 bp, Artificial
  CRISPR gRNA sequence
agtgactcaagccccaaact

SEQ ID NO: 779210 - DNA, 20 bp, Artificial
  CRISPR gRNA sequence
gtgactcaagccccaaactt

SEQ ID NO: 779211 - DNA, 20 bp, Artificial
  CRISPR gRNA sequence
cccaaacttaggaattttcc

SEQ ID NO: 779212 - DNA, 20 bp, Artificial
  CRISPR gRNA sequence
tttttctcaaactatatatc

SEQ ID NO: 779213 - DNA, 20 bp, Artificial
  CRISPR gRNA sequence
aaactatatatctagcctgt

SEQ ID NO: 779214 - DNA, 20 bp, Artificial
  CRISPR gRNA sequence
ctatatatctagcctgtcag

SEQ ID NO: 779215 - DNA, 20 bp, Artificial
  CRISPR gRNA sequence
agcctgtcagcagttccctt

SEQ ID NO: 779216 - DNA, 20 bp, Artificial
  CRISPR gRNA sequence
gcctgtcagcagttcccttc

SEQ ID NO: 779217 - DNA, 20 bp, Artificial
  CRISPR gRNA sequence
tcaggtcttttttcaaacta

SEQ ID NO: 779218 - DNA, 20 bp, Artificial
  CRISPR gRNA sequence
ggtcttttttcaaactatag

SEQ ID NO: 779219 - DNA, 20 bp, Artificial
  CRISPR gRNA sequence
gtcttttttcaaactataga

SEQ ID NO: 779220 - DNA, 20 bp, Artificial
  CRISPR gRNA sequence
aactatagaaggcctaaaca

SEQ ID NO: 779221 - DNA, 20 bp, Artificial
  CRISPR gRNA sequence
actatagaaggcctaaacaa

SEQ ID NO: 779222 - DNA, 20 bp, Artificial
  CRISPR gRNA sequence
tagaaggcctaaacaaagga

SEQ ID NO: 779223 - DNA, 20 bp, Artificial
  CRISPR gRNA sequence
gacatgctgtattcatgaat

SEQ ID NO: 779224 - DNA, 20 bp, Artificial
  CRISPR gRNA sequence
atgctgtattcatgaattgg

SEQ ID NO: 779225 - DNA, 20 bp, Artificial
  CRISPR gRNA sequence
ttggaagactaaatattatt

SEQ ID NO: 779226 - DNA, 20 bp, Artificial
  CRISPR gRNA sequence
aagactaaatattattcagc

SEQ ID NO: 779227 - DNA, 20 bp, Artificial
  CRISPR gRNA sequence
gtattccccaaattgatcta

SEQ ID NO: 779228 - DNA, 20 bp, Artificial
  CRISPR gRNA sequence
tgcaatccctaccaaaattc

SEQ ID NO: 779229 - DNA, 20 bp, Artificial
  CRISPR gRNA sequence
attccagcttcctttgtctg

SEQ ID NO: 779230 - DNA, 20 bp, Artificial
  CRISPR gRNA sequence
cttcctttgtctgcagaaat

SEQ ID NO: 779231 - DNA, 20 bp, Artificial
  CRISPR gRNA sequence
ctttgtctgcagaaatgagc

SEQ ID NO: 779232 - DNA, 20 bp, Artificial
  CRISPR gRNA sequence
taaaattcatttgaaaatgt

SEQ ID NO: 779233 - DNA, 20 bp, Artificial
  CRISPR gRNA sequence
aaaattcatttgaaaatgta

SEQ ID NO: 779234 - DNA, 20 bp, Artificial
  CRISPR gRNA sequence
attcatttgaaaatgtaagg

SEQ ID NO: 779235 - DNA, 20 bp, Artificial
  CRISPR gRNA sequence
aaaatgtaaggaagcccgaa

SEQ ID NO: 779236 - DNA, 20 bp, Artificial
  CRISPR gRNA sequence
cctaaaaaaaaatcttgaaa

SEQ ID NO: 779237 - DNA, 20 bp, Artificial
  CRISPR gRNA sequence
aatcttgaaaaagactaaca

SEQ ID NO: 779238 - DNA, 20 bp, Artificial
  CRISPR gRNA sequence
ttgaaaaagactaacaaagt

SEQ ID NO: 779239 - DNA, 20 bp, Artificial
  CRISPR gRNA sequence
gaaaaagactaacaaagttg

SEQ ID NO: 779240 - DNA, 20 bp, Artificial
  CRISPR gRNA sequence
aaaaagactaacaaagttgg

SEQ ID NO: 779241 - DNA, 20 bp, Artificial
  CRISPR gRNA sequence
gttggaggactcacactttc

SEQ ID NO: 779242 - DNA, 20 bp, Artificial
  CRISPR gRNA sequence
cagtttcaaaacttactaca

SEQ ID NO: 779243 - DNA, 20 bp, Artificial
  CRISPR gRNA sequence
caaaacttactacaaagcta

SEQ ID NO: 779244 - DNA, 20 bp, Artificial
  CRISPR gRNA sequence
ctacagtaatcaacgctgtg

SEQ ID NO: 779245 - DNA, 20 bp, Artificial
  CRISPR gRNA sequence
aacgctgtgtggtactgaca

SEQ ID NO: 779246 - DNA, 20 bp, Artificial
  CRISPR gRNA sequence
acgctgtgtggtactgacat

SEQ ID NO: 779247 - DNA, 20 bp, Artificial
  CRISPR gRNA sequence
tgtgtggtactgacatagga

SEQ ID NO: 779248 - DNA, 20 bp, Artificial
  CRISPR gRNA sequence
actgacataggatagacata

SEQ ID NO: 779249 - DNA, 20 bp, Artificial
  CRISPR gRNA sequence
agacatatagttcaataaaa

SEQ ID NO: 779250 - DNA, 20 bp, Artificial
  CRISPR gRNA sequence
tagttcaataaaacagaatc

SEQ ID NO: 779251 - DNA, 20 bp, Artificial
  CRISPR gRNA sequence
gttcaataaaacagaatcga

SEQ ID NO: 779252 - DNA, 20 bp, Artificial
  CRISPR gRNA sequence
ataaaacagaatcgagagtc

SEQ ID NO: 779253 - DNA, 20 bp, Artificial
  CRISPR gRNA sequence
atgatcaattgatgttttgc

SEQ ID NO: 779254 - DNA, 20 bp, Artificial
  CRISPR gRNA sequence
tgatcaattgatgttttgca

SEQ ID NO: 779255 - DNA, 20 bp, Artificial
  CRISPR gRNA sequence
gatcaattgatgttttgcaa

SEQ ID NO: 779256 - DNA, 20 bp, Artificial
  CRISPR gRNA sequence
tgatgttttgcaagggtgcc

SEQ ID NO: 779257 - DNA, 20 bp, Artificial
  CRISPR gRNA sequence
gttttgcaagggtgccaaga

SEQ ID NO: 779258 - DNA, 20 bp, Artificial
  CRISPR gRNA sequence
agggtgccaagacagttcaa

SEQ ID NO: 779259 - DNA, 20 bp, Artificial
  CRISPR gRNA sequence
gggtgccaagacagttcaat

SEQ ID NO: 779260 - DNA, 20 bp, Artificial
  CRISPR gRNA sequence
ggtgccaagacagttcaata

SEQ ID NO: 779261 - DNA, 20 bp, Artificial
  CRISPR gRNA sequence
ccaagacagttcaataggga

SEQ ID NO: 779262 - DNA, 20 bp, Artificial
  CRISPR gRNA sequence
aatttcctcaacaaattgta

SEQ ID NO: 779263 - DNA, 20 bp, Artificial
  CRISPR gRNA sequence
atttcctcaacaaattgtac

SEQ ID NO: 779264 - DNA, 20 bp, Artificial
  CRISPR gRNA sequence
cacaactgaatgcccacaat

SEQ ID NO: 779265 - DNA, 20 bp, Artificial
  CRISPR gRNA sequence
aactgaatgcccacaatcag

SEQ ID NO: 779266 - DNA, 20 bp, Artificial
  CRISPR gRNA sequence
cacaatcagtagaacaaatt

SEQ ID NO: 779267 - DNA, 20 bp, Artificial
  CRISPR gRNA sequence
gtagaacaaatttggaacta

SEQ ID NO: 779268 - DNA, 20 bp, Artificial
  CRISPR gRNA sequence
ggaactaaagttcttatatt

SEQ ID NO: 779269 - DNA, 20 bp, Artificial
  CRISPR gRNA sequence
gaactaaagttcttatattt

SEQ ID NO: 779270 - DNA, 20 bp, Artificial
  CRISPR gRNA sequence
ttttgtttaatttttgtata

SEQ ID NO: 779271 - DNA, 20 bp, Artificial
  CRISPR gRNA sequence
ttaatttttgtatatggtat

SEQ ID NO: 779272 - DNA, 20 bp, Artificial
  CRISPR gRNA sequence
taatttttgtatatggtatg

SEQ ID NO: 779273 - DNA, 20 bp, Artificial
  CRISPR gRNA sequence
ttttgtatatggtatgaggt

SEQ ID NO: 779274 - DNA, 20 bp, Artificial
  CRISPR gRNA sequence
tttgtatatggtatgaggta

SEQ ID NO: 779275 - DNA, 20 bp, Artificial
  CRISPR gRNA sequence
caaatttgttcttttgcatg

SEQ ID NO: 779276 - DNA, 20 bp, Artificial
  CRISPR gRNA sequence
ttcttttgcatgtggacatc

SEQ ID NO: 779277 - DNA, 20 bp, Artificial
  CRISPR gRNA sequence
tgctccatttatatttatct

SEQ ID NO: 779278 - DNA, 20 bp, Artificial
  CRISPR gRNA sequence
tccatttatatttatcttag

SEQ ID NO: 779279 - DNA, 20 bp, Artificial
  CRISPR gRNA sequence
atttatcttagcagaaaata

SEQ ID NO: 779280 - DNA, 20 bp, Artificial
  CRISPR gRNA sequence
taaatctttgtgaccttgac

SEQ ID NO: 779281 - DNA, 20 bp, Artificial
  CRISPR gRNA sequence
aaatctttgtgaccttgact

SEQ ID NO: 779282 - DNA, 20 bp, Artificial
  CRISPR gRNA sequence
ttgtgaccttgactaggcaa

SEQ ID NO: 779283 - DNA, 20 bp, Artificial
  CRISPR gRNA sequence
ttgactaggcaatggtttct

SEQ ID NO: 779284 - DNA, 20 bp, Artificial
  CRISPR gRNA sequence
tgactaggcaatggtttctt

SEQ ID NO: 779285 - DNA, 20 bp, Artificial
  CRISPR gRNA sequence
tttcttaggtattacaccta

SEQ ID NO: 779286 - DNA, 20 bp, Artificial
  CRISPR gRNA sequence
acctaaagcacaaacaataa

SEQ ID NO: 779287 - DNA, 20 bp, Artificial
  CRISPR gRNA sequence
gcacaaacaataaaagaaaa

SEQ ID NO: 779288 - DNA, 20 bp, Artificial
  CRISPR gRNA sequence
caaacaataaaagaaaaaag

SEQ ID NO: 779289 - DNA, 20 bp, Artificial
  CRISPR gRNA sequence
aaagaaaaaagtagataaat

SEQ ID NO: 779290 - DNA, 20 bp, Artificial
  CRISPR gRNA sequence
attaaaacatttatccttca

SEQ ID NO: 779291 - DNA, 20 bp, Artificial
  CRISPR gRNA sequence
ttaaaacatttatccttcac

SEQ ID NO: 779292 - DNA, 20 bp, Artificial
  CRISPR gRNA sequence
atccttcacaggattctata

SEQ ID NO: 779293 - DNA, 20 bp, Artificial
  CRISPR gRNA sequence
gattctataaagaaactgaa

SEQ ID NO: 779294 - DNA, 20 bp, Artificial
  CRISPR gRNA sequence
gaaactgaaaagacaatgtg

SEQ ID NO: 779295 - DNA, 20 bp, Artificial
  CRISPR gRNA sequence
tgaaaagacaatgtgcagaa

SEQ ID NO: 779296 - DNA, 20 bp, Artificial
  CRISPR gRNA sequence
gaaaagacaatgtgcagaat

SEQ ID NO: 779297 - DNA, 20 bp, Artificial
  CRISPR gRNA sequence
caaatcatatatttgataaa

SEQ ID NO: 779298 - DNA, 20 bp, Artificial
  CRISPR gRNA sequence
catatatttgataaatagtt

SEQ ID NO: 779299 - DNA, 20 bp, Artificial
  CRISPR gRNA sequence
tagtttggcaattcctcaaa

SEQ ID NO: 779300 - DNA, 20 bp, Artificial
  CRISPR gRNA sequence
attcctcaaaaagttaaata

SEQ ID NO: 779301 - DNA, 20 bp, Artificial
  CRISPR gRNA sequence
tcctcaaaaagttaaatata

SEQ ID NO: 779302 - DNA, 20 bp, Artificial
  CRISPR gRNA sequence
tatagagttaccatttaatt

SEQ ID NO: 779303 - DNA, 20 bp, Artificial
  CRISPR gRNA sequence
ctactcctacatatgtaccc

SEQ ID NO: 779304 - DNA, 20 bp, Artificial
  CRISPR gRNA sequence
tatgtacccaagataattaa

SEQ ID NO: 779305 - DNA, 20 bp, Artificial
  CRISPR gRNA sequence
aagataattaaaagtataca

SEQ ID NO: 779306 - DNA, 20 bp, Artificial
  CRISPR gRNA sequence
attaaaagtatacatagaca

SEQ ID NO: 779307 - DNA, 20 bp, Artificial
  CRISPR gRNA sequence
atagacaaagacttgtatat

SEQ ID NO: 779308 - DNA, 20 bp, Artificial
  CRISPR gRNA sequence
gacttgtatatgagttttca

SEQ ID NO: 779309 - DNA, 20 bp, Artificial
  CRISPR gRNA sequence
acttgtatatgagttttcat

SEQ ID NO: 779310 - DNA, 20 bp, Artificial
  CRISPR gRNA sequence
cataggaactttattcataa

SEQ ID NO: 779311 - DNA, 20 bp, Artificial
  CRISPR gRNA sequence
ctttattcataatagccaac

SEQ ID NO: 779312 - DNA, 20 bp, Artificial
  CRISPR gRNA sequence
tattcataatagccaacaag

SEQ ID NO: 779313 - DNA, 20 bp, Artificial
  CRISPR gRNA sequence
aatgaccatcaactgatgaa

SEQ ID NO: 779314 - DNA, 20 bp, Artificial
  CRISPR gRNA sequence
atgaccatcaactgatgaat

SEQ ID NO: 779315 - DNA, 20 bp, Artificial
  CRISPR gRNA sequence
ccatcaactgatgaatgggt

SEQ ID NO: 779316 - DNA, 20 bp, Artificial
  CRISPR gRNA sequence
atgaatgggtaagcaaaatg

SEQ ID NO: 779317 - DNA, 20 bp, Artificial
  CRISPR gRNA sequence
aaatgtggtatatcatacaa

SEQ ID NO: 779318 - DNA, 20 bp, Artificial
  CRISPR gRNA sequence
tcatacaatggaatattatt

SEQ ID NO: 779319 - DNA, 20 bp, Artificial
  CRISPR gRNA sequence
gaatattatttagtcacaaa

SEQ ID NO: 779320 - DNA, 20 bp, Artificial
  CRISPR gRNA sequence
aatattatttagtcacaaaa

SEQ ID NO: 779321 - DNA, 20 bp, Artificial
  CRISPR gRNA sequence
tttagtcacaaaaaggaacg

SEQ ID NO: 779322 - DNA, 20 bp, Artificial
  CRISPR gRNA sequence
tgctgatatatgctacaata

SEQ ID NO: 779323 - DNA, 20 bp, Artificial
  CRISPR gRNA sequence
aaccttgacaacattatgtt

SEQ ID NO: 779324 - DNA, 20 bp, Artificial
  CRISPR gRNA sequence
aacattatgttcggtgaaaa

SEQ ID NO: 779325 - DNA, 20 bp, Artificial
  CRISPR gRNA sequence
ttatgttcggtgaaaaaagc

SEQ ID NO: 779326 - DNA, 20 bp, Artificial
  CRISPR gRNA sequence
gtgaaaaaagccagccacaa

SEQ ID NO: 779327 - DNA, 20 bp, Artificial
  CRISPR gRNA sequence
ttccatttttatgaaatatc

SEQ ID NO: 779328 - DNA, 20 bp, Artificial
  CRISPR gRNA sequence
ttttatgaaatatccagaat

SEQ ID NO: 779329 - DNA, 20 bp, Artificial
  CRISPR gRNA sequence
tatccagaataagcaattga

SEQ ID NO: 779330 - DNA, 20 bp, Artificial
  CRISPR gRNA sequence
tccagaataagcaattgata

SEQ ID NO: 779331 - DNA, 20 bp, Artificial
  CRISPR gRNA sequence
gaataagcaattgatagaga

SEQ ID NO: 779332 - DNA, 20 bp, Artificial
  CRISPR gRNA sequence
caattgatagagacagaaac

SEQ ID NO: 779333 - DNA, 20 bp, Artificial
  CRISPR gRNA sequence
gatagagacagaaactagat

SEQ ID NO: 779334 - DNA, 20 bp, Artificial
  CRISPR gRNA sequence
agagacagaaactagattag

SEQ ID NO: 779335 - DNA, 20 bp, Artificial
  CRISPR gRNA sequence
aaactagattagtggttgcc

SEQ ID NO: 779336 - DNA, 20 bp, Artificial
  CRISPR gRNA sequence
aactagattagtggttgcca

SEQ ID NO: 779337 - DNA, 20 bp, Artificial
  CRISPR gRNA sequence
actagattagtggttgccaa

SEQ ID NO: 779338 - DNA, 20 bp, Artificial
  CRISPR gRNA sequence
ttagtggttgccaagggcca

SEQ ID NO: 779339 - DNA, 20 bp, Artificial
  CRISPR gRNA sequence
tagtggttgccaagggccat

SEQ ID NO: 779340 - DNA, 20 bp, Artificial
  CRISPR gRNA sequence
agtggttgccaagggccata

SEQ ID NO: 779341 - DNA, 20 bp, Artificial
  CRISPR gRNA sequence
gttgccaagggccataggga

SEQ ID NO: 779342 - DNA, 20 bp, Artificial
  CRISPR gRNA sequence
ttgccaagggccatagggaa

SEQ ID NO: 779343 - DNA, 20 bp, Artificial
  CRISPR gRNA sequence
tgccaagggccatagggaaa

SEQ ID NO: 779344 - DNA, 20 bp, Artificial
  CRISPR gRNA sequence
caagggccatagggaaaggg

SEQ ID NO: 779345 - DNA, 20 bp, Artificial
  CRISPR gRNA sequence
aagggccatagggaaaggga

SEQ ID NO: 779346 - DNA, 20 bp, Artificial
  CRISPR gRNA sequence
agggccatagggaaagggaa

SEQ ID NO: 779347 - DNA, 20 bp, Artificial
  CRISPR gRNA sequence
gggccatagggaaagggaag

SEQ ID NO: 779348 - DNA, 20 bp, Artificial
  CRISPR gRNA sequence
tagggaaagggaaggggaaa

SEQ ID NO: 779349 - DNA, 20 bp, Artificial
  CRISPR gRNA sequence
agggaaagggaaggggaaat

SEQ ID NO: 779350 - DNA, 20 bp, Artificial
  CRISPR gRNA sequence
gaaagggaaggggaaatagg

SEQ ID NO: 779351 - DNA, 20 bp, Artificial
  CRISPR gRNA sequence
aaataggaagtttctgctaa

SEQ ID NO: 779352 - DNA, 20 bp, Artificial
  CRISPR gRNA sequence
aataggaagtttctgctaat

SEQ ID NO: 779353 - DNA, 20 bp, Artificial
  CRISPR gRNA sequence
ggaagtttctgctaatgggt

SEQ ID NO: 779354 - DNA, 20 bp, Artificial
  CRISPR gRNA sequence
gaagtttctgctaatgggta

SEQ ID NO: 779355 - DNA, 20 bp, Artificial
  CRISPR gRNA sequence
aagtttctgctaatgggtaa

SEQ ID NO: 779356 - DNA, 20 bp, Artificial
  CRISPR gRNA sequence
agtttctgctaatgggtaag

SEQ ID NO: 779357 - DNA, 20 bp, Artificial
  CRISPR gRNA sequence
atgggtaaggggttcctttt

SEQ ID NO: 779358 - DNA, 20 bp, Artificial
  CRISPR gRNA sequence
tgggtaaggggttccttttc

SEQ ID NO: 779359 - DNA, 20 bp, Artificial
  CRISPR gRNA sequence
gggtaaggggttccttttca

SEQ ID NO: 779360 - DNA, 20 bp, Artificial
  CRISPR gRNA sequence
taatgaaaatgttctaaaat

SEQ ID NO: 779361 - DNA, 20 bp, Artificial
  CRISPR gRNA sequence
aatgttctaaaattggataa

SEQ ID NO: 779362 - DNA, 20 bp, Artificial
  CRISPR gRNA sequence
cgtgaacatactaaaaacca

SEQ ID NO: 779363 - DNA, 20 bp, Artificial
  CRISPR gRNA sequence
tgaacatactaaaaaccaca

SEQ ID NO: 779364 - DNA, 20 bp, Artificial
  CRISPR gRNA sequence
cagagtcgtgcacttaaaaa

SEQ ID NO: 779365 - DNA, 20 bp, Artificial
  CRISPR gRNA sequence
tttaaatatatatacacact

SEQ ID NO: 779366 - DNA, 20 bp, Artificial
  CRISPR gRNA sequence
atatcaattatactttaata

SEQ ID NO: 779367 - DNA, 20 bp, Artificial
  CRISPR gRNA sequence
taaaataaaattttaaaaca

SEQ ID NO: 779368 - DNA, 20 bp, Artificial
  CRISPR gRNA sequence
aaaatatataaactcgccaa

SEQ ID NO: 779369 - DNA, 20 bp, Artificial
  CRISPR gRNA sequence
agaccacttctcacccctac

SEQ ID NO: 779370 - DNA, 20 bp, Artificial
  CRISPR gRNA sequence
cctactagcccctctactct

SEQ ID NO: 779371 - DNA, 20 bp, Artificial
  CRISPR gRNA sequence
gcccctctactctaagctat

SEQ ID NO: 779372 - DNA, 20 bp, Artificial
  CRISPR gRNA sequence
ctcactgcttgtaatcttgc

SEQ ID NO: 779373 - DNA, 20 bp, Artificial
  CRISPR gRNA sequence
tgccagcaacctctccctct

SEQ ID NO: 779374 - DNA, 20 bp, Artificial
  CRISPR gRNA sequence
caacctctccctctcagcaa

SEQ ID NO: 779375 - DNA, 20 bp, Artificial
  CRISPR gRNA sequence
atagtctattgcctacacca

SEQ ID NO: 779376 - DNA, 20 bp, Artificial
  CRISPR gRNA sequence
ctattgcctacaccaaagct

SEQ ID NO: 779377 - DNA, 20 bp, Artificial
  CRISPR gRNA sequence
tgtctcttaatgatgtaaat

SEQ ID NO: 779378 - DNA, 20 bp, Artificial
  CRISPR gRNA sequence
gtctcttaatgatgtaaatg

SEQ ID NO: 779379 - DNA, 20 bp, Artificial
  CRISPR gRNA sequence
ccactgcttttcatcacact

SEQ ID NO: 779380 - DNA, 20 bp, Artificial
  CRISPR gRNA sequence
actgcttttcatcacactca

SEQ ID NO: 779381 - DNA, 20 bp, Artificial
  CRISPR gRNA sequence
gcttttcatcacactcagag

SEQ ID NO: 779382 - DNA, 20 bp, Artificial
  CRISPR gRNA sequence
agctctgctgttgcctgatt

SEQ ID NO: 779383 - DNA, 20 bp, Artificial
  CRISPR gRNA sequence
tgttgcctgatttagatgta

SEQ ID NO: 779384 - DNA, 20 bp, Artificial
  CRISPR gRNA sequence
atttagatgtatggctccaa

SEQ ID NO: 779385 - DNA, 20 bp, Artificial
  CRISPR gRNA sequence
gctccaacagatttcccctg

SEQ ID NO: 779386 - DNA, 20 bp, Artificial
  CRISPR gRNA sequence
cccctgaagaaatgattcca

SEQ ID NO: 779387 - DNA, 20 bp, Artificial
  CRISPR gRNA sequence
aatgattccatggctgataa

SEQ ID NO: 779388 - DNA, 20 bp, Artificial
  CRISPR gRNA sequence
attccatggctgataaaagt

SEQ ID NO: 779389 - DNA, 20 bp, Artificial
  CRISPR gRNA sequence
catggctgataaaagttgga

SEQ ID NO: 779390 - DNA, 20 bp, Artificial
  CRISPR gRNA sequence
taaaagttggaaagcctcct

SEQ ID NO: 779391 - DNA, 20 bp, Artificial
  CRISPR gRNA sequence
ttggaaagcctcctcagttt

SEQ ID NO: 779392 - DNA, 20 bp, Artificial
  CRISPR gRNA sequence
cctcagtttcagaccattat

SEQ ID NO: 779393 - DNA, 20 bp, Artificial
  CRISPR gRNA sequence
gtttcagaccattatcagat

SEQ ID NO: 779394 - DNA, 20 bp, Artificial
  CRISPR gRNA sequence
ctgtccctttcctcaaccat

SEQ ID NO: 779395 - DNA, 20 bp, Artificial
  CRISPR gRNA sequence
tccctttcctcaaccataag

SEQ ID NO: 779396 - DNA, 20 bp, Artificial
  CRISPR gRNA sequence
cctcaaccataagaagtcca

SEQ ID NO: 779397 - DNA, 20 bp, Artificial
  CRISPR gRNA sequence
ccataagaagtccatggata

SEQ ID NO: 779398 - DNA, 20 bp, Artificial
  CRISPR gRNA sequence
aagaagtccatggataaaga

SEQ ID NO: 779399 - DNA, 20 bp, Artificial
  CRISPR gRNA sequence
tccatggataaagaaagctt

SEQ ID NO: 779400 - DNA, 20 bp, Artificial
  CRISPR gRNA sequence
catggataaagaaagcttca

SEQ ID NO: 779401 - DNA, 20 bp, Artificial
  CRISPR gRNA sequence
ataaagaaagcttcagagta

SEQ ID NO: 779402 - DNA, 20 bp, Artificial
  CRISPR gRNA sequence
taaagaaagcttcagagtaa

SEQ ID NO: 779403 - DNA, 20 bp, Artificial
  CRISPR gRNA sequence
aagaaagcttcagagtaaag

SEQ ID NO: 779404 - DNA, 20 bp, Artificial
  CRISPR gRNA sequence
aagcttcagagtaaaggaga

SEQ ID NO: 779405 - DNA, 20 bp, Artificial
  CRISPR gRNA sequence
tcagagtaaaggagaaagca

SEQ ID NO: 779406 - DNA, 20 bp, Artificial
  CRISPR gRNA sequence
cagagtaaaggagaaagcat

SEQ ID NO: 779407 - DNA, 20 bp, Artificial
  CRISPR gRNA sequence
gagtaaaggagaaagcatgg

SEQ ID NO: 779408 - DNA, 20 bp, Artificial
  CRISPR gRNA sequence
agtaaaggagaaagcatggg

SEQ ID NO: 779409 - DNA, 20 bp, Artificial
  CRISPR gRNA sequence
aggagaaagcatgggaggta

SEQ ID NO: 779410 - DNA, 20 bp, Artificial
  CRISPR gRNA sequence
agaaagcatgggaggtacag

SEQ ID NO: 779411 - DNA, 20 bp, Artificial
  CRISPR gRNA sequence
gaaagcatgggaggtacagc

SEQ ID NO: 779412 - DNA, 20 bp, Artificial
  CRISPR gRNA sequence
atgggaggtacagcaggacc

SEQ ID NO: 779413 - DNA, 20 bp, Artificial
  CRISPR gRNA sequence
tgggaggtacagcaggacca

SEQ ID NO: 779414 - DNA, 20 bp, Artificial
  CRISPR gRNA sequence
gaggtacagcaggaccaagg

SEQ ID NO: 779415 - DNA, 20 bp, Artificial
  CRISPR gRNA sequence
aggtacagcaggaccaaggt

SEQ ID NO: 779416 - DNA, 20 bp, Artificial
  CRISPR gRNA sequence
ggtacagcaggaccaaggtg

SEQ ID NO: 779417 - DNA, 20 bp, Artificial
  CRISPR gRNA sequence
ggaccaaggtggggcattcg

SEQ ID NO: 779418 - DNA, 20 bp, Artificial
  CRISPR gRNA sequence
ttcgcagcccccaccctcat

SEQ ID NO: 779419 - DNA, 20 bp, Artificial
  CRISPR gRNA sequence
cgcagcccccaccctcatca

SEQ ID NO: 779420 - DNA, 20 bp, Artificial
  CRISPR gRNA sequence
gcccccaccctcatcagagc

SEQ ID NO: 779421 - DNA, 20 bp, Artificial
  CRISPR gRNA sequence
ctctccctgtctaaacctct

SEQ ID NO: 779422 - DNA, 20 bp, Artificial
  CRISPR gRNA sequence
ccctgtctaaacctcttagt

SEQ ID NO: 779423 - DNA, 20 bp, Artificial
  CRISPR gRNA sequence
ctgtctaaacctcttagtaa

SEQ ID NO: 779424 - DNA, 20 bp, Artificial
  CRISPR gRNA sequence
tgtctaaacctcttagtaag

SEQ ID NO: 779425 - DNA, 20 bp, Artificial
  CRISPR gRNA sequence
ctaaacctcttagtaagagg

SEQ ID NO: 779426 - DNA, 20 bp, Artificial
  CRISPR gRNA sequence
ctcttagtaagaggtagttc

SEQ ID NO: 779427 - DNA, 20 bp, Artificial
  CRISPR gRNA sequence
cttagtaagaggtagttcaa

SEQ ID NO: 779428 - DNA, 20 bp, Artificial
  CRISPR gRNA sequence
tagtaagaggtagttcaaga

SEQ ID NO: 779429 - DNA, 20 bp, Artificial
  CRISPR gRNA sequence
agtaagaggtagttcaagag

SEQ ID NO: 779430 - DNA, 20 bp, Artificial
  CRISPR gRNA sequence
gtaagaggtagttcaagaga

SEQ ID NO: 779431 - DNA, 20 bp, Artificial
  CRISPR gRNA sequence
taagaggtagttcaagagag

SEQ ID NO: 779432 - DNA, 20 bp, Artificial
  CRISPR gRNA sequence
gagaggggcaaactcaattc

SEQ ID NO: 779433 - DNA, 20 bp, Artificial
  CRISPR gRNA sequence
aactcaattccagcactcaa

SEQ ID NO: 779434 - DNA, 20 bp, Artificial
  CRISPR gRNA sequence
aagcacttgactactttgct

SEQ ID NO: 779435 - DNA, 20 bp, Artificial
  CRISPR gRNA sequence
gactactttgctcagtcaac

SEQ ID NO: 779436 - DNA, 20 bp, Artificial
  CRISPR gRNA sequence
actttgctcagtcaactagc

SEQ ID NO: 779437 - DNA, 20 bp, Artificial
  CRISPR gRNA sequence
tcaactagcaagtatttatt

SEQ ID NO: 779438 - DNA, 20 bp, Artificial
  CRISPR gRNA sequence
gcaagtatttattgagaatg

SEQ ID NO: 779439 - DNA, 20 bp, Artificial
  CRISPR gRNA sequence
gagaatgtagctctgttcta

SEQ ID NO: 779440 - DNA, 20 bp, Artificial
  CRISPR gRNA sequence
gaatgtagctctgttctatg

SEQ ID NO: 779441 - DNA, 20 bp, Artificial
  CRISPR gRNA sequence
ttctatggagtcttattttc

SEQ ID NO: 779442 - DNA, 20 bp, Artificial
  CRISPR gRNA sequence
ggagtcttattttcaagtgt

SEQ ID NO: 779443 - DNA, 20 bp, Artificial
  CRISPR gRNA sequence
attttcaagtgtcagactcc

SEQ ID NO: 779444 - DNA, 20 bp, Artificial
  CRISPR gRNA sequence
gtgtcagactcccagacatc

SEQ ID NO: 779445 - DNA, 20 bp, Artificial
  CRISPR gRNA sequence
agactcccagacatccagtc

SEQ ID NO: 779446 - DNA, 20 bp, Artificial
  CRISPR gRNA sequence
gactcccagacatccagtcc

SEQ ID NO: 779447 - DNA, 20 bp, Artificial
  CRISPR gRNA sequence
ccagacatccagtccaggta

SEQ ID NO: 779448 - DNA, 20 bp, Artificial
  CRISPR gRNA sequence
gacatccagtccaggtaaag

SEQ ID NO: 779449 - DNA, 20 bp, Artificial
  CRISPR gRNA sequence
tccagtccaggtaaagaaga

SEQ ID NO: 779450 - DNA, 20 bp, Artificial
  CRISPR gRNA sequence
cattattcatttgacaaaca

SEQ ID NO: 779451 - DNA, 20 bp, Artificial
  CRISPR gRNA sequence
attcatttgacaaacaaagt

SEQ ID NO: 779452 - DNA, 20 bp, Artificial
  CRISPR gRNA sequence
ttcatttgacaaacaaagtt

SEQ ID NO: 779453 - DNA, 20 bp, Artificial
  CRISPR gRNA sequence
tcatttgacaaacaaagttg

SEQ ID NO: 779454 - DNA, 20 bp, Artificial
  CRISPR gRNA sequence
gacaaacaaagttggggttc

SEQ ID NO: 779455 - DNA, 20 bp, Artificial
  CRISPR gRNA sequence
acaaacaaagttggggttca

SEQ ID NO: 779456 - DNA, 20 bp, Artificial
  CRISPR gRNA sequence
caaacaaagttggggttcaa

SEQ ID NO: 779457 - DNA, 20 bp, Artificial
  CRISPR gRNA sequence
caaagttggggttcaagggc

SEQ ID NO: 779458 - DNA, 20 bp, Artificial
  CRISPR gRNA sequence
caagggccagctattgaaaa

SEQ ID NO: 779459 - DNA, 20 bp, Artificial
  CRISPR gRNA sequence
ccagctattgaaaaaagcta

SEQ ID NO: 779460 - DNA, 20 bp, Artificial
  CRISPR gRNA sequence
ctattgaaaaaagctatgga

SEQ ID NO: 779461 - DNA, 20 bp, Artificial
  CRISPR gRNA sequence
aaagctatggaaagcttcat

SEQ ID NO: 779462 - DNA, 20 bp, Artificial
  CRISPR gRNA sequence
ggaaagcttcatgagacgtg

SEQ ID NO: 779463 - DNA, 20 bp, Artificial
  CRISPR gRNA sequence
gaaagcttcatgagacgtgc

SEQ ID NO: 779464 - DNA, 20 bp, Artificial
  CRISPR gRNA sequence
caggtaactgccaatatgtg

SEQ ID NO: 779465 - DNA, 20 bp, Artificial
  CRISPR gRNA sequence
tgccaatatgtgtggttcac

SEQ ID NO: 779466 - DNA, 20 bp, Artificial
  CRISPR gRNA sequence
gccaatatgtgtggttcaca

SEQ ID NO: 779467 - DNA, 20 bp, Artificial
  CRISPR gRNA sequence
tatgtgtggttcacaaggac

SEQ ID NO: 779468 - DNA, 20 bp, Artificial
  CRISPR gRNA sequence
cacaaggactggttcatatt

SEQ ID NO: 779469 - DNA, 20 bp, Artificial
  CRISPR gRNA sequence
gactggttcatattcagaaa

SEQ ID NO: 779470 - DNA, 20 bp, Artificial
  CRISPR gRNA sequence
tcatattcagaaacggccat

SEQ ID NO: 779471 - DNA, 20 bp, Artificial
  CRISPR gRNA sequence
ttcagaaacggccattagaa

SEQ ID NO: 779472 - DNA, 20 bp, Artificial
  CRISPR gRNA sequence
tcagaaacggccattagaaa

SEQ ID NO: 779473 - DNA, 20 bp, Artificial
  CRISPR gRNA sequence
gaaacggccattagaaaagg

SEQ ID NO: 779474 - DNA, 20 bp, Artificial
  CRISPR gRNA sequence
acggccattagaaaaggaag

SEQ ID NO: 779475 - DNA, 20 bp, Artificial
  CRISPR gRNA sequence
aggaagaagaacttctcatt

SEQ ID NO: 779476 - DNA, 20 bp, Artificial
  CRISPR gRNA sequence
acttctcatttggatttata

SEQ ID NO: 779477 - DNA, 20 bp, Artificial
  CRISPR gRNA sequence
ttctcatttggatttataaa

SEQ ID NO: 779478 - DNA, 20 bp, Artificial
  CRISPR gRNA sequence
aatttatatcttctcttctc

SEQ ID NO: 779479 - DNA, 20 bp, Artificial
  CRISPR gRNA sequence
atttatatcttctcttctcc

SEQ ID NO: 779480 - DNA, 20 bp, Artificial
  CRISPR gRNA sequence
caacctataacttctcctcc

SEQ ID NO: 779481 - DNA, 20 bp, Artificial
  CRISPR gRNA sequence
ctcccagctccactctacca

SEQ ID NO: 779482 - DNA, 20 bp, Artificial
  CRISPR gRNA sequence
tgttattcccctgttttcaa

SEQ ID NO: 779483 - DNA, 20 bp, Artificial
  CRISPR gRNA sequence
cctgttttcaaaagtgaaca

SEQ ID NO: 779484 - DNA, 20 bp, Artificial
  CRISPR gRNA sequence
caaaagtgaacaaagaacca

SEQ ID NO: 779485 - DNA, 20 bp, Artificial
  CRISPR gRNA sequence
tgaacaaagaaccaaagacc

SEQ ID NO: 779486 - DNA, 20 bp, Artificial
  CRISPR gRNA sequence
aaagaaccaaagacccagca

SEQ ID NO: 779487 - DNA, 20 bp, Artificial
  CRISPR gRNA sequence
aagacccagcaaagtttcac

SEQ ID NO: 779488 - DNA, 20 bp, Artificial
  CRISPR gRNA sequence
agacccagcaaagtttcaca

SEQ ID NO: 779489 - DNA, 20 bp, Artificial
  CRISPR gRNA sequence
gcaaagtttcacaaggccct

SEQ ID NO: 779490 - DNA, 20 bp, Artificial
  CRISPR gRNA sequence
agactttcaattgtctattt

SEQ ID NO: 779491 - DNA, 20 bp, Artificial
  CRISPR gRNA sequence
tgtctatttcagatcaaata

SEQ ID NO: 779492 - DNA, 20 bp, Artificial
  CRISPR gRNA sequence
atcttcctcctgctaatgtt

SEQ ID NO: 779493 - DNA, 20 bp, Artificial
  CRISPR gRNA sequence
cctcctgctaatgttgagcc

SEQ ID NO: 779494 - DNA, 20 bp, Artificial
  CRISPR gRNA sequence
taatgttgagcctggaattg

SEQ ID NO: 779495 - DNA, 20 bp, Artificial
  CRISPR gRNA sequence
gcctggaattgcagcttcac

SEQ ID NO: 779496 - DNA, 20 bp, Artificial
  CRISPR gRNA sequence
ggaattgcagcttcaccaga

SEQ ID NO: 779497 - DNA, 20 bp, Artificial
  CRISPR gRNA sequence
attgcagcttcaccagatag

SEQ ID NO: 779498 - DNA, 20 bp, Artificial
  CRISPR gRNA sequence
ttgcagcttcaccagatagc

SEQ ID NO: 779499 - DNA, 20 bp, Artificial
  CRISPR gRNA sequence
agcttcaccagatagcaggt

SEQ ID NO: 779500 - DNA, 20 bp, Artificial
  CRISPR gRNA sequence
tcaccagatagcaggtaaga

SEQ ID NO: 779501 - DNA, 20 bp, Artificial
  CRISPR gRNA sequence
caccagatagcaggtaagaa

SEQ ID NO: 779502 - DNA, 20 bp, Artificial
  CRISPR gRNA sequence
atagcaggtaagaaaggaca

SEQ ID NO: 779503 - DNA, 20 bp, Artificial
  CRISPR gRNA sequence
tagcaggtaagaaaggacaa

SEQ ID NO: 779504 - DNA, 20 bp, Artificial
  CRISPR gRNA sequence
agcaggtaagaaaggacaaa

SEQ ID NO: 779505 - DNA, 20 bp, Artificial
  CRISPR gRNA sequence
caggtaagaaaggacaaagg

SEQ ID NO: 779506 - DNA, 20 bp, Artificial
  CRISPR gRNA sequence
ggtaagaaaggacaaaggga

SEQ ID NO: 779507 - DNA, 20 bp, Artificial
  CRISPR gRNA sequence
gtaagaaaggacaaagggag

SEQ ID NO: 779508 - DNA, 20 bp, Artificial
  CRISPR gRNA sequence
aaggacaaagggagaggctt

SEQ ID NO: 779509 - DNA, 20 bp, Artificial
  CRISPR gRNA sequence
acaaagggagaggcttaaga

SEQ ID NO: 779510 - DNA, 20 bp, Artificial
  CRISPR gRNA sequence
aagggagaggcttaagaaag

SEQ ID NO: 779511 - DNA, 20 bp, Artificial
  CRISPR gRNA sequence
gggagaggcttaagaaagaa

SEQ ID NO: 779512 - DNA, 20 bp, Artificial
  CRISPR gRNA sequence
agaggcttaagaaagaagag

SEQ ID NO: 779513 - DNA, 20 bp, Artificial
  CRISPR gRNA sequence
gaggcttaagaaagaagagc

SEQ ID NO: 779514 - DNA, 20 bp, Artificial
  CRISPR gRNA sequence
gcttaagaaagaagagcagg

SEQ ID NO: 779515 - DNA, 20 bp, Artificial
  CRISPR gRNA sequence
taagaaagaagagcaggtgg

SEQ ID NO: 779516 - DNA, 20 bp, Artificial
  CRISPR gRNA sequence
gaagagcaggtggtggttcc

SEQ ID NO: 779517 - DNA, 20 bp, Artificial
  CRISPR gRNA sequence
caggtggtggttcctagcca

SEQ ID NO: 779518 - DNA, 20 bp, Artificial
  CRISPR gRNA sequence
tcctagccaaagccaaaaat

SEQ ID NO: 779519 - DNA, 20 bp, Artificial
  CRISPR gRNA sequence
caaagccaaaaatgagaatg

SEQ ID NO: 779520 - DNA, 20 bp, Artificial
  CRISPR gRNA sequence
aaaaatgagaatgtggccct

SEQ ID NO: 779521 - DNA, 20 bp, Artificial
  CRISPR gRNA sequence
aaaatgagaatgtggccctc

SEQ ID NO: 779522 - DNA, 20 bp, Artificial
  CRISPR gRNA sequence
gagaatgtggccctcaggct

SEQ ID NO: 779523 - DNA, 20 bp, Artificial
  CRISPR gRNA sequence
agaatgtggccctcaggctg

SEQ ID NO: 779524 - DNA, 20 bp, Artificial
  CRISPR gRNA sequence
gaatgtggccctcaggctga

SEQ ID NO: 779525 - DNA, 20 bp, Artificial
  CRISPR gRNA sequence
tcaggctgagggctttcttt

SEQ ID NO: 779526 - DNA, 20 bp, Artificial
  CRISPR gRNA sequence
aggctgagggctttctttga

SEQ ID NO: 779527 - DNA, 20 bp, Artificial
  CRISPR gRNA sequence
ggctgagggctttctttgag

SEQ ID NO: 779528 - DNA, 20 bp, Artificial
  CRISPR gRNA sequence
ttgagaggacgtatgatttc

SEQ ID NO: 779529 - DNA, 20 bp, Artificial
  CRISPR gRNA sequence
tgagaggacgtatgatttct

SEQ ID NO: 779530 - DNA, 20 bp, Artificial
  CRISPR gRNA sequence
tatgatttctgggctattcc

SEQ ID NO: 779531 - DNA, 20 bp, Artificial
  CRISPR gRNA sequence
ccaagcaccacaaaaaaaaa

SEQ ID NO: 779532 - DNA, 20 bp, Artificial
  CRISPR gRNA sequence
aagcaccacaaaaaaaaaaa

SEQ ID NO: 779533 - DNA, 20 bp, Artificial
  CRISPR gRNA sequence
aaaaaaaaaaagagtcccca

SEQ ID NO: 779534 - DNA, 20 bp, Artificial
  CRISPR gRNA sequence
aaaaaaaagagtccccatgg

SEQ ID NO: 779535 - DNA, 20 bp, Artificial
  CRISPR gRNA sequence
atgccaatgtccctatctga

SEQ ID NO: 779536 - DNA, 20 bp, Artificial
  CRISPR gRNA sequence
atgtccctatctgacagaaa

SEQ ID NO: 779537 - DNA, 20 bp, Artificial
  CRISPR gRNA sequence
atctgacagaaacggtgact

SEQ ID NO: 779538 - DNA, 20 bp, Artificial
  CRISPR gRNA sequence
ctccatctattcccactatc

SEQ ID NO: 779539 - DNA, 20 bp, Artificial
  CRISPR gRNA sequence
atctattcccactatccagt

SEQ ID NO: 779540 - DNA, 20 bp, Artificial
  CRISPR gRNA sequence
tctattcccactatccagtg

SEQ ID NO: 779541 - DNA, 20 bp, Artificial
  CRISPR gRNA sequence
ctattcccactatccagtga

SEQ ID NO: 779542 - DNA, 20 bp, Artificial
  CRISPR gRNA sequence
tatccagtgagggtaatgac

SEQ ID NO: 779543 - DNA, 20 bp, Artificial
  CRISPR gRNA sequence
ccagtgagggtaatgacaag

SEQ ID NO: 779544 - DNA, 20 bp, Artificial
  CRISPR gRNA sequence
tgagggtaatgacaagaaga

SEQ ID NO: 779545 - DNA, 20 bp, Artificial
  CRISPR gRNA sequence
gagggtaatgacaagaagac

SEQ ID NO: 779546 - DNA, 20 bp, Artificial
  CRISPR gRNA sequence
gacaagaagacaggatcact

SEQ ID NO: 779547 - DNA, 20 bp, Artificial
  CRISPR gRNA sequence
atgtaaatctaaactgatac

SEQ ID NO: 779548 - DNA, 20 bp, Artificial
  CRISPR gRNA sequence
gtaaatctaaactgatacaa

SEQ ID NO: 779549 - DNA, 20 bp, Artificial
  CRISPR gRNA sequence
taaatctaaactgatacaag

SEQ ID NO: 779550 - DNA, 20 bp, Artificial
  CRISPR gRNA sequence
aaatctaaactgatacaaga

SEQ ID NO: 779551 - DNA, 20 bp, Artificial
  CRISPR gRNA sequence
tctaaactgatacaagaggg

SEQ ID NO: 779552 - DNA, 20 bp, Artificial
  CRISPR gRNA sequence
ctaaactgatacaagagggc

SEQ ID NO: 779553 - DNA, 20 bp, Artificial
  CRISPR gRNA sequence
taaactgatacaagagggca

SEQ ID NO: 779554 - DNA, 20 bp, Artificial
  CRISPR gRNA sequence
aaactgatacaagagggcag

SEQ ID NO: 779555 - DNA, 20 bp, Artificial
  CRISPR gRNA sequence
gatacaagagggcaggggtt

SEQ ID NO: 779556 - DNA, 20 bp, Artificial
  CRISPR gRNA sequence
gcaggggttgagttccctta

SEQ ID NO: 779557 - DNA, 20 bp, Artificial
  CRISPR gRNA sequence
caggggttgagttcccttaa

SEQ ID NO: 779558 - DNA, 20 bp, Artificial
  CRISPR gRNA sequence
ggttgagttcccttaaaggt

SEQ ID NO: 779559 - DNA, 20 bp, Artificial
  CRISPR gRNA sequence
tcccttaaaggtgagatgcc

SEQ ID NO: 779560 - DNA, 20 bp, Artificial
  CRISPR gRNA sequence
cttaaaggtgagatgccaag

SEQ ID NO: 779561 - DNA, 20 bp, Artificial
  CRISPR gRNA sequence
gcagctgtccccttcctttc

SEQ ID NO: 779562 - DNA, 20 bp, Artificial
  CRISPR gRNA sequence
gctgtccccttcctttctgg

SEQ ID NO: 779563 - DNA, 20 bp, Artificial
  CRISPR gRNA sequence
ctgtccccttcctttctggc

SEQ ID NO: 779564 - DNA, 20 bp, Artificial
  CRISPR gRNA sequence
tgtccccttcctttctggca

SEQ ID NO: 779565 - DNA, 20 bp, Artificial
  CRISPR gRNA sequence
tccccttcctttctggcagg

SEQ ID NO: 779566 - DNA, 20 bp, Artificial
  CRISPR gRNA sequence
cccttcctttctggcaggga

SEQ ID NO: 779567 - DNA, 20 bp, Artificial
  CRISPR gRNA sequence
tcctttctggcagggagagt

SEQ ID NO: 779568 - DNA, 20 bp, Artificial
  CRISPR gRNA sequence
cctttctggcagggagagta

SEQ ID NO: 779569 - DNA, 20 bp, Artificial
  CRISPR gRNA sequence
tttctggcagggagagtaag

SEQ ID NO: 779570 - DNA, 20 bp, Artificial
  CRISPR gRNA sequence
cagggagagtaaggagacaa

SEQ ID NO: 779571 - DNA, 20 bp, Artificial
  CRISPR gRNA sequence
gagagtaaggagacaatggc

SEQ ID NO: 779572 - DNA, 20 bp, Artificial
  CRISPR gRNA sequence
agagtaaggagacaatggcc

SEQ ID NO: 779573 - DNA, 20 bp, Artificial
  CRISPR gRNA sequence
gagtaaggagacaatggcca

SEQ ID NO: 779574 - DNA, 20 bp, Artificial
  CRISPR gRNA sequence
cagggaacaccgttactcta

SEQ ID NO: 779575 - DNA, 20 bp, Artificial
  CRISPR gRNA sequence
actctaaagataatgtcttg

SEQ ID NO: 779576 - DNA, 20 bp, Artificial
  CRISPR gRNA sequence
gaagacattctgcatattat

SEQ ID NO: 779577 - DNA, 20 bp, Artificial
  CRISPR gRNA sequence
atattattagttgtttctgt

SEQ ID NO: 779578 - DNA, 20 bp, Artificial
  CRISPR gRNA sequence
ctgtgagtttcttttttgaa

SEQ ID NO: 779579 - DNA, 20 bp, Artificial
  CRISPR gRNA sequence
tcttttttgaaaagcaacaa

SEQ ID NO: 779580 - DNA, 20 bp, Artificial
  CRISPR gRNA sequence
tttttgaaaagcaacaatag

SEQ ID NO: 779581 - DNA, 20 bp, Artificial
  CRISPR gRNA sequence
aaagcaacaatagcagccgt

SEQ ID NO: 779582 - DNA, 20 bp, Artificial
  CRISPR gRNA sequence
tggtcattcataccttaatg

SEQ ID NO: 779583 - DNA, 20 bp, Artificial
  CRISPR gRNA sequence
ataccttaatgtggtttact

SEQ ID NO: 779584 - DNA, 20 bp, Artificial
  CRISPR gRNA sequence
ccaaatgaacaatgaacctt

SEQ ID NO: 779585 - DNA, 20 bp, Artificial
  CRISPR gRNA sequence
caaatgaacaatgaacctta

SEQ ID NO: 779586 - DNA, 20 bp, Artificial
  CRISPR gRNA sequence
gaaccttaaggctatccctt

SEQ ID NO: 779587 - DNA, 20 bp, Artificial
  CRISPR gRNA sequence
aggctatccctttggacttg

SEQ ID NO: 779588 - DNA, 20 bp, Artificial
  CRISPR gRNA sequence
tatccctttggacttgaaga

SEQ ID NO: 779589 - DNA, 20 bp, Artificial
  CRISPR gRNA sequence
atccctttggacttgaagaa

SEQ ID NO: 779590 - DNA, 20 bp, Artificial
  CRISPR gRNA sequence
cttgaagaaaggacttctat

SEQ ID NO: 779591 - DNA, 20 bp, Artificial
  CRISPR gRNA sequence
tgaagaaaggacttctattg

SEQ ID NO: 779592 - DNA, 20 bp, Artificial
  CRISPR gRNA sequence
gaagaaaggacttctattgg

SEQ ID NO: 779593 - DNA, 20 bp, Artificial
  CRISPR gRNA sequence
aaggacttctattggaggat

SEQ ID NO: 779594 - DNA, 20 bp, Artificial
  CRISPR gRNA sequence
aggacttctattggaggatg

SEQ ID NO: 779595 - DNA, 20 bp, Artificial
  CRISPR gRNA sequence
ggacttctattggaggatga

SEQ ID NO: 779596 - DNA, 20 bp, Artificial
  CRISPR gRNA sequence
ttctattggaggatgagggt

SEQ ID NO: 779597 - DNA, 20 bp, Artificial
  CRISPR gRNA sequence
tattggaggatgagggtgag

SEQ ID NO: 779598 - DNA, 20 bp, Artificial
  CRISPR gRNA sequence
ggaggatgagggtgagcaga

SEQ ID NO: 779599 - DNA, 20 bp, Artificial
  CRISPR gRNA sequence
atgagggtgagcagaaagaa

SEQ ID NO: 779600 - DNA, 20 bp, Artificial
  CRISPR gRNA sequence
agggtgagcagaaagaaaag

SEQ ID NO: 779601 - DNA, 20 bp, Artificial
  CRISPR gRNA sequence
cagaaagaaaagcagtttca

SEQ ID NO: 779602 - DNA, 20 bp, Artificial
  CRISPR gRNA sequence
aagaaaagcagtttcacagt

SEQ ID NO: 779603 - DNA, 20 bp, Artificial
  CRISPR gRNA sequence
ttcacagttggttgttctcc

SEQ ID NO: 779604 - DNA, 20 bp, Artificial
  CRISPR gRNA sequence
tcacagttggttgttctcct

SEQ ID NO: 779605 - DNA, 20 bp, Artificial
  CRISPR gRNA sequence
cacagttggttgttctcctg

SEQ ID NO: 779606 - DNA, 20 bp, Artificial
  CRISPR gRNA sequence
agttggttgttctcctgggg

SEQ ID NO: 779607 - DNA, 20 bp, Artificial
  CRISPR gRNA sequence
gttggttgttctcctgggga

SEQ ID NO: 779608 - DNA, 20 bp, Artificial
  CRISPR gRNA sequence
ggttgttctcctggggaagg

SEQ ID NO: 779609 - DNA, 20 bp, Artificial
  CRISPR gRNA sequence
ttctcctggggaaggtagtt

SEQ ID NO: 779610 - DNA, 20 bp, Artificial
  CRISPR gRNA sequence
gaaggtagttcagaccattc

SEQ ID NO: 779611 - DNA, 20 bp, Artificial
  CRISPR gRNA sequence
aaggtagttcagaccattcg

SEQ ID NO: 779612 - DNA, 20 bp, Artificial
  CRISPR gRNA sequence
aggtagttcagaccattcga

SEQ ID NO: 779613 - DNA, 20 bp, Artificial
  CRISPR gRNA sequence
gttcagaccattcgagggtg

SEQ ID NO: 779614 - DNA, 20 bp, Artificial
  CRISPR gRNA sequence
agaccattcgagggtgtagt

SEQ ID NO: 779615 - DNA, 20 bp, Artificial
  CRISPR gRNA sequence
gagggtgtagttagaaccat

SEQ ID NO: 779616 - DNA, 20 bp, Artificial
  CRISPR gRNA sequence
gaaccatgagtgcactattt

SEQ ID NO: 779617 - DNA, 20 bp, Artificial
  CRISPR gRNA sequence
gcactattttggatgaacac

SEQ ID NO: 779618 - DNA, 20 bp, Artificial
  CRISPR gRNA sequence
cactattttggatgaacacc

SEQ ID NO: 779619 - DNA, 20 bp, Artificial
  CRISPR gRNA sequence
ctattttggatgaacaccag

SEQ ID NO: 779620 - DNA, 20 bp, Artificial
  CRISPR gRNA sequence
ttggatgaacaccaggagct

SEQ ID NO: 779621 - DNA, 20 bp, Artificial
  CRISPR gRNA sequence
ggatgaacaccaggagctaa

SEQ ID NO: 779622 - DNA, 20 bp, Artificial
  CRISPR gRNA sequence
atgaacaccaggagctaaga

SEQ ID NO: 779623 - DNA, 20 bp, Artificial
  CRISPR gRNA sequence
caggagctaagagagtaaca

SEQ ID NO: 779624 - DNA, 20 bp, Artificial
  CRISPR gRNA sequence
ggagctaagagagtaacata

SEQ ID NO: 779625 - DNA, 20 bp, Artificial
  CRISPR gRNA sequence
gagctaagagagtaacatag

SEQ ID NO: 779626 - DNA, 20 bp, Artificial
  CRISPR gRNA sequence
aagagagtaacatagaggtg

SEQ ID NO: 779627 - DNA, 20 bp, Artificial
  CRISPR gRNA sequence
gagtaacatagaggtgtgga

SEQ ID NO: 779628 - DNA, 20 bp, Artificial
  CRISPR gRNA sequence
gtaacatagaggtgtggaca

SEQ ID NO: 779629 - DNA, 20 bp, Artificial
  CRISPR gRNA sequence
taacatagaggtgtggacag

SEQ ID NO: 779630 - DNA, 20 bp, Artificial
  CRISPR gRNA sequence
agaggtgtggacagaggatt

SEQ ID NO: 779631 - DNA, 20 bp, Artificial
  CRISPR gRNA sequence
ggacagaggattaagtcctc

SEQ ID NO: 779632 - DNA, 20 bp, Artificial
  CRISPR gRNA sequence
ggattaagtcctcaagacaa

SEQ ID NO: 779633 - DNA, 20 bp, Artificial
  CRISPR gRNA sequence
agtcctcaagacaatagccc

SEQ ID NO: 779634 - DNA, 20 bp, Artificial
  CRISPR gRNA sequence
agacaatagccccagcccca

SEQ ID NO: 779635 - DNA, 20 bp, Artificial
  CRISPR gRNA sequence
gacaatagccccagccccat

SEQ ID NO: 779636 - DNA, 20 bp, Artificial
  CRISPR gRNA sequence
tcatctttctgctcatgatt

SEQ ID NO: 779637 - DNA, 20 bp, Artificial
  CRISPR gRNA sequence
tgctcatgattgagaaataa

SEQ ID NO: 779638 - DNA, 20 bp, Artificial
  CRISPR gRNA sequence
ttgagaaataatggctccct

SEQ ID NO: 779639 - DNA, 20 bp, Artificial
  CRISPR gRNA sequence
tggcacttgataacctttcg

SEQ ID NO: 779640 - DNA, 20 bp, Artificial
  CRISPR gRNA sequence
gcacttgataacctttcgaa

SEQ ID NO: 779641 - DNA, 20 bp, Artificial
  CRISPR gRNA sequence
aagagctttctcctccctac

SEQ ID NO: 779642 - DNA, 20 bp, Artificial
  CRISPR gRNA sequence
gctttctcctccctactagc

SEQ ID NO: 779643 - DNA, 20 bp, Artificial
  CRISPR gRNA sequence
tcctccctactagctggttc

SEQ ID NO: 779644 - DNA, 20 bp, Artificial
  CRISPR gRNA sequence
gttccagatcactcttcacc

SEQ ID NO: 779645 - DNA, 20 bp, Artificial
  CRISPR gRNA sequence
cacattcctctcactcactt

SEQ ID NO: 779646 - DNA, 20 bp, Artificial
  CRISPR gRNA sequence
tctcactcacttgagctgcc

SEQ ID NO: 779647 - DNA, 20 bp, Artificial
  CRISPR gRNA sequence
ctcacttgagctgcccagcc

SEQ ID NO: 779648 - DNA, 20 bp, Artificial
  CRISPR gRNA sequence
ttgagctgcccagcctggtc

SEQ ID NO: 779649 - DNA, 20 bp, Artificial
  CRISPR gRNA sequence
tgcccagcctggtctggcac

SEQ ID NO: 779650 - DNA, 20 bp, Artificial
  CRISPR gRNA sequence
cccagcctggtctggcacta

SEQ ID NO: 779651 - DNA, 20 bp, Artificial
  CRISPR gRNA sequence
tggcactagagacatgcact

SEQ ID NO: 779652 - DNA, 20 bp, Artificial
  CRISPR gRNA sequence
ggcactagagacatgcactt

SEQ ID NO: 779653 - DNA, 20 bp, Artificial
  CRISPR gRNA sequence
gcactagagacatgcacttg

SEQ ID NO: 779654 - DNA, 20 bp, Artificial
  CRISPR gRNA sequence
tgcacttggggccctcctca

SEQ ID NO: 779655 - DNA, 20 bp, Artificial
  CRISPR gRNA sequence
gcacttggggccctcctcaa

SEQ ID NO: 779656 - DNA, 20 bp, Artificial
  CRISPR gRNA sequence
cttggggccctcctcaaagg

SEQ ID NO: 779657 - DNA, 20 bp, Artificial
  CRISPR gRNA sequence
cctcctcaaaggaagaccct

SEQ ID NO: 779658 - DNA, 20 bp, Artificial
  CRISPR gRNA sequence
ttctactctgctcctgcctg

SEQ ID NO: 779659 - DNA, 20 bp, Artificial
  CRISPR gRNA sequence
tctactctgctcctgcctgc

SEQ ID NO: 779660 - DNA, 20 bp, Artificial
  CRISPR gRNA sequence
ctactctgctcctgcctgca

SEQ ID NO: 779661 - DNA, 20 bp, Artificial
  CRISPR gRNA sequence
tctgctcctgcctgcagggc

SEQ ID NO: 779662 - DNA, 20 bp, Artificial
  CRISPR gRNA sequence
cctgcctgcagggccagcta

SEQ ID NO: 779663 - DNA, 20 bp, Artificial
  CRISPR gRNA sequence
ctgcctgcagggccagctaa

SEQ ID NO: 779664 - DNA, 20 bp, Artificial
  CRISPR gRNA sequence
acttttcatgttttctttgc

SEQ ID NO: 779665 - DNA, 20 bp, Artificial
  CRISPR gRNA sequence
cttttcatgttttctttgca

SEQ ID NO: 779666 - DNA, 20 bp, Artificial
  CRISPR gRNA sequence
tctttgcaaggaaccctgcc

SEQ ID NO: 779667 - DNA, 20 bp, Artificial
  CRISPR gRNA sequence
tgcaaggaaccctgcctggc

SEQ ID NO: 779668 - DNA, 20 bp, Artificial
  CRISPR gRNA sequence
accctgcctggctggcattt

SEQ ID NO: 779669 - DNA, 20 bp, Artificial
  CRISPR gRNA sequence
cctgcctggctggcatttta

SEQ ID NO: 779670 - DNA, 20 bp, Artificial
  CRISPR gRNA sequence
ctggctggcattttagagac

SEQ ID NO: 779671 - DNA, 20 bp, Artificial
  CRISPR gRNA sequence
ggcattttagagacaagcaa

SEQ ID NO: 779672 - DNA, 20 bp, Artificial
  CRISPR gRNA sequence
gcattttagagacaagcaaa

SEQ ID NO: 779673 - DNA, 20 bp, Artificial
  CRISPR gRNA sequence
cattttagagacaagcaaaa

SEQ ID NO: 779674 - DNA, 20 bp, Artificial
  CRISPR gRNA sequence
attttagagacaagcaaaag

SEQ ID NO: 779675 - DNA, 20 bp, Artificial
  CRISPR gRNA sequence
ataacttccttgctacaaaa

SEQ ID NO: 779676 - DNA, 20 bp, Artificial
  CRISPR gRNA sequence
ccttgctacaaaacagcttc

SEQ ID NO: 779677 - DNA, 20 bp, Artificial
  CRISPR gRNA sequence
aaaacagcttcaagtttcca

SEQ ID NO: 779678 - DNA, 20 bp, Artificial
  CRISPR gRNA sequence
aacagcttcaagtttccata

SEQ ID NO: 779679 - DNA, 20 bp, Artificial
  CRISPR gRNA sequence
tcaagtttccatagagtgat

SEQ ID NO: 779680 - DNA, 20 bp, Artificial
  CRISPR gRNA sequence
caagtttccatagagtgata

SEQ ID NO: 779681 - DNA, 20 bp, Artificial
  CRISPR gRNA sequence
aagtttccatagagtgataa

SEQ ID NO: 779682 - DNA, 20 bp, Artificial
  CRISPR gRNA sequence
catagagtgataagggaaat

SEQ ID NO: 779683 - DNA, 20 bp, Artificial
  CRISPR gRNA sequence
atagagtgataagggaaatg

SEQ ID NO: 779684 - DNA, 20 bp, Artificial
  CRISPR gRNA sequence
tagagtgataagggaaatga

SEQ ID NO: 779685 - DNA, 20 bp, Artificial
  CRISPR gRNA sequence
ataagggaaatgagggccaa

SEQ ID NO: 779686 - DNA, 20 bp, Artificial
  CRISPR gRNA sequence
agacactgttccccatcctg

SEQ ID NO: 779687 - DNA, 20 bp, Artificial
  CRISPR gRNA sequence
cactgttccccatcctgtgg

SEQ ID NO: 779688 - DNA, 20 bp, Artificial
  CRISPR gRNA sequence
actgttccccatcctgtggc

SEQ ID NO: 779689 - DNA, 20 bp, Artificial
  CRISPR gRNA sequence
tccccatcctgtggcaggac

SEQ ID NO: 779690 - DNA, 20 bp, Artificial
  CRISPR gRNA sequence
ccccatcctgtggcaggact

SEQ ID NO: 779691 - DNA, 20 bp, Artificial
  CRISPR gRNA sequence
cccatcctgtggcaggactg

SEQ ID NO: 779692 - DNA, 20 bp, Artificial
  CRISPR gRNA sequence
ccatcctgtggcaggactgg

SEQ ID NO: 779693 - DNA, 20 bp, Artificial
  CRISPR gRNA sequence
tgtggcaggactgggggctt

SEQ ID NO: 779694 - DNA, 20 bp, Artificial
  CRISPR gRNA sequence
gtggcaggactgggggcttc

SEQ ID NO: 779695 - DNA, 20 bp, Artificial
  CRISPR gRNA sequence
ggcaggactgggggcttcag

SEQ ID NO: 779696 - DNA, 20 bp, Artificial
  CRISPR gRNA sequence
gggggcttcaggagaaaact

SEQ ID NO: 779697 - DNA, 20 bp, Artificial
  CRISPR gRNA sequence
ggggcttcaggagaaaactt

SEQ ID NO: 779698 - DNA, 20 bp, Artificial
  CRISPR gRNA sequence
gggcttcaggagaaaacttg

SEQ ID NO: 779699 - DNA, 20 bp, Artificial
  CRISPR gRNA sequence
tggggaatgtgtaacctctg

SEQ ID NO: 779700 - DNA, 20 bp, Artificial
  CRISPR gRNA sequence
ggggaatgtgtaacctctgt

SEQ ID NO: 779701 - DNA, 20 bp, Artificial
  CRISPR gRNA sequence
gtgtaacctctgtgggtttg

SEQ ID NO: 779702 - DNA, 20 bp, Artificial
  CRISPR gRNA sequence
gtttgtagcttaaaaacact

SEQ ID NO: 779703 - DNA, 20 bp, Artificial
  CRISPR gRNA sequence
gcttaaaaacactgagatcc

SEQ ID NO: 779704 - DNA, 20 bp, Artificial
  CRISPR gRNA sequence
cttaaaaacactgagatcct

SEQ ID NO: 779705 - DNA, 20 bp, Artificial
  CRISPR gRNA sequence
ttgttttttgccttttctct

SEQ ID NO: 779706 - DNA, 20 bp, Artificial
  CRISPR gRNA sequence
tgttttttgccttttctctt

SEQ ID NO: 779707 - DNA, 20 bp, Artificial
  CRISPR gRNA sequence
ttttgccttttctcttagga

SEQ ID NO: 779708 - DNA, 20 bp, Artificial
  CRISPR gRNA sequence
tttgccttttctcttaggaa

SEQ ID NO: 779709 - DNA, 20 bp, Artificial
  CRISPR gRNA sequence
tgccttttctcttaggaaag

SEQ ID NO: 779710 - DNA, 20 bp, Artificial
  CRISPR gRNA sequence
ttttctcttaggaaaggagt

SEQ ID NO: 779711 - DNA, 20 bp, Artificial
  CRISPR gRNA sequence
ctcttaggaaaggagtgagc

SEQ ID NO: 779712 - DNA, 20 bp, Artificial
  CRISPR gRNA sequence
tcttaggaaaggagtgagct

SEQ ID NO: 779713 - DNA, 20 bp, Artificial
  CRISPR gRNA sequence
cttaggaaaggagtgagcta

SEQ ID NO: 779714 - DNA, 20 bp, Artificial
  CRISPR gRNA sequence
aaggagtgagctagggtgac

SEQ ID NO: 779715 - DNA, 20 bp, Artificial
  CRISPR gRNA sequence
aggagtgagctagggtgaca

SEQ ID NO: 779716 - DNA, 20 bp, Artificial
  CRISPR gRNA sequence
ggagtgagctagggtgacaa

SEQ ID NO: 779717 - DNA, 20 bp, Artificial
  CRISPR gRNA sequence
gagtgagctagggtgacaag

SEQ ID NO: 779718 - DNA, 20 bp, Artificial
  CRISPR gRNA sequence
caacattttttatccctcat

SEQ ID NO: 779719 - DNA, 20 bp, Artificial
  CRISPR gRNA sequence
tccctcattggctctttcta

SEQ ID NO: 779720 - DNA, 20 bp, Artificial
  CRISPR gRNA sequence
cctcattggctctttctaca

SEQ ID NO: 779721 - DNA, 20 bp, Artificial
  CRISPR gRNA sequence
ctcattggctctttctacag

SEQ ID NO: 779722 - DNA, 20 bp, Artificial
  CRISPR gRNA sequence
attggctctttctacagagg

SEQ ID NO: 779723 - DNA, 20 bp, Artificial
  CRISPR gRNA sequence
ttggctctttctacagagga

SEQ ID NO: 779724 - DNA, 20 bp, Artificial
  CRISPR gRNA sequence
gaggaaggatcttttcttct

SEQ ID NO: 779725 - DNA, 20 bp, Artificial
  CRISPR gRNA sequence
atcttttcttctaagataat

SEQ ID NO: 779726 - DNA, 20 bp, Artificial
  CRISPR gRNA sequence
tcttctaagataatcagcac

SEQ ID NO: 779727 - DNA, 20 bp, Artificial
  CRISPR gRNA sequence
ataatcagcacaagacaatg

SEQ ID NO: 779728 - DNA, 20 bp, Artificial
  CRISPR gRNA sequence
tcagcacaagacaatgaaga

SEQ ID NO: 779729 - DNA, 20 bp, Artificial
  CRISPR gRNA sequence
cagcacaagacaatgaagat

SEQ ID NO: 779730 - DNA, 20 bp, Artificial
  CRISPR gRNA sequence
aagacaatgaagataggcac

SEQ ID NO: 779731 - DNA, 20 bp, Artificial
  CRISPR gRNA sequence
tgaagataggcactagctcc

SEQ ID NO: 779732 - DNA, 20 bp, Artificial
  CRISPR gRNA sequence
gataggcactagctcccagt

SEQ ID NO: 779733 - DNA, 20 bp, Artificial
  CRISPR gRNA sequence
ataggcactagctcccagtt

SEQ ID NO: 779734 - DNA, 20 bp, Artificial
  CRISPR gRNA sequence
ctcccagttaggtatactaa

SEQ ID NO: 779735 - DNA, 20 bp, Artificial
  CRISPR gRNA sequence
tcccagttaggtatactaat

SEQ ID NO: 779736 - DNA, 20 bp, Artificial
  CRISPR gRNA sequence
cccagttaggtatactaatg

SEQ ID NO: 779737 - DNA, 20 bp, Artificial
  CRISPR gRNA sequence
taggtatactaatggggcaa

SEQ ID NO: 779738 - DNA, 20 bp, Artificial
  CRISPR gRNA sequence
aggtatactaatggggcaaa

SEQ ID NO: 779739 - DNA, 20 bp, Artificial
  CRISPR gRNA sequence
tatactaatggggcaaaagg

SEQ ID NO: 779740 - DNA, 20 bp, Artificial
  CRISPR gRNA sequence
tactaatggggcaaaaggaa

SEQ ID NO: 779741 - DNA, 20 bp, Artificial
  CRISPR gRNA sequence
aagagcatttacatttattg

SEQ ID NO: 779742 - DNA, 20 bp, Artificial
  CRISPR gRNA sequence
attgaagattcactaaatgc

SEQ ID NO: 779743 - DNA, 20 bp, Artificial
  CRISPR gRNA sequence
ctaaatgccagatactgtgc

SEQ ID NO: 779744 - DNA, 20 bp, Artificial
  CRISPR gRNA sequence
taaatgccagatactgtgct

SEQ ID NO: 779745 - DNA, 20 bp, Artificial
  CRISPR gRNA sequence
tgtgctaggcaatttacata

SEQ ID NO: 779746 - DNA, 20 bp, Artificial
  CRISPR gRNA sequence
taggcaatttacatatggta

SEQ ID NO: 779747 - DNA, 20 bp, Artificial
  CRISPR gRNA sequence
tcttcacaatgatcattttg

SEQ ID NO: 779748 - DNA, 20 bp, Artificial
  CRISPR gRNA sequence
cttcacaatgatcattttgc

SEQ ID NO: 779749 - DNA, 20 bp, Artificial
  CRISPR gRNA sequence
acaatgatcattttgcaggt

SEQ ID NO: 779750 - DNA, 20 bp, Artificial
  CRISPR gRNA sequence
caatgatcattttgcaggtg

SEQ ID NO: 779751 - DNA, 20 bp, Artificial
  CRISPR gRNA sequence
aatgatcattttgcaggtga

SEQ ID NO: 779752 - DNA, 20 bp, Artificial
  CRISPR gRNA sequence
cattttgcaggtgagggaac

SEQ ID NO: 779753 - DNA, 20 bp, Artificial
  CRISPR gRNA sequence
caggtgagggaactagaact

SEQ ID NO: 779754 - DNA, 20 bp, Artificial
  CRISPR gRNA sequence
gagggaactagaactcagaa

SEQ ID NO: 779755 - DNA, 20 bp, Artificial
  CRISPR gRNA sequence
agggaactagaactcagaaa

SEQ ID NO: 779756 - DNA, 20 bp, Artificial
  CRISPR gRNA sequence
aaaaggtacttaatttcccc

SEQ ID NO: 779757 - DNA, 20 bp, Artificial
  CRISPR gRNA sequence
ttaatttccccaagattaca

SEQ ID NO: 779758 - DNA, 20 bp, Artificial
  CRISPR gRNA sequence
ccccaagattacatagttat

SEQ ID NO: 779759 - DNA, 20 bp, Artificial
  CRISPR gRNA sequence
cccaagattacatagttatt

SEQ ID NO: 779760 - DNA, 20 bp, Artificial
  CRISPR gRNA sequence
acatagttattaggtgacac

SEQ ID NO: 779761 - DNA, 20 bp, Artificial
  CRISPR gRNA sequence
agttattaggtgacaccggc

SEQ ID NO: 779762 - DNA, 20 bp, Artificial
  CRISPR gRNA sequence
acaccggcaagatttcaaca

SEQ ID NO: 779763 - DNA, 20 bp, Artificial
  CRISPR gRNA sequence
ttactgtgctaccatgatga

SEQ ID NO: 779764 - DNA, 20 bp, Artificial
  CRISPR gRNA sequence
atgatgatggtaatcaaaaa

SEQ ID NO: 779765 - DNA, 20 bp, Artificial
  CRISPR gRNA sequence
atgatggtaatcaaaaatgg

SEQ ID NO: 779766 - DNA, 20 bp, Artificial
  CRISPR gRNA sequence
acccataaatcttccaactt

SEQ ID NO: 779767 - DNA, 20 bp, Artificial
  CRISPR gRNA sequence
taaatcttccaactttggaa

SEQ ID NO: 779768 - DNA, 20 bp, Artificial
  CRISPR gRNA sequence
aaatcttccaactttggaat

SEQ ID NO: 779769 - DNA, 20 bp, Artificial
  CRISPR gRNA sequence
tggaataggtttttgcactg

SEQ ID NO: 779770 - DNA, 20 bp, Artificial
  CRISPR gRNA sequence
tttgcactgaagtctgaata

SEQ ID NO: 779771 - DNA, 20 bp, Artificial
  CRISPR gRNA sequence
tacgtattgaatgtttattc

SEQ ID NO: 779772 - DNA, 20 bp, Artificial
  CRISPR gRNA sequence
atgtttattctggatattca

SEQ ID NO: 779773 - DNA, 20 bp, Artificial
  CRISPR gRNA sequence
tatgttgctgaattaactga

SEQ ID NO: 779774 - DNA, 20 bp, Artificial
  CRISPR gRNA sequence
atgttgctgaattaactgaa

SEQ ID NO: 779775 - DNA, 20 bp, Artificial
  CRISPR gRNA sequence
tgctgaattaactgaaagga

SEQ ID NO: 779776 - DNA, 20 bp, Artificial
  CRISPR gRNA sequence
ctgaaaggaaagtaaaaatg

SEQ ID NO: 779777 - DNA, 20 bp, Artificial
  CRISPR gRNA sequence
tctcattttcttcacgaatt

SEQ ID NO: 779778 - DNA, 20 bp, Artificial
  CRISPR gRNA sequence
cttttctgctttccactatg

SEQ ID NO: 779779 - DNA, 20 bp, Artificial
  CRISPR gRNA sequence
ttccactatgcagataacat

SEQ ID NO: 779780 - DNA, 20 bp, Artificial
  CRISPR gRNA sequence
ctatgcagataacatcagtt

SEQ ID NO: 779781 - DNA, 20 bp, Artificial
  CRISPR gRNA sequence
tattaaatacctacctaaat

SEQ ID NO: 779782 - DNA, 20 bp, Artificial
  CRISPR gRNA sequence
attagaatgccttctcctca

SEQ ID NO: 779783 - DNA, 20 bp, Artificial
  CRISPR gRNA sequence
ttagaatgccttctcctcat

SEQ ID NO: 779784 - DNA, 20 bp, Artificial
  CRISPR gRNA sequence
atttcatgtctctttaatta

SEQ ID NO: 779785 - DNA, 20 bp, Artificial
  CRISPR gRNA sequence
ttcatgtctctttaattaaa

SEQ ID NO: 779786 - DNA, 20 bp, Artificial
  CRISPR gRNA sequence
taattaaagagttttgattt

SEQ ID NO: 779787 - DNA, 20 bp, Artificial
  CRISPR gRNA sequence
attaaagagttttgatttca

SEQ ID NO: 779788 - DNA, 20 bp, Artificial
  CRISPR gRNA sequence
ttaaagagttttgatttcag

SEQ ID NO: 779789 - DNA, 20 bp, Artificial
  CRISPR gRNA sequence
aaagagttttgatttcagag

SEQ ID NO: 779790 - DNA, 20 bp, Artificial
  CRISPR gRNA sequence
aagagttttgatttcagagg

SEQ ID NO: 779791 - DNA, 20 bp, Artificial
  CRISPR gRNA sequence
agagttttgatttcagagga

SEQ ID NO: 779792 - DNA, 20 bp, Artificial
  CRISPR gRNA sequence
tcagaggagggtacctgcaa

SEQ ID NO: 779793 - DNA, 20 bp, Artificial
  CRISPR gRNA sequence
agaaaacaacaaaaaaacta

SEQ ID NO: 779794 - DNA, 20 bp, Artificial
  CRISPR gRNA sequence
gaaaacaacaaaaaaactaa

SEQ ID NO: 779795 - DNA, 20 bp, Artificial
  CRISPR gRNA sequence
acaaaaaaactaaaggatct

SEQ ID NO: 779796 - DNA, 20 bp, Artificial
  CRISPR gRNA sequence
taaaggatctgagaaataat

SEQ ID NO: 779797 - DNA, 20 bp, Artificial
  CRISPR gRNA sequence
aaataattagtgtttacttc

SEQ ID NO: 779798 - DNA, 20 bp, Artificial
  CRISPR gRNA sequence
aataattagtgtttacttct

SEQ ID NO: 779799 - DNA, 20 bp, Artificial
  CRISPR gRNA sequence
ataattagtgtttacttctg

SEQ ID NO: 779800 - DNA, 20 bp, Artificial
  CRISPR gRNA sequence
aattagtgtttacttctggg

SEQ ID NO: 779801 - DNA, 20 bp, Artificial
  CRISPR gRNA sequence
attagtgtttacttctgggg

SEQ ID NO: 779802 - DNA, 20 bp, Artificial
  CRISPR gRNA sequence
ttagtgtttacttctgggga

SEQ ID NO: 779803 - DNA, 20 bp, Artificial
  CRISPR gRNA sequence
tagtgtttacttctggggag

SEQ ID NO: 779804 - DNA, 20 bp, Artificial
  CRISPR gRNA sequence
gtgtttacttctggggaggg

SEQ ID NO: 779805 - DNA, 20 bp, Artificial
  CRISPR gRNA sequence
tgtttacttctggggagggg

SEQ ID NO: 779806 - DNA, 20 bp, Artificial
  CRISPR gRNA sequence
tttacttctggggaggggag

SEQ ID NO: 779807 - DNA, 20 bp, Artificial
  CRISPR gRNA sequence
ttacttctggggaggggagg

SEQ ID NO: 779808 - DNA, 20 bp, Artificial
  CRISPR gRNA sequence
tctggggaggggaggaggtc

SEQ ID NO: 779809 - DNA, 20 bp, Artificial
  CRISPR gRNA sequence
ctggggaggggaggaggtct

SEQ ID NO: 779810 - DNA, 20 bp, Artificial
  CRISPR gRNA sequence
ggaggggaggaggtctggga

SEQ ID NO: 779811 - DNA, 20 bp, Artificial
  CRISPR gRNA sequence
gaggggaggaggtctgggat

SEQ ID NO: 779812 - DNA, 20 bp, Artificial
  CRISPR gRNA sequence
aggggaggaggtctgggatg

SEQ ID NO: 779813 - DNA, 20 bp, Artificial
  CRISPR gRNA sequence
ggggaggaggtctgggatgg

SEQ ID NO: 779814 - DNA, 20 bp, Artificial
  CRISPR gRNA sequence
aggtctgggatgggggtaaa

SEQ ID NO: 779815 - DNA, 20 bp, Artificial
  CRISPR gRNA sequence
ggtctgggatgggggtaaaa

SEQ ID NO: 779816 - DNA, 20 bp, Artificial
  CRISPR gRNA sequence
tgggatgggggtaaaaagga

SEQ ID NO: 779817 - DNA, 20 bp, Artificial
  CRISPR gRNA sequence
tcttatctattatgtatatt

SEQ ID NO: 779818 - DNA, 20 bp, Artificial
  CRISPR gRNA sequence
cttatctattatgtatattc

SEQ ID NO: 779819 - DNA, 20 bp, Artificial
  CRISPR gRNA sequence
ttcaggtttttgttttttac

SEQ ID NO: 779820 - DNA, 20 bp, Artificial
  CRISPR gRNA sequence
aggtttttgttttttacaag

SEQ ID NO: 779821 - DNA, 20 bp, Artificial
  CRISPR gRNA sequence
tttttacaagaagcatgtat

SEQ ID NO: 779822 - DNA, 20 bp, Artificial
  CRISPR gRNA sequence
ttttacaagaagcatgtatt

SEQ ID NO: 779823 - DNA, 20 bp, Artificial
  CRISPR gRNA sequence
aaatataattttaaaaatac

SEQ ID NO: 779824 - DNA, 20 bp, Artificial
  CRISPR gRNA sequence
tttctcatataaaaatatga

SEQ ID NO: 779825 - DNA, 20 bp, Artificial
  CRISPR gRNA sequence
tataaaaatatgaaagtaat

SEQ ID NO: 779826 - DNA, 20 bp, Artificial
  CRISPR gRNA sequence
agtaatcagactgcaacact

SEQ ID NO: 779827 - DNA, 20 bp, Artificial
  CRISPR gRNA sequence
gactgcaacactcagtgcct

SEQ ID NO: 779828 - DNA, 20 bp, Artificial
  CRISPR gRNA sequence
gcaacactcagtgcctgaga

SEQ ID NO: 779829 - DNA, 20 bp, Artificial
  CRISPR gRNA sequence
aacactcagtgcctgagaca

SEQ ID NO: 779830 - DNA, 20 bp, Artificial
  CRISPR gRNA sequence
cagtgcctgagacagagcta

SEQ ID NO: 779831 - DNA, 20 bp, Artificial
  CRISPR gRNA sequence
tgagacagagctacagctat

SEQ ID NO: 779832 - DNA, 20 bp, Artificial
  CRISPR gRNA sequence
gagacagagctacagctatc

SEQ ID NO: 779833 - DNA, 20 bp, Artificial
  CRISPR gRNA sequence
agacagagctacagctatca

SEQ ID NO: 779834 - DNA, 20 bp, Artificial
  CRISPR gRNA sequence
gctacagctatcagggtgtc

SEQ ID NO: 779835 - DNA, 20 bp, Artificial
  CRISPR gRNA sequence
cagctatcagggtgtccaga

SEQ ID NO: 779836 - DNA, 20 bp, Artificial
  CRISPR gRNA sequence
tatcagggtgtccagacaga

SEQ ID NO: 779837 - DNA, 20 bp, Artificial
  CRISPR gRNA sequence
cagggtgtccagacagacag

SEQ ID NO: 779838 - DNA, 20 bp, Artificial
  CRISPR gRNA sequence
tttcttccttgctccttgta

SEQ ID NO: 779839 - DNA, 20 bp, Artificial
  CRISPR gRNA sequence
ccttgctccttgtacagccc

SEQ ID NO: 779840 - DNA, 20 bp, Artificial
  CRISPR gRNA sequence
gacctgcatgcttcattgaa

SEQ ID NO: 779841 - DNA, 20 bp, Artificial
  CRISPR gRNA sequence
gcatgcttcattgaaaagaa

SEQ ID NO: 779842 - DNA, 20 bp, Artificial
  CRISPR gRNA sequence
tgcttcattgaaaagaaaag

SEQ ID NO: 779843 - DNA, 20 bp, Artificial
  CRISPR gRNA sequence
aattaaatcaatgtgatgct

SEQ ID NO: 779844 - DNA, 20 bp, Artificial
  CRISPR gRNA sequence
tgtgatgcttagtaccctat

SEQ ID NO: 779845 - DNA, 20 bp, Artificial
  CRISPR gRNA sequence
taaattttaaaaataacact

SEQ ID NO: 779846 - DNA, 20 bp, Artificial
  CRISPR gRNA sequence
ttttaaaaataacacttggc

SEQ ID NO: 779847 - DNA, 20 bp, Artificial
  CRISPR gRNA sequence
tttaaaaataacacttggcc

SEQ ID NO: 779848 - DNA, 20 bp, Artificial
  CRISPR gRNA sequence
aaataacacttggccaggcg

SEQ ID NO: 779849 - DNA, 20 bp, Artificial
  CRISPR gRNA sequence
taacacttggccaggcgcag

SEQ ID NO: 779850 - DNA, 20 bp, Artificial
  CRISPR gRNA sequence
gtggctcacgcctataatcc

SEQ ID NO: 779851 - DNA, 20 bp, Artificial
  CRISPR gRNA sequence
cgcctataatcccagcccta

SEQ ID NO: 779852 - DNA, 20 bp, Artificial
  CRISPR gRNA sequence
gcctataatcccagccctat

SEQ ID NO: 779853 - DNA, 20 bp, Artificial
  CRISPR gRNA sequence
ctataatcccagccctatgg

SEQ ID NO: 779854 - DNA, 20 bp, Artificial
  CRISPR gRNA sequence
tataatcccagccctatggg

SEQ ID NO: 779855 - DNA, 20 bp, Artificial
  CRISPR gRNA sequence
tcccagccctatgggaggcc

SEQ ID NO: 779856 - DNA, 20 bp, Artificial
  CRISPR gRNA sequence
cccagccctatgggaggccg

SEQ ID NO: 779857 - DNA, 20 bp, Artificial
  CRISPR gRNA sequence
agccctatgggaggccgagg

SEQ ID NO: 779858 - DNA, 20 bp, Artificial
  CRISPR gRNA sequence
gccctatgggaggccgaggc

SEQ ID NO: 779859 - DNA, 20 bp, Artificial
  CRISPR gRNA sequence
ctatgggaggccgaggcggg

SEQ ID NO: 779860 - DNA, 20 bp, Artificial
  CRISPR gRNA sequence
ccgaggcgggtggatcacct

SEQ ID NO: 779861 - DNA, 20 bp, Artificial
  CRISPR gRNA sequence
cgaggcgggtggatcacctc

SEQ ID NO: 779862 - DNA, 20 bp, Artificial
  CRISPR gRNA sequence
gcgggtggatcacctcaggt

SEQ ID NO: 779863 - DNA, 20 bp, Artificial
  CRISPR gRNA sequence
cgggtggatcacctcaggtc

SEQ ID NO: 779864 - DNA, 20 bp, Artificial
  CRISPR gRNA sequence
ggtggatcacctcaggtcag

SEQ ID NO: 779865 - DNA, 20 bp, Artificial
  CRISPR gRNA sequence
tcacctcaggtcaggagttc

SEQ ID NO: 779866 - DNA, 20 bp, Artificial
  CRISPR gRNA sequence
tcaggtcaggagttcgagac

SEQ ID NO: 779867 - DNA, 20 bp, Artificial
  CRISPR gRNA sequence
tcaggagttcgagaccagcc

SEQ ID NO: 779868 - DNA, 20 bp, Artificial
  CRISPR gRNA sequence
cgagaccagcctggccaaca

SEQ ID NO: 779869 - DNA, 20 bp, Artificial
  CRISPR gRNA sequence
aaacccctctgtactaaaaa

SEQ ID NO: 779870 - DNA, 20 bp, Artificial
  CRISPR gRNA sequence
tactaaaaatagaaaaatat

SEQ ID NO: 779871 - DNA, 20 bp, Artificial
  CRISPR gRNA sequence
aaaaatagaaaaatattagc

SEQ ID NO: 779872 - DNA, 20 bp, Artificial
  CRISPR gRNA sequence
aaaatagaaaaatattagcc

SEQ ID NO: 779873 - DNA, 20 bp, Artificial
  CRISPR gRNA sequence
agaaaaatattagccgggca

SEQ ID NO: 779874 - DNA, 20 bp, Artificial
  CRISPR gRNA sequence
aaaatattagccgggcatgg

SEQ ID NO: 779875 - DNA, 20 bp, Artificial
  CRISPR gRNA sequence
atattagccgggcatggtgg

SEQ ID NO: 779876 - DNA, 20 bp, Artificial
  CRISPR gRNA sequence
gtggtggccacctataatcc

SEQ ID NO: 779877 - DNA, 20 bp, Artificial
  CRISPR gRNA sequence
cacctataatccaagctact

SEQ ID NO: 779878 - DNA, 20 bp, Artificial
  CRISPR gRNA sequence
ataatccaagctactcagct

SEQ ID NO: 779879 - DNA, 20 bp, Artificial
  CRISPR gRNA sequence
taatccaagctactcagctg

SEQ ID NO: 779880 - DNA, 20 bp, Artificial
  CRISPR gRNA sequence
tccaagctactcagctgagg

SEQ ID NO: 779881 - DNA, 20 bp, Artificial
  CRISPR gRNA sequence
gcagaaaaattgcttgaacc

SEQ ID NO: 779882 - DNA, 20 bp, Artificial
  CRISPR gRNA sequence
cagaaaaattgcttgaaccc

SEQ ID NO: 779883 - DNA, 20 bp, Artificial
  CRISPR gRNA sequence
gaaaaattgcttgaacccag

SEQ ID NO: 779884 - DNA, 20 bp, Artificial
  CRISPR gRNA sequence
aaaaattgcttgaacccagg

SEQ ID NO: 779885 - DNA, 20 bp, Artificial
  CRISPR gRNA sequence
aattgcttgaacccaggagg

SEQ ID NO: 779886 - DNA, 20 bp, Artificial
  CRISPR gRNA sequence
ttgcttgaacccaggaggca

SEQ ID NO: 779887 - DNA, 20 bp, Artificial
  CRISPR gRNA sequence
tgcttgaacccaggaggcag

SEQ ID NO: 779888 - DNA, 20 bp, Artificial
  CRISPR gRNA sequence
aacccaggaggcagaggttg

SEQ ID NO: 779889 - DNA, 20 bp, Artificial
  CRISPR gRNA sequence
caggaggcagaggttgcagt

SEQ ID NO: 779890 - DNA, 20 bp, Artificial
  CRISPR gRNA sequence
ggcagaggttgcagtgagct

SEQ ID NO: 779891 - DNA, 20 bp, Artificial
  CRISPR gRNA sequence
aagatcatgtcactgtattc

SEQ ID NO: 779892 - DNA, 20 bp, Artificial
  CRISPR gRNA sequence
catgtcactgtattccagcc

SEQ ID NO: 779893 - DNA, 20 bp, Artificial
  CRISPR gRNA sequence
atgtcactgtattccagcct

SEQ ID NO: 779894 - DNA, 20 bp, Artificial
  CRISPR gRNA sequence
ctgtattccagcctgggtga

SEQ ID NO: 779895 - DNA, 20 bp, Artificial
  CRISPR gRNA sequence
gtattccagcctgggtgaca

SEQ ID NO: 779896 - DNA, 20 bp, Artificial
  CRISPR gRNA sequence
tccagcctgggtgacagagt

SEQ ID NO: 779897 - DNA, 20 bp, Artificial
  CRISPR gRNA sequence
tccatttaaaaaaaaaaaaa

SEQ ID NO: 779898 - DNA, 20 bp, Artificial
  CRISPR gRNA sequence
aaaagaaaaaaaaacactta

SEQ ID NO: 779899 - DNA, 20 bp, Artificial
  CRISPR gRNA sequence
agaaaaaaaaacacttatgg

SEQ ID NO: 779900 - DNA, 20 bp, Artificial
  CRISPR gRNA sequence
aacacttatggcggtattct

SEQ ID NO: 779901 - DNA, 20 bp, Artificial
  CRISPR gRNA sequence
taaaaacaatccatatgccc

SEQ ID NO: 779902 - DNA, 20 bp, Artificial
  CRISPR gRNA sequence
aaaacaatccatatgccctg

SEQ ID NO: 779903 - DNA, 20 bp, Artificial
  CRISPR gRNA sequence
tgccctggagaatttgattc

SEQ ID NO: 779904 - DNA, 20 bp, Artificial
  CRISPR gRNA sequence
gccctggagaatttgattcc

SEQ ID NO: 779905 - DNA, 20 bp, Artificial
  CRISPR gRNA sequence
cctggagaatttgattccag

SEQ ID NO: 779906 - DNA, 20 bp, Artificial
  CRISPR gRNA sequence
ggagaatttgattccaggag

SEQ ID NO: 779907 - DNA, 20 bp, Artificial
  CRISPR gRNA sequence
gagaatttgattccaggagt

SEQ ID NO: 779908 - DNA, 20 bp, Artificial
  CRISPR gRNA sequence
tttgattccaggagtaggtc

SEQ ID NO: 779909 - DNA, 20 bp, Artificial
  CRISPR gRNA sequence
gattccaggagtaggtctag

SEQ ID NO: 779910 - DNA, 20 bp, Artificial
  CRISPR gRNA sequence
aggtctagaagaacttcaac

SEQ ID NO: 779911 - DNA, 20 bp, Artificial
  CRISPR gRNA sequence
gtctagaagaacttcaactg

SEQ ID NO: 779912 - DNA, 20 bp, Artificial
  CRISPR gRNA sequence
gaagaacttcaactggagaa

SEQ ID NO: 779913 - DNA, 20 bp, Artificial
  CRISPR gRNA sequence
aacttcaactggagaatgga

SEQ ID NO: 779914 - DNA, 20 bp, Artificial
  CRISPR gRNA sequence
cttcaactggagaatggata

SEQ ID NO: 779915 - DNA, 20 bp, Artificial
  CRISPR gRNA sequence
gagaatggatagagaaatca

SEQ ID NO: 779916 - DNA, 20 bp, Artificial
  CRISPR gRNA sequence
gagaaatcatggtatatttg

SEQ ID NO: 779917 - DNA, 20 bp, Artificial
  CRISPR gRNA sequence
aatatatattatatatataa

SEQ ID NO: 779918 - DNA, 20 bp, Artificial
  CRISPR gRNA sequence
tatattatatatataataga

SEQ ID NO: 779919 - DNA, 20 bp, Artificial
  CRISPR gRNA sequence
tgactacatctattattata

SEQ ID NO: 779920 - DNA, 20 bp, Artificial
  CRISPR gRNA sequence
atctattattatatagcatg

SEQ ID NO: 779921 - DNA, 20 bp, Artificial
  CRISPR gRNA sequence
gtaactacatctatgaatct

SEQ ID NO: 779922 - DNA, 20 bp, Artificial
  CRISPR gRNA sequence
aactacatctatgaatctta

SEQ ID NO: 779923 - DNA, 20 bp, Artificial
  CRISPR gRNA sequence
gaatcttagagcataatatt

SEQ ID NO: 779924 - DNA, 20 bp, Artificial
  CRISPR gRNA sequence
aaaataaataaataaaaatt

SEQ ID NO: 779925 - DNA, 20 bp, Artificial
  CRISPR gRNA sequence
aaataaataaataaaaatta

SEQ ID NO: 779926 - DNA, 20 bp, Artificial
  CRISPR gRNA sequence
aaataaataaaaattaaggc

SEQ ID NO: 779927 - DNA, 20 bp, Artificial
  CRISPR gRNA sequence
taaataaaaattaaggccag

SEQ ID NO: 779928 - DNA, 20 bp, Artificial
  CRISPR gRNA sequence
taaggccagaagataacaca

SEQ ID NO: 779929 - DNA, 20 bp, Artificial
  CRISPR gRNA sequence
cataaataaatatattgctt

SEQ ID NO: 779930 - DNA, 20 bp, Artificial
  CRISPR gRNA sequence
gcttaagcataccttatata

SEQ ID NO: 779931 - DNA, 20 bp, Artificial
  CRISPR gRNA sequence
taagcataccttatatatag

SEQ ID NO: 779932 - DNA, 20 bp, Artificial
  CRISPR gRNA sequence
taccttatatatagaagata

SEQ ID NO: 779933 - DNA, 20 bp, Artificial
  CRISPR gRNA sequence
tatagaagataaagcttaaa

SEQ ID NO: 779934 - DNA, 20 bp, Artificial
  CRISPR gRNA sequence
aagataaagcttaaaaagta

SEQ ID NO: 779935 - DNA, 20 bp, Artificial
  CRISPR gRNA sequence
ataaagcttaaaaagtaaag

SEQ ID NO: 779936 - DNA, 20 bp, Artificial
  CRISPR gRNA sequence
aaagcttaaaaagtaaagaa

SEQ ID NO: 779937 - DNA, 20 bp, Artificial
  CRISPR gRNA sequence
aagcttaaaaagtaaagaag

SEQ ID NO: 779938 - DNA, 20 bp, Artificial
  CRISPR gRNA sequence
ttaaaaagtaaagaagaggc

SEQ ID NO: 779939 - DNA, 20 bp, Artificial
  CRISPR gRNA sequence
taaaaagtaaagaagaggcc

SEQ ID NO: 779940 - DNA, 20 bp, Artificial
  CRISPR gRNA sequence
agtaaagaagaggccgggca

SEQ ID NO: 779941 - DNA, 20 bp, Artificial
  CRISPR gRNA sequence
aaagaagaggccgggcatgg

SEQ ID NO: 779942 - DNA, 20 bp, Artificial
  CRISPR gRNA sequence
gtggctcacgcctgtaatcc

SEQ ID NO: 779943 - DNA, 20 bp, Artificial
  CRISPR gRNA sequence
cgcctgtaatcccagcactt

SEQ ID NO: 779944 - DNA, 20 bp, Artificial
  CRISPR gRNA sequence
gcctgtaatcccagcacttt

SEQ ID NO: 779945 - DNA, 20 bp, Artificial
  CRISPR gRNA sequence
ctgtaatcccagcactttgg

SEQ ID NO: 779946 - DNA, 20 bp, Artificial
  CRISPR gRNA sequence
tgtaatcccagcactttggg

SEQ ID NO: 779947 - DNA, 20 bp, Artificial
  CRISPR gRNA sequence
tcccagcactttgggaggcc

SEQ ID NO: 779948 - DNA, 20 bp, Artificial
  CRISPR gRNA sequence
cccagcactttgggaggcca

SEQ ID NO: 779949 - DNA, 20 bp, Artificial
  CRISPR gRNA sequence
agcactttgggaggccaagg

SEQ ID NO: 779950 - DNA, 20 bp, Artificial
  CRISPR gRNA sequence
gcactttgggaggccaaggt

SEQ ID NO: 779951 - DNA, 20 bp, Artificial
  CRISPR gRNA sequence
ctttgggaggccaaggtggg

SEQ ID NO: 779952 - DNA, 20 bp, Artificial
  CRISPR gRNA sequence
ggccaaggtgggcagatcac

SEQ ID NO: 779953 - DNA, 20 bp, Artificial
  CRISPR gRNA sequence
gccaaggtgggcagatcacg

SEQ ID NO: 779954 - DNA, 20 bp, Artificial
  CRISPR gRNA sequence
aggtgggcagatcacgaggt

SEQ ID NO: 779955 - DNA, 20 bp, Artificial
  CRISPR gRNA sequence
ggtgggcagatcacgaggtc

SEQ ID NO: 779956 - DNA, 20 bp, Artificial
  CRISPR gRNA sequence
tgggcagatcacgaggtcag

SEQ ID NO: 779957 - DNA, 20 bp, Artificial
  CRISPR gRNA sequence
gatcacgaggtcaggagacc

SEQ ID NO: 779958 - DNA, 20 bp, Artificial
  CRISPR gRNA sequence
cgaggtcaggagaccgagac

SEQ ID NO: 779959 - DNA, 20 bp, Artificial
  CRISPR gRNA sequence
tcaggagaccgagaccagcc

SEQ ID NO: 779960 - DNA, 20 bp, Artificial
  CRISPR gRNA sequence
cgagaccagcctggcccgca

SEQ ID NO: 779961 - DNA, 20 bp, Artificial
  CRISPR gRNA sequence
tctacaaaaaatacaaaaat

SEQ ID NO: 779962 - DNA, 20 bp, Artificial
  CRISPR gRNA sequence
caaaaaatacaaaaattagc

SEQ ID NO: 779963 - DNA, 20 bp, Artificial
  CRISPR gRNA sequence
aaaaaatacaaaaattagct

SEQ ID NO: 779964 - DNA, 20 bp, Artificial
  CRISPR gRNA sequence
atacaaaaattagctgggca

SEQ ID NO: 779965 - DNA, 20 bp, Artificial
  CRISPR gRNA sequence
caaaaattagctgggcatgg

SEQ ID NO: 779966 - DNA, 20 bp, Artificial
  CRISPR gRNA sequence
ttagctgggcatggtggcac

SEQ ID NO: 779967 - DNA, 20 bp, Artificial
  CRISPR gRNA sequence
gtggcacaagcctgtaatcc

SEQ ID NO: 779968 - DNA, 20 bp, Artificial
  CRISPR gRNA sequence
agcctgtaatcccagctact

SEQ ID NO: 779969 - DNA, 20 bp, Artificial
  CRISPR gRNA sequence
gcctgtaatcccagctactc

SEQ ID NO: 779970 - DNA, 20 bp, Artificial
  CRISPR gRNA sequence
ctgtaatcccagctactcgg

SEQ ID NO: 779971 - DNA, 20 bp, Artificial
  CRISPR gRNA sequence
tcccagctactcgggagtct

SEQ ID NO: 779972 - DNA, 20 bp, Artificial
  CRISPR gRNA sequence
cccagctactcgggagtctg

SEQ ID NO: 779973 - DNA, 20 bp, Artificial
  CRISPR gRNA sequence
agctactcgggagtctgagg

SEQ ID NO: 779974 - DNA, 20 bp, Artificial
  CRISPR gRNA sequence
gctactcgggagtctgaggc

SEQ ID NO: 779975 - DNA, 20 bp, Artificial
  CRISPR gRNA sequence
tactcgggagtctgaggcag

SEQ ID NO: 779976 - DNA, 20 bp, Artificial
  CRISPR gRNA sequence
ggcaggagaatcgcttgaac

SEQ ID NO: 779977 - DNA, 20 bp, Artificial
  CRISPR gRNA sequence
gcaggagaatcgcttgaacc

SEQ ID NO: 779978 - DNA, 20 bp, Artificial
  CRISPR gRNA sequence
caggagaatcgcttgaacca

SEQ ID NO: 779979 - DNA, 20 bp, Artificial
  CRISPR gRNA sequence
ggagaatcgcttgaaccagg

SEQ ID NO: 779980 - DNA, 20 bp, Artificial
  CRISPR gRNA sequence
aatcgcttgaaccagggagt

SEQ ID NO: 779981 - DNA, 20 bp, Artificial
  CRISPR gRNA sequence
tcgcttgaaccagggagtcg

SEQ ID NO: 779982 - DNA, 20 bp, Artificial
  CRISPR gRNA sequence
cgcttgaaccagggagtcgg

SEQ ID NO: 779983 - DNA, 20 bp, Artificial
  CRISPR gRNA sequence
ttgaaccagggagtcggagg

SEQ ID NO: 779984 - DNA, 20 bp, Artificial
  CRISPR gRNA sequence
aaccagggagtcggaggtgg

SEQ ID NO: 779985 - DNA, 20 bp, Artificial
  CRISPR gRNA sequence
agggagtcggaggtggcggt

SEQ ID NO: 779986 - DNA, 20 bp, Artificial
  CRISPR gRNA sequence
gtcggaggtggcggtgagcc

SEQ ID NO: 779987 - DNA, 20 bp, Artificial
  CRISPR gRNA sequence
aagatcacgccactgcactc

SEQ ID NO: 779988 - DNA, 20 bp, Artificial
  CRISPR gRNA sequence
cacgccactgcactctagcc

SEQ ID NO: 779989 - DNA, 20 bp, Artificial
  CRISPR gRNA sequence
acgccactgcactctagcct

SEQ ID NO: 779990 - DNA, 20 bp, Artificial
  CRISPR gRNA sequence
ctgcactctagcctgggcga

SEQ ID NO: 779991 - DNA, 20 bp, Artificial
  CRISPR gRNA sequence
gcactctagcctgggcgaca

SEQ ID NO: 779992 - DNA, 20 bp, Artificial
  CRISPR gRNA sequence
tctagcctgggcgacagagt

SEQ ID NO: 779993 - DNA, 20 bp, Artificial
  CRISPR gRNA sequence
gtctcaaaaaaaaaaaaaaa

SEQ ID NO: 779994 - DNA, 20 bp, Artificial
  CRISPR gRNA sequence
caaaaaaaaaaaaaaaaagt

SEQ ID NO: 779995 - DNA, 20 bp, Artificial
  CRISPR gRNA sequence
aaaaaaaaaaaaaaaaagta

SEQ ID NO: 779996 - DNA, 20 bp, Artificial
  CRISPR gRNA sequence
aaaaaaaaaaaaaagtaagg

SEQ ID NO: 779997 - DNA, 20 bp, Artificial
  CRISPR gRNA sequence
aaaaaaaaaaaagtaaggaa

SEQ ID NO: 779998 - DNA, 20 bp, Artificial
  CRISPR gRNA sequence
aaagtaaggaagagactgat

SEQ ID NO: 779999 - DNA, 20 bp, Artificial
  CRISPR gRNA sequence
agactgataagcccgatatt

SEQ ID NO: 780000 - DNA, 20 bp, Artificial
  CRISPR gRNA sequence
gactgataagcccgatattc

SEQ ID NO: 780001 - DNA, 20 bp, Artificial
  CRISPR gRNA sequence
aagcccgatattcaggacgc

SEQ ID NO: 780002 - DNA, 20 bp, Artificial
  CRISPR gRNA sequence
ttcaggacgccagttacctc

SEQ ID NO: 780003 - DNA, 20 bp, Artificial
  CRISPR gRNA sequence
gacgccagttacctctggtg

SEQ ID NO: 780004 - DNA, 20 bp, Artificial
  CRISPR gRNA sequence
acgccagttacctctggtgc

SEQ ID NO: 780005 - DNA, 20 bp, Artificial
  CRISPR gRNA sequence
ccagttacctctggtgcagg

SEQ ID NO: 780006 - DNA, 20 bp, Artificial
  CRISPR gRNA sequence
tgcaggcagacatacatcat

SEQ ID NO: 780007 - DNA, 20 bp, Artificial
  CRISPR gRNA sequence
atacatcattagtaatgtgc

SEQ ID NO: 780008 - DNA, 20 bp, Artificial
  CRISPR gRNA sequence
attagtaatgtgctagttct

SEQ ID NO: 780009 - DNA, 20 bp, Artificial
  CRISPR gRNA sequence
ttagtaatgtgctagttctt

SEQ ID NO: 780010 - DNA, 20 bp, Artificial
  CRISPR gRNA sequence
tagtaatgtgctagttctta

SEQ ID NO: 780011 - DNA, 20 bp, Artificial
  CRISPR gRNA sequence
taatgtgctagttcttaggg

SEQ ID NO: 780012 - DNA, 20 bp, Artificial
  CRISPR gRNA sequence
aatgtgctagttcttagggt

SEQ ID NO: 780013 - DNA, 20 bp, Artificial
  CRISPR gRNA sequence
gtgctagttcttagggtagg

SEQ ID NO: 780014 - DNA, 20 bp, Artificial
  CRISPR gRNA sequence
ctagttcttagggtaggtgg

SEQ ID NO: 780015 - DNA, 20 bp, Artificial
  CRISPR gRNA sequence
tagttcttagggtaggtggt

SEQ ID NO: 780016 - DNA, 20 bp, Artificial
  CRISPR gRNA sequence
tagggtaggtggtaggttca

SEQ ID NO: 780017 - DNA, 20 bp, Artificial
  CRISPR gRNA sequence
atattttgaaaatttattta

SEQ ID NO: 780018 - DNA, 20 bp, Artificial
  CRISPR gRNA sequence
ttctgttgtaaaatatatca

SEQ ID NO: 780019 - DNA, 20 bp, Artificial
  CRISPR gRNA sequence
ctgttgtaaaatatatcaca

SEQ ID NO: 780020 - DNA, 20 bp, Artificial
  CRISPR gRNA sequence
aaccacatgaaacaactata

SEQ ID NO: 780021 - DNA, 20 bp, Artificial
  CRISPR gRNA sequence
ataaagcttaacattactat

SEQ ID NO: 780022 - DNA, 20 bp, Artificial
  CRISPR gRNA sequence
taaagcttaacattactata

SEQ ID NO: 780023 - DNA, 20 bp, Artificial
  CRISPR gRNA sequence
ttacttttgtaaccaccacc

SEQ ID NO: 780024 - DNA, 20 bp, Artificial
  CRISPR gRNA sequence
tacttttgtaaccaccaccc

SEQ ID NO: 780025 - DNA, 20 bp, Artificial
  CRISPR gRNA sequence
ttgtaaccaccacccaggtt

SEQ ID NO: 780026 - DNA, 20 bp, Artificial
  CRISPR gRNA sequence
taaccaccacccaggttaag

SEQ ID NO: 780027 - DNA, 20 bp, Artificial
  CRISPR gRNA sequence
caggttaagaagaactttgt

SEQ ID NO: 780028 - DNA, 20 bp, Artificial
  CRISPR gRNA sequence
gaagaactttgtcagctccc

SEQ ID NO: 780029 - DNA, 20 bp, Artificial
  CRISPR gRNA sequence
cagaaatgcttcacataccc

SEQ ID NO: 780030 - DNA, 20 bp, Artificial
  CRISPR gRNA sequence
tcctttgcaaatactcttca

SEQ ID NO: 780031 - DNA, 20 bp, Artificial
  CRISPR gRNA sequence
taaattaaaacaaaactttt

SEQ ID NO: 780032 - DNA, 20 bp, Artificial
  CRISPR gRNA sequence
aattaaaacaaaacttttta

SEQ ID NO: 780033 - DNA, 20 bp, Artificial
  CRISPR gRNA sequence
aaaacaaaactttttagaga

SEQ ID NO: 780034 - DNA, 20 bp, Artificial
  CRISPR gRNA sequence
aaacaaaactttttagagac

SEQ ID NO: 780035 - DNA, 20 bp, Artificial
  CRISPR gRNA sequence
aacaaaactttttagagaca

SEQ ID NO: 780036 - DNA, 20 bp, Artificial
  CRISPR gRNA sequence
tcttcctctgtcatccatgc

SEQ ID NO: 780037 - DNA, 20 bp, Artificial
  CRISPR gRNA sequence
ttcctctgtcatccatgctg

SEQ ID NO: 780038 - DNA, 20 bp, Artificial
  CRISPR gRNA sequence
ctgtcatccatgctggagtg

SEQ ID NO: 780039 - DNA, 20 bp, Artificial
  CRISPR gRNA sequence
tcatccatgctggagtgcag

SEQ ID NO: 780040 - DNA, 20 bp, Artificial
  CRISPR gRNA sequence
ggagtgcagtggcccaacca

SEQ ID NO: 780041 - DNA, 20 bp, Artificial
  CRISPR gRNA sequence
ggcccaaccacagctcactg

SEQ ID NO: 780042 - DNA, 20 bp, Artificial
  CRISPR gRNA sequence
tcactgcagcctccaactcc

SEQ ID NO: 780043 - DNA, 20 bp, Artificial
  CRISPR gRNA sequence
cactgcagcctccaactccc

SEQ ID NO: 780044 - DNA, 20 bp, Artificial
  CRISPR gRNA sequence
agcctccaactcccaggctc

SEQ ID NO: 780045 - DNA, 20 bp, Artificial
  CRISPR gRNA sequence
tccaactcccaggctcaagt

SEQ ID NO: 780046 - DNA, 20 bp, Artificial
  CRISPR gRNA sequence
gtctcctgcctcaatctcct

SEQ ID NO: 780047 - DNA, 20 bp, Artificial
  CRISPR gRNA sequence
tcctgcctcaatctcctgag

SEQ ID NO: 780048 - DNA, 20 bp, Artificial
  CRISPR gRNA sequence
gcctcaatctcctgagtagc

SEQ ID NO: 780049 - DNA, 20 bp, Artificial
  CRISPR gRNA sequence
cctcaatctcctgagtagct

SEQ ID NO: 780050 - DNA, 20 bp, Artificial
  CRISPR gRNA sequence
ctcctgagtagctaggacta

SEQ ID NO: 780051 - DNA, 20 bp, Artificial
  CRISPR gRNA sequence
tcctgagtagctaggactac

SEQ ID NO: 780052 - DNA, 20 bp, Artificial
  CRISPR gRNA sequence
gactacaggcatgtaccacc

SEQ ID NO: 780053 - DNA, 20 bp, Artificial
  CRISPR gRNA sequence
caggcatgtaccacccggtc

SEQ ID NO: 780054 - DNA, 20 bp, Artificial
  CRISPR gRNA sequence
gctaattttttaaacatttt

SEQ ID NO: 780055 - DNA, 20 bp, Artificial
  CRISPR gRNA sequence
tttttaaacatttttagtga

SEQ ID NO: 780056 - DNA, 20 bp, Artificial
  CRISPR gRNA sequence
ttttaaacatttttagtgat

SEQ ID NO: 780057 - DNA, 20 bp, Artificial
  CRISPR gRNA sequence
tttaaacatttttagtgatg

SEQ ID NO: 780058 - DNA, 20 bp, Artificial
  CRISPR gRNA sequence
tggggtcttgctatgttaca

SEQ ID NO: 780059 - DNA, 20 bp, Artificial
  CRISPR gRNA sequence
ggggtcttgctatgttacac

SEQ ID NO: 780060 - DNA, 20 bp, Artificial
  CRISPR gRNA sequence
tcttgctatgttacacaggc

SEQ ID NO: 780061 - DNA, 20 bp, Artificial
  CRISPR gRNA sequence
ggcctcaaacgcctcgtctc

SEQ ID NO: 780062 - DNA, 20 bp, Artificial
  CRISPR gRNA sequence
ctcaagcaatcctcctgccc

SEQ ID NO: 780063 - DNA, 20 bp, Artificial
  CRISPR gRNA sequence
cctcctgccccagcctccca

SEQ ID NO: 780064 - DNA, 20 bp, Artificial
  CRISPR gRNA sequence
ccccagcctcccaaagcact

SEQ ID NO: 780065 - DNA, 20 bp, Artificial
  CRISPR gRNA sequence
ctcccaaagcactgagatca

SEQ ID NO: 780066 - DNA, 20 bp, Artificial
  CRISPR gRNA sequence
tcccaaagcactgagatcac

SEQ ID NO: 780067 - DNA, 20 bp, Artificial
  CRISPR gRNA sequence
agcactgagatcacaggtgt

SEQ ID NO: 780068 - DNA, 20 bp, Artificial
  CRISPR gRNA sequence
caggtgtgagccatcactct

SEQ ID NO: 780069 - DNA, 20 bp, Artificial
  CRISPR gRNA sequence
tgccctttattttttcatga

SEQ ID NO: 780070 - DNA, 20 bp, Artificial
  CRISPR gRNA sequence
tttcatgaaagaaattgctg

SEQ ID NO: 780071 - DNA, 20 bp, Artificial
  CRISPR gRNA sequence
tcatgaaagaaattgctgaa

SEQ ID NO: 780072 - DNA, 20 bp, Artificial
  CRISPR gRNA sequence
catgaaagaaattgctgaag

SEQ ID NO: 780073 - DNA, 20 bp, Artificial
  CRISPR gRNA sequence
aaattgctgaagaggactaa

SEQ ID NO: 780074 - DNA, 20 bp, Artificial
  CRISPR gRNA sequence
ttgctgaagaggactaaaag

SEQ ID NO: 780075 - DNA, 20 bp, Artificial
  CRISPR gRNA sequence
aagaggactaaaagaagttt

SEQ ID NO: 780076 - DNA, 20 bp, Artificial
  CRISPR gRNA sequence
ggactaaaagaagttttagt

SEQ ID NO: 780077 - DNA, 20 bp, Artificial
  CRISPR gRNA sequence
caataaatgtatgttcttta

SEQ ID NO: 780078 - DNA, 20 bp, Artificial
  CRISPR gRNA sequence
gttctttatagtttccaaat

SEQ ID NO: 780079 - DNA, 20 bp, Artificial
  CRISPR gRNA sequence
agtttccaaatcagcaaata

SEQ ID NO: 780080 - DNA, 20 bp, Artificial
  CRISPR gRNA sequence
tatagacatcctgcattttt

SEQ ID NO: 780081 - DNA, 20 bp, Artificial
  CRISPR gRNA sequence
atagacatcctgcattttta

SEQ ID NO: 780082 - DNA, 20 bp, Artificial
  CRISPR gRNA sequence
agacatcctgcatttttaag

SEQ ID NO: 780083 - DNA, 20 bp, Artificial
  CRISPR gRNA sequence
aggagatttatatattttat

SEQ ID NO: 780084 - DNA, 20 bp, Artificial
  CRISPR gRNA sequence
ttatttaaccacttccctgt

SEQ ID NO: 780085 - DNA, 20 bp, Artificial
  CRISPR gRNA sequence
tttaaccacttccctgttgg

SEQ ID NO: 780086 - DNA, 20 bp, Artificial
  CRISPR gRNA sequence
ttatttccattttcttctgc

SEQ ID NO: 780087 - DNA, 20 bp, Artificial
  CRISPR gRNA sequence
aaaaaaatgtgtgcctccta

SEQ ID NO: 780088 - DNA, 20 bp, Artificial
  CRISPR gRNA sequence
cctcctaaagactgtgatga

SEQ ID NO: 780089 - DNA, 20 bp, Artificial
  CRISPR gRNA sequence
ttccttacttgtatgctctt

SEQ ID NO: 780090 - DNA, 20 bp, Artificial
  CRISPR gRNA sequence
actgtgttatctataaaata

SEQ ID NO: 780091 - DNA, 20 bp, Artificial
  CRISPR gRNA sequence
tatctataaaataaagtttg

SEQ ID NO: 780092 - DNA, 20 bp, Artificial
  CRISPR gRNA sequence
taaagtttgaagtgaaaaat

SEQ ID NO: 780093 - DNA, 20 bp, Artificial
  CRISPR gRNA sequence
aaagtttgaagtgaaaaatt

SEQ ID NO: 780094 - DNA, 20 bp, Artificial
  CRISPR gRNA sequence
aagtttgaagtgaaaaatta

SEQ ID NO: 780095 - DNA, 20 bp, Artificial
  CRISPR gRNA sequence
aacattttatatcattttta

SEQ ID NO: 780096 - DNA, 20 bp, Artificial
  CRISPR gRNA sequence
acattttatatcatttttaa

SEQ ID NO: 780097 - DNA, 20 bp, Artificial
  CRISPR gRNA sequence
atttttaaaggatatataca

SEQ ID NO: 780098 - DNA, 20 bp, Artificial
  CRISPR gRNA sequence
catttattctttttttaaaa

SEQ ID NO: 780099 - DNA, 20 bp, Artificial
  CRISPR gRNA sequence
tatgaattttaacaaatgca

SEQ ID NO: 780100 - DNA, 20 bp, Artificial
  CRISPR gRNA sequence
tcctataactaccaccacca

SEQ ID NO: 780101 - DNA, 20 bp, Artificial
  CRISPR gRNA sequence
ccaccaccacagtgaacatc

SEQ ID NO: 780102 - DNA, 20 bp, Artificial
  CRISPR gRNA sequence
caccaccacagtgaacatcc

SEQ ID NO: 780103 - DNA, 20 bp, Artificial
  CRISPR gRNA sequence
accacagtgaacatccagga

SEQ ID NO: 780104 - DNA, 20 bp, Artificial
  CRISPR gRNA sequence
caaacaaacaaacaaacaaa

SEQ ID NO: 780105 - DNA, 20 bp, Artificial
  CRISPR gRNA sequence
acaaacaaaaagcttcaccc

SEQ ID NO: 780106 - DNA, 20 bp, Artificial
  CRISPR gRNA sequence
aaaagcttcacccaagtctt

SEQ ID NO: 780107 - DNA, 20 bp, Artificial
  CRISPR gRNA sequence
cttcacccaagtcttaagtc

SEQ ID NO: 780108 - DNA, 20 bp, Artificial
  CRISPR gRNA sequence
ttcacccaagtcttaagtcc

SEQ ID NO: 780109 - DNA, 20 bp, Artificial
  CRISPR gRNA sequence
tgatctattttctgtcctta

SEQ ID NO: 780110 - DNA, 20 bp, Artificial
  CRISPR gRNA sequence
ccttatagtaatgacttttc

SEQ ID NO: 780111 - DNA, 20 bp, Artificial
  CRISPR gRNA sequence
tttccagaatgtcatataaa

SEQ ID NO: 780112 - DNA, 20 bp, Artificial
  CRISPR gRNA sequence
ttccagaatgtcatataaat

SEQ ID NO: 780113 - DNA, 20 bp, Artificial
  CRISPR gRNA sequence
atataaatgggatcattcat

SEQ ID NO: 780114 - DNA, 20 bp, Artificial
  CRISPR gRNA sequence
attagatatccttttgtatc

SEQ ID NO: 780115 - DNA, 20 bp, Artificial
  CRISPR gRNA sequence
ggcttctttcacttaacata

SEQ ID NO: 780116 - DNA, 20 bp, Artificial
  CRISPR gRNA sequence
atttatacctgtttgctgtt

SEQ ID NO: 780117 - DNA, 20 bp, Artificial
  CRISPR gRNA sequence
gtttgctgttgagtatattc

SEQ ID NO: 780118 - DNA, 20 bp, Artificial
  CRISPR gRNA sequence
ttgtttataaattccccaat

SEQ ID NO: 780119 - DNA, 20 bp, Artificial
  CRISPR gRNA sequence
tgtttataaattccccaatt

SEQ ID NO: 780120 - DNA, 20 bp, Artificial
  CRISPR gRNA sequence
gtttataaattccccaattg

SEQ ID NO: 780121 - DNA, 20 bp, Artificial
  CRISPR gRNA sequence
ttccccaattggggcacatt

SEQ ID NO: 780122 - DNA, 20 bp, Artificial
  CRISPR gRNA sequence
tccccaattggggcacattt

SEQ ID NO: 780123 - DNA, 20 bp, Artificial
  CRISPR gRNA sequence
catttgggtatttcccattt

SEQ ID NO: 780124 - DNA, 20 bp, Artificial
  CRISPR gRNA sequence
atttgggtatttcccatttt

SEQ ID NO: 780125 - DNA, 20 bp, Artificial
  CRISPR gRNA sequence
attttgggtgattacaaata

SEQ ID NO: 780126 - DNA, 20 bp, Artificial
  CRISPR gRNA sequence
ttattataaatatttgcata

SEQ ID NO: 780127 - DNA, 20 bp, Artificial
  CRISPR gRNA sequence
tattataaatatttgcatat

SEQ ID NO: 780128 - DNA, 20 bp, Artificial
  CRISPR gRNA sequence
tatttgcatataggtttttt

SEQ ID NO: 780129 - DNA, 20 bp, Artificial
  CRISPR gRNA sequence
atttgcatataggttttttt

SEQ ID NO: 780130 - DNA, 20 bp, Artificial
  CRISPR gRNA sequence
taggtttttttgggcaaacc

SEQ ID NO: 780131 - DNA, 20 bp, Artificial
  CRISPR gRNA sequence
aggtttttttgggcaaacct

SEQ ID NO: 780132 - DNA, 20 bp, Artificial
  CRISPR gRNA sequence
acctaggttttcatttcact

SEQ ID NO: 780133 - DNA, 20 bp, Artificial
  CRISPR gRNA sequence
atttcacttggataaatacc

SEQ ID NO: 780134 - DNA, 20 bp, Artificial
  CRISPR gRNA sequence
tcacttggataaatacctag

SEQ ID NO: 780135 - DNA, 20 bp, Artificial
  CRISPR gRNA sequence
cttggataaatacctagaag

SEQ ID NO: 780136 - DNA, 20 bp, Artificial
  CRISPR gRNA sequence
ttggataaatacctagaagt

SEQ ID NO: 780137 - DNA, 20 bp, Artificial
  CRISPR gRNA sequence
atacctagaagtgggattgc

SEQ ID NO: 780138 - DNA, 20 bp, Artificial
  CRISPR gRNA sequence
tacctagaagtgggattgct

SEQ ID NO: 780139 - DNA, 20 bp, Artificial
  CRISPR gRNA sequence
agtgggattgctaggtcaca

SEQ ID NO: 780140 - DNA, 20 bp, Artificial
  CRISPR gRNA sequence
ggattgctaggtcacatggt

SEQ ID NO: 780141 - DNA, 20 bp, Artificial
  CRISPR gRNA sequence
taggtcacatggtaagtgta

SEQ ID NO: 780142 - DNA, 20 bp, Artificial
  CRISPR gRNA sequence
gtaagtgtatggtttattgt

SEQ ID NO: 780143 - DNA, 20 bp, Artificial
  CRISPR gRNA sequence
gaaactgccaaacctttcca

SEQ ID NO: 780144 - DNA, 20 bp, Artificial
  CRISPR gRNA sequence
actgccaaacctttccatag

SEQ ID NO: 780145 - DNA, 20 bp, Artificial
  CRISPR gRNA sequence
taccattttttcattcccac

SEQ ID NO: 780146 - DNA, 20 bp, Artificial
  CRISPR gRNA sequence
attttttcattcccaccagc

SEQ ID NO: 780147 - DNA, 20 bp, Artificial
  CRISPR gRNA sequence
attcccaccagcaagtatat

SEQ ID NO: 780148 - DNA, 20 bp, Artificial
  CRISPR gRNA sequence
tcccaccagcaagtatatga

SEQ ID NO: 780149 - DNA, 20 bp, Artificial
  CRISPR gRNA sequence
taattgttcctcatccttcc

SEQ ID NO: 780150 - DNA, 20 bp, Artificial
  CRISPR gRNA sequence
ttcctcatccttcccagcac

SEQ ID NO: 780151 - DNA, 20 bp, Artificial
  CRISPR gRNA sequence
tctattttttcttttttttt

SEQ ID NO: 780152 - DNA, 20 bp, Artificial
  CRISPR gRNA sequence
ttttttctttttttttgaga

SEQ ID NO: 780153 - DNA, 20 bp, Artificial
  CRISPR gRNA sequence
ttttctttttttttgagaca

SEQ ID NO: 780154 - DNA, 20 bp, Artificial
  CRISPR gRNA sequence
cagagtttcgctctgtcacc

SEQ ID NO: 780155 - DNA, 20 bp, Artificial
  CRISPR gRNA sequence
agagtttcgctctgtcaccc

SEQ ID NO: 780156 - DNA, 20 bp, Artificial
  CRISPR gRNA sequence
tcgctctgtcacccaggcta

SEQ ID NO: 780157 - DNA, 20 bp, Artificial
  CRISPR gRNA sequence
aaagtgcaatgccgtgatct

SEQ ID NO: 780158 - DNA, 20 bp, Artificial
  CRISPR gRNA sequence
ttactgcaacctccgcctcc

SEQ ID NO: 780159 - DNA, 20 bp, Artificial
  CRISPR gRNA sequence
tactgcaacctccgcctccc

SEQ ID NO: 780160 - DNA, 20 bp, Artificial
  CRISPR gRNA sequence
caacctccgcctcccgggtt

SEQ ID NO: 780161 - DNA, 20 bp, Artificial
  CRISPR gRNA sequence
aacctccgcctcccgggttc

SEQ ID NO: 780162 - DNA, 20 bp, Artificial
  CRISPR gRNA sequence
ttcaggctattctcctgcct

SEQ ID NO: 780163 - DNA, 20 bp, Artificial
  CRISPR gRNA sequence
ttctcctgcctcagcctccc

SEQ ID NO: 780164 - DNA, 20 bp, Artificial
  CRISPR gRNA sequence
tcctgcctcagcctcccaag

SEQ ID NO: 780165 - DNA, 20 bp, Artificial
  CRISPR gRNA sequence
gcctcagcctcccaagtagc

SEQ ID NO: 780166 - DNA, 20 bp, Artificial
  CRISPR gRNA sequence
cctcagcctcccaagtagct

SEQ ID NO: 780167 - DNA, 20 bp, Artificial
  CRISPR gRNA sequence
ctcccaagtagctgggatta

SEQ ID NO: 780168 - DNA, 20 bp, Artificial
  CRISPR gRNA sequence
tcccaagtagctgggattac

SEQ ID NO: 780169 - DNA, 20 bp, Artificial
  CRISPR gRNA sequence
cttttgttttgtatttttaa

SEQ ID NO: 780170 - DNA, 20 bp, Artificial
  CRISPR gRNA sequence
tttgttttgtatttttaata

SEQ ID NO: 780171 - DNA, 20 bp, Artificial
  CRISPR gRNA sequence
ttttgtatttttaatagaga

SEQ ID NO: 780172 - DNA, 20 bp, Artificial
  CRISPR gRNA sequence
tttgtatttttaatagagac

SEQ ID NO: 780173 - DNA, 20 bp, Artificial
  CRISPR gRNA sequence
ttgtatttttaatagagacg

SEQ ID NO: 780174 - DNA, 20 bp, Artificial
  CRISPR gRNA sequence
cggggttttgccatattgac

SEQ ID NO: 780175 - DNA, 20 bp, Artificial
  CRISPR gRNA sequence
ggggttttgccatattgacc

SEQ ID NO: 780176 - DNA, 20 bp, Artificial
  CRISPR gRNA sequence
ttttgccatattgaccaggc

SEQ ID NO: 780177 - DNA, 20 bp, Artificial
  CRISPR gRNA sequence
tggtcttgaactcctgacct

SEQ ID NO: 780178 - DNA, 20 bp, Artificial
  CRISPR gRNA sequence
ggtcttgaactcctgacctc

SEQ ID NO: 780179 - DNA, 20 bp, Artificial
  CRISPR gRNA sequence
ctcaggtgatccacccacct

SEQ ID NO: 780180 - DNA, 20 bp, Artificial
  CRISPR gRNA sequence
accttggcctcccaaaatgc

SEQ ID NO: 780181 - DNA, 20 bp, Artificial
  CRISPR gRNA sequence
ccttggcctcccaaaatgct

SEQ ID NO: 780182 - DNA, 20 bp, Artificial
  CRISPR gRNA sequence
ctcccaaaatgctgggatta

SEQ ID NO: 780183 - DNA, 20 bp, Artificial
  CRISPR gRNA sequence
tcccaaaatgctgggattac

SEQ ID NO: 780184 - DNA, 20 bp, Artificial
  CRISPR gRNA sequence
aatgctgggattacaggcat

SEQ ID NO: 780185 - DNA, 20 bp, Artificial
  CRISPR gRNA sequence
ccacgccctgctcttttctt

SEQ ID NO: 780186 - DNA, 20 bp, Artificial
  CRISPR gRNA sequence
cttttcttaagtcattctaa

SEQ ID NO: 780187 - DNA, 20 bp, Artificial
  CRISPR gRNA sequence
ttttcttaagtcattctaat

SEQ ID NO: 780188 - DNA, 20 bp, Artificial
  CRISPR gRNA sequence
aagtcattctaataggtgtg

SEQ ID NO: 780189 - DNA, 20 bp, Artificial
  CRISPR gRNA sequence
tcattctaataggtgtgtag

SEQ ID NO: 780190 - DNA, 20 bp, Artificial
  CRISPR gRNA sequence
ttctaataggtgtgtagaag

SEQ ID NO: 780191 - DNA, 20 bp, Artificial
  CRISPR gRNA sequence
tcctaatgactaatgatatt

SEQ ID NO: 780192 - DNA, 20 bp, Artificial
  CRISPR gRNA sequence
acatatttttttcttttttt

SEQ ID NO: 780193 - DNA, 20 bp, Artificial
  CRISPR gRNA sequence
atttttttctttttttgaga

SEQ ID NO: 780194 - DNA, 20 bp, Artificial
  CRISPR gRNA sequence
tttttttctttttttgagac

SEQ ID NO: 780195 - DNA, 20 bp, Artificial
  CRISPR gRNA sequence
ttttttctttttttgagaca

SEQ ID NO: 780196 - DNA, 20 bp, Artificial
  CRISPR gRNA sequence
cagggtatcactctgttgcc

SEQ ID NO: 780197 - DNA, 20 bp, Artificial
  CRISPR gRNA sequence
tatcactctgttgcccagat

SEQ ID NO: 780198 - DNA, 20 bp, Artificial
  CRISPR gRNA sequence
ctgttgcccagattggaata

SEQ ID NO: 780199 - DNA, 20 bp, Artificial
  CRISPR gRNA sequence
ttgcccagattggaatacag

SEQ ID NO: 780200 - DNA, 20 bp, Artificial
  CRISPR gRNA sequence
ggaatacagtggtataatca

SEQ ID NO: 780201 - DNA, 20 bp, Artificial
  CRISPR gRNA sequence
ggtataatcatagctcactg

SEQ ID NO: 780202 - DNA, 20 bp, Artificial
  CRISPR gRNA sequence
tcactgcagcctcgatctct

SEQ ID NO: 780203 - DNA, 20 bp, Artificial
  CRISPR gRNA sequence
cactgcagcctcgatctctc

SEQ ID NO: 780204 - DNA, 20 bp, Artificial
  CRISPR gRNA sequence
agcctcgatctctcaggctc

SEQ ID NO: 780205 - DNA, 20 bp, Artificial
  CRISPR gRNA sequence
ctcaagcgattctcccacct

SEQ ID NO: 780206 - DNA, 20 bp, Artificial
  CRISPR gRNA sequence
ttctcccacctcagactctg

SEQ ID NO: 780207 - DNA, 20 bp, Artificial
  CRISPR gRNA sequence
acctcagactctgtagtaac

SEQ ID NO: 780208 - DNA, 20 bp, Artificial
  CRISPR gRNA sequence
cctcagactctgtagtaact

SEQ ID NO: 780209 - DNA, 20 bp, Artificial
  CRISPR gRNA sequence
ctctgtagtaactgggacta

SEQ ID NO: 780210 - DNA, 20 bp, Artificial
  CRISPR gRNA sequence
tctgtagtaactgggactac

SEQ ID NO: 780211 - DNA, 20 bp, Artificial
  CRISPR gRNA sequence
acaggccatgccaccatgcc

SEQ ID NO: 780212 - DNA, 20 bp, Artificial
  CRISPR gRNA sequence
attttttttttttaattttg

SEQ ID NO: 780213 - DNA, 20 bp, Artificial
  CRISPR gRNA sequence
tttttttaattttgtagaca

SEQ ID NO: 780214 - DNA, 20 bp, Artificial
  CRISPR gRNA sequence
ttttttaattttgtagacat

SEQ ID NO: 780215 - DNA, 20 bp, Artificial
  CRISPR gRNA sequence
tttttaattttgtagacatg

SEQ ID NO: 780216 - DNA, 20 bp, Artificial
  CRISPR gRNA sequence
tggggtctccttgtgtttcc

SEQ ID NO: 780217 - DNA, 20 bp, Artificial
  CRISPR gRNA sequence
ggggtctccttgtgtttccc

SEQ ID NO: 780218 - DNA, 20 bp, Artificial
  CRISPR gRNA sequence
tctccttgtgtttcccaggc

SEQ ID NO: 780219 - DNA, 20 bp, Artificial
  CRISPR gRNA sequence
ccaggccagtctcaaactcc

SEQ ID NO: 780220 - DNA, 20 bp, Artificial
  CRISPR gRNA sequence
agtctcaaactcctggactc

SEQ ID NO: 780221 - DNA, 20 bp, Artificial
  CRISPR gRNA sequence
ctcaagccatcttctcgcct

SEQ ID NO: 780222 - DNA, 20 bp, Artificial
  CRISPR gRNA sequence
gcctcagcctcccaaaatgc

SEQ ID NO: 780223 - DNA, 20 bp, Artificial
  CRISPR gRNA sequence
cctcagcctcccaaaatgct

SEQ ID NO: 780224 - DNA, 20 bp, Artificial
  CRISPR gRNA sequence
ctcccaaaatgctgggatta

SEQ ID NO: 780225 - DNA, 20 bp, Artificial
  CRISPR gRNA sequence
tcccaaaatgctgggattac

SEQ ID NO: 780226 - DNA, 20 bp, Artificial
  CRISPR gRNA sequence
aatgctgggattacaggcat

SEQ ID NO: 780227 - DNA, 20 bp, Artificial
  CRISPR gRNA sequence
caggcataagccactgcacc

SEQ ID NO: 780228 - DNA, 20 bp, Artificial
  CRISPR gRNA sequence
taagccactgcacctggcct

SEQ ID NO: 780229 - DNA, 20 bp, Artificial
  CRISPR gRNA sequence
cactgcacctggccttagtt

SEQ ID NO: 780230 - DNA, 20 bp, Artificial
  CRISPR gRNA sequence
tacttattgtatatcttcat

SEQ ID NO: 780231 - DNA, 20 bp, Artificial
  CRISPR gRNA sequence
atcctttgtaattgtatact

SEQ ID NO: 780232 - DNA, 20 bp, Artificial
  CRISPR gRNA sequence
tcctttgtaattgtatacta

SEQ ID NO: 780233 - DNA, 20 bp, Artificial
  CRISPR gRNA sequence
attgtttattttcttattgt

SEQ ID NO: 780234 - DNA, 20 bp, Artificial
  CRISPR gRNA sequence
ttgtttattttcttattgta

SEQ ID NO: 780235 - DNA, 20 bp, Artificial
  CRISPR gRNA sequence
taaaaattctctattttttt

SEQ ID NO: 780236 - DNA, 20 bp, Artificial
  CRISPR gRNA sequence
ttctctatttttttgagacg

SEQ ID NO: 780237 - DNA, 20 bp, Artificial
  CRISPR gRNA sequence
ttttgagacgcagtctccat

SEQ ID NO: 780238 - DNA, 20 bp, Artificial
  CRISPR gRNA sequence
cgcagtctccatcagtcgcc

SEQ ID NO: 780239 - DNA, 20 bp, Artificial
  CRISPR gRNA sequence
gcagtctccatcagtcgccc

SEQ ID NO: 780240 - DNA, 20 bp, Artificial
  CRISPR gRNA sequence
tctccatcagtcgcccaggc

SEQ ID NO: 780241 - DNA, 20 bp, Artificial
  CRISPR gRNA sequence
tccatcagtcgcccaggctg

SEQ ID NO: 780242 - DNA, 20 bp, Artificial
  CRISPR gRNA sequence
caggctggagttcactgtcg

SEQ ID NO: 780243 - DNA, 20 bp, Artificial
  CRISPR gRNA sequence
ttcactgtcgtggctcacta

SEQ ID NO: 780244 - DNA, 20 bp, Artificial
  CRISPR gRNA sequence
cactacagcctctgcctccc

SEQ ID NO: 780245 - DNA, 20 bp, Artificial
  CRISPR gRNA sequence
agcctctgcctcccaagttt

SEQ ID NO: 780246 - DNA, 20 bp, Artificial
  CRISPR gRNA sequence
cccaagtttaagcgattctc

SEQ ID NO: 780247 - DNA, 20 bp, Artificial
  CRISPR gRNA sequence
tttaagcgattctccagcct

SEQ ID NO: 780248 - DNA, 20 bp, Artificial
  CRISPR gRNA sequence
tccagcctcagcctcttgac

SEQ ID NO: 780249 - DNA, 20 bp, Artificial
  CRISPR gRNA sequence
gcctcagcctcttgactggc

SEQ ID NO: 780250 - DNA, 20 bp, Artificial
  CRISPR gRNA sequence
ctcttgactggctggaatta

SEQ ID NO: 780251 - DNA, 20 bp, Artificial
  CRISPR gRNA sequence
tcttgactggctggaattac

SEQ ID NO: 780252 - DNA, 20 bp, Artificial
  CRISPR gRNA sequence
caggcatgtaccaccatgct

SEQ ID NO: 780253 - DNA, 20 bp, Artificial
  CRISPR gRNA sequence
ttggcttatgtttgtatttt

SEQ ID NO: 780254 - DNA, 20 bp, Artificial
  CRISPR gRNA sequence
gcttatgtttgtattttcag

SEQ ID NO: 780255 - DNA, 20 bp, Artificial
  CRISPR gRNA sequence
ttatgtttgtattttcagta

SEQ ID NO: 780256 - DNA, 20 bp, Artificial
  CRISPR gRNA sequence
gtttgtattttcagtagagt

SEQ ID NO: 780257 - DNA, 20 bp, Artificial
  CRISPR gRNA sequence
tttgtattttcagtagagtc

SEQ ID NO: 780258 - DNA, 20 bp, Artificial
  CRISPR gRNA sequence
ttgtattttcagtagagtcg

SEQ ID NO: 780259 - DNA, 20 bp, Artificial
  CRISPR gRNA sequence
gagtcggggtttcactatgt

SEQ ID NO: 780260 - DNA, 20 bp, Artificial
  CRISPR gRNA sequence
cggggtttcactatgttggc

SEQ ID NO: 780261 - DNA, 20 bp, Artificial
  CRISPR gRNA sequence
ggggtttcactatgttggcc

SEQ ID NO: 780262 - DNA, 20 bp, Artificial
  CRISPR gRNA sequence
tatgttggccaggctgtctc

SEQ ID NO: 780263 - DNA, 20 bp, Artificial
  CRISPR gRNA sequence
tgtctcaagcttctgacctc

SEQ ID NO: 780264 - DNA, 20 bp, Artificial
  CRISPR gRNA sequence
ctcaagcttctgacctcaag

SEQ ID NO: 780265 - DNA, 20 bp, Artificial
  CRISPR gRNA sequence
ctcaagtggcccacccacct

SEQ ID NO: 780266 - DNA, 20 bp, Artificial
  CRISPR gRNA sequence
ccacccaccttggcctccca

SEQ ID NO: 780267 - DNA, 20 bp, Artificial
  CRISPR gRNA sequence
accttggcctcccaaagtgc

SEQ ID NO: 780268 - DNA, 20 bp, Artificial
  CRISPR gRNA sequence
ccttggcctcccaaagtgct

SEQ ID NO: 780269 - DNA, 20 bp, Artificial
  CRISPR gRNA sequence
ctcccaaagtgctgggatta

SEQ ID NO: 780270 - DNA, 20 bp, Artificial
  CRISPR gRNA sequence
tcccaaagtgctgggattac

SEQ ID NO: 780271 - DNA, 20 bp, Artificial
  CRISPR gRNA sequence
agtgctgggattacaggtgt

SEQ ID NO: 780272 - DNA, 20 bp, Artificial
  CRISPR gRNA sequence
tgagccactgccacgacctt

SEQ ID NO: 780273 - DNA, 20 bp, Artificial
  CRISPR gRNA sequence
agccactgccacgaccttaa

SEQ ID NO: 780274 - DNA, 20 bp, Artificial
  CRISPR gRNA sequence
accttaagagttctttattc

SEQ ID NO: 780275 - DNA, 20 bp, Artificial
  CRISPR gRNA sequence
gagttctttattctagatac

SEQ ID NO: 780276 - DNA, 20 bp, Artificial
  CRISPR gRNA sequence
tctagatacaagttctttat

SEQ ID NO: 780277 - DNA, 20 bp, Artificial
  CRISPR gRNA sequence
gattttcaaatattcttttg

SEQ ID NO: 780278 - DNA, 20 bp, Artificial
  CRISPR gRNA sequence
aaatattcttttgaagtctg

SEQ ID NO: 780279 - DNA, 20 bp, Artificial
  CRISPR gRNA sequence
tttcttaactgtgtcttttg

SEQ ID NO: 780280 - DNA, 20 bp, Artificial
  CRISPR gRNA sequence
tcttaactgtgtcttttgca

SEQ ID NO: 780281 - DNA, 20 bp, Artificial
  CRISPR gRNA sequence
actgtgtcttttgcagagca

SEQ ID NO: 780282 - DNA, 20 bp, Artificial
  CRISPR gRNA sequence
caaagattttaattttgatg

SEQ ID NO: 780283 - DNA, 20 bp, Artificial
  CRISPR gRNA sequence
tttatcaatgttttctttta

SEQ ID NO: 780284 - DNA, 20 bp, Artificial
  CRISPR gRNA sequence
tcttttatggatcatgcttt

SEQ ID NO: 780285 - DNA, 20 bp, Artificial
  CRISPR gRNA sequence
aaaaactctttacataaccc

SEQ ID NO: 780286 - DNA, 20 bp, Artificial
  CRISPR gRNA sequence
ttacataacccaagatgtaa

SEQ ID NO: 780287 - DNA, 20 bp, Artificial
  CRISPR gRNA sequence
attttcttctacacattttg

SEQ ID NO: 780288 - DNA, 20 bp, Artificial
  CRISPR gRNA sequence
tagttgtatattctatatgt

SEQ ID NO: 780289 - DNA, 20 bp, Artificial
  CRISPR gRNA sequence
agttgtatattctatatgta

SEQ ID NO: 780290 - DNA, 20 bp, Artificial
  CRISPR gRNA sequence
atccattttaatttttatat

SEQ ID NO: 780291 - DNA, 20 bp, Artificial
  CRISPR gRNA sequence
tccattttaatttttatata

SEQ ID NO: 780292 - DNA, 20 bp, Artificial
  CRISPR gRNA sequence
tttatataaggtgtgatgta

SEQ ID NO: 780293 - DNA, 20 bp, Artificial
  CRISPR gRNA sequence
ttatataaggtgtgatgtat

SEQ ID NO: 780294 - DNA, 20 bp, Artificial
  CRISPR gRNA sequence
taaggtgtgatgtataggtt

SEQ ID NO: 780295 - DNA, 20 bp, Artificial
  CRISPR gRNA sequence
tgtataggttaagctcattt

SEQ ID NO: 780296 - DNA, 20 bp, Artificial
  CRISPR gRNA sequence
gctcattttagttttacatg

SEQ ID NO: 780297 - DNA, 20 bp, Artificial
  CRISPR gRNA sequence
tagttttacatgtagatgtt

SEQ ID NO: 780298 - DNA, 20 bp, Artificial
  CRISPR gRNA sequence
atgtagatgttcagttgttc

SEQ ID NO: 780299 - DNA, 20 bp, Artificial
  CRISPR gRNA sequence
cccatcctttccccattcaa

SEQ ID NO: 780300 - DNA, 20 bp, Artificial
  CRISPR gRNA sequence
gaatcttcatcaaaatcaat

SEQ ID NO: 780301 - DNA, 20 bp, Artificial
  CRISPR gRNA sequence
atcaattagtcatatttatg

SEQ ID NO: 780302 - DNA, 20 bp, Artificial
  CRISPR gRNA sequence
tcaattagtcatatttatgt

SEQ ID NO: 780303 - DNA, 20 bp, Artificial
  CRISPR gRNA sequence
tatttatgtgggtctatttc

SEQ ID NO: 780304 - DNA, 20 bp, Artificial
  CRISPR gRNA sequence
acatttttatttcaaaatct

SEQ ID NO: 780305 - DNA, 20 bp, Artificial
  CRISPR gRNA sequence
catttttatttcaaaatcta

SEQ ID NO: 780306 - DNA, 20 bp, Artificial
  CRISPR gRNA sequence
tctaaggacatcttataacc

SEQ ID NO: 780307 - DNA, 20 bp, Artificial
  CRISPR gRNA sequence
ttttataccttgtcatgtct

SEQ ID NO: 780308 - DNA, 20 bp, Artificial
  CRISPR gRNA sequence
ttataccttgtcatgtctta

SEQ ID NO: 780309 - DNA, 20 bp, Artificial
  CRISPR gRNA sequence
tataccttgtcatgtcttag

SEQ ID NO: 780310 - DNA, 20 bp, Artificial
  CRISPR gRNA sequence
ccttgtcatgtcttagagga

SEQ ID NO: 780311 - DNA, 20 bp, Artificial
  CRISPR gRNA sequence
ttgtcatgtcttagaggaaa

SEQ ID NO: 780312 - DNA, 20 bp, Artificial
  CRISPR gRNA sequence
cttagaggaaagagccaccc

SEQ ID NO: 780313 - DNA, 20 bp, Artificial
  CRISPR gRNA sequence
tttcttctctcttcgtactc

SEQ ID NO: 780314 - DNA, 20 bp, Artificial
  CRISPR gRNA sequence
tcttctctcttcgtactcca

SEQ ID NO: 780315 - DNA, 20 bp, Artificial
  CRISPR gRNA sequence
cttctctcttcgtactccag

SEQ ID NO: 780316 - DNA, 20 bp, Artificial
  CRISPR gRNA sequence
ctctcttcgtactccagagg

SEQ ID NO: 780317 - DNA, 20 bp, Artificial
  CRISPR gRNA sequence
ctccagaggtagatgaaaac

SEQ ID NO: 780318 - DNA, 20 bp, Artificial
  CRISPR gRNA sequence
ccagaggtagatgaaaacca

SEQ ID NO: 780319 - DNA, 20 bp, Artificial
  CRISPR gRNA sequence
cagaggtagatgaaaaccag

SEQ ID NO: 780320 - DNA, 20 bp, Artificial
  CRISPR gRNA sequence
agaggtagatgaaaaccaga

SEQ ID NO: 780321 - DNA, 20 bp, Artificial
  CRISPR gRNA sequence
ccagagggccacaatgacca

SEQ ID NO: 780322 - DNA, 20 bp, Artificial
  CRISPR gRNA sequence
caatgaccatggtgatgcct

SEQ ID NO: 780323 - DNA, 20 bp, Artificial
  CRISPR gRNA sequence
aatgaccatggtgatgcctg

SEQ ID NO: 780324 - DNA, 20 bp, Artificial
  CRISPR gRNA sequence
ggtgatgcctgaggtcattc

SEQ ID NO: 780325 - DNA, 20 bp, Artificial
  CRISPR gRNA sequence
gtgatgcctgaggtcattct

SEQ ID NO: 780326 - DNA, 20 bp, Artificial
  CRISPR gRNA sequence
tgatgcctgaggtcattctg

SEQ ID NO: 780327 - DNA, 20 bp, Artificial
  CRISPR gRNA sequence
cctgaggtcattctggggca

SEQ ID NO: 780328 - DNA, 20 bp, Artificial
  CRISPR gRNA sequence
tcattctggggcacagacct

SEQ ID NO: 780329 - DNA, 20 bp, Artificial
  CRISPR gRNA sequence
ctggggcacagacctcagcc

SEQ ID NO: 780330 - DNA, 20 bp, Artificial
  CRISPR gRNA sequence
tggggcacagacctcagcct

SEQ ID NO: 780331 - DNA, 20 bp, Artificial
  CRISPR gRNA sequence
tactccacttcgcctatctt

SEQ ID NO: 780332 - DNA, 20 bp, Artificial
  CRISPR gRNA sequence
aaactaccctgctgactgct

SEQ ID NO: 780333 - DNA, 20 bp, Artificial
  CRISPR gRNA sequence
gctgactgctgagataaaca

SEQ ID NO: 780334 - DNA, 20 bp, Artificial
  CRISPR gRNA sequence
ctgactgctgagataaacaa

SEQ ID NO: 780335 - DNA, 20 bp, Artificial
  CRISPR gRNA sequence
gactgctgagataaacaaag

SEQ ID NO: 780336 - DNA, 20 bp, Artificial
  CRISPR gRNA sequence
gataaacaaaggagaataat

SEQ ID NO: 780337 - DNA, 20 bp, Artificial
  CRISPR gRNA sequence
ataaacaaaggagaataatc

SEQ ID NO: 780338 - DNA, 20 bp, Artificial
  CRISPR gRNA sequence
acaaaggagaataatcaggt

SEQ ID NO: 780339 - DNA, 20 bp, Artificial
  CRISPR gRNA sequence
caaaggagaataatcaggtt

SEQ ID NO: 780340 - DNA, 20 bp, Artificial
  CRISPR gRNA sequence
aaaggagaataatcaggttg

SEQ ID NO: 780341 - DNA, 20 bp, Artificial
  CRISPR gRNA sequence
gagaataatcaggttgggga

SEQ ID NO: 780342 - DNA, 20 bp, Artificial
  CRISPR gRNA sequence
agaataatcaggttggggaa

SEQ ID NO: 780343 - DNA, 20 bp, Artificial
  CRISPR gRNA sequence
ggggaaaggatttctatgcg

SEQ ID NO: 780344 - DNA, 20 bp, Artificial
  CRISPR gRNA sequence
tgcgaagacatgtctccatg

SEQ ID NO: 780345 - DNA, 20 bp, Artificial
  CRISPR gRNA sequence
ccatgcagtcctcctacact

SEQ ID NO: 780346 - DNA, 20 bp, Artificial
  CRISPR gRNA sequence
tgcagtcctcctacactgag

SEQ ID NO: 780347 - DNA, 20 bp, Artificial
  CRISPR gRNA sequence
cagtcctcctacactgagca

SEQ ID NO: 780348 - DNA, 20 bp, Artificial
  CRISPR gRNA sequence
tcctacactgagcagagcat

SEQ ID NO: 780349 - DNA, 20 bp, Artificial
  CRISPR gRNA sequence
acactgagcagagcatgagt

SEQ ID NO: 780350 - DNA, 20 bp, Artificial
  CRISPR gRNA sequence
cactgagcagagcatgagtc

SEQ ID NO: 780351 - DNA, 20 bp, Artificial
  CRISPR gRNA sequence
cagagcatgagtcaggtgct

SEQ ID NO: 780352 - DNA, 20 bp, Artificial
  CRISPR gRNA sequence
gagcatgagtcaggtgctta

SEQ ID NO: 780353 - DNA, 20 bp, Artificial
  CRISPR gRNA sequence
catgagtcaggtgcttagag

SEQ ID NO: 780354 - DNA, 20 bp, Artificial
  CRISPR gRNA sequence
atgagtcaggtgcttagagc

SEQ ID NO: 780355 - DNA, 20 bp, Artificial
  CRISPR gRNA sequence
agcaggattttgtcctaaac

SEQ ID NO: 780356 - DNA, 20 bp, Artificial
  CRISPR gRNA sequence
gcaggattttgtcctaaacc

SEQ ID NO: 780357 - DNA, 20 bp, Artificial
  CRISPR gRNA sequence
ttgtcctaaaccaggaactt

SEQ ID NO: 780358 - DNA, 20 bp, Artificial
  CRISPR gRNA sequence
gtcctaaaccaggaacttca

SEQ ID NO: 780359 - DNA, 20 bp, Artificial
  CRISPR gRNA sequence
aggaacttcagagttttctg

SEQ ID NO: 780360 - DNA, 20 bp, Artificial
  CRISPR gRNA sequence
tcagagttttctgaagaatg

SEQ ID NO: 780361 - DNA, 20 bp, Artificial
  CRISPR gRNA sequence
ctgaagaatgtggctatgta

SEQ ID NO: 780362 - DNA, 20 bp, Artificial
  CRISPR gRNA sequence
ccaccccacccttacttctc

SEQ ID NO: 780363 - DNA, 20 bp, Artificial
  CRISPR gRNA sequence
tacttctcaagtacattacg

SEQ ID NO: 780364 - DNA, 20 bp, Artificial
  CRISPR gRNA sequence
tctcaagtacattacgtggc

SEQ ID NO: 780365 - DNA, 20 bp, Artificial
  CRISPR gRNA sequence
tacacttctgttgttaaatg

SEQ ID NO: 780366 - DNA, 20 bp, Artificial
  CRISPR gRNA sequence
acacttctgttgttaaatgt

SEQ ID NO: 780367 - DNA, 20 bp, Artificial
  CRISPR gRNA sequence
cacttctgttgttaaatgtg

SEQ ID NO: 780368 - DNA, 20 bp, Artificial
  CRISPR gRNA sequence
acttctgttgttaaatgtgg

SEQ ID NO: 780369 - DNA, 20 bp, Artificial
  CRISPR gRNA sequence
tgggggataaaatataaact

SEQ ID NO: 780370 - DNA, 20 bp, Artificial
  CRISPR gRNA sequence
taaaatataaacttagtttc

SEQ ID NO: 780371 - DNA, 20 bp, Artificial
  CRISPR gRNA sequence
aaatataaacttagtttcaa

SEQ ID NO: 780372 - DNA, 20 bp, Artificial
  CRISPR gRNA sequence
aatataaacttagtttcaag

SEQ ID NO: 780373 - DNA, 20 bp, Artificial
  CRISPR gRNA sequence
ataaacttagtttcaagagg

SEQ ID NO: 780374 - DNA, 20 bp, Artificial
  CRISPR gRNA sequence
gtttcaagaggaagctatct

SEQ ID NO: 780375 - DNA, 20 bp, Artificial
  CRISPR gRNA sequence
tttcaagaggaagctatctt

SEQ ID NO: 780376 - DNA, 20 bp, Artificial
  CRISPR gRNA sequence
tcaagaggaagctatcttgg

SEQ ID NO: 780377 - DNA, 20 bp, Artificial
  CRISPR gRNA sequence
caagaggaagctatcttggg

SEQ ID NO: 780378 - DNA, 20 bp, Artificial
  CRISPR gRNA sequence
tcgttgtgtgtttcctgaat

SEQ ID NO: 780379 - DNA, 20 bp, Artificial
  CRISPR gRNA sequence
tgtgtttcctgaataagtga

SEQ ID NO: 780380 - DNA, 20 bp, Artificial
  CRISPR gRNA sequence
gtgtttcctgaataagtgac

SEQ ID NO: 780381 - DNA, 20 bp, Artificial
  CRISPR gRNA sequence
cttcattgcaataaaatgca

SEQ ID NO: 780382 - DNA, 20 bp, Artificial
  CRISPR gRNA sequence
ataaaatgcaaagctccccc

SEQ ID NO: 780383 - DNA, 20 bp, Artificial
  CRISPR gRNA sequence
aagaatttttgaaatgcatc

SEQ ID NO: 780384 - DNA, 20 bp, Artificial
  CRISPR gRNA sequence
atttttgaaatgcatcaagc

SEQ ID NO: 780385 - DNA, 20 bp, Artificial
  CRISPR gRNA sequence
tttttgaaatgcatcaagct

SEQ ID NO: 780386 - DNA, 20 bp, Artificial
  CRISPR gRNA sequence
tcaagctaggtgttctaatc

SEQ ID NO: 780387 - DNA, 20 bp, Artificial
  CRISPR gRNA sequence
taggtgttctaatctagcaa

SEQ ID NO: 780388 - DNA, 20 bp, Artificial
  CRISPR gRNA sequence
aggtgttctaatctagcaaa

SEQ ID NO: 780389 - DNA, 20 bp, Artificial
  CRISPR gRNA sequence
gaatttttcatgcttttgcc

SEQ ID NO: 780390 - DNA, 20 bp, Artificial
  CRISPR gRNA sequence
ttgccaagtcttttgccctt

SEQ ID NO: 780391 - DNA, 20 bp, Artificial
  CRISPR gRNA sequence
aagtcttttgccctttagtt

SEQ ID NO: 780392 - DNA, 20 bp, Artificial
  CRISPR gRNA sequence
ttttgccctttagtttagtt

SEQ ID NO: 780393 - DNA, 20 bp, Artificial
  CRISPR gRNA sequence
tttgccctttagtttagtta

SEQ ID NO: 780394 - DNA, 20 bp, Artificial
  CRISPR gRNA sequence
ttgccctttagtttagttaa

SEQ ID NO: 780395 - DNA, 20 bp, Artificial
  CRISPR gRNA sequence
agttaagggccccacatgaa

SEQ ID NO: 780396 - DNA, 20 bp, Artificial
  CRISPR gRNA sequence
aagggccccacatgaatgga

SEQ ID NO: 780397 - DNA, 20 bp, Artificial
  CRISPR gRNA sequence
gaatggaaagcctgtgttgt

SEQ ID NO: 780398 - DNA, 20 bp, Artificial
  CRISPR gRNA sequence
gtgttgtcagcttaattttg

SEQ ID NO: 780399 - DNA, 20 bp, Artificial
  CRISPR gRNA sequence
tcagcttaattttgtagttg

SEQ ID NO: 780400 - DNA, 20 bp, Artificial
  CRISPR gRNA sequence
ttgtagttgtggaaaccttc

SEQ ID NO: 780401 - DNA, 20 bp, Artificial
  CRISPR gRNA sequence
tctcctttgtctaatacctt

SEQ ID NO: 780402 - DNA, 20 bp, Artificial
  CRISPR gRNA sequence
ctcctttgtctaataccttc

SEQ ID NO: 780403 - DNA, 20 bp, Artificial
  CRISPR gRNA sequence
cctttgtctaataccttcag

SEQ ID NO: 780404 - DNA, 20 bp, Artificial
  CRISPR gRNA sequence
taccttcaggagttcaatcc

SEQ ID NO: 780405 - DNA, 20 bp, Artificial
  CRISPR gRNA sequence
accttcaggagttcaatcct

SEQ ID NO: 780406 - DNA, 20 bp, Artificial
  CRISPR gRNA sequence
aggagttcaatcctaggttg

SEQ ID NO: 780407 - DNA, 20 bp, Artificial
  CRISPR gRNA sequence
agcttaatttaataaccatg

SEQ ID NO: 780408 - DNA, 20 bp, Artificial
  CRISPR gRNA sequence
taataaccatgtggcatgta

SEQ ID NO: 780409 - DNA, 20 bp, Artificial
  CRISPR gRNA sequence
taaccatgtggcatgtaaag

SEQ ID NO: 780410 - DNA, 20 bp, Artificial
  CRISPR gRNA sequence
aaaacaaaacatcttttcct

SEQ ID NO: 780411 - DNA, 20 bp, Artificial
  CRISPR gRNA sequence
aacatcttttccttagcata

SEQ ID NO: 780412 - DNA, 20 bp, Artificial
  CRISPR gRNA sequence
aaaaaaaaaaaactcactca

SEQ ID NO: 780413 - DNA, 20 bp, Artificial
  CRISPR gRNA sequence
aaaaaactcactcatggatg

SEQ ID NO: 780414 - DNA, 20 bp, Artificial
  CRISPR gRNA sequence
tggatgtagtgtacacatgc

SEQ ID NO: 780415 - DNA, 20 bp, Artificial
  CRISPR gRNA sequence
atgtagtgtacacatgccag

SEQ ID NO: 780416 - DNA, 20 bp, Artificial
  CRISPR gRNA sequence
tacacatgccagtggatata

SEQ ID NO: 780417 - DNA, 20 bp, Artificial
  CRISPR gRNA sequence
tggatatatagtcataactg

SEQ ID NO: 780418 - DNA, 20 bp, Artificial
  CRISPR gRNA sequence
atagtcataactgcagtcat

SEQ ID NO: 780419 - DNA, 20 bp, Artificial
  CRISPR gRNA sequence
gtcataactgcagtcattgg

SEQ ID NO: 780420 - DNA, 20 bp, Artificial
  CRISPR gRNA sequence
aactgcagtcattggtagca

SEQ ID NO: 780421 - DNA, 20 bp, Artificial
  CRISPR gRNA sequence
acagaaataaatgtgcattg

SEQ ID NO: 780422 - DNA, 20 bp, Artificial
  CRISPR gRNA sequence
ataaatgtgcattgaagaca

SEQ ID NO: 780423 - DNA, 20 bp, Artificial
  CRISPR gRNA sequence
aaatgtgcattgaagacaca

SEQ ID NO: 780424 - DNA, 20 bp, Artificial
  CRISPR gRNA sequence
acagagatgaatttgaattc

SEQ ID NO: 780425 - DNA, 20 bp, Artificial
  CRISPR gRNA sequence
aatttgaattccggttccat

SEQ ID NO: 780426 - DNA, 20 bp, Artificial
  CRISPR gRNA sequence
gagctaccattctttgacct

SEQ ID NO: 780427 - DNA, 20 bp, Artificial
  CRISPR gRNA sequence
agctaccattctttgacctt

SEQ ID NO: 780428 - DNA, 20 bp, Artificial
  CRISPR gRNA sequence
accattctttgaccttgggc

SEQ ID NO: 780429 - DNA, 20 bp, Artificial
  CRISPR gRNA sequence
gcaagttgcatcacttcttt

SEQ ID NO: 780430 - DNA, 20 bp, Artificial
  CRISPR gRNA sequence
tgcatcacttctttgagcct

SEQ ID NO: 780431 - DNA, 20 bp, Artificial
  CRISPR gRNA sequence
gtttccccatctgtaaaatg

SEQ ID NO: 780432 - DNA, 20 bp, Artificial
  CRISPR gRNA sequence
ccccatctgtaaaatgtgga

SEQ ID NO: 780433 - DNA, 20 bp, Artificial
  CRISPR gRNA sequence
ggatagcaacatctacctcg

SEQ ID NO: 780434 - DNA, 20 bp, Artificial
  CRISPR gRNA sequence
atagcaacatctacctcgca

SEQ ID NO: 780435 - DNA, 20 bp, Artificial
  CRISPR gRNA sequence
catctacctcgcagagttgc

SEQ ID NO: 780436 - DNA, 20 bp, Artificial
  CRISPR gRNA sequence
atctacctcgcagagttgct

SEQ ID NO: 780437 - DNA, 20 bp, Artificial
  CRISPR gRNA sequence
ctacctcgcagagttgctgg

SEQ ID NO: 780438 - DNA, 20 bp, Artificial
  CRISPR gRNA sequence
tacctcgcagagttgctggg

SEQ ID NO: 780439 - DNA, 20 bp, Artificial
  CRISPR gRNA sequence
cgcagagttgctgggaggat

SEQ ID NO: 780440 - DNA, 20 bp, Artificial
  CRISPR gRNA sequence
gggaggatcagatgaaatga

SEQ ID NO: 780441 - DNA, 20 bp, Artificial
  CRISPR gRNA sequence
ggaggatcagatgaaatgat

SEQ ID NO: 780442 - DNA, 20 bp, Artificial
  CRISPR gRNA sequence
gatcagatgaaatgatgggc

SEQ ID NO: 780443 - DNA, 20 bp, Artificial
  CRISPR gRNA sequence
gatgaaatgatgggctagcc

SEQ ID NO: 780444 - DNA, 20 bp, Artificial
  CRISPR gRNA sequence
gtgtctgacttactgtgttt

SEQ ID NO: 780445 - DNA, 20 bp, Artificial
  CRISPR gRNA sequence
tcaactattacgctacttcc

SEQ ID NO: 780446 - DNA, 20 bp, Artificial
  CRISPR gRNA sequence
attacgctacttcccagtga

SEQ ID NO: 780447 - DNA, 20 bp, Artificial
  CRISPR gRNA sequence
tcccagtgacagtccaaatg

SEQ ID NO: 780448 - DNA, 20 bp, Artificial
  CRISPR gRNA sequence
gtgacagtccaaatgcagac

SEQ ID NO: 780449 - DNA, 20 bp, Artificial
  CRISPR gRNA sequence
accgtgaccttcttaaaatg

SEQ ID NO: 780450 - DNA, 20 bp, Artificial
  CRISPR gRNA sequence
aaatgcagatcctgattccc

SEQ ID NO: 780451 - DNA, 20 bp, Artificial
  CRISPR gRNA sequence
aatgcagatcctgattccct

SEQ ID NO: 780452 - DNA, 20 bp, Artificial
  CRISPR gRNA sequence
agatcctgattccctaggtc

SEQ ID NO: 780453 - DNA, 20 bp, Artificial
  CRISPR gRNA sequence
gatcctgattccctaggtct

SEQ ID NO: 780454 - DNA, 20 bp, Artificial
  CRISPR gRNA sequence
atcctgattccctaggtctg

SEQ ID NO: 780455 - DNA, 20 bp, Artificial
  CRISPR gRNA sequence
ctgattccctaggtctgggg

SEQ ID NO: 780456 - DNA, 20 bp, Artificial
  CRISPR gRNA sequence
tgattccctaggtctgggga

SEQ ID NO: 780457 - DNA, 20 bp, Artificial
  CRISPR gRNA sequence
tgaaattctacatttctacc

SEQ ID NO: 780458 - DNA, 20 bp, Artificial
  CRISPR gRNA sequence
ctacatttctacctagcttc

SEQ ID NO: 780459 - DNA, 20 bp, Artificial
  CRISPR gRNA sequence
tacatttctacctagcttcc

SEQ ID NO: 780460 - DNA, 20 bp, Artificial
  CRISPR gRNA sequence
ttctacctagcttccaggtg

SEQ ID NO: 780461 - DNA, 20 bp, Artificial
  CRISPR gRNA sequence
cctagcttccaggtgaagtt

SEQ ID NO: 780462 - DNA, 20 bp, Artificial
  CRISPR gRNA sequence
ctagcttccaggtgaagttg

SEQ ID NO: 780463 - DNA, 20 bp, Artificial
  CRISPR gRNA sequence
aagttgaggacaacactttg

SEQ ID NO: 780464 - DNA, 20 bp, Artificial
  CRISPR gRNA sequence
agttgaggacaacactttga

SEQ ID NO: 780465 - DNA, 20 bp, Artificial
  CRISPR gRNA sequence
gaggacaacactttgaaggc

SEQ ID NO: 780466 - DNA, 20 bp, Artificial
  CRISPR gRNA sequence
aggacaacactttgaaggca

SEQ ID NO: 780467 - DNA, 20 bp, Artificial
  CRISPR gRNA sequence
acaacactttgaaggcaagg

SEQ ID NO: 780468 - DNA, 20 bp, Artificial
  CRISPR gRNA sequence
ctttgaaggcaaggtggtaa

SEQ ID NO: 780469 - DNA, 20 bp, Artificial
  CRISPR gRNA sequence
atgttactttgtgtaactaa

SEQ ID NO: 780470 - DNA, 20 bp, Artificial
  CRISPR gRNA sequence
tcgcaatactgtctgcactt

SEQ ID NO: 780471 - DNA, 20 bp, Artificial
  CRISPR gRNA sequence
caatactgtctgcactttag

SEQ ID NO: 780472 - DNA, 20 bp, Artificial
  CRISPR gRNA sequence
gtctgcactttagaagctcc

SEQ ID NO: 780473 - DNA, 20 bp, Artificial
  CRISPR gRNA sequence
tctgcactttagaagctccc

SEQ ID NO: 780474 - DNA, 20 bp, Artificial
  CRISPR gRNA sequence
actttagaagctcccaggaa

SEQ ID NO: 780475 - DNA, 20 bp, Artificial
  CRISPR gRNA sequence
ccaaaataatgtaattttaa

SEQ ID NO: 780476 - DNA, 20 bp, Artificial
  CRISPR gRNA sequence
atgtaattttaacagatcca

SEQ ID NO: 780477 - DNA, 20 bp, Artificial
  CRISPR gRNA sequence
taattttaacagatccaaag

SEQ ID NO: 780478 - DNA, 20 bp, Artificial
  CRISPR gRNA sequence
aacagatccaaagtagtgcc

SEQ ID NO: 780479 - DNA, 20 bp, Artificial
  CRISPR gRNA sequence
acagatccaaagtagtgcct

SEQ ID NO: 780480 - DNA, 20 bp, Artificial
  CRISPR gRNA sequence
ccaaagtagtgcctgggcat

SEQ ID NO: 780481 - DNA, 20 bp, Artificial
  CRISPR gRNA sequence
tgggcattagtgtgttttaa

SEQ ID NO: 780482 - DNA, 20 bp, Artificial
  CRISPR gRNA sequence
agtgtgttttaaaagcctcc

SEQ ID NO: 780483 - DNA, 20 bp, Artificial
  CRISPR gRNA sequence
gtgtgttttaaaagcctccc

SEQ ID NO: 780484 - DNA, 20 bp, Artificial
  CRISPR gRNA sequence
ctcccaggtgattccaatgt

SEQ ID NO: 780485 - DNA, 20 bp, Artificial
  CRISPR gRNA sequence
aggtgattccaatgttagcc

SEQ ID NO: 780486 - DNA, 20 bp, Artificial
  CRISPR gRNA sequence
ttccaatgttagccaagatt

SEQ ID NO: 780487 - DNA, 20 bp, Artificial
  CRISPR gRNA sequence
tccaatgttagccaagattg

SEQ ID NO: 780488 - DNA, 20 bp, Artificial
  CRISPR gRNA sequence
caagattgaggccctctgct

SEQ ID NO: 780489 - DNA, 20 bp, Artificial
  CRISPR gRNA sequence
tgcttagtgaatctaatttg

SEQ ID NO: 780490 - DNA, 20 bp, Artificial
  CRISPR gRNA sequence
tagtgaatctaatttgcagc

SEQ ID NO: 780491 - DNA, 20 bp, Artificial
  CRISPR gRNA sequence
agtgaatctaatttgcagct

SEQ ID NO: 780492 - DNA, 20 bp, Artificial
  CRISPR gRNA sequence
tctaatttgcagctgggctt

SEQ ID NO: 780493 - DNA, 20 bp, Artificial
  CRISPR gRNA sequence
cttgagaaaaaacctcttca

SEQ ID NO: 780494 - DNA, 20 bp, Artificial
  CRISPR gRNA sequence
cttcatagaattgtttgcat

SEQ ID NO: 780495 - DNA, 20 bp, Artificial
  CRISPR gRNA sequence
ttgcctctgtaacttacaat

SEQ ID NO: 780496 - DNA, 20 bp, Artificial
  CRISPR gRNA sequence
ctctgtaacttacaataagc

SEQ ID NO: 780497 - DNA, 20 bp, Artificial
  CRISPR gRNA sequence
tacaataagcaagaatgttt

SEQ ID NO: 780498 - DNA, 20 bp, Artificial
  CRISPR gRNA sequence
acaataagcaagaatgtttc

SEQ ID NO: 780499 - DNA, 20 bp, Artificial
  CRISPR gRNA sequence
cctaaacctcttattttgta

SEQ ID NO: 780500 - DNA, 20 bp, Artificial
  CRISPR gRNA sequence
taaacctcttattttgtatg

SEQ ID NO: 780501 - DNA, 20 bp, Artificial
  CRISPR gRNA sequence
ttattttgtatggagtaatc

SEQ ID NO: 780502 - DNA, 20 bp, Artificial
  CRISPR gRNA sequence
gtatggagtaatcaagctca

SEQ ID NO: 780503 - DNA, 20 bp, Artificial
  CRISPR gRNA sequence
agctcaaagtttgcatgtct

SEQ ID NO: 780504 - DNA, 20 bp, Artificial
  CRISPR gRNA sequence
catgtcttagaaactttact

SEQ ID NO: 780505 - DNA, 20 bp, Artificial
  CRISPR gRNA sequence
atgtcttagaaactttactt

SEQ ID NO: 780506 - DNA, 20 bp, Artificial
  CRISPR gRNA sequence
tgtcttagaaactttacttg

SEQ ID NO: 780507 - DNA, 20 bp, Artificial
  CRISPR gRNA sequence
aactttacttggggcaaaat

SEQ ID NO: 780508 - DNA, 20 bp, Artificial
  CRISPR gRNA sequence
acttggggcaaaattagacc

SEQ ID NO: 780509 - DNA, 20 bp, Artificial
  CRISPR gRNA sequence
ccaagtaacaattaatcttc

SEQ ID NO: 780510 - DNA, 20 bp, Artificial
  CRISPR gRNA sequence
caagtaacaattaatcttct

SEQ ID NO: 780511 - DNA, 20 bp, Artificial
  CRISPR gRNA sequence
attaatcttctaggtattct

SEQ ID NO: 780512 - DNA, 20 bp, Artificial
  CRISPR gRNA sequence
tctaggtattctgagctatt

SEQ ID NO: 780513 - DNA, 20 bp, Artificial
  CRISPR gRNA sequence
ctcttttctcttgtaaatat

SEQ ID NO: 780514 - DNA, 20 bp, Artificial
  CRISPR gRNA sequence
aaaaatgtcacctgtctgac

SEQ ID NO: 780515 - DNA, 20 bp, Artificial
  CRISPR gRNA sequence
aatgtcacctgtctgacaag

SEQ ID NO: 780516 - DNA, 20 bp, Artificial
  CRISPR gRNA sequence
tattttatgcctatcactcc

SEQ ID NO: 780517 - DNA, 20 bp, Artificial
  CRISPR gRNA sequence
ctcctggcacgcattcttac

SEQ ID NO: 780518 - DNA, 20 bp, Artificial
  CRISPR gRNA sequence
tcctggcacgcattcttaca

SEQ ID NO: 780519 - DNA, 20 bp, Artificial
  CRISPR gRNA sequence
tggcacgcattcttacaagg

SEQ ID NO: 780520 - DNA, 20 bp, Artificial
  CRISPR gRNA sequence
acgcattcttacaaggcaga

SEQ ID NO: 780521 - DNA, 20 bp, Artificial
  CRISPR gRNA sequence
cgcattcttacaaggcagac

SEQ ID NO: 780522 - DNA, 20 bp, Artificial
  CRISPR gRNA sequence
tacaaggcagacaggaaaaa

SEQ ID NO: 780523 - DNA, 20 bp, Artificial
  CRISPR gRNA sequence
acaaggcagacaggaaaaat

SEQ ID NO: 780524 - DNA, 20 bp, Artificial
  CRISPR gRNA sequence
aggcagacaggaaaaatagg

SEQ ID NO: 780525 - DNA, 20 bp, Artificial
  CRISPR gRNA sequence
caggaaaaataggaagaaaa

SEQ ID NO: 780526 - DNA, 20 bp, Artificial
  CRISPR gRNA sequence
aagaaaatggacttttatca

SEQ ID NO: 780527 - DNA, 20 bp, Artificial
  CRISPR gRNA sequence
agaaaatggacttttatcaa

SEQ ID NO: 780528 - DNA, 20 bp, Artificial
  CRISPR gRNA sequence
atggacttttatcaaaggcc

SEQ ID NO: 780529 - DNA, 20 bp, Artificial
  CRISPR gRNA sequence
tggacttttatcaaaggccc

SEQ ID NO: 780530 - DNA, 20 bp, Artificial
  CRISPR gRNA sequence
acttttatcaaaggcccagg

SEQ ID NO: 780531 - DNA, 20 bp, Artificial
  CRISPR gRNA sequence
tatcaaaggcccaggcagta

SEQ ID NO: 780532 - DNA, 20 bp, Artificial
  CRISPR gRNA sequence
tcaaaggcccaggcagtaaa

SEQ ID NO: 780533 - DNA, 20 bp, Artificial
  CRISPR gRNA sequence
caaaggcccaggcagtaaag

SEQ ID NO: 780534 - DNA, 20 bp, Artificial
  CRISPR gRNA sequence
aaaggcccaggcagtaaaga

SEQ ID NO: 780535 - DNA, 20 bp, Artificial
  CRISPR gRNA sequence
aaggcccaggcagtaaagag

SEQ ID NO: 780536 - DNA, 20 bp, Artificial
  CRISPR gRNA sequence
ggcccaggcagtaaagaggg

SEQ ID NO: 780537 - DNA, 20 bp, Artificial
  CRISPR gRNA sequence
aaagaggggagttctgctgt

SEQ ID NO: 780538 - DNA, 20 bp, Artificial
  CRISPR gRNA sequence
ggggagttctgctgtaagct

SEQ ID NO: 780539 - DNA, 20 bp, Artificial
  CRISPR gRNA sequence
gggagttctgctgtaagcta

SEQ ID NO: 780540 - DNA, 20 bp, Artificial
  CRISPR gRNA sequence
ggagttctgctgtaagctaa

SEQ ID NO: 780541 - DNA, 20 bp, Artificial
  CRISPR gRNA sequence
gagttctgctgtaagctaag

SEQ ID NO: 780542 - DNA, 20 bp, Artificial
  CRISPR gRNA sequence
gttctgctgtaagctaaggg

SEQ ID NO: 780543 - DNA, 20 bp, Artificial
  CRISPR gRNA sequence
ctgtaagctaaggggagttc

SEQ ID NO: 780544 - DNA, 20 bp, Artificial
  CRISPR gRNA sequence
gtaagctaaggggagttcca

SEQ ID NO: 780545 - DNA, 20 bp, Artificial
  CRISPR gRNA sequence
taagctaaggggagttccag

SEQ ID NO: 780546 - DNA, 20 bp, Artificial
  CRISPR gRNA sequence
gctaaggggagttccagagg

SEQ ID NO: 780547 - DNA, 20 bp, Artificial
  CRISPR gRNA sequence
gggagttccagaggaagtta

SEQ ID NO: 780548 - DNA, 20 bp, Artificial
  CRISPR gRNA sequence
ggagttccagaggaagttat

SEQ ID NO: 780549 - DNA, 20 bp, Artificial
  CRISPR gRNA sequence
ggcgttccctttcttatgac

SEQ ID NO: 780550 - DNA, 20 bp, Artificial
  CRISPR gRNA sequence
ttccctttcttatgacaaga

SEQ ID NO: 780551 - DNA, 20 bp, Artificial
  CRISPR gRNA sequence
tttcttatgacaagaaagca

SEQ ID NO: 780552 - DNA, 20 bp, Artificial
  CRISPR gRNA sequence
tatgacaagaaagcatagtg

SEQ ID NO: 780553 - DNA, 20 bp, Artificial
  CRISPR gRNA sequence
cagtaaataaatttgctaaa

SEQ ID NO: 780554 - DNA, 20 bp, Artificial
  CRISPR gRNA sequence
aatttgctaaatagattcaa

SEQ ID NO: 780555 - DNA, 20 bp, Artificial
  CRISPR gRNA sequence
gattcaacagtctctaccca

SEQ ID NO: 780556 - DNA, 20 bp, Artificial
  CRISPR gRNA sequence
atttaattcttgttgttatg

SEQ ID NO: 780557 - DNA, 20 bp, Artificial
  CRISPR gRNA sequence
ttcttgttgttatgcagact

SEQ ID NO: 780558 - DNA, 20 bp, Artificial
  CRISPR gRNA sequence
cagcaactaaccttccttgt

SEQ ID NO: 780559 - DNA, 20 bp, Artificial
  CRISPR gRNA sequence
tttatcaaatgtaattaaac

SEQ ID NO: 780560 - DNA, 20 bp, Artificial
  CRISPR gRNA sequence
tatcaaatgtaattaaacaa

SEQ ID NO: 780561 - DNA, 20 bp, Artificial
  CRISPR gRNA sequence
caaatgtaattaaacaagag

SEQ ID NO: 780562 - DNA, 20 bp, Artificial
  CRISPR gRNA sequence
attaaacaagagaagtatta

SEQ ID NO: 780563 - DNA, 20 bp, Artificial
  CRISPR gRNA sequence
aaacaagagaagtattatag

SEQ ID NO: 780564 - DNA, 20 bp, Artificial
  CRISPR gRNA sequence
acaagagaagtattatagaa

SEQ ID NO: 780565 - DNA, 20 bp, Artificial
  CRISPR gRNA sequence
gaagtattatagaagagtaa

SEQ ID NO: 780566 - DNA, 20 bp, Artificial
  CRISPR gRNA sequence
gtattatagaagagtaaaag

SEQ ID NO: 780567 - DNA, 20 bp, Artificial
  CRISPR gRNA sequence
ttatagaagagtaaaagtag

SEQ ID NO: 780568 - DNA, 20 bp, Artificial
  CRISPR gRNA sequence
tatagaagagtaaaagtagt

SEQ ID NO: 780569 - DNA, 20 bp, Artificial
  CRISPR gRNA sequence
tagtaggtaattcttgaact

SEQ ID NO: 780570 - DNA, 20 bp, Artificial
  CRISPR gRNA sequence
attactacatatttgatgaa

SEQ ID NO: 780571 - DNA, 20 bp, Artificial
  CRISPR gRNA sequence
atagttgaatattattcttc

SEQ ID NO: 780572 - DNA, 20 bp, Artificial
  CRISPR gRNA sequence
tagttgaatattattcttca

SEQ ID NO: 780573 - DNA, 20 bp, Artificial
  CRISPR gRNA sequence
tgaatattattcttcaagga

SEQ ID NO: 780574 - DNA, 20 bp, Artificial
  CRISPR gRNA sequence
attattcttcaaggacagat

SEQ ID NO: 780575 - DNA, 20 bp, Artificial
  CRISPR gRNA sequence
cttcaaggacagattggatt

SEQ ID NO: 780576 - DNA, 20 bp, Artificial
  CRISPR gRNA sequence
ggacagattggatttggtat

SEQ ID NO: 780577 - DNA, 20 bp, Artificial
  CRISPR gRNA sequence
gacagattggatttggtatc

SEQ ID NO: 780578 - DNA, 20 bp, Artificial
  CRISPR gRNA sequence
agattggatttggtatcagg

SEQ ID NO: 780579 - DNA, 20 bp, Artificial
  CRISPR gRNA sequence
gtatcaggtggctctgcatt

SEQ ID NO: 780580 - DNA, 20 bp, Artificial
  CRISPR gRNA sequence
gtggctctgcattaagttat

SEQ ID NO: 780581 - DNA, 20 bp, Artificial
  CRISPR gRNA sequence
tggctctgcattaagttata

SEQ ID NO: 780582 - DNA, 20 bp, Artificial
  CRISPR gRNA sequence
ggctctgcattaagttataa

SEQ ID NO: 780583 - DNA, 20 bp, Artificial
  CRISPR gRNA sequence
tataagggacttaataactc

SEQ ID NO: 780584 - DNA, 20 bp, Artificial
  CRISPR gRNA sequence
acttaataactcaagtattt

SEQ ID NO: 780585 - DNA, 20 bp, Artificial
  CRISPR gRNA sequence
cttaataactcaagtattta

SEQ ID NO: 780586 - DNA, 20 bp, Artificial
  CRISPR gRNA sequence
ataactcaagtatttaagga

SEQ ID NO: 780587 - DNA, 20 bp, Artificial
  CRISPR gRNA sequence
taaggacggcttccatcata

SEQ ID NO: 780588 - DNA, 20 bp, Artificial
  CRISPR gRNA sequence
aaggacggcttccatcataa

SEQ ID NO: 780589 - DNA, 20 bp, Artificial
  CRISPR gRNA sequence
aggacggcttccatcataaa

SEQ ID NO: 780590 - DNA, 20 bp, Artificial
  CRISPR gRNA sequence
tcataaagggatctgccctt

SEQ ID NO: 780591 - DNA, 20 bp, Artificial
  CRISPR gRNA sequence
ataaagggatctgcccttaa

SEQ ID NO: 780592 - DNA, 20 bp, Artificial
  CRISPR gRNA sequence
taaagggatctgcccttaag

SEQ ID NO: 780593 - DNA, 20 bp, Artificial
  CRISPR gRNA sequence
aaagggatctgcccttaaga

SEQ ID NO: 780594 - DNA, 20 bp, Artificial
  CRISPR gRNA sequence
cccttaagagggtcccatta

SEQ ID NO: 780595 - DNA, 20 bp, Artificial
  CRISPR gRNA sequence
cttaagagggtcccattatg

SEQ ID NO: 780596 - DNA, 20 bp, Artificial
  CRISPR gRNA sequence
ggtcccattatggagattct

SEQ ID NO: 780597 - DNA, 20 bp, Artificial
  CRISPR gRNA sequence
gtcccattatggagattctg

SEQ ID NO: 780598 - DNA, 20 bp, Artificial
  CRISPR gRNA sequence
cattatggagattctgaggt

SEQ ID NO: 780599 - DNA, 20 bp, Artificial
  CRISPR gRNA sequence
ttatggagattctgaggtga

SEQ ID NO: 780600 - DNA, 20 bp, Artificial
  CRISPR gRNA sequence
tctgaggtgagagctattcc

SEQ ID NO: 780601 - DNA, 20 bp, Artificial
  CRISPR gRNA sequence
tgagagctattccaagtgtg

SEQ ID NO: 780602 - DNA, 20 bp, Artificial
  CRISPR gRNA sequence
gagctattccaagtgtgcag

SEQ ID NO: 780603 - DNA, 20 bp, Artificial
  CRISPR gRNA sequence
tgtgcagtggattaaaataa

SEQ ID NO: 780604 - DNA, 20 bp, Artificial
  CRISPR gRNA sequence
attaaaataaaagaatcata

SEQ ID NO: 780605 - DNA, 20 bp, Artificial
  CRISPR gRNA sequence
ttaaaataaaagaatcatac

SEQ ID NO: 780606 - DNA, 20 bp, Artificial
  CRISPR gRNA sequence
tctttttacatgccttattc

SEQ ID NO: 780607 - DNA, 20 bp, Artificial
  CRISPR gRNA sequence
ctttttacatgccttattcc

SEQ ID NO: 780608 - DNA, 20 bp, Artificial
  CRISPR gRNA sequence
tttttacatgccttattcca

SEQ ID NO: 780609 - DNA, 20 bp, Artificial
  CRISPR gRNA sequence
attccagggtctttgcaacc

SEQ ID NO: 780610 - DNA, 20 bp, Artificial
  CRISPR gRNA sequence
agggtctttgcaacctggca

SEQ ID NO: 780611 - DNA, 20 bp, Artificial
  CRISPR gRNA sequence
tctttgcaacctggcacagc

SEQ ID NO: 780612 - DNA, 20 bp, Artificial
  CRISPR gRNA sequence
gcaacctggcacagcaagtg

SEQ ID NO: 780613 - DNA, 20 bp, Artificial
  CRISPR gRNA sequence
acagcaagtgcagatatgat

SEQ ID NO: 780614 - DNA, 20 bp, Artificial
  CRISPR gRNA sequence
acacatgtacactcacctta

SEQ ID NO: 780615 - DNA, 20 bp, Artificial
  CRISPR gRNA sequence
cctgtgcccctcctgcacaa

SEQ ID NO: 780616 - DNA, 20 bp, Artificial
  CRISPR gRNA sequence
cctcctgcacaaaagaatgc

SEQ ID NO: 780617 - DNA, 20 bp, Artificial
  CRISPR gRNA sequence
ctcctgcacaaaagaatgct

SEQ ID NO: 780618 - DNA, 20 bp, Artificial
  CRISPR gRNA sequence
cacacgtgaactcctctctg

SEQ ID NO: 780619 - DNA, 20 bp, Artificial
  CRISPR gRNA sequence
cgtgaactcctctctgtaga

SEQ ID NO: 780620 - DNA, 20 bp, Artificial
  CRISPR gRNA sequence
gtgaactcctctctgtagaa

SEQ ID NO: 780621 - DNA, 20 bp, Artificial
  CRISPR gRNA sequence
agaaaggcacattaatgttc

SEQ ID NO: 780622 - DNA, 20 bp, Artificial
  CRISPR gRNA sequence
gcacattaatgttctagcca

SEQ ID NO: 780623 - DNA, 20 bp, Artificial
  CRISPR gRNA sequence
tgttctagccatggttaaaa

SEQ ID NO: 780624 - DNA, 20 bp, Artificial
  CRISPR gRNA sequence
gttctagccatggttaaaac

SEQ ID NO: 780625 - DNA, 20 bp, Artificial
  CRISPR gRNA sequence
ttctagccatggttaaaaca

SEQ ID NO: 780626 - DNA, 20 bp, Artificial
  CRISPR gRNA sequence
agccatggttaaaacaggga

SEQ ID NO: 780627 - DNA, 20 bp, Artificial
  CRISPR gRNA sequence
ccatggttaaaacagggata

SEQ ID NO: 780628 - DNA, 20 bp, Artificial
  CRISPR gRNA sequence
catggttaaaacagggatag

SEQ ID NO: 780629 - DNA, 20 bp, Artificial
  CRISPR gRNA sequence
gttaaaacagggatagaggc

SEQ ID NO: 780630 - DNA, 20 bp, Artificial
  CRISPR gRNA sequence
tagaggcaagccaaaaatgt

SEQ ID NO: 780631 - DNA, 20 bp, Artificial
  CRISPR gRNA sequence
ggtcatttgaaataaatctc

SEQ ID NO: 780632 - DNA, 20 bp, Artificial
  CRISPR gRNA sequence
agtttgtgcatatcactatc

SEQ ID NO: 780633 - DNA, 20 bp, Artificial
  CRISPR gRNA sequence
tcactatcaagtgtgctgtg

SEQ ID NO: 780634 - DNA, 20 bp, Artificial
  CRISPR gRNA sequence
aagtgtgctgtgtggcaatt

SEQ ID NO: 780635 - DNA, 20 bp, Artificial
  CRISPR gRNA sequence
aatgccaatttgtgtgatca

SEQ ID NO: 780636 - DNA, 20 bp, Artificial
  CRISPR gRNA sequence
atgccaatttgtgtgatcac

SEQ ID NO: 780637 - DNA, 20 bp, Artificial
  CRISPR gRNA sequence
caatttgtgtgatcacaggc

SEQ ID NO: 780638 - DNA, 20 bp, Artificial
  CRISPR gRNA sequence
gtgtgatcacaggcaagttg

SEQ ID NO: 780639 - DNA, 20 bp, Artificial
  CRISPR gRNA sequence
ggcaagttgcagtttgatga

SEQ ID NO: 780640 - DNA, 20 bp, Artificial
  CRISPR gRNA sequence
gcaagttgcagtttgatgaa

SEQ ID NO: 780641 - DNA, 20 bp, Artificial
  CRISPR gRNA sequence
gttgcagtttgatgaaagga

SEQ ID NO: 780642 - DNA, 20 bp, Artificial
  CRISPR gRNA sequence
gcagtttgatgaaaggaaag

SEQ ID NO: 780643 - DNA, 20 bp, Artificial
  CRISPR gRNA sequence
agtttgatgaaaggaaagca

SEQ ID NO: 780644 - DNA, 20 bp, Artificial
  CRISPR gRNA sequence
gtttgatgaaaggaaagcag

SEQ ID NO: 780645 - DNA, 20 bp, Artificial
  CRISPR gRNA sequence
agcagaggtgaatatataac

SEQ ID NO: 780646 - DNA, 20 bp, Artificial
  CRISPR gRNA sequence
gcagaggtgaatatataacc

SEQ ID NO: 780647 - DNA, 20 bp, Artificial
  CRISPR gRNA sequence
cagaggtgaatatataacca

SEQ ID NO: 780648 - DNA, 20 bp, Artificial
  CRISPR gRNA sequence
ctttctgtcatttatttgcc

SEQ ID NO: 780649 - DNA, 20 bp, Artificial
  CRISPR gRNA sequence
ttatttgccaagctcttaac

SEQ ID NO: 780650 - DNA, 20 bp, Artificial
  CRISPR gRNA sequence
aactagaacttgctatgtgc

SEQ ID NO: 780651 - DNA, 20 bp, Artificial
  CRISPR gRNA sequence
actagaacttgctatgtgct

SEQ ID NO: 780652 - DNA, 20 bp, Artificial
  CRISPR gRNA sequence
acttgctatgtgctaggtac

SEQ ID NO: 780653 - DNA, 20 bp, Artificial
  CRISPR gRNA sequence
gctaggtactggatatatca

SEQ ID NO: 780654 - DNA, 20 bp, Artificial
  CRISPR gRNA sequence
tggatatatcaaagcaaact

SEQ ID NO: 780655 - DNA, 20 bp, Artificial
  CRISPR gRNA sequence
atatcaaagcaaactcagcc

SEQ ID NO: 780656 - DNA, 20 bp, Artificial
  CRISPR gRNA sequence
cagcctggtctttgccttca

SEQ ID NO: 780657 - DNA, 20 bp, Artificial
  CRISPR gRNA sequence
tctttgccttcaaagatttg

SEQ ID NO: 780658 - DNA, 20 bp, Artificial
  CRISPR gRNA sequence
ctttgccttcaaagatttgc

SEQ ID NO: 780659 - DNA, 20 bp, Artificial
  CRISPR gRNA sequence
gccttcaaagatttgcagga

SEQ ID NO: 780660 - DNA, 20 bp, Artificial
  CRISPR gRNA sequence
ttcaaagatttgcaggatag

SEQ ID NO: 780661 - DNA, 20 bp, Artificial
  CRISPR gRNA sequence
tcaaagatttgcaggatagt

SEQ ID NO: 780662 - DNA, 20 bp, Artificial
  CRISPR gRNA sequence
aagatttgcaggatagtggg

SEQ ID NO: 780663 - DNA, 20 bp, Artificial
  CRISPR gRNA sequence
gtgggaagaaaaacttgaat

SEQ ID NO: 780664 - DNA, 20 bp, Artificial
  CRISPR gRNA sequence
gggaagaaaaacttgaatca

SEQ ID NO: 780665 - DNA, 20 bp, Artificial
  CRISPR gRNA sequence
ggaagaaaaacttgaatcag

SEQ ID NO: 780666 - DNA, 20 bp, Artificial
  CRISPR gRNA sequence
cttgaatcagaggacatctg

SEQ ID NO: 780667 - DNA, 20 bp, Artificial
  CRISPR gRNA sequence
gaatcagaggacatctgcag

SEQ ID NO: 780668 - DNA, 20 bp, Artificial
  CRISPR gRNA sequence
aatcagaggacatctgcagt

SEQ ID NO: 780669 - DNA, 20 bp, Artificial
  CRISPR gRNA sequence
atctgcagtgggaatcattc

SEQ ID NO: 780670 - DNA, 20 bp, Artificial
  CRISPR gRNA sequence
tgcagtgggaatcattcaag

SEQ ID NO: 780671 - DNA, 20 bp, Artificial
  CRISPR gRNA sequence
agtgggaatcattcaagcag

SEQ ID NO: 780672 - DNA, 20 bp, Artificial
  CRISPR gRNA sequence
tcaagcagcagaaaacccaa

SEQ ID NO: 780673 - DNA, 20 bp, Artificial
  CRISPR gRNA sequence
cttatactgtgaaatctgat

SEQ ID NO: 780674 - DNA, 20 bp, Artificial
  CRISPR gRNA sequence
tatactgtgaaatctgatca

SEQ ID NO: 780675 - DNA, 20 bp, Artificial
  CRISPR gRNA sequence
tgtgaaatctgatcagagaa

SEQ ID NO: 780676 - DNA, 20 bp, Artificial
  CRISPR gRNA sequence
gatcagagaatggactgtcc

SEQ ID NO: 780677 - DNA, 20 bp, Artificial
  CRISPR gRNA sequence
agagaatggactgtcctggt

SEQ ID NO: 780678 - DNA, 20 bp, Artificial
  CRISPR gRNA sequence
tcctggttagtaaaatatcc

SEQ ID NO: 780679 - DNA, 20 bp, Artificial
  CRISPR gRNA sequence
ctggttagtaaaatatcctg

SEQ ID NO: 780680 - DNA, 20 bp, Artificial
  CRISPR gRNA sequence
tggttagtaaaatatcctgg

SEQ ID NO: 780681 - DNA, 20 bp, Artificial
  CRISPR gRNA sequence
gtaaaatatcctggaggata

SEQ ID NO: 780682 - DNA, 20 bp, Artificial
  CRISPR gRNA sequence
atatcctggaggataaagat

SEQ ID NO: 780683 - DNA, 20 bp, Artificial
  CRISPR gRNA sequence
atatgaattaccactttccc

SEQ ID NO: 780684 - DNA, 20 bp, Artificial
  CRISPR gRNA sequence
ctttcccaagaattaaaaca

SEQ ID NO: 780685 - DNA, 20 bp, Artificial
  CRISPR gRNA sequence
agaattaaaacatggtacga

SEQ ID NO: 780686 - DNA, 20 bp, Artificial
  CRISPR gRNA sequence
ttaaaacatggtacgaaaga

SEQ ID NO: 780687 - DNA, 20 bp, Artificial
  CRISPR gRNA sequence
taaaacatggtacgaaagaa

SEQ ID NO: 780688 - DNA, 20 bp, Artificial
  CRISPR gRNA sequence
gaaaggaacgaacatttgct

SEQ ID NO: 780689 - DNA, 20 bp, Artificial
  CRISPR gRNA sequence
gctgagtgcctactgcctgc

SEQ ID NO: 780690 - DNA, 20 bp, Artificial
  CRISPR gRNA sequence
tgcctactgcctgccagatc

SEQ ID NO: 780691 - DNA, 20 bp, Artificial
  CRISPR gRNA sequence
gcctactgcctgccagatct

SEQ ID NO: 780692 - DNA, 20 bp, Artificial
  CRISPR gRNA sequence
ttcacatgtaacacctcgtc

SEQ ID NO: 780693 - DNA, 20 bp, Artificial
  CRISPR gRNA sequence
ccagcctccaccacaatact

SEQ ID NO: 780694 - DNA, 20 bp, Artificial
  CRISPR gRNA sequence
agcctccaccacaatactga

SEQ ID NO: 780695 - DNA, 20 bp, Artificial
  CRISPR gRNA sequence
gcctccaccacaatactgag

SEQ ID NO: 780696 - DNA, 20 bp, Artificial
  CRISPR gRNA sequence
tccaccacaatactgagagg

SEQ ID NO: 780697 - DNA, 20 bp, Artificial
  CRISPR gRNA sequence
caccacaatactgagaggta

SEQ ID NO: 780698 - DNA, 20 bp, Artificial
  CRISPR gRNA sequence
tagagttcaacctcatttta

SEQ ID NO: 780699 - DNA, 20 bp, Artificial
  CRISPR gRNA sequence
tcaacctcattttatagata

SEQ ID NO: 780700 - DNA, 20 bp, Artificial
  CRISPR gRNA sequence
aacctcattttatagataaa

SEQ ID NO: 780701 - DNA, 20 bp, Artificial
  CRISPR gRNA sequence
acctcattttatagataaag

SEQ ID NO: 780702 - DNA, 20 bp, Artificial
  CRISPR gRNA sequence
ttttatagataaagaggctg

SEQ ID NO: 780703 - DNA, 20 bp, Artificial
  CRISPR gRNA sequence
taaagaggctgaagctcata

SEQ ID NO: 780704 - DNA, 20 bp, Artificial
  CRISPR gRNA sequence
gctgaagctcataaagatta

SEQ ID NO: 780705 - DNA, 20 bp, Artificial
  CRISPR gRNA sequence
ctgaagctcataaagattaa

SEQ ID NO: 780706 - DNA, 20 bp, Artificial
  CRISPR gRNA sequence
agctcataaagattaaagga

SEQ ID NO: 780707 - DNA, 20 bp, Artificial
  CRISPR gRNA sequence
aagattaaaggacggactca

SEQ ID NO: 780708 - DNA, 20 bp, Artificial
  CRISPR gRNA sequence
aaaggacggactcacagtca

SEQ ID NO: 780709 - DNA, 20 bp, Artificial
  CRISPR gRNA sequence
aaggacggactcacagtcaa

SEQ ID NO: 780710 - DNA, 20 bp, Artificial
  CRISPR gRNA sequence
gtcaaaggactcctaatcct

SEQ ID NO: 780711 - DNA, 20 bp, Artificial
  CRISPR gRNA sequence
aaggactcctaatcctgagt

SEQ ID NO: 780712 - DNA, 20 bp, Artificial
  CRISPR gRNA sequence
cctgagtcagcatttgaacc

SEQ ID NO: 780713 - DNA, 20 bp, Artificial
  CRISPR gRNA sequence
ctgagtcagcatttgaaccc

SEQ ID NO: 780714 - DNA, 20 bp, Artificial
  CRISPR gRNA sequence
ttttatactgaaacaacttc

SEQ ID NO: 780715 - DNA, 20 bp, Artificial
  CRISPR gRNA sequence
tactgaaacaacttctggaa

SEQ ID NO: 780716 - DNA, 20 bp, Artificial
  CRISPR gRNA sequence
cttctggaatagctaatgct

SEQ ID NO: 780717 - DNA, 20 bp, Artificial
  CRISPR gRNA sequence
ctggaatagctaatgcttag

SEQ ID NO: 780718 - DNA, 20 bp, Artificial
  CRISPR gRNA sequence
gaatagctaatgcttagaag

SEQ ID NO: 780719 - DNA, 20 bp, Artificial
  CRISPR gRNA sequence
aatgaatgaataaatgaatg

SEQ ID NO: 780720 - DNA, 20 bp, Artificial
  CRISPR gRNA sequence
aatgaataaatgaatgaagc

SEQ ID NO: 780721 - DNA, 20 bp, Artificial
  CRISPR gRNA sequence
tctaatcttctgtgattatt

SEQ ID NO: 780722 - DNA, 20 bp, Artificial
  CRISPR gRNA sequence
gattattcagaaactacttc

SEQ ID NO: 780723 - DNA, 20 bp, Artificial
  CRISPR gRNA sequence
gaatacccattcattaatga

SEQ ID NO: 780724 - DNA, 20 bp, Artificial
  CRISPR gRNA sequence
tacccattcattaatgatgg

SEQ ID NO: 780725 - DNA, 20 bp, Artificial
  CRISPR gRNA sequence
ccattcattaatgatggaag

SEQ ID NO: 780726 - DNA, 20 bp, Artificial
  CRISPR gRNA sequence
tgatgtaacactacctttac

SEQ ID NO: 780727 - DNA, 20 bp, Artificial
  CRISPR gRNA sequence
taacactacctttactagtt

SEQ ID NO: 780728 - DNA, 20 bp, Artificial
  CRISPR gRNA sequence
cactccttatgcttttttta

SEQ ID NO: 780729 - DNA, 20 bp, Artificial
  CRISPR gRNA sequence
gctttttttatagaactatt

SEQ ID NO: 780730 - DNA, 20 bp, Artificial
  CRISPR gRNA sequence
aattcaacttttaaaaaata

SEQ ID NO: 780731 - DNA, 20 bp, Artificial
  CRISPR gRNA sequence
aataaagccacatacccctg

SEQ ID NO: 780732 - DNA, 20 bp, Artificial
  CRISPR gRNA sequence
aaagccacatacccctgtgg

SEQ ID NO: 780733 - DNA, 20 bp, Artificial
  CRISPR gRNA sequence
ccctgtggtagatgaaaaac

SEQ ID NO: 780734 - DNA, 20 bp, Artificial
  CRISPR gRNA sequence
aaaacaagtatcatttgcac

SEQ ID NO: 780735 - DNA, 20 bp, Artificial
  CRISPR gRNA sequence
gtatcatttgcactggtaaa

SEQ ID NO: 780736 - DNA, 20 bp, Artificial
  CRISPR gRNA sequence
atcatttgcactggtaaata

SEQ ID NO: 780737 - DNA, 20 bp, Artificial
  CRISPR gRNA sequence
ttgcactggtaaatagagaa

SEQ ID NO: 780738 - DNA, 20 bp, Artificial
  CRISPR gRNA sequence
tgcactggtaaatagagaat

SEQ ID NO: 780739 - DNA, 20 bp, Artificial
  CRISPR gRNA sequence
actggtaaatagagaatagg

SEQ ID NO: 780740 - DNA, 20 bp, Artificial
  CRISPR gRNA sequence
aataggaagaaaaataaatg

SEQ ID NO: 780741 - DNA, 20 bp, Artificial
  CRISPR gRNA sequence
aaataaatgcagtgaaaata

SEQ ID NO: 780742 - DNA, 20 bp, Artificial
  CRISPR gRNA sequence
taaatgcagtgaaaataaag

SEQ ID NO: 780743 - DNA, 20 bp, Artificial
  CRISPR gRNA sequence
cagtgttatcaaatcctacc

SEQ ID NO: 780744 - DNA, 20 bp, Artificial
  CRISPR gRNA sequence
cccagatactgttatctacc

SEQ ID NO: 780745 - DNA, 20 bp, Artificial
  CRISPR gRNA sequence
agatactgttatctacccgg

SEQ ID NO: 780746 - DNA, 20 bp, Artificial
  CRISPR gRNA sequence
gaagcttcctgtttgattaa

SEQ ID NO: 780747 - DNA, 20 bp, Artificial
  CRISPR gRNA sequence
aagcttcctgtttgattaaa

SEQ ID NO: 780748 - DNA, 20 bp, Artificial
  CRISPR gRNA sequence
tgtttgattaaaaggaaaaa

SEQ ID NO: 780749 - DNA, 20 bp, Artificial
  CRISPR gRNA sequence
tgattaaaaggaaaaatagc

SEQ ID NO: 780750 - DNA, 20 bp, Artificial
  CRISPR gRNA sequence
aaaggaaaaatagccagtgt

SEQ ID NO: 780751 - DNA, 20 bp, Artificial
  CRISPR gRNA sequence
aggaaaaatagccagtgtta

SEQ ID NO: 780752 - DNA, 20 bp, Artificial
  CRISPR gRNA sequence
ggaaaaatagccagtgttag

SEQ ID NO: 780753 - DNA, 20 bp, Artificial
  CRISPR gRNA sequence
aatagccagtgttagaggtg

SEQ ID NO: 780754 - DNA, 20 bp, Artificial
  CRISPR gRNA sequence
agccagtgttagaggtgtgg

SEQ ID NO: 780755 - DNA, 20 bp, Artificial
  CRISPR gRNA sequence
gtgttagaggtgtggaagtc

SEQ ID NO: 780756 - DNA, 20 bp, Artificial
  CRISPR gRNA sequence
gttgaaattatatgcaattg

SEQ ID NO: 780757 - DNA, 20 bp, Artificial
  CRISPR gRNA sequence
ttgaaattatatgcaattga

SEQ ID NO: 780758 - DNA, 20 bp, Artificial
  CRISPR gRNA sequence
atgcaattgaaggattaaaa

SEQ ID NO: 780759 - DNA, 20 bp, Artificial
  CRISPR gRNA sequence
aggattaaaatagaattgaa

SEQ ID NO: 780760 - DNA, 20 bp, Artificial
  CRISPR gRNA sequence
ggattaaaatagaattgaaa

SEQ ID NO: 780761 - DNA, 20 bp, Artificial
  CRISPR gRNA sequence
gattaaaatagaattgaaaa

SEQ ID NO: 780762 - DNA, 20 bp, Artificial
  CRISPR gRNA sequence
ctgaataatttaactccctt

SEQ ID NO: 780763 - DNA, 20 bp, Artificial
  CRISPR gRNA sequence
tgaataatttaactcccttt

SEQ ID NO: 780764 - DNA, 20 bp, Artificial
  CRISPR gRNA sequence
aaaatcatcttacatacttc

SEQ ID NO: 780765 - DNA, 20 bp, Artificial
  CRISPR gRNA sequence
atcatcttacatacttctag

SEQ ID NO: 780766 - DNA, 20 bp, Artificial
  CRISPR gRNA sequence
gtggcgtgtccctcacattt

SEQ ID NO: 780767 - DNA, 20 bp, Artificial
  CRISPR gRNA sequence
ctcacattttggtaaactct

SEQ ID NO: 780768 - DNA, 20 bp, Artificial
  CRISPR gRNA sequence
acattttggtaaactctgag

SEQ ID NO: 780769 - DNA, 20 bp, Artificial
  CRISPR gRNA sequence
taaactctgagtggaaacta

SEQ ID NO: 780770 - DNA, 20 bp, Artificial
  CRISPR gRNA sequence
agtggaaactacggattttg

SEQ ID NO: 780771 - DNA, 20 bp, Artificial
  CRISPR gRNA sequence
tttgtagtcaaacatctgac

SEQ ID NO: 780772 - DNA, 20 bp, Artificial
  CRISPR gRNA sequence
gtcaaacatctgactggctc

SEQ ID NO: 780773 - DNA, 20 bp, Artificial
  CRISPR gRNA sequence
ctttactaacatatgtcctg

SEQ ID NO: 780774 - DNA, 20 bp, Artificial
  CRISPR gRNA sequence
atgtcctgaagtgaactgct

SEQ ID NO: 780775 - DNA, 20 bp, Artificial
  CRISPR gRNA sequence
gtcctgaagtgaactgcttg

SEQ ID NO: 780776 - DNA, 20 bp, Artificial
  CRISPR gRNA sequence
tgaagtgaactgcttggagc

SEQ ID NO: 780777 - DNA, 20 bp, Artificial
  CRISPR gRNA sequence
atataaccataatgacaaaa

SEQ ID NO: 780778 - DNA, 20 bp, Artificial
  CRISPR gRNA sequence
tataaccataatgacaaaac

SEQ ID NO: 780779 - DNA, 20 bp, Artificial
  CRISPR gRNA sequence
taatgacaaaacaggtttca

SEQ ID NO: 780780 - DNA, 20 bp, Artificial
  CRISPR gRNA sequence
aggtttcacggtcatgtttt

SEQ ID NO: 780781 - DNA, 20 bp, Artificial
  CRISPR gRNA sequence
gttttcagtattaaacaata

SEQ ID NO: 780782 - DNA, 20 bp, Artificial
  CRISPR gRNA sequence
gtattaaacaatatagttaa

SEQ ID NO: 780783 - DNA, 20 bp, Artificial
  CRISPR gRNA sequence
acaatatagttaaaagtacc

SEQ ID NO: 780784 - DNA, 20 bp, Artificial
  CRISPR gRNA sequence
atagttaaaagtacctagca

SEQ ID NO: 780785 - DNA, 20 bp, Artificial
  CRISPR gRNA sequence
aaagtacctagcacagtgcc

SEQ ID NO: 780786 - DNA, 20 bp, Artificial
  CRISPR gRNA sequence
acctagcacagtgcctggca

SEQ ID NO: 780787 - DNA, 20 bp, Artificial
  CRISPR gRNA sequence
gtgcctggcatagaacatac

SEQ ID NO: 780788 - DNA, 20 bp, Artificial
  CRISPR gRNA sequence
gaacatactagatatacatt

SEQ ID NO: 780789 - DNA, 20 bp, Artificial
  CRISPR gRNA sequence
actagatatacattaagtat

SEQ ID NO: 780790 - DNA, 20 bp, Artificial
  CRISPR gRNA sequence
ttttcctttccctttattgt

SEQ ID NO: 780791 - DNA, 20 bp, Artificial
  CRISPR gRNA sequence
ttccctttattgtcagaaaa

SEQ ID NO: 780792 - DNA, 20 bp, Artificial
  CRISPR gRNA sequence
ctttattgtcagaaaataga

SEQ ID NO: 780793 - DNA, 20 bp, Artificial
  CRISPR gRNA sequence
cagaaaatagaaagcatcta

SEQ ID NO: 780794 - DNA, 20 bp, Artificial
  CRISPR gRNA sequence
aaaatagaaagcatctacag

SEQ ID NO: 780795 - DNA, 20 bp, Artificial
  CRISPR gRNA sequence
aaatagaaagcatctacagt

SEQ ID NO: 780796 - DNA, 20 bp, Artificial
  CRISPR gRNA sequence
tacagtgggcttgtatgatg

SEQ ID NO: 780797 - DNA, 20 bp, Artificial
  CRISPR gRNA sequence
agtgggcttgtatgatgtgg

SEQ ID NO: 780798 - DNA, 20 bp, Artificial
  CRISPR gRNA sequence
ggcttgtatgatgtggtggt

SEQ ID NO: 780799 - DNA, 20 bp, Artificial
  CRISPR gRNA sequence
agaaatacctgatctgattc

SEQ ID NO: 780800 - DNA, 20 bp, Artificial
  CRISPR gRNA sequence
tgattctggctgtgcaatct

SEQ ID NO: 780801 - DNA, 20 bp, Artificial
  CRISPR gRNA sequence
gattctggctgtgcaatctt

SEQ ID NO: 780802 - DNA, 20 bp, Artificial
  CRISPR gRNA sequence
ctggctgtgcaatcttgggc

SEQ ID NO: 780803 - DNA, 20 bp, Artificial
  CRISPR gRNA sequence
catttttgttttctgaaaaa

SEQ ID NO: 780804 - DNA, 20 bp, Artificial
  CRISPR gRNA sequence
atttttgttttctgaaaaaa

SEQ ID NO: 780805 - DNA, 20 bp, Artificial
  CRISPR gRNA sequence
ttgttttctgaaaaaaagga

SEQ ID NO: 780806 - DNA, 20 bp, Artificial
  CRISPR gRNA sequence
aatattattacctaccttgc

SEQ ID NO: 780807 - DNA, 20 bp, Artificial
  CRISPR gRNA sequence
ttacctaccttgctggcttc

SEQ ID NO: 780808 - DNA, 20 bp, Artificial
  CRISPR gRNA sequence
tacctaccttgctggcttct

SEQ ID NO: 780809 - DNA, 20 bp, Artificial
  CRISPR gRNA sequence
ctaccttgctggcttctggg

SEQ ID NO: 780810 - DNA, 20 bp, Artificial
  CRISPR gRNA sequence
ccttgctggcttctgggaag

SEQ ID NO: 780811 - DNA, 20 bp, Artificial
  CRISPR gRNA sequence
ctggcttctgggaagaagct

SEQ ID NO: 780812 - DNA, 20 bp, Artificial
  CRISPR gRNA sequence
cttctgggaagaagctcagt

SEQ ID NO: 780813 - DNA, 20 bp, Artificial
  CRISPR gRNA sequence
agctcagtgagacgatgtgt

SEQ ID NO: 780814 - DNA, 20 bp, Artificial
  CRISPR gRNA sequence
tcagtgagacgatgtgttag

SEQ ID NO: 780815 - DNA, 20 bp, Artificial
  CRISPR gRNA sequence
agtgagacgatgtgttagca

SEQ ID NO: 780816 - DNA, 20 bp, Artificial
  CRISPR gRNA sequence
gcagagtgtctgacaattgt

SEQ ID NO: 780817 - DNA, 20 bp, Artificial
  CRISPR gRNA sequence
gacaattgtaagaattcaac

SEQ ID NO: 780818 - DNA, 20 bp, Artificial
  CRISPR gRNA sequence
tgtaagaattcaacaagtaa

SEQ ID NO: 780819 - DNA, 20 bp, Artificial
  CRISPR gRNA sequence
atagttattattaccatcac

SEQ ID NO: 780820 - DNA, 20 bp, Artificial
  CRISPR gRNA sequence
ttattattaccatcactggt

SEQ ID NO: 780821 - DNA, 20 bp, Artificial
  CRISPR gRNA sequence
attattaccatcactggtga

SEQ ID NO: 780822 - DNA, 20 bp, Artificial
  CRISPR gRNA sequence
ttattaccatcactggtgag

SEQ ID NO: 780823 - DNA, 20 bp, Artificial
  CRISPR gRNA sequence
ttaccatcactggtgagagg

SEQ ID NO: 780824 - DNA, 20 bp, Artificial
  CRISPR gRNA sequence
tggtgagaggaagtgatacc

SEQ ID NO: 780825 - DNA, 20 bp, Artificial
  CRISPR gRNA sequence
atacctggcacaaaaatata

SEQ ID NO: 780826 - DNA, 20 bp, Artificial
  CRISPR gRNA sequence
aatatatggattaatcaata

SEQ ID NO: 780827 - DNA, 20 bp, Artificial
  CRISPR gRNA sequence
tggattaatcaatatggatt

SEQ ID NO: 780828 - DNA, 20 bp, Artificial
  CRISPR gRNA sequence
ggattaatcaatatggattg

SEQ ID NO: 780829 - DNA, 20 bp, Artificial
  CRISPR gRNA sequence
gattaatcaatatggattga

SEQ ID NO: 780830 - DNA, 20 bp, Artificial
  CRISPR gRNA sequence
tggattgagggaaacaaacc

SEQ ID NO: 780831 - DNA, 20 bp, Artificial
  CRISPR gRNA sequence
gattgagggaaacaaacctg

SEQ ID NO: 780832 - DNA, 20 bp, Artificial
  CRISPR gRNA sequence
agggaaacaaacctggagaa

SEQ ID NO: 780833 - DNA, 20 bp, Artificial
  CRISPR gRNA sequence
gggaaacaaacctggagaat

SEQ ID NO: 780834 - DNA, 20 bp, Artificial
  CRISPR gRNA sequence
aacctggagaataggatgtg

SEQ ID NO: 780835 - DNA, 20 bp, Artificial
  CRISPR gRNA sequence
acctggagaataggatgtga

SEQ ID NO: 780836 - DNA, 20 bp, Artificial
  CRISPR gRNA sequence
aataggatgtgaaggtattt

SEQ ID NO: 780837 - DNA, 20 bp, Artificial
  CRISPR gRNA sequence
tgaaggtatttaagtaacat

SEQ ID NO: 780838 - DNA, 20 bp, Artificial
  CRISPR gRNA sequence
gtatttaagtaacatgagct

SEQ ID NO: 780839 - DNA, 20 bp, Artificial
  CRISPR gRNA sequence
aacatgagctcagaccttga

SEQ ID NO: 780840 - DNA, 20 bp, Artificial
  CRISPR gRNA sequence
atgagctcagaccttgatgg

SEQ ID NO: 780841 - DNA, 20 bp, Artificial
  CRISPR gRNA sequence
tgagctcagaccttgatggt

SEQ ID NO: 780842 - DNA, 20 bp, Artificial
  CRISPR gRNA sequence
gagctcagaccttgatggta

SEQ ID NO: 780843 - DNA, 20 bp, Artificial
  CRISPR gRNA sequence
ctcagaccttgatggtaggg

SEQ ID NO: 780844 - DNA, 20 bp, Artificial
  CRISPR gRNA sequence
cttgatggtagggaagtcga

SEQ ID NO: 780845 - DNA, 20 bp, Artificial
  CRISPR gRNA sequence
ttgatggtagggaagtcgaa

SEQ ID NO: 780846 - DNA, 20 bp, Artificial
  CRISPR gRNA sequence
atggtagggaagtcgaaagg

SEQ ID NO: 780847 - DNA, 20 bp, Artificial
  CRISPR gRNA sequence
agcattttgttcttatatga

SEQ ID NO: 780848 - DNA, 20 bp, Artificial
  CRISPR gRNA sequence
ttcttatatgacagatgacc

SEQ ID NO: 780849 - DNA, 20 bp, Artificial
  CRISPR gRNA sequence
cagatgacctggaatgactg

SEQ ID NO: 780850 - DNA, 20 bp, Artificial
  CRISPR gRNA sequence
agatgacctggaatgactgc

SEQ ID NO: 780851 - DNA, 20 bp, Artificial
  CRISPR gRNA sequence
gatgacctggaatgactgca

SEQ ID NO: 780852 - DNA, 20 bp, Artificial
  CRISPR gRNA sequence
cctggaatgactgcagggct

SEQ ID NO: 780853 - DNA, 20 bp, Artificial
  CRISPR gRNA sequence
ctggaatgactgcagggctt

SEQ ID NO: 780854 - DNA, 20 bp, Artificial
  CRISPR gRNA sequence
tggaatgactgcagggcttg

SEQ ID NO: 780855 - DNA, 20 bp, Artificial
  CRISPR gRNA sequence
ggaatgactgcagggcttgg

SEQ ID NO: 780856 - DNA, 20 bp, Artificial
  CRISPR gRNA sequence
gaatgactgcagggcttggg

SEQ ID NO: 780857 - DNA, 20 bp, Artificial
  CRISPR gRNA sequence
gactgcagggcttggggggt

SEQ ID NO: 780858 - DNA, 20 bp, Artificial
  CRISPR gRNA sequence
actgcagggcttggggggtc

SEQ ID NO: 780859 - DNA, 20 bp, Artificial
  CRISPR gRNA sequence
ctgcagggcttggggggtca

SEQ ID NO: 780860 - DNA, 20 bp, Artificial
  CRISPR gRNA sequence
gggcttggggggtcagggac

SEQ ID NO: 780861 - DNA, 20 bp, Artificial
  CRISPR gRNA sequence
gcttggggggtcagggactg

SEQ ID NO: 780862 - DNA, 20 bp, Artificial
  CRISPR gRNA sequence
cttggggggtcagggactgg

SEQ ID NO: 780863 - DNA, 20 bp, Artificial
  CRISPR gRNA sequence
ggggggtcagggactggagg

SEQ ID NO: 780864 - DNA, 20 bp, Artificial
  CRISPR gRNA sequence
gggggtcagggactggaggt

SEQ ID NO: 780865 - DNA, 20 bp, Artificial
  CRISPR gRNA sequence
gggtcagggactggaggtgg

SEQ ID NO: 780866 - DNA, 20 bp, Artificial
  CRISPR gRNA sequence
gtcagggactggaggtggga

SEQ ID NO: 780867 - DNA, 20 bp, Artificial
  CRISPR gRNA sequence
tcagggactggaggtgggag

SEQ ID NO: 780868 - DNA, 20 bp, Artificial
  CRISPR gRNA sequence
tggaggtgggagaggcctct

SEQ ID NO: 780869 - DNA, 20 bp, Artificial
  CRISPR gRNA sequence
gaggtgggagaggcctctga

SEQ ID NO: 780870 - DNA, 20 bp, Artificial
  CRISPR gRNA sequence
tgggagaggcctctgagagc

SEQ ID NO: 780871 - DNA, 20 bp, Artificial
  CRISPR gRNA sequence
gagaggcctctgagagcaag

SEQ ID NO: 780872 - DNA, 20 bp, Artificial
  CRISPR gRNA sequence
gagcaagcagtgctgtccac

SEQ ID NO: 780873 - DNA, 20 bp, Artificial
  CRISPR gRNA sequence
caagcagtgctgtccaccag

SEQ ID NO: 780874 - DNA, 20 bp, Artificial
  CRISPR gRNA sequence
tgtccaccagaagctcttgc

SEQ ID NO: 780875 - DNA, 20 bp, Artificial
  CRISPR gRNA sequence
gtccaccagaagctcttgct

SEQ ID NO: 780876 - DNA, 20 bp, Artificial
  CRISPR gRNA sequence
tccaccagaagctcttgctg

SEQ ID NO: 780877 - DNA, 20 bp, Artificial
  CRISPR gRNA sequence
gaagctcttgctggggtgcc

SEQ ID NO: 780878 - DNA, 20 bp, Artificial
  CRISPR gRNA sequence
agctcttgctggggtgccca

SEQ ID NO: 780879 - DNA, 20 bp, Artificial
  CRISPR gRNA sequence
ctcttgctggggtgcccaga

SEQ ID NO: 780880 - DNA, 20 bp, Artificial
  CRISPR gRNA sequence
tcttgctggggtgcccagag

SEQ ID NO: 780881 - DNA, 20 bp, Artificial
  CRISPR gRNA sequence
ttgctggggtgcccagagag

SEQ ID NO: 780882 - DNA, 20 bp, Artificial
  CRISPR gRNA sequence
ggggtgcccagagaggagca

SEQ ID NO: 780883 - DNA, 20 bp, Artificial
  CRISPR gRNA sequence
gggtgcccagagaggagcaa

SEQ ID NO: 780884 - DNA, 20 bp, Artificial
  CRISPR gRNA sequence
ggtgcccagagaggagcaaa

SEQ ID NO: 780885 - DNA, 20 bp, Artificial
  CRISPR gRNA sequence
gcccagagaggagcaaaggg

SEQ ID NO: 780886 - DNA, 20 bp, Artificial
  CRISPR gRNA sequence
agagaggagcaaagggcagt

SEQ ID NO: 780887 - DNA, 20 bp, Artificial
  CRISPR gRNA sequence
gcaaagggcagtcagctgca

SEQ ID NO: 780888 - DNA, 20 bp, Artificial
  CRISPR gRNA sequence
caaagggcagtcagctgcac

SEQ ID NO: 780889 - DNA, 20 bp, Artificial
  CRISPR gRNA sequence
aagggcagtcagctgcacag

SEQ ID NO: 780890 - DNA, 20 bp, Artificial
  CRISPR gRNA sequence
agggcagtcagctgcacagg

SEQ ID NO: 780891 - DNA, 20 bp, Artificial
  CRISPR gRNA sequence
gggcagtcagctgcacagga

SEQ ID NO: 780892 - DNA, 20 bp, Artificial
  CRISPR gRNA sequence
gctgcacaggagggaatgtt

SEQ ID NO: 780893 - DNA, 20 bp, Artificial
  CRISPR gRNA sequence
tgcacaggagggaatgtttg

SEQ ID NO: 780894 - DNA, 20 bp, Artificial
  CRISPR gRNA sequence
gcacaggagggaatgtttgg

SEQ ID NO: 780895 - DNA, 20 bp, Artificial
  CRISPR gRNA sequence
acaggagggaatgtttggag

SEQ ID NO: 780896 - DNA, 20 bp, Artificial
  CRISPR gRNA sequence
aggagggaatgtttggagga

SEQ ID NO: 780897 - DNA, 20 bp, Artificial
  CRISPR gRNA sequence
gagggaatgtttggaggaga

SEQ ID NO: 780898 - DNA, 20 bp, Artificial
  CRISPR gRNA sequence
tttggaggagagagccacct

SEQ ID NO: 780899 - DNA, 20 bp, Artificial
  CRISPR gRNA sequence
aggagagagccacctcagat

SEQ ID NO: 780900 - DNA, 20 bp, Artificial
  CRISPR gRNA sequence
agagagccacctcagatcag

SEQ ID NO: 780901 - DNA, 20 bp, Artificial
  CRISPR gRNA sequence
gagagccacctcagatcagc

SEQ ID NO: 780902 - DNA, 20 bp, Artificial
  CRISPR gRNA sequence
ccacctcagatcagcgggtc

SEQ ID NO: 780903 - DNA, 20 bp, Artificial
  CRISPR gRNA sequence
tcaagaatcccactcttgcc

SEQ ID NO: 780904 - DNA, 20 bp, Artificial
  CRISPR gRNA sequence
gaatcccactcttgcccaga

SEQ ID NO: 780905 - DNA, 20 bp, Artificial
  CRISPR gRNA sequence
cccactcttgcccagatgga

SEQ ID NO: 780906 - DNA, 20 bp, Artificial
  CRISPR gRNA sequence
ccactcttgcccagatggat

SEQ ID NO: 780907 - DNA, 20 bp, Artificial
  CRISPR gRNA sequence
cactcttgcccagatggatg

SEQ ID NO: 780908 - DNA, 20 bp, Artificial
  CRISPR gRNA sequence
ttgcccagatggatggggca

SEQ ID NO: 780909 - DNA, 20 bp, Artificial
  CRISPR gRNA sequence
tgcccagatggatggggcaa

SEQ ID NO: 780910 - DNA, 20 bp, Artificial
  CRISPR gRNA sequence
cccagatggatggggcaaag

SEQ ID NO: 780911 - DNA, 20 bp, Artificial
  CRISPR gRNA sequence
tggatggggcaaaggagaaa

SEQ ID NO: 780912 - DNA, 20 bp, Artificial
  CRISPR gRNA sequence
ggatggggcaaaggagaaaa

SEQ ID NO: 780913 - DNA, 20 bp, Artificial
  CRISPR gRNA sequence
aggagaaaaaggattcgcca

SEQ ID NO: 780914 - DNA, 20 bp, Artificial
  CRISPR gRNA sequence
ggagaaaaaggattcgccac

SEQ ID NO: 780915 - DNA, 20 bp, Artificial
  CRISPR gRNA sequence
ggattcgccacgggaatgtc

SEQ ID NO: 780916 - DNA, 20 bp, Artificial
  CRISPR gRNA sequence
cgccacgggaatgtccagat

SEQ ID NO: 780917 - DNA, 20 bp, Artificial
  CRISPR gRNA sequence
acgggaatgtccagataaga

SEQ ID NO: 780918 - DNA, 20 bp, Artificial
  CRISPR gRNA sequence
cgggaatgtccagataagac

SEQ ID NO: 780919 - DNA, 20 bp, Artificial
  CRISPR gRNA sequence
cagataagacaggtgccttt

SEQ ID NO: 780920 - DNA, 20 bp, Artificial
  CRISPR gRNA sequence
gacaggtgccttttggaaaa

SEQ ID NO: 780921 - DNA, 20 bp, Artificial
  CRISPR gRNA sequence
acaggtgccttttggaaaat

SEQ ID NO: 780922 - DNA, 20 bp, Artificial
  CRISPR gRNA sequence
caggtgccttttggaaaatg

SEQ ID NO: 780923 - DNA, 20 bp, Artificial
  CRISPR gRNA sequence
aggtgccttttggaaaatgg

SEQ ID NO: 780924 - DNA, 20 bp, Artificial
  CRISPR gRNA sequence
gccttttggaaaatgggggt

SEQ ID NO: 780925 - DNA, 20 bp, Artificial
  CRISPR gRNA sequence
tttggaaaatgggggtgaga

SEQ ID NO: 780926 - DNA, 20 bp, Artificial
  CRISPR gRNA sequence
ttggaaaatgggggtgagat

SEQ ID NO: 780927 - DNA, 20 bp, Artificial
  CRISPR gRNA sequence
aatgggggtgagatgggtct

SEQ ID NO: 780928 - DNA, 20 bp, Artificial
  CRISPR gRNA sequence
atgggggtgagatgggtctc

SEQ ID NO: 780929 - DNA, 20 bp, Artificial
  CRISPR gRNA sequence
ggtctcaggttacacttcgt

SEQ ID NO: 780930 - DNA, 20 bp, Artificial
  CRISPR gRNA sequence
aggttacacttcgtaagaac

SEQ ID NO: 780931 - DNA, 20 bp, Artificial
  CRISPR gRNA sequence
ttcgtaagaactggaatgta

SEQ ID NO: 780932 - DNA, 20 bp, Artificial
  CRISPR gRNA sequence
aagaactggaatgtaaagta

SEQ ID NO: 780933 - DNA, 20 bp, Artificial
  CRISPR gRNA sequence
agaactggaatgtaaagtaa

SEQ ID NO: 780934 - DNA, 20 bp, Artificial
  CRISPR gRNA sequence
actggaatgtaaagtaaagg

SEQ ID NO: 780935 - DNA, 20 bp, Artificial
  CRISPR gRNA sequence
aaaatatcttgttttctttt

SEQ ID NO: 780936 - DNA, 20 bp, Artificial
  CRISPR gRNA sequence
tttcttttcagctttattca

SEQ ID NO: 780937 - DNA, 20 bp, Artificial
  CRISPR gRNA sequence
ttcagctttattcacagtga

SEQ ID NO: 780938 - DNA, 20 bp, Artificial
  CRISPR gRNA sequence
tattcacagtgacagtccct

SEQ ID NO: 780939 - DNA, 20 bp, Artificial
  CRISPR gRNA sequence
attcacagtgacagtcccta

SEQ ID NO: 780940 - DNA, 20 bp, Artificial
  CRISPR gRNA sequence
ccctaaggaactgtacataa

SEQ ID NO: 780941 - DNA, 20 bp, Artificial
  CRISPR gRNA sequence
ctaaggaactgtacataata

SEQ ID NO: 780942 - DNA, 20 bp, Artificial
  CRISPR gRNA sequence
gaactgtacataatagagca

SEQ ID NO: 780943 - DNA, 20 bp, Artificial
  CRISPR gRNA sequence
ctgtacataatagagcatgg

SEQ ID NO: 780944 - DNA, 20 bp, Artificial
  CRISPR gRNA sequence
gcatggcagcaatgtgaccc

SEQ ID NO: 780945 - DNA, 20 bp, Artificial
  CRISPR gRNA sequence
ctggaatgcaactttgacac

SEQ ID NO: 780946 - DNA, 20 bp, Artificial
  CRISPR gRNA sequence
gaatgcaactttgacactgg

SEQ ID NO: 780947 - DNA, 20 bp, Artificial
  CRISPR gRNA sequence
actggaagtcatgtgaacct

SEQ ID NO: 780948 - DNA, 20 bp, Artificial
  CRISPR gRNA sequence
tggaagtcatgtgaaccttg

SEQ ID NO: 780949 - DNA, 20 bp, Artificial
  CRISPR gRNA sequence
tgtgaaccttggagcaataa

SEQ ID NO: 780950 - DNA, 20 bp, Artificial
  CRISPR gRNA sequence
aaccttggagcaataacagc

SEQ ID NO: 780951 - DNA, 20 bp, Artificial
  CRISPR gRNA sequence
caataacagccagtttgcaa

SEQ ID NO: 780952 - DNA, 20 bp, Artificial
  CRISPR gRNA sequence
aataacagccagtttgcaaa

SEQ ID NO: 780953 - DNA, 20 bp, Artificial
  CRISPR gRNA sequence
aacagccagtttgcaaaagg

SEQ ID NO: 780954 - DNA, 20 bp, Artificial
  CRISPR gRNA sequence
gatacatccccacaccgtga

SEQ ID NO: 780955 - DNA, 20 bp, Artificial
  CRISPR gRNA sequence
tacatccccacaccgtgaaa

SEQ ID NO: 780956 - DNA, 20 bp, Artificial
  CRISPR gRNA sequence
ccgtgaaagagccactttgc

SEQ ID NO: 780957 - DNA, 20 bp, Artificial
  CRISPR gRNA sequence
gtgaaagagccactttgctg

SEQ ID NO: 780958 - DNA, 20 bp, Artificial
  CRISPR gRNA sequence
tgaaagagccactttgctgg

SEQ ID NO: 780959 - DNA, 20 bp, Artificial
  CRISPR gRNA sequence
aaagagccactttgctggag

SEQ ID NO: 780960 - DNA, 20 bp, Artificial
  CRISPR gRNA sequence
gagccactttgctggaggag

SEQ ID NO: 780961 - DNA, 20 bp, Artificial
  CRISPR gRNA sequence
gctggaggagcagctgcccc

SEQ ID NO: 780962 - DNA, 20 bp, Artificial
  CRISPR gRNA sequence
ctggaggagcagctgcccct

SEQ ID NO: 780963 - DNA, 20 bp, Artificial
  CRISPR gRNA sequence
tggaggagcagctgccccta

SEQ ID NO: 780964 - DNA, 20 bp, Artificial
  CRISPR gRNA sequence
aggagcagctgcccctaggg

SEQ ID NO: 780965 - DNA, 20 bp, Artificial
  CRISPR gRNA sequence
ggagcagctgcccctaggga

SEQ ID NO: 780966 - DNA, 20 bp, Artificial
  CRISPR gRNA sequence
ggcctcgttccacatacctc

SEQ ID NO: 780967 - DNA, 20 bp, Artificial
  CRISPR gRNA sequence
gttccacatacctcaagtcc

SEQ ID NO: 780968 - DNA, 20 bp, Artificial
  CRISPR gRNA sequence
cacatacctcaagtccaagt

SEQ ID NO: 780969 - DNA, 20 bp, Artificial
  CRISPR gRNA sequence
acatacctcaagtccaagtg

SEQ ID NO: 780970 - DNA, 20 bp, Artificial
  CRISPR gRNA sequence
catacctcaagtccaagtga

SEQ ID NO: 780971 - DNA, 20 bp, Artificial
  CRISPR gRNA sequence
tcaagtccaagtgagggacg

SEQ ID NO: 780972 - DNA, 20 bp, Artificial
  CRISPR gRNA sequence
caagtccaagtgagggacga

SEQ ID NO: 780973 - DNA, 20 bp, Artificial
  CRISPR gRNA sequence
tccaagtgagggacgaagga

SEQ ID NO: 780974 - DNA, 20 bp, Artificial
  CRISPR gRNA sequence
taccaatgcataatcatcta

SEQ ID NO: 780975 - DNA, 20 bp, Artificial
  CRISPR gRNA sequence
accaatgcataatcatctat

SEQ ID NO: 780976 - DNA, 20 bp, Artificial
  CRISPR gRNA sequence
ccaatgcataatcatctatg

SEQ ID NO: 780977 - DNA, 20 bp, Artificial
  CRISPR gRNA sequence
taatcatctatggggtcgcc

SEQ ID NO: 780978 - DNA, 20 bp, Artificial
  CRISPR gRNA sequence
aatcatctatggggtcgcct

SEQ ID NO: 780979 - DNA, 20 bp, Artificial
  CRISPR gRNA sequence
atggggtcgcctgggactac

SEQ ID NO: 780980 - DNA, 20 bp, Artificial
  CRISPR gRNA sequence
ctacaagtacctgactctga

SEQ ID NO: 780981 - DNA, 20 bp, Artificial
  CRISPR gRNA sequence
gtacctgactctgaaagtca

SEQ ID NO: 780982 - DNA, 20 bp, Artificial
  CRISPR gRNA sequence
tacctgactctgaaagtcaa

SEQ ID NO: 780983 - DNA, 20 bp, Artificial
  CRISPR gRNA sequence
tgactctgaaagtcaaaggt

SEQ ID NO: 780984 - DNA, 20 bp, Artificial
  CRISPR gRNA sequence
ctctgaaagtcaaaggtgag

SEQ ID NO: 780985 - DNA, 20 bp, Artificial
  CRISPR gRNA sequence
agtcaaaggtgagtggtgtc

SEQ ID NO: 780986 - DNA, 20 bp, Artificial
  CRISPR gRNA sequence
gtcaaaggtgagtggtgtca

SEQ ID NO: 780987 - DNA, 20 bp, Artificial
  CRISPR gRNA sequence
aggtgagtggtgtcaaggac

SEQ ID NO: 780988 - DNA, 20 bp, Artificial
  CRISPR gRNA sequence
gtgtcaaggactagaatcca

SEQ ID NO: 780989 - DNA, 20 bp, Artificial
  CRISPR gRNA sequence
tcaaggactagaatccatgg

SEQ ID NO: 780990 - DNA, 20 bp, Artificial
  CRISPR gRNA sequence
ccatggaagcatctctccaa

SEQ ID NO: 780991 - DNA, 20 bp, Artificial
  CRISPR gRNA sequence
atggaagcatctctccaaca

SEQ ID NO: 780992 - DNA, 20 bp, Artificial
  CRISPR gRNA sequence
tggaagcatctctccaacag

SEQ ID NO: 780993 - DNA, 20 bp, Artificial
  CRISPR gRNA sequence
ctctccaacagaggatctgc

SEQ ID NO: 780994 - DNA, 20 bp, Artificial
  CRISPR gRNA sequence
aacagaggatctgcaagtca

SEQ ID NO: 780995 - DNA, 20 bp, Artificial
  CRISPR gRNA sequence
caagtcacagaaacccatta

SEQ ID NO: 780996 - DNA, 20 bp, Artificial
  CRISPR gRNA sequence
aagtcacagaaacccattaa

SEQ ID NO: 780997 - DNA, 20 bp, Artificial
  CRISPR gRNA sequence
tcacagaaacccattaaagg

SEQ ID NO: 780998 - DNA, 20 bp, Artificial
  CRISPR gRNA sequence
aaacccattaaaggtagctc

SEQ ID NO: 780999 - DNA, 20 bp, Artificial
  CRISPR gRNA sequence
aaggtagctcaagcaaaaac

SEQ ID NO: 781000 - DNA, 20 bp, Artificial
  CRISPR gRNA sequence
gtagctcaagcaaaaacaag

SEQ ID NO: 781001 - DNA, 20 bp, Artificial
  CRISPR gRNA sequence
tagctcaagcaaaaacaagc

SEQ ID NO: 781002 - DNA, 20 bp, Artificial
  CRISPR gRNA sequence
aaaacaagcaggctgctttt

SEQ ID NO: 781003 - DNA, 20 bp, Artificial
  CRISPR gRNA sequence
aaacaagcaggctgctttta

SEQ ID NO: 781004 - DNA, 20 bp, Artificial
  CRISPR gRNA sequence
acaagcaggctgcttttaag

SEQ ID NO: 781005 - DNA, 20 bp, Artificial
  CRISPR gRNA sequence
gcaggctgcttttaaggaga

SEQ ID NO: 781006 - DNA, 20 bp, Artificial
  CRISPR gRNA sequence
ttttaaggagacagctattt

SEQ ID NO: 781007 - DNA, 20 bp, Artificial
  CRISPR gRNA sequence
ttaaggagacagctatttca

SEQ ID NO: 781008 - DNA, 20 bp, Artificial
  CRISPR gRNA sequence
agctatttcagagaaaatga

SEQ ID NO: 781009 - DNA, 20 bp, Artificial
  CRISPR gRNA sequence
agaaaatgaaagcatctgct

SEQ ID NO: 781010 - DNA, 20 bp, Artificial
  CRISPR gRNA sequence
ggaaataatttttgacatct

SEQ ID NO: 781011 - DNA, 20 bp, Artificial
  CRISPR gRNA sequence
atttttgacatctgagtaca

SEQ ID NO: 781012 - DNA, 20 bp, Artificial
  CRISPR gRNA sequence
tttgacatctgagtacaaag

SEQ ID NO: 781013 - DNA, 20 bp, Artificial
  CRISPR gRNA sequence
atctgagtacaaagcagccg

SEQ ID NO: 781014 - DNA, 20 bp, Artificial
  CRISPR gRNA sequence
gtacaaagcagccgaagtac

SEQ ID NO: 781015 - DNA, 20 bp, Artificial
  CRISPR gRNA sequence
agcagccgaagtacaagtga

SEQ ID NO: 781016 - DNA, 20 bp, Artificial
  CRISPR gRNA sequence
gcagccgaagtacaagtgaa

SEQ ID NO: 781017 - DNA, 20 bp, Artificial
  CRISPR gRNA sequence
cagccgaagtacaagtgaaa

SEQ ID NO: 781018 - DNA, 20 bp, Artificial
  CRISPR gRNA sequence
agccgaagtacaagtgaaag

SEQ ID NO: 781019 - DNA, 20 bp, Artificial
  CRISPR gRNA sequence
gccgaagtacaagtgaaagg

SEQ ID NO: 781020 - DNA, 20 bp, Artificial
  CRISPR gRNA sequence
gaagtacaagtgaaaggggg

SEQ ID NO: 781021 - DNA, 20 bp, Artificial
  CRISPR gRNA sequence
aagtacaagtgaaagggggt

SEQ ID NO: 781022 - DNA, 20 bp, Artificial
  CRISPR gRNA sequence
gtgaaagggggtaggaccta

SEQ ID NO: 781023 - DNA, 20 bp, Artificial
  CRISPR gRNA sequence
tgaaagggggtaggacctat

SEQ ID NO: 781024 - DNA, 20 bp, Artificial
  CRISPR gRNA sequence
taggacctataggaataaaa

SEQ ID NO: 781025 - DNA, 20 bp, Artificial
  CRISPR gRNA sequence
aggacctataggaataaaat

SEQ ID NO: 781026 - DNA, 20 bp, Artificial
  CRISPR gRNA sequence
ctataggaataaaatgggac

SEQ ID NO: 781027 - DNA, 20 bp, Artificial
  CRISPR gRNA sequence
ataggaataaaatgggactg

SEQ ID NO: 781028 - DNA, 20 bp, Artificial
  CRISPR gRNA sequence
taggaataaaatgggactgg

SEQ ID NO: 781029 - DNA, 20 bp, Artificial
  CRISPR gRNA sequence
gaataaaatgggactggagg

SEQ ID NO: 781030 - DNA, 20 bp, Artificial
  CRISPR gRNA sequence
aaaatgggactggaggaagc

SEQ ID NO: 781031 - DNA, 20 bp, Artificial
  CRISPR gRNA sequence
aaatgggactggaggaagcc

SEQ ID NO: 781032 - DNA, 20 bp, Artificial
  CRISPR gRNA sequence
ctggaggaagccaggaaaat

SEQ ID NO: 781033 - DNA, 20 bp, Artificial
  CRISPR gRNA sequence
gaaaattagtccctgaaatg

SEQ ID NO: 781034 - DNA, 20 bp, Artificial
  CRISPR gRNA sequence
aaaattagtccctgaaatgt

SEQ ID NO: 781035 - DNA, 20 bp, Artificial
  CRISPR gRNA sequence
aattagtccctgaaatgtgg

SEQ ID NO: 781036 - DNA, 20 bp, Artificial
  CRISPR gRNA sequence
attagtccctgaaatgtggg

SEQ ID NO: 781037 - DNA, 20 bp, Artificial
  CRISPR gRNA sequence
ttagtccctgaaatgtggga

SEQ ID NO: 781038 - DNA, 20 bp, Artificial
  CRISPR gRNA sequence
tgtgggagggtatgaaaaat

SEQ ID NO: 781039 - DNA, 20 bp, Artificial
  CRISPR gRNA sequence
cctaattcacaattctccca

SEQ ID NO: 781040 - DNA, 20 bp, Artificial
  CRISPR gRNA sequence
acatccctgacttgattatt

SEQ ID NO: 781041 - DNA, 20 bp, Artificial
  CRISPR gRNA sequence
attaagatactctttttcaa

SEQ ID NO: 781042 - DNA, 20 bp, Artificial
  CRISPR gRNA sequence
aatagtttataccctgaatc

SEQ ID NO: 781043 - DNA, 20 bp, Artificial
  CRISPR gRNA sequence
tagtttataccctgaatcca

SEQ ID NO: 781044 - DNA, 20 bp, Artificial
  CRISPR gRNA sequence
atccagagtttttaaaacca

SEQ ID NO: 781045 - DNA, 20 bp, Artificial
  CRISPR gRNA sequence
catggtttgccgcccattca

SEQ ID NO: 781046 - DNA, 20 bp, Artificial
  CRISPR gRNA sequence
catggattaaaatatcaatt

SEQ ID NO: 781047 - DNA, 20 bp, Artificial
  CRISPR gRNA sequence
gattaaaatatcaatttagt

SEQ ID NO: 781048 - DNA, 20 bp, Artificial
  CRISPR gRNA sequence
taaaatatcaatttagtgag

SEQ ID NO: 781049 - DNA, 20 bp, Artificial
  CRISPR gRNA sequence
tcaatttagtgagtagcaac

SEQ ID NO: 781050 - DNA, 20 bp, Artificial
  CRISPR gRNA sequence
gccctttaaaaaataatgta

SEQ ID NO: 781051 - DNA, 20 bp, Artificial
  CRISPR gRNA sequence
ctttaaaaaataatgtatag

SEQ ID NO: 781052 - DNA, 20 bp, Artificial
  CRISPR gRNA sequence
ttaaaaaataatgtatagaa

SEQ ID NO: 781053 - DNA, 20 bp, Artificial
  CRISPR gRNA sequence
aaataatgtatagaagagaa

SEQ ID NO: 781054 - DNA, 20 bp, Artificial
  CRISPR gRNA sequence
aatgtatagaagagaataga

SEQ ID NO: 781055 - DNA, 20 bp, Artificial
  CRISPR gRNA sequence
tgtatagaagagaatagaca

SEQ ID NO: 781056 - DNA, 20 bp, Artificial
  CRISPR gRNA sequence
atagaagagaatagacagag

SEQ ID NO: 781057 - DNA, 20 bp, Artificial
  CRISPR gRNA sequence
agagaatagacagagtagat

SEQ ID NO: 781058 - DNA, 20 bp, Artificial
  CRISPR gRNA sequence
gagtagatcagacgacatca

SEQ ID NO: 781059 - DNA, 20 bp, Artificial
  CRISPR gRNA sequence
gtagatcagacgacatcaca

SEQ ID NO: 781060 - DNA, 20 bp, Artificial
  CRISPR gRNA sequence
gatcagacgacatcacagag

SEQ ID NO: 781061 - DNA, 20 bp, Artificial
  CRISPR gRNA sequence
atcagacgacatcacagagt

SEQ ID NO: 781062 - DNA, 20 bp, Artificial
  CRISPR gRNA sequence
cgacatcacagagtaggact

SEQ ID NO: 781063 - DNA, 20 bp, Artificial
  CRISPR gRNA sequence
gtactgtaaaactaatttct

SEQ ID NO: 781064 - DNA, 20 bp, Artificial
  CRISPR gRNA sequence
tactgtaaaactaatttctg

SEQ ID NO: 781065 - DNA, 20 bp, Artificial
  CRISPR gRNA sequence
actgtaaaactaatttctga

SEQ ID NO: 781066 - DNA, 20 bp, Artificial
  CRISPR gRNA sequence
gtgtgtgtgtgtgtgcgtgt

SEQ ID NO: 781067 - DNA, 20 bp, Artificial
  CRISPR gRNA sequence
tgtgtgtgtgtgtgcgtgtt

SEQ ID NO: 781068 - DNA, 20 bp, Artificial
  CRISPR gRNA sequence
tgtgtgtgcgtgttgggtca

SEQ ID NO: 781069 - DNA, 20 bp, Artificial
  CRISPR gRNA sequence
aaattttttttttcttactt

SEQ ID NO: 781070 - DNA, 20 bp, Artificial
  CRISPR gRNA sequence
ttcttactttggatcataaa

SEQ ID NO: 781071 - DNA, 20 bp, Artificial
  CRISPR gRNA sequence
tttggatcataaaaagttac

SEQ ID NO: 781072 - DNA, 20 bp, Artificial
  CRISPR gRNA sequence
atcataaaaagttacaagtt

SEQ ID NO: 781073 - DNA, 20 bp, Artificial
  CRISPR gRNA sequence
ggaaaacactgctcaaatgc

SEQ ID NO: 781074 - DNA, 20 bp, Artificial
  CRISPR gRNA sequence
aatgcaagccctatttattg

SEQ ID NO: 781075 - DNA, 20 bp, Artificial
  CRISPR gRNA sequence
agccctatttattgcagatg

SEQ ID NO: 781076 - DNA, 20 bp, Artificial
  CRISPR gRNA sequence
cctatttattgcagatgaag

SEQ ID NO: 781077 - DNA, 20 bp, Artificial
  CRISPR gRNA sequence
ttattgcagatgaagtagct

SEQ ID NO: 781078 - DNA, 20 bp, Artificial
  CRISPR gRNA sequence
cagatgaagtagctgagatc

SEQ ID NO: 781079 - DNA, 20 bp, Artificial
  CRISPR gRNA sequence
gatgaagtagctgagatcca

SEQ ID NO: 781080 - DNA, 20 bp, Artificial
  CRISPR gRNA sequence
gaagtagctgagatccagag

SEQ ID NO: 781081 - DNA, 20 bp, Artificial
  CRISPR gRNA sequence
aagtagctgagatccagaga

SEQ ID NO: 781082 - DNA, 20 bp, Artificial
  CRISPR gRNA sequence
agtagctgagatccagagaa

SEQ ID NO: 781083 - DNA, 20 bp, Artificial
  CRISPR gRNA sequence
agctgagatccagagaaggg

SEQ ID NO: 781084 - DNA, 20 bp, Artificial
  CRISPR gRNA sequence
tgagatccagagaagggaag

SEQ ID NO: 781085 - DNA, 20 bp, Artificial
  CRISPR gRNA sequence
gagatccagagaagggaagt

SEQ ID NO: 781086 - DNA, 20 bp, Artificial
  CRISPR gRNA sequence
atccagagaagggaagtggg

SEQ ID NO: 781087 - DNA, 20 bp, Artificial
  CRISPR gRNA sequence
agaagggaagtgggtagccc

SEQ ID NO: 781088 - DNA, 20 bp, Artificial
  CRISPR gRNA sequence
aagggaagtgggtagcccaa

SEQ ID NO: 781089 - DNA, 20 bp, Artificial
  CRISPR gRNA sequence
gggaagtgggtagcccaaga

SEQ ID NO: 781090 - DNA, 20 bp, Artificial
  CRISPR gRNA sequence
tagcccaagagagtcccatg

SEQ ID NO: 781091 - DNA, 20 bp, Artificial
  CRISPR gRNA sequence
agagagtcccatgaagtcta

SEQ ID NO: 781092 - DNA, 20 bp, Artificial
  CRISPR gRNA sequence
tatagctgtccctattcctc

SEQ ID NO: 781093 - DNA, 20 bp, Artificial
  CRISPR gRNA sequence
tgtccctattcctctggatt

SEQ ID NO: 781094 - DNA, 20 bp, Artificial
  CRISPR gRNA sequence
gtccctattcctctggattc

SEQ ID NO: 781095 - DNA, 20 bp, Artificial
  CRISPR gRNA sequence
tccctattcctctggattca

SEQ ID NO: 781096 - DNA, 20 bp, Artificial
  CRISPR gRNA sequence
attcagggatctctccactc

SEQ ID NO: 781097 - DNA, 20 bp, Artificial
  CRISPR gRNA sequence
caattgaaaatctaaatata

SEQ ID NO: 781098 - DNA, 20 bp, Artificial
  CRISPR gRNA sequence
attgaaaatctaaatataaa

SEQ ID NO: 781099 - DNA, 20 bp, Artificial
  CRISPR gRNA sequence
cttcacactcttgtttgttc

SEQ ID NO: 781100 - DNA, 20 bp, Artificial
  CRISPR gRNA sequence
cactcttgtttgttctagaa

SEQ ID NO: 781101 - DNA, 20 bp, Artificial
  CRISPR gRNA sequence
actcttgtttgttctagaaa

SEQ ID NO: 781102 - DNA, 20 bp, Artificial
  CRISPR gRNA sequence
tgttctagaaaaggtgattt

SEQ ID NO: 781103 - DNA, 20 bp, Artificial
  CRISPR gRNA sequence
gttctagaaaaggtgatttg

SEQ ID NO: 781104 - DNA, 20 bp, Artificial
  CRISPR gRNA sequence
tagaaaaggtgatttgagga

SEQ ID NO: 781105 - DNA, 20 bp, Artificial
  CRISPR gRNA sequence
catataacaactataaaaaa

SEQ ID NO: 781106 - DNA, 20 bp, Artificial
  CRISPR gRNA sequence
aatagattttgcttgttcat

SEQ ID NO: 781107 - DNA, 20 bp, Artificial
  CRISPR gRNA sequence
tttgcttgttcattggctta

SEQ ID NO: 781108 - DNA, 20 bp, Artificial
  CRISPR gRNA sequence
gttcattggcttatggtctc

SEQ ID NO: 781109 - DNA, 20 bp, Artificial
  CRISPR gRNA sequence
ttcattggcttatggtctcc

SEQ ID NO: 781110 - DNA, 20 bp, Artificial
  CRISPR gRNA sequence
tctccaggcttgaatgctct

SEQ ID NO: 781111 - DNA, 20 bp, Artificial
  CRISPR gRNA sequence
aaatgatgccaatatttctc

SEQ ID NO: 781112 - DNA, 20 bp, Artificial
  CRISPR gRNA sequence
cctcttcccctcccacgcat

SEQ ID NO: 781113 - DNA, 20 bp, Artificial
  CRISPR gRNA sequence
ccctcccacgcattggacct

SEQ ID NO: 781114 - DNA, 20 bp, Artificial
  CRISPR gRNA sequence
cccacgcattggacctcaga

SEQ ID NO: 781115 - DNA, 20 bp, Artificial
  CRISPR gRNA sequence
agatggtctgtactgtcttc

SEQ ID NO: 781116 - DNA, 20 bp, Artificial
  CRISPR gRNA sequence
atggtctgtactgtcttcta

SEQ ID NO: 781117 - DNA, 20 bp, Artificial
  CRISPR gRNA sequence
tggtctgtactgtcttctag

SEQ ID NO: 781118 - DNA, 20 bp, Artificial
  CRISPR gRNA sequence
ggtctgtactgtcttctaga

SEQ ID NO: 781119 - DNA, 20 bp, Artificial
  CRISPR gRNA sequence
actgtcttctagagggtttg

SEQ ID NO: 781120 - DNA, 20 bp, Artificial
  CRISPR gRNA sequence
ctgtcttctagagggtttgt

SEQ ID NO: 781121 - DNA, 20 bp, Artificial
  CRISPR gRNA sequence
tctagagggtttgtgggttt

SEQ ID NO: 781122 - DNA, 20 bp, Artificial
  CRISPR gRNA sequence
ccccaaaaaaccattaacct

SEQ ID NO: 781123 - DNA, 20 bp, Artificial
  CRISPR gRNA sequence
caaaaaaccattaaccttgg

SEQ ID NO: 781124 - DNA, 20 bp, Artificial
  CRISPR gRNA sequence
aaaccattaaccttggcaga

SEQ ID NO: 781125 - DNA, 20 bp, Artificial
  CRISPR gRNA sequence
aagtgtgtgactttatgatc

SEQ ID NO: 781126 - DNA, 20 bp, Artificial
  CRISPR gRNA sequence
tgactttatgatctggtaca

SEQ ID NO: 781127 - DNA, 20 bp, Artificial
  CRISPR gRNA sequence
ctttatgatctggtacaaag

SEQ ID NO: 781128 - DNA, 20 bp, Artificial
  CRISPR gRNA sequence
tttatgatctggtacaaaga

SEQ ID NO: 781129 - DNA, 20 bp, Artificial
  CRISPR gRNA sequence
tggtacaaagaaggacaaac

SEQ ID NO: 781130 - DNA, 20 bp, Artificial
  CRISPR gRNA sequence
gtacaaagaaggacaaacta

SEQ ID NO: 781131 - DNA, 20 bp, Artificial
  CRISPR gRNA sequence
tacaaagaaggacaaactag

SEQ ID NO: 781132 - DNA, 20 bp, Artificial
  CRISPR gRNA sequence
acaaagaaggacaaactaga

SEQ ID NO: 781133 - DNA, 20 bp, Artificial
  CRISPR gRNA sequence
gaaggacaaactagagggac

SEQ ID NO: 781134 - DNA, 20 bp, Artificial
  CRISPR gRNA sequence
aaactagagggactggacat

SEQ ID NO: 781135 - DNA, 20 bp, Artificial
  CRISPR gRNA sequence
aactagagggactggacatg

SEQ ID NO: 781136 - DNA, 20 bp, Artificial
  CRISPR gRNA sequence
attgtgttcgcccttatcct

SEQ ID NO: 781137 - DNA, 20 bp, Artificial
  CRISPR gRNA sequence
ttgtgttcgcccttatcctt

SEQ ID NO: 781138 - DNA, 20 bp, Artificial
  CRISPR gRNA sequence
tgttcgcccttatccttggg

SEQ ID NO: 781139 - DNA, 20 bp, Artificial
  CRISPR gRNA sequence
gttcgcccttatccttgggc

SEQ ID NO: 781140 - DNA, 20 bp, Artificial
  CRISPR gRNA sequence
cctcacattttgcttatttg

SEQ ID NO: 781141 - DNA, 20 bp, Artificial
  CRISPR gRNA sequence
cacattttgcttatttgtag

SEQ ID NO: 781142 - DNA, 20 bp, Artificial
  CRISPR gRNA sequence
tatttgtagaagacgaacaa

SEQ ID NO: 781143 - DNA, 20 bp, Artificial
  CRISPR gRNA sequence
ttgtagaagacgaacaatag

SEQ ID NO: 781144 - DNA, 20 bp, Artificial
  CRISPR gRNA sequence
caatagtagtaccaaacaca

SEQ ID NO: 781145 - DNA, 20 bp, Artificial
  CRISPR gRNA sequence
aatagtagtaccaaacacac

SEQ ID NO: 781146 - DNA, 20 bp, Artificial
  CRISPR gRNA sequence
acaggattgttgtcaacatt

SEQ ID NO: 781147 - DNA, 20 bp, Artificial
  CRISPR gRNA sequence
aggattgttgtcaacattga

SEQ ID NO: 781148 - DNA, 20 bp, Artificial
  CRISPR gRNA sequence
gattgttgtcaacattgaga

SEQ ID NO: 781149 - DNA, 20 bp, Artificial
  CRISPR gRNA sequence
tgagagagataatgaacata

SEQ ID NO: 781150 - DNA, 20 bp, Artificial
  CRISPR gRNA sequence
gataatgaacataaagaact

SEQ ID NO: 781151 - DNA, 20 bp, Artificial
  CRISPR gRNA sequence
tgaacataaagaactgagca

SEQ ID NO: 781152 - DNA, 20 bp, Artificial
  CRISPR gRNA sequence
aaagaactgagcatggtacc

SEQ ID NO: 781153 - DNA, 20 bp, Artificial
  CRISPR gRNA sequence
catggtacccggcatataat

SEQ ID NO: 781154 - DNA, 20 bp, Artificial
  CRISPR gRNA sequence
cccggcatataataagtgtc

SEQ ID NO: 781155 - DNA, 20 bp, Artificial
  CRISPR gRNA sequence
cggcatataataagtgtcca

SEQ ID NO: 781156 - DNA, 20 bp, Artificial
  CRISPR gRNA sequence
ataataagtgtccagagact

SEQ ID NO: 781157 - DNA, 20 bp, Artificial
  CRISPR gRNA sequence
gtgtccagagacttggttaa

SEQ ID NO: 781158 - DNA, 20 bp, Artificial
  CRISPR gRNA sequence
agacttggttaaaagaccct

SEQ ID NO: 781159 - DNA, 20 bp, Artificial
  CRISPR gRNA sequence
taaaagaccctcagttgtta

SEQ ID NO: 781160 - DNA, 20 bp, Artificial
  CRISPR gRNA sequence
aaaagaccctcagttgttac

SEQ ID NO: 781161 - DNA, 20 bp, Artificial
  CRISPR gRNA sequence
aaagaccctcagttgttaca

SEQ ID NO: 781162 - DNA, 20 bp, Artificial
  CRISPR gRNA sequence
aagaccctcagttgttacag

SEQ ID NO: 781163 - DNA, 20 bp, Artificial
  CRISPR gRNA sequence
accctcagttgttacagggg

SEQ ID NO: 781164 - DNA, 20 bp, Artificial
  CRISPR gRNA sequence
ctcacacctcaaccatcaat

SEQ ID NO: 781165 - DNA, 20 bp, Artificial
  CRISPR gRNA sequence
ctcaaccatcaatgagtcac

SEQ ID NO: 781166 - DNA, 20 bp, Artificial
  CRISPR gRNA sequence
tcaaccatcaatgagtcacc

SEQ ID NO: 781167 - DNA, 20 bp, Artificial
  CRISPR gRNA sequence
ccatcaatgagtcaccagga

SEQ ID NO: 781168 - DNA, 20 bp, Artificial
  CRISPR gRNA sequence
tgagtcaccaggaaagccat

SEQ ID NO: 781169 - DNA, 20 bp, Artificial
  CRISPR gRNA sequence
caccaggaaagccattagcc

SEQ ID NO: 781170 - DNA, 20 bp, Artificial
  CRISPR gRNA sequence
tttattgcatttcctacatc

SEQ ID NO: 781171 - DNA, 20 bp, Artificial
  CRISPR gRNA sequence
ttattgcatttcctacatcc

SEQ ID NO: 781172 - DNA, 20 bp, Artificial
  CRISPR gRNA sequence
ttgcatttcctacatccagg

SEQ ID NO: 781173 - DNA, 20 bp, Artificial
  CRISPR gRNA sequence
catttcctacatccaggcag

SEQ ID NO: 781174 - DNA, 20 bp, Artificial
  CRISPR gRNA sequence
tcctacatccaggcagcagc

SEQ ID NO: 781175 - DNA, 20 bp, Artificial
  CRISPR gRNA sequence
cctacatccaggcagcagct

SEQ ID NO: 781176 - DNA, 20 bp, Artificial
  CRISPR gRNA sequence
tacatccaggcagcagctgg

SEQ ID NO: 781177 - DNA, 20 bp, Artificial
  CRISPR gRNA sequence
acatccaggcagcagctggg

SEQ ID NO: 781178 - DNA, 20 bp, Artificial
  CRISPR gRNA sequence
gcagcagctgggaggaactc

SEQ ID NO: 781179 - DNA, 20 bp, Artificial
  CRISPR gRNA sequence
ggaggaactctagaacactg

SEQ ID NO: 781180 - DNA, 20 bp, Artificial
  CRISPR gRNA sequence
tagaacactgaagtttgtct

SEQ ID NO: 781181 - DNA, 20 bp, Artificial
  CRISPR gRNA sequence
tgtctgagttcccttaatgt

SEQ ID NO: 781182 - DNA, 20 bp, Artificial
  CRISPR gRNA sequence
gtctgagttcccttaatgta

SEQ ID NO: 781183 - DNA, 20 bp, Artificial
  CRISPR gRNA sequence
aatgtaaggctgtacattct

SEQ ID NO: 781184 - DNA, 20 bp, Artificial
  CRISPR gRNA sequence
atgtaaggctgtacattctc

SEQ ID NO: 781185 - DNA, 20 bp, Artificial
  CRISPR gRNA sequence
ctatctgaatgctgtattaa

SEQ ID NO: 781186 - DNA, 20 bp, Artificial
  CRISPR gRNA sequence
tatctgaatgctgtattaat

SEQ ID NO: 781187 - DNA, 20 bp, Artificial
  CRISPR gRNA sequence
tgaatgctgtattaatgggc

SEQ ID NO: 781188 - DNA, 20 bp, Artificial
  CRISPR gRNA sequence
gaatgctgtattaatgggcc

SEQ ID NO: 781189 - DNA, 20 bp, Artificial
  CRISPR gRNA sequence
tctgcccattctctcaaact

SEQ ID NO: 781190 - DNA, 20 bp, Artificial
  CRISPR gRNA sequence
tgagaactgtctctcattcc

SEQ ID NO: 781191 - DNA, 20 bp, Artificial
  CRISPR gRNA sequence
gagaactgtctctcattcct

SEQ ID NO: 781192 - DNA, 20 bp, Artificial
  CRISPR gRNA sequence
agaactgtctctcattcctg

SEQ ID NO: 781193 - DNA, 20 bp, Artificial
  CRISPR gRNA sequence
aactgtctctcattcctggg

SEQ ID NO: 781194 - DNA, 20 bp, Artificial
  CRISPR gRNA sequence
actgtctctcattcctgggg

SEQ ID NO: 781195 - DNA, 20 bp, Artificial
  CRISPR gRNA sequence
caccctgcctactccttacc

SEQ ID NO: 781196 - DNA, 20 bp, Artificial
  CRISPR gRNA sequence
tgcctactccttacctagat

SEQ ID NO: 781197 - DNA, 20 bp, Artificial
  CRISPR gRNA sequence
gcctactccttacctagatc

SEQ ID NO: 781198 - DNA, 20 bp, Artificial
  CRISPR gRNA sequence
cctactccttacctagatca

SEQ ID NO: 781199 - DNA, 20 bp, Artificial
  CRISPR gRNA sequence
tacctagatcagggatttct

SEQ ID NO: 781200 - DNA, 20 bp, Artificial
  CRISPR gRNA sequence
gatcagggatttctcagttg

SEQ ID NO: 781201 - DNA, 20 bp, Artificial
  CRISPR gRNA sequence
tcagggatttctcagttgtg

SEQ ID NO: 781202 - DNA, 20 bp, Artificial
  CRISPR gRNA sequence
agggatttctcagttgtgga

SEQ ID NO: 781203 - DNA, 20 bp, Artificial
  CRISPR gRNA sequence
gtggagagatttgttcctta

SEQ ID NO: 781204 - DNA, 20 bp, Artificial
  CRISPR gRNA sequence
agatttgttccttatagtgt

SEQ ID NO: 781205 - DNA, 20 bp, Artificial
  CRISPR gRNA sequence
tatagtgttggtcatcaaac

SEQ ID NO: 781206 - DNA, 20 bp, Artificial
  CRISPR gRNA sequence
atagtgttggtcatcaaact

SEQ ID NO: 781207 - DNA, 20 bp, Artificial
  CRISPR gRNA sequence
ggtcatcaaactgggatatt

SEQ ID NO: 781208 - DNA, 20 bp, Artificial
  CRISPR gRNA sequence
gtcatcaaactgggatattt

SEQ ID NO: 781209 - DNA, 20 bp, Artificial
  CRISPR gRNA sequence
tcatcaaactgggatatttg

SEQ ID NO: 781210 - DNA, 20 bp, Artificial
  CRISPR gRNA sequence
tgggatatttggggattaca

SEQ ID NO: 781211 - DNA, 20 bp, Artificial
  CRISPR gRNA sequence
ggggattacaaagacttttc

SEQ ID NO: 781212 - DNA, 20 bp, Artificial
  CRISPR gRNA sequence
gggattacaaagacttttca

SEQ ID NO: 781213 - DNA, 20 bp, Artificial
  CRISPR gRNA sequence
ggattacaaagacttttcaa

SEQ ID NO: 781214 - DNA, 20 bp, Artificial
  CRISPR gRNA sequence
aagacttttcaagggatgta

SEQ ID NO: 781215 - DNA, 20 bp, Artificial
  CRISPR gRNA sequence
agacttttcaagggatgtat

SEQ ID NO: 781216 - DNA, 20 bp, Artificial
  CRISPR gRNA sequence
tttcaagggatgtatgggca

SEQ ID NO: 781217 - DNA, 20 bp, Artificial
  CRISPR gRNA sequence
ttcaagggatgtatgggcac

SEQ ID NO: 781218 - DNA, 20 bp, Artificial
  CRISPR gRNA sequence
aagggatgtatgggcacagg

SEQ ID NO: 781219 - DNA, 20 bp, Artificial
  CRISPR gRNA sequence
tgtatgggcacaggcagttt

SEQ ID NO: 781220 - DNA, 20 bp, Artificial
  CRISPR gRNA sequence
gtatgggcacaggcagtttt

SEQ ID NO: 781221 - DNA, 20 bp, Artificial
  CRISPR gRNA sequence
tgggcacaggcagttttagg

SEQ ID NO: 781222 - DNA, 20 bp, Artificial
  CRISPR gRNA sequence
cacaggcagttttaggaagt

SEQ ID NO: 781223 - DNA, 20 bp, Artificial
  CRISPR gRNA sequence
agttttaggaagtgagttcc

SEQ ID NO: 781224 - DNA, 20 bp, Artificial
  CRISPR gRNA sequence
tactcgttcccaaaattgac

SEQ ID NO: 781225 - DNA, 20 bp, Artificial
  CRISPR gRNA sequence
gagcctgacaatgtgcatgc

SEQ ID NO: 781226 - DNA, 20 bp, Artificial
  CRISPR gRNA sequence
agcctgacaatgtgcatgcc

SEQ ID NO: 781227 - DNA, 20 bp, Artificial
  CRISPR gRNA sequence
tgacaatgtgcatgccaggc

SEQ ID NO: 781228 - DNA, 20 bp, Artificial
  CRISPR gRNA sequence
gacaatgtgcatgccaggca

SEQ ID NO: 781229 - DNA, 20 bp, Artificial
  CRISPR gRNA sequence
tgcatgccaggcaaggctct

SEQ ID NO: 781230 - DNA, 20 bp, Artificial
  CRISPR gRNA sequence
gcatgccaggcaaggctctt

SEQ ID NO: 781231 - DNA, 20 bp, Artificial
  CRISPR gRNA sequence
catgccaggcaaggctcttg

SEQ ID NO: 781232 - DNA, 20 bp, Artificial
  CRISPR gRNA sequence
cctaaaacacttcctctttt

SEQ ID NO: 781233 - DNA, 20 bp, Artificial
  CRISPR gRNA sequence
ccactcactcatcatgaata

SEQ ID NO: 781234 - DNA, 20 bp, Artificial
  CRISPR gRNA sequence
atgaatatagtccattgtcc

SEQ ID NO: 781235 - DNA, 20 bp, Artificial
  CRISPR gRNA sequence
tgaatatagtccattgtccc

SEQ ID NO: 781236 - DNA, 20 bp, Artificial
  CRISPR gRNA sequence
gaatatagtccattgtccca

SEQ ID NO: 781237 - DNA, 20 bp, Artificial
  CRISPR gRNA sequence
ccagggtgtaaaaccctcta

SEQ ID NO: 781238 - DNA, 20 bp, Artificial
  CRISPR gRNA sequence
ccctctatagtgttaaataa

SEQ ID NO: 781239 - DNA, 20 bp, Artificial
  CRISPR gRNA sequence
gtgttaaataaaagaatgat

SEQ ID NO: 781240 - DNA, 20 bp, Artificial
  CRISPR gRNA sequence
tgttaaataaaagaatgatt

SEQ ID NO: 781241 - DNA, 20 bp, Artificial
  CRISPR gRNA sequence
ttgggaacattgacacctga

SEQ ID NO: 781242 - DNA, 20 bp, Artificial
  CRISPR gRNA sequence
aaacccttttgcaaataatg

SEQ ID NO: 781243 - DNA, 20 bp, Artificial
  CRISPR gRNA sequence
ttctgctttcaacaaaattg

SEQ ID NO: 781244 - DNA, 20 bp, Artificial
  CRISPR gRNA sequence
tctgctttcaacaaaattga

SEQ ID NO: 781245 - DNA, 20 bp, Artificial
  CRISPR gRNA sequence
tgctttcaacaaaattgaag

SEQ ID NO: 781246 - DNA, 20 bp, Artificial
  CRISPR gRNA sequence
gctttcaacaaaattgaagg

SEQ ID NO: 781247 - DNA, 20 bp, Artificial
  CRISPR gRNA sequence
aattgaaggaggcccttata

SEQ ID NO: 781248 - DNA, 20 bp, Artificial
  CRISPR gRNA sequence
aataactgataatcaaaaat

SEQ ID NO: 781249 - DNA, 20 bp, Artificial
  CRISPR gRNA sequence
gtaatttttgccatgtaaat

SEQ ID NO: 781250 - DNA, 20 bp, Artificial
  CRISPR gRNA sequence
taatttttgccatgtaaatc

SEQ ID NO: 781251 - DNA, 20 bp, Artificial
  CRISPR gRNA sequence
ttgccatgtaaatcaggtca

SEQ ID NO: 781252 - DNA, 20 bp, Artificial
  CRISPR gRNA sequence
aatcaggtcaaagaatgaaa

SEQ ID NO: 781253 - DNA, 20 bp, Artificial
  CRISPR gRNA sequence
attgatttactcatacgaac

SEQ ID NO: 781254 - DNA, 20 bp, Artificial
  CRISPR gRNA sequence
ctcatacgaacaagattcct

SEQ ID NO: 781255 - DNA, 20 bp, Artificial
  CRISPR gRNA sequence
caagattccttagcctttat

SEQ ID NO: 781256 - DNA, 20 bp, Artificial
  CRISPR gRNA sequence
agctacaaaaaaatgaaaaa

SEQ ID NO: 781257 - DNA, 20 bp, Artificial
  CRISPR gRNA sequence
aaaaaaatgaaaaatagaaa

SEQ ID NO: 781258 - DNA, 20 bp, Artificial
  CRISPR gRNA sequence
tgaaaaatagaaatagaatt

SEQ ID NO: 781259 - DNA, 20 bp, Artificial
  CRISPR gRNA sequence
gaaaaatagaaatagaattg

SEQ ID NO: 781260 - DNA, 20 bp, Artificial
  CRISPR gRNA sequence
atcattccaaccatgtcata

SEQ ID NO: 781261 - DNA, 20 bp, Artificial
  CRISPR gRNA sequence
aaccatgtcatatggttctt

SEQ ID NO: 781262 - DNA, 20 bp, Artificial
  CRISPR gRNA sequence
cttcggattcatgaataatt

SEQ ID NO: 781263 - DNA, 20 bp, Artificial
  CRISPR gRNA sequence
gattcatgaataatttggaa

SEQ ID NO: 781264 - DNA, 20 bp, Artificial
  CRISPR gRNA sequence
ttcatgaataatttggaaaa

SEQ ID NO: 781265 - DNA, 20 bp, Artificial
  CRISPR gRNA sequence
catgaataatttggaaaaga

SEQ ID NO: 781266 - DNA, 20 bp, Artificial
  CRISPR gRNA sequence
agagccatatccatcttatt

SEQ ID NO: 781267 - DNA, 20 bp, Artificial
  CRISPR gRNA sequence
gagccatatccatcttatta

SEQ ID NO: 781268 - DNA, 20 bp, Artificial
  CRISPR gRNA sequence
agccatatccatcttattaa

SEQ ID NO: 781269 - DNA, 20 bp, Artificial
  CRISPR gRNA sequence
caaatatgtgttaataataa

SEQ ID NO: 781270 - DNA, 20 bp, Artificial
  CRISPR gRNA sequence
aaataaatgtccaacaacga

SEQ ID NO: 781271 - DNA, 20 bp, Artificial
  CRISPR gRNA sequence
aatgtccaacaacgatagac

SEQ ID NO: 781272 - DNA, 20 bp, Artificial
  CRISPR gRNA sequence
caacaacgatagactggatt

SEQ ID NO: 781273 - DNA, 20 bp, Artificial
  CRISPR gRNA sequence
tagactggattaagaaaatg

SEQ ID NO: 781274 - DNA, 20 bp, Artificial
  CRISPR gRNA sequence
aatgtggcacgtatacacca

SEQ ID NO: 781275 - DNA, 20 bp, Artificial
  CRISPR gRNA sequence
atacaccatagaatactatg

SEQ ID NO: 781276 - DNA, 20 bp, Artificial
  CRISPR gRNA sequence
atgcagccataaaaaatgat

SEQ ID NO: 781277 - DNA, 20 bp, Artificial
  CRISPR gRNA sequence
tgatgagttcatgtccttcg

SEQ ID NO: 781278 - DNA, 20 bp, Artificial
  CRISPR gRNA sequence
gatgagttcatgtccttcgt

SEQ ID NO: 781279 - DNA, 20 bp, Artificial
  CRISPR gRNA sequence
atgagttcatgtccttcgta

SEQ ID NO: 781280 - DNA, 20 bp, Artificial
  CRISPR gRNA sequence
tcatgtccttcgtagggaca

SEQ ID NO: 781281 - DNA, 20 bp, Artificial
  CRISPR gRNA sequence
ccttcgtagggacatggatg

SEQ ID NO: 781282 - DNA, 20 bp, Artificial
  CRISPR gRNA sequence
cgtagggacatggatgaagc

SEQ ID NO: 781283 - DNA, 20 bp, Artificial
  CRISPR gRNA sequence
aagctggaaaccatcattct

SEQ ID NO: 781284 - DNA, 20 bp, Artificial
  CRISPR gRNA sequence
cattctcagcaaactatccc

SEQ ID NO: 781285 - DNA, 20 bp, Artificial
  CRISPR gRNA sequence
attctcagcaaactatccca

SEQ ID NO: 781286 - DNA, 20 bp, Artificial
  CRISPR gRNA sequence
acaccgcatgttctcactca

SEQ ID NO: 781287 - DNA, 20 bp, Artificial
  CRISPR gRNA sequence
caccgcatgttctcactcat

SEQ ID NO: 781288 - DNA, 20 bp, Artificial
  CRISPR gRNA sequence
cgcatgttctcactcatagg

SEQ ID NO: 781289 - DNA, 20 bp, Artificial
  CRISPR gRNA sequence
gcatgttctcactcataggt

SEQ ID NO: 781290 - DNA, 20 bp, Artificial
  CRISPR gRNA sequence
ataggtgggaattgaacaat

SEQ ID NO: 781291 - DNA, 20 bp, Artificial
  CRISPR gRNA sequence
aattgaacaatgagaacaca

SEQ ID NO: 781292 - DNA, 20 bp, Artificial
  CRISPR gRNA sequence
acaatgagaacacatggaca

SEQ ID NO: 781293 - DNA, 20 bp, Artificial
  CRISPR gRNA sequence
caatgagaacacatggacac

SEQ ID NO: 781294 - DNA, 20 bp, Artificial
  CRISPR gRNA sequence
aatgagaacacatggacaca

SEQ ID NO: 781295 - DNA, 20 bp, Artificial
  CRISPR gRNA sequence
tgagaacacatggacacagg

SEQ ID NO: 781296 - DNA, 20 bp, Artificial
  CRISPR gRNA sequence
gagaacacatggacacaggg

SEQ ID NO: 781297 - DNA, 20 bp, Artificial
  CRISPR gRNA sequence
agaacacatggacacaggga

SEQ ID NO: 781298 - DNA, 20 bp, Artificial
  CRISPR gRNA sequence
gaacacatggacacagggag

SEQ ID NO: 781299 - DNA, 20 bp, Artificial
  CRISPR gRNA sequence
gggaggggaacatcacacac

SEQ ID NO: 781300 - DNA, 20 bp, Artificial
  CRISPR gRNA sequence
ggaggggaacatcacacact

SEQ ID NO: 781301 - DNA, 20 bp, Artificial
  CRISPR gRNA sequence
gaggggaacatcacacactg

SEQ ID NO: 781302 - DNA, 20 bp, Artificial
  CRISPR gRNA sequence
acacactggggactgttgtg

SEQ ID NO: 781303 - DNA, 20 bp, Artificial
  CRISPR gRNA sequence
actggggactgttgtgtggt

SEQ ID NO: 781304 - DNA, 20 bp, Artificial
  CRISPR gRNA sequence
ctggggactgttgtgtggtc

SEQ ID NO: 781305 - DNA, 20 bp, Artificial
  CRISPR gRNA sequence
tggggactgttgtgtggtcg

SEQ ID NO: 781306 - DNA, 20 bp, Artificial
  CRISPR gRNA sequence
ggggactgttgtgtggtcgg

SEQ ID NO: 781307 - DNA, 20 bp, Artificial
  CRISPR gRNA sequence
ggactgttgtgtggtcgggg

SEQ ID NO: 781308 - DNA, 20 bp, Artificial
  CRISPR gRNA sequence
gactgttgtgtggtcggggg

SEQ ID NO: 781309 - DNA, 20 bp, Artificial
  CRISPR gRNA sequence
actgttgtgtggtcggggga

SEQ ID NO: 781310 - DNA, 20 bp, Artificial
  CRISPR gRNA sequence
ctgttgtgtggtcgggggag

SEQ ID NO: 781311 - DNA, 20 bp, Artificial
  CRISPR gRNA sequence
gttgtgtggtcgggggaggg

SEQ ID NO: 781312 - DNA, 20 bp, Artificial
  CRISPR gRNA sequence
tgtgtggtcgggggagggga

SEQ ID NO: 781313 - DNA, 20 bp, Artificial
  CRISPR gRNA sequence
gtgtggtcgggggaggggag

SEQ ID NO: 781314 - DNA, 20 bp, Artificial
  CRISPR gRNA sequence
tgtggtcgggggaggggaga

SEQ ID NO: 781315 - DNA, 20 bp, Artificial
  CRISPR gRNA sequence
gtcgggggaggggagaggga

SEQ ID NO: 781316 - DNA, 20 bp, Artificial
  CRISPR gRNA sequence
ggaggggagagggatagcat

SEQ ID NO: 781317 - DNA, 20 bp, Artificial
  CRISPR gRNA sequence
gaggggagagggatagcatt

SEQ ID NO: 781318 - DNA, 20 bp, Artificial
  CRISPR gRNA sequence
ggggagagggatagcattag

SEQ ID NO: 781319 - DNA, 20 bp, Artificial
  CRISPR gRNA sequence
tatacctaatgtttaatgac

SEQ ID NO: 781320 - DNA, 20 bp, Artificial
  CRISPR gRNA sequence
aatgtttaatgacaagttaa

SEQ ID NO: 781321 - DNA, 20 bp, Artificial
  CRISPR gRNA sequence
atgtttaatgacaagttaat

SEQ ID NO: 781322 - DNA, 20 bp, Artificial
  CRISPR gRNA sequence
taatgacaagttaatgggtg

SEQ ID NO: 781323 - DNA, 20 bp, Artificial
  CRISPR gRNA sequence
atgggtgcagcacaccaata

SEQ ID NO: 781324 - DNA, 20 bp, Artificial
  CRISPR gRNA sequence
ttactgttaaaaaaaaaaat

SEQ ID NO: 781325 - DNA, 20 bp, Artificial
  CRISPR gRNA sequence
aaaaaaattagatcttaatg

SEQ ID NO: 781326 - DNA, 20 bp, Artificial
  CRISPR gRNA sequence
cagaacaccctgaacattta

SEQ ID NO: 781327 - DNA, 20 bp, Artificial
  CRISPR gRNA sequence
cctgaacatttaaagcttca

SEQ ID NO: 781328 - DNA, 20 bp, Artificial
  CRISPR gRNA sequence
atttaaagcttcatagtcac

SEQ ID NO: 781329 - DNA, 20 bp, Artificial
  CRISPR gRNA sequence
ttaaagcttcatagtcacaa

SEQ ID NO: 781330 - DNA, 20 bp, Artificial
  CRISPR gRNA sequence
gcttcatagtcacaagagaa

SEQ ID NO: 781331 - DNA, 20 bp, Artificial
  CRISPR gRNA sequence
gagaaaagttttcatttcaa

SEQ ID NO: 781332 - DNA, 20 bp, Artificial
  CRISPR gRNA sequence
ataaatattttgttgttgta

SEQ ID NO: 781333 - DNA, 20 bp, Artificial
  CRISPR gRNA sequence
aaacaaaaatatgttacatt

SEQ ID NO: 781334 - DNA, 20 bp, Artificial
  CRISPR gRNA sequence
tacattaagataaaattctg

SEQ ID NO: 781335 - DNA, 20 bp, Artificial
  CRISPR gRNA sequence
acattaagataaaattctgt

SEQ ID NO: 781336 - DNA, 20 bp, Artificial
  CRISPR gRNA sequence
cattaagataaaattctgta

SEQ ID NO: 781337 - DNA, 20 bp, Artificial
  CRISPR gRNA sequence
taagataaaattctgtaggg

SEQ ID NO: 781338 - DNA, 20 bp, Artificial
  CRISPR gRNA sequence
aagataaaattctgtaggga

SEQ ID NO: 781339 - DNA, 20 bp, Artificial
  CRISPR gRNA sequence
ttctgtagggaaggtgaaat

SEQ ID NO: 781340 - DNA, 20 bp, Artificial
  CRISPR gRNA sequence
tgtagggaaggtgaaattgg

SEQ ID NO: 781341 - DNA, 20 bp, Artificial
  CRISPR gRNA sequence
gggaaggtgaaattggaagt

SEQ ID NO: 781342 - DNA, 20 bp, Artificial
  CRISPR gRNA sequence
agtgagtttcaatgaatgaa

SEQ ID NO: 781343 - DNA, 20 bp, Artificial
  CRISPR gRNA sequence
atgaatgaaaagaaacaatt

SEQ ID NO: 781344 - DNA, 20 bp, Artificial
  CRISPR gRNA sequence
atgaaaagaaacaatttaga

SEQ ID NO: 781345 - DNA, 20 bp, Artificial
  CRISPR gRNA sequence
gaaaagaaacaatttagaca

SEQ ID NO: 781346 - DNA, 20 bp, Artificial
  CRISPR gRNA sequence
aagaaacaatttagacagag

SEQ ID NO: 781347 - DNA, 20 bp, Artificial
  CRISPR gRNA sequence
ataatttatttatttttact

SEQ ID NO: 781348 - DNA, 20 bp, Artificial
  CRISPR gRNA sequence
atttatttatttttacttag

SEQ ID NO: 781349 - DNA, 20 bp, Artificial
  CRISPR gRNA sequence
tttatttatttttacttaga

SEQ ID NO: 781350 - DNA, 20 bp, Artificial
  CRISPR gRNA sequence
tttacttagaaggaattgaa

SEQ ID NO: 781351 - DNA, 20 bp, Artificial
  CRISPR gRNA sequence
ttagaaggaattgaatagat

SEQ ID NO: 781352 - DNA, 20 bp, Artificial
  CRISPR gRNA sequence
tagaaggaattgaatagatt

SEQ ID NO: 781353 - DNA, 20 bp, Artificial
  CRISPR gRNA sequence
gattaggttccttacccaaa

SEQ ID NO: 781354 - DNA, 20 bp, Artificial
  CRISPR gRNA sequence
tctcttttttccacattctc

SEQ ID NO: 781355 - DNA, 20 bp, Artificial
  CRISPR gRNA sequence
ctcattccccttttttaaca

SEQ ID NO: 781356 - DNA, 20 bp, Artificial
  CRISPR gRNA sequence
tcattccccttttttaacac

SEQ ID NO: 781357 - DNA, 20 bp, Artificial
  CRISPR gRNA sequence
tttaacacaggaaattattc

SEQ ID NO: 781358 - DNA, 20 bp, Artificial
  CRISPR gRNA sequence
atacatattcttttgtttgt

SEQ ID NO: 781359 - DNA, 20 bp, Artificial
  CRISPR gRNA sequence
acatattcttttgtttgtaa

SEQ ID NO: 781360 - DNA, 20 bp, Artificial
  CRISPR gRNA sequence
taaaatatgtaatattgttt

SEQ ID NO: 781361 - DNA, 20 bp, Artificial
  CRISPR gRNA sequence
tgcatatattttttttcttg

SEQ ID NO: 781362 - DNA, 20 bp, Artificial
  CRISPR gRNA sequence
tgtactatatatatatattt

SEQ ID NO: 781363 - DNA, 20 bp, Artificial
  CRISPR gRNA sequence
atatatatatattttagaaa

SEQ ID NO: 781364 - DNA, 20 bp, Artificial
  CRISPR gRNA sequence
tattttagaaatggacacat

SEQ ID NO: 781365 - DNA, 20 bp, Artificial
  CRISPR gRNA sequence
attttagaaatggacacatt

SEQ ID NO: 781366 - DNA, 20 bp, Artificial
  CRISPR gRNA sequence
tagaaatggacacattaggc

SEQ ID NO: 781367 - DNA, 20 bp, Artificial
  CRISPR gRNA sequence
agaaatggacacattaggcc

SEQ ID NO: 781368 - DNA, 20 bp, Artificial
  CRISPR gRNA sequence
tggacacattaggccgggcg

SEQ ID NO: 781369 - DNA, 20 bp, Artificial
  CRISPR gRNA sequence
acacattaggccgggcgcgg

SEQ ID NO: 781370 - DNA, 20 bp, Artificial
  CRISPR gRNA sequence
gtggctcacgaccgtaatcc

SEQ ID NO: 781371 - DNA, 20 bp, Artificial
  CRISPR gRNA sequence
cgaccgtaatcccagcactt

SEQ ID NO: 781372 - DNA, 20 bp, Artificial
  CRISPR gRNA sequence
gaccgtaatcccagcacttt

SEQ ID NO: 781373 - DNA, 20 bp, Artificial
  CRISPR gRNA sequence
ccgtaatcccagcactttgg

SEQ ID NO: 781374 - DNA, 20 bp, Artificial
  CRISPR gRNA sequence
cgtaatcccagcactttggg

SEQ ID NO: 781375 - DNA, 20 bp, Artificial
  CRISPR gRNA sequence
tcccagcactttgggaggcc

SEQ ID NO: 781376 - DNA, 20 bp, Artificial
  CRISPR gRNA sequence
cccagcactttgggaggcca

SEQ ID NO: 781377 - DNA, 20 bp, Artificial
  CRISPR gRNA sequence
agcactttgggaggccaagg

SEQ ID NO: 781378 - DNA, 20 bp, Artificial
  CRISPR gRNA sequence
gcactttgggaggccaaggc

SEQ ID NO: 781379 - DNA, 20 bp, Artificial
  CRISPR gRNA sequence
ctttgggaggccaaggcggg

SEQ ID NO: 781380 - DNA, 20 bp, Artificial
  CRISPR gRNA sequence
ggccaaggcgggtggatcat

SEQ ID NO: 781381 - DNA, 20 bp, Artificial
  CRISPR gRNA sequence
gccaaggcgggtggatcatg

SEQ ID NO: 781382 - DNA, 20 bp, Artificial
  CRISPR gRNA sequence
aggcgggtggatcatgaggt

SEQ ID NO: 781383 - DNA, 20 bp, Artificial
  CRISPR gRNA sequence
ggcgggtggatcatgaggtc

SEQ ID NO: 781384 - DNA, 20 bp, Artificial
  CRISPR gRNA sequence
cgggtggatcatgaggtcag

SEQ ID NO: 781385 - DNA, 20 bp, Artificial
  CRISPR gRNA sequence
gatcatgaggtcaggagatc

SEQ ID NO: 781386 - DNA, 20 bp, Artificial
  CRISPR gRNA sequence
tcaggagatcgagaccatcc

SEQ ID NO: 781387 - DNA, 20 bp, Artificial
  CRISPR gRNA sequence
cgagaccatcctggctaaca

SEQ ID NO: 781388 - DNA, 20 bp, Artificial
  CRISPR gRNA sequence
ctaaaaaatacaacaaaaat

SEQ ID NO: 781389 - DNA, 20 bp, Artificial
  CRISPR gRNA sequence
aaaatacaacaaaaattagc

SEQ ID NO: 781390 - DNA, 20 bp, Artificial
  CRISPR gRNA sequence
aaatacaacaaaaattagcc

SEQ ID NO: 781391 - DNA, 20 bp, Artificial
  CRISPR gRNA sequence
caacaaaaattagccgggcg

SEQ ID NO: 781392 - DNA, 20 bp, Artificial
  CRISPR gRNA sequence
caaaaattagccgggcgcgg

SEQ ID NO: 781393 - DNA, 20 bp, Artificial
  CRISPR gRNA sequence
aaattagccgggcgcggtgg

SEQ ID NO: 781394 - DNA, 20 bp, Artificial
  CRISPR gRNA sequence
aattagccgggcgcggtggc

SEQ ID NO: 781395 - DNA, 20 bp, Artificial
  CRISPR gRNA sequence
ggcgcggtggcgggcgcctg

SEQ ID NO: 781396 - DNA, 20 bp, Artificial
  CRISPR gRNA sequence
gtggcgggcgcctgtagtcc

SEQ ID NO: 781397 - DNA, 20 bp, Artificial
  CRISPR gRNA sequence
gcgcctgtagtcccagctac

SEQ ID NO: 781398 - DNA, 20 bp, Artificial
  CRISPR gRNA sequence
cgcctgtagtcccagctact

SEQ ID NO: 781399 - DNA, 20 bp, Artificial
  CRISPR gRNA sequence
gcctgtagtcccagctactg

SEQ ID NO: 781400 - DNA, 20 bp, Artificial
  CRISPR gRNA sequence
ctgtagtcccagctactggg

SEQ ID NO: 781401 - DNA, 20 bp, Artificial
  CRISPR gRNA sequence
tgtagtcccagctactgggg

SEQ ID NO: 781402 - DNA, 20 bp, Artificial
  CRISPR gRNA sequence
tcccagctactggggaggct

SEQ ID NO: 781403 - DNA, 20 bp, Artificial
  CRISPR gRNA sequence
cccagctactggggaggctg

SEQ ID NO: 781404 - DNA, 20 bp, Artificial
  CRISPR gRNA sequence
agctactggggaggctgagg

SEQ ID NO: 781405 - DNA, 20 bp, Artificial
  CRISPR gRNA sequence
gctactggggaggctgaggc

SEQ ID NO: 781406 - DNA, 20 bp, Artificial
  CRISPR gRNA sequence
tactggggaggctgaggcag

SEQ ID NO: 781407 - DNA, 20 bp, Artificial
  CRISPR gRNA sequence
gggaggctgaggcaggagaa

SEQ ID NO: 781408 - DNA, 20 bp, Artificial
  CRISPR gRNA sequence
tgaggcaggagaatggcgtt

SEQ ID NO: 781409 - DNA, 20 bp, Artificial
  CRISPR gRNA sequence
gcaggagaatggcgttaagc

SEQ ID NO: 781410 - DNA, 20 bp, Artificial
  CRISPR gRNA sequence
caggagaatggcgttaagcc

SEQ ID NO: 781411 - DNA, 20 bp, Artificial
  CRISPR gRNA sequence
ggagaatggcgttaagccgg

SEQ ID NO: 781412 - DNA, 20 bp, Artificial
  CRISPR gRNA sequence
gagaatggcgttaagccggg

SEQ ID NO: 781413 - DNA, 20 bp, Artificial
  CRISPR gRNA sequence
aatggcgttaagccgggagg

SEQ ID NO: 781414 - DNA, 20 bp, Artificial
  CRISPR gRNA sequence
tggcgttaagccgggaggcg

SEQ ID NO: 781415 - DNA, 20 bp, Artificial
  CRISPR gRNA sequence
aagccgggaggcggagcttg

SEQ ID NO: 781416 - DNA, 20 bp, Artificial
  CRISPR gRNA sequence
cgggaggcggagcttgtagt

SEQ ID NO: 781417 - DNA, 20 bp, Artificial
  CRISPR gRNA sequence
ggcggagcttgtagtgagcc

SEQ ID NO: 781418 - DNA, 20 bp, Artificial
  CRISPR gRNA sequence
gagatcgctccactgcactc

SEQ ID NO: 781419 - DNA, 20 bp, Artificial
  CRISPR gRNA sequence
cgctccactgcactccagcc

SEQ ID NO: 781420 - DNA, 20 bp, Artificial
  CRISPR gRNA sequence
gctccactgcactccagcct

SEQ ID NO: 781421 - DNA, 20 bp, Artificial
  CRISPR gRNA sequence
ctgcactccagcctgggcga

SEQ ID NO: 781422 - DNA, 20 bp, Artificial
  CRISPR gRNA sequence
gcactccagcctgggcgaca

SEQ ID NO: 781423 - DNA, 20 bp, Artificial
  CRISPR gRNA sequence
tccagcctgggcgacagagc

SEQ ID NO: 781424 - DNA, 20 bp, Artificial
  CRISPR gRNA sequence
gcgagactctgtctcaaaaa

SEQ ID NO: 781425 - DNA, 20 bp, Artificial
  CRISPR gRNA sequence
aaaaaaagaaaaaaaaaaaa

SEQ ID NO: 781426 - DNA, 20 bp, Artificial
  CRISPR gRNA sequence
aaaaaagaaattgacacatt

SEQ ID NO: 781427 - DNA, 20 bp, Artificial
  CRISPR gRNA sequence
tattgtgaaaacatgattac

SEQ ID NO: 781428 - DNA, 20 bp, Artificial
  CRISPR gRNA sequence
aacatgattacaagcaataa

SEQ ID NO: 781429 - DNA, 20 bp, Artificial
  CRISPR gRNA sequence
acaagcaataacagatataa

SEQ ID NO: 781430 - DNA, 20 bp, Artificial
  CRISPR gRNA sequence
agcaataacagatataacag

SEQ ID NO: 781431 - DNA, 20 bp, Artificial
  CRISPR gRNA sequence
taacagcagaaaaaattgtg

SEQ ID NO: 781432 - DNA, 20 bp, Artificial
  CRISPR gRNA sequence
agttatgtgcaccttctttt

SEQ ID NO: 781433 - DNA, 20 bp, Artificial
  CRISPR gRNA sequence
ttcttttgagatcatttttt

SEQ ID NO: 781434 - DNA, 20 bp, Artificial
  CRISPR gRNA sequence
tcttttgagatcattttttt

SEQ ID NO: 781435 - DNA, 20 bp, Artificial
  CRISPR gRNA sequence
acaataattgtacttattta

SEQ ID NO: 781436 - DNA, 20 bp, Artificial
  CRISPR gRNA sequence
caataattgtacttatttat

SEQ ID NO: 781437 - DNA, 20 bp, Artificial
  CRISPR gRNA sequence
gtacttatttatgggataca

SEQ ID NO: 781438 - DNA, 20 bp, Artificial
  CRISPR gRNA sequence
gtttcaatatatacaatgta

SEQ ID NO: 781439 - DNA, 20 bp, Artificial
  CRISPR gRNA sequence
tatatacaatgtatagtgat

SEQ ID NO: 781440 - DNA, 20 bp, Artificial
  CRISPR gRNA sequence
acaatgtatagtgatcagat

SEQ ID NO: 781441 - DNA, 20 bp, Artificial
  CRISPR gRNA sequence
caatgtatagtgatcagatc

SEQ ID NO: 781442 - DNA, 20 bp, Artificial
  CRISPR gRNA sequence
aatgtatagtgatcagatcg

SEQ ID NO: 781443 - DNA, 20 bp, Artificial
  CRISPR gRNA sequence
agtgatcagatcggggtaat

SEQ ID NO: 781444 - DNA, 20 bp, Artificial
  CRISPR gRNA sequence
atttattatttctttgtgtt

SEQ ID NO: 781445 - DNA, 20 bp, Artificial
  CRISPR gRNA sequence
aacattcaatgtaccccttc

SEQ ID NO: 781446 - DNA, 20 bp, Artificial
  CRISPR gRNA sequence
gtaccccttctggctatttg

SEQ ID NO: 781447 - DNA, 20 bp, Artificial
  CRISPR gRNA sequence
aatatttatatgtatttttc

SEQ ID NO: 781448 - DNA, 20 bp, Artificial
  CRISPR gRNA sequence
atatttatatgtatttttca

SEQ ID NO: 781449 - DNA, 20 bp, Artificial
  CRISPR gRNA sequence
aaggataatgttgtatataa

SEQ ID NO: 781450 - DNA, 20 bp, Artificial
  CRISPR gRNA sequence
aagataacttcttttatatt

SEQ ID NO: 781451 - DNA, 20 bp, Artificial
  CRISPR gRNA sequence
cttttatatttagtcacctt

SEQ ID NO: 781452 - DNA, 20 bp, Artificial
  CRISPR gRNA sequence
tcacctttggatacatatgt

SEQ ID NO: 781453 - DNA, 20 bp, Artificial
  CRISPR gRNA sequence
acctttggatacatatgtaa

SEQ ID NO: 781454 - DNA, 20 bp, Artificial
  CRISPR gRNA sequence
gttttactaaaaaaattcat

SEQ ID NO: 781455 - DNA, 20 bp, Artificial
  CRISPR gRNA sequence
ctgaacattatatgtttttc

SEQ ID NO: 781456 - DNA, 20 bp, Artificial
  CRISPR gRNA sequence
cattatatgtttttccagta

SEQ ID NO: 781457 - DNA, 20 bp, Artificial
  CRISPR gRNA sequence
agaaacttatgaaaaattat

SEQ ID NO: 781458 - DNA, 20 bp, Artificial
  CRISPR gRNA sequence
aattataagaatcaacttaa

SEQ ID NO: 781459 - DNA, 20 bp, Artificial
  CRISPR gRNA sequence
attataagaatcaacttaat

SEQ ID NO: 781460 - DNA, 20 bp, Artificial
  CRISPR gRNA sequence
taagaatcaacttaataggt

SEQ ID NO: 781461 - DNA, 20 bp, Artificial
  CRISPR gRNA sequence
gaatcaacttaataggtgag

SEQ ID NO: 781462 - DNA, 20 bp, Artificial
  CRISPR gRNA sequence
atcaacttaataggtgagaa

SEQ ID NO: 781463 - DNA, 20 bp, Artificial
  CRISPR gRNA sequence
atactgcatcatacttattt

SEQ ID NO: 781464 - DNA, 20 bp, Artificial
  CRISPR gRNA sequence
tactgcatcatacttatttt

SEQ ID NO: 781465 - DNA, 20 bp, Artificial
  CRISPR gRNA sequence
ctgcatcatacttattttag

SEQ ID NO: 781466 - DNA, 20 bp, Artificial
  CRISPR gRNA sequence
tgcatcatacttattttagg

SEQ ID NO: 781467 - DNA, 20 bp, Artificial
  CRISPR gRNA sequence
acttattttaggaggaatac

SEQ ID NO: 781468 - DNA, 20 bp, Artificial
  CRISPR gRNA sequence
gaggaatacaagcaaaaaaa

SEQ ID NO: 781469 - DNA, 20 bp, Artificial
  CRISPR gRNA sequence
aatacaagcaaaaaaaaagt

SEQ ID NO: 781470 - DNA, 20 bp, Artificial
  CRISPR gRNA sequence
aaaaagttggaccatcacct

SEQ ID NO: 781471 - DNA, 20 bp, Artificial
  CRISPR gRNA sequence
aaagttggaccatcacctaa

SEQ ID NO: 781472 - DNA, 20 bp, Artificial
  CRISPR gRNA sequence
gttggaccatcacctaagag

SEQ ID NO: 781473 - DNA, 20 bp, Artificial
  CRISPR gRNA sequence
ttggaccatcacctaagagt

SEQ ID NO: 781474 - DNA, 20 bp, Artificial
  CRISPR gRNA sequence
aagagtaggctaccctgatc

SEQ ID NO: 781475 - DNA, 20 bp, Artificial
  CRISPR gRNA sequence
agagtaggctaccctgatcc

SEQ ID NO: 781476 - DNA, 20 bp, Artificial
  CRISPR gRNA sequence
gagtaggctaccctgatcca

SEQ ID NO: 781477 - DNA, 20 bp, Artificial
  CRISPR gRNA sequence
ccctgatccagggtctctaa

SEQ ID NO: 781478 - DNA, 20 bp, Artificial
  CRISPR gRNA sequence
tgatccagggtctctaaaag

SEQ ID NO: 781479 - DNA, 20 bp, Artificial
  CRISPR gRNA sequence
ccagggtctctaaaagaagc

SEQ ID NO: 781480 - DNA, 20 bp, Artificial
  CRISPR gRNA sequence
ggtctctaaaagaagcaaga

SEQ ID NO: 781481 - DNA, 20 bp, Artificial
  CRISPR gRNA sequence
aaaagaagcaagatagatct

SEQ ID NO: 781482 - DNA, 20 bp, Artificial
  CRISPR gRNA sequence
aaagaagcaagatagatctg

SEQ ID NO: 781483 - DNA, 20 bp, Artificial
  CRISPR gRNA sequence
gatagatctgaggccccaat

SEQ ID NO: 781484 - DNA, 20 bp, Artificial
  CRISPR gRNA sequence
atagatctgaggccccaatg

SEQ ID NO: 781485 - DNA, 20 bp, Artificial
  CRISPR gRNA sequence
tagatctgaggccccaatga

SEQ ID NO: 781486 - DNA, 20 bp, Artificial
  CRISPR gRNA sequence
aatgagggttcccatgaatg

SEQ ID NO: 781487 - DNA, 20 bp, Artificial
  CRISPR gRNA sequence
gagggttcccatgaatgaag

SEQ ID NO: 781488 - DNA, 20 bp, Artificial
  CRISPR gRNA sequence
agggttcccatgaatgaagt

SEQ ID NO: 781489 - DNA, 20 bp, Artificial
  CRISPR gRNA sequence
tcccatgaatgaagtaggac

SEQ ID NO: 781490 - DNA, 20 bp, Artificial
  CRISPR gRNA sequence
catgaatgaagtaggactag

SEQ ID NO: 781491 - DNA, 20 bp, Artificial
  CRISPR gRNA sequence
gaatgaagtaggactagaag

SEQ ID NO: 781492 - DNA, 20 bp, Artificial
  CRISPR gRNA sequence
aatgaagtaggactagaaga

SEQ ID NO: 781493 - DNA, 20 bp, Artificial
  CRISPR gRNA sequence
aaggacatgtttttatctta

SEQ ID NO: 781494 - DNA, 20 bp, Artificial
  CRISPR gRNA sequence
atcttaaagtgcctgatcca

SEQ ID NO: 781495 - DNA, 20 bp, Artificial
  CRISPR gRNA sequence
agtgcctgatccatggcata

SEQ ID NO: 781496 - DNA, 20 bp, Artificial
  CRISPR gRNA sequence
catggcataaagcttgaaaa

SEQ ID NO: 781497 - DNA, 20 bp, Artificial
  CRISPR gRNA sequence
atggcataaagcttgaaaat

SEQ ID NO: 781498 - DNA, 20 bp, Artificial
  CRISPR gRNA sequence
cttgaaaatgggtttgttta

SEQ ID NO: 781499 - DNA, 20 bp, Artificial
  CRISPR gRNA sequence
atagcaccttcgttgatgtc

SEQ ID NO: 781500 - DNA, 20 bp, Artificial
  CRISPR gRNA sequence
tagcaccttcgttgatgtct

SEQ ID NO: 781501 - DNA, 20 bp, Artificial
  CRISPR gRNA sequence
caccttcgttgatgtctggg

SEQ ID NO: 781502 - DNA, 20 bp, Artificial
  CRISPR gRNA sequence
ttcttatcaaatataatgaa

SEQ ID NO: 781503 - DNA, 20 bp, Artificial
  CRISPR gRNA sequence
cttatcaaatataatgaaaa

SEQ ID NO: 781504 - DNA, 20 bp, Artificial
  CRISPR gRNA sequence
atgaaaagagttaatttcaa

SEQ ID NO: 781505 - DNA, 20 bp, Artificial
  CRISPR gRNA sequence
tgaaaagagttaatttcaaa

SEQ ID NO: 781506 - DNA, 20 bp, Artificial
  CRISPR gRNA sequence
aagagttaatttcaaaagga

SEQ ID NO: 781507 - DNA, 20 bp, Artificial
  CRISPR gRNA sequence
aaaaggacagaacaaattat

SEQ ID NO: 781508 - DNA, 20 bp, Artificial
  CRISPR gRNA sequence
aaaggacagaacaaattatg

SEQ ID NO: 781509 - DNA, 20 bp, Artificial
  CRISPR gRNA sequence
ggacagaacaaattatgagg

SEQ ID NO: 781510 - DNA, 20 bp, Artificial
  CRISPR gRNA sequence
aaattatgaggtggaatgac

SEQ ID NO: 781511 - DNA, 20 bp, Artificial
  CRISPR gRNA sequence
attatgaggtggaatgaccg

SEQ ID NO: 781512 - DNA, 20 bp, Artificial
  CRISPR gRNA sequence
ggtggaatgaccggagattc

SEQ ID NO: 781513 - DNA, 20 bp, Artificial
  CRISPR gRNA sequence
ggaatgaccggagattctgg

SEQ ID NO: 781514 - DNA, 20 bp, Artificial
  CRISPR gRNA sequence
aatgaccggagattctggaa

SEQ ID NO: 781515 - DNA, 20 bp, Artificial
  CRISPR gRNA sequence
accggagattctggaagaga

SEQ ID NO: 781516 - DNA, 20 bp, Artificial
  CRISPR gRNA sequence
ttctggaagagacagtgata

SEQ ID NO: 781517 - DNA, 20 bp, Artificial
  CRISPR gRNA sequence
tctggaagagacagtgataa

SEQ ID NO: 781518 - DNA, 20 bp, Artificial
  CRISPR gRNA sequence
gagacagtgataaaggactg

SEQ ID NO: 781519 - DNA, 20 bp, Artificial
  CRISPR gRNA sequence
aaaggactgtggtttctgaa

SEQ ID NO: 781520 - DNA, 20 bp, Artificial
  CRISPR gRNA sequence
gactgtggtttctgaaaagc

SEQ ID NO: 781521 - DNA, 20 bp, Artificial
  CRISPR gRNA sequence
actgtggtttctgaaaagcc

SEQ ID NO: 781522 - DNA, 20 bp, Artificial
  CRISPR gRNA sequence
gtggtttctgaaaagccagg

SEQ ID NO: 781523 - DNA, 20 bp, Artificial
  CRISPR gRNA sequence
ccaggtggcacctacatttc

SEQ ID NO: 781524 - DNA, 20 bp, Artificial
  CRISPR gRNA sequence
caggtggcacctacatttct

SEQ ID NO: 781525 - DNA, 20 bp, Artificial
  CRISPR gRNA sequence
aggtggcacctacatttctg

SEQ ID NO: 781526 - DNA, 20 bp, Artificial
  CRISPR gRNA sequence
ggtggcacctacatttctgg

SEQ ID NO: 781527 - DNA, 20 bp, Artificial
  CRISPR gRNA sequence
tttctgggggcaatccatct

SEQ ID NO: 781528 - DNA, 20 bp, Artificial
  CRISPR gRNA sequence
ttctgggggcaatccatctg

SEQ ID NO: 781529 - DNA, 20 bp, Artificial
  CRISPR gRNA sequence
tgggggcaatccatctgagg

SEQ ID NO: 781530 - DNA, 20 bp, Artificial
  CRISPR gRNA sequence
gggggcaatccatctgagga

SEQ ID NO: 781531 - DNA, 20 bp, Artificial
  CRISPR gRNA sequence
ggggcaatccatctgaggaa

SEQ ID NO: 781532 - DNA, 20 bp, Artificial
  CRISPR gRNA sequence
gggcaatccatctgaggaag

SEQ ID NO: 781533 - DNA, 20 bp, Artificial
  CRISPR gRNA sequence
caatccatctgaggaagggg

SEQ ID NO: 781534 - DNA, 20 bp, Artificial
  CRISPR gRNA sequence
aatccatctgaggaaggggc

SEQ ID NO: 781535 - DNA, 20 bp, Artificial
  CRISPR gRNA sequence
tccatctgaggaaggggcgg

SEQ ID NO: 781536 - DNA, 20 bp, Artificial
  CRISPR gRNA sequence
ctgaggaaggggcgggagca

SEQ ID NO: 781537 - DNA, 20 bp, Artificial
  CRISPR gRNA sequence
aaggggcgggagcatggcca

SEQ ID NO: 781538 - DNA, 20 bp, Artificial
  CRISPR gRNA sequence
gcgggagcatggccaaagaa

SEQ ID NO: 781539 - DNA, 20 bp, Artificial
  CRISPR gRNA sequence
gggagcatggccaaagaaca

SEQ ID NO: 781540 - DNA, 20 bp, Artificial
  CRISPR gRNA sequence
gagcatggccaaagaacaga

SEQ ID NO: 781541 - DNA, 20 bp, Artificial
  CRISPR gRNA sequence
agcatggccaaagaacagag

SEQ ID NO: 781542 - DNA, 20 bp, Artificial
  CRISPR gRNA sequence
gccaaagaacagagaggccc

SEQ ID NO: 781543 - DNA, 20 bp, Artificial
  CRISPR gRNA sequence
ccaaagaacagagaggcccc

SEQ ID NO: 781544 - DNA, 20 bp, Artificial
  CRISPR gRNA sequence
aaagaacagagaggccccag

SEQ ID NO: 781545 - DNA, 20 bp, Artificial
  CRISPR gRNA sequence
acagagaggccccaggagcc

SEQ ID NO: 781546 - DNA, 20 bp, Artificial
  CRISPR gRNA sequence
cagagaggccccaggagccc

SEQ ID NO: 781547 - DNA, 20 bp, Artificial
  CRISPR gRNA sequence
agagaggccccaggagccca

SEQ ID NO: 781548 - DNA, 20 bp, Artificial
  CRISPR gRNA sequence
gagaggccccaggagcccag

SEQ ID NO: 781549 - DNA, 20 bp, Artificial
  CRISPR gRNA sequence
ccaggagcccaggggtctct

SEQ ID NO: 781550 - DNA, 20 bp, Artificial
  CRISPR gRNA sequence
aggagcccaggggtctctca

SEQ ID NO: 781551 - DNA, 20 bp, Artificial
  CRISPR gRNA sequence
ggagcccaggggtctctcag

SEQ ID NO: 781552 - DNA, 20 bp, Artificial
  CRISPR gRNA sequence
agcccaggggtctctcagag

SEQ ID NO: 781553 - DNA, 20 bp, Artificial
  CRISPR gRNA sequence
caggggtctctcagaggagc

SEQ ID NO: 781554 - DNA, 20 bp, Artificial
  CRISPR gRNA sequence
aggggtctctcagaggagct

SEQ ID NO: 781555 - DNA, 20 bp, Artificial
  CRISPR gRNA sequence
ggggtctctcagaggagctg

SEQ ID NO: 781556 - DNA, 20 bp, Artificial
  CRISPR gRNA sequence
ctctcagaggagctggggtt

SEQ ID NO: 781557 - DNA, 20 bp, Artificial
  CRISPR gRNA sequence
gaggagctggggttgagaac

SEQ ID NO: 781558 - DNA, 20 bp, Artificial
  CRISPR gRNA sequence
gttgagaactggtctgtgca

SEQ ID NO: 781559 - DNA, 20 bp, Artificial
  CRISPR gRNA sequence
ttgagaactggtctgtgcaa

SEQ ID NO: 781560 - DNA, 20 bp, Artificial
  CRISPR gRNA sequence
ctggtctgtgcaaaggtttc

SEQ ID NO: 781561 - DNA, 20 bp, Artificial
  CRISPR gRNA sequence
tctgtgcaaaggtttccaga

SEQ ID NO: 781562 - DNA, 20 bp, Artificial
  CRISPR gRNA sequence
ctgtgcaaaggtttccagac

SEQ ID NO: 781563 - DNA, 20 bp, Artificial
  CRISPR gRNA sequence
tgtgcaaaggtttccagaca

SEQ ID NO: 781564 - DNA, 20 bp, Artificial
  CRISPR gRNA sequence
aaggtttccagacagggttg

SEQ ID NO: 781565 - DNA, 20 bp, Artificial
  CRISPR gRNA sequence
ggtttccagacagggttgca

SEQ ID NO: 781566 - DNA, 20 bp, Artificial
  CRISPR gRNA sequence
gtttccagacagggttgcag

SEQ ID NO: 781567 - DNA, 20 bp, Artificial
  CRISPR gRNA sequence
ttccagacagggttgcagag

SEQ ID NO: 781568 - DNA, 20 bp, Artificial
  CRISPR gRNA sequence
tccagacagggttgcagagg

SEQ ID NO: 781569 - DNA, 20 bp, Artificial
  CRISPR gRNA sequence
gcagaggaggcactaaaaac

SEQ ID NO: 781570 - DNA, 20 bp, Artificial
  CRISPR gRNA sequence
gcactaaaaacaagaacacc

SEQ ID NO: 781571 - DNA, 20 bp, Artificial
  CRISPR gRNA sequence
actaaaaacaagaacaccaa

SEQ ID NO: 781572 - DNA, 20 bp, Artificial
  CRISPR gRNA sequence
ccaagagccaaaccatcctg

SEQ ID NO: 781573 - DNA, 20 bp, Artificial
  CRISPR gRNA sequence
caagagccaaaccatcctga

SEQ ID NO: 781574 - DNA, 20 bp, Artificial
  CRISPR gRNA sequence
gccaaaccatcctgaaggcc

SEQ ID NO: 781575 - DNA, 20 bp, Artificial
  CRISPR gRNA sequence
ccaaaccatcctgaaggcct

SEQ ID NO: 781576 - DNA, 20 bp, Artificial
  CRISPR gRNA sequence
aaccatcctgaaggcctggg

SEQ ID NO: 781577 - DNA, 20 bp, Artificial
  CRISPR gRNA sequence
accatcctgaaggcctgggc

SEQ ID NO: 781578 - DNA, 20 bp, Artificial
  CRISPR gRNA sequence
ccatcctgaaggcctgggca

SEQ ID NO: 781579 - DNA, 20 bp, Artificial
  CRISPR gRNA sequence
tcctgaaggcctgggcaggg

SEQ ID NO: 781580 - DNA, 20 bp, Artificial
  CRISPR gRNA sequence
cctgaaggcctgggcagggc

SEQ ID NO: 781581 - DNA, 20 bp, Artificial
  CRISPR gRNA sequence
ctgaaggcctgggcagggca

SEQ ID NO: 781582 - DNA, 20 bp, Artificial
  CRISPR gRNA sequence
tgaaggcctgggcagggcag

SEQ ID NO: 781583 - DNA, 20 bp, Artificial
  CRISPR gRNA sequence
gaaggcctgggcagggcagg

SEQ ID NO: 781584 - DNA, 20 bp, Artificial
  CRISPR gRNA sequence
gcctgggcagggcaggggga

SEQ ID NO: 781585 - DNA, 20 bp, Artificial
  CRISPR gRNA sequence
cctgggcagggcagggggat

SEQ ID NO: 781586 - DNA, 20 bp, Artificial
  CRISPR gRNA sequence
gggcagggcagggggatggg

SEQ ID NO: 781587 - DNA, 20 bp, Artificial
  CRISPR gRNA sequence
gcagggcagggggatgggaa

SEQ ID NO: 781588 - DNA, 20 bp, Artificial
  CRISPR gRNA sequence
gggatgggaagagccaacac

SEQ ID NO: 781589 - DNA, 20 bp, Artificial
  CRISPR gRNA sequence
ggatgggaagagccaacacc

SEQ ID NO: 781590 - DNA, 20 bp, Artificial
  CRISPR gRNA sequence
ggaagagccaacaccaggaa

SEQ ID NO: 781591 - DNA, 20 bp, Artificial
  CRISPR gRNA sequence
gaagagccaacaccaggaat

SEQ ID NO: 781592 - DNA, 20 bp, Artificial
  CRISPR gRNA sequence
ccaacaccaggaatgggctg

SEQ ID NO: 781593 - DNA, 20 bp, Artificial
  CRISPR gRNA sequence
caggaatgggctgaagctga

SEQ ID NO: 781594 - DNA, 20 bp, Artificial
  CRISPR gRNA sequence
gaatgggctgaagctgacag

SEQ ID NO: 781595 - DNA, 20 bp, Artificial
  CRISPR gRNA sequence
ctgacagaagtacttcaaac

SEQ ID NO: 781596 - DNA, 20 bp, Artificial
  CRISPR gRNA sequence
aaactatgccctaccacaaa

SEQ ID NO: 781597 - DNA, 20 bp, Artificial
  CRISPR gRNA sequence
cctaccacaaatagacttaa

SEQ ID NO: 781598 - DNA, 20 bp, Artificial
  CRISPR gRNA sequence
atagacttaacagatattta

SEQ ID NO: 781599 - DNA, 20 bp, Artificial
  CRISPR gRNA sequence
aacattctacccaacaatcg

SEQ ID NO: 781600 - DNA, 20 bp, Artificial
  CRISPR gRNA sequence
agaatatacattctattcat

SEQ ID NO: 781601 - DNA, 20 bp, Artificial
  CRISPR gRNA sequence
acattctattcatcagcata

SEQ ID NO: 781602 - DNA, 20 bp, Artificial
  CRISPR gRNA sequence
cagcatatggaacattctcc

SEQ ID NO: 781603 - DNA, 20 bp, Artificial
  CRISPR gRNA sequence
atatggaacattctccaaga

SEQ ID NO: 781604 - DNA, 20 bp, Artificial
  CRISPR gRNA sequence
attctccaagatagactata

SEQ ID NO: 781605 - DNA, 20 bp, Artificial
  CRISPR gRNA sequence
ctccaagatagactatatag

SEQ ID NO: 781606 - DNA, 20 bp, Artificial
  CRISPR gRNA sequence
tccaagatagactatatagt

SEQ ID NO: 781607 - DNA, 20 bp, Artificial
  CRISPR gRNA sequence
tatatagtaggccacaaaac

SEQ ID NO: 781608 - DNA, 20 bp, Artificial
  CRISPR gRNA sequence
aaacaagtctccataaattt

SEQ ID NO: 781609 - DNA, 20 bp, Artificial
  CRISPR gRNA sequence
aagaaaatcaaaattatatc

SEQ ID NO: 781610 - DNA, 20 bp, Artificial
  CRISPR gRNA sequence
aattatatcaagtactctct

SEQ ID NO: 781611 - DNA, 20 bp, Artificial
  CRISPR gRNA sequence
tcaagtactctcttagatca

SEQ ID NO: 781612 - DNA, 20 bp, Artificial
  CRISPR gRNA sequence
agtactctcttagatcacag

SEQ ID NO: 781613 - DNA, 20 bp, Artificial
  CRISPR gRNA sequence
tactctcttagatcacagtg

SEQ ID NO: 781614 - DNA, 20 bp, Artificial
  CRISPR gRNA sequence
agatcacagtggagtaaaac

SEQ ID NO: 781615 - DNA, 20 bp, Artificial
  CRISPR gRNA sequence
aaactggaaataaactccaa

SEQ ID NO: 781616 - DNA, 20 bp, Artificial
  CRISPR gRNA sequence
aactggaaataaactccaaa

SEQ ID NO: 781617 - DNA, 20 bp, Artificial
  CRISPR gRNA sequence
ttcaaaaccatgcaattaca

SEQ ID NO: 781618 - DNA, 20 bp, Artificial
  CRISPR gRNA sequence
aaaaccatgcaattacatgg

SEQ ID NO: 781619 - DNA, 20 bp, Artificial
  CRISPR gRNA sequence
ttacatggaagttaaataat

SEQ ID NO: 781620 - DNA, 20 bp, Artificial
  CRISPR gRNA sequence
gttaaataatgagtgatcat

SEQ ID NO: 781621 - DNA, 20 bp, Artificial
  CRISPR gRNA sequence
ttaaataatgagtgatcatt

SEQ ID NO: 781622 - DNA, 20 bp, Artificial
  CRISPR gRNA sequence
attgggtgaacaatgaaatc

SEQ ID NO: 781623 - DNA, 20 bp, Artificial
  CRISPR gRNA sequence
ggtgaacaatgaaatcaaga

SEQ ID NO: 781624 - DNA, 20 bp, Artificial
  CRISPR gRNA sequence
ctctttgaactgaacgataa

SEQ ID NO: 781625 - DNA, 20 bp, Artificial
  CRISPR gRNA sequence
gacacaacctatcaaaactc

SEQ ID NO: 781626 - DNA, 20 bp, Artificial
  CRISPR gRNA sequence
acacaacctatcaaaactct

SEQ ID NO: 781627 - DNA, 20 bp, Artificial
  CRISPR gRNA sequence
cctatcaaaactctgggata

SEQ ID NO: 781628 - DNA, 20 bp, Artificial
  CRISPR gRNA sequence
aaaactctgggatacagcaa

SEQ ID NO: 781629 - DNA, 20 bp, Artificial
  CRISPR gRNA sequence
actctgggatacagcaaaag

SEQ ID NO: 781630 - DNA, 20 bp, Artificial
  CRISPR gRNA sequence
gatacagcaaaagcagtgct

SEQ ID NO: 781631 - DNA, 20 bp, Artificial
  CRISPR gRNA sequence
tacagcaaaagcagtgctaa

SEQ ID NO: 781632 - DNA, 20 bp, Artificial
  CRISPR gRNA sequence
agtgctaagagaaacattca

SEQ ID NO: 781633 - DNA, 20 bp, Artificial
  CRISPR gRNA sequence
cattaaatgcctacatcaaa

SEQ ID NO: 781634 - DNA, 20 bp, Artificial
  CRISPR gRNA sequence
gcctacatcaaaaagtctga

SEQ ID NO: 781635 - DNA, 20 bp, Artificial
  CRISPR gRNA sequence
ctacatcaaaaagtctgaaa

SEQ ID NO: 781636 - DNA, 20 bp, Artificial
  CRISPR gRNA sequence
aaagtctgaaagagcacaaa

SEQ ID NO: 781637 - DNA, 20 bp, Artificial
  CRISPR gRNA sequence
aagtctgaaagagcacaaat

SEQ ID NO: 781638 - DNA, 20 bp, Artificial
  CRISPR gRNA sequence
agagcacaaataggcaatct

SEQ ID NO: 781639 - DNA, 20 bp, Artificial
  CRISPR gRNA sequence
gagcacaaataggcaatcta

SEQ ID NO: 781640 - DNA, 20 bp, Artificial
  CRISPR gRNA sequence
caatctaaggtcacacctcc

SEQ ID NO: 781641 - DNA, 20 bp, Artificial
  CRISPR gRNA sequence
atctaaggtcacacctcctg

SEQ ID NO: 781642 - DNA, 20 bp, Artificial
  CRISPR gRNA sequence
aaggtcacacctcctggagc

SEQ ID NO: 781643 - DNA, 20 bp, Artificial
  CRISPR gRNA sequence
ggtcacacctcctggagctg

SEQ ID NO: 781644 - DNA, 20 bp, Artificial
  CRISPR gRNA sequence
cctcctggagctggagaaac

SEQ ID NO: 781645 - DNA, 20 bp, Artificial
  CRISPR gRNA sequence
gaacaatccaaacccaaacc

SEQ ID NO: 781646 - DNA, 20 bp, Artificial
  CRISPR gRNA sequence
caatccaaacccaaacccag

SEQ ID NO: 781647 - DNA, 20 bp, Artificial
  CRISPR gRNA sequence
tccaaacccaaacccagcag

SEQ ID NO: 781648 - DNA, 20 bp, Artificial
  CRISPR gRNA sequence
acccaaacccagcagaagaa

SEQ ID NO: 781649 - DNA, 20 bp, Artificial
  CRISPR gRNA sequence
gcagaagaaaagaaattaca

SEQ ID NO: 781650 - DNA, 20 bp, Artificial
  CRISPR gRNA sequence
agaaaagaaattacaaagat

SEQ ID NO: 781651 - DNA, 20 bp, Artificial
  CRISPR gRNA sequence
gaaaagaaattacaaagatc

SEQ ID NO: 781652 - DNA, 20 bp, Artificial
  CRISPR gRNA sequence
aaaagaaattacaaagatca

SEQ ID NO: 781653 - DNA, 20 bp, Artificial
  CRISPR gRNA sequence
agaaattacaaagatcaggg

SEQ ID NO: 781654 - DNA, 20 bp, Artificial
  CRISPR gRNA sequence
ttgaaacaaaaaaaatacaa

SEQ ID NO: 781655 - DNA, 20 bp, Artificial
  CRISPR gRNA sequence
gaaacaaaaaaaatacaaaa

SEQ ID NO: 781656 - DNA, 20 bp, Artificial
  CRISPR gRNA sequence
agagaaatgaaacaaaaatc

SEQ ID NO: 781657 - DNA, 20 bp, Artificial
  CRISPR gRNA sequence
caaaaatctggttatttgaa

SEQ ID NO: 781658 - DNA, 20 bp, Artificial
  CRISPR gRNA sequence
gataaataaaattgataacc

SEQ ID NO: 781659 - DNA, 20 bp, Artificial
  CRISPR gRNA sequence
ataaaattgataaccaagaa

SEQ ID NO: 781660 - DNA, 20 bp, Artificial
  CRISPR gRNA sequence
aaattgataaccaagaaaag

SEQ ID NO: 781661 - DNA, 20 bp, Artificial
  CRISPR gRNA sequence
attgataaccaagaaaagaa

SEQ ID NO: 781662 - DNA, 20 bp, Artificial
  CRISPR gRNA sequence
tgataaccaagaaaagaaga

SEQ ID NO: 781663 - DNA, 20 bp, Artificial
  CRISPR gRNA sequence
taaccaagaaaagaagagag

SEQ ID NO: 781664 - DNA, 20 bp, Artificial
  CRISPR gRNA sequence
aagatccaaataatctcaat

SEQ ID NO: 781665 - DNA, 20 bp, Artificial
  CRISPR gRNA sequence
aatctcaattagaaatgaaa

SEQ ID NO: 781666 - DNA, 20 bp, Artificial
  CRISPR gRNA sequence
tctcaattagaaatgaaatg

SEQ ID NO: 781667 - DNA, 20 bp, Artificial
  CRISPR gRNA sequence
agatattactactcatatca

SEQ ID NO: 781668 - DNA, 20 bp, Artificial
  CRISPR gRNA sequence
ctcatatcacagaaatacaa

SEQ ID NO: 781669 - DNA, 20 bp, Artificial
  CRISPR gRNA sequence
agaaatacaaaagattattc

SEQ ID NO: 781670 - DNA, 20 bp, Artificial
  CRISPR gRNA sequence
gaaatacaaaagattattca

SEQ ID NO: 781671 - DNA, 20 bp, Artificial
  CRISPR gRNA sequence
acacctttacacgtacaaac

SEQ ID NO: 781672 - DNA, 20 bp, Artificial
  CRISPR gRNA sequence
tttacacgtacaaactagaa

SEQ ID NO: 781673 - DNA, 20 bp, Artificial
  CRISPR gRNA sequence
cacgtacaaactagaaaagc

SEQ ID NO: 781674 - DNA, 20 bp, Artificial
  CRISPR gRNA sequence
cgtacaaactagaaaagcta

SEQ ID NO: 781675 - DNA, 20 bp, Artificial
  CRISPR gRNA sequence
gtacaaactagaaaagctag

SEQ ID NO: 781676 - DNA, 20 bp, Artificial
  CRISPR gRNA sequence
acaaactagaaaagctagag

SEQ ID NO: 781677 - DNA, 20 bp, Artificial
  CRISPR gRNA sequence
actagaaaagctagaggaga

SEQ ID NO: 781678 - DNA, 20 bp, Artificial
  CRISPR gRNA sequence
agaggagatggatacattcc

SEQ ID NO: 781679 - DNA, 20 bp, Artificial
  CRISPR gRNA sequence
atacaacccttcgattaaac

SEQ ID NO: 781680 - DNA, 20 bp, Artificial
  CRISPR gRNA sequence
aacccttcgattaaaccaga

SEQ ID NO: 781681 - DNA, 20 bp, Artificial
  CRISPR gRNA sequence
tcgattaaaccagaaagata

SEQ ID NO: 781682 - DNA, 20 bp, Artificial
  CRISPR gRNA sequence
cgattaaaccagaaagatat

SEQ ID NO: 781683 - DNA, 20 bp, Artificial
  CRISPR gRNA sequence
aaagatataggaactataaa

SEQ ID NO: 781684 - DNA, 20 bp, Artificial
  CRISPR gRNA sequence
actataaacagatcaataac

SEQ ID NO: 781685 - DNA, 20 bp, Artificial
  CRISPR gRNA sequence
ataaacagatcaataacaag

SEQ ID NO: 781686 - DNA, 20 bp, Artificial
  CRISPR gRNA sequence
acagatcaataacaagcagc

SEQ ID NO: 781687 - DNA, 20 bp, Artificial
  CRISPR gRNA sequence
taacaagcagcaagattgaa

SEQ ID NO: 781688 - DNA, 20 bp, Artificial
  CRISPR gRNA sequence
attgtcaacaaaaaaaaatc

SEQ ID NO: 781689 - DNA, 20 bp, Artificial
  CRISPR gRNA sequence
ttgtcaacaaaaaaaaatcc

SEQ ID NO: 781690 - DNA, 20 bp, Artificial
  CRISPR gRNA sequence
aacaaaaaaaaatccaggac

SEQ ID NO: 781691 - DNA, 20 bp, Artificial
  CRISPR gRNA sequence
aaaaaaaatccaggaccaga

SEQ ID NO: 781692 - DNA, 20 bp, Artificial
  CRISPR gRNA sequence
tccaggaccagacagattca

SEQ ID NO: 781693 - DNA, 20 bp, Artificial
  CRISPR gRNA sequence
gattcatagctgaattctat

SEQ ID NO: 781694 - DNA, 20 bp, Artificial
  CRISPR gRNA sequence
tgaattctatcagacattca

SEQ ID NO: 781695 - DNA, 20 bp, Artificial
  CRISPR gRNA sequence
attctatcagacattcaaag

SEQ ID NO: 781696 - DNA, 20 bp, Artificial
  CRISPR gRNA sequence
tcagacattcaaagaagaat

SEQ ID NO: 781697 - DNA, 20 bp, Artificial
  CRISPR gRNA sequence
attctattgacactattcca

SEQ ID NO: 781698 - DNA, 20 bp, Artificial
  CRISPR gRNA sequence
ttctattgacactattccat

SEQ ID NO: 781699 - DNA, 20 bp, Artificial
  CRISPR gRNA sequence
attgacactattccatggga

SEQ ID NO: 781700 - DNA, 20 bp, Artificial
  CRISPR gRNA sequence
tgacactattccatgggata

SEQ ID NO: 781701 - DNA, 20 bp, Artificial
  CRISPR gRNA sequence
actattccatgggatagaga

SEQ ID NO: 781702 - DNA, 20 bp, Artificial
  CRISPR gRNA sequence
tattccatgggatagagaaa

SEQ ID NO: 781703 - DNA, 20 bp, Artificial
  CRISPR gRNA sequence
attccatgggatagagaaag

SEQ ID NO: 781704 - DNA, 20 bp, Artificial
  CRISPR gRNA sequence
ttccatgggatagagaaaga

SEQ ID NO: 781705 - DNA, 20 bp, Artificial
  CRISPR gRNA sequence
cctccctaaatcattctatg

SEQ ID NO: 781706 - DNA, 20 bp, Artificial
  CRISPR gRNA sequence
cctaaatcattctatgaagc

SEQ ID NO: 781707 - DNA, 20 bp, Artificial
  CRISPR gRNA sequence
aaatcattctatgaagccag

SEQ ID NO: 781708 - DNA, 20 bp, Artificial
  CRISPR gRNA sequence
tagcaccctaatacaaaaac

SEQ ID NO: 781709 - DNA, 20 bp, Artificial
  CRISPR gRNA sequence
agcaccctaatacaaaaacc

SEQ ID NO: 781710 - DNA, 20 bp, Artificial
  CRISPR gRNA sequence
gcaccctaatacaaaaacca

SEQ ID NO: 781711 - DNA, 20 bp, Artificial
  CRISPR gRNA sequence
ccctaatacaaaaaccaggg

SEQ ID NO: 781712 - DNA, 20 bp, Artificial
  CRISPR gRNA sequence
cctaatacaaaaaccaggga

SEQ ID NO: 781713 - DNA, 20 bp, Artificial
  CRISPR gRNA sequence
agggaaggacataacaaaaa

SEQ ID NO: 781714 - DNA, 20 bp, Artificial
  CRISPR gRNA sequence
ataacaaaaaaagaaaacta

SEQ ID NO: 781715 - DNA, 20 bp, Artificial
  CRISPR gRNA sequence
taacaaaaaaagaaaactac

SEQ ID NO: 781716 - DNA, 20 bp, Artificial
  CRISPR gRNA sequence
aaaaaaagaaaactacaggc

SEQ ID NO: 781717 - DNA, 20 bp, Artificial
  CRISPR gRNA sequence
gccagtatccctgatgaaca

SEQ ID NO: 781718 - DNA, 20 bp, Artificial
  CRISPR gRNA sequence
aaaaatcctcaacaaaatac

SEQ ID NO: 781719 - DNA, 20 bp, Artificial
  CRISPR gRNA sequence
tactagctaaccaaatccaa

SEQ ID NO: 781720 - DNA, 20 bp, Artificial
  CRISPR gRNA sequence
aaatccaacagcatatcaaa

SEQ ID NO: 781721 - DNA, 20 bp, Artificial
  CRISPR gRNA sequence
aaagataatccaccatgatc

SEQ ID NO: 781722 - DNA, 20 bp, Artificial
  CRISPR gRNA sequence
gataatccaccatgatcaag

SEQ ID NO: 781723 - DNA, 20 bp, Artificial
  CRISPR gRNA sequence
ataatccaccatgatcaagt

SEQ ID NO: 781724 - DNA, 20 bp, Artificial
  CRISPR gRNA sequence
tgatcaagtgggttttacac

SEQ ID NO: 781725 - DNA, 20 bp, Artificial
  CRISPR gRNA sequence
gatcaagtgggttttacacc

SEQ ID NO: 781726 - DNA, 20 bp, Artificial
  CRISPR gRNA sequence
atcaagtgggttttacacca

SEQ ID NO: 781727 - DNA, 20 bp, Artificial
  CRISPR gRNA sequence
tgggttttacaccagggatg

SEQ ID NO: 781728 - DNA, 20 bp, Artificial
  CRISPR gRNA sequence
gggttttacaccagggatgc

SEQ ID NO: 781729 - DNA, 20 bp, Artificial
  CRISPR gRNA sequence
ggttttacaccagggatgca

SEQ ID NO: 781730 - DNA, 20 bp, Artificial
  CRISPR gRNA sequence
ttacaccagggatgcaggga

SEQ ID NO: 781731 - DNA, 20 bp, Artificial
  CRISPR gRNA sequence
agggatggtttaacatccac

SEQ ID NO: 781732 - DNA, 20 bp, Artificial
  CRISPR gRNA sequence
aatgtgatacaccacacaaa

SEQ ID NO: 781733 - DNA, 20 bp, Artificial
  CRISPR gRNA sequence
aaatcacatgatcatctcaa

SEQ ID NO: 781734 - DNA, 20 bp, Artificial
  CRISPR gRNA sequence
catgatcatctcaatagatt

SEQ ID NO: 781735 - DNA, 20 bp, Artificial
  CRISPR gRNA sequence
catctcaatagattcagaaa

SEQ ID NO: 781736 - DNA, 20 bp, Artificial
  CRISPR gRNA sequence
tcctttatgattaaaaccct

SEQ ID NO: 781737 - DNA, 20 bp, Artificial
  CRISPR gRNA sequence
attaaaaccctcagcaaaat

SEQ ID NO: 781738 - DNA, 20 bp, Artificial
  CRISPR gRNA sequence
aaccctcagcaaaattagca

SEQ ID NO: 781739 - DNA, 20 bp, Artificial
  CRISPR gRNA sequence
cctcagcaaaattagcacag

SEQ ID NO: 781740 - DNA, 20 bp, Artificial
  CRISPR gRNA sequence
ctcagcaaaattagcacaga

SEQ ID NO: 781741 - DNA, 20 bp, Artificial
  CRISPR gRNA sequence
gcacagaaggaacatatctt

SEQ ID NO: 781742 - DNA, 20 bp, Artificial
  CRISPR gRNA sequence
cacagaaggaacatatctta

SEQ ID NO: 781743 - DNA, 20 bp, Artificial
  CRISPR gRNA sequence
aacatatcttaaggtaataa

SEQ ID NO: 781744 - DNA, 20 bp, Artificial
  CRISPR gRNA sequence
agctaactacgacaaaccca

SEQ ID NO: 781745 - DNA, 20 bp, Artificial
  CRISPR gRNA sequence
acagccaacattatgctgaa

SEQ ID NO: 781746 - DNA, 20 bp, Artificial
  CRISPR gRNA sequence
cagccaacattatgctgaat

SEQ ID NO: 781747 - DNA, 20 bp, Artificial
  CRISPR gRNA sequence
agccaacattatgctgaatg

SEQ ID NO: 781748 - DNA, 20 bp, Artificial
  CRISPR gRNA sequence
acattatgctgaatggggaa

SEQ ID NO: 781749 - DNA, 20 bp, Artificial
  CRISPR gRNA sequence
gctgaatggggaaaagttga

SEQ ID NO: 781750 - DNA, 20 bp, Artificial
  CRISPR gRNA sequence
aagttgaaagcattttccct

SEQ ID NO: 781751 - DNA, 20 bp, Artificial
  CRISPR gRNA sequence
aaagcattttccctgagaat

SEQ ID NO: 781752 - DNA, 20 bp, Artificial
  CRISPR gRNA sequence
ttttccctgagaattggaac

SEQ ID NO: 781753 - DNA, 20 bp, Artificial
  CRISPR gRNA sequence
cctgagaattggaacaagac

SEQ ID NO: 781754 - DNA, 20 bp, Artificial
  CRISPR gRNA sequence
acactttcaccacttttatt

SEQ ID NO: 781755 - DNA, 20 bp, Artificial
  CRISPR gRNA sequence
ttcaccacttttattcagca

SEQ ID NO: 781756 - DNA, 20 bp, Artificial
  CRISPR gRNA sequence
acttttattcagcatagtac

SEQ ID NO: 781757 - DNA, 20 bp, Artificial
  CRISPR gRNA sequence
tttattcagcatagtactgg

SEQ ID NO: 781758 - DNA, 20 bp, Artificial
  CRISPR gRNA sequence
cagcatagtactggaagtcc

SEQ ID NO: 781759 - DNA, 20 bp, Artificial
  CRISPR gRNA sequence
atagtactggaagtcctggc

SEQ ID NO: 781760 - DNA, 20 bp, Artificial
  CRISPR gRNA sequence
agtactggaagtcctggcca

SEQ ID NO: 781761 - DNA, 20 bp, Artificial
  CRISPR gRNA sequence
agtcctggccagagcactca

SEQ ID NO: 781762 - DNA, 20 bp, Artificial
  CRISPR gRNA sequence
tcctggccagagcactcaaa

SEQ ID NO: 781763 - DNA, 20 bp, Artificial
  CRISPR gRNA sequence
ggccagagcactcaaagaga

SEQ ID NO: 781764 - DNA, 20 bp, Artificial
  CRISPR gRNA sequence
cactcaaagagaaagaaata

SEQ ID NO: 781765 - DNA, 20 bp, Artificial
  CRISPR gRNA sequence
actcaaagagaaagaaataa

SEQ ID NO: 781766 - DNA, 20 bp, Artificial
  CRISPR gRNA sequence
ctcaaagagaaagaaataaa

SEQ ID NO: 781767 - DNA, 20 bp, Artificial
  CRISPR gRNA sequence
gaaataaagggcatccaaat

SEQ ID NO: 781768 - DNA, 20 bp, Artificial
  CRISPR gRNA sequence
aaagggcatccaaattggta

SEQ ID NO: 781769 - DNA, 20 bp, Artificial
  CRISPR gRNA sequence
agggcatccaaattggtaaa

SEQ ID NO: 781770 - DNA, 20 bp, Artificial
  CRISPR gRNA sequence
gggcatccaaattggtaaag

SEQ ID NO: 781771 - DNA, 20 bp, Artificial
  CRISPR gRNA sequence
catccaaattggtaaagagg

SEQ ID NO: 781772 - DNA, 20 bp, Artificial
  CRISPR gRNA sequence
tgatgatatgatcatatacc

SEQ ID NO: 781773 - DNA, 20 bp, Artificial
  CRISPR gRNA sequence
tcatatacctagaaaaccct

SEQ ID NO: 781774 - DNA, 20 bp, Artificial
  CRISPR gRNA sequence
catatacctagaaaacccta

SEQ ID NO: 781775 - DNA, 20 bp, Artificial
  CRISPR gRNA sequence
accctaaggattcatcttga

SEQ ID NO: 781776 - DNA, 20 bp, Artificial
  CRISPR gRNA sequence
ggattcatcttgaaagctcc

SEQ ID NO: 781777 - DNA, 20 bp, Artificial
  CRISPR gRNA sequence
atcttgaaagctcctagaac

SEQ ID NO: 781778 - DNA, 20 bp, Artificial
  CRISPR gRNA sequence
ctagaactggtaaacaaatt

SEQ ID NO: 781779 - DNA, 20 bp, Artificial
  CRISPR gRNA sequence
actggtaaacaaattcagca

SEQ ID NO: 781780 - DNA, 20 bp, Artificial
  CRISPR gRNA sequence
aaacaaattcagcaaagttt

SEQ ID NO: 781781 - DNA, 20 bp, Artificial
  CRISPR gRNA sequence
aacaaattcagcaaagtttc

SEQ ID NO: 781782 - DNA, 20 bp, Artificial
  CRISPR gRNA sequence
caaaattaatgtacacaaat

SEQ ID NO: 781783 - DNA, 20 bp, Artificial
  CRISPR gRNA sequence
aattaatgtacacaaatcag

SEQ ID NO: 781784 - DNA, 20 bp, Artificial
  CRISPR gRNA sequence
tatacaccaacatcaaccaa

SEQ ID NO: 781785 - DNA, 20 bp, Artificial
  CRISPR gRNA sequence
caaaaataaaataaaatact

SEQ ID NO: 781786 - DNA, 20 bp, Artificial
  CRISPR gRNA sequence
aaaaataaaataaaatactt

SEQ ID NO: 781787 - DNA, 20 bp, Artificial
  CRISPR gRNA sequence
acttaggaatatacctaacg

SEQ ID NO: 781788 - DNA, 20 bp, Artificial
  CRISPR gRNA sequence
cttaggaatatacctaacga

SEQ ID NO: 781789 - DNA, 20 bp, Artificial
  CRISPR gRNA sequence
atacctaacgaaggacatga

SEQ ID NO: 781790 - DNA, 20 bp, Artificial
  CRISPR gRNA sequence
aggacatgaaagacctctac

SEQ ID NO: 781791 - DNA, 20 bp, Artificial
  CRISPR gRNA sequence
ggacatgaaagacctctaca

SEQ ID NO: 781792 - DNA, 20 bp, Artificial
  CRISPR gRNA sequence
aaactacaaatcactactga

SEQ ID NO: 781793 - DNA, 20 bp, Artificial
  CRISPR gRNA sequence
atcactactgaaagaaatca

SEQ ID NO: 781794 - DNA, 20 bp, Artificial
  CRISPR gRNA sequence
tcacagatgacacaaacaaa

SEQ ID NO: 781795 - DNA, 20 bp, Artificial
  CRISPR gRNA sequence
acacatcccatgttcatgaa

SEQ ID NO: 781796 - DNA, 20 bp, Artificial
  CRISPR gRNA sequence
cacatcccatgttcatgaat

SEQ ID NO: 781797 - DNA, 20 bp, Artificial
  CRISPR gRNA sequence
gtgaaaatgaccatactttg

SEQ ID NO: 781798 - DNA, 20 bp, Artificial
  CRISPR gRNA sequence
ccatactttgtagattgcaa

SEQ ID NO: 781799 - DNA, 20 bp, Artificial
  CRISPR gRNA sequence
gattgcaaaagcaatctaca

SEQ ID NO: 781800 - DNA, 20 bp, Artificial
  CRISPR gRNA sequence
actaccatcattcttcacaa

SEQ ID NO: 781801 - DNA, 20 bp, Artificial
  CRISPR gRNA sequence
accatcattcttcacaaaag

SEQ ID NO: 781802 - DNA, 20 bp, Artificial
  CRISPR gRNA sequence
attcttcacaaaagtagaaa

SEQ ID NO: 781803 - DNA, 20 bp, Artificial
  CRISPR gRNA sequence
aagaaatcctaaaattcata

SEQ ID NO: 781804 - DNA, 20 bp, Artificial
  CRISPR gRNA sequence
aaattcatatggaaccaaaa

SEQ ID NO: 781805 - DNA, 20 bp, Artificial
  CRISPR gRNA sequence
attcatatggaaccaaaaaa

SEQ ID NO: 781806 - DNA, 20 bp, Artificial
  CRISPR gRNA sequence
gaaccaaaaaagagcccaca

SEQ ID NO: 781807 - DNA, 20 bp, Artificial
  CRISPR gRNA sequence
aaaaagagcccacatagcca

SEQ ID NO: 781808 - DNA, 20 bp, Artificial
  CRISPR gRNA sequence
agagcccacatagccaaagc

SEQ ID NO: 781809 - DNA, 20 bp, Artificial
  CRISPR gRNA sequence
gagcccacatagccaaagca

SEQ ID NO: 781810 - DNA, 20 bp, Artificial
  CRISPR gRNA sequence
cccacatagccaaagcaagg

SEQ ID NO: 781811 - DNA, 20 bp, Artificial
  CRISPR gRNA sequence
tagccaaagcaaggaagact

SEQ ID NO: 781812 - DNA, 20 bp, Artificial
  CRISPR gRNA sequence
agcaaggaagactaagcaaa

SEQ ID NO: 781813 - DNA, 20 bp, Artificial
  CRISPR gRNA sequence
ctaagcaaaaagaacaaacc

SEQ ID NO: 781814 - DNA, 20 bp, Artificial
  CRISPR gRNA sequence
aagcaaaaagaacaaacctg

SEQ ID NO: 781815 - DNA, 20 bp, Artificial
  CRISPR gRNA sequence
agcaaaaagaacaaacctgg

SEQ ID NO: 781816 - DNA, 20 bp, Artificial
  CRISPR gRNA sequence
caaaccatactataacacca

SEQ ID NO: 781817 - DNA, 20 bp, Artificial
  CRISPR gRNA sequence
taacaccatagtcaccaaaa

SEQ ID NO: 781818 - DNA, 20 bp, Artificial
  CRISPR gRNA sequence
tcaccaaaacagcataatac

SEQ ID NO: 781819 - DNA, 20 bp, Artificial
  CRISPR gRNA sequence
gcataatactagtataaaaa

SEQ ID NO: 781820 - DNA, 20 bp, Artificial
  CRISPR gRNA sequence
cataatactagtataaaaat

SEQ ID NO: 781821 - DNA, 20 bp, Artificial
  CRISPR gRNA sequence
ctagtataaaaataggcaca

SEQ ID NO: 781822 - DNA, 20 bp, Artificial
  CRISPR gRNA sequence
aaaataggcacatagaccaa

SEQ ID NO: 781823 - DNA, 20 bp, Artificial
  CRISPR gRNA sequence
catagaccaatggaacaaaa

SEQ ID NO: 781824 - DNA, 20 bp, Artificial
  CRISPR gRNA sequence
tagaccaatggaacaaaacg

SEQ ID NO: 781825 - DNA, 20 bp, Artificial
  CRISPR gRNA sequence
atggaacaaaacggagaacc

SEQ ID NO: 781826 - DNA, 20 bp, Artificial
  CRISPR gRNA sequence
tggaacaaaacggagaacct

SEQ ID NO: 781827 - DNA, 20 bp, Artificial
  CRISPR gRNA sequence
aaacggagaacctaggaata

SEQ ID NO: 781828 - DNA, 20 bp, Artificial
  CRISPR gRNA sequence
ggaataaagccaaatactta

SEQ ID NO: 781829 - DNA, 20 bp, Artificial
  CRISPR gRNA sequence
tagccaactgatctttgaca

SEQ ID NO: 781830 - DNA, 20 bp, Artificial
  CRISPR gRNA sequence
acaaagcaaacaaaaacata

SEQ ID NO: 781831 - DNA, 20 bp, Artificial
  CRISPR gRNA sequence
aagcaaacaaaaacataaag

SEQ ID NO: 781832 - DNA, 20 bp, Artificial
  CRISPR gRNA sequence
agcaaacaaaaacataaagt

SEQ ID NO: 781833 - DNA, 20 bp, Artificial
  CRISPR gRNA sequence
gcaaacaaaaacataaagtg

SEQ ID NO: 781834 - DNA, 20 bp, Artificial
  CRISPR gRNA sequence
acaaaaacataaagtgggga

SEQ ID NO: 781835 - DNA, 20 bp, Artificial
  CRISPR gRNA sequence
agtacatcctattcaacaaa

SEQ ID NO: 781836 - DNA, 20 bp, Artificial
  CRISPR gRNA sequence
tcctattcaacaaacggtgc

SEQ ID NO: 781837 - DNA, 20 bp, Artificial
  CRISPR gRNA sequence
cctattcaacaaacggtgct

SEQ ID NO: 781838 - DNA, 20 bp, Artificial
  CRISPR gRNA sequence
acaaacggtgctgggataat

SEQ ID NO: 781839 - DNA, 20 bp, Artificial
  CRISPR gRNA sequence
acggtgctgggataattggc

SEQ ID NO: 781840 - DNA, 20 bp, Artificial
  CRISPR gRNA sequence
gggataattggctagccaca

SEQ ID NO: 781841 - DNA, 20 bp, Artificial
  CRISPR gRNA sequence
gataattggctagccacatg

SEQ ID NO: 781842 - DNA, 20 bp, Artificial
  CRISPR gRNA sequence
aattggctagccacatggag

SEQ ID NO: 781843 - DNA, 20 bp, Artificial
  CRISPR gRNA sequence
ccacatggagaagaataaac

SEQ ID NO: 781844 - DNA, 20 bp, Artificial
  CRISPR gRNA sequence
accttataaaaaatcaactc

SEQ ID NO: 781845 - DNA, 20 bp, Artificial
  CRISPR gRNA sequence
tataaaaaatcaactcaaga

SEQ ID NO: 781846 - DNA, 20 bp, Artificial
  CRISPR gRNA sequence
aatcaactcaagatggatca

SEQ ID NO: 781847 - DNA, 20 bp, Artificial
  CRISPR gRNA sequence
tggatcaaagacttaaatct

SEQ ID NO: 781848 - DNA, 20 bp, Artificial
  CRISPR gRNA sequence
acctgaaaccataacgattc

SEQ ID NO: 781849 - DNA, 20 bp, Artificial
  CRISPR gRNA sequence
tgaaaccataacgattctag

SEQ ID NO: 781850 - DNA, 20 bp, Artificial
  CRISPR gRNA sequence
tctagaagataacatcgaaa

SEQ ID NO: 781851 - DNA, 20 bp, Artificial
  CRISPR gRNA sequence
taacatcgaaaaagcccttc

SEQ ID NO: 781852 - DNA, 20 bp, Artificial
  CRISPR gRNA sequence
gaaaaagcccttctagacat

SEQ ID NO: 781853 - DNA, 20 bp, Artificial
  CRISPR gRNA sequence
agcccttctagacattagct

SEQ ID NO: 781854 - DNA, 20 bp, Artificial
  CRISPR gRNA sequence
gcccttctagacattagctt

SEQ ID NO: 781855 - DNA, 20 bp, Artificial
  CRISPR gRNA sequence
tctagacattagcttaggca

SEQ ID NO: 781856 - DNA, 20 bp, Artificial
  CRISPR gRNA sequence
taggcaaagacttcgtgacc

SEQ ID NO: 781857 - DNA, 20 bp, Artificial
  CRISPR gRNA sequence
cttcgtgaccaagaacccaa

SEQ ID NO: 781858 - DNA, 20 bp, Artificial
  CRISPR gRNA sequence
acccaaaagcaaatgcaaca

SEQ ID NO: 781859 - DNA, 20 bp, Artificial
  CRISPR gRNA sequence
aagcaaatgcaacaaagaca

SEQ ID NO: 781860 - DNA, 20 bp, Artificial
  CRISPR gRNA sequence
agcaaatgcaacaaagacaa

SEQ ID NO: 781861 - DNA, 20 bp, Artificial
  CRISPR gRNA sequence
gcaacaaagacaaaggtaaa

SEQ ID NO: 781862 - DNA, 20 bp, Artificial
  CRISPR gRNA sequence
gacaaaggtaaatagataaa

SEQ ID NO: 781863 - DNA, 20 bp, Artificial
  CRISPR gRNA sequence
acaaaggtaaatagataaat

SEQ ID NO: 781864 - DNA, 20 bp, Artificial
  CRISPR gRNA sequence
caaaggtaaatagataaata

SEQ ID NO: 781865 - DNA, 20 bp, Artificial
  CRISPR gRNA sequence
agggacttaattaaactaaa

SEQ ID NO: 781866 - DNA, 20 bp, Artificial
  CRISPR gRNA sequence
taaactaaaaagcttctgca

SEQ ID NO: 781867 - DNA, 20 bp, Artificial
  CRISPR gRNA sequence
aaaaagcttctgcacagcaa

SEQ ID NO: 781868 - DNA, 20 bp, Artificial
  CRISPR gRNA sequence
tgcacagcaaaagaaataat

SEQ ID NO: 781869 - DNA, 20 bp, Artificial
  CRISPR gRNA sequence
acagcaaaagaaataatcag

SEQ ID NO: 781870 - DNA, 20 bp, Artificial
  CRISPR gRNA sequence
agcaaaagaaataatcagca

SEQ ID NO: 781871 - DNA, 20 bp, Artificial
  CRISPR gRNA sequence
gaaataatcagcagagttaa

SEQ ID NO: 781872 - DNA, 20 bp, Artificial
  CRISPR gRNA sequence
cagagttaacagacaaccca

SEQ ID NO: 781873 - DNA, 20 bp, Artificial
  CRISPR gRNA sequence
gagttaacagacaacccaca

SEQ ID NO: 781874 - DNA, 20 bp, Artificial
  CRISPR gRNA sequence
ttaacagacaacccacagag

SEQ ID NO: 781875 - DNA, 20 bp, Artificial
  CRISPR gRNA sequence
taacagacaacccacagagt

SEQ ID NO: 781876 - DNA, 20 bp, Artificial
  CRISPR gRNA sequence
acagacaacccacagagtgg

SEQ ID NO: 781877 - DNA, 20 bp, Artificial
  CRISPR gRNA sequence
cacaatctatacatctgaca

SEQ ID NO: 781878 - DNA, 20 bp, Artificial
  CRISPR gRNA sequence
acaatctatacatctgacaa

SEQ ID NO: 781879 - DNA, 20 bp, Artificial
  CRISPR gRNA sequence
tctgacaaaggactaatatc

SEQ ID NO: 781880 - DNA, 20 bp, Artificial
  CRISPR gRNA sequence
gactaatatccagaatctac

SEQ ID NO: 781881 - DNA, 20 bp, Artificial
  CRISPR gRNA sequence
actaatatccagaatctaca

SEQ ID NO: 781882 - DNA, 20 bp, Artificial
  CRISPR gRNA sequence
tacaaggtatgcaaataaat

SEQ ID NO: 781883 - DNA, 20 bp, Artificial
  CRISPR gRNA sequence
aggtatgcaaataaatcagc

SEQ ID NO: 781884 - DNA, 20 bp, Artificial
  CRISPR gRNA sequence
caaacgatcccatcaaaaaa

SEQ ID NO: 781885 - DNA, 20 bp, Artificial
  CRISPR gRNA sequence
aaacgatcccatcaaaaaat

SEQ ID NO: 781886 - DNA, 20 bp, Artificial
  CRISPR gRNA sequence
atcccatcaaaaaatgggct

SEQ ID NO: 781887 - DNA, 20 bp, Artificial
  CRISPR gRNA sequence
tcccatcaaaaaatgggcta

SEQ ID NO: 781888 - DNA, 20 bp, Artificial
  CRISPR gRNA sequence
aaatgggctaaggacatgaa

SEQ ID NO: 781889 - DNA, 20 bp, Artificial
  CRISPR gRNA sequence
catgaatagacaattctcac

SEQ ID NO: 781890 - DNA, 20 bp, Artificial
  CRISPR gRNA sequence
atgaatagacaattctcaca

SEQ ID NO: 781891 - DNA, 20 bp, Artificial
  CRISPR gRNA sequence
gaatagacaattctcacaag

SEQ ID NO: 781892 - DNA, 20 bp, Artificial
  CRISPR gRNA sequence
gagatacacaaatgaccaac

SEQ ID NO: 781893 - DNA, 20 bp, Artificial
  CRISPR gRNA sequence
acaaatgaccaacgagcata

SEQ ID NO: 781894 - DNA, 20 bp, Artificial
  CRISPR gRNA sequence
tgctcaacatcactaattct

SEQ ID NO: 781895 - DNA, 20 bp, Artificial
  CRISPR gRNA sequence
gctcaacatcactaattctc

SEQ ID NO: 781896 - DNA, 20 bp, Artificial
  CRISPR gRNA sequence
ctcaacatcactaattctca

SEQ ID NO: 781897 - DNA, 20 bp, Artificial
  CRISPR gRNA sequence
cgataccaccttactcctgc

SEQ ID NO: 781898 - DNA, 20 bp, Artificial
  CRISPR gRNA sequence
ccaccttactcctgcaagaa

SEQ ID NO: 781899 - DNA, 20 bp, Artificial
  CRISPR gRNA sequence
tggccataacaaaaaaataa

SEQ ID NO: 781900 - DNA, 20 bp, Artificial
  CRISPR gRNA sequence
aacaaaaaaataatagatgt

SEQ ID NO: 781901 - DNA, 20 bp, Artificial
  CRISPR gRNA sequence
aaaaataatagatgttggca

SEQ ID NO: 781902 - DNA, 20 bp, Artificial
  CRISPR gRNA sequence
aatagatgttggcatggatg

SEQ ID NO: 781903 - DNA, 20 bp, Artificial
  CRISPR gRNA sequence
gttggcatggatgtggtgaa

SEQ ID NO: 781904 - DNA, 20 bp, Artificial
  CRISPR gRNA sequence
aagaaacactcttacactgt

SEQ ID NO: 781905 - DNA, 20 bp, Artificial
  CRISPR gRNA sequence
aaacactcttacactgttgg

SEQ ID NO: 781906 - DNA, 20 bp, Artificial
  CRISPR gRNA sequence
aacactcttacactgttggt

SEQ ID NO: 781907 - DNA, 20 bp, Artificial
  CRISPR gRNA sequence
ctgttggtgggaatgtaaac

SEQ ID NO: 781908 - DNA, 20 bp, Artificial
  CRISPR gRNA sequence
gtaaactagtacaaccacta

SEQ ID NO: 781909 - DNA, 20 bp, Artificial
  CRISPR gRNA sequence
agtacaaccactatggaaaa

SEQ ID NO: 781910 - DNA, 20 bp, Artificial
  CRISPR gRNA sequence
aaccactatggaaaacagtg

SEQ ID NO: 781911 - DNA, 20 bp, Artificial
  CRISPR gRNA sequence
ccactatggaaaacagtgtg

SEQ ID NO: 781912 - DNA, 20 bp, Artificial
  CRISPR gRNA sequence
gagattcctttaaaaactaa

SEQ ID NO: 781913 - DNA, 20 bp, Artificial
  CRISPR gRNA sequence
attcctttaaaaactaaaag

SEQ ID NO: 781914 - DNA, 20 bp, Artificial
  CRISPR gRNA sequence
agtagatctaccatttgatc

SEQ ID NO: 781915 - DNA, 20 bp, Artificial
  CRISPR gRNA sequence
tgatccagcaatcccactac

SEQ ID NO: 781916 - DNA, 20 bp, Artificial
  CRISPR gRNA sequence
gatccagcaatcccactact

SEQ ID NO: 781917 - DNA, 20 bp, Artificial
  CRISPR gRNA sequence
cactactaggtatttaccca

SEQ ID NO: 781918 - DNA, 20 bp, Artificial
  CRISPR gRNA sequence
actactaggtatttacccaa

SEQ ID NO: 781919 - DNA, 20 bp, Artificial
  CRISPR gRNA sequence
taggtatttacccaaaggaa

SEQ ID NO: 781920 - DNA, 20 bp, Artificial
  CRISPR gRNA sequence
gtatttacccaaaggaaaag

SEQ ID NO: 781921 - DNA, 20 bp, Artificial
  CRISPR gRNA sequence
agaagtcattatacaaaaaa

SEQ ID NO: 781922 - DNA, 20 bp, Artificial
  CRISPR gRNA sequence
tacttgcacacgcattttta

SEQ ID NO: 781923 - DNA, 20 bp, Artificial
  CRISPR gRNA sequence
ttgcacacgcatttttatag

SEQ ID NO: 781924 - DNA, 20 bp, Artificial
  CRISPR gRNA sequence
aatttgcaattgcaaatata

SEQ ID NO: 781925 - DNA, 20 bp, Artificial
  CRISPR gRNA sequence
caattgcaaatatatggaac

SEQ ID NO: 781926 - DNA, 20 bp, Artificial
  CRISPR gRNA sequence
cagcccaaatgcccatcaat

SEQ ID NO: 781927 - DNA, 20 bp, Artificial
  CRISPR gRNA sequence
ccaaatgcccatcaatcagt

SEQ ID NO: 781928 - DNA, 20 bp, Artificial
  CRISPR gRNA sequence
aatgcccatcaatcagtgag

SEQ ID NO: 781929 - DNA, 20 bp, Artificial
  CRISPR gRNA sequence
catcaatcagtgagtggata

SEQ ID NO: 781930 - DNA, 20 bp, Artificial
  CRISPR gRNA sequence
gtgagtggataaagaaaatg

SEQ ID NO: 781931 - DNA, 20 bp, Artificial
  CRISPR gRNA sequence
catattatatatatacacca

SEQ ID NO: 781932 - DNA, 20 bp, Artificial
  CRISPR gRNA sequence
atacaccatggaatactact

SEQ ID NO: 781933 - DNA, 20 bp, Artificial
  CRISPR gRNA sequence
gaatactacttagctatgaa

SEQ ID NO: 781934 - DNA, 20 bp, Artificial
  CRISPR gRNA sequence
aatactacttagctatgaaa

SEQ ID NO: 781935 - DNA, 20 bp, Artificial
  CRISPR gRNA sequence
tatgaaaaggaatgaaatca

SEQ ID NO: 781936 - DNA, 20 bp, Artificial
  CRISPR gRNA sequence
gaatgaaatcatagcatttg

SEQ ID NO: 781937 - DNA, 20 bp, Artificial
  CRISPR gRNA sequence
tcatagcatttgcagcatcc

SEQ ID NO: 781938 - DNA, 20 bp, Artificial
  CRISPR gRNA sequence
agcatttgcagcatcctgga

SEQ ID NO: 781939 - DNA, 20 bp, Artificial
  CRISPR gRNA sequence
tgcagcatcctggatggaat

SEQ ID NO: 781940 - DNA, 20 bp, Artificial
  CRISPR gRNA sequence
cagcatcctggatggaatta

SEQ ID NO: 781941 - DNA, 20 bp, Artificial
  CRISPR gRNA sequence
gaattagagactattattct

SEQ ID NO: 781942 - DNA, 20 bp, Artificial
  CRISPR gRNA sequence
agagactattattctaagtg

SEQ ID NO: 781943 - DNA, 20 bp, Artificial
  CRISPR gRNA sequence
ttattctaagtgaagtaact

SEQ ID NO: 781944 - DNA, 20 bp, Artificial
  CRISPR gRNA sequence
tattctaagtgaagtaactc

SEQ ID NO: 781945 - DNA, 20 bp, Artificial
  CRISPR gRNA sequence
cattgtatgctctcactcat

SEQ ID NO: 781946 - DNA, 20 bp, Artificial
  CRISPR gRNA sequence
atgctctcactcataagtgc

SEQ ID NO: 781947 - DNA, 20 bp, Artificial
  CRISPR gRNA sequence
ctcactcataagtgcgagct

SEQ ID NO: 781948 - DNA, 20 bp, Artificial
  CRISPR gRNA sequence
ataagtgcgagctaagctat

SEQ ID NO: 781949 - DNA, 20 bp, Artificial
  CRISPR gRNA sequence
taagtgcgagctaagctatg

SEQ ID NO: 781950 - DNA, 20 bp, Artificial
  CRISPR gRNA sequence
tgcgagctaagctatgagga

SEQ ID NO: 781951 - DNA, 20 bp, Artificial
  CRISPR gRNA sequence
agctaagctatgaggatgga

SEQ ID NO: 781952 - DNA, 20 bp, Artificial
  CRISPR gRNA sequence
gctaagctatgaggatggaa

SEQ ID NO: 781953 - DNA, 20 bp, Artificial
  CRISPR gRNA sequence
ctatgaggatggaaaggcat

SEQ ID NO: 781954 - DNA, 20 bp, Artificial
  CRISPR gRNA sequence
aaggcataagaatgatacaa

SEQ ID NO: 781955 - DNA, 20 bp, Artificial
  CRISPR gRNA sequence
agaatgatacaatggacttt

SEQ ID NO: 781956 - DNA, 20 bp, Artificial
  CRISPR gRNA sequence
gaatgatacaatggactttc

SEQ ID NO: 781957 - DNA, 20 bp, Artificial
  CRISPR gRNA sequence
tacaatggactttcaggact

SEQ ID NO: 781958 - DNA, 20 bp, Artificial
  CRISPR gRNA sequence
acaatggactttcaggactt

SEQ ID NO: 781959 - DNA, 20 bp, Artificial
  CRISPR gRNA sequence
caatggactttcaggactta

SEQ ID NO: 781960 - DNA, 20 bp, Artificial
  CRISPR gRNA sequence
aatggactttcaggacttag

SEQ ID NO: 781961 - DNA, 20 bp, Artificial
  CRISPR gRNA sequence
gactttcaggacttagggga

SEQ ID NO: 781962 - DNA, 20 bp, Artificial
  CRISPR gRNA sequence
actttcaggacttaggggaa

SEQ ID NO: 781963 - DNA, 20 bp, Artificial
  CRISPR gRNA sequence
tcaggacttaggggaaagga

SEQ ID NO: 781964 - DNA, 20 bp, Artificial
  CRISPR gRNA sequence
gacttaggggaaaggatggt

SEQ ID NO: 781965 - DNA, 20 bp, Artificial
  CRISPR gRNA sequence
acttaggggaaaggatggtt

SEQ ID NO: 781966 - DNA, 20 bp, Artificial
  CRISPR gRNA sequence
cttaggggaaaggatggttg

SEQ ID NO: 781967 - DNA, 20 bp, Artificial
  CRISPR gRNA sequence
ttaggggaaaggatggttgg

SEQ ID NO: 781968 - DNA, 20 bp, Artificial
  CRISPR gRNA sequence
gggaaaggatggttgggggt

SEQ ID NO: 781969 - DNA, 20 bp, Artificial
  CRISPR gRNA sequence
gaaaggatggttgggggtga

SEQ ID NO: 781970 - DNA, 20 bp, Artificial
  CRISPR gRNA sequence
gagataaaaaactccacatt

SEQ ID NO: 781971 - DNA, 20 bp, Artificial
  CRISPR gRNA sequence
agataaaaaactccacattt

SEQ ID NO: 781972 - DNA, 20 bp, Artificial
  CRISPR gRNA sequence
aaaaaactccacatttgggc

SEQ ID NO: 781973 - DNA, 20 bp, Artificial
  CRISPR gRNA sequence
aaaaactccacatttgggcc

SEQ ID NO: 781974 - DNA, 20 bp, Artificial
  CRISPR gRNA sequence
ctccacatttgggccaggcg

SEQ ID NO: 781975 - DNA, 20 bp, Artificial
  CRISPR gRNA sequence
gttgctcacacctgtaatcc

SEQ ID NO: 781976 - DNA, 20 bp, Artificial
  CRISPR gRNA sequence
cacctgtaatcccagcactt

SEQ ID NO: 781977 - DNA, 20 bp, Artificial
  CRISPR gRNA sequence
acctgtaatcccagcacttt

SEQ ID NO: 781978 - DNA, 20 bp, Artificial
  CRISPR gRNA sequence
ctgtaatcccagcactttgg

SEQ ID NO: 781979 - DNA, 20 bp, Artificial
  CRISPR gRNA sequence
tgtaatcccagcactttggg

SEQ ID NO: 781980 - DNA, 20 bp, Artificial
  CRISPR gRNA sequence
tcccagcactttgggaggcc

SEQ ID NO: 781981 - DNA, 20 bp, Artificial
  CRISPR gRNA sequence
cccagcactttgggaggccg

SEQ ID NO: 781982 - DNA, 20 bp, Artificial
  CRISPR gRNA sequence
agcactttgggaggccgagg

SEQ ID NO: 781983 - DNA, 20 bp, Artificial
  CRISPR gRNA sequence
gcactttgggaggccgaggt

SEQ ID NO: 781984 - DNA, 20 bp, Artificial
  CRISPR gRNA sequence
ctttgggaggccgaggtggg

SEQ ID NO: 781985 - DNA, 20 bp, Artificial
  CRISPR gRNA sequence
ggccgaggtgggcagatcac

SEQ ID NO: 781986 - DNA, 20 bp, Artificial
  CRISPR gRNA sequence
gccgaggtgggcagatcacg

SEQ ID NO: 781987 - DNA, 20 bp, Artificial
  CRISPR gRNA sequence
aggtgggcagatcacgaggt

SEQ ID NO: 781988 - DNA, 20 bp, Artificial
  CRISPR gRNA sequence
ggtgggcagatcacgaggtc

SEQ ID NO: 781989 - DNA, 20 bp, Artificial
  CRISPR gRNA sequence
tgggcagatcacgaggtcag

SEQ ID NO: 781990 - DNA, 20 bp, Artificial
  CRISPR gRNA sequence
gatcacgaggtcaggagatc

SEQ ID NO: 781991 - DNA, 20 bp, Artificial
  CRISPR gRNA sequence
tcaggagatcaagatcatcc

SEQ ID NO: 781992 - DNA, 20 bp, Artificial
  CRISPR gRNA sequence
caagatcatcctggctaaca

SEQ ID NO: 781993 - DNA, 20 bp, Artificial
  CRISPR gRNA sequence
ctactaaaaatacaaaaaat

SEQ ID NO: 781994 - DNA, 20 bp, Artificial
  CRISPR gRNA sequence
taaaaatacaaaaaattagc

SEQ ID NO: 781995 - DNA, 20 bp, Artificial
  CRISPR gRNA sequence
aaaaatacaaaaaattagcc

SEQ ID NO: 781996 - DNA, 20 bp, Artificial
  CRISPR gRNA sequence
tacaaaaaattagccgggcg

SEQ ID NO: 781997 - DNA, 20 bp, Artificial
  CRISPR gRNA sequence
aaaaaattagccgggcgtgg

SEQ ID NO: 781998 - DNA, 20 bp, Artificial
  CRISPR gRNA sequence
aaattagccgggcgtggtgg

SEQ ID NO: 781999 - DNA, 20 bp, Artificial
  CRISPR gRNA sequence
aattagccgggcgtggtggc

SEQ ID NO: 782000 - DNA, 20 bp, Artificial
  CRISPR gRNA sequence
ggcgtggtggcaggcacctg

SEQ ID NO: 782001 - DNA, 20 bp, Artificial
  CRISPR gRNA sequence
gtggcaggcacctgcagtcg

SEQ ID NO: 782002 - DNA, 20 bp, Artificial
  CRISPR gRNA sequence
cacctgcagtcgcagctact

SEQ ID NO: 782003 - DNA, 20 bp, Artificial
  CRISPR gRNA sequence
acctgcagtcgcagctactc

SEQ ID NO: 782004 - DNA, 20 bp, Artificial
  CRISPR gRNA sequence
ctgcagtcgcagctactcgg

SEQ ID NO: 782005 - DNA, 20 bp, Artificial
  CRISPR gRNA sequence
tgcagtcgcagctactcggg

SEQ ID NO: 782006 - DNA, 20 bp, Artificial
  CRISPR gRNA sequence
tcgcagctactcgggaggct

SEQ ID NO: 782007 - DNA, 20 bp, Artificial
  CRISPR gRNA sequence
cgcagctactcgggaggctg

SEQ ID NO: 782008 - DNA, 20 bp, Artificial
  CRISPR gRNA sequence
agctactcgggaggctgagg

SEQ ID NO: 782009 - DNA, 20 bp, Artificial
  CRISPR gRNA sequence
gctactcgggaggctgaggc

SEQ ID NO: 782010 - DNA, 20 bp, Artificial
  CRISPR gRNA sequence
tactcgggaggctgaggcag

SEQ ID NO: 782011 - DNA, 20 bp, Artificial
  CRISPR gRNA sequence
gggaggctgaggcaggagaa

SEQ ID NO: 782012 - DNA, 20 bp, Artificial
  CRISPR gRNA sequence
aggctgaggcaggagaatgg

SEQ ID NO: 782013 - DNA, 20 bp, Artificial
  CRISPR gRNA sequence
ggctgaggcaggagaatggc

SEQ ID NO: 782014 - DNA, 20 bp, Artificial
  CRISPR gRNA sequence
gcaggagaatggcaggaacc

SEQ ID NO: 782015 - DNA, 20 bp, Artificial
  CRISPR gRNA sequence
caggagaatggcaggaacct

SEQ ID NO: 782016 - DNA, 20 bp, Artificial
  CRISPR gRNA sequence
ggagaatggcaggaacctgg

SEQ ID NO: 782017 - DNA, 20 bp, Artificial
  CRISPR gRNA sequence
gagaatggcaggaacctggg

SEQ ID NO: 782018 - DNA, 20 bp, Artificial
  CRISPR gRNA sequence
aatggcaggaacctgggagg

SEQ ID NO: 782019 - DNA, 20 bp, Artificial
  CRISPR gRNA sequence
tgggaggcggattttgcaat

SEQ ID NO: 782020 - DNA, 20 bp, Artificial
  CRISPR gRNA sequence
gaggcggattttgcaatgag

SEQ ID NO: 782021 - DNA, 20 bp, Artificial
  CRISPR gRNA sequence
ggcggattttgcaatgagca

SEQ ID NO: 782022 - DNA, 20 bp, Artificial
  CRISPR gRNA sequence
gcggattttgcaatgagcag

SEQ ID NO: 782023 - DNA, 20 bp, Artificial
  CRISPR gRNA sequence
gaggtcgcaccactgcactc

SEQ ID NO: 782024 - DNA, 20 bp, Artificial
  CRISPR gRNA sequence
cgcaccactgcactccagcc

SEQ ID NO: 782025 - DNA, 20 bp, Artificial
  CRISPR gRNA sequence
gcaccactgcactccagcct

SEQ ID NO: 782026 - DNA, 20 bp, Artificial
  CRISPR gRNA sequence
ctgcactccagcctgggcga

SEQ ID NO: 782027 - DNA, 20 bp, Artificial
  CRISPR gRNA sequence
gcactccagcctgggcgaca

SEQ ID NO: 782028 - DNA, 20 bp, Artificial
  CRISPR gRNA sequence
tccagcctgggcgacagagc

SEQ ID NO: 782029 - DNA, 20 bp, Artificial
  CRISPR gRNA sequence
aaaaaaaaaaaaaaaaaaaa

SEQ ID NO: 782030 - DNA, 20 bp, Artificial
  CRISPR gRNA sequence
aaaaaaatggccttcaccct

SEQ ID NO: 782031 - DNA, 20 bp, Artificial
  CRISPR gRNA sequence
aaaatggccttcaccctaag

SEQ ID NO: 782032 - DNA, 20 bp, Artificial
  CRISPR gRNA sequence
aaatggccttcaccctaaga

SEQ ID NO: 782033 - DNA, 20 bp, Artificial
  CRISPR gRNA sequence
tggccttcaccctaagaagg

SEQ ID NO: 782034 - DNA, 20 bp, Artificial
  CRISPR gRNA sequence
accctaagaaggaagaaacc

SEQ ID NO: 782035 - DNA, 20 bp, Artificial
  CRISPR gRNA sequence
ccctaagaaggaagaaacca

SEQ ID NO: 782036 - DNA, 20 bp, Artificial
  CRISPR gRNA sequence
cctaagaaggaagaaaccaa

SEQ ID NO: 782037 - DNA, 20 bp, Artificial
  CRISPR gRNA sequence
aagaaggaagaaaccaaggg

SEQ ID NO: 782038 - DNA, 20 bp, Artificial
  CRISPR gRNA sequence
gaaggaagaaaccaagggca

SEQ ID NO: 782039 - DNA, 20 bp, Artificial
  CRISPR gRNA sequence
aaggaagaaaccaagggcag

SEQ ID NO: 782040 - DNA, 20 bp, Artificial
  CRISPR gRNA sequence
gaagaaaccaagggcagagg

SEQ ID NO: 782041 - DNA, 20 bp, Artificial
  CRISPR gRNA sequence
aagaaaccaagggcagagga

SEQ ID NO: 782042 - DNA, 20 bp, Artificial
  CRISPR gRNA sequence
gcagaggaaggaaacaatca

SEQ ID NO: 782043 - DNA, 20 bp, Artificial
  CRISPR gRNA sequence
agaggaaggaaacaatcaaa

SEQ ID NO: 782044 - DNA, 20 bp, Artificial
  CRISPR gRNA sequence
ggaaggaaacaatcaaagag

SEQ ID NO: 782045 - DNA, 20 bp, Artificial
  CRISPR gRNA sequence
ggaaacaatcaaagagaagc

SEQ ID NO: 782046 - DNA, 20 bp, Artificial
  CRISPR gRNA sequence
gaaacaatcaaagagaagca

SEQ ID NO: 782047 - DNA, 20 bp, Artificial
  CRISPR gRNA sequence
acaatcaaagagaagcaagg

SEQ ID NO: 782048 - DNA, 20 bp, Artificial
  CRISPR gRNA sequence
atcaaagagaagcaaggcag

SEQ ID NO: 782049 - DNA, 20 bp, Artificial
  CRISPR gRNA sequence
agaagcaaggcagcagtgaa

SEQ ID NO: 782050 - DNA, 20 bp, Artificial
  CRISPR gRNA sequence
gaaaagacaactgtacgttt

SEQ ID NO: 782051 - DNA, 20 bp, Artificial
  CRISPR gRNA sequence
aactgtacgtttaagcctct

SEQ ID NO: 782052 - DNA, 20 bp, Artificial
  CRISPR gRNA sequence
actgtacgtttaagcctcta

SEQ ID NO: 782053 - DNA, 20 bp, Artificial
  CRISPR gRNA sequence
cgtttaagcctctaaggccc

SEQ ID NO: 782054 - DNA, 20 bp, Artificial
  CRISPR gRNA sequence
gtttaagcctctaaggccca

SEQ ID NO: 782055 - DNA, 20 bp, Artificial
  CRISPR gRNA sequence
aagcctctaaggcccaagga

SEQ ID NO: 782056 - DNA, 20 bp, Artificial
  CRISPR gRNA sequence
ccaaggaaagcatttgctaa

SEQ ID NO: 782057 - DNA, 20 bp, Artificial
  CRISPR gRNA sequence
aaggaaagcatttgctaaaa

SEQ ID NO: 782058 - DNA, 20 bp, Artificial
  CRISPR gRNA sequence
aagcatttgctaaaagagcc

SEQ ID NO: 782059 - DNA, 20 bp, Artificial
  CRISPR gRNA sequence
ttgctaaaagagccaagtct

SEQ ID NO: 782060 - DNA, 20 bp, Artificial
  CRISPR gRNA sequence
ctcagtgtctttttttccct

SEQ ID NO: 782061 - DNA, 20 bp, Artificial
  CRISPR gRNA sequence
tcagtgtctttttttccctt

SEQ ID NO: 782062 - DNA, 20 bp, Artificial
  CRISPR gRNA sequence
cagtgtctttttttcccttg

SEQ ID NO: 782063 - DNA, 20 bp, Artificial
  CRISPR gRNA sequence
ctttttttcccttggggaaa

SEQ ID NO: 782064 - DNA, 20 bp, Artificial
  CRISPR gRNA sequence
tttttcccttggggaaacag

SEQ ID NO: 782065 - DNA, 20 bp, Artificial
  CRISPR gRNA sequence
ttttcccttggggaaacaga

SEQ ID NO: 782066 - DNA, 20 bp, Artificial
  CRISPR gRNA sequence
tttcccttggggaaacagaa

SEQ ID NO: 782067 - DNA, 20 bp, Artificial
  CRISPR gRNA sequence
ttggggaaacagaagggtgt

SEQ ID NO: 782068 - DNA, 20 bp, Artificial
  CRISPR gRNA sequence
acagaagggtgtaagaaaat

SEQ ID NO: 782069 - DNA, 20 bp, Artificial
  CRISPR gRNA sequence
agaagggtgtaagaaaatcg

SEQ ID NO: 782070 - DNA, 20 bp, Artificial
  CRISPR gRNA sequence
ggtgtaagaaaatcggagtc

SEQ ID NO: 782071 - DNA, 20 bp, Artificial
  CRISPR gRNA sequence
cggagtcaagaaaatgtcct

SEQ ID NO: 782072 - DNA, 20 bp, Artificial
  CRISPR gRNA sequence
aatgtcctgagctccgcctg

SEQ ID NO: 782073 - DNA, 20 bp, Artificial
  CRISPR gRNA sequence
gtcctgagctccgcctgcag

SEQ ID NO: 782074 - DNA, 20 bp, Artificial
  CRISPR gRNA sequence
ctgagctccgcctgcagtag

SEQ ID NO: 782075 - DNA, 20 bp, Artificial
  CRISPR gRNA sequence
tgagctccgcctgcagtagc

SEQ ID NO: 782076 - DNA, 20 bp, Artificial
  CRISPR gRNA sequence
gctccgcctgcagtagcggg

SEQ ID NO: 782077 - DNA, 20 bp, Artificial
  CRISPR gRNA sequence
gcctgcagtagcgggaagcc

SEQ ID NO: 782078 - DNA, 20 bp, Artificial
  CRISPR gRNA sequence
cctgcagtagcgggaagcct

SEQ ID NO: 782079 - DNA, 20 bp, Artificial
  CRISPR gRNA sequence
tgcagtagcgggaagcctag

SEQ ID NO: 782080 - DNA, 20 bp, Artificial
  CRISPR gRNA sequence
taacacgttttttaaaaata

SEQ ID NO: 782081 - DNA, 20 bp, Artificial
  CRISPR gRNA sequence
acgttttttaaaaataaaga

SEQ ID NO: 782082 - DNA, 20 bp, Artificial
  CRISPR gRNA sequence
agaaagaaattattttaaaa

SEQ ID NO: 782083 - DNA, 20 bp, Artificial
  CRISPR gRNA sequence
aacaatgtcctgaatttcaa

SEQ ID NO: 782084 - DNA, 20 bp, Artificial
  CRISPR gRNA sequence
acaatgtcctgaatttcaat

SEQ ID NO: 782085 - DNA, 20 bp, Artificial
  CRISPR gRNA sequence
caatgtcctgaatttcaatg

SEQ ID NO: 782086 - DNA, 20 bp, Artificial
  CRISPR gRNA sequence
tgtcctgaatttcaatgggg

SEQ ID NO: 782087 - DNA, 20 bp, Artificial
  CRISPR gRNA sequence
gtcctgaatttcaatggggt

SEQ ID NO: 782088 - DNA, 20 bp, Artificial
  CRISPR gRNA sequence
tcctgaatttcaatggggtg

SEQ ID NO: 782089 - DNA, 20 bp, Artificial
  CRISPR gRNA sequence
cctgaatttcaatggggtgg

SEQ ID NO: 782090 - DNA, 20 bp, Artificial
  CRISPR gRNA sequence
ctgaatttcaatggggtggg

SEQ ID NO: 782091 - DNA, 20 bp, Artificial
  CRISPR gRNA sequence
tgaatttcaatggggtgggg

SEQ ID NO: 782092 - DNA, 20 bp, Artificial
  CRISPR gRNA sequence
aatttcaatggggtgggggg

SEQ ID NO: 782093 - DNA, 20 bp, Artificial
  CRISPR gRNA sequence
atttcaatggggtggggggg

SEQ ID NO: 782094 - DNA, 20 bp, Artificial
  CRISPR gRNA sequence
tttcaatggggtggggggga

SEQ ID NO: 782095 - DNA, 20 bp, Artificial
  CRISPR gRNA sequence
ttcaatggggtgggggggag

SEQ ID NO: 782096 - DNA, 20 bp, Artificial
  CRISPR gRNA sequence
aatggggtgggggggagggg

SEQ ID NO: 782097 - DNA, 20 bp, Artificial
  CRISPR gRNA sequence
tgggggggaggggaagctcc

SEQ ID NO: 782098 - DNA, 20 bp, Artificial
  CRISPR gRNA sequence
gggggggaggggaagctcct

SEQ ID NO: 782099 - DNA, 20 bp, Artificial
  CRISPR gRNA sequence
ggggggaggggaagctcctg

SEQ ID NO: 782100 - DNA, 20 bp, Artificial
  CRISPR gRNA sequence
gttaacctgctattcctttt

SEQ ID NO: 782101 - DNA, 20 bp, Artificial
  CRISPR gRNA sequence
ttaacctgctattccttttc

SEQ ID NO: 782102 - DNA, 20 bp, Artificial
  CRISPR gRNA sequence
ttccttttcaggcaatttaa

SEQ ID NO: 782103 - DNA, 20 bp, Artificial
  CRISPR gRNA sequence
caatttaacagatgaattga

SEQ ID NO: 782104 - DNA, 20 bp, Artificial
  CRISPR gRNA sequence
tttaacagatgaattgaaag

SEQ ID NO: 782105 - DNA, 20 bp, Artificial
  CRISPR gRNA sequence
tgaattgaaagcagtcctaa

SEQ ID NO: 782106 - DNA, 20 bp, Artificial
  CRISPR gRNA sequence
taaaagatttaactgattac

SEQ ID NO: 782107 - DNA, 20 bp, Artificial
  CRISPR gRNA sequence
ctgattactagaaacttgca

SEQ ID NO: 782108 - DNA, 20 bp, Artificial
  CRISPR gRNA sequence
gaaacttgcatagatcctct

SEQ ID NO: 782109 - DNA, 20 bp, Artificial
  CRISPR gRNA sequence
tgcatagatcctctaagacc

SEQ ID NO: 782110 - DNA, 20 bp, Artificial
  CRISPR gRNA sequence
gcatagatcctctaagacca

SEQ ID NO: 782111 - DNA, 20 bp, Artificial
  CRISPR gRNA sequence
ctgtcattatgactataaaa

SEQ ID NO: 782112 - DNA, 20 bp, Artificial
  CRISPR gRNA sequence
tatacatttcatctttattt

SEQ ID NO: 782113 - DNA, 20 bp, Artificial
  CRISPR gRNA sequence
catctttatttcagaaatta

SEQ ID NO: 782114 - DNA, 20 bp, Artificial
  CRISPR gRNA sequence
attgcttgtaacatatctgt

SEQ ID NO: 782115 - DNA, 20 bp, Artificial
  CRISPR gRNA sequence
cttgtaacatatctgtcaga

SEQ ID NO: 782116 - DNA, 20 bp, Artificial
  CRISPR gRNA sequence
taacatatctgtcagacagc

SEQ ID NO: 782117 - DNA, 20 bp, Artificial
  CRISPR gRNA sequence
gtcagacagccagaacaaac

SEQ ID NO: 782118 - DNA, 20 bp, Artificial
  CRISPR gRNA sequence
tcagacagccagaacaaacc

SEQ ID NO: 782119 - DNA, 20 bp, Artificial
  CRISPR gRNA sequence
cagacagccagaacaaacca

SEQ ID NO: 782120 - DNA, 20 bp, Artificial
  CRISPR gRNA sequence
gccagaacaaaccagggaaa

SEQ ID NO: 782121 - DNA, 20 bp, Artificial
  CRISPR gRNA sequence
acagaaaccatttaaacctg

SEQ ID NO: 782122 - DNA, 20 bp, Artificial
  CRISPR gRNA sequence
tttaaacctgtggaaatcta

SEQ ID NO: 782123 - DNA, 20 bp, Artificial
  CRISPR gRNA sequence
tggaaatctaaagctgaaac

SEQ ID NO: 782124 - DNA, 20 bp, Artificial
  CRISPR gRNA sequence
aaactagtaattcttttaat

SEQ ID NO: 782125 - DNA, 20 bp, Artificial
  CRISPR gRNA sequence
aactagtaattcttttaatg

SEQ ID NO: 782126 - DNA, 20 bp, Artificial
  CRISPR gRNA sequence
actagtaattcttttaatga

SEQ ID NO: 782127 - DNA, 20 bp, Artificial
  CRISPR gRNA sequence
tagtaattcttttaatgagg

SEQ ID NO: 782128 - DNA, 20 bp, Artificial
  CRISPR gRNA sequence
ttcttttaatgagggagact

SEQ ID NO: 782129 - DNA, 20 bp, Artificial
  CRISPR gRNA sequence
ttttaatgagggagactgag

SEQ ID NO: 782130 - DNA, 20 bp, Artificial
  CRISPR gRNA sequence
agggagactgagaagccaaa

SEQ ID NO: 782131 - DNA, 20 bp, Artificial
  CRISPR gRNA sequence
ggagactgagaagccaaaca

SEQ ID NO: 782132 - DNA, 20 bp, Artificial
  CRISPR gRNA sequence
ctgagaagccaaacagagaa

SEQ ID NO: 782133 - DNA, 20 bp, Artificial
  CRISPR gRNA sequence
tgagaagccaaacagagaac

SEQ ID NO: 782134 - DNA, 20 bp, Artificial
  CRISPR gRNA sequence
gagaagccaaacagagaaca

SEQ ID NO: 782135 - DNA, 20 bp, Artificial
  CRISPR gRNA sequence
aagccaaacagagaacaggg

SEQ ID NO: 782136 - DNA, 20 bp, Artificial
  CRISPR gRNA sequence
cagagaacagggaagcaatt

SEQ ID NO: 782137 - DNA, 20 bp, Artificial
  CRISPR gRNA sequence
cagggaagcaattcagaaat

SEQ ID NO: 782138 - DNA, 20 bp, Artificial
  CRISPR gRNA sequence
agcaattcagaaattagcaa

SEQ ID NO: 782139 - DNA, 20 bp, Artificial
  CRISPR gRNA sequence
aattcagaaattagcaatag

SEQ ID NO: 782140 - DNA, 20 bp, Artificial
  CRISPR gRNA sequence
cagaaattagcaatagcaga

SEQ ID NO: 782141 - DNA, 20 bp, Artificial
  CRISPR gRNA sequence
cagaaagctgctcctaccac

SEQ ID NO: 782142 - DNA, 20 bp, Artificial
  CRISPR gRNA sequence
agaaagctgctcctaccact

SEQ ID NO: 782143 - DNA, 20 bp, Artificial
  CRISPR gRNA sequence
ctgctcctaccactaggcta

SEQ ID NO: 782144 - DNA, 20 bp, Artificial
  CRISPR gRNA sequence
taccactaggctatagtgaa

SEQ ID NO: 782145 - DNA, 20 bp, Artificial
  CRISPR gRNA sequence
accactaggctatagtgaaa

SEQ ID NO: 782146 - DNA, 20 bp, Artificial
  CRISPR gRNA sequence
ccactaggctatagtgaaaa

SEQ ID NO: 782147 - DNA, 20 bp, Artificial
  CRISPR gRNA sequence
cactaggctatagtgaaaag

SEQ ID NO: 782148 - DNA, 20 bp, Artificial
  CRISPR gRNA sequence
actaggctatagtgaaaagg

SEQ ID NO: 782149 - DNA, 20 bp, Artificial
  CRISPR gRNA sequence
aggctatagtgaaaaggggg

SEQ ID NO: 782150 - DNA, 20 bp, Artificial
  CRISPR gRNA sequence
ggctatagtgaaaaggggga

SEQ ID NO: 782151 - DNA, 20 bp, Artificial
  CRISPR gRNA sequence
tatagtgaaaagggggaagg

SEQ ID NO: 782152 - DNA, 20 bp, Artificial
  CRISPR gRNA sequence
atagtgaaaagggggaaggc

SEQ ID NO: 782153 - DNA, 20 bp, Artificial
  CRISPR gRNA sequence
tagtgaaaagggggaaggca

SEQ ID NO: 782154 - DNA, 20 bp, Artificial
  CRISPR gRNA sequence
aagggggaaggcagggttaa

SEQ ID NO: 782155 - DNA, 20 bp, Artificial
  CRISPR gRNA sequence
gggggaaggcagggttaatg

SEQ ID NO: 782156 - DNA, 20 bp, Artificial
  CRISPR gRNA sequence
aaggcagggttaatggagcc

SEQ ID NO: 782157 - DNA, 20 bp, Artificial
  CRISPR gRNA sequence
aggcagggttaatggagccc

SEQ ID NO: 782158 - DNA, 20 bp, Artificial
  CRISPR gRNA sequence
ggcagggttaatggagccca

SEQ ID NO: 782159 - DNA, 20 bp, Artificial
  CRISPR gRNA sequence
ttaatggagcccagggatta

SEQ ID NO: 782160 - DNA, 20 bp, Artificial
  CRISPR gRNA sequence
cagggattaaagtcacttga

SEQ ID NO: 782161 - DNA, 20 bp, Artificial
  CRISPR gRNA sequence
taaagtcacttgacagacac

SEQ ID NO: 782162 - DNA, 20 bp, Artificial
  CRISPR gRNA sequence
acttgacagacactggaacc

SEQ ID NO: 782163 - DNA, 20 bp, Artificial
  CRISPR gRNA sequence
tgacagacactggaacccag

SEQ ID NO: 782164 - DNA, 20 bp, Artificial
  CRISPR gRNA sequence
gacagacactggaacccagt

SEQ ID NO: 782165 - DNA, 20 bp, Artificial
  CRISPR gRNA sequence
aacccagtgggcctgtccat

SEQ ID NO: 782166 - DNA, 20 bp, Artificial
  CRISPR gRNA sequence
tgggcctgtccattggtatc

SEQ ID NO: 782167 - DNA, 20 bp, Artificial
  CRISPR gRNA sequence
ggcctgtccattggtatctg

SEQ ID NO: 782168 - DNA, 20 bp, Artificial
  CRISPR gRNA sequence
tgtccattggtatctggagc

SEQ ID NO: 782169 - DNA, 20 bp, Artificial
  CRISPR gRNA sequence
gtccattggtatctggagcc

SEQ ID NO: 782170 - DNA, 20 bp, Artificial
  CRISPR gRNA sequence
tccattggtatctggagcca

SEQ ID NO: 782171 - DNA, 20 bp, Artificial
  CRISPR gRNA sequence
attggtatctggagccaggg

SEQ ID NO: 782172 - DNA, 20 bp, Artificial
  CRISPR gRNA sequence
tggtatctggagccagggaa

SEQ ID NO: 782173 - DNA, 20 bp, Artificial
  CRISPR gRNA sequence
ggaagagatacatcttctgc

SEQ ID NO: 782174 - DNA, 20 bp, Artificial
  CRISPR gRNA sequence
aagagatacatcttctgctg

SEQ ID NO: 782175 - DNA, 20 bp, Artificial
  CRISPR gRNA sequence
gagatacatcttctgctgga

SEQ ID NO: 782176 - DNA, 20 bp, Artificial
  CRISPR gRNA sequence
agatacatcttctgctggag

SEQ ID NO: 782177 - DNA, 20 bp, Artificial
  CRISPR gRNA sequence
ttctgctggagaggccacaa

SEQ ID NO: 782178 - DNA, 20 bp, Artificial
  CRISPR gRNA sequence
ctggagaggccacaaaagta

SEQ ID NO: 782179 - DNA, 20 bp, Artificial
  CRISPR gRNA sequence
ggagaggccacaaaagtata

SEQ ID NO: 782180 - DNA, 20 bp, Artificial
  CRISPR gRNA sequence
ggccacaaaagtatagagca

SEQ ID NO: 782181 - DNA, 20 bp, Artificial
  CRISPR gRNA sequence
gccacaaaagtatagagcat

SEQ ID NO: 782182 - DNA, 20 bp, Artificial
  CRISPR gRNA sequence
ccacaaaagtatagagcata

SEQ ID NO: 782183 - DNA, 20 bp, Artificial
  CRISPR gRNA sequence
cacaaaagtatagagcatag

SEQ ID NO: 782184 - DNA, 20 bp, Artificial
  CRISPR gRNA sequence
caaaagtatagagcataggg

SEQ ID NO: 782185 - DNA, 20 bp, Artificial
  CRISPR gRNA sequence
aataccttcccttctccctc

SEQ ID NO: 782186 - DNA, 20 bp, Artificial
  CRISPR gRNA sequence
tctccctccagtccaccctc

SEQ ID NO: 782187 - DNA, 20 bp, Artificial
  CRISPR gRNA sequence
gttcctgtcttgcttcctat

SEQ ID NO: 782188 - DNA, 20 bp, Artificial
  CRISPR gRNA sequence
cctattggctgtcacgttcc

SEQ ID NO: 782189 - DNA, 20 bp, Artificial
  CRISPR gRNA sequence
ctattggctgtcacgttcct

SEQ ID NO: 782190 - DNA, 20 bp, Artificial
  CRISPR gRNA sequence
tgtcacgttcctaggctata

SEQ ID NO: 782191 - DNA, 20 bp, Artificial
  CRISPR gRNA sequence
gtcacgttcctaggctatac

SEQ ID NO: 782192 - DNA, 20 bp, Artificial
  CRISPR gRNA sequence
ttcctaggctatacaggcca

SEQ ID NO: 782193 - DNA, 20 bp, Artificial
  CRISPR gRNA sequence
tcctaggctatacaggccac

SEQ ID NO: 782194 - DNA, 20 bp, Artificial
  CRISPR gRNA sequence
ctaggctatacaggccacag

SEQ ID NO: 782195 - DNA, 20 bp, Artificial
  CRISPR gRNA sequence
gagtctgccttcctgcaaca

SEQ ID NO: 782196 - DNA, 20 bp, Artificial
  CRISPR gRNA sequence
gtctgccttcctgcaacaca

SEQ ID NO: 782197 - DNA, 20 bp, Artificial
  CRISPR gRNA sequence
tgccttcctgcaacacagag

SEQ ID NO: 782198 - DNA, 20 bp, Artificial
  CRISPR gRNA sequence
ccttcctgcaacacagagca

SEQ ID NO: 782199 - DNA, 20 bp, Artificial
  CRISPR gRNA sequence
tcctgcaacacagagcagag

SEQ ID NO: 782200 - DNA, 20 bp, Artificial
  CRISPR gRNA sequence
aacacagagcagagaagaaa

SEQ ID NO: 782201 - DNA, 20 bp, Artificial
  CRISPR gRNA sequence
cagagcagagaagaaaaagt

SEQ ID NO: 782202 - DNA, 20 bp, Artificial
  CRISPR gRNA sequence
gagcagagaagaaaaagtga

SEQ ID NO: 782203 - DNA, 20 bp, Artificial
  CRISPR gRNA sequence
agagaagaaaaagtgagaga

SEQ ID NO: 782204 - DNA, 20 bp, Artificial
  CRISPR gRNA sequence
aaaagtgagagatggatctg

SEQ ID NO: 782205 - DNA, 20 bp, Artificial
  CRISPR gRNA sequence
aaagtgagagatggatctga

SEQ ID NO: 782206 - DNA, 20 bp, Artificial
  CRISPR gRNA sequence
gagatggatctgaaggcaaa

SEQ ID NO: 782207 - DNA, 20 bp, Artificial
  CRISPR gRNA sequence
gatctgaaggcaaacagacc

SEQ ID NO: 782208 - DNA, 20 bp, Artificial
  CRISPR gRNA sequence
atctgaaggcaaacagaccc

SEQ ID NO: 782209 - DNA, 20 bp, Artificial
  CRISPR gRNA sequence
aaacagacccaggacacaca

SEQ ID NO: 782210 - DNA, 20 bp, Artificial
  CRISPR gRNA sequence
agcacacacaccttgtgtat

SEQ ID NO: 782211 - DNA, 20 bp, Artificial
  CRISPR gRNA sequence
gcacacacaccttgtgtatt

SEQ ID NO: 782212 - DNA, 20 bp, Artificial
  CRISPR gRNA sequence
cacacaccttgtgtattggg

SEQ ID NO: 782213 - DNA, 20 bp, Artificial
  CRISPR gRNA sequence
ccttgtgtattgggtggtaa

SEQ ID NO: 782214 - DNA, 20 bp, Artificial
  CRISPR gRNA sequence
cttgtgtattgggtggtaaa

SEQ ID NO: 782215 - DNA, 20 bp, Artificial
  CRISPR gRNA sequence
gtgtattgggtggtaaaagg

SEQ ID NO: 782216 - DNA, 20 bp, Artificial
  CRISPR gRNA sequence
tgtattgggtggtaaaaggt

SEQ ID NO: 782217 - DNA, 20 bp, Artificial
  CRISPR gRNA sequence
taaaaggtgggataataata

SEQ ID NO: 782218 - DNA, 20 bp, Artificial
  CRISPR gRNA sequence
gggataataatacagttgac

SEQ ID NO: 782219 - DNA, 20 bp, Artificial
  CRISPR gRNA sequence
acagttgactagatctataa

SEQ ID NO: 782220 - DNA, 20 bp, Artificial
  CRISPR gRNA sequence
tagatctataacagactgaa

SEQ ID NO: 782221 - DNA, 20 bp, Artificial
  CRISPR gRNA sequence
tctataacagactgaaaagc

SEQ ID NO: 782222 - DNA, 20 bp, Artificial
  CRISPR gRNA sequence
ataacagactgaaaagctag

SEQ ID NO: 782223 - DNA, 20 bp, Artificial
  CRISPR gRNA sequence
ctgaaaagctagtagttgtt

SEQ ID NO: 782224 - DNA, 20 bp, Artificial
  CRISPR gRNA sequence
aaagctagtagttgttgagt

SEQ ID NO: 782225 - DNA, 20 bp, Artificial
  CRISPR gRNA sequence
aagctagtagttgttgagtc

SEQ ID NO: 782226 - DNA, 20 bp, Artificial
  CRISPR gRNA sequence
agctagtagttgttgagtca

SEQ ID NO: 782227 - DNA, 20 bp, Artificial
  CRISPR gRNA sequence
ttgttgagtcagggacaacg

SEQ ID NO: 782228 - DNA, 20 bp, Artificial
  CRISPR gRNA sequence
tgttgagtcagggacaacga

SEQ ID NO: 782229 - DNA, 20 bp, Artificial
  CRISPR gRNA sequence
gagtcagggacaacgaaggc

SEQ ID NO: 782230 - DNA, 20 bp, Artificial
  CRISPR gRNA sequence
ggacaacgaaggctggctga

SEQ ID NO: 782231 - DNA, 20 bp, Artificial
  CRISPR gRNA sequence
cgaaggctggctgatggcct

SEQ ID NO: 782232 - DNA, 20 bp, Artificial
  CRISPR gRNA sequence
gctgatggcctcagtcaact

SEQ ID NO: 782233 - DNA, 20 bp, Artificial
  CRISPR gRNA sequence
tgatggcctcagtcaacttg

SEQ ID NO: 782234 - DNA, 20 bp, Artificial
  CRISPR gRNA sequence
tcaacttggagacaatctcc

SEQ ID NO: 782235 - DNA, 20 bp, Artificial
  CRISPR gRNA sequence
ggagacaatctccaagtgct

SEQ ID NO: 782236 - DNA, 20 bp, Artificial
  CRISPR gRNA sequence
gagacaatctccaagtgcta

SEQ ID NO: 782237 - DNA, 20 bp, Artificial
  CRISPR gRNA sequence
agacaatctccaagtgctaa

SEQ ID NO: 782238 - DNA, 20 bp, Artificial
  CRISPR gRNA sequence
gacaatctccaagtgctaag

SEQ ID NO: 782239 - DNA, 20 bp, Artificial
  CRISPR gRNA sequence
gtgctaaggggtctgttatt

SEQ ID NO: 782240 - DNA, 20 bp, Artificial
  CRISPR gRNA sequence
tgctaaggggtctgttattc

SEQ ID NO: 782241 - DNA, 20 bp, Artificial
  CRISPR gRNA sequence
gggtctgttattcaggttgt

SEQ ID NO: 782242 - DNA, 20 bp, Artificial
  CRISPR gRNA sequence
ggtctgttattcaggttgta

SEQ ID NO: 782243 - DNA, 20 bp, Artificial
  CRISPR gRNA sequence
ttattcaggttgtaaggata

SEQ ID NO: 782244 - DNA, 20 bp, Artificial
  CRISPR gRNA sequence
aggatatagccaacctaact

SEQ ID NO: 782245 - DNA, 20 bp, Artificial
  CRISPR gRNA sequence
atatagccaacctaactgag

SEQ ID NO: 782246 - DNA, 20 bp, Artificial
  CRISPR gRNA sequence
tagccaacctaactgagcag

SEQ ID NO: 782247 - DNA, 20 bp, Artificial
  CRISPR gRNA sequence
tgagcagcagatcatatatt

SEQ ID NO: 782248 - DNA, 20 bp, Artificial
  CRISPR gRNA sequence
caaaactgatcttatgacct

SEQ ID NO: 782249 - DNA, 20 bp, Artificial
  CRISPR gRNA sequence
aaaactgatcttatgacctt

SEQ ID NO: 782250 - DNA, 20 bp, Artificial
  CRISPR gRNA sequence
cttaggttacattaaaaccc

SEQ ID NO: 782251 - DNA, 20 bp, Artificial
  CRISPR gRNA sequence
ccctggatatttgtgctgct

SEQ ID NO: 782252 - DNA, 20 bp, Artificial
  CRISPR gRNA sequence
tgtgctgcttagataatatc

SEQ ID NO: 782253 - DNA, 20 bp, Artificial
  CRISPR gRNA sequence
cttagataatatctagaata

SEQ ID NO: 782254 - DNA, 20 bp, Artificial
  CRISPR gRNA sequence
tgtgttacatatccttttta

SEQ ID NO: 782255 - DNA, 20 bp, Artificial
  CRISPR gRNA sequence
catatcctttttaaagaacg

SEQ ID NO: 782256 - DNA, 20 bp, Artificial
  CRISPR gRNA sequence
gcaaaactaaactataacca

SEQ ID NO: 782257 - DNA, 20 bp, Artificial
  CRISPR gRNA sequence
tataaccaaagactactatc

SEQ ID NO: 782258 - DNA, 20 bp, Artificial
  CRISPR gRNA sequence
caaagactactatctggaaa

SEQ ID NO: 782259 - DNA, 20 bp, Artificial
  CRISPR gRNA sequence
aaagactactatctggaaat

SEQ ID NO: 782260 - DNA, 20 bp, Artificial
  CRISPR gRNA sequence
actatctggaaatgggtctg

SEQ ID NO: 782261 - DNA, 20 bp, Artificial
  CRISPR gRNA sequence
gtctgaagactgtatcttgt

SEQ ID NO: 782262 - DNA, 20 bp, Artificial
  CRISPR gRNA sequence
agactgtatcttgtgagata

SEQ ID NO: 782263 - DNA, 20 bp, Artificial
  CRISPR gRNA sequence
tatcttgtgagatatagtta

SEQ ID NO: 782264 - DNA, 20 bp, Artificial
  CRISPR gRNA sequence
atcttgtgagatatagttaa

SEQ ID NO: 782265 - DNA, 20 bp, Artificial
  CRISPR gRNA sequence
cttgtgagatatagttaaag

SEQ ID NO: 782266 - DNA, 20 bp, Artificial
  CRISPR gRNA sequence
ttgtgagatatagttaaagg

SEQ ID NO: 782267 - DNA, 20 bp, Artificial
  CRISPR gRNA sequence
tgagatatagttaaaggagg

SEQ ID NO: 782268 - DNA, 20 bp, Artificial
  CRISPR gRNA sequence
gagatatagttaaaggaggt

SEQ ID NO: 782269 - DNA, 20 bp, Artificial
  CRISPR gRNA sequence
ggaggtaggcatgttttact

SEQ ID NO: 782270 - DNA, 20 bp, Artificial
  CRISPR gRNA sequence
gaggtaggcatgttttactt

SEQ ID NO: 782271 - DNA, 20 bp, Artificial
  CRISPR gRNA sequence
aggtaggcatgttttactta

SEQ ID NO: 782272 - DNA, 20 bp, Artificial
  CRISPR gRNA sequence
atgttttacttagggttgaa

SEQ ID NO: 782273 - DNA, 20 bp, Artificial
  CRISPR gRNA sequence
ttacttagggttgaaaagac

SEQ ID NO: 782274 - DNA, 20 bp, Artificial
  CRISPR gRNA sequence
ttagggttgaaaagactaga

SEQ ID NO: 782275 - DNA, 20 bp, Artificial
  CRISPR gRNA sequence
agggttgaaaagactagatg

SEQ ID NO: 782276 - DNA, 20 bp, Artificial
  CRISPR gRNA sequence
aagactagatggagtcttcc

SEQ ID NO: 782277 - DNA, 20 bp, Artificial
  CRISPR gRNA sequence
tcccagttatattcaaatat

SEQ ID NO: 782278 - DNA, 20 bp, Artificial
  CRISPR gRNA sequence
cagttatattcaaatatcag

SEQ ID NO: 782279 - DNA, 20 bp, Artificial
  CRISPR gRNA sequence
agttatattcaaatatcaga

SEQ ID NO: 782280 - DNA, 20 bp, Artificial
  CRISPR gRNA sequence
gttatattcaaatatcagaa

SEQ ID NO: 782281 - DNA, 20 bp, Artificial
  CRISPR gRNA sequence
aataattgctaacactaatt

SEQ ID NO: 782282 - DNA, 20 bp, Artificial
  CRISPR gRNA sequence
attgagtgtttactacgttc

SEQ ID NO: 782283 - DNA, 20 bp, Artificial
  CRISPR gRNA sequence
aattatttaacacccttgtt

SEQ ID NO: 782284 - DNA, 20 bp, Artificial
  CRISPR gRNA sequence
attatttaacacccttgtta

SEQ ID NO: 782285 - DNA, 20 bp, Artificial
  CRISPR gRNA sequence
ttaacacccttgttaaggat

SEQ ID NO: 782286 - DNA, 20 bp, Artificial
  CRISPR gRNA sequence
gctgtatccatttcctaaac

SEQ ID NO: 782287 - DNA, 20 bp, Artificial
  CRISPR gRNA sequence
atttcctaaacaagaaaact

SEQ ID NO: 782288 - DNA, 20 bp, Artificial
  CRISPR gRNA sequence
tttcctaaacaagaaaactg

SEQ ID NO: 782289 - DNA, 20 bp, Artificial
  CRISPR gRNA sequence
ttcctaaacaagaaaactga

SEQ ID NO: 782290 - DNA, 20 bp, Artificial
  CRISPR gRNA sequence
aacaagaaaactgagggttt

SEQ ID NO: 782291 - DNA, 20 bp, Artificial
  CRISPR gRNA sequence
caagaaaactgagggtttaa

SEQ ID NO: 782292 - DNA, 20 bp, Artificial
  CRISPR gRNA sequence
aagaaaactgagggtttaag

SEQ ID NO: 782293 - DNA, 20 bp, Artificial
  CRISPR gRNA sequence
ggtttaagaggtcatataac

SEQ ID NO: 782294 - DNA, 20 bp, Artificial
  CRISPR gRNA sequence
gaggtcatataactagccct

SEQ ID NO: 782295 - DNA, 20 bp, Artificial
  CRISPR gRNA sequence
atataactagcccttggcta

SEQ ID NO: 782296 - DNA, 20 bp, Artificial
  CRISPR gRNA sequence
taaagcctactcaaactgct

SEQ ID NO: 782297 - DNA, 20 bp, Artificial
  CRISPR gRNA sequence
tgaactcatgtttttaacta

SEQ ID NO: 782298 - DNA, 20 bp, Artificial
  CRISPR gRNA sequence
catatgttgtgttactaaac

SEQ ID NO: 782299 - DNA, 20 bp, Artificial
  CRISPR gRNA sequence
ctaaactagacaaataccaa

SEQ ID NO: 782300 - DNA, 20 bp, Artificial
  CRISPR gRNA sequence
taaactagacaaataccaat

SEQ ID NO: 782301 - DNA, 20 bp, Artificial
  CRISPR gRNA sequence
actagacaaataccaatggg

SEQ ID NO: 782302 - DNA, 20 bp, Artificial
  CRISPR gRNA sequence
agacaaataccaatgggtag

SEQ ID NO: 782303 - DNA, 20 bp, Artificial
  CRISPR gRNA sequence
accaatgggtagaagctaca

SEQ ID NO: 782304 - DNA, 20 bp, Artificial
  CRISPR gRNA sequence
caatgggtagaagctacaaa

SEQ ID NO: 782305 - DNA, 20 bp, Artificial
  CRISPR gRNA sequence
aatgggtagaagctacaaag

SEQ ID NO: 782306 - DNA, 20 bp, Artificial
  CRISPR gRNA sequence
caaagaggcacaattttgct

SEQ ID NO: 782307 - DNA, 20 bp, Artificial
  CRISPR gRNA sequence
gcacaattttgcttggcatg

SEQ ID NO: 782308 - DNA, 20 bp, Artificial
  CRISPR gRNA sequence
catgaagaaaatctttccaa

SEQ ID NO: 782309 - DNA, 20 bp, Artificial
  CRISPR gRNA sequence
gaagaaaatctttccaatgg

SEQ ID NO: 782310 - DNA, 20 bp, Artificial
  CRISPR gRNA sequence
acttgcttattgtataatca

SEQ ID NO: 782311 - DNA, 20 bp, Artificial
  CRISPR gRNA sequence
cttattgtataatcatggca

SEQ ID NO: 782312 - DNA, 20 bp, Artificial
  CRISPR gRNA sequence
atcatggcaaagactgcttc

SEQ ID NO: 782313 - DNA, 20 bp, Artificial
  CRISPR gRNA sequence
catggcaaagactgcttcta

SEQ ID NO: 782314 - DNA, 20 bp, Artificial
  CRISPR gRNA sequence
atggcaaagactgcttctag

SEQ ID NO: 782315 - DNA, 20 bp, Artificial
  CRISPR gRNA sequence
gcaaagactgcttctagagg

SEQ ID NO: 782316 - DNA, 20 bp, Artificial
  CRISPR gRNA sequence
aagactgcttctagaggaag

SEQ ID NO: 782317 - DNA, 20 bp, Artificial
  CRISPR gRNA sequence
agactgcttctagaggaagt

SEQ ID NO: 782318 - DNA, 20 bp, Artificial
  CRISPR gRNA sequence
actgcttctagaggaagtag

SEQ ID NO: 782319 - DNA, 20 bp, Artificial
  CRISPR gRNA sequence
gaagtaggagtttccattca

SEQ ID NO: 782320 - DNA, 20 bp, Artificial
  CRISPR gRNA sequence
tttccattcatagatgtttt

SEQ ID NO: 782321 - DNA, 20 bp, Artificial
  CRISPR gRNA sequence
ttccattcatagatgttttc

SEQ ID NO: 782322 - DNA, 20 bp, Artificial
  CRISPR gRNA sequence
tcatagatgttttcaggcaa

SEQ ID NO: 782323 - DNA, 20 bp, Artificial
  CRISPR gRNA sequence
gttttcaggcaaaagttatt

SEQ ID NO: 782324 - DNA, 20 bp, Artificial
  CRISPR gRNA sequence
ttcaggcaaaagttatttag

SEQ ID NO: 782325 - DNA, 20 bp, Artificial
  CRISPR gRNA sequence
atttagcagtttactaatat

SEQ ID NO: 782326 - DNA, 20 bp, Artificial
  CRISPR gRNA sequence
tagcagtttactaatatcag

SEQ ID NO: 782327 - DNA, 20 bp, Artificial
  CRISPR gRNA sequence
tcagaagaaaaatattacta

SEQ ID NO: 782328 - DNA, 20 bp, Artificial
  CRISPR gRNA sequence
aaaatattactaaagataac

SEQ ID NO: 782329 - DNA, 20 bp, Artificial
  CRISPR gRNA sequence
aaatattactaaagataaca

SEQ ID NO: 782330 - DNA, 20 bp, Artificial
  CRISPR gRNA sequence
aatattactaaagataacaa

SEQ ID NO: 782331 - DNA, 20 bp, Artificial
  CRISPR gRNA sequence
gggacacttcataatgataa

SEQ ID NO: 782332 - DNA, 20 bp, Artificial
  CRISPR gRNA sequence
gacacttcataatgataaaa

SEQ ID NO: 782333 - DNA, 20 bp, Artificial
  CRISPR gRNA sequence
cttcataatgataaaagagt

SEQ ID NO: 782334 - DNA, 20 bp, Artificial
  CRISPR gRNA sequence
tgataaaagagtgagttcta

SEQ ID NO: 782335 - DNA, 20 bp, Artificial
  CRISPR gRNA sequence
gataaaagagtgagttctaa

SEQ ID NO: 782336 - DNA, 20 bp, Artificial
  CRISPR gRNA sequence
ctaaatgtgtgtccatttaa

SEQ ID NO: 782337 - DNA, 20 bp, Artificial
  CRISPR gRNA sequence
tgtgtgtccatttaacagta

SEQ ID NO: 782338 - DNA, 20 bp, Artificial
  CRISPR gRNA sequence
tcaaaatattaaacaacaat

SEQ ID NO: 782339 - DNA, 20 bp, Artificial
  CRISPR gRNA sequence
aaatattaaacaacaattgg

SEQ ID NO: 782340 - DNA, 20 bp, Artificial
  CRISPR gRNA sequence
taaacaacaattggcagact

SEQ ID NO: 782341 - DNA, 20 bp, Artificial
  CRISPR gRNA sequence
aaacaacaattggcagactt

SEQ ID NO: 782342 - DNA, 20 bp, Artificial
  CRISPR gRNA sequence
acaacaattggcagacttag

SEQ ID NO: 782343 - DNA, 20 bp, Artificial
  CRISPR gRNA sequence
attggcagacttaggagaac

SEQ ID NO: 782344 - DNA, 20 bp, Artificial
  CRISPR gRNA sequence
tcaaatccacaattacattt

SEQ ID NO: 782345 - DNA, 20 bp, Artificial
  CRISPR gRNA sequence
ctcatctctattacaactga

SEQ ID NO: 782346 - DNA, 20 bp, Artificial
  CRISPR gRNA sequence
aactgatagaacaaacaatt

SEQ ID NO: 782347 - DNA, 20 bp, Artificial
  CRISPR gRNA sequence
agaacaaacaattaagaaaa

SEQ ID NO: 782348 - DNA, 20 bp, Artificial
  CRISPR gRNA sequence
gaaaatctgaacaacacaat

SEQ ID NO: 782349 - DNA, 20 bp, Artificial
  CRISPR gRNA sequence
aattagccatcttgacctaa

SEQ ID NO: 782350 - DNA, 20 bp, Artificial
  CRISPR gRNA sequence
cctaatagacatatgatata

SEQ ID NO: 782351 - DNA, 20 bp, Artificial
  CRISPR gRNA sequence
tgatatatagaacatacacc

SEQ ID NO: 782352 - DNA, 20 bp, Artificial
  CRISPR gRNA sequence
gaacatacacccagcaacta

SEQ ID NO: 782353 - DNA, 20 bp, Artificial
  CRISPR gRNA sequence
acagaacacacattgttttc

SEQ ID NO: 782354 - DNA, 20 bp, Artificial
  CRISPR gRNA sequence
acattgttttcaagcgtatg

SEQ ID NO: 782355 - DNA, 20 bp, Artificial
  CRISPR gRNA sequence
cgtatgtggaacaatcatca

SEQ ID NO: 782356 - DNA, 20 bp, Artificial
  CRISPR gRNA sequence
caatcatcaaagcaattatc

SEQ ID NO: 782357 - DNA, 20 bp, Artificial
  CRISPR gRNA sequence
aatcatcaaagcaattatct

SEQ ID NO: 782358 - DNA, 20 bp, Artificial
  CRISPR gRNA sequence
tcatcaaagcaattatctag

SEQ ID NO: 782359 - DNA, 20 bp, Artificial
  CRISPR gRNA sequence
attatctaggagaattgctg

SEQ ID NO: 782360 - DNA, 20 bp, Artificial
  CRISPR gRNA sequence
atctaggagaattgctgtag

SEQ ID NO: 782361 - DNA, 20 bp, Artificial
  CRISPR gRNA sequence
tctaggagaattgctgtaga

SEQ ID NO: 782362 - DNA, 20 bp, Artificial
  CRISPR gRNA sequence
tgtagaaggtgtttttcatt

SEQ ID NO: 782363 - DNA, 20 bp, Artificial
  CRISPR gRNA sequence
ggtgtttttcattgagcaat

SEQ ID NO: 782364 - DNA, 20 bp, Artificial
  CRISPR gRNA sequence
tttttcattgagcaataagt

SEQ ID NO: 782365 - DNA, 20 bp, Artificial
  CRISPR gRNA sequence
agtcagatgacttgaatttt

SEQ ID NO: 782366 - DNA, 20 bp, Artificial
  CRISPR gRNA sequence
tcagatgacttgaatttttg

SEQ ID NO: 782367 - DNA, 20 bp, Artificial
  CRISPR gRNA sequence
aaatttactcatcttttcct

SEQ ID NO: 782368 - DNA, 20 bp, Artificial
  CRISPR gRNA sequence
tttcctaagaatatcaccct

SEQ ID NO: 782369 - DNA, 20 bp, Artificial
  CRISPR gRNA sequence
taagaatatcaccctcagtc

SEQ ID NO: 782370 - DNA, 20 bp, Artificial
  CRISPR gRNA sequence
tcagtccagcttccccactg

SEQ ID NO: 782371 - DNA, 20 bp, Artificial
  CRISPR gRNA sequence
cagtccagcttccccactgt

SEQ ID NO: 782372 - DNA, 20 bp, Artificial
  CRISPR gRNA sequence
tccagcttccccactgtggg

SEQ ID NO: 782373 - DNA, 20 bp, Artificial
  CRISPR gRNA sequence
ttttccaccaccttccaaat

SEQ ID NO: 782374 - DNA, 20 bp, Artificial
  CRISPR gRNA sequence
ccaccaccttccaaataaga

SEQ ID NO: 782375 - DNA, 20 bp, Artificial
  CRISPR gRNA sequence
accaccttccaaataagaaa

SEQ ID NO: 782376 - DNA, 20 bp, Artificial
  CRISPR gRNA sequence
ccaccttccaaataagaaag

SEQ ID NO: 782377 - DNA, 20 bp, Artificial
  CRISPR gRNA sequence
tccaaataagaaagaggctg

SEQ ID NO: 782378 - DNA, 20 bp, Artificial
  CRISPR gRNA sequence
caaataagaaagaggctgtg

SEQ ID NO: 782379 - DNA, 20 bp, Artificial
  CRISPR gRNA sequence
tttctgatactgcaaaaatg

SEQ ID NO: 782380 - DNA, 20 bp, Artificial
  CRISPR gRNA sequence
ttctgatactgcaaaaatgt

SEQ ID NO: 782381 - DNA, 20 bp, Artificial
  CRISPR gRNA sequence
tactgcaaaaatgtaggatg

SEQ ID NO: 782382 - DNA, 20 bp, Artificial
  CRISPR gRNA sequence
actgcaaaaatgtaggatgt

SEQ ID NO: 782383 - DNA, 20 bp, Artificial
  CRISPR gRNA sequence
ccaaaccttgctgattcttg

SEQ ID NO: 782384 - DNA, 20 bp, Artificial
  CRISPR gRNA sequence
aaccttgctgattcttgtag

SEQ ID NO: 782385 - DNA, 20 bp, Artificial
  CRISPR gRNA sequence
cttgctgattcttgtagtgg

SEQ ID NO: 782386 - DNA, 20 bp, Artificial
  CRISPR gRNA sequence
tgctgattcttgtagtggaa

SEQ ID NO: 782387 - DNA, 20 bp, Artificial
  CRISPR gRNA sequence
tctgctccctcatgtatccc

SEQ ID NO: 782388 - DNA, 20 bp, Artificial
  CRISPR gRNA sequence
ccctcatgtatcccaagtca

SEQ ID NO: 782389 - DNA, 20 bp, Artificial
  CRISPR gRNA sequence
tgtatcccaagtcaaagcct

SEQ ID NO: 782390 - DNA, 20 bp, Artificial
  CRISPR gRNA sequence
cccaagtcaaagcctcagcc

SEQ ID NO: 782391 - DNA, 20 bp, Artificial
  CRISPR gRNA sequence
tcagccaagctcccaattcc

SEQ ID NO: 782392 - DNA, 20 bp, Artificial
  CRISPR gRNA sequence
ttctgaaatcacttctcaac

SEQ ID NO: 782393 - DNA, 20 bp, Artificial
  CRISPR gRNA sequence
tctgaaatcacttctcaacc

SEQ ID NO: 782394 - DNA, 20 bp, Artificial
  CRISPR gRNA sequence
cacttctcaaccaggacacc

SEQ ID NO: 782395 - DNA, 20 bp, Artificial
  CRISPR gRNA sequence
ctcaaccaggacaccaagat

SEQ ID NO: 782396 - DNA, 20 bp, Artificial
  CRISPR gRNA sequence
ggacaccaagatcagtttct

SEQ ID NO: 782397 - DNA, 20 bp, Artificial
  CRISPR gRNA sequence
caagatcagtttcttggtcc

SEQ ID NO: 782398 - DNA, 20 bp, Artificial
  CRISPR gRNA sequence
ttggtccaagccacctgcaa

SEQ ID NO: 782399 - DNA, 20 bp, Artificial
  CRISPR gRNA sequence
gtccaagccacctgcaatag

SEQ ID NO: 782400 - DNA, 20 bp, Artificial
  CRISPR gRNA sequence
tccaagccacctgcaatagt

SEQ ID NO: 782401 - DNA, 20 bp, Artificial
  CRISPR gRNA sequence
agccacctgcaatagtgggc

SEQ ID NO: 782402 - DNA, 20 bp, Artificial
  CRISPR gRNA sequence
gtgggctggaccctcaccca

SEQ ID NO: 782403 - DNA, 20 bp, Artificial
  CRISPR gRNA sequence
tgttctacttcattccccaa

SEQ ID NO: 782404 - DNA, 20 bp, Artificial
  CRISPR gRNA sequence
cttcattccccaaaagactt

SEQ ID NO: 782405 - DNA, 20 bp, Artificial
  CRISPR gRNA sequence
tcattccccaaaagacttga

SEQ ID NO: 782406 - DNA, 20 bp, Artificial
  CRISPR gRNA sequence
ccaaaagacttgagagctta

SEQ ID NO: 782407 - DNA, 20 bp, Artificial
  CRISPR gRNA sequence
gagcttacagaaataatcta

SEQ ID NO: 782408 - DNA, 20 bp, Artificial
  CRISPR gRNA sequence
atcatataaaatgattacaa

SEQ ID NO: 782409 - DNA, 20 bp, Artificial
  CRISPR gRNA sequence
attacaaaagacattgaacc

SEQ ID NO: 782410 - DNA, 20 bp, Artificial
  CRISPR gRNA sequence
ttacaaaagacattgaacca

SEQ ID NO: 782411 - DNA, 20 bp, Artificial
  CRISPR gRNA sequence
tacaaaagacattgaaccaa

SEQ ID NO: 782412 - DNA, 20 bp, Artificial
  CRISPR gRNA sequence
acattgaaccaagggaaaat

SEQ ID NO: 782413 - DNA, 20 bp, Artificial
  CRISPR gRNA sequence
gaaccaagggaaaataagtg

SEQ ID NO: 782414 - DNA, 20 bp, Artificial
  CRISPR gRNA sequence
gtagataaataatacaaaat

SEQ ID NO: 782415 - DNA, 20 bp, Artificial
  CRISPR gRNA sequence
agataaataatacaaaatga

SEQ ID NO: 782416 - DNA, 20 bp, Artificial
  CRISPR gRNA sequence
ataatacaaaatgagagata

SEQ ID NO: 782417 - DNA, 20 bp, Artificial
  CRISPR gRNA sequence
tacaaaatgagagataaagt

SEQ ID NO: 782418 - DNA, 20 bp, Artificial
  CRISPR gRNA sequence
agtactcgaaatacacactt

SEQ ID NO: 782419 - DNA, 20 bp, Artificial
  CRISPR gRNA sequence
gtactcgaaatacacacttc

SEQ ID NO: 782420 - DNA, 20 bp, Artificial
  CRISPR gRNA sequence
cgggtactgtttgattatga

SEQ ID NO: 782421 - DNA, 20 bp, Artificial
  CRISPR gRNA sequence
tactgtttgattatgaaaga

SEQ ID NO: 782422 - DNA, 20 bp, Artificial
  CRISPR gRNA sequence
actgtttgattatgaaagat

SEQ ID NO: 782423 - DNA, 20 bp, Artificial
  CRISPR gRNA sequence
tgattatgaaagataggcca

SEQ ID NO: 782424 - DNA, 20 bp, Artificial
  CRISPR gRNA sequence
tgaaagataggccaaagttt

SEQ ID NO: 782425 - DNA, 20 bp, Artificial
  CRISPR gRNA sequence
taggccaaagttttggcttc

SEQ ID NO: 782426 - DNA, 20 bp, Artificial
  CRISPR gRNA sequence
aggccaaagttttggcttca

SEQ ID NO: 782427 - DNA, 20 bp, Artificial
  CRISPR gRNA sequence
gccaaagttttggcttcaag

SEQ ID NO: 782428 - DNA, 20 bp, Artificial
  CRISPR gRNA sequence
agttttggcttcaaggagat

SEQ ID NO: 782429 - DNA, 20 bp, Artificial
  CRISPR gRNA sequence
ttggcttcaaggagattggt

SEQ ID NO: 782430 - DNA, 20 bp, Artificial
  CRISPR gRNA sequence
aaggagattggtgagtctaa

SEQ ID NO: 782431 - DNA, 20 bp, Artificial
  CRISPR gRNA sequence
aggagattggtgagtctaac

SEQ ID NO: 782432 - DNA, 20 bp, Artificial
  CRISPR gRNA sequence
attggtgagtctaacaggtc

SEQ ID NO: 782433 - DNA, 20 bp, Artificial
  CRISPR gRNA sequence
gtctaacaggtcaagtcctt

SEQ ID NO: 782434 - DNA, 20 bp, Artificial
  CRISPR gRNA sequence
taacaggtcaagtccttcag

SEQ ID NO: 782435 - DNA, 20 bp, Artificial
  CRISPR gRNA sequence
aacaggtcaagtccttcagt

SEQ ID NO: 782436 - DNA, 20 bp, Artificial
  CRISPR gRNA sequence
agtccttcagtaggctgctt

SEQ ID NO: 782437 - DNA, 20 bp, Artificial
  CRISPR gRNA sequence
gccttatcttctactactgc

SEQ ID NO: 782438 - DNA, 20 bp, Artificial
  CRISPR gRNA sequence
ccttatcttctactactgct

SEQ ID NO: 782439 - DNA, 20 bp, Artificial
  CRISPR gRNA sequence
tactactgctgggtgctcct

SEQ ID NO: 782440 - DNA, 20 bp, Artificial
  CRISPR gRNA sequence
ctgggtgctcctaagaacct

SEQ ID NO: 782441 - DNA, 20 bp, Artificial
  CRISPR gRNA sequence
gggtgctcctaagaacctca

SEQ ID NO: 782442 - DNA, 20 bp, Artificial
  CRISPR gRNA sequence
tgcttatgttgcaccatccc

SEQ ID NO: 782443 - DNA, 20 bp, Artificial
  CRISPR gRNA sequence
cctagacatctgcaattaca

SEQ ID NO: 782444 - DNA, 20 bp, Artificial
  CRISPR gRNA sequence
tagacatctgcaattacaca

SEQ ID NO: 782445 - DNA, 20 bp, Artificial
  CRISPR gRNA sequence
cacagagacacatcctctta

SEQ ID NO: 782446 - DNA, 20 bp, Artificial
  CRISPR gRNA sequence
ctcttatggtgattccaatt

SEQ ID NO: 782447 - DNA, 20 bp, Artificial
  CRISPR gRNA sequence
attaagaatgcattacaaaa

SEQ ID NO: 782448 - DNA, 20 bp, Artificial
  CRISPR gRNA sequence
tatgaattttacccacctca

SEQ ID NO: 782449 - DNA, 20 bp, Artificial
  CRISPR gRNA sequence
atgaattttacccacctcat

SEQ ID NO: 782450 - DNA, 20 bp, Artificial
  CRISPR gRNA sequence
tgaattttacccacctcata

SEQ ID NO: 782451 - DNA, 20 bp, Artificial
  CRISPR gRNA sequence
tattatgtatatttatacat

SEQ ID NO: 782452 - DNA, 20 bp, Artificial
  CRISPR gRNA sequence
attatgtatatttatacatt

SEQ ID NO: 782453 - DNA, 20 bp, Artificial
  CRISPR gRNA sequence
ttatgtatatttatacatta

SEQ ID NO: 782454 - DNA, 20 bp, Artificial
  CRISPR gRNA sequence
tatgtatatttatacattag

SEQ ID NO: 782455 - DNA, 20 bp, Artificial
  CRISPR gRNA sequence
atgtatatttatacattagg

SEQ ID NO: 782456 - DNA, 20 bp, Artificial
  CRISPR gRNA sequence
atatttatacattaggggga

SEQ ID NO: 782457 - DNA, 20 bp, Artificial
  CRISPR gRNA sequence
tacattagggggaaagatgt

SEQ ID NO: 782458 - DNA, 20 bp, Artificial
  CRISPR gRNA sequence
cattagggggaaagatgtca

SEQ ID NO: 782459 - DNA, 20 bp, Artificial
  CRISPR gRNA sequence
ggaaagatgtcagagctttt

SEQ ID NO: 782460 - DNA, 20 bp, Artificial
  CRISPR gRNA sequence
gaaagatgtcagagcttttt

SEQ ID NO: 782461 - DNA, 20 bp, Artificial
  CRISPR gRNA sequence
cagagctttttgggacatac

SEQ ID NO: 782462 - DNA, 20 bp, Artificial
  CRISPR gRNA sequence
agagctttttgggacatacc

SEQ ID NO: 782463 - DNA, 20 bp, Artificial
  CRISPR gRNA sequence
agctttttgggacataccag

SEQ ID NO: 782464 - DNA, 20 bp, Artificial
  CRISPR gRNA sequence
gctttttgggacataccagg

SEQ ID NO: 782465 - DNA, 20 bp, Artificial
  CRISPR gRNA sequence
ttgggacataccaggaggcc

SEQ ID NO: 782466 - DNA, 20 bp, Artificial
  CRISPR gRNA sequence
gacataccaggaggcccagc

SEQ ID NO: 782467 - DNA, 20 bp, Artificial
  CRISPR gRNA sequence
acataccaggaggcccagct

SEQ ID NO: 782468 - DNA, 20 bp, Artificial
  CRISPR gRNA sequence
agctgggtgtgctgaccaca

SEQ ID NO: 782469 - DNA, 20 bp, Artificial
  CRISPR gRNA sequence
ctgggtgtgctgaccacatg

SEQ ID NO: 782470 - DNA, 20 bp, Artificial
  CRISPR gRNA sequence
tgtgctgaccacatggagac

SEQ ID NO: 782471 - DNA, 20 bp, Artificial
  CRISPR gRNA sequence
cacatggagacgagaacttc

SEQ ID NO: 782472 - DNA, 20 bp, Artificial
  CRISPR gRNA sequence
acatggagacgagaacttca

SEQ ID NO: 782473 - DNA, 20 bp, Artificial
  CRISPR gRNA sequence
catggagacgagaacttcaa

SEQ ID NO: 782474 - DNA, 20 bp, Artificial
  CRISPR gRNA sequence
tggagacgagaacttcaagg

SEQ ID NO: 782475 - DNA, 20 bp, Artificial
  CRISPR gRNA sequence
gagacgagaacttcaaggga

SEQ ID NO: 782476 - DNA, 20 bp, Artificial
  CRISPR gRNA sequence
agaacttcaagggagagcca

SEQ ID NO: 782477 - DNA, 20 bp, Artificial
  CRISPR gRNA sequence
agggagagccaaagtgcacg

SEQ ID NO: 782478 - DNA, 20 bp, Artificial
  CRISPR gRNA sequence
gggagagccaaagtgcacgc

SEQ ID NO: 782479 - DNA, 20 bp, Artificial
  CRISPR gRNA sequence
gccaaagtgcacgcaggttc

SEQ ID NO: 782480 - DNA, 20 bp, Artificial
  CRISPR gRNA sequence
aaagtgcacgcaggttctgg

SEQ ID NO: 782481 - DNA, 20 bp, Artificial
  CRISPR gRNA sequence
ctggtggatgtttcattgtg

SEQ ID NO: 782482 - DNA, 20 bp, Artificial
  CRISPR gRNA sequence
tgtgcagtgaccctgctctc

SEQ ID NO: 782483 - DNA, 20 bp, Artificial
  CRISPR gRNA sequence
accctgctctctagtgaacc

SEQ ID NO: 782484 - DNA, 20 bp, Artificial
  CRISPR gRNA sequence
ctctctagtgaacccagatc

SEQ ID NO: 782485 - DNA, 20 bp, Artificial
  CRISPR gRNA sequence
tctagtgaacccagatctag

SEQ ID NO: 782486 - DNA, 20 bp, Artificial
  CRISPR gRNA sequence
ctagtgaacccagatctagt

SEQ ID NO: 782487 - DNA, 20 bp, Artificial
  CRISPR gRNA sequence
aattgtcaactcttaacatt

SEQ ID NO: 782488 - DNA, 20 bp, Artificial
  CRISPR gRNA sequence
taacattgagacccacaaca

SEQ ID NO: 782489 - DNA, 20 bp, Artificial
  CRISPR gRNA sequence
aacattgagacccacaacac

SEQ ID NO: 782490 - DNA, 20 bp, Artificial
  CRISPR gRNA sequence
cattgagacccacaacacag

SEQ ID NO: 782491 - DNA, 20 bp, Artificial
  CRISPR gRNA sequence
attgagacccacaacacagg

SEQ ID NO: 782492 - DNA, 20 bp, Artificial
  CRISPR gRNA sequence
ttgagacccacaacacagga

SEQ ID NO: 782493 - DNA, 20 bp, Artificial
  CRISPR gRNA sequence
tgagacccacaacacaggag

SEQ ID NO: 782494 - DNA, 20 bp, Artificial
  CRISPR gRNA sequence
cccacaacacaggaggggaa

SEQ ID NO: 782495 - DNA, 20 bp, Artificial
  CRISPR gRNA sequence
cacaacacaggaggggaaca

SEQ ID NO: 782496 - DNA, 20 bp, Artificial
  CRISPR gRNA sequence
acaacacaggaggggaacag

SEQ ID NO: 782497 - DNA, 20 bp, Artificial
  CRISPR gRNA sequence
caacacaggaggggaacaga

SEQ ID NO: 782498 - DNA, 20 bp, Artificial
  CRISPR gRNA sequence
aacacaggaggggaacagag

SEQ ID NO: 782499 - DNA, 20 bp, Artificial
  CRISPR gRNA sequence
acagaggggcaaaaattgtg

SEQ ID NO: 782500 - DNA, 20 bp, Artificial
  CRISPR gRNA sequence
ggggcaaaaattgtgaagaa

SEQ ID NO: 782501 - DNA, 20 bp, Artificial
  CRISPR gRNA sequence
tgaacattccttctcttcca

SEQ ID NO: 782502 - DNA, 20 bp, Artificial
  CRISPR gRNA sequence
gaacattccttctcttccat

SEQ ID NO: 782503 - DNA, 20 bp, Artificial
  CRISPR gRNA sequence
ttctcttccataggatgtaa

SEQ ID NO: 782504 - DNA, 20 bp, Artificial
  CRISPR gRNA sequence
tctcttccataggatgtaaa

SEQ ID NO: 782505 - DNA, 20 bp, Artificial
  CRISPR gRNA sequence
ccataggatgtaaaaggacg

SEQ ID NO: 782506 - DNA, 20 bp, Artificial
  CRISPR gRNA sequence
atgtaaaaggacgtggcaca

SEQ ID NO: 782507 - DNA, 20 bp, Artificial
  CRISPR gRNA sequence
gtggcacaaagctcaacaca

SEQ ID NO: 782508 - DNA, 20 bp, Artificial
  CRISPR gRNA sequence
ctcaacacatagaaaacaat

SEQ ID NO: 782509 - DNA, 20 bp, Artificial
  CRISPR gRNA sequence
aataagtaaatcatacacat

SEQ ID NO: 782510 - DNA, 20 bp, Artificial
  CRISPR gRNA sequence
agtaaatcatacacatcaga

SEQ ID NO: 782511 - DNA, 20 bp, Artificial
  CRISPR gRNA sequence
cacatcagatggttttcaca

SEQ ID NO: 782512 - DNA, 20 bp, Artificial
  CRISPR gRNA sequence
atgtgaaattgtttttcaca

SEQ ID NO: 782513 - DNA, 20 bp, Artificial
  CRISPR gRNA sequence
tatttatacttccaacaatt

SEQ ID NO: 782514 - DNA, 20 bp, Artificial
  CRISPR gRNA sequence
atttatacttccaacaattt

SEQ ID NO: 782515 - DNA, 20 bp, Artificial
  CRISPR gRNA sequence
ttatacttccaacaatttag

SEQ ID NO: 782516 - DNA, 20 bp, Artificial
  CRISPR gRNA sequence
tccaacaatttaggagaaaa

SEQ ID NO: 782517 - DNA, 20 bp, Artificial
  CRISPR gRNA sequence
cacacctctgcctttacttc

SEQ ID NO: 782518 - DNA, 20 bp, Artificial
  CRISPR gRNA sequence
attgaaatttaatttcttaa

SEQ ID NO: 782519 - DNA, 20 bp, Artificial
  CRISPR gRNA sequence
aaagaatatttcctaccgaa

SEQ ID NO: 782520 - DNA, 20 bp, Artificial
  CRISPR gRNA sequence
gaatatttcctaccgaatgg

SEQ ID NO: 782521 - DNA, 20 bp, Artificial
  CRISPR gRNA sequence
atttcctaccgaatggaagc

SEQ ID NO: 782522 - DNA, 20 bp, Artificial
  CRISPR gRNA sequence
ttcctctcaccaaatatcaa

SEQ ID NO: 782523 - DNA, 20 bp, Artificial
  CRISPR gRNA sequence
tcctctcaccaaatatcaac

SEQ ID NO: 782524 - DNA, 20 bp, Artificial
  CRISPR gRNA sequence
aggtgactttccacactgcc

SEQ ID NO: 782525 - DNA, 20 bp, Artificial
  CRISPR gRNA sequence
cactgcctggtaactgcata

SEQ ID NO: 782526 - DNA, 20 bp, Artificial
  CRISPR gRNA sequence
tattgatatttgtttatttt

SEQ ID NO: 782527 - DNA, 20 bp, Artificial
  CRISPR gRNA sequence
tttatttttagctattatct

SEQ ID NO: 782528 - DNA, 20 bp, Artificial
  CRISPR gRNA sequence
tagctattatctaagaccac

SEQ ID NO: 782529 - DNA, 20 bp, Artificial
  CRISPR gRNA sequence
ctattatctaagaccactgg

SEQ ID NO: 782530 - DNA, 20 bp, Artificial
  CRISPR gRNA sequence
tattatctaagaccactgga

SEQ ID NO: 782531 - DNA, 20 bp, Artificial
  CRISPR gRNA sequence
aggtttgttcttgtgtcttc

SEQ ID NO: 782532 - DNA, 20 bp, Artificial
  CRISPR gRNA sequence
tcttgtgtcttctagtctct

SEQ ID NO: 782533 - DNA, 20 bp, Artificial
  CRISPR gRNA sequence
gcctattttacttattttta

SEQ ID NO: 782534 - DNA, 20 bp, Artificial
  CRISPR gRNA sequence
cttatttttaaagtttttat

SEQ ID NO: 782535 - DNA, 20 bp, Artificial
  CRISPR gRNA sequence
ttatttttaaagtttttata

SEQ ID NO: 782536 - DNA, 20 bp, Artificial
  CRISPR gRNA sequence
ttttaaaatttatttttaac

SEQ ID NO: 782537 - DNA, 20 bp, Artificial
  CRISPR gRNA sequence
ctggcaataatgtatattta

SEQ ID NO: 782538 - DNA, 20 bp, Artificial
  CRISPR gRNA sequence
tggcaataatgtatatttat

SEQ ID NO: 782539 - DNA, 20 bp, Artificial
  CRISPR gRNA sequence
ggcaataatgtatatttatg

SEQ ID NO: 782540 - DNA, 20 bp, Artificial
  CRISPR gRNA sequence
atgatgttttgatctatgta

SEQ ID NO: 782541 - DNA, 20 bp, Artificial
  CRISPR gRNA sequence
tttgatctatgtatagatta

SEQ ID NO: 782542 - DNA, 20 bp, Artificial
  CRISPR gRNA sequence
atctatgtatagattataga

SEQ ID NO: 782543 - DNA, 20 bp, Artificial
  CRISPR gRNA sequence
ctatgtatagattatagaaa

SEQ ID NO: 782544 - DNA, 20 bp, Artificial
  CRISPR gRNA sequence
gattatagaaagagtcaatc

SEQ ID NO: 782545 - DNA, 20 bp, Artificial
  CRISPR gRNA sequence
atagaaagagtcaatcaagc

SEQ ID NO: 782546 - DNA, 20 bp, Artificial
  CRISPR gRNA sequence
tagaaagagtcaatcaagcc

SEQ ID NO: 782547 - DNA, 20 bp, Artificial
  CRISPR gRNA sequence
agagtcaatcaagccgggca

SEQ ID NO: 782548 - DNA, 20 bp, Artificial
  CRISPR gRNA sequence
gtcaatcaagccgggcacag

SEQ ID NO: 782549 - DNA, 20 bp, Artificial
  CRISPR gRNA sequence
gtggctcatgcctgtaatcc

SEQ ID NO: 782550 - DNA, 20 bp, Artificial
  CRISPR gRNA sequence
tgcctgtaatcccagcactt

SEQ ID NO: 782551 - DNA, 20 bp, Artificial
  CRISPR gRNA sequence
gcctgtaatcccagcacttt

SEQ ID NO: 782552 - DNA, 20 bp, Artificial
  CRISPR gRNA sequence
ctgtaatcccagcactttgg

SEQ ID NO: 782553 - DNA, 20 bp, Artificial
  CRISPR gRNA sequence
tgtaatcccagcactttggg

SEQ ID NO: 782554 - DNA, 20 bp, Artificial
  CRISPR gRNA sequence
tcccagcactttgggaggcc

SEQ ID NO: 782555 - DNA, 20 bp, Artificial
  CRISPR gRNA sequence
cccagcactttgggaggcca

SEQ ID NO: 782556 - DNA, 20 bp, Artificial
  CRISPR gRNA sequence
agcactttgggaggccaagg

SEQ ID NO: 782557 - DNA, 20 bp, Artificial
  CRISPR gRNA sequence
gcactttgggaggccaaggc

SEQ ID NO: 782558 - DNA, 20 bp, Artificial
  CRISPR gRNA sequence
ctttgggaggccaaggcagg

SEQ ID NO: 782559 - DNA, 20 bp, Artificial
  CRISPR gRNA sequence
ccaaggcaggtggatcacct

SEQ ID NO: 782560 - DNA, 20 bp, Artificial
  CRISPR gRNA sequence
caaggcaggtggatcacctg

SEQ ID NO: 782561 - DNA, 20 bp, Artificial
  CRISPR gRNA sequence
gcaggtggatcacctgaggt

SEQ ID NO: 782562 - DNA, 20 bp, Artificial
  CRISPR gRNA sequence
caggtggatcacctgaggtc

SEQ ID NO: 782563 - DNA, 20 bp, Artificial
  CRISPR gRNA sequence
ggtggatcacctgaggtcag

SEQ ID NO: 782564 - DNA, 20 bp, Artificial
  CRISPR gRNA sequence
tgaggtcaggagttcaaaac

SEQ ID NO: 782565 - DNA, 20 bp, Artificial
  CRISPR gRNA sequence
gaggtcaggagttcaaaacc

SEQ ID NO: 782566 - DNA, 20 bp, Artificial
  CRISPR gRNA sequence
caaaaccaggctgaccaaca

SEQ ID NO: 782567 - DNA, 20 bp, Artificial
  CRISPR gRNA sequence
aaccccatctctactgaaaa

SEQ ID NO: 782568 - DNA, 20 bp, Artificial
  CRISPR gRNA sequence
ctactgaaaatagaaaaaat

SEQ ID NO: 782569 - DNA, 20 bp, Artificial
  CRISPR gRNA sequence
tgaaaatagaaaaaattagc

SEQ ID NO: 782570 - DNA, 20 bp, Artificial
  CRISPR gRNA sequence
gaaaatagaaaaaattagcc

SEQ ID NO: 782571 - DNA, 20 bp, Artificial
  CRISPR gRNA sequence
tagaaaaaattagccaggca

SEQ ID NO: 782572 - DNA, 20 bp, Artificial
  CRISPR gRNA sequence
aaaaaattagccaggcatgg

SEQ ID NO: 782573 - DNA, 20 bp, Artificial
  CRISPR gRNA sequence
aaattagccaggcatggtgg

SEQ ID NO: 782574 - DNA, 20 bp, Artificial
  CRISPR gRNA sequence
aattagccaggcatggtggc

SEQ ID NO: 782575 - DNA, 20 bp, Artificial
  CRISPR gRNA sequence
gtggcaggtgcctgcaatcc

SEQ ID NO: 782576 - DNA, 20 bp, Artificial
  CRISPR gRNA sequence
tgcctgcaatcccagctact

SEQ ID NO: 782577 - DNA, 20 bp, Artificial
  CRISPR gRNA sequence
gcctgcaatcccagctactc

SEQ ID NO: 782578 - DNA, 20 bp, Artificial
  CRISPR gRNA sequence
tgcaatcccagctactcagg

SEQ ID NO: 782579 - DNA, 20 bp, Artificial
  CRISPR gRNA sequence
tcccagctactcaggaagct

SEQ ID NO: 782580 - DNA, 20 bp, Artificial
  CRISPR gRNA sequence
cccagctactcaggaagctg

SEQ ID NO: 782581 - DNA, 20 bp, Artificial
  CRISPR gRNA sequence
agctactcaggaagctgagg

SEQ ID NO: 782582 - DNA, 20 bp, Artificial
  CRISPR gRNA sequence
gctactcaggaagctgaggc

SEQ ID NO: 782583 - DNA, 20 bp, Artificial
  CRISPR gRNA sequence
tactcaggaagctgaggcag

SEQ ID NO: 782584 - DNA, 20 bp, Artificial
  CRISPR gRNA sequence
gcaggagaattgcttgaacc

SEQ ID NO: 782585 - DNA, 20 bp, Artificial
  CRISPR gRNA sequence
caggagaattgcttgaacct

SEQ ID NO: 782586 - DNA, 20 bp, Artificial
  CRISPR gRNA sequence
ggagaattgcttgaacctgg

SEQ ID NO: 782587 - DNA, 20 bp, Artificial
  CRISPR gRNA sequence
gagaattgcttgaacctggg

SEQ ID NO: 782588 - DNA, 20 bp, Artificial
  CRISPR gRNA sequence
aattgcttgaacctgggagg

SEQ ID NO: 782589 - DNA, 20 bp, Artificial
  CRISPR gRNA sequence
ttgcttgaacctgggaggtg

SEQ ID NO: 782590 - DNA, 20 bp, Artificial
  CRISPR gRNA sequence
tgcttgaacctgggaggtgg

SEQ ID NO: 782591 - DNA, 20 bp, Artificial
  CRISPR gRNA sequence
aacctgggaggtggaggttg

SEQ ID NO: 782592 - DNA, 20 bp, Artificial
  CRISPR gRNA sequence
tgggaggtggaggttgcagt

SEQ ID NO: 782593 - DNA, 20 bp, Artificial
  CRISPR gRNA sequence
ggtggaggttgcagtgagcc

SEQ ID NO: 782594 - DNA, 20 bp, Artificial
  CRISPR gRNA sequence
gagatcacgctgttgcactc

SEQ ID NO: 782595 - DNA, 20 bp, Artificial
  CRISPR gRNA sequence
cacgctgttgcactccagcc

SEQ ID NO: 782596 - DNA, 20 bp, Artificial
  CRISPR gRNA sequence
acgctgttgcactccagcct

SEQ ID NO: 782597 - DNA, 20 bp, Artificial
  CRISPR gRNA sequence
tgcactccagcctgggtgac

SEQ ID NO: 782598 - DNA, 20 bp, Artificial
  CRISPR gRNA sequence
caaaaaaaaaaaaaaaaaaa

SEQ ID NO: 782599 - DNA, 20 bp, Artificial
  CRISPR gRNA sequence
aaaaaaagaataaatcaaac

SEQ ID NO: 782600 - DNA, 20 bp, Artificial
  CRISPR gRNA sequence
agttaacatatcacatcacc

SEQ ID NO: 782601 - DNA, 20 bp, Artificial
  CRISPR gRNA sequence
atcaccaagttgtttttttg

SEQ ID NO: 782602 - DNA, 20 bp, Artificial
  CRISPR gRNA sequence
ttctcttcttaatctcaaaa

SEQ ID NO: 782603 - DNA, 20 bp, Artificial
  CRISPR gRNA sequence
ctcttcttaatctcaaaaca

SEQ ID NO: 782604 - DNA, 20 bp, Artificial
  CRISPR gRNA sequence
atgtaaaaaattcatgcttt

SEQ ID NO: 782605 - DNA, 20 bp, Artificial
  CRISPR gRNA sequence
gcttttagcaaatttgaata

SEQ ID NO: 782606 - DNA, 20 bp, Artificial
  CRISPR gRNA sequence
aatacagaatgcattaactg

SEQ ID NO: 782607 - DNA, 20 bp, Artificial
  CRISPR gRNA sequence
ttaactgtggtcatcacaca

SEQ ID NO: 782608 - DNA, 20 bp, Artificial
  CRISPR gRNA sequence
gtggtcatcacacatggcaa

SEQ ID NO: 782609 - DNA, 20 bp, Artificial
  CRISPR gRNA sequence
taaaacatttcctctactct

SEQ ID NO: 782610 - DNA, 20 bp, Artificial
  CRISPR gRNA sequence
atttcctctactctgagact

SEQ ID NO: 782611 - DNA, 20 bp, Artificial
  CRISPR gRNA sequence
agcaacatcttccacatccc

SEQ ID NO: 782612 - DNA, 20 bp, Artificial
  CRISPR gRNA sequence
acctttctactctgtttcta

SEQ ID NO: 782613 - DNA, 20 bp, Artificial
  CRISPR gRNA sequence
cctttctactctgtttctat

SEQ ID NO: 782614 - DNA, 20 bp, Artificial
  CRISPR gRNA sequence
ttctatgggatctacttttt

SEQ ID NO: 782615 - DNA, 20 bp, Artificial
  CRISPR gRNA sequence
tttagatttcacaaataaat

SEQ ID NO: 782616 - DNA, 20 bp, Artificial
  CRISPR gRNA sequence
attatctgtctttttgtgcc

SEQ ID NO: 782617 - DNA, 20 bp, Artificial
  CRISPR gRNA sequence
tgtgcctggcttacttaact

SEQ ID NO: 782618 - DNA, 20 bp, Artificial
  CRISPR gRNA sequence
taacttagcataataccctt

SEQ ID NO: 782619 - DNA, 20 bp, Artificial
  CRISPR gRNA sequence
atccatgttgtcatgaatga

SEQ ID NO: 782620 - DNA, 20 bp, Artificial
  CRISPR gRNA sequence
gacagattttacttctttct

SEQ ID NO: 782621 - DNA, 20 bp, Artificial
  CRISPR gRNA sequence
acagattttacttctttcta

SEQ ID NO: 782622 - DNA, 20 bp, Artificial
  CRISPR gRNA sequence
cagattttacttctttctaa

SEQ ID NO: 782623 - DNA, 20 bp, Artificial
  CRISPR gRNA sequence
tacttctttctaagggctgt

SEQ ID NO: 782624 - DNA, 20 bp, Artificial
  CRISPR gRNA sequence
ctttattcattctctgttga

SEQ ID NO: 782625 - DNA, 20 bp, Artificial
  CRISPR gRNA sequence
attctctgttgatggacatt

SEQ ID NO: 782626 - DNA, 20 bp, Artificial
  CRISPR gRNA sequence
ctgttgatggacatttagtt

SEQ ID NO: 782627 - DNA, 20 bp, Artificial
  CRISPR gRNA sequence
tttagtttggttccacatct

SEQ ID NO: 782628 - DNA, 20 bp, Artificial
  CRISPR gRNA sequence
gaatcatgctgaaatgaata

SEQ ID NO: 782629 - DNA, 20 bp, Artificial
  CRISPR gRNA sequence
aatcatgctgaaatgaataa

SEQ ID NO: 782630 - DNA, 20 bp, Artificial
  CRISPR gRNA sequence
ctgaaatgaataaaggaata

SEQ ID NO: 782631 - DNA, 20 bp, Artificial
  CRISPR gRNA sequence
catactaaattcaattcctt

SEQ ID NO: 782632 - DNA, 20 bp, Artificial
  CRISPR gRNA sequence
aattcctttggatatatacc

SEQ ID NO: 782633 - DNA, 20 bp, Artificial
  CRISPR gRNA sequence
tcctttggatatatacccag

SEQ ID NO: 782634 - DNA, 20 bp, Artificial
  CRISPR gRNA sequence
tttggatatatacccagaag

SEQ ID NO: 782635 - DNA, 20 bp, Artificial
  CRISPR gRNA sequence
ttggatatatacccagaagt

SEQ ID NO: 782636 - DNA, 20 bp, Artificial
  CRISPR gRNA sequence
atacccagaagtaggactgc

SEQ ID NO: 782637 - DNA, 20 bp, Artificial
  CRISPR gRNA sequence
agtaggactgctggatcatg

SEQ ID NO: 782638 - DNA, 20 bp, Artificial
  CRISPR gRNA sequence
tcatgtggtcattctatttt

SEQ ID NO: 782639 - DNA, 20 bp, Artificial
  CRISPR gRNA sequence
cattctatttttagtttttt

SEQ ID NO: 782640 - DNA, 20 bp, Artificial
  CRISPR gRNA sequence
attctatttttagttttttg

SEQ ID NO: 782641 - DNA, 20 bp, Artificial
  CRISPR gRNA sequence
ttttccaaaatgactatact

SEQ ID NO: 782642 - DNA, 20 bp, Artificial
  CRISPR gRNA sequence
aaatgactatacttagatct

SEQ ID NO: 782643 - DNA, 20 bp, Artificial
  CRISPR gRNA sequence
acttagatctcagctttctt

SEQ ID NO: 782644 - DNA, 20 bp, Artificial
  CRISPR gRNA sequence
cttagatctcagctttcttg

SEQ ID NO: 782645 - DNA, 20 bp, Artificial
  CRISPR gRNA sequence
agatctcagctttcttgagg

SEQ ID NO: 782646 - DNA, 20 bp, Artificial
  CRISPR gRNA sequence
gatctcagctttcttgaggc

SEQ ID NO: 782647 - DNA, 20 bp, Artificial
  CRISPR gRNA sequence
atctcagctttcttgaggca

SEQ ID NO: 782648 - DNA, 20 bp, Artificial
  CRISPR gRNA sequence
ctcagctttcttgaggcagg

SEQ ID NO: 782649 - DNA, 20 bp, Artificial
  CRISPR gRNA sequence
ccatatctgtttaattcact

SEQ ID NO: 782650 - DNA, 20 bp, Artificial
  CRISPR gRNA sequence
ttcactcagcatatactgca

SEQ ID NO: 782651 - DNA, 20 bp, Artificial
  CRISPR gRNA sequence
actcagcatatactgcaaag

SEQ ID NO: 782652 - DNA, 20 bp, Artificial
  CRISPR gRNA sequence
cagcatatactgcaaagaag

SEQ ID NO: 782653 - DNA, 20 bp, Artificial
  CRISPR gRNA sequence
agcatatactgcaaagaagc

SEQ ID NO: 782654 - DNA, 20 bp, Artificial
  CRISPR gRNA sequence
gtgtatgtatctgcatgtgt

SEQ ID NO: 782655 - DNA, 20 bp, Artificial
  CRISPR gRNA sequence
tgtatgtatctgcatgtgtt

SEQ ID NO: 782656 - DNA, 20 bp, Artificial
  CRISPR gRNA sequence
gtatgtatctgcatgtgtta

SEQ ID NO: 782657 - DNA, 20 bp, Artificial
  CRISPR gRNA sequence
atgtatctgcatgtgttagg

SEQ ID NO: 782658 - DNA, 20 bp, Artificial
  CRISPR gRNA sequence
tatctgcatgtgttagggag

SEQ ID NO: 782659 - DNA, 20 bp, Artificial
  CRISPR gRNA sequence
gcatgtgttagggagaagtg

SEQ ID NO: 782660 - DNA, 20 bp, Artificial
  CRISPR gRNA sequence
acccaactctttactatgta

SEQ ID NO: 782661 - DNA, 20 bp, Artificial
  CRISPR gRNA sequence
tactatgtatagacattatc

SEQ ID NO: 782662 - DNA, 20 bp, Artificial
  CRISPR gRNA sequence
actatgtatagacattatct

SEQ ID NO: 782663 - DNA, 20 bp, Artificial
  CRISPR gRNA sequence
tttttctcttcttaatctca

SEQ ID NO: 782664 - DNA, 20 bp, Artificial
  CRISPR gRNA sequence
cttcttaatctcaaagaaaa

SEQ ID NO: 782665 - DNA, 20 bp, Artificial
  CRISPR gRNA sequence
tcttaatctcaaagaaaaca

SEQ ID NO: 782666 - DNA, 20 bp, Artificial
  CRISPR gRNA sequence
cttaatctcaaagaaaacag

SEQ ID NO: 782667 - DNA, 20 bp, Artificial
  CRISPR gRNA sequence
atctcaaagaaaacagagga

SEQ ID NO: 782668 - DNA, 20 bp, Artificial
  CRISPR gRNA sequence
tctcaaagaaaacagaggaa

SEQ ID NO: 782669 - DNA, 20 bp, Artificial
  CRISPR gRNA sequence
tcaaagaaaacagaggaaag

SEQ ID NO: 782670 - DNA, 20 bp, Artificial
  CRISPR gRNA sequence
caaagaaaacagaggaaagg

SEQ ID NO: 782671 - DNA, 20 bp, Artificial
  CRISPR gRNA sequence
agaaaacagaggaaaggagg

SEQ ID NO: 782672 - DNA, 20 bp, Artificial
  CRISPR gRNA sequence
agaggaaaggaggaagtaaa

SEQ ID NO: 782673 - DNA, 20 bp, Artificial
  CRISPR gRNA sequence
aaaaagtaaatttttgcctg

SEQ ID NO: 782674 - DNA, 20 bp, Artificial
  CRISPR gRNA sequence
aatttttgcctgaagatgtt

SEQ ID NO: 782675 - DNA, 20 bp, Artificial
  CRISPR gRNA sequence
tttggaaaaaataccaaata

SEQ ID NO: 782676 - DNA, 20 bp, Artificial
  CRISPR gRNA sequence
gaaaaaataccaaataaagt

SEQ ID NO: 782677 - DNA, 20 bp, Artificial
  CRISPR gRNA sequence
aaataccaaataaagtgaga

SEQ ID NO: 782678 - DNA, 20 bp, Artificial
  CRISPR gRNA sequence
taccaaataaagtgagatag

SEQ ID NO: 782679 - DNA, 20 bp, Artificial
  CRISPR gRNA sequence
accaaataaagtgagatagt

SEQ ID NO: 782680 - DNA, 20 bp, Artificial
  CRISPR gRNA sequence
aagtgagatagtgggtaatc

SEQ ID NO: 782681 - DNA, 20 bp, Artificial
  CRISPR gRNA sequence
ttatttttccgtcctctttc

SEQ ID NO: 782682 - DNA, 20 bp, Artificial
  CRISPR gRNA sequence
tccaattgtgaaataattta

SEQ ID NO: 782683 - DNA, 20 bp, Artificial
  CRISPR gRNA sequence
gaaataatttatagcactgt

SEQ ID NO: 782684 - DNA, 20 bp, Artificial
  CRISPR gRNA sequence
taatttatagcactgtaaga

SEQ ID NO: 782685 - DNA, 20 bp, Artificial
  CRISPR gRNA sequence
tttatagcactgtaagaaag

SEQ ID NO: 782686 - DNA, 20 bp, Artificial
  CRISPR gRNA sequence
aagaaagaagccacaaattg

SEQ ID NO: 782687 - DNA, 20 bp, Artificial
  CRISPR gRNA sequence
aaagaagccacaaattgtgg

SEQ ID NO: 782688 - DNA, 20 bp, Artificial
  CRISPR gRNA sequence
agccacaaattgtggtagct

SEQ ID NO: 782689 - DNA, 20 bp, Artificial
  CRISPR gRNA sequence
tggtagcttggaccactgtt

SEQ ID NO: 782690 - DNA, 20 bp, Artificial
  CRISPR gRNA sequence
ggtagcttggaccactgttg

SEQ ID NO: 782691 - DNA, 20 bp, Artificial
  CRISPR gRNA sequence
cttggaccactgttgaggtc

SEQ ID NO: 782692 - DNA, 20 bp, Artificial
  CRISPR gRNA sequence
ccactgttgaggtctggaat

SEQ ID NO: 782693 - DNA, 20 bp, Artificial
  CRISPR gRNA sequence
gaattccaatgttcaaatat

SEQ ID NO: 782694 - DNA, 20 bp, Artificial
  CRISPR gRNA sequence
tgttcaaatattggtcctac

SEQ ID NO: 782695 - DNA, 20 bp, Artificial
  CRISPR gRNA sequence
atattggtcctaccagttat

SEQ ID NO: 782696 - DNA, 20 bp, Artificial
  CRISPR gRNA sequence
acactcaacttctctatctt

SEQ ID NO: 782697 - DNA, 20 bp, Artificial
  CRISPR gRNA sequence
tatcttcagtaaccgtccac

SEQ ID NO: 782698 - DNA, 20 bp, Artificial
  CRISPR gRNA sequence
cagtaaccgtccacaagaat

SEQ ID NO: 782699 - DNA, 20 bp, Artificial
  CRISPR gRNA sequence
agtaaccgtccacaagaatt

SEQ ID NO: 782700 - DNA, 20 bp, Artificial
  CRISPR gRNA sequence
tgccatctttattgcattgt

SEQ ID NO: 782701 - DNA, 20 bp, Artificial
  CRISPR gRNA sequence
attaaataattcaatatatg

SEQ ID NO: 782702 - DNA, 20 bp, Artificial
  CRISPR gRNA sequence
aattcaatatatgtggaaaa

SEQ ID NO: 782703 - DNA, 20 bp, Artificial
  CRISPR gRNA sequence
tgtggaaaatagcatgatat

SEQ ID NO: 782704 - DNA, 20 bp, Artificial
  CRISPR gRNA sequence
gtggaaaatagcatgatatc

SEQ ID NO: 782705 - DNA, 20 bp, Artificial
  CRISPR gRNA sequence
tggaaaatagcatgatatca

SEQ ID NO: 782706 - DNA, 20 bp, Artificial
  CRISPR gRNA sequence
ccattattacttaatattga

SEQ ID NO: 782707 - DNA, 20 bp, Artificial
  CRISPR gRNA sequence
ataattttattcatttcaca

SEQ ID NO: 782708 - DNA, 20 bp, Artificial
  CRISPR gRNA sequence
tattcatttcacatggcatg

SEQ ID NO: 782709 - DNA, 20 bp, Artificial
  CRISPR gRNA sequence
ttcacatggcatgaagtacc

SEQ ID NO: 782710 - DNA, 20 bp, Artificial
  CRISPR gRNA sequence
gcatgaagtaccaagctcta

SEQ ID NO: 782711 - DNA, 20 bp, Artificial
  CRISPR gRNA sequence
catgaagtaccaagctctat

SEQ ID NO: 782712 - DNA, 20 bp, Artificial
  CRISPR gRNA sequence
gtaccaagctctataggaat

SEQ ID NO: 782713 - DNA, 20 bp, Artificial
  CRISPR gRNA sequence
tctataggaatcagaaaata

SEQ ID NO: 782714 - DNA, 20 bp, Artificial
  CRISPR gRNA sequence
tctttttcttctctattgtc

SEQ ID NO: 782715 - DNA, 20 bp, Artificial
  CRISPR gRNA sequence
ctctattgtccagcttccta

SEQ ID NO: 782716 - DNA, 20 bp, Artificial
  CRISPR gRNA sequence
tctattgtccagcttcctac

SEQ ID NO: 782717 - DNA, 20 bp, Artificial
  CRISPR gRNA sequence
aaataaacactcacatccta

SEQ ID NO: 782718 - DNA, 20 bp, Artificial
  CRISPR gRNA sequence
aataaacactcacatcctaa

SEQ ID NO: 782719 - DNA, 20 bp, Artificial
  CRISPR gRNA sequence
cactcacatcctaaaggttc

SEQ ID NO: 782720 - DNA, 20 bp, Artificial
  CRISPR gRNA sequence
catcctaaaggttccagaaa

SEQ ID NO: 782721 - DNA, 20 bp, Artificial
  CRISPR gRNA sequence
taaaggttccagaaacagat

SEQ ID NO: 782722 - DNA, 20 bp, Artificial
  CRISPR gRNA sequence
aaaggttccagaaacagatg

SEQ ID NO: 782723 - DNA, 20 bp, Artificial
  CRISPR gRNA sequence
ggttccagaaacagatgagg

SEQ ID NO: 782724 - DNA, 20 bp, Artificial
  CRISPR gRNA sequence
ttccagaaacagatgaggta

SEQ ID NO: 782725 - DNA, 20 bp, Artificial
  CRISPR gRNA sequence
atgaggtagagctcacctgc

SEQ ID NO: 782726 - DNA, 20 bp, Artificial
  CRISPR gRNA sequence
tgaggtagagctcacctgcc

SEQ ID NO: 782727 - DNA, 20 bp, Artificial
  CRISPR gRNA sequence
agagctcacctgccaggcta

SEQ ID NO: 782728 - DNA, 20 bp, Artificial
  CRISPR gRNA sequence
gagctcacctgccaggctac

SEQ ID NO: 782729 - DNA, 20 bp, Artificial
  CRISPR gRNA sequence
ccaggctacaggttatcctc

SEQ ID NO: 782730 - DNA, 20 bp, Artificial
  CRISPR gRNA sequence
ggctacaggttatcctctgg

SEQ ID NO: 782731 - DNA, 20 bp, Artificial
  CRISPR gRNA sequence
tacaggttatcctctggcag

SEQ ID NO: 782732 - DNA, 20 bp, Artificial
  CRISPR gRNA sequence
atcctctggcagaagtatcc

SEQ ID NO: 782733 - DNA, 20 bp, Artificial
  CRISPR gRNA sequence
gaagtatcctggccaaacgt

SEQ ID NO: 782734 - DNA, 20 bp, Artificial
  CRISPR gRNA sequence
gtcagcgttcctgccaacac

SEQ ID NO: 782735 - DNA, 20 bp, Artificial
  CRISPR gRNA sequence
cctgccaacaccagccactc

SEQ ID NO: 782736 - DNA, 20 bp, Artificial
  CRISPR gRNA sequence
ctgccaacaccagccactcc

SEQ ID NO: 782737 - DNA, 20 bp, Artificial
  CRISPR gRNA sequence
cagccactccaggacccctg

SEQ ID NO: 782738 - DNA, 20 bp, Artificial
  CRISPR gRNA sequence
agccactccaggacccctga

SEQ ID NO: 782739 - DNA, 20 bp, Artificial
  CRISPR gRNA sequence
ggacccctgaaggcctctac

SEQ ID NO: 782740 - DNA, 20 bp, Artificial
  CRISPR gRNA sequence
gacccctgaaggcctctacc

SEQ ID NO: 782741 - DNA, 20 bp, Artificial
  CRISPR gRNA sequence
gaaggcctctaccaggtcac

SEQ ID NO: 782742 - DNA, 20 bp, Artificial
  CRISPR gRNA sequence
tcaccagtgttctgcgccta

SEQ ID NO: 782743 - DNA, 20 bp, Artificial
  CRISPR gRNA sequence
ctgcgcctaaagccaccccc

SEQ ID NO: 782744 - DNA, 20 bp, Artificial
  CRISPR gRNA sequence
cgcctaaagccaccccctgg

SEQ ID NO: 782745 - DNA, 20 bp, Artificial
  CRISPR gRNA sequence
ccaccccctggcagaaactt

SEQ ID NO: 782746 - DNA, 20 bp, Artificial
  CRISPR gRNA sequence
gaaacttcagctgtgtgttc

SEQ ID NO: 782747 - DNA, 20 bp, Artificial
  CRISPR gRNA sequence
gtgttctggaatactcacgt

SEQ ID NO: 782748 - DNA, 20 bp, Artificial
  CRISPR gRNA sequence
tgttctggaatactcacgtg

SEQ ID NO: 782749 - DNA, 20 bp, Artificial
  CRISPR gRNA sequence
gttctggaatactcacgtga

SEQ ID NO: 782750 - DNA, 20 bp, Artificial
  CRISPR gRNA sequence
tcacgtgagggaacttactt

SEQ ID NO: 782751 - DNA, 20 bp, Artificial
  CRISPR gRNA sequence
gtgagggaacttactttggc

SEQ ID NO: 782752 - DNA, 20 bp, Artificial
  CRISPR gRNA sequence
ttggccagcattgaccttca

SEQ ID NO: 782753 - DNA, 20 bp, Artificial
  CRISPR gRNA sequence
ccagcattgaccttcaaagt

SEQ ID NO: 782754 - DNA, 20 bp, Artificial
  CRISPR gRNA sequence
agcattgaccttcaaagtaa

SEQ ID NO: 782755 - DNA, 20 bp, Artificial
  CRISPR gRNA sequence
taagagctgcccccacttcc

SEQ ID NO: 782756 - DNA, 20 bp, Artificial
  CRISPR gRNA sequence
aagagctgcccccacttcct

SEQ ID NO: 782757 - DNA, 20 bp, Artificial
  CRISPR gRNA sequence
cccccacttcctaggtctat

SEQ ID NO: 782758 - DNA, 20 bp, Artificial
  CRISPR gRNA sequence
cacttcctaggtctatcagt

SEQ ID NO: 782759 - DNA, 20 bp, Artificial
  CRISPR gRNA sequence
acttcctaggtctatcagtt

SEQ ID NO: 782760 - DNA, 20 bp, Artificial
  CRISPR gRNA sequence
cttcctaggtctatcagtta

SEQ ID NO: 782761 - DNA, 20 bp, Artificial
  CRISPR gRNA sequence
taggtctatcagttagggtt

SEQ ID NO: 782762 - DNA, 20 bp, Artificial
  CRISPR gRNA sequence
ctatcagttagggttcagac

SEQ ID NO: 782763 - DNA, 20 bp, Artificial
  CRISPR gRNA sequence
gttagggttcagacaagaaa

SEQ ID NO: 782764 - DNA, 20 bp, Artificial
  CRISPR gRNA sequence
gggttcagacaagaaacaga

SEQ ID NO: 782765 - DNA, 20 bp, Artificial
  CRISPR gRNA sequence
aagaaacagatggcatactc

SEQ ID NO: 782766 - DNA, 20 bp, Artificial
  CRISPR gRNA sequence
atggcatactcgagtgattt

SEQ ID NO: 782767 - DNA, 20 bp, Artificial
  CRISPR gRNA sequence
tggcatactcgagtgatttg

SEQ ID NO: 782768 - DNA, 20 bp, Artificial
  CRISPR gRNA sequence
gcatactcgagtgatttgag

SEQ ID NO: 782769 - DNA, 20 bp, Artificial
  CRISPR gRNA sequence
atactcgagtgatttgagga

SEQ ID NO: 782770 - DNA, 20 bp, Artificial
  CRISPR gRNA sequence
gatttgaggagagtgtaata

SEQ ID NO: 782771 - DNA, 20 bp, Artificial
  CRISPR gRNA sequence
atttgaggagagtgtaataa

SEQ ID NO: 782772 - DNA, 20 bp, Artificial
  CRISPR gRNA sequence
tttgaggagagtgtaataaa

SEQ ID NO: 782773 - DNA, 20 bp, Artificial
  CRISPR gRNA sequence
taataaagggactgtttaca

SEQ ID NO: 782774 - DNA, 20 bp, Artificial
  CRISPR gRNA sequence
aataaagggactgtttacaa

SEQ ID NO: 782775 - DNA, 20 bp, Artificial
  CRISPR gRNA sequence
acaaaggtgtgatcaccatt

SEQ ID NO: 782776 - DNA, 20 bp, Artificial
  CRISPR gRNA sequence
aaaggtgtgatcaccatttg

SEQ ID NO: 782777 - DNA, 20 bp, Artificial
  CRISPR gRNA sequence
caccatttggagaaactaca

SEQ ID NO: 782778 - DNA, 20 bp, Artificial
  CRISPR gRNA sequence
accatttggagaaactacaa

SEQ ID NO: 782779 - DNA, 20 bp, Artificial
  CRISPR gRNA sequence
tttggagaaactacaaagga

SEQ ID NO: 782780 - DNA, 20 bp, Artificial
  CRISPR gRNA sequence
agaaactacaaaggatagtg

SEQ ID NO: 782781 - DNA, 20 bp, Artificial
  CRISPR gRNA sequence
caaaggatagtgcagaacac

SEQ ID NO: 782782 - DNA, 20 bp, Artificial
  CRISPR gRNA sequence
aaaggatagtgcagaacact

SEQ ID NO: 782783 - DNA, 20 bp, Artificial
  CRISPR gRNA sequence
aaggatagtgcagaacactg

SEQ ID NO: 782784 - DNA, 20 bp, Artificial
  CRISPR gRNA sequence
gaacactggggcttcaatgt

SEQ ID NO: 782785 - DNA, 20 bp, Artificial
  CRISPR gRNA sequence
aacactggggcttcaatgtt

SEQ ID NO: 782786 - DNA, 20 bp, Artificial
  CRISPR gRNA sequence
cactggggcttcaatgttgg

SEQ ID NO: 782787 - DNA, 20 bp, Artificial
  CRISPR gRNA sequence
actggggcttcaatgttggg

SEQ ID NO: 782788 - DNA, 20 bp, Artificial
  CRISPR gRNA sequence
ctggggcttcaatgttggga

SEQ ID NO: 782789 - DNA, 20 bp, Artificial
  CRISPR gRNA sequence
gggagggcaattaccactgt

SEQ ID NO: 782790 - DNA, 20 bp, Artificial
  CRISPR gRNA sequence
gagggcaattaccactgttg

SEQ ID NO: 782791 - DNA, 20 bp, Artificial
  CRISPR gRNA sequence
ggcaattaccactgttggag

SEQ ID NO: 782792 - DNA, 20 bp, Artificial
  CRISPR gRNA sequence
accactgttggagaagttac

SEQ ID NO: 782793 - DNA, 20 bp, Artificial
  CRISPR gRNA sequence
gttggagaagttactggaat

SEQ ID NO: 782794 - DNA, 20 bp, Artificial
  CRISPR gRNA sequence
ggagaagttactggaatcag

SEQ ID NO: 782795 - DNA, 20 bp, Artificial
  CRISPR gRNA sequence
gagaagttactggaatcaga

SEQ ID NO: 782796 - DNA, 20 bp, Artificial
  CRISPR gRNA sequence
agaagttactggaatcagaa

SEQ ID NO: 782797 - DNA, 20 bp, Artificial
  CRISPR gRNA sequence
aagttactggaatcagaagg

SEQ ID NO: 782798 - DNA, 20 bp, Artificial
  CRISPR gRNA sequence
ctggaatcagaagggagctg

SEQ ID NO: 782799 - DNA, 20 bp, Artificial
  CRISPR gRNA sequence
tggaatcagaagggagctgt

SEQ ID NO: 782800 - DNA, 20 bp, Artificial
  CRISPR gRNA sequence
ggaatcagaagggagctgta

SEQ ID NO: 782801 - DNA, 20 bp, Artificial
  CRISPR gRNA sequence
tcagaagggagctgtaggga

SEQ ID NO: 782802 - DNA, 20 bp, Artificial
  CRISPR gRNA sequence
gtagggaaagccccacttcc

SEQ ID NO: 782803 - DNA, 20 bp, Artificial
  CRISPR gRNA sequence
tagggaaagccccacttccc

SEQ ID NO: 782804 - DNA, 20 bp, Artificial
  CRISPR gRNA sequence
gggaaagccccacttcccag

SEQ ID NO: 782805 - DNA, 20 bp, Artificial
  CRISPR gRNA sequence
gccccacttcccaggagctg

SEQ ID NO: 782806 - DNA, 20 bp, Artificial
  CRISPR gRNA sequence
cttcccaggagctgtagcca

SEQ ID NO: 782807 - DNA, 20 bp, Artificial
  CRISPR gRNA sequence
caggagctgtagccacagaa

SEQ ID NO: 782808 - DNA, 20 bp, Artificial
  CRISPR gRNA sequence
aggagctgtagccacagaat

SEQ ID NO: 782809 - DNA, 20 bp, Artificial
  CRISPR gRNA sequence
ggagctgtagccacagaata

SEQ ID NO: 782810 - DNA, 20 bp, Artificial
  CRISPR gRNA sequence
gctgtagccacagaataggg

SEQ ID NO: 782811 - DNA, 20 bp, Artificial
  CRISPR gRNA sequence
aatagggaagctgccacatg

SEQ ID NO: 782812 - DNA, 20 bp, Artificial
  CRISPR gRNA sequence
tgccacatgcagcgactcca

SEQ ID NO: 782813 - DNA, 20 bp, Artificial
  CRISPR gRNA sequence
gccacatgcagcgactccaa

SEQ ID NO: 782814 - DNA, 20 bp, Artificial
  CRISPR gRNA sequence
ccacatgcagcgactccaaa

SEQ ID NO: 782815 - DNA, 20 bp, Artificial
  CRISPR gRNA sequence
catgcagcgactccaaaggg

SEQ ID NO: 782816 - DNA, 20 bp, Artificial
  CRISPR gRNA sequence
cgactccaaagggtggaaac

SEQ ID NO: 782817 - DNA, 20 bp, Artificial
  CRISPR gRNA sequence
cccaccctccaatctcctgc

SEQ ID NO: 782818 - DNA, 20 bp, Artificial
  CRISPR gRNA sequence
ctcctgctagcacctcccat

SEQ ID NO: 782819 - DNA, 20 bp, Artificial
  CRISPR gRNA sequence
cacctcccattggctgaacc

SEQ ID NO: 782820 - DNA, 20 bp, Artificial
  CRISPR gRNA sequence
tcccattggctgaacccagc

SEQ ID NO: 782821 - DNA, 20 bp, Artificial
  CRISPR gRNA sequence
cattggctgaacccagctag

SEQ ID NO: 782822 - DNA, 20 bp, Artificial
  CRISPR gRNA sequence
ggctgaacccagctagaagt

SEQ ID NO: 782823 - DNA, 20 bp, Artificial
  CRISPR gRNA sequence
ctgaacccagctagaagtca

SEQ ID NO: 782824 - DNA, 20 bp, Artificial
  CRISPR gRNA sequence
agctagaagtcagagaatac

SEQ ID NO: 782825 - DNA, 20 bp, Artificial
  CRISPR gRNA sequence
gctagaagtcagagaataca

SEQ ID NO: 782826 - DNA, 20 bp, Artificial
  CRISPR gRNA sequence
ctagaagtcagagaatacaa

SEQ ID NO: 782827 - DNA, 20 bp, Artificial
  CRISPR gRNA sequence
tccactgttgtattccataa

SEQ ID NO: 782828 - DNA, 20 bp, Artificial
  CRISPR gRNA sequence
ttccataaaagtcaacttct

SEQ ID NO: 782829 - DNA, 20 bp, Artificial
  CRISPR gRNA sequence
tccataaaagtcaacttctc

SEQ ID NO: 782830 - DNA, 20 bp, Artificial
  CRISPR gRNA sequence
ccataaaagtcaacttctca

SEQ ID NO: 782831 - DNA, 20 bp, Artificial
  CRISPR gRNA sequence
aaagtcaacttctcagggct

SEQ ID NO: 782832 - DNA, 20 bp, Artificial
  CRISPR gRNA sequence
agtcaacttctcagggctca

SEQ ID NO: 782833 - DNA, 20 bp, Artificial
  CRISPR gRNA sequence
cagagcaatattgacatgta

SEQ ID NO: 782834 - DNA, 20 bp, Artificial
  CRISPR gRNA sequence
caatattgacatgtacagaa

SEQ ID NO: 782835 - DNA, 20 bp, Artificial
  CRISPR gRNA sequence
tgacatgtacagaatagatc

SEQ ID NO: 782836 - DNA, 20 bp, Artificial
  CRISPR gRNA sequence
acatgtacagaatagatctg

SEQ ID NO: 782837 - DNA, 20 bp, Artificial
  CRISPR gRNA sequence
atgtacagaatagatctgga

SEQ ID NO: 782838 - DNA, 20 bp, Artificial
  CRISPR gRNA sequence
tgtacagaatagatctggag

SEQ ID NO: 782839 - DNA, 20 bp, Artificial
  CRISPR gRNA sequence
gaatagatctggagaggaaa

SEQ ID NO: 782840 - DNA, 20 bp, Artificial
  CRISPR gRNA sequence
gagaggaaacagaaaatatc

SEQ ID NO: 782841 - DNA, 20 bp, Artificial
  CRISPR gRNA sequence
acagaaaatatctagtacaa

SEQ ID NO: 782842 - DNA, 20 bp, Artificial
  CRISPR gRNA sequence
taatcactgtgattcatgca

SEQ ID NO: 782843 - DNA, 20 bp, Artificial
  CRISPR gRNA sequence
tgattcatgcacagtgtcat

SEQ ID NO: 782844 - DNA, 20 bp, Artificial
  CRISPR gRNA sequence
tcatgcacagtgtcatgagc

SEQ ID NO: 782845 - DNA, 20 bp, Artificial
  CRISPR gRNA sequence
tgcacagtgtcatgagccag

SEQ ID NO: 782846 - DNA, 20 bp, Artificial
  CRISPR gRNA sequence
gcacagtgtcatgagccagc

SEQ ID NO: 782847 - DNA, 20 bp, Artificial
  CRISPR gRNA sequence
tcctttgctgtacttgctgc

SEQ ID NO: 782848 - DNA, 20 bp, Artificial
  CRISPR gRNA sequence
ttgctgtacttgctgccagt

SEQ ID NO: 782849 - DNA, 20 bp, Artificial
  CRISPR gRNA sequence
tgtacttgctgccagtcagc

SEQ ID NO: 782850 - DNA, 20 bp, Artificial
  CRISPR gRNA sequence
tgctgccagtcagctggtta

SEQ ID NO: 782851 - DNA, 20 bp, Artificial
  CRISPR gRNA sequence
gctgccagtcagctggttat

SEQ ID NO: 782852 - DNA, 20 bp, Artificial
  CRISPR gRNA sequence
agctggttatgggtttttcc

SEQ ID NO: 782853 - DNA, 20 bp, Artificial
  CRISPR gRNA sequence
atgggtttttccaagaaatt

SEQ ID NO: 782854 - DNA, 20 bp, Artificial
  CRISPR gRNA sequence
tggtctctaacaaaattctt

SEQ ID NO: 782855 - DNA, 20 bp, Artificial
  CRISPR gRNA sequence
gtctctaacaaaattcttca

SEQ ID NO: 782856 - DNA, 20 bp, Artificial
  CRISPR gRNA sequence
agagcctttactgactatgc

SEQ ID NO: 782857 - DNA, 20 bp, Artificial
  CRISPR gRNA sequence
ctgactatgctggatatttt

SEQ ID NO: 782858 - DNA, 20 bp, Artificial
  CRISPR gRNA sequence
actatgctggatatttttgg

SEQ ID NO: 782859 - DNA, 20 bp, Artificial
  CRISPR gRNA sequence
ctatgctggatatttttgga

SEQ ID NO: 782860 - DNA, 20 bp, Artificial
  CRISPR gRNA sequence
tatgctggatatttttggaa

SEQ ID NO: 782861 - DNA, 20 bp, Artificial
  CRISPR gRNA sequence
ccatacttttgaacttcata

SEQ ID NO: 782862 - DNA, 20 bp, Artificial
  CRISPR gRNA sequence
tacttttgaacttcatacag

SEQ ID NO: 782863 - DNA, 20 bp, Artificial
  CRISPR gRNA sequence
agcagaatttcaaacaatct

SEQ ID NO: 782864 - DNA, 20 bp, Artificial
  CRISPR gRNA sequence
gcagaatttcaaacaatctt

SEQ ID NO: 782865 - DNA, 20 bp, Artificial
  CRISPR gRNA sequence
aataacaacttttatctgcc

SEQ ID NO: 782866 - DNA, 20 bp, Artificial
  CRISPR gRNA sequence
acaacttttatctgcccagt

SEQ ID NO: 782867 - DNA, 20 bp, Artificial
  CRISPR gRNA sequence
caacttttatctgcccagta

SEQ ID NO: 782868 - DNA, 20 bp, Artificial
  CRISPR gRNA sequence
cagtaaggacaactaacacc

SEQ ID NO: 782869 - DNA, 20 bp, Artificial
  CRISPR gRNA sequence
tagtatcataatcatttcgt

SEQ ID NO: 782870 - DNA, 20 bp, Artificial
  CRISPR gRNA sequence
gtatcataatcatttcgtaa

SEQ ID NO: 782871 - DNA, 20 bp, Artificial
  CRISPR gRNA sequence
cataatcatttcgtaagaga

SEQ ID NO: 782872 - DNA, 20 bp, Artificial
  CRISPR gRNA sequence
ataatcatttcgtaagagac

SEQ ID NO: 782873 - DNA, 20 bp, Artificial
  CRISPR gRNA sequence
agacaggtaatttcatcacc

SEQ ID NO: 782874 - DNA, 20 bp, Artificial
  CRISPR gRNA sequence
ctcttatatcaaattaccac

SEQ ID NO: 782875 - DNA, 20 bp, Artificial
  CRISPR gRNA sequence
tcaaattaccacaagcttca

SEQ ID NO: 782876 - DNA, 20 bp, Artificial
  CRISPR gRNA sequence
taccacaagcttcacagttt

SEQ ID NO: 782877 - DNA, 20 bp, Artificial
  CRISPR gRNA sequence
cttcacagtttaagacaaca

SEQ ID NO: 782878 - DNA, 20 bp, Artificial
  CRISPR gRNA sequence
gatttattatctgatactta

SEQ ID NO: 782879 - DNA, 20 bp, Artificial
  CRISPR gRNA sequence
tttattatctgatacttatg

SEQ ID NO: 782880 - DNA, 20 bp, Artificial
  CRISPR gRNA sequence
ttattatctgatacttatgg

SEQ ID NO: 782881 - DNA, 20 bp, Artificial
  CRISPR gRNA sequence
tatctgatacttatggaggt

SEQ ID NO: 782882 - DNA, 20 bp, Artificial
  CRISPR gRNA sequence
tgatacttatggaggtcaga

SEQ ID NO: 782883 - DNA, 20 bp, Artificial
  CRISPR gRNA sequence
acttatggaggtcagaaagc

SEQ ID NO: 782884 - DNA, 20 bp, Artificial
  CRISPR gRNA sequence
gaggtcagaaagccagactt

SEQ ID NO: 782885 - DNA, 20 bp, Artificial
  CRISPR gRNA sequence
aagccagacttgagtttcac

SEQ ID NO: 782886 - DNA, 20 bp, Artificial
  CRISPR gRNA sequence
agccagacttgagtttcact

SEQ ID NO: 782887 - DNA, 20 bp, Artificial
  CRISPR gRNA sequence
agtttcactgggctcaaatc

SEQ ID NO: 782888 - DNA, 20 bp, Artificial
  CRISPR gRNA sequence
gtttcactgggctcaaatca

SEQ ID NO: 782889 - DNA, 20 bp, Artificial
  CRISPR gRNA sequence
ctgggctcaaatcaaggtgt

SEQ ID NO: 782890 - DNA, 20 bp, Artificial
  CRISPR gRNA sequence
ggctcaaatcaaggtgtcag

SEQ ID NO: 782891 - DNA, 20 bp, Artificial
  CRISPR gRNA sequence
gctcaaatcaaggtgtcagc

SEQ ID NO: 782892 - DNA, 20 bp, Artificial
  CRISPR gRNA sequence
tcaaggtgtcagcaggattg

SEQ ID NO: 782893 - DNA, 20 bp, Artificial
  CRISPR gRNA sequence
aaggtgtcagcaggattgca

SEQ ID NO: 782894 - DNA, 20 bp, Artificial
  CRISPR gRNA sequence
aggtgtcagcaggattgcag

SEQ ID NO: 782895 - DNA, 20 bp, Artificial
  CRISPR gRNA sequence
agcaggattgcagaggccct

SEQ ID NO: 782896 - DNA, 20 bp, Artificial
  CRISPR gRNA sequence
gcaggattgcagaggcccta

SEQ ID NO: 782897 - DNA, 20 bp, Artificial
  CRISPR gRNA sequence
caggattgcagaggccctaa

SEQ ID NO: 782898 - DNA, 20 bp, Artificial
  CRISPR gRNA sequence
gattgcagaggccctaaggg

SEQ ID NO: 782899 - DNA, 20 bp, Artificial
  CRISPR gRNA sequence
ttccactttcctgtcttttc

SEQ ID NO: 782900 - DNA, 20 bp, Artificial
  CRISPR gRNA sequence
ttcctgtcttttccagctgc

SEQ ID NO: 782901 - DNA, 20 bp, Artificial
  CRISPR gRNA sequence
cctgtcttttccagctgcta

SEQ ID NO: 782902 - DNA, 20 bp, Artificial
  CRISPR gRNA sequence
ctgtcttttccagctgctag

SEQ ID NO: 782903 - DNA, 20 bp, Artificial
  CRISPR gRNA sequence
cacctgcattaattgcctca

SEQ ID NO: 782904 - DNA, 20 bp, Artificial
  CRISPR gRNA sequence
atggcccctccctctatctt

SEQ ID NO: 782905 - DNA, 20 bp, Artificial
  CRISPR gRNA sequence
ggcccctccctctatcttca

SEQ ID NO: 782906 - DNA, 20 bp, Artificial
  CRISPR gRNA sequence
gcccctccctctatcttcag

SEQ ID NO: 782907 - DNA, 20 bp, Artificial
  CRISPR gRNA sequence
cctccctctatcttcagagg

SEQ ID NO: 782908 - DNA, 20 bp, Artificial
  CRISPR gRNA sequence
gaggcagcaaccctatcatt

SEQ ID NO: 782909 - DNA, 20 bp, Artificial
  CRISPR gRNA sequence
tctctctctttttttttttt

SEQ ID NO: 782910 - DNA, 20 bp, Artificial
  CRISPR gRNA sequence
tcttttttttttttgagatg

SEQ ID NO: 782911 - DNA, 20 bp, Artificial
  CRISPR gRNA sequence
tgaagtcttattctgccccc

SEQ ID NO: 782912 - DNA, 20 bp, Artificial
  CRISPR gRNA sequence
gaagtcttattctgcccccc

SEQ ID NO: 782913 - DNA, 20 bp, Artificial
  CRISPR gRNA sequence
tcttattctgccccccaggc

SEQ ID NO: 782914 - DNA, 20 bp, Artificial
  CRISPR gRNA sequence
ctgccccccaggctggaatg

SEQ ID NO: 782915 - DNA, 20 bp, Artificial
  CRISPR gRNA sequence
ccccccaggctggaatgcag

SEQ ID NO: 782916 - DNA, 20 bp, Artificial
  CRISPR gRNA sequence
ggaatgcagtggcacgatcc

SEQ ID NO: 782917 - DNA, 20 bp, Artificial
  CRISPR gRNA sequence
tcactgcaacccctgcctcc

SEQ ID NO: 782918 - DNA, 20 bp, Artificial
  CRISPR gRNA sequence
cactgcaacccctgcctccc

SEQ ID NO: 782919 - DNA, 20 bp, Artificial
  CRISPR gRNA sequence
aacccctgcctcccgggttc

SEQ ID NO: 782920 - DNA, 20 bp, Artificial
  CRISPR gRNA sequence
ttcaagctattctcctgtct

SEQ ID NO: 782921 - DNA, 20 bp, Artificial
  CRISPR gRNA sequence
ttctcctgtctcagcctcct

SEQ ID NO: 782922 - DNA, 20 bp, Artificial
  CRISPR gRNA sequence
tcctgtctcagcctcctgag

SEQ ID NO: 782923 - DNA, 20 bp, Artificial
  CRISPR gRNA sequence
gtctcagcctcctgagtagc

SEQ ID NO: 782924 - DNA, 20 bp, Artificial
  CRISPR gRNA sequence
tctcagcctcctgagtagct

SEQ ID NO: 782925 - DNA, 20 bp, Artificial
  CRISPR gRNA sequence
ctcctgagtagctgggatta

SEQ ID NO: 782926 - DNA, 20 bp, Artificial
  CRISPR gRNA sequence
tcctgagtagctgggattac

SEQ ID NO: 782927 - DNA, 20 bp, Artificial
  CRISPR gRNA sequence
caggcacatgccaacatgcc

SEQ ID NO: 782928 - DNA, 20 bp, Artificial
  CRISPR gRNA sequence
ctggctaatttttgtatttt

SEQ ID NO: 782929 - DNA, 20 bp, Artificial
  CRISPR gRNA sequence
gctaatttttgtatttttag

SEQ ID NO: 782930 - DNA, 20 bp, Artificial
  CRISPR gRNA sequence
taatttttgtatttttagta

SEQ ID NO: 782931 - DNA, 20 bp, Artificial
  CRISPR gRNA sequence
ttttgtatttttagtagaga

SEQ ID NO: 782932 - DNA, 20 bp, Artificial
  CRISPR gRNA sequence
tttgtatttttagtagagat

SEQ ID NO: 782933 - DNA, 20 bp, Artificial
  CRISPR gRNA sequence
agagatgggtttcaccatgt

SEQ ID NO: 782934 - DNA, 20 bp, Artificial
  CRISPR gRNA sequence
atgggtttcaccatgttggc

SEQ ID NO: 782935 - DNA, 20 bp, Artificial
  CRISPR gRNA sequence
tgggtttcaccatgttggcc

SEQ ID NO: 782936 - DNA, 20 bp, Artificial
  CRISPR gRNA sequence
tttcaccatgttggccaggc

SEQ ID NO: 782937 - DNA, 20 bp, Artificial
  CRISPR gRNA sequence
tggtctcaaactcctgacct

SEQ ID NO: 782938 - DNA, 20 bp, Artificial
  CRISPR gRNA sequence
ggtctcaaactcctgacctc

SEQ ID NO: 782939 - DNA, 20 bp, Artificial
  CRISPR gRNA sequence
ctcaggtgatccgcccgcct

SEQ ID NO: 782940 - DNA, 20 bp, Artificial
  CRISPR gRNA sequence
gcctcagcctcccaaattgc

SEQ ID NO: 782941 - DNA, 20 bp, Artificial
  CRISPR gRNA sequence
cctcagcctcccaaattgct

SEQ ID NO: 782942 - DNA, 20 bp, Artificial
  CRISPR gRNA sequence
ctcccaaattgctaggatta

SEQ ID NO: 782943 - DNA, 20 bp, Artificial
  CRISPR gRNA sequence
tcccaaattgctaggattac

SEQ ID NO: 782944 - DNA, 20 bp, Artificial
  CRISPR gRNA sequence
attgctaggattacaggcgt

SEQ ID NO: 782945 - DNA, 20 bp, Artificial
  CRISPR gRNA sequence
caggcgtgagccatcatgat

SEQ ID NO: 782946 - DNA, 20 bp, Artificial
  CRISPR gRNA sequence
gccacatctctttccctaac

SEQ ID NO: 782947 - DNA, 20 bp, Artificial
  CRISPR gRNA sequence
gcttctctttgccacctctt

SEQ ID NO: 782948 - DNA, 20 bp, Artificial
  CRISPR gRNA sequence
cttctctttgccacctctta

SEQ ID NO: 782949 - DNA, 20 bp, Artificial
  CRISPR gRNA sequence
aaggacccttgtgattgcat

SEQ ID NO: 782950 - DNA, 20 bp, Artificial
  CRISPR gRNA sequence
aggacccttgtgattgcatt

SEQ ID NO: 782951 - DNA, 20 bp, Artificial
  CRISPR gRNA sequence
cattaggtactccatccccc

SEQ ID NO: 782952 - DNA, 20 bp, Artificial
  CRISPR gRNA sequence
actccatccccctggttatt

SEQ ID NO: 782953 - DNA, 20 bp, Artificial
  CRISPR gRNA sequence
ctccatccccctggttattt

SEQ ID NO: 782954 - DNA, 20 bp, Artificial
  CRISPR gRNA sequence
tccatccccctggttatttg

SEQ ID NO: 782955 - DNA, 20 bp, Artificial
  CRISPR gRNA sequence
tggggtgatcttcccatctc

SEQ ID NO: 782956 - DNA, 20 bp, Artificial
  CRISPR gRNA sequence
ggggtgatcttcccatctca

SEQ ID NO: 782957 - DNA, 20 bp, Artificial
  CRISPR gRNA sequence
caaaattccttttgccatgt

SEQ ID NO: 782958 - DNA, 20 bp, Artificial
  CRISPR gRNA sequence
aaaattccttttgccatgta

SEQ ID NO: 782959 - DNA, 20 bp, Artificial
  CRISPR gRNA sequence
ggtgacatattcacatgttc

SEQ ID NO: 782960 - DNA, 20 bp, Artificial
  CRISPR gRNA sequence
gtgacatattcacatgttcc

SEQ ID NO: 782961 - DNA, 20 bp, Artificial
  CRISPR gRNA sequence
tgacatattcacatgttcca

SEQ ID NO: 782962 - DNA, 20 bp, Artificial
  CRISPR gRNA sequence
tattcacatgttccagggat

SEQ ID NO: 782963 - DNA, 20 bp, Artificial
  CRISPR gRNA sequence
atgttccagggattagaata

SEQ ID NO: 782964 - DNA, 20 bp, Artificial
  CRISPR gRNA sequence
gattagaatatggacatctt

SEQ ID NO: 782965 - DNA, 20 bp, Artificial
  CRISPR gRNA sequence
attagaatatggacatcttt

SEQ ID NO: 782966 - DNA, 20 bp, Artificial
  CRISPR gRNA sequence
ttagaatatggacatctttg

SEQ ID NO: 782967 - DNA, 20 bp, Artificial
  CRISPR gRNA sequence
agaatatggacatctttggg

SEQ ID NO: 782968 - DNA, 20 bp, Artificial
  CRISPR gRNA sequence
aatatggacatctttgggga

SEQ ID NO: 782969 - DNA, 20 bp, Artificial
  CRISPR gRNA sequence
ataattttatttatcctact

SEQ ID NO: 782970 - DNA, 20 bp, Artificial
  CRISPR gRNA sequence
attttatttatcctactgag

SEQ ID NO: 782971 - DNA, 20 bp, Artificial
  CRISPR gRNA sequence
ttttatttatcctactgaga

SEQ ID NO: 782972 - DNA, 20 bp, Artificial
  CRISPR gRNA sequence
tttatttatcctactgagaa

SEQ ID NO: 782973 - DNA, 20 bp, Artificial
  CRISPR gRNA sequence
actgagaagggatatactct

SEQ ID NO: 782974 - DNA, 20 bp, Artificial
  CRISPR gRNA sequence
agggatatactctcagacta

SEQ ID NO: 782975 - DNA, 20 bp, Artificial
  CRISPR gRNA sequence
gggatatactctcagactaa

SEQ ID NO: 782976 - DNA, 20 bp, Artificial
  CRISPR gRNA sequence
tatactctcagactaaagga

SEQ ID NO: 782977 - DNA, 20 bp, Artificial
  CRISPR gRNA sequence
tcagactaaaggacagtccc

SEQ ID NO: 782978 - DNA, 20 bp, Artificial
  CRISPR gRNA sequence
tccctagtactgattcaatc

SEQ ID NO: 782979 - DNA, 20 bp, Artificial
  CRISPR gRNA sequence
actgattcaatctggcttta

SEQ ID NO: 782980 - DNA, 20 bp, Artificial
  CRISPR gRNA sequence
tatattgtcattgtatttca

SEQ ID NO: 782981 - DNA, 20 bp, Artificial
  CRISPR gRNA sequence
tcacagtttgccctttgtct

SEQ ID NO: 782982 - DNA, 20 bp, Artificial
  CRISPR gRNA sequence
agtttgccctttgtcttagc

SEQ ID NO: 782983 - DNA, 20 bp, Artificial
  CRISPR gRNA sequence
tgccctttgtcttagctggt

SEQ ID NO: 782984 - DNA, 20 bp, Artificial
  CRISPR gRNA sequence
ctttgtcttagctggtaaga

SEQ ID NO: 782985 - DNA, 20 bp, Artificial
  CRISPR gRNA sequence
ttgtcttagctggtaagaca

SEQ ID NO: 782986 - DNA, 20 bp, Artificial
  CRISPR gRNA sequence
ggtaagacagagcctatgat

SEQ ID NO: 782987 - DNA, 20 bp, Artificial
  CRISPR gRNA sequence
gtaagacagagcctatgata

SEQ ID NO: 782988 - DNA, 20 bp, Artificial
  CRISPR gRNA sequence
gcctatgataaggacttgtg

SEQ ID NO: 782989 - DNA, 20 bp, Artificial
  CRISPR gRNA sequence
ataaggacttgtgtggcatg

SEQ ID NO: 782990 - DNA, 20 bp, Artificial
  CRISPR gRNA sequence
taaggacttgtgtggcatgc

SEQ ID NO: 782991 - DNA, 20 bp, Artificial
  CRISPR gRNA sequence
gtggcatgcaggtatttaat

SEQ ID NO: 782992 - DNA, 20 bp, Artificial
  CRISPR gRNA sequence
aggtatttaattggcaaccc

SEQ ID NO: 782993 - DNA, 20 bp, Artificial
  CRISPR gRNA sequence
gtatttaattggcaacccca

SEQ ID NO: 782994 - DNA, 20 bp, Artificial
  CRISPR gRNA sequence
tatttaattggcaaccccag

SEQ ID NO: 782995 - DNA, 20 bp, Artificial
  CRISPR gRNA sequence
atttaattggcaaccccaga

SEQ ID NO: 782996 - DNA, 20 bp, Artificial
  CRISPR gRNA sequence
taattggcaaccccagaggg

SEQ ID NO: 782997 - DNA, 20 bp, Artificial
  CRISPR gRNA sequence
ttggcaaccccagagggcag

SEQ ID NO: 782998 - DNA, 20 bp, Artificial
  CRISPR gRNA sequence
caaccccagagggcagaagc

SEQ ID NO: 782999 - DNA, 20 bp, Artificial
  CRISPR gRNA sequence
accccagagggcagaagcaa

SEQ ID NO: 783000 - DNA, 20 bp, Artificial
  CRISPR gRNA sequence
gagggcagaagcaagagatt

SEQ ID NO: 783001 - DNA, 20 bp, Artificial
  CRISPR gRNA sequence
agggcagaagcaagagattt

SEQ ID NO: 783002 - DNA, 20 bp, Artificial
  CRISPR gRNA sequence
ggcagaagcaagagatttag

SEQ ID NO: 783003 - DNA, 20 bp, Artificial
  CRISPR gRNA sequence
agcaagagatttaggagttt

SEQ ID NO: 783004 - DNA, 20 bp, Artificial
  CRISPR gRNA sequence
caagagatttaggagtttaa

SEQ ID NO: 783005 - DNA, 20 bp, Artificial
  CRISPR gRNA sequence
agagatttaggagtttaaga

SEQ ID NO: 783006 - DNA, 20 bp, Artificial
  CRISPR gRNA sequence
gagatttaggagtttaagag

SEQ ID NO: 783007 - DNA, 20 bp, Artificial
  CRISPR gRNA sequence
agatttaggagtttaagaga

SEQ ID NO: 783008 - DNA, 20 bp, Artificial
  CRISPR gRNA sequence
agtttaagagagggtaatat

SEQ ID NO: 783009 - DNA, 20 bp, Artificial
  CRISPR gRNA sequence
tttaagagagggtaatataa

SEQ ID NO: 783010 - DNA, 20 bp, Artificial
  CRISPR gRNA sequence
aatataagagtatattatca

SEQ ID NO: 783011 - DNA, 20 bp, Artificial
  CRISPR gRNA sequence
agagtatattatcaaagttg

SEQ ID NO: 783012 - DNA, 20 bp, Artificial
  CRISPR gRNA sequence
atattatcaaagttgtagtg

SEQ ID NO: 783013 - DNA, 20 bp, Artificial
  CRISPR gRNA sequence
caaagttgtagtgtggacaa

SEQ ID NO: 783014 - DNA, 20 bp, Artificial
  CRISPR gRNA sequence
caacagaaactcaaatattc

SEQ ID NO: 783015 - DNA, 20 bp, Artificial
  CRISPR gRNA sequence
aacagaaactcaaatattca

SEQ ID NO: 783016 - DNA, 20 bp, Artificial
  CRISPR gRNA sequence
aaactcaaatattcaaggac

SEQ ID NO: 783017 - DNA, 20 bp, Artificial
  CRISPR gRNA sequence
aatattcaaggaccagcatg

SEQ ID NO: 783018 - DNA, 20 bp, Artificial
  CRISPR gRNA sequence
ttcaaggaccagcatgtaga

SEQ ID NO: 783019 - DNA, 20 bp, Artificial
  CRISPR gRNA sequence
cagcatgtagacagcctcct

SEQ ID NO: 783020 - DNA, 20 bp, Artificial
  CRISPR gRNA sequence
agcctcctaagatgtctact

SEQ ID NO: 783021 - DNA, 20 bp, Artificial
  CRISPR gRNA sequence
ctaagatgtctactcagaca

SEQ ID NO: 783022 - DNA, 20 bp, Artificial
  CRISPR gRNA sequence
tctactcagacaaagaattt

SEQ ID NO: 783023 - DNA, 20 bp, Artificial
  CRISPR gRNA sequence
ctactcagacaaagaatttc

SEQ ID NO: 783024 - DNA, 20 bp, Artificial
  CRISPR gRNA sequence
ctcagacaaagaatttcagg

SEQ ID NO: 783025 - DNA, 20 bp, Artificial
  CRISPR gRNA sequence
agacaaagaatttcaggtgg

SEQ ID NO: 783026 - DNA, 20 bp, Artificial
  CRISPR gRNA sequence
gacaaagaatttcaggtgga

SEQ ID NO: 783027 - DNA, 20 bp, Artificial
  CRISPR gRNA sequence
ttcatctgcttcacgcccat

SEQ ID NO: 783028 - DNA, 20 bp, Artificial
  CRISPR gRNA sequence
gcttcacgcccattggttga

SEQ ID NO: 783029 - DNA, 20 bp, Artificial
  CRISPR gRNA sequence
cttcacgcccattggttgac

SEQ ID NO: 783030 - DNA, 20 bp, Artificial
  CRISPR gRNA sequence
tatgaactccattctgctgc

SEQ ID NO: 783031 - DNA, 20 bp, Artificial
  CRISPR gRNA sequence
atgaactccattctgctgct

SEQ ID NO: 783032 - DNA, 20 bp, Artificial
  CRISPR gRNA sequence
actccattctgctgctgggc

SEQ ID NO: 783033 - DNA, 20 bp, Artificial
  CRISPR gRNA sequence
tgctgggctagacatgcatg

SEQ ID NO: 783034 - DNA, 20 bp, Artificial
  CRISPR gRNA sequence
gctgggctagacatgcatgt

SEQ ID NO: 783035 - DNA, 20 bp, Artificial
  CRISPR gRNA sequence
gctagacatgcatgtgggct

SEQ ID NO: 783036 - DNA, 20 bp, Artificial
  CRISPR gRNA sequence
gacatgcatgtgggctgagt

SEQ ID NO: 783037 - DNA, 20 bp, Artificial
  CRISPR gRNA sequence
tgggctgagtgagctttccc

SEQ ID NO: 783038 - DNA, 20 bp, Artificial
  CRISPR gRNA sequence
tgagctttccccagtatccg

SEQ ID NO: 783039 - DNA, 20 bp, Artificial
  CRISPR gRNA sequence
ttccccagtatccgtagcat

SEQ ID NO: 783040 - DNA, 20 bp, Artificial
  CRISPR gRNA sequence
cagtatccgtagcatcagaa

SEQ ID NO: 783041 - DNA, 20 bp, Artificial
  CRISPR gRNA sequence
ccgtagcatcagaaaagtcg

SEQ ID NO: 783042 - DNA, 20 bp, Artificial
  CRISPR gRNA sequence
cgtagcatcagaaaagtcgc

SEQ ID NO: 783043 - DNA, 20 bp, Artificial
  CRISPR gRNA sequence
gtagcatcagaaaagtcgca

SEQ ID NO: 783044 - DNA, 20 bp, Artificial
  CRISPR gRNA sequence
gcatcagaaaagtcgcaggg

SEQ ID NO: 783045 - DNA, 20 bp, Artificial
  CRISPR gRNA sequence
cagaaaagtcgcagggcaga

SEQ ID NO: 783046 - DNA, 20 bp, Artificial
  CRISPR gRNA sequence
aagtcgcagggcagaaagaa

SEQ ID NO: 783047 - DNA, 20 bp, Artificial
  CRISPR gRNA sequence
gaaagaaaagtatccaattt

SEQ ID NO: 783048 - DNA, 20 bp, Artificial
  CRISPR gRNA sequence
aaagaaaagtatccaatttg

SEQ ID NO: 783049 - DNA, 20 bp, Artificial
  CRISPR gRNA sequence
gaggtgaattactgaccttg

SEQ ID NO: 783050 - DNA, 20 bp, Artificial
  CRISPR gRNA sequence
tgaattactgaccttgaagt

SEQ ID NO: 783051 - DNA, 20 bp, Artificial
  CRISPR gRNA sequence
actgaccttgaagtgagtgt

SEQ ID NO: 783052 - DNA, 20 bp, Artificial
  CRISPR gRNA sequence
gaagtgagtgtaagcctaac

SEQ ID NO: 783053 - DNA, 20 bp, Artificial
  CRISPR gRNA sequence
gcctaactagaattctaccc

SEQ ID NO: 783054 - DNA, 20 bp, Artificial
  CRISPR gRNA sequence
aactagaattctaccccagc

SEQ ID NO: 783055 - DNA, 20 bp, Artificial
  CRISPR gRNA sequence
aattctaccccagctggctg

SEQ ID NO: 783056 - DNA, 20 bp, Artificial
  CRISPR gRNA sequence
accccagctggctgaagtga

SEQ ID NO: 783057 - DNA, 20 bp, Artificial
  CRISPR gRNA sequence
ccccagctggctgaagtgaa

SEQ ID NO: 783058 - DNA, 20 bp, Artificial
  CRISPR gRNA sequence
agctggctgaagtgaaaggt

SEQ ID NO: 783059 - DNA, 20 bp, Artificial
  CRISPR gRNA sequence
gctggctgaagtgaaaggtg

SEQ ID NO: 783060 - DNA, 20 bp, Artificial
  CRISPR gRNA sequence
ctgaagtgaaaggtgaggct

SEQ ID NO: 783061 - DNA, 20 bp, Artificial
  CRISPR gRNA sequence
gaagtgaaaggtgaggctga

SEQ ID NO: 783062 - DNA, 20 bp, Artificial
  CRISPR gRNA sequence
aagtgaaaggtgaggctgag

SEQ ID NO: 783063 - DNA, 20 bp, Artificial
  CRISPR gRNA sequence
aggtgaggctgagaggaaat

SEQ ID NO: 783064 - DNA, 20 bp, Artificial
  CRISPR gRNA sequence
ggtgaggctgagaggaaata

SEQ ID NO: 783065 - DNA, 20 bp, Artificial
  CRISPR gRNA sequence
gaggctgagaggaaataagg

SEQ ID NO: 783066 - DNA, 20 bp, Artificial
  CRISPR gRNA sequence
aggctgagaggaaataaggc

SEQ ID NO: 783067 - DNA, 20 bp, Artificial
  CRISPR gRNA sequence
ggaaataaggcaggactgca

SEQ ID NO: 783068 - DNA, 20 bp, Artificial
  CRISPR gRNA sequence
atccactcatgcccttcatt

SEQ ID NO: 783069 - DNA, 20 bp, Artificial
  CRISPR gRNA sequence
actcatgcccttcattaagt

SEQ ID NO: 783070 - DNA, 20 bp, Artificial
  CRISPR gRNA sequence
attaagtcagctctgccact

SEQ ID NO: 783071 - DNA, 20 bp, Artificial
  CRISPR gRNA sequence
agctctgccactgagccttc

SEQ ID NO: 783072 - DNA, 20 bp, Artificial
  CRISPR gRNA sequence
ctgccactgagccttccagc

SEQ ID NO: 783073 - DNA, 20 bp, Artificial
  CRISPR gRNA sequence
tgccactgagccttccagct

SEQ ID NO: 783074 - DNA, 20 bp, Artificial
  CRISPR gRNA sequence
ccactgagccttccagctgg

SEQ ID NO: 783075 - DNA, 20 bp, Artificial
  CRISPR gRNA sequence
cactgagccttccagctggg

SEQ ID NO: 783076 - DNA, 20 bp, Artificial
  CRISPR gRNA sequence
tgagccttccagctgggagg

SEQ ID NO: 783077 - DNA, 20 bp, Artificial
  CRISPR gRNA sequence
ggaggcagccacaatctctg

SEQ ID NO: 783078 - DNA, 20 bp, Artificial
  CRISPR gRNA sequence
ggcagccacaatctctgcag

SEQ ID NO: 783079 - DNA, 20 bp, Artificial
  CRISPR gRNA sequence
gcagaagatttaatatacac

SEQ ID NO: 783080 - DNA, 20 bp, Artificial
  CRISPR gRNA sequence
atttaatatacaccagtttg

SEQ ID NO: 783081 - DNA, 20 bp, Artificial
  CRISPR gRNA sequence
tatacaccagtttgtggaac

SEQ ID NO: 783082 - DNA, 20 bp, Artificial
  CRISPR gRNA sequence
ccagtttgtggaacaagctg

SEQ ID NO: 783083 - DNA, 20 bp, Artificial
  CRISPR gRNA sequence
tgtagttcctgctgctgctg

SEQ ID NO: 783084 - DNA, 20 bp, Artificial
  CRISPR gRNA sequence
ctgctgctgctgtggatccc

SEQ ID NO: 783085 - DNA, 20 bp, Artificial
  CRISPR gRNA sequence
ctgctgtggatcccaagcca

SEQ ID NO: 783086 - DNA, 20 bp, Artificial
  CRISPR gRNA sequence
cactcatccaccatacattc

SEQ ID NO: 783087 - DNA, 20 bp, Artificial
  CRISPR gRNA sequence
atttccctcacctaacaccc

SEQ ID NO: 783088 - DNA, 20 bp, Artificial
  CRISPR gRNA sequence
ccctcacctaacaccccaga

SEQ ID NO: 783089 - DNA, 20 bp, Artificial
  CRISPR gRNA sequence
acctaacaccccagatggaa

SEQ ID NO: 783090 - DNA, 20 bp, Artificial
  CRISPR gRNA sequence
ggaatggtttctttgcctga

SEQ ID NO: 783091 - DNA, 20 bp, Artificial
  CRISPR gRNA sequence
gaatggtttctttgcctgat

SEQ ID NO: 783092 - DNA, 20 bp, Artificial
  CRISPR gRNA sequence
aatggtttctttgcctgata

SEQ ID NO: 783093 - DNA, 20 bp, Artificial
  CRISPR gRNA sequence
ctttgcctgatagggtgacc

SEQ ID NO: 783094 - DNA, 20 bp, Artificial
  CRISPR gRNA sequence
gacccagacttaacgaccct

SEQ ID NO: 783095 - DNA, 20 bp, Artificial
  CRISPR gRNA sequence
cccagacttaacgaccctaa

SEQ ID NO: 783096 - DNA, 20 bp, Artificial
  CRISPR gRNA sequence
ttaacgaccctaagagatct

SEQ ID NO: 783097 - DNA, 20 bp, Artificial
  CRISPR gRNA sequence
aagagatctgagcttttgat

SEQ ID NO: 783098 - DNA, 20 bp, Artificial
  CRISPR gRNA sequence
tttgatcagcatgcccttaa

SEQ ID NO: 783099 - DNA, 20 bp, Artificial
  CRISPR gRNA sequence
tcagcatgcccttaacagac

SEQ ID NO: 783100 - DNA, 20 bp, Artificial
  CRISPR gRNA sequence
cagcatgcccttaacagact

SEQ ID NO: 783101 - DNA, 20 bp, Artificial
  CRISPR gRNA sequence
agcatgcccttaacagactg

SEQ ID NO: 783102 - DNA, 20 bp, Artificial
  CRISPR gRNA sequence
aaatatcttttcattatcac

SEQ ID NO: 783103 - DNA, 20 bp, Artificial
  CRISPR gRNA sequence
cttttcattatcactggata

SEQ ID NO: 783104 - DNA, 20 bp, Artificial
  CRISPR gRNA sequence
ttcattatcactggatatgg

SEQ ID NO: 783105 - DNA, 20 bp, Artificial
  CRISPR gRNA sequence
tcactggatatggaagtaaa

SEQ ID NO: 783106 - DNA, 20 bp, Artificial
  CRISPR gRNA sequence
gatatggaagtaaaaagaac

SEQ ID NO: 783107 - DNA, 20 bp, Artificial
  CRISPR gRNA sequence
agtaaaaagaaccagtgaat

SEQ ID NO: 783108 - DNA, 20 bp, Artificial
  CRISPR gRNA sequence
aaaaagaaccagtgaatcag

SEQ ID NO: 783109 - DNA, 20 bp, Artificial
  CRISPR gRNA sequence
cagtgaatcagcggacccct

SEQ ID NO: 783110 - DNA, 20 bp, Artificial
  CRISPR gRNA sequence
atcagcggacccctgagttc

SEQ ID NO: 783111 - DNA, 20 bp, Artificial
  CRISPR gRNA sequence
tcttccttgtctccattatg

SEQ ID NO: 783112 - DNA, 20 bp, Artificial
  CRISPR gRNA sequence
tccttgtctccattatgtag

SEQ ID NO: 783113 - DNA, 20 bp, Artificial
  CRISPR gRNA sequence
tccattatgtagcagtgttc

SEQ ID NO: 783114 - DNA, 20 bp, Artificial
  CRISPR gRNA sequence
tcaagattttcatgataatc

SEQ ID NO: 783115 - DNA, 20 bp, Artificial
  CRISPR gRNA sequence
atcaagattgatttctccac

SEQ ID NO: 783116 - DNA, 20 bp, Artificial
  CRISPR gRNA sequence
gattgatttctccaccagta

SEQ ID NO: 783117 - DNA, 20 bp, Artificial
  CRISPR gRNA sequence
taatttttttctttgctcac

SEQ ID NO: 783118 - DNA, 20 bp, Artificial
  CRISPR gRNA sequence
ctcactggtctgccaatatt

SEQ ID NO: 783119 - DNA, 20 bp, Artificial
  CRISPR gRNA sequence
cactggtctgccaatattaa

SEQ ID NO: 783120 - DNA, 20 bp, Artificial
  CRISPR gRNA sequence
tctgccaatattaagagctc

SEQ ID NO: 783121 - DNA, 20 bp, Artificial
  CRISPR gRNA sequence
ctgccaatattaagagctca

SEQ ID NO: 783122 - DNA, 20 bp, Artificial
  CRISPR gRNA sequence
ccaatattaagagctcaagg

SEQ ID NO: 783123 - DNA, 20 bp, Artificial
  CRISPR gRNA sequence
tattaagagctcaaggtggc

SEQ ID NO: 783124 - DNA, 20 bp, Artificial
  CRISPR gRNA sequence
attaagagctcaaggtggcc

SEQ ID NO: 783125 - DNA, 20 bp, Artificial
  CRISPR gRNA sequence
agagctcaaggtggccaggc

SEQ ID NO: 783126 - DNA, 20 bp, Artificial
  CRISPR gRNA sequence
gctcaaggtggccaggccag

SEQ ID NO: 783127 - DNA, 20 bp, Artificial
  CRISPR gRNA sequence
caaggtggccaggccagtag

SEQ ID NO: 783128 - DNA, 20 bp, Artificial
  CRISPR gRNA sequence
aggtggccaggccagtagca

SEQ ID NO: 783129 - DNA, 20 bp, Artificial
  CRISPR gRNA sequence
ccaggccagtagcagagctt

SEQ ID NO: 783130 - DNA, 20 bp, Artificial
  CRISPR gRNA sequence
cagtagcagagctttagatg

SEQ ID NO: 783131 - DNA, 20 bp, Artificial
  CRISPR gRNA sequence
tagcagagctttagatgcag

SEQ ID NO: 783132 - DNA, 20 bp, Artificial
  CRISPR gRNA sequence
agctttagatgcagtagaac

SEQ ID NO: 783133 - DNA, 20 bp, Artificial
  CRISPR gRNA sequence
tttagatgcagtagaacaag

SEQ ID NO: 783134 - DNA, 20 bp, Artificial
  CRISPR gRNA sequence
tagatgcagtagaacaagca

SEQ ID NO: 783135 - DNA, 20 bp, Artificial
  CRISPR gRNA sequence
acaagcagagtatcccctgc

SEQ ID NO: 783136 - DNA, 20 bp, Artificial
  CRISPR gRNA sequence
tcccctgctagaattccccg

SEQ ID NO: 783137 - DNA, 20 bp, Artificial
  CRISPR gRNA sequence
cccctgctagaattccccgt

SEQ ID NO: 783138 - DNA, 20 bp, Artificial
  CRISPR gRNA sequence
ctgctagaattccccgtagg

SEQ ID NO: 783139 - DNA, 20 bp, Artificial
  CRISPR gRNA sequence
tagaattccccgtaggaagc

SEQ ID NO: 783140 - DNA, 20 bp, Artificial
  CRISPR gRNA sequence
aggaagccagacctttgatt

SEQ ID NO: 783141 - DNA, 20 bp, Artificial
  CRISPR gRNA sequence
aagccagacctttgattcag

SEQ ID NO: 783142 - DNA, 20 bp, Artificial
  CRISPR gRNA sequence
gccagacctttgattcagca

SEQ ID NO: 783143 - DNA, 20 bp, Artificial
  CRISPR gRNA sequence
ttcagcagagcctaaatgtg

SEQ ID NO: 783144 - DNA, 20 bp, Artificial
  CRISPR gRNA sequence
tcagcagagcctaaatgtgt

SEQ ID NO: 783145 - DNA, 20 bp, Artificial
  CRISPR gRNA sequence
cagcagagcctaaatgtgtg

SEQ ID NO: 783146 - DNA, 20 bp, Artificial
  CRISPR gRNA sequence
gagcctaaatgtgtggggtt

SEQ ID NO: 783147 - DNA, 20 bp, Artificial
  CRISPR gRNA sequence
ttgagtgaacttctatacgt

SEQ ID NO: 783148 - DNA, 20 bp, Artificial
  CRISPR gRNA sequence
aacttctatacgtgagtcat

SEQ ID NO: 783149 - DNA, 20 bp, Artificial
  CRISPR gRNA sequence
ttctatacgtgagtcattag

SEQ ID NO: 783150 - DNA, 20 bp, Artificial
  CRISPR gRNA sequence
acgtgagtcattagaagtaa

SEQ ID NO: 783151 - DNA, 20 bp, Artificial
  CRISPR gRNA sequence
gagtcattagaagtaatggt

SEQ ID NO: 783152 - DNA, 20 bp, Artificial
  CRISPR gRNA sequence
gtcattagaagtaatggtga

SEQ ID NO: 783153 - DNA, 20 bp, Artificial
  CRISPR gRNA sequence
tcattagaagtaatggtgag

SEQ ID NO: 783154 - DNA, 20 bp, Artificial
  CRISPR gRNA sequence
cattagaagtaatggtgaga

SEQ ID NO: 783155 - DNA, 20 bp, Artificial
  CRISPR gRNA sequence
attagaagtaatggtgagag

SEQ ID NO: 783156 - DNA, 20 bp, Artificial
  CRISPR gRNA sequence
tggtgagaggggccaacctg

SEQ ID NO: 783157 - DNA, 20 bp, Artificial
  CRISPR gRNA sequence
gaggggccaacctgcagcac

SEQ ID NO: 783158 - DNA, 20 bp, Artificial
  CRISPR gRNA sequence
aggggccaacctgcagcact

SEQ ID NO: 783159 - DNA, 20 bp, Artificial
  CRISPR gRNA sequence
gccaacctgcagcactggga

SEQ ID NO: 783160 - DNA, 20 bp, Artificial
  CRISPR gRNA sequence
ctgcagcactgggatagccc

SEQ ID NO: 783161 - DNA, 20 bp, Artificial
  CRISPR gRNA sequence
gcactgggatagccctggta

SEQ ID NO: 783162 - DNA, 20 bp, Artificial
  CRISPR gRNA sequence
ggatagccctggtacagacg

SEQ ID NO: 783163 - DNA, 20 bp, Artificial
  CRISPR gRNA sequence
tacagacgtagaacatgctt

SEQ ID NO: 783164 - DNA, 20 bp, Artificial
  CRISPR gRNA sequence
acagacgtagaacatgcttg

SEQ ID NO: 783165 - DNA, 20 bp, Artificial
  CRISPR gRNA sequence
agacgtagaacatgcttgag

SEQ ID NO: 783166 - DNA, 20 bp, Artificial
  CRISPR gRNA sequence
gacgtagaacatgcttgagg

SEQ ID NO: 783167 - DNA, 20 bp, Artificial
  CRISPR gRNA sequence
aacatgcttgaggaggttgt

SEQ ID NO: 783168 - DNA, 20 bp, Artificial
  CRISPR gRNA sequence
acatgcttgaggaggttgtc

SEQ ID NO: 783169 - DNA, 20 bp, Artificial
  CRISPR gRNA sequence
atgcttgaggaggttgtcag

SEQ ID NO: 783170 - DNA, 20 bp, Artificial
  CRISPR gRNA sequence
tgcttgaggaggttgtcagg

SEQ ID NO: 783171 - DNA, 20 bp, Artificial
  CRISPR gRNA sequence
ggaggttgtcaggaggaaat

SEQ ID NO: 783172 - DNA, 20 bp, Artificial
  CRISPR gRNA sequence
gttgtcaggaggaaatgagt

SEQ ID NO: 783173 - DNA, 20 bp, Artificial
  CRISPR gRNA sequence
gaaatgagttagaccttgca

SEQ ID NO: 783174 - DNA, 20 bp, Artificial
  CRISPR gRNA sequence
tgcacagaactaccaccatc

SEQ ID NO: 783175 - DNA, 20 bp, Artificial
  CRISPR gRNA sequence
agaactaccaccatcaagta

SEQ ID NO: 783176 - DNA, 20 bp, Artificial
  CRISPR gRNA sequence
ctaccaccatcaagtacagt

SEQ ID NO: 783177 - DNA, 20 bp, Artificial
  CRISPR gRNA sequence
taccaccatcaagtacagtt

SEQ ID NO: 783178 - DNA, 20 bp, Artificial
  CRISPR gRNA sequence
accaccatcaagtacagttg

SEQ ID NO: 783179 - DNA, 20 bp, Artificial
  CRISPR gRNA sequence
ccatcaagtacagttggggt

SEQ ID NO: 783180 - DNA, 20 bp, Artificial
  CRISPR gRNA sequence
catcaagtacagttggggtg

SEQ ID NO: 783181 - DNA, 20 bp, Artificial
  CRISPR gRNA sequence
caagtacagttggggtgagg

SEQ ID NO: 783182 - DNA, 20 bp, Artificial
  CRISPR gRNA sequence
cagttggggtgaggcagaca

SEQ ID NO: 783183 - DNA, 20 bp, Artificial
  CRISPR gRNA sequence
gggtgaggcagacatggtat

SEQ ID NO: 783184 - DNA, 20 bp, Artificial
  CRISPR gRNA sequence
aggcagacatggtatgagtt

SEQ ID NO: 783185 - DNA, 20 bp, Artificial
  CRISPR gRNA sequence
ggcagacatggtatgagttg

SEQ ID NO: 783186 - DNA, 20 bp, Artificial
  CRISPR gRNA sequence
catggtatgagttgaggcat

SEQ ID NO: 783187 - DNA, 20 bp, Artificial
  CRISPR gRNA sequence
tggtatgagttgaggcatca

SEQ ID NO: 783188 - DNA, 20 bp, Artificial
  CRISPR gRNA sequence
aattaaaattaattttttca

SEQ ID NO: 783189 - DNA, 20 bp, Artificial
  CRISPR gRNA sequence
ttaaaattaattttttcatg

SEQ ID NO: 783190 - DNA, 20 bp, Artificial
  CRISPR gRNA sequence
catggagtgacactgatcca

SEQ ID NO: 783191 - DNA, 20 bp, Artificial
  CRISPR gRNA sequence
agtgacactgatccacagac

SEQ ID NO: 783192 - DNA, 20 bp, Artificial
  CRISPR gRNA sequence
tgatccacagaccagactcc

SEQ ID NO: 783193 - DNA, 20 bp, Artificial
  CRISPR gRNA sequence
accagactccaagaactttg

SEQ ID NO: 783194 - DNA, 20 bp, Artificial
  CRISPR gRNA sequence
ccatctcatcataactttcc

SEQ ID NO: 783195 - DNA, 20 bp, Artificial
  CRISPR gRNA sequence
actttcctggtattttcttc

SEQ ID NO: 783196 - DNA, 20 bp, Artificial
  CRISPR gRNA sequence
gaaaaaattcttccctgata

SEQ ID NO: 783197 - DNA, 20 bp, Artificial
  CRISPR gRNA sequence
ttcttccctgatacagtttt

SEQ ID NO: 783198 - DNA, 20 bp, Artificial
  CRISPR gRNA sequence
cttccctgatacagttttca

SEQ ID NO: 783199 - DNA, 20 bp, Artificial
  CRISPR gRNA sequence
ttccctgatacagttttcag

SEQ ID NO: 783200 - DNA, 20 bp, Artificial
  CRISPR gRNA sequence
cctgatacagttttcagagg

SEQ ID NO: 783201 - DNA, 20 bp, Artificial
  CRISPR gRNA sequence
atacagttttcagaggcagc

SEQ ID NO: 783202 - DNA, 20 bp, Artificial
  CRISPR gRNA sequence
actacccaatgccaacacta

SEQ ID NO: 783203 - DNA, 20 bp, Artificial
  CRISPR gRNA sequence
cccaatgccaacactaaagt

SEQ ID NO: 783204 - DNA, 20 bp, Artificial
  CRISPR gRNA sequence
cttccttctaactaaattat

SEQ ID NO: 783205 - DNA, 20 bp, Artificial
  CRISPR gRNA sequence
ttctaactaaattattagtt

SEQ ID NO: 783206 - DNA, 20 bp, Artificial
  CRISPR gRNA sequence
taactaaattattagtttag

SEQ ID NO: 783207 - DNA, 20 bp, Artificial
  CRISPR gRNA sequence
aactaaattattagtttaga

SEQ ID NO: 783208 - DNA, 20 bp, Artificial
  CRISPR gRNA sequence
aaattattagtttagaagga

SEQ ID NO: 783209 - DNA, 20 bp, Artificial
  CRISPR gRNA sequence
attattagtttagaaggaaa

SEQ ID NO: 783210 - DNA, 20 bp, Artificial
  CRISPR gRNA sequence
tattagtttagaaggaaaga

SEQ ID NO: 783211 - DNA, 20 bp, Artificial
  CRISPR gRNA sequence
attagtttagaaggaaagag

SEQ ID NO: 783212 - DNA, 20 bp, Artificial
  CRISPR gRNA sequence
tagtttagaaggaaagagag

SEQ ID NO: 783213 - DNA, 20 bp, Artificial
  CRISPR gRNA sequence
ggaaagagaggagtcatgct

SEQ ID NO: 783214 - DNA, 20 bp, Artificial
  CRISPR gRNA sequence
gaaagagaggagtcatgcta

SEQ ID NO: 783215 - DNA, 20 bp, Artificial
  CRISPR gRNA sequence
cttaactgaaatcaaaacat

SEQ ID NO: 783216 - DNA, 20 bp, Artificial
  CRISPR gRNA sequence
taactgaaatcaaaacatta

SEQ ID NO: 783217 - DNA, 20 bp, Artificial
  CRISPR gRNA sequence
aactgaaatcaaaacattag

SEQ ID NO: 783218 - DNA, 20 bp, Artificial
  CRISPR gRNA sequence
gaaatcaaaacattagaggc

SEQ ID NO: 783219 - DNA, 20 bp, Artificial
  CRISPR gRNA sequence
aaatcaaaacattagaggct

SEQ ID NO: 783220 - DNA, 20 bp, Artificial
  CRISPR gRNA sequence
aaaacattagaggctgggca

SEQ ID NO: 783221 - DNA, 20 bp, Artificial
  CRISPR gRNA sequence
acattagaggctgggcatgg

SEQ ID NO: 783222 - DNA, 20 bp, Artificial
  CRISPR gRNA sequence
gtggttcttgtctgtaatcc

SEQ ID NO: 783223 - DNA, 20 bp, Artificial
  CRISPR gRNA sequence
tgtctgtaatcccagcactt

SEQ ID NO: 783224 - DNA, 20 bp, Artificial
  CRISPR gRNA sequence
gtctgtaatcccagcacttt

SEQ ID NO: 783225 - DNA, 20 bp, Artificial
  CRISPR gRNA sequence
ctgtaatcccagcactttgg

SEQ ID NO: 783226 - DNA, 20 bp, Artificial
  CRISPR gRNA sequence
tgtaatcccagcactttggg

SEQ ID NO: 783227 - DNA, 20 bp, Artificial
  CRISPR gRNA sequence
tcccagcactttgggaggcc

SEQ ID NO: 783228 - DNA, 20 bp, Artificial
  CRISPR gRNA sequence
cccagcactttgggaggcca

SEQ ID NO: 783229 - DNA, 20 bp, Artificial
  CRISPR gRNA sequence
agcactttgggaggccaagg

SEQ ID NO: 783230 - DNA, 20 bp, Artificial
  CRISPR gRNA sequence
gcactttgggaggccaaggc

SEQ ID NO: 783231 - DNA, 20 bp, Artificial
  CRISPR gRNA sequence
actttgggaggccaaggcag

SEQ ID NO: 783232 - DNA, 20 bp, Artificial
  CRISPR gRNA sequence
ctttgggaggccaaggcagg

SEQ ID NO: 783233 - DNA, 20 bp, Artificial
  CRISPR gRNA sequence
ccaaggcaggaggatcactt

SEQ ID NO: 783234 - DNA, 20 bp, Artificial
  CRISPR gRNA sequence
gcaggaggatcacttgagcc

SEQ ID NO: 783235 - DNA, 20 bp, Artificial
  CRISPR gRNA sequence
ggaggatcacttgagcccag

SEQ ID NO: 783236 - DNA, 20 bp, Artificial
  CRISPR gRNA sequence
tcacttgagcccagtagatt

SEQ ID NO: 783237 - DNA, 20 bp, Artificial
  CRISPR gRNA sequence
cacttgagcccagtagattg

SEQ ID NO: 783238 - DNA, 20 bp, Artificial
  CRISPR gRNA sequence
agcccagtagattgaggtta

SEQ ID NO: 783239 - DNA, 20 bp, Artificial
  CRISPR gRNA sequence
cagtagattgaggttacagt

SEQ ID NO: 783240 - DNA, 20 bp, Artificial
  CRISPR gRNA sequence
tgtgccattgtactccactc

SEQ ID NO: 783241 - DNA, 20 bp, Artificial
  CRISPR gRNA sequence
cattgtactccactccagcc

SEQ ID NO: 783242 - DNA, 20 bp, Artificial
  CRISPR gRNA sequence
attgtactccactccagcct

SEQ ID NO: 783243 - DNA, 20 bp, Artificial
  CRISPR gRNA sequence
ccactccagcctgggcaacc

SEQ ID NO: 783244 - DNA, 20 bp, Artificial
  CRISPR gRNA sequence
tccagcctgggcaaccgagt

SEQ ID NO: 783245 - DNA, 20 bp, Artificial
  CRISPR gRNA sequence
gtgagactctgtctccaaaa

SEQ ID NO: 783246 - DNA, 20 bp, Artificial
  CRISPR gRNA sequence
actctgtctccaaaaaagaa

SEQ ID NO: 783247 - DNA, 20 bp, Artificial
  CRISPR gRNA sequence
ctctgtctccaaaaaagaaa

SEQ ID NO: 783248 - DNA, 20 bp, Artificial
  CRISPR gRNA sequence
gtctccaaaaaagaaaagga

SEQ ID NO: 783249 - DNA, 20 bp, Artificial
  CRISPR gRNA sequence
tctccaaaaaagaaaaggaa

SEQ ID NO: 783250 - DNA, 20 bp, Artificial
  CRISPR gRNA sequence
ctccaaaaaagaaaaggaaa

SEQ ID NO: 783251 - DNA, 20 bp, Artificial
  CRISPR gRNA sequence
tccaaaaaagaaaaggaaag

SEQ ID NO: 783252 - DNA, 20 bp, Artificial
  CRISPR gRNA sequence
caaaaaagaaaaggaaaggg

SEQ ID NO: 783253 - DNA, 20 bp, Artificial
  CRISPR gRNA sequence
aaaaagaaaaggaaagggga

SEQ ID NO: 783254 - DNA, 20 bp, Artificial
  CRISPR gRNA sequence
aaaagaaaaggaaaggggag

SEQ ID NO: 783255 - DNA, 20 bp, Artificial
  CRISPR gRNA sequence
aagaaaaggaaaggggagag

SEQ ID NO: 783256 - DNA, 20 bp, Artificial
  CRISPR gRNA sequence
agaaaaggaaaggggagagg

SEQ ID NO: 783257 - DNA, 20 bp, Artificial
  CRISPR gRNA sequence
gaaaaggaaaggggagagga

SEQ ID NO: 783258 - DNA, 20 bp, Artificial
  CRISPR gRNA sequence
aaaaggaaaggggagaggag

SEQ ID NO: 783259 - DNA, 20 bp, Artificial
  CRISPR gRNA sequence
aaggaaaggggagaggaggg

SEQ ID NO: 783260 - DNA, 20 bp, Artificial
  CRISPR gRNA sequence
ggaaaggggagaggagggga

SEQ ID NO: 783261 - DNA, 20 bp, Artificial
  CRISPR gRNA sequence
gaaaggggagaggaggggag

SEQ ID NO: 783262 - DNA, 20 bp, Artificial
  CRISPR gRNA sequence
aaggggagaggaggggagag

SEQ ID NO: 783263 - DNA, 20 bp, Artificial
  CRISPR gRNA sequence
aggggagaggaggggagagg

SEQ ID NO: 783264 - DNA, 20 bp, Artificial
  CRISPR gRNA sequence
ggagaggaggggagaggagg

SEQ ID NO: 783265 - DNA, 20 bp, Artificial
  CRISPR gRNA sequence
gagaggaggggagaggaggt

SEQ ID NO: 783266 - DNA, 20 bp, Artificial
  CRISPR gRNA sequence
agaggaggggagaggaggta

SEQ ID NO: 783267 - DNA, 20 bp, Artificial
  CRISPR gRNA sequence
aggaggggagaggaggtagg

SEQ ID NO: 783268 - DNA, 20 bp, Artificial
  CRISPR gRNA sequence
ggaggggagaggaggtaggg

SEQ ID NO: 783269 - DNA, 20 bp, Artificial
  CRISPR gRNA sequence
gaggggagaggaggtaggga

SEQ ID NO: 783270 - DNA, 20 bp, Artificial
  CRISPR gRNA sequence
aggggagaggaggtagggag

SEQ ID NO: 783271 - DNA, 20 bp, Artificial
  CRISPR gRNA sequence
gagaggaggtagggagggga

SEQ ID NO: 783272 - DNA, 20 bp, Artificial
  CRISPR gRNA sequence
ggaggtagggaggggaaaga

SEQ ID NO: 783273 - DNA, 20 bp, Artificial
  CRISPR gRNA sequence
gggaggggaaagaaagaaac

SEQ ID NO: 783274 - DNA, 20 bp, Artificial
  CRISPR gRNA sequence
aactagaaatccatcaattt

SEQ ID NO: 783275 - DNA, 20 bp, Artificial
  CRISPR gRNA sequence
actagaaatccatcaatttt

SEQ ID NO: 783276 - DNA, 20 bp, Artificial
  CRISPR gRNA sequence
atcaattttaggaccaactt

SEQ ID NO: 783277 - DNA, 20 bp, Artificial
  CRISPR gRNA sequence
tcaattttaggaccaacttc

SEQ ID NO: 783278 - DNA, 20 bp, Artificial
  CRISPR gRNA sequence
cttcaggtaaaaaaatgaat

SEQ ID NO: 783279 - DNA, 20 bp, Artificial
  CRISPR gRNA sequence
ttcaggtaaaaaaatgaatt

SEQ ID NO: 783280 - DNA, 20 bp, Artificial
  CRISPR gRNA sequence
ggtaaaaaaatgaattaggc

SEQ ID NO: 783281 - DNA, 20 bp, Artificial
  CRISPR gRNA sequence
aaaaaatgaattaggcaagt

SEQ ID NO: 783282 - DNA, 20 bp, Artificial
  CRISPR gRNA sequence
ctctacctctctttatatca

SEQ ID NO: 783283 - DNA, 20 bp, Artificial
  CRISPR gRNA sequence
cctctctttatatcatggtt

SEQ ID NO: 783284 - DNA, 20 bp, Artificial
  CRISPR gRNA sequence
ttatatcatggttgagacca

SEQ ID NO: 783285 - DNA, 20 bp, Artificial
  CRISPR gRNA sequence
acagacttctcacctcatga

SEQ ID NO: 783286 - DNA, 20 bp, Artificial
  CRISPR gRNA sequence
actctaactaattcatacta

SEQ ID NO: 783287 - DNA, 20 bp, Artificial
  CRISPR gRNA sequence
actaattcatactaaagcta

SEQ ID NO: 783288 - DNA, 20 bp, Artificial
  CRISPR gRNA sequence
tactaaagctaaagcctcta

SEQ ID NO: 783289 - DNA, 20 bp, Artificial
  CRISPR gRNA sequence
ctaaagctaaagcctctaaa

SEQ ID NO: 783290 - DNA, 20 bp, Artificial
  CRISPR gRNA sequence
taaagctaaagcctctaaag

SEQ ID NO: 783291 - DNA, 20 bp, Artificial
  CRISPR gRNA sequence
ctctaaagaggattaaatat

SEQ ID NO: 783292 - DNA, 20 bp, Artificial
  CRISPR gRNA sequence
ttaaatatgagcaatcccac

SEQ ID NO: 783293 - DNA, 20 bp, Artificial
  CRISPR gRNA sequence
ccacgagaacttttttcccc

SEQ ID NO: 783294 - DNA, 20 bp, Artificial
  CRISPR gRNA sequence
ttcaactgtcgttcgttata

SEQ ID NO: 783295 - DNA, 20 bp, Artificial
  CRISPR gRNA sequence
gttatatggaatttcctgcc

SEQ ID NO: 783296 - DNA, 20 bp, Artificial
  CRISPR gRNA sequence
atggaatttcctgcctggtt

SEQ ID NO: 783297 - DNA, 20 bp, Artificial
  CRISPR gRNA sequence
atttcctgcctggttaagtg

SEQ ID NO: 783298 - DNA, 20 bp, Artificial
  CRISPR gRNA sequence
tttcctgcctggttaagtgt

SEQ ID NO: 783299 - DNA, 20 bp, Artificial
  CRISPR gRNA sequence
ctgcctggttaagtgtaggc

SEQ ID NO: 783300 - DNA, 20 bp, Artificial
  CRISPR gRNA sequence
ttaagtgtaggccagtactt

SEQ ID NO: 783301 - DNA, 20 bp, Artificial
  CRISPR gRNA sequence
ccagtactttggatgaattg

SEQ ID NO: 783302 - DNA, 20 bp, Artificial
  CRISPR gRNA sequence
ttggatgaattgtagttttc

SEQ ID NO: 783303 - DNA, 20 bp, Artificial
  CRISPR gRNA sequence
atgaattgtagttttctaga

SEQ ID NO: 783304 - DNA, 20 bp, Artificial
  CRISPR gRNA sequence
tagaaagacgcttcttatat

SEQ ID NO: 783305 - DNA, 20 bp, Artificial
  CRISPR gRNA sequence
ttcttatataagaacctctc

SEQ ID NO: 783306 - DNA, 20 bp, Artificial
  CRISPR gRNA sequence
tcttatataagaacctctcc

SEQ ID NO: 783307 - DNA, 20 bp, Artificial
  CRISPR gRNA sequence
cttatataagaacctctcca

SEQ ID NO: 783308 - DNA, 20 bp, Artificial
  CRISPR gRNA sequence
taagaacctctccagggaaa

SEQ ID NO: 783309 - DNA, 20 bp, Artificial
  CRISPR gRNA sequence
aagaacctctccagggaaac

SEQ ID NO: 783310 - DNA, 20 bp, Artificial
  CRISPR gRNA sequence
agaacctctccagggaaaca

SEQ ID NO: 783311 - DNA, 20 bp, Artificial
  CRISPR gRNA sequence
gaacctctccagggaaacag

SEQ ID NO: 783312 - DNA, 20 bp, Artificial
  CRISPR gRNA sequence
agggaaacaggggcctgtat

SEQ ID NO: 783313 - DNA, 20 bp, Artificial
  CRISPR gRNA sequence
gggcctgtatgagatgaatt

SEQ ID NO: 783314 - DNA, 20 bp, Artificial
  CRISPR gRNA sequence
ctttacaccactgattatgt

SEQ ID NO: 783315 - DNA, 20 bp, Artificial
  CRISPR gRNA sequence
tgtcagtgttctattctgca

SEQ ID NO: 783316 - DNA, 20 bp, Artificial
  CRISPR gRNA sequence
cagtgttctattctgcatgg

SEQ ID NO: 783317 - DNA, 20 bp, Artificial
  CRISPR gRNA sequence
gtgttctattctgcatggta

SEQ ID NO: 783318 - DNA, 20 bp, Artificial
  CRISPR gRNA sequence
tctgcatggtagagatgtga

SEQ ID NO: 783319 - DNA, 20 bp, Artificial
  CRISPR gRNA sequence
ctgcatggtagagatgtgaa

SEQ ID NO: 783320 - DNA, 20 bp, Artificial
  CRISPR gRNA sequence
tgcatggtagagatgtgaaa

SEQ ID NO: 783321 - DNA, 20 bp, Artificial
  CRISPR gRNA sequence
atggtagagatgtgaaaggg

SEQ ID NO: 783322 - DNA, 20 bp, Artificial
  CRISPR gRNA sequence
gggcagactgaccattgctc

SEQ ID NO: 783323 - DNA, 20 bp, Artificial
  CRISPR gRNA sequence
cagactgaccattgctctgg

SEQ ID NO: 783324 - DNA, 20 bp, Artificial
  CRISPR gRNA sequence
tctggaagcctttacgctgt

SEQ ID NO: 783325 - DNA, 20 bp, Artificial
  CRISPR gRNA sequence
ggaagcctttacgctgtgag

SEQ ID NO: 783326 - DNA, 20 bp, Artificial
  CRISPR gRNA sequence
tttacgctgtgagaagttaa

SEQ ID NO: 783327 - DNA, 20 bp, Artificial
  CRISPR gRNA sequence
acgctgtgagaagttaacag

SEQ ID NO: 783328 - DNA, 20 bp, Artificial
  CRISPR gRNA sequence
gctgtgagaagttaacagtg

SEQ ID NO: 783329 - DNA, 20 bp, Artificial
  CRISPR gRNA sequence
aagttaacagtggagtaaaa

SEQ ID NO: 783330 - DNA, 20 bp, Artificial
  CRISPR gRNA sequence
tggccactccactctcttca

SEQ ID NO: 783331 - DNA, 20 bp, Artificial
  CRISPR gRNA sequence
ccactccactctcttcatgg

SEQ ID NO: 783332 - DNA, 20 bp, Artificial
  CRISPR gRNA sequence
tctcttcatggaagccaaca

SEQ ID NO: 783333 - DNA, 20 bp, Artificial
  CRISPR gRNA sequence
agccaacatggcttactaaa

SEQ ID NO: 783334 - DNA, 20 bp, Artificial
  CRISPR gRNA sequence
tactaaatagtcaacaacca

SEQ ID NO: 783335 - DNA, 20 bp, Artificial
  CRISPR gRNA sequence
actaaatagtcaacaaccat

SEQ ID NO: 783336 - DNA, 20 bp, Artificial
  CRISPR gRNA sequence
taaatagtcaacaaccatgg

SEQ ID NO: 783337 - DNA, 20 bp, Artificial
  CRISPR gRNA sequence
aatagtcaacaaccatggga

SEQ ID NO: 783338 - DNA, 20 bp, Artificial
  CRISPR gRNA sequence
acaaccatgggagagacctg

SEQ ID NO: 783339 - DNA, 20 bp, Artificial
  CRISPR gRNA sequence
caaccatgggagagacctgt

SEQ ID NO: 783340 - DNA, 20 bp, Artificial
  CRISPR gRNA sequence
aaccatgggagagacctgtg

SEQ ID NO: 783341 - DNA, 20 bp, Artificial
  CRISPR gRNA sequence
gagacctgtggggtcttcat

SEQ ID NO: 783342 - DNA, 20 bp, Artificial
  CRISPR gRNA sequence
gacctgtggggtcttcatca

SEQ ID NO: 783343 - DNA, 20 bp, Artificial
  CRISPR gRNA sequence
gtggggtcttcatcagagct

SEQ ID NO: 783344 - DNA, 20 bp, Artificial
  CRISPR gRNA sequence
tggggtcttcatcagagctc

SEQ ID NO: 783345 - DNA, 20 bp, Artificial
  CRISPR gRNA sequence
catcagagctcaggatctcc

SEQ ID NO: 783346 - DNA, 20 bp, Artificial
  CRISPR gRNA sequence
atcagagctcaggatctcct

SEQ ID NO: 783347 - DNA, 20 bp, Artificial
  CRISPR gRNA sequence
tcagagctcaggatctccta

SEQ ID NO: 783348 - DNA, 20 bp, Artificial
  CRISPR gRNA sequence
tagggtatcactcataaata

SEQ ID NO: 783349 - DNA, 20 bp, Artificial
  CRISPR gRNA sequence
tcactcataaatacagccat

SEQ ID NO: 783350 - DNA, 20 bp, Artificial
  CRISPR gRNA sequence
cactcataaatacagccatc

SEQ ID NO: 783351 - DNA, 20 bp, Artificial
  CRISPR gRNA sequence
actcataaatacagccatca

SEQ ID NO: 783352 - DNA, 20 bp, Artificial
  CRISPR gRNA sequence
tcataaatacagccatcagg

SEQ ID NO: 783353 - DNA, 20 bp, Artificial
  CRISPR gRNA sequence
aaatacagccatcagggaga

SEQ ID NO: 783354 - DNA, 20 bp, Artificial
  CRISPR gRNA sequence
atacagccatcagggagatg

SEQ ID NO: 783355 - DNA, 20 bp, Artificial
  CRISPR gRNA sequence
gagatggagaaatctttgtg

SEQ ID NO: 783356 - DNA, 20 bp, Artificial
  CRISPR gRNA sequence
tggagaaatctttgtgcagc

SEQ ID NO: 783357 - DNA, 20 bp, Artificial
  CRISPR gRNA sequence
gcagccagaaattctcaacc

SEQ ID NO: 783358 - DNA, 20 bp, Artificial
  CRISPR gRNA sequence
cgtcctactgtttactgaca

SEQ ID NO: 783359 - DNA, 20 bp, Artificial
  CRISPR gRNA sequence
caccacatgctctctgaact

SEQ ID NO: 783360 - DNA, 20 bp, Artificial
  CRISPR gRNA sequence
acctccatgccttctttgct

SEQ ID NO: 783361 - DNA, 20 bp, Artificial
  CRISPR gRNA sequence
cctccatgccttctttgctc

SEQ ID NO: 783362 - DNA, 20 bp, Artificial
  CRISPR gRNA sequence
atcattatttccctctctac

SEQ ID NO: 783363 - DNA, 20 bp, Artificial
  CRISPR gRNA sequence
tttccctctctactagctcc

SEQ ID NO: 783364 - DNA, 20 bp, Artificial
  CRISPR gRNA sequence
ctccaagcccaccctctctc

SEQ ID NO: 783365 - DNA, 20 bp, Artificial
  CRISPR gRNA sequence
tccaagcccaccctctctct

SEQ ID NO: 783366 - DNA, 20 bp, Artificial
  CRISPR gRNA sequence
ccaagcccaccctctctctg

SEQ ID NO: 783367 - DNA, 20 bp, Artificial
  CRISPR gRNA sequence
agcccaccctctctctgggg

SEQ ID NO: 783368 - DNA, 20 bp, Artificial
  CRISPR gRNA sequence
accctctctctggggcagct

SEQ ID NO: 783369 - DNA, 20 bp, Artificial
  CRISPR gRNA sequence
ctggggcagctcagtcactc

SEQ ID NO: 783370 - DNA, 20 bp, Artificial
  CRISPR gRNA sequence
tggggcagctcagtcactcc

SEQ ID NO: 783371 - DNA, 20 bp, Artificial
  CRISPR gRNA sequence
ggggcagctcagtcactcca

SEQ ID NO: 783372 - DNA, 20 bp, Artificial
  CRISPR gRNA sequence
gctcagtcactccagggcac

SEQ ID NO: 783373 - DNA, 20 bp, Artificial
  CRISPR gRNA sequence
ctcagtcactccagggcaca

SEQ ID NO: 783374 - DNA, 20 bp, Artificial
  CRISPR gRNA sequence
tcagtcactccagggcacaa

SEQ ID NO: 783375 - DNA, 20 bp, Artificial
  CRISPR gRNA sequence
cagtcactccagggcacaag

SEQ ID NO: 783376 - DNA, 20 bp, Artificial
  CRISPR gRNA sequence
agtcactccagggcacaagg

SEQ ID NO: 783377 - DNA, 20 bp, Artificial
  CRISPR gRNA sequence
tttccctcatcccacatttt

SEQ ID NO: 783378 - DNA, 20 bp, Artificial
  CRISPR gRNA sequence
acattttgagacctactacc

SEQ ID NO: 783379 - DNA, 20 bp, Artificial
  CRISPR gRNA sequence
tgtattttcattgttcacac

SEQ ID NO: 783380 - DNA, 20 bp, Artificial
  CRISPR gRNA sequence
agtcttctttattccacact

SEQ ID NO: 783381 - DNA, 20 bp, Artificial
  CRISPR gRNA sequence
gtcttctttattccacacta

SEQ ID NO: 783382 - DNA, 20 bp, Artificial
  CRISPR gRNA sequence
tttattccacactaaggcaa

SEQ ID NO: 783383 - DNA, 20 bp, Artificial
  CRISPR gRNA sequence
attccacactaaggcaaaag

SEQ ID NO: 783384 - DNA, 20 bp, Artificial
  CRISPR gRNA sequence
tccacactaaggcaaaagca

SEQ ID NO: 783385 - DNA, 20 bp, Artificial
  CRISPR gRNA sequence
cagagtcctgtgttcataat

SEQ ID NO: 783386 - DNA, 20 bp, Artificial
  CRISPR gRNA sequence
aataagtgctcaacaaatgt

SEQ ID NO: 783387 - DNA, 20 bp, Artificial
  CRISPR gRNA sequence
ataagtgctcaacaaatgtt

SEQ ID NO: 783388 - DNA, 20 bp, Artificial
  CRISPR gRNA sequence
tcaacaaatgttgggttgat

SEQ ID NO: 783389 - DNA, 20 bp, Artificial
  CRISPR gRNA sequence
caacaaatgttgggttgatt

SEQ ID NO: 783390 - DNA, 20 bp, Artificial
  CRISPR gRNA sequence
aaatgttgggttgattgggt

SEQ ID NO: 783391 - DNA, 20 bp, Artificial
  CRISPR gRNA sequence
atgttgggttgattgggttg

SEQ ID NO: 783392 - DNA, 20 bp, Artificial
  CRISPR gRNA sequence
ttgggttggagattccatct

SEQ ID NO: 783393 - DNA, 20 bp, Artificial
  CRISPR gRNA sequence
gattccatcttagataatcg

SEQ ID NO: 783394 - DNA, 20 bp, Artificial
  CRISPR gRNA sequence
taatcgcagtcccatcatgc

SEQ ID NO: 783395 - DNA, 20 bp, Artificial
  CRISPR gRNA sequence
agtcccatcatgccagctac

SEQ ID NO: 783396 - DNA, 20 bp, Artificial
  CRISPR gRNA sequence
atgccagctaccagactgtg

SEQ ID NO: 783397 - DNA, 20 bp, Artificial
  CRISPR gRNA sequence
cagctaccagactgtgtgga

SEQ ID NO: 783398 - DNA, 20 bp, Artificial
  CRISPR gRNA sequence
taccagactgtgtggacagc

SEQ ID NO: 783399 - DNA, 20 bp, Artificial
  CRISPR gRNA sequence
accagactgtgtggacagcc

SEQ ID NO: 783400 - DNA, 20 bp, Artificial
  CRISPR gRNA sequence
gactgtgtggacagccaggt

SEQ ID NO: 783401 - DNA, 20 bp, Artificial
  CRISPR gRNA sequence
ctgtgtggacagccaggtca

SEQ ID NO: 783402 - DNA, 20 bp, Artificial
  CRISPR gRNA sequence
tgtggacagccaggtcagag

SEQ ID NO: 783403 - DNA, 20 bp, Artificial
  CRISPR gRNA sequence
agagcagccaaatgatattc

SEQ ID NO: 783404 - DNA, 20 bp, Artificial
  CRISPR gRNA sequence
ccaaatgatattctagcttg

SEQ ID NO: 783405 - DNA, 20 bp, Artificial
  CRISPR gRNA sequence
ctagcttgtggcacaaatac

SEQ ID NO: 783406 - DNA, 20 bp, Artificial
  CRISPR gRNA sequence
taccagcaacaaaataacca

SEQ ID NO: 783407 - DNA, 20 bp, Artificial
  CRISPR gRNA sequence
aaagtcacacatctgcctct

SEQ ID NO: 783408 - DNA, 20 bp, Artificial
  CRISPR gRNA sequence
cacatctgcctctgagttcc

SEQ ID NO: 783409 - DNA, 20 bp, Artificial
  CRISPR gRNA sequence
gttcctggcttctatttctc

SEQ ID NO: 783410 - DNA, 20 bp, Artificial
  CRISPR gRNA sequence
ttcctggcttctatttctca

SEQ ID NO: 783411 - DNA, 20 bp, Artificial
  CRISPR gRNA sequence
tcctggcttctatttctcaa

SEQ ID NO: 783412 - DNA, 20 bp, Artificial
  CRISPR gRNA sequence
tatttctcaagggcattttt

SEQ ID NO: 783413 - DNA, 20 bp, Artificial
  CRISPR gRNA sequence
tctactcattctcataaatt

SEQ ID NO: 783414 - DNA, 20 bp, Artificial
  CRISPR gRNA sequence
cattctcataaattgagctg

SEQ ID NO: 783415 - DNA, 20 bp, Artificial
  CRISPR gRNA sequence
tgtggactgctgtgacccac

SEQ ID NO: 783416 - DNA, 20 bp, Artificial
  CRISPR gRNA sequence
ctgtgacccacaagcttctc

SEQ ID NO: 783417 - DNA, 20 bp, Artificial
  CRISPR gRNA sequence
tgacccacaagcttctccgg

SEQ ID NO: 783418 - DNA, 20 bp, Artificial
  CRISPR gRNA sequence
gtcaatgtataaaacaaaca

SEQ ID NO: 783419 - DNA, 20 bp, Artificial
  CRISPR gRNA sequence
ataaaacaaacacggaaacg

SEQ ID NO: 783420 - DNA, 20 bp, Artificial
  CRISPR gRNA sequence
aaaacaaacacggaaacgaa

SEQ ID NO: 783421 - DNA, 20 bp, Artificial
  CRISPR gRNA sequence
aaacacggaaacgaagagta

SEQ ID NO: 783422 - DNA, 20 bp, Artificial
  CRISPR gRNA sequence
cacggaaacgaagagtatgg

SEQ ID NO: 783423 - DNA, 20 bp, Artificial
  CRISPR gRNA sequence
acggaaacgaagagtatggt

SEQ ID NO: 783424 - DNA, 20 bp, Artificial
  CRISPR gRNA sequence
gaaacgaagagtatggtggg

SEQ ID NO: 783425 - DNA, 20 bp, Artificial
  CRISPR gRNA sequence
aacgaagagtatggtgggtg

SEQ ID NO: 783426 - DNA, 20 bp, Artificial
  CRISPR gRNA sequence
acgaagagtatggtgggtgg

SEQ ID NO: 783427 - DNA, 20 bp, Artificial
  CRISPR gRNA sequence
cgaagagtatggtgggtgga

SEQ ID NO: 783428 - DNA, 20 bp, Artificial
  CRISPR gRNA sequence
ggagggtactccactgactc

SEQ ID NO: 783429 - DNA, 20 bp, Artificial
  CRISPR gRNA sequence
gtactccactgactctagaa

SEQ ID NO: 783430 - DNA, 20 bp, Artificial
  CRISPR gRNA sequence
gactgaacattccaaatttc

SEQ ID NO: 783431 - DNA, 20 bp, Artificial
  CRISPR gRNA sequence
acattccaaatttcaagcac

SEQ ID NO: 783432 - DNA, 20 bp, Artificial
  CRISPR gRNA sequence
tccaaatttcaagcacaagt

SEQ ID NO: 783433 - DNA, 20 bp, Artificial
  CRISPR gRNA sequence
ccaaatttcaagcacaagtt

SEQ ID NO: 783434 - DNA, 20 bp, Artificial
  CRISPR gRNA sequence
caaatttcaagcacaagtta

SEQ ID NO: 783435 - DNA, 20 bp, Artificial
  CRISPR gRNA sequence
aatttcaagcacaagttagg

SEQ ID NO: 783436 - DNA, 20 bp, Artificial
  CRISPR gRNA sequence
aagcacaagttagggagcaa

SEQ ID NO: 783437 - DNA, 20 bp, Artificial
  CRISPR gRNA sequence
agatcattttccttttgaaa

SEQ ID NO: 783438 - DNA, 20 bp, Artificial
  CRISPR gRNA sequence
gatcattttccttttgaaat

SEQ ID NO: 783439 - DNA, 20 bp, Artificial
  CRISPR gRNA sequence
atcattttccttttgaaata

SEQ ID NO: 783440 - DNA, 20 bp, Artificial
  CRISPR gRNA sequence
gaaatagggtttcttctgct

SEQ ID NO: 783441 - DNA, 20 bp, Artificial
  CRISPR gRNA sequence
tagggtttcttctgctcagc

SEQ ID NO: 783442 - DNA, 20 bp, Artificial
  CRISPR gRNA sequence
gccagttgttgtattttcat

SEQ ID NO: 783443 - DNA, 20 bp, Artificial
  CRISPR gRNA sequence
ccagttgttgtattttcatt

SEQ ID NO: 783444 - DNA, 20 bp, Artificial
  CRISPR gRNA sequence
gttgtattttcattaggaaa

SEQ ID NO: 783445 - DNA, 20 bp, Artificial
  CRISPR gRNA sequence
attttcattaggaaatggaa

SEQ ID NO: 783446 - DNA, 20 bp, Artificial
  CRISPR gRNA sequence
ttttcattaggaaatggaat

SEQ ID NO: 783447 - DNA, 20 bp, Artificial
  CRISPR gRNA sequence
taggaaatggaatgggacta

SEQ ID NO: 783448 - DNA, 20 bp, Artificial
  CRISPR gRNA sequence
agcacaaaaaataaatataa

SEQ ID NO: 783449 - DNA, 20 bp, Artificial
  CRISPR gRNA sequence
gcacaaaaaataaatataaa

SEQ ID NO: 783450 - DNA, 20 bp, Artificial
  CRISPR gRNA sequence
taaatataaaaggacccttg

SEQ ID NO: 783451 - DNA, 20 bp, Artificial
  CRISPR gRNA sequence
aaatataaaaggacccttgt

SEQ ID NO: 783452 - DNA, 20 bp, Artificial
  CRISPR gRNA sequence
aatataaaaggacccttgta

SEQ ID NO: 783453 - DNA, 20 bp, Artificial
  CRISPR gRNA sequence
taaaaggacccttgtagggc

SEQ ID NO: 783454 - DNA, 20 bp, Artificial
  CRISPR gRNA sequence
aaggacccttgtagggctgg

SEQ ID NO: 783455 - DNA, 20 bp, Artificial
  CRISPR gRNA sequence
cccttgtagggctggcagaa

SEQ ID NO: 783456 - DNA, 20 bp, Artificial
  CRISPR gRNA sequence
cttgtagggctggcagaaaa

SEQ ID NO: 783457 - DNA, 20 bp, Artificial
  CRISPR gRNA sequence
gcagaaaagagaatccttcc

SEQ ID NO: 783458 - DNA, 20 bp, Artificial
  CRISPR gRNA sequence
cagaaaagagaatccttcct

SEQ ID NO: 783459 - DNA, 20 bp, Artificial
  CRISPR gRNA sequence
gaaaagagaatccttcctag

SEQ ID NO: 783460 - DNA, 20 bp, Artificial
  CRISPR gRNA sequence
agaatccttcctaggagacc

SEQ ID NO: 783461 - DNA, 20 bp, Artificial
  CRISPR gRNA sequence
aatccttcctaggagacctg

SEQ ID NO: 783462 - DNA, 20 bp, Artificial
  CRISPR gRNA sequence
atccttcctaggagacctgg

SEQ ID NO: 783463 - DNA, 20 bp, Artificial
  CRISPR gRNA sequence
aggagacctggaggtgattc

SEQ ID NO: 783464 - DNA, 20 bp, Artificial
  CRISPR gRNA sequence
ggagacctggaggtgattcc

SEQ ID NO: 783465 - DNA, 20 bp, Artificial
  CRISPR gRNA sequence
gacctggaggtgattccagg

SEQ ID NO: 783466 - DNA, 20 bp, Artificial
  CRISPR gRNA sequence
ctggaggtgattccaggcag

SEQ ID NO: 783467 - DNA, 20 bp, Artificial
  CRISPR gRNA sequence
ggtgattccaggcagtggtt

SEQ ID NO: 783468 - DNA, 20 bp, Artificial
  CRISPR gRNA sequence
tgattccaggcagtggttga

SEQ ID NO: 783469 - DNA, 20 bp, Artificial
  CRISPR gRNA sequence
ccaggcagtggttgagagca

SEQ ID NO: 783470 - DNA, 20 bp, Artificial
  CRISPR gRNA sequence
caggcagtggttgagagcat

SEQ ID NO: 783471 - DNA, 20 bp, Artificial
  CRISPR gRNA sequence
gagagcatgggctctgatgt

SEQ ID NO: 783472 - DNA, 20 bp, Artificial
  CRISPR gRNA sequence
gcatgggctctgatgtcaga

SEQ ID NO: 783473 - DNA, 20 bp, Artificial
  CRISPR gRNA sequence
catgggctctgatgtcagac

SEQ ID NO: 783474 - DNA, 20 bp, Artificial
  CRISPR gRNA sequence
atttcaaactctctctctat

SEQ ID NO: 783475 - DNA, 20 bp, Artificial
  CRISPR gRNA sequence
actctctctctattagcttt

SEQ ID NO: 783476 - DNA, 20 bp, Artificial
  CRISPR gRNA sequence
gagaacctaaatatcctact

SEQ ID NO: 783477 - DNA, 20 bp, Artificial
  CRISPR gRNA sequence
aatatcctacttagccactc

SEQ ID NO: 783478 - DNA, 20 bp, Artificial
  CRISPR gRNA sequence
tacttagccactctagcact

SEQ ID NO: 783479 - DNA, 20 bp, Artificial
  CRISPR gRNA sequence
agcactcagtctctcatgtg

SEQ ID NO: 783480 - DNA, 20 bp, Artificial
  CRISPR gRNA sequence
cagtctctcatgtgtagcat

SEQ ID NO: 783481 - DNA, 20 bp, Artificial
  CRISPR gRNA sequence
agtctctcatgtgtagcatg

SEQ ID NO: 783482 - DNA, 20 bp, Artificial
  CRISPR gRNA sequence
gtctctcatgtgtagcatga

SEQ ID NO: 783483 - DNA, 20 bp, Artificial
  CRISPR gRNA sequence
ctcatgtgtagcatgagggt

SEQ ID NO: 783484 - DNA, 20 bp, Artificial
  CRISPR gRNA sequence
atgtgtagcatgagggtgag

SEQ ID NO: 783485 - DNA, 20 bp, Artificial
  CRISPR gRNA sequence
tgtagcatgagggtgagtag

SEQ ID NO: 783486 - DNA, 20 bp, Artificial
  CRISPR gRNA sequence
agcatgagggtgagtagtgg

SEQ ID NO: 783487 - DNA, 20 bp, Artificial
  CRISPR gRNA sequence
tgagggtgagtagtggtaga

SEQ ID NO: 783488 - DNA, 20 bp, Artificial
  CRISPR gRNA sequence
gagtagtggtagacagttta

SEQ ID NO: 783489 - DNA, 20 bp, Artificial
  CRISPR gRNA sequence
agtagtggtagacagtttat

SEQ ID NO: 783490 - DNA, 20 bp, Artificial
  CRISPR gRNA sequence
gtagtggtagacagtttata

SEQ ID NO: 783491 - DNA, 20 bp, Artificial
  CRISPR gRNA sequence
gtagacagtttatagggtta

SEQ ID NO: 783492 - DNA, 20 bp, Artificial
  CRISPR gRNA sequence
acagtttatagggttatagt

SEQ ID NO: 783493 - DNA, 20 bp, Artificial
  CRISPR gRNA sequence
cagtttatagggttatagtg

SEQ ID NO: 783494 - DNA, 20 bp, Artificial
  CRISPR gRNA sequence
ttaaatgaaatgtgcttata

SEQ ID NO: 783495 - DNA, 20 bp, Artificial
  CRISPR gRNA sequence
aaatgtgcttataaagtgct

SEQ ID NO: 783496 - DNA, 20 bp, Artificial
  CRISPR gRNA sequence
cttataaagtgcttagtact

SEQ ID NO: 783497 - DNA, 20 bp, Artificial
  CRISPR gRNA sequence
taaagtgcttagtactcaga

SEQ ID NO: 783498 - DNA, 20 bp, Artificial
  CRISPR gRNA sequence
gtactcagaaagtgtgcaaa

SEQ ID NO: 783499 - DNA, 20 bp, Artificial
  CRISPR gRNA sequence
gtgcaaacagtaaaaaaaaa

SEQ ID NO: 783500 - DNA, 20 bp, Artificial
  CRISPR gRNA sequence
gtaaaaaaaaatggtatatc

SEQ ID NO: 783501 - DNA, 20 bp, Artificial
  CRISPR gRNA sequence
aaaaaaatggtatatctagc

SEQ ID NO: 783502 - DNA, 20 bp, Artificial
  CRISPR gRNA sequence
aagttgcatgccttacttgt

SEQ ID NO: 783503 - DNA, 20 bp, Artificial
  CRISPR gRNA sequence
gccttacttgtgagttcatg

SEQ ID NO: 783504 - DNA, 20 bp, Artificial
  CRISPR gRNA sequence
cttgtgagttcatgaagttg

SEQ ID NO: 783505 - DNA, 20 bp, Artificial
  CRISPR gRNA sequence
tgagttcatgaagttgtggc

SEQ ID NO: 783506 - DNA, 20 bp, Artificial
  CRISPR gRNA sequence
gagttcatgaagttgtggca

SEQ ID NO: 783507 - DNA, 20 bp, Artificial
  CRISPR gRNA sequence
catgaagttgtggcaaggat

SEQ ID NO: 783508 - DNA, 20 bp, Artificial
  CRISPR gRNA sequence
tgcatcattatatcattgct

SEQ ID NO: 783509 - DNA, 20 bp, Artificial
  CRISPR gRNA sequence
catcattatatcattgctaa

SEQ ID NO: 783510 - DNA, 20 bp, Artificial
  CRISPR gRNA sequence
tgctaagagtatgccattat

SEQ ID NO: 783511 - DNA, 20 bp, Artificial
  CRISPR gRNA sequence
aagagtatgccattattggc

SEQ ID NO: 783512 - DNA, 20 bp, Artificial
  CRISPR gRNA sequence
agagtatgccattattggcc

SEQ ID NO: 783513 - DNA, 20 bp, Artificial
  CRISPR gRNA sequence
atgccattattggccaggtg

SEQ ID NO: 783514 - DNA, 20 bp, Artificial
  CRISPR gRNA sequence
ccattattggccaggtgcgg

SEQ ID NO: 783515 - DNA, 20 bp, Artificial
  CRISPR gRNA sequence
gtggctcatgcctgtaatcc

SEQ ID NO: 783516 - DNA, 20 bp, Artificial
  CRISPR gRNA sequence
tgcctgtaatcctagcactt

SEQ ID NO: 783517 - DNA, 20 bp, Artificial
  CRISPR gRNA sequence
gcctgtaatcctagcacttt

SEQ ID NO: 783518 - DNA, 20 bp, Artificial
  CRISPR gRNA sequence
ctgtaatcctagcactttgg

SEQ ID NO: 783519 - DNA, 20 bp, Artificial
  CRISPR gRNA sequence
tgtaatcctagcactttggg

SEQ ID NO: 783520 - DNA, 20 bp, Artificial
  CRISPR gRNA sequence
tcctagcactttgggaggct

SEQ ID NO: 783521 - DNA, 20 bp, Artificial
  CRISPR gRNA sequence
agcactttgggaggctgaga

SEQ ID NO: 783522 - DNA, 20 bp, Artificial
  CRISPR gRNA sequence
gcactttgggaggctgagat

SEQ ID NO: 783523 - DNA, 20 bp, Artificial
  CRISPR gRNA sequence
ctttgggaggctgagatggg

SEQ ID NO: 783524 - DNA, 20 bp, Artificial
  CRISPR gRNA sequence
ctgagatgggtggattgctt

SEQ ID NO: 783525 - DNA, 20 bp, Artificial
  CRISPR gRNA sequence
tgagatgggtggattgcttg

SEQ ID NO: 783526 - DNA, 20 bp, Artificial
  CRISPR gRNA sequence
atgggtggattgcttgaggc

SEQ ID NO: 783527 - DNA, 20 bp, Artificial
  CRISPR gRNA sequence
tgggtggattgcttgaggcc

SEQ ID NO: 783528 - DNA, 20 bp, Artificial
  CRISPR gRNA sequence
ggtggattgcttgaggccag

SEQ ID NO: 783529 - DNA, 20 bp, Artificial
  CRISPR gRNA sequence
gaggccaggagttcaaaaat

SEQ ID NO: 783530 - DNA, 20 bp, Artificial
  CRISPR gRNA sequence
caggagttcaaaaatcagcc

SEQ ID NO: 783531 - DNA, 20 bp, Artificial
  CRISPR gRNA sequence
aaaaatcagcctggctaaca

SEQ ID NO: 783532 - DNA, 20 bp, Artificial
  CRISPR gRNA sequence
ctactaaaaatacaaaaaat

SEQ ID NO: 783533 - DNA, 20 bp, Artificial
  CRISPR gRNA sequence
taaaaatacaaaaaattagc

SEQ ID NO: 783534 - DNA, 20 bp, Artificial
  CRISPR gRNA sequence
aaaaatacaaaaaattagcc

SEQ ID NO: 783535 - DNA, 20 bp, Artificial
  CRISPR gRNA sequence
tacaaaaaattagccaggca

SEQ ID NO: 783536 - DNA, 20 bp, Artificial
  CRISPR gRNA sequence
aaaaaattagccaggcatgg

SEQ ID NO: 783537 - DNA, 20 bp, Artificial
  CRISPR gRNA sequence
aaattagccaggcatggtgg

SEQ ID NO: 783538 - DNA, 20 bp, Artificial
  CRISPR gRNA sequence
aattagccaggcatggtggc

SEQ ID NO: 783539 - DNA, 20 bp, Artificial
  CRISPR gRNA sequence
gtggcaggtgcctgtaatcc

SEQ ID NO: 783540 - DNA, 20 bp, Artificial
  CRISPR gRNA sequence
gcctgtaatcccagctactc

SEQ ID NO: 783541 - DNA, 20 bp, Artificial
  CRISPR gRNA sequence
ctgtaatcccagctactcaa

SEQ ID NO: 783542 - DNA, 20 bp, Artificial
  CRISPR gRNA sequence
tgtaatcccagctactcaag

SEQ ID NO: 783543 - DNA, 20 bp, Artificial
  CRISPR gRNA sequence
tcccagctactcaagaggcc

SEQ ID NO: 783544 - DNA, 20 bp, Artificial
  CRISPR gRNA sequence
cccagctactcaagaggccg

SEQ ID NO: 783545 - DNA, 20 bp, Artificial
  CRISPR gRNA sequence
agctactcaagaggccgagg

SEQ ID NO: 783546 - DNA, 20 bp, Artificial
  CRISPR gRNA sequence
gctactcaagaggccgaggc

SEQ ID NO: 783547 - DNA, 20 bp, Artificial
  CRISPR gRNA sequence
tactcaagaggccgaggcag

SEQ ID NO: 783548 - DNA, 20 bp, Artificial
  CRISPR gRNA sequence
gcaggagaatcacttgaacc

SEQ ID NO: 783549 - DNA, 20 bp, Artificial
  CRISPR gRNA sequence
caggagaatcacttgaaccc

SEQ ID NO: 783550 - DNA, 20 bp, Artificial
  CRISPR gRNA sequence
ggagaatcacttgaacccag

SEQ ID NO: 783551 - DNA, 20 bp, Artificial
  CRISPR gRNA sequence
gagaatcacttgaacccagg

SEQ ID NO: 783552 - DNA, 20 bp, Artificial
  CRISPR gRNA sequence
aatcacttgaacccaggagg

SEQ ID NO: 783553 - DNA, 20 bp, Artificial
  CRISPR gRNA sequence
tcacttgaacccaggaggcg

SEQ ID NO: 783554 - DNA, 20 bp, Artificial
  CRISPR gRNA sequence
cacttgaacccaggaggcgg

SEQ ID NO: 783555 - DNA, 20 bp, Artificial
  CRISPR gRNA sequence
aacccaggaggcggaggttg

SEQ ID NO: 783556 - DNA, 20 bp, Artificial
  CRISPR gRNA sequence
caggaggcggaggttgcagt

SEQ ID NO: 783557 - DNA, 20 bp, Artificial
  CRISPR gRNA sequence
ggcggaggttgcagtgagcc

SEQ ID NO: 783558 - DNA, 20 bp, Artificial
  CRISPR gRNA sequence
aagatcatgccactgcactc

SEQ ID NO: 783559 - DNA, 20 bp, Artificial
  CRISPR gRNA sequence
catgccactgcactccagcc

SEQ ID NO: 783560 - DNA, 20 bp, Artificial
  CRISPR gRNA sequence
atgccactgcactccagcct

SEQ ID NO: 783561 - DNA, 20 bp, Artificial
  CRISPR gRNA sequence
tgcactccagcctgggcaac

SEQ ID NO: 783562 - DNA, 20 bp, Artificial
  CRISPR gRNA sequence
cactccagcctgggcaacaa

SEQ ID NO: 783563 - DNA, 20 bp, Artificial
  CRISPR gRNA sequence
actccagcctgggcaacaag

SEQ ID NO: 783564 - DNA, 20 bp, Artificial
  CRISPR gRNA sequence
ctccagcctgggcaacaaga

SEQ ID NO: 783565 - DNA, 20 bp, Artificial
  CRISPR gRNA sequence
taaattaattaattaaatta

SEQ ID NO: 783566 - DNA, 20 bp, Artificial
  CRISPR gRNA sequence
ttaaattaaagaaacgacaa

SEQ ID NO: 783567 - DNA, 20 bp, Artificial
  CRISPR gRNA sequence
aaattaaagaaacgacaaaa

SEQ ID NO: 783568 - DNA, 20 bp, Artificial
  CRISPR gRNA sequence
gaaacgacaaaagagtatgc

SEQ ID NO: 783569 - DNA, 20 bp, Artificial
  CRISPR gRNA sequence
gcaagaattttaaaacaact

SEQ ID NO: 783570 - DNA, 20 bp, Artificial
  CRISPR gRNA sequence
aagaattttaaaacaactta

SEQ ID NO: 783571 - DNA, 20 bp, Artificial
  CRISPR gRNA sequence
agaattttaaaacaacttag

SEQ ID NO: 783572 - DNA, 20 bp, Artificial
  CRISPR gRNA sequence
caacttagaggaatatgtat

SEQ ID NO: 783573 - DNA, 20 bp, Artificial
  CRISPR gRNA sequence
aacttagaggaatatgtatg

SEQ ID NO: 783574 - DNA, 20 bp, Artificial
  CRISPR gRNA sequence
gaggaatatgtatgaggata

SEQ ID NO: 783575 - DNA, 20 bp, Artificial
  CRISPR gRNA sequence
aggaatatgtatgaggatac

SEQ ID NO: 783576 - DNA, 20 bp, Artificial
  CRISPR gRNA sequence
tatgtatgaggatacaggct

SEQ ID NO: 783577 - DNA, 20 bp, Artificial
  CRISPR gRNA sequence
caggctaagctaccataatg

SEQ ID NO: 783578 - DNA, 20 bp, Artificial
  CRISPR gRNA sequence
ggctaagctaccataatgaa

SEQ ID NO: 783579 - DNA, 20 bp, Artificial
  CRISPR gRNA sequence
aatgaagagacctcgaaata

SEQ ID NO: 783580 - DNA, 20 bp, Artificial
  CRISPR gRNA sequence
aagagacctcgaaatacagt

SEQ ID NO: 783581 - DNA, 20 bp, Artificial
  CRISPR gRNA sequence
agacctcgaaatacagtgag

SEQ ID NO: 783582 - DNA, 20 bp, Artificial
  CRISPR gRNA sequence
ctcgaaatacagtgagaagc

SEQ ID NO: 783583 - DNA, 20 bp, Artificial
  CRISPR gRNA sequence
aaatacagtgagaagcgaga

SEQ ID NO: 783584 - DNA, 20 bp, Artificial
  CRISPR gRNA sequence
tacagtgagaagcgagacag

SEQ ID NO: 783585 - DNA, 20 bp, Artificial
  CRISPR gRNA sequence
ctttcgttccatgtaacact

SEQ ID NO: 783586 - DNA, 20 bp, Artificial
  CRISPR gRNA sequence
tttcgttccatgtaacactc

SEQ ID NO: 783587 - DNA, 20 bp, Artificial
  CRISPR gRNA sequence
cgttccatgtaacactcagg

SEQ ID NO: 783588 - DNA, 20 bp, Artificial
  CRISPR gRNA sequence
catgtaacactcaggtggtt

SEQ ID NO: 783589 - DNA, 20 bp, Artificial
  CRISPR gRNA sequence
tgtaacactcaggtggttca

SEQ ID NO: 783590 - DNA, 20 bp, Artificial
  CRISPR gRNA sequence
aacactcaggtggttcagag

SEQ ID NO: 783591 - DNA, 20 bp, Artificial
  CRISPR gRNA sequence
tcaggtggttcagagcagct

SEQ ID NO: 783592 - DNA, 20 bp, Artificial
  CRISPR gRNA sequence
ggtggttcagagcagctaag

SEQ ID NO: 783593 - DNA, 20 bp, Artificial
  CRISPR gRNA sequence
agctaagcagctatgttcca

SEQ ID NO: 783594 - DNA, 20 bp, Artificial
  CRISPR gRNA sequence
ctaagcagctatgttccata

SEQ ID NO: 783595 - DNA, 20 bp, Artificial
  CRISPR gRNA sequence
ctatgttccatagagtcatt

SEQ ID NO: 783596 - DNA, 20 bp, Artificial
  CRISPR gRNA sequence
catagagtcattcagtgatc

SEQ ID NO: 783597 - DNA, 20 bp, Artificial
  CRISPR gRNA sequence
tctgttgctctgccattctc

SEQ ID NO: 783598 - DNA, 20 bp, Artificial
  CRISPR gRNA sequence
ctgttgctctgccattctcc

SEQ ID NO: 783599 - DNA, 20 bp, Artificial
  CRISPR gRNA sequence
ttgtccctataaaattgtca

SEQ ID NO: 783600 - DNA, 20 bp, Artificial
  CRISPR gRNA sequence
cctataaaattgtcaaagct

SEQ ID NO: 783601 - DNA, 20 bp, Artificial
  CRISPR gRNA sequence
taaaattgtcaaagctcagt

SEQ ID NO: 783602 - DNA, 20 bp, Artificial
  CRISPR gRNA sequence
caaacccatgtttcaacctt

SEQ ID NO: 783603 - DNA, 20 bp, Artificial
  CRISPR gRNA sequence
cccatgtttcaaccttcaga

SEQ ID NO: 783604 - DNA, 20 bp, Artificial
  CRISPR gRNA sequence
tcaaccttcagaaagtaaac

SEQ ID NO: 783605 - DNA, 20 bp, Artificial
  CRISPR gRNA sequence
accttcagaaagtaaacgag

SEQ ID NO: 783606 - DNA, 20 bp, Artificial
  CRISPR gRNA sequence
ttcagaaagtaaacgagtgg

SEQ ID NO: 783607 - DNA, 20 bp, Artificial
  CRISPR gRNA sequence
gaaaacacattcaatgtttt

SEQ ID NO: 783608 - DNA, 20 bp, Artificial
  CRISPR gRNA sequence
aaaacacattcaatgtttta

SEQ ID NO: 783609 - DNA, 20 bp, Artificial
  CRISPR gRNA sequence
acattcaatgttttaaggcc

SEQ ID NO: 783610 - DNA, 20 bp, Artificial
  CRISPR gRNA sequence
accttgaaaactcactctct

SEQ ID NO: 783611 - DNA, 20 bp, Artificial
  CRISPR gRNA sequence
tcactctcttagcctgaact

SEQ ID NO: 783612 - DNA, 20 bp, Artificial
  CRISPR gRNA sequence
tagcctgaacttagattaca

SEQ ID NO: 783613 - DNA, 20 bp, Artificial
  CRISPR gRNA sequence
ctgaacttagattacatggc

SEQ ID NO: 783614 - DNA, 20 bp, Artificial
  CRISPR gRNA sequence
tgaacttagattacatggct

SEQ ID NO: 783615 - DNA, 20 bp, Artificial
  CRISPR gRNA sequence
tggctgggcccacttaacta

SEQ ID NO: 783616 - DNA, 20 bp, Artificial
  CRISPR gRNA sequence
ggctgggcccacttaactat

SEQ ID NO: 783617 - DNA, 20 bp, Artificial
  CRISPR gRNA sequence
gctgggcccacttaactata

SEQ ID NO: 783618 - DNA, 20 bp, Artificial
  CRISPR gRNA sequence
ctgggcccacttaactatag

SEQ ID NO: 783619 - DNA, 20 bp, Artificial
  CRISPR gRNA sequence
gggcccacttaactataggg

SEQ ID NO: 783620 - DNA, 20 bp, Artificial
  CRISPR gRNA sequence
ggcccacttaactatagggg

SEQ ID NO: 783621 - DNA, 20 bp, Artificial
  CRISPR gRNA sequence
acttaactataggggaggct

SEQ ID NO: 783622 - DNA, 20 bp, Artificial
  CRISPR gRNA sequence
ataggggaggcttggaaaca

SEQ ID NO: 783623 - DNA, 20 bp, Artificial
  CRISPR gRNA sequence
ggcttggaaacatagtctct

SEQ ID NO: 783624 - DNA, 20 bp, Artificial
  CRISPR gRNA sequence
ttggaaacatagtctctgag

SEQ ID NO: 783625 - DNA, 20 bp, Artificial
  CRISPR gRNA sequence
tctctgagaagccatgtgtc

SEQ ID NO: 783626 - DNA, 20 bp, Artificial
  CRISPR gRNA sequence
cagctaattccctaatacta

SEQ ID NO: 783627 - DNA, 20 bp, Artificial
  CRISPR gRNA sequence
ttccctaatactaaagttga

SEQ ID NO: 783628 - DNA, 20 bp, Artificial
  CRISPR gRNA sequence
ctaatactaaagttgaaaga

SEQ ID NO: 783629 - DNA, 20 bp, Artificial
  CRISPR gRNA sequence
actaaagttgaaagaaagaa

SEQ ID NO: 783630 - DNA, 20 bp, Artificial
  CRISPR gRNA sequence
gaaagaaagaatggattaac

SEQ ID NO: 783631 - DNA, 20 bp, Artificial
  CRISPR gRNA sequence
agaaagaatggattaaccag

SEQ ID NO: 783632 - DNA, 20 bp, Artificial
  CRISPR gRNA sequence
attaaccagcagtataccac

SEQ ID NO: 783633 - DNA, 20 bp, Artificial
  CRISPR gRNA sequence
ttaaccagcagtataccaca

SEQ ID NO: 783634 - DNA, 20 bp, Artificial
  CRISPR gRNA sequence
accacaaggtaacaaatgac

SEQ ID NO: 783635 - DNA, 20 bp, Artificial
  CRISPR gRNA sequence
ccacaaggtaacaaatgact

SEQ ID NO: 783636 - DNA, 20 bp, Artificial
  CRISPR gRNA sequence
acaaggtaacaaatgactag

SEQ ID NO: 783637 - DNA, 20 bp, Artificial
  CRISPR gRNA sequence
caaggtaacaaatgactagg

SEQ ID NO: 783638 - DNA, 20 bp, Artificial
  CRISPR gRNA sequence
taacaaatgactaggaggat

SEQ ID NO: 783639 - DNA, 20 bp, Artificial
  CRISPR gRNA sequence
aacaaatgactaggaggatc

SEQ ID NO: 783640 - DNA, 20 bp, Artificial
  CRISPR gRNA sequence
aatgactaggaggatcaggc

SEQ ID NO: 783641 - DNA, 20 bp, Artificial
  CRISPR gRNA sequence
atgactaggaggatcaggct

SEQ ID NO: 783642 - DNA, 20 bp, Artificial
  CRISPR gRNA sequence
actaggaggatcaggctagg

SEQ ID NO: 783643 - DNA, 20 bp, Artificial
  CRISPR gRNA sequence
gaggatcaggctaggtggac

SEQ ID NO: 783644 - DNA, 20 bp, Artificial
  CRISPR gRNA sequence
tcaggctaggtggactagaa

SEQ ID NO: 783645 - DNA, 20 bp, Artificial
  CRISPR gRNA sequence
aggctaggtggactagaaaa

SEQ ID NO: 783646 - DNA, 20 bp, Artificial
  CRISPR gRNA sequence
taggtggactagaaaagaga

SEQ ID NO: 783647 - DNA, 20 bp, Artificial
  CRISPR gRNA sequence
tagaaaagagacagtcaatt

SEQ ID NO: 783648 - DNA, 20 bp, Artificial
  CRISPR gRNA sequence
tcagtgcaacaattccatat

SEQ ID NO: 783649 - DNA, 20 bp, Artificial
  CRISPR gRNA sequence
ccatattggcacttttcatg

SEQ ID NO: 783650 - DNA, 20 bp, Artificial
  CRISPR gRNA sequence
cttttcatgtagctgttgct

SEQ ID NO: 783651 - DNA, 20 bp, Artificial
  CRISPR gRNA sequence
agctgttgcttggctctatc

SEQ ID NO: 783652 - DNA, 20 bp, Artificial
  CRISPR gRNA sequence
ctgttgcttggctctatcta

SEQ ID NO: 783653 - DNA, 20 bp, Artificial
  CRISPR gRNA sequence
gttgcttggctctatctaga

SEQ ID NO: 783654 - DNA, 20 bp, Artificial
  CRISPR gRNA sequence
ttgcttggctctatctagag

SEQ ID NO: 783655 - DNA, 20 bp, Artificial
  CRISPR gRNA sequence
ggctctatctagagaggact

SEQ ID NO: 783656 - DNA, 20 bp, Artificial
  CRISPR gRNA sequence
ctctatctagagaggactca

SEQ ID NO: 783657 - DNA, 20 bp, Artificial
  CRISPR gRNA sequence
tctatctagagaggactcag

SEQ ID NO: 783658 - DNA, 20 bp, Artificial
  CRISPR gRNA sequence
atctagagaggactcagagg

SEQ ID NO: 783659 - DNA, 20 bp, Artificial
  CRISPR gRNA sequence
gagaggactcagaggtagtt

SEQ ID NO: 783660 - DNA, 20 bp, Artificial
  CRISPR gRNA sequence
gactcagaggtagtttagat

SEQ ID NO: 783661 - DNA, 20 bp, Artificial
  CRISPR gRNA sequence
actcagaggtagtttagata

SEQ ID NO: 783662 - DNA, 20 bp, Artificial
  CRISPR gRNA sequence
aggcctttgccctccaaata

SEQ ID NO: 783663 - DNA, 20 bp, Artificial
  CRISPR gRNA sequence
ttgccctccaaatacagtct

SEQ ID NO: 783664 - DNA, 20 bp, Artificial
  CRISPR gRNA sequence
ccctccaaatacagtctaag

SEQ ID NO: 783665 - DNA, 20 bp, Artificial
  CRISPR gRNA sequence
taagcagactgatttcctac

SEQ ID NO: 783666 - DNA, 20 bp, Artificial
  CRISPR gRNA sequence
tcctactggatgttcaactt

SEQ ID NO: 783667 - DNA, 20 bp, Artificial
  CRISPR gRNA sequence
ctactggatgttcaactttg

SEQ ID NO: 783668 - DNA, 20 bp, Artificial
  CRISPR gRNA sequence
atgttcaactttggagtctt

SEQ ID NO: 783669 - DNA, 20 bp, Artificial
  CRISPR gRNA sequence
tgttcaactttggagtcttc

SEQ ID NO: 783670 - DNA, 20 bp, Artificial
  CRISPR gRNA sequence
gttcaactttggagtcttca

SEQ ID NO: 783671 - DNA, 20 bp, Artificial
  CRISPR gRNA sequence
actttggagtcttcagggat

SEQ ID NO: 783672 - DNA, 20 bp, Artificial
  CRISPR gRNA sequence
ttggagtcttcagggatgag

SEQ ID NO: 783673 - DNA, 20 bp, Artificial
  CRISPR gRNA sequence
tggagtcttcagggatgagt

SEQ ID NO: 783674 - DNA, 20 bp, Artificial
  CRISPR gRNA sequence
ggagtcttcagggatgagta

SEQ ID NO: 783675 - DNA, 20 bp, Artificial
  CRISPR gRNA sequence
atgagtagggcttctgtacg

SEQ ID NO: 783676 - DNA, 20 bp, Artificial
  CRISPR gRNA sequence
agtagggcttctgtacgtgg

SEQ ID NO: 783677 - DNA, 20 bp, Artificial
  CRISPR gRNA sequence
tagggcttctgtacgtggaa

SEQ ID NO: 783678 - DNA, 20 bp, Artificial
  CRISPR gRNA sequence
ctgtacgtggaagagactat

SEQ ID NO: 783679 - DNA, 20 bp, Artificial
  CRISPR gRNA sequence
tgtacgtggaagagactatg

SEQ ID NO: 783680 - DNA, 20 bp, Artificial
  CRISPR gRNA sequence
gtacgtggaagagactatga

SEQ ID NO: 783681 - DNA, 20 bp, Artificial
  CRISPR gRNA sequence
agactatgagggaacctgca

SEQ ID NO: 783682 - DNA, 20 bp, Artificial
  CRISPR gRNA sequence
gactatgagggaacctgcac

SEQ ID NO: 783683 - DNA, 20 bp, Artificial
  CRISPR gRNA sequence
tgagggaacctgcacaggac

SEQ ID NO: 783684 - DNA, 20 bp, Artificial
  CRISPR gRNA sequence
gagggaacctgcacaggaca

SEQ ID NO: 783685 - DNA, 20 bp, Artificial
  CRISPR gRNA sequence
agggaacctgcacaggacaa

SEQ ID NO: 783686 - DNA, 20 bp, Artificial
  CRISPR gRNA sequence
acaggacaagggtttgcata

SEQ ID NO: 783687 - DNA, 20 bp, Artificial
  CRISPR gRNA sequence
agggtttgcataaagacact

SEQ ID NO: 783688 - DNA, 20 bp, Artificial
  CRISPR gRNA sequence
gggtttgcataaagacactg

SEQ ID NO: 783689 - DNA, 20 bp, Artificial
  CRISPR gRNA sequence
tttgcataaagacactgagg

SEQ ID NO: 783690 - DNA, 20 bp, Artificial
  CRISPR gRNA sequence
ttgcataaagacactgaggt

SEQ ID NO: 783691 - DNA, 20 bp, Artificial
  CRISPR gRNA sequence
tgcataaagacactgaggta

SEQ ID NO: 783692 - DNA, 20 bp, Artificial
  CRISPR gRNA sequence
ggtagggacctctcctgttg

SEQ ID NO: 783693 - DNA, 20 bp, Artificial
  CRISPR gRNA sequence
gtagggacctctcctgttgt

SEQ ID NO: 783694 - DNA, 20 bp, Artificial
  CRISPR gRNA sequence
tagggacctctcctgttgtg

SEQ ID NO: 783695 - DNA, 20 bp, Artificial
  CRISPR gRNA sequence
gacctctcctgttgtgggga

SEQ ID NO: 783696 - DNA, 20 bp, Artificial
  CRISPR gRNA sequence
tctcctgttgtggggacagt

SEQ ID NO: 783697 - DNA, 20 bp, Artificial
  CRISPR gRNA sequence
tcctgttgtggggacagtga

SEQ ID NO: 783698 - DNA, 20 bp, Artificial
  CRISPR gRNA sequence
cctgttgtggggacagtgag

SEQ ID NO: 783699 - DNA, 20 bp, Artificial
  CRISPR gRNA sequence
tgtggggacagtgagaggcc

SEQ ID NO: 783700 - DNA, 20 bp, Artificial
  CRISPR gRNA sequence
gtggggacagtgagaggccc

SEQ ID NO: 783701 - DNA, 20 bp, Artificial
  CRISPR gRNA sequence
ccaggtctccttgactcaca

SEQ ID NO: 783702 - DNA, 20 bp, Artificial
  CRISPR gRNA sequence
tgactcacaaagtgcttact

SEQ ID NO: 783703 - DNA, 20 bp, Artificial
  CRISPR gRNA sequence
agtgcttactaagcacttac

SEQ ID NO: 783704 - DNA, 20 bp, Artificial
  CRISPR gRNA sequence
ctaagcacttactagaaatt

SEQ ID NO: 783705 - DNA, 20 bp, Artificial
  CRISPR gRNA sequence
agcacttactagaaattaag

SEQ ID NO: 783706 - DNA, 20 bp, Artificial
  CRISPR gRNA sequence
acttactagaaattaagaag

SEQ ID NO: 783707 - DNA, 20 bp, Artificial
  CRISPR gRNA sequence
gaagcagattataatcaata

SEQ ID NO: 783708 - DNA, 20 bp, Artificial
  CRISPR gRNA sequence
aagcagattataatcaatat

SEQ ID NO: 783709 - DNA, 20 bp, Artificial
  CRISPR gRNA sequence
aatatgggttatccaatgtt

SEQ ID NO: 783710 - DNA, 20 bp, Artificial
  CRISPR gRNA sequence
gggttatccaatgtttggat

SEQ ID NO: 783711 - DNA, 20 bp, Artificial
  CRISPR gRNA sequence
tatccaatgtttggatgagc

SEQ ID NO: 783712 - DNA, 20 bp, Artificial
  CRISPR gRNA sequence
atccaatgtttggatgagca

SEQ ID NO: 783713 - DNA, 20 bp, Artificial
  CRISPR gRNA sequence
taatgttaatcacactcttt

SEQ ID NO: 783714 - DNA, 20 bp, Artificial
  CRISPR gRNA sequence
gttaatcacactcttttgga

SEQ ID NO: 783715 - DNA, 20 bp, Artificial
  CRISPR gRNA sequence
taatcacactcttttggatg

SEQ ID NO: 783716 - DNA, 20 bp, Artificial
  CRISPR gRNA sequence
tggatggagacaaatatctg

SEQ ID NO: 783717 - DNA, 20 bp, Artificial
  CRISPR gRNA sequence
ggatggagacaaatatctgt

SEQ ID NO: 783718 - DNA, 20 bp, Artificial
  CRISPR gRNA sequence
gatggagacaaatatctgtg

SEQ ID NO: 783719 - DNA, 20 bp, Artificial
  CRISPR gRNA sequence
atggagacaaatatctgtgg

SEQ ID NO: 783720 - DNA, 20 bp, Artificial
  CRISPR gRNA sequence
gacaaatatctgtgggggct

SEQ ID NO: 783721 - DNA, 20 bp, Artificial
  CRISPR gRNA sequence
tatctgtgggggctgagctt

SEQ ID NO: 783722 - DNA, 20 bp, Artificial
  CRISPR gRNA sequence
atctgtgggggctgagcttt

SEQ ID NO: 783723 - DNA, 20 bp, Artificial
  CRISPR gRNA sequence
gtgggggctgagctttgggt

SEQ ID NO: 783724 - DNA, 20 bp, Artificial
  CRISPR gRNA sequence
gggctgagctttgggtcaga

SEQ ID NO: 783725 - DNA, 20 bp, Artificial
  CRISPR gRNA sequence
agctttgggtcagatagatc

SEQ ID NO: 783726 - DNA, 20 bp, Artificial
  CRISPR gRNA sequence
gctttgggtcagatagatct

SEQ ID NO: 783727 - DNA, 20 bp, Artificial
  CRISPR gRNA sequence
tagatctgggtttgcaatcc

SEQ ID NO: 783728 - DNA, 20 bp, Artificial
  CRISPR gRNA sequence
tcctggcattgacttttact

SEQ ID NO: 783729 - DNA, 20 bp, Artificial
  CRISPR gRNA sequence
tggcattgacttttacttag

SEQ ID NO: 783730 - DNA, 20 bp, Artificial
  CRISPR gRNA sequence
ttagcagtgatgacctcaca

SEQ ID NO: 783731 - DNA, 20 bp, Artificial
  CRISPR gRNA sequence
atgacctcacatagattatt

SEQ ID NO: 783732 - DNA, 20 bp, Artificial
  CRISPR gRNA sequence
atagattatttagcaactct

SEQ ID NO: 783733 - DNA, 20 bp, Artificial
  CRISPR gRNA sequence
tacttcctcaactctaaaat

SEQ ID NO: 783734 - DNA, 20 bp, Artificial
  CRISPR gRNA sequence
acttcctcaactctaaaatg

SEQ ID NO: 783735 - DNA, 20 bp, Artificial
  CRISPR gRNA sequence
cttcctcaactctaaaatga

SEQ ID NO: 783736 - DNA, 20 bp, Artificial
  CRISPR gRNA sequence
ttcctcaactctaaaatgag

SEQ ID NO: 783737 - DNA, 20 bp, Artificial
  CRISPR gRNA sequence
caactctaaaatgaggggct

SEQ ID NO: 783738 - DNA, 20 bp, Artificial
  CRISPR gRNA sequence
ataatgtctaatctcttctc

SEQ ID NO: 783739 - DNA, 20 bp, Artificial
  CRISPR gRNA sequence
ttctccagtaaaacaatccg

SEQ ID NO: 783740 - DNA, 20 bp, Artificial
  CRISPR gRNA sequence
gtaaaacaatccgtggttct

SEQ ID NO: 783741 - DNA, 20 bp, Artificial
  CRISPR gRNA sequence
aacaatccgtggttctcaga

SEQ ID NO: 783742 - DNA, 20 bp, Artificial
  CRISPR gRNA sequence
gttctcagatagcactgtgc

SEQ ID NO: 783743 - DNA, 20 bp, Artificial
  CRISPR gRNA sequence
tctcagatagcactgtgctg

SEQ ID NO: 783744 - DNA, 20 bp, Artificial
  CRISPR gRNA sequence
ctcagatagcactgtgctgg

SEQ ID NO: 783745 - DNA, 20 bp, Artificial
  CRISPR gRNA sequence
agatagcactgtgctggagg

SEQ ID NO: 783746 - DNA, 20 bp, Artificial
  CRISPR gRNA sequence
tagcactgtgctggaggtag

SEQ ID NO: 783747 - DNA, 20 bp, Artificial
  CRISPR gRNA sequence
agcactgtgctggaggtagt

SEQ ID NO: 783748 - DNA, 20 bp, Artificial
  CRISPR gRNA sequence
gcactgtgctggaggtagtg

SEQ ID NO: 783749 - DNA, 20 bp, Artificial
  CRISPR gRNA sequence
tgctggaggtagtggggttt

SEQ ID NO: 783750 - DNA, 20 bp, Artificial
  CRISPR gRNA sequence
gctggaggtagtggggtttg

SEQ ID NO: 783751 - DNA, 20 bp, Artificial
  CRISPR gRNA sequence
ctggaggtagtggggtttga

SEQ ID NO: 783752 - DNA, 20 bp, Artificial
  CRISPR gRNA sequence
aggtagtggggtttgagggc

SEQ ID NO: 783753 - DNA, 20 bp, Artificial
  CRISPR gRNA sequence
ggtagtggggtttgagggct

SEQ ID NO: 783754 - DNA, 20 bp, Artificial
  CRISPR gRNA sequence
agtggggtttgagggctggg

SEQ ID NO: 783755 - DNA, 20 bp, Artificial
  CRISPR gRNA sequence
gggtttgagggctgggaagt

SEQ ID NO: 783756 - DNA, 20 bp, Artificial
  CRISPR gRNA sequence
ggtttgagggctgggaagtt

SEQ ID NO: 783757 - DNA, 20 bp, Artificial
  CRISPR gRNA sequence
tttgagggctgggaagttgg

SEQ ID NO: 783758 - DNA, 20 bp, Artificial
  CRISPR gRNA sequence
ttgagggctgggaagttggg

SEQ ID NO: 783759 - DNA, 20 bp, Artificial
  CRISPR gRNA sequence
gctgggaagttgggaggact

SEQ ID NO: 783760 - DNA, 20 bp, Artificial
  CRISPR gRNA sequence
aggactgagcccttcccgct

SEQ ID NO: 783761 - DNA, 20 bp, Artificial
  CRISPR gRNA sequence
actgagcccttcccgctgag

SEQ ID NO: 783762 - DNA, 20 bp, Artificial
  CRISPR gRNA sequence
tcccgctgagcagtttcgtc

SEQ ID NO: 783763 - DNA, 20 bp, Artificial
  CRISPR gRNA sequence
tcgtccagtttttcctgtac

SEQ ID NO: 783764 - DNA, 20 bp, Artificial
  CRISPR gRNA sequence
ttattccatgtgaatgactc

SEQ ID NO: 783765 - DNA, 20 bp, Artificial
  CRISPR gRNA sequence
attccatgtgaatgactcca

SEQ ID NO: 783766 - DNA, 20 bp, Artificial
  CRISPR gRNA sequence
ttccatgtgaatgactccag

SEQ ID NO: 783767 - DNA, 20 bp, Artificial
  CRISPR gRNA sequence
tgactccagaggcaaaattc

SEQ ID NO: 783768 - DNA, 20 bp, Artificial
  CRISPR gRNA sequence
gcaaaattcaagcttttgaa

SEQ ID NO: 783769 - DNA, 20 bp, Artificial
  CRISPR gRNA sequence
caaaattcaagcttttgaat

SEQ ID NO: 783770 - DNA, 20 bp, Artificial
  CRISPR gRNA sequence
aaaattcaagcttttgaata

SEQ ID NO: 783771 - DNA, 20 bp, Artificial
  CRISPR gRNA sequence
aatagggcacaaattaactt

SEQ ID NO: 783772 - DNA, 20 bp, Artificial
  CRISPR gRNA sequence
agtaccctttcatttccctg

SEQ ID NO: 783773 - DNA, 20 bp, Artificial
  CRISPR gRNA sequence
gtaccctttcatttccctgt

SEQ ID NO: 783774 - DNA, 20 bp, Artificial
  CRISPR gRNA sequence
cctgtaggtgaacactcctc

SEQ ID NO: 783775 - DNA, 20 bp, Artificial
  CRISPR gRNA sequence
cctctagccctgccttttgt

SEQ ID NO: 783776 - DNA, 20 bp, Artificial
  CRISPR gRNA sequence
agccctgccttttgtcagtc

SEQ ID NO: 783777 - DNA, 20 bp, Artificial
  CRISPR gRNA sequence
ccctgccttttgtcagtctg

SEQ ID NO: 783778 - DNA, 20 bp, Artificial
  CRISPR gRNA sequence
ttgttctaatctgtacacac

SEQ ID NO: 783779 - DNA, 20 bp, Artificial
  CRISPR gRNA sequence
gttctaatctgtacacacca

SEQ ID NO: 783780 - DNA, 20 bp, Artificial
  CRISPR gRNA sequence
ttctaatctgtacacaccag

SEQ ID NO: 783781 - DNA, 20 bp, Artificial
  CRISPR gRNA sequence
tacacaccagaggactttac

SEQ ID NO: 783782 - DNA, 20 bp, Artificial
  CRISPR gRNA sequence
acacaccagaggactttaca

SEQ ID NO: 783783 - DNA, 20 bp, Artificial
  CRISPR gRNA sequence
ggactttacaaggctttccc

SEQ ID NO: 783784 - DNA, 20 bp, Artificial
  CRISPR gRNA sequence
acaaggctttccccagcctc

SEQ ID NO: 783785 - DNA, 20 bp, Artificial
  CRISPR gRNA sequence
tactaaactcaccctttcct

SEQ ID NO: 783786 - DNA, 20 bp, Artificial
  CRISPR gRNA sequence
actcaccctttcctcagtgc

SEQ ID NO: 783787 - DNA, 20 bp, Artificial
  CRISPR gRNA sequence
ctcaccctttcctcagtgct

SEQ ID NO: 783788 - DNA, 20 bp, Artificial
  CRISPR gRNA sequence
ggacgttgaaaaaccgaaac

SEQ ID NO: 783789 - DNA, 20 bp, Artificial
  CRISPR gRNA sequence
gacgttgaaaaaccgaaaca

SEQ ID NO: 783790 - DNA, 20 bp, Artificial
  CRISPR gRNA sequence
tgaaaaaccgaaacaaggca

SEQ ID NO: 783791 - DNA, 20 bp, Artificial
  CRISPR gRNA sequence
gaaaaaccgaaacaaggcaa

SEQ ID NO: 783792 - DNA, 20 bp, Artificial
  CRISPR gRNA sequence
aaaaaccgaaacaaggcaaa

SEQ ID NO: 783793 - DNA, 20 bp, Artificial
  CRISPR gRNA sequence
caattgtaataattcacact

SEQ ID NO: 783794 - DNA, 20 bp, Artificial
  CRISPR gRNA sequence
aattgtaataattcacacta

SEQ ID NO: 783795 - DNA, 20 bp, Artificial
  CRISPR gRNA sequence
aataattcacactaaggcat

SEQ ID NO: 783796 - DNA, 20 bp, Artificial
  CRISPR gRNA sequence
cacactaaggcatgagtgac

SEQ ID NO: 783797 - DNA, 20 bp, Artificial
  CRISPR gRNA sequence
acactaaggcatgagtgact

SEQ ID NO: 783798 - DNA, 20 bp, Artificial
  CRISPR gRNA sequence
aaggcatgagtgactaggtt

SEQ ID NO: 783799 - DNA, 20 bp, Artificial
  CRISPR gRNA sequence
tttagtatattaacactacc

SEQ ID NO: 783800 - DNA, 20 bp, Artificial
  CRISPR gRNA sequence
ttagtatattaacactacct

SEQ ID NO: 783801 - DNA, 20 bp, Artificial
  CRISPR gRNA sequence
ggatattctatttcttccaa

SEQ ID NO: 783802 - DNA, 20 bp, Artificial
  CRISPR gRNA sequence
gatattctatttcttccaaa

SEQ ID NO: 783803 - DNA, 20 bp, Artificial
  CRISPR gRNA sequence
ccttgaaatttaacaactaa

SEQ ID NO: 783804 - DNA, 20 bp, Artificial
  CRISPR gRNA sequence
aaatttaacaactaatggta

SEQ ID NO: 783805 - DNA, 20 bp, Artificial
  CRISPR gRNA sequence
caactaatggtatagattct

SEQ ID NO: 783806 - DNA, 20 bp, Artificial
  CRISPR gRNA sequence
gtatagattctaagcactgt

SEQ ID NO: 783807 - DNA, 20 bp, Artificial
  CRISPR gRNA sequence
taagcactgtgagtacttgt

SEQ ID NO: 783808 - DNA, 20 bp, Artificial
  CRISPR gRNA sequence
gcactgtgagtacttgtcag

SEQ ID NO: 783809 - DNA, 20 bp, Artificial
  CRISPR gRNA sequence
cactgtgagtacttgtcagt

SEQ ID NO: 783810 - DNA, 20 bp, Artificial
  CRISPR gRNA sequence
actgtgagtacttgtcagtg

SEQ ID NO: 783811 - DNA, 20 bp, Artificial
  CRISPR gRNA sequence
ctgtgagtacttgtcagtgg

SEQ ID NO: 783812 - DNA, 20 bp, Artificial
  CRISPR gRNA sequence
gagtacttgtcagtggggga

SEQ ID NO: 783813 - DNA, 20 bp, Artificial
  CRISPR gRNA sequence
cagtgggggaaagacatttt

SEQ ID NO: 783814 - DNA, 20 bp, Artificial
  CRISPR gRNA sequence
agtgggggaaagacattttt

SEQ ID NO: 783815 - DNA, 20 bp, Artificial
  CRISPR gRNA sequence
gggaaagacatttttgggct

SEQ ID NO: 783816 - DNA, 20 bp, Artificial
  CRISPR gRNA sequence
gaaagacatttttgggctga

SEQ ID NO: 783817 - DNA, 20 bp, Artificial
  CRISPR gRNA sequence
gggctgagagactttgccac

SEQ ID NO: 783818 - DNA, 20 bp, Artificial
  CRISPR gRNA sequence
ggctgagagactttgccact

SEQ ID NO: 783819 - DNA, 20 bp, Artificial
  CRISPR gRNA sequence
tgagagactttgccactggg

SEQ ID NO: 783820 - DNA, 20 bp, Artificial
  CRISPR gRNA sequence
agagactttgccactgggaa

SEQ ID NO: 783821 - DNA, 20 bp, Artificial
  CRISPR gRNA sequence
agactttgccactgggaaga

SEQ ID NO: 783822 - DNA, 20 bp, Artificial
  CRISPR gRNA sequence
actttgccactgggaagaga

SEQ ID NO: 783823 - DNA, 20 bp, Artificial
  CRISPR gRNA sequence
tttgccactgggaagagaga

SEQ ID NO: 783824 - DNA, 20 bp, Artificial
  CRISPR gRNA sequence
ttgccactgggaagagagag

SEQ ID NO: 783825 - DNA, 20 bp, Artificial
  CRISPR gRNA sequence
actgggaagagagagaggat

SEQ ID NO: 783826 - DNA, 20 bp, Artificial
  CRISPR gRNA sequence
ctgggaagagagagaggatg

SEQ ID NO: 783827 - DNA, 20 bp, Artificial
  CRISPR gRNA sequence
gggaagagagagaggatgag

SEQ ID NO: 783828 - DNA, 20 bp, Artificial
  CRISPR gRNA sequence
ggaagagagagaggatgagg

SEQ ID NO: 783829 - DNA, 20 bp, Artificial
  CRISPR gRNA sequence
aagagagagaggatgaggag

SEQ ID NO: 783830 - DNA, 20 bp, Artificial
  CRISPR gRNA sequence
agagagaggatgaggaggag

SEQ ID NO: 783831 - DNA, 20 bp, Artificial
  CRISPR gRNA sequence
gagagaggatgaggaggaga

SEQ ID NO: 783832 - DNA, 20 bp, Artificial
  CRISPR gRNA sequence
agagaggatgaggaggagaa

SEQ ID NO: 783833 - DNA, 20 bp, Artificial
  CRISPR gRNA sequence
gagaggatgaggaggagaag

SEQ ID NO: 783834 - DNA, 20 bp, Artificial
  CRISPR gRNA sequence
agaggatgaggaggagaagg

SEQ ID NO: 783835 - DNA, 20 bp, Artificial
  CRISPR gRNA sequence
gatgaggaggagaaggggga

SEQ ID NO: 783836 - DNA, 20 bp, Artificial
  CRISPR gRNA sequence
atgaggaggagaagggggat

SEQ ID NO: 783837 - DNA, 20 bp, Artificial
  CRISPR gRNA sequence
tgaggaggagaagggggata

SEQ ID NO: 783838 - DNA, 20 bp, Artificial
  CRISPR gRNA sequence
aggaggagaagggggatagg

SEQ ID NO: 783839 - DNA, 20 bp, Artificial
  CRISPR gRNA sequence
ggaggagaagggggataggg

SEQ ID NO: 783840 - DNA, 20 bp, Artificial
  CRISPR gRNA sequence
gaagggggatagggaggaaa

SEQ ID NO: 783841 - DNA, 20 bp, Artificial
  CRISPR gRNA sequence
agggggatagggaggaaaaa

SEQ ID NO: 783842 - DNA, 20 bp, Artificial
  CRISPR gRNA sequence
tagggaggaaaaagagaaaa

SEQ ID NO: 783843 - DNA, 20 bp, Artificial
  CRISPR gRNA sequence
gaggaaaaagagaaaaaaga

SEQ ID NO: 783844 - DNA, 20 bp, Artificial
  CRISPR gRNA sequence
aaaaagagaaaaaagaaaga

SEQ ID NO: 783845 - DNA, 20 bp, Artificial
  CRISPR gRNA sequence
aaaaaagaaagaaagatgat

SEQ ID NO: 783846 - DNA, 20 bp, Artificial
  CRISPR gRNA sequence
aaagaaagatgattagatga

SEQ ID NO: 783847 - DNA, 20 bp, Artificial
  CRISPR gRNA sequence
aaagatgattagatgataga

SEQ ID NO: 783848 - DNA, 20 bp, Artificial
  CRISPR gRNA sequence
atgattagatgatagatgga

SEQ ID NO: 783849 - DNA, 20 bp, Artificial
  CRISPR gRNA sequence
atgatagatggatggattga

SEQ ID NO: 783850 - DNA, 20 bp, Artificial
  CRISPR gRNA sequence
tagatggatggattgatgga

SEQ ID NO: 783851 - DNA, 20 bp, Artificial
  CRISPR gRNA sequence
tggatggattgatggatgga

SEQ ID NO: 783852 - DNA, 20 bp, Artificial
  CRISPR gRNA sequence
tggatggaaaaaaataacat

SEQ ID NO: 783853 - DNA, 20 bp, Artificial
  CRISPR gRNA sequence
gatggaaaaaaataacatga

SEQ ID NO: 783854 - DNA, 20 bp, Artificial
  CRISPR gRNA sequence
tggaaaaaaataacatgaga

SEQ ID NO: 783855 - DNA, 20 bp, Artificial
  CRISPR gRNA sequence
aaaaaaataacatgagagag

SEQ ID NO: 783856 - DNA, 20 bp, Artificial
  CRISPR gRNA sequence
taacatgagagagtggtaaa

SEQ ID NO: 783857 - DNA, 20 bp, Artificial
  CRISPR gRNA sequence
tgagagagtggtaaaaagca

SEQ ID NO: 783858 - DNA, 20 bp, Artificial
  CRISPR gRNA sequence
gtggtaaaaagcacagaatc

SEQ ID NO: 783859 - DNA, 20 bp, Artificial
  CRISPR gRNA sequence
aaaagcacagaatctggaac

SEQ ID NO: 783860 - DNA, 20 bp, Artificial
  CRISPR gRNA sequence
tctggaaccagactgtatct

SEQ ID NO: 783861 - DNA, 20 bp, Artificial
  CRISPR gRNA sequence
gaaccagactgtatcttagc

SEQ ID NO: 783862 - DNA, 20 bp, Artificial
  CRISPR gRNA sequence
aaccagactgtatcttagct

SEQ ID NO: 783863 - DNA, 20 bp, Artificial
  CRISPR gRNA sequence
gggtcacttactatgtaact

SEQ ID NO: 783864 - DNA, 20 bp, Artificial
  CRISPR gRNA sequence
ggtcacttactatgtaactt

SEQ ID NO: 783865 - DNA, 20 bp, Artificial
  CRISPR gRNA sequence
gtcacttactatgtaactta

SEQ ID NO: 783866 - DNA, 20 bp, Artificial
  CRISPR gRNA sequence
cttactatgtaacttaggga

SEQ ID NO: 783867 - DNA, 20 bp, Artificial
  CRISPR gRNA sequence
gtaacttagggaaagcttcc

SEQ ID NO: 783868 - DNA, 20 bp, Artificial
  CRISPR gRNA sequence
ctgtgcctccctttcttcac

SEQ ID NO: 783869 - DNA, 20 bp, Artificial
  CRISPR gRNA sequence
ccctttcttcaccagtgaaa

SEQ ID NO: 783870 - DNA, 20 bp, Artificial
  CRISPR gRNA sequence
cctttcttcaccagtgaaat

SEQ ID NO: 783871 - DNA, 20 bp, Artificial
  CRISPR gRNA sequence
ctttcttcaccagtgaaatg

SEQ ID NO: 783872 - DNA, 20 bp, Artificial
  CRISPR gRNA sequence
caccagtgaaatggggatca

SEQ ID NO: 783873 - DNA, 20 bp, Artificial
  CRISPR gRNA sequence
cagtgaaatggggatcatag

SEQ ID NO: 783874 - DNA, 20 bp, Artificial
  CRISPR gRNA sequence
gtgaaatggggatcatagca

SEQ ID NO: 783875 - DNA, 20 bp, Artificial
  CRISPR gRNA sequence
tcatagcagagccaacttca

SEQ ID NO: 783876 - DNA, 20 bp, Artificial
  CRISPR gRNA sequence
atagcagagccaacttcaca

SEQ ID NO: 783877 - DNA, 20 bp, Artificial
  CRISPR gRNA sequence
gcagagccaacttcacagag

SEQ ID NO: 783878 - DNA, 20 bp, Artificial
  CRISPR gRNA sequence
caacttcacagagtggttgc

SEQ ID NO: 783879 - DNA, 20 bp, Artificial
  CRISPR gRNA sequence
aacttcacagagtggttgcg

SEQ ID NO: 783880 - DNA, 20 bp, Artificial
  CRISPR gRNA sequence
cttcacagagtggttgcgag

SEQ ID NO: 783881 - DNA, 20 bp, Artificial
  CRISPR gRNA sequence
cacagagtggttgcgaggag

SEQ ID NO: 783882 - DNA, 20 bp, Artificial
  CRISPR gRNA sequence
agtggttgcgaggagtggat

SEQ ID NO: 783883 - DNA, 20 bp, Artificial
  CRISPR gRNA sequence
gcgaggagtggatgagctga

SEQ ID NO: 783884 - DNA, 20 bp, Artificial
  CRISPR gRNA sequence
cgaggagtggatgagctgat

SEQ ID NO: 783885 - DNA, 20 bp, Artificial
  CRISPR gRNA sequence
agtggatgagctgataggtg

SEQ ID NO: 783886 - DNA, 20 bp, Artificial
  CRISPR gRNA sequence
tggatgagctgataggtgca

SEQ ID NO: 783887 - DNA, 20 bp, Artificial
  CRISPR gRNA sequence
gctgataggtgcagagcact

SEQ ID NO: 783888 - DNA, 20 bp, Artificial
  CRISPR gRNA sequence
taggtgcagagcacttagaa

SEQ ID NO: 783889 - DNA, 20 bp, Artificial
  CRISPR gRNA sequence
aggtgcagagcacttagaat

SEQ ID NO: 783890 - DNA, 20 bp, Artificial
  CRISPR gRNA sequence
ggtgcagagcacttagaata

SEQ ID NO: 783891 - DNA, 20 bp, Artificial
  CRISPR gRNA sequence
agagcacttagaatagggcc

SEQ ID NO: 783892 - DNA, 20 bp, Artificial
  CRISPR gRNA sequence
acttagaatagggcctggtg

SEQ ID NO: 783893 - DNA, 20 bp, Artificial
  CRISPR gRNA sequence
ttagaatagggcctggtgtg

SEQ ID NO: 783894 - DNA, 20 bp, Artificial
  CRISPR gRNA sequence
ggtgtggagtaaatgctcca

SEQ ID NO: 783895 - DNA, 20 bp, Artificial
  CRISPR gRNA sequence
tgtggagtaaatgctccaca

SEQ ID NO: 783896 - DNA, 20 bp, Artificial
  CRISPR gRNA sequence
gagtaaatgctccacagagc

SEQ ID NO: 783897 - DNA, 20 bp, Artificial
  CRISPR gRNA sequence
ctccacagagctagccgtgt

SEQ ID NO: 783898 - DNA, 20 bp, Artificial
  CRISPR gRNA sequence
ttggctgtcacccactcatg

SEQ ID NO: 783899 - DNA, 20 bp, Artificial
  CRISPR gRNA sequence
ctgtcacccactcatgtggc

SEQ ID NO: 783900 - DNA, 20 bp, Artificial
  CRISPR gRNA sequence
cactcatgtggccagcctgt

SEQ ID NO: 783901 - DNA, 20 bp, Artificial
  CRISPR gRNA sequence
cagcctgttggtctacctct

SEQ ID NO: 783902 - DNA, 20 bp, Artificial
  CRISPR gRNA sequence
acctcttagttgccatgtaa

SEQ ID NO: 783903 - DNA, 20 bp, Artificial
  CRISPR gRNA sequence
cctcttagttgccatgtaac

SEQ ID NO: 783904 - DNA, 20 bp, Artificial
  CRISPR gRNA sequence
gttgccatgtaacaggattc

SEQ ID NO: 783905 - DNA, 20 bp, Artificial
  CRISPR gRNA sequence
tctggtgcttttcctttgcc

SEQ ID NO: 783906 - DNA, 20 bp, Artificial
  CRISPR gRNA sequence
ctggtgcttttcctttgccc

SEQ ID NO: 783907 - DNA, 20 bp, Artificial
  CRISPR gRNA sequence
tgcttttcctttgcccaggt

SEQ ID NO: 783908 - DNA, 20 bp, Artificial
  CRISPR gRNA sequence
tttcctttgcccaggtcaga

SEQ ID NO: 783909 - DNA, 20 bp, Artificial
  CRISPR gRNA sequence
tgcccaggtcagatggaacc

SEQ ID NO: 783910 - DNA, 20 bp, Artificial
  CRISPR gRNA sequence
gcccaggtcagatggaaccc

SEQ ID NO: 783911 - DNA, 20 bp, Artificial
  CRISPR gRNA sequence
aacccaggacccatccaact

SEQ ID NO: 783912 - DNA, 20 bp, Artificial
  CRISPR gRNA sequence
catcattgctttcattttca

SEQ ID NO: 783913 - DNA, 20 bp, Artificial
  CRISPR gRNA sequence
tgctttcattttcatagcca

SEQ ID NO: 783914 - DNA, 20 bp, Artificial
  CRISPR gRNA sequence
cattttcatagccacagtga

SEQ ID NO: 783915 - DNA, 20 bp, Artificial
  CRISPR gRNA sequence
atagccacagtgatagccct

SEQ ID NO: 783916 - DNA, 20 bp, Artificial
  CRISPR gRNA sequence
taagaaaacaactctgtcaa

SEQ ID NO: 783917 - DNA, 20 bp, Artificial
  CRISPR gRNA sequence
tcaaaagctgtattcttcaa

SEQ ID NO: 783918 - DNA, 20 bp, Artificial
  CRISPR gRNA sequence
caaaagctgtattcttcaaa

SEQ ID NO: 783919 - DNA, 20 bp, Artificial
  CRISPR gRNA sequence
agctgtattcttcaaaaggt

SEQ ID NO: 783920 - DNA, 20 bp, Artificial
  CRISPR gRNA sequence
gtattcttcaaaaggtaagt

SEQ ID NO: 783921 - DNA, 20 bp, Artificial
  CRISPR gRNA sequence
aggtaagtgagttttattca

SEQ ID NO: 783922 - DNA, 20 bp, Artificial
  CRISPR gRNA sequence
ttcatggtaacccaatgcac

SEQ ID NO: 783923 - DNA, 20 bp, Artificial
  CRISPR gRNA sequence
tcatggtaacccaatgcact

SEQ ID NO: 783924 - DNA, 20 bp, Artificial
  CRISPR gRNA sequence
cccaatgcactgggtgtctg

SEQ ID NO: 783925 - DNA, 20 bp, Artificial
  CRISPR gRNA sequence
gcactgggtgtctgcagcat

SEQ ID NO: 783926 - DNA, 20 bp, Artificial
  CRISPR gRNA sequence
tgagccactgctttgcactg

SEQ ID NO: 783927 - DNA, 20 bp, Artificial
  CRISPR gRNA sequence
gagccactgctttgcactgc

SEQ ID NO: 783928 - DNA, 20 bp, Artificial
  CRISPR gRNA sequence
tgctttgcactgcaggccta

SEQ ID NO: 783929 - DNA, 20 bp, Artificial
  CRISPR gRNA sequence
gctttcatgctaaacccact

SEQ ID NO: 783930 - DNA, 20 bp, Artificial
  CRISPR gRNA sequence
tttcatgctaaacccactca

SEQ ID NO: 783931 - DNA, 20 bp, Artificial
  CRISPR gRNA sequence
cagagcttatgaaccacttt

SEQ ID NO: 783932 - DNA, 20 bp, Artificial
  CRISPR gRNA sequence
tcttgatgattatttttccc

SEQ ID NO: 783933 - DNA, 20 bp, Artificial
  CRISPR gRNA sequence
tgatgattatttttccccag

SEQ ID NO: 783934 - DNA, 20 bp, Artificial
  CRISPR gRNA sequence
tatttttccccagaagaaaa

SEQ ID NO: 783935 - DNA, 20 bp, Artificial
  CRISPR gRNA sequence
aagaaaatggctctcatcgt

SEQ ID NO: 783936 - DNA, 20 bp, Artificial
  CRISPR gRNA sequence
aaatggctctcatcgtcagt

SEQ ID NO: 783937 - DNA, 20 bp, Artificial
  CRISPR gRNA sequence
tgagctgaacttcttacact

SEQ ID NO: 783938 - DNA, 20 bp, Artificial
  CRISPR gRNA sequence
ttcttacactgagtttttta

SEQ ID NO: 783939 - DNA, 20 bp, Artificial
  CRISPR gRNA sequence
tcttacactgagttttttaa

SEQ ID NO: 783940 - DNA, 20 bp, Artificial
  CRISPR gRNA sequence
cttacactgagttttttaaa

SEQ ID NO: 783941 - DNA, 20 bp, Artificial
  CRISPR gRNA sequence
tgttttgttcttatgtctga

SEQ ID NO: 783942 - DNA, 20 bp, Artificial
  CRISPR gRNA sequence
ttttgttcttatgtctgaaa

SEQ ID NO: 783943 - DNA, 20 bp, Artificial
  CRISPR gRNA sequence
aagagtttgtcttattcttt

SEQ ID NO: 783944 - DNA, 20 bp, Artificial
  CRISPR gRNA sequence
tttgtcttattctttgagcc

SEQ ID NO: 783945 - DNA, 20 bp, Artificial
  CRISPR gRNA sequence
tgtcttattctttgagccaa

SEQ ID NO: 783946 - DNA, 20 bp, Artificial
  CRISPR gRNA sequence
tttgagccaagagctttcat

SEQ ID NO: 783947 - DNA, 20 bp, Artificial
  CRISPR gRNA sequence
agagctttcatcagcctcat

SEQ ID NO: 783948 - DNA, 20 bp, Artificial
  CRISPR gRNA sequence
agctttcatcagcctcatga

SEQ ID NO: 783949 - DNA, 20 bp, Artificial
  CRISPR gRNA sequence
tcatgagagtgatgttattt

SEQ ID NO: 783950 - DNA, 20 bp, Artificial
  CRISPR gRNA sequence
gtgatgttattttggcaatg

SEQ ID NO: 783951 - DNA, 20 bp, Artificial
  CRISPR gRNA sequence
gatgttattttggcaatgca

SEQ ID NO: 783952 - DNA, 20 bp, Artificial
  CRISPR gRNA sequence
tgttattttggcaatgcaga

SEQ ID NO: 783953 - DNA, 20 bp, Artificial
  CRISPR gRNA sequence
gctacgtgctccgattttgc

SEQ ID NO: 783954 - DNA, 20 bp, Artificial
  CRISPR gRNA sequence
acgtgctccgattttgctgg

SEQ ID NO: 783955 - DNA, 20 bp, Artificial
  CRISPR gRNA sequence
cgtgctccgattttgctggt

SEQ ID NO: 783956 - DNA, 20 bp, Artificial
  CRISPR gRNA sequence
tgctccgattttgctggtgg

SEQ ID NO: 783957 - DNA, 20 bp, Artificial
  CRISPR gRNA sequence
gctccgattttgctggtggg

SEQ ID NO: 783958 - DNA, 20 bp, Artificial
  CRISPR gRNA sequence
ttttgctggtgggaggttgc

SEQ ID NO: 783959 - DNA, 20 bp, Artificial
  CRISPR gRNA sequence
tttgctggtgggaggttgcc

SEQ ID NO: 783960 - DNA, 20 bp, Artificial
  CRISPR gRNA sequence
aggttgccaggatcctttct

SEQ ID NO: 783961 - DNA, 20 bp, Artificial
  CRISPR gRNA sequence
ggttgccaggatcctttctg

SEQ ID NO: 783962 - DNA, 20 bp, Artificial
  CRISPR gRNA sequence
attttcacccctcttttccc

SEQ ID NO: 783963 - DNA, 20 bp, Artificial
  CRISPR gRNA sequence
cacccctcttttccccagtc

SEQ ID NO: 783964 - DNA, 20 bp, Artificial
  CRISPR gRNA sequence
tccccagtctggatatgacc

SEQ ID NO: 783965 - DNA, 20 bp, Artificial
  CRISPR gRNA sequence
ccccagtctggatatgacct

SEQ ID NO: 783966 - DNA, 20 bp, Artificial
  CRISPR gRNA sequence
gttaaacccaccccctctcc

SEQ ID NO: 783967 - DNA, 20 bp, Artificial
  CRISPR gRNA sequence
ttaaacccaccccctctccc

SEQ ID NO: 783968 - DNA, 20 bp, Artificial
  CRISPR gRNA sequence
tcccaggaatctcaacctca

SEQ ID NO: 783969 - DNA, 20 bp, Artificial
  CRISPR gRNA sequence
aggaatctcaacctcacggt

SEQ ID NO: 783970 - DNA, 20 bp, Artificial
  CRISPR gRNA sequence
ggaatctcaacctcacggtt

SEQ ID NO: 783971 - DNA, 20 bp, Artificial
  CRISPR gRNA sequence
tctcaacctcacggttgggt

SEQ ID NO: 783972 - DNA, 20 bp, Artificial
  CRISPR gRNA sequence
ctcaacctcacggttgggta

SEQ ID NO: 783973 - DNA, 20 bp, Artificial
  CRISPR gRNA sequence
acctcacggttgggtaagga

SEQ ID NO: 783974 - DNA, 20 bp, Artificial
  CRISPR gRNA sequence
cctcacggttgggtaaggaa

SEQ ID NO: 783975 - DNA, 20 bp, Artificial
  CRISPR gRNA sequence
tcacggttgggtaaggaaag

SEQ ID NO: 783976 - DNA, 20 bp, Artificial
  CRISPR gRNA sequence
ggttgggtaaggaaaggaga

SEQ ID NO: 783977 - DNA, 20 bp, Artificial
  CRISPR gRNA sequence
gttgggtaaggaaaggagaa

SEQ ID NO: 783978 - DNA, 20 bp, Artificial
  CRISPR gRNA sequence
aggaaaggagaaaggtttgt

SEQ ID NO: 783979 - DNA, 20 bp, Artificial
  CRISPR gRNA sequence
ggaaaggagaaaggtttgtg

SEQ ID NO: 783980 - DNA, 20 bp, Artificial
  CRISPR gRNA sequence
gaaaggtttgtgaggccatt

SEQ ID NO: 783981 - DNA, 20 bp, Artificial
  CRISPR gRNA sequence
aaaggtttgtgaggccattt

SEQ ID NO: 783982 - DNA, 20 bp, Artificial
  CRISPR gRNA sequence
aaggtttgtgaggccatttg

SEQ ID NO: 783983 - DNA, 20 bp, Artificial
  CRISPR gRNA sequence
ttgtgaggccatttggggat

SEQ ID NO: 783984 - DNA, 20 bp, Artificial
  CRISPR gRNA sequence
tgtgaggccatttggggata

SEQ ID NO: 783985 - DNA, 20 bp, Artificial
  CRISPR gRNA sequence
gccatttggggataaggaaa

SEQ ID NO: 783986 - DNA, 20 bp, Artificial
  CRISPR gRNA sequence
tttggggataaggaaacagc

SEQ ID NO: 783987 - DNA, 20 bp, Artificial
  CRISPR gRNA sequence
gggataaggaaacagctggt

SEQ ID NO: 783988 - DNA, 20 bp, Artificial
  CRISPR gRNA sequence
ataaggaaacagctggttgg

SEQ ID NO: 783989 - DNA, 20 bp, Artificial
  CRISPR gRNA sequence
ggtggtgcattaacgtcttt

SEQ ID NO: 783990 - DNA, 20 bp, Artificial
  CRISPR gRNA sequence
ggtgcattaacgtctttcag

SEQ ID NO: 783991 - DNA, 20 bp, Artificial
  CRISPR gRNA sequence
gtctttcagcagctcccttc

SEQ ID NO: 783992 - DNA, 20 bp, Artificial
  CRISPR gRNA sequence
gctcccttcgagtttctcct

SEQ ID NO: 783993 - DNA, 20 bp, Artificial
  CRISPR gRNA sequence
acactcctgttctgttgtac

SEQ ID NO: 783994 - DNA, 20 bp, Artificial
  CRISPR gRNA sequence
tcctgttctgttgtaccagc

SEQ ID NO: 783995 - DNA, 20 bp, Artificial
  CRISPR gRNA sequence
cctgttctgttgtaccagct

SEQ ID NO: 783996 - DNA, 20 bp, Artificial
  CRISPR gRNA sequence
ttctgttgtaccagctggga

SEQ ID NO: 783997 - DNA, 20 bp, Artificial
  CRISPR gRNA sequence
ctgttgtaccagctgggaca

SEQ ID NO: 783998 - DNA, 20 bp, Artificial
  CRISPR gRNA sequence
agctgggacagagcatgctg

SEQ ID NO: 783999 - DNA, 20 bp, Artificial
  CRISPR gRNA sequence
cagagcatgctgaagccttt

SEQ ID NO: 784000 - DNA, 20 bp, Artificial
  CRISPR gRNA sequence
attgttcatgtgtctgtctt

SEQ ID NO: 784001 - DNA, 20 bp, Artificial
  CRISPR gRNA sequence
tgtgtctgtctttggtttcc

SEQ ID NO: 784002 - DNA, 20 bp, Artificial
  CRISPR gRNA sequence
gtgtctgtctttggtttcct

SEQ ID NO: 784003 - DNA, 20 bp, Artificial
  CRISPR gRNA sequence
tctgtctttggtttcctggg

SEQ ID NO: 784004 - DNA, 20 bp, Artificial
  CRISPR gRNA sequence
tgtctttggtttcctgggtg

SEQ ID NO: 784005 - DNA, 20 bp, Artificial
  CRISPR gRNA sequence
gagcctgcccacaaaacccc

SEQ ID NO: 784006 - DNA, 20 bp, Artificial
  CRISPR gRNA sequence
caaaacccccagaatgtatg

SEQ ID NO: 784007 - DNA, 20 bp, Artificial
  CRISPR gRNA sequence
aaaacccccagaatgtatgc

SEQ ID NO: 784008 - DNA, 20 bp, Artificial
  CRISPR gRNA sequence
ccccagaatgtatgcaggcc

SEQ ID NO: 784009 - DNA, 20 bp, Artificial
  CRISPR gRNA sequence
agaatgtatgcaggcctagc

SEQ ID NO: 784010 - DNA, 20 bp, Artificial
  CRISPR gRNA sequence
ctagctggtgctttcctaaa

SEQ ID NO: 784011 - DNA, 20 bp, Artificial
  CRISPR gRNA sequence
gcactcaatgaacttctcca

SEQ ID NO: 784012 - DNA, 20 bp, Artificial
  CRISPR gRNA sequence
cttctccaaagatctataca

SEQ ID NO: 784013 - DNA, 20 bp, Artificial
  CRISPR gRNA sequence
tctatacatggcctcatcta

SEQ ID NO: 784014 - DNA, 20 bp, Artificial
  CRISPR gRNA sequence
tacatggcctcatctataga

SEQ ID NO: 784015 - DNA, 20 bp, Artificial
  CRISPR gRNA sequence
catggcctcatctatagaaa

SEQ ID NO: 784016 - DNA, 20 bp, Artificial
  CRISPR gRNA sequence
atagaaagagaaatgacatg

SEQ ID NO: 784017 - DNA, 20 bp, Artificial
  CRISPR gRNA sequence
aatgacatgtggaaataatt

SEQ ID NO: 784018 - DNA, 20 bp, Artificial
  CRISPR gRNA sequence
gacatgtggaaataattcag

SEQ ID NO: 784019 - DNA, 20 bp, Artificial
  CRISPR gRNA sequence
acatgtggaaataattcagt

SEQ ID NO: 784020 - DNA, 20 bp, Artificial
  CRISPR gRNA sequence
atgtggaaataattcagtag

SEQ ID NO: 784021 - DNA, 20 bp, Artificial
  CRISPR gRNA sequence
aataattcagtaggagtttg

SEQ ID NO: 784022 - DNA, 20 bp, Artificial
  CRISPR gRNA sequence
aattcagtaggagtttgcag

SEQ ID NO: 784023 - DNA, 20 bp, Artificial
  CRISPR gRNA sequence
agtttgcagcagcactatct

SEQ ID NO: 784024 - DNA, 20 bp, Artificial
  CRISPR gRNA sequence
gtttgcagcagcactatctg

SEQ ID NO: 784025 - DNA, 20 bp, Artificial
  CRISPR gRNA sequence
cagcagcactatctgaggac

SEQ ID NO: 784026 - DNA, 20 bp, Artificial
  CRISPR gRNA sequence
agcagcactatctgaggact

SEQ ID NO: 784027 - DNA, 20 bp, Artificial
  CRISPR gRNA sequence
gcagcactatctgaggacta

SEQ ID NO: 784028 - DNA, 20 bp, Artificial
  CRISPR gRNA sequence
cagcactatctgaggactag

SEQ ID NO: 784029 - DNA, 20 bp, Artificial
  CRISPR gRNA sequence
ctgaggactaggggaatttt

SEQ ID NO: 784030 - DNA, 20 bp, Artificial
  CRISPR gRNA sequence
aggactaggggaattttaag

SEQ ID NO: 784031 - DNA, 20 bp, Artificial
  CRISPR gRNA sequence
tatgtgtgtatgtattcact

SEQ ID NO: 784032 - DNA, 20 bp, Artificial
  CRISPR gRNA sequence
atgtgtgtatgtattcactt

SEQ ID NO: 784033 - DNA, 20 bp, Artificial
  CRISPR gRNA sequence
gaccacaatatttctaactg

SEQ ID NO: 784034 - DNA, 20 bp, Artificial
  CRISPR gRNA sequence
tatttctaactgtagaatgc

SEQ ID NO: 784035 - DNA, 20 bp, Artificial
  CRISPR gRNA sequence
atttctaactgtagaatgca

SEQ ID NO: 784036 - DNA, 20 bp, Artificial
  CRISPR gRNA sequence
atgcaaggaattgttgccaa

SEQ ID NO: 784037 - DNA, 20 bp, Artificial
  CRISPR gRNA sequence
ggaattgttgccaaaagaaa

SEQ ID NO: 784038 - DNA, 20 bp, Artificial
  CRISPR gRNA sequence
ttgttgccaaaagaaaaaga

SEQ ID NO: 784039 - DNA, 20 bp, Artificial
  CRISPR gRNA sequence
gttgccaaaagaaaaagaca

SEQ ID NO: 784040 - DNA, 20 bp, Artificial
  CRISPR gRNA sequence
ttgccaaaagaaaaagacag

SEQ ID NO: 784041 - DNA, 20 bp, Artificial
  CRISPR gRNA sequence
tgccaaaagaaaaagacaga

SEQ ID NO: 784042 - DNA, 20 bp, Artificial
  CRISPR gRNA sequence
ccaaaagaaaaagacagagg

SEQ ID NO: 784043 - DNA, 20 bp, Artificial
  CRISPR gRNA sequence
caaaagaaaaagacagaggg

SEQ ID NO: 784044 - DNA, 20 bp, Artificial
  CRISPR gRNA sequence
aaaagaaaaagacagaggga

SEQ ID NO: 784045 - DNA, 20 bp, Artificial
  CRISPR gRNA sequence
agaaaaagacagagggaggg

SEQ ID NO: 784046 - DNA, 20 bp, Artificial
  CRISPR gRNA sequence
aaaagacagagggagggaag

SEQ ID NO: 784047 - DNA, 20 bp, Artificial
  CRISPR gRNA sequence
gacagagggagggaagaaga

SEQ ID NO: 784048 - DNA, 20 bp, Artificial
  CRISPR gRNA sequence
gagggagggaagaagatggc

SEQ ID NO: 784049 - DNA, 20 bp, Artificial
  CRISPR gRNA sequence
agggagggaagaagatggcc

SEQ ID NO: 784050 - DNA, 20 bp, Artificial
  CRISPR gRNA sequence
gggagggaagaagatggcca

SEQ ID NO: 784051 - DNA, 20 bp, Artificial
  CRISPR gRNA sequence
ggagggaagaagatggccag

SEQ ID NO: 784052 - DNA, 20 bp, Artificial
  CRISPR gRNA sequence
agggaagaagatggccaggg

SEQ ID NO: 784053 - DNA, 20 bp, Artificial
  CRISPR gRNA sequence
aagaagatggccaggggagt

SEQ ID NO: 784054 - DNA, 20 bp, Artificial
  CRISPR gRNA sequence
agaagatggccaggggagtg

SEQ ID NO: 784055 - DNA, 20 bp, Artificial
  CRISPR gRNA sequence
gaagatggccaggggagtga

SEQ ID NO: 784056 - DNA, 20 bp, Artificial
  CRISPR gRNA sequence
agatggccaggggagtgagg

SEQ ID NO: 784057 - DNA, 20 bp, Artificial
  CRISPR gRNA sequence
ggccaggggagtgagggaga

SEQ ID NO: 784058 - DNA, 20 bp, Artificial
  CRISPR gRNA sequence
ccaggggagtgagggagaaa

SEQ ID NO: 784059 - DNA, 20 bp, Artificial
  CRISPR gRNA sequence
agtgagggagaaagagaaaa

SEQ ID NO: 784060 - DNA, 20 bp, Artificial
  CRISPR gRNA sequence
gtgagggagaaagagaaaac

SEQ ID NO: 784061 - DNA, 20 bp, Artificial
  CRISPR gRNA sequence
gagggagaaagagaaaacag

SEQ ID NO: 784062 - DNA, 20 bp, Artificial
  CRISPR gRNA sequence
gagaaagagaaaacaggaga

SEQ ID NO: 784063 - DNA, 20 bp, Artificial
  CRISPR gRNA sequence
gaaagagaaaacaggagatg

SEQ ID NO: 784064 - DNA, 20 bp, Artificial
  CRISPR gRNA sequence
agagaaaacaggagatggag

SEQ ID NO: 784065 - DNA, 20 bp, Artificial
  CRISPR gRNA sequence
gaaaacaggagatggagaag

SEQ ID NO: 784066 - DNA, 20 bp, Artificial
  CRISPR gRNA sequence
acaggagatggagaagaaga

SEQ ID NO: 784067 - DNA, 20 bp, Artificial
  CRISPR gRNA sequence
gagatggagaagaagaaaga

SEQ ID NO: 784068 - DNA, 20 bp, Artificial
  CRISPR gRNA sequence
tggagaagaagaaagataga

SEQ ID NO: 784069 - DNA, 20 bp, Artificial
  CRISPR gRNA sequence
gatagaaagaaaaataaatg

SEQ ID NO: 784070 - DNA, 20 bp, Artificial
  CRISPR gRNA sequence
atagaaagaaaaataaatgt

SEQ ID NO: 784071 - DNA, 20 bp, Artificial
  CRISPR gRNA sequence
agaaagaaaaataaatgtgg

SEQ ID NO: 784072 - DNA, 20 bp, Artificial
  CRISPR gRNA sequence
gaaagaaaaataaatgtggg

SEQ ID NO: 784073 - DNA, 20 bp, Artificial
  CRISPR gRNA sequence
aaagaaaaataaatgtggga

SEQ ID NO: 784074 - DNA, 20 bp, Artificial
  CRISPR gRNA sequence
gaaaaataaatgtgggaggg

SEQ ID NO: 784075 - DNA, 20 bp, Artificial
  CRISPR gRNA sequence
aaaaataaatgtgggaggga

SEQ ID NO: 784076 - DNA, 20 bp, Artificial
  CRISPR gRNA sequence
aaaataaatgtgggagggaa

SEQ ID NO: 784077 - DNA, 20 bp, Artificial
  CRISPR gRNA sequence
aataaatgtgggagggaagg

SEQ ID NO: 784078 - DNA, 20 bp, Artificial
  CRISPR gRNA sequence
tgggagggaagggagcttca

SEQ ID NO: 784079 - DNA, 20 bp, Artificial
  CRISPR gRNA sequence
gggaagggagcttcatggta

SEQ ID NO: 784080 - DNA, 20 bp, Artificial
  CRISPR gRNA sequence
ggaagggagcttcatggtaa

SEQ ID NO: 784081 - DNA, 20 bp, Artificial
  CRISPR gRNA sequence
aagggagcttcatggtaaag

SEQ ID NO: 784082 - DNA, 20 bp, Artificial
  CRISPR gRNA sequence
agggagcttcatggtaaagg

SEQ ID NO: 784083 - DNA, 20 bp, Artificial
  CRISPR gRNA sequence
ggagcttcatggtaaaggag

SEQ ID NO: 784084 - DNA, 20 bp, Artificial
  CRISPR gRNA sequence
gagcttcatggtaaaggagg

SEQ ID NO: 784085 - DNA, 20 bp, Artificial
  CRISPR gRNA sequence
aaaggaggaggtatgtccaa

SEQ ID NO: 784086 - DNA, 20 bp, Artificial
  CRISPR gRNA sequence
acagaacttcgacttttaaa

SEQ ID NO: 784087 - DNA, 20 bp, Artificial
  CRISPR gRNA sequence
acttttaaatagaaccactt

SEQ ID NO: 784088 - DNA, 20 bp, Artificial
  CRISPR gRNA sequence
ttttaaatagaaccacttca

SEQ ID NO: 784089 - DNA, 20 bp, Artificial
  CRISPR gRNA sequence
ttaaatagaaccacttcaga

SEQ ID NO: 784090 - DNA, 20 bp, Artificial
  CRISPR gRNA sequence
accacttcagagagttgtgt

SEQ ID NO: 784091 - DNA, 20 bp, Artificial
  CRISPR gRNA sequence
ccacttcagagagttgtgtc

SEQ ID NO: 784092 - DNA, 20 bp, Artificial
  CRISPR gRNA sequence
gagttgtgtcaggtgcacct

SEQ ID NO: 784093 - DNA, 20 bp, Artificial
  CRISPR gRNA sequence
tacctctcacacccatacct

SEQ ID NO: 784094 - DNA, 20 bp, Artificial
  CRISPR gRNA sequence
acctctcacacccatacctc

SEQ ID NO: 784095 - DNA, 20 bp, Artificial
  CRISPR gRNA sequence
cctctcacacccatacctca

SEQ ID NO: 784096 - DNA, 20 bp, Artificial
  CRISPR gRNA sequence
acacccatacctcagggttc

SEQ ID NO: 784097 - DNA, 20 bp, Artificial
  CRISPR gRNA sequence
cacccatacctcagggttca

SEQ ID NO: 784098 - DNA, 20 bp, Artificial
  CRISPR gRNA sequence
atacctcagggttcaaggcc

SEQ ID NO: 784099 - DNA, 20 bp, Artificial
  CRISPR gRNA sequence
tacctcagggttcaaggcct

SEQ ID NO: 784100 - DNA, 20 bp, Artificial
  CRISPR gRNA sequence
acctcagggttcaaggcctg

SEQ ID NO: 784101 - DNA, 20 bp, Artificial
  CRISPR gRNA sequence
gggttcaaggcctggggcct

SEQ ID NO: 784102 - DNA, 20 bp, Artificial
  CRISPR gRNA sequence
ggttcaaggcctggggcctg

SEQ ID NO: 784103 - DNA, 20 bp, Artificial
  CRISPR gRNA sequence
tgaggactccttaataactt

SEQ ID NO: 784104 - DNA, 20 bp, Artificial
  CRISPR gRNA sequence
tccttaataacttcagaaat

SEQ ID NO: 784105 - DNA, 20 bp, Artificial
  CRISPR gRNA sequence
ttaataacttcagaaatgag

SEQ ID NO: 784106 - DNA, 20 bp, Artificial
  CRISPR gRNA sequence
aacttcagaaatgagcagct

SEQ ID NO: 784107 - DNA, 20 bp, Artificial
  CRISPR gRNA sequence
agcagctgagtgttccgttc

SEQ ID NO: 784108 - DNA, 20 bp, Artificial
  CRISPR gRNA sequence
tgttccgttccagctgtctt

SEQ ID NO: 784109 - DNA, 20 bp, Artificial
  CRISPR gRNA sequence
gttccgttccagctgtcttt

SEQ ID NO: 784110 - DNA, 20 bp, Artificial
  CRISPR gRNA sequence
tccgttccagctgtctttgg

SEQ ID NO: 784111 - DNA, 20 bp, Artificial
  CRISPR gRNA sequence
tccagctgtctttgggagaa

SEQ ID NO: 784112 - DNA, 20 bp, Artificial
  CRISPR gRNA sequence
ctgtctttgggagaatggaa

SEQ ID NO: 784113 - DNA, 20 bp, Artificial
  CRISPR gRNA sequence
gtctttgggagaatggaatg

SEQ ID NO: 784114 - DNA, 20 bp, Artificial
  CRISPR gRNA sequence
atggaatggagtcacactca

SEQ ID NO: 784115 - DNA, 20 bp, Artificial
  CRISPR gRNA sequence
aatggagtcacactcaaaga

SEQ ID NO: 784116 - DNA, 20 bp, Artificial
  CRISPR gRNA sequence
tggagtcacactcaaagata

SEQ ID NO: 784117 - DNA, 20 bp, Artificial
  CRISPR gRNA sequence
agtcacactcaaagatagag

SEQ ID NO: 784118 - DNA, 20 bp, Artificial
  CRISPR gRNA sequence
tcatccttcaccccaatctt

SEQ ID NO: 784119 - DNA, 20 bp, Artificial
  CRISPR gRNA sequence
atccttcaccccaatcttaa

SEQ ID NO: 784120 - DNA, 20 bp, Artificial
  CRISPR gRNA sequence
ttcaccccaatcttaagagt

SEQ ID NO: 784121 - DNA, 20 bp, Artificial
  CRISPR gRNA sequence
ccccaatcttaagagtgagt

SEQ ID NO: 784122 - DNA, 20 bp, Artificial
  CRISPR gRNA sequence
cccaatcttaagagtgagtg

SEQ ID NO: 784123 - DNA, 20 bp, Artificial
  CRISPR gRNA sequence
ttaagagtgagtgaggatat

SEQ ID NO: 784124 - DNA, 20 bp, Artificial
  CRISPR gRNA sequence
agagtgagtgaggatatcag

SEQ ID NO: 784125 - DNA, 20 bp, Artificial
  CRISPR gRNA sequence
gtgaggatatcagtagctcc

SEQ ID NO: 784126 - DNA, 20 bp, Artificial
  CRISPR gRNA sequence
ggatatcagtagctccgagc

SEQ ID NO: 784127 - DNA, 20 bp, Artificial
  CRISPR gRNA sequence
gatatcagtagctccgagct

SEQ ID NO: 784128 - DNA, 20 bp, Artificial
  CRISPR gRNA sequence
tatcagtagctccgagctgg

SEQ ID NO: 784129 - DNA, 20 bp, Artificial
  CRISPR gRNA sequence
atcagtagctccgagctggg

SEQ ID NO: 784130 - DNA, 20 bp, Artificial
  CRISPR gRNA sequence
tagctccgagctgggaggta

SEQ ID NO: 784131 - DNA, 20 bp, Artificial
  CRISPR gRNA sequence
cgagctgggaggtaaagctc

SEQ ID NO: 784132 - DNA, 20 bp, Artificial
  CRISPR gRNA sequence
gctcaagttctaactgtgat

SEQ ID NO: 784133 - DNA, 20 bp, Artificial
  CRISPR gRNA sequence
ctcaagttctaactgtgatt

SEQ ID NO: 784134 - DNA, 20 bp, Artificial
  CRISPR gRNA sequence
caagttctaactgtgattag

SEQ ID NO: 784135 - DNA, 20 bp, Artificial
  CRISPR gRNA sequence
aggagacctttcttacaaat

SEQ ID NO: 784136 - DNA, 20 bp, Artificial
  CRISPR gRNA sequence
ctttcttacaaataagaatt

SEQ ID NO: 784137 - DNA, 20 bp, Artificial
  CRISPR gRNA sequence
cttttatatttttaatgaac

SEQ ID NO: 784138 - DNA, 20 bp, Artificial
  CRISPR gRNA sequence
tttatatttttaatgaacca

SEQ ID NO: 784139 - DNA, 20 bp, Artificial
  CRISPR gRNA sequence
tatatttttaatgaaccaga

SEQ ID NO: 784140 - DNA, 20 bp, Artificial
  CRISPR gRNA sequence
aatgaaccagagagaaatca

SEQ ID NO: 784141 - DNA, 20 bp, Artificial
  CRISPR gRNA sequence
gtctccaactcacttgcatt

SEQ ID NO: 784142 - DNA, 20 bp, Artificial
  CRISPR gRNA sequence
gcacacaaacttgtgtgcca

SEQ ID NO: 784143 - DNA, 20 bp, Artificial
  CRISPR gRNA sequence
caaacttgtgtgccatggaa

SEQ ID NO: 784144 - DNA, 20 bp, Artificial
  CRISPR gRNA sequence
aaacttgtgtgccatggaaa

SEQ ID NO: 784145 - DNA, 20 bp, Artificial
  CRISPR gRNA sequence
aacttgtgtgccatggaaaa

SEQ ID NO: 784146 - DNA, 20 bp, Artificial
  CRISPR gRNA sequence
gtgtgccatggaaaagggtt

SEQ ID NO: 784147 - DNA, 20 bp, Artificial
  CRISPR gRNA sequence
ggaaaagggttgagaactgc

SEQ ID NO: 784148 - DNA, 20 bp, Artificial
  CRISPR gRNA sequence
gttgagaactgctggtgatg

SEQ ID NO: 784149 - DNA, 20 bp, Artificial
  CRISPR gRNA sequence
agaactgctggtgatgcaga

SEQ ID NO: 784150 - DNA, 20 bp, Artificial
  CRISPR gRNA sequence
aactgctggtgatgcagaca

SEQ ID NO: 784151 - DNA, 20 bp, Artificial
  CRISPR gRNA sequence
atgcagacagagctttaaac

SEQ ID NO: 784152 - DNA, 20 bp, Artificial
  CRISPR gRNA sequence
tgcagacagagctttaaacc

SEQ ID NO: 784153 - DNA, 20 bp, Artificial
  CRISPR gRNA sequence
gcagacagagctttaaacca

SEQ ID NO: 784154 - DNA, 20 bp, Artificial
  CRISPR gRNA sequence
acagagctttaaaccagggt

SEQ ID NO: 784155 - DNA, 20 bp, Artificial
  CRISPR gRNA sequence
agagctttaaaccagggtca

SEQ ID NO: 784156 - DNA, 20 bp, Artificial
  CRISPR gRNA sequence
gagctttaaaccagggtcag

SEQ ID NO: 784157 - DNA, 20 bp, Artificial
  CRISPR gRNA sequence
agctttaaaccagggtcaga

SEQ ID NO: 784158 - DNA, 20 bp, Artificial
  CRISPR gRNA sequence
ttaaaccagggtcagagggc

SEQ ID NO: 784159 - DNA, 20 bp, Artificial
  CRISPR gRNA sequence
taaaccagggtcagagggct

SEQ ID NO: 784160 - DNA, 20 bp, Artificial
  CRISPR gRNA sequence
ccagggtcagagggctaggc

SEQ ID NO: 784161 - DNA, 20 bp, Artificial
  CRISPR gRNA sequence
cagggtcagagggctaggct

SEQ ID NO: 784162 - DNA, 20 bp, Artificial
  CRISPR gRNA sequence
gaccttgtgctgccatttgt

SEQ ID NO: 784163 - DNA, 20 bp, Artificial
  CRISPR gRNA sequence
acaaattgcctatcttcttt

SEQ ID NO: 784164 - DNA, 20 bp, Artificial
  CRISPR gRNA sequence
attgcctatcttctttgaga

SEQ ID NO: 784165 - DNA, 20 bp, Artificial
  CRISPR gRNA sequence
gatggtctttctatctgtaa

SEQ ID NO: 784166 - DNA, 20 bp, Artificial
  CRISPR gRNA sequence
atggtctttctatctgtaaa

SEQ ID NO: 784167 - DNA, 20 bp, Artificial
  CRISPR gRNA sequence
tggtctttctatctgtaaaa

SEQ ID NO: 784168 - DNA, 20 bp, Artificial
  CRISPR gRNA sequence
ggtctttctatctgtaaaag

SEQ ID NO: 784169 - DNA, 20 bp, Artificial
  CRISPR gRNA sequence
ctttctatctgtaaaagggg

SEQ ID NO: 784170 - DNA, 20 bp, Artificial
  CRISPR gRNA sequence
tctatctgtaaaaggggaag

SEQ ID NO: 784171 - DNA, 20 bp, Artificial
  CRISPR gRNA sequence
tctgtaaaaggggaagcagc

SEQ ID NO: 784172 - DNA, 20 bp, Artificial
  CRISPR gRNA sequence
tgtaaaaggggaagcagcaa

SEQ ID NO: 784173 - DNA, 20 bp, Artificial
  CRISPR gRNA sequence
aaaaggggaagcagcaagag

SEQ ID NO: 784174 - DNA, 20 bp, Artificial
  CRISPR gRNA sequence
aaaggggaagcagcaagaga

SEQ ID NO: 784175 - DNA, 20 bp, Artificial
  CRISPR gRNA sequence
gcaagagaaggaacatttta

SEQ ID NO: 784176 - DNA, 20 bp, Artificial
  CRISPR gRNA sequence
aggaacattttacagcttat

SEQ ID NO: 784177 - DNA, 20 bp, Artificial
  CRISPR gRNA sequence
tggccgaacttcactgccgc

SEQ ID NO: 784178 - DNA, 20 bp, Artificial
  CRISPR gRNA sequence
gaacttcactgccgctagtg

SEQ ID NO: 784179 - DNA, 20 bp, Artificial
  CRISPR gRNA sequence
gccgctagtgtggttcaact

SEQ ID NO: 784180 - DNA, 20 bp, Artificial
  CRISPR gRNA sequence
gtgtggttcaacttggacta

SEQ ID NO: 784181 - DNA, 20 bp, Artificial
  CRISPR gRNA sequence
gtggttcaacttggactaca

SEQ ID NO: 784182 - DNA, 20 bp, Artificial
  CRISPR gRNA sequence
tacagagaaatcttcctaac

SEQ ID NO: 784183 - DNA, 20 bp, Artificial
  CRISPR gRNA sequence
cactcctgctacctccaact

SEQ ID NO: 784184 - DNA, 20 bp, Artificial
  CRISPR gRNA sequence
gttctcactttttgctataa

SEQ ID NO: 784185 - DNA, 20 bp, Artificial
  CRISPR gRNA sequence
ttctcactttttgctataat

SEQ ID NO: 784186 - DNA, 20 bp, Artificial
  CRISPR gRNA sequence
tctaccatgtgtcctctgtc

SEQ ID NO: 784187 - DNA, 20 bp, Artificial
  CRISPR gRNA sequence
ctctgtccagaccttctcca

SEQ ID NO: 784188 - DNA, 20 bp, Artificial
  CRISPR gRNA sequence
catggcttcttattgctcac

SEQ ID NO: 784189 - DNA, 20 bp, Artificial
  CRISPR gRNA sequence
ttcttattgctcactggatg

SEQ ID NO: 784190 - DNA, 20 bp, Artificial
  CRISPR gRNA sequence
tcactggatgaagttccaac

SEQ ID NO: 784191 - DNA, 20 bp, Artificial
  CRISPR gRNA sequence
ggatgaagttccaacgagcc

SEQ ID NO: 784192 - DNA, 20 bp, Artificial
  CRISPR gRNA sequence
gatgaagttccaacgagccc

SEQ ID NO: 784193 - DNA, 20 bp, Artificial
  CRISPR gRNA sequence
aagttccaacgagcccagga

SEQ ID NO: 784194 - DNA, 20 bp, Artificial
  CRISPR gRNA sequence
gatggtttgactcatgtctc

SEQ ID NO: 784195 - DNA, 20 bp, Artificial
  CRISPR gRNA sequence
accatcaccttcattgtcta

SEQ ID NO: 784196 - DNA, 20 bp, Artificial
  CRISPR gRNA sequence
tgtctaaagctctaaccaca

SEQ ID NO: 784197 - DNA, 20 bp, Artificial
  CRISPR gRNA sequence
gtctaaagctctaaccacac

SEQ ID NO: 784198 - DNA, 20 bp, Artificial
  CRISPR gRNA sequence
tctaaccacacaggattttc

SEQ ID NO: 784199 - DNA, 20 bp, Artificial
  CRISPR gRNA sequence
acacaggattttctagtcct

SEQ ID NO: 784200 - DNA, 20 bp, Artificial
  CRISPR gRNA sequence
acaggattttctagtcctca

SEQ ID NO: 784201 - DNA, 20 bp, Artificial
  CRISPR gRNA sequence
caggattttctagtcctcag

SEQ ID NO: 784202 - DNA, 20 bp, Artificial
  CRISPR gRNA sequence
ttttctagtcctcagaggca

SEQ ID NO: 784203 - DNA, 20 bp, Artificial
  CRISPR gRNA sequence
tctagtcctcagaggcatgg

SEQ ID NO: 784204 - DNA, 20 bp, Artificial
  CRISPR gRNA sequence
catggcagtctttcaattcc

SEQ ID NO: 784205 - DNA, 20 bp, Artificial
  CRISPR gRNA sequence
ttttttcttgttgtccacct

SEQ ID NO: 784206 - DNA, 20 bp, Artificial
  CRISPR gRNA sequence
ttcttgttgtccacctgagt

SEQ ID NO: 784207 - DNA, 20 bp, Artificial
  CRISPR gRNA sequence
cttgttgtccacctgagttg

SEQ ID NO: 784208 - DNA, 20 bp, Artificial
  CRISPR gRNA sequence
tggagtcatcttttaaatct

SEQ ID NO: 784209 - DNA, 20 bp, Artificial
  CRISPR gRNA sequence
tcatcttttaaatctcagct

SEQ ID NO: 784210 - DNA, 20 bp, Artificial
  CRISPR gRNA sequence
agctaagcttatacttcatc

SEQ ID NO: 784211 - DNA, 20 bp, Artificial
  CRISPR gRNA sequence
ccccttattatatgtttcca

SEQ ID NO: 784212 - DNA, 20 bp, Artificial
  CRISPR gRNA sequence
atagcacctacttcttcttt

SEQ ID NO: 784213 - DNA, 20 bp, Artificial
  CRISPR gRNA sequence
acttcttctttcagtatact

SEQ ID NO: 784214 - DNA, 20 bp, Artificial
  CRISPR gRNA sequence
tcagcacacaatcacatgtc

SEQ ID NO: 784215 - DNA, 20 bp, Artificial
  CRISPR gRNA sequence
cagcacacaatcacatgtct

SEQ ID NO: 784216 - DNA, 20 bp, Artificial
  CRISPR gRNA sequence
atgtctaggatctgttttaa

SEQ ID NO: 784217 - DNA, 20 bp, Artificial
  CRISPR gRNA sequence
taggatctgttttaatagct

SEQ ID NO: 784218 - DNA, 20 bp, Artificial
  CRISPR gRNA sequence
aattttccaattgattcctc

SEQ ID NO: 784219 - DNA, 20 bp, Artificial
  CRISPR gRNA sequence
aagtacccacatgcccatct

SEQ ID NO: 784220 - DNA, 20 bp, Artificial
  CRISPR gRNA sequence
acccacatgcccatcttagc

SEQ ID NO: 784221 - DNA, 20 bp, Artificial
  CRISPR gRNA sequence
cacatgcccatcttagcaag

SEQ ID NO: 784222 - DNA, 20 bp, Artificial
  CRISPR gRNA sequence
gcccatcttagcaagaagtt

SEQ ID NO: 784223 - DNA, 20 bp, Artificial
  CRISPR gRNA sequence
agttcagtgtctccctctta

SEQ ID NO: 784224 - DNA, 20 bp, Artificial
  CRISPR gRNA sequence
ctccacctcccacaaactgc

SEQ ID NO: 784225 - DNA, 20 bp, Artificial
  CRISPR gRNA sequence
acctcccacaaactgccaga

SEQ ID NO: 784226 - DNA, 20 bp, Artificial
  CRISPR gRNA sequence
aaactgccagaaagcttact

SEQ ID NO: 784227 - DNA, 20 bp, Artificial
  CRISPR gRNA sequence
cagaaagcttacttagccca

SEQ ID NO: 784228 - DNA, 20 bp, Artificial
  CRISPR gRNA sequence
agaaagcttacttagcccac

SEQ ID NO: 784229 - DNA, 20 bp, Artificial
  CRISPR gRNA sequence
gaaagcttacttagcccaca

SEQ ID NO: 784230 - DNA, 20 bp, Artificial
  CRISPR gRNA sequence
gcttacttagcccacagggc

SEQ ID NO: 784231 - DNA, 20 bp, Artificial
  CRISPR gRNA sequence
ttagcccacagggccagtgc

SEQ ID NO: 784232 - DNA, 20 bp, Artificial
  CRISPR gRNA sequence
tagcccacagggccagtgct

SEQ ID NO: 784233 - DNA, 20 bp, Artificial
  CRISPR gRNA sequence
cccacagggccagtgctagg

SEQ ID NO: 784234 - DNA, 20 bp, Artificial
  CRISPR gRNA sequence
cagggccagtgctaggcagc

SEQ ID NO: 784235 - DNA, 20 bp, Artificial
  CRISPR gRNA sequence
agggccagtgctaggcagct

SEQ ID NO: 784236 - DNA, 20 bp, Artificial
  CRISPR gRNA sequence
ccagtgctaggcagctaggt

SEQ ID NO: 784237 - DNA, 20 bp, Artificial
  CRISPR gRNA sequence
aggcagctaggttagtcctc

SEQ ID NO: 784238 - DNA, 20 bp, Artificial
  CRISPR gRNA sequence
gcagctaggttagtcctcca

SEQ ID NO: 784239 - DNA, 20 bp, Artificial
  CRISPR gRNA sequence
cagctaggttagtcctccag

SEQ ID NO: 784240 - DNA, 20 bp, Artificial
  CRISPR gRNA sequence
agctaggttagtcctccaga

SEQ ID NO: 784241 - DNA, 20 bp, Artificial
  CRISPR gRNA sequence
gttagtcctccagagggccc

SEQ ID NO: 784242 - DNA, 20 bp, Artificial
  CRISPR gRNA sequence
ctccagagggccctggtttt

SEQ ID NO: 784243 - DNA, 20 bp, Artificial
  CRISPR gRNA sequence
cagagggccctggttttgag

SEQ ID NO: 784244 - DNA, 20 bp, Artificial
  CRISPR gRNA sequence
tgagcagttgctgtctactc

SEQ ID NO: 784245 - DNA, 20 bp, Artificial
  CRISPR gRNA sequence
tgctgtctactccggccatg

SEQ ID NO: 784246 - DNA, 20 bp, Artificial
  CRISPR gRNA sequence
ctccggccatgcagaatctc

SEQ ID NO: 784247 - DNA, 20 bp, Artificial
  CRISPR gRNA sequence
tgcagaatctctggtccttc

SEQ ID NO: 784248 - DNA, 20 bp, Artificial
  CRISPR gRNA sequence
atgtctccatccactgtgca

SEQ ID NO: 784249 - DNA, 20 bp, Artificial
  CRISPR gRNA sequence
tgtctccatccactgtgcaa

SEQ ID NO: 784250 - DNA, 20 bp, Artificial
  CRISPR gRNA sequence
ctgtgcaaaggtaaccttgc

SEQ ID NO: 784251 - DNA, 20 bp, Artificial
  CRISPR gRNA sequence
tgctggttccgatccccaca

SEQ ID NO: 784252 - DNA, 20 bp, Artificial
  CRISPR gRNA sequence
tccgatccccacacagacca

SEQ ID NO: 784253 - DNA, 20 bp, Artificial
  CRISPR gRNA sequence
cacacagaccacagtgctac

SEQ ID NO: 784254 - DNA, 20 bp, Artificial
  CRISPR gRNA sequence
accacagtgctacaagatta

SEQ ID NO: 784255 - DNA, 20 bp, Artificial
  CRISPR gRNA sequence
ctacaagattacagttctta

SEQ ID NO: 784256 - DNA, 20 bp, Artificial
  CRISPR gRNA sequence
cccaacacatgctctgtcat

SEQ ID NO: 784257 - DNA, 20 bp, Artificial
  CRISPR gRNA sequence
atgctctgtcattggtccca

SEQ ID NO: 784258 - DNA, 20 bp, Artificial
  CRISPR gRNA sequence
ctctgtcattggtcccaaag

SEQ ID NO: 784259 - DNA, 20 bp, Artificial
  CRISPR gRNA sequence
tctgtcattggtcccaaagc

SEQ ID NO: 784260 - DNA, 20 bp, Artificial
  CRISPR gRNA sequence
gtcccaaagcaggaccccta

SEQ ID NO: 784261 - DNA, 20 bp, Artificial
  CRISPR gRNA sequence
tcccaaagcaggacccctat

SEQ ID NO: 784262 - DNA, 20 bp, Artificial
  CRISPR gRNA sequence
caggacccctatgggttgat

SEQ ID NO: 784263 - DNA, 20 bp, Artificial
  CRISPR gRNA sequence
aggacccctatgggttgatg

SEQ ID NO: 784264 - DNA, 20 bp, Artificial
  CRISPR gRNA sequence
acccctatgggttgatgagg

SEQ ID NO: 784265 - DNA, 20 bp, Artificial
  CRISPR gRNA sequence
cccctatgggttgatgaggt

SEQ ID NO: 784266 - DNA, 20 bp, Artificial
  CRISPR gRNA sequence
cctatgggttgatgaggtag

SEQ ID NO: 784267 - DNA, 20 bp, Artificial
  CRISPR gRNA sequence
ctatgggttgatgaggtagg

SEQ ID NO: 784268 - DNA, 20 bp, Artificial
  CRISPR gRNA sequence
atgggttgatgaggtaggag

SEQ ID NO: 784269 - DNA, 20 bp, Artificial
  CRISPR gRNA sequence
tgggttgatgaggtaggagg

SEQ ID NO: 784270 - DNA, 20 bp, Artificial
  CRISPR gRNA sequence
gtaggaggaggtccctgcct

SEQ ID NO: 784271 - DNA, 20 bp, Artificial
  CRISPR gRNA sequence
ggaggtccctgccttagcca

SEQ ID NO: 784272 - DNA, 20 bp, Artificial
  CRISPR gRNA sequence
gccttagccacagctgcaca

SEQ ID NO: 784273 - DNA, 20 bp, Artificial
  CRISPR gRNA sequence
tagccacagctgcacacagc

SEQ ID NO: 784274 - DNA, 20 bp, Artificial
  CRISPR gRNA sequence
acagccagcctcttcccttc

SEQ ID NO: 784275 - DNA, 20 bp, Artificial
  CRISPR gRNA sequence
cagccagcctcttcccttct

SEQ ID NO: 784276 - DNA, 20 bp, Artificial
  CRISPR gRNA sequence
cccttctaggccctcatgtt

SEQ ID NO: 784277 - DNA, 20 bp, Artificial
  CRISPR gRNA sequence
ctaggccctcatgttgagcc

SEQ ID NO: 784278 - DNA, 20 bp, Artificial
  CRISPR gRNA sequence
taggccctcatgttgagcct

SEQ ID NO: 784279 - DNA, 20 bp, Artificial
  CRISPR gRNA sequence
tcatgttgagcctgggacgc

SEQ ID NO: 784280 - DNA, 20 bp, Artificial
  CRISPR gRNA sequence
agtcctaacttccttctctt

SEQ ID NO: 784281 - DNA, 20 bp, Artificial
  CRISPR gRNA sequence
tccttctcttcagttcctct

SEQ ID NO: 784282 - DNA, 20 bp, Artificial
  CRISPR gRNA sequence
ccttctcttcagttcctctt

SEQ ID NO: 784283 - DNA, 20 bp, Artificial
  CRISPR gRNA sequence
cttctcttcagttcctctta

SEQ ID NO: 784284 - DNA, 20 bp, Artificial
  CRISPR gRNA sequence
tcagttcctcttagggccat

SEQ ID NO: 784285 - DNA, 20 bp, Artificial
  CRISPR gRNA sequence
cattggtatcctgaatttct

SEQ ID NO: 784286 - DNA, 20 bp, Artificial
  CRISPR gRNA sequence
gaatttcttagtccattgca

SEQ ID NO: 784287 - DNA, 20 bp, Artificial
  CRISPR gRNA sequence
tcttagtccattgcaaagtt

SEQ ID NO: 784288 - DNA, 20 bp, Artificial
  CRISPR gRNA sequence
gtccattgcaaagttaagta

SEQ ID NO: 784289 - DNA, 20 bp, Artificial
  CRISPR gRNA sequence
cattgcaaagttaagtaaag

SEQ ID NO: 784290 - DNA, 20 bp, Artificial
  CRISPR gRNA sequence
tgcaaagttaagtaaagaag

SEQ ID NO: 784291 - DNA, 20 bp, Artificial
  CRISPR gRNA sequence
aaagttaagtaaagaagcag

SEQ ID NO: 784292 - DNA, 20 bp, Artificial
  CRISPR gRNA sequence
aagttaagtaaagaagcagc

SEQ ID NO: 784293 - DNA, 20 bp, Artificial
  CRISPR gRNA sequence
aagtaaagaagcagcaggct

SEQ ID NO: 784294 - DNA, 20 bp, Artificial
  CRISPR gRNA sequence
aggcttggtccctttccttc

SEQ ID NO: 784295 - DNA, 20 bp, Artificial
  CRISPR gRNA sequence
ttggtccctttccttccaga

SEQ ID NO: 784296 - DNA, 20 bp, Artificial
  CRISPR gRNA sequence
tttccttccagatggcttct

SEQ ID NO: 784297 - DNA, 20 bp, Artificial
  CRISPR gRNA sequence
atggcttcttagctcctgaa

SEQ ID NO: 784298 - DNA, 20 bp, Artificial
  CRISPR gRNA sequence
agatttacccacctatacct

SEQ ID NO: 784299 - DNA, 20 bp, Artificial
  CRISPR gRNA sequence
cccacctatacctcagtgac

SEQ ID NO: 784300 - DNA, 20 bp, Artificial
  CRISPR gRNA sequence
gtgactagctctgtgtacta

SEQ ID NO: 784301 - DNA, 20 bp, Artificial
  CRISPR gRNA sequence
ctctgtgtactaaagtgtat

SEQ ID NO: 784302 - DNA, 20 bp, Artificial
  CRISPR gRNA sequence
tctgtgtactaaagtgtatt

SEQ ID NO: 784303 - DNA, 20 bp, Artificial
  CRISPR gRNA sequence
tgtgtactaaagtgtattgg

SEQ ID NO: 784304 - DNA, 20 bp, Artificial
  CRISPR gRNA sequence
gtgtactaaagtgtattggg

SEQ ID NO: 784305 - DNA, 20 bp, Artificial
  CRISPR gRNA sequence
tgtactaaagtgtattggga

SEQ ID NO: 784306 - DNA, 20 bp, Artificial
  CRISPR gRNA sequence
actaaagtgtattgggaggg

SEQ ID NO: 784307 - DNA, 20 bp, Artificial
  CRISPR gRNA sequence
attgggagggcagccattat

SEQ ID NO: 784308 - DNA, 20 bp, Artificial
  CRISPR gRNA sequence
cagccattattggtccataa

SEQ ID NO: 784309 - DNA, 20 bp, Artificial
  CRISPR gRNA sequence
agccattattggtccataaa

SEQ ID NO: 784310 - DNA, 20 bp, Artificial
  CRISPR gRNA sequence
cctgcttaccattttcccct

SEQ ID NO: 784311 - DNA, 20 bp, Artificial
  CRISPR gRNA sequence
tgcttaccattttcccctaa

SEQ ID NO: 784312 - DNA, 20 bp, Artificial
  CRISPR gRNA sequence
gcttaccattttcccctaag

SEQ ID NO: 784313 - DNA, 20 bp, Artificial
  CRISPR gRNA sequence
ccctaagaggaaccattcaa

SEQ ID NO: 784314 - DNA, 20 bp, Artificial
  CRISPR gRNA sequence
agaggaaccattcaacagtt

SEQ ID NO: 784315 - DNA, 20 bp, Artificial
  CRISPR gRNA sequence
gaggaaccattcaacagttt

SEQ ID NO: 784316 - DNA, 20 bp, Artificial
  CRISPR gRNA sequence
aggaaccattcaacagtttg

SEQ ID NO: 784317 - DNA, 20 bp, Artificial
  CRISPR gRNA sequence
cattcaacagtttggggctc

SEQ ID NO: 784318 - DNA, 20 bp, Artificial
  CRISPR gRNA sequence
attcaacagtttggggctcg

SEQ ID NO: 784319 - DNA, 20 bp, Artificial
  CRISPR gRNA sequence
ttcaacagtttggggctcga

SEQ ID NO: 784320 - DNA, 20 bp, Artificial
  CRISPR gRNA sequence
ggggctcgagggtgacctgc

SEQ ID NO: 784321 - DNA, 20 bp, Artificial
  CRISPR gRNA sequence
gggctcgagggtgacctgct

SEQ ID NO: 784322 - DNA, 20 bp, Artificial
  CRISPR gRNA sequence
gagggtgacctgctgggctc

SEQ ID NO: 784323 - DNA, 20 bp, Artificial
  CRISPR gRNA sequence
gggtgacctgctgggctcta

SEQ ID NO: 784324 - DNA, 20 bp, Artificial
  CRISPR gRNA sequence
tgacctgctgggctctagag

SEQ ID NO: 784325 - DNA, 20 bp, Artificial
  CRISPR gRNA sequence
cctgctgggctctagagaag

SEQ ID NO: 784326 - DNA, 20 bp, Artificial
  CRISPR gRNA sequence
ctgggctctagagaagaagc

SEQ ID NO: 784327 - DNA, 20 bp, Artificial
  CRISPR gRNA sequence
tctgcttgtctttacgtttc

SEQ ID NO: 784328 - DNA, 20 bp, Artificial
  CRISPR gRNA sequence
gtctttacgtttcaagaata

SEQ ID NO: 784329 - DNA, 20 bp, Artificial
  CRISPR gRNA sequence
ctgattcaccaatatatgcc

SEQ ID NO: 784330 - DNA, 20 bp, Artificial
  CRISPR gRNA sequence
ccagtgtctaaaaaattacc

SEQ ID NO: 784331 - DNA, 20 bp, Artificial
  CRISPR gRNA sequence
aacattgaacctactatatg

SEQ ID NO: 784332 - DNA, 20 bp, Artificial
  CRISPR gRNA sequence
acattgaacctactatatgc

SEQ ID NO: 784333 - DNA, 20 bp, Artificial
  CRISPR gRNA sequence
tgaacctactatatgcaggt

SEQ ID NO: 784334 - DNA, 20 bp, Artificial
  CRISPR gRNA sequence
ctatatgcaggtgagtatgc

SEQ ID NO: 784335 - DNA, 20 bp, Artificial
  CRISPR gRNA sequence
atctgctctgtccaatataa

SEQ ID NO: 784336 - DNA, 20 bp, Artificial
  CRISPR gRNA sequence
tccaatataatagccatctg

SEQ ID NO: 784337 - DNA, 20 bp, Artificial
  CRISPR gRNA sequence
agccatctgtggctcttttt

SEQ ID NO: 784338 - DNA, 20 bp, Artificial
  CRISPR gRNA sequence
taagttaaataaaaattcat

SEQ ID NO: 784339 - DNA, 20 bp, Artificial
  CRISPR gRNA sequence
aaattcatcagtcacatctt

SEQ ID NO: 784340 - DNA, 20 bp, Artificial
  CRISPR gRNA sequence
cttaagtattcacacactgt

SEQ ID NO: 784341 - DNA, 20 bp, Artificial
  CRISPR gRNA sequence
cacacactgtaagtgctcaa

SEQ ID NO: 784342 - DNA, 20 bp, Artificial
  CRISPR gRNA sequence
aagtgctcaatagccatgta

SEQ ID NO: 784343 - DNA, 20 bp, Artificial
  CRISPR gRNA sequence
acagataattgctcctgtat

SEQ ID NO: 784344 - DNA, 20 bp, Artificial
  CRISPR gRNA sequence
ataattgctcctgtattgga

SEQ ID NO: 784345 - DNA, 20 bp, Artificial
  CRISPR gRNA sequence
tgctcctgtattggacagta

SEQ ID NO: 784346 - DNA, 20 bp, Artificial
  CRISPR gRNA sequence
atacaacatttccatcattg

SEQ ID NO: 784347 - DNA, 20 bp, Artificial
  CRISPR gRNA sequence
aacatttccatcattgcaga

SEQ ID NO: 784348 - DNA, 20 bp, Artificial
  CRISPR gRNA sequence
tctactgaaaaccactgtgc

SEQ ID NO: 784349 - DNA, 20 bp, Artificial
  CRISPR gRNA sequence
aatttcacaaaaattgcttg

SEQ ID NO: 784350 - DNA, 20 bp, Artificial
  CRISPR gRNA sequence
tcacaaaaattgcttgtggc

SEQ ID NO: 784351 - DNA, 20 bp, Artificial
  CRISPR gRNA sequence
cacaaaaattgcttgtggca

SEQ ID NO: 784352 - DNA, 20 bp, Artificial
  CRISPR gRNA sequence
caaaaattgcttgtggcaag

SEQ ID NO: 784353 - DNA, 20 bp, Artificial
  CRISPR gRNA sequence
aaattgcttgtggcaaggag

SEQ ID NO: 784354 - DNA, 20 bp, Artificial
  CRISPR gRNA sequence
aaggagaagtgtctttatgc

SEQ ID NO: 784355 - DNA, 20 bp, Artificial
  CRISPR gRNA sequence
ggagaagtgtctttatgctg

SEQ ID NO: 784356 - DNA, 20 bp, Artificial
  CRISPR gRNA sequence
agtgtctttatgctggagtt

SEQ ID NO: 784357 - DNA, 20 bp, Artificial
  CRISPR gRNA sequence
tctttatgctggagttaaga

SEQ ID NO: 784358 - DNA, 20 bp, Artificial
  CRISPR gRNA sequence
tatgctggagttaagaaagt

SEQ ID NO: 784359 - DNA, 20 bp, Artificial
  CRISPR gRNA sequence
atgctggagttaagaaagtg

SEQ ID NO: 784360 - DNA, 20 bp, Artificial
  CRISPR gRNA sequence
ggagttaagaaagtgaggct

SEQ ID NO: 784361 - DNA, 20 bp, Artificial
  CRISPR gRNA sequence
taagaaagtgaggctcagaa

SEQ ID NO: 784362 - DNA, 20 bp, Artificial
  CRISPR gRNA sequence
aaaagttatatgacttccca

SEQ ID NO: 784363 - DNA, 20 bp, Artificial
  CRISPR gRNA sequence
tatgacttcccaaagtcata

SEQ ID NO: 784364 - DNA, 20 bp, Artificial
  CRISPR gRNA sequence
acttcccaaagtcatacagc

SEQ ID NO: 784365 - DNA, 20 bp, Artificial
  CRISPR gRNA sequence
cttcccaaagtcatacagct

SEQ ID NO: 784366 - DNA, 20 bp, Artificial
  CRISPR gRNA sequence
atacagctgggatttgaata

SEQ ID NO: 784367 - DNA, 20 bp, Artificial
  CRISPR gRNA sequence
tacagctgggatttgaatac

SEQ ID NO: 784368 - DNA, 20 bp, Artificial
  CRISPR gRNA sequence
ctgtttgactccaaaacttg

SEQ ID NO: 784369 - DNA, 20 bp, Artificial
  CRISPR gRNA sequence
ttgtggcctatttgttgcaa

SEQ ID NO: 784370 - DNA, 20 bp, Artificial
  CRISPR gRNA sequence
caaaagtgcttaatacaaat

SEQ ID NO: 784371 - DNA, 20 bp, Artificial
  CRISPR gRNA sequence
gtgcttaatacaaattggtt

SEQ ID NO: 784372 - DNA, 20 bp, Artificial
  CRISPR gRNA sequence
atattattatctttgaacaa

SEQ ID NO: 784373 - DNA, 20 bp, Artificial
  CRISPR gRNA sequence
ttattatctttgaacaatgg

SEQ ID NO: 784374 - DNA, 20 bp, Artificial
  CRISPR gRNA sequence
tattatctttgaacaatgga

SEQ ID NO: 784375 - DNA, 20 bp, Artificial
  CRISPR gRNA sequence
ttatctttgaacaatggaag

SEQ ID NO: 784376 - DNA, 20 bp, Artificial
  CRISPR gRNA sequence
ctttgaacaatggaaggaga

SEQ ID NO: 784377 - DNA, 20 bp, Artificial
  CRISPR gRNA sequence
gaacaatggaaggagaaagt

SEQ ID NO: 784378 - DNA, 20 bp, Artificial
  CRISPR gRNA sequence
agtttcaatccaaaataatt

SEQ ID NO: 784379 - DNA, 20 bp, Artificial
  CRISPR gRNA sequence
gacttatacattgacttgct

SEQ ID NO: 784380 - DNA, 20 bp, Artificial
  CRISPR gRNA sequence
acattgacttgctgagccaa

SEQ ID NO: 784381 - DNA, 20 bp, Artificial
  CRISPR gRNA sequence
gacttgctgagccaatggca

SEQ ID NO: 784382 - DNA, 20 bp, Artificial
  CRISPR gRNA sequence
gctgagccaatggcaaagtc

SEQ ID NO: 784383 - DNA, 20 bp, Artificial
  CRISPR gRNA sequence
agccaatggcaaagtcaagt

SEQ ID NO: 784384 - DNA, 20 bp, Artificial
  CRISPR gRNA sequence
ggcaaagtcaagttagaatc

SEQ ID NO: 784385 - DNA, 20 bp, Artificial
  CRISPR gRNA sequence
aaagtcaagttagaatccag

SEQ ID NO: 784386 - DNA, 20 bp, Artificial
  CRISPR gRNA sequence
gtcaagttagaatccagcag

SEQ ID NO: 784387 - DNA, 20 bp, Artificial
  CRISPR gRNA sequence
tagaatccagcagaagtcac

SEQ ID NO: 784388 - DNA, 20 bp, Artificial
  CRISPR gRNA sequence
ccagcagaagtcaccagcta

SEQ ID NO: 784389 - DNA, 20 bp, Artificial
  CRISPR gRNA sequence
aagtcaccagctacagaatc

SEQ ID NO: 784390 - DNA, 20 bp, Artificial
  CRISPR gRNA sequence
agctacagaatctagatctt

SEQ ID NO: 784391 - DNA, 20 bp, Artificial
  CRISPR gRNA sequence
agatctttagaacatgtctt

SEQ ID NO: 784392 - DNA, 20 bp, Artificial
  CRISPR gRNA sequence
agaacatgtcttcagatctt

SEQ ID NO: 784393 - DNA, 20 bp, Artificial
  CRISPR gRNA sequence
atgtcttcagatcttcagaa

SEQ ID NO: 784394 - DNA, 20 bp, Artificial
  CRISPR gRNA sequence
gtttcttaaactctcttgtg

SEQ ID NO: 784395 - DNA, 20 bp, Artificial
  CRISPR gRNA sequence
tttcttaaactctcttgtga

SEQ ID NO: 784396 - DNA, 20 bp, Artificial
  CRISPR gRNA sequence
taaactctcttgtgaaggaa

SEQ ID NO: 784397 - DNA, 20 bp, Artificial
  CRISPR gRNA sequence
tgaaggaacagttatcatca

SEQ ID NO: 784398 - DNA, 20 bp, Artificial
  CRISPR gRNA sequence
gaaggaacagttatcatcat

SEQ ID NO: 784399 - DNA, 20 bp, Artificial
  CRISPR gRNA sequence
gaacagttatcatcataggc

SEQ ID NO: 784400 - DNA, 20 bp, Artificial
  CRISPR gRNA sequence
ttatcatcataggctggtaa

SEQ ID NO: 784401 - DNA, 20 bp, Artificial
  CRISPR gRNA sequence
gctggtaacagttcacctac

SEQ ID NO: 784402 - DNA, 20 bp, Artificial
  CRISPR gRNA sequence
aacagttcacctaccagcac

SEQ ID NO: 784403 - DNA, 20 bp, Artificial
  CRISPR gRNA sequence
accagcaccagcccatgaac

SEQ ID NO: 784404 - DNA, 20 bp, Artificial
  CRISPR gRNA sequence
cagcccatgaaccagactct

SEQ ID NO: 784405 - DNA, 20 bp, Artificial
  CRISPR gRNA sequence
cccatgaaccagactctaag

SEQ ID NO: 784406 - DNA, 20 bp, Artificial
  CRISPR gRNA sequence
gaaccagactctaagtggca

SEQ ID NO: 784407 - DNA, 20 bp, Artificial
  CRISPR gRNA sequence
gactctaagtggcacagccc

SEQ ID NO: 784408 - DNA, 20 bp, Artificial
  CRISPR gRNA sequence
tctaagtggcacagccctag

SEQ ID NO: 784409 - DNA, 20 bp, Artificial
  CRISPR gRNA sequence
tggcacagccctagaagatt

SEQ ID NO: 784410 - DNA, 20 bp, Artificial
  CRISPR gRNA sequence
acagccctagaagattgagc

SEQ ID NO: 784411 - DNA, 20 bp, Artificial
  CRISPR gRNA sequence
aagattgagccagaatttta

SEQ ID NO: 784412 - DNA, 20 bp, Artificial
  CRISPR gRNA sequence
gattgagccagaattttaca

SEQ ID NO: 784413 - DNA, 20 bp, Artificial
  CRISPR gRNA sequence
attgagccagaattttacag

SEQ ID NO: 784414 - DNA, 20 bp, Artificial
  CRISPR gRNA sequence
cagaattttacagaggttta

SEQ ID NO: 784415 - DNA, 20 bp, Artificial
  CRISPR gRNA sequence
ggtttaaagaccaaatatgc

SEQ ID NO: 784416 - DNA, 20 bp, Artificial
  CRISPR gRNA sequence
agaccaaatatgctggttta

SEQ ID NO: 784417 - DNA, 20 bp, Artificial
  CRISPR gRNA sequence
tgctggtttatggttacctg

SEQ ID NO: 784418 - DNA, 20 bp, Artificial
  CRISPR gRNA sequence
ttatggttacctgtggccca

SEQ ID NO: 784419 - DNA, 20 bp, Artificial
  CRISPR gRNA sequence
atggttacctgtggcccaca

SEQ ID NO: 784420 - DNA, 20 bp, Artificial
  CRISPR gRNA sequence
tacctgtggcccacagagaa

SEQ ID NO: 784421 - DNA, 20 bp, Artificial
  CRISPR gRNA sequence
ctgtggcccacagagaatgg

SEQ ID NO: 784422 - DNA, 20 bp, Artificial
  CRISPR gRNA sequence
gagaatggcagcactaacct

SEQ ID NO: 784423 - DNA, 20 bp, Artificial
  CRISPR gRNA sequence
agaatggcagcactaacctc

SEQ ID NO: 784424 - DNA, 20 bp, Artificial
  CRISPR gRNA sequence
cactaacctcaggcataaat

SEQ ID NO: 784425 - DNA, 20 bp, Artificial
  CRISPR gRNA sequence
actaacctcaggcataaatg

SEQ ID NO: 784426 - DNA, 20 bp, Artificial
  CRISPR gRNA sequence
cataaatgaggtacccactg

SEQ ID NO: 784427 - DNA, 20 bp, Artificial
  CRISPR gRNA sequence
acccactgaagccaacattc

SEQ ID NO: 784428 - DNA, 20 bp, Artificial
  CRISPR gRNA sequence
ccactgaagccaacattcaa

SEQ ID NO: 784429 - DNA, 20 bp, Artificial
  CRISPR gRNA sequence
acattcaagagcaattccta

SEQ ID NO: 784430 - DNA, 20 bp, Artificial
  CRISPR gRNA sequence
cattcaagagcaattcctat

SEQ ID NO: 784431 - DNA, 20 bp, Artificial
  CRISPR gRNA sequence
aattcctatgggttaaccat

SEQ ID NO: 784432 - DNA, 20 bp, Artificial
  CRISPR gRNA sequence
attcctatgggttaaccatt

SEQ ID NO: 784433 - DNA, 20 bp, Artificial
  CRISPR gRNA sequence
tcaaatgcaaaccctcatga

SEQ ID NO: 784434 - DNA, 20 bp, Artificial
  CRISPR gRNA sequence
aaatgcaaaccctcatgaaa

SEQ ID NO: 784435 - DNA, 20 bp, Artificial
  CRISPR gRNA sequence
aaccctcatgaaagagacta

SEQ ID NO: 784436 - DNA, 20 bp, Artificial
  CRISPR gRNA sequence
aaagagactacagtgctgaa

SEQ ID NO: 784437 - DNA, 20 bp, Artificial
  CRISPR gRNA sequence
agagactacagtgctgaata

SEQ ID NO: 784438 - DNA, 20 bp, Artificial
  CRISPR gRNA sequence
gaatagagacctccaaattc

SEQ ID NO: 784439 - DNA, 20 bp, Artificial
  CRISPR gRNA sequence
aatagagacctccaaattcc

SEQ ID NO: 784440 - DNA, 20 bp, Artificial
  CRISPR gRNA sequence
agacctccaaattccaggcc

SEQ ID NO: 784441 - DNA, 20 bp, Artificial
  CRISPR gRNA sequence
tccaaattccaggccaagct

SEQ ID NO: 784442 - DNA, 20 bp, Artificial
  CRISPR gRNA sequence
ccaaattccaggccaagctc

SEQ ID NO: 784443 - DNA, 20 bp, Artificial
  CRISPR gRNA sequence
attccaggccaagctcagga

SEQ ID NO: 784444 - DNA, 20 bp, Artificial
  CRISPR gRNA sequence
gccaagctcaggatagtcat

SEQ ID NO: 784445 - DNA, 20 bp, Artificial
  CRISPR gRNA sequence
ccaagctcaggatagtcatg

SEQ ID NO: 784446 - DNA, 20 bp, Artificial
  CRISPR gRNA sequence
caagctcaggatagtcatga

SEQ ID NO: 784447 - DNA, 20 bp, Artificial
  CRISPR gRNA sequence
tgagggaattactaaaaacc

SEQ ID NO: 784448 - DNA, 20 bp, Artificial
  CRISPR gRNA sequence
attactaaaaacctggtata

SEQ ID NO: 784449 - DNA, 20 bp, Artificial
  CRISPR gRNA sequence
ttactaaaaacctggtatat

SEQ ID NO: 784450 - DNA, 20 bp, Artificial
  CRISPR gRNA sequence
tactaaaaacctggtatata

SEQ ID NO: 784451 - DNA, 20 bp, Artificial
  CRISPR gRNA sequence
aaacctggtatatagggcaa

SEQ ID NO: 784452 - DNA, 20 bp, Artificial
  CRISPR gRNA sequence
cctggtatatagggcaaaag

SEQ ID NO: 784453 - DNA, 20 bp, Artificial
  CRISPR gRNA sequence
atatagggcaaaagcagaat

SEQ ID NO: 784454 - DNA, 20 bp, Artificial
  CRISPR gRNA sequence
tatagggcaaaagcagaatt

SEQ ID NO: 784455 - DNA, 20 bp, Artificial
  CRISPR gRNA sequence
ggcaaaagcagaattaggaa

SEQ ID NO: 784456 - DNA, 20 bp, Artificial
  CRISPR gRNA sequence
aattaggaatggactgattt

SEQ ID NO: 784457 - DNA, 20 bp, Artificial
  CRISPR gRNA sequence
attaggaatggactgatttc

SEQ ID NO: 784458 - DNA, 20 bp, Artificial
  CRISPR gRNA sequence
atggactgatttcaggaacc

SEQ ID NO: 784459 - DNA, 20 bp, Artificial
  CRISPR gRNA sequence
tggactgatttcaggaaccc

SEQ ID NO: 784460 - DNA, 20 bp, Artificial
  CRISPR gRNA sequence
gatttcaggaacccaggcaa

SEQ ID NO: 784461 - DNA, 20 bp, Artificial
  CRISPR gRNA sequence
ttcaggaacccaggcaatgg

SEQ ID NO: 784462 - DNA, 20 bp, Artificial
  CRISPR gRNA sequence
tcaggaacccaggcaatggc

SEQ ID NO: 784463 - DNA, 20 bp, Artificial
  CRISPR gRNA sequence
aggaacccaggcaatggcag

SEQ ID NO: 784464 - DNA, 20 bp, Artificial
  CRISPR gRNA sequence
acccaggcaatggcaggagt

SEQ ID NO: 784465 - DNA, 20 bp, Artificial
  CRISPR gRNA sequence
cccaggcaatggcaggagtt

SEQ ID NO: 784466 - DNA, 20 bp, Artificial
  CRISPR gRNA sequence
agttgggcattaaatcctaa

SEQ ID NO: 784467 - DNA, 20 bp, Artificial
  CRISPR gRNA sequence
ttgggcattaaatcctaaaa

SEQ ID NO: 784468 - DNA, 20 bp, Artificial
  CRISPR gRNA sequence
attaaatcctaaaagagaat

SEQ ID NO: 784469 - DNA, 20 bp, Artificial
  CRISPR gRNA sequence
taaatcctaaaagagaatca

SEQ ID NO: 784470 - DNA, 20 bp, Artificial
  CRISPR gRNA sequence
atcctaaaagagaatcagag

SEQ ID NO: 784471 - DNA, 20 bp, Artificial
  CRISPR gRNA sequence
tcctaaaagagaatcagagt

SEQ ID NO: 784472 - DNA, 20 bp, Artificial
  CRISPR gRNA sequence
ctaaaagagaatcagagtgg

SEQ ID NO: 784473 - DNA, 20 bp, Artificial
  CRISPR gRNA sequence
taaaagagaatcagagtggg

SEQ ID NO: 784474 - DNA, 20 bp, Artificial
  CRISPR gRNA sequence
aaaagagaatcagagtggga

SEQ ID NO: 784475 - DNA, 20 bp, Artificial
  CRISPR gRNA sequence
tgggagggaatatgtgaaat

SEQ ID NO: 784476 - DNA, 20 bp, Artificial
  CRISPR gRNA sequence
ggagggaatatgtgaaatca

SEQ ID NO: 784477 - DNA, 20 bp, Artificial
  CRISPR gRNA sequence
gagggaatatgtgaaatcag

SEQ ID NO: 784478 - DNA, 20 bp, Artificial
  CRISPR gRNA sequence
aatatgtgaaatcagaggtt

SEQ ID NO: 784479 - DNA, 20 bp, Artificial
  CRISPR gRNA sequence
gaaatcagaggttaagaaaa

SEQ ID NO: 784480 - DNA, 20 bp, Artificial
  CRISPR gRNA sequence
aaaacctattcatgattgca

SEQ ID NO: 784481 - DNA, 20 bp, Artificial
  CRISPR gRNA sequence
caaagatatgaaaccaacct

SEQ ID NO: 784482 - DNA, 20 bp, Artificial
  CRISPR gRNA sequence
ctaagatcccattgacgaat

SEQ ID NO: 784483 - DNA, 20 bp, Artificial
  CRISPR gRNA sequence
agatcccattgacgaataag

SEQ ID NO: 784484 - DNA, 20 bp, Artificial
  CRISPR gRNA sequence
cattgacgaataagtggata

SEQ ID NO: 784485 - DNA, 20 bp, Artificial
  CRISPR gRNA sequence
ataagtggataaagaaaatg

SEQ ID NO: 784486 - DNA, 20 bp, Artificial
  CRISPR gRNA sequence
aatgtggtatatatacacca

SEQ ID NO: 784487 - DNA, 20 bp, Artificial
  CRISPR gRNA sequence
atacaccatggaatactact

SEQ ID NO: 784488 - DNA, 20 bp, Artificial
  CRISPR gRNA sequence
aatactactcagccatgaaa

SEQ ID NO: 784489 - DNA, 20 bp, Artificial
  CRISPR gRNA sequence
actcagccatgaaaaagaat

SEQ ID NO: 784490 - DNA, 20 bp, Artificial
  CRISPR gRNA sequence
taatgtgttttgcaacaact

SEQ ID NO: 784491 - DNA, 20 bp, Artificial
  CRISPR gRNA sequence
gtgttttgcaacaacttgga

SEQ ID NO: 784492 - DNA, 20 bp, Artificial
  CRISPR gRNA sequence
tgcaacaacttggatggaac

SEQ ID NO: 784493 - DNA, 20 bp, Artificial
  CRISPR gRNA sequence
caacaacttggatggaactg

SEQ ID NO: 784494 - DNA, 20 bp, Artificial
  CRISPR gRNA sequence
aacaacttggatggaactgg

SEQ ID NO: 784495 - DNA, 20 bp, Artificial
  CRISPR gRNA sequence
gaactggaggtcattattcc

SEQ ID NO: 784496 - DNA, 20 bp, Artificial
  CRISPR gRNA sequence
ggaggtcattattccaagtg

SEQ ID NO: 784497 - DNA, 20 bp, Artificial
  CRISPR gRNA sequence
ttattccaagtgaagtaact

SEQ ID NO: 784498 - DNA, 20 bp, Artificial
  CRISPR gRNA sequence
tattccaagtgaagtaactc

SEQ ID NO: 784499 - DNA, 20 bp, Artificial
  CRISPR gRNA sequence
caagtgaagtaactcaggaa

SEQ ID NO: 784500 - DNA, 20 bp, Artificial
  CRISPR gRNA sequence
taccatatattctcacttgt

SEQ ID NO: 784501 - DNA, 20 bp, Artificial
  CRISPR gRNA sequence
catatattctcacttgtaag

SEQ ID NO: 784502 - DNA, 20 bp, Artificial
  CRISPR gRNA sequence
atatattctcacttgtaagt

SEQ ID NO: 784503 - DNA, 20 bp, Artificial
  CRISPR gRNA sequence
atattctcacttgtaagtgg

SEQ ID NO: 784504 - DNA, 20 bp, Artificial
  CRISPR gRNA sequence
ctcacttgtaagtgggagct

SEQ ID NO: 784505 - DNA, 20 bp, Artificial
  CRISPR gRNA sequence
tgtaagtgggagctaagcta

SEQ ID NO: 784506 - DNA, 20 bp, Artificial
  CRISPR gRNA sequence
agctaagctatggatatgca

SEQ ID NO: 784507 - DNA, 20 bp, Artificial
  CRISPR gRNA sequence
gctaagctatggatatgcaa

SEQ ID NO: 784508 - DNA, 20 bp, Artificial
  CRISPR gRNA sequence
tatggatatgcaaaggcata

SEQ ID NO: 784509 - DNA, 20 bp, Artificial
  CRISPR gRNA sequence
tggatatgcaaaggcataca

SEQ ID NO: 784510 - DNA, 20 bp, Artificial
  CRISPR gRNA sequence
atatgcaaaggcatacagag

SEQ ID NO: 784511 - DNA, 20 bp, Artificial
  CRISPR gRNA sequence
aggcatacagagtggtataa

SEQ ID NO: 784512 - DNA, 20 bp, Artificial
  CRISPR gRNA sequence
ggcatacagagtggtataat

SEQ ID NO: 784513 - DNA, 20 bp, Artificial
  CRISPR gRNA sequence
acagagtggtataatgggca

SEQ ID NO: 784514 - DNA, 20 bp, Artificial
  CRISPR gRNA sequence
cagagtggtataatgggcat

SEQ ID NO: 784515 - DNA, 20 bp, Artificial
  CRISPR gRNA sequence
gagtggtataatgggcatgg

SEQ ID NO: 784516 - DNA, 20 bp, Artificial
  CRISPR gRNA sequence
tataatgggcatgggagact

SEQ ID NO: 784517 - DNA, 20 bp, Artificial
  CRISPR gRNA sequence
aatgggcatgggagactcag

SEQ ID NO: 784518 - DNA, 20 bp, Artificial
  CRISPR gRNA sequence
atgggcatgggagactcaga

SEQ ID NO: 784519 - DNA, 20 bp, Artificial
  CRISPR gRNA sequence
gggcatgggagactcagaag

SEQ ID NO: 784520 - DNA, 20 bp, Artificial
  CRISPR gRNA sequence
gcatgggagactcagaagga

SEQ ID NO: 784521 - DNA, 20 bp, Artificial
  CRISPR gRNA sequence
atgggagactcagaaggaga

SEQ ID NO: 784522 - DNA, 20 bp, Artificial
  CRISPR gRNA sequence
ggagactcagaaggagagag

SEQ ID NO: 784523 - DNA, 20 bp, Artificial
  CRISPR gRNA sequence
gagactcagaaggagagagt

SEQ ID NO: 784524 - DNA, 20 bp, Artificial
  CRISPR gRNA sequence
agactcagaaggagagagta

SEQ ID NO: 784525 - DNA, 20 bp, Artificial
  CRISPR gRNA sequence
actcagaaggagagagtagg

SEQ ID NO: 784526 - DNA, 20 bp, Artificial
  CRISPR gRNA sequence
cagaaggagagagtagggag

SEQ ID NO: 784527 - DNA, 20 bp, Artificial
  CRISPR gRNA sequence
aaggagagagtagggagtgg

SEQ ID NO: 784528 - DNA, 20 bp, Artificial
  CRISPR gRNA sequence
agagagtagggagtggcagt

SEQ ID NO: 784529 - DNA, 20 bp, Artificial
  CRISPR gRNA sequence
gagagtagggagtggcagtg

SEQ ID NO: 784530 - DNA, 20 bp, Artificial
  CRISPR gRNA sequence
agtggcagtgaggaataaaa

SEQ ID NO: 784531 - DNA, 20 bp, Artificial
  CRISPR gRNA sequence
gaataaaaaagctgcatatt

SEQ ID NO: 784532 - DNA, 20 bp, Artificial
  CRISPR gRNA sequence
tgagttcaatgtacactatt

SEQ ID NO: 784533 - DNA, 20 bp, Artificial
  CRISPR gRNA sequence
gagttcaatgtacactattt

SEQ ID NO: 784534 - DNA, 20 bp, Artificial
  CRISPR gRNA sequence
aatgtacactatttgggtga

SEQ ID NO: 784535 - DNA, 20 bp, Artificial
  CRISPR gRNA sequence
atgtacactatttgggtgac

SEQ ID NO: 784536 - DNA, 20 bp, Artificial
  CRISPR gRNA sequence
gtgacgggtgcactaaaatt

SEQ ID NO: 784537 - DNA, 20 bp, Artificial
  CRISPR gRNA sequence
cactaaaattcagacttcac

SEQ ID NO: 784538 - DNA, 20 bp, Artificial
  CRISPR gRNA sequence
tgatataaaaaaaaaattaa

SEQ ID NO: 784539 - DNA, 20 bp, Artificial
  CRISPR gRNA sequence
ataaaaaaaaaattaaaaga

SEQ ID NO: 784540 - DNA, 20 bp, Artificial
  CRISPR gRNA sequence
taaaagaaagatgtgaaatc

SEQ ID NO: 784541 - DNA, 20 bp, Artificial
  CRISPR gRNA sequence
aaaagaaagatgtgaaatca

SEQ ID NO: 784542 - DNA, 20 bp, Artificial
  CRISPR gRNA sequence
gtgaaatcaaggaaacttac

SEQ ID NO: 784543 - DNA, 20 bp, Artificial
  CRISPR gRNA sequence
aatcaaggaaacttactggt

SEQ ID NO: 784544 - DNA, 20 bp, Artificial
  CRISPR gRNA sequence
caaggaaacttactggtgag

SEQ ID NO: 784545 - DNA, 20 bp, Artificial
  CRISPR gRNA sequence
gtgaacttgtgcttctgaac

SEQ ID NO: 784546 - DNA, 20 bp, Artificial
  CRISPR gRNA sequence
tgcttctgaaccagtaactt

SEQ ID NO: 784547 - DNA, 20 bp, Artificial
  CRISPR gRNA sequence
ccagtaacttgagttacttt

SEQ ID NO: 784548 - DNA, 20 bp, Artificial
  CRISPR gRNA sequence
taacttgagttactttgagc

SEQ ID NO: 784549 - DNA, 20 bp, Artificial
  CRISPR gRNA sequence
gagttactttgagccagtat

SEQ ID NO: 784550 - DNA, 20 bp, Artificial
  CRISPR gRNA sequence
agtatcagtcacttatacct

SEQ ID NO: 784551 - DNA, 20 bp, Artificial
  CRISPR gRNA sequence
ttagtgcaaaattaattgat

SEQ ID NO: 784552 - DNA, 20 bp, Artificial
  CRISPR gRNA sequence
attgatcagacattctgacc

SEQ ID NO: 784553 - DNA, 20 bp, Artificial
  CRISPR gRNA sequence
tcagacattctgacctggac

SEQ ID NO: 784554 - DNA, 20 bp, Artificial
  CRISPR gRNA sequence
cagacattctgacctggacc

SEQ ID NO: 784555 - DNA, 20 bp, Artificial
  CRISPR gRNA sequence
agacattctgacctggacca

SEQ ID NO: 784556 - DNA, 20 bp, Artificial
  CRISPR gRNA sequence
cattctgacctggaccaggg

SEQ ID NO: 784557 - DNA, 20 bp, Artificial
  CRISPR gRNA sequence
attctgacctggaccaggga

SEQ ID NO: 784558 - DNA, 20 bp, Artificial
  CRISPR gRNA sequence
ctgacctggaccagggaagg

SEQ ID NO: 784559 - DNA, 20 bp, Artificial
  CRISPR gRNA sequence
tgacctggaccagggaaggc

SEQ ID NO: 784560 - DNA, 20 bp, Artificial
  CRISPR gRNA sequence
cctggaccagggaaggcagg

SEQ ID NO: 784561 - DNA, 20 bp, Artificial
  CRISPR gRNA sequence
ggaccagggaaggcaggcag

SEQ ID NO: 784562 - DNA, 20 bp, Artificial
  CRISPR gRNA sequence
ccagggaaggcaggcagaag

SEQ ID NO: 784563 - DNA, 20 bp, Artificial
  CRISPR gRNA sequence
gggaaggcaggcagaagtag

SEQ ID NO: 784564 - DNA, 20 bp, Artificial
  CRISPR gRNA sequence
ggcaggcagaagtagcagtc

SEQ ID NO: 784565 - DNA, 20 bp, Artificial
  CRISPR gRNA sequence
agaagtagcagtcaagacta

SEQ ID NO: 784566 - DNA, 20 bp, Artificial
  CRISPR gRNA sequence
agtagcagtcaagactaaag

SEQ ID NO: 784567 - DNA, 20 bp, Artificial
  CRISPR gRNA sequence
cagtcaagactaaagcagaa

SEQ ID NO: 784568 - DNA, 20 bp, Artificial
  CRISPR gRNA sequence
agtcaagactaaagcagaaa

SEQ ID NO: 784569 - DNA, 20 bp, Artificial
  CRISPR gRNA sequence
gtcaagactaaagcagaaaa

SEQ ID NO: 784570 - DNA, 20 bp, Artificial
  CRISPR gRNA sequence
caagactaaagcagaaaagg

SEQ ID NO: 784571 - DNA, 20 bp, Artificial
  CRISPR gRNA sequence
agactaaagcagaaaaggga

SEQ ID NO: 784572 - DNA, 20 bp, Artificial
  CRISPR gRNA sequence
aaaagggagagctaattctg

SEQ ID NO: 784573 - DNA, 20 bp, Artificial
  CRISPR gRNA sequence
gggagagctaattctgcagc

SEQ ID NO: 784574 - DNA, 20 bp, Artificial
  CRISPR gRNA sequence
ttctgcagccagacatttcc

SEQ ID NO: 784575 - DNA, 20 bp, Artificial
  CRISPR gRNA sequence
cctggattgaatacccaaat

SEQ ID NO: 784576 - DNA, 20 bp, Artificial
  CRISPR gRNA sequence
gaatacccaaattagtccct

SEQ ID NO: 784577 - DNA, 20 bp, Artificial
  CRISPR gRNA sequence
aaattagtccctcagccttt

SEQ ID NO: 784578 - DNA, 20 bp, Artificial
  CRISPR gRNA sequence
ccctcagcctttaagtgcct

SEQ ID NO: 784579 - DNA, 20 bp, Artificial
  CRISPR gRNA sequence
cctcagcctttaagtgcctg

SEQ ID NO: 784580 - DNA, 20 bp, Artificial
  CRISPR gRNA sequence
ctcagcctttaagtgcctga

SEQ ID NO: 784581 - DNA, 20 bp, Artificial
  CRISPR gRNA sequence
gcctttaagtgcctgagggc

SEQ ID NO: 784582 - DNA, 20 bp, Artificial
  CRISPR gRNA sequence
cctttaagtgcctgagggcc

SEQ ID NO: 784583 - DNA, 20 bp, Artificial
  CRISPR gRNA sequence
tttaagtgcctgagggccag

SEQ ID NO: 784584 - DNA, 20 bp, Artificial
  CRISPR gRNA sequence
aagtgcctgagggccaggag

SEQ ID NO: 784585 - DNA, 20 bp, Artificial
  CRISPR gRNA sequence
gcctgagggccaggagtaga

SEQ ID NO: 784586 - DNA, 20 bp, Artificial
  CRISPR gRNA sequence
ctgagggccaggagtagaca

SEQ ID NO: 784587 - DNA, 20 bp, Artificial
  CRISPR gRNA sequence
tgagggccaggagtagacag

SEQ ID NO: 784588 - DNA, 20 bp, Artificial
  CRISPR gRNA sequence
gccaggagtagacagaggaa

SEQ ID NO: 784589 - DNA, 20 bp, Artificial
  CRISPR gRNA sequence
ggagtagacagaggaatgga

SEQ ID NO: 784590 - DNA, 20 bp, Artificial
  CRISPR gRNA sequence
gacagaggaatggaaagtgt

SEQ ID NO: 784591 - DNA, 20 bp, Artificial
  CRISPR gRNA sequence
ctttgttcacactctttgcc

SEQ ID NO: 784592 - DNA, 20 bp, Artificial
  CRISPR gRNA sequence
tttgttcacactctttgcct

SEQ ID NO: 784593 - DNA, 20 bp, Artificial
  CRISPR gRNA sequence
ttgttcacactctttgccta

SEQ ID NO: 784594 - DNA, 20 bp, Artificial
  CRISPR gRNA sequence
tgttcacactctttgcctag

SEQ ID NO: 784595 - DNA, 20 bp, Artificial
  CRISPR gRNA sequence
cacactctttgcctaggggc

SEQ ID NO: 784596 - DNA, 20 bp, Artificial
  CRISPR gRNA sequence
gctttatgcattaccatccg

SEQ ID NO: 784597 - DNA, 20 bp, Artificial
  CRISPR gRNA sequence
tgcattaccatccgaagtcc

SEQ ID NO: 784598 - DNA, 20 bp, Artificial
  CRISPR gRNA sequence
gcattaccatccgaagtccc

SEQ ID NO: 784599 - DNA, 20 bp, Artificial
  CRISPR gRNA sequence
ccatccgaagtcccaggcca

SEQ ID NO: 784600 - DNA, 20 bp, Artificial
  CRISPR gRNA sequence
cccaggccacagtgaacatt

SEQ ID NO: 784601 - DNA, 20 bp, Artificial
  CRISPR gRNA sequence
ccaggccacagtgaacattt

SEQ ID NO: 784602 - DNA, 20 bp, Artificial
  CRISPR gRNA sequence
aacatttgggcttcgctatg

SEQ ID NO: 784603 - DNA, 20 bp, Artificial
  CRISPR gRNA sequence
cttcgctatgtggatttatt

SEQ ID NO: 784604 - DNA, 20 bp, Artificial
  CRISPR gRNA sequence
cctgccatattttaatctat

SEQ ID NO: 784605 - DNA, 20 bp, Artificial
  CRISPR gRNA sequence
attttaatctataagccaaa

SEQ ID NO: 784606 - DNA, 20 bp, Artificial
  CRISPR gRNA sequence
cattaatcttattccatttc

SEQ ID NO: 784607 - DNA, 20 bp, Artificial
  CRISPR gRNA sequence
tttctggaatttttcctttt

SEQ ID NO: 784608 - DNA, 20 bp, Artificial
  CRISPR gRNA sequence
tccttttcagacacaacaaa

SEQ ID NO: 784609 - DNA, 20 bp, Artificial
  CRISPR gRNA sequence
aaagacctgtcaccacaaca

SEQ ID NO: 784610 - DNA, 20 bp, Artificial
  CRISPR gRNA sequence
agacctgtcaccacaacaaa

SEQ ID NO: 784611 - DNA, 20 bp, Artificial
  CRISPR gRNA sequence
gacctgtcaccacaacaaag

SEQ ID NO: 784612 - DNA, 20 bp, Artificial
  CRISPR gRNA sequence
acctgtcaccacaacaaaga

SEQ ID NO: 784613 - DNA, 20 bp, Artificial
  CRISPR gRNA sequence
tgtcaccacaacaaagaggg

SEQ ID NO: 784614 - DNA, 20 bp, Artificial
  CRISPR gRNA sequence
acaacaaagagggaagtgaa

SEQ ID NO: 784615 - DNA, 20 bp, Artificial
  CRISPR gRNA sequence
agggaagtgaacagtgctgt

SEQ ID NO: 784616 - DNA, 20 bp, Artificial
  CRISPR gRNA sequence
aagtgaacagtgctgtgagt

SEQ ID NO: 784617 - DNA, 20 bp, Artificial
  CRISPR gRNA sequence
tcttactttcttttctctct

SEQ ID NO: 784618 - DNA, 20 bp, Artificial
  CRISPR gRNA sequence
ctctctcagcttgaatttta

SEQ ID NO: 784619 - DNA, 20 bp, Artificial
  CRISPR gRNA sequence
accactgttctattaattca

SEQ ID NO: 784620 - DNA, 20 bp, Artificial
  CRISPR gRNA sequence
actgttctattaattcatgg

SEQ ID NO: 784621 - DNA, 20 bp, Artificial
  CRISPR gRNA sequence
ctgttctattaattcatgga

SEQ ID NO: 784622 - DNA, 20 bp, Artificial
  CRISPR gRNA sequence
attcatggaaggcaactgaa

SEQ ID NO: 784623 - DNA, 20 bp, Artificial
  CRISPR gRNA sequence
ggaaggcaactgaatagttc

SEQ ID NO: 784624 - DNA, 20 bp, Artificial
  CRISPR gRNA sequence
aactgaatagttccagctta

SEQ ID NO: 784625 - DNA, 20 bp, Artificial
  CRISPR gRNA sequence
gcttatagaatcttcctgtt

SEQ ID NO: 784626 - DNA, 20 bp, Artificial
  CRISPR gRNA sequence
tatagaatcttcctgtttgg

SEQ ID NO: 784627 - DNA, 20 bp, Artificial
  CRISPR gRNA sequence
cttcctgtttggtagcattt

SEQ ID NO: 784628 - DNA, 20 bp, Artificial
  CRISPR gRNA sequence
tgtttggtagcatttcagcg

SEQ ID NO: 784629 - DNA, 20 bp, Artificial
  CRISPR gRNA sequence
tttcagcgaagcctcgttct

SEQ ID NO: 784630 - DNA, 20 bp, Artificial
  CRISPR gRNA sequence
cgaagcctcgttcttagccc

SEQ ID NO: 784631 - DNA, 20 bp, Artificial
  CRISPR gRNA sequence
caatcatgccatcttttgct

SEQ ID NO: 784632 - DNA, 20 bp, Artificial
  CRISPR gRNA sequence
tttgctcggtctatattcct

SEQ ID NO: 784633 - DNA, 20 bp, Artificial
  CRISPR gRNA sequence
tctatattcctaagcactcc

SEQ ID NO: 784634 - DNA, 20 bp, Artificial
  CRISPR gRNA sequence
actcctagatgatactgcac

SEQ ID NO: 784635 - DNA, 20 bp, Artificial
  CRISPR gRNA sequence
atgatactgcactggacctc

SEQ ID NO: 784636 - DNA, 20 bp, Artificial
  CRISPR gRNA sequence
actggacctctggtctcaca

SEQ ID NO: 784637 - DNA, 20 bp, Artificial
  CRISPR gRNA sequence
gacctctggtctcacatagt

SEQ ID NO: 784638 - DNA, 20 bp, Artificial
  CRISPR gRNA sequence
tggtctcacatagttagaaa

SEQ ID NO: 784639 - DNA, 20 bp, Artificial
  CRISPR gRNA sequence
gtctcacatagttagaaaca

SEQ ID NO: 784640 - DNA, 20 bp, Artificial
  CRISPR gRNA sequence
gaaacagagttaaaatcgaa

SEQ ID NO: 784641 - DNA, 20 bp, Artificial
  CRISPR gRNA sequence
agagttaaaatcgaacagca

SEQ ID NO: 784642 - DNA, 20 bp, Artificial
  CRISPR gRNA sequence
agttaaaatcgaacagcaaa

SEQ ID NO: 784643 - DNA, 20 bp, Artificial
  CRISPR gRNA sequence
taaaatcgaacagcaaagag

SEQ ID NO: 784644 - DNA, 20 bp, Artificial
  CRISPR gRNA sequence
aactgcgatgcaattgacaa

SEQ ID NO: 784645 - DNA, 20 bp, Artificial
  CRISPR gRNA sequence
ttttgcaacaaacaatgatt

SEQ ID NO: 784646 - DNA, 20 bp, Artificial
  CRISPR gRNA sequence
tgcaacaaacaatgattaag

SEQ ID NO: 784647 - DNA, 20 bp, Artificial
  CRISPR gRNA sequence
gattaagaagtacattgttg

SEQ ID NO: 784648 - DNA, 20 bp, Artificial
  CRISPR gRNA sequence
attaagaagtacattgttgt

SEQ ID NO: 784649 - DNA, 20 bp, Artificial
  CRISPR gRNA sequence
agtacattgttgtgggctct

SEQ ID NO: 784650 - DNA, 20 bp, Artificial
  CRISPR gRNA sequence
attgttgtgggctctgagtc

SEQ ID NO: 784651 - DNA, 20 bp, Artificial
  CRISPR gRNA sequence
tgttgtgggctctgagtcaa

SEQ ID NO: 784652 - DNA, 20 bp, Artificial
  CRISPR gRNA sequence
gctctgagtcaagagtaata

SEQ ID NO: 784653 - DNA, 20 bp, Artificial
  CRISPR gRNA sequence
ctctgagtcaagagtaatat

SEQ ID NO: 784654 - DNA, 20 bp, Artificial
  CRISPR gRNA sequence
gagtaatatgggaaaaacac

SEQ ID NO: 784655 - DNA, 20 bp, Artificial
  CRISPR gRNA sequence
aaaaacacaagtctcttcat

SEQ ID NO: 784656 - DNA, 20 bp, Artificial
  CRISPR gRNA sequence
aaaacacaagtctcttcatg

SEQ ID NO: 784657 - DNA, 20 bp, Artificial
  CRISPR gRNA sequence
aagtctcttcatgaggttga

SEQ ID NO: 784658 - DNA, 20 bp, Artificial
  CRISPR gRNA sequence
agtctcttcatgaggttgac

SEQ ID NO: 784659 - DNA, 20 bp, Artificial
  CRISPR gRNA sequence
cttcatgaggttgacaggtt

SEQ ID NO: 784660 - DNA, 20 bp, Artificial
  CRISPR gRNA sequence
tcatgaggttgacaggtttg

SEQ ID NO: 784661 - DNA, 20 bp, Artificial
  CRISPR gRNA sequence
gaggttgacaggtttggagc

SEQ ID NO: 784662 - DNA, 20 bp, Artificial
  CRISPR gRNA sequence
aggtttggagctggaatctg

SEQ ID NO: 784663 - DNA, 20 bp, Artificial
  CRISPR gRNA sequence
gtttggagctggaatctgtg

SEQ ID NO: 784664 - DNA, 20 bp, Artificial
  CRISPR gRNA sequence
tttggagctggaatctgtgg

SEQ ID NO: 784665 - DNA, 20 bp, Artificial
  CRISPR gRNA sequence
tggagctggaatctgtggag

SEQ ID NO: 784666 - DNA, 20 bp, Artificial
  CRISPR gRNA sequence
ggagctggaatctgtggagg

SEQ ID NO: 784667 - DNA, 20 bp, Artificial
  CRISPR gRNA sequence
gctggaatctgtggaggagg

SEQ ID NO: 784668 - DNA, 20 bp, Artificial
  CRISPR gRNA sequence
ctggaatctgtggaggagga

SEQ ID NO: 784669 - DNA, 20 bp, Artificial
  CRISPR gRNA sequence
ggaggaggaaggatatgatc

SEQ ID NO: 784670 - DNA, 20 bp, Artificial
  CRISPR gRNA sequence
gaggaggaaggatatgatct

SEQ ID NO: 784671 - DNA, 20 bp, Artificial
  CRISPR gRNA sequence
aggaggaaggatatgatcta

SEQ ID NO: 784672 - DNA, 20 bp, Artificial
  CRISPR gRNA sequence
ggaggaaggatatgatctag

SEQ ID NO: 784673 - DNA, 20 bp, Artificial
  CRISPR gRNA sequence
gaaggatatgatctaggggt

SEQ ID NO: 784674 - DNA, 20 bp, Artificial
  CRISPR gRNA sequence
ggatatgatctaggggtcag

SEQ ID NO: 784675 - DNA, 20 bp, Artificial
  CRISPR gRNA sequence
tatgatctaggggtcagaag

SEQ ID NO: 784676 - DNA, 20 bp, Artificial
  CRISPR gRNA sequence
gatctaggggtcagaagaag

SEQ ID NO: 784677 - DNA, 20 bp, Artificial
  CRISPR gRNA sequence
atctaggggtcagaagaagt

SEQ ID NO: 784678 - DNA, 20 bp, Artificial
  CRISPR gRNA sequence
agtgggttactaaaatcatt

SEQ ID NO: 784679 - DNA, 20 bp, Artificial
  CRISPR gRNA sequence
gttactaaaatcattaagcc

SEQ ID NO: 784680 - DNA, 20 bp, Artificial
  CRISPR gRNA sequence
ctaaaatcattaagcctggt

SEQ ID NO: 784681 - DNA, 20 bp, Artificial
  CRISPR gRNA sequence
attaagcctggttggatgaa

SEQ ID NO: 784682 - DNA, 20 bp, Artificial
  CRISPR gRNA sequence
gcctggttggatgaaaagct

SEQ ID NO: 784683 - DNA, 20 bp, Artificial
  CRISPR gRNA sequence
ttggatgaaaagcttagact

SEQ ID NO: 784684 - DNA, 20 bp, Artificial
  CRISPR gRNA sequence
tggatgaaaagcttagactc

SEQ ID NO: 784685 - DNA, 20 bp, Artificial
  CRISPR gRNA sequence
ggatgaaaagcttagactca

SEQ ID NO: 784686 - DNA, 20 bp, Artificial
  CRISPR gRNA sequence
gatgaaaagcttagactcag

SEQ ID NO: 784687 - DNA, 20 bp, Artificial
  CRISPR gRNA sequence
gaaaagcttagactcagggg

SEQ ID NO: 784688 - DNA, 20 bp, Artificial
  CRISPR gRNA sequence
aagcttagactcaggggaag

SEQ ID NO: 784689 - DNA, 20 bp, Artificial
  CRISPR gRNA sequence
ggggaagcagcacatgattg

SEQ ID NO: 784690 - DNA, 20 bp, Artificial
  CRISPR gRNA sequence
gggaagcagcacatgattgt

SEQ ID NO: 784691 - DNA, 20 bp, Artificial
  CRISPR gRNA sequence
ggaagcagcacatgattgtg

SEQ ID NO: 784692 - DNA, 20 bp, Artificial
  CRISPR gRNA sequence
gaagcagcacatgattgtgg

SEQ ID NO: 784693 - DNA, 20 bp, Artificial
  CRISPR gRNA sequence
cagcacatgattgtgggggc

SEQ ID NO: 784694 - DNA, 20 bp, Artificial
  CRISPR gRNA sequence
acatgattgtgggggctggc

SEQ ID NO: 784695 - DNA, 20 bp, Artificial
  CRISPR gRNA sequence
gctggcaagtttgaaatgtg

SEQ ID NO: 784696 - DNA, 20 bp, Artificial
  CRISPR gRNA sequence
ctggcaagtttgaaatgtgt

SEQ ID NO: 784697 - DNA, 20 bp, Artificial
  CRISPR gRNA sequence
tggcaagtttgaaatgtgta

SEQ ID NO: 784698 - DNA, 20 bp, Artificial
  CRISPR gRNA sequence
caagtttgaaatgtgtaggg

SEQ ID NO: 784699 - DNA, 20 bp, Artificial
  CRISPR gRNA sequence
aagtttgaaatgtgtagggc

SEQ ID NO: 784700 - DNA, 20 bp, Artificial
  CRISPR gRNA sequence
ttgaaatgtgtagggcaggc

SEQ ID NO: 784701 - DNA, 20 bp, Artificial
  CRISPR gRNA sequence
aaatgtgtagggcaggccag

SEQ ID NO: 784702 - DNA, 20 bp, Artificial
  CRISPR gRNA sequence
tgtagggcaggccagcagtc

SEQ ID NO: 784703 - DNA, 20 bp, Artificial
  CRISPR gRNA sequence
aggccagcagtctggaaacc

SEQ ID NO: 784704 - DNA, 20 bp, Artificial
  CRISPR gRNA sequence
ggccagcagtctggaaaccc

SEQ ID NO: 784705 - DNA, 20 bp, Artificial
  CRISPR gRNA sequence
cagcagtctggaaacccagg

SEQ ID NO: 784706 - DNA, 20 bp, Artificial
  CRISPR gRNA sequence
agcagtctggaaacccaggc

SEQ ID NO: 784707 - DNA, 20 bp, Artificial
  CRISPR gRNA sequence
caggcaggatttctacctta

SEQ ID NO: 784708 - DNA, 20 bp, Artificial
  CRISPR gRNA sequence
gatttctaccttacagtctt

SEQ ID NO: 784709 - DNA, 20 bp, Artificial
  CRISPR gRNA sequence
atttctaccttacagtcttg

SEQ ID NO: 784710 - DNA, 20 bp, Artificial
  CRISPR gRNA sequence
tctaccttacagtcttgagg

SEQ ID NO: 784711 - DNA, 20 bp, Artificial
  CRISPR gRNA sequence
aggcagaattccatcttttc

SEQ ID NO: 784712 - DNA, 20 bp, Artificial
  CRISPR gRNA sequence
ggcagaattccatcttttct

SEQ ID NO: 784713 - DNA, 20 bp, Artificial
  CRISPR gRNA sequence
ccatcttttctgggaaacct

SEQ ID NO: 784714 - DNA, 20 bp, Artificial
  CRISPR gRNA sequence
aacctcagttttttgctctt

SEQ ID NO: 784715 - DNA, 20 bp, Artificial
  CRISPR gRNA sequence
acctcagttttttgctctta

SEQ ID NO: 784716 - DNA, 20 bp, Artificial
  CRISPR gRNA sequence
ggccctcaactgattgaatg

SEQ ID NO: 784717 - DNA, 20 bp, Artificial
  CRISPR gRNA sequence
aatgaagccaacctacatca

SEQ ID NO: 784718 - DNA, 20 bp, Artificial
  CRISPR gRNA sequence
atgaagccaacctacatcat

SEQ ID NO: 784719 - DNA, 20 bp, Artificial
  CRISPR gRNA sequence
gaagccaacctacatcatgg

SEQ ID NO: 784720 - DNA, 20 bp, Artificial
  CRISPR gRNA sequence
cctacatcatgggagataat

SEQ ID NO: 784721 - DNA, 20 bp, Artificial
  CRISPR gRNA sequence
gagataatcagctttacttc

SEQ ID NO: 784722 - DNA, 20 bp, Artificial
  CRISPR gRNA sequence
ctttacttcaagttaactga

SEQ ID NO: 784723 - DNA, 20 bp, Artificial
  CRISPR gRNA sequence
acatctacaaaatactttca

SEQ ID NO: 784724 - DNA, 20 bp, Artificial
  CRISPR gRNA sequence
aatactttcacagcaacata

SEQ ID NO: 784725 - DNA, 20 bp, Artificial
  CRISPR gRNA sequence
tttcacagcaacatatagac

SEQ ID NO: 784726 - DNA, 20 bp, Artificial
  CRISPR gRNA sequence
atatagactagcatttgact

SEQ ID NO: 784727 - DNA, 20 bp, Artificial
  CRISPR gRNA sequence
tagcatttgactaagcaact

SEQ ID NO: 784728 - DNA, 20 bp, Artificial
  CRISPR gRNA sequence
gactaagcaactgagcacca

SEQ ID NO: 784729 - DNA, 20 bp, Artificial
  CRISPR gRNA sequence
agcaactgagcaccatagcc

SEQ ID NO: 784730 - DNA, 20 bp, Artificial
  CRISPR gRNA sequence
acacataaaattaatcatca

SEQ ID NO: 784731 - DNA, 20 bp, Artificial
  CRISPR gRNA sequence
cacataaaattaatcatcac

SEQ ID NO: 784732 - DNA, 20 bp, Artificial
  CRISPR gRNA sequence
aattaatcatcacaggcacc

SEQ ID NO: 784733 - DNA, 20 bp, Artificial
  CRISPR gRNA sequence
ttaatcatcacaggcaccaa

SEQ ID NO: 784734 - DNA, 20 bp, Artificial
  CRISPR gRNA sequence
catcacaggcaccaagagat

SEQ ID NO: 784735 - DNA, 20 bp, Artificial
  CRISPR gRNA sequence
atcacaggcaccaagagatg

SEQ ID NO: 784736 - DNA, 20 bp, Artificial
  CRISPR gRNA sequence
tcacaggcaccaagagatga

SEQ ID NO: 784737 - DNA, 20 bp, Artificial
  CRISPR gRNA sequence
cacaggcaccaagagatgag

SEQ ID NO: 784738 - DNA, 20 bp, Artificial
  CRISPR gRNA sequence
acaggcaccaagagatgagg

SEQ ID NO: 784739 - DNA, 20 bp, Artificial
  CRISPR gRNA sequence
caggcaccaagagatgaggg

SEQ ID NO: 784740 - DNA, 20 bp, Artificial
  CRISPR gRNA sequence
gcaccaagagatgagggggg

SEQ ID NO: 784741 - DNA, 20 bp, Artificial
  CRISPR gRNA sequence
agagatgaggggggcagtct

SEQ ID NO: 784742 - DNA, 20 bp, Artificial
  CRISPR gRNA sequence
ggcagtcttggccatatatt

SEQ ID NO: 784743 - DNA, 20 bp, Artificial
  CRISPR gRNA sequence
cttggccatatatttggctg

SEQ ID NO: 784744 - DNA, 20 bp, Artificial
  CRISPR gRNA sequence
gccatatatttggctgaagt

SEQ ID NO: 784745 - DNA, 20 bp, Artificial
  CRISPR gRNA sequence
tcaatttgtcattcctgcat

SEQ ID NO: 784746 - DNA, 20 bp, Artificial
  CRISPR gRNA sequence
cctgcatgagcctttataaa

SEQ ID NO: 784747 - DNA, 20 bp, Artificial
  CRISPR gRNA sequence
gcatgagcctttataaacag

SEQ ID NO: 784748 - DNA, 20 bp, Artificial
  CRISPR gRNA sequence
gagcctttataaacagaagt

SEQ ID NO: 784749 - DNA, 20 bp, Artificial
  CRISPR gRNA sequence
gtaagtaaccaactactatt

SEQ ID NO: 784750 - DNA, 20 bp, Artificial
  CRISPR gRNA sequence
accaactactatttggtcat

SEQ ID NO: 784751 - DNA, 20 bp, Artificial
  CRISPR gRNA sequence
caactactatttggtcattg

SEQ ID NO: 784752 - DNA, 20 bp, Artificial
  CRISPR gRNA sequence
tttggtcattggagttgtcc

SEQ ID NO: 784753 - DNA, 20 bp, Artificial
  CRISPR gRNA sequence
tggtcattggagttgtccaa

SEQ ID NO: 784754 - DNA, 20 bp, Artificial
  CRISPR gRNA sequence
ggtcattggagttgtccaag

SEQ ID NO: 784755 - DNA, 20 bp, Artificial
  CRISPR gRNA sequence
attggagttgtccaagaggc

SEQ ID NO: 784756 - DNA, 20 bp, Artificial
  CRISPR gRNA sequence
ttggagttgtccaagaggcc

SEQ ID NO: 784757 - DNA, 20 bp, Artificial
  CRISPR gRNA sequence
tggagttgtccaagaggcca

SEQ ID NO: 784758 - DNA, 20 bp, Artificial
  CRISPR gRNA sequence
catgcatgaacatgccaacc

SEQ ID NO: 784759 - DNA, 20 bp, Artificial
  CRISPR gRNA sequence
atgccaacctagattgcatg

SEQ ID NO: 784760 - DNA, 20 bp, Artificial
  CRISPR gRNA sequence
ctagattgcatgcagactac

SEQ ID NO: 784761 - DNA, 20 bp, Artificial
  CRISPR gRNA sequence
tgcatgcagactaccagttt

SEQ ID NO: 784762 - DNA, 20 bp, Artificial
  CRISPR gRNA sequence
gcatgcagactaccagtttt

SEQ ID NO: 784763 - DNA, 20 bp, Artificial
  CRISPR gRNA sequence
accagttttgggtttttgtt

SEQ ID NO: 784764 - DNA, 20 bp, Artificial
  CRISPR gRNA sequence
ttttgggtttttgtttagtt

SEQ ID NO: 784765 - DNA, 20 bp, Artificial
  CRISPR gRNA sequence
tgggtttttgtttagttcag

SEQ ID NO: 784766 - DNA, 20 bp, Artificial
  CRISPR gRNA sequence
gggtttttgtttagttcagc

SEQ ID NO: 784767 - DNA, 20 bp, Artificial
  CRISPR gRNA sequence
tagttcagcaggatttttct

SEQ ID NO: 784768 - DNA, 20 bp, Artificial
  CRISPR gRNA sequence
ctcactgcctctcaaacttt

SEQ ID NO: 784769 - DNA, 20 bp, Artificial
  CRISPR gRNA sequence
tctcaaactttcagcaacaa

SEQ ID NO: 784770 - DNA, 20 bp, Artificial
  CRISPR gRNA sequence
ctcaaactttcagcaacaaa

SEQ ID NO: 784771 - DNA, 20 bp, Artificial
  CRISPR gRNA sequence
caaaaggacatctgtgatat

SEQ ID NO: 784772 - DNA, 20 bp, Artificial
  CRISPR gRNA sequence
atatcagaatctaccactct

SEQ ID NO: 784773 - DNA, 20 bp, Artificial
  CRISPR gRNA sequence
aatctaccactctaagtatt

SEQ ID NO: 784774 - DNA, 20 bp, Artificial
  CRISPR gRNA sequence
ctctaagtatttggatgcaa

SEQ ID NO: 784775 - DNA, 20 bp, Artificial
  CRISPR gRNA sequence
tgcaatagcaatgaatatct

SEQ ID NO: 784776 - DNA, 20 bp, Artificial
  CRISPR gRNA sequence
aatgaatatctgagtaaatc

SEQ ID NO: 784777 - DNA, 20 bp, Artificial
  CRISPR gRNA sequence
atgaatatctgagtaaatct

SEQ ID NO: 784778 - DNA, 20 bp, Artificial
  CRISPR gRNA sequence
aatatctgagtaaatctagg

SEQ ID NO: 784779 - DNA, 20 bp, Artificial
  CRISPR gRNA sequence
atatctgagtaaatctaggt

SEQ ID NO: 784780 - DNA, 20 bp, Artificial
  CRISPR gRNA sequence
tatctgagtaaatctaggtg

SEQ ID NO: 784781 - DNA, 20 bp, Artificial
  CRISPR gRNA sequence
tctgagtaaatctaggtggg

SEQ ID NO: 784782 - DNA, 20 bp, Artificial
  CRISPR gRNA sequence
gagtaaatctaggtggggag

SEQ ID NO: 784783 - DNA, 20 bp, Artificial
  CRISPR gRNA sequence
agtaaatctaggtggggagt

SEQ ID NO: 784784 - DNA, 20 bp, Artificial
  CRISPR gRNA sequence
gtaaatctaggtggggagtg

SEQ ID NO: 784785 - DNA, 20 bp, Artificial
  CRISPR gRNA sequence
taaatctaggtggggagtgg

SEQ ID NO: 784786 - DNA, 20 bp, Artificial
  CRISPR gRNA sequence
tggggagtgggggcaccctg

SEQ ID NO: 784787 - DNA, 20 bp, Artificial
  CRISPR gRNA sequence
acaaaatcaaaccaaaattt

SEQ ID NO: 784788 - DNA, 20 bp, Artificial
  CRISPR gRNA sequence
aaattttggaaatgatgcct

SEQ ID NO: 784789 - DNA, 20 bp, Artificial
  CRISPR gRNA sequence
aatgatgccttggtacaatg

SEQ ID NO: 784790 - DNA, 20 bp, Artificial
  CRISPR gRNA sequence
tgatgccttggtacaatgaa

SEQ ID NO: 784791 - DNA, 20 bp, Artificial
  CRISPR gRNA sequence
gtacaatgaagagactactt

SEQ ID NO: 784792 - DNA, 20 bp, Artificial
  CRISPR gRNA sequence
tacaatgaagagactacttg

SEQ ID NO: 784793 - DNA, 20 bp, Artificial
  CRISPR gRNA sequence
aatgaagagactacttgagg

SEQ ID NO: 784794 - DNA, 20 bp, Artificial
  CRISPR gRNA sequence
atgaagagactacttgaggt

SEQ ID NO: 784795 - DNA, 20 bp, Artificial
  CRISPR gRNA sequence
tttctttaccaatacctaat

SEQ ID NO: 784796 - DNA, 20 bp, Artificial
  CRISPR gRNA sequence
ttctttaccaatacctaatg

SEQ ID NO: 784797 - DNA, 20 bp, Artificial
  CRISPR gRNA sequence
atgaggaatttaaatatttc

SEQ ID NO: 784798 - DNA, 20 bp, Artificial
  CRISPR gRNA sequence
ggaatttaaatatttctaga

SEQ ID NO: 784799 - DNA, 20 bp, Artificial
  CRISPR gRNA sequence
taaatatttctagatagctt

SEQ ID NO: 784800 - DNA, 20 bp, Artificial
  CRISPR gRNA sequence
tatttctagatagctttgga

SEQ ID NO: 784801 - DNA, 20 bp, Artificial
  CRISPR gRNA sequence
atttctagatagctttggaa

SEQ ID NO: 784802 - DNA, 20 bp, Artificial
  CRISPR gRNA sequence
agctttggaaaggtccctta

SEQ ID NO: 784803 - DNA, 20 bp, Artificial
  CRISPR gRNA sequence
ctttggaaaggtcccttaaa

SEQ ID NO: 784804 - DNA, 20 bp, Artificial
  CRISPR gRNA sequence
tttggaaaggtcccttaaag

SEQ ID NO: 784805 - DNA, 20 bp, Artificial
  CRISPR gRNA sequence
aaggtcccttaaagaggcac

SEQ ID NO: 784806 - DNA, 20 bp, Artificial
  CRISPR gRNA sequence
aggcaccagcataccactgc

SEQ ID NO: 784807 - DNA, 20 bp, Artificial
  CRISPR gRNA sequence
catgtcatctcttgtctcta

SEQ ID NO: 784808 - DNA, 20 bp, Artificial
  CRISPR gRNA sequence
agatcatatcaaatccttcc

SEQ ID NO: 784809 - DNA, 20 bp, Artificial
  CRISPR gRNA sequence
atcatatcaaatccttccca

SEQ ID NO: 784810 - DNA, 20 bp, Artificial
  CRISPR gRNA sequence
aaatccttcccagagttttt

SEQ ID NO: 784811 - DNA, 20 bp, Artificial
  CRISPR gRNA sequence
aatccttcccagagtttttc

SEQ ID NO: 784812 - DNA, 20 bp, Artificial
  CRISPR gRNA sequence
ttttcaggccttttgacaac

SEQ ID NO: 784813 - DNA, 20 bp, Artificial
  CRISPR gRNA sequence
acaactagccacatttcact

SEQ ID NO: 784814 - DNA, 20 bp, Artificial
  CRISPR gRNA sequence
cttcaacaaaacttttcctc

SEQ ID NO: 784815 - DNA, 20 bp, Artificial
  CRISPR gRNA sequence
acaaaacttttcctcaagtt

SEQ ID NO: 784816 - DNA, 20 bp, Artificial
  CRISPR gRNA sequence
tccaccaacaccactgccat

SEQ ID NO: 784817 - DNA, 20 bp, Artificial
  CRISPR gRNA sequence
tgagctcattcccacttctg

SEQ ID NO: 784818 - DNA, 20 bp, Artificial
  CRISPR gRNA sequence
ttctgtggctttgctcatgt

SEQ ID NO: 784819 - DNA, 20 bp, Artificial
  CRISPR gRNA sequence
gctcatgttggttatttttt

SEQ ID NO: 784820 - DNA, 20 bp, Artificial
  CRISPR gRNA sequence
tcatgttggttatttttttg

SEQ ID NO: 784821 - DNA, 20 bp, Artificial
  CRISPR gRNA sequence
cttgtcccaatcccaacttt

SEQ ID NO: 784822 - DNA, 20 bp, Artificial
  CRISPR gRNA sequence
cccaatcccaacttttggca

SEQ ID NO: 784823 - DNA, 20 bp, Artificial
  CRISPR gRNA sequence
cttttggcatggtctacttt

SEQ ID NO: 784824 - DNA, 20 bp, Artificial
  CRISPR gRNA sequence
gcatggtctactttaagata

SEQ ID NO: 784825 - DNA, 20 bp, Artificial
  CRISPR gRNA sequence
ctactttaagatacagtaat

SEQ ID NO: 784826 - DNA, 20 bp, Artificial
  CRISPR gRNA sequence
taactttattattataacac

SEQ ID NO: 784827 - DNA, 20 bp, Artificial
  CRISPR gRNA sequence
aactttattattataacacc

SEQ ID NO: 784828 - DNA, 20 bp, Artificial
  CRISPR gRNA sequence
taacaccaggcttctgttct

SEQ ID NO: 784829 - DNA, 20 bp, Artificial
  CRISPR gRNA sequence
aggcttctgttctaagacat

SEQ ID NO: 784830 - DNA, 20 bp, Artificial
  CRISPR gRNA sequence
cttctgttctaagacattag

SEQ ID NO: 784831 - DNA, 20 bp, Artificial
  CRISPR gRNA sequence
taagacattagaagtgtgtt

SEQ ID NO: 784832 - DNA, 20 bp, Artificial
  CRISPR gRNA sequence
cattagaagtgtgtttagac

SEQ ID NO: 784833 - DNA, 20 bp, Artificial
  CRISPR gRNA sequence
actagctcatttaatcctca

SEQ ID NO: 784834 - DNA, 20 bp, Artificial
  CRISPR gRNA sequence
agctcatttaatcctcacag

SEQ ID NO: 784835 - DNA, 20 bp, Artificial
  CRISPR gRNA sequence
atcctcacagtagccctctg

SEQ ID NO: 784836 - DNA, 20 bp, Artificial
  CRISPR gRNA sequence
actccctgcttcccatttta

SEQ ID NO: 784837 - DNA, 20 bp, Artificial
  CRISPR gRNA sequence
ctccctgcttcccattttat

SEQ ID NO: 784838 - DNA, 20 bp, Artificial
  CRISPR gRNA sequence
ctgcttcccattttataggt

SEQ ID NO: 784839 - DNA, 20 bp, Artificial
  CRISPR gRNA sequence
tgcttcccattttataggtg

SEQ ID NO: 784840 - DNA, 20 bp, Artificial
  CRISPR gRNA sequence
ttcccattttataggtgagg

SEQ ID NO: 784841 - DNA, 20 bp, Artificial
  CRISPR gRNA sequence
aggtgaggaagaaaaacatg

SEQ ID NO: 784842 - DNA, 20 bp, Artificial
  CRISPR gRNA sequence
gtgaggaagaaaaacatgaa

SEQ ID NO: 784843 - DNA, 20 bp, Artificial
  CRISPR gRNA sequence
tgaggaagaaaaacatgaag

SEQ ID NO: 784844 - DNA, 20 bp, Artificial
  CRISPR gRNA sequence
agaggttaactaacttgccc

SEQ ID NO: 784845 - DNA, 20 bp, Artificial
  CRISPR gRNA sequence
gaggttaactaacttgccca

SEQ ID NO: 784846 - DNA, 20 bp, Artificial
  CRISPR gRNA sequence
actaacttgcccaaggtata

SEQ ID NO: 784847 - DNA, 20 bp, Artificial
  CRISPR gRNA sequence
aggtatatagctaataatat

SEQ ID NO: 784848 - DNA, 20 bp, Artificial
  CRISPR gRNA sequence
ggtatatagctaataatata

SEQ ID NO: 784849 - DNA, 20 bp, Artificial
  CRISPR gRNA sequence
gtatatagctaataatataa

SEQ ID NO: 784850 - DNA, 20 bp, Artificial
  CRISPR gRNA sequence
taagggccaataaattgatt

SEQ ID NO: 784851 - DNA, 20 bp, Artificial
  CRISPR gRNA sequence
aataaattgattcagcaatc

SEQ ID NO: 784852 - DNA, 20 bp, Artificial
  CRISPR gRNA sequence
ataaattgattcagcaatcc

SEQ ID NO: 784853 - DNA, 20 bp, Artificial
  CRISPR gRNA sequence
attcagcaatccaggtgtcc

SEQ ID NO: 784854 - DNA, 20 bp, Artificial
  CRISPR gRNA sequence
gcaatccaggtgtccaagtc

SEQ ID NO: 784855 - DNA, 20 bp, Artificial
  CRISPR gRNA sequence
aatttaattcaatttttttt

SEQ ID NO: 784856 - DNA, 20 bp, Artificial
  CRISPR gRNA sequence
tttaattcaattttttttta

SEQ ID NO: 784857 - DNA, 20 bp, Artificial
  CRISPR gRNA sequence
attcaatttttttttagaga

SEQ ID NO: 784858 - DNA, 20 bp, Artificial
  CRISPR gRNA sequence
tcaatttttttttagagaca

SEQ ID NO: 784859 - DNA, 20 bp, Artificial
  CRISPR gRNA sequence
cagagtcttgctctatcacc

SEQ ID NO: 784860 - DNA, 20 bp, Artificial
  CRISPR gRNA sequence
agagtcttgctctatcaccc

SEQ ID NO: 784861 - DNA, 20 bp, Artificial
  CRISPR gRNA sequence
tcttgctctatcacccaggt

SEQ ID NO: 784862 - DNA, 20 bp, Artificial
  CRISPR gRNA sequence
ttgctctatcacccaggttg

SEQ ID NO: 784863 - DNA, 20 bp, Artificial
  CRISPR gRNA sequence
ctatcacccaggttggagtg

SEQ ID NO: 784864 - DNA, 20 bp, Artificial
  CRISPR gRNA sequence
tcacccaggttggagtgcag

SEQ ID NO: 784865 - DNA, 20 bp, Artificial
  CRISPR gRNA sequence
ggagtgcagtggtatgaccg

SEQ ID NO: 784866 - DNA, 20 bp, Artificial
  CRISPR gRNA sequence
ggtatgaccgtggctcactg

SEQ ID NO: 784867 - DNA, 20 bp, Artificial
  CRISPR gRNA sequence
ctcactgcagcctcaacttt

SEQ ID NO: 784868 - DNA, 20 bp, Artificial
  CRISPR gRNA sequence
cagcctcaacttttggactc

SEQ ID NO: 784869 - DNA, 20 bp, Artificial
  CRISPR gRNA sequence
ctcaagctatcttcccacct

SEQ ID NO: 784870 - DNA, 20 bp, Artificial
  CRISPR gRNA sequence
tcttcccacctcagcctcct

SEQ ID NO: 784871 - DNA, 20 bp, Artificial
  CRISPR gRNA sequence
tcccacctcagcctcctgag

SEQ ID NO: 784872 - DNA, 20 bp, Artificial
  CRISPR gRNA sequence
acctcagcctcctgagtagc

SEQ ID NO: 784873 - DNA, 20 bp, Artificial
  CRISPR gRNA sequence
cctcagcctcctgagtagct

SEQ ID NO: 784874 - DNA, 20 bp, Artificial
  CRISPR gRNA sequence
ctcctgagtagctgggacta

SEQ ID NO: 784875 - DNA, 20 bp, Artificial
  CRISPR gRNA sequence
tcctgagtagctgggactac

SEQ ID NO: 784876 - DNA, 20 bp, Artificial
  CRISPR gRNA sequence
caggtgcatgccaccgtacc

SEQ ID NO: 784877 - DNA, 20 bp, Artificial
  CRISPR gRNA sequence
ttttttatttttattttttg

SEQ ID NO: 784878 - DNA, 20 bp, Artificial
  CRISPR gRNA sequence
atttttattttttgtagaac

SEQ ID NO: 784879 - DNA, 20 bp, Artificial
  CRISPR gRNA sequence
tttttattttttgtagaact

SEQ ID NO: 784880 - DNA, 20 bp, Artificial
  CRISPR gRNA sequence
ttttattttttgtagaactg

SEQ ID NO: 784881 - DNA, 20 bp, Artificial
  CRISPR gRNA sequence
tggggtctcactatgttgcc

SEQ ID NO: 784882 - DNA, 20 bp, Artificial
  CRISPR gRNA sequence
ggggtctcactatgttgccc

SEQ ID NO: 784883 - DNA, 20 bp, Artificial
  CRISPR gRNA sequence
tctcactatgttgcccagga

SEQ ID NO: 784884 - DNA, 20 bp, Artificial
  CRISPR gRNA sequence
caggatggtctcaaactcct

SEQ ID NO: 784885 - DNA, 20 bp, Artificial
  CRISPR gRNA sequence
ggtctcaaactcctcggctc

SEQ ID NO: 784886 - DNA, 20 bp, Artificial
  CRISPR gRNA sequence
ctcaagcaatcctcctgcct

SEQ ID NO: 784887 - DNA, 20 bp, Artificial
  CRISPR gRNA sequence
cctcctgccttggcctccca

SEQ ID NO: 784888 - DNA, 20 bp, Artificial
  CRISPR gRNA sequence
gccttggcctcccaaagtgc

SEQ ID NO: 784889 - DNA, 20 bp, Artificial
  CRISPR gRNA sequence
ccttggcctcccaaagtgct

SEQ ID NO: 784890 - DNA, 20 bp, Artificial
  CRISPR gRNA sequence
ctcccaaagtgctgggattc

SEQ ID NO: 784891 - DNA, 20 bp, Artificial
  CRISPR gRNA sequence
tcccaaagtgctgggattcc

SEQ ID NO: 784892 - DNA, 20 bp, Artificial
  CRISPR gRNA sequence
agtgctgggattccaggcgt

SEQ ID NO: 784893 - DNA, 20 bp, Artificial
  CRISPR gRNA sequence
caggcgtaagccactgtgcc

SEQ ID NO: 784894 - DNA, 20 bp, Artificial
  CRISPR gRNA sequence
cactctcttgcttaatctgt

SEQ ID NO: 784895 - DNA, 20 bp, Artificial
  CRISPR gRNA sequence
acacaatctataccactctt

SEQ ID NO: 784896 - DNA, 20 bp, Artificial
  CRISPR gRNA sequence
cactcttaagcacatgatta

SEQ ID NO: 784897 - DNA, 20 bp, Artificial
  CRISPR gRNA sequence
atgattacagcgttattttc

SEQ ID NO: 784898 - DNA, 20 bp, Artificial
  CRISPR gRNA sequence
gcttctatgtgtctatattt

SEQ ID NO: 784899 - DNA, 20 bp, Artificial
  CRISPR gRNA sequence
cttctatgtgtctatatttt

SEQ ID NO: 784900 - DNA, 20 bp, Artificial
  CRISPR gRNA sequence
gtctatattttaggtccacc

SEQ ID NO: 784901 - DNA, 20 bp, Artificial
  CRISPR gRNA sequence
tccacctggtcaatataata

SEQ ID NO: 784902 - DNA, 20 bp, Artificial
  CRISPR gRNA sequence
acctggtcaatataataaag

SEQ ID NO: 784903 - DNA, 20 bp, Artificial
  CRISPR gRNA sequence
cctggtcaatataataaagt

SEQ ID NO: 784904 - DNA, 20 bp, Artificial
  CRISPR gRNA sequence
aatataataaagtgggatat

SEQ ID NO: 784905 - DNA, 20 bp, Artificial
  CRISPR gRNA sequence
ttagtgttaatgcaactata

SEQ ID NO: 784906 - DNA, 20 bp, Artificial
  CRISPR gRNA sequence
ccgtttatcaatgtttctta

SEQ ID NO: 784907 - DNA, 20 bp, Artificial
  CRISPR gRNA sequence
ttattatataataaatttaa

SEQ ID NO: 784908 - DNA, 20 bp, Artificial
  CRISPR gRNA sequence
tattatataataaatttaaa

SEQ ID NO: 784909 - DNA, 20 bp, Artificial
  CRISPR gRNA sequence
aaataaattttgtttaattt

SEQ ID NO: 784910 - DNA, 20 bp, Artificial
  CRISPR gRNA sequence
aattttgtttaattttagtt

SEQ ID NO: 784911 - DNA, 20 bp, Artificial
  CRISPR gRNA sequence
ttgagtctatcaactcaaaa

SEQ ID NO: 784912 - DNA, 20 bp, Artificial
  CRISPR gRNA sequence
gaataacgtacaacaataac

SEQ ID NO: 784913 - DNA, 20 bp, Artificial
  CRISPR gRNA sequence
cgtacaacaataacaagttt

SEQ ID NO: 784914 - DNA, 20 bp, Artificial
  CRISPR gRNA sequence
ttttaaattactgattttat

SEQ ID NO: 784915 - DNA, 20 bp, Artificial
  CRISPR gRNA sequence
tataaaaataaaaaataaaa

SEQ ID NO: 784916 - DNA, 20 bp, Artificial
  CRISPR gRNA sequence
ataaaaaataaaaaagtata

SEQ ID NO: 784917 - DNA, 20 bp, Artificial
  CRISPR gRNA sequence
taaagaaaacaaaaataatt

SEQ ID NO: 784918 - DNA, 20 bp, Artificial
  CRISPR gRNA sequence
ataatttagaatccattgcc

SEQ ID NO: 784919 - DNA, 20 bp, Artificial
  CRISPR gRNA sequence
ccattgcctagaaattgcca

SEQ ID NO: 784920 - DNA, 20 bp, Artificial
  CRISPR gRNA sequence
gcctagaaattgccatggtt

SEQ ID NO: 784921 - DNA, 20 bp, Artificial
  CRISPR gRNA sequence
gttaagattttaatattgct

SEQ ID NO: 784922 - DNA, 20 bp, Artificial
  CRISPR gRNA sequence
ttaagattttaatattgctc

SEQ ID NO: 784923 - DNA, 20 bp, Artificial
  CRISPR gRNA sequence
attttaatattgctcaggcc

SEQ ID NO: 784924 - DNA, 20 bp, Artificial
  CRISPR gRNA sequence
taatattgctcaggcccaga

SEQ ID NO: 784925 - DNA, 20 bp, Artificial
  CRISPR gRNA sequence
ttgctcaggcccagacagct

SEQ ID NO: 784926 - DNA, 20 bp, Artificial
  CRISPR gRNA sequence
tgctcaggcccagacagctc

SEQ ID NO: 784927 - DNA, 20 bp, Artificial
  CRISPR gRNA sequence
gctcaggcccagacagctca

SEQ ID NO: 784928 - DNA, 20 bp, Artificial
  CRISPR gRNA sequence
acacccattctctgccatcc

SEQ ID NO: 784929 - DNA, 20 bp, Artificial
  CRISPR gRNA sequence
atcccaaaaccatccattat

SEQ ID NO: 784930 - DNA, 20 bp, Artificial
  CRISPR gRNA sequence
tcccaaaaccatccattatg

SEQ ID NO: 784931 - DNA, 20 bp, Artificial
  CRISPR gRNA sequence
ccaaaaccatccattatgag

SEQ ID NO: 784932 - DNA, 20 bp, Artificial
  CRISPR gRNA sequence
aaaaccatccattatgagga

SEQ ID NO: 784933 - DNA, 20 bp, Artificial
  CRISPR gRNA sequence
tccattatgaggagagtgta

SEQ ID NO: 784934 - DNA, 20 bp, Artificial
  CRISPR gRNA sequence
atgaggagagtgtacagctc

SEQ ID NO: 784935 - DNA, 20 bp, Artificial
  CRISPR gRNA sequence
tgaggagagtgtacagctct

SEQ ID NO: 784936 - DNA, 20 bp, Artificial
  CRISPR gRNA sequence
gtgtacagctctaggctgcc

SEQ ID NO: 784937 - DNA, 20 bp, Artificial
  CRISPR gRNA sequence
tgtacagctctaggctgccc

SEQ ID NO: 784938 - DNA, 20 bp, Artificial
  CRISPR gRNA sequence
tacagctctaggctgcccgg

SEQ ID NO: 784939 - DNA, 20 bp, Artificial
  CRISPR gRNA sequence
cgcactctcattttgtgact

SEQ ID NO: 784940 - DNA, 20 bp, Artificial
  CRISPR gRNA sequence
cattttgtgactcggcatct

SEQ ID NO: 784941 - DNA, 20 bp, Artificial
  CRISPR gRNA sequence
attttgtgactcggcatctt

SEQ ID NO: 784942 - DNA, 20 bp, Artificial
  CRISPR gRNA sequence
tttgtgactcggcatcttgg

SEQ ID NO: 784943 - DNA, 20 bp, Artificial
  CRISPR gRNA sequence
tgactcggcatcttgggaga

SEQ ID NO: 784944 - DNA, 20 bp, Artificial
  CRISPR gRNA sequence
actcggcatcttgggagatg

SEQ ID NO: 784945 - DNA, 20 bp, Artificial
  CRISPR gRNA sequence
catcttgggagatggagtct

SEQ ID NO: 784946 - DNA, 20 bp, Artificial
  CRISPR gRNA sequence
atcttgggagatggagtctt

SEQ ID NO: 784947 - DNA, 20 bp, Artificial
  CRISPR gRNA sequence
ggagatggagtcttgggact

SEQ ID NO: 784948 - DNA, 20 bp, Artificial
  CRISPR gRNA sequence
tggagtcttgggacttagcc

SEQ ID NO: 784949 - DNA, 20 bp, Artificial
  CRISPR gRNA sequence
cccttgcatgtacttcttac

SEQ ID NO: 784950 - DNA, 20 bp, Artificial
  CRISPR gRNA sequence
cttcttacaagacttttatt

SEQ ID NO: 784951 - DNA, 20 bp, Artificial
  CRISPR gRNA sequence
aatattttcccttccaactt

SEQ ID NO: 784952 - DNA, 20 bp, Artificial
  CRISPR gRNA sequence
attttcccttccaacttaag

SEQ ID NO: 784953 - DNA, 20 bp, Artificial
  CRISPR gRNA sequence
cccttccaacttaagaagca

SEQ ID NO: 784954 - DNA, 20 bp, Artificial
  CRISPR gRNA sequence
ccttccaacttaagaagcac

SEQ ID NO: 784955 - DNA, 20 bp, Artificial
  CRISPR gRNA sequence
cttccaacttaagaagcaca

SEQ ID NO: 784956 - DNA, 20 bp, Artificial
  CRISPR gRNA sequence
ttaagaagcacagggcttgc

SEQ ID NO: 784957 - DNA, 20 bp, Artificial
  CRISPR gRNA sequence
gctggttttgcttcactaac

SEQ ID NO: 784958 - DNA, 20 bp, Artificial
  CRISPR gRNA sequence
gcttcactaaccagcaactg

SEQ ID NO: 784959 - DNA, 20 bp, Artificial
  CRISPR gRNA sequence
cactaaccagcaactgaagc

SEQ ID NO: 784960 - DNA, 20 bp, Artificial
  CRISPR gRNA sequence
tgacttgtgaaaatgcctaa

SEQ ID NO: 784961 - DNA, 20 bp, Artificial
  CRISPR gRNA sequence
acttgtgaaaatgcctaata

SEQ ID NO: 784962 - DNA, 20 bp, Artificial
  CRISPR gRNA sequence
tgaaaatgcctaatagagtt

SEQ ID NO: 784963 - DNA, 20 bp, Artificial
  CRISPR gRNA sequence
tgcctaatagagttcagtat

SEQ ID NO: 784964 - DNA, 20 bp, Artificial
  CRISPR gRNA sequence
agcgctgtttcaccatttcc

SEQ ID NO: 784965 - DNA, 20 bp, Artificial
  CRISPR gRNA sequence
tcttgcctttgtgcacatga

SEQ ID NO: 784966 - DNA, 20 bp, Artificial
  CRISPR gRNA sequence
acttctctgtgattaatttg

SEQ ID NO: 784967 - DNA, 20 bp, Artificial
  CRISPR gRNA sequence
tctgtgattaatttgtagtt

SEQ ID NO: 784968 - DNA, 20 bp, Artificial
  CRISPR gRNA sequence
gattaatttgtagttaagtg

SEQ ID NO: 784969 - DNA, 20 bp, Artificial
  CRISPR gRNA sequence
tgtggtcatgtaactcgctt

SEQ ID NO: 784970 - DNA, 20 bp, Artificial
  CRISPR gRNA sequence
cgctttggtcaattaaatgt

SEQ ID NO: 784971 - DNA, 20 bp, Artificial
  CRISPR gRNA sequence
ggtcaattaaatgtaagcat

SEQ ID NO: 784972 - DNA, 20 bp, Artificial
  CRISPR gRNA sequence
taagtgatgcgtgttatttc

SEQ ID NO: 784973 - DNA, 20 bp, Artificial
  CRISPR gRNA sequence
aagtgatgcgtgttatttct

SEQ ID NO: 784974 - DNA, 20 bp, Artificial
  CRISPR gRNA sequence
tgatgcgtgttatttctggg

SEQ ID NO: 784975 - DNA, 20 bp, Artificial
  CRISPR gRNA sequence
tgcgtgttatttctgggtag

SEQ ID NO: 784976 - DNA, 20 bp, Artificial
  CRISPR gRNA sequence
tatttctgggtagaagatgt

SEQ ID NO: 784977 - DNA, 20 bp, Artificial
  CRISPR gRNA sequence
tttctgggtagaagatgtaa

SEQ ID NO: 784978 - DNA, 20 bp, Artificial
  CRISPR gRNA sequence
tgggtagaagatgtaagagt

SEQ ID NO: 784979 - DNA, 20 bp, Artificial
  CRISPR gRNA sequence
ccatattttctttatccatc

SEQ ID NO: 784980 - DNA, 20 bp, Artificial
  CRISPR gRNA sequence
ttttctttatccatctggca

SEQ ID NO: 784981 - DNA, 20 bp, Artificial
  CRISPR gRNA sequence
tatccatctggcatggtaac

SEQ ID NO: 784982 - DNA, 20 bp, Artificial
  CRISPR gRNA sequence
catggtaaccagtaacattc

SEQ ID NO: 784983 - DNA, 20 bp, Artificial
  CRISPR gRNA sequence
atggtaaccagtaacattct

SEQ ID NO: 784984 - DNA, 20 bp, Artificial
  CRISPR gRNA sequence
gtaaccagtaacattctagg

SEQ ID NO: 784985 - DNA, 20 bp, Artificial
  CRISPR gRNA sequence
ctaggtagtaattgctccat

SEQ ID NO: 784986 - DNA, 20 bp, Artificial
  CRISPR gRNA sequence
agtaattgctccatcagtct

SEQ ID NO: 784987 - DNA, 20 bp, Artificial
  CRISPR gRNA sequence
ctccatcagtctcagtctct

SEQ ID NO: 784988 - DNA, 20 bp, Artificial
  CRISPR gRNA sequence
ctctgagtgactaaaattga

SEQ ID NO: 784989 - DNA, 20 bp, Artificial
  CRISPR gRNA sequence
ctgagtgactaaaattgaca

SEQ ID NO: 784990 - DNA, 20 bp, Artificial
  CRISPR gRNA sequence
ctgctgaccctcaatgtaca

SEQ ID NO: 784991 - DNA, 20 bp, Artificial
  CRISPR gRNA sequence
aatgtacatggaacatgaac

SEQ ID NO: 784992 - DNA, 20 bp, Artificial
  CRISPR gRNA sequence
catggaacatgaacaagaat

SEQ ID NO: 784993 - DNA, 20 bp, Artificial
  CRISPR gRNA sequence
aagcttttgttttttatatt

SEQ ID NO: 784994 - DNA, 20 bp, Artificial
  CRISPR gRNA sequence
tgttttttatattgagattt

SEQ ID NO: 784995 - DNA, 20 bp, Artificial
  CRISPR gRNA sequence
ttttttatattgagattttg

SEQ ID NO: 784996 - DNA, 20 bp, Artificial
  CRISPR gRNA sequence
tttggagttgtttgttccta

SEQ ID NO: 784997 - DNA, 20 bp, Artificial
  CRISPR gRNA sequence
tttgttcctacagcattacc

SEQ ID NO: 784998 - DNA, 20 bp, Artificial
  CRISPR gRNA sequence
tagtttactctaatacaaca

SEQ ID NO: 784999 - DNA, 20 bp, Artificial
  CRISPR gRNA sequence
taatacaacatggaaaaaac

SEQ ID NO: 785000 - DNA, 20 bp, Artificial
  CRISPR gRNA sequence
aaactggaacctataataaa

SEQ ID NO: 785001 - DNA, 20 bp, Artificial
  CRISPR gRNA sequence
tacgttgccatttaaacttc

SEQ ID NO: 785002 - DNA, 20 bp, Artificial
  CRISPR gRNA sequence
ccatttaaacttctagttct

SEQ ID NO: 785003 - DNA, 20 bp, Artificial
  CRISPR gRNA sequence
catttaaacttctagttctg

SEQ ID NO: 785004 - DNA, 20 bp, Artificial
  CRISPR gRNA sequence
agttctgaggaataataatg

SEQ ID NO: 785005 - DNA, 20 bp, Artificial
  CRISPR gRNA sequence
gttctgaggaataataatgt

SEQ ID NO: 785006 - DNA, 20 bp, Artificial
  CRISPR gRNA sequence
ttctgaggaataataatgtg

SEQ ID NO: 785007 - DNA, 20 bp, Artificial
  CRISPR gRNA sequence
ctttctatataataaaaaaa

SEQ ID NO: 785008 - DNA, 20 bp, Artificial
  CRISPR gRNA sequence
cctattaaaaatgttattta

SEQ ID NO: 785009 - DNA, 20 bp, Artificial
  CRISPR gRNA sequence
ctcaccatattcccttcctc

SEQ ID NO: 785010 - DNA, 20 bp, Artificial
  CRISPR gRNA sequence
attcccttcctccagaaaaa

SEQ ID NO: 785011 - DNA, 20 bp, Artificial
  CRISPR gRNA sequence
cccttcctccagaaaaacag

SEQ ID NO: 785012 - DNA, 20 bp, Artificial
  CRISPR gRNA sequence
aatgcctgtaatcatgtttt

SEQ ID NO: 785013 - DNA, 20 bp, Artificial
  CRISPR gRNA sequence
gtaatcatgtttttggatta

SEQ ID NO: 785014 - DNA, 20 bp, Artificial
  CRISPR gRNA sequence
tgtttttggattatggaatc

SEQ ID NO: 785015 - DNA, 20 bp, Artificial
  CRISPR gRNA sequence
ttgtacttcactacattttt

SEQ ID NO: 785016 - DNA, 20 bp, Artificial
  CRISPR gRNA sequence
cctgatgtattactttcaaa

SEQ ID NO: 785017 - DNA, 20 bp, Artificial
  CRISPR gRNA sequence
gatgtattactttcaaaaag

SEQ ID NO: 785018 - DNA, 20 bp, Artificial
  CRISPR gRNA sequence
gtattactttcaaaaagaag

SEQ ID NO: 785019 - DNA, 20 bp, Artificial
  CRISPR gRNA sequence
aagaagaagaatactttctg

SEQ ID NO: 785020 - DNA, 20 bp, Artificial
  CRISPR gRNA sequence
accatccccactcacctctc

SEQ ID NO: 785021 - DNA, 20 bp, Artificial
  CRISPR gRNA sequence
ccactcacctctctagatcc

SEQ ID NO: 785022 - DNA, 20 bp, Artificial
  CRISPR gRNA sequence
cagtaaccaaatacattata

SEQ ID NO: 785023 - DNA, 20 bp, Artificial
  CRISPR gRNA sequence
agtaaccaaatacattatat

SEQ ID NO: 785024 - DNA, 20 bp, Artificial
  CRISPR gRNA sequence
cattatataggactcttcat

SEQ ID NO: 785025 - DNA, 20 bp, Artificial
  CRISPR gRNA sequence
actcttcatcagtccttatc

SEQ ID NO: 785026 - DNA, 20 bp, Artificial
  CRISPR gRNA sequence
tcatcagtccttatcaagtt

SEQ ID NO: 785027 - DNA, 20 bp, Artificial
  CRISPR gRNA sequence
catcagtccttatcaagttt

SEQ ID NO: 785028 - DNA, 20 bp, Artificial
  CRISPR gRNA sequence
cagtccttatcaagtttagg

SEQ ID NO: 785029 - DNA, 20 bp, Artificial
  CRISPR gRNA sequence
agtccttatcaagtttagga

SEQ ID NO: 785030 - DNA, 20 bp, Artificial
  CRISPR gRNA sequence
gtccttatcaagtttaggaa

SEQ ID NO: 785031 - DNA, 20 bp, Artificial
  CRISPR gRNA sequence
gcgatgctataccttcttta

SEQ ID NO: 785032 - DNA, 20 bp, Artificial
  CRISPR gRNA sequence
cgatgctataccttctttaa

SEQ ID NO: 785033 - DNA, 20 bp, Artificial
  CRISPR gRNA sequence
aaggacacctaccaatgtct

SEQ ID NO: 785034 - DNA, 20 bp, Artificial
  CRISPR gRNA sequence
aatgtcttagttgcctttca

SEQ ID NO: 785035 - DNA, 20 bp, Artificial
  CRISPR gRNA sequence
agttgcctttcaaagactcc

SEQ ID NO: 785036 - DNA, 20 bp, Artificial
  CRISPR gRNA sequence
cctttcaaagactcctagca

SEQ ID NO: 785037 - DNA, 20 bp, Artificial
  CRISPR gRNA sequence
cctagcacagctaaatgtga

SEQ ID NO: 785038 - DNA, 20 bp, Artificial
  CRISPR gRNA sequence
aaatgtgatggatatgctct

SEQ ID NO: 785039 - DNA, 20 bp, Artificial
  CRISPR gRNA sequence
aatgtgatggatatgctcta

SEQ ID NO: 785040 - DNA, 20 bp, Artificial
  CRISPR gRNA sequence
tggatatgctctaaggatat

SEQ ID NO: 785041 - DNA, 20 bp, Artificial
  CRISPR gRNA sequence
gatatgctctaaggatataa

SEQ ID NO: 785042 - DNA, 20 bp, Artificial
  CRISPR gRNA sequence
ctctaaggatataagagctg

SEQ ID NO: 785043 - DNA, 20 bp, Artificial
  CRISPR gRNA sequence
agagctgaagtgacttgcat

SEQ ID NO: 785044 - DNA, 20 bp, Artificial
  CRISPR gRNA sequence
gagctgaagtgacttgcata

SEQ ID NO: 785045 - DNA, 20 bp, Artificial
  CRISPR gRNA sequence
gtcatatcataacttactgt

SEQ ID NO: 785046 - DNA, 20 bp, Artificial
  CRISPR gRNA sequence
tcataacttactgttagaaa

SEQ ID NO: 785047 - DNA, 20 bp, Artificial
  CRISPR gRNA sequence
ataacttactgttagaaatg

SEQ ID NO: 785048 - DNA, 20 bp, Artificial
  CRISPR gRNA sequence
cttactgttagaaatggagc

SEQ ID NO: 785049 - DNA, 20 bp, Artificial
  CRISPR gRNA sequence
ttagaaatggagctagaact

SEQ ID NO: 785050 - DNA, 20 bp, Artificial
  CRISPR gRNA sequence
agctagaactcagacccact

SEQ ID NO: 785051 - DNA, 20 bp, Artificial
  CRISPR gRNA sequence
cacactgccctttccatttg

SEQ ID NO: 785052 - DNA, 20 bp, Artificial
  CRISPR gRNA sequence
actgccctttccatttgtgg

SEQ ID NO: 785053 - DNA, 20 bp, Artificial
  CRISPR gRNA sequence
actttatctgtgctactatt

SEQ ID NO: 785054 - DNA, 20 bp, Artificial
  CRISPR gRNA sequence
ctttatctgtgctactattt

SEQ ID NO: 785055 - DNA, 20 bp, Artificial
  CRISPR gRNA sequence
tctgtgctactatttgggcc

SEQ ID NO: 785056 - DNA, 20 bp, Artificial
  CRISPR gRNA sequence
tagccattctccctcttatg

SEQ ID NO: 785057 - DNA, 20 bp, Artificial
  CRISPR gRNA sequence
attctccctcttatgcagac

SEQ ID NO: 785058 - DNA, 20 bp, Artificial
  CRISPR gRNA sequence
ctccctcttatgcagacaag

SEQ ID NO: 785059 - DNA, 20 bp, Artificial
  CRISPR gRNA sequence
tatgcagacaagcagataaa

SEQ ID NO: 785060 - DNA, 20 bp, Artificial
  CRISPR gRNA sequence
gcagataaacagtaaaactt

SEQ ID NO: 785061 - DNA, 20 bp, Artificial
  CRISPR gRNA sequence
cagataaacagtaaaacttt

SEQ ID NO: 785062 - DNA, 20 bp, Artificial
  CRISPR gRNA sequence
gataaacagtaaaactttag

SEQ ID NO: 785063 - DNA, 20 bp, Artificial
  CRISPR gRNA sequence
aaacagtaaaactttaggag

SEQ ID NO: 785064 - DNA, 20 bp, Artificial
  CRISPR gRNA sequence
aggagtggattatgatacca

SEQ ID NO: 785065 - DNA, 20 bp, Artificial
  CRISPR gRNA sequence
atcatctatcctttacaaaa

SEQ ID NO: 785066 - DNA, 20 bp, Artificial
  CRISPR gRNA sequence
cctttacaaaatagttatta

SEQ ID NO: 785067 - DNA, 20 bp, Artificial
  CRISPR gRNA sequence
aaatagttattacagtcatc

SEQ ID NO: 785068 - DNA, 20 bp, Artificial
  CRISPR gRNA sequence
ttattacagtcatcaagcct

SEQ ID NO: 785069 - DNA, 20 bp, Artificial
  CRISPR gRNA sequence
tacagtcatcaagccttggt

SEQ ID NO: 785070 - DNA, 20 bp, Artificial
  CRISPR gRNA sequence
cagtcatcaagccttggtta

SEQ ID NO: 785071 - DNA, 20 bp, Artificial
  CRISPR gRNA sequence
caagccttggttagagttta

SEQ ID NO: 785072 - DNA, 20 bp, Artificial
  CRISPR gRNA sequence
agtttacagaccatgtatcc

SEQ ID NO: 785073 - DNA, 20 bp, Artificial
  CRISPR gRNA sequence
atcctagctacctcatttca

SEQ ID NO: 785074 - DNA, 20 bp, Artificial
  CRISPR gRNA sequence
catttcacagattatgacat

SEQ ID NO: 785075 - DNA, 20 bp, Artificial
  CRISPR gRNA sequence
atttcacagattatgacatt

SEQ ID NO: 785076 - DNA, 20 bp, Artificial
  CRISPR gRNA sequence
tttcacagattatgacattg

SEQ ID NO: 785077 - DNA, 20 bp, Artificial
  CRISPR gRNA sequence
ttcacagattatgacattgg

SEQ ID NO: 785078 - DNA, 20 bp, Artificial
  CRISPR gRNA sequence
agattatgacattgggggct

SEQ ID NO: 785079 - DNA, 20 bp, Artificial
  CRISPR gRNA sequence
attatgacattgggggctaa

SEQ ID NO: 785080 - DNA, 20 bp, Artificial
  CRISPR gRNA sequence
attgggggctaagagatatt

SEQ ID NO: 785081 - DNA, 20 bp, Artificial
  CRISPR gRNA sequence
agatattaagtgacttcctt

SEQ ID NO: 785082 - DNA, 20 bp, Artificial
  CRISPR gRNA sequence
agtgacttccttaagtgaaa

SEQ ID NO: 785083 - DNA, 20 bp, Artificial
  CRISPR gRNA sequence
gacttccttaagtgaaacag

SEQ ID NO: 785084 - DNA, 20 bp, Artificial
  CRISPR gRNA sequence
ttccttaagtgaaacagtag

SEQ ID NO: 785085 - DNA, 20 bp, Artificial
  CRISPR gRNA sequence
gtgaaacagtagcagaccaa

SEQ ID NO: 785086 - DNA, 20 bp, Artificial
  CRISPR gRNA sequence
aaacagtagcagaccaaaag

SEQ ID NO: 785087 - DNA, 20 bp, Artificial
  CRISPR gRNA sequence
ccaaaagaagtcatgattcc

SEQ ID NO: 785088 - DNA, 20 bp, Artificial
  CRISPR gRNA sequence
agaagtcatgattcccagca

SEQ ID NO: 785089 - DNA, 20 bp, Artificial
  CRISPR gRNA sequence
cccactcacaaacctgtatt

SEQ ID NO: 785090 - DNA, 20 bp, Artificial
  CRISPR gRNA sequence
attaagtttctgttatttgc

SEQ ID NO: 785091 - DNA, 20 bp, Artificial
  CRISPR gRNA sequence
tgttatttgcaagaccctgt

SEQ ID NO: 785092 - DNA, 20 bp, Artificial
  CRISPR gRNA sequence
atttgcaagaccctgtcagt

SEQ ID NO: 785093 - DNA, 20 bp, Artificial
  CRISPR gRNA sequence
tttgcaagaccctgtcagtt

SEQ ID NO: 785094 - DNA, 20 bp, Artificial
  CRISPR gRNA sequence
accctgtcagttaggccatg

SEQ ID NO: 785095 - DNA, 20 bp, Artificial
  CRISPR gRNA sequence
ccctgtcagttaggccatgt

SEQ ID NO: 785096 - DNA, 20 bp, Artificial
  CRISPR gRNA sequence
cagttaggccatgtgggaac

SEQ ID NO: 785097 - DNA, 20 bp, Artificial
  CRISPR gRNA sequence
ttaggccatgtgggaactag

SEQ ID NO: 785098 - DNA, 20 bp, Artificial
  CRISPR gRNA sequence
taggccatgtgggaactaga

SEQ ID NO: 785099 - DNA, 20 bp, Artificial
  CRISPR gRNA sequence
aactagaaggatgaatttat

SEQ ID NO: 785100 - DNA, 20 bp, Artificial
  CRISPR gRNA sequence
gatgaatttatcagtcatcc

SEQ ID NO: 785101 - DNA, 20 bp, Artificial
  CRISPR gRNA sequence
catccaagattcttacaatt

SEQ ID NO: 785102 - DNA, 20 bp, Artificial
  CRISPR gRNA sequence
tacaattaagtattaccgat

SEQ ID NO: 785103 - DNA, 20 bp, Artificial
  CRISPR gRNA sequence
acaattaagtattaccgata

SEQ ID NO: 785104 - DNA, 20 bp, Artificial
  CRISPR gRNA sequence
gtattaccgataaggtactc

SEQ ID NO: 785105 - DNA, 20 bp, Artificial
  CRISPR gRNA sequence
ccgataaggtactcaagaaa

SEQ ID NO: 785106 - DNA, 20 bp, Artificial
  CRISPR gRNA sequence
cagttctcattcacataatt

SEQ ID NO: 785107 - DNA, 20 bp, Artificial
  CRISPR gRNA sequence
agttctcattcacataattt

SEQ ID NO: 785108 - DNA, 20 bp, Artificial
  CRISPR gRNA sequence
ataatttgggttaaaacaaa

SEQ ID NO: 785109 - DNA, 20 bp, Artificial
  CRISPR gRNA sequence
atttgggttaaaacaaaaag

SEQ ID NO: 785110 - DNA, 20 bp, Artificial
  CRISPR gRNA sequence
gggttaaaacaaaaagaagc

SEQ ID NO: 785111 - DNA, 20 bp, Artificial
  CRISPR gRNA sequence
gccagctttctatatacttt

SEQ ID NO: 785112 - DNA, 20 bp, Artificial
  CRISPR gRNA sequence
ctttctatatacttttggtc

SEQ ID NO: 785113 - DNA, 20 bp, Artificial
  CRISPR gRNA sequence
tttgttttgtttgttttcat

SEQ ID NO: 785114 - DNA, 20 bp, Artificial
  CRISPR gRNA sequence
gagtatcccgacttccttct

SEQ ID NO: 785115 - DNA, 20 bp, Artificial
  CRISPR gRNA sequence
ccttctaagaacttccacct

SEQ ID NO: 785116 - DNA, 20 bp, Artificial
  CRISPR gRNA sequence
ttccacctgagaactgacca

SEQ ID NO: 785117 - DNA, 20 bp, Artificial
  CRISPR gRNA sequence
ctgagaactgaccacagcgt

SEQ ID NO: 785118 - DNA, 20 bp, Artificial
  CRISPR gRNA sequence
cacagcgtcagcattccaca

SEQ ID NO: 785119 - DNA, 20 bp, Artificial
  CRISPR gRNA sequence
acagcgtcagcattccacat

SEQ ID NO: 785120 - DNA, 20 bp, Artificial
  CRISPR gRNA sequence
tcctttcccctttcccattt

SEQ ID NO: 785121 - DNA, 20 bp, Artificial
  CRISPR gRNA sequence
tttcccctttcccatttcag

SEQ ID NO: 785122 - DNA, 20 bp, Artificial
  CRISPR gRNA sequence
tttccaatttctttttcttt

SEQ ID NO: 785123 - DNA, 20 bp, Artificial
  CRISPR gRNA sequence
ggcactataaacctttcgca

SEQ ID NO: 785124 - DNA, 20 bp, Artificial
  CRISPR gRNA sequence
gcactataaacctttcgcaa

SEQ ID NO: 785125 - DNA, 20 bp, Artificial
  CRISPR gRNA sequence
acctttcgcaaaggaaatat

SEQ ID NO: 785126 - DNA, 20 bp, Artificial
  CRISPR gRNA sequence
ttcgcaaaggaaatattaga

SEQ ID NO: 785127 - DNA, 20 bp, Artificial
  CRISPR gRNA sequence
agacagaactcctacatgtc

SEQ ID NO: 785128 - DNA, 20 bp, Artificial
  CRISPR gRNA sequence
acatgtcaagcaaattaaaa

SEQ ID NO: 785129 - DNA, 20 bp, Artificial
  CRISPR gRNA sequence
tgtcaagcaaattaaaatag

SEQ ID NO: 785130 - DNA, 20 bp, Artificial
  CRISPR gRNA sequence
aattaaaatagtggtgaaat

SEQ ID NO: 785131 - DNA, 20 bp, Artificial
  CRISPR gRNA sequence
ttaaaatagtggtgaaatta

SEQ ID NO: 785132 - DNA, 20 bp, Artificial
  CRISPR gRNA sequence
aaatagtggtgaaattagag

SEQ ID NO: 785133 - DNA, 20 bp, Artificial
  CRISPR gRNA sequence
atagtggtgaaattagagtg

SEQ ID NO: 785134 - DNA, 20 bp, Artificial
  CRISPR gRNA sequence
tagtggtgaaattagagtgg

SEQ ID NO: 785135 - DNA, 20 bp, Artificial
  CRISPR gRNA sequence
gacataatcaccctatcata

SEQ ID NO: 785136 - DNA, 20 bp, Artificial
  CRISPR gRNA sequence
acataatcaccctatcatat

SEQ ID NO: 785137 - DNA, 20 bp, Artificial
  CRISPR gRNA sequence
atatcatatttgtccctaca

SEQ ID NO: 785138 - DNA, 20 bp, Artificial
  CRISPR gRNA sequence
tatcatatttgtccctacaa

SEQ ID NO: 785139 - DNA, 20 bp, Artificial
  CRISPR gRNA sequence
ttgtccctacaaaggcctct

SEQ ID NO: 785140 - DNA, 20 bp, Artificial
  CRISPR gRNA sequence
tgtccctacaaaggcctcta

SEQ ID NO: 785141 - DNA, 20 bp, Artificial
  CRISPR gRNA sequence
ccctacaaaggcctctaagg

SEQ ID NO: 785142 - DNA, 20 bp, Artificial
  CRISPR gRNA sequence
cctacaaaggcctctaaggc

SEQ ID NO: 785143 - DNA, 20 bp, Artificial
  CRISPR gRNA sequence
ctacaaaggcctctaaggca

SEQ ID NO: 785144 - DNA, 20 bp, Artificial
  CRISPR gRNA sequence
tacaaaggcctctaaggcag

SEQ ID NO: 785145 - DNA, 20 bp, Artificial
  CRISPR gRNA sequence
aggcaggggtccccaacctc

SEQ ID NO: 785146 - DNA, 20 bp, Artificial
  CRISPR gRNA sequence
ggcaggggtccccaacctct

SEQ ID NO: 785147 - DNA, 20 bp, Artificial
  CRISPR gRNA sequence
ggtccccaacctctgggccg

SEQ ID NO: 785148 - DNA, 20 bp, Artificial
  CRISPR gRNA sequence
ccaacctctgggccgcagac

SEQ ID NO: 785149 - DNA, 20 bp, Artificial
  CRISPR gRNA sequence
tctgggccgcagaccggtac

SEQ ID NO: 785150 - DNA, 20 bp, Artificial
  CRISPR gRNA sequence
gggccgcagaccggtaccag

SEQ ID NO: 785151 - DNA, 20 bp, Artificial
  CRISPR gRNA sequence
gaccggtaccagtggcctgt

SEQ ID NO: 785152 - DNA, 20 bp, Artificial
  CRISPR gRNA sequence
accggtaccagtggcctgtt

SEQ ID NO: 785153 - DNA, 20 bp, Artificial
  CRISPR gRNA sequence
ccagtggcctgttaggaact

SEQ ID NO: 785154 - DNA, 20 bp, Artificial
  CRISPR gRNA sequence
ctgttaggaactgagccaca

SEQ ID NO: 785155 - DNA, 20 bp, Artificial
  CRISPR gRNA sequence
ttaggaactgagccacacag

SEQ ID NO: 785156 - DNA, 20 bp, Artificial
  CRISPR gRNA sequence
taggaactgagccacacagc

SEQ ID NO: 785157 - DNA, 20 bp, Artificial
  CRISPR gRNA sequence
ggaactgagccacacagcag

SEQ ID NO: 785158 - DNA, 20 bp, Artificial
  CRISPR gRNA sequence
gaactgagccacacagcagg

SEQ ID NO: 785159 - DNA, 20 bp, Artificial
  CRISPR gRNA sequence
tgagccacacagcaggaggt

SEQ ID NO: 785160 - DNA, 20 bp, Artificial
  CRISPR gRNA sequence
gccacacagcaggaggtgag

SEQ ID NO: 785161 - DNA, 20 bp, Artificial
  CRISPR gRNA sequence
ccacacagcaggaggtgagc

SEQ ID NO: 785162 - DNA, 20 bp, Artificial
  CRISPR gRNA sequence
acacagcaggaggtgagcgg

SEQ ID NO: 785163 - DNA, 20 bp, Artificial
  CRISPR gRNA sequence
gcaggaggtgagcgggagac

SEQ ID NO: 785164 - DNA, 20 bp, Artificial
  CRISPR gRNA sequence
ggaggtgagcgggagacaag

SEQ ID NO: 785165 - DNA, 20 bp, Artificial
  CRISPR gRNA sequence
gaggtgagcgggagacaagc

SEQ ID NO: 785166 - DNA, 20 bp, Artificial
  CRISPR gRNA sequence
acaagcgggcactactacct

SEQ ID NO: 785167 - DNA, 20 bp, Artificial
  CRISPR gRNA sequence
acctgagctctacctcctgt

SEQ ID NO: 785168 - DNA, 20 bp, Artificial
  CRISPR gRNA sequence
agctctacctcctgtgagat

SEQ ID NO: 785169 - DNA, 20 bp, Artificial
  CRISPR gRNA sequence
tctacctcctgtgagatcag

SEQ ID NO: 785170 - DNA, 20 bp, Artificial
  CRISPR gRNA sequence
acctcctgtgagatcagcag

SEQ ID NO: 785171 - DNA, 20 bp, Artificial
  CRISPR gRNA sequence
tgtgagatcagcagcagcat

SEQ ID NO: 785172 - DNA, 20 bp, Artificial
  CRISPR gRNA sequence
gcagcagcattagattctca

SEQ ID NO: 785173 - DNA, 20 bp, Artificial
  CRISPR gRNA sequence
gcagcattagattctcatag

SEQ ID NO: 785174 - DNA, 20 bp, Artificial
  CRISPR gRNA sequence
ctattgtgaactgcacatat

SEQ ID NO: 785175 - DNA, 20 bp, Artificial
  CRISPR gRNA sequence
tattgtgaactgcacatatg

SEQ ID NO: 785176 - DNA, 20 bp, Artificial
  CRISPR gRNA sequence
attgtgaactgcacatatga

SEQ ID NO: 785177 - DNA, 20 bp, Artificial
  CRISPR gRNA sequence
aactgcacatatgagggatc

SEQ ID NO: 785178 - DNA, 20 bp, Artificial
  CRISPR gRNA sequence
actgcacatatgagggatct

SEQ ID NO: 785179 - DNA, 20 bp, Artificial
  CRISPR gRNA sequence
aatctaatgtctgacgatct

SEQ ID NO: 785180 - DNA, 20 bp, Artificial
  CRISPR gRNA sequence
atctaatgtctgacgatctg

SEQ ID NO: 785181 - DNA, 20 bp, Artificial
  CRISPR gRNA sequence
taatgtctgacgatctgagg

SEQ ID NO: 785182 - DNA, 20 bp, Artificial
  CRISPR gRNA sequence
tctgacgatctgaggtggaa

SEQ ID NO: 785183 - DNA, 20 bp, Artificial
  CRISPR gRNA sequence
ctgacgatctgaggtggaac

SEQ ID NO: 785184 - DNA, 20 bp, Artificial
  CRISPR gRNA sequence
acaggttcatcctgaaacta

SEQ ID NO: 785185 - DNA, 20 bp, Artificial
  CRISPR gRNA sequence
ccactcccacacccaatcca

SEQ ID NO: 785186 - DNA, 20 bp, Artificial
  CRISPR gRNA sequence
aaaattgtcttccctgaaac

SEQ ID NO: 785187 - DNA, 20 bp, Artificial
  CRISPR gRNA sequence
tcttccctgaaaccagtccc

SEQ ID NO: 785188 - DNA, 20 bp, Artificial
  CRISPR gRNA sequence
gtccctggtgccaaaaatgt

SEQ ID NO: 785189 - DNA, 20 bp, Artificial
  CRISPR gRNA sequence
tccctggtgccaaaaatgtt

SEQ ID NO: 785190 - DNA, 20 bp, Artificial
  CRISPR gRNA sequence
ccctggtgccaaaaatgttg

SEQ ID NO: 785191 - DNA, 20 bp, Artificial
  CRISPR gRNA sequence
atgttggggaccactgctct

SEQ ID NO: 785192 - DNA, 20 bp, Artificial
  CRISPR gRNA sequence
ctaagataccttgtgcttct

SEQ ID NO: 785193 - DNA, 20 bp, Artificial
  CRISPR gRNA sequence
tgtgcttcttggaacatatt

SEQ ID NO: 785194 - DNA, 20 bp, Artificial
  CRISPR gRNA sequence
aacatatttggaaaatcatg

SEQ ID NO: 785195 - DNA, 20 bp, Artificial
  CRISPR gRNA sequence
caaattatccctatgtcctg

SEQ ID NO: 785196 - DNA, 20 bp, Artificial
  CRISPR gRNA sequence
cccaccttaccatcaatcct

SEQ ID NO: 785197 - DNA, 20 bp, Artificial
  CRISPR gRNA sequence
cagaaatacccaacccatgt

SEQ ID NO: 785198 - DNA, 20 bp, Artificial
  CRISPR gRNA sequence
agaaatacccaacccatgtc

SEQ ID NO: 785199 - DNA, 20 bp, Artificial
  CRISPR gRNA sequence
aacttcacactttctttctt

SEQ ID NO: 785200 - DNA, 20 bp, Artificial
  CRISPR gRNA sequence
acttcacactttctttcttc

SEQ ID NO: 785201 - DNA, 20 bp, Artificial
  CRISPR gRNA sequence
tcacactttctttcttcagg

SEQ ID NO: 785202 - DNA, 20 bp, Artificial
  CRISPR gRNA sequence
ctttctttcttcaggcagca

SEQ ID NO: 785203 - DNA, 20 bp, Artificial
  CRISPR gRNA sequence
ttcaggcagcacagttgtct

SEQ ID NO: 785204 - DNA, 20 bp, Artificial
  CRISPR gRNA sequence
tcaggcagcacagttgtctc

SEQ ID NO: 785205 - DNA, 20 bp, Artificial
  CRISPR gRNA sequence
caggcagcacagttgtctca

SEQ ID NO: 785206 - DNA, 20 bp, Artificial
  CRISPR gRNA sequence
ggcagcacagttgtctcagg

SEQ ID NO: 785207 - DNA, 20 bp, Artificial
  CRISPR gRNA sequence
gcagcacagttgtctcaggg

SEQ ID NO: 785208 - DNA, 20 bp, Artificial
  CRISPR gRNA sequence
cagcacagttgtctcaggga

SEQ ID NO: 785209 - DNA, 20 bp, Artificial
  CRISPR gRNA sequence
gcacagttgtctcagggagg

SEQ ID NO: 785210 - DNA, 20 bp, Artificial
  CRISPR gRNA sequence
cacagttgtctcagggaggg

SEQ ID NO: 785211 - DNA, 20 bp, Artificial
  CRISPR gRNA sequence
cagttgtctcagggagggag

SEQ ID NO: 785212 - DNA, 20 bp, Artificial
  CRISPR gRNA sequence
gttgtctcagggagggagga

SEQ ID NO: 785213 - DNA, 20 bp, Artificial
  CRISPR gRNA sequence
gggagggaggagagtgctat

SEQ ID NO: 785214 - DNA, 20 bp, Artificial
  CRISPR gRNA sequence
gggaggagagtgctattagc

SEQ ID NO: 785215 - DNA, 20 bp, Artificial
  CRISPR gRNA sequence
gaggagagtgctattagcaa

SEQ ID NO: 785216 - DNA, 20 bp, Artificial
  CRISPR gRNA sequence
aggagagtgctattagcaag

SEQ ID NO: 785217 - DNA, 20 bp, Artificial
  CRISPR gRNA sequence
gagagtgctattagcaagag

SEQ ID NO: 785218 - DNA, 20 bp, Artificial
  CRISPR gRNA sequence
ttagcaagaggagtcactaa

SEQ ID NO: 785219 - DNA, 20 bp, Artificial
  CRISPR gRNA sequence
ctgtgcccatgaatttttaa

SEQ ID NO: 785220 - DNA, 20 bp, Artificial
  CRISPR gRNA sequence
tgaatttttaatggtgtgaa

SEQ ID NO: 785221 - DNA, 20 bp, Artificial
  CRISPR gRNA sequence
aaaagtctgtgtatttttta

SEQ ID NO: 785222 - DNA, 20 bp, Artificial
  CRISPR gRNA sequence
gtattttttatggttctcta

SEQ ID NO: 785223 - DNA, 20 bp, Artificial
  CRISPR gRNA sequence
tggttctctatggctcatat

SEQ ID NO: 785224 - DNA, 20 bp, Artificial
  CRISPR gRNA sequence
gttctctatggctcatataa

SEQ ID NO: 785225 - DNA, 20 bp, Artificial
  CRISPR gRNA sequence
ttctctatggctcatataag

SEQ ID NO: 785226 - DNA, 20 bp, Artificial
  CRISPR gRNA sequence
tctctatggctcatataaga

SEQ ID NO: 785227 - DNA, 20 bp, Artificial
  CRISPR gRNA sequence
gagggacaaacaatacatga

SEQ ID NO: 785228 - DNA, 20 bp, Artificial
  CRISPR gRNA sequence
acaaacaatacatgaaagtt

SEQ ID NO: 785229 - DNA, 20 bp, Artificial
  CRISPR gRNA sequence
aaacaatacatgaaagttca

SEQ ID NO: 785230 - DNA, 20 bp, Artificial
  CRISPR gRNA sequence
aatacatgaaagttcagaga

SEQ ID NO: 785231 - DNA, 20 bp, Artificial
  CRISPR gRNA sequence
atacatgaaagttcagagat

SEQ ID NO: 785232 - DNA, 20 bp, Artificial
  CRISPR gRNA sequence
tacatgaaagttcagagatg

SEQ ID NO: 785233 - DNA, 20 bp, Artificial
  CRISPR gRNA sequence
atggggacaaatatcacttt

SEQ ID NO: 785234 - DNA, 20 bp, Artificial
  CRISPR gRNA sequence
ggacaaatatcactttaagc

SEQ ID NO: 785235 - DNA, 20 bp, Artificial
  CRISPR gRNA sequence
gacaaatatcactttaagct

SEQ ID NO: 785236 - DNA, 20 bp, Artificial
  CRISPR gRNA sequence
acaaatatcactttaagctg

SEQ ID NO: 785237 - DNA, 20 bp, Artificial
  CRISPR gRNA sequence
cactttaagctggggataat

SEQ ID NO: 785238 - DNA, 20 bp, Artificial
  CRISPR gRNA sequence
actttaagctggggataatc

SEQ ID NO: 785239 - DNA, 20 bp, Artificial
  CRISPR gRNA sequence
ctttaagctggggataatca

SEQ ID NO: 785240 - DNA, 20 bp, Artificial
  CRISPR gRNA sequence
taagctggggataatcaggg

SEQ ID NO: 785241 - DNA, 20 bp, Artificial
  CRISPR gRNA sequence
gctggggataatcagggaag

SEQ ID NO: 785242 - DNA, 20 bp, Artificial
  CRISPR gRNA sequence
gggataatcagggaagaaga

SEQ ID NO: 785243 - DNA, 20 bp, Artificial
  CRISPR gRNA sequence
agggaagaagaaagttttca

SEQ ID NO: 785244 - DNA, 20 bp, Artificial
  CRISPR gRNA sequence
ggaagaagaaagttttcatg

SEQ ID NO: 785245 - DNA, 20 bp, Artificial
  CRISPR gRNA sequence
agaagaaagttttcatggag

SEQ ID NO: 785246 - DNA, 20 bp, Artificial
  CRISPR gRNA sequence
gaagaaagttttcatggaga

SEQ ID NO: 785247 - DNA, 20 bp, Artificial
  CRISPR gRNA sequence
ggagaaggtgacttttgaat

SEQ ID NO: 785248 - DNA, 20 bp, Artificial
  CRISPR gRNA sequence
gagaaggtgacttttgaatc

SEQ ID NO: 785249 - DNA, 20 bp, Artificial
  CRISPR gRNA sequence
aaggtgacttttgaatcagg

SEQ ID NO: 785250 - DNA, 20 bp, Artificial
  CRISPR gRNA sequence
acttttgaatcaggaagaaa

SEQ ID NO: 785251 - DNA, 20 bp, Artificial
  CRISPR gRNA sequence
gaatcaggaagaaatggaaa

SEQ ID NO: 785252 - DNA, 20 bp, Artificial
  CRISPR gRNA sequence
atggaaacagcaaactcttc

SEQ ID NO: 785253 - DNA, 20 bp, Artificial
  CRISPR gRNA sequence
aaacagcaaactcttctaga

SEQ ID NO: 785254 - DNA, 20 bp, Artificial
  CRISPR gRNA sequence
acagcaaactcttctagata

SEQ ID NO: 785255 - DNA, 20 bp, Artificial
  CRISPR gRNA sequence
cagcaaactcttctagatag

SEQ ID NO: 785256 - DNA, 20 bp, Artificial
  CRISPR gRNA sequence
gcaaactcttctagatagag

SEQ ID NO: 785257 - DNA, 20 bp, Artificial
  CRISPR gRNA sequence
ctagatagaggagacactaa

SEQ ID NO: 785258 - DNA, 20 bp, Artificial
  CRISPR gRNA sequence
tagatagaggagacactaac

SEQ ID NO: 785259 - DNA, 20 bp, Artificial
  CRISPR gRNA sequence
tagaggagacactaacagga

SEQ ID NO: 785260 - DNA, 20 bp, Artificial
  CRISPR gRNA sequence
agaggagacactaacaggaa

SEQ ID NO: 785261 - DNA, 20 bp, Artificial
  CRISPR gRNA sequence
ggagacactaacaggaaagg

SEQ ID NO: 785262 - DNA, 20 bp, Artificial
  CRISPR gRNA sequence
agacactaacaggaaaggca

SEQ ID NO: 785263 - DNA, 20 bp, Artificial
  CRISPR gRNA sequence
acactaacaggaaaggcaga

SEQ ID NO: 785264 - DNA, 20 bp, Artificial
  CRISPR gRNA sequence
cactaacaggaaaggcagag

SEQ ID NO: 785265 - DNA, 20 bp, Artificial
  CRISPR gRNA sequence
taacaggaaaggcagagagg

SEQ ID NO: 785266 - DNA, 20 bp, Artificial
  CRISPR gRNA sequence
aacaggaaaggcagagaggc

SEQ ID NO: 785267 - DNA, 20 bp, Artificial
  CRISPR gRNA sequence
aggaaaggcagagaggcagg

SEQ ID NO: 785268 - DNA, 20 bp, Artificial
  CRISPR gRNA sequence
ggaaaggcagagaggcagga

SEQ ID NO: 785269 - DNA, 20 bp, Artificial
  CRISPR gRNA sequence
ggcagagaggcaggaaggtg

SEQ ID NO: 785270 - DNA, 20 bp, Artificial
  CRISPR gRNA sequence
gcagagaggcaggaaggtgt

SEQ ID NO: 785271 - DNA, 20 bp, Artificial
  CRISPR gRNA sequence
agaggcaggaaggtgtggga

SEQ ID NO: 785272 - DNA, 20 bp, Artificial
  CRISPR gRNA sequence
aaagtgcacgtgaccccgtt

SEQ ID NO: 785273 - DNA, 20 bp, Artificial
  CRISPR gRNA sequence
agtgcacgtgaccccgttca

SEQ ID NO: 785274 - DNA, 20 bp, Artificial
  CRISPR gRNA sequence
tgcacgtgaccccgttcaga

SEQ ID NO: 785275 - DNA, 20 bp, Artificial
  CRISPR gRNA sequence
cgtgaccccgttcagagaga

SEQ ID NO: 785276 - DNA, 20 bp, Artificial
  CRISPR gRNA sequence
accccgttcagagagaaagc

SEQ ID NO: 785277 - DNA, 20 bp, Artificial
  CRISPR gRNA sequence
ccccgttcagagagaaagcc

SEQ ID NO: 785278 - DNA, 20 bp, Artificial
  CRISPR gRNA sequence
tcagagagaaagccaggtgt

SEQ ID NO: 785279 - DNA, 20 bp, Artificial
  CRISPR gRNA sequence
gagaaagccaggtgtgagat

SEQ ID NO: 785280 - DNA, 20 bp, Artificial
  CRISPR gRNA sequence
agaaagccaggtgtgagata

SEQ ID NO: 785281 - DNA, 20 bp, Artificial
  CRISPR gRNA sequence
gaaagccaggtgtgagataa

SEQ ID NO: 785282 - DNA, 20 bp, Artificial
  CRISPR gRNA sequence
aaagccaggtgtgagataag

SEQ ID NO: 785283 - DNA, 20 bp, Artificial
  CRISPR gRNA sequence
aagccaggtgtgagataagg

SEQ ID NO: 785284 - DNA, 20 bp, Artificial
  CRISPR gRNA sequence
caggtgtgagataaggggga

SEQ ID NO: 785285 - DNA, 20 bp, Artificial
  CRISPR gRNA sequence
agataagggggaaagactgt

SEQ ID NO: 785286 - DNA, 20 bp, Artificial
  CRISPR gRNA sequence
gataagggggaaagactgtt

SEQ ID NO: 785287 - DNA, 20 bp, Artificial
  CRISPR gRNA sequence
ataagggggaaagactgtta

SEQ ID NO: 785288 - DNA, 20 bp, Artificial
  CRISPR gRNA sequence
gtattgtaaaccactaattc

SEQ ID NO: 785289 - DNA, 20 bp, Artificial
  CRISPR gRNA sequence
tattgtaaaccactaattcc

SEQ ID NO: 785290 - DNA, 20 bp, Artificial
  CRISPR gRNA sequence
aaaccactaattccaggcaa

SEQ ID NO: 785291 - DNA, 20 bp, Artificial
  CRISPR gRNA sequence
cactaattccaggcaaaagt

SEQ ID NO: 785292 - DNA, 20 bp, Artificial
  CRISPR gRNA sequence
aaagttagattttacttact

SEQ ID NO: 785293 - DNA, 20 bp, Artificial
  CRISPR gRNA sequence
ttagattttacttactaagc

SEQ ID NO: 785294 - DNA, 20 bp, Artificial
  CRISPR gRNA sequence
agattttacttactaagcaa

SEQ ID NO: 785295 - DNA, 20 bp, Artificial
  CRISPR gRNA sequence
cttactaagcaagagtgctt

SEQ ID NO: 785296 - DNA, 20 bp, Artificial
  CRISPR gRNA sequence
ctaagcaagagtgcttcagt

SEQ ID NO: 785297 - DNA, 20 bp, Artificial
  CRISPR gRNA sequence
agagtgcttcagttagatcc

SEQ ID NO: 785298 - DNA, 20 bp, Artificial
  CRISPR gRNA sequence
gtgcttcagttagatcctag

SEQ ID NO: 785299 - DNA, 20 bp, Artificial
  CRISPR gRNA sequence
tgcttcagttagatcctagc

SEQ ID NO: 785300 - DNA, 20 bp, Artificial
  CRISPR gRNA sequence
agttagatcctagcaggaaa

SEQ ID NO: 785301 - DNA, 20 bp, Artificial
  CRISPR gRNA sequence
ttagatcctagcaggaaatg

SEQ ID NO: 785302 - DNA, 20 bp, Artificial
  CRISPR gRNA sequence
tagatcctagcaggaaatgg

SEQ ID NO: 785303 - DNA, 20 bp, Artificial
  CRISPR gRNA sequence
agatcctagcaggaaatgga

SEQ ID NO: 785304 - DNA, 20 bp, Artificial
  CRISPR gRNA sequence
caggaaatggagggtatgct

SEQ ID NO: 785305 - DNA, 20 bp, Artificial
  CRISPR gRNA sequence
gaaatggagggtatgcttag

SEQ ID NO: 785306 - DNA, 20 bp, Artificial
  CRISPR gRNA sequence
aatggagggtatgcttagaa

SEQ ID NO: 785307 - DNA, 20 bp, Artificial
  CRISPR gRNA sequence
atggagggtatgcttagaag

SEQ ID NO: 785308 - DNA, 20 bp, Artificial
  CRISPR gRNA sequence
tatgcttagaagaggtaact

SEQ ID NO: 785309 - DNA, 20 bp, Artificial
  CRISPR gRNA sequence
atgcttagaagaggtaactg

SEQ ID NO: 785310 - DNA, 20 bp, Artificial
  CRISPR gRNA sequence
ttagaagaggtaactgaggc

SEQ ID NO: 785311 - DNA, 20 bp, Artificial
  CRISPR gRNA sequence
tgaggcaagtttaatttata

SEQ ID NO: 785312 - DNA, 20 bp, Artificial
  CRISPR gRNA sequence
gaggcaagtttaatttataa

SEQ ID NO: 785313 - DNA, 20 bp, Artificial
  CRISPR gRNA sequence
ttaatttataaaggtgtgtg

SEQ ID NO: 785314 - DNA, 20 bp, Artificial
  CRISPR gRNA sequence
ataaaggtgtgtgcagcatt

SEQ ID NO: 785315 - DNA, 20 bp, Artificial
  CRISPR gRNA sequence
taaaggtgtgtgcagcatta

SEQ ID NO: 785316 - DNA, 20 bp, Artificial
  CRISPR gRNA sequence
aaaggtgtgtgcagcattaa

SEQ ID NO: 785317 - DNA, 20 bp, Artificial
  CRISPR gRNA sequence
tgtgcagcattaagggaaac

SEQ ID NO: 785318 - DNA, 20 bp, Artificial
  CRISPR gRNA sequence
cagcattaagggaaaccagc

SEQ ID NO: 785319 - DNA, 20 bp, Artificial
  CRISPR gRNA sequence
agcattaagggaaaccagca

SEQ ID NO: 785320 - DNA, 20 bp, Artificial
  CRISPR gRNA sequence
gcattaagggaaaccagcaa

SEQ ID NO: 785321 - DNA, 20 bp, Artificial
  CRISPR gRNA sequence
ggaaaccagcaagggatact

SEQ ID NO: 785322 - DNA, 20 bp, Artificial
  CRISPR gRNA sequence
gcaagggatactgagcatgc

SEQ ID NO: 785323 - DNA, 20 bp, Artificial
  CRISPR gRNA sequence
caagggatactgagcatgcc

SEQ ID NO: 785324 - DNA, 20 bp, Artificial
  CRISPR gRNA sequence
tactgagcatgccaggatgc

SEQ ID NO: 785325 - DNA, 20 bp, Artificial
  CRISPR gRNA sequence
ctgagcatgccaggatgcaa

SEQ ID NO: 785326 - DNA, 20 bp, Artificial
  CRISPR gRNA sequence
agcatgccaggatgcaagag

SEQ ID NO: 785327 - DNA, 20 bp, Artificial
  CRISPR gRNA sequence
gcatgccaggatgcaagagc

SEQ ID NO: 785328 - DNA, 20 bp, Artificial
  CRISPR gRNA sequence
tgccaggatgcaagagcagg

SEQ ID NO: 785329 - DNA, 20 bp, Artificial
  CRISPR gRNA sequence
gccaggatgcaagagcaggc

SEQ ID NO: 785330 - DNA, 20 bp, Artificial
  CRISPR gRNA sequence
ccaggatgcaagagcaggca

SEQ ID NO: 785331 - DNA, 20 bp, Artificial
  CRISPR gRNA sequence
ggatgcaagagcaggcaggg

SEQ ID NO: 785332 - DNA, 20 bp, Artificial
  CRISPR gRNA sequence
gatgcaagagcaggcaggga

SEQ ID NO: 785333 - DNA, 20 bp, Artificial
  CRISPR gRNA sequence
gcagggaaggtgactattcc

SEQ ID NO: 785334 - DNA, 20 bp, Artificial
  CRISPR gRNA sequence
cagggaaggtgactattcct

SEQ ID NO: 785335 - DNA, 20 bp, Artificial
  CRISPR gRNA sequence
ggtgactattcctaggtctg

SEQ ID NO: 785336 - DNA, 20 bp, Artificial
  CRISPR gRNA sequence
gtgactattcctaggtctga

SEQ ID NO: 785337 - DNA, 20 bp, Artificial
  CRISPR gRNA sequence
gactattcctaggtctgaag

SEQ ID NO: 785338 - DNA, 20 bp, Artificial
  CRISPR gRNA sequence
attcctaggtctgaaggaga

SEQ ID NO: 785339 - DNA, 20 bp, Artificial
  CRISPR gRNA sequence
ttcctaggtctgaaggagaa

SEQ ID NO: 785340 - DNA, 20 bp, Artificial
  CRISPR gRNA sequence
tcctaggtctgaaggagaaa

SEQ ID NO: 785341 - DNA, 20 bp, Artificial
  CRISPR gRNA sequence
cctaggtctgaaggagaaag

SEQ ID NO: 785342 - DNA, 20 bp, Artificial
  CRISPR gRNA sequence
taggtctgaaggagaaaggg

SEQ ID NO: 785343 - DNA, 20 bp, Artificial
  CRISPR gRNA sequence
aggtctgaaggagaaagggg

SEQ ID NO: 785344 - DNA, 20 bp, Artificial
  CRISPR gRNA sequence
ggtctgaaggagaaagggga

SEQ ID NO: 785345 - DNA, 20 bp, Artificial
  CRISPR gRNA sequence
tctgaaggagaaaggggagg

SEQ ID NO: 785346 - DNA, 20 bp, Artificial
  CRISPR gRNA sequence
gaaggagaaaggggagggag

SEQ ID NO: 785347 - DNA, 20 bp, Artificial
  CRISPR gRNA sequence
aaaggggagggagcagttcc

SEQ ID NO: 785348 - DNA, 20 bp, Artificial
  CRISPR gRNA sequence
gggagcagttcccagaaccc

SEQ ID NO: 785349 - DNA, 20 bp, Artificial
  CRISPR gRNA sequence
tcccagaaccctagtaaaaa

SEQ ID NO: 785350 - DNA, 20 bp, Artificial
  CRISPR gRNA sequence
accctagtaaaaatggcaat

SEQ ID NO: 785351 - DNA, 20 bp, Artificial
  CRISPR gRNA sequence
tagtaaaaatggcaatgaga

SEQ ID NO: 785352 - DNA, 20 bp, Artificial
  CRISPR gRNA sequence
agtaaaaatggcaatgagaa

SEQ ID NO: 785353 - DNA, 20 bp, Artificial
  CRISPR gRNA sequence
ggcaatgagaaaggtccatc

SEQ ID NO: 785354 - DNA, 20 bp, Artificial
  CRISPR gRNA sequence
aatgagaaaggtccatctgg

SEQ ID NO: 785355 - DNA, 20 bp, Artificial
  CRISPR gRNA sequence
atgagaaaggtccatctggc

SEQ ID NO: 785356 - DNA, 20 bp, Artificial
  CRISPR gRNA sequence
ggtccatctggcaggaccta

SEQ ID NO: 785357 - DNA, 20 bp, Artificial
  CRISPR gRNA sequence
gcaggacctatggtctttaa

SEQ ID NO: 785358 - DNA, 20 bp, Artificial
  CRISPR gRNA sequence
aggacctatggtctttaaca

SEQ ID NO: 785359 - DNA, 20 bp, Artificial
  CRISPR gRNA sequence
ggacctatggtctttaacag

SEQ ID NO: 785360 - DNA, 20 bp, Artificial
  CRISPR gRNA sequence
gacctatggtctttaacaga

SEQ ID NO: 785361 - DNA, 20 bp, Artificial
  CRISPR gRNA sequence
tggtctttaacagagggaca

SEQ ID NO: 785362 - DNA, 20 bp, Artificial
  CRISPR gRNA sequence
aagtcaacccacaacttgtc

SEQ ID NO: 785363 - DNA, 20 bp, Artificial
  CRISPR gRNA sequence
agtcaacccacaacttgtct

SEQ ID NO: 785364 - DNA, 20 bp, Artificial
  CRISPR gRNA sequence
tcaacccacaacttgtctgg

SEQ ID NO: 785365 - DNA, 20 bp, Artificial
  CRISPR gRNA sequence
caacccacaacttgtctggg

SEQ ID NO: 785366 - DNA, 20 bp, Artificial
  CRISPR gRNA sequence
aacttgtctgggaggttgct

SEQ ID NO: 785367 - DNA, 20 bp, Artificial
  CRISPR gRNA sequence
acttgtctgggaggttgctg

SEQ ID NO: 785368 - DNA, 20 bp, Artificial
  CRISPR gRNA sequence
tctgggaggttgctgaggaa

SEQ ID NO: 785369 - DNA, 20 bp, Artificial
  CRISPR gRNA sequence
ctgcaacactctttttcccc

SEQ ID NO: 785370 - DNA, 20 bp, Artificial
  CRISPR gRNA sequence
cactctttttcccctagact

SEQ ID NO: 785371 - DNA, 20 bp, Artificial
  CRISPR gRNA sequence
tttttcccctagactgagcc

SEQ ID NO: 785372 - DNA, 20 bp, Artificial
  CRISPR gRNA sequence
ccctagactgagcccagtca

SEQ ID NO: 785373 - DNA, 20 bp, Artificial
  CRISPR gRNA sequence
agactgagcccagtcaaaga

SEQ ID NO: 785374 - DNA, 20 bp, Artificial
  CRISPR gRNA sequence
actgagcccagtcaaagaca

SEQ ID NO: 785375 - DNA, 20 bp, Artificial
  CRISPR gRNA sequence
ctgagcccagtcaaagacag

SEQ ID NO: 785376 - DNA, 20 bp, Artificial
  CRISPR gRNA sequence
tgagcccagtcaaagacaga

SEQ ID NO: 785377 - DNA, 20 bp, Artificial
  CRISPR gRNA sequence
agcccagtcaaagacagagg

SEQ ID NO: 785378 - DNA, 20 bp, Artificial
  CRISPR gRNA sequence
gcccagtcaaagacagaggg

SEQ ID NO: 785379 - DNA, 20 bp, Artificial
  CRISPR gRNA sequence
ccagtcaaagacagagggag

SEQ ID NO: 785380 - DNA, 20 bp, Artificial
  CRISPR gRNA sequence
caaagacagagggaggagcc

SEQ ID NO: 785381 - DNA, 20 bp, Artificial
  CRISPR gRNA sequence
gagggaggagcccagtgatg

SEQ ID NO: 785382 - DNA, 20 bp, Artificial
  CRISPR gRNA sequence
agtctgcaatgtcatcatcc

SEQ ID NO: 785383 - DNA, 20 bp, Artificial
  CRISPR gRNA sequence
tctgcaatgtcatcatcctg

SEQ ID NO: 785384 - DNA, 20 bp, Artificial
  CRISPR gRNA sequence
tcatcatcctggagcatgaa

SEQ ID NO: 785385 - DNA, 20 bp, Artificial
  CRISPR gRNA sequence
atcatcctggagcatgaata

SEQ ID NO: 785386 - DNA, 20 bp, Artificial
  CRISPR gRNA sequence
cctggagcatgaatagagtg

SEQ ID NO: 785387 - DNA, 20 bp, Artificial
  CRISPR gRNA sequence
ggagcatgaatagagtgcag

SEQ ID NO: 785388 - DNA, 20 bp, Artificial
  CRISPR gRNA sequence
gagcatgaatagagtgcagc

SEQ ID NO: 785389 - DNA, 20 bp, Artificial
  CRISPR gRNA sequence
agcatgaatagagtgcagca

SEQ ID NO: 785390 - DNA, 20 bp, Artificial
  CRISPR gRNA sequence
agtgcagcagggtgaataat

SEQ ID NO: 785391 - DNA, 20 bp, Artificial
  CRISPR gRNA sequence
cagggtgaataatgagtctg

SEQ ID NO: 785392 - DNA, 20 bp, Artificial
  CRISPR gRNA sequence
agggtgaataatgagtctgc

SEQ ID NO: 785393 - DNA, 20 bp, Artificial
  CRISPR gRNA sequence
aatgagtctgcaggaattaa

SEQ ID NO: 785394 - DNA, 20 bp, Artificial
  CRISPR gRNA sequence
aatagaaatatctgacacaa

SEQ ID NO: 785395 - DNA, 20 bp, Artificial
  CRISPR gRNA sequence
atagaaatatctgacacaat

SEQ ID NO: 785396 - DNA, 20 bp, Artificial
  CRISPR gRNA sequence
tagaaatatctgacacaata

SEQ ID NO: 785397 - DNA, 20 bp, Artificial
  CRISPR gRNA sequence
ctgacacaatagggaactat

SEQ ID NO: 785398 - DNA, 20 bp, Artificial
  CRISPR gRNA sequence
gacacaatagggaactataa

SEQ ID NO: 785399 - DNA, 20 bp, Artificial
  CRISPR gRNA sequence
acacaatagggaactataag

SEQ ID NO: 785400 - DNA, 20 bp, Artificial
  CRISPR gRNA sequence
gaactataagaggttttgaa

SEQ ID NO: 785401 - DNA, 20 bp, Artificial
  CRISPR gRNA sequence
aactataagaggttttgaat

SEQ ID NO: 785402 - DNA, 20 bp, Artificial
  CRISPR gRNA sequence
ctataagaggttttgaatag

SEQ ID NO: 785403 - DNA, 20 bp, Artificial
  CRISPR gRNA sequence
ataagaggttttgaatagga

SEQ ID NO: 785404 - DNA, 20 bp, Artificial
  CRISPR gRNA sequence
taagaggttttgaataggag

SEQ ID NO: 785405 - DNA, 20 bp, Artificial
  CRISPR gRNA sequence
caatattactgaactatgtg

SEQ ID NO: 785406 - DNA, 20 bp, Artificial
  CRISPR gRNA sequence
actgaactatgtgtggccca

SEQ ID NO: 785407 - DNA, 20 bp, Artificial
  CRISPR gRNA sequence
actatgtgtggcccaaagaa

SEQ ID NO: 785408 - DNA, 20 bp, Artificial
  CRISPR gRNA sequence
atgtgtggcccaaagaatgg

SEQ ID NO: 785409 - DNA, 20 bp, Artificial
  CRISPR gRNA sequence
gtgtggcccaaagaatggaa

SEQ ID NO: 785410 - DNA, 20 bp, Artificial
  CRISPR gRNA sequence
tgtggcccaaagaatggaag

SEQ ID NO: 785411 - DNA, 20 bp, Artificial
  CRISPR gRNA sequence
cccaaagaatggaagaggaa

SEQ ID NO: 785412 - DNA, 20 bp, Artificial
  CRISPR gRNA sequence
aagaggaacagctcttgcaa

SEQ ID NO: 785413 - DNA, 20 bp, Artificial
  CRISPR gRNA sequence
agaggaacagctcttgcaat

SEQ ID NO: 785414 - DNA, 20 bp, Artificial
  CRISPR gRNA sequence
acagctcttgcaataggtct

SEQ ID NO: 785415 - DNA, 20 bp, Artificial
  CRISPR gRNA sequence
cagctcttgcaataggtctg

SEQ ID NO: 785416 - DNA, 20 bp, Artificial
  CRISPR gRNA sequence
gctcttgcaataggtctgag

SEQ ID NO: 785417 - DNA, 20 bp, Artificial
  CRISPR gRNA sequence
tcttgcaataggtctgagga

SEQ ID NO: 785418 - DNA, 20 bp, Artificial
  CRISPR gRNA sequence
tgcaataggtctgaggagag

SEQ ID NO: 785419 - DNA, 20 bp, Artificial
  CRISPR gRNA sequence
aggtctgaggagagaagctg

SEQ ID NO: 785420 - DNA, 20 bp, Artificial
  CRISPR gRNA sequence
gaggagagaagctgaagact

SEQ ID NO: 785421 - DNA, 20 bp, Artificial
  CRISPR gRNA sequence
gagaagctgaagacttggac

SEQ ID NO: 785422 - DNA, 20 bp, Artificial
  CRISPR gRNA sequence
agaagctgaagacttggact

SEQ ID NO: 785423 - DNA, 20 bp, Artificial
  CRISPR gRNA sequence
gaagctgaagacttggacta

SEQ ID NO: 785424 - DNA, 20 bp, Artificial
  CRISPR gRNA sequence
gaagacttggactagggcaa

SEQ ID NO: 785425 - DNA, 20 bp, Artificial
  CRISPR gRNA sequence
tagggcaatggtaaaaactg

SEQ ID NO: 785426 - DNA, 20 bp, Artificial
  CRISPR gRNA sequence
gcaatggtaaaaactgtgga

SEQ ID NO: 785427 - DNA, 20 bp, Artificial
  CRISPR gRNA sequence
atggtaaaaactgtggaaag

SEQ ID NO: 785428 - DNA, 20 bp, Artificial
  CRISPR gRNA sequence
ggaaagaagttttaaatgaa

SEQ ID NO: 785429 - DNA, 20 bp, Artificial
  CRISPR gRNA sequence
atgaaaagttttaaaccatg

SEQ ID NO: 785430 - DNA, 20 bp, Artificial
  CRISPR gRNA sequence
gttttaaaccatgcggcttc

SEQ ID NO: 785431 - DNA, 20 bp, Artificial
  CRISPR gRNA sequence
taaaccatgcggcttccagc

SEQ ID NO: 785432 - DNA, 20 bp, Artificial
  CRISPR gRNA sequence
atgaacttttttaaaaaaat

SEQ ID NO: 785433 - DNA, 20 bp, Artificial
  CRISPR gRNA sequence
ttagttcctcactcaaattt

SEQ ID NO: 785434 - DNA, 20 bp, Artificial
  CRISPR gRNA sequence
tagttcctcactcaaatttt

SEQ ID NO: 785435 - DNA, 20 bp, Artificial
  CRISPR gRNA sequence
agttcctcactcaaattttg

SEQ ID NO: 785436 - DNA, 20 bp, Artificial
  CRISPR gRNA sequence
ttcctcactcaaattttggg

SEQ ID NO: 785437 - DNA, 20 bp, Artificial
  CRISPR gRNA sequence
tcctcactcaaattttgggg

SEQ ID NO: 785438 - DNA, 20 bp, Artificial
  CRISPR gRNA sequence
aaaatgatttttcttatttg

SEQ ID NO: 785439 - DNA, 20 bp, Artificial
  CRISPR gRNA sequence
aaatgatttttcttatttgt

SEQ ID NO: 785440 - DNA, 20 bp, Artificial
  CRISPR gRNA sequence
tatttgtgggcttttctccc

SEQ ID NO: 785441 - DNA, 20 bp, Artificial
  CRISPR gRNA sequence
tctccccagatctgaacctg

SEQ ID NO: 785442 - DNA, 20 bp, Artificial
  CRISPR gRNA sequence
cagatctgaacctgtggtct

SEQ ID NO: 785443 - DNA, 20 bp, Artificial
  CRISPR gRNA sequence
agatctgaacctgtggtctt

SEQ ID NO: 785444 - DNA, 20 bp, Artificial
  CRISPR gRNA sequence
atctgaacctgtggtcttgg

SEQ ID NO: 785445 - DNA, 20 bp, Artificial
  CRISPR gRNA sequence
gaacctgtggtcttgggagc

SEQ ID NO: 785446 - DNA, 20 bp, Artificial
  CRISPR gRNA sequence
aacctgtggtcttgggagcc

SEQ ID NO: 785447 - DNA, 20 bp, Artificial
  CRISPR gRNA sequence
acctgtggtcttgggagcca

SEQ ID NO: 785448 - DNA, 20 bp, Artificial
  CRISPR gRNA sequence
gtgacctgatatgacatcta

SEQ ID NO: 785449 - DNA, 20 bp, Artificial
  CRISPR gRNA sequence
acctgatatgacatctaaag

SEQ ID NO: 785450 - DNA, 20 bp, Artificial
  CRISPR gRNA sequence
atgacatctaaagaagcttc

SEQ ID NO: 785451 - DNA, 20 bp, Artificial
  CRISPR gRNA sequence
gaagcttctggactctgaac

SEQ ID NO: 785452 - DNA, 20 bp, Artificial
  CRISPR gRNA sequence
ctggactctgaacaagaatt

SEQ ID NO: 785453 - DNA, 20 bp, Artificial
  CRISPR gRNA sequence
gactctgaacaagaattcgg

SEQ ID NO: 785454 - DNA, 20 bp, Artificial
  CRISPR gRNA sequence
aacaagaattcggtggcctg

SEQ ID NO: 785455 - DNA, 20 bp, Artificial
  CRISPR gRNA sequence
caagaattcggtggcctgca

SEQ ID NO: 785456 - DNA, 20 bp, Artificial
  CRISPR gRNA sequence
ttgcacttttcaaatgcctt

SEQ ID NO: 785457 - DNA, 20 bp, Artificial
  CRISPR gRNA sequence
tcaaatgcctttggatgacc

SEQ ID NO: 785458 - DNA, 20 bp, Artificial
  CRISPR gRNA sequence
tttaatctgaaacctgcaac

SEQ ID NO: 785459 - DNA, 20 bp, Artificial
  CRISPR gRNA sequence
tctgaaacctgcaacaagac

SEQ ID NO: 785460 - DNA, 20 bp, Artificial
  CRISPR gRNA sequence
caacaagactagccaacacc

SEQ ID NO: 785461 - DNA, 20 bp, Artificial
  CRISPR gRNA sequence
aacttgccccttcactgatc

SEQ ID NO: 785462 - DNA, 20 bp, Artificial
  CRISPR gRNA sequence
cactgatctggactcacctc

SEQ ID NO: 785463 - DNA, 20 bp, Artificial
  CRISPR gRNA sequence
ctgatctggactcacctctg

SEQ ID NO: 785464 - DNA, 20 bp, Artificial
  CRISPR gRNA sequence
ggactcacctctggagccta

SEQ ID NO: 785465 - DNA, 20 bp, Artificial
  CRISPR gRNA sequence
cctctggagcctatggcttt

SEQ ID NO: 785466 - DNA, 20 bp, Artificial
  CRISPR gRNA sequence
tggagcctatggctttaagc

SEQ ID NO: 785467 - DNA, 20 bp, Artificial
  CRISPR gRNA sequence
gcaagcactactgcacttta

SEQ ID NO: 785468 - DNA, 20 bp, Artificial
  CRISPR gRNA sequence
actttacagaattaccccac

SEQ ID NO: 785469 - DNA, 20 bp, Artificial
  CRISPR gRNA sequence
agaattaccccactggatcc

SEQ ID NO: 785470 - DNA, 20 bp, Artificial
  CRISPR gRNA sequence
cccactggatcctggaccca

SEQ ID NO: 785471 - DNA, 20 bp, Artificial
  CRISPR gRNA sequence
ctggacccacagaattcctt

SEQ ID NO: 785472 - DNA, 20 bp, Artificial
  CRISPR gRNA sequence
tggacccacagaattccttc

SEQ ID NO: 785473 - DNA, 20 bp, Artificial
  CRISPR gRNA sequence
ttcaggatccttcttgctgc

SEQ ID NO: 785474 - DNA, 20 bp, Artificial
  CRISPR gRNA sequence
ccttcttgctgccagactga

SEQ ID NO: 785475 - DNA, 20 bp, Artificial
  CRISPR gRNA sequence
tgctgccagactgaaagcaa

SEQ ID NO: 785476 - DNA, 20 bp, Artificial
  CRISPR gRNA sequence
gctgccagactgaaagcaaa

SEQ ID NO: 785477 - DNA, 20 bp, Artificial
  CRISPR gRNA sequence
aaaaggaattatttcccctc

SEQ ID NO: 785478 - DNA, 20 bp, Artificial
  CRISPR gRNA sequence
tatttcccctcaagttttct

SEQ ID NO: 785479 - DNA, 20 bp, Artificial
  CRISPR gRNA sequence
gttttctaagtgatttccaa

SEQ ID NO: 785480 - DNA, 20 bp, Artificial
  CRISPR gRNA sequence
ttctaagtgatttccaaaag

SEQ ID NO: 785481 - DNA, 20 bp, Artificial
  CRISPR gRNA sequence
ctaagtgatttccaaaagca

SEQ ID NO: 785482 - DNA, 20 bp, Artificial
  CRISPR gRNA sequence
taagtgatttccaaaagcag

SEQ ID NO: 785483 - DNA, 20 bp, Artificial
  CRISPR gRNA sequence
tttccaaaagcagaggtgtg

SEQ ID NO: 785484 - DNA, 20 bp, Artificial
  CRISPR gRNA sequence
cagaggtgtgtggaaatttc

SEQ ID NO: 785485 - DNA, 20 bp, Artificial
  CRISPR gRNA sequence
tgtgtggaaatttccagtaa

SEQ ID NO: 785486 - DNA, 20 bp, Artificial
  CRISPR gRNA sequence
gaaatttccagtaacagaaa

SEQ ID NO: 785487 - DNA, 20 bp, Artificial
  CRISPR gRNA sequence
tttccagtaacagaaacaga

SEQ ID NO: 785488 - DNA, 20 bp, Artificial
  CRISPR gRNA sequence
ttccagtaacagaaacagat

SEQ ID NO: 785489 - DNA, 20 bp, Artificial
  CRISPR gRNA sequence
agaaacagatgggttgccaa

SEQ ID NO: 785490 - DNA, 20 bp, Artificial
  CRISPR gRNA sequence
aaacagatgggttgccaata

SEQ ID NO: 785491 - DNA, 20 bp, Artificial
  CRISPR gRNA sequence
atagagttattttttatcta

SEQ ID NO: 785492 - DNA, 20 bp, Artificial
  CRISPR gRNA sequence
tttttatctatagcttcctc

SEQ ID NO: 785493 - DNA, 20 bp, Artificial
  CRISPR gRNA sequence
ttttatctatagcttcctct

SEQ ID NO: 785494 - DNA, 20 bp, Artificial
  CRISPR gRNA sequence
ctatagcttcctctgggtac

SEQ ID NO: 785495 - DNA, 20 bp, Artificial
  CRISPR gRNA sequence
tagcttcctctgggtactag

SEQ ID NO: 785496 - DNA, 20 bp, Artificial
  CRISPR gRNA sequence
gcttcctctgggtactagaa

SEQ ID NO: 785497 - DNA, 20 bp, Artificial
  CRISPR gRNA sequence
cttcctctgggtactagaag

SEQ ID NO: 785498 - DNA, 20 bp, Artificial
  CRISPR gRNA sequence
gggtactagaagaggctatt

SEQ ID NO: 785499 - DNA, 20 bp, Artificial
  CRISPR gRNA sequence
gaagaggctattgagactat

SEQ ID NO: 785500 - DNA, 20 bp, Artificial
  CRISPR gRNA sequence
ctattgagactatgagctca

SEQ ID NO: 785501 - DNA, 20 bp, Artificial
  CRISPR gRNA sequence
tgagactatgagctcacaga

SEQ ID NO: 785502 - DNA, 20 bp, Artificial
  CRISPR gRNA sequence
gagactatgagctcacagac

SEQ ID NO: 785503 - DNA, 20 bp, Artificial
  CRISPR gRNA sequence
agactatgagctcacagaca

SEQ ID NO: 785504 - DNA, 20 bp, Artificial
  CRISPR gRNA sequence
atcataattgacatgtttta

SEQ ID NO: 785505 - DNA, 20 bp, Artificial
  CRISPR gRNA sequence
tgacatgttttatggattac

SEQ ID NO: 785506 - DNA, 20 bp, Artificial
  CRISPR gRNA sequence
atggattactggaatcttga

SEQ ID NO: 785507 - DNA, 20 bp, Artificial
  CRISPR gRNA sequence
ggaatcttgatagcataatg

SEQ ID NO: 785508 - DNA, 20 bp, Artificial
  CRISPR gRNA sequence
aatgaagttgttctaattaa

SEQ ID NO: 785509 - DNA, 20 bp, Artificial
  CRISPR gRNA sequence
tgaagttgttctaattaaca

SEQ ID NO: 785510 - DNA, 20 bp, Artificial
  CRISPR gRNA sequence
aagttgttctaattaacaga

SEQ ID NO: 785511 - DNA, 20 bp, Artificial
  CRISPR gRNA sequence
agagcatttaaatatacact

SEQ ID NO: 785512 - DNA, 20 bp, Artificial
  CRISPR gRNA sequence
tacactaagtgcacaaattg

SEQ ID NO: 785513 - DNA, 20 bp, Artificial
  CRISPR gRNA sequence
cactaagtgcacaaattgtg

SEQ ID NO: 785514 - DNA, 20 bp, Artificial
  CRISPR gRNA sequence
agtgcacaaattgtggagta

SEQ ID NO: 785515 - DNA, 20 bp, Artificial
  CRISPR gRNA sequence
aattgtggagtaaagtcatc

SEQ ID NO: 785516 - DNA, 20 bp, Artificial
  CRISPR gRNA sequence
agtcatcaagctctgttttt

SEQ ID NO: 785517 - DNA, 20 bp, Artificial
  CRISPR gRNA sequence
gtcatcaagctctgtttttg

SEQ ID NO: 785518 - DNA, 20 bp, Artificial
  CRISPR gRNA sequence
aagctctgtttttgaggtct

SEQ ID NO: 785519 - DNA, 20 bp, Artificial
  CRISPR gRNA sequence
tttttgaggtctaagtcaca

SEQ ID NO: 785520 - DNA, 20 bp, Artificial
  CRISPR gRNA sequence
gcatttgttttaacctgtaa

SEQ ID NO: 785521 - DNA, 20 bp, Artificial
  CRISPR gRNA sequence
tgtaatggcaccatgtttaa

SEQ ID NO: 785522 - DNA, 20 bp, Artificial
  CRISPR gRNA sequence
aatggcaccatgtttaatgg

SEQ ID NO: 785523 - DNA, 20 bp, Artificial
  CRISPR gRNA sequence
atctttcctttaaaaattat

SEQ ID NO: 785524 - DNA, 20 bp, Artificial
  CRISPR gRNA sequence
ctttttatttgtttttacct

SEQ ID NO: 785525 - DNA, 20 bp, Artificial
  CRISPR gRNA sequence
ccttagaaatcaattatata

SEQ ID NO: 785526 - DNA, 20 bp, Artificial
  CRISPR gRNA sequence
atgctcatacgttgtatctg

SEQ ID NO: 785527 - DNA, 20 bp, Artificial
  CRISPR gRNA sequence
cgttgtatctgcagcaattt

SEQ ID NO: 785528 - DNA, 20 bp, Artificial
  CRISPR gRNA sequence
tatctgcagcaatttcagat

SEQ ID NO: 785529 - DNA, 20 bp, Artificial
  CRISPR gRNA sequence
ctgcagcaatttcagataag

SEQ ID NO: 785530 - DNA, 20 bp, Artificial
  CRISPR gRNA sequence
tttcagataagtagctaaaa

SEQ ID NO: 785531 - DNA, 20 bp, Artificial
  CRISPR gRNA sequence
ataagtagctaaaatggcca

SEQ ID NO: 785532 - DNA, 20 bp, Artificial
  CRISPR gRNA sequence
aatggccaaagccccaaact

SEQ ID NO: 785533 - DNA, 20 bp, Artificial
  CRISPR gRNA sequence
ccaaactaagcctccttttc

SEQ ID NO: 785534 - DNA, 20 bp, Artificial
  CRISPR gRNA sequence
tgactttaaatttgactttt

SEQ ID NO: 785535 - DNA, 20 bp, Artificial
  CRISPR gRNA sequence
aatttgacttttcagtgcct

SEQ ID NO: 785536 - DNA, 20 bp, Artificial
  CRISPR gRNA sequence
cagtttgcacatctgtaata

SEQ ID NO: 785537 - DNA, 20 bp, Artificial
  CRISPR gRNA sequence
atctgtaatacagcaatgct

SEQ ID NO: 785538 - DNA, 20 bp, Artificial
  CRISPR gRNA sequence
tgtaatacagcaatgctaag

SEQ ID NO: 785539 - DNA, 20 bp, Artificial
  CRISPR gRNA sequence
tacagcaatgctaagtagtc

SEQ ID NO: 785540 - DNA, 20 bp, Artificial
  CRISPR gRNA sequence
acagcaatgctaagtagtca

SEQ ID NO: 785541 - DNA, 20 bp, Artificial
  CRISPR gRNA sequence
tagtcaaggcctttgataat

SEQ ID NO: 785542 - DNA, 20 bp, Artificial
  CRISPR gRNA sequence
gcctttgataattggcacta

SEQ ID NO: 785543 - DNA, 20 bp, Artificial
  CRISPR gRNA sequence
tggcactatggaaatcctgc

SEQ ID NO: 785544 - DNA, 20 bp, Artificial
  CRISPR gRNA sequence
aagatcccactacatatgtg

SEQ ID NO: 785545 - DNA, 20 bp, Artificial
  CRISPR gRNA sequence
gatcccactacatatgtgtg

SEQ ID NO: 785546 - DNA, 20 bp, Artificial
  CRISPR gRNA sequence
cccactacatatgtgtggag

SEQ ID NO: 785547 - DNA, 20 bp, Artificial
  CRISPR gRNA sequence
actacatatgtgtggagcag

SEQ ID NO: 785548 - DNA, 20 bp, Artificial
  CRISPR gRNA sequence
ctacatatgtgtggagcaga

SEQ ID NO: 785549 - DNA, 20 bp, Artificial
  CRISPR gRNA sequence
tacatatgtgtggagcagaa

SEQ ID NO: 785550 - DNA, 20 bp, Artificial
  CRISPR gRNA sequence
tgtggagcagaagggtaact

SEQ ID NO: 785551 - DNA, 20 bp, Artificial
  CRISPR gRNA sequence
gcagaagggtaactcggcta

SEQ ID NO: 785552 - DNA, 20 bp, Artificial
  CRISPR gRNA sequence
gggtaactcggctacagtaa

SEQ ID NO: 785553 - DNA, 20 bp, Artificial
  CRISPR gRNA sequence
gttaaatttgttctttatac

SEQ ID NO: 785554 - DNA, 20 bp, Artificial
  CRISPR gRNA sequence
taaatttgttctttatactg

SEQ ID NO: 785555 - DNA, 20 bp, Artificial
  CRISPR gRNA sequence
ttctttatactggagccatg

SEQ ID NO: 785556 - DNA, 20 bp, Artificial
  CRISPR gRNA sequence
tatactggagccatgaagct

SEQ ID NO: 785557 - DNA, 20 bp, Artificial
  CRISPR gRNA sequence
tactggagccatgaagctca

SEQ ID NO: 785558 - DNA, 20 bp, Artificial
  CRISPR gRNA sequence
agccatgaagctcagagcat

SEQ ID NO: 785559 - DNA, 20 bp, Artificial
  CRISPR gRNA sequence
tgacccttgaactattcaaa

SEQ ID NO: 785560 - DNA, 20 bp, Artificial
  CRISPR gRNA sequence
gacccttgaactattcaaat

SEQ ID NO: 785561 - DNA, 20 bp, Artificial
  CRISPR gRNA sequence
aactattcaaatgggcacat

SEQ ID NO: 785562 - DNA, 20 bp, Artificial
  CRISPR gRNA sequence
attcaaatgggcacattagc

SEQ ID NO: 785563 - DNA, 20 bp, Artificial
  CRISPR gRNA sequence
gggcacattagctagtataa

SEQ ID NO: 785564 - DNA, 20 bp, Artificial
  CRISPR gRNA sequence
gctagtataacagacttaca

SEQ ID NO: 785565 - DNA, 20 bp, Artificial
  CRISPR gRNA sequence
ctagtataacagacttacat

SEQ ID NO: 785566 - DNA, 20 bp, Artificial
  CRISPR gRNA sequence
gtataacagacttacatagg

SEQ ID NO: 785567 - DNA, 20 bp, Artificial
  CRISPR gRNA sequence
tataacagacttacataggt

SEQ ID NO: 785568 - DNA, 20 bp, Artificial
  CRISPR gRNA sequence
gacttacataggtgggccta

SEQ ID NO: 785569 - DNA, 20 bp, Artificial
  CRISPR gRNA sequence
tacataggtgggcctaaagc

SEQ ID NO: 785570 - DNA, 20 bp, Artificial
  CRISPR gRNA sequence
ctaaagcaagctccttaact

SEQ ID NO: 785571 - DNA, 20 bp, Artificial
  CRISPR gRNA sequence
ctccttaactgagcaaaatt

SEQ ID NO: 785572 - DNA, 20 bp, Artificial
  CRISPR gRNA sequence
tccttaactgagcaaaattt

SEQ ID NO: 785573 - DNA, 20 bp, Artificial
  CRISPR gRNA sequence
ccttaactgagcaaaatttg

SEQ ID NO: 785574 - DNA, 20 bp, Artificial
  CRISPR gRNA sequence
gagcaaaatttggggcttat

SEQ ID NO: 785575 - DNA, 20 bp, Artificial
  CRISPR gRNA sequence
tttggggcttatgagaatga

SEQ ID NO: 785576 - DNA, 20 bp, Artificial
  CRISPR gRNA sequence
ttggggcttatgagaatgaa

SEQ ID NO: 785577 - DNA, 20 bp, Artificial
  CRISPR gRNA sequence
tggggcttatgagaatgaaa

SEQ ID NO: 785578 - DNA, 20 bp, Artificial
  CRISPR gRNA sequence
aagggtgtgaaattgactaa

SEQ ID NO: 785579 - DNA, 20 bp, Artificial
  CRISPR gRNA sequence
aacagacaaatcatacatct

SEQ ID NO: 785580 - DNA, 20 bp, Artificial
  CRISPR gRNA sequence
ttctcaattctcatgtaaat

SEQ ID NO: 785581 - DNA, 20 bp, Artificial
  CRISPR gRNA sequence
ctcaattctcatgtaaatca

SEQ ID NO: 785582 - DNA, 20 bp, Artificial
  CRISPR gRNA sequence
taaatcagagaatgccttta

SEQ ID NO: 785583 - DNA, 20 bp, Artificial
  CRISPR gRNA sequence
ttctttatatattctacttt

SEQ ID NO: 785584 - DNA, 20 bp, Artificial
  CRISPR gRNA sequence
tctttatatattctactttt

SEQ ID NO: 785585 - DNA, 20 bp, Artificial
  CRISPR gRNA sequence
tatatattctacttttgggt

SEQ ID NO: 785586 - DNA, 20 bp, Artificial
  CRISPR gRNA sequence
tatattctacttttgggtaa

SEQ ID NO: 785587 - DNA, 20 bp, Artificial
  CRISPR gRNA sequence
atattctacttttgggtaag

SEQ ID NO: 785588 - DNA, 20 bp, Artificial
  CRISPR gRNA sequence
ttttgggtaagaggtttgct

SEQ ID NO: 785589 - DNA, 20 bp, Artificial
  CRISPR gRNA sequence
tttgggtaagaggtttgctc

SEQ ID NO: 785590 - DNA, 20 bp, Artificial
  CRISPR gRNA sequence
ttgggtaagaggtttgctca

SEQ ID NO: 785591 - DNA, 20 bp, Artificial
  CRISPR gRNA sequence
aggtttgctcagggtcttgc

SEQ ID NO: 785592 - DNA, 20 bp, Artificial
  CRISPR gRNA sequence
ttgctcagggtcttgcaagt

SEQ ID NO: 785593 - DNA, 20 bp, Artificial
  CRISPR gRNA sequence
tcagggtcttgcaagtcagt

SEQ ID NO: 785594 - DNA, 20 bp, Artificial
  CRISPR gRNA sequence
taatatcctattacgccatt

SEQ ID NO: 785595 - DNA, 20 bp, Artificial
  CRISPR gRNA sequence
attacgccatttggctccca

SEQ ID NO: 785596 - DNA, 20 bp, Artificial
  CRISPR gRNA sequence
atttggctcccaaagatttg

SEQ ID NO: 785597 - DNA, 20 bp, Artificial
  CRISPR gRNA sequence
tttggctcccaaagatttga

SEQ ID NO: 785598 - DNA, 20 bp, Artificial
  CRISPR gRNA sequence
ccaaagatttgaaggccttt

SEQ ID NO: 785599 - DNA, 20 bp, Artificial
  CRISPR gRNA sequence
caaagatttgaaggcctttg

SEQ ID NO: 785600 - DNA, 20 bp, Artificial
  CRISPR gRNA sequence
gaaggcctttgaggcaaact

SEQ ID NO: 785601 - DNA, 20 bp, Artificial
  CRISPR gRNA sequence
gtacatccaagtttgcctca

SEQ ID NO: 785602 - DNA, 20 bp, Artificial
  CRISPR gRNA sequence
tacatccaagtttgcctcaa

SEQ ID NO: 785603 - DNA, 20 bp, Artificial
  CRISPR gRNA sequence
ctcaaaggccttcaaatctt

SEQ ID NO: 785604 - DNA, 20 bp, Artificial
  CRISPR gRNA sequence
tcaaaggccttcaaatcttt

SEQ ID NO: 785605 - DNA, 20 bp, Artificial
  CRISPR gRNA sequence
aaaggccttcaaatctttgg

SEQ ID NO: 785606 - DNA, 20 bp, Artificial
  CRISPR gRNA sequence
tcaaatctttgggagccaaa

SEQ ID NO: 785607 - DNA, 20 bp, Artificial
  CRISPR gRNA sequence
ttgggagccaaatggcgtaa

SEQ ID NO: 785608 - DNA, 20 bp, Artificial
  CRISPR gRNA sequence
tgggagccaaatggcgtaat

SEQ ID NO: 785609 - DNA, 20 bp, Artificial
  CRISPR gRNA sequence
tattaaacttactgacttgc

SEQ ID NO: 785610 - DNA, 20 bp, Artificial
  CRISPR gRNA sequence
ttactgacttgcaagaccct

SEQ ID NO: 785611 - DNA, 20 bp, Artificial
  CRISPR gRNA sequence
tgagcaaacctcttacccaa

SEQ ID NO: 785612 - DNA, 20 bp, Artificial
  CRISPR gRNA sequence
gcaaacctcttacccaaaag

SEQ ID NO: 785613 - DNA, 20 bp, Artificial
  CRISPR gRNA sequence
acccaaaagtagaatatata

SEQ ID NO: 785614 - DNA, 20 bp, Artificial
  CRISPR gRNA sequence
agaatatataaagaacgttg

SEQ ID NO: 785615 - DNA, 20 bp, Artificial
  CRISPR gRNA sequence
aacgttgaagaataacaatt

SEQ ID NO: 785616 - DNA, 20 bp, Artificial
  CRISPR gRNA sequence
caattgagttttattcttta

SEQ ID NO: 785617 - DNA, 20 bp, Artificial
  CRISPR gRNA sequence
aattgagttttattctttaa

SEQ ID NO: 785618 - DNA, 20 bp, Artificial
  CRISPR gRNA sequence
aggcattctctgatttacat

SEQ ID NO: 785619 - DNA, 20 bp, Artificial
  CRISPR gRNA sequence
ctctgatttacatgagaatt

SEQ ID NO: 785620 - DNA, 20 bp, Artificial
  CRISPR gRNA sequence
tacatgagaattgagaaact

SEQ ID NO: 785621 - DNA, 20 bp, Artificial
  CRISPR gRNA sequence
gagatgtatgatttgtctgt

SEQ ID NO: 785622 - DNA, 20 bp, Artificial
  CRISPR gRNA sequence
tcacaccctttcattctcat

SEQ ID NO: 785623 - DNA, 20 bp, Artificial
  CRISPR gRNA sequence
cataagccccaaattttgct

SEQ ID NO: 785624 - DNA, 20 bp, Artificial
  CRISPR gRNA sequence
gccccaaattttgctcagtt

SEQ ID NO: 785625 - DNA, 20 bp, Artificial
  CRISPR gRNA sequence
ccccaaattttgctcagtta

SEQ ID NO: 785626 - DNA, 20 bp, Artificial
  CRISPR gRNA sequence
ccaaattttgctcagttaag

SEQ ID NO: 785627 - DNA, 20 bp, Artificial
  CRISPR gRNA sequence
ctcagttaaggagcttgctt

SEQ ID NO: 785628 - DNA, 20 bp, Artificial
  CRISPR gRNA sequence
tcagttaaggagcttgcttt

SEQ ID NO: 785629 - DNA, 20 bp, Artificial
  CRISPR gRNA sequence
tgctttaggcccacctatgt

SEQ ID NO: 785630 - DNA, 20 bp, Artificial
  CRISPR gRNA sequence
cctatgtaagtctgttatac

SEQ ID NO: 785631 - DNA, 20 bp, Artificial
  CRISPR gRNA sequence
agctaatgtgcccatttgaa

SEQ ID NO: 785632 - DNA, 20 bp, Artificial
  CRISPR gRNA sequence
tgtgcccatttgaatagttc

SEQ ID NO: 785633 - DNA, 20 bp, Artificial
  CRISPR gRNA sequence
gtgcccatttgaatagttca

SEQ ID NO: 785634 - DNA, 20 bp, Artificial
  CRISPR gRNA sequence
tgcccatttgaatagttcaa

SEQ ID NO: 785635 - DNA, 20 bp, Artificial
  CRISPR gRNA sequence
catttgaatagttcaagggt

SEQ ID NO: 785636 - DNA, 20 bp, Artificial
  CRISPR gRNA sequence
caagggtcagctaatgctct

SEQ ID NO: 785637 - DNA, 20 bp, Artificial
  CRISPR gRNA sequence
agctaatgctctgagcttca

SEQ ID NO: 785638 - DNA, 20 bp, Artificial
  CRISPR gRNA sequence
tgctctgagcttcatggctc

SEQ ID NO: 785639 - DNA, 20 bp, Artificial
  CRISPR gRNA sequence
agcttcatggctccagtata

SEQ ID NO: 785640 - DNA, 20 bp, Artificial
  CRISPR gRNA sequence
agaacaaatttaacaaaatt

SEQ ID NO: 785641 - DNA, 20 bp, Artificial
  CRISPR gRNA sequence
acaaaattaagctgttactg

SEQ ID NO: 785642 - DNA, 20 bp, Artificial
  CRISPR gRNA sequence
attaagctgttactgtagcc

SEQ ID NO: 785643 - DNA, 20 bp, Artificial
  CRISPR gRNA sequence
ccttctgctccacacatatg

SEQ ID NO: 785644 - DNA, 20 bp, Artificial
  CRISPR gRNA sequence
tctgctccacacatatgtag

SEQ ID NO: 785645 - DNA, 20 bp, Artificial
  CRISPR gRNA sequence
ctgctccacacatatgtagt

SEQ ID NO: 785646 - DNA, 20 bp, Artificial
  CRISPR gRNA sequence
acatatgtagtgggatcttg

SEQ ID NO: 785647 - DNA, 20 bp, Artificial
  CRISPR gRNA sequence
catatgtagtgggatcttgc

SEQ ID NO: 785648 - DNA, 20 bp, Artificial
  CRISPR gRNA sequence
gggatcttgcaggatttcca

SEQ ID NO: 785649 - DNA, 20 bp, Artificial
  CRISPR gRNA sequence
ttccatagtgccaattatca

SEQ ID NO: 785650 - DNA, 20 bp, Artificial
  CRISPR gRNA sequence
tccatagtgccaattatcaa

SEQ ID NO: 785651 - DNA, 20 bp, Artificial
  CRISPR gRNA sequence
tatcaaaggccttgactact

SEQ ID NO: 785652 - DNA, 20 bp, Artificial
  CRISPR gRNA sequence
tacttagcattgctgtatta

SEQ ID NO: 785653 - DNA, 20 bp, Artificial
  CRISPR gRNA sequence
gtattacagatgtgcaaact

SEQ ID NO: 785654 - DNA, 20 bp, Artificial
  CRISPR gRNA sequence
tattacagatgtgcaaactg

SEQ ID NO: 785655 - DNA, 20 bp, Artificial
  CRISPR gRNA sequence
gtgcaaactgaggcactgaa

SEQ ID NO: 785656 - DNA, 20 bp, Artificial
  CRISPR gRNA sequence
gcactgaaaagtcaaattta

SEQ ID NO: 785657 - DNA, 20 bp, Artificial
  CRISPR gRNA sequence
gtcaaatttaaagtcatatt

SEQ ID NO: 785658 - DNA, 20 bp, Artificial
  CRISPR gRNA sequence
tcaaatttaaagtcatattg

SEQ ID NO: 785659 - DNA, 20 bp, Artificial
  CRISPR gRNA sequence
caaatttaaagtcatattga

SEQ ID NO: 785660 - DNA, 20 bp, Artificial
  CRISPR gRNA sequence
tttaaagtcatattgagggc

SEQ ID NO: 785661 - DNA, 20 bp, Artificial
  CRISPR gRNA sequence
agtcatattgagggccagaa

SEQ ID NO: 785662 - DNA, 20 bp, Artificial
  CRISPR gRNA sequence
gtcatattgagggccagaaa

SEQ ID NO: 785663 - DNA, 20 bp, Artificial
  CRISPR gRNA sequence
catattgagggccagaaaag

SEQ ID NO: 785664 - DNA, 20 bp, Artificial
  CRISPR gRNA sequence
atattgagggccagaaaagg

SEQ ID NO: 785665 - DNA, 20 bp, Artificial
  CRISPR gRNA sequence
gagggccagaaaaggaggct

SEQ ID NO: 785666 - DNA, 20 bp, Artificial
  CRISPR gRNA sequence
ccagaaaaggaggcttagtt

SEQ ID NO: 785667 - DNA, 20 bp, Artificial
  CRISPR gRNA sequence
cagaaaaggaggcttagttt

SEQ ID NO: 785668 - DNA, 20 bp, Artificial
  CRISPR gRNA sequence
agaaaaggaggcttagtttg

SEQ ID NO: 785669 - DNA, 20 bp, Artificial
  CRISPR gRNA sequence
ggaggcttagtttggggctt

SEQ ID NO: 785670 - DNA, 20 bp, Artificial
  CRISPR gRNA sequence
gtttggggctttggccattt

SEQ ID NO: 785671 - DNA, 20 bp, Artificial
  CRISPR gRNA sequence
ctacttatctgaaattgctg

SEQ ID NO: 785672 - DNA, 20 bp, Artificial
  CRISPR gRNA sequence
ttgctgcagatacaacgtat

SEQ ID NO: 785673 - DNA, 20 bp, Artificial
  CRISPR gRNA sequence
actgtatataattgatttct

SEQ ID NO: 785674 - DNA, 20 bp, Artificial
  CRISPR gRNA sequence
ctgtatataattgatttcta

SEQ ID NO: 785675 - DNA, 20 bp, Artificial
  CRISPR gRNA sequence
ctaaggtaaaaacaaataaa

SEQ ID NO: 785676 - DNA, 20 bp, Artificial
  CRISPR gRNA sequence
aaagaaaccaataattttta

SEQ ID NO: 785677 - DNA, 20 bp, Artificial
  CRISPR gRNA sequence
aagaaaccaataatttttaa

SEQ ID NO: 785678 - DNA, 20 bp, Artificial
  CRISPR gRNA sequence
aaccaataatttttaaagga

SEQ ID NO: 785679 - DNA, 20 bp, Artificial
  CRISPR gRNA sequence
taatttttaaaggaaagatg

SEQ ID NO: 785680 - DNA, 20 bp, Artificial
  CRISPR gRNA sequence
aaaaaaaccaccattaaaca

SEQ ID NO: 785681 - DNA, 20 bp, Artificial
  CRISPR gRNA sequence
cattaaacatggtgccatta

SEQ ID NO: 785682 - DNA, 20 bp, Artificial
  CRISPR gRNA sequence
attaaacatggtgccattac

SEQ ID NO: 785683 - DNA, 20 bp, Artificial
  CRISPR gRNA sequence
aaaacaaatgctttgtgact

SEQ ID NO: 785684 - DNA, 20 bp, Artificial
  CRISPR gRNA sequence
tgtgacttagacctcaaaaa

SEQ ID NO: 785685 - DNA, 20 bp, Artificial
  CRISPR gRNA sequence
tgacttagacctcaaaaaca

SEQ ID NO: 785686 - DNA, 20 bp, Artificial
  CRISPR gRNA sequence
tactccacaatttgtgcact

SEQ ID NO: 785687 - DNA, 20 bp, Artificial
  CRISPR gRNA sequence
tttaaatgctctctgttaat

SEQ ID NO: 785688 - DNA, 20 bp, Artificial
  CRISPR gRNA sequence
aacaacttcattatgctatc

SEQ ID NO: 785689 - DNA, 20 bp, Artificial
  CRISPR gRNA sequence
tcattatgctatcaagattc

SEQ ID NO: 785690 - DNA, 20 bp, Artificial
  CRISPR gRNA sequence
aaacatgtcaattatgattt

SEQ ID NO: 785691 - DNA, 20 bp, Artificial
  CRISPR gRNA sequence
ttatgatttgagtttgtgcg

SEQ ID NO: 785692 - DNA, 20 bp, Artificial
  CRISPR gRNA sequence
ttgtgcgaagccctgtctgt

SEQ ID NO: 785693 - DNA, 20 bp, Artificial
  CRISPR gRNA sequence
aagccctgtctgtgagctca

SEQ ID NO: 785694 - DNA, 20 bp, Artificial
  CRISPR gRNA sequence
ctgtgagctcatagtctcaa

SEQ ID NO: 785695 - DNA, 20 bp, Artificial
  CRISPR gRNA sequence
atagtctcaatagcctcttc

SEQ ID NO: 785696 - DNA, 20 bp, Artificial
  CRISPR gRNA sequence
caatagcctcttctagtacc

SEQ ID NO: 785697 - DNA, 20 bp, Artificial
  CRISPR gRNA sequence
atagcctcttctagtaccca

SEQ ID NO: 785698 - DNA, 20 bp, Artificial
  CRISPR gRNA sequence
tagcctcttctagtacccag

SEQ ID NO: 785699 - DNA, 20 bp, Artificial
  CRISPR gRNA sequence
cctcttctagtacccagagg

SEQ ID NO: 785700 - DNA, 20 bp, Artificial
  CRISPR gRNA sequence
ctagtacccagaggaagcta

SEQ ID NO: 785701 - DNA, 20 bp, Artificial
  CRISPR gRNA sequence
tagataaaaaataactctat

SEQ ID NO: 785702 - DNA, 20 bp, Artificial
  CRISPR gRNA sequence
aacccatctgtttctgttac

SEQ ID NO: 785703 - DNA, 20 bp, Artificial
  CRISPR gRNA sequence
tttccacacacctctgcttt

SEQ ID NO: 785704 - DNA, 20 bp, Artificial
  CRISPR gRNA sequence
ctctgcttttggaaatcact

SEQ ID NO: 785705 - DNA, 20 bp, Artificial
  CRISPR gRNA sequence
ggaaatcacttagaaaactt

SEQ ID NO: 785706 - DNA, 20 bp, Artificial
  CRISPR gRNA sequence
gaaatcacttagaaaacttg

SEQ ID NO: 785707 - DNA, 20 bp, Artificial
  CRISPR gRNA sequence
aaatcacttagaaaacttga

SEQ ID NO: 785708 - DNA, 20 bp, Artificial
  CRISPR gRNA sequence
aatcacttagaaaacttgag

SEQ ID NO: 785709 - DNA, 20 bp, Artificial
  CRISPR gRNA sequence
gaaataattccttttgcttt

SEQ ID NO: 785710 - DNA, 20 bp, Artificial
  CRISPR gRNA sequence
aattccttttgctttcagtc

SEQ ID NO: 785711 - DNA, 20 bp, Artificial
  CRISPR gRNA sequence
tccttttgctttcagtctgg

SEQ ID NO: 785712 - DNA, 20 bp, Artificial
  CRISPR gRNA sequence
tttgctttcagtctggcagc

SEQ ID NO: 785713 - DNA, 20 bp, Artificial
  CRISPR gRNA sequence
gctttcagtctggcagcaag

SEQ ID NO: 785714 - DNA, 20 bp, Artificial
  CRISPR gRNA sequence
ctttcagtctggcagcaaga

SEQ ID NO: 785715 - DNA, 20 bp, Artificial
  CRISPR gRNA sequence
tggcagcaagaaggatcctg

SEQ ID NO: 785716 - DNA, 20 bp, Artificial
  CRISPR gRNA sequence
ggcagcaagaaggatcctga

SEQ ID NO: 785717 - DNA, 20 bp, Artificial
  CRISPR gRNA sequence
aggatcctgaaggaattctg

SEQ ID NO: 785718 - DNA, 20 bp, Artificial
  CRISPR gRNA sequence
ggatcctgaaggaattctgt

SEQ ID NO: 785719 - DNA, 20 bp, Artificial
  CRISPR gRNA sequence
ctgaaggaattctgtgggtc

SEQ ID NO: 785720 - DNA, 20 bp, Artificial
  CRISPR gRNA sequence
tgaaggaattctgtgggtcc

SEQ ID NO: 785721 - DNA, 20 bp, Artificial
  CRISPR gRNA sequence
aattctgtgggtccaggatc

SEQ ID NO: 785722 - DNA, 20 bp, Artificial
  CRISPR gRNA sequence
tctgtgggtccaggatccag

SEQ ID NO: 785723 - DNA, 20 bp, Artificial
  CRISPR gRNA sequence
ctgtgggtccaggatccagt

SEQ ID NO: 785724 - DNA, 20 bp, Artificial
  CRISPR gRNA sequence
tgtgggtccaggatccagtg

SEQ ID NO: 785725 - DNA, 20 bp, Artificial
  CRISPR gRNA sequence
tccagtggggtaattctgta

SEQ ID NO: 785726 - DNA, 20 bp, Artificial
  CRISPR gRNA sequence
tggggtaattctgtaaagtg

SEQ ID NO: 785727 - DNA, 20 bp, Artificial
  CRISPR gRNA sequence
ggtaattctgtaaagtgcag

SEQ ID NO: 785728 - DNA, 20 bp, Artificial
  CRISPR gRNA sequence
agtgcagtagtgcttgctta

SEQ ID NO: 785729 - DNA, 20 bp, Artificial
  CRISPR gRNA sequence
gtagtgcttgcttaaagcca

SEQ ID NO: 785730 - DNA, 20 bp, Artificial
  CRISPR gRNA sequence
tagtgcttgcttaaagccat

SEQ ID NO: 785731 - DNA, 20 bp, Artificial
  CRISPR gRNA sequence
ttgcttaaagccataggctc

SEQ ID NO: 785732 - DNA, 20 bp, Artificial
  CRISPR gRNA sequence
gcttaaagccataggctcca

SEQ ID NO: 785733 - DNA, 20 bp, Artificial
  CRISPR gRNA sequence
cttaaagccataggctccag

SEQ ID NO: 785734 - DNA, 20 bp, Artificial
  CRISPR gRNA sequence
aagccataggctccagaggt

SEQ ID NO: 785735 - DNA, 20 bp, Artificial
  CRISPR gRNA sequence
ataggctccagaggtgagtc

SEQ ID NO: 785736 - DNA, 20 bp, Artificial
  CRISPR gRNA sequence
ctccagaggtgagtccagat

SEQ ID NO: 785737 - DNA, 20 bp, Artificial
  CRISPR gRNA sequence
gaggtgagtccagatcagtg

SEQ ID NO: 785738 - DNA, 20 bp, Artificial
  CRISPR gRNA sequence
aggtgagtccagatcagtga

SEQ ID NO: 785739 - DNA, 20 bp, Artificial
  CRISPR gRNA sequence
ggtgagtccagatcagtgaa

SEQ ID NO: 785740 - DNA, 20 bp, Artificial
  CRISPR gRNA sequence
gtgagtccagatcagtgaag

SEQ ID NO: 785741 - DNA, 20 bp, Artificial
  CRISPR gRNA sequence
gtccagatcagtgaaggggc

SEQ ID NO: 785742 - DNA, 20 bp, Artificial
  CRISPR gRNA sequence
cagtgaaggggcaagtttca

SEQ ID NO: 785743 - DNA, 20 bp, Artificial
  CRISPR gRNA sequence
gaaggggcaagtttcatggc

SEQ ID NO: 785744 - DNA, 20 bp, Artificial
  CRISPR gRNA sequence
aaggggcaagtttcatggcc

SEQ ID NO: 785745 - DNA, 20 bp, Artificial
  CRISPR gRNA sequence
caagtttcatggccaggtgt

SEQ ID NO: 785746 - DNA, 20 bp, Artificial
  CRISPR gRNA sequence
tttcatggccaggtgttggc

SEQ ID NO: 785747 - DNA, 20 bp, Artificial
  CRISPR gRNA sequence
ggtgttggctagtcttgttg

SEQ ID NO: 785748 - DNA, 20 bp, Artificial
  CRISPR gRNA sequence
gtgttggctagtcttgttgc

SEQ ID NO: 785749 - DNA, 20 bp, Artificial
  CRISPR gRNA sequence
gctagtcttgttgcaggttt

SEQ ID NO: 785750 - DNA, 20 bp, Artificial
  CRISPR gRNA sequence
ttgttgcaggtttcagatta

SEQ ID NO: 785751 - DNA, 20 bp, Artificial
  CRISPR gRNA sequence
caggtttcagattaaagtgc

SEQ ID NO: 785752 - DNA, 20 bp, Artificial
  CRISPR gRNA sequence
aggtttcagattaaagtgct

SEQ ID NO: 785753 - DNA, 20 bp, Artificial
  CRISPR gRNA sequence
ttaaagtgctgggtcatcca

SEQ ID NO: 785754 - DNA, 20 bp, Artificial
  CRISPR gRNA sequence
taaagtgctgggtcatccaa

SEQ ID NO: 785755 - DNA, 20 bp, Artificial
  CRISPR gRNA sequence
gtcatccaaaggcatttgaa

SEQ ID NO: 785756 - DNA, 20 bp, Artificial
  CRISPR gRNA sequence
aggcatttgaaaagtgcaaa

SEQ ID NO: 785757 - DNA, 20 bp, Artificial
  CRISPR gRNA sequence
atttgaaaagtgcaaatggc

SEQ ID NO: 785758 - DNA, 20 bp, Artificial
  CRISPR gRNA sequence
agtgcaaatggcaagctctg

SEQ ID NO: 785759 - DNA, 20 bp, Artificial
  CRISPR gRNA sequence
gtgcaaatggcaagctctgc

SEQ ID NO: 785760 - DNA, 20 bp, Artificial
  CRISPR gRNA sequence
caggccaccgaattcttgtt

SEQ ID NO: 785761 - DNA, 20 bp, Artificial
  CRISPR gRNA sequence
ggccaccgaattcttgttca

SEQ ID NO: 785762 - DNA, 20 bp, Artificial
  CRISPR gRNA sequence
ccgaattcttgttcagagtc

SEQ ID NO: 785763 - DNA, 20 bp, Artificial
  CRISPR gRNA sequence
aattcttgttcagagtccag

SEQ ID NO: 785764 - DNA, 20 bp, Artificial
  CRISPR gRNA sequence
tcagagtccagaagcttctt

SEQ ID NO: 785765 - DNA, 20 bp, Artificial
  CRISPR gRNA sequence
agcttctttagatgtcatat

SEQ ID NO: 785766 - DNA, 20 bp, Artificial
  CRISPR gRNA sequence
gcttctttagatgtcatatc

SEQ ID NO: 785767 - DNA, 20 bp, Artificial
  CRISPR gRNA sequence
gatgtcatatcaggtcaccc

SEQ ID NO: 785768 - DNA, 20 bp, Artificial
  CRISPR gRNA sequence
atcaggtcaccctggctccc

SEQ ID NO: 785769 - DNA, 20 bp, Artificial
  CRISPR gRNA sequence
caccctggctcccaagacca

SEQ ID NO: 785770 - DNA, 20 bp, Artificial
  CRISPR gRNA sequence
accctggctcccaagaccac

SEQ ID NO: 785771 - DNA, 20 bp, Artificial
  CRISPR gRNA sequence
ggctcccaagaccacaggtt

SEQ ID NO: 785772 - DNA, 20 bp, Artificial
  CRISPR gRNA sequence
caagaccacaggttcagatc

SEQ ID NO: 785773 - DNA, 20 bp, Artificial
  CRISPR gRNA sequence
aagaccacaggttcagatct

SEQ ID NO: 785774 - DNA, 20 bp, Artificial
  CRISPR gRNA sequence
agaccacaggttcagatctg

SEQ ID NO: 785775 - DNA, 20 bp, Artificial
  CRISPR gRNA sequence
accacaggttcagatctggg

SEQ ID NO: 785776 - DNA, 20 bp, Artificial
  CRISPR gRNA sequence
aggttcagatctggggagaa

SEQ ID NO: 785777 - DNA, 20 bp, Artificial
  CRISPR gRNA sequence
ggggagaaaagcccacaaat

SEQ ID NO: 785778 - DNA, 20 bp, Artificial
  CRISPR gRNA sequence
gaaaaatcattttttatgat

SEQ ID NO: 785779 - DNA, 20 bp, Artificial
  CRISPR gRNA sequence
atataacctccccaaaattt

SEQ ID NO: 785780 - DNA, 20 bp, Artificial
  CRISPR gRNA sequence
aacctccccaaaatttgagt

SEQ ID NO: 785781 - DNA, 20 bp, Artificial
  CRISPR gRNA sequence
acctccccaaaatttgagtg

SEQ ID NO: 785782 - DNA, 20 bp, Artificial
  CRISPR gRNA sequence
aggaactaatttttttaaaa

SEQ ID NO: 785783 - DNA, 20 bp, Artificial
  CRISPR gRNA sequence
tttttttaaaaaagttcatc

SEQ ID NO: 785784 - DNA, 20 bp, Artificial
  CRISPR gRNA sequence
tttaaaaaagttcatctagc

SEQ ID NO: 785785 - DNA, 20 bp, Artificial
  CRISPR gRNA sequence
aaaaaagttcatctagctgg

SEQ ID NO: 785786 - DNA, 20 bp, Artificial
  CRISPR gRNA sequence
tcatctagctggaagccgca

SEQ ID NO: 785787 - DNA, 20 bp, Artificial
  CRISPR gRNA sequence
tcatttaaaacttctttcca

SEQ ID NO: 785788 - DNA, 20 bp, Artificial
  CRISPR gRNA sequence
cacagtttttaccattgccc

SEQ ID NO: 785789 - DNA, 20 bp, Artificial
  CRISPR gRNA sequence
ttttaccattgccctagtcc

SEQ ID NO: 785790 - DNA, 20 bp, Artificial
  CRISPR gRNA sequence
attgccctagtccaagtctt

SEQ ID NO: 785791 - DNA, 20 bp, Artificial
  CRISPR gRNA sequence
aagtcttcagcttctctcct

SEQ ID NO: 785792 - DNA, 20 bp, Artificial
  CRISPR gRNA sequence
tctctcctcagacctattgc

SEQ ID NO: 785793 - DNA, 20 bp, Artificial
  CRISPR gRNA sequence
tctcctcagacctattgcaa

SEQ ID NO: 785794 - DNA, 20 bp, Artificial
  CRISPR gRNA sequence
gctgttcctcttccattctt

SEQ ID NO: 785795 - DNA, 20 bp, Artificial
  CRISPR gRNA sequence
ctgttcctcttccattcttt

SEQ ID NO: 785796 - DNA, 20 bp, Artificial
  CRISPR gRNA sequence
tccattctttgggccacaca

SEQ ID NO: 785797 - DNA, 20 bp, Artificial
  CRISPR gRNA sequence
tctttgggccacacatagtt

SEQ ID NO: 785798 - DNA, 20 bp, Artificial
  CRISPR gRNA sequence
cacacatagttcagtaatat

SEQ ID NO: 785799 - DNA, 20 bp, Artificial
  CRISPR gRNA sequence
cacatagttcagtaatattg

SEQ ID NO: 785800 - DNA, 20 bp, Artificial
  CRISPR gRNA sequence
agtaatattggagcacattt

SEQ ID NO: 785801 - DNA, 20 bp, Artificial
  CRISPR gRNA sequence
gtaatattggagcacatttc

SEQ ID NO: 785802 - DNA, 20 bp, Artificial
  CRISPR gRNA sequence
taatattggagcacatttca

SEQ ID NO: 785803 - DNA, 20 bp, Artificial
  CRISPR gRNA sequence
aatattggagcacatttcag

SEQ ID NO: 785804 - DNA, 20 bp, Artificial
  CRISPR gRNA sequence
ctcctattcaaaacctctta

SEQ ID NO: 785805 - DNA, 20 bp, Artificial
  CRISPR gRNA sequence
cttatagttccctattgtgt

SEQ ID NO: 785806 - DNA, 20 bp, Artificial
  CRISPR gRNA sequence
gatatttctattaattcctg

SEQ ID NO: 785807 - DNA, 20 bp, Artificial
  CRISPR gRNA sequence
gctgcactctattcatgctc

SEQ ID NO: 785808 - DNA, 20 bp, Artificial
  CRISPR gRNA sequence
ctgcactctattcatgctcc

SEQ ID NO: 785809 - DNA, 20 bp, Artificial
  CRISPR gRNA sequence
gctccaggatgatgacattg

SEQ ID NO: 785810 - DNA, 20 bp, Artificial
  CRISPR gRNA sequence
gacattgcagactgcatcac

SEQ ID NO: 785811 - DNA, 20 bp, Artificial
  CRISPR gRNA sequence
acattgcagactgcatcact

SEQ ID NO: 785812 - DNA, 20 bp, Artificial
  CRISPR gRNA sequence
ctcctccctctgtctttgac

SEQ ID NO: 785813 - DNA, 20 bp, Artificial
  CRISPR gRNA sequence
tcctccctctgtctttgact

SEQ ID NO: 785814 - DNA, 20 bp, Artificial
  CRISPR gRNA sequence
cctctgtctttgactgggct

SEQ ID NO: 785815 - DNA, 20 bp, Artificial
  CRISPR gRNA sequence
gtctttgactgggctcagtc

SEQ ID NO: 785816 - DNA, 20 bp, Artificial
  CRISPR gRNA sequence
tctttgactgggctcagtct

SEQ ID NO: 785817 - DNA, 20 bp, Artificial
  CRISPR gRNA sequence
ctttgactgggctcagtcta

SEQ ID NO: 785818 - DNA, 20 bp, Artificial
  CRISPR gRNA sequence
tttgactgggctcagtctag

SEQ ID NO: 785819 - DNA, 20 bp, Artificial
  CRISPR gRNA sequence
tgggctcagtctaggggaaa

SEQ ID NO: 785820 - DNA, 20 bp, Artificial
  CRISPR gRNA sequence
ggctcagtctaggggaaaaa

SEQ ID NO: 785821 - DNA, 20 bp, Artificial
  CRISPR gRNA sequence
ctaggggaaaaagagtgttg

SEQ ID NO: 785822 - DNA, 20 bp, Artificial
  CRISPR gRNA sequence
ggggaaaaagagtgttgcag

SEQ ID NO: 785823 - DNA, 20 bp, Artificial
  CRISPR gRNA sequence
gggaaaaagagtgttgcagt

SEQ ID NO: 785824 - DNA, 20 bp, Artificial
  CRISPR gRNA sequence
aaagagtgttgcagtgggtt

SEQ ID NO: 785825 - DNA, 20 bp, Artificial
  CRISPR gRNA sequence
agagtgttgcagtgggttga

SEQ ID NO: 785826 - DNA, 20 bp, Artificial
  CRISPR gRNA sequence
agtgttgcagtgggttgaga

SEQ ID NO: 785827 - DNA, 20 bp, Artificial
  CRISPR gRNA sequence
tgttgcagtgggttgagaga

SEQ ID NO: 785828 - DNA, 20 bp, Artificial
  CRISPR gRNA sequence
gttgcagtgggttgagagag

SEQ ID NO: 785829 - DNA, 20 bp, Artificial
  CRISPR gRNA sequence
cagtgggttgagagagaggt

SEQ ID NO: 785830 - DNA, 20 bp, Artificial
  CRISPR gRNA sequence
agtgggttgagagagaggtt

SEQ ID NO: 785831 - DNA, 20 bp, Artificial
  CRISPR gRNA sequence
gtgggttgagagagaggttg

SEQ ID NO: 785832 - DNA, 20 bp, Artificial
  CRISPR gRNA sequence
aggttggggtatctattcct

SEQ ID NO: 785833 - DNA, 20 bp, Artificial
  CRISPR gRNA sequence
tctattcctcagcaacctcc

SEQ ID NO: 785834 - DNA, 20 bp, Artificial
  CRISPR gRNA sequence
tcctcagcaacctcccagac

SEQ ID NO: 785835 - DNA, 20 bp, Artificial
  CRISPR gRNA sequence
gcaacctcccagacaagttg

SEQ ID NO: 785836 - DNA, 20 bp, Artificial
  CRISPR gRNA sequence
caacctcccagacaagttgt

SEQ ID NO: 785837 - DNA, 20 bp, Artificial
  CRISPR gRNA sequence
ttgactttgtccctctgtta

SEQ ID NO: 785838 - DNA, 20 bp, Artificial
  CRISPR gRNA sequence
tgtccctctgttaaagacca

SEQ ID NO: 785839 - DNA, 20 bp, Artificial
  CRISPR gRNA sequence
gtccctctgttaaagaccat

SEQ ID NO: 785840 - DNA, 20 bp, Artificial
  CRISPR gRNA sequence
ttaaagaccataggtcctgc

SEQ ID NO: 785841 - DNA, 20 bp, Artificial
  CRISPR gRNA sequence
agaccataggtcctgccaga

SEQ ID NO: 785842 - DNA, 20 bp, Artificial
  CRISPR gRNA sequence
tttctcattgccatttttac

SEQ ID NO: 785843 - DNA, 20 bp, Artificial
  CRISPR gRNA sequence
ttctcattgccatttttact

SEQ ID NO: 785844 - DNA, 20 bp, Artificial
  CRISPR gRNA sequence
tctcattgccatttttacta

SEQ ID NO: 785845 - DNA, 20 bp, Artificial
  CRISPR gRNA sequence
tgccatttttactagggttc

SEQ ID NO: 785846 - DNA, 20 bp, Artificial
  CRISPR gRNA sequence
gccatttttactagggttct

SEQ ID NO: 785847 - DNA, 20 bp, Artificial
  CRISPR gRNA sequence
gctccctcccctttctcctt

SEQ ID NO: 785848 - DNA, 20 bp, Artificial
  CRISPR gRNA sequence
tcccctttctccttcagacc

SEQ ID NO: 785849 - DNA, 20 bp, Artificial
  CRISPR gRNA sequence
cccctttctccttcagacct

SEQ ID NO: 785850 - DNA, 20 bp, Artificial
  CRISPR gRNA sequence
ttctccttcagacctaggaa

SEQ ID NO: 785851 - DNA, 20 bp, Artificial
  CRISPR gRNA sequence
ccctgcctgctcttgcatcc

SEQ ID NO: 785852 - DNA, 20 bp, Artificial
  CRISPR gRNA sequence
ctcttgcatcctggcatgct

SEQ ID NO: 785853 - DNA, 20 bp, Artificial
  CRISPR gRNA sequence
gcatgctcagtatcccttgc

SEQ ID NO: 785854 - DNA, 20 bp, Artificial
  CRISPR gRNA sequence
tttataaattaaacttgcct

SEQ ID NO: 785855 - DNA, 20 bp, Artificial
  CRISPR gRNA sequence
ttgcctcagttacctcttct

SEQ ID NO: 785856 - DNA, 20 bp, Artificial
  CRISPR gRNA sequence
gcataccctccatttcctgc

SEQ ID NO: 785857 - DNA, 20 bp, Artificial
  CRISPR gRNA sequence
cataccctccatttcctgct

SEQ ID NO: 785858 - DNA, 20 bp, Artificial
  CRISPR gRNA sequence
ttcctgctaggatctaactg

SEQ ID NO: 785859 - DNA, 20 bp, Artificial
  CRISPR gRNA sequence
ctaactgaagcactcttgct

SEQ ID NO: 785860 - DNA, 20 bp, Artificial
  CRISPR gRNA sequence
ctgaagcactcttgcttagt

SEQ ID NO: 785861 - DNA, 20 bp, Artificial
  CRISPR gRNA sequence
agtaaaatctaacttttgcc

SEQ ID NO: 785862 - DNA, 20 bp, Artificial
  CRISPR gRNA sequence
atctaacttttgcctggaat

SEQ ID NO: 785863 - DNA, 20 bp, Artificial
  CRISPR gRNA sequence
taacttttgcctggaattag

SEQ ID NO: 785864 - DNA, 20 bp, Artificial
  CRISPR gRNA sequence
gtttacaatacatgccctaa

SEQ ID NO: 785865 - DNA, 20 bp, Artificial
  CRISPR gRNA sequence
tttcccccttatctcacacc

SEQ ID NO: 785866 - DNA, 20 bp, Artificial
  CRISPR gRNA sequence
cacctggctttctctctgaa

SEQ ID NO: 785867 - DNA, 20 bp, Artificial
  CRISPR gRNA sequence
acctggctttctctctgaac

SEQ ID NO: 785868 - DNA, 20 bp, Artificial
  CRISPR gRNA sequence
cctggctttctctctgaacg

SEQ ID NO: 785869 - DNA, 20 bp, Artificial
  CRISPR gRNA sequence
tgcctctctgcctttcctgt

SEQ ID NO: 785870 - DNA, 20 bp, Artificial
  CRISPR gRNA sequence
ctgttagtgtctcctctatc

SEQ ID NO: 785871 - DNA, 20 bp, Artificial
  CRISPR gRNA sequence
ttagtgtctcctctatctag

SEQ ID NO: 785872 - DNA, 20 bp, Artificial
  CRISPR gRNA sequence
agtgtctcctctatctagaa

SEQ ID NO: 785873 - DNA, 20 bp, Artificial
  CRISPR gRNA sequence
tccatttcttcctgattcaa

SEQ ID NO: 785874 - DNA, 20 bp, Artificial
  CRISPR gRNA sequence
tcttcttccctgattatccc

SEQ ID NO: 785875 - DNA, 20 bp, Artificial
  CRISPR gRNA sequence
ccctgattatccccagctta

SEQ ID NO: 785876 - DNA, 20 bp, Artificial
  CRISPR gRNA sequence
attgtttgtccctcttatat

SEQ ID NO: 785877 - DNA, 20 bp, Artificial
  CRISPR gRNA sequence
tgtccctcttatatgagcca

SEQ ID NO: 785878 - DNA, 20 bp, Artificial
  CRISPR gRNA sequence
tccctcttatatgagccata

SEQ ID NO: 785879 - DNA, 20 bp, Artificial
  CRISPR gRNA sequence
agagaaccataaaaaataca

SEQ ID NO: 785880 - DNA, 20 bp, Artificial
  CRISPR gRNA sequence
ttcacaccattaaaaattca

SEQ ID NO: 785881 - DNA, 20 bp, Artificial
  CRISPR gRNA sequence
tcacaccattaaaaattcat

SEQ ID NO: 785882 - DNA, 20 bp, Artificial
  CRISPR gRNA sequence
ccattaaaaattcatgggca

SEQ ID NO: 785883 - DNA, 20 bp, Artificial
  CRISPR gRNA sequence
cattaaaaattcatgggcac

SEQ ID NO: 785884 - DNA, 20 bp, Artificial
  CRISPR gRNA sequence
aaaaattcatgggcacaggt

SEQ ID NO: 785885 - DNA, 20 bp, Artificial
  CRISPR gRNA sequence
ttcatgggcacaggtgagtg

SEQ ID NO: 785886 - DNA, 20 bp, Artificial
  CRISPR gRNA sequence
gcacaggtgagtgaagctgt

SEQ ID NO: 785887 - DNA, 20 bp, Artificial
  CRISPR gRNA sequence
ttagtgactcctcttgctaa

SEQ ID NO: 785888 - DNA, 20 bp, Artificial
  CRISPR gRNA sequence
tagcactctcctccctccct

SEQ ID NO: 785889 - DNA, 20 bp, Artificial
  CRISPR gRNA sequence
tgagacaactgtgctgcctg

SEQ ID NO: 785890 - DNA, 20 bp, Artificial
  CRISPR gRNA sequence
acaactgtgctgcctgaaga

SEQ ID NO: 785891 - DNA, 20 bp, Artificial
  CRISPR gRNA sequence
ctgtgctgcctgaagaaaga

SEQ ID NO: 785892 - DNA, 20 bp, Artificial
  CRISPR gRNA sequence
gcctgaagaaagaaagtgtg

SEQ ID NO: 785893 - DNA, 20 bp, Artificial
  CRISPR gRNA sequence
aagtgtgaagttgcctgaca

SEQ ID NO: 785894 - DNA, 20 bp, Artificial
  CRISPR gRNA sequence
agtgtgaagttgcctgacat

SEQ ID NO: 785895 - DNA, 20 bp, Artificial
  CRISPR gRNA sequence
tgaagttgcctgacatgggt

SEQ ID NO: 785896 - DNA, 20 bp, Artificial
  CRISPR gRNA sequence
gaagttgcctgacatgggtt

SEQ ID NO: 785897 - DNA, 20 bp, Artificial
  CRISPR gRNA sequence
gacatgggttgggtatttct

SEQ ID NO: 785898 - DNA, 20 bp, Artificial
  CRISPR gRNA sequence
acatgggttgggtatttctg

SEQ ID NO: 785899 - DNA, 20 bp, Artificial
  CRISPR gRNA sequence
tgggtatttctgaggattga

SEQ ID NO: 785900 - DNA, 20 bp, Artificial
  CRISPR gRNA sequence
tatttctgaggattgatggt

SEQ ID NO: 785901 - DNA, 20 bp, Artificial
  CRISPR gRNA sequence
atttctgaggattgatggta

SEQ ID NO: 785902 - DNA, 20 bp, Artificial
  CRISPR gRNA sequence
tctgaggattgatggtaagg

SEQ ID NO: 785903 - DNA, 20 bp, Artificial
  CRISPR gRNA sequence
ctgaggattgatggtaaggt

SEQ ID NO: 785904 - DNA, 20 bp, Artificial
  CRISPR gRNA sequence
attgatggtaaggtgggctt

SEQ ID NO: 785905 - DNA, 20 bp, Artificial
  CRISPR gRNA sequence
ttgatggtaaggtgggcttc

SEQ ID NO: 785906 - DNA, 20 bp, Artificial
  CRISPR gRNA sequence
gtaaggtgggcttcaggaca

SEQ ID NO: 785907 - DNA, 20 bp, Artificial
  CRISPR gRNA sequence
taaggtgggcttcaggacat

SEQ ID NO: 785908 - DNA, 20 bp, Artificial
  CRISPR gRNA sequence
aaggtgggcttcaggacata

SEQ ID NO: 785909 - DNA, 20 bp, Artificial
  CRISPR gRNA sequence
tcaggacatagggataattt

SEQ ID NO: 785910 - DNA, 20 bp, Artificial
  CRISPR gRNA sequence
aggacatagggataatttga

SEQ ID NO: 785911 - DNA, 20 bp, Artificial
  CRISPR gRNA sequence
tgattttccaaatatgttcc

SEQ ID NO: 785912 - DNA, 20 bp, Artificial
  CRISPR gRNA sequence
ttttccaaatatgttccaag

SEQ ID NO: 785913 - DNA, 20 bp, Artificial
  CRISPR gRNA sequence
aaatatgttccaagaagcac

SEQ ID NO: 785914 - DNA, 20 bp, Artificial
  CRISPR gRNA sequence
aatatgttccaagaagcaca

SEQ ID NO: 785915 - DNA, 20 bp, Artificial
  CRISPR gRNA sequence
ccaagaagcacaaggtatct

SEQ ID NO: 785916 - DNA, 20 bp, Artificial
  CRISPR gRNA sequence
aagaagcacaaggtatctta

SEQ ID NO: 785917 - DNA, 20 bp, Artificial
  CRISPR gRNA sequence
aagcacaaggtatcttagag

SEQ ID NO: 785918 - DNA, 20 bp, Artificial
  CRISPR gRNA sequence
cacaaggtatcttagagcag

SEQ ID NO: 785919 - DNA, 20 bp, Artificial
  CRISPR gRNA sequence
gcagtggtccccaacatttt

SEQ ID NO: 785920 - DNA, 20 bp, Artificial
  CRISPR gRNA sequence
gtccccaacatttttggcac

SEQ ID NO: 785921 - DNA, 20 bp, Artificial
  CRISPR gRNA sequence
tccccaacatttttggcacc

SEQ ID NO: 785922 - DNA, 20 bp, Artificial
  CRISPR gRNA sequence
ccccaacatttttggcacca

SEQ ID NO: 785923 - DNA, 20 bp, Artificial
  CRISPR gRNA sequence
acatttttggcaccagggac

SEQ ID NO: 785924 - DNA, 20 bp, Artificial
  CRISPR gRNA sequence
ttggcaccagggactggttt

SEQ ID NO: 785925 - DNA, 20 bp, Artificial
  CRISPR gRNA sequence
tggcaccagggactggtttc

SEQ ID NO: 785926 - DNA, 20 bp, Artificial
  CRISPR gRNA sequence
ggcaccagggactggtttca

SEQ ID NO: 785927 - DNA, 20 bp, Artificial
  CRISPR gRNA sequence
accagggactggtttcaggg

SEQ ID NO: 785928 - DNA, 20 bp, Artificial
  CRISPR gRNA sequence
cagggaagacaatttttcca

SEQ ID NO: 785929 - DNA, 20 bp, Artificial
  CRISPR gRNA sequence
aagacaatttttccatggat

SEQ ID NO: 785930 - DNA, 20 bp, Artificial
  CRISPR gRNA sequence
agacaatttttccatggatt

SEQ ID NO: 785931 - DNA, 20 bp, Artificial
  CRISPR gRNA sequence
atttttccatggattgggtg

SEQ ID NO: 785932 - DNA, 20 bp, Artificial
  CRISPR gRNA sequence
tttttccatggattgggtgt

SEQ ID NO: 785933 - DNA, 20 bp, Artificial
  CRISPR gRNA sequence
tttccatggattgggtgtgg

SEQ ID NO: 785934 - DNA, 20 bp, Artificial
  CRISPR gRNA sequence
ccatggattgggtgtgggag

SEQ ID NO: 785935 - DNA, 20 bp, Artificial
  CRISPR gRNA sequence
catggattgggtgtgggagt

SEQ ID NO: 785936 - DNA, 20 bp, Artificial
  CRISPR gRNA sequence
atggattgggtgtgggagtg

SEQ ID NO: 785937 - DNA, 20 bp, Artificial
  CRISPR gRNA sequence
tggattgggtgtgggagtgg

SEQ ID NO: 785938 - DNA, 20 bp, Artificial
  CRISPR gRNA sequence
attgggtgtgggagtggggg

SEQ ID NO: 785939 - DNA, 20 bp, Artificial
  CRISPR gRNA sequence
ttgggtgtgggagtgggggt

SEQ ID NO: 785940 - DNA, 20 bp, Artificial
  CRISPR gRNA sequence
gtgggagtgggggtaggcta

SEQ ID NO: 785941 - DNA, 20 bp, Artificial
  CRISPR gRNA sequence
gtgggggtaggctatagttt

SEQ ID NO: 785942 - DNA, 20 bp, Artificial
  CRISPR gRNA sequence
tgggggtaggctatagtttc

SEQ ID NO: 785943 - DNA, 20 bp, Artificial
  CRISPR gRNA sequence
aggatgaacctgttccacct

SEQ ID NO: 785944 - DNA, 20 bp, Artificial
  CRISPR gRNA sequence
cctgttccacctcagatcgt

SEQ ID NO: 785945 - DNA, 20 bp, Artificial
  CRISPR gRNA sequence
cacctcagatcgtcagacat

SEQ ID NO: 785946 - DNA, 20 bp, Artificial
  CRISPR gRNA sequence
gtcagacattagattttcat

SEQ ID NO: 785947 - DNA, 20 bp, Artificial
  CRISPR gRNA sequence
tcagacattagattttcata

SEQ ID NO: 785948 - DNA, 20 bp, Artificial
  CRISPR gRNA sequence
agacattagattttcataag

SEQ ID NO: 785949 - DNA, 20 bp, Artificial
  CRISPR gRNA sequence
ttcataaggagcacacaacc

SEQ ID NO: 785950 - DNA, 20 bp, Artificial
  CRISPR gRNA sequence
acctagatccctcatatgtg

SEQ ID NO: 785951 - DNA, 20 bp, Artificial
  CRISPR gRNA sequence
ctcatatgtgcagttcacaa

SEQ ID NO: 785952 - DNA, 20 bp, Artificial
  CRISPR gRNA sequence
tcatatgtgcagttcacaat

SEQ ID NO: 785953 - DNA, 20 bp, Artificial
  CRISPR gRNA sequence
aataggattcacgcttctat

SEQ ID NO: 785954 - DNA, 20 bp, Artificial
  CRISPR gRNA sequence
taatgctgctgctgatctca

SEQ ID NO: 785955 - DNA, 20 bp, Artificial
  CRISPR gRNA sequence
aatgctgctgctgatctcac

SEQ ID NO: 785956 - DNA, 20 bp, Artificial
  CRISPR gRNA sequence
tgctgctgctgatctcacag

SEQ ID NO: 785957 - DNA, 20 bp, Artificial
  CRISPR gRNA sequence
gctgctgctgatctcacagg

SEQ ID NO: 785958 - DNA, 20 bp, Artificial
  CRISPR gRNA sequence
gctgctgatctcacaggagg

SEQ ID NO: 785959 - DNA, 20 bp, Artificial
  CRISPR gRNA sequence
tgctgatctcacaggaggta

SEQ ID NO: 785960 - DNA, 20 bp, Artificial
  CRISPR gRNA sequence
atctcacaggaggtagagct

SEQ ID NO: 785961 - DNA, 20 bp, Artificial
  CRISPR gRNA sequence
tctcacaggaggtagagctc

SEQ ID NO: 785962 - DNA, 20 bp, Artificial
  CRISPR gRNA sequence
cacaggaggtagagctcagg

SEQ ID NO: 785963 - DNA, 20 bp, Artificial
  CRISPR gRNA sequence
aggaggtagagctcaggtag

SEQ ID NO: 785964 - DNA, 20 bp, Artificial
  CRISPR gRNA sequence
cccgctcacctcctgctgtg

SEQ ID NO: 785965 - DNA, 20 bp, Artificial
  CRISPR gRNA sequence
tcacctcctgctgtgtggct

SEQ ID NO: 785966 - DNA, 20 bp, Artificial
  CRISPR gRNA sequence
ctgtgtggctcagttcctaa

SEQ ID NO: 785967 - DNA, 20 bp, Artificial
  CRISPR gRNA sequence
tgtgtggctcagttcctaac

SEQ ID NO: 785968 - DNA, 20 bp, Artificial
  CRISPR gRNA sequence
ctcagttcctaacaggccac

SEQ ID NO: 785969 - DNA, 20 bp, Artificial
  CRISPR gRNA sequence
tcctaacaggccactggtac

SEQ ID NO: 785970 - DNA, 20 bp, Artificial
  CRISPR gRNA sequence
aggccactggtaccggtctg

SEQ ID NO: 785971 - DNA, 20 bp, Artificial
  CRISPR gRNA sequence
actggtaccggtctgcggcc

SEQ ID NO: 785972 - DNA, 20 bp, Artificial
  CRISPR gRNA sequence
tggtaccggtctgcggccca

SEQ ID NO: 785973 - DNA, 20 bp, Artificial
  CRISPR gRNA sequence
ggtaccggtctgcggcccag

SEQ ID NO: 785974 - DNA, 20 bp, Artificial
  CRISPR gRNA sequence
ccggtctgcggcccagaggt

SEQ ID NO: 785975 - DNA, 20 bp, Artificial
  CRISPR gRNA sequence
cggtctgcggcccagaggtt

SEQ ID NO: 785976 - DNA, 20 bp, Artificial
  CRISPR gRNA sequence
ggtctgcggcccagaggttg

SEQ ID NO: 785977 - DNA, 20 bp, Artificial
  CRISPR gRNA sequence
gaggttggggacccctgcct

SEQ ID NO: 785978 - DNA, 20 bp, Artificial
  CRISPR gRNA sequence
ggttggggacccctgcctta

SEQ ID NO: 785979 - DNA, 20 bp, Artificial
  CRISPR gRNA sequence
gttggggacccctgccttag

SEQ ID NO: 785980 - DNA, 20 bp, Artificial
  CRISPR gRNA sequence
ccctgccttagaggcctttg

SEQ ID NO: 785981 - DNA, 20 bp, Artificial
  CRISPR gRNA sequence
cctgccttagaggcctttgt

SEQ ID NO: 785982 - DNA, 20 bp, Artificial
  CRISPR gRNA sequence
ctgccttagaggcctttgta

SEQ ID NO: 785983 - DNA, 20 bp, Artificial
  CRISPR gRNA sequence
ttgtagggacaaatatgata

SEQ ID NO: 785984 - DNA, 20 bp, Artificial
  CRISPR gRNA sequence
acaaatatgatatggacaaa

SEQ ID NO: 785985 - DNA, 20 bp, Artificial
  CRISPR gRNA sequence
tggacaaatagcctatatga

SEQ ID NO: 785986 - DNA, 20 bp, Artificial
  CRISPR gRNA sequence
ggacaaatagcctatatgat

SEQ ID NO: 785987 - DNA, 20 bp, Artificial
  CRISPR gRNA sequence
gacaaatagcctatatgata

SEQ ID NO: 785988 - DNA, 20 bp, Artificial
  CRISPR gRNA sequence
attttaatttgcttgacatg

SEQ ID NO: 785989 - DNA, 20 bp, Artificial
  CRISPR gRNA sequence
ttttaatttgcttgacatgt

SEQ ID NO: 785990 - DNA, 20 bp, Artificial
  CRISPR gRNA sequence
ttaatttgcttgacatgtag

SEQ ID NO: 785991 - DNA, 20 bp, Artificial
  CRISPR gRNA sequence
gtctaatatttcctttgcga

SEQ ID NO: 785992 - DNA, 20 bp, Artificial
  CRISPR gRNA sequence
tctaatatttcctttgcgaa

SEQ ID NO: 785993 - DNA, 20 bp, Artificial
  CRISPR gRNA sequence
tttcctttgcgaaaggttta

SEQ ID NO: 785994 - DNA, 20 bp, Artificial
  CRISPR gRNA sequence
cgaaaggtttatagtgccaa

SEQ ID NO: 785995 - DNA, 20 bp, Artificial
  CRISPR gRNA sequence
gtttatagtgccaaaagaaa

SEQ ID NO: 785996 - DNA, 20 bp, Artificial
  CRISPR gRNA sequence
gtgccaaaagaaaaagaaat

SEQ ID NO: 785997 - DNA, 20 bp, Artificial
  CRISPR gRNA sequence
gaaattggaaaccactgaaa

SEQ ID NO: 785998 - DNA, 20 bp, Artificial
  CRISPR gRNA sequence
aaattggaaaccactgaaat

SEQ ID NO: 785999 - DNA, 20 bp, Artificial
  CRISPR gRNA sequence
tggaaaccactgaaatggga

SEQ ID NO: 786000 - DNA, 20 bp, Artificial
  CRISPR gRNA sequence
ggaaaccactgaaatgggaa

SEQ ID NO: 786001 - DNA, 20 bp, Artificial
  CRISPR gRNA sequence
gaaaccactgaaatgggaaa

SEQ ID NO: 786002 - DNA, 20 bp, Artificial
  CRISPR gRNA sequence
aaaccactgaaatgggaaag

SEQ ID NO: 786003 - DNA, 20 bp, Artificial
  CRISPR gRNA sequence
cactgaaatgggaaagggga

SEQ ID NO: 786004 - DNA, 20 bp, Artificial
  CRISPR gRNA sequence
actgaaatgggaaaggggaa

SEQ ID NO: 786005 - DNA, 20 bp, Artificial
  CRISPR gRNA sequence
ggaaaggaaacacacccatg

SEQ ID NO: 786006 - DNA, 20 bp, Artificial
  CRISPR gRNA sequence
catgtggaatgctgacgctg

SEQ ID NO: 786007 - DNA, 20 bp, Artificial
  CRISPR gRNA sequence
tggaatgctgacgctgtggt

SEQ ID NO: 786008 - DNA, 20 bp, Artificial
  CRISPR gRNA sequence
ctgacgctgtggtcagttct

SEQ ID NO: 786009 - DNA, 20 bp, Artificial
  CRISPR gRNA sequence
tgacgctgtggtcagttctc

SEQ ID NO: 786010 - DNA, 20 bp, Artificial
  CRISPR gRNA sequence
cgctgtggtcagttctcagg

SEQ ID NO: 786011 - DNA, 20 bp, Artificial
  CRISPR gRNA sequence
tgtggtcagttctcaggtgg

SEQ ID NO: 786012 - DNA, 20 bp, Artificial
  CRISPR gRNA sequence
agttctcaggtggaagttct

SEQ ID NO: 786013 - DNA, 20 bp, Artificial
  CRISPR gRNA sequence
tctcaggtggaagttcttag

SEQ ID NO: 786014 - DNA, 20 bp, Artificial
  CRISPR gRNA sequence
ctcaggtggaagttcttaga

SEQ ID NO: 786015 - DNA, 20 bp, Artificial
  CRISPR gRNA sequence
aggtggaagttcttagaagg

SEQ ID NO: 786016 - DNA, 20 bp, Artificial
  CRISPR gRNA sequence
ggaagttcttagaaggaagt

SEQ ID NO: 786017 - DNA, 20 bp, Artificial
  CRISPR gRNA sequence
gaagttcttagaaggaagtc

SEQ ID NO: 786018 - DNA, 20 bp, Artificial
  CRISPR gRNA sequence
aaaacaaaacaaaaaacgta

SEQ ID NO: 786019 - DNA, 20 bp, Artificial
  CRISPR gRNA sequence
aaaacaaaaaacgtaaagac

SEQ ID NO: 786020 - DNA, 20 bp, Artificial
  CRISPR gRNA sequence
aaacgtaaagactggaccaa

SEQ ID NO: 786021 - DNA, 20 bp, Artificial
  CRISPR gRNA sequence
aagactggaccaaaagtata

SEQ ID NO: 786022 - DNA, 20 bp, Artificial
  CRISPR gRNA sequence
ctggaccaaaagtatataga

SEQ ID NO: 786023 - DNA, 20 bp, Artificial
  CRISPR gRNA sequence
accaaaagtatatagaaagc

SEQ ID NO: 786024 - DNA, 20 bp, Artificial
  CRISPR gRNA sequence
ttaacccaaattatgtgaat

SEQ ID NO: 786025 - DNA, 20 bp, Artificial
  CRISPR gRNA sequence
gtgaatgagaactgtttctt

SEQ ID NO: 786026 - DNA, 20 bp, Artificial
  CRISPR gRNA sequence
ctgtttcttgagtaccttat

SEQ ID NO: 786027 - DNA, 20 bp, Artificial
  CRISPR gRNA sequence
tatcggtaatacttaattgt

SEQ ID NO: 786028 - DNA, 20 bp, Artificial
  CRISPR gRNA sequence
atacttaattgtaagaatct

SEQ ID NO: 786029 - DNA, 20 bp, Artificial
  CRISPR gRNA sequence
gactgataaattcatccttc

SEQ ID NO: 786030 - DNA, 20 bp, Artificial
  CRISPR gRNA sequence
tcatccttctagttcccaca

SEQ ID NO: 786031 - DNA, 20 bp, Artificial
  CRISPR gRNA sequence
ttcccacatggcctaactga

SEQ ID NO: 786032 - DNA, 20 bp, Artificial
  CRISPR gRNA sequence
tcccacatggcctaactgac

SEQ ID NO: 786033 - DNA, 20 bp, Artificial
  CRISPR gRNA sequence
cccacatggcctaactgaca

SEQ ID NO: 786034 - DNA, 20 bp, Artificial
  CRISPR gRNA sequence
tgacagggtcttgcaaataa

SEQ ID NO: 786035 - DNA, 20 bp, Artificial
  CRISPR gRNA sequence
caaataacagaaacttaata

SEQ ID NO: 786036 - DNA, 20 bp, Artificial
  CRISPR gRNA sequence
aaataacagaaacttaatac

SEQ ID NO: 786037 - DNA, 20 bp, Artificial
  CRISPR gRNA sequence
gaaacttaatacaggtttgt

SEQ ID NO: 786038 - DNA, 20 bp, Artificial
  CRISPR gRNA sequence
acttaatacaggtttgtgag

SEQ ID NO: 786039 - DNA, 20 bp, Artificial
  CRISPR gRNA sequence
cttaatacaggtttgtgagt

SEQ ID NO: 786040 - DNA, 20 bp, Artificial
  CRISPR gRNA sequence
gggtgaatgaatgaataaat

SEQ ID NO: 786041 - DNA, 20 bp, Artificial
  CRISPR gRNA sequence
gaatgaatgaataaatgagt

SEQ ID NO: 786042 - DNA, 20 bp, Artificial
  CRISPR gRNA sequence
tgaatgaataaatgagtgag

SEQ ID NO: 786043 - DNA, 20 bp, Artificial
  CRISPR gRNA sequence
atgagtgagtagcactatgc

SEQ ID NO: 786044 - DNA, 20 bp, Artificial
  CRISPR gRNA sequence
tgagtgagtagcactatgct

SEQ ID NO: 786045 - DNA, 20 bp, Artificial
  CRISPR gRNA sequence
ctgggaatcatgacttcttt

SEQ ID NO: 786046 - DNA, 20 bp, Artificial
  CRISPR gRNA sequence
ggtctgctactgtttcactt

SEQ ID NO: 786047 - DNA, 20 bp, Artificial
  CRISPR gRNA sequence
gtctgctactgtttcactta

SEQ ID NO: 786048 - DNA, 20 bp, Artificial
  CRISPR gRNA sequence
tgctactgtttcacttaagg

SEQ ID NO: 786049 - DNA, 20 bp, Artificial
  CRISPR gRNA sequence
ggaagtcacttaatatctct

SEQ ID NO: 786050 - DNA, 20 bp, Artificial
  CRISPR gRNA sequence
aatgtcataatctgtgaaat

SEQ ID NO: 786051 - DNA, 20 bp, Artificial
  CRISPR gRNA sequence
atgtcataatctgtgaaatg

SEQ ID NO: 786052 - DNA, 20 bp, Artificial
  CRISPR gRNA sequence
tcataatctgtgaaatgagg

SEQ ID NO: 786053 - DNA, 20 bp, Artificial
  CRISPR gRNA sequence
aatctgtgaaatgaggtagc

SEQ ID NO: 786054 - DNA, 20 bp, Artificial
  CRISPR gRNA sequence
atctgtgaaatgaggtagct

SEQ ID NO: 786055 - DNA, 20 bp, Artificial
  CRISPR gRNA sequence
aatgaggtagctaggataca

SEQ ID NO: 786056 - DNA, 20 bp, Artificial
  CRISPR gRNA sequence
atggtctgtaaactctaacc

SEQ ID NO: 786057 - DNA, 20 bp, Artificial
  CRISPR gRNA sequence
tggtctgtaaactctaacca

SEQ ID NO: 786058 - DNA, 20 bp, Artificial
  CRISPR gRNA sequence
actgtaataactattttgta

SEQ ID NO: 786059 - DNA, 20 bp, Artificial
  CRISPR gRNA sequence
ctgtaataactattttgtaa

SEQ ID NO: 786060 - DNA, 20 bp, Artificial
  CRISPR gRNA sequence
aataactattttgtaaagga

SEQ ID NO: 786061 - DNA, 20 bp, Artificial
  CRISPR gRNA sequence
ggatagatgatatatatcta

SEQ ID NO: 786062 - DNA, 20 bp, Artificial
  CRISPR gRNA sequence
ggtatcataatccactccta

SEQ ID NO: 786063 - DNA, 20 bp, Artificial
  CRISPR gRNA sequence
gtttatctgcttgtctgcat

SEQ ID NO: 786064 - DNA, 20 bp, Artificial
  CRISPR gRNA sequence
ttatctgcttgtctgcataa

SEQ ID NO: 786065 - DNA, 20 bp, Artificial
  CRISPR gRNA sequence
tatctgcttgtctgcataag

SEQ ID NO: 786066 - DNA, 20 bp, Artificial
  CRISPR gRNA sequence
atctgcttgtctgcataaga

SEQ ID NO: 786067 - DNA, 20 bp, Artificial
  CRISPR gRNA sequence
ctgcttgtctgcataagagg

SEQ ID NO: 786068 - DNA, 20 bp, Artificial
  CRISPR gRNA sequence
tgtctgcataagagggagaa

SEQ ID NO: 786069 - DNA, 20 bp, Artificial
  CRISPR gRNA sequence
tgcataagagggagaatggc

SEQ ID NO: 786070 - DNA, 20 bp, Artificial
  CRISPR gRNA sequence
gcataagagggagaatggct

SEQ ID NO: 786071 - DNA, 20 bp, Artificial
  CRISPR gRNA sequence
ggagaatggctaggcccaaa

SEQ ID NO: 786072 - DNA, 20 bp, Artificial
  CRISPR gRNA sequence
gaatggctaggcccaaatag

SEQ ID NO: 786073 - DNA, 20 bp, Artificial
  CRISPR gRNA sequence
gctaggcccaaatagtagca

SEQ ID NO: 786074 - DNA, 20 bp, Artificial
  CRISPR gRNA sequence
cccaaatagtagcacagata

SEQ ID NO: 786075 - DNA, 20 bp, Artificial
  CRISPR gRNA sequence
aatagtagcacagataaagt

SEQ ID NO: 786076 - DNA, 20 bp, Artificial
  CRISPR gRNA sequence
gcacagataaagttagatac

SEQ ID NO: 786077 - DNA, 20 bp, Artificial
  CRISPR gRNA sequence
acaagaacaacttccacaaa

SEQ ID NO: 786078 - DNA, 20 bp, Artificial
  CRISPR gRNA sequence
gaacaacttccacaaatgga

SEQ ID NO: 786079 - DNA, 20 bp, Artificial
  CRISPR gRNA sequence
aacaacttccacaaatggaa

SEQ ID NO: 786080 - DNA, 20 bp, Artificial
  CRISPR gRNA sequence
acaacttccacaaatggaaa

SEQ ID NO: 786081 - DNA, 20 bp, Artificial
  CRISPR gRNA sequence
acttccacaaatggaaaggg

SEQ ID NO: 786082 - DNA, 20 bp, Artificial
  CRISPR gRNA sequence
atggaaagggcagtgtgtca

SEQ ID NO: 786083 - DNA, 20 bp, Artificial
  CRISPR gRNA sequence
aagggcagtgtgtcacagac

SEQ ID NO: 786084 - DNA, 20 bp, Artificial
  CRISPR gRNA sequence
agggcagtgtgtcacagaca

SEQ ID NO: 786085 - DNA, 20 bp, Artificial
  CRISPR gRNA sequence
gtgtgtcacagacaaggact

SEQ ID NO: 786086 - DNA, 20 bp, Artificial
  CRISPR gRNA sequence
tgtcacagacaaggactcag

SEQ ID NO: 786087 - DNA, 20 bp, Artificial
  CRISPR gRNA sequence
gtcacagacaaggactcagt

SEQ ID NO: 786088 - DNA, 20 bp, Artificial
  CRISPR gRNA sequence
gacaaggactcagtgggtct

SEQ ID NO: 786089 - DNA, 20 bp, Artificial
  CRISPR gRNA sequence
gactcagtgggtctgagttc

SEQ ID NO: 786090 - DNA, 20 bp, Artificial
  CRISPR gRNA sequence
agttctagctccatttctaa

SEQ ID NO: 786091 - DNA, 20 bp, Artificial
  CRISPR gRNA sequence
ctagctccatttctaacagt

SEQ ID NO: 786092 - DNA, 20 bp, Artificial
  CRISPR gRNA sequence
gttatgatatgaccttatgc

SEQ ID NO: 786093 - DNA, 20 bp, Artificial
  CRISPR gRNA sequence
tgaccttatgcaagtcactt

SEQ ID NO: 786094 - DNA, 20 bp, Artificial
  CRISPR gRNA sequence
cacttcagctcttatatcct

SEQ ID NO: 786095 - DNA, 20 bp, Artificial
  CRISPR gRNA sequence
cttcagctcttatatcctta

SEQ ID NO: 786096 - DNA, 20 bp, Artificial
  CRISPR gRNA sequence
tagagcatatccatcacatt

SEQ ID NO: 786097 - DNA, 20 bp, Artificial
  CRISPR gRNA sequence
tccatcacatttagctgtgc

SEQ ID NO: 786098 - DNA, 20 bp, Artificial
  CRISPR gRNA sequence
ccatcacatttagctgtgct

SEQ ID NO: 786099 - DNA, 20 bp, Artificial
  CRISPR gRNA sequence
atcacatttagctgtgctag

SEQ ID NO: 786100 - DNA, 20 bp, Artificial
  CRISPR gRNA sequence
gctgtgctaggagtctttga

SEQ ID NO: 786101 - DNA, 20 bp, Artificial
  CRISPR gRNA sequence
ctgtgctaggagtctttgaa

SEQ ID NO: 786102 - DNA, 20 bp, Artificial
  CRISPR gRNA sequence
ggagtctttgaaaggcaact

SEQ ID NO: 786103 - DNA, 20 bp, Artificial
  CRISPR gRNA sequence
ttgaaaggcaactaagacat

SEQ ID NO: 786104 - DNA, 20 bp, Artificial
  CRISPR gRNA sequence
aaaggcaactaagacattgg

SEQ ID NO: 786105 - DNA, 20 bp, Artificial
  CRISPR gRNA sequence
aaggcaactaagacattggt

SEQ ID NO: 786106 - DNA, 20 bp, Artificial
  CRISPR gRNA sequence
acattggtaggtgtccttta

SEQ ID NO: 786107 - DNA, 20 bp, Artificial
  CRISPR gRNA sequence
ttggtaggtgtcctttaaag

SEQ ID NO: 786108 - DNA, 20 bp, Artificial
  CRISPR gRNA sequence
tggtaggtgtcctttaaaga

SEQ ID NO: 786109 - DNA, 20 bp, Artificial
  CRISPR gRNA sequence
ggtgtcctttaaagaaggta

SEQ ID NO: 786110 - DNA, 20 bp, Artificial
  CRISPR gRNA sequence
tcgcccttcctaaacttgat

SEQ ID NO: 786111 - DNA, 20 bp, Artificial
  CRISPR gRNA sequence
cgcccttcctaaacttgata

SEQ ID NO: 786112 - DNA, 20 bp, Artificial
  CRISPR gRNA sequence
aaacttgataaggactgatg

SEQ ID NO: 786113 - DNA, 20 bp, Artificial
  CRISPR gRNA sequence
acttgataaggactgatgaa

SEQ ID NO: 786114 - DNA, 20 bp, Artificial
  CRISPR gRNA sequence
agagtcctatataatgtatt

SEQ ID NO: 786115 - DNA, 20 bp, Artificial
  CRISPR gRNA sequence
tatataatgtatttggttac

SEQ ID NO: 786116 - DNA, 20 bp, Artificial
  CRISPR gRNA sequence
atataatgtatttggttact

SEQ ID NO: 786117 - DNA, 20 bp, Artificial
  CRISPR gRNA sequence
tgtatttggttactgggatc

SEQ ID NO: 786118 - DNA, 20 bp, Artificial
  CRISPR gRNA sequence
tatttggttactgggatcta

SEQ ID NO: 786119 - DNA, 20 bp, Artificial
  CRISPR gRNA sequence
tttggttactgggatctaga

SEQ ID NO: 786120 - DNA, 20 bp, Artificial
  CRISPR gRNA sequence
ttggttactgggatctagag

SEQ ID NO: 786121 - DNA, 20 bp, Artificial
  CRISPR gRNA sequence
ttactgggatctagagaggt

SEQ ID NO: 786122 - DNA, 20 bp, Artificial
  CRISPR gRNA sequence
ctgggatctagagaggtgag

SEQ ID NO: 786123 - DNA, 20 bp, Artificial
  CRISPR gRNA sequence
tgggatctagagaggtgagt

SEQ ID NO: 786124 - DNA, 20 bp, Artificial
  CRISPR gRNA sequence
gggatctagagaggtgagtg

SEQ ID NO: 786125 - DNA, 20 bp, Artificial
  CRISPR gRNA sequence
tctagagaggtgagtgggga

SEQ ID NO: 786126 - DNA, 20 bp, Artificial
  CRISPR gRNA sequence
gtgagtggggatggttgaaa

SEQ ID NO: 786127 - DNA, 20 bp, Artificial
  CRISPR gRNA sequence
ggggatggttgaaatggctt

SEQ ID NO: 786128 - DNA, 20 bp, Artificial
  CRISPR gRNA sequence
atggttgaaatggcttcaga

SEQ ID NO: 786129 - DNA, 20 bp, Artificial
  CRISPR gRNA sequence
agtattcttcttctttttga

SEQ ID NO: 786130 - DNA, 20 bp, Artificial
  CRISPR gRNA sequence
tctttttgaaagtaatacat

SEQ ID NO: 786131 - DNA, 20 bp, Artificial
  CRISPR gRNA sequence
ctttttgaaagtaatacatc

SEQ ID NO: 786132 - DNA, 20 bp, Artificial
  CRISPR gRNA sequence
tttttgaaagtaatacatca

SEQ ID NO: 786133 - DNA, 20 bp, Artificial
  CRISPR gRNA sequence
catcagggcactcaaaaatg

SEQ ID NO: 786134 - DNA, 20 bp, Artificial
  CRISPR gRNA sequence
gggcactcaaaaatgtagtg

SEQ ID NO: 786135 - DNA, 20 bp, Artificial
  CRISPR gRNA sequence
agtgaagtacaacaaaaatt

SEQ ID NO: 786136 - DNA, 20 bp, Artificial
  CRISPR gRNA sequence
caaaaattcagaaaacataa

SEQ ID NO: 786137 - DNA, 20 bp, Artificial
  CRISPR gRNA sequence
tcagaaaacataaaagtaaa

SEQ ID NO: 786138 - DNA, 20 bp, Artificial
  CRISPR gRNA sequence
ataatccaaaaacatgatta

SEQ ID NO: 786139 - DNA, 20 bp, Artificial
  CRISPR gRNA sequence
taatccaaaaacatgattac

SEQ ID NO: 786140 - DNA, 20 bp, Artificial
  CRISPR gRNA sequence
tatttttacttctgtttttc

SEQ ID NO: 786141 - DNA, 20 bp, Artificial
  CRISPR gRNA sequence
tttttacttctgtttttctg

SEQ ID NO: 786142 - DNA, 20 bp, Artificial
  CRISPR gRNA sequence
ttttacttctgtttttctgg

SEQ ID NO: 786143 - DNA, 20 bp, Artificial
  CRISPR gRNA sequence
tacttctgtttttctggagg

SEQ ID NO: 786144 - DNA, 20 bp, Artificial
  CRISPR gRNA sequence
acttctgtttttctggagga

SEQ ID NO: 786145 - DNA, 20 bp, Artificial
  CRISPR gRNA sequence
cttctgtttttctggaggaa

SEQ ID NO: 786146 - DNA, 20 bp, Artificial
  CRISPR gRNA sequence
ttttctggaggaagggaata

SEQ ID NO: 786147 - DNA, 20 bp, Artificial
  CRISPR gRNA sequence
ctggaggaagggaatatggt

SEQ ID NO: 786148 - DNA, 20 bp, Artificial
  CRISPR gRNA sequence
tctataaataacatttttaa

SEQ ID NO: 786149 - DNA, 20 bp, Artificial
  CRISPR gRNA sequence
ctataaataacatttttaat

SEQ ID NO: 786150 - DNA, 20 bp, Artificial
  CRISPR gRNA sequence
ataggacatgaatgatacat

SEQ ID NO: 786151 - DNA, 20 bp, Artificial
  CRISPR gRNA sequence
ttttctatttttttattata

SEQ ID NO: 786152 - DNA, 20 bp, Artificial
  CRISPR gRNA sequence
ctatttttttattatataga

SEQ ID NO: 786153 - DNA, 20 bp, Artificial
  CRISPR gRNA sequence
ttccccacattattattcct

SEQ ID NO: 786154 - DNA, 20 bp, Artificial
  CRISPR gRNA sequence
acattattattcctcagaac

SEQ ID NO: 786155 - DNA, 20 bp, Artificial
  CRISPR gRNA sequence
ttattattcctcagaactag

SEQ ID NO: 786156 - DNA, 20 bp, Artificial
  CRISPR gRNA sequence
ctcagaactagaagtttaaa

SEQ ID NO: 786157 - DNA, 20 bp, Artificial
  CRISPR gRNA sequence
tagaagtttaaatggcaacg

SEQ ID NO: 786158 - DNA, 20 bp, Artificial
  CRISPR gRNA sequence
agaagtttaaatggcaacgt

SEQ ID NO: 786159 - DNA, 20 bp, Artificial
  CRISPR gRNA sequence
gaagtttaaatggcaacgta

SEQ ID NO: 786160 - DNA, 20 bp, Artificial
  CRISPR gRNA sequence
aacgtagggtctatttatta

SEQ ID NO: 786161 - DNA, 20 bp, Artificial
  CRISPR gRNA sequence
acgtagggtctatttattat

SEQ ID NO: 786162 - DNA, 20 bp, Artificial
  CRISPR gRNA sequence
ggtctatttattataggttc

SEQ ID NO: 786163 - DNA, 20 bp, Artificial
  CRISPR gRNA sequence
cagttttttccatgttgtat

SEQ ID NO: 786164 - DNA, 20 bp, Artificial
  CRISPR gRNA sequence
gttttttccatgttgtatta

SEQ ID NO: 786165 - DNA, 20 bp, Artificial
  CRISPR gRNA sequence
catgttgtattagagtaaac

SEQ ID NO: 786166 - DNA, 20 bp, Artificial
  CRISPR gRNA sequence
atgttgtattagagtaaact

SEQ ID NO: 786167 - DNA, 20 bp, Artificial
  CRISPR gRNA sequence
gagtaaactaggtaatgctg

SEQ ID NO: 786168 - DNA, 20 bp, Artificial
  CRISPR gRNA sequence
agtaaactaggtaatgctgt

SEQ ID NO: 786169 - DNA, 20 bp, Artificial
  CRISPR gRNA sequence
aatctcaatataaaaaacaa

SEQ ID NO: 786170 - DNA, 20 bp, Artificial
  CRISPR gRNA sequence
gttcatgttccatgtacatt

SEQ ID NO: 786171 - DNA, 20 bp, Artificial
  CRISPR gRNA sequence
ttcatgttccatgtacattg

SEQ ID NO: 786172 - DNA, 20 bp, Artificial
  CRISPR gRNA sequence
tcatgttccatgtacattga

SEQ ID NO: 786173 - DNA, 20 bp, Artificial
  CRISPR gRNA sequence
gttccatgtacattgagggt

SEQ ID NO: 786174 - DNA, 20 bp, Artificial
  CRISPR gRNA sequence
ccatgtacattgagggtcag

SEQ ID NO: 786175 - DNA, 20 bp, Artificial
  CRISPR gRNA sequence
catgtacattgagggtcagc

SEQ ID NO: 786176 - DNA, 20 bp, Artificial
  CRISPR gRNA sequence
atgtacattgagggtcagca

SEQ ID NO: 786177 - DNA, 20 bp, Artificial
  CRISPR gRNA sequence
tgtacattgagggtcagcag

SEQ ID NO: 786178 - DNA, 20 bp, Artificial
  CRISPR gRNA sequence
gcaggggactctgtcaattt

SEQ ID NO: 786179 - DNA, 20 bp, Artificial
  CRISPR gRNA sequence
ctctgtcaattttagtcact

SEQ ID NO: 786180 - DNA, 20 bp, Artificial
  CRISPR gRNA sequence
ctgtcaattttagtcactca

SEQ ID NO: 786181 - DNA, 20 bp, Artificial
  CRISPR gRNA sequence
attttagtcactcagagact

SEQ ID NO: 786182 - DNA, 20 bp, Artificial
  CRISPR gRNA sequence
cactcagagactgagactga

SEQ ID NO: 786183 - DNA, 20 bp, Artificial
  CRISPR gRNA sequence
ctcagagactgagactgatg

SEQ ID NO: 786184 - DNA, 20 bp, Artificial
  CRISPR gRNA sequence
ctgatggagcaattactacc

SEQ ID NO: 786185 - DNA, 20 bp, Artificial
  CRISPR gRNA sequence
attactacctagaatgttac

SEQ ID NO: 786186 - DNA, 20 bp, Artificial
  CRISPR gRNA sequence
aatgttactggttaccatgc

SEQ ID NO: 786187 - DNA, 20 bp, Artificial
  CRISPR gRNA sequence
ttactggttaccatgccaga

SEQ ID NO: 786188 - DNA, 20 bp, Artificial
  CRISPR gRNA sequence
gttaccatgccagatggata

SEQ ID NO: 786189 - DNA, 20 bp, Artificial
  CRISPR gRNA sequence
ccagatggataaagaaaata

SEQ ID NO: 786190 - DNA, 20 bp, Artificial
  CRISPR gRNA sequence
tggataaagaaaatatggca

SEQ ID NO: 786191 - DNA, 20 bp, Artificial
  CRISPR gRNA sequence
caactcttacatcttctacc

SEQ ID NO: 786192 - DNA, 20 bp, Artificial
  CRISPR gRNA sequence
tgcttacatttaattgacca

SEQ ID NO: 786193 - DNA, 20 bp, Artificial
  CRISPR gRNA sequence
tacatttaattgaccaaagc

SEQ ID NO: 786194 - DNA, 20 bp, Artificial
  CRISPR gRNA sequence
acttaactacaaattaatca

SEQ ID NO: 786195 - DNA, 20 bp, Artificial
  CRISPR gRNA sequence
ttaactacaaattaatcaca

SEQ ID NO: 786196 - DNA, 20 bp, Artificial
  CRISPR gRNA sequence
actacaaattaatcacagag

SEQ ID NO: 786197 - DNA, 20 bp, Artificial
  CRISPR gRNA sequence
gcaattctatcatgtgcaca

SEQ ID NO: 786198 - DNA, 20 bp, Artificial
  CRISPR gRNA sequence
caattctatcatgtgcacaa

SEQ ID NO: 786199 - DNA, 20 bp, Artificial
  CRISPR gRNA sequence
tctatcatgtgcacaaaggc

SEQ ID NO: 786200 - DNA, 20 bp, Artificial
  CRISPR gRNA sequence
tatcatgtgcacaaaggcaa

SEQ ID NO: 786201 - DNA, 20 bp, Artificial
  CRISPR gRNA sequence
gtgcacaaaggcaagagatc

SEQ ID NO: 786202 - DNA, 20 bp, Artificial
  CRISPR gRNA sequence
tgcacaaaggcaagagatcc

SEQ ID NO: 786203 - DNA, 20 bp, Artificial
  CRISPR gRNA sequence
aaggcaagagatccaggaaa

SEQ ID NO: 786204 - DNA, 20 bp, Artificial
  CRISPR gRNA sequence
agatccaggaaatggtgaaa

SEQ ID NO: 786205 - DNA, 20 bp, Artificial
  CRISPR gRNA sequence
gcgctaatactgaactctat

SEQ ID NO: 786206 - DNA, 20 bp, Artificial
  CRISPR gRNA sequence
cgctaatactgaactctatt

SEQ ID NO: 786207 - DNA, 20 bp, Artificial
  CRISPR gRNA sequence
actctattaggcattttcac

SEQ ID NO: 786208 - DNA, 20 bp, Artificial
  CRISPR gRNA sequence
tattaggcattttcacaagt

SEQ ID NO: 786209 - DNA, 20 bp, Artificial
  CRISPR gRNA sequence
attaggcattttcacaagtc

SEQ ID NO: 786210 - DNA, 20 bp, Artificial
  CRISPR gRNA sequence
tcacaagtcaggtcttgctt

SEQ ID NO: 786211 - DNA, 20 bp, Artificial
  CRISPR gRNA sequence
tcaggtcttgcttcagttgc

SEQ ID NO: 786212 - DNA, 20 bp, Artificial
  CRISPR gRNA sequence
gtcttgcttcagttgctggt

SEQ ID NO: 786213 - DNA, 20 bp, Artificial
  CRISPR gRNA sequence
gcttcagttgctggttagtg

SEQ ID NO: 786214 - DNA, 20 bp, Artificial
  CRISPR gRNA sequence
gctggttagtgaagcaaaac

SEQ ID NO: 786215 - DNA, 20 bp, Artificial
  CRISPR gRNA sequence
gttagtgaagcaaaaccagc

SEQ ID NO: 786216 - DNA, 20 bp, Artificial
  CRISPR gRNA sequence
cagcaagccctgtgcttctt

SEQ ID NO: 786217 - DNA, 20 bp, Artificial
  CRISPR gRNA sequence
aagccctgtgcttcttaagt

SEQ ID NO: 786218 - DNA, 20 bp, Artificial
  CRISPR gRNA sequence
ccctgtgcttcttaagttgg

SEQ ID NO: 786219 - DNA, 20 bp, Artificial
  CRISPR gRNA sequence
cctgtgcttcttaagttgga

SEQ ID NO: 786220 - DNA, 20 bp, Artificial
  CRISPR gRNA sequence
ctgtgcttcttaagttggaa

SEQ ID NO: 786221 - DNA, 20 bp, Artificial
  CRISPR gRNA sequence
gaaaatattcatctgaataa

SEQ ID NO: 786222 - DNA, 20 bp, Artificial
  CRISPR gRNA sequence
catctgaataaaagtcttgt

SEQ ID NO: 786223 - DNA, 20 bp, Artificial
  CRISPR gRNA sequence
ctgaataaaagtcttgtaag

SEQ ID NO: 786224 - DNA, 20 bp, Artificial
  CRISPR gRNA sequence
gtcttgtaagaagtacatgc

SEQ ID NO: 786225 - DNA, 20 bp, Artificial
  CRISPR gRNA sequence
tcttgtaagaagtacatgca

SEQ ID NO: 786226 - DNA, 20 bp, Artificial
  CRISPR gRNA sequence
cttgtaagaagtacatgcaa

SEQ ID NO: 786227 - DNA, 20 bp, Artificial
  CRISPR gRNA sequence
gtacatgcaagggacatgtc

SEQ ID NO: 786228 - DNA, 20 bp, Artificial
  CRISPR gRNA sequence
tacatgcaagggacatgtcc

SEQ ID NO: 786229 - DNA, 20 bp, Artificial
  CRISPR gRNA sequence
gcaagggacatgtccaggct

SEQ ID NO: 786230 - DNA, 20 bp, Artificial
  CRISPR gRNA sequence
acatgtccaggctaagtccc

SEQ ID NO: 786231 - DNA, 20 bp, Artificial
  CRISPR gRNA sequence
gtcccaagactccatctccc

SEQ ID NO: 786232 - DNA, 20 bp, Artificial
  CRISPR gRNA sequence
actccatctcccaagatgcc

SEQ ID NO: 786233 - DNA, 20 bp, Artificial
  CRISPR gRNA sequence
aagatgccgagtcacaaaat

SEQ ID NO: 786234 - DNA, 20 bp, Artificial
  CRISPR gRNA sequence
gatgccgagtcacaaaatga

SEQ ID NO: 786235 - DNA, 20 bp, Artificial
  CRISPR gRNA sequence
cgagtcacaaaatgagagtg

SEQ ID NO: 786236 - DNA, 20 bp, Artificial
  CRISPR gRNA sequence
gagtcacaaaatgagagtgc

SEQ ID NO: 786237 - DNA, 20 bp, Artificial
  CRISPR gRNA sequence
cacaaaatgagagtgcggga

SEQ ID NO: 786238 - DNA, 20 bp, Artificial
  CRISPR gRNA sequence
tgagagtgcgggatggctcc

SEQ ID NO: 786239 - DNA, 20 bp, Artificial
  CRISPR gRNA sequence
gagagtgcgggatggctccc

SEQ ID NO: 786240 - DNA, 20 bp, Artificial
  CRISPR gRNA sequence
agtgcgggatggctcccggg

SEQ ID NO: 786241 - DNA, 20 bp, Artificial
  CRISPR gRNA sequence
gggatggctcccgggcagcc

SEQ ID NO: 786242 - DNA, 20 bp, Artificial
  CRISPR gRNA sequence
gatggctcccgggcagccta

SEQ ID NO: 786243 - DNA, 20 bp, Artificial
  CRISPR gRNA sequence
gctgtacactctcctcataa

SEQ ID NO: 786244 - DNA, 20 bp, Artificial
  CRISPR gRNA sequence
tacactctcctcataatgga

SEQ ID NO: 786245 - DNA, 20 bp, Artificial
  CRISPR gRNA sequence
ctcctcataatggatggttt

SEQ ID NO: 786246 - DNA, 20 bp, Artificial
  CRISPR gRNA sequence
tcctcataatggatggtttt

SEQ ID NO: 786247 - DNA, 20 bp, Artificial
  CRISPR gRNA sequence
ataatggatggttttgggat

SEQ ID NO: 786248 - DNA, 20 bp, Artificial
  CRISPR gRNA sequence
tggatggttttgggatgaga

SEQ ID NO: 786249 - DNA, 20 bp, Artificial
  CRISPR gRNA sequence
gttttgggatgagatagaac

SEQ ID NO: 786250 - DNA, 20 bp, Artificial
  CRISPR gRNA sequence
ttttgggatgagatagaact

SEQ ID NO: 786251 - DNA, 20 bp, Artificial
  CRISPR gRNA sequence
gggatgagatagaactggga

SEQ ID NO: 786252 - DNA, 20 bp, Artificial
  CRISPR gRNA sequence
atgagatagaactgggatgg

SEQ ID NO: 786253 - DNA, 20 bp, Artificial
  CRISPR gRNA sequence
gagatagaactgggatggca

SEQ ID NO: 786254 - DNA, 20 bp, Artificial
  CRISPR gRNA sequence
agaactgggatggcagagaa

SEQ ID NO: 786255 - DNA, 20 bp, Artificial
  CRISPR gRNA sequence
gaactgggatggcagagaat

SEQ ID NO: 786256 - DNA, 20 bp, Artificial
  CRISPR gRNA sequence
gggatggcagagaatgggtg

SEQ ID NO: 786257 - DNA, 20 bp, Artificial
  CRISPR gRNA sequence
ggatggcagagaatgggtgt

SEQ ID NO: 786258 - DNA, 20 bp, Artificial
  CRISPR gRNA sequence
gaatgggtgtgggaatgtca

SEQ ID NO: 786259 - DNA, 20 bp, Artificial
  CRISPR gRNA sequence
tgtgggaatgtcaaagccct

SEQ ID NO: 786260 - DNA, 20 bp, Artificial
  CRISPR gRNA sequence
tgtcaaagccctgagctgtc

SEQ ID NO: 786261 - DNA, 20 bp, Artificial
  CRISPR gRNA sequence
gtcaaagccctgagctgtct

SEQ ID NO: 786262 - DNA, 20 bp, Artificial
  CRISPR gRNA sequence
gccctgagctgtctgggcct

SEQ ID NO: 786263 - DNA, 20 bp, Artificial
  CRISPR gRNA sequence
caatattaaaatcttaacca

SEQ ID NO: 786264 - DNA, 20 bp, Artificial
  CRISPR gRNA sequence
atcttaaccatggcaatttc

SEQ ID NO: 786265 - DNA, 20 bp, Artificial
  CRISPR gRNA sequence
tcttaaccatggcaatttct

SEQ ID NO: 786266 - DNA, 20 bp, Artificial
  CRISPR gRNA sequence
ccatggcaatttctaggcaa

SEQ ID NO: 786267 - DNA, 20 bp, Artificial
  CRISPR gRNA sequence
tatttttatactcataaaat

SEQ ID NO: 786268 - DNA, 20 bp, Artificial
  CRISPR gRNA sequence
gttgtacgttattctttttt

SEQ ID NO: 786269 - DNA, 20 bp, Artificial
  CRISPR gRNA sequence
gttattcttttttgagttga

SEQ ID NO: 786270 - DNA, 20 bp, Artificial
  CRISPR gRNA sequence
tttattttaatattgttttt

SEQ ID NO: 786271 - DNA, 20 bp, Artificial
  CRISPR gRNA sequence
taatattgttttttagtatt

SEQ ID NO: 786272 - DNA, 20 bp, Artificial
  CRISPR gRNA sequence
ttttagtatttagtcaaatt

SEQ ID NO: 786273 - DNA, 20 bp, Artificial
  CRISPR gRNA sequence
tagtcaaatttggtcaaaat

SEQ ID NO: 786274 - DNA, 20 bp, Artificial
  CRISPR gRNA sequence
tttattatataataaactat

SEQ ID NO: 786275 - DNA, 20 bp, Artificial
  CRISPR gRNA sequence
ctataagaaacattgataaa

SEQ ID NO: 786276 - DNA, 20 bp, Artificial
  CRISPR gRNA sequence
aagaaacattgataaacgga

SEQ ID NO: 786277 - DNA, 20 bp, Artificial
  CRISPR gRNA sequence
aacattgataaacggacaga

SEQ ID NO: 786278 - DNA, 20 bp, Artificial
  CRISPR gRNA sequence
gacaaatatcaaataccata

SEQ ID NO: 786279 - DNA, 20 bp, Artificial
  CRISPR gRNA sequence
tcccactttattatattgac

SEQ ID NO: 786280 - DNA, 20 bp, Artificial
  CRISPR gRNA sequence
cccactttattatattgacc

SEQ ID NO: 786281 - DNA, 20 bp, Artificial
  CRISPR gRNA sequence
actttattatattgaccagg

SEQ ID NO: 786282 - DNA, 20 bp, Artificial
  CRISPR gRNA sequence
gaccaggtggacctaaaata

SEQ ID NO: 786283 - DNA, 20 bp, Artificial
  CRISPR gRNA sequence
ggacctaaaatatagacaca

SEQ ID NO: 786284 - DNA, 20 bp, Artificial
  CRISPR gRNA sequence
cctaaaatatagacacatag

SEQ ID NO: 786285 - DNA, 20 bp, Artificial
  CRISPR gRNA sequence
aaaatatagacacatagaag

SEQ ID NO: 786286 - DNA, 20 bp, Artificial
  CRISPR gRNA sequence
tatagacacatagaagcagc

SEQ ID NO: 786287 - DNA, 20 bp, Artificial
  CRISPR gRNA sequence
aacgctgtaatcatgtgctt

SEQ ID NO: 786288 - DNA, 20 bp, Artificial
  CRISPR gRNA sequence
cgctgtaatcatgtgcttaa

SEQ ID NO: 786289 - DNA, 20 bp, Artificial
  CRISPR gRNA sequence
tgtaatcatgtgcttaagag

SEQ ID NO: 786290 - DNA, 20 bp, Artificial
  CRISPR gRNA sequence
tcatgtgcttaagagtggta

SEQ ID NO: 786291 - DNA, 20 bp, Artificial
  CRISPR gRNA sequence
tatagattgtgtgtacaatg

SEQ ID NO: 786292 - DNA, 20 bp, Artificial
  CRISPR gRNA sequence
tagattgtgtgtacaatgca

SEQ ID NO: 786293 - DNA, 20 bp, Artificial
  CRISPR gRNA sequence
agattgtgtgtacaatgcag

SEQ ID NO: 786294 - DNA, 20 bp, Artificial
  CRISPR gRNA sequence
caatgcagaggaaaaataaa

SEQ ID NO: 786295 - DNA, 20 bp, Artificial
  CRISPR gRNA sequence
aatgcagaggaaaaataaaa

SEQ ID NO: 786296 - DNA, 20 bp, Artificial
  CRISPR gRNA sequence
gaggaaaaataaaaaggtat

SEQ ID NO: 786297 - DNA, 20 bp, Artificial
  CRISPR gRNA sequence
gaaaaataaaaaggtatgag

SEQ ID NO: 786298 - DNA, 20 bp, Artificial
  CRISPR gRNA sequence
aaaaataaaaaggtatgagt

SEQ ID NO: 786299 - DNA, 20 bp, Artificial
  CRISPR gRNA sequence
aaaataaaaaggtatgagtg

SEQ ID NO: 786300 - DNA, 20 bp, Artificial
  CRISPR gRNA sequence
aaataaaaaggtatgagtgg

SEQ ID NO: 786301 - DNA, 20 bp, Artificial
  CRISPR gRNA sequence
ataaaaaggtatgagtgggg

SEQ ID NO: 786302 - DNA, 20 bp, Artificial
  CRISPR gRNA sequence
aaaaaggtatgagtggggga

SEQ ID NO: 786303 - DNA, 20 bp, Artificial
  CRISPR gRNA sequence
aaaggtatgagtgggggaga

SEQ ID NO: 786304 - DNA, 20 bp, Artificial
  CRISPR gRNA sequence
gagtgggggagagagtctta

SEQ ID NO: 786305 - DNA, 20 bp, Artificial
  CRISPR gRNA sequence
gggagagagtcttacagatt

SEQ ID NO: 786306 - DNA, 20 bp, Artificial
  CRISPR gRNA sequence
gagagtcttacagattaagc

SEQ ID NO: 786307 - DNA, 20 bp, Artificial
  CRISPR gRNA sequence
gagtcttacagattaagcaa

SEQ ID NO: 786308 - DNA, 20 bp, Artificial
  CRISPR gRNA sequence
gtcttacagattaagcaaga

SEQ ID NO: 786309 - DNA, 20 bp, Artificial
  CRISPR gRNA sequence
gcaagagagtgttgtgtatg

SEQ ID NO: 786310 - DNA, 20 bp, Artificial
  CRISPR gRNA sequence
caagagagtgttgtgtatgt

SEQ ID NO: 786311 - DNA, 20 bp, Artificial
  CRISPR gRNA sequence
agagtgttgtgtatgtaggc

SEQ ID NO: 786312 - DNA, 20 bp, Artificial
  CRISPR gRNA sequence
gagtgttgtgtatgtaggct

SEQ ID NO: 786313 - DNA, 20 bp, Artificial
  CRISPR gRNA sequence
ttgtgtatgtaggctgggca

SEQ ID NO: 786314 - DNA, 20 bp, Artificial
  CRISPR gRNA sequence
tgtatgtaggctgggcacag

SEQ ID NO: 786315 - DNA, 20 bp, Artificial
  CRISPR gRNA sequence
tgggcacagtggcttacgcc

SEQ ID NO: 786316 - DNA, 20 bp, Artificial
  CRISPR gRNA sequence
gtggcttacgcctggaatcc

SEQ ID NO: 786317 - DNA, 20 bp, Artificial
  CRISPR gRNA sequence
cgcctggaatcccagcactt

SEQ ID NO: 786318 - DNA, 20 bp, Artificial
  CRISPR gRNA sequence
gcctggaatcccagcacttt

SEQ ID NO: 786319 - DNA, 20 bp, Artificial
  CRISPR gRNA sequence
ctggaatcccagcactttgg

SEQ ID NO: 786320 - DNA, 20 bp, Artificial
  CRISPR gRNA sequence
tggaatcccagcactttggg

SEQ ID NO: 786321 - DNA, 20 bp, Artificial
  CRISPR gRNA sequence
tcccagcactttgggaggcc

SEQ ID NO: 786322 - DNA, 20 bp, Artificial
  CRISPR gRNA sequence
cccagcactttgggaggcca

SEQ ID NO: 786323 - DNA, 20 bp, Artificial
  CRISPR gRNA sequence
agcactttgggaggccaagg

SEQ ID NO: 786324 - DNA, 20 bp, Artificial
  CRISPR gRNA sequence
gcactttgggaggccaaggc

SEQ ID NO: 786325 - DNA, 20 bp, Artificial
  CRISPR gRNA sequence
actttgggaggccaaggcag

SEQ ID NO: 786326 - DNA, 20 bp, Artificial
  CRISPR gRNA sequence
ctttgggaggccaaggcagg

SEQ ID NO: 786327 - DNA, 20 bp, Artificial
  CRISPR gRNA sequence
ccaaggcaggaggattgctt

SEQ ID NO: 786328 - DNA, 20 bp, Artificial
  CRISPR gRNA sequence
gcaggaggattgcttgagcc

SEQ ID NO: 786329 - DNA, 20 bp, Artificial
  CRISPR gRNA sequence
caggaggattgcttgagccg

SEQ ID NO: 786330 - DNA, 20 bp, Artificial
  CRISPR gRNA sequence
ggaggattgcttgagccgag

SEQ ID NO: 786331 - DNA, 20 bp, Artificial
  CRISPR gRNA sequence
ttgcttgagccgaggagttt

SEQ ID NO: 786332 - DNA, 20 bp, Artificial
  CRISPR gRNA sequence
cgaggagtttgagaccatcc

SEQ ID NO: 786333 - DNA, 20 bp, Artificial
  CRISPR gRNA sequence
gaggagtttgagaccatcct

SEQ ID NO: 786334 - DNA, 20 bp, Artificial
  CRISPR gRNA sequence
tgagaccatcctgggcaaca

SEQ ID NO: 786335 - DNA, 20 bp, Artificial
  CRISPR gRNA sequence
accatcctgggcaacatagt

SEQ ID NO: 786336 - DNA, 20 bp, Artificial
  CRISPR gRNA sequence
tgggcaacatagtgagaccc

SEQ ID NO: 786337 - DNA, 20 bp, Artificial
  CRISPR gRNA sequence
aaaaataaaaataaaaaatc

SEQ ID NO: 786338 - DNA, 20 bp, Artificial
  CRISPR gRNA sequence
aaaataaaaataaaaaatcc

SEQ ID NO: 786339 - DNA, 20 bp, Artificial
  CRISPR gRNA sequence
aaaaataaaaaatccaggta

SEQ ID NO: 786340 - DNA, 20 bp, Artificial
  CRISPR gRNA sequence
aataaaaaatccaggtacgg

SEQ ID NO: 786341 - DNA, 20 bp, Artificial
  CRISPR gRNA sequence
ggtacggtggcatgcacctg

SEQ ID NO: 786342 - DNA, 20 bp, Artificial
  CRISPR gRNA sequence
gtggcatgcacctgtagtcc

SEQ ID NO: 786343 - DNA, 20 bp, Artificial
  CRISPR gRNA sequence
cacctgtagtcccagctact

SEQ ID NO: 786344 - DNA, 20 bp, Artificial
  CRISPR gRNA sequence
acctgtagtcccagctactc

SEQ ID NO: 786345 - DNA, 20 bp, Artificial
  CRISPR gRNA sequence
ctgtagtcccagctactcag

SEQ ID NO: 786346 - DNA, 20 bp, Artificial
  CRISPR gRNA sequence
tgtagtcccagctactcagg

SEQ ID NO: 786347 - DNA, 20 bp, Artificial
  CRISPR gRNA sequence
tcccagctactcaggaggct

SEQ ID NO: 786348 - DNA, 20 bp, Artificial
  CRISPR gRNA sequence
cccagctactcaggaggctg

SEQ ID NO: 786349 - DNA, 20 bp, Artificial
  CRISPR gRNA sequence
agctactcaggaggctgagg

SEQ ID NO: 786350 - DNA, 20 bp, Artificial
  CRISPR gRNA sequence
gctactcaggaggctgaggt

SEQ ID NO: 786351 - DNA, 20 bp, Artificial
  CRISPR gRNA sequence
actcaggaggctgaggtggg

SEQ ID NO: 786352 - DNA, 20 bp, Artificial
  CRISPR gRNA sequence
aggaggctgaggtgggaaga

SEQ ID NO: 786353 - DNA, 20 bp, Artificial
  CRISPR gRNA sequence
ctgaggtgggaagatagctt

SEQ ID NO: 786354 - DNA, 20 bp, Artificial
  CRISPR gRNA sequence
ggaagatagcttgagtccaa

SEQ ID NO: 786355 - DNA, 20 bp, Artificial
  CRISPR gRNA sequence
atagcttgagtccaaaagtt

SEQ ID NO: 786356 - DNA, 20 bp, Artificial
  CRISPR gRNA sequence
tagcttgagtccaaaagttg

SEQ ID NO: 786357 - DNA, 20 bp, Artificial
  CRISPR gRNA sequence
gagtccaaaagttgaggctg

SEQ ID NO: 786358 - DNA, 20 bp, Artificial
  CRISPR gRNA sequence
ccaaaagttgaggctgcagt

SEQ ID NO: 786359 - DNA, 20 bp, Artificial
  CRISPR gRNA sequence
gttgaggctgcagtgagcca

SEQ ID NO: 786360 - DNA, 20 bp, Artificial
  CRISPR gRNA sequence
cataccactgcactccaacc

SEQ ID NO: 786361 - DNA, 20 bp, Artificial
  CRISPR gRNA sequence
ataccactgcactccaacct

SEQ ID NO: 786362 - DNA, 20 bp, Artificial
  CRISPR gRNA sequence
ctgcactccaacctgggtga

SEQ ID NO: 786363 - DNA, 20 bp, Artificial
  CRISPR gRNA sequence
gcactccaacctgggtgata

SEQ ID NO: 786364 - DNA, 20 bp, Artificial
  CRISPR gRNA sequence
tccaacctgggtgatagagc

SEQ ID NO: 786365 - DNA, 20 bp, Artificial
  CRISPR gRNA sequence
aattgaattaaattttaaaa

SEQ ID NO: 786366 - DNA, 20 bp, Artificial
  CRISPR gRNA sequence
tgaattaaattttaaaaaag

SEQ ID NO: 786367 - DNA, 20 bp, Artificial
  CRISPR gRNA sequence
aattaaattttaaaaaagca

SEQ ID NO: 786368 - DNA, 20 bp, Artificial
  CRISPR gRNA sequence
aattttaaaaaagcagagtg

SEQ ID NO: 786369 - DNA, 20 bp, Artificial
  CRISPR gRNA sequence
aaaaagcagagtgtagtgta

SEQ ID NO: 786370 - DNA, 20 bp, Artificial
  CRISPR gRNA sequence
aaaagcagagtgtagtgtat

SEQ ID NO: 786371 - DNA, 20 bp, Artificial
  CRISPR gRNA sequence
cagagtgtagtgtatgggtg

SEQ ID NO: 786372 - DNA, 20 bp, Artificial
  CRISPR gRNA sequence
tagtgtatgggtgtggattc

SEQ ID NO: 786373 - DNA, 20 bp, Artificial
  CRISPR gRNA sequence
atgggtgtggattctggact

SEQ ID NO: 786374 - DNA, 20 bp, Artificial
  CRISPR gRNA sequence
ggattctggacttggacacc

SEQ ID NO: 786375 - DNA, 20 bp, Artificial
  CRISPR gRNA sequence
ggattgctgaatcaatttat

SEQ ID NO: 786376 - DNA, 20 bp, Artificial
  CRISPR gRNA sequence
tttattggcccttatattat

SEQ ID NO: 786377 - DNA, 20 bp, Artificial
  CRISPR gRNA sequence
atattattagctatatacct

SEQ ID NO: 786378 - DNA, 20 bp, Artificial
  CRISPR gRNA sequence
tattattagctatatacctt

SEQ ID NO: 786379 - DNA, 20 bp, Artificial
  CRISPR gRNA sequence
attagctatataccttgggc

SEQ ID NO: 786380 - DNA, 20 bp, Artificial
  CRISPR gRNA sequence
gctatataccttgggcaagt

SEQ ID NO: 786381 - DNA, 20 bp, Artificial
  CRISPR gRNA sequence
tttcttcctcacctataaaa

SEQ ID NO: 786382 - DNA, 20 bp, Artificial
  CRISPR gRNA sequence
ttcttcctcacctataaaat

SEQ ID NO: 786383 - DNA, 20 bp, Artificial
  CRISPR gRNA sequence
ttcctcacctataaaatggg

SEQ ID NO: 786384 - DNA, 20 bp, Artificial
  CRISPR gRNA sequence
ctcacctataaaatgggaag

SEQ ID NO: 786385 - DNA, 20 bp, Artificial
  CRISPR gRNA sequence
tcacctataaaatgggaagc

SEQ ID NO: 786386 - DNA, 20 bp, Artificial
  CRISPR gRNA sequence
cacctataaaatgggaagca

SEQ ID NO: 786387 - DNA, 20 bp, Artificial
  CRISPR gRNA sequence
cctataaaatgggaagcagg

SEQ ID NO: 786388 - DNA, 20 bp, Artificial
  CRISPR gRNA sequence
taaaatgggaagcagggagt

SEQ ID NO: 786389 - DNA, 20 bp, Artificial
  CRISPR gRNA sequence
gaagcagggagtaagtactt

SEQ ID NO: 786390 - DNA, 20 bp, Artificial
  CRISPR gRNA sequence
agcagggagtaagtacttca

SEQ ID NO: 786391 - DNA, 20 bp, Artificial
  CRISPR gRNA sequence
gcagggagtaagtacttcag

SEQ ID NO: 786392 - DNA, 20 bp, Artificial
  CRISPR gRNA sequence
cagggagtaagtacttcaga

SEQ ID NO: 786393 - DNA, 20 bp, Artificial
  CRISPR gRNA sequence
gtacttcagagggctactgt

SEQ ID NO: 786394 - DNA, 20 bp, Artificial
  CRISPR gRNA sequence
tacttcagagggctactgtg

SEQ ID NO: 786395 - DNA, 20 bp, Artificial
  CRISPR gRNA sequence
ggctactgtgaggattaaat

SEQ ID NO: 786396 - DNA, 20 bp, Artificial
  CRISPR gRNA sequence
actgtgaggattaaatgagc

SEQ ID NO: 786397 - DNA, 20 bp, Artificial
  CRISPR gRNA sequence
taaacacacttctaatgtct

SEQ ID NO: 786398 - DNA, 20 bp, Artificial
  CRISPR gRNA sequence
acacttctaatgtcttagaa

SEQ ID NO: 786399 - DNA, 20 bp, Artificial
  CRISPR gRNA sequence
cttctaatgtcttagaacag

SEQ ID NO: 786400 - DNA, 20 bp, Artificial
  CRISPR gRNA sequence
aatgtcttagaacagaagcc

SEQ ID NO: 786401 - DNA, 20 bp, Artificial
  CRISPR gRNA sequence
agcctggtgttataataata

SEQ ID NO: 786402 - DNA, 20 bp, Artificial
  CRISPR gRNA sequence
ttactcattactgtatctta

SEQ ID NO: 786403 - DNA, 20 bp, Artificial
  CRISPR gRNA sequence
ctcattactgtatcttaaag

SEQ ID NO: 786404 - DNA, 20 bp, Artificial
  CRISPR gRNA sequence
cttaaagtagaccatgccaa

SEQ ID NO: 786405 - DNA, 20 bp, Artificial
  CRISPR gRNA sequence
aagtagaccatgccaaaagt

SEQ ID NO: 786406 - DNA, 20 bp, Artificial
  CRISPR gRNA sequence
agtagaccatgccaaaagtt

SEQ ID NO: 786407 - DNA, 20 bp, Artificial
  CRISPR gRNA sequence
accatgccaaaagttgggat

SEQ ID NO: 786408 - DNA, 20 bp, Artificial
  CRISPR gRNA sequence
ccatgccaaaagttgggatt

SEQ ID NO: 786409 - DNA, 20 bp, Artificial
  CRISPR gRNA sequence
ccaaaagttgggattgggac

SEQ ID NO: 786410 - DNA, 20 bp, Artificial
  CRISPR gRNA sequence
aagttgggattgggacaagt

SEQ ID NO: 786411 - DNA, 20 bp, Artificial
  CRISPR gRNA sequence
ttgggattgggacaagtaag

SEQ ID NO: 786412 - DNA, 20 bp, Artificial
  CRISPR gRNA sequence
tgggattgggacaagtaaga

SEQ ID NO: 786413 - DNA, 20 bp, Artificial
  CRISPR gRNA sequence
ttgggacaagtaagaaggaa

SEQ ID NO: 786414 - DNA, 20 bp, Artificial
  CRISPR gRNA sequence
tgggacaagtaagaaggaat

SEQ ID NO: 786415 - DNA, 20 bp, Artificial
  CRISPR gRNA sequence
gggacaagtaagaaggaata

SEQ ID NO: 786416 - DNA, 20 bp, Artificial
  CRISPR gRNA sequence
gacaagtaagaaggaatagg

SEQ ID NO: 786417 - DNA, 20 bp, Artificial
  CRISPR gRNA sequence
acaagtaagaaggaataggg

SEQ ID NO: 786418 - DNA, 20 bp, Artificial
  CRISPR gRNA sequence
tccaaaaaaataaccaacat

SEQ ID NO: 786419 - DNA, 20 bp, Artificial
  CRISPR gRNA sequence
aaaaataaccaacatgagca

SEQ ID NO: 786420 - DNA, 20 bp, Artificial
  CRISPR gRNA sequence
aaccaacatgagcaaagcca

SEQ ID NO: 786421 - DNA, 20 bp, Artificial
  CRISPR gRNA sequence
caacatgagcaaagccacag

SEQ ID NO: 786422 - DNA, 20 bp, Artificial
  CRISPR gRNA sequence
catgagcaaagccacagaag

SEQ ID NO: 786423 - DNA, 20 bp, Artificial
  CRISPR gRNA sequence
atgagcaaagccacagaagt

SEQ ID NO: 786424 - DNA, 20 bp, Artificial
  CRISPR gRNA sequence
aaagccacagaagtgggaat

SEQ ID NO: 786425 - DNA, 20 bp, Artificial
  CRISPR gRNA sequence
cagaagtgggaatgagctca

SEQ ID NO: 786426 - DNA, 20 bp, Artificial
  CRISPR gRNA sequence
aagtgggaatgagctcatgg

SEQ ID NO: 786427 - DNA, 20 bp, Artificial
  CRISPR gRNA sequence
tgggaatgagctcatggcag

SEQ ID NO: 786428 - DNA, 20 bp, Artificial
  CRISPR gRNA sequence
tgagctcatggcagtggtgt

SEQ ID NO: 786429 - DNA, 20 bp, Artificial
  CRISPR gRNA sequence
gctcatggcagtggtgttgg

SEQ ID NO: 786430 - DNA, 20 bp, Artificial
  CRISPR gRNA sequence
tcatggcagtggtgttggtg

SEQ ID NO: 786431 - DNA, 20 bp, Artificial
  CRISPR gRNA sequence
tggcagtggtgttggtggag

SEQ ID NO: 786432 - DNA, 20 bp, Artificial
  CRISPR gRNA sequence
ttggtggagcagctcaactt

SEQ ID NO: 786433 - DNA, 20 bp, Artificial
  CRISPR gRNA sequence
tggtggagcagctcaacttg

SEQ ID NO: 786434 - DNA, 20 bp, Artificial
  CRISPR gRNA sequence
gagcagctcaacttgaggaa

SEQ ID NO: 786435 - DNA, 20 bp, Artificial
  CRISPR gRNA sequence
cttgaggaaaagttttgttg

SEQ ID NO: 786436 - DNA, 20 bp, Artificial
  CRISPR gRNA sequence
tgaggaaaagttttgttgaa

SEQ ID NO: 786437 - DNA, 20 bp, Artificial
  CRISPR gRNA sequence
ggaaaagttttgttgaagag

SEQ ID NO: 786438 - DNA, 20 bp, Artificial
  CRISPR gRNA sequence
aaagttttgttgaagagtgg

SEQ ID NO: 786439 - DNA, 20 bp, Artificial
  CRISPR gRNA sequence
tttgttgaagagtggtagat

SEQ ID NO: 786440 - DNA, 20 bp, Artificial
  CRISPR gRNA sequence
ttgaagagtggtagatgagt

SEQ ID NO: 786441 - DNA, 20 bp, Artificial
  CRISPR gRNA sequence
gagtggtagatgagttggct

SEQ ID NO: 786442 - DNA, 20 bp, Artificial
  CRISPR gRNA sequence
tgagttggcttagtgaaatg

SEQ ID NO: 786443 - DNA, 20 bp, Artificial
  CRISPR gRNA sequence
ttggcttagtgaaatgtggc

SEQ ID NO: 786444 - DNA, 20 bp, Artificial
  CRISPR gRNA sequence
gaaatgtggctagttgtcaa

SEQ ID NO: 786445 - DNA, 20 bp, Artificial
  CRISPR gRNA sequence
aaatgtggctagttgtcaaa

SEQ ID NO: 786446 - DNA, 20 bp, Artificial
  CRISPR gRNA sequence
tcaaaaggcctgaaaaactc

SEQ ID NO: 786447 - DNA, 20 bp, Artificial
  CRISPR gRNA sequence
caaaaggcctgaaaaactct

SEQ ID NO: 786448 - DNA, 20 bp, Artificial
  CRISPR gRNA sequence
aaggcctgaaaaactctggg

SEQ ID NO: 786449 - DNA, 20 bp, Artificial
  CRISPR gRNA sequence
aggcctgaaaaactctggga

SEQ ID NO: 786450 - DNA, 20 bp, Artificial
  CRISPR gRNA sequence
gaaggatttgatatgatcta

SEQ ID NO: 786451 - DNA, 20 bp, Artificial
  CRISPR gRNA sequence
aggatttgatatgatctata

SEQ ID NO: 786452 - DNA, 20 bp, Artificial
  CRISPR gRNA sequence
ttgatatgatctatagagac

SEQ ID NO: 786453 - DNA, 20 bp, Artificial
  CRISPR gRNA sequence
gatatgatctatagagacaa

SEQ ID NO: 786454 - DNA, 20 bp, Artificial
  CRISPR gRNA sequence
tgacatgatgatgatgaaaa

SEQ ID NO: 786455 - DNA, 20 bp, Artificial
  CRISPR gRNA sequence
atgatgatgaaaacagtgtt

SEQ ID NO: 786456 - DNA, 20 bp, Artificial
  CRISPR gRNA sequence
tgatgatgaaaacagtgttt

SEQ ID NO: 786457 - DNA, 20 bp, Artificial
  CRISPR gRNA sequence
gatgatgaaaacagtgtttg

SEQ ID NO: 786458 - DNA, 20 bp, Artificial
  CRISPR gRNA sequence
atgatgaaaacagtgtttgg

SEQ ID NO: 786459 - DNA, 20 bp, Artificial
  CRISPR gRNA sequence
tgatgaaaacagtgtttggg

SEQ ID NO: 786460 - DNA, 20 bp, Artificial
  CRISPR gRNA sequence
aaaacagtgtttggggggat

SEQ ID NO: 786461 - DNA, 20 bp, Artificial
  CRISPR gRNA sequence
gtgtttggggggattagatc

SEQ ID NO: 786462 - DNA, 20 bp, Artificial
  CRISPR gRNA sequence
tttggggggattagatctgg

SEQ ID NO: 786463 - DNA, 20 bp, Artificial
  CRISPR gRNA sequence
ggggggattagatctggcag

SEQ ID NO: 786464 - DNA, 20 bp, Artificial
  CRISPR gRNA sequence
tagatctggcagtggtatgc

SEQ ID NO: 786465 - DNA, 20 bp, Artificial
  CRISPR gRNA sequence
tggtatgctggtgcctcttt

SEQ ID NO: 786466 - DNA, 20 bp, Artificial
  CRISPR gRNA sequence
ggtatgctggtgcctcttta

SEQ ID NO: 786467 - DNA, 20 bp, Artificial
  CRISPR gRNA sequence
gtatgctggtgcctctttaa

SEQ ID NO: 786468 - DNA, 20 bp, Artificial
  CRISPR gRNA sequence
ctctttaagggacctttcca

SEQ ID NO: 786469 - DNA, 20 bp, Artificial
  CRISPR gRNA sequence
gggacctttccaaagctatc

SEQ ID NO: 786470 - DNA, 20 bp, Artificial
  CRISPR gRNA sequence
gaaatatttaaattcctcat

SEQ ID NO: 786471 - DNA, 20 bp, Artificial
  CRISPR gRNA sequence
aaatatttaaattcctcatt

SEQ ID NO: 786472 - DNA, 20 bp, Artificial
  CRISPR gRNA sequence
ttaaattcctcattaggtat

SEQ ID NO: 786473 - DNA, 20 bp, Artificial
  CRISPR gRNA sequence
ttcctcattaggtattggta

SEQ ID NO: 786474 - DNA, 20 bp, Artificial
  CRISPR gRNA sequence
taggtattggtaaagaaaat

SEQ ID NO: 786475 - DNA, 20 bp, Artificial
  CRISPR gRNA sequence
tggtaaagaaaataagatat

SEQ ID NO: 786476 - DNA, 20 bp, Artificial
  CRISPR gRNA sequence
aagaaaataagatattagat

SEQ ID NO: 786477 - DNA, 20 bp, Artificial
  CRISPR gRNA sequence
agataagtcaaacctacctc

SEQ ID NO: 786478 - DNA, 20 bp, Artificial
  CRISPR gRNA sequence
taagtcaaacctacctcaag

SEQ ID NO: 786479 - DNA, 20 bp, Artificial
  CRISPR gRNA sequence
agtagtctcttcattgtacc

SEQ ID NO: 786480 - DNA, 20 bp, Artificial
  CRISPR gRNA sequence
gtagtctcttcattgtacca

SEQ ID NO: 786481 - DNA, 20 bp, Artificial
  CRISPR gRNA sequence
aggcatcatttccaaaattt

SEQ ID NO: 786482 - DNA, 20 bp, Artificial
  CRISPR gRNA sequence
ttgattttgttaaatcattt

SEQ ID NO: 786483 - DNA, 20 bp, Artificial
  CRISPR gRNA sequence
ttgttaaatcattttggcta

SEQ ID NO: 786484 - DNA, 20 bp, Artificial
  CRISPR gRNA sequence
tgttaaatcattttggctac

SEQ ID NO: 786485 - DNA, 20 bp, Artificial
  CRISPR gRNA sequence
gttaaatcattttggctaca

SEQ ID NO: 786486 - DNA, 20 bp, Artificial
  CRISPR gRNA sequence
gggtgcccccactccccacc

SEQ ID NO: 786487 - DNA, 20 bp, Artificial
  CRISPR gRNA sequence
actccccacctagatttact

SEQ ID NO: 786488 - DNA, 20 bp, Artificial
  CRISPR gRNA sequence
tgctattgcatccaaatact

SEQ ID NO: 786489 - DNA, 20 bp, Artificial
  CRISPR gRNA sequence
ctattgcatccaaatactta

SEQ ID NO: 786490 - DNA, 20 bp, Artificial
  CRISPR gRNA sequence
ttgcatccaaatacttagag

SEQ ID NO: 786491 - DNA, 20 bp, Artificial
  CRISPR gRNA sequence
catccaaatacttagagtgg

SEQ ID NO: 786492 - DNA, 20 bp, Artificial
  CRISPR gRNA sequence
agtggtagattctgatatca

SEQ ID NO: 786493 - DNA, 20 bp, Artificial
  CRISPR gRNA sequence
agatgtccttttgttgctga

SEQ ID NO: 786494 - DNA, 20 bp, Artificial
  CRISPR gRNA sequence
ccttttgttgctgaaagttt

SEQ ID NO: 786495 - DNA, 20 bp, Artificial
  CRISPR gRNA sequence
ttttgttgctgaaagtttga

SEQ ID NO: 786496 - DNA, 20 bp, Artificial
  CRISPR gRNA sequence
tttgttgctgaaagtttgag

SEQ ID NO: 786497 - DNA, 20 bp, Artificial
  CRISPR gRNA sequence
gttgctgaaagtttgagagg

SEQ ID NO: 786498 - DNA, 20 bp, Artificial
  CRISPR gRNA sequence
ctgaaagtttgagaggcagt

SEQ ID NO: 786499 - DNA, 20 bp, Artificial
  CRISPR gRNA sequence
agtttgagaggcagtgagct

SEQ ID NO: 786500 - DNA, 20 bp, Artificial
  CRISPR gRNA sequence
actaaacaaaaacccaaaac

SEQ ID NO: 786501 - DNA, 20 bp, Artificial
  CRISPR gRNA sequence
aaacaaaaacccaaaactgg

SEQ ID NO: 786502 - DNA, 20 bp, Artificial
  CRISPR gRNA sequence
ctggtagtctgcatgcaatc

SEQ ID NO: 786503 - DNA, 20 bp, Artificial
  CRISPR gRNA sequence
tggtagtctgcatgcaatct

SEQ ID NO: 786504 - DNA, 20 bp, Artificial
  CRISPR gRNA sequence
agtctgcatgcaatctaggt

SEQ ID NO: 786505 - DNA, 20 bp, Artificial
  CRISPR gRNA sequence
ttggcatgttcatgcatgaa

SEQ ID NO: 786506 - DNA, 20 bp, Artificial
  CRISPR gRNA sequence
tggcatgttcatgcatgaac

SEQ ID NO: 786507 - DNA, 20 bp, Artificial
  CRISPR gRNA sequence
gttcatgcatgaacaggtat

SEQ ID NO: 786508 - DNA, 20 bp, Artificial
  CRISPR gRNA sequence
atgcatgaacaggtattaga

SEQ ID NO: 786509 - DNA, 20 bp, Artificial
  CRISPR gRNA sequence
acaggtattagacagaaccc

SEQ ID NO: 786510 - DNA, 20 bp, Artificial
  CRISPR gRNA sequence
tagacagaaccctggcctct

SEQ ID NO: 786511 - DNA, 20 bp, Artificial
  CRISPR gRNA sequence
ggacaactccaatgaccaaa

SEQ ID NO: 786512 - DNA, 20 bp, Artificial
  CRISPR gRNA sequence
caactccaatgaccaaatag

SEQ ID NO: 786513 - DNA, 20 bp, Artificial
  CRISPR gRNA sequence
tccaatgaccaaatagtagt

SEQ ID NO: 786514 - DNA, 20 bp, Artificial
  CRISPR gRNA sequence
gttacttacttctgtttata

SEQ ID NO: 786515 - DNA, 20 bp, Artificial
  CRISPR gRNA sequence
ttacttacttctgtttataa

SEQ ID NO: 786516 - DNA, 20 bp, Artificial
  CRISPR gRNA sequence
tctgtttataaaggctcatg

SEQ ID NO: 786517 - DNA, 20 bp, Artificial
  CRISPR gRNA sequence
ctgtttataaaggctcatgc

SEQ ID NO: 786518 - DNA, 20 bp, Artificial
  CRISPR gRNA sequence
aatgacaaattgacttactt

SEQ ID NO: 786519 - DNA, 20 bp, Artificial
  CRISPR gRNA sequence
acttacttcagccaaatata

SEQ ID NO: 786520 - DNA, 20 bp, Artificial
  CRISPR gRNA sequence
cttcagccaaatatatggcc

SEQ ID NO: 786521 - DNA, 20 bp, Artificial
  CRISPR gRNA sequence
agactgcccccctcatctct

SEQ ID NO: 786522 - DNA, 20 bp, Artificial
  CRISPR gRNA sequence
attaattttatgtgtcatct

SEQ ID NO: 786523 - DNA, 20 bp, Artificial
  CRISPR gRNA sequence
tttatgtgtcatcttggcta

SEQ ID NO: 786524 - DNA, 20 bp, Artificial
  CRISPR gRNA sequence
gtcatcttggctatggtgct

SEQ ID NO: 786525 - DNA, 20 bp, Artificial
  CRISPR gRNA sequence
ggctatggtgctcagttgct

SEQ ID NO: 786526 - DNA, 20 bp, Artificial
  CRISPR gRNA sequence
tcagttgcttagtcaaatgc

SEQ ID NO: 786527 - DNA, 20 bp, Artificial
  CRISPR gRNA sequence
tagtctatatgttgctgtga

SEQ ID NO: 786528 - DNA, 20 bp, Artificial
  CRISPR gRNA sequence
gttgctgtgaaagtattttg

SEQ ID NO: 786529 - DNA, 20 bp, Artificial
  CRISPR gRNA sequence
atgtaattatcatttgctat

SEQ ID NO: 786530 - DNA, 20 bp, Artificial
  CRISPR gRNA sequence
atttgctatcagttaacttg

SEQ ID NO: 786531 - DNA, 20 bp, Artificial
  CRISPR gRNA sequence
ctatcagttaacttgaagta

SEQ ID NO: 786532 - DNA, 20 bp, Artificial
  CRISPR gRNA sequence
gctgattatctcccatgatg

SEQ ID NO: 786533 - DNA, 20 bp, Artificial
  CRISPR gRNA sequence
ctgattatctcccatgatgt

SEQ ID NO: 786534 - DNA, 20 bp, Artificial
  CRISPR gRNA sequence
ttatctcccatgatgtaggt

SEQ ID NO: 786535 - DNA, 20 bp, Artificial
  CRISPR gRNA sequence
gtaggttggcttcattcaat

SEQ ID NO: 786536 - DNA, 20 bp, Artificial
  CRISPR gRNA sequence
ttggcttcattcaatcagtt

SEQ ID NO: 786537 - DNA, 20 bp, Artificial
  CRISPR gRNA sequence
tggcttcattcaatcagttg

SEQ ID NO: 786538 - DNA, 20 bp, Artificial
  CRISPR gRNA sequence
ggcttcattcaatcagttga

SEQ ID NO: 786539 - DNA, 20 bp, Artificial
  CRISPR gRNA sequence
ttcaatcagttgagggcctt

SEQ ID NO: 786540 - DNA, 20 bp, Artificial
  CRISPR gRNA sequence
caatcagttgagggccttaa

SEQ ID NO: 786541 - DNA, 20 bp, Artificial
  CRISPR gRNA sequence
ggccttaagagcaaaaaact

SEQ ID NO: 786542 - DNA, 20 bp, Artificial
  CRISPR gRNA sequence
gccttaagagcaaaaaactg

SEQ ID NO: 786543 - DNA, 20 bp, Artificial
  CRISPR gRNA sequence
agcaaaaaactgaggtttcc

SEQ ID NO: 786544 - DNA, 20 bp, Artificial
  CRISPR gRNA sequence
aaaactgaggtttcccagaa

SEQ ID NO: 786545 - DNA, 20 bp, Artificial
  CRISPR gRNA sequence
ctgaggtttcccagaaaaga

SEQ ID NO: 786546 - DNA, 20 bp, Artificial
  CRISPR gRNA sequence
aaaagatggaattctgcctc

SEQ ID NO: 786547 - DNA, 20 bp, Artificial
  CRISPR gRNA sequence
gaattctgcctcaagactgt

SEQ ID NO: 786548 - DNA, 20 bp, Artificial
  CRISPR gRNA sequence
aattctgcctcaagactgta

SEQ ID NO: 786549 - DNA, 20 bp, Artificial
  CRISPR gRNA sequence
tctgcctcaagactgtaagg

SEQ ID NO: 786550 - DNA, 20 bp, Artificial
  CRISPR gRNA sequence
tgtaaggtagaaatcctgcc

SEQ ID NO: 786551 - DNA, 20 bp, Artificial
  CRISPR gRNA sequence
gtaaggtagaaatcctgcct

SEQ ID NO: 786552 - DNA, 20 bp, Artificial
  CRISPR gRNA sequence
agaaatcctgcctgggtttc

SEQ ID NO: 786553 - DNA, 20 bp, Artificial
  CRISPR gRNA sequence
tgcctgggtttccagactgc

SEQ ID NO: 786554 - DNA, 20 bp, Artificial
  CRISPR gRNA sequence
cctacacatttcaaacttgc

SEQ ID NO: 786555 - DNA, 20 bp, Artificial
  CRISPR gRNA sequence
aatcatgtgctgcttcccct

SEQ ID NO: 786556 - DNA, 20 bp, Artificial
  CRISPR gRNA sequence
gtgctgcttcccctgagtct

SEQ ID NO: 786557 - DNA, 20 bp, Artificial
  CRISPR gRNA sequence
gtctaagcttttcatccaac

SEQ ID NO: 786558 - DNA, 20 bp, Artificial
  CRISPR gRNA sequence
tctaagcttttcatccaacc

SEQ ID NO: 786559 - DNA, 20 bp, Artificial
  CRISPR gRNA sequence
ccaaccaggcttaatgattt

SEQ ID NO: 786560 - DNA, 20 bp, Artificial
  CRISPR gRNA sequence
aacccacttcttctgacccc

SEQ ID NO: 786561 - DNA, 20 bp, Artificial
  CRISPR gRNA sequence
atcatatccttcctcctcca

SEQ ID NO: 786562 - DNA, 20 bp, Artificial
  CRISPR gRNA sequence
ccttcctcctccacagattc

SEQ ID NO: 786563 - DNA, 20 bp, Artificial
  CRISPR gRNA sequence
ccaaacctgtcaacctcatg

SEQ ID NO: 786564 - DNA, 20 bp, Artificial
  CRISPR gRNA sequence
aaacctgtcaacctcatgaa

SEQ ID NO: 786565 - DNA, 20 bp, Artificial
  CRISPR gRNA sequence
ttcccatattactcttgact

SEQ ID NO: 786566 - DNA, 20 bp, Artificial
  CRISPR gRNA sequence
cccatattactcttgactca

SEQ ID NO: 786567 - DNA, 20 bp, Artificial
  CRISPR gRNA sequence
atccattgtcaattgcatcg

SEQ ID NO: 786568 - DNA, 20 bp, Artificial
  CRISPR gRNA sequence
aactctgtttctaactatgt

SEQ ID NO: 786569 - DNA, 20 bp, Artificial
  CRISPR gRNA sequence
tgtttctaactatgtgagac

SEQ ID NO: 786570 - DNA, 20 bp, Artificial
  CRISPR gRNA sequence
tttctaactatgtgagacca

SEQ ID NO: 786571 - DNA, 20 bp, Artificial
  CRISPR gRNA sequence
ttctaactatgtgagaccag

SEQ ID NO: 786572 - DNA, 20 bp, Artificial
  CRISPR gRNA sequence
actatgtgagaccagaggtc

SEQ ID NO: 786573 - DNA, 20 bp, Artificial
  CRISPR gRNA sequence
gtgagaccagaggtccagtg

SEQ ID NO: 786574 - DNA, 20 bp, Artificial
  CRISPR gRNA sequence
aggtccagtgcagtatcatc

SEQ ID NO: 786575 - DNA, 20 bp, Artificial
  CRISPR gRNA sequence
ggtccagtgcagtatcatct

SEQ ID NO: 786576 - DNA, 20 bp, Artificial
  CRISPR gRNA sequence
tccagtgcagtatcatctag

SEQ ID NO: 786577 - DNA, 20 bp, Artificial
  CRISPR gRNA sequence
cagtatcatctaggagtgct

SEQ ID NO: 786578 - DNA, 20 bp, Artificial
  CRISPR gRNA sequence
agtatcatctaggagtgctt

SEQ ID NO: 786579 - DNA, 20 bp, Artificial
  CRISPR gRNA sequence
tctaggagtgcttaggaata

SEQ ID NO: 786580 - DNA, 20 bp, Artificial
  CRISPR gRNA sequence
agtgcttaggaatatagacc

SEQ ID NO: 786581 - DNA, 20 bp, Artificial
  CRISPR gRNA sequence
taggaatatagaccgagcaa

SEQ ID NO: 786582 - DNA, 20 bp, Artificial
  CRISPR gRNA sequence
aatatagaccgagcaaaaga

SEQ ID NO: 786583 - DNA, 20 bp, Artificial
  CRISPR gRNA sequence
aaaagatggcatgattgttc

SEQ ID NO: 786584 - DNA, 20 bp, Artificial
  CRISPR gRNA sequence
aaagatggcatgattgttct

SEQ ID NO: 786585 - DNA, 20 bp, Artificial
  CRISPR gRNA sequence
aagatggcatgattgttctg

SEQ ID NO: 786586 - DNA, 20 bp, Artificial
  CRISPR gRNA sequence
ggcatgattgttctggggct

SEQ ID NO: 786587 - DNA, 20 bp, Artificial
  CRISPR gRNA sequence
attgttctggggctaagaac

SEQ ID NO: 786588 - DNA, 20 bp, Artificial
  CRISPR gRNA sequence
ttgttctggggctaagaacg

SEQ ID NO: 786589 - DNA, 20 bp, Artificial
  CRISPR gRNA sequence
ttcgctgaaatgctaccaaa

SEQ ID NO: 786590 - DNA, 20 bp, Artificial
  CRISPR gRNA sequence
tcgctgaaatgctaccaaac

SEQ ID NO: 786591 - DNA, 20 bp, Artificial
  CRISPR gRNA sequence
ctgaaatgctaccaaacagg

SEQ ID NO: 786592 - DNA, 20 bp, Artificial
  CRISPR gRNA sequence
accaaacaggaagattctat

SEQ ID NO: 786593 - DNA, 20 bp, Artificial
  CRISPR gRNA sequence
aacaggaagattctataagc

SEQ ID NO: 786594 - DNA, 20 bp, Artificial
  CRISPR gRNA sequence
ttctataagctggaactatt

SEQ ID NO: 786595 - DNA, 20 bp, Artificial
  CRISPR gRNA sequence
agttgccttccatgaattaa

SEQ ID NO: 786596 - DNA, 20 bp, Artificial
  CRISPR gRNA sequence
ccttccatgaattaatagaa

SEQ ID NO: 786597 - DNA, 20 bp, Artificial
  CRISPR gRNA sequence
tccatgaattaatagaacag

SEQ ID NO: 786598 - DNA, 20 bp, Artificial
  CRISPR gRNA sequence
cagtggttactttaaaattc

SEQ ID NO: 786599 - DNA, 20 bp, Artificial
  CRISPR gRNA sequence
gttactttaaaattcaagct

SEQ ID NO: 786600 - DNA, 20 bp, Artificial
  CRISPR gRNA sequence
tactttaaaattcaagctga

SEQ ID NO: 786601 - DNA, 20 bp, Artificial
  CRISPR gRNA sequence
ctttaaaattcaagctgaga

SEQ ID NO: 786602 - DNA, 20 bp, Artificial
  CRISPR gRNA sequence
aaattcaagctgagagagaa

SEQ ID NO: 786603 - DNA, 20 bp, Artificial
  CRISPR gRNA sequence
tcaagctgagagagaaaaga

SEQ ID NO: 786604 - DNA, 20 bp, Artificial
  CRISPR gRNA sequence
gctgagagagaaaagaaagt

SEQ ID NO: 786605 - DNA, 20 bp, Artificial
  CRISPR gRNA sequence
agagagaaaagaaagtaaga

SEQ ID NO: 786606 - DNA, 20 bp, Artificial
  CRISPR gRNA sequence
gaaaagaaagtaagaaagaa

SEQ ID NO: 786607 - DNA, 20 bp, Artificial
  CRISPR gRNA sequence
gtaaaaatcatgcttactca

SEQ ID NO: 786608 - DNA, 20 bp, Artificial
  CRISPR gRNA sequence
gttcacttccctctttgttg

SEQ ID NO: 786609 - DNA, 20 bp, Artificial
  CRISPR gRNA sequence
ttccctctttgttgtggtga

SEQ ID NO: 786610 - DNA, 20 bp, Artificial
  CRISPR gRNA sequence
tccctctttgttgtggtgac

SEQ ID NO: 786611 - DNA, 20 bp, Artificial
  CRISPR gRNA sequence
gtctttttgttgtgtctgaa

SEQ ID NO: 786612 - DNA, 20 bp, Artificial
  CRISPR gRNA sequence
tctttttgttgtgtctgaaa

SEQ ID NO: 786613 - DNA, 20 bp, Artificial
  CRISPR gRNA sequence
tgtctgaaaaggaaaaattc

SEQ ID NO: 786614 - DNA, 20 bp, Artificial
  CRISPR gRNA sequence
aaaaggaaaaattccagaaa

SEQ ID NO: 786615 - DNA, 20 bp, Artificial
  CRISPR gRNA sequence
aaaaattccagaaatggaat

SEQ ID NO: 786616 - DNA, 20 bp, Artificial
  CRISPR gRNA sequence
agaaatggaataagattaat

SEQ ID NO: 786617 - DNA, 20 bp, Artificial
  CRISPR gRNA sequence
agattaatgagaaaactgtt

SEQ ID NO: 786618 - DNA, 20 bp, Artificial
  CRISPR gRNA sequence
tgagaaaactgtttggctta

SEQ ID NO: 786619 - DNA, 20 bp, Artificial
  CRISPR gRNA sequence
ttggcttatagattaaaata

SEQ ID NO: 786620 - DNA, 20 bp, Artificial
  CRISPR gRNA sequence
gcttatagattaaaatatgg

SEQ ID NO: 786621 - DNA, 20 bp, Artificial
  CRISPR gRNA sequence
cttatagattaaaatatggc

SEQ ID NO: 786622 - DNA, 20 bp, Artificial
  CRISPR gRNA sequence
ttaaaatatggcaggacaaa

SEQ ID NO: 786623 - DNA, 20 bp, Artificial
  CRISPR gRNA sequence
taaatctaaataaatccaca

SEQ ID NO: 786624 - DNA, 20 bp, Artificial
  CRISPR gRNA sequence
ctaaataaatccacatagcg

SEQ ID NO: 786625 - DNA, 20 bp, Artificial
  CRISPR gRNA sequence
cgaagcccaaatgttcactg

SEQ ID NO: 786626 - DNA, 20 bp, Artificial
  CRISPR gRNA sequence
cccaaatgttcactgtggcc

SEQ ID NO: 786627 - DNA, 20 bp, Artificial
  CRISPR gRNA sequence
ccaaatgttcactgtggcct

SEQ ID NO: 786628 - DNA, 20 bp, Artificial
  CRISPR gRNA sequence
ttcactgtggcctgggactt

SEQ ID NO: 786629 - DNA, 20 bp, Artificial
  CRISPR gRNA sequence
ctgtggcctgggacttcgga

SEQ ID NO: 786630 - DNA, 20 bp, Artificial
  CRISPR gRNA sequence
acttcggatggtaatgcata

SEQ ID NO: 786631 - DNA, 20 bp, Artificial
  CRISPR gRNA sequence
gtaatgcataaagcaaaatc

SEQ ID NO: 786632 - DNA, 20 bp, Artificial
  CRISPR gRNA sequence
ataaagcaaaatctggcccc

SEQ ID NO: 786633 - DNA, 20 bp, Artificial
  CRISPR gRNA sequence
taaagcaaaatctggcccct

SEQ ID NO: 786634 - DNA, 20 bp, Artificial
  CRISPR gRNA sequence
caaaatctggcccctaggca

SEQ ID NO: 786635 - DNA, 20 bp, Artificial
  CRISPR gRNA sequence
aaatctggcccctaggcaaa

SEQ ID NO: 786636 - DNA, 20 bp, Artificial
  CRISPR gRNA sequence
ctaggcaaagagtgtgaaca

SEQ ID NO: 786637 - DNA, 20 bp, Artificial
  CRISPR gRNA sequence
ggcaaagagtgtgaacaaag

SEQ ID NO: 786638 - DNA, 20 bp, Artificial
  CRISPR gRNA sequence
tccattcctctgtctactcc

SEQ ID NO: 786639 - DNA, 20 bp, Artificial
  CRISPR gRNA sequence
ctctgtctactcctggccct

SEQ ID NO: 786640 - DNA, 20 bp, Artificial
  CRISPR gRNA sequence
tctgtctactcctggccctc

SEQ ID NO: 786641 - DNA, 20 bp, Artificial
  CRISPR gRNA sequence
tcctggccctcaggcactta

SEQ ID NO: 786642 - DNA, 20 bp, Artificial
  CRISPR gRNA sequence
cctggccctcaggcacttaa

SEQ ID NO: 786643 - DNA, 20 bp, Artificial
  CRISPR gRNA sequence
ccctcaggcacttaaaggct

SEQ ID NO: 786644 - DNA, 20 bp, Artificial
  CRISPR gRNA sequence
cctcaggcacttaaaggctg

SEQ ID NO: 786645 - DNA, 20 bp, Artificial
  CRISPR gRNA sequence
ctcaggcacttaaaggctga

SEQ ID NO: 786646 - DNA, 20 bp, Artificial
  CRISPR gRNA sequence
taaaggctgagggactaatt

SEQ ID NO: 786647 - DNA, 20 bp, Artificial
  CRISPR gRNA sequence
aaaggctgagggactaattt

SEQ ID NO: 786648 - DNA, 20 bp, Artificial
  CRISPR gRNA sequence
actaatttgggtattcaatc

SEQ ID NO: 786649 - DNA, 20 bp, Artificial
  CRISPR gRNA sequence
ctaatttgggtattcaatcc

SEQ ID NO: 786650 - DNA, 20 bp, Artificial
  CRISPR gRNA sequence
tattcaatccaggaaatgtc

SEQ ID NO: 786651 - DNA, 20 bp, Artificial
  CRISPR gRNA sequence
atccaggaaatgtctggctg

SEQ ID NO: 786652 - DNA, 20 bp, Artificial
  CRISPR gRNA sequence
gaaatgtctggctgcagaat

SEQ ID NO: 786653 - DNA, 20 bp, Artificial
  CRISPR gRNA sequence
tagctctcccttttctgctt

SEQ ID NO: 786654 - DNA, 20 bp, Artificial
  CRISPR gRNA sequence
ctacttctgcctgccttccc

SEQ ID NO: 786655 - DNA, 20 bp, Artificial
  CRISPR gRNA sequence
tctgcctgccttccctggtc

SEQ ID NO: 786656 - DNA, 20 bp, Artificial
  CRISPR gRNA sequence
ctgcctgccttccctggtcc

SEQ ID NO: 786657 - DNA, 20 bp, Artificial
  CRISPR gRNA sequence
ctgccttccctggtccaggt

SEQ ID NO: 786658 - DNA, 20 bp, Artificial
  CRISPR gRNA sequence
tgatcaattaattttgcact

SEQ ID NO: 786659 - DNA, 20 bp, Artificial
  CRISPR gRNA sequence
gatcaattaattttgcacta

SEQ ID NO: 786660 - DNA, 20 bp, Artificial
  CRISPR gRNA sequence
ttaattttgcactaaggtat

SEQ ID NO: 786661 - DNA, 20 bp, Artificial
  CRISPR gRNA sequence
aaggtataagtgactgatac

SEQ ID NO: 786662 - DNA, 20 bp, Artificial
  CRISPR gRNA sequence
aagtgactgatactggctca

SEQ ID NO: 786663 - DNA, 20 bp, Artificial
  CRISPR gRNA sequence
atactggctcaaagtaactc

SEQ ID NO: 786664 - DNA, 20 bp, Artificial
  CRISPR gRNA sequence
ctcaaagtaactcaagttac

SEQ ID NO: 786665 - DNA, 20 bp, Artificial
  CRISPR gRNA sequence
agtaactcaagttactggtt

SEQ ID NO: 786666 - DNA, 20 bp, Artificial
  CRISPR gRNA sequence
aactcaagttactggttcag

SEQ ID NO: 786667 - DNA, 20 bp, Artificial
  CRISPR gRNA sequence
agttactggttcagaagcac

SEQ ID NO: 786668 - DNA, 20 bp, Artificial
  CRISPR gRNA sequence
agaagcacaagttcacataa

SEQ ID NO: 786669 - DNA, 20 bp, Artificial
  CRISPR gRNA sequence
gaagcacaagttcacataat

SEQ ID NO: 786670 - DNA, 20 bp, Artificial
  CRISPR gRNA sequence
cataatgggatgctgctcac

SEQ ID NO: 786671 - DNA, 20 bp, Artificial
  CRISPR gRNA sequence
atgggatgctgctcaccagt

SEQ ID NO: 786672 - DNA, 20 bp, Artificial
  CRISPR gRNA sequence
taattttttttttatatcaa

SEQ ID NO: 786673 - DNA, 20 bp, Artificial
  CRISPR gRNA sequence
aattttttttttatatcaat

SEQ ID NO: 786674 - DNA, 20 bp, Artificial
  CRISPR gRNA sequence
tttttttatatcaataggtt

SEQ ID NO: 786675 - DNA, 20 bp, Artificial
  CRISPR gRNA sequence
ttttttatatcaataggttt

SEQ ID NO: 786676 - DNA, 20 bp, Artificial
  CRISPR gRNA sequence
tttttatatcaataggttta

SEQ ID NO: 786677 - DNA, 20 bp, Artificial
  CRISPR gRNA sequence
ttttatatcaataggtttag

SEQ ID NO: 786678 - DNA, 20 bp, Artificial
  CRISPR gRNA sequence
tatcaataggtttaggggta

SEQ ID NO: 786679 - DNA, 20 bp, Artificial
  CRISPR gRNA sequence
atcaataggtttaggggtac

SEQ ID NO: 786680 - DNA, 20 bp, Artificial
  CRISPR gRNA sequence
aataggtttaggggtacagg

SEQ ID NO: 786681 - DNA, 20 bp, Artificial
  CRISPR gRNA sequence
ttaggggtacaggtggtttt

SEQ ID NO: 786682 - DNA, 20 bp, Artificial
  CRISPR gRNA sequence
acaggtggtttttggttaca

SEQ ID NO: 786683 - DNA, 20 bp, Artificial
  CRISPR gRNA sequence
tacatggatgaattgtatac

SEQ ID NO: 786684 - DNA, 20 bp, Artificial
  CRISPR gRNA sequence
ggatgaattgtatactggtg

SEQ ID NO: 786685 - DNA, 20 bp, Artificial
  CRISPR gRNA sequence
tactggtgaagtctgaattt

SEQ ID NO: 786686 - DNA, 20 bp, Artificial
  CRISPR gRNA sequence
tagtgcacccgtcacccaaa

SEQ ID NO: 786687 - DNA, 20 bp, Artificial
  CRISPR gRNA sequence
tgtacattgaactcaatatg

SEQ ID NO: 786688 - DNA, 20 bp, Artificial
  CRISPR gRNA sequence
actccctactctctccttct

SEQ ID NO: 786689 - DNA, 20 bp, Artificial
  CRISPR gRNA sequence
tgtatgcctttgcatatcca

SEQ ID NO: 786690 - DNA, 20 bp, Artificial
  CRISPR gRNA sequence
gcctttgcatatccatagct

SEQ ID NO: 786691 - DNA, 20 bp, Artificial
  CRISPR gRNA sequence
atagcttagctcccacttac

SEQ ID NO: 786692 - DNA, 20 bp, Artificial
  CRISPR gRNA sequence
cttagctcccacttacaagt

SEQ ID NO: 786693 - DNA, 20 bp, Artificial
  CRISPR gRNA sequence
cacttacaagtgagaatata

SEQ ID NO: 786694 - DNA, 20 bp, Artificial
  CRISPR gRNA sequence
aagtgagaatatatggtatt

SEQ ID NO: 786695 - DNA, 20 bp, Artificial
  CRISPR gRNA sequence
gtatttggttttccattcct

SEQ ID NO: 786696 - DNA, 20 bp, Artificial
  CRISPR gRNA sequence
cattcctgagttacttcact

SEQ ID NO: 786697 - DNA, 20 bp, Artificial
  CRISPR gRNA sequence
tcacttggaataatgacctc

SEQ ID NO: 786698 - DNA, 20 bp, Artificial
  CRISPR gRNA sequence
aatgacctccagttccatcc

SEQ ID NO: 786699 - DNA, 20 bp, Artificial
  CRISPR gRNA sequence
cattatctcattctttttca

SEQ ID NO: 786700 - DNA, 20 bp, Artificial
  CRISPR gRNA sequence
tctcattctttttcatggct

SEQ ID NO: 786701 - DNA, 20 bp, Artificial
  CRISPR gRNA sequence
cattctttttcatggctgag

SEQ ID NO: 786702 - DNA, 20 bp, Artificial
  CRISPR gRNA sequence
catggctgagtagtattcca

SEQ ID NO: 786703 - DNA, 20 bp, Artificial
  CRISPR gRNA sequence
tttatccacttattcgtcaa

SEQ ID NO: 786704 - DNA, 20 bp, Artificial
  CRISPR gRNA sequence
ttatccacttattcgtcaat

SEQ ID NO: 786705 - DNA, 20 bp, Artificial
  CRISPR gRNA sequence
cttattcgtcaatgggatct

SEQ ID NO: 786706 - DNA, 20 bp, Artificial
  CRISPR gRNA sequence
ttattcgtcaatgggatctt

SEQ ID NO: 786707 - DNA, 20 bp, Artificial
  CRISPR gRNA sequence
tcgtcaatgggatcttaggt

SEQ ID NO: 786708 - DNA, 20 bp, Artificial
  CRISPR gRNA sequence
catatctttgcaatcatgaa

SEQ ID NO: 786709 - DNA, 20 bp, Artificial
  CRISPR gRNA sequence
atatctttgcaatcatgaat

SEQ ID NO: 786710 - DNA, 20 bp, Artificial
  CRISPR gRNA sequence
ctcccactctgattctcttt

SEQ ID NO: 786711 - DNA, 20 bp, Artificial
  CRISPR gRNA sequence
tcccactctgattctctttt

SEQ ID NO: 786712 - DNA, 20 bp, Artificial
  CRISPR gRNA sequence
gcccaactcctgccattgcc

SEQ ID NO: 786713 - DNA, 20 bp, Artificial
  CRISPR gRNA sequence
cccaactcctgccattgcct

SEQ ID NO: 786714 - DNA, 20 bp, Artificial
  CRISPR gRNA sequence
attgcctgggttcctgaaat

SEQ ID NO: 786715 - DNA, 20 bp, Artificial
  CRISPR gRNA sequence
tctgcttttgccctatatac

SEQ ID NO: 786716 - DNA, 20 bp, Artificial
  CRISPR gRNA sequence
ctgcttttgccctatatacc

SEQ ID NO: 786717 - DNA, 20 bp, Artificial
  CRISPR gRNA sequence
tgccctatataccaggtttt

SEQ ID NO: 786718 - DNA, 20 bp, Artificial
  CRISPR gRNA sequence
aattccctcatgactatcct

SEQ ID NO: 786719 - DNA, 20 bp, Artificial
  CRISPR gRNA sequence
cctcatgactatcctgagct

SEQ ID NO: 786720 - DNA, 20 bp, Artificial
  CRISPR gRNA sequence
tgactatcctgagcttggcc

SEQ ID NO: 786721 - DNA, 20 bp, Artificial
  CRISPR gRNA sequence
cctgagcttggcctggaatt

SEQ ID NO: 786722 - DNA, 20 bp, Artificial
  CRISPR gRNA sequence
tgagcttggcctggaatttg

SEQ ID NO: 786723 - DNA, 20 bp, Artificial
  CRISPR gRNA sequence
gagcttggcctggaatttgg

SEQ ID NO: 786724 - DNA, 20 bp, Artificial
  CRISPR gRNA sequence
ggaatttggaggtctctatt

SEQ ID NO: 786725 - DNA, 20 bp, Artificial
  CRISPR gRNA sequence
gaggtctctattcagcactg

SEQ ID NO: 786726 - DNA, 20 bp, Artificial
  CRISPR gRNA sequence
agcactgtagtctctttcat

SEQ ID NO: 786727 - DNA, 20 bp, Artificial
  CRISPR gRNA sequence
gcactgtagtctctttcatg

SEQ ID NO: 786728 - DNA, 20 bp, Artificial
  CRISPR gRNA sequence
cactgtagtctctttcatga

SEQ ID NO: 786729 - DNA, 20 bp, Artificial
  CRISPR gRNA sequence
tcatgagggtttgcatttga

SEQ ID NO: 786730 - DNA, 20 bp, Artificial
  CRISPR gRNA sequence
catgagggtttgcatttgaa

SEQ ID NO: 786731 - DNA, 20 bp, Artificial
  CRISPR gRNA sequence
tgagggtttgcatttgaaag

SEQ ID NO: 786732 - DNA, 20 bp, Artificial
  CRISPR gRNA sequence
tgcatttgaaaggagcccaa

SEQ ID NO: 786733 - DNA, 20 bp, Artificial
  CRISPR gRNA sequence
ggagcccaatggttaaccca

SEQ ID NO: 786734 - DNA, 20 bp, Artificial
  CRISPR gRNA sequence
gagcccaatggttaacccat

SEQ ID NO: 786735 - DNA, 20 bp, Artificial
  CRISPR gRNA sequence
taggaattgctcttgaatgt

SEQ ID NO: 786736 - DNA, 20 bp, Artificial
  CRISPR gRNA sequence
ttgctcttgaatgttggctt

SEQ ID NO: 786737 - DNA, 20 bp, Artificial
  CRISPR gRNA sequence
ctcttgaatgttggcttcag

SEQ ID NO: 786738 - DNA, 20 bp, Artificial
  CRISPR gRNA sequence
tcttgaatgttggcttcagt

SEQ ID NO: 786739 - DNA, 20 bp, Artificial
  CRISPR gRNA sequence
tgggtacctcatttatgcct

SEQ ID NO: 786740 - DNA, 20 bp, Artificial
  CRISPR gRNA sequence
gggtacctcatttatgcctg

SEQ ID NO: 786741 - DNA, 20 bp, Artificial
  CRISPR gRNA sequence
acctcatttatgcctgaggt

SEQ ID NO: 786742 - DNA, 20 bp, Artificial
  CRISPR gRNA sequence
gttagtgctgccattctctg

SEQ ID NO: 786743 - DNA, 20 bp, Artificial
  CRISPR gRNA sequence
ttagtgctgccattctctgt

SEQ ID NO: 786744 - DNA, 20 bp, Artificial
  CRISPR gRNA sequence
ctgccattctctgtgggcca

SEQ ID NO: 786745 - DNA, 20 bp, Artificial
  CRISPR gRNA sequence
tgccattctctgtgggccac

SEQ ID NO: 786746 - DNA, 20 bp, Artificial
  CRISPR gRNA sequence
ggccacaggtaaccataaac

SEQ ID NO: 786747 - DNA, 20 bp, Artificial
  CRISPR gRNA sequence
taaccataaaccagcatatt

SEQ ID NO: 786748 - DNA, 20 bp, Artificial
  CRISPR gRNA sequence
tttaaacctctgtaaaattc

SEQ ID NO: 786749 - DNA, 20 bp, Artificial
  CRISPR gRNA sequence
aaaattctggctcaatcttc

SEQ ID NO: 786750 - DNA, 20 bp, Artificial
  CRISPR gRNA sequence
aaattctggctcaatcttct

SEQ ID NO: 786751 - DNA, 20 bp, Artificial
  CRISPR gRNA sequence
aattctggctcaatcttcta

SEQ ID NO: 786752 - DNA, 20 bp, Artificial
  CRISPR gRNA sequence
tcttctagggctgtgccact

SEQ ID NO: 786753 - DNA, 20 bp, Artificial
  CRISPR gRNA sequence
ttctagggctgtgccactta

SEQ ID NO: 786754 - DNA, 20 bp, Artificial
  CRISPR gRNA sequence
gggctgtgccacttagagtc

SEQ ID NO: 786755 - DNA, 20 bp, Artificial
  CRISPR gRNA sequence
gccacttagagtctggttca

SEQ ID NO: 786756 - DNA, 20 bp, Artificial
  CRISPR gRNA sequence
ccacttagagtctggttcat

SEQ ID NO: 786757 - DNA, 20 bp, Artificial
  CRISPR gRNA sequence
ttagagtctggttcatgggc

SEQ ID NO: 786758 - DNA, 20 bp, Artificial
  CRISPR gRNA sequence
tctggttcatgggctggtgc

SEQ ID NO: 786759 - DNA, 20 bp, Artificial
  CRISPR gRNA sequence
ggttcatgggctggtgctgg

SEQ ID NO: 786760 - DNA, 20 bp, Artificial
  CRISPR gRNA sequence
gttcatgggctggtgctggt

SEQ ID NO: 786761 - DNA, 20 bp, Artificial
  CRISPR gRNA sequence
gctggtaggtgaactgttac

SEQ ID NO: 786762 - DNA, 20 bp, Artificial
  CRISPR gRNA sequence
gatgataactgttccttcac

SEQ ID NO: 786763 - DNA, 20 bp, Artificial
  CRISPR gRNA sequence
tgataactgttccttcacaa

SEQ ID NO: 786764 - DNA, 20 bp, Artificial
  CRISPR gRNA sequence
ataactgttccttcacaaga

SEQ ID NO: 786765 - DNA, 20 bp, Artificial
  CRISPR gRNA sequence
gttccttcacaagagagttt

SEQ ID NO: 786766 - DNA, 20 bp, Artificial
  CRISPR gRNA sequence
gtttaagaaacactgttctg

SEQ ID NO: 786767 - DNA, 20 bp, Artificial
  CRISPR gRNA sequence
aacactgttctgaagatctg

SEQ ID NO: 786768 - DNA, 20 bp, Artificial
  CRISPR gRNA sequence
agatctgaagacatgttcta

SEQ ID NO: 786769 - DNA, 20 bp, Artificial
  CRISPR gRNA sequence
gaagacatgttctaaagatc

SEQ ID NO: 786770 - DNA, 20 bp, Artificial
  CRISPR gRNA sequence
ttctaaagatctagattctg

SEQ ID NO: 786771 - DNA, 20 bp, Artificial
  CRISPR gRNA sequence
aaagatctagattctgtagc

SEQ ID NO: 786772 - DNA, 20 bp, Artificial
  CRISPR gRNA sequence
ctgtagctggtgacttctgc

SEQ ID NO: 786773 - DNA, 20 bp, Artificial
  CRISPR gRNA sequence
ttctaacttgactttgccat

SEQ ID NO: 786774 - DNA, 20 bp, Artificial
  CRISPR gRNA sequence
acttgactttgccattggct

SEQ ID NO: 786775 - DNA, 20 bp, Artificial
  CRISPR gRNA sequence
gactttgccattggctcagc

SEQ ID NO: 786776 - DNA, 20 bp, Artificial
  CRISPR gRNA sequence
ggctcagcaagtcaatgtat

SEQ ID NO: 786777 - DNA, 20 bp, Artificial
  CRISPR gRNA sequence
tataagtcactcaattattt

SEQ ID NO: 786778 - DNA, 20 bp, Artificial
  CRISPR gRNA sequence
ctttctccttccattgttca

SEQ ID NO: 786779 - DNA, 20 bp, Artificial
  CRISPR gRNA sequence
tgactgaaccaatttgtatt

SEQ ID NO: 786780 - DNA, 20 bp, Artificial
  CRISPR gRNA sequence
ttaagcacttttgcaacaaa

SEQ ID NO: 786781 - DNA, 20 bp, Artificial
  CRISPR gRNA sequence
taagcacttttgcaacaaat

SEQ ID NO: 786782 - DNA, 20 bp, Artificial
  CRISPR gRNA sequence
ttttgcaacaaataggccac

SEQ ID NO: 786783 - DNA, 20 bp, Artificial
  CRISPR gRNA sequence
aacaaataggccacaagttt

SEQ ID NO: 786784 - DNA, 20 bp, Artificial
  CRISPR gRNA sequence
caaataggccacaagttttg

SEQ ID NO: 786785 - DNA, 20 bp, Artificial
  CRISPR gRNA sequence
ccacaagttttggagtcaaa

SEQ ID NO: 786786 - DNA, 20 bp, Artificial
  CRISPR gRNA sequence
acagacctgtattcaaatcc

SEQ ID NO: 786787 - DNA, 20 bp, Artificial
  CRISPR gRNA sequence
aaatcccagctgtatgactt

SEQ ID NO: 786788 - DNA, 20 bp, Artificial
  CRISPR gRNA sequence
aatcccagctgtatgacttt

SEQ ID NO: 786789 - DNA, 20 bp, Artificial
  CRISPR gRNA sequence
cccagctgtatgactttggg

SEQ ID NO: 786790 - DNA, 20 bp, Artificial
  CRISPR gRNA sequence
ggaagtcatataacttttct

SEQ ID NO: 786791 - DNA, 20 bp, Artificial
  CRISPR gRNA sequence
gagcctcactttcttaactc

SEQ ID NO: 786792 - DNA, 20 bp, Artificial
  CRISPR gRNA sequence
actttcttaactccagcata

SEQ ID NO: 786793 - DNA, 20 bp, Artificial
  CRISPR gRNA sequence
aagacacttctccttgccac

SEQ ID NO: 786794 - DNA, 20 bp, Artificial
  CRISPR gRNA sequence
caatttttgtgaaattaaat

SEQ ID NO: 786795 - DNA, 20 bp, Artificial
  CRISPR gRNA sequence
tttttgtgaaattaaatgag

SEQ ID NO: 786796 - DNA, 20 bp, Artificial
  CRISPR gRNA sequence
aattaaatgagaagtttgta

SEQ ID NO: 786797 - DNA, 20 bp, Artificial
  CRISPR gRNA sequence
attaaatgagaagtttgtaa

SEQ ID NO: 786798 - DNA, 20 bp, Artificial
  CRISPR gRNA sequence
ttaaatgagaagtttgtaaa

SEQ ID NO: 786799 - DNA, 20 bp, Artificial
  CRISPR gRNA sequence
tgagaagtttgtaaagggtc

SEQ ID NO: 786800 - DNA, 20 bp, Artificial
  CRISPR gRNA sequence
agtttgtaaagggtctagca

SEQ ID NO: 786801 - DNA, 20 bp, Artificial
  CRISPR gRNA sequence
ttgtaaagggtctagcacag

SEQ ID NO: 786802 - DNA, 20 bp, Artificial
  CRISPR gRNA sequence
gggtctagcacagtggtttt

SEQ ID NO: 786803 - DNA, 20 bp, Artificial
  CRISPR gRNA sequence
tctagcacagtggttttcag

SEQ ID NO: 786804 - DNA, 20 bp, Artificial
  CRISPR gRNA sequence
agtagaactttctgcaatga

SEQ ID NO: 786805 - DNA, 20 bp, Artificial
  CRISPR gRNA sequence
tatatctgtactgtccaata

SEQ ID NO: 786806 - DNA, 20 bp, Artificial
  CRISPR gRNA sequence
atatctgtactgtccaatac

SEQ ID NO: 786807 - DNA, 20 bp, Artificial
  CRISPR gRNA sequence
atctgtactgtccaatacag

SEQ ID NO: 786808 - DNA, 20 bp, Artificial
  CRISPR gRNA sequence
caggagcaattatctgtaca

SEQ ID NO: 786809 - DNA, 20 bp, Artificial
  CRISPR gRNA sequence
attatctgtacatggctatt

SEQ ID NO: 786810 - DNA, 20 bp, Artificial
  CRISPR gRNA sequence
acatggctattgagcactta

SEQ ID NO: 786811 - DNA, 20 bp, Artificial
  CRISPR gRNA sequence
cttacagtgtgtgaatactt

SEQ ID NO: 786812 - DNA, 20 bp, Artificial
  CRISPR gRNA sequence
gaatttttatttaacttaaa

SEQ ID NO: 786813 - DNA, 20 bp, Artificial
  CRISPR gRNA sequence
atttttatttaacttaaaaa

SEQ ID NO: 786814 - DNA, 20 bp, Artificial
  CRISPR gRNA sequence
atttaacttaaaaagagcca

SEQ ID NO: 786815 - DNA, 20 bp, Artificial
  CRISPR gRNA sequence
aacttaaaaagagccacaga

SEQ ID NO: 786816 - DNA, 20 bp, Artificial
  CRISPR gRNA sequence
gccacagatggctattatat

SEQ ID NO: 786817 - DNA, 20 bp, Artificial
  CRISPR gRNA sequence
cagatggctattatattgga

SEQ ID NO: 786818 - DNA, 20 bp, Artificial
  CRISPR gRNA sequence
gatggctattatattggaca

SEQ ID NO: 786819 - DNA, 20 bp, Artificial
  CRISPR gRNA sequence
ggctattatattggacagag

SEQ ID NO: 786820 - DNA, 20 bp, Artificial
  CRISPR gRNA sequence
tatattggacagagcagatc

SEQ ID NO: 786821 - DNA, 20 bp, Artificial
  CRISPR gRNA sequence
ctagcatactcacctgcata

SEQ ID NO: 786822 - DNA, 20 bp, Artificial
  CRISPR gRNA sequence
gcatactcacctgcatatag

SEQ ID NO: 786823 - DNA, 20 bp, Artificial
  CRISPR gRNA sequence
catactcacctgcatatagt

SEQ ID NO: 786824 - DNA, 20 bp, Artificial
  CRISPR gRNA sequence
attgaacatttattatatgc

SEQ ID NO: 786825 - DNA, 20 bp, Artificial
  CRISPR gRNA sequence
ttgaacatttattatatgcc

SEQ ID NO: 786826 - DNA, 20 bp, Artificial
  CRISPR gRNA sequence
ttatatgccaggtaattttt

SEQ ID NO: 786827 - DNA, 20 bp, Artificial
  CRISPR gRNA sequence
ccaggtaattttttagacac

SEQ ID NO: 786828 - DNA, 20 bp, Artificial
  CRISPR gRNA sequence
caggtaattttttagacact

SEQ ID NO: 786829 - DNA, 20 bp, Artificial
  CRISPR gRNA sequence
tttagacactgggcatatat

SEQ ID NO: 786830 - DNA, 20 bp, Artificial
  CRISPR gRNA sequence
ctgggcatatattggtgaat

SEQ ID NO: 786831 - DNA, 20 bp, Artificial
  CRISPR gRNA sequence
gggcatatattggtgaatca

SEQ ID NO: 786832 - DNA, 20 bp, Artificial
  CRISPR gRNA sequence
attggtgaatcagagaaaca

SEQ ID NO: 786833 - DNA, 20 bp, Artificial
  CRISPR gRNA sequence
tactgtattcttgaaacgta

SEQ ID NO: 786834 - DNA, 20 bp, Artificial
  CRISPR gRNA sequence
tattcttgaaacgtaaagac

SEQ ID NO: 786835 - DNA, 20 bp, Artificial
  CRISPR gRNA sequence
tcttgaaacgtaaagacaag

SEQ ID NO: 786836 - DNA, 20 bp, Artificial
  CRISPR gRNA sequence
aacgtaaagacaagcagatg

SEQ ID NO: 786837 - DNA, 20 bp, Artificial
  CRISPR gRNA sequence
gtaaagacaagcagatgaag

SEQ ID NO: 786838 - DNA, 20 bp, Artificial
  CRISPR gRNA sequence
aatttaacattattttgcaa

SEQ ID NO: 786839 - DNA, 20 bp, Artificial
  CRISPR gRNA sequence
ttaacattattttgcaacag

SEQ ID NO: 786840 - DNA, 20 bp, Artificial
  CRISPR gRNA sequence
tattttgcaacagaagttgc

SEQ ID NO: 786841 - DNA, 20 bp, Artificial
  CRISPR gRNA sequence
gaagttgccagcttcttctc

SEQ ID NO: 786842 - DNA, 20 bp, Artificial
  CRISPR gRNA sequence
agttgccagcttcttctcta

SEQ ID NO: 786843 - DNA, 20 bp, Artificial
  CRISPR gRNA sequence
ccagcttcttctctagagcc

SEQ ID NO: 786844 - DNA, 20 bp, Artificial
  CRISPR gRNA sequence
gcttcttctctagagcccag

SEQ ID NO: 786845 - DNA, 20 bp, Artificial
  CRISPR gRNA sequence
cttcttctctagagcccagc

SEQ ID NO: 786846 - DNA, 20 bp, Artificial
  CRISPR gRNA sequence
gagcccagcaggtcaccctc

SEQ ID NO: 786847 - DNA, 20 bp, Artificial
  CRISPR gRNA sequence
tcgagccccaaactgttgaa

SEQ ID NO: 786848 - DNA, 20 bp, Artificial
  CRISPR gRNA sequence
aactgttgaatggttcctct

SEQ ID NO: 786849 - DNA, 20 bp, Artificial
  CRISPR gRNA sequence
actgttgaatggttcctctt

SEQ ID NO: 786850 - DNA, 20 bp, Artificial
  CRISPR gRNA sequence
ctgttgaatggttcctctta

SEQ ID NO: 786851 - DNA, 20 bp, Artificial
  CRISPR gRNA sequence
tgttgaatggttcctcttag

SEQ ID NO: 786852 - DNA, 20 bp, Artificial
  CRISPR gRNA sequence
tggttcctcttaggggaaaa

SEQ ID NO: 786853 - DNA, 20 bp, Artificial
  CRISPR gRNA sequence
tcctcttaggggaaaatggt

SEQ ID NO: 786854 - DNA, 20 bp, Artificial
  CRISPR gRNA sequence
tcttaggggaaaatggtaag

SEQ ID NO: 786855 - DNA, 20 bp, Artificial
  CRISPR gRNA sequence
cttaggggaaaatggtaagc

SEQ ID NO: 786856 - DNA, 20 bp, Artificial
  CRISPR gRNA sequence
atggtaagcaggacctttta

SEQ ID NO: 786857 - DNA, 20 bp, Artificial
  CRISPR gRNA sequence
gaccttttatggaccaataa

SEQ ID NO: 786858 - DNA, 20 bp, Artificial
  CRISPR gRNA sequence
gctgccctcccaatacactt

SEQ ID NO: 786859 - DNA, 20 bp, Artificial
  CRISPR gRNA sequence
tcccaatacactttagtaca

SEQ ID NO: 786860 - DNA, 20 bp, Artificial
  CRISPR gRNA sequence
ccaatacactttagtacaca

SEQ ID NO: 786861 - DNA, 20 bp, Artificial
  CRISPR gRNA sequence
tacactttagtacacagagc

SEQ ID NO: 786862 - DNA, 20 bp, Artificial
  CRISPR gRNA sequence
agtacacagagctagtcact

SEQ ID NO: 786863 - DNA, 20 bp, Artificial
  CRISPR gRNA sequence
gtacacagagctagtcactg

SEQ ID NO: 786864 - DNA, 20 bp, Artificial
  CRISPR gRNA sequence
cagagctagtcactgaggta

SEQ ID NO: 786865 - DNA, 20 bp, Artificial
  CRISPR gRNA sequence
agagctagtcactgaggtat

SEQ ID NO: 786866 - DNA, 20 bp, Artificial
  CRISPR gRNA sequence
gctagtcactgaggtatagg

SEQ ID NO: 786867 - DNA, 20 bp, Artificial
  CRISPR gRNA sequence
ctagtcactgaggtataggt

SEQ ID NO: 786868 - DNA, 20 bp, Artificial
  CRISPR gRNA sequence
tataggtgggtaaatctgtt

SEQ ID NO: 786869 - DNA, 20 bp, Artificial
  CRISPR gRNA sequence
ataggtgggtaaatctgttc

SEQ ID NO: 786870 - DNA, 20 bp, Artificial
  CRISPR gRNA sequence
aggtgggtaaatctgttcag

SEQ ID NO: 786871 - DNA, 20 bp, Artificial
  CRISPR gRNA sequence
ggtaaatctgttcaggagct

SEQ ID NO: 786872 - DNA, 20 bp, Artificial
  CRISPR gRNA sequence
aaatctgttcaggagctaag

SEQ ID NO: 786873 - DNA, 20 bp, Artificial
  CRISPR gRNA sequence
tcaggagctaagaagccatc

SEQ ID NO: 786874 - DNA, 20 bp, Artificial
  CRISPR gRNA sequence
ggagctaagaagccatctgg

SEQ ID NO: 786875 - DNA, 20 bp, Artificial
  CRISPR gRNA sequence
gagctaagaagccatctgga

SEQ ID NO: 786876 - DNA, 20 bp, Artificial
  CRISPR gRNA sequence
taagaagccatctggaagga

SEQ ID NO: 786877 - DNA, 20 bp, Artificial
  CRISPR gRNA sequence
aagaagccatctggaaggaa

SEQ ID NO: 786878 - DNA, 20 bp, Artificial
  CRISPR gRNA sequence
agaagccatctggaaggaaa

SEQ ID NO: 786879 - DNA, 20 bp, Artificial
  CRISPR gRNA sequence
catctggaaggaaagggacc

SEQ ID NO: 786880 - DNA, 20 bp, Artificial
  CRISPR gRNA sequence
ttctttacttaactttgcaa

SEQ ID NO: 786881 - DNA, 20 bp, Artificial
  CRISPR gRNA sequence
acttaactttgcaatggact

SEQ ID NO: 786882 - DNA, 20 bp, Artificial
  CRISPR gRNA sequence
ttgcaatggactaagaaatt

SEQ ID NO: 786883 - DNA, 20 bp, Artificial
  CRISPR gRNA sequence
tgcaatggactaagaaattc

SEQ ID NO: 786884 - DNA, 20 bp, Artificial
  CRISPR gRNA sequence
taagaaattcaggataccaa

SEQ ID NO: 786885 - DNA, 20 bp, Artificial
  CRISPR gRNA sequence
ttcaggataccaatggccct

SEQ ID NO: 786886 - DNA, 20 bp, Artificial
  CRISPR gRNA sequence
caggataccaatggccctaa

SEQ ID NO: 786887 - DNA, 20 bp, Artificial
  CRISPR gRNA sequence
aggataccaatggccctaag

SEQ ID NO: 786888 - DNA, 20 bp, Artificial
  CRISPR gRNA sequence
aatggccctaagaggaactg

SEQ ID NO: 786889 - DNA, 20 bp, Artificial
  CRISPR gRNA sequence
tggccctaagaggaactgaa

SEQ ID NO: 786890 - DNA, 20 bp, Artificial
  CRISPR gRNA sequence
ccctaagaggaactgaagag

SEQ ID NO: 786891 - DNA, 20 bp, Artificial
  CRISPR gRNA sequence
cctaagaggaactgaagaga

SEQ ID NO: 786892 - DNA, 20 bp, Artificial
  CRISPR gRNA sequence
aagaggaactgaagagaagg

SEQ ID NO: 786893 - DNA, 20 bp, Artificial
  CRISPR gRNA sequence
ggaactgaagagaaggaagt

SEQ ID NO: 786894 - DNA, 20 bp, Artificial
  CRISPR gRNA sequence
gaactgaagagaaggaagtt

SEQ ID NO: 786895 - DNA, 20 bp, Artificial
  CRISPR gRNA sequence
gaagagaaggaagttaggac

SEQ ID NO: 786896 - DNA, 20 bp, Artificial
  CRISPR gRNA sequence
ggaagttaggactggcgtcc

SEQ ID NO: 786897 - DNA, 20 bp, Artificial
  CRISPR gRNA sequence
gaagttaggactggcgtccc

SEQ ID NO: 786898 - DNA, 20 bp, Artificial
  CRISPR gRNA sequence
tggcgtcccaggctcaacat

SEQ ID NO: 786899 - DNA, 20 bp, Artificial
  CRISPR gRNA sequence
ggcgtcccaggctcaacatg

SEQ ID NO: 786900 - DNA, 20 bp, Artificial
  CRISPR gRNA sequence
gcgtcccaggctcaacatga

SEQ ID NO: 786901 - DNA, 20 bp, Artificial
  CRISPR gRNA sequence
ccaggctcaacatgagggcc

SEQ ID NO: 786902 - DNA, 20 bp, Artificial
  CRISPR gRNA sequence
ggctcaacatgagggcctag

SEQ ID NO: 786903 - DNA, 20 bp, Artificial
  CRISPR gRNA sequence
gctcaacatgagggcctaga

SEQ ID NO: 786904 - DNA, 20 bp, Artificial
  CRISPR gRNA sequence
ctcaacatgagggcctagaa

SEQ ID NO: 786905 - DNA, 20 bp, Artificial
  CRISPR gRNA sequence
aacatgagggcctagaaggg

SEQ ID NO: 786906 - DNA, 20 bp, Artificial
  CRISPR gRNA sequence
catgagggcctagaagggaa

SEQ ID NO: 786907 - DNA, 20 bp, Artificial
  CRISPR gRNA sequence
atgagggcctagaagggaag

SEQ ID NO: 786908 - DNA, 20 bp, Artificial
  CRISPR gRNA sequence
gggcctagaagggaagaggc

SEQ ID NO: 786909 - DNA, 20 bp, Artificial
  CRISPR gRNA sequence
gggaagaggctggctgtgtg

SEQ ID NO: 786910 - DNA, 20 bp, Artificial
  CRISPR gRNA sequence
aggctggctgtgtgcagctg

SEQ ID NO: 786911 - DNA, 20 bp, Artificial
  CRISPR gRNA sequence
ggctgtgtgcagctgtggct

SEQ ID NO: 786912 - DNA, 20 bp, Artificial
  CRISPR gRNA sequence
gctgtgtgcagctgtggcta

SEQ ID NO: 786913 - DNA, 20 bp, Artificial
  CRISPR gRNA sequence
gtgtgcagctgtggctaagg

SEQ ID NO: 786914 - DNA, 20 bp, Artificial
  CRISPR gRNA sequence
tgtgcagctgtggctaaggc

SEQ ID NO: 786915 - DNA, 20 bp, Artificial
  CRISPR gRNA sequence
gtgcagctgtggctaaggca

SEQ ID NO: 786916 - DNA, 20 bp, Artificial
  CRISPR gRNA sequence
cctcctacctcatcaaccca

SEQ ID NO: 786917 - DNA, 20 bp, Artificial
  CRISPR gRNA sequence
ctcctacctcatcaacccat

SEQ ID NO: 786918 - DNA, 20 bp, Artificial
  CRISPR gRNA sequence
tcctacctcatcaacccata

SEQ ID NO: 786919 - DNA, 20 bp, Artificial
  CRISPR gRNA sequence
cctacctcatcaacccatag

SEQ ID NO: 786920 - DNA, 20 bp, Artificial
  CRISPR gRNA sequence
aacccataggggtcctgctt

SEQ ID NO: 786921 - DNA, 20 bp, Artificial
  CRISPR gRNA sequence
acccataggggtcctgcttt

SEQ ID NO: 786922 - DNA, 20 bp, Artificial
  CRISPR gRNA sequence
tcctgctttgggaccaatga

SEQ ID NO: 786923 - DNA, 20 bp, Artificial
  CRISPR gRNA sequence
ctgctttgggaccaatgaca

SEQ ID NO: 786924 - DNA, 20 bp, Artificial
  CRISPR gRNA sequence
accaatgacagagcatgtgt

SEQ ID NO: 786925 - DNA, 20 bp, Artificial
  CRISPR gRNA sequence
ccaatgacagagcatgtgtt

SEQ ID NO: 786926 - DNA, 20 bp, Artificial
  CRISPR gRNA sequence
caatgacagagcatgtgttg

SEQ ID NO: 786927 - DNA, 20 bp, Artificial
  CRISPR gRNA sequence
agcatgtgttggggaaccat

SEQ ID NO: 786928 - DNA, 20 bp, Artificial
  CRISPR gRNA sequence
ccataagaactgtaatcttg

SEQ ID NO: 786929 - DNA, 20 bp, Artificial
  CRISPR gRNA sequence
actgtaatcttgtagcactg

SEQ ID NO: 786930 - DNA, 20 bp, Artificial
  CRISPR gRNA sequence
ttgtagcactgtggtctgtg

SEQ ID NO: 786931 - DNA, 20 bp, Artificial
  CRISPR gRNA sequence
tgtagcactgtggtctgtgt

SEQ ID NO: 786932 - DNA, 20 bp, Artificial
  CRISPR gRNA sequence
gtagcactgtggtctgtgtg

SEQ ID NO: 786933 - DNA, 20 bp, Artificial
  CRISPR gRNA sequence
actgtggtctgtgtggggat

SEQ ID NO: 786934 - DNA, 20 bp, Artificial
  CRISPR gRNA sequence
gtctgtgtggggatcggaac

SEQ ID NO: 786935 - DNA, 20 bp, Artificial
  CRISPR gRNA sequence
gtgtggggatcggaaccagc

SEQ ID NO: 786936 - DNA, 20 bp, Artificial
  CRISPR gRNA sequence
tgtggggatcggaaccagca

SEQ ID NO: 786937 - DNA, 20 bp, Artificial
  CRISPR gRNA sequence
ccagcaaggttacctttgca

SEQ ID NO: 786938 - DNA, 20 bp, Artificial
  CRISPR gRNA sequence
gcaaggttacctttgcacag

SEQ ID NO: 786939 - DNA, 20 bp, Artificial
  CRISPR gRNA sequence
ggttacctttgcacagtgga

SEQ ID NO: 786940 - DNA, 20 bp, Artificial
  CRISPR gRNA sequence
ttacctttgcacagtggatg

SEQ ID NO: 786941 - DNA, 20 bp, Artificial
  CRISPR gRNA sequence
gcacagtggatggagacatc

SEQ ID NO: 786942 - DNA, 20 bp, Artificial
  CRISPR gRNA sequence
cagtggatggagacatctgg

SEQ ID NO: 786943 - DNA, 20 bp, Artificial
  CRISPR gRNA sequence
agtggatggagacatctgga

SEQ ID NO: 786944 - DNA, 20 bp, Artificial
  CRISPR gRNA sequence
atggagacatctggaaggac

SEQ ID NO: 786945 - DNA, 20 bp, Artificial
  CRISPR gRNA sequence
ggagacatctggaaggacca

SEQ ID NO: 786946 - DNA, 20 bp, Artificial
  CRISPR gRNA sequence
gaaggaccagagattctgca

SEQ ID NO: 786947 - DNA, 20 bp, Artificial
  CRISPR gRNA sequence
gaccagagattctgcatggc

SEQ ID NO: 786948 - DNA, 20 bp, Artificial
  CRISPR gRNA sequence
ccagagattctgcatggccg

SEQ ID NO: 786949 - DNA, 20 bp, Artificial
  CRISPR gRNA sequence
gagattctgcatggccggag

SEQ ID NO: 786950 - DNA, 20 bp, Artificial
  CRISPR gRNA sequence
ttctgcatggccggagtaga

SEQ ID NO: 786951 - DNA, 20 bp, Artificial
  CRISPR gRNA sequence
agacagcaactgctcaaaac

SEQ ID NO: 786952 - DNA, 20 bp, Artificial
  CRISPR gRNA sequence
gacagcaactgctcaaaacc

SEQ ID NO: 786953 - DNA, 20 bp, Artificial
  CRISPR gRNA sequence
acagcaactgctcaaaacca

SEQ ID NO: 786954 - DNA, 20 bp, Artificial
  CRISPR gRNA sequence
tgctcaaaaccagggccctc

SEQ ID NO: 786955 - DNA, 20 bp, Artificial
  CRISPR gRNA sequence
ctcaaaaccagggccctctg

SEQ ID NO: 786956 - DNA, 20 bp, Artificial
  CRISPR gRNA sequence
tcaaaaccagggccctctgg

SEQ ID NO: 786957 - DNA, 20 bp, Artificial
  CRISPR gRNA sequence
ggccctctggaggactaacc

SEQ ID NO: 786958 - DNA, 20 bp, Artificial
  CRISPR gRNA sequence
ggaggactaacctagctgcc

SEQ ID NO: 786959 - DNA, 20 bp, Artificial
  CRISPR gRNA sequence
ctaacctagctgcctagcac

SEQ ID NO: 786960 - DNA, 20 bp, Artificial
  CRISPR gRNA sequence
gctgcctagcactggccctg

SEQ ID NO: 786961 - DNA, 20 bp, Artificial
  CRISPR gRNA sequence
ctgcctagcactggccctgt

SEQ ID NO: 786962 - DNA, 20 bp, Artificial
  CRISPR gRNA sequence
tagcactggccctgtgggct

SEQ ID NO: 786963 - DNA, 20 bp, Artificial
  CRISPR gRNA sequence
actggccctgtgggctaagt

SEQ ID NO: 786964 - DNA, 20 bp, Artificial
  CRISPR gRNA sequence
tgtgggctaagtaagctttc

SEQ ID NO: 786965 - DNA, 20 bp, Artificial
  CRISPR gRNA sequence
gggctaagtaagctttctgg

SEQ ID NO: 786966 - DNA, 20 bp, Artificial
  CRISPR gRNA sequence
gtaagctttctggcagtttg

SEQ ID NO: 786967 - DNA, 20 bp, Artificial
  CRISPR gRNA sequence
taagctttctggcagtttgt

SEQ ID NO: 786968 - DNA, 20 bp, Artificial
  CRISPR gRNA sequence
agctttctggcagtttgtgg

SEQ ID NO: 786969 - DNA, 20 bp, Artificial
  CRISPR gRNA sequence
gctttctggcagtttgtggg

SEQ ID NO: 786970 - DNA, 20 bp, Artificial
  CRISPR gRNA sequence
ttctggcagtttgtgggagg

SEQ ID NO: 786971 - DNA, 20 bp, Artificial
  CRISPR gRNA sequence
ctggcagtttgtgggaggtg

SEQ ID NO: 786972 - DNA, 20 bp, Artificial
  CRISPR gRNA sequence
gcagtttgtgggaggtggag

SEQ ID NO: 786973 - DNA, 20 bp, Artificial
  CRISPR gRNA sequence
ggtggagaagtacatgctat

SEQ ID NO: 786974 - DNA, 20 bp, Artificial
  CRISPR gRNA sequence
tggagaagtacatgctataa

SEQ ID NO: 786975 - DNA, 20 bp, Artificial
  CRISPR gRNA sequence
ggagaagtacatgctataag

SEQ ID NO: 786976 - DNA, 20 bp, Artificial
  CRISPR gRNA sequence
gagaagtacatgctataaga

SEQ ID NO: 786977 - DNA, 20 bp, Artificial
  CRISPR gRNA sequence
gaagtacatgctataagagg

SEQ ID NO: 786978 - DNA, 20 bp, Artificial
  CRISPR gRNA sequence
gagacactgaacttcttgct

SEQ ID NO: 786979 - DNA, 20 bp, Artificial
  CRISPR gRNA sequence
cactgaacttcttgctaaga

SEQ ID NO: 786980 - DNA, 20 bp, Artificial
  CRISPR gRNA sequence
actgaacttcttgctaagat

SEQ ID NO: 786981 - DNA, 20 bp, Artificial
  CRISPR gRNA sequence
ttcttgctaagatgggcatg

SEQ ID NO: 786982 - DNA, 20 bp, Artificial
  CRISPR gRNA sequence
tcttgctaagatgggcatgt

SEQ ID NO: 786983 - DNA, 20 bp, Artificial
  CRISPR gRNA sequence
agatgggcatgtgggtactt

SEQ ID NO: 786984 - DNA, 20 bp, Artificial
  CRISPR gRNA sequence
gatgggcatgtgggtacttg

SEQ ID NO: 786985 - DNA, 20 bp, Artificial
  CRISPR gRNA sequence
tgggtacttgaggaatcaat

SEQ ID NO: 786986 - DNA, 20 bp, Artificial
  CRISPR gRNA sequence
ggaatcaattggaaaattaa

SEQ ID NO: 786987 - DNA, 20 bp, Artificial
  CRISPR gRNA sequence
gaatcaattggaaaattaaa

SEQ ID NO: 786988 - DNA, 20 bp, Artificial
  CRISPR gRNA sequence
aatcaattggaaaattaaaa

SEQ ID NO: 786989 - DNA, 20 bp, Artificial
  CRISPR gRNA sequence
taaaagggatgcaatttaat

SEQ ID NO: 786990 - DNA, 20 bp, Artificial
  CRISPR gRNA sequence
aagggatgcaatttaattgg

SEQ ID NO: 786991 - DNA, 20 bp, Artificial
  CRISPR gRNA sequence
tgcaatttaattggtagtcc

SEQ ID NO: 786992 - DNA, 20 bp, Artificial
  CRISPR gRNA sequence
ggtagtccaagctattaaaa

SEQ ID NO: 786993 - DNA, 20 bp, Artificial
  CRISPR gRNA sequence
caagctattaaaacagatcc

SEQ ID NO: 786994 - DNA, 20 bp, Artificial
  CRISPR gRNA sequence
tagacatgtgattgtgtgct

SEQ ID NO: 786995 - DNA, 20 bp, Artificial
  CRISPR gRNA sequence
ttgtgtgctgagtatactga

SEQ ID NO: 786996 - DNA, 20 bp, Artificial
  CRISPR gRNA sequence
tgtgctgagtatactgaaag

SEQ ID NO: 786997 - DNA, 20 bp, Artificial
  CRISPR gRNA sequence
gctgagtatactgaaagaag

SEQ ID NO: 786998 - DNA, 20 bp, Artificial
  CRISPR gRNA sequence
gagtatactgaaagaagaag

SEQ ID NO: 786999 - DNA, 20 bp, Artificial
  CRISPR gRNA sequence
agtatactgaaagaagaagt

SEQ ID NO: 787000 - DNA, 20 bp, Artificial
  CRISPR gRNA sequence
gaaagaagaagtaggtgcta

SEQ ID NO: 787001 - DNA, 20 bp, Artificial
  CRISPR gRNA sequence
gtgctatggaaacatataat

SEQ ID NO: 787002 - DNA, 20 bp, Artificial
  CRISPR gRNA sequence
tgctatggaaacatataata

SEQ ID NO: 787003 - DNA, 20 bp, Artificial
  CRISPR gRNA sequence
gctatggaaacatataataa

SEQ ID NO: 787004 - DNA, 20 bp, Artificial
  CRISPR gRNA sequence
ctatggaaacatataataag

SEQ ID NO: 787005 - DNA, 20 bp, Artificial
  CRISPR gRNA sequence
aataaggggatttaatgtaa

SEQ ID NO: 787006 - DNA, 20 bp, Artificial
  CRISPR gRNA sequence
ataaggggatttaatgtaat

SEQ ID NO: 787007 - DNA, 20 bp, Artificial
  CRISPR gRNA sequence
gggatttaatgtaatgggtg

SEQ ID NO: 787008 - DNA, 20 bp, Artificial
  CRISPR gRNA sequence
aatgtaatgggtgtggtgcg

SEQ ID NO: 787009 - DNA, 20 bp, Artificial
  CRISPR gRNA sequence
tgtaatgggtgtggtgcgtg

SEQ ID NO: 787010 - DNA, 20 bp, Artificial
  CRISPR gRNA sequence
gtaatgggtgtggtgcgtgg

SEQ ID NO: 787011 - DNA, 20 bp, Artificial
  CRISPR gRNA sequence
atgggtgtggtgcgtggagg

SEQ ID NO: 787012 - DNA, 20 bp, Artificial
  CRISPR gRNA sequence
gtggtgcgtggaggtagaat

SEQ ID NO: 787013 - DNA, 20 bp, Artificial
  CRISPR gRNA sequence
tggtgcgtggaggtagaatt

SEQ ID NO: 787014 - DNA, 20 bp, Artificial
  CRISPR gRNA sequence
gcgtggaggtagaattagga

SEQ ID NO: 787015 - DNA, 20 bp, Artificial
  CRISPR gRNA sequence
gaattaggaaagacttgatg

SEQ ID NO: 787016 - DNA, 20 bp, Artificial
  CRISPR gRNA sequence
ggaaagacttgatgaagtat

SEQ ID NO: 787017 - DNA, 20 bp, Artificial
  CRISPR gRNA sequence
gacttgatgaagtataagct

SEQ ID NO: 787018 - DNA, 20 bp, Artificial
  CRISPR gRNA sequence
gatgaagtataagcttagct

SEQ ID NO: 787019 - DNA, 20 bp, Artificial
  CRISPR gRNA sequence
taagcttagctgagatttaa

SEQ ID NO: 787020 - DNA, 20 bp, Artificial
  CRISPR gRNA sequence
tttaaaagatgactccaact

SEQ ID NO: 787021 - DNA, 20 bp, Artificial
  CRISPR gRNA sequence
ttaaaagatgactccaactc

SEQ ID NO: 787022 - DNA, 20 bp, Artificial
  CRISPR gRNA sequence
aaagatgactccaactcagg

SEQ ID NO: 787023 - DNA, 20 bp, Artificial
  CRISPR gRNA sequence
ctccaactcaggtggacaac

SEQ ID NO: 787024 - DNA, 20 bp, Artificial
  CRISPR gRNA sequence
acaacaagaaaaaatatttt

SEQ ID NO: 787025 - DNA, 20 bp, Artificial
  CRISPR gRNA sequence
acaagaaaaaatattttaag

SEQ ID NO: 787026 - DNA, 20 bp, Artificial
  CRISPR gRNA sequence
aagaaaaaatattttaagaa

SEQ ID NO: 787027 - DNA, 20 bp, Artificial
  CRISPR gRNA sequence
aagaagagacaatattgtat

SEQ ID NO: 787028 - DNA, 20 bp, Artificial
  CRISPR gRNA sequence
caatattgtatgagaaaact

SEQ ID NO: 787029 - DNA, 20 bp, Artificial
  CRISPR gRNA sequence
atgagaaaactcggaattga

SEQ ID NO: 787030 - DNA, 20 bp, Artificial
  CRISPR gRNA sequence
tgaaagactgccatgcctct

SEQ ID NO: 787031 - DNA, 20 bp, Artificial
  CRISPR gRNA sequence
gaaagactgccatgcctctg

SEQ ID NO: 787032 - DNA, 20 bp, Artificial
  CRISPR gRNA sequence
actgccatgcctctgaggac

SEQ ID NO: 787033 - DNA, 20 bp, Artificial
  CRISPR gRNA sequence
gaggactagaaaatcctgtg

SEQ ID NO: 787034 - DNA, 20 bp, Artificial
  CRISPR gRNA sequence
actagaaaatcctgtgtggt

SEQ ID NO: 787035 - DNA, 20 bp, Artificial
  CRISPR gRNA sequence
tagaaaatcctgtgtggtta

SEQ ID NO: 787036 - DNA, 20 bp, Artificial
  CRISPR gRNA sequence
atcctgtgtggttagagctt

SEQ ID NO: 787037 - DNA, 20 bp, Artificial
  CRISPR gRNA sequence
ggttagagctttagacaatg

SEQ ID NO: 787038 - DNA, 20 bp, Artificial
  CRISPR gRNA sequence
gttagagctttagacaatga

SEQ ID NO: 787039 - DNA, 20 bp, Artificial
  CRISPR gRNA sequence
gctttagacaatgaaggtga

SEQ ID NO: 787040 - DNA, 20 bp, Artificial
  CRISPR gRNA sequence
caatgaaggtgatggtgatg

SEQ ID NO: 787041 - DNA, 20 bp, Artificial
  CRISPR gRNA sequence
aggtgatggtgatgcagtta

SEQ ID NO: 787042 - DNA, 20 bp, Artificial
  CRISPR gRNA sequence
gatggtgatgcagttaaagc

SEQ ID NO: 787043 - DNA, 20 bp, Artificial
  CRISPR gRNA sequence
tggtgatgcagttaaagctg

SEQ ID NO: 787044 - DNA, 20 bp, Artificial
  CRISPR gRNA sequence
gcagttaaagctggagacat

SEQ ID NO: 787045 - DNA, 20 bp, Artificial
  CRISPR gRNA sequence
agacatgagtcaaaccatcc

SEQ ID NO: 787046 - DNA, 20 bp, Artificial
  CRISPR gRNA sequence
gacatgagtcaaaccatcct

SEQ ID NO: 787047 - DNA, 20 bp, Artificial
  CRISPR gRNA sequence
tcaaaccatcctgggctcgt

SEQ ID NO: 787048 - DNA, 20 bp, Artificial
  CRISPR gRNA sequence
gggctcgttggaacttcatc

SEQ ID NO: 787049 - DNA, 20 bp, Artificial
  CRISPR gRNA sequence
tcgttggaacttcatccagt

SEQ ID NO: 787050 - DNA, 20 bp, Artificial
  CRISPR gRNA sequence
aacttcatccagtgagcaat

SEQ ID NO: 787051 - DNA, 20 bp, Artificial
  CRISPR gRNA sequence
ttcatccagtgagcaataag

SEQ ID NO: 787052 - DNA, 20 bp, Artificial
  CRISPR gRNA sequence
cagtgagcaataagaagcca

SEQ ID NO: 787053 - DNA, 20 bp, Artificial
  CRISPR gRNA sequence
gtgagcaataagaagccatg

SEQ ID NO: 787054 - DNA, 20 bp, Artificial
  CRISPR gRNA sequence
agcaataagaagccatggag

SEQ ID NO: 787055 - DNA, 20 bp, Artificial
  CRISPR gRNA sequence
gcaataagaagccatggaga

SEQ ID NO: 787056 - DNA, 20 bp, Artificial
  CRISPR gRNA sequence
aagaagccatggagaaggtc

SEQ ID NO: 787057 - DNA, 20 bp, Artificial
  CRISPR gRNA sequence
agccatggagaaggtctgga

SEQ ID NO: 787058 - DNA, 20 bp, Artificial
  CRISPR gRNA sequence
ccatggagaaggtctggaca

SEQ ID NO: 787059 - DNA, 20 bp, Artificial
  CRISPR gRNA sequence
catggagaaggtctggacag

SEQ ID NO: 787060 - DNA, 20 bp, Artificial
  CRISPR gRNA sequence
aggtctggacagaggacaca

SEQ ID NO: 787061 - DNA, 20 bp, Artificial
  CRISPR gRNA sequence
tctggacagaggacacatgg

SEQ ID NO: 787062 - DNA, 20 bp, Artificial
  CRISPR gRNA sequence
ggtagatttatgatttttaa

SEQ ID NO: 787063 - DNA, 20 bp, Artificial
  CRISPR gRNA sequence
tgatttttaaaagcctatta

SEQ ID NO: 787064 - DNA, 20 bp, Artificial
  CRISPR gRNA sequence
taaaagcctattatagcaaa

SEQ ID NO: 787065 - DNA, 20 bp, Artificial
  CRISPR gRNA sequence
agcctattatagcaaaaagt

SEQ ID NO: 787066 - DNA, 20 bp, Artificial
  CRISPR gRNA sequence
attatagcaaaaagtgagaa

SEQ ID NO: 787067 - DNA, 20 bp, Artificial
  CRISPR gRNA sequence
gcaaaaagtgagaacagacc

SEQ ID NO: 787068 - DNA, 20 bp, Artificial
  CRISPR gRNA sequence
aaagtgagaacagaccaagt

SEQ ID NO: 787069 - DNA, 20 bp, Artificial
  CRISPR gRNA sequence
agtgagaacagaccaagttg

SEQ ID NO: 787070 - DNA, 20 bp, Artificial
  CRISPR gRNA sequence
gtgagaacagaccaagttgg

SEQ ID NO: 787071 - DNA, 20 bp, Artificial
  CRISPR gRNA sequence
agaacagaccaagttggagg

SEQ ID NO: 787072 - DNA, 20 bp, Artificial
  CRISPR gRNA sequence
acagaccaagttggaggtag

SEQ ID NO: 787073 - DNA, 20 bp, Artificial
  CRISPR gRNA sequence
cagaccaagttggaggtagc

SEQ ID NO: 787074 - DNA, 20 bp, Artificial
  CRISPR gRNA sequence
gaccaagttggaggtagcag

SEQ ID NO: 787075 - DNA, 20 bp, Artificial
  CRISPR gRNA sequence
ggaggtagcaggagtgaata

SEQ ID NO: 787076 - DNA, 20 bp, Artificial
  CRISPR gRNA sequence
gaggtagcaggagtgaatac

SEQ ID NO: 787077 - DNA, 20 bp, Artificial
  CRISPR gRNA sequence
aggtagcaggagtgaataca

SEQ ID NO: 787078 - DNA, 20 bp, Artificial
  CRISPR gRNA sequence
aggagtgaatacagggaaac

SEQ ID NO: 787079 - DNA, 20 bp, Artificial
  CRISPR gRNA sequence
gtgaatacagggaaaccagt

SEQ ID NO: 787080 - DNA, 20 bp, Artificial
  CRISPR gRNA sequence
tgaatacagggaaaccagtt

SEQ ID NO: 787081 - DNA, 20 bp, Artificial
  CRISPR gRNA sequence
atacagggaaaccagttagg

SEQ ID NO: 787082 - DNA, 20 bp, Artificial
  CRISPR gRNA sequence
cagttaggaagatttctctg

SEQ ID NO: 787083 - DNA, 20 bp, Artificial
  CRISPR gRNA sequence
ggaagatttctctgtagtcc

SEQ ID NO: 787084 - DNA, 20 bp, Artificial
  CRISPR gRNA sequence
tagtccaagttgaaccacac

SEQ ID NO: 787085 - DNA, 20 bp, Artificial
  CRISPR gRNA sequence
tccaagttgaaccacactag

SEQ ID NO: 787086 - DNA, 20 bp, Artificial
  CRISPR gRNA sequence
aagttgaaccacactagcgg

SEQ ID NO: 787087 - DNA, 20 bp, Artificial
  CRISPR gRNA sequence
gaaccacactagcggcagtg

SEQ ID NO: 787088 - DNA, 20 bp, Artificial
  CRISPR gRNA sequence
acactagcggcagtgaagtt

SEQ ID NO: 787089 - DNA, 20 bp, Artificial
  CRISPR gRNA sequence
ggcagtgaagttcggccaat

SEQ ID NO: 787090 - DNA, 20 bp, Artificial
  CRISPR gRNA sequence
tcttgctgcttcccctttta

SEQ ID NO: 787091 - DNA, 20 bp, Artificial
  CRISPR gRNA sequence
gctgcttccccttttacaga

SEQ ID NO: 787092 - DNA, 20 bp, Artificial
  CRISPR gRNA sequence
cttccccttttacagataga

SEQ ID NO: 787093 - DNA, 20 bp, Artificial
  CRISPR gRNA sequence
cagatagaaagaccatctca

SEQ ID NO: 787094 - DNA, 20 bp, Artificial
  CRISPR gRNA sequence
atagaaagaccatctcaaag

SEQ ID NO: 787095 - DNA, 20 bp, Artificial
  CRISPR gRNA sequence
aaagaccatctcaaagaaga

SEQ ID NO: 787096 - DNA, 20 bp, Artificial
  CRISPR gRNA sequence
aagaccatctcaaagaagat

SEQ ID NO: 787097 - DNA, 20 bp, Artificial
  CRISPR gRNA sequence
agaagataggcaatttgtac

SEQ ID NO: 787098 - DNA, 20 bp, Artificial
  CRISPR gRNA sequence
gaagataggcaatttgtaca

SEQ ID NO: 787099 - DNA, 20 bp, Artificial
  CRISPR gRNA sequence
ataggcaatttgtacaaggt

SEQ ID NO: 787100 - DNA, 20 bp, Artificial
  CRISPR gRNA sequence
gcaatttgtacaaggtcaga

SEQ ID NO: 787101 - DNA, 20 bp, Artificial
  CRISPR gRNA sequence
aaggtcagaaagccaacaaa

SEQ ID NO: 787102 - DNA, 20 bp, Artificial
  CRISPR gRNA sequence
gtcagaaagccaacaaatgg

SEQ ID NO: 787103 - DNA, 20 bp, Artificial
  CRISPR gRNA sequence
aagccaacaaatggcagcac

SEQ ID NO: 787104 - DNA, 20 bp, Artificial
  CRISPR gRNA sequence
agccaacaaatggcagcaca

SEQ ID NO: 787105 - DNA, 20 bp, Artificial
  CRISPR gRNA sequence
caaatggcagcacaaggtcc

SEQ ID NO: 787106 - DNA, 20 bp, Artificial
  CRISPR gRNA sequence
ggcagcacaaggtcccagcc

SEQ ID NO: 787107 - DNA, 20 bp, Artificial
  CRISPR gRNA sequence
ccagcctagccctctgaccc

SEQ ID NO: 787108 - DNA, 20 bp, Artificial
  CRISPR gRNA sequence
agccctctgaccctggttta

SEQ ID NO: 787109 - DNA, 20 bp, Artificial
  CRISPR gRNA sequence
taaagctctgtctgcatcac

SEQ ID NO: 787110 - DNA, 20 bp, Artificial
  CRISPR gRNA sequence
agctctgtctgcatcaccag

SEQ ID NO: 787111 - DNA, 20 bp, Artificial
  CRISPR gRNA sequence
cagttctcaacccttttcca

SEQ ID NO: 787112 - DNA, 20 bp, Artificial
  CRISPR gRNA sequence
aacccttttccatggcacac

SEQ ID NO: 787113 - DNA, 20 bp, Artificial
  CRISPR gRNA sequence
ggcacacaagtttgtgtgca

SEQ ID NO: 787114 - DNA, 20 bp, Artificial
  CRISPR gRNA sequence
acacaagtttgtgtgcatgg

SEQ ID NO: 787115 - DNA, 20 bp, Artificial
  CRISPR gRNA sequence
tgtgcatggcagacacatgt

SEQ ID NO: 787116 - DNA, 20 bp, Artificial
  CRISPR gRNA sequence
catggcagacacatgtaaga

SEQ ID NO: 787117 - DNA, 20 bp, Artificial
  CRISPR gRNA sequence
ggcagacacatgtaagaaag

SEQ ID NO: 787118 - DNA, 20 bp, Artificial
  CRISPR gRNA sequence
aagaaagcagatctgaatgc

SEQ ID NO: 787119 - DNA, 20 bp, Artificial
  CRISPR gRNA sequence
aagcagatctgaatgcaagt

SEQ ID NO: 787120 - DNA, 20 bp, Artificial
  CRISPR gRNA sequence
agatctgaatgcaagtgagt

SEQ ID NO: 787121 - DNA, 20 bp, Artificial
  CRISPR gRNA sequence
atctgaatgcaagtgagttg

SEQ ID NO: 787122 - DNA, 20 bp, Artificial
  CRISPR gRNA sequence
aatgcaagtgagttggagac

SEQ ID NO: 787123 - DNA, 20 bp, Artificial
  CRISPR gRNA sequence
atgcaagtgagttggagaca

SEQ ID NO: 787124 - DNA, 20 bp, Artificial
  CRISPR gRNA sequence
tgcaagtgagttggagacaa

SEQ ID NO: 787125 - DNA, 20 bp, Artificial
  CRISPR gRNA sequence
agttggagacaagggttata

SEQ ID NO: 787126 - DNA, 20 bp, Artificial
  CRISPR gRNA sequence
gttggagacaagggttatat

SEQ ID NO: 787127 - DNA, 20 bp, Artificial
  CRISPR gRNA sequence
aggcaaccatgatttctctc

SEQ ID NO: 787128 - DNA, 20 bp, Artificial
  CRISPR gRNA sequence
ctggttcattaaaaatataa

SEQ ID NO: 787129 - DNA, 20 bp, Artificial
  CRISPR gRNA sequence
ttcacttaattcttatttgt

SEQ ID NO: 787130 - DNA, 20 bp, Artificial
  CRISPR gRNA sequence
cttaattcttatttgtaaga

SEQ ID NO: 787131 - DNA, 20 bp, Artificial
  CRISPR gRNA sequence
ttaattcttatttgtaagaa

SEQ ID NO: 787132 - DNA, 20 bp, Artificial
  CRISPR gRNA sequence
taagaaaggtctcctaatca

SEQ ID NO: 787133 - DNA, 20 bp, Artificial
  CRISPR gRNA sequence
aaaggtctcctaatcacagt

SEQ ID NO: 787134 - DNA, 20 bp, Artificial
  CRISPR gRNA sequence
cctaatcacagttagaactt

SEQ ID NO: 787135 - DNA, 20 bp, Artificial
  CRISPR gRNA sequence
agaacttgagctttacctcc

SEQ ID NO: 787136 - DNA, 20 bp, Artificial
  CRISPR gRNA sequence
ttgagctttacctcccagct

SEQ ID NO: 787137 - DNA, 20 bp, Artificial
  CRISPR gRNA sequence
gagctttacctcccagctcg

SEQ ID NO: 787138 - DNA, 20 bp, Artificial
  CRISPR gRNA sequence
tgatatcctcactcactctt

SEQ ID NO: 787139 - DNA, 20 bp, Artificial
  CRISPR gRNA sequence
tcctcactcactcttaagat

SEQ ID NO: 787140 - DNA, 20 bp, Artificial
  CRISPR gRNA sequence
cctcactcactcttaagatt

SEQ ID NO: 787141 - DNA, 20 bp, Artificial
  CRISPR gRNA sequence
ctcactcactcttaagattg

SEQ ID NO: 787142 - DNA, 20 bp, Artificial
  CRISPR gRNA sequence
tcactcttaagattggggtg

SEQ ID NO: 787143 - DNA, 20 bp, Artificial
  CRISPR gRNA sequence
cactcttaagattggggtga

SEQ ID NO: 787144 - DNA, 20 bp, Artificial
  CRISPR gRNA sequence
ttaagattggggtgaaggat

SEQ ID NO: 787145 - DNA, 20 bp, Artificial
  CRISPR gRNA sequence
taagattggggtgaaggatg

SEQ ID NO: 787146 - DNA, 20 bp, Artificial
  CRISPR gRNA sequence
agattggggtgaaggatgag

SEQ ID NO: 787147 - DNA, 20 bp, Artificial
  CRISPR gRNA sequence
attggggtgaaggatgagga

SEQ ID NO: 787148 - DNA, 20 bp, Artificial
  CRISPR gRNA sequence
ttggggtgaaggatgaggag

SEQ ID NO: 787149 - DNA, 20 bp, Artificial
  CRISPR gRNA sequence
tttatttccactctatcttt

SEQ ID NO: 787150 - DNA, 20 bp, Artificial
  CRISPR gRNA sequence
gactccattccattctccca

SEQ ID NO: 787151 - DNA, 20 bp, Artificial
  CRISPR gRNA sequence
ccattccattctcccaaaga

SEQ ID NO: 787152 - DNA, 20 bp, Artificial
  CRISPR gRNA sequence
tccattctcccaaagacagc

SEQ ID NO: 787153 - DNA, 20 bp, Artificial
  CRISPR gRNA sequence
tctcccaaagacagctggaa

SEQ ID NO: 787154 - DNA, 20 bp, Artificial
  CRISPR gRNA sequence
gacagctggaacggaacact

SEQ ID NO: 787155 - DNA, 20 bp, Artificial
  CRISPR gRNA sequence
cactcagctgctcatttctg

SEQ ID NO: 787156 - DNA, 20 bp, Artificial
  CRISPR gRNA sequence
tgctcatttctgaagttatt

SEQ ID NO: 787157 - DNA, 20 bp, Artificial
  CRISPR gRNA sequence
gctcatttctgaagttatta

SEQ ID NO: 787158 - DNA, 20 bp, Artificial
  CRISPR gRNA sequence
tcatttctgaagttattaag

SEQ ID NO: 787159 - DNA, 20 bp, Artificial
  CRISPR gRNA sequence
tgaagttattaaggagtcct

SEQ ID NO: 787160 - DNA, 20 bp, Artificial
  CRISPR gRNA sequence
gaagttattaaggagtcctc

SEQ ID NO: 787161 - DNA, 20 bp, Artificial
  CRISPR gRNA sequence
attaaggagtcctcaggccc

SEQ ID NO: 787162 - DNA, 20 bp, Artificial
  CRISPR gRNA sequence
ttaaggagtcctcaggcccc

SEQ ID NO: 787163 - DNA, 20 bp, Artificial
  CRISPR gRNA sequence
ggccccaggccttgaaccct

SEQ ID NO: 787164 - DNA, 20 bp, Artificial
  CRISPR gRNA sequence
gccccaggccttgaaccctg

SEQ ID NO: 787165 - DNA, 20 bp, Artificial
  CRISPR gRNA sequence
aggccttgaaccctgaggta

SEQ ID NO: 787166 - DNA, 20 bp, Artificial
  CRISPR gRNA sequence
ggccttgaaccctgaggtat

SEQ ID NO: 787167 - DNA, 20 bp, Artificial
  CRISPR gRNA sequence
gaaccctgaggtatgggtgt

SEQ ID NO: 787168 - DNA, 20 bp, Artificial
  CRISPR gRNA sequence
accctgaggtatgggtgtga

SEQ ID NO: 787169 - DNA, 20 bp, Artificial
  CRISPR gRNA sequence
ccctgaggtatgggtgtgag

SEQ ID NO: 787170 - DNA, 20 bp, Artificial
  CRISPR gRNA sequence
ggtatgggtgtgagaggtaa

SEQ ID NO: 787171 - DNA, 20 bp, Artificial
  CRISPR gRNA sequence
atgggtgtgagaggtaaaag

SEQ ID NO: 787172 - DNA, 20 bp, Artificial
  CRISPR gRNA sequence
tgtgagaggtaaaagaagaa

SEQ ID NO: 787173 - DNA, 20 bp, Artificial
  CRISPR gRNA sequence
gagaggtaaaagaagaatgg

SEQ ID NO: 787174 - DNA, 20 bp, Artificial
  CRISPR gRNA sequence
aggtaaaagaagaatggcag

SEQ ID NO: 787175 - DNA, 20 bp, Artificial
  CRISPR gRNA sequence
aaagaagaatggcagaagat

SEQ ID NO: 787176 - DNA, 20 bp, Artificial
  CRISPR gRNA sequence
tggcagaagataagacaact

SEQ ID NO: 787177 - DNA, 20 bp, Artificial
  CRISPR gRNA sequence
ggcagaagataagacaactg

SEQ ID NO: 787178 - DNA, 20 bp, Artificial
  CRISPR gRNA sequence
gcacctgacacaactctctg

SEQ ID NO: 787179 - DNA, 20 bp, Artificial
  CRISPR gRNA sequence
cctgacacaactctctgaag

SEQ ID NO: 787180 - DNA, 20 bp, Artificial
  CRISPR gRNA sequence
tctgaagtggttctatttaa

SEQ ID NO: 787181 - DNA, 20 bp, Artificial
  CRISPR gRNA sequence
gtggttctatttaaaagtcg

SEQ ID NO: 787182 - DNA, 20 bp, Artificial
  CRISPR gRNA sequence
tttaaaagtcgaagttctgt

SEQ ID NO: 787183 - DNA, 20 bp, Artificial
  CRISPR gRNA sequence
atacctcctcctttaccatg

SEQ ID NO: 787184 - DNA, 20 bp, Artificial
  CRISPR gRNA sequence
ctctttctccctcactcccc

SEQ ID NO: 787185 - DNA, 20 bp, Artificial
  CRISPR gRNA sequence
ctccctctgtctttttcttt

SEQ ID NO: 787186 - DNA, 20 bp, Artificial
  CRISPR gRNA sequence
caacaattccttgcattcta

SEQ ID NO: 787187 - DNA, 20 bp, Artificial
  CRISPR gRNA sequence
aattccttgcattctacagt

SEQ ID NO: 787188 - DNA, 20 bp, Artificial
  CRISPR gRNA sequence
ttctacagttagaaatattg

SEQ ID NO: 787189 - DNA, 20 bp, Artificial
  CRISPR gRNA sequence
acagttagaaatattgtggt

SEQ ID NO: 787190 - DNA, 20 bp, Artificial
  CRISPR gRNA sequence
aaatattgtggtcagcaccc

SEQ ID NO: 787191 - DNA, 20 bp, Artificial
  CRISPR gRNA sequence
caagtgaatacatacacaca

SEQ ID NO: 787192 - DNA, 20 bp, Artificial
  CRISPR gRNA sequence
aagtgaatacatacacacat

SEQ ID NO: 787193 - DNA, 20 bp, Artificial
  CRISPR gRNA sequence
agtgaatacatacacacata

SEQ ID NO: 787194 - DNA, 20 bp, Artificial
  CRISPR gRNA sequence
tacatacacacatagggcaa

SEQ ID NO: 787195 - DNA, 20 bp, Artificial
  CRISPR gRNA sequence
cacatagggcaatggacaaa

SEQ ID NO: 787196 - DNA, 20 bp, Artificial
  CRISPR gRNA sequence
tagaacatgacaatatttta

SEQ ID NO: 787197 - DNA, 20 bp, Artificial
  CRISPR gRNA sequence
aacatgacaatattttatgg

SEQ ID NO: 787198 - DNA, 20 bp, Artificial
  CRISPR gRNA sequence
ttttatggcagatgaaaata

SEQ ID NO: 787199 - DNA, 20 bp, Artificial
  CRISPR gRNA sequence
tatggcagatgaaaatatag

SEQ ID NO: 787200 - DNA, 20 bp, Artificial
  CRISPR gRNA sequence
gatgaaaatatagaagttat

SEQ ID NO: 787201 - DNA, 20 bp, Artificial
  CRISPR gRNA sequence
gaagttatgagtataaatgt

SEQ ID NO: 787202 - DNA, 20 bp, Artificial
  CRISPR gRNA sequence
acaaccacttaaaattcccc

SEQ ID NO: 787203 - DNA, 20 bp, Artificial
  CRISPR gRNA sequence
cttaaaattcccctagtcct

SEQ ID NO: 787204 - DNA, 20 bp, Artificial
  CRISPR gRNA sequence
aaattcccctagtcctcaga

SEQ ID NO: 787205 - DNA, 20 bp, Artificial
  CRISPR gRNA sequence
acatgtcatttctctttcta

SEQ ID NO: 787206 - DNA, 20 bp, Artificial
  CRISPR gRNA sequence
tcatttctctttctatagat

SEQ ID NO: 787207 - DNA, 20 bp, Artificial
  CRISPR gRNA sequence
catttctctttctatagatg

SEQ ID NO: 787208 - DNA, 20 bp, Artificial
  CRISPR gRNA sequence
tctatagatgaggccatgta

SEQ ID NO: 787209 - DNA, 20 bp, Artificial
  CRISPR gRNA sequence
tgaggccatgtatagatctt

SEQ ID NO: 787210 - DNA, 20 bp, Artificial
  CRISPR gRNA sequence
aggccatgtatagatctttg

SEQ ID NO: 787211 - DNA, 20 bp, Artificial
  CRISPR gRNA sequence
ccatgtatagatctttggag

SEQ ID NO: 787212 - DNA, 20 bp, Artificial
  CRISPR gRNA sequence
gatctttggagaagttcatt

SEQ ID NO: 787213 - DNA, 20 bp, Artificial
  CRISPR gRNA sequence
ttggagaagttcattgagtg

SEQ ID NO: 787214 - DNA, 20 bp, Artificial
  CRISPR gRNA sequence
gaagttcattgagtgcagac

SEQ ID NO: 787215 - DNA, 20 bp, Artificial
  CRISPR gRNA sequence
aagttcattgagtgcagaca

SEQ ID NO: 787216 - DNA, 20 bp, Artificial
  CRISPR gRNA sequence
agttcattgagtgcagacaa

SEQ ID NO: 787217 - DNA, 20 bp, Artificial
  CRISPR gRNA sequence
ttcattgagtgcagacaagg

SEQ ID NO: 787218 - DNA, 20 bp, Artificial
  CRISPR gRNA sequence
gtgcagacaagggagccgtt

SEQ ID NO: 787219 - DNA, 20 bp, Artificial
  CRISPR gRNA sequence
tgcagacaagggagccgttt

SEQ ID NO: 787220 - DNA, 20 bp, Artificial
  CRISPR gRNA sequence
gacaagggagccgtttagga

SEQ ID NO: 787221 - DNA, 20 bp, Artificial
  CRISPR gRNA sequence
ggagccgtttaggaaagcac

SEQ ID NO: 787222 - DNA, 20 bp, Artificial
  CRISPR gRNA sequence
ccgtttaggaaagcaccagc

SEQ ID NO: 787223 - DNA, 20 bp, Artificial
  CRISPR gRNA sequence
cgtttaggaaagcaccagct

SEQ ID NO: 787224 - DNA, 20 bp, Artificial
  CRISPR gRNA sequence
agctaggcctgcatacattc

SEQ ID NO: 787225 - DNA, 20 bp, Artificial
  CRISPR gRNA sequence
gctaggcctgcatacattct

SEQ ID NO: 787226 - DNA, 20 bp, Artificial
  CRISPR gRNA sequence
ctaggcctgcatacattctg

SEQ ID NO: 787227 - DNA, 20 bp, Artificial
  CRISPR gRNA sequence
taggcctgcatacattctgg

SEQ ID NO: 787228 - DNA, 20 bp, Artificial
  CRISPR gRNA sequence
catacattctgggggttttg

SEQ ID NO: 787229 - DNA, 20 bp, Artificial
  CRISPR gRNA sequence
atacattctgggggttttgt

SEQ ID NO: 787230 - DNA, 20 bp, Artificial
  CRISPR gRNA sequence
cattctgggggttttgtggg

SEQ ID NO: 787231 - DNA, 20 bp, Artificial
  CRISPR gRNA sequence
attctgggggttttgtgggc

SEQ ID NO: 787232 - DNA, 20 bp, Artificial
  CRISPR gRNA sequence
ttttgtgggcaggctccacc

SEQ ID NO: 787233 - DNA, 20 bp, Artificial
  CRISPR gRNA sequence
tttgtgggcaggctccaccc

SEQ ID NO: 787234 - DNA, 20 bp, Artificial
  CRISPR gRNA sequence
aggctccacccaggaaacca

SEQ ID NO: 787235 - DNA, 20 bp, Artificial
  CRISPR gRNA sequence
tccacccaggaaaccaaaga

SEQ ID NO: 787236 - DNA, 20 bp, Artificial
  CRISPR gRNA sequence
agacagacacatgaacaatg

SEQ ID NO: 787237 - DNA, 20 bp, Artificial
  CRISPR gRNA sequence
gaacaatgaagcaatgaaat

SEQ ID NO: 787238 - DNA, 20 bp, Artificial
  CRISPR gRNA sequence
aacaatgaagcaatgaaatc

SEQ ID NO: 787239 - DNA, 20 bp, Artificial
  CRISPR gRNA sequence
acaatgaagcaatgaaatca

SEQ ID NO: 787240 - DNA, 20 bp, Artificial
  CRISPR gRNA sequence
agcaatgaaatcagggctga

SEQ ID NO: 787241 - DNA, 20 bp, Artificial
  CRISPR gRNA sequence
gcaatgaaatcagggctgaa

SEQ ID NO: 787242 - DNA, 20 bp, Artificial
  CRISPR gRNA sequence
aaatcagggctgaaaggctt

SEQ ID NO: 787243 - DNA, 20 bp, Artificial
  CRISPR gRNA sequence
ggcttcagcatgctctgtcc

SEQ ID NO: 787244 - DNA, 20 bp, Artificial
  CRISPR gRNA sequence
tcagcatgctctgtcccagc

SEQ ID NO: 787245 - DNA, 20 bp, Artificial
  CRISPR gRNA sequence
ctctgtcccagctggtacaa

SEQ ID NO: 787246 - DNA, 20 bp, Artificial
  CRISPR gRNA sequence
tcccagctggtacaacagaa

SEQ ID NO: 787247 - DNA, 20 bp, Artificial
  CRISPR gRNA sequence
cccagctggtacaacagaac

SEQ ID NO: 787248 - DNA, 20 bp, Artificial
  CRISPR gRNA sequence
cagctggtacaacagaacag

SEQ ID NO: 787249 - DNA, 20 bp, Artificial
  CRISPR gRNA sequence
acaacagaacaggagtgtgt

SEQ ID NO: 787250 - DNA, 20 bp, Artificial
  CRISPR gRNA sequence
cagaacaggagtgtgttggt

SEQ ID NO: 787251 - DNA, 20 bp, Artificial
  CRISPR gRNA sequence
gtgtgttggtaagaatacaa

SEQ ID NO: 787252 - DNA, 20 bp, Artificial
  CRISPR gRNA sequence
tgtgttggtaagaatacaac

SEQ ID NO: 787253 - DNA, 20 bp, Artificial
  CRISPR gRNA sequence
tggtaagaatacaacaggct

SEQ ID NO: 787254 - DNA, 20 bp, Artificial
  CRISPR gRNA sequence
ggtaagaatacaacaggcta

SEQ ID NO: 787255 - DNA, 20 bp, Artificial
  CRISPR gRNA sequence
taagaatacaacaggctaag

SEQ ID NO: 787256 - DNA, 20 bp, Artificial
  CRISPR gRNA sequence
acaggctaaggagaaactcg

SEQ ID NO: 787257 - DNA, 20 bp, Artificial
  CRISPR gRNA sequence
caggctaaggagaaactcga

SEQ ID NO: 787258 - DNA, 20 bp, Artificial
  CRISPR gRNA sequence
aggctaaggagaaactcgaa

SEQ ID NO: 787259 - DNA, 20 bp, Artificial
  CRISPR gRNA sequence
gctaaggagaaactcgaagg

SEQ ID NO: 787260 - DNA, 20 bp, Artificial
  CRISPR gRNA sequence
aactcgaagggagctgctga

SEQ ID NO: 787261 - DNA, 20 bp, Artificial
  CRISPR gRNA sequence
gacgttaatgcaccaccaac

SEQ ID NO: 787262 - DNA, 20 bp, Artificial
  CRISPR gRNA sequence
gctgtttccttatccccaaa

SEQ ID NO: 787263 - DNA, 20 bp, Artificial
  CRISPR gRNA sequence
tcctttccttacccaaccgt

SEQ ID NO: 787264 - DNA, 20 bp, Artificial
  CRISPR gRNA sequence
cctttccttacccaaccgtg

SEQ ID NO: 787265 - DNA, 20 bp, Artificial
  CRISPR gRNA sequence
ccttacccaaccgtgaggtt

SEQ ID NO: 787266 - DNA, 20 bp, Artificial
  CRISPR gRNA sequence
aaccgtgaggttgagattcc

SEQ ID NO: 787267 - DNA, 20 bp, Artificial
  CRISPR gRNA sequence
accgtgaggttgagattcct

SEQ ID NO: 787268 - DNA, 20 bp, Artificial
  CRISPR gRNA sequence
cgtgaggttgagattcctgg

SEQ ID NO: 787269 - DNA, 20 bp, Artificial
  CRISPR gRNA sequence
tgaggttgagattcctggga

SEQ ID NO: 787270 - DNA, 20 bp, Artificial
  CRISPR gRNA sequence
gaggttgagattcctgggag

SEQ ID NO: 787271 - DNA, 20 bp, Artificial
  CRISPR gRNA sequence
aggttgagattcctgggaga

SEQ ID NO: 787272 - DNA, 20 bp, Artificial
  CRISPR gRNA sequence
ggttgagattcctgggagag

SEQ ID NO: 787273 - DNA, 20 bp, Artificial
  CRISPR gRNA sequence
gttgagattcctgggagagg

SEQ ID NO: 787274 - DNA, 20 bp, Artificial
  CRISPR gRNA sequence
gagattcctgggagaggggg

SEQ ID NO: 787275 - DNA, 20 bp, Artificial
  CRISPR gRNA sequence
agattcctgggagagggggt

SEQ ID NO: 787276 - DNA, 20 bp, Artificial
  CRISPR gRNA sequence
gagagggggtgggtttaacc

SEQ ID NO: 787277 - DNA, 20 bp, Artificial
  CRISPR gRNA sequence
agagggggtgggtttaaccc

SEQ ID NO: 787278 - DNA, 20 bp, Artificial
  CRISPR gRNA sequence
ggtttaacccaggtcatatc

SEQ ID NO: 787279 - DNA, 20 bp, Artificial
  CRISPR gRNA sequence
aacccaggtcatatccagac

SEQ ID NO: 787280 - DNA, 20 bp, Artificial
  CRISPR gRNA sequence
acccaggtcatatccagact

SEQ ID NO: 787281 - DNA, 20 bp, Artificial
  CRISPR gRNA sequence
cccaggtcatatccagactg

SEQ ID NO: 787282 - DNA, 20 bp, Artificial
  CRISPR gRNA sequence
gtcatatccagactggggaa

SEQ ID NO: 787283 - DNA, 20 bp, Artificial
  CRISPR gRNA sequence
catatccagactggggaaaa

SEQ ID NO: 787284 - DNA, 20 bp, Artificial
  CRISPR gRNA sequence
atatccagactggggaaaag

SEQ ID NO: 787285 - DNA, 20 bp, Artificial
  CRISPR gRNA sequence
tatccagactggggaaaaga

SEQ ID NO: 787286 - DNA, 20 bp, Artificial
  CRISPR gRNA sequence
atccagactggggaaaagag

SEQ ID NO: 787287 - DNA, 20 bp, Artificial
  CRISPR gRNA sequence
ggggaaaagaggggtgaaaa

SEQ ID NO: 787288 - DNA, 20 bp, Artificial
  CRISPR gRNA sequence
gaaaagaggggtgaaaatgg

SEQ ID NO: 787289 - DNA, 20 bp, Artificial
  CRISPR gRNA sequence
aaaagaggggtgaaaatgga

SEQ ID NO: 787290 - DNA, 20 bp, Artificial
  CRISPR gRNA sequence
gtgaaaatggaaggaatcct

SEQ ID NO: 787291 - DNA, 20 bp, Artificial
  CRISPR gRNA sequence
aaatggaaggaatcctcaga

SEQ ID NO: 787292 - DNA, 20 bp, Artificial
  CRISPR gRNA sequence
aatggaaggaatcctcagaa

SEQ ID NO: 787293 - DNA, 20 bp, Artificial
  CRISPR gRNA sequence
ggaatcctcagaaaggatcc

SEQ ID NO: 787294 - DNA, 20 bp, Artificial
  CRISPR gRNA sequence
ggatcctggcaacctcccac

SEQ ID NO: 787295 - DNA, 20 bp, Artificial
  CRISPR gRNA sequence
caacctcccaccagcaaaat

SEQ ID NO: 787296 - DNA, 20 bp, Artificial
  CRISPR gRNA sequence
acctcccaccagcaaaatcg

SEQ ID NO: 787297 - DNA, 20 bp, Artificial
  CRISPR gRNA sequence
accagcaaaatcggagcacg

SEQ ID NO: 787298 - DNA, 20 bp, Artificial
  CRISPR gRNA sequence
caaaataacatcactctcat

SEQ ID NO: 787299 - DNA, 20 bp, Artificial
  CRISPR gRNA sequence
aaaataacatcactctcatg

SEQ ID NO: 787300 - DNA, 20 bp, Artificial
  CRISPR gRNA sequence
cactctcatgaggctgatga

SEQ ID NO: 787301 - DNA, 20 bp, Artificial
  CRISPR gRNA sequence
atgaggctgatgaaagctct

SEQ ID NO: 787302 - DNA, 20 bp, Artificial
  CRISPR gRNA sequence
tgatgaaagctcttggctca

SEQ ID NO: 787303 - DNA, 20 bp, Artificial
  CRISPR gRNA sequence
aagctcttggctcaaagaat

SEQ ID NO: 787304 - DNA, 20 bp, Artificial
  CRISPR gRNA sequence
aagaataagacaaactcttt

SEQ ID NO: 787305 - DNA, 20 bp, Artificial
  CRISPR gRNA sequence
agacaaactctttcagacat

SEQ ID NO: 787306 - DNA, 20 bp, Artificial
  CRISPR gRNA sequence
aacattccctttaaaaaact

SEQ ID NO: 787307 - DNA, 20 bp, Artificial
  CRISPR gRNA sequence
ccctttaaaaaactcagtgt

SEQ ID NO: 787308 - DNA, 20 bp, Artificial
  CRISPR gRNA sequence
tttaaaaaactcagtgtaag

SEQ ID NO: 787309 - DNA, 20 bp, Artificial
  CRISPR gRNA sequence
aaaactcagtgtaagaagtt

SEQ ID NO: 787310 - DNA, 20 bp, Artificial
  CRISPR gRNA sequence
aagttcagctcactgacgat

SEQ ID NO: 787311 - DNA, 20 bp, Artificial
  CRISPR gRNA sequence
gttcagctcactgacgatga

SEQ ID NO: 787312 - DNA, 20 bp, Artificial
  CRISPR gRNA sequence
cgatgagagccattttcttc

SEQ ID NO: 787313 - DNA, 20 bp, Artificial
  CRISPR gRNA sequence
gatgagagccattttcttct

SEQ ID NO: 787314 - DNA, 20 bp, Artificial
  CRISPR gRNA sequence
atgagagccattttcttctg

SEQ ID NO: 787315 - DNA, 20 bp, Artificial
  CRISPR gRNA sequence
tctggggaaaaataatcatc

SEQ ID NO: 787316 - DNA, 20 bp, Artificial
  CRISPR gRNA sequence
ggaaaaataatcatcaagac

SEQ ID NO: 787317 - DNA, 20 bp, Artificial
  CRISPR gRNA sequence
taatcatcaagacaagctca

SEQ ID NO: 787318 - DNA, 20 bp, Artificial
  CRISPR gRNA sequence
tcatcaagacaagctcaaag

SEQ ID NO: 787319 - DNA, 20 bp, Artificial
  CRISPR gRNA sequence
acaagctcaaagtggttcat

SEQ ID NO: 787320 - DNA, 20 bp, Artificial
  CRISPR gRNA sequence
caaagtggttcataagctct

SEQ ID NO: 787321 - DNA, 20 bp, Artificial
  CRISPR gRNA sequence
agtggttcataagctctgag

SEQ ID NO: 787322 - DNA, 20 bp, Artificial
  CRISPR gRNA sequence
gtggttcataagctctgagt

SEQ ID NO: 787323 - DNA, 20 bp, Artificial
  CRISPR gRNA sequence
tcataagctctgagtgggtt

SEQ ID NO: 787324 - DNA, 20 bp, Artificial
  CRISPR gRNA sequence
tctgagtgggtttagcatga

SEQ ID NO: 787325 - DNA, 20 bp, Artificial
  CRISPR gRNA sequence
gagtgggtttagcatgaaag

SEQ ID NO: 787326 - DNA, 20 bp, Artificial
  CRISPR gRNA sequence
gggtttagcatgaaagcagc

SEQ ID NO: 787327 - DNA, 20 bp, Artificial
  CRISPR gRNA sequence
agcatgaaagcagcaagcca

SEQ ID NO: 787328 - DNA, 20 bp, Artificial
  CRISPR gRNA sequence
gcatgaaagcagcaagccat

SEQ ID NO: 787329 - DNA, 20 bp, Artificial
  CRISPR gRNA sequence
agcagcaagccataggcctg

SEQ ID NO: 787330 - DNA, 20 bp, Artificial
  CRISPR gRNA sequence
agccataggcctgcagtgca

SEQ ID NO: 787331 - DNA, 20 bp, Artificial
  CRISPR gRNA sequence
cataggcctgcagtgcaaag

SEQ ID NO: 787332 - DNA, 20 bp, Artificial
  CRISPR gRNA sequence
aggcctgcagtgcaaagcag

SEQ ID NO: 787333 - DNA, 20 bp, Artificial
  CRISPR gRNA sequence
caaagcagtggctcatgctg

SEQ ID NO: 787334 - DNA, 20 bp, Artificial
  CRISPR gRNA sequence
tggctcatgctgcagacacc

SEQ ID NO: 787335 - DNA, 20 bp, Artificial
  CRISPR gRNA sequence
gctgcagacacccagtgcat

SEQ ID NO: 787336 - DNA, 20 bp, Artificial
  CRISPR gRNA sequence
ctgcagacacccagtgcatt

SEQ ID NO: 787337 - DNA, 20 bp, Artificial
  CRISPR gRNA sequence
taaaactcacttaccttttg

SEQ ID NO: 787338 - DNA, 20 bp, Artificial
  CRISPR gRNA sequence
cacttaccttttgaagaata

SEQ ID NO: 787339 - DNA, 20 bp, Artificial
  CRISPR gRNA sequence
ttgaagaatacagcttttga

SEQ ID NO: 787340 - DNA, 20 bp, Artificial
  CRISPR gRNA sequence
gaagaatacagcttttgaca

SEQ ID NO: 787341 - DNA, 20 bp, Artificial
  CRISPR gRNA sequence
ttttgacagagttgttttct

SEQ ID NO: 787342 - DNA, 20 bp, Artificial
  CRISPR gRNA sequence
tttgacagagttgttttctt

SEQ ID NO: 787343 - DNA, 20 bp, Artificial
  CRISPR gRNA sequence
ttgacagagttgttttctta

SEQ ID NO: 787344 - DNA, 20 bp, Artificial
  CRISPR gRNA sequence
ttttcttagggctatcactg

SEQ ID NO: 787345 - DNA, 20 bp, Artificial
  CRISPR gRNA sequence
cactgtggctatgaaaatga

SEQ ID NO: 787346 - DNA, 20 bp, Artificial
  CRISPR gRNA sequence
tgaaaatgaaagcaatgatg

SEQ ID NO: 787347 - DNA, 20 bp, Artificial
  CRISPR gRNA sequence
aaatgaaagcaatgatgcag

SEQ ID NO: 787348 - DNA, 20 bp, Artificial
  CRISPR gRNA sequence
aatgaaagcaatgatgcaga

SEQ ID NO: 787349 - DNA, 20 bp, Artificial
  CRISPR gRNA sequence
atgaaagcaatgatgcagaa

SEQ ID NO: 787350 - DNA, 20 bp, Artificial
  CRISPR gRNA sequence
tgaaagcaatgatgcagaag

SEQ ID NO: 787351 - DNA, 20 bp, Artificial
  CRISPR gRNA sequence
cagaaggggatgaaaatgtg

SEQ ID NO: 787352 - DNA, 20 bp, Artificial
  CRISPR gRNA sequence
aaggggatgaaaatgtgaag

SEQ ID NO: 787353 - DNA, 20 bp, Artificial
  CRISPR gRNA sequence
gatgaaaatgtgaagcagcc

SEQ ID NO: 787354 - DNA, 20 bp, Artificial
  CRISPR gRNA sequence
aaaatgtgaagcagccaagt

SEQ ID NO: 787355 - DNA, 20 bp, Artificial
  CRISPR gRNA sequence
tgtgaagcagccaagttgga

SEQ ID NO: 787356 - DNA, 20 bp, Artificial
  CRISPR gRNA sequence
gtgaagcagccaagttggat

SEQ ID NO: 787357 - DNA, 20 bp, Artificial
  CRISPR gRNA sequence
cagccaagttggatgggtcc

SEQ ID NO: 787358 - DNA, 20 bp, Artificial
  CRISPR gRNA sequence
agccaagttggatgggtcct

SEQ ID NO: 787359 - DNA, 20 bp, Artificial
  CRISPR gRNA sequence
gtcctgggttccatctgacc

SEQ ID NO: 787360 - DNA, 20 bp, Artificial
  CRISPR gRNA sequence
tcctgggttccatctgacct

SEQ ID NO: 787361 - DNA, 20 bp, Artificial
  CRISPR gRNA sequence
ggttccatctgacctgggca

SEQ ID NO: 787362 - DNA, 20 bp, Artificial
  CRISPR gRNA sequence
gttccatctgacctgggcaa

SEQ ID NO: 787363 - DNA, 20 bp, Artificial
  CRISPR gRNA sequence
atctgacctgggcaaaggaa

SEQ ID NO: 787364 - DNA, 20 bp, Artificial
  CRISPR gRNA sequence
cctgggcaaaggaaaagcac

SEQ ID NO: 787365 - DNA, 20 bp, Artificial
  CRISPR gRNA sequence
agcaccagaatcctgttaca

SEQ ID NO: 787366 - DNA, 20 bp, Artificial
  CRISPR gRNA sequence
aatcctgttacatggcaact

SEQ ID NO: 787367 - DNA, 20 bp, Artificial
  CRISPR gRNA sequence
tcctgttacatggcaactaa

SEQ ID NO: 787368 - DNA, 20 bp, Artificial
  CRISPR gRNA sequence
cctgttacatggcaactaag

SEQ ID NO: 787369 - DNA, 20 bp, Artificial
  CRISPR gRNA sequence
gttacatggcaactaagagg

SEQ ID NO: 787370 - DNA, 20 bp, Artificial
  CRISPR gRNA sequence
gcaactaagaggtagaccaa

SEQ ID NO: 787371 - DNA, 20 bp, Artificial
  CRISPR gRNA sequence
caactaagaggtagaccaac

SEQ ID NO: 787372 - DNA, 20 bp, Artificial
  CRISPR gRNA sequence
taagaggtagaccaacaggc

SEQ ID NO: 787373 - DNA, 20 bp, Artificial
  CRISPR gRNA sequence
gaccaacaggctggccacat

SEQ ID NO: 787374 - DNA, 20 bp, Artificial
  CRISPR gRNA sequence
caacaggctggccacatgag

SEQ ID NO: 787375 - DNA, 20 bp, Artificial
  CRISPR gRNA sequence
aacaggctggccacatgagt

SEQ ID NO: 787376 - DNA, 20 bp, Artificial
  CRISPR gRNA sequence
ctggccacatgagtgggtga

SEQ ID NO: 787377 - DNA, 20 bp, Artificial
  CRISPR gRNA sequence
tgagtgggtgacagccaaca

SEQ ID NO: 787378 - DNA, 20 bp, Artificial
  CRISPR gRNA sequence
tgggtgacagccaacacggc

SEQ ID NO: 787379 - DNA, 20 bp, Artificial
  CRISPR gRNA sequence
agccaacacggctagctctg

SEQ ID NO: 787380 - DNA, 20 bp, Artificial
  CRISPR gRNA sequence
ccaacacggctagctctgtg

SEQ ID NO: 787381 - DNA, 20 bp, Artificial
  CRISPR gRNA sequence
gtggagcatttactccacac

SEQ ID NO: 787382 - DNA, 20 bp, Artificial
  CRISPR gRNA sequence
tggagcatttactccacacc

SEQ ID NO: 787383 - DNA, 20 bp, Artificial
  CRISPR gRNA sequence
tccacaccaggccctattct

SEQ ID NO: 787384 - DNA, 20 bp, Artificial
  CRISPR gRNA sequence
tctaagtgctctgcacctat

SEQ ID NO: 787385 - DNA, 20 bp, Artificial
  CRISPR gRNA sequence
ctcctcgcaaccactctgtg

SEQ ID NO: 787386 - DNA, 20 bp, Artificial
  CRISPR gRNA sequence
tcgcaaccactctgtgaagt

SEQ ID NO: 787387 - DNA, 20 bp, Artificial
  CRISPR gRNA sequence
tgctatgatccccatttcac

SEQ ID NO: 787388 - DNA, 20 bp, Artificial
  CRISPR gRNA sequence
tgatccccatttcactggtg

SEQ ID NO: 787389 - DNA, 20 bp, Artificial
  CRISPR gRNA sequence
ccccatttcactggtgaaga

SEQ ID NO: 787390 - DNA, 20 bp, Artificial
  CRISPR gRNA sequence
cccatttcactggtgaagaa

SEQ ID NO: 787391 - DNA, 20 bp, Artificial
  CRISPR gRNA sequence
ccatttcactggtgaagaaa

SEQ ID NO: 787392 - DNA, 20 bp, Artificial
  CRISPR gRNA sequence
atttcactggtgaagaaagg

SEQ ID NO: 787393 - DNA, 20 bp, Artificial
  CRISPR gRNA sequence
tttcactggtgaagaaaggg

SEQ ID NO: 787394 - DNA, 20 bp, Artificial
  CRISPR gRNA sequence
ctggtgaagaaagggaggca

SEQ ID NO: 787395 - DNA, 20 bp, Artificial
  CRISPR gRNA sequence
ggtgaagaaagggaggcaca

SEQ ID NO: 787396 - DNA, 20 bp, Artificial
  CRISPR gRNA sequence
tgaagaaagggaggcacaga

SEQ ID NO: 787397 - DNA, 20 bp, Artificial
  CRISPR gRNA sequence
aaagggaggcacagagagac

SEQ ID NO: 787398 - DNA, 20 bp, Artificial
  CRISPR gRNA sequence
aagggaggcacagagagact

SEQ ID NO: 787399 - DNA, 20 bp, Artificial
  CRISPR gRNA sequence
ggaggcacagagagactagg

SEQ ID NO: 787400 - DNA, 20 bp, Artificial
  CRISPR gRNA sequence
gagactaggaagctttccct

SEQ ID NO: 787401 - DNA, 20 bp, Artificial
  CRISPR gRNA sequence
gaagctttccctaagttaca

SEQ ID NO: 787402 - DNA, 20 bp, Artificial
  CRISPR gRNA sequence
ctttccctaagttacatagt

SEQ ID NO: 787403 - DNA, 20 bp, Artificial
  CRISPR gRNA sequence
aagttacatagtaagtgacc

SEQ ID NO: 787404 - DNA, 20 bp, Artificial
  CRISPR gRNA sequence
acatagtaagtgacccagct

SEQ ID NO: 787405 - DNA, 20 bp, Artificial
  CRISPR gRNA sequence
taagtgacccagctaagata

SEQ ID NO: 787406 - DNA, 20 bp, Artificial
  CRISPR gRNA sequence
gacccagctaagatacagtc

SEQ ID NO: 787407 - DNA, 20 bp, Artificial
  CRISPR gRNA sequence
gctaagatacagtctggttc

SEQ ID NO: 787408 - DNA, 20 bp, Artificial
  CRISPR gRNA sequence
cctcatcctctctctcttcc

SEQ ID NO: 787409 - DNA, 20 bp, Artificial
  CRISPR gRNA sequence
catcctctctctcttcccag

SEQ ID NO: 787410 - DNA, 20 bp, Artificial
  CRISPR gRNA sequence
tctctctcttcccagtggca

SEQ ID NO: 787411 - DNA, 20 bp, Artificial
  CRISPR gRNA sequence
ttcccagtggcaaagtctct

SEQ ID NO: 787412 - DNA, 20 bp, Artificial
  CRISPR gRNA sequence
aatgtctttcccccactgac

SEQ ID NO: 787413 - DNA, 20 bp, Artificial
  CRISPR gRNA sequence
cccccactgacaagtactca

SEQ ID NO: 787414 - DNA, 20 bp, Artificial
  CRISPR gRNA sequence
tgacaagtactcacagtgct

SEQ ID NO: 787415 - DNA, 20 bp, Artificial
  CRISPR gRNA sequence
gtgcttagaatctataccat

SEQ ID NO: 787416 - DNA, 20 bp, Artificial
  CRISPR gRNA sequence
accattagttgttaaatttc

SEQ ID NO: 787417 - DNA, 20 bp, Artificial
  CRISPR gRNA sequence
ccattagttgttaaatttca

SEQ ID NO: 787418 - DNA, 20 bp, Artificial
  CRISPR gRNA sequence
tgttaaatttcaaggattaa

SEQ ID NO: 787419 - DNA, 20 bp, Artificial
  CRISPR gRNA sequence
gttaaatttcaaggattaac

SEQ ID NO: 787420 - DNA, 20 bp, Artificial
  CRISPR gRNA sequence
aaggattaacaggatccttt

SEQ ID NO: 787421 - DNA, 20 bp, Artificial
  CRISPR gRNA sequence
gattaacaggatccttttgg

SEQ ID NO: 787422 - DNA, 20 bp, Artificial
  CRISPR gRNA sequence
caggatccttttggaagaaa

SEQ ID NO: 787423 - DNA, 20 bp, Artificial
  CRISPR gRNA sequence
ttggaagaaatagaatatcc

SEQ ID NO: 787424 - DNA, 20 bp, Artificial
  CRISPR gRNA sequence
tggaagaaatagaatatcct

SEQ ID NO: 787425 - DNA, 20 bp, Artificial
  CRISPR gRNA sequence
aagaaatagaatatcctagg

SEQ ID NO: 787426 - DNA, 20 bp, Artificial
  CRISPR gRNA sequence
tagtgttaatatactaaacc

SEQ ID NO: 787427 - DNA, 20 bp, Artificial
  CRISPR gRNA sequence
aaacctagtcactcatgcct

SEQ ID NO: 787428 - DNA, 20 bp, Artificial
  CRISPR gRNA sequence
ttagtgtgaattattacaat

SEQ ID NO: 787429 - DNA, 20 bp, Artificial
  CRISPR gRNA sequence
attggccctttgccttgttt

SEQ ID NO: 787430 - DNA, 20 bp, Artificial
  CRISPR gRNA sequence
gtttcggtttttcaacgtcc

SEQ ID NO: 787431 - DNA, 20 bp, Artificial
  CRISPR gRNA sequence
tttttcaacgtcctagcact

SEQ ID NO: 787432 - DNA, 20 bp, Artificial
  CRISPR gRNA sequence
ttttcaacgtcctagcactg

SEQ ID NO: 787433 - DNA, 20 bp, Artificial
  CRISPR gRNA sequence
caacgtcctagcactgagga

SEQ ID NO: 787434 - DNA, 20 bp, Artificial
  CRISPR gRNA sequence
aacgtcctagcactgaggaa

SEQ ID NO: 787435 - DNA, 20 bp, Artificial
  CRISPR gRNA sequence
acgtcctagcactgaggaaa

SEQ ID NO: 787436 - DNA, 20 bp, Artificial
  CRISPR gRNA sequence
cctagcactgaggaaagggt

SEQ ID NO: 787437 - DNA, 20 bp, Artificial
  CRISPR gRNA sequence
cactgaggaaagggtgagtt

SEQ ID NO: 787438 - DNA, 20 bp, Artificial
  CRISPR gRNA sequence
tgaggaaagggtgagtttag

SEQ ID NO: 787439 - DNA, 20 bp, Artificial
  CRISPR gRNA sequence
aggaaagggtgagtttagta

SEQ ID NO: 787440 - DNA, 20 bp, Artificial
  CRISPR gRNA sequence
ggaaagggtgagtttagtag

SEQ ID NO: 787441 - DNA, 20 bp, Artificial
  CRISPR gRNA sequence
gaaagggtgagtttagtaga

SEQ ID NO: 787442 - DNA, 20 bp, Artificial
  CRISPR gRNA sequence
agggtgagtttagtagaggg

SEQ ID NO: 787443 - DNA, 20 bp, Artificial
  CRISPR gRNA sequence
gagtttagtagagggtggat

SEQ ID NO: 787444 - DNA, 20 bp, Artificial
  CRISPR gRNA sequence
tttagtagagggtggatcag

SEQ ID NO: 787445 - DNA, 20 bp, Artificial
  CRISPR gRNA sequence
gtggatcagaagaataattc

SEQ ID NO: 787446 - DNA, 20 bp, Artificial
  CRISPR gRNA sequence
ggatcagaagaataattctg

SEQ ID NO: 787447 - DNA, 20 bp, Artificial
  CRISPR gRNA sequence
gatcagaagaataattctgg

SEQ ID NO: 787448 - DNA, 20 bp, Artificial
  CRISPR gRNA sequence
agaagaataattctggaggc

SEQ ID NO: 787449 - DNA, 20 bp, Artificial
  CRISPR gRNA sequence
gaagaataattctggaggct

SEQ ID NO: 787450 - DNA, 20 bp, Artificial
  CRISPR gRNA sequence
aagaataattctggaggctg

SEQ ID NO: 787451 - DNA, 20 bp, Artificial
  CRISPR gRNA sequence
ataattctggaggctgggga

SEQ ID NO: 787452 - DNA, 20 bp, Artificial
  CRISPR gRNA sequence
aggctggggaaagccttgta

SEQ ID NO: 787453 - DNA, 20 bp, Artificial
  CRISPR gRNA sequence
gaaagccttgtaaagtcctc

SEQ ID NO: 787454 - DNA, 20 bp, Artificial
  CRISPR gRNA sequence
gtaaagtcctctggtgtgta

SEQ ID NO: 787455 - DNA, 20 bp, Artificial
  CRISPR gRNA sequence
gtcctctggtgtgtacagat

SEQ ID NO: 787456 - DNA, 20 bp, Artificial
  CRISPR gRNA sequence
tggtgtgtacagattagaac

SEQ ID NO: 787457 - DNA, 20 bp, Artificial
  CRISPR gRNA sequence
ggtgtgtacagattagaaca

SEQ ID NO: 787458 - DNA, 20 bp, Artificial
  CRISPR gRNA sequence
gtgtgtacagattagaacaa

SEQ ID NO: 787459 - DNA, 20 bp, Artificial
  CRISPR gRNA sequence
acagattagaacaagggctc

SEQ ID NO: 787460 - DNA, 20 bp, Artificial
  CRISPR gRNA sequence
caagggctccagactgacaa

SEQ ID NO: 787461 - DNA, 20 bp, Artificial
  CRISPR gRNA sequence
aagggctccagactgacaaa

SEQ ID NO: 787462 - DNA, 20 bp, Artificial
  CRISPR gRNA sequence
ggctccagactgacaaaagg

SEQ ID NO: 787463 - DNA, 20 bp, Artificial
  CRISPR gRNA sequence
gctccagactgacaaaaggc

SEQ ID NO: 787464 - DNA, 20 bp, Artificial
  CRISPR gRNA sequence
ctccagactgacaaaaggca

SEQ ID NO: 787465 - DNA, 20 bp, Artificial
  CRISPR gRNA sequence
agactgacaaaaggcagggc

SEQ ID NO: 787466 - DNA, 20 bp, Artificial
  CRISPR gRNA sequence
actgacaaaaggcagggcta

SEQ ID NO: 787467 - DNA, 20 bp, Artificial
  CRISPR gRNA sequence
ctgacaaaaggcagggctag

SEQ ID NO: 787468 - DNA, 20 bp, Artificial
  CRISPR gRNA sequence
gacaaaaggcagggctagag

SEQ ID NO: 787469 - DNA, 20 bp, Artificial
  CRISPR gRNA sequence
gctagaggagtgttcaccta

SEQ ID NO: 787470 - DNA, 20 bp, Artificial
  CRISPR gRNA sequence
ctagaggagtgttcacctac

SEQ ID NO: 787471 - DNA, 20 bp, Artificial
  CRISPR gRNA sequence
tagaggagtgttcacctaca

SEQ ID NO: 787472 - DNA, 20 bp, Artificial
  CRISPR gRNA sequence
gttcacctacagggaaatga

SEQ ID NO: 787473 - DNA, 20 bp, Artificial
  CRISPR gRNA sequence
ttcacctacagggaaatgaa

SEQ ID NO: 787474 - DNA, 20 bp, Artificial
  CRISPR gRNA sequence
tcacctacagggaaatgaaa

SEQ ID NO: 787475 - DNA, 20 bp, Artificial
  CRISPR gRNA sequence
agggaaatgaaagggtactc

SEQ ID NO: 787476 - DNA, 20 bp, Artificial
  CRISPR gRNA sequence
ttaatttgtgccctattcaa

SEQ ID NO: 787477 - DNA, 20 bp, Artificial
  CRISPR gRNA sequence
aaaagcttgaattttgcctc

SEQ ID NO: 787478 - DNA, 20 bp, Artificial
  CRISPR gRNA sequence
aagcttgaattttgcctctg

SEQ ID NO: 787479 - DNA, 20 bp, Artificial
  CRISPR gRNA sequence
tgcctctggagtcattcaca

SEQ ID NO: 787480 - DNA, 20 bp, Artificial
  CRISPR gRNA sequence
ttcacatggaataaacatga

SEQ ID NO: 787481 - DNA, 20 bp, Artificial
  CRISPR gRNA sequence
tcacatggaataaacatgac

SEQ ID NO: 787482 - DNA, 20 bp, Artificial
  CRISPR gRNA sequence
atggaataaacatgacaggc

SEQ ID NO: 787483 - DNA, 20 bp, Artificial
  CRISPR gRNA sequence
ataaacatgacaggctggta

SEQ ID NO: 787484 - DNA, 20 bp, Artificial
  CRISPR gRNA sequence
taaacatgacaggctggtac

SEQ ID NO: 787485 - DNA, 20 bp, Artificial
  CRISPR gRNA sequence
caggctggtacaggaaaaac

SEQ ID NO: 787486 - DNA, 20 bp, Artificial
  CRISPR gRNA sequence
aaaaactggacgaaactgct

SEQ ID NO: 787487 - DNA, 20 bp, Artificial
  CRISPR gRNA sequence
aactggacgaaactgctcag

SEQ ID NO: 787488 - DNA, 20 bp, Artificial
  CRISPR gRNA sequence
actggacgaaactgctcagc

SEQ ID NO: 787489 - DNA, 20 bp, Artificial
  CRISPR gRNA sequence
ggacgaaactgctcagcggg

SEQ ID NO: 787490 - DNA, 20 bp, Artificial
  CRISPR gRNA sequence
gacgaaactgctcagcggga

SEQ ID NO: 787491 - DNA, 20 bp, Artificial
  CRISPR gRNA sequence
acgaaactgctcagcgggaa

SEQ ID NO: 787492 - DNA, 20 bp, Artificial
  CRISPR gRNA sequence
actgctcagcgggaagggct

SEQ ID NO: 787493 - DNA, 20 bp, Artificial
  CRISPR gRNA sequence
gctcagtcctcccaacttcc

SEQ ID NO: 787494 - DNA, 20 bp, Artificial
  CRISPR gRNA sequence
ccctcaaaccccactacctc

SEQ ID NO: 787495 - DNA, 20 bp, Artificial
  CRISPR gRNA sequence
aaaccccactacctccagca

SEQ ID NO: 787496 - DNA, 20 bp, Artificial
  CRISPR gRNA sequence
cctccagcacagtgctatct

SEQ ID NO: 787497 - DNA, 20 bp, Artificial
  CRISPR gRNA sequence
acagtgctatctgagaacca

SEQ ID NO: 787498 - DNA, 20 bp, Artificial
  CRISPR gRNA sequence
agaaccacggattgttttac

SEQ ID NO: 787499 - DNA, 20 bp, Artificial
  CRISPR gRNA sequence
aaccacggattgttttactg

SEQ ID NO: 787500 - DNA, 20 bp, Artificial
  CRISPR gRNA sequence
cacggattgttttactggag

SEQ ID NO: 787501 - DNA, 20 bp, Artificial
  CRISPR gRNA sequence
cggattgttttactggagaa

SEQ ID NO: 787502 - DNA, 20 bp, Artificial
  CRISPR gRNA sequence
tgttttactggagaagagat

SEQ ID NO: 787503 - DNA, 20 bp, Artificial
  CRISPR gRNA sequence
agaagagattagacattatt

SEQ ID NO: 787504 - DNA, 20 bp, Artificial
  CRISPR gRNA sequence
gattagacattatttagtct

SEQ ID NO: 787505 - DNA, 20 bp, Artificial
  CRISPR gRNA sequence
ttagtctgagcccctcattt

SEQ ID NO: 787506 - DNA, 20 bp, Artificial
  CRISPR gRNA sequence
agtctgagcccctcatttta

SEQ ID NO: 787507 - DNA, 20 bp, Artificial
  CRISPR gRNA sequence
gagcccctcattttagagtt

SEQ ID NO: 787508 - DNA, 20 bp, Artificial
  CRISPR gRNA sequence
agcccctcattttagagttg

SEQ ID NO: 787509 - DNA, 20 bp, Artificial
  CRISPR gRNA sequence
ccctcattttagagttgagg

SEQ ID NO: 787510 - DNA, 20 bp, Artificial
  CRISPR gRNA sequence
cattttagagttgaggaagt

SEQ ID NO: 787511 - DNA, 20 bp, Artificial
  CRISPR gRNA sequence
agagttgaggaagtaagtct

SEQ ID NO: 787512 - DNA, 20 bp, Artificial
  CRISPR gRNA sequence
agttgaggaagtaagtctca

SEQ ID NO: 787513 - DNA, 20 bp, Artificial
  CRISPR gRNA sequence
agttgctaaataatctatgt

SEQ ID NO: 787514 - DNA, 20 bp, Artificial
  CRISPR gRNA sequence
gttgctaaataatctatgtg

SEQ ID NO: 787515 - DNA, 20 bp, Artificial
  CRISPR gRNA sequence
tatgtgaggtcatcactgct

SEQ ID NO: 787516 - DNA, 20 bp, Artificial
  CRISPR gRNA sequence
aggtcatcactgctaagtaa

SEQ ID NO: 787517 - DNA, 20 bp, Artificial
  CRISPR gRNA sequence
tgctaagtaaaagtcaatgc

SEQ ID NO: 787518 - DNA, 20 bp, Artificial
  CRISPR gRNA sequence
gctaagtaaaagtcaatgcc

SEQ ID NO: 787519 - DNA, 20 bp, Artificial
  CRISPR gRNA sequence
caatgccaggattgcaaacc

SEQ ID NO: 787520 - DNA, 20 bp, Artificial
  CRISPR gRNA sequence
acccagatctatctgaccca

SEQ ID NO: 787521 - DNA, 20 bp, Artificial
  CRISPR gRNA sequence
gatctatctgacccaaagct

SEQ ID NO: 787522 - DNA, 20 bp, Artificial
  CRISPR gRNA sequence
gacccaaagctcagccccca

SEQ ID NO: 787523 - DNA, 20 bp, Artificial
  CRISPR gRNA sequence
agatatttgtctccatccaa

SEQ ID NO: 787524 - DNA, 20 bp, Artificial
  CRISPR gRNA sequence
atatttgtctccatccaaaa

SEQ ID NO: 787525 - DNA, 20 bp, Artificial
  CRISPR gRNA sequence
gagtgtgattaacattaacg

SEQ ID NO: 787526 - DNA, 20 bp, Artificial
  CRISPR gRNA sequence
tgattaacattaacgaagaa

SEQ ID NO: 787527 - DNA, 20 bp, Artificial
  CRISPR gRNA sequence
aacattaacgaagaaaagat

SEQ ID NO: 787528 - DNA, 20 bp, Artificial
  CRISPR gRNA sequence
acattaacgaagaaaagata

SEQ ID NO: 787529 - DNA, 20 bp, Artificial
  CRISPR gRNA sequence
attaacgaagaaaagataag

SEQ ID NO: 787530 - DNA, 20 bp, Artificial
  CRISPR gRNA sequence
agccttgctcatccaaacat

SEQ ID NO: 787531 - DNA, 20 bp, Artificial
  CRISPR gRNA sequence
ataatctgcttcttaatttc

SEQ ID NO: 787532 - DNA, 20 bp, Artificial
  CRISPR gRNA sequence
tctgcttcttaatttctagt

SEQ ID NO: 787533 - DNA, 20 bp, Artificial
  CRISPR gRNA sequence
cttaatttctagtaagtgct

SEQ ID NO: 787534 - DNA, 20 bp, Artificial
  CRISPR gRNA sequence
atttctagtaagtgcttagt

SEQ ID NO: 787535 - DNA, 20 bp, Artificial
  CRISPR gRNA sequence
gtgcttagtaagcactttgt

SEQ ID NO: 787536 - DNA, 20 bp, Artificial
  CRISPR gRNA sequence
tagtaagcactttgtgagtc

SEQ ID NO: 787537 - DNA, 20 bp, Artificial
  CRISPR gRNA sequence
agtaagcactttgtgagtca

SEQ ID NO: 787538 - DNA, 20 bp, Artificial
  CRISPR gRNA sequence
taagcactttgtgagtcaag

SEQ ID NO: 787539 - DNA, 20 bp, Artificial
  CRISPR gRNA sequence
ctttgtgagtcaaggagacc

SEQ ID NO: 787540 - DNA, 20 bp, Artificial
  CRISPR gRNA sequence
tttgtgagtcaaggagacct

SEQ ID NO: 787541 - DNA, 20 bp, Artificial
  CRISPR gRNA sequence
gcctctcactgtccccacaa

SEQ ID NO: 787542 - DNA, 20 bp, Artificial
  CRISPR gRNA sequence
cctctcactgtccccacaac

SEQ ID NO: 787543 - DNA, 20 bp, Artificial
  CRISPR gRNA sequence
tctcactgtccccacaacag

SEQ ID NO: 787544 - DNA, 20 bp, Artificial
  CRISPR gRNA sequence
tcactgtccccacaacagga

SEQ ID NO: 787545 - DNA, 20 bp, Artificial
  CRISPR gRNA sequence
cactgtccccacaacaggag

SEQ ID NO: 787546 - DNA, 20 bp, Artificial
  CRISPR gRNA sequence
aacaggagaggtccctacct

SEQ ID NO: 787547 - DNA, 20 bp, Artificial
  CRISPR gRNA sequence
atgcaaacccttgtcctgtg

SEQ ID NO: 787548 - DNA, 20 bp, Artificial
  CRISPR gRNA sequence
tgcaaacccttgtcctgtgc

SEQ ID NO: 787549 - DNA, 20 bp, Artificial
  CRISPR gRNA sequence
gtcctgtgcaggttccctca

SEQ ID NO: 787550 - DNA, 20 bp, Artificial
  CRISPR gRNA sequence
ctcatagtctcttccacgta

SEQ ID NO: 787551 - DNA, 20 bp, Artificial
  CRISPR gRNA sequence
atagtctcttccacgtacag

SEQ ID NO: 787552 - DNA, 20 bp, Artificial
  CRISPR gRNA sequence
agaagccctactcatccctg

SEQ ID NO: 787553 - DNA, 20 bp, Artificial
  CRISPR gRNA sequence
actcatccctgaagactcca

SEQ ID NO: 787554 - DNA, 20 bp, Artificial
  CRISPR gRNA sequence
agactccaaagttgaacatc

SEQ ID NO: 787555 - DNA, 20 bp, Artificial
  CRISPR gRNA sequence
ctccaaagttgaacatccag

SEQ ID NO: 787556 - DNA, 20 bp, Artificial
  CRISPR gRNA sequence
tccaaagttgaacatccagt

SEQ ID NO: 787557 - DNA, 20 bp, Artificial
  CRISPR gRNA sequence
ttgaacatccagtaggaaat

SEQ ID NO: 787558 - DNA, 20 bp, Artificial
  CRISPR gRNA sequence
cagtaggaaatcagtctgct

SEQ ID NO: 787559 - DNA, 20 bp, Artificial
  CRISPR gRNA sequence
cagtctgcttagactgtatt

SEQ ID NO: 787560 - DNA, 20 bp, Artificial
  CRISPR gRNA sequence
gtctgcttagactgtatttg

SEQ ID NO: 787561 - DNA, 20 bp, Artificial
  CRISPR gRNA sequence
tctgcttagactgtatttgg

SEQ ID NO: 787562 - DNA, 20 bp, Artificial
  CRISPR gRNA sequence
ctgcttagactgtatttgga

SEQ ID NO: 787563 - DNA, 20 bp, Artificial
  CRISPR gRNA sequence
tagactgtatttggagggca

SEQ ID NO: 787564 - DNA, 20 bp, Artificial
  CRISPR gRNA sequence
agactgtatttggagggcaa

SEQ ID NO: 787565 - DNA, 20 bp, Artificial
  CRISPR gRNA sequence
gccttatctaaactacctct

SEQ ID NO: 787566 - DNA, 20 bp, Artificial
  CRISPR gRNA sequence
aactacctctgagtcctctc

SEQ ID NO: 787567 - DNA, 20 bp, Artificial
  CRISPR gRNA sequence
acctctgagtcctctctaga

SEQ ID NO: 787568 - DNA, 20 bp, Artificial
  CRISPR gRNA sequence
ctctgagtcctctctagata

SEQ ID NO: 787569 - DNA, 20 bp, Artificial
  CRISPR gRNA sequence
agtcctctctagatagagcc

SEQ ID NO: 787570 - DNA, 20 bp, Artificial
  CRISPR gRNA sequence
ctctagatagagccaagcaa

SEQ ID NO: 787571 - DNA, 20 bp, Artificial
  CRISPR gRNA sequence
ccaagcaacagctacatgaa

SEQ ID NO: 787572 - DNA, 20 bp, Artificial
  CRISPR gRNA sequence
ctacatgaaaagtgccaata

SEQ ID NO: 787573 - DNA, 20 bp, Artificial
  CRISPR gRNA sequence
tgaattgactgtctcttttc

SEQ ID NO: 787574 - DNA, 20 bp, Artificial
  CRISPR gRNA sequence
tgtctcttttctagtccacc

SEQ ID NO: 787575 - DNA, 20 bp, Artificial
  CRISPR gRNA sequence
tccacctagcctgatcctcc

SEQ ID NO: 787576 - DNA, 20 bp, Artificial
  CRISPR gRNA sequence
cctagtcatttgttaccttg

SEQ ID NO: 787577 - DNA, 20 bp, Artificial
  CRISPR gRNA sequence
gttaccttgtggtatactgc

SEQ ID NO: 787578 - DNA, 20 bp, Artificial
  CRISPR gRNA sequence
tccattctttctttcaactt

SEQ ID NO: 787579 - DNA, 20 bp, Artificial
  CRISPR gRNA sequence
ctttctttcaactttagtat

SEQ ID NO: 787580 - DNA, 20 bp, Artificial
  CRISPR gRNA sequence
tttctttcaactttagtatt

SEQ ID NO: 787581 - DNA, 20 bp, Artificial
  CRISPR gRNA sequence
ttctttcaactttagtatta

SEQ ID NO: 787582 - DNA, 20 bp, Artificial
  CRISPR gRNA sequence
caactttagtattagggaat

SEQ ID NO: 787583 - DNA, 20 bp, Artificial
  CRISPR gRNA sequence
tttagtattagggaattagc

SEQ ID NO: 787584 - DNA, 20 bp, Artificial
  CRISPR gRNA sequence
tagggaattagctggacaca

SEQ ID NO: 787585 - DNA, 20 bp, Artificial
  CRISPR gRNA sequence
tagctggacacatggcttct

SEQ ID NO: 787586 - DNA, 20 bp, Artificial
  CRISPR gRNA sequence
gctggacacatggcttctca

SEQ ID NO: 787587 - DNA, 20 bp, Artificial
  CRISPR gRNA sequence
ttctcagagactatgtttcc

SEQ ID NO: 787588 - DNA, 20 bp, Artificial
  CRISPR gRNA sequence
atgtttccaagcctccccta

SEQ ID NO: 787589 - DNA, 20 bp, Artificial
  CRISPR gRNA sequence
tccaagcctcccctatagtt

SEQ ID NO: 787590 - DNA, 20 bp, Artificial
  CRISPR gRNA sequence
aagcctcccctatagttaag

SEQ ID NO: 787591 - DNA, 20 bp, Artificial
  CRISPR gRNA sequence
agcctcccctatagttaagt

SEQ ID NO: 787592 - DNA, 20 bp, Artificial
  CRISPR gRNA sequence
cccctatagttaagtgggcc

SEQ ID NO: 787593 - DNA, 20 bp, Artificial
  CRISPR gRNA sequence
tgggcccagccatgtaatct

SEQ ID NO: 787594 - DNA, 20 bp, Artificial
  CRISPR gRNA sequence
ccagccatgtaatctaagtt

SEQ ID NO: 787595 - DNA, 20 bp, Artificial
  CRISPR gRNA sequence
cagccatgtaatctaagttc

SEQ ID NO: 787596 - DNA, 20 bp, Artificial
  CRISPR gRNA sequence
atgtaatctaagttcaggct

SEQ ID NO: 787597 - DNA, 20 bp, Artificial
  CRISPR gRNA sequence
gtaatctaagttcaggctaa

SEQ ID NO: 787598 - DNA, 20 bp, Artificial
  CRISPR gRNA sequence
aatctaagttcaggctaaga

SEQ ID NO: 787599 - DNA, 20 bp, Artificial
  CRISPR gRNA sequence
taagttcaggctaagagagt

SEQ ID NO: 787600 - DNA, 20 bp, Artificial
  CRISPR gRNA sequence
ggctaagagagtgagttttc

SEQ ID NO: 787601 - DNA, 20 bp, Artificial
  CRISPR gRNA sequence
gctaagagagtgagttttca

SEQ ID NO: 787602 - DNA, 20 bp, Artificial
  CRISPR gRNA sequence
agagtgagttttcaaggtct

SEQ ID NO: 787603 - DNA, 20 bp, Artificial
  CRISPR gRNA sequence
caccactcgtttactttctg

SEQ ID NO: 787604 - DNA, 20 bp, Artificial
  CRISPR gRNA sequence
accactcgtttactttctga

SEQ ID NO: 787605 - DNA, 20 bp, Artificial
  CRISPR gRNA sequence
actttctgaaggttgaaaca

SEQ ID NO: 787606 - DNA, 20 bp, Artificial
  CRISPR gRNA sequence
ctttctgaaggttgaaacat

SEQ ID NO: 787607 - DNA, 20 bp, Artificial
  CRISPR gRNA sequence
tgaaggttgaaacatgggtt

SEQ ID NO: 787608 - DNA, 20 bp, Artificial
  CRISPR gRNA sequence
acatgggtttggcactgact

SEQ ID NO: 787609 - DNA, 20 bp, Artificial
  CRISPR gRNA sequence
actgagctttgacaatttta

SEQ ID NO: 787610 - DNA, 20 bp, Artificial
  CRISPR gRNA sequence
ctgagctttgacaattttat

SEQ ID NO: 787611 - DNA, 20 bp, Artificial
  CRISPR gRNA sequence
tgagctttgacaattttata

SEQ ID NO: 787612 - DNA, 20 bp, Artificial
  CRISPR gRNA sequence
attttatagggacaacatcc

SEQ ID NO: 787613 - DNA, 20 bp, Artificial
  CRISPR gRNA sequence
tttatagggacaacatcctg

SEQ ID NO: 787614 - DNA, 20 bp, Artificial
  CRISPR gRNA sequence
agggacaacatcctggagaa

SEQ ID NO: 787615 - DNA, 20 bp, Artificial
  CRISPR gRNA sequence
gacaacatcctggagaatgg

SEQ ID NO: 787616 - DNA, 20 bp, Artificial
  CRISPR gRNA sequence
caacatcctggagaatggca

SEQ ID NO: 787617 - DNA, 20 bp, Artificial
  CRISPR gRNA sequence
cctggagaatggcagagcaa

SEQ ID NO: 787618 - DNA, 20 bp, Artificial
  CRISPR gRNA sequence
agcaacagatgaaaataatc

SEQ ID NO: 787619 - DNA, 20 bp, Artificial
  CRISPR gRNA sequence
tggatcactgaatgactcta

SEQ ID NO: 787620 - DNA, 20 bp, Artificial
  CRISPR gRNA sequence
ctgaatgactctatggaaca

SEQ ID NO: 787621 - DNA, 20 bp, Artificial
  CRISPR gRNA sequence
ctctatggaacatagctgct

SEQ ID NO: 787622 - DNA, 20 bp, Artificial
  CRISPR gRNA sequence
ttagctgctctgaaccacct

SEQ ID NO: 787623 - DNA, 20 bp, Artificial
  CRISPR gRNA sequence
tgaaccacctgagtgttaca

SEQ ID NO: 787624 - DNA, 20 bp, Artificial
  CRISPR gRNA sequence
ctgagtgttacatggaacga

SEQ ID NO: 787625 - DNA, 20 bp, Artificial
  CRISPR gRNA sequence
ctcgcttctcactgtatttc

SEQ ID NO: 787626 - DNA, 20 bp, Artificial
  CRISPR gRNA sequence
tcgcttctcactgtatttcg

SEQ ID NO: 787627 - DNA, 20 bp, Artificial
  CRISPR gRNA sequence
atttcgaggtctcttcatta

SEQ ID NO: 787628 - DNA, 20 bp, Artificial
  CRISPR gRNA sequence
tcgaggtctcttcattatgg

SEQ ID NO: 787629 - DNA, 20 bp, Artificial
  CRISPR gRNA sequence
gtctcttcattatggtagct

SEQ ID NO: 787630 - DNA, 20 bp, Artificial
  CRISPR gRNA sequence
atcctcatacatattcctct

SEQ ID NO: 787631 - DNA, 20 bp, Artificial
  CRISPR gRNA sequence
attaattaatttatttattt

SEQ ID NO: 787632 - DNA, 20 bp, Artificial
  CRISPR gRNA sequence
aattaatttatttatttgag

SEQ ID NO: 787633 - DNA, 20 bp, Artificial
  CRISPR gRNA sequence
attaatttatttatttgaga

SEQ ID NO: 787634 - DNA, 20 bp, Artificial
  CRISPR gRNA sequence
taatttatttatttgagaag

SEQ ID NO: 787635 - DNA, 20 bp, Artificial
  CRISPR gRNA sequence
ggagtttccctcttgttgcc

SEQ ID NO: 787636 - DNA, 20 bp, Artificial
  CRISPR gRNA sequence
gagtttccctcttgttgccc

SEQ ID NO: 787637 - DNA, 20 bp, Artificial
  CRISPR gRNA sequence
ttccctcttgttgcccaggc

SEQ ID NO: 787638 - DNA, 20 bp, Artificial
  CRISPR gRNA sequence
ccctcttgttgcccaggctg

SEQ ID NO: 787639 - DNA, 20 bp, Artificial
  CRISPR gRNA sequence
ttgttgcccaggctggagtg

SEQ ID NO: 787640 - DNA, 20 bp, Artificial
  CRISPR gRNA sequence
ttgcccaggctggagtgcag

SEQ ID NO: 787641 - DNA, 20 bp, Artificial
  CRISPR gRNA sequence
ggagtgcagtggcatgatct

SEQ ID NO: 787642 - DNA, 20 bp, Artificial
  CRISPR gRNA sequence
tcactgcaacctccgcctcc

SEQ ID NO: 787643 - DNA, 20 bp, Artificial
  CRISPR gRNA sequence
cactgcaacctccgcctcct

SEQ ID NO: 787644 - DNA, 20 bp, Artificial
  CRISPR gRNA sequence
aacctccgcctcctgggttc

SEQ ID NO: 787645 - DNA, 20 bp, Artificial
  CRISPR gRNA sequence
ttcaagtgattctcctgcct

SEQ ID NO: 787646 - DNA, 20 bp, Artificial
  CRISPR gRNA sequence
ttctcctgcctcggcctctt

SEQ ID NO: 787647 - DNA, 20 bp, Artificial
  CRISPR gRNA sequence
tcctgcctcggcctcttgag

SEQ ID NO: 787648 - DNA, 20 bp, Artificial
  CRISPR gRNA sequence
gcctcggcctcttgagtagc

SEQ ID NO: 787649 - DNA, 20 bp, Artificial
  CRISPR gRNA sequence
cctcggcctcttgagtagct

SEQ ID NO: 787650 - DNA, 20 bp, Artificial
  CRISPR gRNA sequence
ctcttgagtagctgggatta

SEQ ID NO: 787651 - DNA, 20 bp, Artificial
  CRISPR gRNA sequence
tcttgagtagctgggattac

SEQ ID NO: 787652 - DNA, 20 bp, Artificial
  CRISPR gRNA sequence
caggcacctgccaccatgcc

SEQ ID NO: 787653 - DNA, 20 bp, Artificial
  CRISPR gRNA sequence
tggctaattttttgtatttt

SEQ ID NO: 787654 - DNA, 20 bp, Artificial
  CRISPR gRNA sequence
ctaattttttgtatttttag

SEQ ID NO: 787655 - DNA, 20 bp, Artificial
  CRISPR gRNA sequence
aattttttgtatttttagta

SEQ ID NO: 787656 - DNA, 20 bp, Artificial
  CRISPR gRNA sequence
ttttgtatttttagtagaga

SEQ ID NO: 787657 - DNA, 20 bp, Artificial
  CRISPR gRNA sequence
tttgtatttttagtagagac

SEQ ID NO: 787658 - DNA, 20 bp, Artificial
  CRISPR gRNA sequence
ttgtatttttagtagagacg

SEQ ID NO: 787659 - DNA, 20 bp, Artificial
  CRISPR gRNA sequence
gagacggggtttcaccatgt

SEQ ID NO: 787660 - DNA, 20 bp, Artificial
  CRISPR gRNA sequence
cggggtttcaccatgttagc

SEQ ID NO: 787661 - DNA, 20 bp, Artificial
  CRISPR gRNA sequence
ggggtttcaccatgttagcc

SEQ ID NO: 787662 - DNA, 20 bp, Artificial
  CRISPR gRNA sequence
caggctgatttttgaactcc

SEQ ID NO: 787663 - DNA, 20 bp, Artificial
  CRISPR gRNA sequence
atttttgaactcctggcctc

SEQ ID NO: 787664 - DNA, 20 bp, Artificial
  CRISPR gRNA sequence
ctcaagcaatccacccatct

SEQ ID NO: 787665 - DNA, 20 bp, Artificial
  CRISPR gRNA sequence
ccacccatctcagcctccca

SEQ ID NO: 787666 - DNA, 20 bp, Artificial
  CRISPR gRNA sequence
atctcagcctcccaaagtgc

SEQ ID NO: 787667 - DNA, 20 bp, Artificial
  CRISPR gRNA sequence
tctcagcctcccaaagtgct

SEQ ID NO: 787668 - DNA, 20 bp, Artificial
  CRISPR gRNA sequence
ctcccaaagtgctaggatta

SEQ ID NO: 787669 - DNA, 20 bp, Artificial
  CRISPR gRNA sequence
tcccaaagtgctaggattac

SEQ ID NO: 787670 - DNA, 20 bp, Artificial
  CRISPR gRNA sequence
agtgctaggattacaggcat

SEQ ID NO: 787671 - DNA, 20 bp, Artificial
  CRISPR gRNA sequence
caggcatgagccaccgcacc

SEQ ID NO: 787672 - DNA, 20 bp, Artificial
  CRISPR gRNA sequence
ccaccgcacctggccaataa

SEQ ID NO: 787673 - DNA, 20 bp, Artificial
  CRISPR gRNA sequence
ggccaataatggcatactct

SEQ ID NO: 787674 - DNA, 20 bp, Artificial
  CRISPR gRNA sequence
gcaatgatataatgatgcaa

SEQ ID NO: 787675 - DNA, 20 bp, Artificial
  CRISPR gRNA sequence
ccacaacttcatgaactcac

SEQ ID NO: 787676 - DNA, 20 bp, Artificial
  CRISPR gRNA sequence
aacttcatgaactcacaagt

SEQ ID NO: 787677 - DNA, 20 bp, Artificial
  CRISPR gRNA sequence
acttcatgaactcacaagta

SEQ ID NO: 787678 - DNA, 20 bp, Artificial
  CRISPR gRNA sequence
aagtaaggcatgcaacttgc

SEQ ID NO: 787679 - DNA, 20 bp, Artificial
  CRISPR gRNA sequence
ttactgtttgcacactttct

SEQ ID NO: 787680 - DNA, 20 bp, Artificial
  CRISPR gRNA sequence
ttgcacactttctgagtact

SEQ ID NO: 787681 - DNA, 20 bp, Artificial
  CRISPR gRNA sequence
ctgagtactaagcactttat

SEQ ID NO: 787682 - DNA, 20 bp, Artificial
  CRISPR gRNA sequence
ctcaccctcatgctacacat

SEQ ID NO: 787683 - DNA, 20 bp, Artificial
  CRISPR gRNA sequence
caccctcatgctacacatga

SEQ ID NO: 787684 - DNA, 20 bp, Artificial
  CRISPR gRNA sequence
catgctacacatgagagact

SEQ ID NO: 787685 - DNA, 20 bp, Artificial
  CRISPR gRNA sequence
acacatgagagactgagtgc

SEQ ID NO: 787686 - DNA, 20 bp, Artificial
  CRISPR gRNA sequence
acatgagagactgagtgcta

SEQ ID NO: 787687 - DNA, 20 bp, Artificial
  CRISPR gRNA sequence
tgagagactgagtgctagag

SEQ ID NO: 787688 - DNA, 20 bp, Artificial
  CRISPR gRNA sequence
gactgagtgctagagtggct

SEQ ID NO: 787689 - DNA, 20 bp, Artificial
  CRISPR gRNA sequence
tgagtgctagagtggctaag

SEQ ID NO: 787690 - DNA, 20 bp, Artificial
  CRISPR gRNA sequence
gagtgctagagtggctaagt

SEQ ID NO: 787691 - DNA, 20 bp, Artificial
  CRISPR gRNA sequence
gagtggctaagtaggatatt

SEQ ID NO: 787692 - DNA, 20 bp, Artificial
  CRISPR gRNA sequence
agtggctaagtaggatattt

SEQ ID NO: 787693 - DNA, 20 bp, Artificial
  CRISPR gRNA sequence
gtaggatatttaggttctca

SEQ ID NO: 787694 - DNA, 20 bp, Artificial
  CRISPR gRNA sequence
atttaggttctcaaagctaa

SEQ ID NO: 787695 - DNA, 20 bp, Artificial
  CRISPR gRNA sequence
ttaggttctcaaagctaata

SEQ ID NO: 787696 - DNA, 20 bp, Artificial
  CRISPR gRNA sequence
aggttctcaaagctaataga

SEQ ID NO: 787697 - DNA, 20 bp, Artificial
  CRISPR gRNA sequence
gttctcaaagctaatagaga

SEQ ID NO: 787698 - DNA, 20 bp, Artificial
  CRISPR gRNA sequence
tctcaaagctaatagagaga

SEQ ID NO: 787699 - DNA, 20 bp, Artificial
  CRISPR gRNA sequence
agagagagagtttgaaattt

SEQ ID NO: 787700 - DNA, 20 bp, Artificial
  CRISPR gRNA sequence
aatttaagcctgtctgacat

SEQ ID NO: 787701 - DNA, 20 bp, Artificial
  CRISPR gRNA sequence
tttaagcctgtctgacatca

SEQ ID NO: 787702 - DNA, 20 bp, Artificial
  CRISPR gRNA sequence
ccatgctctcaaccactgcc

SEQ ID NO: 787703 - DNA, 20 bp, Artificial
  CRISPR gRNA sequence
ccactgcctggaatcacctc

SEQ ID NO: 787704 - DNA, 20 bp, Artificial
  CRISPR gRNA sequence
cactgcctggaatcacctcc

SEQ ID NO: 787705 - DNA, 20 bp, Artificial
  CRISPR gRNA sequence
ggaatcacctccaggtctcc

SEQ ID NO: 787706 - DNA, 20 bp, Artificial
  CRISPR gRNA sequence
gaatcacctccaggtctcct

SEQ ID NO: 787707 - DNA, 20 bp, Artificial
  CRISPR gRNA sequence
tcacctccaggtctcctagg

SEQ ID NO: 787708 - DNA, 20 bp, Artificial
  CRISPR gRNA sequence
cacctccaggtctcctagga

SEQ ID NO: 787709 - DNA, 20 bp, Artificial
  CRISPR gRNA sequence
ggaaggattctcttttctgc

SEQ ID NO: 787710 - DNA, 20 bp, Artificial
  CRISPR gRNA sequence
ctcttttctgccagccctac

SEQ ID NO: 787711 - DNA, 20 bp, Artificial
  CRISPR gRNA sequence
tcttttctgccagccctaca

SEQ ID NO: 787712 - DNA, 20 bp, Artificial
  CRISPR gRNA sequence
cttttctgccagccctacaa

SEQ ID NO: 787713 - DNA, 20 bp, Artificial
  CRISPR gRNA sequence
tatatttattttttgtgctg

SEQ ID NO: 787714 - DNA, 20 bp, Artificial
  CRISPR gRNA sequence
cctaatgaaaatacaacaac

SEQ ID NO: 787715 - DNA, 20 bp, Artificial
  CRISPR gRNA sequence
tgaaaatacaacaactggct

SEQ ID NO: 787716 - DNA, 20 bp, Artificial
  CRISPR gRNA sequence
aaatacaacaactggctgag

SEQ ID NO: 787717 - DNA, 20 bp, Artificial
  CRISPR gRNA sequence
tacaacaactggctgagcag

SEQ ID NO: 787718 - DNA, 20 bp, Artificial
  CRISPR gRNA sequence
cagaagaaaccctatttcaa

SEQ ID NO: 787719 - DNA, 20 bp, Artificial
  CRISPR gRNA sequence
agaagaaaccctatttcaaa

SEQ ID NO: 787720 - DNA, 20 bp, Artificial
  CRISPR gRNA sequence
cctaacttgtgcttgaaatt

SEQ ID NO: 787721 - DNA, 20 bp, Artificial
  CRISPR gRNA sequence
tgcttgaaatttggaatgtt

SEQ ID NO: 787722 - DNA, 20 bp, Artificial
  CRISPR gRNA sequence
gaatgttcagtcatccattc

SEQ ID NO: 787723 - DNA, 20 bp, Artificial
  CRISPR gRNA sequence
atgttcagtcatccattcta

SEQ ID NO: 787724 - DNA, 20 bp, Artificial
  CRISPR gRNA sequence
tcagtcatccattctagagt

SEQ ID NO: 787725 - DNA, 20 bp, Artificial
  CRISPR gRNA sequence
gtcatccattctagagtcag

SEQ ID NO: 787726 - DNA, 20 bp, Artificial
  CRISPR gRNA sequence
catccattctagagtcagtg

SEQ ID NO: 787727 - DNA, 20 bp, Artificial
  CRISPR gRNA sequence
ttgttttatacattgacttc

SEQ ID NO: 787728 - DNA, 20 bp, Artificial
  CRISPR gRNA sequence
gttttatacattgacttccg

SEQ ID NO: 787729 - DNA, 20 bp, Artificial
  CRISPR gRNA sequence
ttatacattgacttccggag

SEQ ID NO: 787730 - DNA, 20 bp, Artificial
  CRISPR gRNA sequence
ttgacttccggagaagcttg

SEQ ID NO: 787731 - DNA, 20 bp, Artificial
  CRISPR gRNA sequence
tgacttccggagaagcttgt

SEQ ID NO: 787732 - DNA, 20 bp, Artificial
  CRISPR gRNA sequence
ccggagaagcttgtgggtca

SEQ ID NO: 787733 - DNA, 20 bp, Artificial
  CRISPR gRNA sequence
gagaagcttgtgggtcacag

SEQ ID NO: 787734 - DNA, 20 bp, Artificial
  CRISPR gRNA sequence
ttgtgggtcacagcagtcca

SEQ ID NO: 787735 - DNA, 20 bp, Artificial
  CRISPR gRNA sequence
cagtccacagctcaatttat

SEQ ID NO: 787736 - DNA, 20 bp, Artificial
  CRISPR gRNA sequence
acagctcaatttatgagaat

SEQ ID NO: 787737 - DNA, 20 bp, Artificial
  CRISPR gRNA sequence
gctcaatttatgagaatgag

SEQ ID NO: 787738 - DNA, 20 bp, Artificial
  CRISPR gRNA sequence
aatttatgagaatgagtaga

SEQ ID NO: 787739 - DNA, 20 bp, Artificial
  CRISPR gRNA sequence
atttatgagaatgagtagaa

SEQ ID NO: 787740 - DNA, 20 bp, Artificial
  CRISPR gRNA sequence
tttatgagaatgagtagaaa

SEQ ID NO: 787741 - DNA, 20 bp, Artificial
  CRISPR gRNA sequence
gagaatgagtagaaagggaa

SEQ ID NO: 787742 - DNA, 20 bp, Artificial
  CRISPR gRNA sequence
agtagaaagggaacagtcat

SEQ ID NO: 787743 - DNA, 20 bp, Artificial
  CRISPR gRNA sequence
gacaacttaaaaatgccctt

SEQ ID NO: 787744 - DNA, 20 bp, Artificial
  CRISPR gRNA sequence
ttaaaaatgcccttgagaaa

SEQ ID NO: 787745 - DNA, 20 bp, Artificial
  CRISPR gRNA sequence
aaaatgcccttgagaaatag

SEQ ID NO: 787746 - DNA, 20 bp, Artificial
  CRISPR gRNA sequence
tgcccttgagaaatagaagc

SEQ ID NO: 787747 - DNA, 20 bp, Artificial
  CRISPR gRNA sequence
gcccttgagaaatagaagcc

SEQ ID NO: 787748 - DNA, 20 bp, Artificial
  CRISPR gRNA sequence
agaaatagaagccaggaact

SEQ ID NO: 787749 - DNA, 20 bp, Artificial
  CRISPR gRNA sequence
aaatagaagccaggaactca

SEQ ID NO: 787750 - DNA, 20 bp, Artificial
  CRISPR gRNA sequence
aatagaagccaggaactcag

SEQ ID NO: 787751 - DNA, 20 bp, Artificial
  CRISPR gRNA sequence
agaagccaggaactcagagg

SEQ ID NO: 787752 - DNA, 20 bp, Artificial
  CRISPR gRNA sequence
cagaggcagatgtgtgactt

SEQ ID NO: 787753 - DNA, 20 bp, Artificial
  CRISPR gRNA sequence
gactttggttattttgttgc

SEQ ID NO: 787754 - DNA, 20 bp, Artificial
  CRISPR gRNA sequence
gttgctggtatttgtgccac

SEQ ID NO: 787755 - DNA, 20 bp, Artificial
  CRISPR gRNA sequence
ctggtatttgtgccacaagc

SEQ ID NO: 787756 - DNA, 20 bp, Artificial
  CRISPR gRNA sequence
ccacaagctagaatatcatt

SEQ ID NO: 787757 - DNA, 20 bp, Artificial
  CRISPR gRNA sequence
atcatttggctgctctgacc

SEQ ID NO: 787758 - DNA, 20 bp, Artificial
  CRISPR gRNA sequence
ctctgacctggctgtccaca

SEQ ID NO: 787759 - DNA, 20 bp, Artificial
  CRISPR gRNA sequence
acctggctgtccacacagtc

SEQ ID NO: 787760 - DNA, 20 bp, Artificial
  CRISPR gRNA sequence
tggctgtccacacagtctgg

SEQ ID NO: 787761 - DNA, 20 bp, Artificial
  CRISPR gRNA sequence
tgtccacacagtctggtagc

SEQ ID NO: 787762 - DNA, 20 bp, Artificial
  CRISPR gRNA sequence
cagtctggtagctggcatga

SEQ ID NO: 787763 - DNA, 20 bp, Artificial
  CRISPR gRNA sequence
agtctggtagctggcatgat

SEQ ID NO: 787764 - DNA, 20 bp, Artificial
  CRISPR gRNA sequence
tgatgggactgcgattatct

SEQ ID NO: 787765 - DNA, 20 bp, Artificial
  CRISPR gRNA sequence
gggactgcgattatctaaga

SEQ ID NO: 787766 - DNA, 20 bp, Artificial
  CRISPR gRNA sequence
caatcaacccaacatttgtt

SEQ ID NO: 787767 - DNA, 20 bp, Artificial
  CRISPR gRNA sequence
ttgagcacttattatgaaca

SEQ ID NO: 787768 - DNA, 20 bp, Artificial
  CRISPR gRNA sequence
tgagcacttattatgaacac

SEQ ID NO: 787769 - DNA, 20 bp, Artificial
  CRISPR gRNA sequence
acaggactctgcttttgcct

SEQ ID NO: 787770 - DNA, 20 bp, Artificial
  CRISPR gRNA sequence
actctgcttttgccttagtg

SEQ ID NO: 787771 - DNA, 20 bp, Artificial
  CRISPR gRNA sequence
ttttgccttagtgtggaata

SEQ ID NO: 787772 - DNA, 20 bp, Artificial
  CRISPR gRNA sequence
tgccttagtgtggaataaag

SEQ ID NO: 787773 - DNA, 20 bp, Artificial
  CRISPR gRNA sequence
gtgtgaacaatgaaaataca

SEQ ID NO: 787774 - DNA, 20 bp, Artificial
  CRISPR gRNA sequence
aaaatacatggaaaataaaa

SEQ ID NO: 787775 - DNA, 20 bp, Artificial
  CRISPR gRNA sequence
aaaataaaatagcaattaaa

SEQ ID NO: 787776 - DNA, 20 bp, Artificial
  CRISPR gRNA sequence
aaataaaatagcaattaaaa

SEQ ID NO: 787777 - DNA, 20 bp, Artificial
  CRISPR gRNA sequence
aaaatagcaattaaaaaggc

SEQ ID NO: 787778 - DNA, 20 bp, Artificial
  CRISPR gRNA sequence
agcaattaaaaaggcaagca

SEQ ID NO: 787779 - DNA, 20 bp, Artificial
  CRISPR gRNA sequence
aaaaaggcaagcatagttac

SEQ ID NO: 787780 - DNA, 20 bp, Artificial
  CRISPR gRNA sequence
aaaaggcaagcatagttaca

SEQ ID NO: 787781 - DNA, 20 bp, Artificial
  CRISPR gRNA sequence
atagttacaaggcaaacaaa

SEQ ID NO: 787782 - DNA, 20 bp, Artificial
  CRISPR gRNA sequence
tacaaggcaaacaaatggtc

SEQ ID NO: 787783 - DNA, 20 bp, Artificial
  CRISPR gRNA sequence
acaaggcaaacaaatggtcc

SEQ ID NO: 787784 - DNA, 20 bp, Artificial
  CRISPR gRNA sequence
aggcaaacaaatggtccagg

SEQ ID NO: 787785 - DNA, 20 bp, Artificial
  CRISPR gRNA sequence
caaacaaatggtccaggtag

SEQ ID NO: 787786 - DNA, 20 bp, Artificial
  CRISPR gRNA sequence
aaacaaatggtccaggtagt

SEQ ID NO: 787787 - DNA, 20 bp, Artificial
  CRISPR gRNA sequence
aggtagtaggtctcaaaatg

SEQ ID NO: 787788 - DNA, 20 bp, Artificial
  CRISPR gRNA sequence
ggtagtaggtctcaaaatgt

SEQ ID NO: 787789 - DNA, 20 bp, Artificial
  CRISPR gRNA sequence
taggtctcaaaatgtgggat

SEQ ID NO: 787790 - DNA, 20 bp, Artificial
  CRISPR gRNA sequence
aggtctcaaaatgtgggatg

SEQ ID NO: 787791 - DNA, 20 bp, Artificial
  CRISPR gRNA sequence
ggtctcaaaatgtgggatga

SEQ ID NO: 787792 - DNA, 20 bp, Artificial
  CRISPR gRNA sequence
tcaaaatgtgggatgaggga

SEQ ID NO: 787793 - DNA, 20 bp, Artificial
  CRISPR gRNA sequence
ggaaagacccccttgtgccc

SEQ ID NO: 787794 - DNA, 20 bp, Artificial
  CRISPR gRNA sequence
aaagacccccttgtgccctg

SEQ ID NO: 787795 - DNA, 20 bp, Artificial
  CRISPR gRNA sequence
ccttgtgccctggagtgact

SEQ ID NO: 787796 - DNA, 20 bp, Artificial
  CRISPR gRNA sequence
ctggagtgactgagctgccc

SEQ ID NO: 787797 - DNA, 20 bp, Artificial
  CRISPR gRNA sequence
ggagtgactgagctgcccca

SEQ ID NO: 787798 - DNA, 20 bp, Artificial
  CRISPR gRNA sequence
agtgactgagctgccccaga

SEQ ID NO: 787799 - DNA, 20 bp, Artificial
  CRISPR gRNA sequence
tgactgagctgccccagaga

SEQ ID NO: 787800 - DNA, 20 bp, Artificial
  CRISPR gRNA sequence
gactgagctgccccagagag

SEQ ID NO: 787801 - DNA, 20 bp, Artificial
  CRISPR gRNA sequence
actgagctgccccagagaga

SEQ ID NO: 787802 - DNA, 20 bp, Artificial
  CRISPR gRNA sequence
gagctgccccagagagaggg

SEQ ID NO: 787803 - DNA, 20 bp, Artificial
  CRISPR gRNA sequence
agctgccccagagagagggt

SEQ ID NO: 787804 - DNA, 20 bp, Artificial
  CRISPR gRNA sequence
ccccagagagagggtgggct

SEQ ID NO: 787805 - DNA, 20 bp, Artificial
  CRISPR gRNA sequence
ccagagagagggtgggcttg

SEQ ID NO: 787806 - DNA, 20 bp, Artificial
  CRISPR gRNA sequence
agagagggtgggcttggagc

SEQ ID NO: 787807 - DNA, 20 bp, Artificial
  CRISPR gRNA sequence
gagggtgggcttggagctag

SEQ ID NO: 787808 - DNA, 20 bp, Artificial
  CRISPR gRNA sequence
gggtgggcttggagctagta

SEQ ID NO: 787809 - DNA, 20 bp, Artificial
  CRISPR gRNA sequence
gtgggcttggagctagtaga

SEQ ID NO: 787810 - DNA, 20 bp, Artificial
  CRISPR gRNA sequence
tgggcttggagctagtagag

SEQ ID NO: 787811 - DNA, 20 bp, Artificial
  CRISPR gRNA sequence
gggcttggagctagtagaga

SEQ ID NO: 787812 - DNA, 20 bp, Artificial
  CRISPR gRNA sequence
gggaaataatgatatttatg

SEQ ID NO: 787813 - DNA, 20 bp, Artificial
  CRISPR gRNA sequence
atatttatgtggaaaaacct

SEQ ID NO: 787814 - DNA, 20 bp, Artificial
  CRISPR gRNA sequence
tatgtggaaaaacctgagca

SEQ ID NO: 787815 - DNA, 20 bp, Artificial
  CRISPR gRNA sequence
gtggaaaaacctgagcaaag

SEQ ID NO: 787816 - DNA, 20 bp, Artificial
  CRISPR gRNA sequence
tggaaaaacctgagcaaaga

SEQ ID NO: 787817 - DNA, 20 bp, Artificial
  CRISPR gRNA sequence
aaacctgagcaaagaaggca

SEQ ID NO: 787818 - DNA, 20 bp, Artificial
  CRISPR gRNA sequence
acctgagcaaagaaggcatg

SEQ ID NO: 787819 - DNA, 20 bp, Artificial
  CRISPR gRNA sequence
cctgagcaaagaaggcatgg

SEQ ID NO: 787820 - DNA, 20 bp, Artificial
  CRISPR gRNA sequence
gagcaaagaaggcatggagg

SEQ ID NO: 787821 - DNA, 20 bp, Artificial
  CRISPR gRNA sequence
aagaaggcatggaggtagaa

SEQ ID NO: 787822 - DNA, 20 bp, Artificial
  CRISPR gRNA sequence
agaaggcatggaggtagaaa

SEQ ID NO: 787823 - DNA, 20 bp, Artificial
  CRISPR gRNA sequence
gcatggaggtagaaaaggtg

SEQ ID NO: 787824 - DNA, 20 bp, Artificial
  CRISPR gRNA sequence
gaggtagaaaaggtgcagcc

SEQ ID NO: 787825 - DNA, 20 bp, Artificial
  CRISPR gRNA sequence
agaaaaggtgcagccaagtt

SEQ ID NO: 787826 - DNA, 20 bp, Artificial
  CRISPR gRNA sequence
aaaaggtgcagccaagttca

SEQ ID NO: 787827 - DNA, 20 bp, Artificial
  CRISPR gRNA sequence
aaggtgcagccaagttcaga

SEQ ID NO: 787828 - DNA, 20 bp, Artificial
  CRISPR gRNA sequence
agccaagttcagagagcatg

SEQ ID NO: 787829 - DNA, 20 bp, Artificial
  CRISPR gRNA sequence
aagttcagagagcatgtggt

SEQ ID NO: 787830 - DNA, 20 bp, Artificial
  CRISPR gRNA sequence
agttcagagagcatgtggtg

SEQ ID NO: 787831 - DNA, 20 bp, Artificial
  CRISPR gRNA sequence
tcagagagcatgtggtgagg

SEQ ID NO: 787832 - DNA, 20 bp, Artificial
  CRISPR gRNA sequence
cagagagcatgtggtgagga

SEQ ID NO: 787833 - DNA, 20 bp, Artificial
  CRISPR gRNA sequence
agagagcatgtggtgaggaa

SEQ ID NO: 787834 - DNA, 20 bp, Artificial
  CRISPR gRNA sequence
agcatgtggtgaggaaggga

SEQ ID NO: 787835 - DNA, 20 bp, Artificial
  CRISPR gRNA sequence
tgaggaagggatggttaatg

SEQ ID NO: 787836 - DNA, 20 bp, Artificial
  CRISPR gRNA sequence
ggaagggatggttaatgaag

SEQ ID NO: 787837 - DNA, 20 bp, Artificial
  CRISPR gRNA sequence
aagggatggttaatgaagca

SEQ ID NO: 787838 - DNA, 20 bp, Artificial
  CRISPR gRNA sequence
agggatggttaatgaagcag

SEQ ID NO: 787839 - DNA, 20 bp, Artificial
  CRISPR gRNA sequence
atgaagcagaggatccatgt

SEQ ID NO: 787840 - DNA, 20 bp, Artificial
  CRISPR gRNA sequence
agaggatccatgtcagtaaa

SEQ ID NO: 787841 - DNA, 20 bp, Artificial
  CRISPR gRNA sequence
ggatccatgtcagtaaacag

SEQ ID NO: 787842 - DNA, 20 bp, Artificial
  CRISPR gRNA sequence
gatccatgtcagtaaacagt

SEQ ID NO: 787843 - DNA, 20 bp, Artificial
  CRISPR gRNA sequence
taaacagtaggacgaataca

SEQ ID NO: 787844 - DNA, 20 bp, Artificial
  CRISPR gRNA sequence
cagtaggacgaatacaaagt

SEQ ID NO: 787845 - DNA, 20 bp, Artificial
  CRISPR gRNA sequence
agtaggacgaatacaaagtt

SEQ ID NO: 787846 - DNA, 20 bp, Artificial
  CRISPR gRNA sequence
aggacgaatacaaagttggg

SEQ ID NO: 787847 - DNA, 20 bp, Artificial
  CRISPR gRNA sequence
ggacgaatacaaagttggga

SEQ ID NO: 787848 - DNA, 20 bp, Artificial
  CRISPR gRNA sequence
gaatacaaagttgggaagga

SEQ ID NO: 787849 - DNA, 20 bp, Artificial
  CRISPR gRNA sequence
aatacaaagttgggaaggat

SEQ ID NO: 787850 - DNA, 20 bp, Artificial
  CRISPR gRNA sequence
ttgggaaggatgggtaaaac

SEQ ID NO: 787851 - DNA, 20 bp, Artificial
  CRISPR gRNA sequence
tgggaaggatgggtaaaacc

SEQ ID NO: 787852 - DNA, 20 bp, Artificial
  CRISPR gRNA sequence
aggatgggtaaaaccaggtt

SEQ ID NO: 787853 - DNA, 20 bp, Artificial
  CRISPR gRNA sequence
aaaaccaggttgagaatttc

SEQ ID NO: 787854 - DNA, 20 bp, Artificial
  CRISPR gRNA sequence
tgagaatttctggctgcaca

SEQ ID NO: 787855 - DNA, 20 bp, Artificial
  CRISPR gRNA sequence
agatttctccatctccctga

SEQ ID NO: 787856 - DNA, 20 bp, Artificial
  CRISPR gRNA sequence
tccctgatggctgtatttat

SEQ ID NO: 787857 - DNA, 20 bp, Artificial
  CRISPR gRNA sequence
tgtatttatgagtgataccc

SEQ ID NO: 787858 - DNA, 20 bp, Artificial
  CRISPR gRNA sequence
gtatttatgagtgataccct

SEQ ID NO: 787859 - DNA, 20 bp, Artificial
  CRISPR gRNA sequence
atttatgagtgataccctag

SEQ ID NO: 787860 - DNA, 20 bp, Artificial
  CRISPR gRNA sequence
gtgataccctaggagatcct

SEQ ID NO: 787861 - DNA, 20 bp, Artificial
  CRISPR gRNA sequence
ggagatcctgagctctgatg

SEQ ID NO: 787862 - DNA, 20 bp, Artificial
  CRISPR gRNA sequence
gagctctgatgaagacccca

SEQ ID NO: 787863 - DNA, 20 bp, Artificial
  CRISPR gRNA sequence
agctctgatgaagaccccac

SEQ ID NO: 787864 - DNA, 20 bp, Artificial
  CRISPR gRNA sequence
gaccccacaggtctctccca

SEQ ID NO: 787865 - DNA, 20 bp, Artificial
  CRISPR gRNA sequence
tcccatggttgttgactatt

SEQ ID NO: 787866 - DNA, 20 bp, Artificial
  CRISPR gRNA sequence
atggttgttgactatttagt

SEQ ID NO: 787867 - DNA, 20 bp, Artificial
  CRISPR gRNA sequence
gactatttagtaagccatgt

SEQ ID NO: 787868 - DNA, 20 bp, Artificial
  CRISPR gRNA sequence
aagccatgttggcttccatg

SEQ ID NO: 787869 - DNA, 20 bp, Artificial
  CRISPR gRNA sequence
gccatgttggcttccatgaa

SEQ ID NO: 787870 - DNA, 20 bp, Artificial
  CRISPR gRNA sequence
catgttggcttccatgaaga

SEQ ID NO: 787871 - DNA, 20 bp, Artificial
  CRISPR gRNA sequence
gttggcttccatgaagagag

SEQ ID NO: 787872 - DNA, 20 bp, Artificial
  CRISPR gRNA sequence
tggcttccatgaagagagtg

SEQ ID NO: 787873 - DNA, 20 bp, Artificial
  CRISPR gRNA sequence
cttccatgaagagagtggag

SEQ ID NO: 787874 - DNA, 20 bp, Artificial
  CRISPR gRNA sequence
actccactgttaacttctca

SEQ ID NO: 787875 - DNA, 20 bp, Artificial
  CRISPR gRNA sequence
tgttaacttctcacagcgta

SEQ ID NO: 787876 - DNA, 20 bp, Artificial
  CRISPR gRNA sequence
gttaacttctcacagcgtaa

SEQ ID NO: 787877 - DNA, 20 bp, Artificial
  CRISPR gRNA sequence
tctcacagcgtaaaggcttc

SEQ ID NO: 787878 - DNA, 20 bp, Artificial
  CRISPR gRNA sequence
tcacagcgtaaaggcttcca

SEQ ID NO: 787879 - DNA, 20 bp, Artificial
  CRISPR gRNA sequence
cgtaaaggcttccagagcaa

SEQ ID NO: 787880 - DNA, 20 bp, Artificial
  CRISPR gRNA sequence
aaggcttccagagcaatggt

SEQ ID NO: 787881 - DNA, 20 bp, Artificial
  CRISPR gRNA sequence
cctttcacatctctaccatg

SEQ ID NO: 787882 - DNA, 20 bp, Artificial
  CRISPR gRNA sequence
cacatctctaccatgcagaa

SEQ ID NO: 787883 - DNA, 20 bp, Artificial
  CRISPR gRNA sequence
gaatagaacactgacataat

SEQ ID NO: 787884 - DNA, 20 bp, Artificial
  CRISPR gRNA sequence
tagaacactgacataatcag

SEQ ID NO: 787885 - DNA, 20 bp, Artificial
  CRISPR gRNA sequence
ctgacataatcagtggtgta

SEQ ID NO: 787886 - DNA, 20 bp, Artificial
  CRISPR gRNA sequence
atttctcaattcatctcata

SEQ ID NO: 787887 - DNA, 20 bp, Artificial
  CRISPR gRNA sequence
tttctcaattcatctcatac

SEQ ID NO: 787888 - DNA, 20 bp, Artificial
  CRISPR gRNA sequence
catacaggcccctgtttccc

SEQ ID NO: 787889 - DNA, 20 bp, Artificial
  CRISPR gRNA sequence
tacaggcccctgtttccctg

SEQ ID NO: 787890 - DNA, 20 bp, Artificial
  CRISPR gRNA sequence
caggcccctgtttccctgga

SEQ ID NO: 787891 - DNA, 20 bp, Artificial
  CRISPR gRNA sequence
aggcccctgtttccctggag

SEQ ID NO: 787892 - DNA, 20 bp, Artificial
  CRISPR gRNA sequence
ccctggagaggttcttatat

SEQ ID NO: 787893 - DNA, 20 bp, Artificial
  CRISPR gRNA sequence
tggagaggttcttatataag

SEQ ID NO: 787894 - DNA, 20 bp, Artificial
  CRISPR gRNA sequence
ttatataagaagcgtctttc

SEQ ID NO: 787895 - DNA, 20 bp, Artificial
  CRISPR gRNA sequence
agaaaactacaattcatcca

SEQ ID NO: 787896 - DNA, 20 bp, Artificial
  CRISPR gRNA sequence
ctacaattcatccaaagtac

SEQ ID NO: 787897 - DNA, 20 bp, Artificial
  CRISPR gRNA sequence
agtactggcctacacttaac

SEQ ID NO: 787898 - DNA, 20 bp, Artificial
  CRISPR gRNA sequence
gtactggcctacacttaacc

SEQ ID NO: 787899 - DNA, 20 bp, Artificial
  CRISPR gRNA sequence
ctggcctacacttaaccagg

SEQ ID NO: 787900 - DNA, 20 bp, Artificial
  CRISPR gRNA sequence
tggcctacacttaaccaggc

SEQ ID NO: 787901 - DNA, 20 bp, Artificial
  CRISPR gRNA sequence
aaattccatataacgaacga

SEQ ID NO: 787902 - DNA, 20 bp, Artificial
  CRISPR gRNA sequence
gacagttgaataaacaattc

SEQ ID NO: 787903 - DNA, 20 bp, Artificial
  CRISPR gRNA sequence
acagttgaataaacaattcc

SEQ ID NO: 787904 - DNA, 20 bp, Artificial
  CRISPR gRNA sequence
cagttgaataaacaattcca

SEQ ID NO: 787905 - DNA, 20 bp, Artificial
  CRISPR gRNA sequence
agttgaataaacaattccag

SEQ ID NO: 787906 - DNA, 20 bp, Artificial
  CRISPR gRNA sequence
taaacaattccaggggaaaa

SEQ ID NO: 787907 - DNA, 20 bp, Artificial
  CRISPR gRNA sequence
ccaggggaaaaaagttctcg

SEQ ID NO: 787908 - DNA, 20 bp, Artificial
  CRISPR gRNA sequence
caggggaaaaaagttctcgt

SEQ ID NO: 787909 - DNA, 20 bp, Artificial
  CRISPR gRNA sequence
tgctcatatttaatcctctt

SEQ ID NO: 787910 - DNA, 20 bp, Artificial
  CRISPR gRNA sequence
ctcatatttaatcctcttta

SEQ ID NO: 787911 - DNA, 20 bp, Artificial
  CRISPR gRNA sequence
tcatatttaatcctctttag

SEQ ID NO: 787912 - DNA, 20 bp, Artificial
  CRISPR gRNA sequence
ttaatcctctttagaggctt

SEQ ID NO: 787913 - DNA, 20 bp, Artificial
  CRISPR gRNA sequence
ctctttagaggctttagctt

SEQ ID NO: 787914 - DNA, 20 bp, Artificial
  CRISPR gRNA sequence
gctttagctttagtatgaat

SEQ ID NO: 787915 - DNA, 20 bp, Artificial
  CRISPR gRNA sequence
tagctttagtatgaattagt

SEQ ID NO: 787916 - DNA, 20 bp, Artificial
  CRISPR gRNA sequence
gctttagtatgaattagtta

SEQ ID NO: 787917 - DNA, 20 bp, Artificial
  CRISPR gRNA sequence
agttagagttcatctttcat

SEQ ID NO: 787918 - DNA, 20 bp, Artificial
  CRISPR gRNA sequence
gttagagttcatctttcatg

SEQ ID NO: 787919 - DNA, 20 bp, Artificial
  CRISPR gRNA sequence
gagttcatctttcatgaggt

SEQ ID NO: 787920 - DNA, 20 bp, Artificial
  CRISPR gRNA sequence
ttcatctttcatgaggtgag

SEQ ID NO: 787921 - DNA, 20 bp, Artificial
  CRISPR gRNA sequence
ttcatgaggtgagaagtctg

SEQ ID NO: 787922 - DNA, 20 bp, Artificial
  CRISPR gRNA sequence
gtggtctcaaccatgatata

SEQ ID NO: 787923 - DNA, 20 bp, Artificial
  CRISPR gRNA sequence
ggtctcaaccatgatataaa

SEQ ID NO: 787924 - DNA, 20 bp, Artificial
  CRISPR gRNA sequence
tctcaaccatgatataaaga

SEQ ID NO: 787925 - DNA, 20 bp, Artificial
  CRISPR gRNA sequence
ctcaaccatgatataaagag

SEQ ID NO: 787926 - DNA, 20 bp, Artificial
  CRISPR gRNA sequence
aaccatgatataaagagagg

SEQ ID NO: 787927 - DNA, 20 bp, Artificial
  CRISPR gRNA sequence
ccatgatataaagagaggta

SEQ ID NO: 787928 - DNA, 20 bp, Artificial
  CRISPR gRNA sequence
agagaggtagagaatgttga

SEQ ID NO: 787929 - DNA, 20 bp, Artificial
  CRISPR gRNA sequence
ctaattcatttttttacctg

SEQ ID NO: 787930 - DNA, 20 bp, Artificial
  CRISPR gRNA sequence
ttcatttttttacctgaagt

SEQ ID NO: 787931 - DNA, 20 bp, Artificial
  CRISPR gRNA sequence
gaagttggtcctaaaattga

SEQ ID NO: 787932 - DNA, 20 bp, Artificial
  CRISPR gRNA sequence
tcctaaaattgatggatttc

SEQ ID NO: 787933 - DNA, 20 bp, Artificial
  CRISPR gRNA sequence
tcccctttccttttcttttt

SEQ ID NO: 787934 - DNA, 20 bp, Artificial
  CRISPR gRNA sequence
ccctttccttttcttttttg

SEQ ID NO: 787935 - DNA, 20 bp, Artificial
  CRISPR gRNA sequence
ttccttttcttttttggaga

SEQ ID NO: 787936 - DNA, 20 bp, Artificial
  CRISPR gRNA sequence
ccttttcttttttggagaca

SEQ ID NO: 787937 - DNA, 20 bp, Artificial
  CRISPR gRNA sequence
tttggagacagagtctcact

SEQ ID NO: 787938 - DNA, 20 bp, Artificial
  CRISPR gRNA sequence
cagagtctcactcggttgcc

SEQ ID NO: 787939 - DNA, 20 bp, Artificial
  CRISPR gRNA sequence
agagtctcactcggttgccc

SEQ ID NO: 787940 - DNA, 20 bp, Artificial
  CRISPR gRNA sequence
tctcactcggttgcccaggc

SEQ ID NO: 787941 - DNA, 20 bp, Artificial
  CRISPR gRNA sequence
tcactcggttgcccaggctg

SEQ ID NO: 787942 - DNA, 20 bp, Artificial
  CRISPR gRNA sequence
ctcggttgcccaggctggag

SEQ ID NO: 787943 - DNA, 20 bp, Artificial
  CRISPR gRNA sequence
cggttgcccaggctggagtg

SEQ ID NO: 787944 - DNA, 20 bp, Artificial
  CRISPR gRNA sequence
caggctggagtggagtacaa

SEQ ID NO: 787945 - DNA, 20 bp, Artificial
  CRISPR gRNA sequence
ggagtacaatggcacaattg

SEQ ID NO: 787946 - DNA, 20 bp, Artificial
  CRISPR gRNA sequence
tcactgtaacctcaatctac

SEQ ID NO: 787947 - DNA, 20 bp, Artificial
  CRISPR gRNA sequence
cactgtaacctcaatctact

SEQ ID NO: 787948 - DNA, 20 bp, Artificial
  CRISPR gRNA sequence
aacctcaatctactgggctc

SEQ ID NO: 787949 - DNA, 20 bp, Artificial
  CRISPR gRNA sequence
ctcaagtgatcctcctgcct

SEQ ID NO: 787950 - DNA, 20 bp, Artificial
  CRISPR gRNA sequence
cctcctgccttggcctccca

SEQ ID NO: 787951 - DNA, 20 bp, Artificial
  CRISPR gRNA sequence
gccttggcctcccaaagtgc

SEQ ID NO: 787952 - DNA, 20 bp, Artificial
  CRISPR gRNA sequence
ccttggcctcccaaagtgct

SEQ ID NO: 787953 - DNA, 20 bp, Artificial
  CRISPR gRNA sequence
ctcccaaagtgctgggatta

SEQ ID NO: 787954 - DNA, 20 bp, Artificial
  CRISPR gRNA sequence
aaagtgctgggattacagac

SEQ ID NO: 787955 - DNA, 20 bp, Artificial
  CRISPR gRNA sequence
cagacaagaaccaccatgcc

SEQ ID NO: 787956 - DNA, 20 bp, Artificial
  CRISPR gRNA sequence
agcctctaatgttttgattt

SEQ ID NO: 787957 - DNA, 20 bp, Artificial
  CRISPR gRNA sequence
ctaatgttttgatttcagtt

SEQ ID NO: 787958 - DNA, 20 bp, Artificial
  CRISPR gRNA sequence
ttgatttcagttaagatcct

SEQ ID NO: 787959 - DNA, 20 bp, Artificial
  CRISPR gRNA sequence
ttccttctaaactaataatt

SEQ ID NO: 787960 - DNA, 20 bp, Artificial
  CRISPR gRNA sequence
ttctaaactaataatttagt

SEQ ID NO: 787961 - DNA, 20 bp, Artificial
  CRISPR gRNA sequence
taaactaataatttagttag

SEQ ID NO: 787962 - DNA, 20 bp, Artificial
  CRISPR gRNA sequence
aaactaataatttagttaga

SEQ ID NO: 787963 - DNA, 20 bp, Artificial
  CRISPR gRNA sequence
ctaataatttagttagaagg

SEQ ID NO: 787964 - DNA, 20 bp, Artificial
  CRISPR gRNA sequence
taatttagttagaaggaagt

SEQ ID NO: 787965 - DNA, 20 bp, Artificial
  CRISPR gRNA sequence
aatttagttagaaggaagtt

SEQ ID NO: 787966 - DNA, 20 bp, Artificial
  CRISPR gRNA sequence
gaaggaagttgggctaactt

SEQ ID NO: 787967 - DNA, 20 bp, Artificial
  CRISPR gRNA sequence
agttgggctaactttagtgt

SEQ ID NO: 787968 - DNA, 20 bp, Artificial
  CRISPR gRNA sequence
gctaactttagtgttggcat

SEQ ID NO: 787969 - DNA, 20 bp, Artificial
  CRISPR gRNA sequence
ctaactttagtgttggcatt

SEQ ID NO: 787970 - DNA, 20 bp, Artificial
  CRISPR gRNA sequence
actttagtgttggcattggg

SEQ ID NO: 787971 - DNA, 20 bp, Artificial
  CRISPR gRNA sequence
tggcattgggtagtaaattg

SEQ ID NO: 787972 - DNA, 20 bp, Artificial
  CRISPR gRNA sequence
attgggtagtaaattgtgga

SEQ ID NO: 787973 - DNA, 20 bp, Artificial
  CRISPR gRNA sequence
ttgggtagtaaattgtggat

SEQ ID NO: 787974 - DNA, 20 bp, Artificial
  CRISPR gRNA sequence
ggtagtaaattgtggatagg

SEQ ID NO: 787975 - DNA, 20 bp, Artificial
  CRISPR gRNA sequence
gtagtaaattgtggataggt

SEQ ID NO: 787976 - DNA, 20 bp, Artificial
  CRISPR gRNA sequence
tagtaaattgtggataggta

SEQ ID NO: 787977 - DNA, 20 bp, Artificial
  CRISPR gRNA sequence
taaattgtggataggtaggg

SEQ ID NO: 787978 - DNA, 20 bp, Artificial
  CRISPR gRNA sequence
attgtggataggtagggaag

SEQ ID NO: 787979 - DNA, 20 bp, Artificial
  CRISPR gRNA sequence
ttgtggataggtagggaagt

SEQ ID NO: 787980 - DNA, 20 bp, Artificial
  CRISPR gRNA sequence
gataggtagggaagtgggaa

SEQ ID NO: 787981 - DNA, 20 bp, Artificial
  CRISPR gRNA sequence
ataggtagggaagtgggaaa

SEQ ID NO: 787982 - DNA, 20 bp, Artificial
  CRISPR gRNA sequence
taggtagggaagtgggaaaa

SEQ ID NO: 787983 - DNA, 20 bp, Artificial
  CRISPR gRNA sequence
aggtagggaagtgggaaaag

SEQ ID NO: 787984 - DNA, 20 bp, Artificial
  CRISPR gRNA sequence
gtagggaagtgggaaaaggg

SEQ ID NO: 787985 - DNA, 20 bp, Artificial
  CRISPR gRNA sequence
agggaagtgggaaaagggga

SEQ ID NO: 787986 - DNA, 20 bp, Artificial
  CRISPR gRNA sequence
tgggaaaaggggagagatga

SEQ ID NO: 787987 - DNA, 20 bp, Artificial
  CRISPR gRNA sequence
gggagagatgacagtgcatc

SEQ ID NO: 787988 - DNA, 20 bp, Artificial
  CRISPR gRNA sequence
gctgcctctgaaaactgtat

SEQ ID NO: 787989 - DNA, 20 bp, Artificial
  CRISPR gRNA sequence
ctgcctctgaaaactgtatc

SEQ ID NO: 787990 - DNA, 20 bp, Artificial
  CRISPR gRNA sequence
tgcctctgaaaactgtatca

SEQ ID NO: 787991 - DNA, 20 bp, Artificial
  CRISPR gRNA sequence
ctctgaaaactgtatcaggg

SEQ ID NO: 787992 - DNA, 20 bp, Artificial
  CRISPR gRNA sequence
tatcagggaagaattttttc

SEQ ID NO: 787993 - DNA, 20 bp, Artificial
  CRISPR gRNA sequence
cagggaagaattttttccag

SEQ ID NO: 787994 - DNA, 20 bp, Artificial
  CRISPR gRNA sequence
ttttttccagaagaaaatac

SEQ ID NO: 787995 - DNA, 20 bp, Artificial
  CRISPR gRNA sequence
tttttccagaagaaaatacc

SEQ ID NO: 787996 - DNA, 20 bp, Artificial
  CRISPR gRNA sequence
tccagaagaaaataccagga

SEQ ID NO: 787997 - DNA, 20 bp, Artificial
  CRISPR gRNA sequence
aataccaggaaagttatgat

SEQ ID NO: 787998 - DNA, 20 bp, Artificial
  CRISPR gRNA sequence
ccaggaaagttatgatgaga

SEQ ID NO: 787999 - DNA, 20 bp, Artificial
  CRISPR gRNA sequence
caggaaagttatgatgagat

SEQ ID NO: 788000 - DNA, 20 bp, Artificial
  CRISPR gRNA sequence
gttatgatgagatgggtatt

SEQ ID NO: 788001 - DNA, 20 bp, Artificial
  CRISPR gRNA sequence
atgggtatttagtcactgca

SEQ ID NO: 788002 - DNA, 20 bp, Artificial
  CRISPR gRNA sequence
tttagtcactgcaaagttct

SEQ ID NO: 788003 - DNA, 20 bp, Artificial
  CRISPR gRNA sequence
tagtcactgcaaagttcttg

SEQ ID NO: 788004 - DNA, 20 bp, Artificial
  CRISPR gRNA sequence
actgcaaagttcttggagtc

SEQ ID NO: 788005 - DNA, 20 bp, Artificial
  CRISPR gRNA sequence
agttcttggagtctggtctg

SEQ ID NO: 788006 - DNA, 20 bp, Artificial
  CRISPR gRNA sequence
ttggagtctggtctgtggat

SEQ ID NO: 788007 - DNA, 20 bp, Artificial
  CRISPR gRNA sequence
tgaaaaaattaattttaatt

SEQ ID NO: 788008 - DNA, 20 bp, Artificial
  CRISPR gRNA sequence
attaattttaatttggcata

SEQ ID NO: 788009 - DNA, 20 bp, Artificial
  CRISPR gRNA sequence
tttaatttggcataaagcat

SEQ ID NO: 788010 - DNA, 20 bp, Artificial
  CRISPR gRNA sequence
ctcaccccaactgtacttga

SEQ ID NO: 788011 - DNA, 20 bp, Artificial
  CRISPR gRNA sequence
accccaactgtacttgatgg

SEQ ID NO: 788012 - DNA, 20 bp, Artificial
  CRISPR gRNA sequence
ccaactgtacttgatggtgg

SEQ ID NO: 788013 - DNA, 20 bp, Artificial
  CRISPR gRNA sequence
tgatggtggtagttctgtgc

SEQ ID NO: 788014 - DNA, 20 bp, Artificial
  CRISPR gRNA sequence
gatggtggtagttctgtgca

SEQ ID NO: 788015 - DNA, 20 bp, Artificial
  CRISPR gRNA sequence
ttcctcctgacaacctcctc

SEQ ID NO: 788016 - DNA, 20 bp, Artificial
  CRISPR gRNA sequence
agcatgttctacgtctgtac

SEQ ID NO: 788017 - DNA, 20 bp, Artificial
  CRISPR gRNA sequence
gcatgttctacgtctgtacc

SEQ ID NO: 788018 - DNA, 20 bp, Artificial
  CRISPR gRNA sequence
catgttctacgtctgtacca

SEQ ID NO: 788019 - DNA, 20 bp, Artificial
  CRISPR gRNA sequence
cgtctgtaccagggctatcc

SEQ ID NO: 788020 - DNA, 20 bp, Artificial
  CRISPR gRNA sequence
ccagggctatcccagtgctg

SEQ ID NO: 788021 - DNA, 20 bp, Artificial
  CRISPR gRNA sequence
cagggctatcccagtgctgc

SEQ ID NO: 788022 - DNA, 20 bp, Artificial
  CRISPR gRNA sequence
gctatcccagtgctgcaggt

SEQ ID NO: 788023 - DNA, 20 bp, Artificial
  CRISPR gRNA sequence
tacttctaatgactcacgta

SEQ ID NO: 788024 - DNA, 20 bp, Artificial
  CRISPR gRNA sequence
ttctaatgactcacgtatag

SEQ ID NO: 788025 - DNA, 20 bp, Artificial
  CRISPR gRNA sequence
ttcactcaaccccacacatt

SEQ ID NO: 788026 - DNA, 20 bp, Artificial
  CRISPR gRNA sequence
tcactcaaccccacacattt

SEQ ID NO: 788027 - DNA, 20 bp, Artificial
  CRISPR gRNA sequence
atttaggctctgctgaatca

SEQ ID NO: 788028 - DNA, 20 bp, Artificial
  CRISPR gRNA sequence
tttaggctctgctgaatcaa

SEQ ID NO: 788029 - DNA, 20 bp, Artificial
  CRISPR gRNA sequence
gctctgctgaatcaaaggtc

SEQ ID NO: 788030 - DNA, 20 bp, Artificial
  CRISPR gRNA sequence
atcaaaggtctggcttccta

SEQ ID NO: 788031 - DNA, 20 bp, Artificial
  CRISPR gRNA sequence
tcaaaggtctggcttcctac

SEQ ID NO: 788032 - DNA, 20 bp, Artificial
  CRISPR gRNA sequence
caaaggtctggcttcctacg

SEQ ID NO: 788033 - DNA, 20 bp, Artificial
  CRISPR gRNA sequence
tggcttcctacggggaattc

SEQ ID NO: 788034 - DNA, 20 bp, Artificial
  CRISPR gRNA sequence
cttcctacggggaattctag

SEQ ID NO: 788035 - DNA, 20 bp, Artificial
  CRISPR gRNA sequence
ttcctacggggaattctagc

SEQ ID NO: 788036 - DNA, 20 bp, Artificial
  CRISPR gRNA sequence
tcctacggggaattctagca

SEQ ID NO: 788037 - DNA, 20 bp, Artificial
  CRISPR gRNA sequence
cctacggggaattctagcag

SEQ ID NO: 788038 - DNA, 20 bp, Artificial
  CRISPR gRNA sequence
tgcttgttctactgcatcta

SEQ ID NO: 788039 - DNA, 20 bp, Artificial
  CRISPR gRNA sequence
tgcatctaaagctctgctac

SEQ ID NO: 788040 - DNA, 20 bp, Artificial
  CRISPR gRNA sequence
ctaaagctctgctactggcc

SEQ ID NO: 788041 - DNA, 20 bp, Artificial
  CRISPR gRNA sequence
gctactggcctggccacctt

SEQ ID NO: 788042 - DNA, 20 bp, Artificial
  CRISPR gRNA sequence
ccaccttgagctcttaatat

SEQ ID NO: 788043 - DNA, 20 bp, Artificial
  CRISPR gRNA sequence
ccttgagctcttaatattgg

SEQ ID NO: 788044 - DNA, 20 bp, Artificial
  CRISPR gRNA sequence
agctcttaatattggcagac

SEQ ID NO: 788045 - DNA, 20 bp, Artificial
  CRISPR gRNA sequence
cttaatattggcagaccagt

SEQ ID NO: 788046 - DNA, 20 bp, Artificial
  CRISPR gRNA sequence
tattggcagaccagtgagca

SEQ ID NO: 788047 - DNA, 20 bp, Artificial
  CRISPR gRNA sequence
aaagaaaaaaattaccatac

SEQ ID NO: 788048 - DNA, 20 bp, Artificial
  CRISPR gRNA sequence
gaaaaaaattaccatactgg

SEQ ID NO: 788049 - DNA, 20 bp, Artificial
  CRISPR gRNA sequence
aaaaaattaccatactggtg

SEQ ID NO: 788050 - DNA, 20 bp, Artificial
  CRISPR gRNA sequence
tcttgaacactgctacataa

SEQ ID NO: 788051 - DNA, 20 bp, Artificial
  CRISPR gRNA sequence
ttgaacactgctacataatg

SEQ ID NO: 788052 - DNA, 20 bp, Artificial
  CRISPR gRNA sequence
cactgctacataatggagac

SEQ ID NO: 788053 - DNA, 20 bp, Artificial
  CRISPR gRNA sequence
actgctacataatggagaca

SEQ ID NO: 788054 - DNA, 20 bp, Artificial
  CRISPR gRNA sequence
gctacataatggagacaagg

SEQ ID NO: 788055 - DNA, 20 bp, Artificial
  CRISPR gRNA sequence
tacataatggagacaaggaa

SEQ ID NO: 788056 - DNA, 20 bp, Artificial
  CRISPR gRNA sequence
gagacaaggaagagtatgtc

SEQ ID NO: 788057 - DNA, 20 bp, Artificial
  CRISPR gRNA sequence
ggaagagtatgtctggaact

SEQ ID NO: 788058 - DNA, 20 bp, Artificial
  CRISPR gRNA sequence
gaagagtatgtctggaactc

SEQ ID NO: 788059 - DNA, 20 bp, Artificial
  CRISPR gRNA sequence
aagagtatgtctggaactca

SEQ ID NO: 788060 - DNA, 20 bp, Artificial
  CRISPR gRNA sequence
agagtatgtctggaactcag

SEQ ID NO: 788061 - DNA, 20 bp, Artificial
  CRISPR gRNA sequence
tcaggggtccgctgattcac

SEQ ID NO: 788062 - DNA, 20 bp, Artificial
  CRISPR gRNA sequence
gttctttttacttccatatc

SEQ ID NO: 788063 - DNA, 20 bp, Artificial
  CRISPR gRNA sequence
ccatatccagtgataatgaa

SEQ ID NO: 788064 - DNA, 20 bp, Artificial
  CRISPR gRNA sequence
aaagatatttgcaacaaccc

SEQ ID NO: 788065 - DNA, 20 bp, Artificial
  CRISPR gRNA sequence
tgcaacaaccccagtctgtt

SEQ ID NO: 788066 - DNA, 20 bp, Artificial
  CRISPR gRNA sequence
gcaacaaccccagtctgtta

SEQ ID NO: 788067 - DNA, 20 bp, Artificial
  CRISPR gRNA sequence
caacaaccccagtctgttaa

SEQ ID NO: 788068 - DNA, 20 bp, Artificial
  CRISPR gRNA sequence
gttaagggcatgctgatcaa

SEQ ID NO: 788069 - DNA, 20 bp, Artificial
  CRISPR gRNA sequence
gggcatgctgatcaaaagct

SEQ ID NO: 788070 - DNA, 20 bp, Artificial
  CRISPR gRNA sequence
gatcaaaagctcagatctct

SEQ ID NO: 788071 - DNA, 20 bp, Artificial
  CRISPR gRNA sequence
atcaaaagctcagatctctt

SEQ ID NO: 788072 - DNA, 20 bp, Artificial
  CRISPR gRNA sequence
tcaaaagctcagatctctta

SEQ ID NO: 788073 - DNA, 20 bp, Artificial
  CRISPR gRNA sequence
tcagatctcttagggtcgtt

SEQ ID NO: 788074 - DNA, 20 bp, Artificial
  CRISPR gRNA sequence
tctcttagggtcgttaagtc

SEQ ID NO: 788075 - DNA, 20 bp, Artificial
  CRISPR gRNA sequence
ctcttagggtcgttaagtct

SEQ ID NO: 788076 - DNA, 20 bp, Artificial
  CRISPR gRNA sequence
ttaagtctgggtcaccctat

SEQ ID NO: 788077 - DNA, 20 bp, Artificial
  CRISPR gRNA sequence
taagtctgggtcaccctatc

SEQ ID NO: 788078 - DNA, 20 bp, Artificial
  CRISPR gRNA sequence
ctgggtcaccctatcaggca

SEQ ID NO: 788079 - DNA, 20 bp, Artificial
  CRISPR gRNA sequence
ggcaaagaaaccattccatc

SEQ ID NO: 788080 - DNA, 20 bp, Artificial
  CRISPR gRNA sequence
gcaaagaaaccattccatct

SEQ ID NO: 788081 - DNA, 20 bp, Artificial
  CRISPR gRNA sequence
caaagaaaccattccatctg

SEQ ID NO: 788082 - DNA, 20 bp, Artificial
  CRISPR gRNA sequence
aaccattccatctggggtgt

SEQ ID NO: 788083 - DNA, 20 bp, Artificial
  CRISPR gRNA sequence
accattccatctggggtgtt

SEQ ID NO: 788084 - DNA, 20 bp, Artificial
  CRISPR gRNA sequence
ttccatctggggtgttaggt

SEQ ID NO: 788085 - DNA, 20 bp, Artificial
  CRISPR gRNA sequence
tccatctggggtgttaggtg

SEQ ID NO: 788086 - DNA, 20 bp, Artificial
  CRISPR gRNA sequence
ccatctggggtgttaggtga

SEQ ID NO: 788087 - DNA, 20 bp, Artificial
  CRISPR gRNA sequence
ggtgttaggtgagggaaatc

SEQ ID NO: 788088 - DNA, 20 bp, Artificial
  CRISPR gRNA sequence
tgagggaaatctggaatgta

SEQ ID NO: 788089 - DNA, 20 bp, Artificial
  CRISPR gRNA sequence
gggaaatctggaatgtatgg

SEQ ID NO: 788090 - DNA, 20 bp, Artificial
  CRISPR gRNA sequence
atctggaatgtatggtggat

SEQ ID NO: 788091 - DNA, 20 bp, Artificial
  CRISPR gRNA sequence
ggaatgtatggtggatgagt

SEQ ID NO: 788092 - DNA, 20 bp, Artificial
  CRISPR gRNA sequence
gagacaacaaatatcaactg

SEQ ID NO: 788093 - DNA, 20 bp, Artificial
  CRISPR gRNA sequence
aacaaatatcaactgtggct

SEQ ID NO: 788094 - DNA, 20 bp, Artificial
  CRISPR gRNA sequence
acaaatatcaactgtggctt

SEQ ID NO: 788095 - DNA, 20 bp, Artificial
  CRISPR gRNA sequence
caactgtggcttgggatcca

SEQ ID NO: 788096 - DNA, 20 bp, Artificial
  CRISPR gRNA sequence
ctgtggcttgggatccacag

SEQ ID NO: 788097 - DNA, 20 bp, Artificial
  CRISPR gRNA sequence
tggcttgggatccacagcag

SEQ ID NO: 788098 - DNA, 20 bp, Artificial
  CRISPR gRNA sequence
cttgggatccacagcagcag

SEQ ID NO: 788099 - DNA, 20 bp, Artificial
  CRISPR gRNA sequence
ttgggatccacagcagcagc

SEQ ID NO: 788100 - DNA, 20 bp, Artificial
  CRISPR gRNA sequence
cacagcagcagcaggaacta

SEQ ID NO: 788101 - DNA, 20 bp, Artificial
  CRISPR gRNA sequence
ctacagcttgttccacaaac

SEQ ID NO: 788102 - DNA, 20 bp, Artificial
  CRISPR gRNA sequence
ggtgtatattaaatcttctg

SEQ ID NO: 788103 - DNA, 20 bp, Artificial
  CRISPR gRNA sequence
tgtatattaaatcttctgca

SEQ ID NO: 788104 - DNA, 20 bp, Artificial
  CRISPR gRNA sequence
taaatcttctgcagagattg

SEQ ID NO: 788105 - DNA, 20 bp, Artificial
  CRISPR gRNA sequence
cagagattgtggctgcctcc

SEQ ID NO: 788106 - DNA, 20 bp, Artificial
  CRISPR gRNA sequence
gattgtggctgcctcccagc

SEQ ID NO: 788107 - DNA, 20 bp, Artificial
  CRISPR gRNA sequence
tgtggctgcctcccagctgg

SEQ ID NO: 788108 - DNA, 20 bp, Artificial
  CRISPR gRNA sequence
gtggctgcctcccagctgga

SEQ ID NO: 788109 - DNA, 20 bp, Artificial
  CRISPR gRNA sequence
tgcctcccagctggaaggct

SEQ ID NO: 788110 - DNA, 20 bp, Artificial
  CRISPR gRNA sequence
ctcccagctggaaggctcag

SEQ ID NO: 788111 - DNA, 20 bp, Artificial
  CRISPR gRNA sequence
ccagctggaaggctcagtgg

SEQ ID NO: 788112 - DNA, 20 bp, Artificial
  CRISPR gRNA sequence
agctggaaggctcagtggca

SEQ ID NO: 788113 - DNA, 20 bp, Artificial
  CRISPR gRNA sequence
gtggcagagctgacttaatg

SEQ ID NO: 788114 - DNA, 20 bp, Artificial
  CRISPR gRNA sequence
tggcagagctgacttaatga

SEQ ID NO: 788115 - DNA, 20 bp, Artificial
  CRISPR gRNA sequence
ggcagagctgacttaatgaa

SEQ ID NO: 788116 - DNA, 20 bp, Artificial
  CRISPR gRNA sequence
gctgacttaatgaagggcat

SEQ ID NO: 788117 - DNA, 20 bp, Artificial
  CRISPR gRNA sequence
gacttaatgaagggcatgag

SEQ ID NO: 788118 - DNA, 20 bp, Artificial
  CRISPR gRNA sequence
agggcatgagtggatttgaa

SEQ ID NO: 788119 - DNA, 20 bp, Artificial
  CRISPR gRNA sequence
gtggatttgaacagtacaat

SEQ ID NO: 788120 - DNA, 20 bp, Artificial
  CRISPR gRNA sequence
tggatttgaacagtacaatt

SEQ ID NO: 788121 - DNA, 20 bp, Artificial
  CRISPR gRNA sequence
ggatttgaacagtacaattg

SEQ ID NO: 788122 - DNA, 20 bp, Artificial
  CRISPR gRNA sequence
cagtacaattggggactgtg

SEQ ID NO: 788123 - DNA, 20 bp, Artificial
  CRISPR gRNA sequence
agtcctgccttatttcctct

SEQ ID NO: 788124 - DNA, 20 bp, Artificial
  CRISPR gRNA sequence
ctcagcctcacctttcactt

SEQ ID NO: 788125 - DNA, 20 bp, Artificial
  CRISPR gRNA sequence
gcctcacctttcacttcagc

SEQ ID NO: 788126 - DNA, 20 bp, Artificial
  CRISPR gRNA sequence
cacctttcacttcagccagc

SEQ ID NO: 788127 - DNA, 20 bp, Artificial
  CRISPR gRNA sequence
acctttcacttcagccagct

SEQ ID NO: 788128 - DNA, 20 bp, Artificial
  CRISPR gRNA sequence
cctttcacttcagccagctg

SEQ ID NO: 788129 - DNA, 20 bp, Artificial
  CRISPR gRNA sequence
ttcacttcagccagctgggg

SEQ ID NO: 788130 - DNA, 20 bp, Artificial
  CRISPR gRNA sequence
agccagctggggtagaattc

SEQ ID NO: 788131 - DNA, 20 bp, Artificial
  CRISPR gRNA sequence
agctggggtagaattctagt

SEQ ID NO: 788132 - DNA, 20 bp, Artificial
  CRISPR gRNA sequence
gctggggtagaattctagtt

SEQ ID NO: 788133 - DNA, 20 bp, Artificial
  CRISPR gRNA sequence
gttaggcttacactcacttc

SEQ ID NO: 788134 - DNA, 20 bp, Artificial
  CRISPR gRNA sequence
ttaggcttacactcacttca

SEQ ID NO: 788135 - DNA, 20 bp, Artificial
  CRISPR gRNA sequence
gcttacactcacttcaaggt

SEQ ID NO: 788136 - DNA, 20 bp, Artificial
  CRISPR gRNA sequence
gtcagtaattcacctcaaat

SEQ ID NO: 788137 - DNA, 20 bp, Artificial
  CRISPR gRNA sequence
ctgcgacttttctgatgcta

SEQ ID NO: 788138 - DNA, 20 bp, Artificial
  CRISPR gRNA sequence
ttttctgatgctacggatac

SEQ ID NO: 788139 - DNA, 20 bp, Artificial
  CRISPR gRNA sequence
tttctgatgctacggatact

SEQ ID NO: 788140 - DNA, 20 bp, Artificial
  CRISPR gRNA sequence
ttctgatgctacggatactg

SEQ ID NO: 788141 - DNA, 20 bp, Artificial
  CRISPR gRNA sequence
gatgctacggatactgggga

SEQ ID NO: 788142 - DNA, 20 bp, Artificial
  CRISPR gRNA sequence
gatactggggaaagctcact

SEQ ID NO: 788143 - DNA, 20 bp, Artificial
  CRISPR gRNA sequence
actcagcccacatgcatgtc

SEQ ID NO: 788144 - DNA, 20 bp, Artificial
  CRISPR gRNA sequence
gcccacatgcatgtctagcc

SEQ ID NO: 788145 - DNA, 20 bp, Artificial
  CRISPR gRNA sequence
cacatgcatgtctagcccag

SEQ ID NO: 788146 - DNA, 20 bp, Artificial
  CRISPR gRNA sequence
atgcatgtctagcccagcag

SEQ ID NO: 788147 - DNA, 20 bp, Artificial
  CRISPR gRNA sequence
tgtctagcccagcagcagaa

SEQ ID NO: 788148 - DNA, 20 bp, Artificial
  CRISPR gRNA sequence
tctagcccagcagcagaatg

SEQ ID NO: 788149 - DNA, 20 bp, Artificial
  CRISPR gRNA sequence
ttcatattcctgtcaaccaa

SEQ ID NO: 788150 - DNA, 20 bp, Artificial
  CRISPR gRNA sequence
tcatattcctgtcaaccaat

SEQ ID NO: 788151 - DNA, 20 bp, Artificial
  CRISPR gRNA sequence
cctgtcaaccaatgggcgtg

SEQ ID NO: 788152 - DNA, 20 bp, Artificial
  CRISPR gRNA sequence
gtcaaccaatgggcgtgaag

SEQ ID NO: 788153 - DNA, 20 bp, Artificial
  CRISPR gRNA sequence
tgggcgtgaagcagatgaac

SEQ ID NO: 788154 - DNA, 20 bp, Artificial
  CRISPR gRNA sequence
ccacctgaaattctttgtct

SEQ ID NO: 788155 - DNA, 20 bp, Artificial
  CRISPR gRNA sequence
cctgaaattctttgtctgag

SEQ ID NO: 788156 - DNA, 20 bp, Artificial
  CRISPR gRNA sequence
ctttgtctgagtagacatct

SEQ ID NO: 788157 - DNA, 20 bp, Artificial
  CRISPR gRNA sequence
tttgtctgagtagacatctt

SEQ ID NO: 788158 - DNA, 20 bp, Artificial
  CRISPR gRNA sequence
tgtctgagtagacatcttag

SEQ ID NO: 788159 - DNA, 20 bp, Artificial
  CRISPR gRNA sequence
gtctgagtagacatcttagg

SEQ ID NO: 788160 - DNA, 20 bp, Artificial
  CRISPR gRNA sequence
ttaggaggctgtctacatgc

SEQ ID NO: 788161 - DNA, 20 bp, Artificial
  CRISPR gRNA sequence
atgctggtccttgaatattt

SEQ ID NO: 788162 - DNA, 20 bp, Artificial
  CRISPR gRNA sequence
aatctcttgcttctgccctc

SEQ ID NO: 788163 - DNA, 20 bp, Artificial
  CRISPR gRNA sequence
atctcttgcttctgccctct

SEQ ID NO: 788164 - DNA, 20 bp, Artificial
  CRISPR gRNA sequence
tctcttgcttctgccctctg

SEQ ID NO: 788165 - DNA, 20 bp, Artificial
  CRISPR gRNA sequence
taaatacctgcatgccacac

SEQ ID NO: 788166 - DNA, 20 bp, Artificial
  CRISPR gRNA sequence
tgccacacaagtccttatca

SEQ ID NO: 788167 - DNA, 20 bp, Artificial
  CRISPR gRNA sequence
gccacacaagtccttatcat

SEQ ID NO: 788168 - DNA, 20 bp, Artificial
  CRISPR gRNA sequence
tatcataggctctgtcttac

SEQ ID NO: 788169 - DNA, 20 bp, Artificial
  CRISPR gRNA sequence
taggctctgtcttaccagct

SEQ ID NO: 788170 - DNA, 20 bp, Artificial
  CRISPR gRNA sequence
ctgtcttaccagctaagaca

SEQ ID NO: 788171 - DNA, 20 bp, Artificial
  CRISPR gRNA sequence
tgtcttaccagctaagacaa

SEQ ID NO: 788172 - DNA, 20 bp, Artificial
  CRISPR gRNA sequence
gtcttaccagctaagacaaa

SEQ ID NO: 788173 - DNA, 20 bp, Artificial
  CRISPR gRNA sequence
tgtgaaatacaatgacaata

SEQ ID NO: 788174 - DNA, 20 bp, Artificial
  CRISPR gRNA sequence
aatatagtgaattttctata

SEQ ID NO: 788175 - DNA, 20 bp, Artificial
  CRISPR gRNA sequence
tagtgaattttctataaagc

SEQ ID NO: 788176 - DNA, 20 bp, Artificial
  CRISPR gRNA sequence
tctataaagccagattgaat

SEQ ID NO: 788177 - DNA, 20 bp, Artificial
  CRISPR gRNA sequence
aagccagattgaatcagtac

SEQ ID NO: 788178 - DNA, 20 bp, Artificial
  CRISPR gRNA sequence
agccagattgaatcagtact

SEQ ID NO: 788179 - DNA, 20 bp, Artificial
  CRISPR gRNA sequence
gccagattgaatcagtacta

SEQ ID NO: 788180 - DNA, 20 bp, Artificial
  CRISPR gRNA sequence
cagtactagggactgtcctt

SEQ ID NO: 788181 - DNA, 20 bp, Artificial
  CRISPR gRNA sequence
tagggactgtcctttagtct

SEQ ID NO: 788182 - DNA, 20 bp, Artificial
  CRISPR gRNA sequence
gggactgtcctttagtctga

SEQ ID NO: 788183 - DNA, 20 bp, Artificial
  CRISPR gRNA sequence
tctgagagtatatcccttct

SEQ ID NO: 788184 - DNA, 20 bp, Artificial
  CRISPR gRNA sequence
gagagtatatcccttctcag

SEQ ID NO: 788185 - DNA, 20 bp, Artificial
  CRISPR gRNA sequence
agagtatatcccttctcagt

SEQ ID NO: 788186 - DNA, 20 bp, Artificial
  CRISPR gRNA sequence
cagtaggataaataaaatta

SEQ ID NO: 788187 - DNA, 20 bp, Artificial
  CRISPR gRNA sequence
taaaattatggctctcccca

SEQ ID NO: 788188 - DNA, 20 bp, Artificial
  CRISPR gRNA sequence
gatgtccatattctaatccc

SEQ ID NO: 788189 - DNA, 20 bp, Artificial
  CRISPR gRNA sequence
tgtgaatatgtcaccttaca

SEQ ID NO: 788190 - DNA, 20 bp, Artificial
  CRISPR gRNA sequence
tatgtcaccttacatggcaa

SEQ ID NO: 788191 - DNA, 20 bp, Artificial
  CRISPR gRNA sequence
atgtcaccttacatggcaaa

SEQ ID NO: 788192 - DNA, 20 bp, Artificial
  CRISPR gRNA sequence
acatggcaaaaggaattttg

SEQ ID NO: 788193 - DNA, 20 bp, Artificial
  CRISPR gRNA sequence
ggcaaaaggaattttgaaga

SEQ ID NO: 788194 - DNA, 20 bp, Artificial
  CRISPR gRNA sequence
gaattttgaagatggacctt

SEQ ID NO: 788195 - DNA, 20 bp, Artificial
  CRISPR gRNA sequence
tttgaagatggaccttgaga

SEQ ID NO: 788196 - DNA, 20 bp, Artificial
  CRISPR gRNA sequence
ttgaagatggaccttgagat

SEQ ID NO: 788197 - DNA, 20 bp, Artificial
  CRISPR gRNA sequence
aagatggaccttgagatggg

SEQ ID NO: 788198 - DNA, 20 bp, Artificial
  CRISPR gRNA sequence
ggaagatcaccccaaataac

SEQ ID NO: 788199 - DNA, 20 bp, Artificial
  CRISPR gRNA sequence
gaagatcaccccaaataacc

SEQ ID NO: 788200 - DNA, 20 bp, Artificial
  CRISPR gRNA sequence
aagatcaccccaaataacca

SEQ ID NO: 788201 - DNA, 20 bp, Artificial
  CRISPR gRNA sequence
agatcaccccaaataaccag

SEQ ID NO: 788202 - DNA, 20 bp, Artificial
  CRISPR gRNA sequence
gatcaccccaaataaccagg

SEQ ID NO: 788203 - DNA, 20 bp, Artificial
  CRISPR gRNA sequence
accccaaataaccaggggga

SEQ ID NO: 788204 - DNA, 20 bp, Artificial
  CRISPR gRNA sequence
cccaaataaccagggggatg

SEQ ID NO: 788205 - DNA, 20 bp, Artificial
  CRISPR gRNA sequence
ggagtacctaatgcaatcac

SEQ ID NO: 788206 - DNA, 20 bp, Artificial
  CRISPR gRNA sequence
gagtacctaatgcaatcaca

SEQ ID NO: 788207 - DNA, 20 bp, Artificial
  CRISPR gRNA sequence
agtacctaatgcaatcacaa

SEQ ID NO: 788208 - DNA, 20 bp, Artificial
  CRISPR gRNA sequence
atgcaatcacaagggtcctt

SEQ ID NO: 788209 - DNA, 20 bp, Artificial
  CRISPR gRNA sequence
gcaatcacaagggtccttaa

SEQ ID NO: 788210 - DNA, 20 bp, Artificial
  CRISPR gRNA sequence
caatcacaagggtccttaag

SEQ ID NO: 788211 - DNA, 20 bp, Artificial
  CRISPR gRNA sequence
tcacaagggtccttaagagg

SEQ ID NO: 788212 - DNA, 20 bp, Artificial
  CRISPR gRNA sequence
agggtccttaagaggtggca

SEQ ID NO: 788213 - DNA, 20 bp, Artificial
  CRISPR gRNA sequence
ggtccttaagaggtggcaaa

SEQ ID NO: 788214 - DNA, 20 bp, Artificial
  CRISPR gRNA sequence
ccttaagaggtggcaaagag

SEQ ID NO: 788215 - DNA, 20 bp, Artificial
  CRISPR gRNA sequence
aagaggtggcaaagagaagc

SEQ ID NO: 788216 - DNA, 20 bp, Artificial
  CRISPR gRNA sequence
ggtggcaaagagaagcaagc

SEQ ID NO: 788217 - DNA, 20 bp, Artificial
  CRISPR gRNA sequence
gcaaagagaagcaagctagt

SEQ ID NO: 788218 - DNA, 20 bp, Artificial
  CRISPR gRNA sequence
caaagagaagcaagctagtt

SEQ ID NO: 788219 - DNA, 20 bp, Artificial
  CRISPR gRNA sequence
aaagagaagcaagctagtta

SEQ ID NO: 788220 - DNA, 20 bp, Artificial
  CRISPR gRNA sequence
agaagcaagctagttaggga

SEQ ID NO: 788221 - DNA, 20 bp, Artificial
  CRISPR gRNA sequence
aagcaagctagttagggaaa

SEQ ID NO: 788222 - DNA, 20 bp, Artificial
  CRISPR gRNA sequence
gctagttagggaaagagatg

SEQ ID NO: 788223 - DNA, 20 bp, Artificial
  CRISPR gRNA sequence
agagatgtggctgatcatga

SEQ ID NO: 788224 - DNA, 20 bp, Artificial
  CRISPR gRNA sequence
atggctcacgcctgtaatcc

SEQ ID NO: 788225 - DNA, 20 bp, Artificial
  CRISPR gRNA sequence
cgcctgtaatcctagcaatt

SEQ ID NO: 788226 - DNA, 20 bp, Artificial
  CRISPR gRNA sequence
gcctgtaatcctagcaattt

SEQ ID NO: 788227 - DNA, 20 bp, Artificial
  CRISPR gRNA sequence
ctgtaatcctagcaatttgg

SEQ ID NO: 788228 - DNA, 20 bp, Artificial
  CRISPR gRNA sequence
tgtaatcctagcaatttggg

SEQ ID NO: 788229 - DNA, 20 bp, Artificial
  CRISPR gRNA sequence
tcctagcaatttgggaggct

SEQ ID NO: 788230 - DNA, 20 bp, Artificial
  CRISPR gRNA sequence
cctagcaatttgggaggctg

SEQ ID NO: 788231 - DNA, 20 bp, Artificial
  CRISPR gRNA sequence
agcaatttgggaggctgagg

SEQ ID NO: 788232 - DNA, 20 bp, Artificial
  CRISPR gRNA sequence
gcaatttgggaggctgaggc

SEQ ID NO: 788233 - DNA, 20 bp, Artificial
  CRISPR gRNA sequence
atttgggaggctgaggcggg

SEQ ID NO: 788234 - DNA, 20 bp, Artificial
  CRISPR gRNA sequence
ctgaggcgggcggatcacct

SEQ ID NO: 788235 - DNA, 20 bp, Artificial
  CRISPR gRNA sequence
tgaggcgggcggatcacctg

SEQ ID NO: 788236 - DNA, 20 bp, Artificial
  CRISPR gRNA sequence
gcgggcggatcacctgaggt

SEQ ID NO: 788237 - DNA, 20 bp, Artificial
  CRISPR gRNA sequence
cgggcggatcacctgaggtc

SEQ ID NO: 788238 - DNA, 20 bp, Artificial
  CRISPR gRNA sequence
ggcggatcacctgaggtcag

SEQ ID NO: 788239 - DNA, 20 bp, Artificial
  CRISPR gRNA sequence
tcacctgaggtcaggagttt

SEQ ID NO: 788240 - DNA, 20 bp, Artificial
  CRISPR gRNA sequence
tgaggtcaggagtttgagac

SEQ ID NO: 788241 - DNA, 20 bp, Artificial
  CRISPR gRNA sequence
tcaggagtttgagaccagcc

SEQ ID NO: 788242 - DNA, 20 bp, Artificial
  CRISPR gRNA sequence
tgagaccagcctggccaaca

SEQ ID NO: 788243 - DNA, 20 bp, Artificial
  CRISPR gRNA sequence
tctactaaaaatacaaaaat

SEQ ID NO: 788244 - DNA, 20 bp, Artificial
  CRISPR gRNA sequence
ctaaaaatacaaaaattagc

SEQ ID NO: 788245 - DNA, 20 bp, Artificial
  CRISPR gRNA sequence
taaaaatacaaaaattagcc

SEQ ID NO: 788246 - DNA, 20 bp, Artificial
  CRISPR gRNA sequence
caaaaattagccaggcatgt

SEQ ID NO: 788247 - DNA, 20 bp, Artificial
  CRISPR gRNA sequence
ttggcatgtgcctgtaatcc

SEQ ID NO: 788248 - DNA, 20 bp, Artificial
  CRISPR gRNA sequence
tgcctgtaatcccagctact

SEQ ID NO: 788249 - DNA, 20 bp, Artificial
  CRISPR gRNA sequence
gcctgtaatcccagctactc

SEQ ID NO: 788250 - DNA, 20 bp, Artificial
  CRISPR gRNA sequence
ctgtaatcccagctactcag

SEQ ID NO: 788251 - DNA, 20 bp, Artificial
  CRISPR gRNA sequence
tgtaatcccagctactcagg

SEQ ID NO: 788252 - DNA, 20 bp, Artificial
  CRISPR gRNA sequence
tcccagctactcaggaggct

SEQ ID NO: 788253 - DNA, 20 bp, Artificial
  CRISPR gRNA sequence
agctactcaggaggctgaga

SEQ ID NO: 788254 - DNA, 20 bp, Artificial
  CRISPR gRNA sequence
gctactcaggaggctgagac

SEQ ID NO: 788255 - DNA, 20 bp, Artificial
  CRISPR gRNA sequence
tactcaggaggctgagacag

SEQ ID NO: 788256 - DNA, 20 bp, Artificial
  CRISPR gRNA sequence
aggaggctgagacaggagaa

SEQ ID NO: 788257 - DNA, 20 bp, Artificial
  CRISPR gRNA sequence
acaggagaatagcttgaacc

SEQ ID NO: 788258 - DNA, 20 bp, Artificial
  CRISPR gRNA sequence
caggagaatagcttgaaccc

SEQ ID NO: 788259 - DNA, 20 bp, Artificial
  CRISPR gRNA sequence
ggagaatagcttgaacccgg

SEQ ID NO: 788260 - DNA, 20 bp, Artificial
  CRISPR gRNA sequence
gagaatagcttgaacccggg

SEQ ID NO: 788261 - DNA, 20 bp, Artificial
  CRISPR gRNA sequence
aatagcttgaacccgggagg

SEQ ID NO: 788262 - DNA, 20 bp, Artificial
  CRISPR gRNA sequence
atagcttgaacccgggaggc

SEQ ID NO: 788263 - DNA, 20 bp, Artificial
  CRISPR gRNA sequence
tagcttgaacccgggaggca

SEQ ID NO: 788264 - DNA, 20 bp, Artificial
  CRISPR gRNA sequence
agcttgaacccgggaggcag

SEQ ID NO: 788265 - DNA, 20 bp, Artificial
  CRISPR gRNA sequence
aacccgggaggcaggggttg

SEQ ID NO: 788266 - DNA, 20 bp, Artificial
  CRISPR gRNA sequence
cgggaggcaggggttgcagt

SEQ ID NO: 788267 - DNA, 20 bp, Artificial
  CRISPR gRNA sequence
aggcaggggttgcagtgagc

SEQ ID NO: 788268 - DNA, 20 bp, Artificial
  CRISPR gRNA sequence
ggcaggggttgcagtgagcc

SEQ ID NO: 788269 - DNA, 20 bp, Artificial
  CRISPR gRNA sequence
gggatcgtgccactgcattc

SEQ ID NO: 788270 - DNA, 20 bp, Artificial
  CRISPR gRNA sequence
cgtgccactgcattccagcc

SEQ ID NO: 788271 - DNA, 20 bp, Artificial
  CRISPR gRNA sequence
gtgccactgcattccagcct

SEQ ID NO: 788272 - DNA, 20 bp, Artificial
  CRISPR gRNA sequence
tgccactgcattccagcctg

SEQ ID NO: 788273 - DNA, 20 bp, Artificial
  CRISPR gRNA sequence
gccactgcattccagcctgg

SEQ ID NO: 788274 - DNA, 20 bp, Artificial
  CRISPR gRNA sequence
ccactgcattccagcctggg

SEQ ID NO: 788275 - DNA, 20 bp, Artificial
  CRISPR gRNA sequence
ctgcattccagcctgggggg

SEQ ID NO: 788276 - DNA, 20 bp, Artificial
  CRISPR gRNA sequence
tccagcctggggggcagaat

SEQ ID NO: 788277 - DNA, 20 bp, Artificial
  CRISPR gRNA sequence
acttcatctcaaaaaaaaaa

SEQ ID NO: 788278 - DNA, 20 bp, Artificial
  CRISPR gRNA sequence
ttcatctcaaaaaaaaaaaa

SEQ ID NO: 788279 - DNA, 20 bp, Artificial
  CRISPR gRNA sequence
catctcaaaaaaaaaaaaga

SEQ ID NO: 788280 - DNA, 20 bp, Artificial
  CRISPR gRNA sequence
tctcaaaaaaaaaaaagaga

SEQ ID NO: 788281 - DNA, 20 bp, Artificial
  CRISPR gRNA sequence
tcaaaaaaaaaaaagagaga

SEQ ID NO: 788282 - DNA, 20 bp, Artificial
  CRISPR gRNA sequence
aaaaaaaaaaaagagagaga

SEQ ID NO: 788283 - DNA, 20 bp, Artificial
  CRISPR gRNA sequence
aaaaaaaaaagagagagaga

SEQ ID NO: 788284 - DNA, 20 bp, Artificial
  CRISPR gRNA sequence
aaaagagagagagagagatg

SEQ ID NO: 788285 - DNA, 20 bp, Artificial
  CRISPR gRNA sequence
gagagagagagatgtggtga

SEQ ID NO: 788286 - DNA, 20 bp, Artificial
  CRISPR gRNA sequence
agagagagatgtggtgacag

SEQ ID NO: 788287 - DNA, 20 bp, Artificial
  CRISPR gRNA sequence
gagagatgtggtgacagaag

SEQ ID NO: 788288 - DNA, 20 bp, Artificial
  CRISPR gRNA sequence
agatgtggtgacagaagcag

SEQ ID NO: 788289 - DNA, 20 bp, Artificial
  CRISPR gRNA sequence
gatgtggtgacagaagcaga

SEQ ID NO: 788290 - DNA, 20 bp, Artificial
  CRISPR gRNA sequence
agaagcagaaggctgaatga

SEQ ID NO: 788291 - DNA, 20 bp, Artificial
  CRISPR gRNA sequence
gaagcagaaggctgaatgat

SEQ ID NO: 788292 - DNA, 20 bp, Artificial
  CRISPR gRNA sequence
aagcagaaggctgaatgata

SEQ ID NO: 788293 - DNA, 20 bp, Artificial
  CRISPR gRNA sequence
tgatagggttgctgcctctg

SEQ ID NO: 788294 - DNA, 20 bp, Artificial
  CRISPR gRNA sequence
agggttgctgcctctgaaga

SEQ ID NO: 788295 - DNA, 20 bp, Artificial
  CRISPR gRNA sequence
ggttgctgcctctgaagata

SEQ ID NO: 788296 - DNA, 20 bp, Artificial
  CRISPR gRNA sequence
gttgctgcctctgaagatag

SEQ ID NO: 788297 - DNA, 20 bp, Artificial
  CRISPR gRNA sequence
ttgctgcctctgaagataga

SEQ ID NO: 788298 - DNA, 20 bp, Artificial
  CRISPR gRNA sequence
gctgcctctgaagatagagg

SEQ ID NO: 788299 - DNA, 20 bp, Artificial
  CRISPR gRNA sequence
ctgcctctgaagatagaggg

SEQ ID NO: 788300 - DNA, 20 bp, Artificial
  CRISPR gRNA sequence
tgcctctgaagatagaggga

SEQ ID NO: 788301 - DNA, 20 bp, Artificial
  CRISPR gRNA sequence
gcctctgaagatagagggag

SEQ ID NO: 788302 - DNA, 20 bp, Artificial
  CRISPR gRNA sequence
aagatagagggaggggccat

SEQ ID NO: 788303 - DNA, 20 bp, Artificial
  CRISPR gRNA sequence
agatagagggaggggccatg

SEQ ID NO: 788304 - DNA, 20 bp, Artificial
  CRISPR gRNA sequence
gggccatgaggcaattaatg

SEQ ID NO: 788305 - DNA, 20 bp, Artificial
  CRISPR gRNA sequence
ggccatgaggcaattaatgc

SEQ ID NO: 788306 - DNA, 20 bp, Artificial
  CRISPR gRNA sequence
catgaggcaattaatgcagg

SEQ ID NO: 788307 - DNA, 20 bp, Artificial
  CRISPR gRNA sequence
caattaatgcaggtggcctc

SEQ ID NO: 788308 - DNA, 20 bp, Artificial
  CRISPR gRNA sequence
ttaatgcaggtggcctctag

SEQ ID NO: 788309 - DNA, 20 bp, Artificial
  CRISPR gRNA sequence
tgcaggtggcctctagcagc

SEQ ID NO: 788310 - DNA, 20 bp, Artificial
  CRISPR gRNA sequence
gtggcctctagcagctggaa

SEQ ID NO: 788311 - DNA, 20 bp, Artificial
  CRISPR gRNA sequence
cctctagcagctggaaaaga

SEQ ID NO: 788312 - DNA, 20 bp, Artificial
  CRISPR gRNA sequence
ctctagcagctggaaaagac

SEQ ID NO: 788313 - DNA, 20 bp, Artificial
  CRISPR gRNA sequence
agcagctggaaaagacagga

SEQ ID NO: 788314 - DNA, 20 bp, Artificial
  CRISPR gRNA sequence
agctggaaaagacaggaaag

SEQ ID NO: 788315 - DNA, 20 bp, Artificial
  CRISPR gRNA sequence
aggaaagtggaatcttccct

SEQ ID NO: 788316 - DNA, 20 bp, Artificial
  CRISPR gRNA sequence
ggaaagtggaatcttccctt

SEQ ID NO: 788317 - DNA, 20 bp, Artificial
  CRISPR gRNA sequence
gaaagtggaatcttccctta

SEQ ID NO: 788318 - DNA, 20 bp, Artificial
  CRISPR gRNA sequence
tcctgctgacaccttgattt

SEQ ID NO: 788319 - DNA, 20 bp, Artificial
  CRISPR gRNA sequence
ctgacaccttgatttgagcc

SEQ ID NO: 788320 - DNA, 20 bp, Artificial
  CRISPR gRNA sequence
atttgagcccagtgaaactc

SEQ ID NO: 788321 - DNA, 20 bp, Artificial
  CRISPR gRNA sequence
agcccagtgaaactcaagtc

SEQ ID NO: 788322 - DNA, 20 bp, Artificial
  CRISPR gRNA sequence
tctggctttctgacctccat

SEQ ID NO: 788323 - DNA, 20 bp, Artificial
  CRISPR gRNA sequence
tttctgacctccataagtat

SEQ ID NO: 788324 - DNA, 20 bp, Artificial
  CRISPR gRNA sequence
ctgtgttgtcttaaactgtg

SEQ ID NO: 788325 - DNA, 20 bp, Artificial
  CRISPR gRNA sequence
gtcttaaactgtgaagcttg

SEQ ID NO: 788326 - DNA, 20 bp, Artificial
  CRISPR gRNA sequence
agcttgtggtaatttgatat

SEQ ID NO: 788327 - DNA, 20 bp, Artificial
  CRISPR gRNA sequence
cttgtggtaatttgatataa

SEQ ID NO: 788328 - DNA, 20 bp, Artificial
  CRISPR gRNA sequence
gtaatttgatataagagcat

SEQ ID NO: 788329 - DNA, 20 bp, Artificial
  CRISPR gRNA sequence
cattagaaaacatatgcact

SEQ ID NO: 788330 - DNA, 20 bp, Artificial
  CRISPR gRNA sequence
ttacgaaatgattatgatac

SEQ ID NO: 788331 - DNA, 20 bp, Artificial
  CRISPR gRNA sequence
tacgaaatgattatgatact

SEQ ID NO: 788332 - DNA, 20 bp, Artificial
  CRISPR gRNA sequence
atgattatgatactaggtgt

SEQ ID NO: 788333 - DNA, 20 bp, Artificial
  CRISPR gRNA sequence
taggtgttagttgtccttac

SEQ ID NO: 788334 - DNA, 20 bp, Artificial
  CRISPR gRNA sequence
aggtgttagttgtccttact

SEQ ID NO: 788335 - DNA, 20 bp, Artificial
  CRISPR gRNA sequence
tgttagttgtccttactggg

SEQ ID NO: 788336 - DNA, 20 bp, Artificial
  CRISPR gRNA sequence
tgtccttactgggcagataa

SEQ ID NO: 788337 - DNA, 20 bp, Artificial
  CRISPR gRNA sequence
ataaaagttgttattttccc

SEQ ID NO: 788338 - DNA, 20 bp, Artificial
  CRISPR gRNA sequence
gtttgaaattctgctgtatg

SEQ ID NO: 788339 - DNA, 20 bp, Artificial
  CRISPR gRNA sequence
ttctgctgtatgaagttcaa

SEQ ID NO: 788340 - DNA, 20 bp, Artificial
  CRISPR gRNA sequence
ctgtatgaagttcaaaagta

SEQ ID NO: 788341 - DNA, 20 bp, Artificial
  CRISPR gRNA sequence
tgtatgaagttcaaaagtat

SEQ ID NO: 788342 - DNA, 20 bp, Artificial
  CRISPR gRNA sequence
ggatcccttccaaaaatatc

SEQ ID NO: 788343 - DNA, 20 bp, Artificial
  CRISPR gRNA sequence
ccttccaaaaatatccagca

SEQ ID NO: 788344 - DNA, 20 bp, Artificial
  CRISPR gRNA sequence
ccaaaaatatccagcatagt

SEQ ID NO: 788345 - DNA, 20 bp, Artificial
  CRISPR gRNA sequence
aatatccagcatagtcagta

SEQ ID NO: 788346 - DNA, 20 bp, Artificial
  CRISPR gRNA sequence
atatccagcatagtcagtaa

SEQ ID NO: 788347 - DNA, 20 bp, Artificial
  CRISPR gRNA sequence
catagtcagtaaaggctctg

SEQ ID NO: 788348 - DNA, 20 bp, Artificial
  CRISPR gRNA sequence
aaggctctgaagaattttgt

SEQ ID NO: 788349 - DNA, 20 bp, Artificial
  CRISPR gRNA sequence
ggctctgaagaattttgtta

SEQ ID NO: 788350 - DNA, 20 bp, Artificial
  CRISPR gRNA sequence
ttgttagagaccaaatttct

SEQ ID NO: 788351 - DNA, 20 bp, Artificial
  CRISPR gRNA sequence
ttcttggaaaaacccataac

SEQ ID NO: 788352 - DNA, 20 bp, Artificial
  CRISPR gRNA sequence
aaaacccataaccagctgac

SEQ ID NO: 788353 - DNA, 20 bp, Artificial
  CRISPR gRNA sequence
acccataaccagctgactgg

SEQ ID NO: 788354 - DNA, 20 bp, Artificial
  CRISPR gRNA sequence
ataaccagctgactggcagc

SEQ ID NO: 788355 - DNA, 20 bp, Artificial
  CRISPR gRNA sequence
cagctgactggcagcaagta

SEQ ID NO: 788356 - DNA, 20 bp, Artificial
  CRISPR gRNA sequence
gactggcagcaagtacagca

SEQ ID NO: 788357 - DNA, 20 bp, Artificial
  CRISPR gRNA sequence
actggcagcaagtacagcaa

SEQ ID NO: 788358 - DNA, 20 bp, Artificial
  CRISPR gRNA sequence
caaaggaatattcatcctgc

SEQ ID NO: 788359 - DNA, 20 bp, Artificial
  CRISPR gRNA sequence
atgacactgtgcatgaatca

SEQ ID NO: 788360 - DNA, 20 bp, Artificial
  CRISPR gRNA sequence
tgtgcatgaatcacagtgat

SEQ ID NO: 788361 - DNA, 20 bp, Artificial
  CRISPR gRNA sequence
acagtgattagctattgtac

SEQ ID NO: 788362 - DNA, 20 bp, Artificial
  CRISPR gRNA sequence
gatattttctgtttcctctc

SEQ ID NO: 788363 - DNA, 20 bp, Artificial
  CRISPR gRNA sequence
gtacatgtcaatattgctct

SEQ ID NO: 788364 - DNA, 20 bp, Artificial
  CRISPR gRNA sequence
tcaatattgctctgagccct

SEQ ID NO: 788365 - DNA, 20 bp, Artificial
  CRISPR gRNA sequence
atattgctctgagccctgag

SEQ ID NO: 788366 - DNA, 20 bp, Artificial
  CRISPR gRNA sequence
ccctgagaagttgactttta

SEQ ID NO: 788367 - DNA, 20 bp, Artificial
  CRISPR gRNA sequence
ttgacttttatggaatacaa

SEQ ID NO: 788368 - DNA, 20 bp, Artificial
  CRISPR gRNA sequence
acttttatggaatacaacag

SEQ ID NO: 788369 - DNA, 20 bp, Artificial
  CRISPR gRNA sequence
cccttgtattctctgacttc

SEQ ID NO: 788370 - DNA, 20 bp, Artificial
  CRISPR gRNA sequence
tgtattctctgacttctagc

SEQ ID NO: 788371 - DNA, 20 bp, Artificial
  CRISPR gRNA sequence
gtattctctgacttctagct

SEQ ID NO: 788372 - DNA, 20 bp, Artificial
  CRISPR gRNA sequence
ctctgacttctagctgggtt

SEQ ID NO: 788373 - DNA, 20 bp, Artificial
  CRISPR gRNA sequence
ttctagctgggttcagccaa

SEQ ID NO: 788374 - DNA, 20 bp, Artificial
  CRISPR gRNA sequence
tctagctgggttcagccaat

SEQ ID NO: 788375 - DNA, 20 bp, Artificial
  CRISPR gRNA sequence
tagctgggttcagccaatgg

SEQ ID NO: 788376 - DNA, 20 bp, Artificial
  CRISPR gRNA sequence
agctgggttcagccaatggg

SEQ ID NO: 788377 - DNA, 20 bp, Artificial
  CRISPR gRNA sequence
gttcagccaatgggaggtgc

SEQ ID NO: 788378 - DNA, 20 bp, Artificial
  CRISPR gRNA sequence
cagccaatgggaggtgctag

SEQ ID NO: 788379 - DNA, 20 bp, Artificial
  CRISPR gRNA sequence
agccaatgggaggtgctagc

SEQ ID NO: 788380 - DNA, 20 bp, Artificial
  CRISPR gRNA sequence
ccaatgggaggtgctagcag

SEQ ID NO: 788381 - DNA, 20 bp, Artificial
  CRISPR gRNA sequence
gggaggtgctagcaggagat

SEQ ID NO: 788382 - DNA, 20 bp, Artificial
  CRISPR gRNA sequence
gaggtgctagcaggagattg

SEQ ID NO: 788383 - DNA, 20 bp, Artificial
  CRISPR gRNA sequence
aggtgctagcaggagattgg

SEQ ID NO: 788384 - DNA, 20 bp, Artificial
  CRISPR gRNA sequence
ggtgctagcaggagattgga

SEQ ID NO: 788385 - DNA, 20 bp, Artificial
  CRISPR gRNA sequence
gctagcaggagattggaggg

SEQ ID NO: 788386 - DNA, 20 bp, Artificial
  CRISPR gRNA sequence
ctagcaggagattggagggt

SEQ ID NO: 788387 - DNA, 20 bp, Artificial
  CRISPR gRNA sequence
agcaggagattggagggtgg

SEQ ID NO: 788388 - DNA, 20 bp, Artificial
  CRISPR gRNA sequence
gcaggagattggagggtggg

SEQ ID NO: 788389 - DNA, 20 bp, Artificial
  CRISPR gRNA sequence
aggagattggagggtgggag

SEQ ID NO: 788390 - DNA, 20 bp, Artificial
  CRISPR gRNA sequence
ttggagggtgggaggagaat

SEQ ID NO: 788391 - DNA, 20 bp, Artificial
  CRISPR gRNA sequence
agggtgggaggagaatgagt

SEQ ID NO: 788392 - DNA, 20 bp, Artificial
  CRISPR gRNA sequence
gggtgggaggagaatgagtt

SEQ ID NO: 788393 - DNA, 20 bp, Artificial
  CRISPR gRNA sequence
ggtgggaggagaatgagttg

SEQ ID NO: 788394 - DNA, 20 bp, Artificial
  CRISPR gRNA sequence
agttggggtattcattcatc

SEQ ID NO: 788395 - DNA, 20 bp, Artificial
  CRISPR gRNA sequence
ttcatccagtttccaccctt

SEQ ID NO: 788396 - DNA, 20 bp, Artificial
  CRISPR gRNA sequence
catccagtttccaccctttg

SEQ ID NO: 788397 - DNA, 20 bp, Artificial
  CRISPR gRNA sequence
ccctttggagtcgctgcatg

SEQ ID NO: 788398 - DNA, 20 bp, Artificial
  CRISPR gRNA sequence
tttggagtcgctgcatgtgg

SEQ ID NO: 788399 - DNA, 20 bp, Artificial
  CRISPR gRNA sequence
gtggcagcttccctattctg

SEQ ID NO: 788400 - DNA, 20 bp, Artificial
  CRISPR gRNA sequence
gcttccctattctgtggcta

SEQ ID NO: 788401 - DNA, 20 bp, Artificial
  CRISPR gRNA sequence
tattctgtggctacagctcc

SEQ ID NO: 788402 - DNA, 20 bp, Artificial
  CRISPR gRNA sequence
attctgtggctacagctcct

SEQ ID NO: 788403 - DNA, 20 bp, Artificial
  CRISPR gRNA sequence
ctgtggctacagctcctggg

SEQ ID NO: 788404 - DNA, 20 bp, Artificial
  CRISPR gRNA sequence
tggctacagctcctgggaag

SEQ ID NO: 788405 - DNA, 20 bp, Artificial
  CRISPR gRNA sequence
ggctacagctcctgggaagt

SEQ ID NO: 788406 - DNA, 20 bp, Artificial
  CRISPR gRNA sequence
gctacagctcctgggaagtg

SEQ ID NO: 788407 - DNA, 20 bp, Artificial
  CRISPR gRNA sequence
gggaagtggggctttcccta

SEQ ID NO: 788408 - DNA, 20 bp, Artificial
  CRISPR gRNA sequence
ctacagctcccttctgattc

SEQ ID NO: 788409 - DNA, 20 bp, Artificial
  CRISPR gRNA sequence
gattccagtaacttctccaa

SEQ ID NO: 788410 - DNA, 20 bp, Artificial
  CRISPR gRNA sequence
tccagtaacttctccaacag

SEQ ID NO: 788411 - DNA, 20 bp, Artificial
  CRISPR gRNA sequence
taattgccctcccaacattg

SEQ ID NO: 788412 - DNA, 20 bp, Artificial
  CRISPR gRNA sequence
ccctcccaacattgaagccc

SEQ ID NO: 788413 - DNA, 20 bp, Artificial
  CRISPR gRNA sequence
gtgttctgcactatcctttg

SEQ ID NO: 788414 - DNA, 20 bp, Artificial
  CRISPR gRNA sequence
tcctttgtagtttctccaaa

SEQ ID NO: 788415 - DNA, 20 bp, Artificial
  CRISPR gRNA sequence
ggtgatcacacctttgtaaa

SEQ ID NO: 788416 - DNA, 20 bp, Artificial
  CRISPR gRNA sequence
acactctcctcaaatcactc

SEQ ID NO: 788417 - DNA, 20 bp, Artificial
  CRISPR gRNA sequence
cttgtctgaaccctaactga

SEQ ID NO: 788418 - DNA, 20 bp, Artificial
  CRISPR gRNA sequence
tgaaccctaactgatagacc

SEQ ID NO: 788419 - DNA, 20 bp, Artificial
  CRISPR gRNA sequence
gaaccctaactgatagacct

SEQ ID NO: 788420 - DNA, 20 bp, Artificial
  CRISPR gRNA sequence
ccctaactgatagacctagg

SEQ ID NO: 788421 - DNA, 20 bp, Artificial
  CRISPR gRNA sequence
taactgatagacctaggaag

SEQ ID NO: 788422 - DNA, 20 bp, Artificial
  CRISPR gRNA sequence
aactgatagacctaggaagt

SEQ ID NO: 788423 - DNA, 20 bp, Artificial
  CRISPR gRNA sequence
actgatagacctaggaagtg

SEQ ID NO: 788424 - DNA, 20 bp, Artificial
  CRISPR gRNA sequence
ctgatagacctaggaagtgg

SEQ ID NO: 788425 - DNA, 20 bp, Artificial
  CRISPR gRNA sequence
atagacctaggaagtggggg

SEQ ID NO: 788426 - DNA, 20 bp, Artificial
  CRISPR gRNA sequence
tgggggcagctcttactttg

SEQ ID NO: 788427 - DNA, 20 bp, Artificial
  CRISPR gRNA sequence
gggggcagctcttactttga

SEQ ID NO: 788428 - DNA, 20 bp, Artificial
  CRISPR gRNA sequence
cttactttgaaggtcaatgc

SEQ ID NO: 788429 - DNA, 20 bp, Artificial
  CRISPR gRNA sequence
ttgaaggtcaatgctggcca

SEQ ID NO: 788430 - DNA, 20 bp, Artificial
  CRISPR gRNA sequence
aggtcaatgctggccaaagt

SEQ ID NO: 788431 - DNA, 20 bp, Artificial
  CRISPR gRNA sequence
caaagtaagttccctcacgt

SEQ ID NO: 788432 - DNA, 20 bp, Artificial
  CRISPR gRNA sequence
gttccctcacgtgagtattc

SEQ ID NO: 788433 - DNA, 20 bp, Artificial
  CRISPR gRNA sequence
cgtgagtattccagaacaca

SEQ ID NO: 788434 - DNA, 20 bp, Artificial
  CRISPR gRNA sequence
tattccagaacacacagctg

SEQ ID NO: 788435 - DNA, 20 bp, Artificial
  CRISPR gRNA sequence
cacacagctgaagtttctgc

SEQ ID NO: 788436 - DNA, 20 bp, Artificial
  CRISPR gRNA sequence
acacagctgaagtttctgcc

SEQ ID NO: 788437 - DNA, 20 bp, Artificial
  CRISPR gRNA sequence
cacagctgaagtttctgcca

SEQ ID NO: 788438 - DNA, 20 bp, Artificial
  CRISPR gRNA sequence
acagctgaagtttctgccag

SEQ ID NO: 788439 - DNA, 20 bp, Artificial
  CRISPR gRNA sequence
cagctgaagtttctgccagg

SEQ ID NO: 788440 - DNA, 20 bp, Artificial
  CRISPR gRNA sequence
ctgaagtttctgccaggggg

SEQ ID NO: 788441 - DNA, 20 bp, Artificial
  CRISPR gRNA sequence
tttctgccagggggtggctt

SEQ ID NO: 788442 - DNA, 20 bp, Artificial
  CRISPR gRNA sequence
ttctgccagggggtggcttt

SEQ ID NO: 788443 - DNA, 20 bp, Artificial
  CRISPR gRNA sequence
ccagggggtggctttaggcg

SEQ ID NO: 788444 - DNA, 20 bp, Artificial
  CRISPR gRNA sequence
tggctttaggcgcagaacac

SEQ ID NO: 788445 - DNA, 20 bp, Artificial
  CRISPR gRNA sequence
ggcgcagaacactggtgacc

SEQ ID NO: 788446 - DNA, 20 bp, Artificial
  CRISPR gRNA sequence
gcagaacactggtgacctgg

SEQ ID NO: 788447 - DNA, 20 bp, Artificial
  CRISPR gRNA sequence
agaacactggtgacctggta

SEQ ID NO: 788448 - DNA, 20 bp, Artificial
  CRISPR gRNA sequence
gaacactggtgacctggtag

SEQ ID NO: 788449 - DNA, 20 bp, Artificial
  CRISPR gRNA sequence
ggtgacctggtagaggcctt

SEQ ID NO: 788450 - DNA, 20 bp, Artificial
  CRISPR gRNA sequence
gtgacctggtagaggccttc

SEQ ID NO: 788451 - DNA, 20 bp, Artificial
  CRISPR gRNA sequence
tgacctggtagaggccttca

SEQ ID NO: 788452 - DNA, 20 bp, Artificial
  CRISPR gRNA sequence
gacctggtagaggccttcag

SEQ ID NO: 788453 - DNA, 20 bp, Artificial
  CRISPR gRNA sequence
gtagaggccttcaggggtcc

SEQ ID NO: 788454 - DNA, 20 bp, Artificial
  CRISPR gRNA sequence
agaggccttcaggggtcctg

SEQ ID NO: 788455 - DNA, 20 bp, Artificial
  CRISPR gRNA sequence
ggccttcaggggtcctggag

SEQ ID NO: 788456 - DNA, 20 bp, Artificial
  CRISPR gRNA sequence
ttcaggggtcctggagtggc

SEQ ID NO: 788457 - DNA, 20 bp, Artificial
  CRISPR gRNA sequence
ggtcctggagtggctggtgt

SEQ ID NO: 788458 - DNA, 20 bp, Artificial
  CRISPR gRNA sequence
cctggagtggctggtgttgg

SEQ ID NO: 788459 - DNA, 20 bp, Artificial
  CRISPR gRNA sequence
ctggagtggctggtgttggc

SEQ ID NO: 788460 - DNA, 20 bp, Artificial
  CRISPR gRNA sequence
ttggcaggaacgctgacgtt

SEQ ID NO: 788461 - DNA, 20 bp, Artificial
  CRISPR gRNA sequence
caggaacgctgacgtttggc

SEQ ID NO: 788462 - DNA, 20 bp, Artificial
  CRISPR gRNA sequence
aggaacgctgacgtttggcc

SEQ ID NO: 788463 - DNA, 20 bp, Artificial
  CRISPR gRNA sequence
tttggccaggatacttctgc

SEQ ID NO: 788464 - DNA, 20 bp, Artificial
  CRISPR gRNA sequence
tggccaggatacttctgcca

SEQ ID NO: 788465 - DNA, 20 bp, Artificial
  CRISPR gRNA sequence
ggccaggatacttctgccag

SEQ ID NO: 788466 - DNA, 20 bp, Artificial
  CRISPR gRNA sequence
ttctgccagaggataacctg

SEQ ID NO: 788467 - DNA, 20 bp, Artificial
  CRISPR gRNA sequence
ccagaggataacctgtagcc

SEQ ID NO: 788468 - DNA, 20 bp, Artificial
  CRISPR gRNA sequence
gaggataacctgtagcctgg

SEQ ID NO: 788469 - DNA, 20 bp, Artificial
  CRISPR gRNA sequence
aggataacctgtagcctggc

SEQ ID NO: 788470 - DNA, 20 bp, Artificial
  CRISPR gRNA sequence
taacctgtagcctggcaggt

SEQ ID NO: 788471 - DNA, 20 bp, Artificial
  CRISPR gRNA sequence
agctctacctcatctgtttc

SEQ ID NO: 788472 - DNA, 20 bp, Artificial
  CRISPR gRNA sequence
tcatctgtttctggaacctt

SEQ ID NO: 788473 - DNA, 20 bp, Artificial
  CRISPR gRNA sequence
catctgtttctggaaccttt

SEQ ID NO: 788474 - DNA, 20 bp, Artificial
  CRISPR gRNA sequence
ttctggaacctttaggatgt

SEQ ID NO: 788475 - DNA, 20 bp, Artificial
  CRISPR gRNA sequence
tgtgagtgtttattttcctg

SEQ ID NO: 788476 - DNA, 20 bp, Artificial
  CRISPR gRNA sequence
gtgagtgtttattttcctgt

SEQ ID NO: 788477 - DNA, 20 bp, Artificial
  CRISPR gRNA sequence
agtgtttattttcctgtagg

SEQ ID NO: 788478 - DNA, 20 bp, Artificial
  CRISPR gRNA sequence
tttattttcctgtaggaagc

SEQ ID NO: 788479 - DNA, 20 bp, Artificial
  CRISPR gRNA sequence
tcctgtaggaagctggacaa

SEQ ID NO: 788480 - DNA, 20 bp, Artificial
  CRISPR gRNA sequence
ctgtaggaagctggacaata

SEQ ID NO: 788481 - DNA, 20 bp, Artificial
  CRISPR gRNA sequence
taggaagctggacaatagag

SEQ ID NO: 788482 - DNA, 20 bp, Artificial
  CRISPR gRNA sequence
gctggacaatagagaagaaa

SEQ ID NO: 788483 - DNA, 20 bp, Artificial
  CRISPR gRNA sequence
aatagagaagaaaaagaaat

SEQ ID NO: 788484 - DNA, 20 bp, Artificial
  CRISPR gRNA sequence
actttattttctgattccta

SEQ ID NO: 788485 - DNA, 20 bp, Artificial
  CRISPR gRNA sequence
tttattttctgattcctata

SEQ ID NO: 788486 - DNA, 20 bp, Artificial
  CRISPR gRNA sequence
tttctgattcctatagagct

SEQ ID NO: 788487 - DNA, 20 bp, Artificial
  CRISPR gRNA sequence
aaattatcactatcaatatt

SEQ ID NO: 788488 - DNA, 20 bp, Artificial
  CRISPR gRNA sequence
ctatcaatattaagtaataa

SEQ ID NO: 788489 - DNA, 20 bp, Artificial
  CRISPR gRNA sequence
ttaattcttacaatgcaata

SEQ ID NO: 788490 - DNA, 20 bp, Artificial
  CRISPR gRNA sequence
ttcttacaatgcaataaaga

SEQ ID NO: 788491 - DNA, 20 bp, Artificial
  CRISPR gRNA sequence
gttgatattcccaattcttg

SEQ ID NO: 788492 - DNA, 20 bp, Artificial
  CRISPR gRNA sequence
atattcccaattcttgtgga

SEQ ID NO: 788493 - DNA, 20 bp, Artificial
  CRISPR gRNA sequence
attcttgtggacggttactg

SEQ ID NO: 788494 - DNA, 20 bp, Artificial
  CRISPR gRNA sequence
ttgtggacggttactgaaga

SEQ ID NO: 788495 - DNA, 20 bp, Artificial
  CRISPR gRNA sequence
gtggacggttactgaagata

SEQ ID NO: 788496 - DNA, 20 bp, Artificial
  CRISPR gRNA sequence
gacggttactgaagatagag

SEQ ID NO: 788497 - DNA, 20 bp, Artificial
  CRISPR gRNA sequence
ttactgaagatagagaagtt

SEQ ID NO: 788498 - DNA, 20 bp, Artificial
  CRISPR gRNA sequence
gaagttgagtgttttgttca

SEQ ID NO: 788499 - DNA, 20 bp, Artificial
  CRISPR gRNA sequence
gagtgttttgttcatagtca

SEQ ID NO: 788500 - DNA, 20 bp, Artificial
  CRISPR gRNA sequence
gtgttttgttcatagtcata

SEQ ID NO: 788501 - DNA, 20 bp, Artificial
  CRISPR gRNA sequence
atagtcatagagcttataac

SEQ ID NO: 788502 - DNA, 20 bp, Artificial
  CRISPR gRNA sequence
gtcatagagcttataactgg

SEQ ID NO: 788503 - DNA, 20 bp, Artificial
  CRISPR gRNA sequence
tcatagagcttataactggt

SEQ ID NO: 788504 - DNA, 20 bp, Artificial
  CRISPR gRNA sequence
taggaccaatatttgaacat

SEQ ID NO: 788505 - DNA, 20 bp, Artificial
  CRISPR gRNA sequence
gaacattggaattctgattc

SEQ ID NO: 788506 - DNA, 20 bp, Artificial
  CRISPR gRNA sequence
attctgattccagacctcaa

SEQ ID NO: 788507 - DNA, 20 bp, Artificial
  CRISPR gRNA sequence
ctgattccagacctcaacag

SEQ ID NO: 788508 - DNA, 20 bp, Artificial
  CRISPR gRNA sequence
ccagacctcaacagtggtcc

SEQ ID NO: 788509 - DNA, 20 bp, Artificial
  CRISPR gRNA sequence
gtccaagctaccacaatttg

SEQ ID NO: 788510 - DNA, 20 bp, Artificial
  CRISPR gRNA sequence
aatttgtggcttctttctta

SEQ ID NO: 788511 - DNA, 20 bp, Artificial
  CRISPR gRNA sequence
gctataaattatttcacaat

SEQ ID NO: 788512 - DNA, 20 bp, Artificial
  CRISPR gRNA sequence
tataaattatttcacaattg

SEQ ID NO: 788513 - DNA, 20 bp, Artificial
  CRISPR gRNA sequence
ataaattatttcacaattgg

SEQ ID NO: 788514 - DNA, 20 bp, Artificial
  CRISPR gRNA sequence
attatttcacaattggaggc

SEQ ID NO: 788515 - DNA, 20 bp, Artificial
  CRISPR gRNA sequence
tttcacaattggaggccaga

SEQ ID NO: 788516 - DNA, 20 bp, Artificial
  CRISPR gRNA sequence
tcacaattggaggccagaaa

SEQ ID NO: 788517 - DNA, 20 bp, Artificial
  CRISPR gRNA sequence
cacaattggaggccagaaag

SEQ ID NO: 788518 - DNA, 20 bp, Artificial
  CRISPR gRNA sequence
attggaggccagaaagagga

SEQ ID NO: 788519 - DNA, 20 bp, Artificial
  CRISPR gRNA sequence
gacggaaaaataaaaatcac

SEQ ID NO: 788520 - DNA, 20 bp, Artificial
  CRISPR gRNA sequence
acccactatctcactttatt

SEQ ID NO: 788521 - DNA, 20 bp, Artificial
  CRISPR gRNA sequence
gtattttttccaaacatctt

SEQ ID NO: 788522 - DNA, 20 bp, Artificial
  CRISPR gRNA sequence
tattttttccaaacatcttc

SEQ ID NO: 788523 - DNA, 20 bp, Artificial
  CRISPR gRNA sequence
tcctttcctctgttttcttt

SEQ ID NO: 788524 - DNA, 20 bp, Artificial
  CRISPR gRNA sequence
cctctgttttctttgagatt

SEQ ID NO: 788525 - DNA, 20 bp, Artificial
  CRISPR gRNA sequence
ctgttttctttgagattaag

SEQ ID NO: 788526 - DNA, 20 bp, Artificial
  CRISPR gRNA sequence
gttttctttgagattaagaa

SEQ ID NO: 788527 - DNA, 20 bp, Artificial
  CRISPR gRNA sequence
ttaagaagagaaaaaaaata

SEQ ID NO: 788528 - DNA, 20 bp, Artificial
  CRISPR gRNA sequence
agagaaaaaaaataaagacc

SEQ ID NO: 788529 - DNA, 20 bp, Artificial
  CRISPR gRNA sequence
acctagataatgtctataca

SEQ ID NO: 788530 - DNA, 20 bp, Artificial
  CRISPR gRNA sequence
gataatgtctatacatagta

SEQ ID NO: 788531 - DNA, 20 bp, Artificial
  CRISPR gRNA sequence
taatgtctatacatagtaaa

SEQ ID NO: 788532 - DNA, 20 bp, Artificial
  CRISPR gRNA sequence
gtctatacatagtaaagagt

SEQ ID NO: 788533 - DNA, 20 bp, Artificial
  CRISPR gRNA sequence
tctatacatagtaaagagtt

SEQ ID NO: 788534 - DNA, 20 bp, Artificial
  CRISPR gRNA sequence
gcacttctccctaacacatg

SEQ ID NO: 788535 - DNA, 20 bp, Artificial
  CRISPR gRNA sequence
tacatacacacaaacacaca

SEQ ID NO: 788536 - DNA, 20 bp, Artificial
  CRISPR gRNA sequence
tacacacacctgcttctttg

SEQ ID NO: 788537 - DNA, 20 bp, Artificial
  CRISPR gRNA sequence
gcttctttgcagtatatgct

SEQ ID NO: 788538 - DNA, 20 bp, Artificial
  CRISPR gRNA sequence
tatatgctgagtgaattaaa

SEQ ID NO: 788539 - DNA, 20 bp, Artificial
  CRISPR gRNA sequence
ctgagtgaattaaacagata

SEQ ID NO: 788540 - DNA, 20 bp, Artificial
  CRISPR gRNA sequence
cagatatggctccctgcctc

SEQ ID NO: 788541 - DNA, 20 bp, Artificial
  CRISPR gRNA sequence
tatggctccctgcctcaaga

SEQ ID NO: 788542 - DNA, 20 bp, Artificial
  CRISPR gRNA sequence
ctccctgcctcaagaaagct

SEQ ID NO: 788543 - DNA, 20 bp, Artificial
  CRISPR gRNA sequence
cctcaagaaagctgagatct

SEQ ID NO: 788544 - DNA, 20 bp, Artificial
  CRISPR gRNA sequence
agaaagctgagatctaagta

SEQ ID NO: 788545 - DNA, 20 bp, Artificial
  CRISPR gRNA sequence
agatctaagtatagtcattt

SEQ ID NO: 788546 - DNA, 20 bp, Artificial
  CRISPR gRNA sequence
agtatagtcattttggaaaa

SEQ ID NO: 788547 - DNA, 20 bp, Artificial
  CRISPR gRNA sequence
agtcattttggaaaatagta

SEQ ID NO: 788548 - DNA, 20 bp, Artificial
  CRISPR gRNA sequence
tcattttggaaaatagtata

SEQ ID NO: 788549 - DNA, 20 bp, Artificial
  CRISPR gRNA sequence
cattttggaaaatagtatag

SEQ ID NO: 788550 - DNA, 20 bp, Artificial
  CRISPR gRNA sequence
ggtcctcaaaaaactaaaaa

SEQ ID NO: 788551 - DNA, 20 bp, Artificial
  CRISPR gRNA sequence
aatagaatgaccacatgatc

SEQ ID NO: 788552 - DNA, 20 bp, Artificial
  CRISPR gRNA sequence
agaatgaccacatgatccag

SEQ ID NO: 788553 - DNA, 20 bp, Artificial
  CRISPR gRNA sequence
tgatccagcagtcctacttc

SEQ ID NO: 788554 - DNA, 20 bp, Artificial
  CRISPR gRNA sequence
gatccagcagtcctacttct

SEQ ID NO: 788555 - DNA, 20 bp, Artificial
  CRISPR gRNA sequence
tacttctgggtatatatcca

SEQ ID NO: 788556 - DNA, 20 bp, Artificial
  CRISPR gRNA sequence
acttctgggtatatatccaa

SEQ ID NO: 788557 - DNA, 20 bp, Artificial
  CRISPR gRNA sequence
atatccaaaggaattgaatt

SEQ ID NO: 788558 - DNA, 20 bp, Artificial
  CRISPR gRNA sequence
gaattgaatttagtatgttg

SEQ ID NO: 788559 - DNA, 20 bp, Artificial
  CRISPR gRNA sequence
attgaatttagtatgttgaa

SEQ ID NO: 788560 - DNA, 20 bp, Artificial
  CRISPR gRNA sequence
ctgtattcctttattcattt

SEQ ID NO: 788561 - DNA, 20 bp, Artificial
  CRISPR gRNA sequence
cagcatgattcacaataacc

SEQ ID NO: 788562 - DNA, 20 bp, Artificial
  CRISPR gRNA sequence
gattcacaataaccaagatg

SEQ ID NO: 788563 - DNA, 20 bp, Artificial
  CRISPR gRNA sequence
ccaaactaaatgtccatcaa

SEQ ID NO: 788564 - DNA, 20 bp, Artificial
  CRISPR gRNA sequence
aaactaaatgtccatcaaca

SEQ ID NO: 788565 - DNA, 20 bp, Artificial
  CRISPR gRNA sequence
ccatcaacagagaatgaata

SEQ ID NO: 788566 - DNA, 20 bp, Artificial
  CRISPR gRNA sequence
gagaatgaataaagaaaatg

SEQ ID NO: 788567 - DNA, 20 bp, Artificial
  CRISPR gRNA sequence
aatgtggtatatatacacaa

SEQ ID NO: 788568 - DNA, 20 bp, Artificial
  CRISPR gRNA sequence
tatacacaatggaatactta

SEQ ID NO: 788569 - DNA, 20 bp, Artificial
  CRISPR gRNA sequence
aatggaatacttacagccct

SEQ ID NO: 788570 - DNA, 20 bp, Artificial
  CRISPR gRNA sequence
gaatacttacagcccttaga

SEQ ID NO: 788571 - DNA, 20 bp, Artificial
  CRISPR gRNA sequence
tacttacagcccttagaaag

SEQ ID NO: 788572 - DNA, 20 bp, Artificial
  CRISPR gRNA sequence
atctgtcattcatgacaaca

SEQ ID NO: 788573 - DNA, 20 bp, Artificial
  CRISPR gRNA sequence
gtcattcatgacaacatgga

SEQ ID NO: 788574 - DNA, 20 bp, Artificial
  CRISPR gRNA sequence
tgacaacatggatggaactg

SEQ ID NO: 788575 - DNA, 20 bp, Artificial
  CRISPR gRNA sequence
gacaacatggatggaactga

SEQ ID NO: 788576 - DNA, 20 bp, Artificial
  CRISPR gRNA sequence
acaacatggatggaactgaa

SEQ ID NO: 788577 - DNA, 20 bp, Artificial
  CRISPR gRNA sequence
gaactgaagggtattatgct

SEQ ID NO: 788578 - DNA, 20 bp, Artificial
  CRISPR gRNA sequence
gaagggtattatgctaagtt

SEQ ID NO: 788579 - DNA, 20 bp, Artificial
  CRISPR gRNA sequence
ggtattatgctaagttaagt

SEQ ID NO: 788580 - DNA, 20 bp, Artificial
  CRISPR gRNA sequence
ttatgctaagttaagtaagc

SEQ ID NO: 788581 - DNA, 20 bp, Artificial
  CRISPR gRNA sequence
tatgctaagttaagtaagcc

SEQ ID NO: 788582 - DNA, 20 bp, Artificial
  CRISPR gRNA sequence
ttaagtaagccaggcacaaa

SEQ ID NO: 788583 - DNA, 20 bp, Artificial
  CRISPR gRNA sequence
gtaagccaggcacaaaaaga

SEQ ID NO: 788584 - DNA, 20 bp, Artificial
  CRISPR gRNA sequence
tttatttgtgaaatctaaaa

SEQ ID NO: 788585 - DNA, 20 bp, Artificial
  CRISPR gRNA sequence
atttgtgaaatctaaaaaag

SEQ ID NO: 788586 - DNA, 20 bp, Artificial
  CRISPR gRNA sequence
atctaaaaaagtagatccca

SEQ ID NO: 788587 - DNA, 20 bp, Artificial
  CRISPR gRNA sequence
aaaagtagatcccatagaaa

SEQ ID NO: 788588 - DNA, 20 bp, Artificial
  CRISPR gRNA sequence
aagtagatcccatagaaaca

SEQ ID NO: 788589 - DNA, 20 bp, Artificial
  CRISPR gRNA sequence
tagatcccatagaaacagag

SEQ ID NO: 788590 - DNA, 20 bp, Artificial
  CRISPR gRNA sequence
tcccatagaaacagagtaga

SEQ ID NO: 788591 - DNA, 20 bp, Artificial
  CRISPR gRNA sequence
cccatagaaacagagtagaa

SEQ ID NO: 788592 - DNA, 20 bp, Artificial
  CRISPR gRNA sequence
atagaaacagagtagaaagg

SEQ ID NO: 788593 - DNA, 20 bp, Artificial
  CRISPR gRNA sequence
cagagtagaaaggtggttat

SEQ ID NO: 788594 - DNA, 20 bp, Artificial
  CRISPR gRNA sequence
gagtagaaaggtggttatca

SEQ ID NO: 788595 - DNA, 20 bp, Artificial
  CRISPR gRNA sequence
agtagaaaggtggttatcag

SEQ ID NO: 788596 - DNA, 20 bp, Artificial
  CRISPR gRNA sequence
gaaaggtggttatcagaggc

SEQ ID NO: 788597 - DNA, 20 bp, Artificial
  CRISPR gRNA sequence
aaaggtggttatcagaggct

SEQ ID NO: 788598 - DNA, 20 bp, Artificial
  CRISPR gRNA sequence
aaggtggttatcagaggctg

SEQ ID NO: 788599 - DNA, 20 bp, Artificial
  CRISPR gRNA sequence
gttatcagaggctggggatg

SEQ ID NO: 788600 - DNA, 20 bp, Artificial
  CRISPR gRNA sequence
atcagaggctggggatgtgg

SEQ ID NO: 788601 - DNA, 20 bp, Artificial
  CRISPR gRNA sequence
gggatgtggaagatgttgct

SEQ ID NO: 788602 - DNA, 20 bp, Artificial
  CRISPR gRNA sequence
tggaagatgttgctcagtct

SEQ ID NO: 788603 - DNA, 20 bp, Artificial
  CRISPR gRNA sequence
gaagatgttgctcagtctca

SEQ ID NO: 788604 - DNA, 20 bp, Artificial
  CRISPR gRNA sequence
gatgttgctcagtctcagag

SEQ ID NO: 788605 - DNA, 20 bp, Artificial
  CRISPR gRNA sequence
tgttgctcagtctcagagta

SEQ ID NO: 788606 - DNA, 20 bp, Artificial
  CRISPR gRNA sequence
gttgctcagtctcagagtag

SEQ ID NO: 788607 - DNA, 20 bp, Artificial
  CRISPR gRNA sequence
tcagagtagaggaaatgttt

SEQ ID NO: 788608 - DNA, 20 bp, Artificial
  CRISPR gRNA sequence
attgccatgtgtgatgacca

SEQ ID NO: 788609 - DNA, 20 bp, Artificial
  CRISPR gRNA sequence
tctgtattcaaatttgctaa

SEQ ID NO: 788610 - DNA, 20 bp, Artificial
  CRISPR gRNA sequence
ttttttacattctctgtttt

SEQ ID NO: 788611 - DNA, 20 bp, Artificial
  CRISPR gRNA sequence
acattctctgttttgagatt

SEQ ID NO: 788612 - DNA, 20 bp, Artificial
  CRISPR gRNA sequence
ttctctgttttgagattaag

SEQ ID NO: 788613 - DNA, 20 bp, Artificial
  CRISPR gRNA sequence
ctctgttttgagattaagaa

SEQ ID NO: 788614 - DNA, 20 bp, Artificial
  CRISPR gRNA sequence
attaagaagagaaaaaaata

SEQ ID NO: 788615 - DNA, 20 bp, Artificial
  CRISPR gRNA sequence
aagaccacaaaaaaacaact

SEQ ID NO: 788616 - DNA, 20 bp, Artificial
  CRISPR gRNA sequence
tggtgatgtgatatgttaac

SEQ ID NO: 788617 - DNA, 20 bp, Artificial
  CRISPR gRNA sequence
tttttttttttttttttttt

SEQ ID NO: 788618 - DNA, 20 bp, Artificial
  CRISPR gRNA sequence
ttttttttttttttttgaga

SEQ ID NO: 788619 - DNA, 20 bp, Artificial
  CRISPR gRNA sequence
ttttttttttttttgagaca

SEQ ID NO: 788620 - DNA, 20 bp, Artificial
  CRISPR gRNA sequence
acagagtttcgctcgtcacc

SEQ ID NO: 788621 - DNA, 20 bp, Artificial
  CRISPR gRNA sequence
cagagtttcgctcgtcaccc

SEQ ID NO: 788622 - DNA, 20 bp, Artificial
  CRISPR gRNA sequence
gtttcgctcgtcacccaggc

SEQ ID NO: 788623 - DNA, 20 bp, Artificial
  CRISPR gRNA sequence
ttcgctcgtcacccaggctg

SEQ ID NO: 788624 - DNA, 20 bp, Artificial
  CRISPR gRNA sequence
tcacccaggctggagtgcaa

SEQ ID NO: 788625 - DNA, 20 bp, Artificial
  CRISPR gRNA sequence
ggagtgcaacagcgtgatct

SEQ ID NO: 788626 - DNA, 20 bp, Artificial
  CRISPR gRNA sequence
tcactgcaacctccacctcc

SEQ ID NO: 788627 - DNA, 20 bp, Artificial
  CRISPR gRNA sequence
cactgcaacctccacctccc

SEQ ID NO: 788628 - DNA, 20 bp, Artificial
  CRISPR gRNA sequence
aacctccacctcccaggttc

SEQ ID NO: 788629 - DNA, 20 bp, Artificial
  CRISPR gRNA sequence
ttcaagcaattctcctgcct

SEQ ID NO: 788630 - DNA, 20 bp, Artificial
  CRISPR gRNA sequence
ttctcctgcctcagcttcct

SEQ ID NO: 788631 - DNA, 20 bp, Artificial
  CRISPR gRNA sequence
tcctgcctcagcttcctgag

SEQ ID NO: 788632 - DNA, 20 bp, Artificial
  CRISPR gRNA sequence
gcctcagcttcctgagtagc

SEQ ID NO: 788633 - DNA, 20 bp, Artificial
  CRISPR gRNA sequence
cctcagcttcctgagtagct

SEQ ID NO: 788634 - DNA, 20 bp, Artificial
  CRISPR gRNA sequence
ttcctgagtagctgggattg

SEQ ID NO: 788635 - DNA, 20 bp, Artificial
  CRISPR gRNA sequence
tcctgagtagctgggattgc

SEQ ID NO: 788636 - DNA, 20 bp, Artificial
  CRISPR gRNA sequence
caggcacctgccaccatgcc

SEQ ID NO: 788637 - DNA, 20 bp, Artificial
  CRISPR gRNA sequence
tggctaattttttctatttt

SEQ ID NO: 788638 - DNA, 20 bp, Artificial
  CRISPR gRNA sequence
ctaattttttctattttcag

SEQ ID NO: 788639 - DNA, 20 bp, Artificial
  CRISPR gRNA sequence
aattttttctattttcagta

SEQ ID NO: 788640 - DNA, 20 bp, Artificial
  CRISPR gRNA sequence
ttttctattttcagtagaga

SEQ ID NO: 788641 - DNA, 20 bp, Artificial
  CRISPR gRNA sequence
tttctattttcagtagagat

SEQ ID NO: 788642 - DNA, 20 bp, Artificial
  CRISPR gRNA sequence
ttctattttcagtagagatg

SEQ ID NO: 788643 - DNA, 20 bp, Artificial
  CRISPR gRNA sequence
gagatggggtttcaccatgt

SEQ ID NO: 788644 - DNA, 20 bp, Artificial
  CRISPR gRNA sequence
tggggtttcaccatgttggt

SEQ ID NO: 788645 - DNA, 20 bp, Artificial
  CRISPR gRNA sequence
tttcaccatgttggtcagcc

SEQ ID NO: 788646 - DNA, 20 bp, Artificial
  CRISPR gRNA sequence
tggttttgaactcctgacct

SEQ ID NO: 788647 - DNA, 20 bp, Artificial
  CRISPR gRNA sequence
ggttttgaactcctgacctc

SEQ ID NO: 788648 - DNA, 20 bp, Artificial
  CRISPR gRNA sequence
ctcaggtgatccacctgcct

SEQ ID NO: 788649 - DNA, 20 bp, Artificial
  CRISPR gRNA sequence
ccacctgccttggcctccca

SEQ ID NO: 788650 - DNA, 20 bp, Artificial
  CRISPR gRNA sequence
gccttggcctcccaaagtgc

SEQ ID NO: 788651 - DNA, 20 bp, Artificial
  CRISPR gRNA sequence
ccttggcctcccaaagtgct

SEQ ID NO: 788652 - DNA, 20 bp, Artificial
  CRISPR gRNA sequence
ctcccaaagtgctgggatta

SEQ ID NO: 788653 - DNA, 20 bp, Artificial
  CRISPR gRNA sequence
tcccaaagtgctgggattac

SEQ ID NO: 788654 - DNA, 20 bp, Artificial
  CRISPR gRNA sequence
agtgctgggattacaggcat

SEQ ID NO: 788655 - DNA, 20 bp, Artificial
  CRISPR gRNA sequence
caggcatgagccactgtgcc

SEQ ID NO: 788656 - DNA, 20 bp, Artificial
  CRISPR gRNA sequence
ctctttctataatctataca

SEQ ID NO: 788657 - DNA, 20 bp, Artificial
  CRISPR gRNA sequence
ccataaatatacattattgc

SEQ ID NO: 788658 - DNA, 20 bp, Artificial
  CRISPR gRNA sequence
cttataaaaactttaaaaat

SEQ ID NO: 788659 - DNA, 20 bp, Artificial
  CRISPR gRNA sequence
aactttaaaaataagtaaaa

SEQ ID NO: 788660 - DNA, 20 bp, Artificial
  CRISPR gRNA sequence
actttaaaaataagtaaaat

SEQ ID NO: 788661 - DNA, 20 bp, Artificial
  CRISPR gRNA sequence
taaaataggcatgatattcc

SEQ ID NO: 788662 - DNA, 20 bp, Artificial
  CRISPR gRNA sequence
aaataggcatgatattccaa

SEQ ID NO: 788663 - DNA, 20 bp, Artificial
  CRISPR gRNA sequence
ggcatgatattccaagagac

SEQ ID NO: 788664 - DNA, 20 bp, Artificial
  CRISPR gRNA sequence
atgatattccaagagactag

SEQ ID NO: 788665 - DNA, 20 bp, Artificial
  CRISPR gRNA sequence
tccaagagactagaagacac

SEQ ID NO: 788666 - DNA, 20 bp, Artificial
  CRISPR gRNA sequence
agacacaagaacaaaccttc

SEQ ID NO: 788667 - DNA, 20 bp, Artificial
  CRISPR gRNA sequence
cacaagaacaaaccttccag

SEQ ID NO: 788668 - DNA, 20 bp, Artificial
  CRISPR gRNA sequence
aacaaaccttccagtggtct

SEQ ID NO: 788669 - DNA, 20 bp, Artificial
  CRISPR gRNA sequence
cttccagtggtcttagataa

SEQ ID NO: 788670 - DNA, 20 bp, Artificial
  CRISPR gRNA sequence
acaaatatcaataccatatg

SEQ ID NO: 788671 - DNA, 20 bp, Artificial
  CRISPR gRNA sequence
tcaataccatatgcagttac

SEQ ID NO: 788672 - DNA, 20 bp, Artificial
  CRISPR gRNA sequence
caataccatatgcagttacc

SEQ ID NO: 788673 - DNA, 20 bp, Artificial
  CRISPR gRNA sequence
taccatatgcagttaccagg

SEQ ID NO: 788674 - DNA, 20 bp, Artificial
  CRISPR gRNA sequence
tatgcagttaccaggcagtg

SEQ ID NO: 788675 - DNA, 20 bp, Artificial
  CRISPR gRNA sequence
cagttaccaggcagtgtgga

SEQ ID NO: 788676 - DNA, 20 bp, Artificial
  CRISPR gRNA sequence
gaaagtcacctgttgatatt

SEQ ID NO: 788677 - DNA, 20 bp, Artificial
  CRISPR gRNA sequence
gtcacctgttgatatttggt

SEQ ID NO: 788678 - DNA, 20 bp, Artificial
  CRISPR gRNA sequence
cacctgttgatatttggtga

SEQ ID NO: 788679 - DNA, 20 bp, Artificial
  CRISPR gRNA sequence
acctgttgatatttggtgag

SEQ ID NO: 788680 - DNA, 20 bp, Artificial
  CRISPR gRNA sequence
tgttgatatttggtgagagg

SEQ ID NO: 788681 - DNA, 20 bp, Artificial
  CRISPR gRNA sequence
ttgatatttggtgagaggaa

SEQ ID NO: 788682 - DNA, 20 bp, Artificial
  CRISPR gRNA sequence
tgatatttggtgagaggaag

SEQ ID NO: 788683 - DNA, 20 bp, Artificial
  CRISPR gRNA sequence
gatatttggtgagaggaaga

SEQ ID NO: 788684 - DNA, 20 bp, Artificial
  CRISPR gRNA sequence
atatttggtgagaggaagag

SEQ ID NO: 788685 - DNA, 20 bp, Artificial
  CRISPR gRNA sequence
tggtgagaggaagaggggat

SEQ ID NO: 788686 - DNA, 20 bp, Artificial
  CRISPR gRNA sequence
gaggaagaggggatgagcac

SEQ ID NO: 788687 - DNA, 20 bp, Artificial
  CRISPR gRNA sequence
gatgagcactggcttccatt

SEQ ID NO: 788688 - DNA, 20 bp, Artificial
  CRISPR gRNA sequence
gagcactggcttccattcgg

SEQ ID NO: 788689 - DNA, 20 bp, Artificial
  CRISPR gRNA sequence
agcactggcttccattcggt

SEQ ID NO: 788690 - DNA, 20 bp, Artificial
  CRISPR gRNA sequence
tcggtaggaaatattctttt

SEQ ID NO: 788691 - DNA, 20 bp, Artificial
  CRISPR gRNA sequence
aaatttcaatacaatttttg

SEQ ID NO: 788692 - DNA, 20 bp, Artificial
  CRISPR gRNA sequence
ttcaatacaatttttgaagt

SEQ ID NO: 788693 - DNA, 20 bp, Artificial
  CRISPR gRNA sequence
tacaatttttgaagtaagtg

SEQ ID NO: 788694 - DNA, 20 bp, Artificial
  CRISPR gRNA sequence
ttgaagtaagtgtagtcttg

SEQ ID NO: 788695 - DNA, 20 bp, Artificial
  CRISPR gRNA sequence
gtaagtgtagtcttgaagta

SEQ ID NO: 788696 - DNA, 20 bp, Artificial
  CRISPR gRNA sequence
taagtgtagtcttgaagtaa

SEQ ID NO: 788697 - DNA, 20 bp, Artificial
  CRISPR gRNA sequence
gtgtagtcttgaagtaaagg

SEQ ID NO: 788698 - DNA, 20 bp, Artificial
  CRISPR gRNA sequence
gtagtcttgaagtaaaggca

SEQ ID NO: 788699 - DNA, 20 bp, Artificial
  CRISPR gRNA sequence
tagtcttgaagtaaaggcag

SEQ ID NO: 788700 - DNA, 20 bp, Artificial
  CRISPR gRNA sequence
acttttttctcctaaattgt

SEQ ID NO: 788701 - DNA, 20 bp, Artificial
  CRISPR gRNA sequence
tttttctcctaaattgttgg

SEQ ID NO: 788702 - DNA, 20 bp, Artificial
  CRISPR gRNA sequence
taaattgttggaagtataaa

SEQ ID NO: 788703 - DNA, 20 bp, Artificial
  CRISPR gRNA sequence
aaattgttggaagtataaat

SEQ ID NO: 788704 - DNA, 20 bp, Artificial
  CRISPR gRNA sequence
acaatttcacattaaaataa

SEQ ID NO: 788705 - DNA, 20 bp, Artificial
  CRISPR gRNA sequence
cttattgttttctatgtgtt

SEQ ID NO: 788706 - DNA, 20 bp, Artificial
  CRISPR gRNA sequence
ccacgtccttttacatccta

SEQ ID NO: 788707 - DNA, 20 bp, Artificial
  CRISPR gRNA sequence
cgtccttttacatcctatgg

SEQ ID NO: 788708 - DNA, 20 bp, Artificial
  CRISPR gRNA sequence
tccttttacatcctatggaa

SEQ ID NO: 788709 - DNA, 20 bp, Artificial
  CRISPR gRNA sequence
ttttacatcctatggaagag

SEQ ID NO: 788710 - DNA, 20 bp, Artificial
  CRISPR gRNA sequence
tttacatcctatggaagaga

SEQ ID NO: 788711 - DNA, 20 bp, Artificial
  CRISPR gRNA sequence
tctgttcccctcctgtgttg

SEQ ID NO: 788712 - DNA, 20 bp, Artificial
  CRISPR gRNA sequence
ctgttcccctcctgtgttgt

SEQ ID NO: 788713 - DNA, 20 bp, Artificial
  CRISPR gRNA sequence
gtgttgtgggtctcaatgtt

SEQ ID NO: 788714 - DNA, 20 bp, Artificial
  CRISPR gRNA sequence
gttgtgggtctcaatgttaa

SEQ ID NO: 788715 - DNA, 20 bp, Artificial
  CRISPR gRNA sequence
gttgacaatttgattcatta

SEQ ID NO: 788716 - DNA, 20 bp, Artificial
  CRISPR gRNA sequence
ttatagcaaacaacacccac

SEQ ID NO: 788717 - DNA, 20 bp, Artificial
  CRISPR gRNA sequence
caaacaacacccactagatc

SEQ ID NO: 788718 - DNA, 20 bp, Artificial
  CRISPR gRNA sequence
aaacaacacccactagatct

SEQ ID NO: 788719 - DNA, 20 bp, Artificial
  CRISPR gRNA sequence
cccactagatctgggttcac

SEQ ID NO: 788720 - DNA, 20 bp, Artificial
  CRISPR gRNA sequence
cactagatctgggttcacta

SEQ ID NO: 788721 - DNA, 20 bp, Artificial
  CRISPR gRNA sequence
ctagatctgggttcactaga

SEQ ID NO: 788722 - DNA, 20 bp, Artificial
  CRISPR gRNA sequence
gatctgggttcactagagag

SEQ ID NO: 788723 - DNA, 20 bp, Artificial
  CRISPR gRNA sequence
atctgggttcactagagagc

SEQ ID NO: 788724 - DNA, 20 bp, Artificial
  CRISPR gRNA sequence
tctgggttcactagagagca

SEQ ID NO: 788725 - DNA, 20 bp, Artificial
  CRISPR gRNA sequence
ctgcacaatgaaacatccac

SEQ ID NO: 788726 - DNA, 20 bp, Artificial
  CRISPR gRNA sequence
accagaacctgcgtgcactt

SEQ ID NO: 788727 - DNA, 20 bp, Artificial
  CRISPR gRNA sequence
tgcactttggctctcccttg

SEQ ID NO: 788728 - DNA, 20 bp, Artificial
  CRISPR gRNA sequence
ttgaagttctcgtctccatg

SEQ ID NO: 788729 - DNA, 20 bp, Artificial
  CRISPR gRNA sequence
agttctcgtctccatgtggt

SEQ ID NO: 788730 - DNA, 20 bp, Artificial
  CRISPR gRNA sequence
ctccatgtggtcagcacacc

SEQ ID NO: 788731 - DNA, 20 bp, Artificial
  CRISPR gRNA sequence
atgtggtcagcacacccagc

SEQ ID NO: 788732 - DNA, 20 bp, Artificial
  CRISPR gRNA sequence
tgtggtcagcacacccagct

SEQ ID NO: 788733 - DNA, 20 bp, Artificial
  CRISPR gRNA sequence
gcacacccagctgggcctcc

SEQ ID NO: 788734 - DNA, 20 bp, Artificial
  CRISPR gRNA sequence
gcctcctggtatgtcccaaa

SEQ ID NO: 788735 - DNA, 20 bp, Artificial
  CRISPR gRNA sequence
tatgtcatttaaatgatatg

SEQ ID NO: 788736 - DNA, 20 bp, Artificial
  CRISPR gRNA sequence
aaatgatatgcagaccctat

SEQ ID NO: 788737 - DNA, 20 bp, Artificial
  CRISPR gRNA sequence
aatgatatgcagaccctatg

SEQ ID NO: 788738 - DNA, 20 bp, Artificial
  CRISPR gRNA sequence
gatatgcagaccctatgagg

SEQ ID NO: 788739 - DNA, 20 bp, Artificial
  CRISPR gRNA sequence
atatgcagaccctatgaggt

SEQ ID NO: 788740 - DNA, 20 bp, Artificial
  CRISPR gRNA sequence
ttttgtaatgcattcttaat

SEQ ID NO: 788741 - DNA, 20 bp, Artificial
  CRISPR gRNA sequence
ttcttaattggaatcaccat

SEQ ID NO: 788742 - DNA, 20 bp, Artificial
  CRISPR gRNA sequence
cttaattggaatcaccataa

SEQ ID NO: 788743 - DNA, 20 bp, Artificial
  CRISPR gRNA sequence
ttaattggaatcaccataag

SEQ ID NO: 788744 - DNA, 20 bp, Artificial
  CRISPR gRNA sequence
gatgtgtctctgtgtaattg

SEQ ID NO: 788745 - DNA, 20 bp, Artificial
  CRISPR gRNA sequence
tctgtgtaattgcagatgtc

SEQ ID NO: 788746 - DNA, 20 bp, Artificial
  CRISPR gRNA sequence
ctgtgtaattgcagatgtct

SEQ ID NO: 788747 - DNA, 20 bp, Artificial
  CRISPR gRNA sequence
tgtgtaattgcagatgtcta

SEQ ID NO: 788748 - DNA, 20 bp, Artificial
  CRISPR gRNA sequence
taattgcagatgtctaggga

SEQ ID NO: 788749 - DNA, 20 bp, Artificial
  CRISPR gRNA sequence
gtctagggatggtgcaacat

SEQ ID NO: 788750 - DNA, 20 bp, Artificial
  CRISPR gRNA sequence
tagggatggtgcaacataag

SEQ ID NO: 788751 - DNA, 20 bp, Artificial
  CRISPR gRNA sequence
gatggtgcaacataagcaga

SEQ ID NO: 788752 - DNA, 20 bp, Artificial
  CRISPR gRNA sequence
tggtgcaacataagcagata

SEQ ID NO: 788753 - DNA, 20 bp, Artificial
  CRISPR gRNA sequence
ggtgcaacataagcagatag

SEQ ID NO: 788754 - DNA, 20 bp, Artificial
  CRISPR gRNA sequence
cagatagaggaatatgctct

SEQ ID NO: 788755 - DNA, 20 bp, Artificial
  CRISPR gRNA sequence
agatagaggaatatgctctg

SEQ ID NO: 788756 - DNA, 20 bp, Artificial
  CRISPR gRNA sequence
ggaatatgctctgaggttct

SEQ ID NO: 788757 - DNA, 20 bp, Artificial
  CRISPR gRNA sequence
gaatatgctctgaggttctt

SEQ ID NO: 788758 - DNA, 20 bp, Artificial
  CRISPR gRNA sequence
atatgctctgaggttcttag

SEQ ID NO: 788759 - DNA, 20 bp, Artificial
  CRISPR gRNA sequence
ctgaggttcttaggagcacc

SEQ ID NO: 788760 - DNA, 20 bp, Artificial
  CRISPR gRNA sequence
aggttcttaggagcacccag

SEQ ID NO: 788761 - DNA, 20 bp, Artificial
  CRISPR gRNA sequence
ttcttaggagcacccagcag

SEQ ID NO: 788762 - DNA, 20 bp, Artificial
  CRISPR gRNA sequence
ttaggagcacccagcagtag

SEQ ID NO: 788763 - DNA, 20 bp, Artificial
  CRISPR gRNA sequence
ggagcacccagcagtagtag

SEQ ID NO: 788764 - DNA, 20 bp, Artificial
  CRISPR gRNA sequence
acccagcagtagtagaagat

SEQ ID NO: 788765 - DNA, 20 bp, Artificial
  CRISPR gRNA sequence
cccagcagtagtagaagata

SEQ ID NO: 788766 - DNA, 20 bp, Artificial
  CRISPR gRNA sequence
tagtagaagataaggcaatt

SEQ ID NO: 788767 - DNA, 20 bp, Artificial
  CRISPR gRNA sequence
ataaggcaattcagacactg

SEQ ID NO: 788768 - DNA, 20 bp, Artificial
  CRISPR gRNA sequence
aggcaattcagacactgaag

SEQ ID NO: 788769 - DNA, 20 bp, Artificial
  CRISPR gRNA sequence
gacactgaagcagcctactg

SEQ ID NO: 788770 - DNA, 20 bp, Artificial
  CRISPR gRNA sequence
acactgaagcagcctactga

SEQ ID NO: 788771 - DNA, 20 bp, Artificial
  CRISPR gRNA sequence
tactgaaggacttgacctgt

SEQ ID NO: 788772 - DNA, 20 bp, Artificial
  CRISPR gRNA sequence
tagactcaccaatctccttg

SEQ ID NO: 788773 - DNA, 20 bp, Artificial
  CRISPR gRNA sequence
tctccttgaagccaaaactt

SEQ ID NO: 788774 - DNA, 20 bp, Artificial
  CRISPR gRNA sequence
gcctatctttcataatcaaa

SEQ ID NO: 788775 - DNA, 20 bp, Artificial
  CRISPR gRNA sequence
tcataatcaaacagtacccg

SEQ ID NO: 788776 - DNA, 20 bp, Artificial
  CRISPR gRNA sequence
gtacccgaagtgtgtatttc

SEQ ID NO: 788777 - DNA, 20 bp, Artificial
  CRISPR gRNA sequence
tatctacacttattttccct

SEQ ID NO: 788778 - DNA, 20 bp, Artificial
  CRISPR gRNA sequence
cattttatatgatcatactg

SEQ ID NO: 788779 - DNA, 20 bp, Artificial
  CRISPR gRNA sequence
atactgtagattatttctgt

SEQ ID NO: 788780 - DNA, 20 bp, Artificial
  CRISPR gRNA sequence
gattatttctgtaagctctc

SEQ ID NO: 788781 - DNA, 20 bp, Artificial
  CRISPR gRNA sequence
ctgtaagctctcaagtcttt

SEQ ID NO: 788782 - DNA, 20 bp, Artificial
  CRISPR gRNA sequence
tgtaagctctcaagtctttt

SEQ ID NO: 788783 - DNA, 20 bp, Artificial
  CRISPR gRNA sequence
gtaagctctcaagtcttttg

SEQ ID NO: 788784 - DNA, 20 bp, Artificial
  CRISPR gRNA sequence
ctcaagtcttttggggaatg

SEQ ID NO: 788785 - DNA, 20 bp, Artificial
  CRISPR gRNA sequence
aagtcttttggggaatgaag

SEQ ID NO: 788786 - DNA, 20 bp, Artificial
  CRISPR gRNA sequence
tttggggaatgaagtagaac

SEQ ID NO: 788787 - DNA, 20 bp, Artificial
  CRISPR gRNA sequence
ggaatgaagtagaacaagaa

SEQ ID NO: 788788 - DNA, 20 bp, Artificial
  CRISPR gRNA sequence
gaatgaagtagaacaagaac

SEQ ID NO: 788789 - DNA, 20 bp, Artificial
  CRISPR gRNA sequence
atgaagtagaacaagaacag

SEQ ID NO: 788790 - DNA, 20 bp, Artificial
  CRISPR gRNA sequence
aagtagaacaagaacaggag

SEQ ID NO: 788791 - DNA, 20 bp, Artificial
  CRISPR gRNA sequence
gtagaacaagaacaggagca

SEQ ID NO: 788792 - DNA, 20 bp, Artificial
  CRISPR gRNA sequence
agaacaggagcagagtactg

SEQ ID NO: 788793 - DNA, 20 bp, Artificial
  CRISPR gRNA sequence
gaacaggagcagagtactgt

SEQ ID NO: 788794 - DNA, 20 bp, Artificial
  CRISPR gRNA sequence
aggagcagagtactgtgggt

SEQ ID NO: 788795 - DNA, 20 bp, Artificial
  CRISPR gRNA sequence
ggagcagagtactgtgggtg

SEQ ID NO: 788796 - DNA, 20 bp, Artificial
  CRISPR gRNA sequence
gagcagagtactgtgggtga

SEQ ID NO: 788797 - DNA, 20 bp, Artificial
  CRISPR gRNA sequence
gagtactgtgggtgagggtc

SEQ ID NO: 788798 - DNA, 20 bp, Artificial
  CRISPR gRNA sequence
gagggtccagcccactattg

SEQ ID NO: 788799 - DNA, 20 bp, Artificial
  CRISPR gRNA sequence
agggtccagcccactattgc

SEQ ID NO: 788800 - DNA, 20 bp, Artificial
  CRISPR gRNA sequence
gtccagcccactattgcagg

SEQ ID NO: 788801 - DNA, 20 bp, Artificial
  CRISPR gRNA sequence
gcccactattgcaggtggct

SEQ ID NO: 788802 - DNA, 20 bp, Artificial
  CRISPR gRNA sequence
tattgcaggtggcttggacc

SEQ ID NO: 788803 - DNA, 20 bp, Artificial
  CRISPR gRNA sequence
ttggaccaagaaactgatct

SEQ ID NO: 788804 - DNA, 20 bp, Artificial
  CRISPR gRNA sequence
agaaactgatcttggtgtcc

SEQ ID NO: 788805 - DNA, 20 bp, Artificial
  CRISPR gRNA sequence
ctgatcttggtgtcctggtt

SEQ ID NO: 788806 - DNA, 20 bp, Artificial
  CRISPR gRNA sequence
atcttggtgtcctggttgag

SEQ ID NO: 788807 - DNA, 20 bp, Artificial
  CRISPR gRNA sequence
tcctggttgagaagtgattt

SEQ ID NO: 788808 - DNA, 20 bp, Artificial
  CRISPR gRNA sequence
tggttgagaagtgatttcag

SEQ ID NO: 788809 - DNA, 20 bp, Artificial
  CRISPR gRNA sequence
ttgagaagtgatttcagaag

SEQ ID NO: 788810 - DNA, 20 bp, Artificial
  CRISPR gRNA sequence
tgagaagtgatttcagaagt

SEQ ID NO: 788811 - DNA, 20 bp, Artificial
  CRISPR gRNA sequence
gagaagtgatttcagaagta

SEQ ID NO: 788812 - DNA, 20 bp, Artificial
  CRISPR gRNA sequence
gatttcagaagtagggatgc

SEQ ID NO: 788813 - DNA, 20 bp, Artificial
  CRISPR gRNA sequence
atttcagaagtagggatgcc

SEQ ID NO: 788814 - DNA, 20 bp, Artificial
  CRISPR gRNA sequence
gaagtagggatgccaggaat

SEQ ID NO: 788815 - DNA, 20 bp, Artificial
  CRISPR gRNA sequence
aagtagggatgccaggaatt

SEQ ID NO: 788816 - DNA, 20 bp, Artificial
  CRISPR gRNA sequence
gtagggatgccaggaattgg

SEQ ID NO: 788817 - DNA, 20 bp, Artificial
  CRISPR gRNA sequence
gatgccaggaattgggagct

SEQ ID NO: 788818 - DNA, 20 bp, Artificial
  CRISPR gRNA sequence
caggaattgggagcttggct

SEQ ID NO: 788819 - DNA, 20 bp, Artificial
  CRISPR gRNA sequence
aggaattgggagcttggctg

SEQ ID NO: 788820 - DNA, 20 bp, Artificial
  CRISPR gRNA sequence
gcttggctgaggctttgact

SEQ ID NO: 788821 - DNA, 20 bp, Artificial
  CRISPR gRNA sequence
cttggctgaggctttgactt

SEQ ID NO: 788822 - DNA, 20 bp, Artificial
  CRISPR gRNA sequence
ggctttgacttgggatacat

SEQ ID NO: 788823 - DNA, 20 bp, Artificial
  CRISPR gRNA sequence
gctttgacttgggatacatg

SEQ ID NO: 788824 - DNA, 20 bp, Artificial
  CRISPR gRNA sequence
ctttgacttgggatacatga

SEQ ID NO: 788825 - DNA, 20 bp, Artificial
  CRISPR gRNA sequence
ttgacttgggatacatgagg

SEQ ID NO: 788826 - DNA, 20 bp, Artificial
  CRISPR gRNA sequence
acttgggatacatgagggag

SEQ ID NO: 788827 - DNA, 20 bp, Artificial
  CRISPR gRNA sequence
gggatacatgagggagcaga

SEQ ID NO: 788828 - DNA, 20 bp, Artificial
  CRISPR gRNA sequence
ggatacatgagggagcagat

SEQ ID NO: 788829 - DNA, 20 bp, Artificial
  CRISPR gRNA sequence
gatacatgagggagcagata

SEQ ID NO: 788830 - DNA, 20 bp, Artificial
  CRISPR gRNA sequence
tacatgagggagcagatagg

SEQ ID NO: 788831 - DNA, 20 bp, Artificial
  CRISPR gRNA sequence
tgagggagcagatagggaga

SEQ ID NO: 788832 - DNA, 20 bp, Artificial
  CRISPR gRNA sequence
agggagcagatagggagaca

SEQ ID NO: 788833 - DNA, 20 bp, Artificial
  CRISPR gRNA sequence
ggagcagatagggagacaga

SEQ ID NO: 788834 - DNA, 20 bp, Artificial
  CRISPR gRNA sequence
agcagatagggagacagaga

SEQ ID NO: 788835 - DNA, 20 bp, Artificial
  CRISPR gRNA sequence
cagatagggagacagagaga

SEQ ID NO: 788836 - DNA, 20 bp, Artificial
  CRISPR gRNA sequence
agagagagctcttccactac

SEQ ID NO: 788837 - DNA, 20 bp, Artificial
  CRISPR gRNA sequence
agctcttccactacaagaat

SEQ ID NO: 788838 - DNA, 20 bp, Artificial
  CRISPR gRNA sequence
cttccactacaagaatcagc

SEQ ID NO: 788839 - DNA, 20 bp, Artificial
  CRISPR gRNA sequence
ttccactacaagaatcagca

SEQ ID NO: 788840 - DNA, 20 bp, Artificial
  CRISPR gRNA sequence
ctacaagaatcagcaaggtt

SEQ ID NO: 788841 - DNA, 20 bp, Artificial
  CRISPR gRNA sequence
tacaagaatcagcaaggttt

SEQ ID NO: 788842 - DNA, 20 bp, Artificial
  CRISPR gRNA sequence
acaagaatcagcaaggtttg

SEQ ID NO: 788843 - DNA, 20 bp, Artificial
  CRISPR gRNA sequence
agaatcagcaaggtttgggg

SEQ ID NO: 788844 - DNA, 20 bp, Artificial
  CRISPR gRNA sequence
gaatcagcaaggtttgggga

SEQ ID NO: 788845 - DNA, 20 bp, Artificial
  CRISPR gRNA sequence
aatcagcaaggtttggggaa

SEQ ID NO: 788846 - DNA, 20 bp, Artificial
  CRISPR gRNA sequence
agcaaggtttggggaaggga

SEQ ID NO: 788847 - DNA, 20 bp, Artificial
  CRISPR gRNA sequence
gcaaggtttggggaagggac

SEQ ID NO: 788848 - DNA, 20 bp, Artificial
  CRISPR gRNA sequence
aaggtttggggaagggacag

SEQ ID NO: 788849 - DNA, 20 bp, Artificial
  CRISPR gRNA sequence
gcccacatcctacatttttg

SEQ ID NO: 788850 - DNA, 20 bp, Artificial
  CRISPR gRNA sequence
atcctacatttttgcagtat

SEQ ID NO: 788851 - DNA, 20 bp, Artificial
  CRISPR gRNA sequence
cagtatcagaaatgtctcca

SEQ ID NO: 788852 - DNA, 20 bp, Artificial
  CRISPR gRNA sequence
tccacagcctctttcttatt

SEQ ID NO: 788853 - DNA, 20 bp, Artificial
  CRISPR gRNA sequence
acagcctctttcttatttgg

SEQ ID NO: 788854 - DNA, 20 bp, Artificial
  CRISPR gRNA sequence
cagcctctttcttatttgga

SEQ ID NO: 788855 - DNA, 20 bp, Artificial
  CRISPR gRNA sequence
cctctttcttatttggaagg

SEQ ID NO: 788856 - DNA, 20 bp, Artificial
  CRISPR gRNA sequence
ctttcttatttggaaggtgg

SEQ ID NO: 788857 - DNA, 20 bp, Artificial
  CRISPR gRNA sequence
ttatttggaaggtggtggaa

SEQ ID NO: 788858 - DNA, 20 bp, Artificial
  CRISPR gRNA sequence
tatttggaaggtggtggaaa

SEQ ID NO: 788859 - DNA, 20 bp, Artificial
  CRISPR gRNA sequence
ggaaaaggaatcgcttccca

SEQ ID NO: 788860 - DNA, 20 bp, Artificial
  CRISPR gRNA sequence
aaaggaatcgcttcccacag

SEQ ID NO: 788861 - DNA, 20 bp, Artificial
  CRISPR gRNA sequence
aaggaatcgcttcccacagt

SEQ ID NO: 788862 - DNA, 20 bp, Artificial
  CRISPR gRNA sequence
aggaatcgcttcccacagtg

SEQ ID NO: 788863 - DNA, 20 bp, Artificial
  CRISPR gRNA sequence
aatcgcttcccacagtgggg

SEQ ID NO: 788864 - DNA, 20 bp, Artificial
  CRISPR gRNA sequence
gcttcccacagtggggaagc

SEQ ID NO: 788865 - DNA, 20 bp, Artificial
  CRISPR gRNA sequence
cacagtggggaagctggact

SEQ ID NO: 788866 - DNA, 20 bp, Artificial
  CRISPR gRNA sequence
acagtggggaagctggactg

SEQ ID NO: 788867 - DNA, 20 bp, Artificial
  CRISPR gRNA sequence
cagtggggaagctggactga

SEQ ID NO: 788868 - DNA, 20 bp, Artificial
  CRISPR gRNA sequence
tggactgagggtgatattct

SEQ ID NO: 788869 - DNA, 20 bp, Artificial
  CRISPR gRNA sequence
ggactgagggtgatattctt

SEQ ID NO: 788870 - DNA, 20 bp, Artificial
  CRISPR gRNA sequence
gagggtgatattcttaggaa

SEQ ID NO: 788871 - DNA, 20 bp, Artificial
  CRISPR gRNA sequence
tgatattcttaggaaaagat

SEQ ID NO: 788872 - DNA, 20 bp, Artificial
  CRISPR gRNA sequence
aggaaaagatgagtaaattt

SEQ ID NO: 788873 - DNA, 20 bp, Artificial
  CRISPR gRNA sequence
atgagtaaattttagaattt

SEQ ID NO: 788874 - DNA, 20 bp, Artificial
  CRISPR gRNA sequence
gagtaaattttagaatttaa

SEQ ID NO: 788875 - DNA, 20 bp, Artificial
  CRISPR gRNA sequence
agtaaattttagaatttaag

SEQ ID NO: 788876 - DNA, 20 bp, Artificial
  CRISPR gRNA sequence
aaattttagaatttaagagg

SEQ ID NO: 788877 - DNA, 20 bp, Artificial
  CRISPR gRNA sequence
ttttagaatttaagaggcgg

SEQ ID NO: 788878 - DNA, 20 bp, Artificial
  CRISPR gRNA sequence
cggaagtactccaaaaattc

SEQ ID NO: 788879 - DNA, 20 bp, Artificial
  CRISPR gRNA sequence
tcaatgaaaaacaccttcta

SEQ ID NO: 788880 - DNA, 20 bp, Artificial
  CRISPR gRNA sequence
accttctacagcaattctcc

SEQ ID NO: 788881 - DNA, 20 bp, Artificial
  CRISPR gRNA sequence
tgaaaacaatgtgtgttctg

SEQ ID NO: 788882 - DNA, 20 bp, Artificial
  CRISPR gRNA sequence
aatgtgtgttctgtagttgc

SEQ ID NO: 788883 - DNA, 20 bp, Artificial
  CRISPR gRNA sequence
atgtgtgttctgtagttgct

SEQ ID NO: 788884 - DNA, 20 bp, Artificial
  CRISPR gRNA sequence
tctatatatcatatgtctat

SEQ ID NO: 788885 - DNA, 20 bp, Artificial
  CRISPR gRNA sequence
ctatatatcatatgtctatt

SEQ ID NO: 788886 - DNA, 20 bp, Artificial
  CRISPR gRNA sequence
tatcatatgtctattaggtc

SEQ ID NO: 788887 - DNA, 20 bp, Artificial
  CRISPR gRNA sequence
atatgtctattaggtcaaga

SEQ ID NO: 788888 - DNA, 20 bp, Artificial
  CRISPR gRNA sequence
agatggctaattgtgttgtt

SEQ ID NO: 788889 - DNA, 20 bp, Artificial
  CRISPR gRNA sequence
ttcttaattgtttgttctat

SEQ ID NO: 788890 - DNA, 20 bp, Artificial
  CRISPR gRNA sequence
gtttgttctatcagttgtaa

SEQ ID NO: 788891 - DNA, 20 bp, Artificial
  CRISPR gRNA sequence
ttgttctatcagttgtaata

SEQ ID NO: 788892 - DNA, 20 bp, Artificial
  CRISPR gRNA sequence
ctatcagttgtaatagagat

SEQ ID NO: 788893 - DNA, 20 bp, Artificial
  CRISPR gRNA sequence
tgaaatctcaaatgtaattg

SEQ ID NO: 788894 - DNA, 20 bp, Artificial
  CRISPR gRNA sequence
aatgtaattgtggatttgac

SEQ ID NO: 788895 - DNA, 20 bp, Artificial
  CRISPR gRNA sequence
tggatttgactggttctcct

SEQ ID NO: 788896 - DNA, 20 bp, Artificial
  CRISPR gRNA sequence
aattgttgtttaatattttg

SEQ ID NO: 788897 - DNA, 20 bp, Artificial
  CRISPR gRNA sequence
tttgaagctatactgttaaa

SEQ ID NO: 788898 - DNA, 20 bp, Artificial
  CRISPR gRNA sequence
ctgttaaatggacacacatt

SEQ ID NO: 788899 - DNA, 20 bp, Artificial
  CRISPR gRNA sequence
tgttaaatggacacacattt

SEQ ID NO: 788900 - DNA, 20 bp, Artificial
  CRISPR gRNA sequence
aggattgttatgtgttcctt

SEQ ID NO: 788901 - DNA, 20 bp, Artificial
  CRISPR gRNA sequence
ctcactcttttatcattatg

SEQ ID NO: 788902 - DNA, 20 bp, Artificial
  CRISPR gRNA sequence
gaagtgtcccttgttatctt

SEQ ID NO: 788903 - DNA, 20 bp, Artificial
  CRISPR gRNA sequence
taatatttttcttctgatat

SEQ ID NO: 788904 - DNA, 20 bp, Artificial
  CRISPR gRNA sequence
tgcctgaaaacatctatgaa

SEQ ID NO: 788905 - DNA, 20 bp, Artificial
  CRISPR gRNA sequence
atggaaactcctacttcctc

SEQ ID NO: 788906 - DNA, 20 bp, Artificial
  CRISPR gRNA sequence
gaaactcctacttcctctag

SEQ ID NO: 788907 - DNA, 20 bp, Artificial
  CRISPR gRNA sequence
actcctacttcctctagaag

SEQ ID NO: 788908 - DNA, 20 bp, Artificial
  CRISPR gRNA sequence
ctttgccatgattatacaat

SEQ ID NO: 788909 - DNA, 20 bp, Artificial
  CRISPR gRNA sequence
gccatgattatacaataagc

SEQ ID NO: 788910 - DNA, 20 bp, Artificial
  CRISPR gRNA sequence
taagcaagttaaacttccat

SEQ ID NO: 788911 - DNA, 20 bp, Artificial
  CRISPR gRNA sequence
caagttaaacttccattgga

SEQ ID NO: 788912 - DNA, 20 bp, Artificial
  CRISPR gRNA sequence
ggaaagattttcttcatgcc

SEQ ID NO: 788913 - DNA, 20 bp, Artificial
  CRISPR gRNA sequence
agcaaaattgtgcctctttg

SEQ ID NO: 788914 - DNA, 20 bp, Artificial
  CRISPR gRNA sequence
tctttgtagcttctacccat

SEQ ID NO: 788915 - DNA, 20 bp, Artificial
  CRISPR gRNA sequence
tctacccattggtatttgtc

SEQ ID NO: 788916 - DNA, 20 bp, Artificial
  CRISPR gRNA sequence
ccattggtatttgtctagtt

SEQ ID NO: 788917 - DNA, 20 bp, Artificial
  CRISPR gRNA sequence
tagtttagtaacacaacata

SEQ ID NO: 788918 - DNA, 20 bp, Artificial
  CRISPR gRNA sequence
ttagtaacacaacatatggt

SEQ ID NO: 788919 - DNA, 20 bp, Artificial
  CRISPR gRNA sequence
acaacatatggtaagcaccg

SEQ ID NO: 788920 - DNA, 20 bp, Artificial
  CRISPR gRNA sequence
agcaccgtagttaaaaacat

SEQ ID NO: 788921 - DNA, 20 bp, Artificial
  CRISPR gRNA sequence
cgtagttaaaaacatgagtt

SEQ ID NO: 788922 - DNA, 20 bp, Artificial
  CRISPR gRNA sequence
aaaacatgagttcagaatct

SEQ ID NO: 788923 - DNA, 20 bp, Artificial
  CRISPR gRNA sequence
acatgagttcagaatctgag

SEQ ID NO: 788924 - DNA, 20 bp, Artificial
  CRISPR gRNA sequence
gttcagaatctgagcagttt

SEQ ID NO: 788925 - DNA, 20 bp, Artificial
  CRISPR gRNA sequence
cagaatctgagcagtttgag

SEQ ID NO: 788926 - DNA, 20 bp, Artificial
  CRISPR gRNA sequence
agaatctgagcagtttgagt

SEQ ID NO: 788927 - DNA, 20 bp, Artificial
  CRISPR gRNA sequence
tgagcagtttgagtaggctt

SEQ ID NO: 788928 - DNA, 20 bp, Artificial
  CRISPR gRNA sequence
agtttgagtaggctttagcc

SEQ ID NO: 788929 - DNA, 20 bp, Artificial
  CRISPR gRNA sequence
gtttgagtaggctttagcca

SEQ ID NO: 788930 - DNA, 20 bp, Artificial
  CRISPR gRNA sequence
tttgagtaggctttagccaa

SEQ ID NO: 788931 - DNA, 20 bp, Artificial
  CRISPR gRNA sequence
agtaggctttagccaagggc

SEQ ID NO: 788932 - DNA, 20 bp, Artificial
  CRISPR gRNA sequence
tatatgacctcttaaaccct

SEQ ID NO: 788933 - DNA, 20 bp, Artificial
  CRISPR gRNA sequence
aaaccctcagttttcttgtt

SEQ ID NO: 788934 - DNA, 20 bp, Artificial
  CRISPR gRNA sequence
aaccctcagttttcttgttt

SEQ ID NO: 788935 - DNA, 20 bp, Artificial
  CRISPR gRNA sequence
cagttttcttgtttaggaaa

SEQ ID NO: 788936 - DNA, 20 bp, Artificial
  CRISPR gRNA sequence
tcttgtttaggaaatggata

SEQ ID NO: 788937 - DNA, 20 bp, Artificial
  CRISPR gRNA sequence
cagcaatacttatccttaac

SEQ ID NO: 788938 - DNA, 20 bp, Artificial
  CRISPR gRNA sequence
agcaatacttatccttaaca

SEQ ID NO: 788939 - DNA, 20 bp, Artificial
  CRISPR gRNA sequence
gcaatacttatccttaacaa

SEQ ID NO: 788940 - DNA, 20 bp, Artificial
  CRISPR gRNA sequence
taacaagggtgttaaataat

SEQ ID NO: 788941 - DNA, 20 bp, Artificial
  CRISPR gRNA sequence
aagggtgttaaataattagt

SEQ ID NO: 788942 - DNA, 20 bp, Artificial
  CRISPR gRNA sequence
taaataattagttagatgtc

SEQ ID NO: 788943 - DNA, 20 bp, Artificial
  CRISPR gRNA sequence
ttagttagatgtctagaacg

SEQ ID NO: 788944 - DNA, 20 bp, Artificial
  CRISPR gRNA sequence
gaacgtagtaaacactcaat

SEQ ID NO: 788945 - DNA, 20 bp, Artificial
  CRISPR gRNA sequence
agtaaacactcaattagtgt

SEQ ID NO: 788946 - DNA, 20 bp, Artificial
  CRISPR gRNA sequence
attagtgttagcaattattg

SEQ ID NO: 788947 - DNA, 20 bp, Artificial
  CRISPR gRNA sequence
ttagtgttagcaattattgc

SEQ ID NO: 788948 - DNA, 20 bp, Artificial
  CRISPR gRNA sequence
ttctgatatttgaatataac

SEQ ID NO: 788949 - DNA, 20 bp, Artificial
  CRISPR gRNA sequence
tctgatatttgaatataact

SEQ ID NO: 788950 - DNA, 20 bp, Artificial
  CRISPR gRNA sequence
gatatttgaatataactggg

SEQ ID NO: 788951 - DNA, 20 bp, Artificial
  CRISPR gRNA sequence
ataactgggaagactccatc

SEQ ID NO: 788952 - DNA, 20 bp, Artificial
  CRISPR gRNA sequence
catctagtcttttcaaccct

SEQ ID NO: 788953 - DNA, 20 bp, Artificial
  CRISPR gRNA sequence
ctcctttaactatatctcac

SEQ ID NO: 788954 - DNA, 20 bp, Artificial
  CRISPR gRNA sequence
taactatatctcacaagata

SEQ ID NO: 788955 - DNA, 20 bp, Artificial
  CRISPR gRNA sequence
atctcacaagatacagtctt

SEQ ID NO: 788956 - DNA, 20 bp, Artificial
  CRISPR gRNA sequence
acagtcttcagacccatttc

SEQ ID NO: 788957 - DNA, 20 bp, Artificial
  CRISPR gRNA sequence
tcttcagacccatttccaga

SEQ ID NO: 788958 - DNA, 20 bp, Artificial
  CRISPR gRNA sequence
tcagacccatttccagatag

SEQ ID NO: 788959 - DNA, 20 bp, Artificial
  CRISPR gRNA sequence
catttccagatagtagtctt

SEQ ID NO: 788960 - DNA, 20 bp, Artificial
  CRISPR gRNA sequence
cagatagtagtctttggtta

SEQ ID NO: 788961 - DNA, 20 bp, Artificial
  CRISPR gRNA sequence
agtagtctttggttatagtt

SEQ ID NO: 788962 - DNA, 20 bp, Artificial
  CRISPR gRNA sequence
gttttgccacgttctttaaa

SEQ ID NO: 788963 - DNA, 20 bp, Artificial
  CRISPR gRNA sequence
ttttgccacgttctttaaaa

SEQ ID NO: 788964 - DNA, 20 bp, Artificial
  CRISPR gRNA sequence
atgtaacacaatctatattc

SEQ ID NO: 788965 - DNA, 20 bp, Artificial
  CRISPR gRNA sequence
ctatattctagatattatct

SEQ ID NO: 788966 - DNA, 20 bp, Artificial
  CRISPR gRNA sequence
tattctagatattatctaag

SEQ ID NO: 788967 - DNA, 20 bp, Artificial
  CRISPR gRNA sequence
atctaagcagcacaaatatc

SEQ ID NO: 788968 - DNA, 20 bp, Artificial
  CRISPR gRNA sequence
tctaagcagcacaaatatcc

SEQ ID NO: 788969 - DNA, 20 bp, Artificial
  CRISPR gRNA sequence
ctaagcagcacaaatatcca

SEQ ID NO: 788970 - DNA, 20 bp, Artificial
  CRISPR gRNA sequence
ccagggttttaatgtaacct

SEQ ID NO: 788971 - DNA, 20 bp, Artificial
  CRISPR gRNA sequence
cagggttttaatgtaaccta

SEQ ID NO: 788972 - DNA, 20 bp, Artificial
  CRISPR gRNA sequence
ttaatgtaacctaaggtcat

SEQ ID NO: 788973 - DNA, 20 bp, Artificial
  CRISPR gRNA sequence
gtaacctaaggtcataagat

SEQ ID NO: 788974 - DNA, 20 bp, Artificial
  CRISPR gRNA sequence
taaatatatgatctgctgct

SEQ ID NO: 788975 - DNA, 20 bp, Artificial
  CRISPR gRNA sequence
tatatgatctgctgctcagt

SEQ ID NO: 788976 - DNA, 20 bp, Artificial
  CRISPR gRNA sequence
atatgatctgctgctcagtt

SEQ ID NO: 788977 - DNA, 20 bp, Artificial
  CRISPR gRNA sequence
gatctgctgctcagttaggt

SEQ ID NO: 788978 - DNA, 20 bp, Artificial
  CRISPR gRNA sequence
tatccttacaacctgaataa

SEQ ID NO: 788979 - DNA, 20 bp, Artificial
  CRISPR gRNA sequence
aacctgaataacagacccct

SEQ ID NO: 788980 - DNA, 20 bp, Artificial
  CRISPR gRNA sequence
ataacagaccccttagcact

SEQ ID NO: 788981 - DNA, 20 bp, Artificial
  CRISPR gRNA sequence
aacagaccccttagcacttg

SEQ ID NO: 788982 - DNA, 20 bp, Artificial
  CRISPR gRNA sequence
agcacttggagattgtctcc

SEQ ID NO: 788983 - DNA, 20 bp, Artificial
  CRISPR gRNA sequence
agattgtctccaagttgact

SEQ ID NO: 788984 - DNA, 20 bp, Artificial
  CRISPR gRNA sequence
gattgtctccaagttgactg

SEQ ID NO: 788985 - DNA, 20 bp, Artificial
  CRISPR gRNA sequence
tccaagttgactgaggccat

SEQ ID NO: 788986 - DNA, 20 bp, Artificial
  CRISPR gRNA sequence
agttgactgaggccatcagc

SEQ ID NO: 788987 - DNA, 20 bp, Artificial
  CRISPR gRNA sequence
gtccctgactcaacaactac

SEQ ID NO: 788988 - DNA, 20 bp, Artificial
  CRISPR gRNA sequence
ctcaacaactactagctttt

SEQ ID NO: 788989 - DNA, 20 bp, Artificial
  CRISPR gRNA sequence
actagcttttcagtctgtta

SEQ ID NO: 788990 - DNA, 20 bp, Artificial
  CRISPR gRNA sequence
ttttcagtctgttatagatc

SEQ ID NO: 788991 - DNA, 20 bp, Artificial
  CRISPR gRNA sequence
ccttttaccacccaatacac

SEQ ID NO: 788992 - DNA, 20 bp, Artificial
  CRISPR gRNA sequence
cttttaccacccaatacaca

SEQ ID NO: 788993 - DNA, 20 bp, Artificial
  CRISPR gRNA sequence
tgtgtgtgctttgtgtgtcc

SEQ ID NO: 788994 - DNA, 20 bp, Artificial
  CRISPR gRNA sequence
gtgtgtgctttgtgtgtcct

SEQ ID NO: 788995 - DNA, 20 bp, Artificial
  CRISPR gRNA sequence
gtcctgggtctgtttgcctt

SEQ ID NO: 788996 - DNA, 20 bp, Artificial
  CRISPR gRNA sequence
ttcttctctgctctgtgttg

SEQ ID NO: 788997 - DNA, 20 bp, Artificial
  CRISPR gRNA sequence
tcttctctgctctgtgttgc

SEQ ID NO: 788998 - DNA, 20 bp, Artificial
  CRISPR gRNA sequence
tctctgctctgtgttgcagg

SEQ ID NO: 788999 - DNA, 20 bp, Artificial
  CRISPR gRNA sequence
ctctgctctgtgttgcagga

SEQ ID NO: 789000 - DNA, 20 bp, Artificial
  CRISPR gRNA sequence
tgctctgtgttgcaggaagg

SEQ ID NO: 789001 - DNA, 20 bp, Artificial
  CRISPR gRNA sequence
tgcaggaaggcagactcctg

SEQ ID NO: 789002 - DNA, 20 bp, Artificial
  CRISPR gRNA sequence
gcagactcctgtggcctgta

SEQ ID NO: 789003 - DNA, 20 bp, Artificial
  CRISPR gRNA sequence
ctcctgtggcctgtatagcc

SEQ ID NO: 789004 - DNA, 20 bp, Artificial
  CRISPR gRNA sequence
tcctgtggcctgtatagcct

SEQ ID NO: 789005 - DNA, 20 bp, Artificial
  CRISPR gRNA sequence
tgtatagcctaggaacgtga

SEQ ID NO: 789006 - DNA, 20 bp, Artificial
  CRISPR gRNA sequence
cctaggaacgtgacagccaa

SEQ ID NO: 789007 - DNA, 20 bp, Artificial
  CRISPR gRNA sequence
ctaggaacgtgacagccaat

SEQ ID NO: 789008 - DNA, 20 bp, Artificial
  CRISPR gRNA sequence
ggaacgtgacagccaatagg

SEQ ID NO: 789009 - DNA, 20 bp, Artificial
  CRISPR gRNA sequence
cgtgacagccaataggaagc

SEQ ID NO: 789010 - DNA, 20 bp, Artificial
  CRISPR gRNA sequence
acagccaataggaagcaaga

SEQ ID NO: 789011 - DNA, 20 bp, Artificial
  CRISPR gRNA sequence
cagccaataggaagcaagac

SEQ ID NO: 789012 - DNA, 20 bp, Artificial
  CRISPR gRNA sequence
aggaagcaagacaggaacac

SEQ ID NO: 789013 - DNA, 20 bp, Artificial
  CRISPR gRNA sequence
gaagcaagacaggaacacta

SEQ ID NO: 789014 - DNA, 20 bp, Artificial
  CRISPR gRNA sequence
aagcaagacaggaacactag

SEQ ID NO: 789015 - DNA, 20 bp, Artificial
  CRISPR gRNA sequence
agcaagacaggaacactaga

SEQ ID NO: 789016 - DNA, 20 bp, Artificial
  CRISPR gRNA sequence
aagacaggaacactagaggg

SEQ ID NO: 789017 - DNA, 20 bp, Artificial
  CRISPR gRNA sequence
aggaacactagagggtggac

SEQ ID NO: 789018 - DNA, 20 bp, Artificial
  CRISPR gRNA sequence
gaacactagagggtggactg

SEQ ID NO: 789019 - DNA, 20 bp, Artificial
  CRISPR gRNA sequence
aacactagagggtggactgg

SEQ ID NO: 789020 - DNA, 20 bp, Artificial
  CRISPR gRNA sequence
acactagagggtggactgga

SEQ ID NO: 789021 - DNA, 20 bp, Artificial
  CRISPR gRNA sequence
actagagggtggactggagg

SEQ ID NO: 789022 - DNA, 20 bp, Artificial
  CRISPR gRNA sequence
agagggtggactggagggag

SEQ ID NO: 789023 - DNA, 20 bp, Artificial
  CRISPR gRNA sequence
gagggtggactggagggaga

SEQ ID NO: 789024 - DNA, 20 bp, Artificial
  CRISPR gRNA sequence
agggtggactggagggagaa

SEQ ID NO: 789025 - DNA, 20 bp, Artificial
  CRISPR gRNA sequence
gtggactggagggagaaggg

SEQ ID NO: 789026 - DNA, 20 bp, Artificial
  CRISPR gRNA sequence
tggactggagggagaaggga

SEQ ID NO: 789027 - DNA, 20 bp, Artificial
  CRISPR gRNA sequence
ccctatgctctatacttttg

SEQ ID NO: 789028 - DNA, 20 bp, Artificial
  CRISPR gRNA sequence
ctatacttttgtggcctctc

SEQ ID NO: 789029 - DNA, 20 bp, Artificial
  CRISPR gRNA sequence
tacttttgtggcctctccag

SEQ ID NO: 789030 - DNA, 20 bp, Artificial
  CRISPR gRNA sequence
ttttgtggcctctccagcag

SEQ ID NO: 789031 - DNA, 20 bp, Artificial
  CRISPR gRNA sequence
cagaagatgtatctcttccc

SEQ ID NO: 789032 - DNA, 20 bp, Artificial
  CRISPR gRNA sequence
atgtatctcttccctggctc

SEQ ID NO: 789033 - DNA, 20 bp, Artificial
  CRISPR gRNA sequence
tccctggctccagataccaa

SEQ ID NO: 789034 - DNA, 20 bp, Artificial
  CRISPR gRNA sequence
tggctccagataccaatgga

SEQ ID NO: 789035 - DNA, 20 bp, Artificial
  CRISPR gRNA sequence
ggctccagataccaatggac

SEQ ID NO: 789036 - DNA, 20 bp, Artificial
  CRISPR gRNA sequence
ataccaatggacaggcccac

SEQ ID NO: 789037 - DNA, 20 bp, Artificial
  CRISPR gRNA sequence
taccaatggacaggcccact

SEQ ID NO: 789038 - DNA, 20 bp, Artificial
  CRISPR gRNA sequence
tggacaggcccactgggttc

SEQ ID NO: 789039 - DNA, 20 bp, Artificial
  CRISPR gRNA sequence
actgggttccagtgtctgtc

SEQ ID NO: 789040 - DNA, 20 bp, Artificial
  CRISPR gRNA sequence
tgtcaagtgactttaatccc

SEQ ID NO: 789041 - DNA, 20 bp, Artificial
  CRISPR gRNA sequence
gtcaagtgactttaatccct

SEQ ID NO: 789042 - DNA, 20 bp, Artificial
  CRISPR gRNA sequence
tgccttcccccttttcacta

SEQ ID NO: 789043 - DNA, 20 bp, Artificial
  CRISPR gRNA sequence
tcccccttttcactatagcc

SEQ ID NO: 789044 - DNA, 20 bp, Artificial
  CRISPR gRNA sequence
cccttttcactatagcctag

SEQ ID NO: 789045 - DNA, 20 bp, Artificial
  CRISPR gRNA sequence
ttttcactatagcctagtgg

SEQ ID NO: 789046 - DNA, 20 bp, Artificial
  CRISPR gRNA sequence
tttcactatagcctagtggt

SEQ ID NO: 789047 - DNA, 20 bp, Artificial
  CRISPR gRNA sequence
tcactatagcctagtggtag

SEQ ID NO: 789048 - DNA, 20 bp, Artificial
  CRISPR gRNA sequence
ctatagcctagtggtaggag

SEQ ID NO: 789049 - DNA, 20 bp, Artificial
  CRISPR gRNA sequence
ttgcttccctgttctctgtt

SEQ ID NO: 789050 - DNA, 20 bp, Artificial
  CRISPR gRNA sequence
ctgttctctgtttggcttct

SEQ ID NO: 789051 - DNA, 20 bp, Artificial
  CRISPR gRNA sequence
ttctcagtctccctcattaa

SEQ ID NO: 789052 - DNA, 20 bp, Artificial
  CRISPR gRNA sequence
tccctcattaaaagaattac

SEQ ID NO: 789053 - DNA, 20 bp, Artificial
  CRISPR gRNA sequence
attaaaagaattactagttt

SEQ ID NO: 789054 - DNA, 20 bp, Artificial
  CRISPR gRNA sequence
agaattactagtttcagctt

SEQ ID NO: 789055 - DNA, 20 bp, Artificial
  CRISPR gRNA sequence
gtttcagctttagatttcca

SEQ ID NO: 789056 - DNA, 20 bp, Artificial
  CRISPR gRNA sequence
tttcagctttagatttccac

SEQ ID NO: 789057 - DNA, 20 bp, Artificial
  CRISPR gRNA sequence
tagatttccacaggtttaaa

SEQ ID NO: 789058 - DNA, 20 bp, Artificial
  CRISPR gRNA sequence
ttaaatggtttctgtttccc

SEQ ID NO: 789059 - DNA, 20 bp, Artificial
  CRISPR gRNA sequence
tctgtttccctggtttgttc

SEQ ID NO: 789060 - DNA, 20 bp, Artificial
  CRISPR gRNA sequence
ggtttgttctggctgtctga

SEQ ID NO: 789061 - DNA, 20 bp, Artificial
  CRISPR gRNA sequence
ctgtctgacagatatgttac

SEQ ID NO: 789062 - DNA, 20 bp, Artificial
  CRISPR gRNA sequence
atgctgtaatttctgaaata

SEQ ID NO: 789063 - DNA, 20 bp, Artificial
  CRISPR gRNA sequence
ataaagatgaaatgtataca

SEQ ID NO: 789064 - DNA, 20 bp, Artificial
  CRISPR gRNA sequence
aagatgaaatgtatacatgg

SEQ ID NO: 789065 - DNA, 20 bp, Artificial
  CRISPR gRNA sequence
acatggtagtatctgtttta

SEQ ID NO: 789066 - DNA, 20 bp, Artificial
  CRISPR gRNA sequence
ctgttttatagtcataatga

SEQ ID NO: 789067 - DNA, 20 bp, Artificial
  CRISPR gRNA sequence
tcataatgacagtaaataaa

SEQ ID NO: 789068 - DNA, 20 bp, Artificial
  CRISPR gRNA sequence
agtaaataaatggaaaaatg

SEQ ID NO: 789069 - DNA, 20 bp, Artificial
  CRISPR gRNA sequence
aaatgtagttttacatgcct

SEQ ID NO: 789070 - DNA, 20 bp, Artificial
  CRISPR gRNA sequence
agttttacatgccttggtct

SEQ ID NO: 789071 - DNA, 20 bp, Artificial
  CRISPR gRNA sequence
ttttacatgccttggtctta

SEQ ID NO: 789072 - DNA, 20 bp, Artificial
  CRISPR gRNA sequence
tttacatgccttggtcttag

SEQ ID NO: 789073 - DNA, 20 bp, Artificial
  CRISPR gRNA sequence
tggtcttagaggatctatgc

SEQ ID NO: 789074 - DNA, 20 bp, Artificial
  CRISPR gRNA sequence
agaggatctatgcaagtttc

SEQ ID NO: 789075 - DNA, 20 bp, Artificial
  CRISPR gRNA sequence
ctatgcaagtttctagtaat

SEQ ID NO: 789076 - DNA, 20 bp, Artificial
  CRISPR gRNA sequence
tagtaatcagttaaatcttt

SEQ ID NO: 789077 - DNA, 20 bp, Artificial
  CRISPR gRNA sequence
agtaatcagttaaatctttt

SEQ ID NO: 789078 - DNA, 20 bp, Artificial
  CRISPR gRNA sequence
catctgttaaattgcctgaa

SEQ ID NO: 789079 - DNA, 20 bp, Artificial
  CRISPR gRNA sequence
atctgttaaattgcctgaaa

SEQ ID NO: 789080 - DNA, 20 bp, Artificial
  CRISPR gRNA sequence
ttaaattgcctgaaaaggaa

SEQ ID NO: 789081 - DNA, 20 bp, Artificial
  CRISPR gRNA sequence
aattgcctgaaaaggaatag

SEQ ID NO: 789082 - DNA, 20 bp, Artificial
  CRISPR gRNA sequence
attgcctgaaaaggaatagc

SEQ ID NO: 789083 - DNA, 20 bp, Artificial
  CRISPR gRNA sequence
aaaaggaatagcaggttaac

SEQ ID NO: 789084 - DNA, 20 bp, Artificial
  CRISPR gRNA sequence
gttaacgagtttgtaatccc

SEQ ID NO: 789085 - DNA, 20 bp, Artificial
  CRISPR gRNA sequence
ttaacgagtttgtaatcccc

SEQ ID NO: 789086 - DNA, 20 bp, Artificial
  CRISPR gRNA sequence
aacgagtttgtaatccccag

SEQ ID NO: 789087 - DNA, 20 bp, Artificial
  CRISPR gRNA sequence
ccccccaccccattgaaatt

SEQ ID NO: 789088 - DNA, 20 bp, Artificial
  CRISPR gRNA sequence
cccccaccccattgaaattc

SEQ ID NO: 789089 - DNA, 20 bp, Artificial
  CRISPR gRNA sequence
aaaacgtgttattttactcc

SEQ ID NO: 789090 - DNA, 20 bp, Artificial
  CRISPR gRNA sequence
aaacgtgttattttactcct

SEQ ID NO: 789091 - DNA, 20 bp, Artificial
  CRISPR gRNA sequence
tcctaggcttcccgctactg

SEQ ID NO: 789092 - DNA, 20 bp, Artificial
  CRISPR gRNA sequence
cctaggcttcccgctactgc

SEQ ID NO: 789093 - DNA, 20 bp, Artificial
  CRISPR gRNA sequence
aggcttcccgctactgcagg

SEQ ID NO: 789094 - DNA, 20 bp, Artificial
  CRISPR gRNA sequence
gcttcccgctactgcaggcg

SEQ ID NO: 789095 - DNA, 20 bp, Artificial
  CRISPR gRNA sequence
ccgctactgcaggcggagct

SEQ ID NO: 789096 - DNA, 20 bp, Artificial
  CRISPR gRNA sequence
cgctactgcaggcggagctc

SEQ ID NO: 789097 - DNA, 20 bp, Artificial
  CRISPR gRNA sequence
ttacacccttctgtttcccc

SEQ ID NO: 789098 - DNA, 20 bp, Artificial
  CRISPR gRNA sequence
tacacccttctgtttcccca

SEQ ID NO: 789099 - DNA, 20 bp, Artificial
  CRISPR gRNA sequence
acacccttctgtttccccaa

SEQ ID NO: 789100 - DNA, 20 bp, Artificial
  CRISPR gRNA sequence
ctgtttccccaagggaaaaa

SEQ ID NO: 789101 - DNA, 20 bp, Artificial
  CRISPR gRNA sequence
ccaagggaaaaaaagacact

SEQ ID NO: 789102 - DNA, 20 bp, Artificial
  CRISPR gRNA sequence
gaaaaaaagacactgagact

SEQ ID NO: 789103 - DNA, 20 bp, Artificial
  CRISPR gRNA sequence
acactgagacttggctcttt

SEQ ID NO: 789104 - DNA, 20 bp, Artificial
  CRISPR gRNA sequence
cttttagcaaatgctttcct

SEQ ID NO: 789105 - DNA, 20 bp, Artificial
  CRISPR gRNA sequence
ttttagcaaatgctttcctt

SEQ ID NO: 789106 - DNA, 20 bp, Artificial
  CRISPR gRNA sequence
caaatgctttccttgggcct

SEQ ID NO: 789107 - DNA, 20 bp, Artificial
  CRISPR gRNA sequence
aatgctttccttgggcctta

SEQ ID NO: 789108 - DNA, 20 bp, Artificial
  CRISPR gRNA sequence
atgctttccttgggccttag

SEQ ID NO: 789109 - DNA, 20 bp, Artificial
  CRISPR gRNA sequence
gccttagaggcttaaacgta

SEQ ID NO: 789110 - DNA, 20 bp, Artificial
  CRISPR gRNA sequence
ttgtttccttcctctgccct

SEQ ID NO: 789111 - DNA, 20 bp, Artificial
  CRISPR gRNA sequence
gcccttggtttcttccttct

SEQ ID NO: 789112 - DNA, 20 bp, Artificial
  CRISPR gRNA sequence
cccttggtttcttccttctt

SEQ ID NO: 789113 - DNA, 20 bp, Artificial
  CRISPR gRNA sequence
ccttggtttcttccttctta

SEQ ID NO: 789114 - DNA, 20 bp, Artificial
  CRISPR gRNA sequence
gtttcttccttcttagggtg

SEQ ID NO: 789115 - DNA, 20 bp, Artificial
  CRISPR gRNA sequence
tttcttccttcttagggtga

SEQ ID NO: 789116 - DNA, 20 bp, Artificial
  CRISPR gRNA sequence
tttttttttttttttttttt

SEQ ID NO: 789117 - DNA, 20 bp, Artificial
  CRISPR gRNA sequence
ttttttttttttttttgaga

SEQ ID NO: 789118 - DNA, 20 bp, Artificial
  CRISPR gRNA sequence
ttttttttttttttgagacg

SEQ ID NO: 789119 - DNA, 20 bp, Artificial
  CRISPR gRNA sequence
cggagtctcgctctgtcgcc

SEQ ID NO: 789120 - DNA, 20 bp, Artificial
  CRISPR gRNA sequence
ggagtctcgctctgtcgccc

SEQ ID NO: 789121 - DNA, 20 bp, Artificial
  CRISPR gRNA sequence
tctcgctctgtcgcccaggc

SEQ ID NO: 789122 - DNA, 20 bp, Artificial
  CRISPR gRNA sequence
tcgctctgtcgcccaggctg

SEQ ID NO: 789123 - DNA, 20 bp, Artificial
  CRISPR gRNA sequence
ctgtcgcccaggctggagtg

SEQ ID NO: 789124 - DNA, 20 bp, Artificial
  CRISPR gRNA sequence
tcgcccaggctggagtgcag

SEQ ID NO: 789125 - DNA, 20 bp, Artificial
  CRISPR gRNA sequence
tcattgcaaaatccgcctcc

SEQ ID NO: 789126 - DNA, 20 bp, Artificial
  CRISPR gRNA sequence
cattgcaaaatccgcctccc

SEQ ID NO: 789127 - DNA, 20 bp, Artificial
  CRISPR gRNA sequence
ttcctgccattctcctgcct

SEQ ID NO: 789128 - DNA, 20 bp, Artificial
  CRISPR gRNA sequence
ttctcctgcctcagcctccc

SEQ ID NO: 789129 - DNA, 20 bp, Artificial
  CRISPR gRNA sequence
tcctgcctcagcctcccgag

SEQ ID NO: 789130 - DNA, 20 bp, Artificial
  CRISPR gRNA sequence
ctcccgagtagctgcgactg

SEQ ID NO: 789131 - DNA, 20 bp, Artificial
  CRISPR gRNA sequence
tcccgagtagctgcgactgc

SEQ ID NO: 789132 - DNA, 20 bp, Artificial
  CRISPR gRNA sequence
caggtgcctgccaccacgcc

SEQ ID NO: 789133 - DNA, 20 bp, Artificial
  CRISPR gRNA sequence
cggctaattttttgtatttt

SEQ ID NO: 789134 - DNA, 20 bp, Artificial
  CRISPR gRNA sequence
ctaattttttgtatttttag

SEQ ID NO: 789135 - DNA, 20 bp, Artificial
  CRISPR gRNA sequence
aattttttgtatttttagta

SEQ ID NO: 789136 - DNA, 20 bp, Artificial
  CRISPR gRNA sequence
ttttgtatttttagtagaga

SEQ ID NO: 789137 - DNA, 20 bp, Artificial
  CRISPR gRNA sequence
tttgtatttttagtagagac

SEQ ID NO: 789138 - DNA, 20 bp, Artificial
  CRISPR gRNA sequence
ttgtatttttagtagagacg

SEQ ID NO: 789139 - DNA, 20 bp, Artificial
  CRISPR gRNA sequence
gagacggggtttcaccgtgt

SEQ ID NO: 789140 - DNA, 20 bp, Artificial
  CRISPR gRNA sequence
cggggtttcaccgtgttagc

SEQ ID NO: 789141 - DNA, 20 bp, Artificial
  CRISPR gRNA sequence
ggggtttcaccgtgttagcc

SEQ ID NO: 789142 - DNA, 20 bp, Artificial
  CRISPR gRNA sequence
acctcgtgatctgcccacct

SEQ ID NO: 789143 - DNA, 20 bp, Artificial
  CRISPR gRNA sequence
ctgcccacctcggcctccca

SEQ ID NO: 789144 - DNA, 20 bp, Artificial
  CRISPR gRNA sequence
acctcggcctcccaaagtgc

SEQ ID NO: 789145 - DNA, 20 bp, Artificial
  CRISPR gRNA sequence
cctcggcctcccaaagtgct

SEQ ID NO: 789146 - DNA, 20 bp, Artificial
  CRISPR gRNA sequence
ctcccaaagtgctgggatta

SEQ ID NO: 789147 - DNA, 20 bp, Artificial
  CRISPR gRNA sequence
tcccaaagtgctgggattac

SEQ ID NO: 789148 - DNA, 20 bp, Artificial
  CRISPR gRNA sequence
agtgctgggattacaggtgt

SEQ ID NO: 789149 - DNA, 20 bp, Artificial
  CRISPR gRNA sequence
caggtgtgagcaaccacgcc

SEQ ID NO: 789150 - DNA, 20 bp, Artificial
  CRISPR gRNA sequence
aaccacgcctggcccaaatg

SEQ ID NO: 789151 - DNA, 20 bp, Artificial
  CRISPR gRNA sequence
ccacgcctggcccaaatgtg

SEQ ID NO: 789152 - DNA, 20 bp, Artificial
  CRISPR gRNA sequence
ccccaaccatcctttcccct

SEQ ID NO: 789153 - DNA, 20 bp, Artificial
  CRISPR gRNA sequence
tcctttcccctaagtcctga

SEQ ID NO: 789154 - DNA, 20 bp, Artificial
  CRISPR gRNA sequence
cttatgcctttccatcctca

SEQ ID NO: 789155 - DNA, 20 bp, Artificial
  CRISPR gRNA sequence
gcctttccatcctcatagct

SEQ ID NO: 789156 - DNA, 20 bp, Artificial
  CRISPR gRNA sequence
atagcttagctcgcacttat

SEQ ID NO: 789157 - DNA, 20 bp, Artificial
  CRISPR gRNA sequence
cttagctcgcacttatgagt

SEQ ID NO: 789158 - DNA, 20 bp, Artificial
  CRISPR gRNA sequence
tagctcgcacttatgagtga

SEQ ID NO: 789159 - DNA, 20 bp, Artificial
  CRISPR gRNA sequence
gagtgagagcatacaatgtt

SEQ ID NO: 789160 - DNA, 20 bp, Artificial
  CRISPR gRNA sequence
atgtttggttttacattcct

SEQ ID NO: 789161 - DNA, 20 bp, Artificial
  CRISPR gRNA sequence
cattcctgagttacttcact

SEQ ID NO: 789162 - DNA, 20 bp, Artificial
  CRISPR gRNA sequence
agttacttcacttagaataa

SEQ ID NO: 789163 - DNA, 20 bp, Artificial
  CRISPR gRNA sequence
taatagtctctaattccatc

SEQ ID NO: 789164 - DNA, 20 bp, Artificial
  CRISPR gRNA sequence
aatagtctctaattccatcc

SEQ ID NO: 789165 - DNA, 20 bp, Artificial
  CRISPR gRNA sequence
tatgatttcattccttttca

SEQ ID NO: 789166 - DNA, 20 bp, Artificial
  CRISPR gRNA sequence
tttcattccttttcatagct

SEQ ID NO: 789167 - DNA, 20 bp, Artificial
  CRISPR gRNA sequence
cattccttttcatagctaag

SEQ ID NO: 789168 - DNA, 20 bp, Artificial
  CRISPR gRNA sequence
catagctaagtagtattcca

SEQ ID NO: 789169 - DNA, 20 bp, Artificial
  CRISPR gRNA sequence
tttatccactcactgattga

SEQ ID NO: 789170 - DNA, 20 bp, Artificial
  CRISPR gRNA sequence
ttatccactcactgattgat

SEQ ID NO: 789171 - DNA, 20 bp, Artificial
  CRISPR gRNA sequence
ctcactgattgatgggcatt

SEQ ID NO: 789172 - DNA, 20 bp, Artificial
  CRISPR gRNA sequence
tcactgattgatgggcattt

SEQ ID NO: 789173 - DNA, 20 bp, Artificial
  CRISPR gRNA sequence
tgattgatgggcatttgggc

SEQ ID NO: 789174 - DNA, 20 bp, Artificial
  CRISPR gRNA sequence
tgctataaaaatgcgtgtgc

SEQ ID NO: 789175 - DNA, 20 bp, Artificial
  CRISPR gRNA sequence
tataatgacttcttttcctt

SEQ ID NO: 789176 - DNA, 20 bp, Artificial
  CRISPR gRNA sequence
ataatgacttcttttccttt

SEQ ID NO: 789177 - DNA, 20 bp, Artificial
  CRISPR gRNA sequence
ttttcctttgggtaaatacc

SEQ ID NO: 789178 - DNA, 20 bp, Artificial
  CRISPR gRNA sequence
tcctttgggtaaatacctag

SEQ ID NO: 789179 - DNA, 20 bp, Artificial
  CRISPR gRNA sequence
tttgggtaaatacctagtag

SEQ ID NO: 789180 - DNA, 20 bp, Artificial
  CRISPR gRNA sequence
ttgggtaaatacctagtagt

SEQ ID NO: 789181 - DNA, 20 bp, Artificial
  CRISPR gRNA sequence
atacctagtagtgggattgc

SEQ ID NO: 789182 - DNA, 20 bp, Artificial
  CRISPR gRNA sequence
agtgggattgctggatcaaa

SEQ ID NO: 789183 - DNA, 20 bp, Artificial
  CRISPR gRNA sequence
gggattgctggatcaaatgg

SEQ ID NO: 789184 - DNA, 20 bp, Artificial
  CRISPR gRNA sequence
tcaaatggtagatctacttt

SEQ ID NO: 789185 - DNA, 20 bp, Artificial
  CRISPR gRNA sequence
agatctacttttagttttta

SEQ ID NO: 789186 - DNA, 20 bp, Artificial
  CRISPR gRNA sequence
gatctacttttagtttttaa

SEQ ID NO: 789187 - DNA, 20 bp, Artificial
  CRISPR gRNA sequence
aatctccacactgttttcca

SEQ ID NO: 789188 - DNA, 20 bp, Artificial
  CRISPR gRNA sequence
ctccacactgttttccatag

SEQ ID NO: 789189 - DNA, 20 bp, Artificial
  CRISPR gRNA sequence
gttttccatagtggttgtac

SEQ ID NO: 789190 - DNA, 20 bp, Artificial
  CRISPR gRNA sequence
ctagtttacattcccaccaa

SEQ ID NO: 789191 - DNA, 20 bp, Artificial
  CRISPR gRNA sequence
tacattcccaccaacagtgt

SEQ ID NO: 789192 - DNA, 20 bp, Artificial
  CRISPR gRNA sequence
cattcccaccaacagtgtaa

SEQ ID NO: 789193 - DNA, 20 bp, Artificial
  CRISPR gRNA sequence
catctattatttttttgtta

SEQ ID NO: 789194 - DNA, 20 bp, Artificial
  CRISPR gRNA sequence
ttttgttatggccattcttg

SEQ ID NO: 789195 - DNA, 20 bp, Artificial
  CRISPR gRNA sequence
tttgttatggccattcttgc

SEQ ID NO: 789196 - DNA, 20 bp, Artificial
  CRISPR gRNA sequence
tgttatggccattcttgcag

SEQ ID NO: 789197 - DNA, 20 bp, Artificial
  CRISPR gRNA sequence
atggccattcttgcaggagt

SEQ ID NO: 789198 - DNA, 20 bp, Artificial
  CRISPR gRNA sequence
tggccattcttgcaggagta

SEQ ID NO: 789199 - DNA, 20 bp, Artificial
  CRISPR gRNA sequence
ccattcttgcaggagtaagg

SEQ ID NO: 789200 - DNA, 20 bp, Artificial
  CRISPR gRNA sequence
gcaggagtaaggtggtatcg

SEQ ID NO: 789201 - DNA, 20 bp, Artificial
  CRISPR gRNA sequence
agtaaggtggtatcgcagtg

SEQ ID NO: 789202 - DNA, 20 bp, Artificial
  CRISPR gRNA sequence
gttttgatttgcatttccct

SEQ ID NO: 789203 - DNA, 20 bp, Artificial
  CRISPR gRNA sequence
atttgcatttccctgagaat

SEQ ID NO: 789204 - DNA, 20 bp, Artificial
  CRISPR gRNA sequence
ccctgagaattagtgatgtt

SEQ ID NO: 789205 - DNA, 20 bp, Artificial
  CRISPR gRNA sequence
gcatttttccatatgctcgt

SEQ ID NO: 789206 - DNA, 20 bp, Artificial
  CRISPR gRNA sequence
tcatttgtgtatctccttgt

SEQ ID NO: 789207 - DNA, 20 bp, Artificial
  CRISPR gRNA sequence
gaattgtctattcatgtcct

SEQ ID NO: 789208 - DNA, 20 bp, Artificial
  CRISPR gRNA sequence
gtccttagcccattttttga

SEQ ID NO: 789209 - DNA, 20 bp, Artificial
  CRISPR gRNA sequence
tccttagcccattttttgat

SEQ ID NO: 789210 - DNA, 20 bp, Artificial
  CRISPR gRNA sequence
tgatttatttgcataccttg

SEQ ID NO: 789211 - DNA, 20 bp, Artificial
  CRISPR gRNA sequence
tttgcataccttgtagattc

SEQ ID NO: 789212 - DNA, 20 bp, Artificial
  CRISPR gRNA sequence
accttgtagattctggatat

SEQ ID NO: 789213 - DNA, 20 bp, Artificial
  CRISPR gRNA sequence
tctggatattagtcctttgt

SEQ ID NO: 789214 - DNA, 20 bp, Artificial
  CRISPR gRNA sequence
ttagtcctttgtcagatgta

SEQ ID NO: 789215 - DNA, 20 bp, Artificial
  CRISPR gRNA sequence
tgtcagatgtatagattgtg

SEQ ID NO: 789216 - DNA, 20 bp, Artificial
  CRISPR gRNA sequence
gaagattttctcccactctg

SEQ ID NO: 789217 - DNA, 20 bp, Artificial
  CRISPR gRNA sequence
aagattttctcccactctgt

SEQ ID NO: 789218 - DNA, 20 bp, Artificial
  CRISPR gRNA sequence
tgattatttcttttgctgtg

SEQ ID NO: 789219 - DNA, 20 bp, Artificial
  CRISPR gRNA sequence
ttatttcttttgctgtgcag

SEQ ID NO: 789220 - DNA, 20 bp, Artificial
  CRISPR gRNA sequence
tttgctgtgcagaagctttt

SEQ ID NO: 789221 - DNA, 20 bp, Artificial
  CRISPR gRNA sequence
agaagctttttagtttaatt

SEQ ID NO: 789222 - DNA, 20 bp, Artificial
  CRISPR gRNA sequence
gtctttgttgcatttgcttt

SEQ ID NO: 789223 - DNA, 20 bp, Artificial
  CRISPR gRNA sequence
tctttgttgcatttgctttt

SEQ ID NO: 789224 - DNA, 20 bp, Artificial
  CRISPR gRNA sequence
tgcatttgcttttgggttct

SEQ ID NO: 789225 - DNA, 20 bp, Artificial
  CRISPR gRNA sequence
cttttgggttcttggtcacg

SEQ ID NO: 789226 - DNA, 20 bp, Artificial
  CRISPR gRNA sequence
tggtcacgaagtctttgcct

SEQ ID NO: 789227 - DNA, 20 bp, Artificial
  CRISPR gRNA sequence
tctttgcctaagctaatgtc

SEQ ID NO: 789228 - DNA, 20 bp, Artificial
  CRISPR gRNA sequence
ttgcctaagctaatgtctag

SEQ ID NO: 789229 - DNA, 20 bp, Artificial
  CRISPR gRNA sequence
tgcctaagctaatgtctaga

SEQ ID NO: 789230 - DNA, 20 bp, Artificial
  CRISPR gRNA sequence
gcctaagctaatgtctagaa

SEQ ID NO: 789231 - DNA, 20 bp, Artificial
  CRISPR gRNA sequence
gctttttcgatgttatcttc

SEQ ID NO: 789232 - DNA, 20 bp, Artificial
  CRISPR gRNA sequence
gttatcttctagaatcgtta

SEQ ID NO: 789233 - DNA, 20 bp, Artificial
  CRISPR gRNA sequence
ttctagaatcgttatggttt

SEQ ID NO: 789234 - DNA, 20 bp, Artificial
  CRISPR gRNA sequence
tctagaatcgttatggtttc

SEQ ID NO: 789235 - DNA, 20 bp, Artificial
  CRISPR gRNA sequence
atcgttatggtttcaggtct

SEQ ID NO: 789236 - DNA, 20 bp, Artificial
  CRISPR gRNA sequence
tggtttcaggtcttagattt

SEQ ID NO: 789237 - DNA, 20 bp, Artificial
  CRISPR gRNA sequence
ttaagtctttgatccatctt

SEQ ID NO: 789238 - DNA, 20 bp, Artificial
  CRISPR gRNA sequence
atcttgagttgattttttat

SEQ ID NO: 789239 - DNA, 20 bp, Artificial
  CRISPR gRNA sequence
tcttgagttgattttttata

SEQ ID NO: 789240 - DNA, 20 bp, Artificial
  CRISPR gRNA sequence
gagttgattttttataaggt

SEQ ID NO: 789241 - DNA, 20 bp, Artificial
  CRISPR gRNA sequence
ttttttataaggtaagatat

SEQ ID NO: 789242 - DNA, 20 bp, Artificial
  CRISPR gRNA sequence
tttttataaggtaagatatg

SEQ ID NO: 789243 - DNA, 20 bp, Artificial
  CRISPR gRNA sequence
taaggtaagatatgaggatc

SEQ ID NO: 789244 - DNA, 20 bp, Artificial
  CRISPR gRNA sequence
ccagtttattcttctccatg

SEQ ID NO: 789245 - DNA, 20 bp, Artificial
  CRISPR gRNA sequence
tttattcttctccatgtggc

SEQ ID NO: 789246 - DNA, 20 bp, Artificial
  CRISPR gRNA sequence
atgtggctagccaattatcc

SEQ ID NO: 789247 - DNA, 20 bp, Artificial
  CRISPR gRNA sequence
tcccagcaccgtttgttgaa

SEQ ID NO: 789248 - DNA, 20 bp, Artificial
  CRISPR gRNA sequence
cccagcaccgtttgttgaat

SEQ ID NO: 789249 - DNA, 20 bp, Artificial
  CRISPR gRNA sequence
tgtttttgtttgctttgtca

SEQ ID NO: 789250 - DNA, 20 bp, Artificial
  CRISPR gRNA sequence
ttgtttgctttgtcaaagat

SEQ ID NO: 789251 - DNA, 20 bp, Artificial
  CRISPR gRNA sequence
ttgctttgtcaaagatcagt

SEQ ID NO: 789252 - DNA, 20 bp, Artificial
  CRISPR gRNA sequence
gtcaaagatcagttggctat

SEQ ID NO: 789253 - DNA, 20 bp, Artificial
  CRISPR gRNA sequence
atcagttggctataagtatt

SEQ ID NO: 789254 - DNA, 20 bp, Artificial
  CRISPR gRNA sequence
taagtatttggctttattcc

SEQ ID NO: 789255 - DNA, 20 bp, Artificial
  CRISPR gRNA sequence
aagtatttggctttattcct

SEQ ID NO: 789256 - DNA, 20 bp, Artificial
  CRISPR gRNA sequence
ggttctccgttttgttccat

SEQ ID NO: 789257 - DNA, 20 bp, Artificial
  CRISPR gRNA sequence
ctatgtgcctatttttatac

SEQ ID NO: 789258 - DNA, 20 bp, Artificial
  CRISPR gRNA sequence
atactagtattatgctgttt

SEQ ID NO: 789259 - DNA, 20 bp, Artificial
  CRISPR gRNA sequence
ttatgctgttttggtgacta

SEQ ID NO: 789260 - DNA, 20 bp, Artificial
  CRISPR gRNA sequence
ttttggtgactatggtgtta

SEQ ID NO: 789261 - DNA, 20 bp, Artificial
  CRISPR gRNA sequence
gtgactatggtgttatagta

SEQ ID NO: 789262 - DNA, 20 bp, Artificial
  CRISPR gRNA sequence
tggtgttatagtatggtttg

SEQ ID NO: 789263 - DNA, 20 bp, Artificial
  CRISPR gRNA sequence
gttatagtatggtttgaagt

SEQ ID NO: 789264 - DNA, 20 bp, Artificial
  CRISPR gRNA sequence
ttatagtatggtttgaagtt

SEQ ID NO: 789265 - DNA, 20 bp, Artificial
  CRISPR gRNA sequence
gttaggcaatgtgatgcctc

SEQ ID NO: 789266 - DNA, 20 bp, Artificial
  CRISPR gRNA sequence
ttaggcaatgtgatgcctcc

SEQ ID NO: 789267 - DNA, 20 bp, Artificial
  CRISPR gRNA sequence
ccaggtttgttctttttgct

SEQ ID NO: 789268 - DNA, 20 bp, Artificial
  CRISPR gRNA sequence
ttgcttagtcttccttgctt

SEQ ID NO: 789269 - DNA, 20 bp, Artificial
  CRISPR gRNA sequence
tcttccttgctttggctatg

SEQ ID NO: 789270 - DNA, 20 bp, Artificial
  CRISPR gRNA sequence
cttccttgctttggctatgt

SEQ ID NO: 789271 - DNA, 20 bp, Artificial
  CRISPR gRNA sequence
tggctatgtgggctcttttt

SEQ ID NO: 789272 - DNA, 20 bp, Artificial
  CRISPR gRNA sequence
ttttggttccatatgaattt

SEQ ID NO: 789273 - DNA, 20 bp, Artificial
  CRISPR gRNA sequence
tttggttccatatgaatttt

SEQ ID NO: 789274 - DNA, 20 bp, Artificial
  CRISPR gRNA sequence
tttctttttctacttttgtg

SEQ ID NO: 789275 - DNA, 20 bp, Artificial
  CRISPR gRNA sequence
tctacttttgtgaagaatga

SEQ ID NO: 789276 - DNA, 20 bp, Artificial
  CRISPR gRNA sequence
acttttgtgaagaatgatgg

SEQ ID NO: 789277 - DNA, 20 bp, Artificial
  CRISPR gRNA sequence
gaatgatggtagtattttga

SEQ ID NO: 789278 - DNA, 20 bp, Artificial
  CRISPR gRNA sequence
aatgatggtagtattttgat

SEQ ID NO: 789279 - DNA, 20 bp, Artificial
  CRISPR gRNA sequence
atgatggtagtattttgatg

SEQ ID NO: 789280 - DNA, 20 bp, Artificial
  CRISPR gRNA sequence
tggggattgcattgactttg

SEQ ID NO: 789281 - DNA, 20 bp, Artificial
  CRISPR gRNA sequence
gattgcttttgcaatctaca

SEQ ID NO: 789282 - DNA, 20 bp, Artificial
  CRISPR gRNA sequence
cttttgcaatctacaaagta

SEQ ID NO: 789283 - DNA, 20 bp, Artificial
  CRISPR gRNA sequence
attgtacctattcatgaaca

SEQ ID NO: 789284 - DNA, 20 bp, Artificial
  CRISPR gRNA sequence
ttgtacctattcatgaacat

SEQ ID NO: 789285 - DNA, 20 bp, Artificial
  CRISPR gRNA sequence
gtgtcatctgtgatttcttt

SEQ ID NO: 789286 - DNA, 20 bp, Artificial
  CRISPR gRNA sequence
tcatctgtgatttctttcag

SEQ ID NO: 789287 - DNA, 20 bp, Artificial
  CRISPR gRNA sequence
tttctttcagtagtgatttg

SEQ ID NO: 789288 - DNA, 20 bp, Artificial
  CRISPR gRNA sequence
gtgatttgtagttttccttg

SEQ ID NO: 789289 - DNA, 20 bp, Artificial
  CRISPR gRNA sequence
gatttgtagttttccttgta

SEQ ID NO: 789290 - DNA, 20 bp, Artificial
  CRISPR gRNA sequence
atttgtagttttccttgtag

SEQ ID NO: 789291 - DNA, 20 bp, Artificial
  CRISPR gRNA sequence
aggtctttcatgtccttcgt

SEQ ID NO: 789292 - DNA, 20 bp, Artificial
  CRISPR gRNA sequence
ggtctttcatgtccttcgtt

SEQ ID NO: 789293 - DNA, 20 bp, Artificial
  CRISPR gRNA sequence
ccttcgttaggtatattcct

SEQ ID NO: 789294 - DNA, 20 bp, Artificial
  CRISPR gRNA sequence
agtattttattttatttttg

SEQ ID NO: 789295 - DNA, 20 bp, Artificial
  CRISPR gRNA sequence
tattttatttttgcagctat

SEQ ID NO: 789296 - DNA, 20 bp, Artificial
  CRISPR gRNA sequence
ttgcagctattggttgatgt

SEQ ID NO: 789297 - DNA, 20 bp, Artificial
  CRISPR gRNA sequence
tattggttgatgttggtgta

SEQ ID NO: 789298 - DNA, 20 bp, Artificial
  CRISPR gRNA sequence
tggttgatgttggtgtatag

SEQ ID NO: 789299 - DNA, 20 bp, Artificial
  CRISPR gRNA sequence
gttgatgttggtgtatagca

SEQ ID NO: 789300 - DNA, 20 bp, Artificial
  CRISPR gRNA sequence
actttgctgaatttgtttac

SEQ ID NO: 789301 - DNA, 20 bp, Artificial
  CRISPR gRNA sequence
ctgaatttgtttaccagttc

SEQ ID NO: 789302 - DNA, 20 bp, Artificial
  CRISPR gRNA sequence
tgaatttgtttaccagttct

SEQ ID NO: 789303 - DNA, 20 bp, Artificial
  CRISPR gRNA sequence
aatttgtttaccagttctag

SEQ ID NO: 789304 - DNA, 20 bp, Artificial
  CRISPR gRNA sequence
taccagttctaggagctttc

SEQ ID NO: 789305 - DNA, 20 bp, Artificial
  CRISPR gRNA sequence
gagctttcaagatgaatcct

SEQ ID NO: 789306 - DNA, 20 bp, Artificial
  CRISPR gRNA sequence
agctttcaagatgaatcctt

SEQ ID NO: 789307 - DNA, 20 bp, Artificial
  CRISPR gRNA sequence
gctttcaagatgaatcctta

SEQ ID NO: 789308 - DNA, 20 bp, Artificial
  CRISPR gRNA sequence
gatgaatccttagggttttc

SEQ ID NO: 789309 - DNA, 20 bp, Artificial
  CRISPR gRNA sequence
atgaatccttagggttttct

SEQ ID NO: 789310 - DNA, 20 bp, Artificial
  CRISPR gRNA sequence
taggtatatgatcatatcat

SEQ ID NO: 789311 - DNA, 20 bp, Artificial
  CRISPR gRNA sequence
atgatcatatcatcagcaaa

SEQ ID NO: 789312 - DNA, 20 bp, Artificial
  CRISPR gRNA sequence
atatcatcagcaaacagcaa

SEQ ID NO: 789313 - DNA, 20 bp, Artificial
  CRISPR gRNA sequence
tgacttcctctttaccaatt

SEQ ID NO: 789314 - DNA, 20 bp, Artificial
  CRISPR gRNA sequence
ccctttatttctttctcttt

SEQ ID NO: 789315 - DNA, 20 bp, Artificial
  CRISPR gRNA sequence
ttctttctctttgagtgctc

SEQ ID NO: 789316 - DNA, 20 bp, Artificial
  CRISPR gRNA sequence
ttctctttgagtgctctggc

SEQ ID NO: 789317 - DNA, 20 bp, Artificial
  CRISPR gRNA sequence
tctctttgagtgctctggcc

SEQ ID NO: 789318 - DNA, 20 bp, Artificial
  CRISPR gRNA sequence
agtgctctggccaggacttc

SEQ ID NO: 789319 - DNA, 20 bp, Artificial
  CRISPR gRNA sequence
tccagtactatgctgaataa

SEQ ID NO: 789320 - DNA, 20 bp, Artificial
  CRISPR gRNA sequence
agtactatgctgaataaaag

SEQ ID NO: 789321 - DNA, 20 bp, Artificial
  CRISPR gRNA sequence
atgctgaataaaagtggtga

SEQ ID NO: 789322 - DNA, 20 bp, Artificial
  CRISPR gRNA sequence
tcttgtcttgttccaattct

SEQ ID NO: 789323 - DNA, 20 bp, Artificial
  CRISPR gRNA sequence
cttgtcttgttccaattctc

SEQ ID NO: 789324 - DNA, 20 bp, Artificial
  CRISPR gRNA sequence
ttgtcttgttccaattctca

SEQ ID NO: 789325 - DNA, 20 bp, Artificial
  CRISPR gRNA sequence
gctttcaacttttccccatt

SEQ ID NO: 789326 - DNA, 20 bp, Artificial
  CRISPR gRNA sequence
ttccccattcagcataatgt

SEQ ID NO: 789327 - DNA, 20 bp, Artificial
  CRISPR gRNA sequence
attcagcataatgttggctg

SEQ ID NO: 789328 - DNA, 20 bp, Artificial
  CRISPR gRNA sequence
ttcagcataatgttggctgt

SEQ ID NO: 789329 - DNA, 20 bp, Artificial
  CRISPR gRNA sequence
tgttggctgtgggtttgtcg

SEQ ID NO: 789330 - DNA, 20 bp, Artificial
  CRISPR gRNA sequence
ggctgtgggtttgtcgtagt

SEQ ID NO: 789331 - DNA, 20 bp, Artificial
  CRISPR gRNA sequence
tagttagcttttattacctt

SEQ ID NO: 789332 - DNA, 20 bp, Artificial
  CRISPR gRNA sequence
ccttctgtgctaattttgct

SEQ ID NO: 789333 - DNA, 20 bp, Artificial
  CRISPR gRNA sequence
cttctgtgctaattttgctg

SEQ ID NO: 789334 - DNA, 20 bp, Artificial
  CRISPR gRNA sequence
ttctgtgctaattttgctga

SEQ ID NO: 789335 - DNA, 20 bp, Artificial
  CRISPR gRNA sequence
tgctgagggttttaatcata

SEQ ID NO: 789336 - DNA, 20 bp, Artificial
  CRISPR gRNA sequence
gctgagggttttaatcataa

SEQ ID NO: 789337 - DNA, 20 bp, Artificial
  CRISPR gRNA sequence
gttttaatcataaaggatgt

SEQ ID NO: 789338 - DNA, 20 bp, Artificial
  CRISPR gRNA sequence
atgctttttctgaatctatt

SEQ ID NO: 789339 - DNA, 20 bp, Artificial
  CRISPR gRNA sequence
tgtttttaattctgtttgtg

SEQ ID NO: 789340 - DNA, 20 bp, Artificial
  CRISPR gRNA sequence
gtatcacatttattaacttg

SEQ ID NO: 789341 - DNA, 20 bp, Artificial
  CRISPR gRNA sequence
ttaaaccatccctgcatccc

SEQ ID NO: 789342 - DNA, 20 bp, Artificial
  CRISPR gRNA sequence
gtgtaaaacccacttgatca

SEQ ID NO: 789343 - DNA, 20 bp, Artificial
  CRISPR gRNA sequence
taaaacccacttgatcatgg

SEQ ID NO: 789344 - DNA, 20 bp, Artificial
  CRISPR gRNA sequence
ttatctttttgatatgctgt

SEQ ID NO: 789345 - DNA, 20 bp, Artificial
  CRISPR gRNA sequence
ttttgatatgctgttggatt

SEQ ID NO: 789346 - DNA, 20 bp, Artificial
  CRISPR gRNA sequence
gatatgctgttggatttggt

SEQ ID NO: 789347 - DNA, 20 bp, Artificial
  CRISPR gRNA sequence
tgctgttggatttggttagc

SEQ ID NO: 789348 - DNA, 20 bp, Artificial
  CRISPR gRNA sequence
tggttagctagtattttgtt

SEQ ID NO: 789349 - DNA, 20 bp, Artificial
  CRISPR gRNA sequence
ggttagctagtattttgttg

SEQ ID NO: 789350 - DNA, 20 bp, Artificial
  CRISPR gRNA sequence
atttttacatctatgttcat

SEQ ID NO: 789351 - DNA, 20 bp, Artificial
  CRISPR gRNA sequence
tttttacatctatgttcatc

SEQ ID NO: 789352 - DNA, 20 bp, Artificial
  CRISPR gRNA sequence
ttttacatctatgttcatca

SEQ ID NO: 789353 - DNA, 20 bp, Artificial
  CRISPR gRNA sequence
tctatgttcatcagggatac

SEQ ID NO: 789354 - DNA, 20 bp, Artificial
  CRISPR gRNA sequence
tcatcagggatactggcctg

SEQ ID NO: 789355 - DNA, 20 bp, Artificial
  CRISPR gRNA sequence
ttttttgttatgtccttccc

SEQ ID NO: 789356 - DNA, 20 bp, Artificial
  CRISPR gRNA sequence
tccttccctggtttttgtat

SEQ ID NO: 789357 - DNA, 20 bp, Artificial
  CRISPR gRNA sequence
ccttccctggtttttgtatt

SEQ ID NO: 789358 - DNA, 20 bp, Artificial
  CRISPR gRNA sequence
cttccctggtttttgtatta

SEQ ID NO: 789359 - DNA, 20 bp, Artificial
  CRISPR gRNA sequence
tttttgtattagggtgctac

SEQ ID NO: 789360 - DNA, 20 bp, Artificial
  CRISPR gRNA sequence
ttagggtgctactggcttca

SEQ ID NO: 789361 - DNA, 20 bp, Artificial
  CRISPR gRNA sequence
actggcttcatagaatgatt

SEQ ID NO: 789362 - DNA, 20 bp, Artificial
  CRISPR gRNA sequence
ctggcttcatagaatgattt

SEQ ID NO: 789363 - DNA, 20 bp, Artificial
  CRISPR gRNA sequence
tggcttcatagaatgattta

SEQ ID NO: 789364 - DNA, 20 bp, Artificial
  CRISPR gRNA sequence
gcttcatagaatgatttagg

SEQ ID NO: 789365 - DNA, 20 bp, Artificial
  CRISPR gRNA sequence
cttcatagaatgatttaggg

SEQ ID NO: 789366 - DNA, 20 bp, Artificial
  CRISPR gRNA sequence
ttccctctttctctatccca

SEQ ID NO: 789367 - DNA, 20 bp, Artificial
  CRISPR gRNA sequence
tctttctctatcccatggaa

SEQ ID NO: 789368 - DNA, 20 bp, Artificial
  CRISPR gRNA sequence
atcccatggaatagtgtcaa

SEQ ID NO: 789369 - DNA, 20 bp, Artificial
  CRISPR gRNA sequence
tggaatagtgtcaatagaat

SEQ ID NO: 789370 - DNA, 20 bp, Artificial
  CRISPR gRNA sequence
attcttctttgaatgtctga

SEQ ID NO: 789371 - DNA, 20 bp, Artificial
  CRISPR gRNA sequence
tttgaatgtctgatagaatt

SEQ ID NO: 789372 - DNA, 20 bp, Artificial
  CRISPR gRNA sequence
aattcagctatgaatctgtc

SEQ ID NO: 789373 - DNA, 20 bp, Artificial
  CRISPR gRNA sequence
gctatgaatctgtctggtcc

SEQ ID NO: 789374 - DNA, 20 bp, Artificial
  CRISPR gRNA sequence
ttttttgttgacaattttaa

SEQ ID NO: 789375 - DNA, 20 bp, Artificial
  CRISPR gRNA sequence
gcttgttattgatctgttta

SEQ ID NO: 789376 - DNA, 20 bp, Artificial
  CRISPR gRNA sequence
ttatagttcctatatctttc

SEQ ID NO: 789377 - DNA, 20 bp, Artificial
  CRISPR gRNA sequence
atatctttctggtttaatcg

SEQ ID NO: 789378 - DNA, 20 bp, Artificial
  CRISPR gRNA sequence
tatctttctggtttaatcga

SEQ ID NO: 789379 - DNA, 20 bp, Artificial
  CRISPR gRNA sequence
atctttctggtttaatcgaa

SEQ ID NO: 789380 - DNA, 20 bp, Artificial
  CRISPR gRNA sequence
atcgaagggttgtatatttc

SEQ ID NO: 789381 - DNA, 20 bp, Artificial
  CRISPR gRNA sequence
tcgaagggttgtatatttcc

SEQ ID NO: 789382 - DNA, 20 bp, Artificial
  CRISPR gRNA sequence
aggaatgtatccatctcctc

SEQ ID NO: 789383 - DNA, 20 bp, Artificial
  CRISPR gRNA sequence
tccatctcctctagcttttc

SEQ ID NO: 789384 - DNA, 20 bp, Artificial
  CRISPR gRNA sequence
ttttctagtttgtacgtgta

SEQ ID NO: 789385 - DNA, 20 bp, Artificial
  CRISPR gRNA sequence
tttctagtttgtacgtgtaa

SEQ ID NO: 789386 - DNA, 20 bp, Artificial
  CRISPR gRNA sequence
tgtacgtgtaaaggtgttca

SEQ ID NO: 789387 - DNA, 20 bp, Artificial
  CRISPR gRNA sequence
acgtgtaaaggtgttcatag

SEQ ID NO: 789388 - DNA, 20 bp, Artificial
  CRISPR gRNA sequence
cttttgtatttctgtgatat

SEQ ID NO: 789389 - DNA, 20 bp, Artificial
  CRISPR gRNA sequence
ttgtatttctgtgatatgag

SEQ ID NO: 789390 - DNA, 20 bp, Artificial
  CRISPR gRNA sequence
tctccatttcatttctaatt

SEQ ID NO: 789391 - DNA, 20 bp, Artificial
  CRISPR gRNA sequence
catttctaattgagattatt

SEQ ID NO: 789392 - DNA, 20 bp, Artificial
  CRISPR gRNA sequence
gatcttctctcttcttttct

SEQ ID NO: 789393 - DNA, 20 bp, Artificial
  CRISPR gRNA sequence
tatttatcttttcaaataac

SEQ ID NO: 789394 - DNA, 20 bp, Artificial
  CRISPR gRNA sequence
ttttttgtttcaatttcatt

SEQ ID NO: 789395 - DNA, 20 bp, Artificial
  CRISPR gRNA sequence
tgtaatttcttttcttctgc

SEQ ID NO: 789396 - DNA, 20 bp, Artificial
  CRISPR gRNA sequence
gtaatttcttttcttctgct

SEQ ID NO: 789397 - DNA, 20 bp, Artificial
  CRISPR gRNA sequence
ttcttttcttctgctgggtt

SEQ ID NO: 789398 - DNA, 20 bp, Artificial
  CRISPR gRNA sequence
tcttttcttctgctgggttt

SEQ ID NO: 789399 - DNA, 20 bp, Artificial
  CRISPR gRNA sequence
tcttctgctgggtttgggtt

SEQ ID NO: 789400 - DNA, 20 bp, Artificial
  CRISPR gRNA sequence
ttggattgttcttgtttctc

SEQ ID NO: 789401 - DNA, 20 bp, Artificial
  CRISPR gRNA sequence
tgttcttgtttctccagctc

SEQ ID NO: 789402 - DNA, 20 bp, Artificial
  CRISPR gRNA sequence
gttcttgtttctccagctcc

SEQ ID NO: 789403 - DNA, 20 bp, Artificial
  CRISPR gRNA sequence
tcttgtttctccagctccag

SEQ ID NO: 789404 - DNA, 20 bp, Artificial
  CRISPR gRNA sequence
cttgtttctccagctccagg

SEQ ID NO: 789405 - DNA, 20 bp, Artificial
  CRISPR gRNA sequence
agctccaggaggtgtgacct

SEQ ID NO: 789406 - DNA, 20 bp, Artificial
  CRISPR gRNA sequence
attgcctatttgtgctcttt

SEQ ID NO: 789407 - DNA, 20 bp, Artificial
  CRISPR gRNA sequence
ctctttcagactttttgatg

SEQ ID NO: 789408 - DNA, 20 bp, Artificial
  CRISPR gRNA sequence
tctttcagactttttgatgt

SEQ ID NO: 789409 - DNA, 20 bp, Artificial
  CRISPR gRNA sequence
aatgctatgaatgtttctct

SEQ ID NO: 789410 - DNA, 20 bp, Artificial
  CRISPR gRNA sequence
gcactgcttttgctgtatcc

SEQ ID NO: 789411 - DNA, 20 bp, Artificial
  CRISPR gRNA sequence
actgcttttgctgtatccca

SEQ ID NO: 789412 - DNA, 20 bp, Artificial
  CRISPR gRNA sequence
gctgtatcccagagttttga

SEQ ID NO: 789413 - DNA, 20 bp, Artificial
  CRISPR gRNA sequence
ctgtatcccagagttttgat

SEQ ID NO: 789414 - DNA, 20 bp, Artificial
  CRISPR gRNA sequence
gttgtgtcactattatcgtt

SEQ ID NO: 789415 - DNA, 20 bp, Artificial
  CRISPR gRNA sequence
cactattatcgttcagttca

SEQ ID NO: 789416 - DNA, 20 bp, Artificial
  CRISPR gRNA sequence
ctattatcgttcagttcaaa

SEQ ID NO: 789417 - DNA, 20 bp, Artificial
  CRISPR gRNA sequence
ttaacttccatgtaattgca

SEQ ID NO: 789418 - DNA, 20 bp, Artificial
  CRISPR gRNA sequence
catgtaattgcatggttttg

SEQ ID NO: 789419 - DNA, 20 bp, Artificial
  CRISPR gRNA sequence
atgtaattgcatggttttga

SEQ ID NO: 789420 - DNA, 20 bp, Artificial
  CRISPR gRNA sequence
atggttttgaaggttccttt

SEQ ID NO: 789421 - DNA, 20 bp, Artificial
  CRISPR gRNA sequence
ggttttgaaggttccttttg

SEQ ID NO: 789422 - DNA, 20 bp, Artificial
  CRISPR gRNA sequence
ttccttttggagtttatttc

SEQ ID NO: 789423 - DNA, 20 bp, Artificial
  CRISPR gRNA sequence
gttttactccactgtgatct

SEQ ID NO: 789424 - DNA, 20 bp, Artificial
  CRISPR gRNA sequence
tttactccactgtgatctaa

SEQ ID NO: 789425 - DNA, 20 bp, Artificial
  CRISPR gRNA sequence
tactccactgtgatctaaga

SEQ ID NO: 789426 - DNA, 20 bp, Artificial
  CRISPR gRNA sequence
ttttgattttcttaaattta

SEQ ID NO: 789427 - DNA, 20 bp, Artificial
  CRISPR gRNA sequence
ttgattttcttaaatttatg

SEQ ID NO: 789428 - DNA, 20 bp, Artificial
  CRISPR gRNA sequence
atttatggagacttgttttg

SEQ ID NO: 789429 - DNA, 20 bp, Artificial
  CRISPR gRNA sequence
ttgttttgtggcctactata

SEQ ID NO: 789430 - DNA, 20 bp, Artificial
  CRISPR gRNA sequence
gcctactatatagtctatct

SEQ ID NO: 789431 - DNA, 20 bp, Artificial
  CRISPR gRNA sequence
ctactatatagtctatcttg

SEQ ID NO: 789432 - DNA, 20 bp, Artificial
  CRISPR gRNA sequence
atgttccatatgctgatgaa

SEQ ID NO: 789433 - DNA, 20 bp, Artificial
  CRISPR gRNA sequence
aatgtatattctgcgattgt

SEQ ID NO: 789434 - DNA, 20 bp, Artificial
  CRISPR gRNA sequence
atgtatattctgcgattgtt

SEQ ID NO: 789435 - DNA, 20 bp, Artificial
  CRISPR gRNA sequence
tatattctgcgattgttggg

SEQ ID NO: 789436 - DNA, 20 bp, Artificial
  CRISPR gRNA sequence
atgttctgtaaatatctgtt

SEQ ID NO: 789437 - DNA, 20 bp, Artificial
  CRISPR gRNA sequence
atatctgttaagtctatttg

SEQ ID NO: 789438 - DNA, 20 bp, Artificial
  CRISPR gRNA sequence
tctgttaagtctatttgtgg

SEQ ID NO: 789439 - DNA, 20 bp, Artificial
  CRISPR gRNA sequence
ctgttaagtctatttgtggt

SEQ ID NO: 789440 - DNA, 20 bp, Artificial
  CRISPR gRNA sequence
tgttaagtctatttgtggta

SEQ ID NO: 789441 - DNA, 20 bp, Artificial
  CRISPR gRNA sequence
agtctatttgtggtagggca

SEQ ID NO: 789442 - DNA, 20 bp, Artificial
  CRISPR gRNA sequence
tagtttaaattcattgtttc

SEQ ID NO: 789443 - DNA, 20 bp, Artificial
  CRISPR gRNA sequence
aattcattgtttctggtttg

SEQ ID NO: 789444 - DNA, 20 bp, Artificial
  CRISPR gRNA sequence
ctggtttgaagtacttctgt

SEQ ID NO: 789445 - DNA, 20 bp, Artificial
  CRISPR gRNA sequence
tgaagtacttctgtcagctt

SEQ ID NO: 789446 - DNA, 20 bp, Artificial
  CRISPR gRNA sequence
tgtcagcttcagcccattcc

SEQ ID NO: 789447 - DNA, 20 bp, Artificial
  CRISPR gRNA sequence
cttcagcccattcctggtgt

SEQ ID NO: 789448 - DNA, 20 bp, Artificial
  CRISPR gRNA sequence
tcccatccccctgccctgcc

SEQ ID NO: 789449 - DNA, 20 bp, Artificial
  CRISPR gRNA sequence
cccatccccctgccctgccc

SEQ ID NO: 789450 - DNA, 20 bp, Artificial
  CRISPR gRNA sequence
ccctgccctgcccaggcctt

SEQ ID NO: 789451 - DNA, 20 bp, Artificial
  CRISPR gRNA sequence
cctgccctgcccaggccttc

SEQ ID NO: 789452 - DNA, 20 bp, Artificial
  CRISPR gRNA sequence
ccctgcccaggccttcagga

SEQ ID NO: 789453 - DNA, 20 bp, Artificial
  CRISPR gRNA sequence
cccaggccttcaggatggtt

SEQ ID NO: 789454 - DNA, 20 bp, Artificial
  CRISPR gRNA sequence
cttcaggatggtttggctct

SEQ ID NO: 789455 - DNA, 20 bp, Artificial
  CRISPR gRNA sequence
gctcttggtgttcttgtttt

SEQ ID NO: 789456 - DNA, 20 bp, Artificial
  CRISPR gRNA sequence
gcctcctctgcaaccctgtc

SEQ ID NO: 789457 - DNA, 20 bp, Artificial
  CRISPR gRNA sequence
cctgtctggaaacctttgca

SEQ ID NO: 789458 - DNA, 20 bp, Artificial
  CRISPR gRNA sequence
ctggaaacctttgcacagac

SEQ ID NO: 789459 - DNA, 20 bp, Artificial
  CRISPR gRNA sequence
cacagaccagttctcaaccc

SEQ ID NO: 789460 - DNA, 20 bp, Artificial
  CRISPR gRNA sequence
ttctcaaccccagctcctct

SEQ ID NO: 789461 - DNA, 20 bp, Artificial
  CRISPR gRNA sequence
ctcaaccccagctcctctga

SEQ ID NO: 789462 - DNA, 20 bp, Artificial
  CRISPR gRNA sequence
cagctcctctgagagacccc

SEQ ID NO: 789463 - DNA, 20 bp, Artificial
  CRISPR gRNA sequence
agctcctctgagagacccct

SEQ ID NO: 789464 - DNA, 20 bp, Artificial
  CRISPR gRNA sequence
ctgagagacccctgggctcc

SEQ ID NO: 789465 - DNA, 20 bp, Artificial
  CRISPR gRNA sequence
tgagagacccctgggctcct

SEQ ID NO: 789466 - DNA, 20 bp, Artificial
  CRISPR gRNA sequence
gagagacccctgggctcctg

SEQ ID NO: 789467 - DNA, 20 bp, Artificial
  CRISPR gRNA sequence
cctggggcctctctgttctt

SEQ ID NO: 789468 - DNA, 20 bp, Artificial
  CRISPR gRNA sequence
ccatgctcccgccccttcct

SEQ ID NO: 789469 - DNA, 20 bp, Artificial
  CRISPR gRNA sequence
gctcccgccccttcctcaga

SEQ ID NO: 789470 - DNA, 20 bp, Artificial
  CRISPR gRNA sequence
ttcctcagatggattgcccc

SEQ ID NO: 789471 - DNA, 20 bp, Artificial
  CRISPR gRNA sequence
atggattgcccccagaaatg

SEQ ID NO: 789472 - DNA, 20 bp, Artificial
  CRISPR gRNA sequence
tggattgcccccagaaatgt

SEQ ID NO: 789473 - DNA, 20 bp, Artificial
  CRISPR gRNA sequence
ccagaaatgtaggtgccacc

SEQ ID NO: 789474 - DNA, 20 bp, Artificial
  CRISPR gRNA sequence
gtaggtgccacctggctttt

SEQ ID NO: 789475 - DNA, 20 bp, Artificial
  CRISPR gRNA sequence
acctggcttttcagaaacca

SEQ ID NO: 789476 - DNA, 20 bp, Artificial
  CRISPR gRNA sequence
tcctttatcactgtctcttc

SEQ ID NO: 789477 - DNA, 20 bp, Artificial
  CRISPR gRNA sequence
actgtctcttccagaatctc

SEQ ID NO: 789478 - DNA, 20 bp, Artificial
  CRISPR gRNA sequence
ctcttttcattatatttgat

SEQ ID NO: 789479 - DNA, 20 bp, Artificial
  CRISPR gRNA sequence
atttgataagaatttctgcc

SEQ ID NO: 789480 - DNA, 20 bp, Artificial
  CRISPR gRNA sequence
tttctgcccagacatcaacg

SEQ ID NO: 789481 - DNA, 20 bp, Artificial
  CRISPR gRNA sequence
ttctgcccagacatcaacga

SEQ ID NO: 789482 - DNA, 20 bp, Artificial
  CRISPR gRNA sequence
ctataaacaaacccattttc

SEQ ID NO: 789483 - DNA, 20 bp, Artificial
  CRISPR gRNA sequence
cattttcaagctttatgcca

SEQ ID NO: 789484 - DNA, 20 bp, Artificial
  CRISPR gRNA sequence
tcaagctttatgccatggat

SEQ ID NO: 789485 - DNA, 20 bp, Artificial
  CRISPR gRNA sequence
caagctttatgccatggatc

SEQ ID NO: 789486 - DNA, 20 bp, Artificial
  CRISPR gRNA sequence
tgccatggatcaggcacttt

SEQ ID NO: 789487 - DNA, 20 bp, Artificial
  CRISPR gRNA sequence
ataaaaacatgtccttcttc

SEQ ID NO: 789488 - DNA, 20 bp, Artificial
  CRISPR gRNA sequence
ttctagtcctacttcattca

SEQ ID NO: 789489 - DNA, 20 bp, Artificial
  CRISPR gRNA sequence
tctagtcctacttcattcat

SEQ ID NO: 789490 - DNA, 20 bp, Artificial
  CRISPR gRNA sequence
tcattcatgggaaccctcat

SEQ ID NO: 789491 - DNA, 20 bp, Artificial
  CRISPR gRNA sequence
cattcatgggaaccctcatt

SEQ ID NO: 789492 - DNA, 20 bp, Artificial
  CRISPR gRNA sequence
attcatgggaaccctcattg

SEQ ID NO: 789493 - DNA, 20 bp, Artificial
  CRISPR gRNA sequence
gggaaccctcattggggcct

SEQ ID NO: 789494 - DNA, 20 bp, Artificial
  CRISPR gRNA sequence
cagatctatcttgcttcttt

SEQ ID NO: 789495 - DNA, 20 bp, Artificial
  CRISPR gRNA sequence
gatctatcttgcttctttta

SEQ ID NO: 789496 - DNA, 20 bp, Artificial
  CRISPR gRNA sequence
cttgcttcttttagagaccc

SEQ ID NO: 789497 - DNA, 20 bp, Artificial
  CRISPR gRNA sequence
ttcttttagagaccctggat

SEQ ID NO: 789498 - DNA, 20 bp, Artificial
  CRISPR gRNA sequence
tcttttagagaccctggatc

SEQ ID NO: 789499 - DNA, 20 bp, Artificial
  CRISPR gRNA sequence
cttttagagaccctggatca

SEQ ID NO: 789500 - DNA, 20 bp, Artificial
  CRISPR gRNA sequence
ttagagaccctggatcaggg

SEQ ID NO: 789501 - DNA, 20 bp, Artificial
  CRISPR gRNA sequence
ggatcagggtagcctactct

SEQ ID NO: 789502 - DNA, 20 bp, Artificial
  CRISPR gRNA sequence
gatcagggtagcctactctt

SEQ ID NO: 789503 - DNA, 20 bp, Artificial
  CRISPR gRNA sequence
ggtagcctactcttaggtga

SEQ ID NO: 789504 - DNA, 20 bp, Artificial
  CRISPR gRNA sequence
gcttgtattcctcctaaaat

SEQ ID NO: 789505 - DNA, 20 bp, Artificial
  CRISPR gRNA sequence
ctcctaaaataagtatgatg

SEQ ID NO: 789506 - DNA, 20 bp, Artificial
  CRISPR gRNA sequence
gtatgctcttctcacctatt

SEQ ID NO: 789507 - DNA, 20 bp, Artificial
  CRISPR gRNA sequence
tgattcttataatttttcat

SEQ ID NO: 789508 - DNA, 20 bp, Artificial
  CRISPR gRNA sequence
tttttcataagtttctatac

SEQ ID NO: 789509 - DNA, 20 bp, Artificial
  CRISPR gRNA sequence
ctggaaaaacatataatgtt

SEQ ID NO: 789510 - DNA, 20 bp, Artificial
  CRISPR gRNA sequence
cagcatcttatgaatttttt

SEQ ID NO: 789511 - DNA, 20 bp, Artificial
  CRISPR gRNA sequence
tactcttacatatgtatcca

SEQ ID NO: 789512 - DNA, 20 bp, Artificial
  CRISPR gRNA sequence
actcttacatatgtatccaa

SEQ ID NO: 789513 - DNA, 20 bp, Artificial
  CRISPR gRNA sequence
ccaaaggtgactaaatataa

SEQ ID NO: 789514 - DNA, 20 bp, Artificial
  CRISPR gRNA sequence
aaggtgactaaatataaaag

SEQ ID NO: 789515 - DNA, 20 bp, Artificial
  CRISPR gRNA sequence
tacatataaatatttaacaa

SEQ ID NO: 789516 - DNA, 20 bp, Artificial
  CRISPR gRNA sequence
aaatatttaacaacagtata

SEQ ID NO: 789517 - DNA, 20 bp, Artificial
  CRISPR gRNA sequence
caacagtatatagcttcaaa

SEQ ID NO: 789518 - DNA, 20 bp, Artificial
  CRISPR gRNA sequence
agtatatagcttcaaatagc

SEQ ID NO: 789519 - DNA, 20 bp, Artificial
  CRISPR gRNA sequence
atatagcttcaaatagccag

SEQ ID NO: 789520 - DNA, 20 bp, Artificial
  CRISPR gRNA sequence
tatagcttcaaatagccaga

SEQ ID NO: 789521 - DNA, 20 bp, Artificial
  CRISPR gRNA sequence
atagcttcaaatagccagaa

SEQ ID NO: 789522 - DNA, 20 bp, Artificial
  CRISPR gRNA sequence
tagcttcaaatagccagaag

SEQ ID NO: 789523 - DNA, 20 bp, Artificial
  CRISPR gRNA sequence
cattgaatgttctcaacaca

SEQ ID NO: 789524 - DNA, 20 bp, Artificial
  CRISPR gRNA sequence
caaagaaataataaatattt

SEQ ID NO: 789525 - DNA, 20 bp, Artificial
  CRISPR gRNA sequence
tcactatgtatcccataaat

SEQ ID NO: 789526 - DNA, 20 bp, Artificial
  CRISPR gRNA sequence
caattattgtcaattaaaaa

SEQ ID NO: 789527 - DNA, 20 bp, Artificial
  CRISPR gRNA sequence
acccaaaaaaatgatctcaa

SEQ ID NO: 789528 - DNA, 20 bp, Artificial
  CRISPR gRNA sequence
caaaaaaatgatctcaaaag

SEQ ID NO: 789529 - DNA, 20 bp, Artificial
  CRISPR gRNA sequence
aaaaaaatgatctcaaaaga

SEQ ID NO: 789530 - DNA, 20 bp, Artificial
  CRISPR gRNA sequence
ttttttttttttcttttttt

SEQ ID NO: 789531 - DNA, 20 bp, Artificial
  CRISPR gRNA sequence
ttttttttctttttttgaga

SEQ ID NO: 789532 - DNA, 20 bp, Artificial
  CRISPR gRNA sequence
ttttttctttttttgagaca

SEQ ID NO: 789533 - DNA, 20 bp, Artificial
  CRISPR gRNA sequence
cagagtctcgctctgtcgcc

SEQ ID NO: 789534 - DNA, 20 bp, Artificial
  CRISPR gRNA sequence
agagtctcgctctgtcgccc

SEQ ID NO: 789535 - DNA, 20 bp, Artificial
  CRISPR gRNA sequence
tctcgctctgtcgcccaggc

SEQ ID NO: 789536 - DNA, 20 bp, Artificial
  CRISPR gRNA sequence
tcgctctgtcgcccaggctg

SEQ ID NO: 789537 - DNA, 20 bp, Artificial
  CRISPR gRNA sequence
ctgtcgcccaggctggagtg

SEQ ID NO: 789538 - DNA, 20 bp, Artificial
  CRISPR gRNA sequence
tcgcccaggctggagtgcag

SEQ ID NO: 789539 - DNA, 20 bp, Artificial
  CRISPR gRNA sequence
gcccaggctggagtgcagtg

SEQ ID NO: 789540 - DNA, 20 bp, Artificial
  CRISPR gRNA sequence
ggagtgcagtggagcgatct

SEQ ID NO: 789541 - DNA, 20 bp, Artificial
  CRISPR gRNA sequence
gagcgatctcggctcactac

SEQ ID NO: 789542 - DNA, 20 bp, Artificial
  CRISPR gRNA sequence
tcactacaagctccgcctcc

SEQ ID NO: 789543 - DNA, 20 bp, Artificial
  CRISPR gRNA sequence
ttaacgccattctcctgcct

SEQ ID NO: 789544 - DNA, 20 bp, Artificial
  CRISPR gRNA sequence
ttctcctgcctcagcctccc

SEQ ID NO: 789545 - DNA, 20 bp, Artificial
  CRISPR gRNA sequence
tcctgcctcagcctccccag

SEQ ID NO: 789546 - DNA, 20 bp, Artificial
  CRISPR gRNA sequence
gcctcagcctccccagtagc

SEQ ID NO: 789547 - DNA, 20 bp, Artificial
  CRISPR gRNA sequence
cctcagcctccccagtagct

SEQ ID NO: 789548 - DNA, 20 bp, Artificial
  CRISPR gRNA sequence
ctccccagtagctgggacta

SEQ ID NO: 789549 - DNA, 20 bp, Artificial
  CRISPR gRNA sequence
tccccagtagctgggactac

SEQ ID NO: 789550 - DNA, 20 bp, Artificial
  CRISPR gRNA sequence
caggcgcccgccaccgcgcc

SEQ ID NO: 789551 - DNA, 20 bp, Artificial
  CRISPR gRNA sequence
ctaatttttgttgtattttt

SEQ ID NO: 789552 - DNA, 20 bp, Artificial
  CRISPR gRNA sequence
atttttgttgtattttttag

SEQ ID NO: 789553 - DNA, 20 bp, Artificial
  CRISPR gRNA sequence
ttttgttgtattttttagta

SEQ ID NO: 789554 - DNA, 20 bp, Artificial
  CRISPR gRNA sequence
gttgtattttttagtagaga

SEQ ID NO: 789555 - DNA, 20 bp, Artificial
  CRISPR gRNA sequence
ttgtattttttagtagagac

SEQ ID NO: 789556 - DNA, 20 bp, Artificial
  CRISPR gRNA sequence
tgtattttttagtagagaca

SEQ ID NO: 789557 - DNA, 20 bp, Artificial
  CRISPR gRNA sequence
gagacagggtttcaccatgt

SEQ ID NO: 789558 - DNA, 20 bp, Artificial
  CRISPR gRNA sequence
cagggtttcaccatgttagc

SEQ ID NO: 789559 - DNA, 20 bp, Artificial
  CRISPR gRNA sequence
agggtttcaccatgttagcc

SEQ ID NO: 789560 - DNA, 20 bp, Artificial
  CRISPR gRNA sequence
tttcaccatgttagccagga

SEQ ID NO: 789561 - DNA, 20 bp, Artificial
  CRISPR gRNA sequence
acctcatgatccacccgcct

SEQ ID NO: 789562 - DNA, 20 bp, Artificial
  CRISPR gRNA sequence
ccacccgccttggcctccca

SEQ ID NO: 789563 - DNA, 20 bp, Artificial
  CRISPR gRNA sequence
gccttggcctcccaaagtgc

SEQ ID NO: 789564 - DNA, 20 bp, Artificial
  CRISPR gRNA sequence
ccttggcctcccaaagtgct

SEQ ID NO: 789565 - DNA, 20 bp, Artificial
  CRISPR gRNA sequence
ctcccaaagtgctgggatta

SEQ ID NO: 789566 - DNA, 20 bp, Artificial
  CRISPR gRNA sequence
agtgctgggattacggtcgt

SEQ ID NO: 789567 - DNA, 20 bp, Artificial
  CRISPR gRNA sequence
cggtcgtgagccaccgcgcc

SEQ ID NO: 789568 - DNA, 20 bp, Artificial
  CRISPR gRNA sequence
atttctaaaatatatatata

SEQ ID NO: 789569 - DNA, 20 bp, Artificial
  CRISPR gRNA sequence
tatatatatatagtacaata

SEQ ID NO: 789570 - DNA, 20 bp, Artificial
  CRISPR gRNA sequence
tagtacaatatagtttccac

SEQ ID NO: 789571 - DNA, 20 bp, Artificial
  CRISPR gRNA sequence
caatattacatattttaaat

SEQ ID NO: 789572 - DNA, 20 bp, Artificial
  CRISPR gRNA sequence
aaataagctcttacaaacaa

SEQ ID NO: 789573 - DNA, 20 bp, Artificial
  CRISPR gRNA sequence
agaatatgtatgaaacatgc

SEQ ID NO: 789574 - DNA, 20 bp, Artificial
  CRISPR gRNA sequence
aataatttcctgtgttaaaa

SEQ ID NO: 789575 - DNA, 20 bp, Artificial
  CRISPR gRNA sequence
ataatttcctgtgttaaaaa

SEQ ID NO: 789576 - DNA, 20 bp, Artificial
  CRISPR gRNA sequence
taatttcctgtgttaaaaaa

SEQ ID NO: 789577 - DNA, 20 bp, Artificial
  CRISPR gRNA sequence
aatttcctgtgttaaaaaag

SEQ ID NO: 789578 - DNA, 20 bp, Artificial
  CRISPR gRNA sequence
ctgtgttaaaaaaggggaat

SEQ ID NO: 789579 - DNA, 20 bp, Artificial
  CRISPR gRNA sequence
ttaaaaaaggggaatgagac

SEQ ID NO: 789580 - DNA, 20 bp, Artificial
  CRISPR gRNA sequence
aaaaaaggggaatgagactg

SEQ ID NO: 789581 - DNA, 20 bp, Artificial
  CRISPR gRNA sequence
gggaatgagactggagaatg

SEQ ID NO: 789582 - DNA, 20 bp, Artificial
  CRISPR gRNA sequence
agactggagaatgtggaaaa

SEQ ID NO: 789583 - DNA, 20 bp, Artificial
  CRISPR gRNA sequence
actggagaatgtggaaaaaa

SEQ ID NO: 789584 - DNA, 20 bp, Artificial
  CRISPR gRNA sequence
aaaaaagagaataaataaat

SEQ ID NO: 789585 - DNA, 20 bp, Artificial
  CRISPR gRNA sequence
taaataaataagacaaataa

SEQ ID NO: 789586 - DNA, 20 bp, Artificial
  CRISPR gRNA sequence
aataaataagacaaataaca

SEQ ID NO: 789587 - DNA, 20 bp, Artificial
  CRISPR gRNA sequence
ataaataagacaaataacag

SEQ ID NO: 789588 - DNA, 20 bp, Artificial
  CRISPR gRNA sequence
gacaaataacagaggctttt

SEQ ID NO: 789589 - DNA, 20 bp, Artificial
  CRISPR gRNA sequence
acaaataacagaggcttttt

SEQ ID NO: 789590 - DNA, 20 bp, Artificial
  CRISPR gRNA sequence
ataacagaggctttttgggt

SEQ ID NO: 789591 - DNA, 20 bp, Artificial
  CRISPR gRNA sequence
taacagaggctttttgggta

SEQ ID NO: 789592 - DNA, 20 bp, Artificial
  CRISPR gRNA sequence
taatctattcaattccttct

SEQ ID NO: 789593 - DNA, 20 bp, Artificial
  CRISPR gRNA sequence
ttccaatttcaccttcccta

SEQ ID NO: 789594 - DNA, 20 bp, Artificial
  CRISPR gRNA sequence
tgtaacatatttttgtttga

SEQ ID NO: 789595 - DNA, 20 bp, Artificial
  CRISPR gRNA sequence
ttacaacaacaaaatattta

SEQ ID NO: 789596 - DNA, 20 bp, Artificial
  CRISPR gRNA sequence
acttttctcttgtgactatg

SEQ ID NO: 789597 - DNA, 20 bp, Artificial
  CRISPR gRNA sequence
actatgaagctttaaatgtt

SEQ ID NO: 789598 - DNA, 20 bp, Artificial
  CRISPR gRNA sequence
ctatgaagctttaaatgttc

SEQ ID NO: 789599 - DNA, 20 bp, Artificial
  CRISPR gRNA sequence
tatgaagctttaaatgttca

SEQ ID NO: 789600 - DNA, 20 bp, Artificial
  CRISPR gRNA sequence
tgttcagggtgttctgcatt

SEQ ID NO: 789601 - DNA, 20 bp, Artificial
  CRISPR gRNA sequence
gatctaatttttttttttaa

SEQ ID NO: 789602 - DNA, 20 bp, Artificial
  CRISPR gRNA sequence
taatttttttttttaacagt

SEQ ID NO: 789603 - DNA, 20 bp, Artificial
  CRISPR gRNA sequence
ttttttttaacagtaagttt

SEQ ID NO: 789604 - DNA, 20 bp, Artificial
  CRISPR gRNA sequence
tttttttaacagtaagtttt

SEQ ID NO: 789605 - DNA, 20 bp, Artificial
  CRISPR gRNA sequence
ttttttaacagtaagtttta

SEQ ID NO: 789606 - DNA, 20 bp, Artificial
  CRISPR gRNA sequence
gggtacatgtgcacaacgtg

SEQ ID NO: 789607 - DNA, 20 bp, Artificial
  CRISPR gRNA sequence
ggtacatgtgcacaacgtgc

SEQ ID NO: 789608 - DNA, 20 bp, Artificial
  CRISPR gRNA sequence
tatgtatacatgtgccatat

SEQ ID NO: 789609 - DNA, 20 bp, Artificial
  CRISPR gRNA sequence
attaacttgtcattaaacat

SEQ ID NO: 789610 - DNA, 20 bp, Artificial
  CRISPR gRNA sequence
ttaacttgtcattaaacatt

SEQ ID NO: 789611 - DNA, 20 bp, Artificial
  CRISPR gRNA sequence
cccctcccccgaccacacaa

SEQ ID NO: 789612 - DNA, 20 bp, Artificial
  CRISPR gRNA sequence
cccgaccacacaacagtccc

SEQ ID NO: 789613 - DNA, 20 bp, Artificial
  CRISPR gRNA sequence
attgttcaattcccacctat

SEQ ID NO: 789614 - DNA, 20 bp, Artificial
  CRISPR gRNA sequence
ttcaattcccacctatgagt

SEQ ID NO: 789615 - DNA, 20 bp, Artificial
  CRISPR gRNA sequence
cacctatgagtgagaacatg

SEQ ID NO: 789616 - DNA, 20 bp, Artificial
  CRISPR gRNA sequence
gagtgagaacatgcggtgtt

SEQ ID NO: 789617 - DNA, 20 bp, Artificial
  CRISPR gRNA sequence
ggtgtttggttttttgtcct

SEQ ID NO: 789618 - DNA, 20 bp, Artificial
  CRISPR gRNA sequence
gtgtttggttttttgtcctt

SEQ ID NO: 789619 - DNA, 20 bp, Artificial
  CRISPR gRNA sequence
ttggttttttgtccttggga

SEQ ID NO: 789620 - DNA, 20 bp, Artificial
  CRISPR gRNA sequence
tgtccttgggatagtttgct

SEQ ID NO: 789621 - DNA, 20 bp, Artificial
  CRISPR gRNA sequence
ggatagtttgctgagaatga

SEQ ID NO: 789622 - DNA, 20 bp, Artificial
  CRISPR gRNA sequence
ttgctgagaatgatggtttc

SEQ ID NO: 789623 - DNA, 20 bp, Artificial
  CRISPR gRNA sequence
gcttcatccatgtccctacg

SEQ ID NO: 789624 - DNA, 20 bp, Artificial
  CRISPR gRNA sequence
cttcatccatgtccctacga

SEQ ID NO: 789625 - DNA, 20 bp, Artificial
  CRISPR gRNA sequence
catgaactcatcatttttta

SEQ ID NO: 789626 - DNA, 20 bp, Artificial
  CRISPR gRNA sequence
catcattttttatggctgca

SEQ ID NO: 789627 - DNA, 20 bp, Artificial
  CRISPR gRNA sequence
tatggctgcatagtattcta

SEQ ID NO: 789628 - DNA, 20 bp, Artificial
  CRISPR gRNA sequence
cgtgccacattttcttaatc

SEQ ID NO: 789629 - DNA, 20 bp, Artificial
  CRISPR gRNA sequence
ttaatccagtctatcgttgt

SEQ ID NO: 789630 - DNA, 20 bp, Artificial
  CRISPR gRNA sequence
ttgataattattaaacatga

SEQ ID NO: 789631 - DNA, 20 bp, Artificial
  CRISPR gRNA sequence
catgaaagatgaaaatttat

SEQ ID NO: 789632 - DNA, 20 bp, Artificial
  CRISPR gRNA sequence
atgaaagatgaaaatttatt

SEQ ID NO: 789633 - DNA, 20 bp, Artificial
  CRISPR gRNA sequence
ttgggaatgtgtcccttaat

SEQ ID NO: 789634 - DNA, 20 bp, Artificial
  CRISPR gRNA sequence
gaatgtgtcccttaataaga

SEQ ID NO: 789635 - DNA, 20 bp, Artificial
  CRISPR gRNA sequence
gtcccttaataagatggata

SEQ ID NO: 789636 - DNA, 20 bp, Artificial
  CRISPR gRNA sequence
ccaaattattcatgaatccg

SEQ ID NO: 789637 - DNA, 20 bp, Artificial
  CRISPR gRNA sequence
atccgaagaaccatatgaca

SEQ ID NO: 789638 - DNA, 20 bp, Artificial
  CRISPR gRNA sequence
gaagaaccatatgacatggt

SEQ ID NO: 789639 - DNA, 20 bp, Artificial
  CRISPR gRNA sequence
gttggaatgattttatataa

SEQ ID NO: 789640 - DNA, 20 bp, Artificial
  CRISPR gRNA sequence
tgattttatataatagaatt

SEQ ID NO: 789641 - DNA, 20 bp, Artificial
  CRISPR gRNA sequence
ttctatttttcatttttttg

SEQ ID NO: 789642 - DNA, 20 bp, Artificial
  CRISPR gRNA sequence
tcatttttttgtagcttata

SEQ ID NO: 789643 - DNA, 20 bp, Artificial
  CRISPR gRNA sequence
catttttttgtagcttataa

SEQ ID NO: 789644 - DNA, 20 bp, Artificial
  CRISPR gRNA sequence
ttttgtagcttataaaggct

SEQ ID NO: 789645 - DNA, 20 bp, Artificial
  CRISPR gRNA sequence
tttgtagcttataaaggcta

SEQ ID NO: 789646 - DNA, 20 bp, Artificial
  CRISPR gRNA sequence
ctaaggaatcttgttcgtat

SEQ ID NO: 789647 - DNA, 20 bp, Artificial
  CRISPR gRNA sequence
tgttcgtatgagtaaatcaa

SEQ ID NO: 789648 - DNA, 20 bp, Artificial
  CRISPR gRNA sequence
gttcgtatgagtaaatcaat

SEQ ID NO: 789649 - DNA, 20 bp, Artificial
  CRISPR gRNA sequence
tatgagtaaatcaatgggaa

SEQ ID NO: 789650 - DNA, 20 bp, Artificial
  CRISPR gRNA sequence
gagtaaatcaatgggaatgg

SEQ ID NO: 789651 - DNA, 20 bp, Artificial
  CRISPR gRNA sequence
taaatcaatgggaatggaag

SEQ ID NO: 789652 - DNA, 20 bp, Artificial
  CRISPR gRNA sequence
gaatggaagcagtttcgtta

SEQ ID NO: 789653 - DNA, 20 bp, Artificial
  CRISPR gRNA sequence
attctttgacctgatttaca

SEQ ID NO: 789654 - DNA, 20 bp, Artificial
  CRISPR gRNA sequence
aattactcatttttgattat

SEQ ID NO: 789655 - DNA, 20 bp, Artificial
  CRISPR gRNA sequence
ttatcagttattaactttat

SEQ ID NO: 789656 - DNA, 20 bp, Artificial
  CRISPR gRNA sequence
tatcagttattaactttata

SEQ ID NO: 789657 - DNA, 20 bp, Artificial
  CRISPR gRNA sequence
atcagttattaactttataa

SEQ ID NO: 789658 - DNA, 20 bp, Artificial
  CRISPR gRNA sequence
gcctccttcaattttgttga

SEQ ID NO: 789659 - DNA, 20 bp, Artificial
  CRISPR gRNA sequence
tccttcaattttgttgaaag

SEQ ID NO: 789660 - DNA, 20 bp, Artificial
  CRISPR gRNA sequence
ttttgttgaaagcagaaaat

SEQ ID NO: 789661 - DNA, 20 bp, Artificial
  CRISPR gRNA sequence
agataccacattatttgcaa

SEQ ID NO: 789662 - DNA, 20 bp, Artificial
  CRISPR gRNA sequence
gataccacattatttgcaaa

SEQ ID NO: 789663 - DNA, 20 bp, Artificial
  CRISPR gRNA sequence
ataccacattatttgcaaaa

SEQ ID NO: 789664 - DNA, 20 bp, Artificial
  CRISPR gRNA sequence
attatttgcaaaagggtttt

SEQ ID NO: 789665 - DNA, 20 bp, Artificial
  CRISPR gRNA sequence
aaaagggtttttagtcataa

SEQ ID NO: 789666 - DNA, 20 bp, Artificial
  CRISPR gRNA sequence
tttagtcataacagttccat

SEQ ID NO: 789667 - DNA, 20 bp, Artificial
  CRISPR gRNA sequence
ttagtcataacagttccatc

SEQ ID NO: 789668 - DNA, 20 bp, Artificial
  CRISPR gRNA sequence
cattcttttatttaacacta

SEQ ID NO: 789669 - DNA, 20 bp, Artificial
  CRISPR gRNA sequence
ttcttttatttaacactata

SEQ ID NO: 789670 - DNA, 20 bp, Artificial
  CRISPR gRNA sequence
tcttttatttaacactatag

SEQ ID NO: 789671 - DNA, 20 bp, Artificial
  CRISPR gRNA sequence
cttttatttaacactataga

SEQ ID NO: 789672 - DNA, 20 bp, Artificial
  CRISPR gRNA sequence
ctatagagggttttacaccc

SEQ ID NO: 789673 - DNA, 20 bp, Artificial
  CRISPR gRNA sequence
tatagagggttttacaccct

SEQ ID NO: 789674 - DNA, 20 bp, Artificial
  CRISPR gRNA sequence
ggttttacaccctgggacaa

SEQ ID NO: 789675 - DNA, 20 bp, Artificial
  CRISPR gRNA sequence
caatggactatattcatgat

SEQ ID NO: 789676 - DNA, 20 bp, Artificial
  CRISPR gRNA sequence
ggactatattcatgatgagt

SEQ ID NO: 789677 - DNA, 20 bp, Artificial
  CRISPR gRNA sequence
ctatattcatgatgagtgag

SEQ ID NO: 789678 - DNA, 20 bp, Artificial
  CRISPR gRNA sequence
tattcatgatgagtgagtgg

SEQ ID NO: 789679 - DNA, 20 bp, Artificial
  CRISPR gRNA sequence
attcatgatgagtgagtggt

SEQ ID NO: 789680 - DNA, 20 bp, Artificial
  CRISPR gRNA sequence
tgagtgagtggtaggcttaa

SEQ ID NO: 789681 - DNA, 20 bp, Artificial
  CRISPR gRNA sequence
agtgagtggtaggcttaaaa

SEQ ID NO: 789682 - DNA, 20 bp, Artificial
  CRISPR gRNA sequence
gtgagtggtaggcttaaaag

SEQ ID NO: 789683 - DNA, 20 bp, Artificial
  CRISPR gRNA sequence
agtggtaggcttaaaagagg

SEQ ID NO: 789684 - DNA, 20 bp, Artificial
  CRISPR gRNA sequence
gcttaaaagaggaagtgttt

SEQ ID NO: 789685 - DNA, 20 bp, Artificial
  CRISPR gRNA sequence
cttaaaagaggaagtgtttt

SEQ ID NO: 789686 - DNA, 20 bp, Artificial
  CRISPR gRNA sequence
ttaaaagaggaagtgtttta

SEQ ID NO: 789687 - DNA, 20 bp, Artificial
  CRISPR gRNA sequence
taaaagaggaagtgttttag

SEQ ID NO: 789688 - DNA, 20 bp, Artificial
  CRISPR gRNA sequence
aagtgttttaggggaacccc

SEQ ID NO: 789689 - DNA, 20 bp, Artificial
  CRISPR gRNA sequence
gtgttttaggggaaccccaa

SEQ ID NO: 789690 - DNA, 20 bp, Artificial
  CRISPR gRNA sequence
ggaaccccaagagccttgcc

SEQ ID NO: 789691 - DNA, 20 bp, Artificial
  CRISPR gRNA sequence
ttgcctggcatgcacattgt

SEQ ID NO: 789692 - DNA, 20 bp, Artificial
  CRISPR gRNA sequence
tgcctggcatgcacattgtc

SEQ ID NO: 789693 - DNA, 20 bp, Artificial
  CRISPR gRNA sequence
attgtcaggctcgtcaattt

SEQ ID NO: 789694 - DNA, 20 bp, Artificial
  CRISPR gRNA sequence
ttgtcaggctcgtcaatttt

SEQ ID NO: 789695 - DNA, 20 bp, Artificial
  CRISPR gRNA sequence
ggctcgtcaattttgggaac

SEQ ID NO: 789696 - DNA, 20 bp, Artificial
  CRISPR gRNA sequence
caattttgggaacgagtatt

SEQ ID NO: 789697 - DNA, 20 bp, Artificial
  CRISPR gRNA sequence
aattttgggaacgagtattt

SEQ ID NO: 789698 - DNA, 20 bp, Artificial
  CRISPR gRNA sequence
attttgggaacgagtatttg

SEQ ID NO: 789699 - DNA, 20 bp, Artificial
  CRISPR gRNA sequence
ttgggaacgagtatttgggg

SEQ ID NO: 789700 - DNA, 20 bp, Artificial
  CRISPR gRNA sequence
aacgagtatttggggaagat

SEQ ID NO: 789701 - DNA, 20 bp, Artificial
  CRISPR gRNA sequence
acgagtatttggggaagatg

SEQ ID NO: 789702 - DNA, 20 bp, Artificial
  CRISPR gRNA sequence
atttggggaagatgaggatc

SEQ ID NO: 789703 - DNA, 20 bp, Artificial
  CRISPR gRNA sequence
tttggggaagatgaggatct

SEQ ID NO: 789704 - DNA, 20 bp, Artificial
  CRISPR gRNA sequence
gtgcccatacatcccttgaa

SEQ ID NO: 789705 - DNA, 20 bp, Artificial
  CRISPR gRNA sequence
tttgtaatccccaaatatcc

SEQ ID NO: 789706 - DNA, 20 bp, Artificial
  CRISPR gRNA sequence
agtttgatgaccaacactat

SEQ ID NO: 789707 - DNA, 20 bp, Artificial
  CRISPR gRNA sequence
gtttgatgaccaacactata

SEQ ID NO: 789708 - DNA, 20 bp, Artificial
  CRISPR gRNA sequence
gaacaaatctctccacaact

SEQ ID NO: 789709 - DNA, 20 bp, Artificial
  CRISPR gRNA sequence
caactgagaaatccctgatc

SEQ ID NO: 789710 - DNA, 20 bp, Artificial
  CRISPR gRNA sequence
aactgagaaatccctgatct

SEQ ID NO: 789711 - DNA, 20 bp, Artificial
  CRISPR gRNA sequence
gagaaatccctgatctaggt

SEQ ID NO: 789712 - DNA, 20 bp, Artificial
  CRISPR gRNA sequence
agaaatccctgatctaggta

SEQ ID NO: 789713 - DNA, 20 bp, Artificial
  CRISPR gRNA sequence
aaatccctgatctaggtaag

SEQ ID NO: 789714 - DNA, 20 bp, Artificial
  CRISPR gRNA sequence
tccctgatctaggtaaggag

SEQ ID NO: 789715 - DNA, 20 bp, Artificial
  CRISPR gRNA sequence
ccctgatctaggtaaggagt

SEQ ID NO: 789716 - DNA, 20 bp, Artificial
  CRISPR gRNA sequence
tgatctaggtaaggagtagg

SEQ ID NO: 789717 - DNA, 20 bp, Artificial
  CRISPR gRNA sequence
gatctaggtaaggagtaggc

SEQ ID NO: 789718 - DNA, 20 bp, Artificial
  CRISPR gRNA sequence
atctaggtaaggagtaggca

SEQ ID NO: 789719 - DNA, 20 bp, Artificial
  CRISPR gRNA sequence
gagtaggcagggtgcctccc

SEQ ID NO: 789720 - DNA, 20 bp, Artificial
  CRISPR gRNA sequence
agtaggcagggtgcctcccc

SEQ ID NO: 789721 - DNA, 20 bp, Artificial
  CRISPR gRNA sequence
cagggtgcctccccaggaat

SEQ ID NO: 789722 - DNA, 20 bp, Artificial
  CRISPR gRNA sequence
gggtgcctccccaggaatga

SEQ ID NO: 789723 - DNA, 20 bp, Artificial
  CRISPR gRNA sequence
gcctccccaggaatgagaga

SEQ ID NO: 789724 - DNA, 20 bp, Artificial
  CRISPR gRNA sequence
caggaatgagagacagttct

SEQ ID NO: 789725 - DNA, 20 bp, Artificial
  CRISPR gRNA sequence
tgagagacagttctcagttt

SEQ ID NO: 789726 - DNA, 20 bp, Artificial
  CRISPR gRNA sequence
agagacagttctcagtttga

SEQ ID NO: 789727 - DNA, 20 bp, Artificial
  CRISPR gRNA sequence
cagttctcagtttgagagaa

SEQ ID NO: 789728 - DNA, 20 bp, Artificial
  CRISPR gRNA sequence
agttctcagtttgagagaat

SEQ ID NO: 789729 - DNA, 20 bp, Artificial
  CRISPR gRNA sequence
tctcagtttgagagaatggg

SEQ ID NO: 789730 - DNA, 20 bp, Artificial
  CRISPR gRNA sequence
cagtttgagagaatgggcag

SEQ ID NO: 789731 - DNA, 20 bp, Artificial
  CRISPR gRNA sequence
agtttgagagaatgggcaga

SEQ ID NO: 789732 - DNA, 20 bp, Artificial
  CRISPR gRNA sequence
gagagaatgggcagaaggcc

SEQ ID NO: 789733 - DNA, 20 bp, Artificial
  CRISPR gRNA sequence
gaaggcctggcccattaata

SEQ ID NO: 789734 - DNA, 20 bp, Artificial
  CRISPR gRNA sequence
tggcccattaatacagcatt

SEQ ID NO: 789735 - DNA, 20 bp, Artificial
  CRISPR gRNA sequence
ccattaatacagcattcaga

SEQ ID NO: 789736 - DNA, 20 bp, Artificial
  CRISPR gRNA sequence
attaatacagcattcagata

SEQ ID NO: 789737 - DNA, 20 bp, Artificial
  CRISPR gRNA sequence
cagatagagatcaataaaaa

SEQ ID NO: 789738 - DNA, 20 bp, Artificial
  CRISPR gRNA sequence
gatagagatcaataaaaaca

SEQ ID NO: 789739 - DNA, 20 bp, Artificial
  CRISPR gRNA sequence
atagagatcaataaaaacag

SEQ ID NO: 789740 - DNA, 20 bp, Artificial
  CRISPR gRNA sequence
gagatcaataaaaacagagg

SEQ ID NO: 789741 - DNA, 20 bp, Artificial
  CRISPR gRNA sequence
taaaaacagaggtggtgatt

SEQ ID NO: 789742 - DNA, 20 bp, Artificial
  CRISPR gRNA sequence
aaaaacagaggtggtgattt

SEQ ID NO: 789743 - DNA, 20 bp, Artificial
  CRISPR gRNA sequence
aaaacagaggtggtgattta

SEQ ID NO: 789744 - DNA, 20 bp, Artificial
  CRISPR gRNA sequence
gaggtggtgatttagggttg

SEQ ID NO: 789745 - DNA, 20 bp, Artificial
  CRISPR gRNA sequence
atttagggttgcagatattc

SEQ ID NO: 789746 - DNA, 20 bp, Artificial
  CRISPR gRNA sequence
tgcagatattcgagtacatc

SEQ ID NO: 789747 - DNA, 20 bp, Artificial
  CRISPR gRNA sequence
gcagatattcgagtacatca

SEQ ID NO: 789748 - DNA, 20 bp, Artificial
  CRISPR gRNA sequence
cgagtacatcaaggcatcct

SEQ ID NO: 789749 - DNA, 20 bp, Artificial
  CRISPR gRNA sequence
caaggcatcctgagaatgta

SEQ ID NO: 789750 - DNA, 20 bp, Artificial
  CRISPR gRNA sequence
agaatgtacagccttacatt

SEQ ID NO: 789751 - DNA, 20 bp, Artificial
  CRISPR gRNA sequence
gaatgtacagccttacatta

SEQ ID NO: 789752 - DNA, 20 bp, Artificial
  CRISPR gRNA sequence
aatgtacagccttacattaa

SEQ ID NO: 789753 - DNA, 20 bp, Artificial
  CRISPR gRNA sequence
agccttacattaagggaact

SEQ ID NO: 789754 - DNA, 20 bp, Artificial
  CRISPR gRNA sequence
aagggaactcagacaaactt

SEQ ID NO: 789755 - DNA, 20 bp, Artificial
  CRISPR gRNA sequence
tcagacaaacttcagtgttc

SEQ ID NO: 789756 - DNA, 20 bp, Artificial
  CRISPR gRNA sequence
agacaaacttcagtgttcta

SEQ ID NO: 789757 - DNA, 20 bp, Artificial
  CRISPR gRNA sequence
cagtgttctagagttcctcc

SEQ ID NO: 789758 - DNA, 20 bp, Artificial
  CRISPR gRNA sequence
agttcctcccagctgctgcc

SEQ ID NO: 789759 - DNA, 20 bp, Artificial
  CRISPR gRNA sequence
tcccagctgctgcctggatg

SEQ ID NO: 789760 - DNA, 20 bp, Artificial
  CRISPR gRNA sequence
cccagctgctgcctggatgt

SEQ ID NO: 789761 - DNA, 20 bp, Artificial
  CRISPR gRNA sequence
tggatgtaggaaatgcaata

SEQ ID NO: 789762 - DNA, 20 bp, Artificial
  CRISPR gRNA sequence
tgtaggaaatgcaataaaga

SEQ ID NO: 789763 - DNA, 20 bp, Artificial
  CRISPR gRNA sequence
aatgcaataaagatagaaaa

SEQ ID NO: 789764 - DNA, 20 bp, Artificial
  CRISPR gRNA sequence
agatagaaaacagttacatc

SEQ ID NO: 789765 - DNA, 20 bp, Artificial
  CRISPR gRNA sequence
gatagaaaacagttacatct

SEQ ID NO: 789766 - DNA, 20 bp, Artificial
  CRISPR gRNA sequence
aacagttacatctaggctaa

SEQ ID NO: 789767 - DNA, 20 bp, Artificial
  CRISPR gRNA sequence
atctaggctaatggctttcc

SEQ ID NO: 789768 - DNA, 20 bp, Artificial
  CRISPR gRNA sequence
ctttcctggtgactcattga

SEQ ID NO: 789769 - DNA, 20 bp, Artificial
  CRISPR gRNA sequence
ctggtgactcattgatggtt

SEQ ID NO: 789770 - DNA, 20 bp, Artificial
  CRISPR gRNA sequence
tggtgactcattgatggttg

SEQ ID NO: 789771 - DNA, 20 bp, Artificial
  CRISPR gRNA sequence
ctcattgatggttgaggtgt

SEQ ID NO: 789772 - DNA, 20 bp, Artificial
  CRISPR gRNA sequence
tcattgatggttgaggtgtg

SEQ ID NO: 789773 - DNA, 20 bp, Artificial
  CRISPR gRNA sequence
attgatggttgaggtgtgag

SEQ ID NO: 789774 - DNA, 20 bp, Artificial
  CRISPR gRNA sequence
ttgatggttgaggtgtgagg

SEQ ID NO: 789775 - DNA, 20 bp, Artificial
  CRISPR gRNA sequence
tcactgcccctgtaacaact

SEQ ID NO: 789776 - DNA, 20 bp, Artificial
  CRISPR gRNA sequence
cactgcccctgtaacaactg

SEQ ID NO: 789777 - DNA, 20 bp, Artificial
  CRISPR gRNA sequence
actgcccctgtaacaactga

SEQ ID NO: 789778 - DNA, 20 bp, Artificial
  CRISPR gRNA sequence
caactgagggtcttttaacc

SEQ ID NO: 789779 - DNA, 20 bp, Artificial
  CRISPR gRNA sequence
gggtcttttaaccaagtctc

SEQ ID NO: 789780 - DNA, 20 bp, Artificial
  CRISPR gRNA sequence
tctggacacttattatatgc

SEQ ID NO: 789781 - DNA, 20 bp, Artificial
  CRISPR gRNA sequence
ctggacacttattatatgcc

SEQ ID NO: 789782 - DNA, 20 bp, Artificial
  CRISPR gRNA sequence
tatatgccgggtaccatgct

SEQ ID NO: 789783 - DNA, 20 bp, Artificial
  CRISPR gRNA sequence
tgacaacaatcctgtgtgtt

SEQ ID NO: 789784 - DNA, 20 bp, Artificial
  CRISPR gRNA sequence
attgttcgtcttctacaaat

SEQ ID NO: 789785 - DNA, 20 bp, Artificial
  CRISPR gRNA sequence
tctacaaataagcaaaatgt

SEQ ID NO: 789786 - DNA, 20 bp, Artificial
  CRISPR gRNA sequence
ctacaaataagcaaaatgtg

SEQ ID NO: 789787 - DNA, 20 bp, Artificial
  CRISPR gRNA sequence
agcaaaatgtgaggttatga

SEQ ID NO: 789788 - DNA, 20 bp, Artificial
  CRISPR gRNA sequence
gcaaaatgtgaggttatgaa

SEQ ID NO: 789789 - DNA, 20 bp, Artificial
  CRISPR gRNA sequence
aaaggcaaaataacctgccc

SEQ ID NO: 789790 - DNA, 20 bp, Artificial
  CRISPR gRNA sequence
aaggcaaaataacctgccca

SEQ ID NO: 789791 - DNA, 20 bp, Artificial
  CRISPR gRNA sequence
aaaataacctgcccaaggat

SEQ ID NO: 789792 - DNA, 20 bp, Artificial
  CRISPR gRNA sequence
aaataacctgcccaaggata

SEQ ID NO: 789793 - DNA, 20 bp, Artificial
  CRISPR gRNA sequence
aataacctgcccaaggataa

SEQ ID NO: 789794 - DNA, 20 bp, Artificial
  CRISPR gRNA sequence
acaatattcatcctcatgtc

SEQ ID NO: 789795 - DNA, 20 bp, Artificial
  CRISPR gRNA sequence
atcctcatgtccagtccctc

SEQ ID NO: 789796 - DNA, 20 bp, Artificial
  CRISPR gRNA sequence
tagtttgtccttctttgtac

SEQ ID NO: 789797 - DNA, 20 bp, Artificial
  CRISPR gRNA sequence
cttctttgtaccagatcata

SEQ ID NO: 789798 - DNA, 20 bp, Artificial
  CRISPR gRNA sequence
aaagtcacacactttctgcc

SEQ ID NO: 789799 - DNA, 20 bp, Artificial
  CRISPR gRNA sequence
aagtcacacactttctgcca

SEQ ID NO: 789800 - DNA, 20 bp, Artificial
  CRISPR gRNA sequence
acactttctgccaaggttaa

SEQ ID NO: 789801 - DNA, 20 bp, Artificial
  CRISPR gRNA sequence
tgccaaggttaatggttttt

SEQ ID NO: 789802 - DNA, 20 bp, Artificial
  CRISPR gRNA sequence
gccaaggttaatggtttttt

SEQ ID NO: 789803 - DNA, 20 bp, Artificial
  CRISPR gRNA sequence
ccaaggttaatggttttttg

SEQ ID NO: 789804 - DNA, 20 bp, Artificial
  CRISPR gRNA sequence
gccaaaacccacaaaccctc

SEQ ID NO: 789805 - DNA, 20 bp, Artificial
  CRISPR gRNA sequence
aaaacccacaaaccctctag

SEQ ID NO: 789806 - DNA, 20 bp, Artificial
  CRISPR gRNA sequence
cccacaaaccctctagaaga

SEQ ID NO: 789807 - DNA, 20 bp, Artificial
  CRISPR gRNA sequence
aaaccctctagaagacagta

SEQ ID NO: 789808 - DNA, 20 bp, Artificial
  CRISPR gRNA sequence
gaagacagtacagaccatct

SEQ ID NO: 789809 - DNA, 20 bp, Artificial
  CRISPR gRNA sequence
aagacagtacagaccatctg

SEQ ID NO: 789810 - DNA, 20 bp, Artificial
  CRISPR gRNA sequence
accatctgaggtccaatgcg

SEQ ID NO: 789811 - DNA, 20 bp, Artificial
  CRISPR gRNA sequence
ccatctgaggtccaatgcgt

SEQ ID NO: 789812 - DNA, 20 bp, Artificial
  CRISPR gRNA sequence
atctgaggtccaatgcgtgg

SEQ ID NO: 789813 - DNA, 20 bp, Artificial
  CRISPR gRNA sequence
tctgaggtccaatgcgtggg

SEQ ID NO: 789814 - DNA, 20 bp, Artificial
  CRISPR gRNA sequence
ctgaggtccaatgcgtggga

SEQ ID NO: 789815 - DNA, 20 bp, Artificial
  CRISPR gRNA sequence
tgaggtccaatgcgtgggag

SEQ ID NO: 789816 - DNA, 20 bp, Artificial
  CRISPR gRNA sequence
ggtccaatgcgtgggagggg

SEQ ID NO: 789817 - DNA, 20 bp, Artificial
  CRISPR gRNA sequence
tccaatgcgtgggaggggaa

SEQ ID NO: 789818 - DNA, 20 bp, Artificial
  CRISPR gRNA sequence
ccaatgcgtgggaggggaag

SEQ ID NO: 789819 - DNA, 20 bp, Artificial
  CRISPR gRNA sequence
tgcgtgggaggggaagaggc

SEQ ID NO: 789820 - DNA, 20 bp, Artificial
  CRISPR gRNA sequence
cgtgggaggggaagaggcca

SEQ ID NO: 789821 - DNA, 20 bp, Artificial
  CRISPR gRNA sequence
ggaagaggccagagaaatat

SEQ ID NO: 789822 - DNA, 20 bp, Artificial
  CRISPR gRNA sequence
aatattggcatcatttatct

SEQ ID NO: 789823 - DNA, 20 bp, Artificial
  CRISPR gRNA sequence
tattggcatcatttatctca

SEQ ID NO: 789824 - DNA, 20 bp, Artificial
  CRISPR gRNA sequence
tcatttatctcagagcattc

SEQ ID NO: 789825 - DNA, 20 bp, Artificial
  CRISPR gRNA sequence
tatctcagagcattcaagcc

SEQ ID NO: 789826 - DNA, 20 bp, Artificial
  CRISPR gRNA sequence
tctcagagcattcaagcctg

SEQ ID NO: 789827 - DNA, 20 bp, Artificial
  CRISPR gRNA sequence
cattcaagcctggagaccat

SEQ ID NO: 789828 - DNA, 20 bp, Artificial
  CRISPR gRNA sequence
gagaccataagccaatgaac

SEQ ID NO: 789829 - DNA, 20 bp, Artificial
  CRISPR gRNA sequence
caagcaaaatctatttttta

SEQ ID NO: 789830 - DNA, 20 bp, Artificial
  CRISPR gRNA sequence
tttcctcaaatcaccttttc

SEQ ID NO: 789831 - DNA, 20 bp, Artificial
  CRISPR gRNA sequence
tcaccttttctagaacaaac

SEQ ID NO: 789832 - DNA, 20 bp, Artificial
  CRISPR gRNA sequence
accttttctagaacaaacaa

SEQ ID NO: 789833 - DNA, 20 bp, Artificial
  CRISPR gRNA sequence
ctagaacaaacaagagtgtg

SEQ ID NO: 789834 - DNA, 20 bp, Artificial
  CRISPR gRNA sequence
gtgaagattctctttatatt

SEQ ID NO: 789835 - DNA, 20 bp, Artificial
  CRISPR gRNA sequence
atttagattttcaattgtgc

SEQ ID NO: 789836 - DNA, 20 bp, Artificial
  CRISPR gRNA sequence
ttagattttcaattgtgctg

SEQ ID NO: 789837 - DNA, 20 bp, Artificial
  CRISPR gRNA sequence
gattttcaattgtgctggag

SEQ ID NO: 789838 - DNA, 20 bp, Artificial
  CRISPR gRNA sequence
ttttcaattgtgctggagtg

SEQ ID NO: 789839 - DNA, 20 bp, Artificial
  CRISPR gRNA sequence
ttcaattgtgctggagtgga

SEQ ID NO: 789840 - DNA, 20 bp, Artificial
  CRISPR gRNA sequence
agtggagagatccctgaatc

SEQ ID NO: 789841 - DNA, 20 bp, Artificial
  CRISPR gRNA sequence
tggagagatccctgaatcca

SEQ ID NO: 789842 - DNA, 20 bp, Artificial
  CRISPR gRNA sequence
ggagagatccctgaatccag

SEQ ID NO: 789843 - DNA, 20 bp, Artificial
  CRISPR gRNA sequence
gatccctgaatccagaggaa

SEQ ID NO: 789844 - DNA, 20 bp, Artificial
  CRISPR gRNA sequence
atccctgaatccagaggaat

SEQ ID NO: 789845 - DNA, 20 bp, Artificial
  CRISPR gRNA sequence
tccctgaatccagaggaata

SEQ ID NO: 789846 - DNA, 20 bp, Artificial
  CRISPR gRNA sequence
tgaatccagaggaataggga

SEQ ID NO: 789847 - DNA, 20 bp, Artificial
  CRISPR gRNA sequence
cagaggaatagggacagcta

SEQ ID NO: 789848 - DNA, 20 bp, Artificial
  CRISPR gRNA sequence
agggacagctatagacttca

SEQ ID NO: 789849 - DNA, 20 bp, Artificial
  CRISPR gRNA sequence
gggacagctatagacttcat

SEQ ID NO: 789850 - DNA, 20 bp, Artificial
  CRISPR gRNA sequence
tagacttcatgggactctct

SEQ ID NO: 789851 - DNA, 20 bp, Artificial
  CRISPR gRNA sequence
agacttcatgggactctctt

SEQ ID NO: 789852 - DNA, 20 bp, Artificial
  CRISPR gRNA sequence
ggctacccacttcccttctc

SEQ ID NO: 789853 - DNA, 20 bp, Artificial
  CRISPR gRNA sequence
cacttcccttctctggatct

SEQ ID NO: 789854 - DNA, 20 bp, Artificial
  CRISPR gRNA sequence
gctacttcatctgcaataaa

SEQ ID NO: 789855 - DNA, 20 bp, Artificial
  CRISPR gRNA sequence
ctacttcatctgcaataaat

SEQ ID NO: 789856 - DNA, 20 bp, Artificial
  CRISPR gRNA sequence
tacttcatctgcaataaata

SEQ ID NO: 789857 - DNA, 20 bp, Artificial
  CRISPR gRNA sequence
aataaatagggcttgcattt

SEQ ID NO: 789858 - DNA, 20 bp, Artificial
  CRISPR gRNA sequence
aaatagggcttgcatttgag

SEQ ID NO: 789859 - DNA, 20 bp, Artificial
  CRISPR gRNA sequence
ttgtaactttttatgatcca

SEQ ID NO: 789860 - DNA, 20 bp, Artificial
  CRISPR gRNA sequence
aactttttatgatccaaagt

SEQ ID NO: 789861 - DNA, 20 bp, Artificial
  CRISPR gRNA sequence
acacacacacacacgtccct

SEQ ID NO: 789862 - DNA, 20 bp, Artificial
  CRISPR gRNA sequence
cacacacgtccctcagaaat

SEQ ID NO: 789863 - DNA, 20 bp, Artificial
  CRISPR gRNA sequence
tccctcagaaattagtttta

SEQ ID NO: 789864 - DNA, 20 bp, Artificial
  CRISPR gRNA sequence
gaaattagttttacagtact

SEQ ID NO: 789865 - DNA, 20 bp, Artificial
  CRISPR gRNA sequence
cttctatacattatttttta

SEQ ID NO: 789866 - DNA, 20 bp, Artificial
  CRISPR gRNA sequence
ttctatacattattttttaa

SEQ ID NO: 789867 - DNA, 20 bp, Artificial
  CRISPR gRNA sequence
tctatacattattttttaaa

SEQ ID NO: 789868 - DNA, 20 bp, Artificial
  CRISPR gRNA sequence
atacattattttttaaaggg

SEQ ID NO: 789869 - DNA, 20 bp, Artificial
  CRISPR gRNA sequence
tacattattttttaaagggc

SEQ ID NO: 789870 - DNA, 20 bp, Artificial
  CRISPR gRNA sequence
aagggcgggaaacgtgcatc

SEQ ID NO: 789871 - DNA, 20 bp, Artificial
  CRISPR gRNA sequence
ttgatattttaatccatgaa

SEQ ID NO: 789872 - DNA, 20 bp, Artificial
  CRISPR gRNA sequence
tgatattttaatccatgaat

SEQ ID NO: 789873 - DNA, 20 bp, Artificial
  CRISPR gRNA sequence
tattttaatccatgaatggg

SEQ ID NO: 789874 - DNA, 20 bp, Artificial
  CRISPR gRNA sequence
catgaatgggcggcaaacca

SEQ ID NO: 789875 - DNA, 20 bp, Artificial
  CRISPR gRNA sequence
aaccatggttttaaaaactc

SEQ ID NO: 789876 - DNA, 20 bp, Artificial
  CRISPR gRNA sequence
ggttttaaaaactctggatt

SEQ ID NO: 789877 - DNA, 20 bp, Artificial
  CRISPR gRNA sequence
gttttaaaaactctggattc

SEQ ID NO: 789878 - DNA, 20 bp, Artificial
  CRISPR gRNA sequence
ttttaaaaactctggattca

SEQ ID NO: 789879 - DNA, 20 bp, Artificial
  CRISPR gRNA sequence
cagggtataaactattgaaa

SEQ ID NO: 789880 - DNA, 20 bp, Artificial
  CRISPR gRNA sequence
gggtataaactattgaaaaa

SEQ ID NO: 789881 - DNA, 20 bp, Artificial
  CRISPR gRNA sequence
aaaagagtatcttaataatc

SEQ ID NO: 789882 - DNA, 20 bp, Artificial
  CRISPR gRNA sequence
gagtatcttaataatcaagt

SEQ ID NO: 789883 - DNA, 20 bp, Artificial
  CRISPR gRNA sequence
agtatcttaataatcaagtc

SEQ ID NO: 789884 - DNA, 20 bp, Artificial
  CRISPR gRNA sequence
gtatcttaataatcaagtca

SEQ ID NO: 789885 - DNA, 20 bp, Artificial
  CRISPR gRNA sequence
atcaagtcagggatgttcca

SEQ ID NO: 789886 - DNA, 20 bp, Artificial
  CRISPR gRNA sequence
tcaagtcagggatgttccat

SEQ ID NO: 789887 - DNA, 20 bp, Artificial
  CRISPR gRNA sequence
aagtcagggatgttccatgg

SEQ ID NO: 789888 - DNA, 20 bp, Artificial
  CRISPR gRNA sequence
tccatgggagaattgtgaat

SEQ ID NO: 789889 - DNA, 20 bp, Artificial
  CRISPR gRNA sequence
ccatgggagaattgtgaatt

SEQ ID NO: 789890 - DNA, 20 bp, Artificial
  CRISPR gRNA sequence
ggagaattgtgaattaggca

SEQ ID NO: 789891 - DNA, 20 bp, Artificial
  CRISPR gRNA sequence
tttcataccctcccacattt

SEQ ID NO: 789892 - DNA, 20 bp, Artificial
  CRISPR gRNA sequence
ttcataccctcccacatttc

SEQ ID NO: 789893 - DNA, 20 bp, Artificial
  CRISPR gRNA sequence
tcataccctcccacatttca

SEQ ID NO: 789894 - DNA, 20 bp, Artificial
  CRISPR gRNA sequence
atttcagggactaattttcc

SEQ ID NO: 789895 - DNA, 20 bp, Artificial
  CRISPR gRNA sequence
ctaattttcctggcttcctc

SEQ ID NO: 789896 - DNA, 20 bp, Artificial
  CRISPR gRNA sequence
ccagtcccattttattccta

SEQ ID NO: 789897 - DNA, 20 bp, Artificial
  CRISPR gRNA sequence
cagtcccattttattcctat

SEQ ID NO: 789898 - DNA, 20 bp, Artificial
  CRISPR gRNA sequence
accccctttcacttgtactt

SEQ ID NO: 789899 - DNA, 20 bp, Artificial
  CRISPR gRNA sequence
tacttcggctgctttgtact

SEQ ID NO: 789900 - DNA, 20 bp, Artificial
  CRISPR gRNA sequence
agatgtcaaaaattatttcc

SEQ ID NO: 789901 - DNA, 20 bp, Artificial
  CRISPR gRNA sequence
tgtcaaaaattatttccgag

SEQ ID NO: 789902 - DNA, 20 bp, Artificial
  CRISPR gRNA sequence
tgctttcattttctctgaaa

SEQ ID NO: 789903 - DNA, 20 bp, Artificial
  CRISPR gRNA sequence
tgaaatagctgtctccttaa

SEQ ID NO: 789904 - DNA, 20 bp, Artificial
  CRISPR gRNA sequence
aatagctgtctccttaaaag

SEQ ID NO: 789905 - DNA, 20 bp, Artificial
  CRISPR gRNA sequence
cagcctgcttgtttttgctt

SEQ ID NO: 789906 - DNA, 20 bp, Artificial
  CRISPR gRNA sequence
tttgcttgagctacctttaa

SEQ ID NO: 789907 - DNA, 20 bp, Artificial
  CRISPR gRNA sequence
ttgcttgagctacctttaat

SEQ ID NO: 789908 - DNA, 20 bp, Artificial
  CRISPR gRNA sequence
taatgggtttctgtgacttg

SEQ ID NO: 789909 - DNA, 20 bp, Artificial
  CRISPR gRNA sequence
gtgacttgcagatcctctgt

SEQ ID NO: 789910 - DNA, 20 bp, Artificial
  CRISPR gRNA sequence
gacttgcagatcctctgttg

SEQ ID NO: 789911 - DNA, 20 bp, Artificial
  CRISPR gRNA sequence
cttgcagatcctctgttgga

SEQ ID NO: 789912 - DNA, 20 bp, Artificial
  CRISPR gRNA sequence
ctgttggagagatgcttcca

SEQ ID NO: 789913 - DNA, 20 bp, Artificial
  CRISPR gRNA sequence
agagatgcttccatggattc

SEQ ID NO: 789914 - DNA, 20 bp, Artificial
  CRISPR gRNA sequence
caccactcacctttgacttt

SEQ ID NO: 789915 - DNA, 20 bp, Artificial
  CRISPR gRNA sequence
ccactcacctttgactttca

SEQ ID NO: 789916 - DNA, 20 bp, Artificial
  CRISPR gRNA sequence
tcacctttgactttcagagt

SEQ ID NO: 789917 - DNA, 20 bp, Artificial
  CRISPR gRNA sequence
cacctttgactttcagagtc

SEQ ID NO: 789918 - DNA, 20 bp, Artificial
  CRISPR gRNA sequence
ctttcagagtcaggtacttg

SEQ ID NO: 789919 - DNA, 20 bp, Artificial
  CRISPR gRNA sequence
gagtcaggtacttgtagtcc

SEQ ID NO: 789920 - DNA, 20 bp, Artificial
  CRISPR gRNA sequence
agtcaggtacttgtagtccc

SEQ ID NO: 789921 - DNA, 20 bp, Artificial
  CRISPR gRNA sequence
tgtagtcccaggcgacccca

SEQ ID NO: 789922 - DNA, 20 bp, Artificial
  CRISPR gRNA sequence
ccccatagatgattatgcat

SEQ ID NO: 789923 - DNA, 20 bp, Artificial
  CRISPR gRNA sequence
actgtccttcgtccctcact

SEQ ID NO: 789924 - DNA, 20 bp, Artificial
  CRISPR gRNA sequence
ttcgtccctcacttggactt

SEQ ID NO: 789925 - DNA, 20 bp, Artificial
  CRISPR gRNA sequence
tcgtccctcacttggacttg

SEQ ID NO: 789926 - DNA, 20 bp, Artificial
  CRISPR gRNA sequence
tcacttggacttgaggtatg

SEQ ID NO: 789927 - DNA, 20 bp, Artificial
  CRISPR gRNA sequence
ggacttgaggtatgtggaac

SEQ ID NO: 789928 - DNA, 20 bp, Artificial
  CRISPR gRNA sequence
gacttgaggtatgtggaacg

SEQ ID NO: 789929 - DNA, 20 bp, Artificial
  CRISPR gRNA sequence
atgtggaacgaggccttccc

SEQ ID NO: 789930 - DNA, 20 bp, Artificial
  CRISPR gRNA sequence
tgtggaacgaggccttccct

SEQ ID NO: 789931 - DNA, 20 bp, Artificial
  CRISPR gRNA sequence
gtggaacgaggccttcccta

SEQ ID NO: 789932 - DNA, 20 bp, Artificial
  CRISPR gRNA sequence
tggaacgaggccttccctag

SEQ ID NO: 789933 - DNA, 20 bp, Artificial
  CRISPR gRNA sequence
aacgaggccttccctagggg

SEQ ID NO: 789934 - DNA, 20 bp, Artificial
  CRISPR gRNA sequence
cctaggggcagctgctcctc

SEQ ID NO: 789935 - DNA, 20 bp, Artificial
  CRISPR gRNA sequence
gggcagctgctcctccagca

SEQ ID NO: 789936 - DNA, 20 bp, Artificial
  CRISPR gRNA sequence
cagctgctcctccagcaaag

SEQ ID NO: 789937 - DNA, 20 bp, Artificial
  CRISPR gRNA sequence
ccagcaaagtggctctttca

SEQ ID NO: 789938 - DNA, 20 bp, Artificial
  CRISPR gRNA sequence
aaagtggctctttcacggtg

SEQ ID NO: 789939 - DNA, 20 bp, Artificial
  CRISPR gRNA sequence
aagtggctctttcacggtgt

SEQ ID NO: 789940 - DNA, 20 bp, Artificial
  CRISPR gRNA sequence
agtggctctttcacggtgtg

SEQ ID NO: 789941 - DNA, 20 bp, Artificial
  CRISPR gRNA sequence
attttccaccttttgcaaac

SEQ ID NO: 789942 - DNA, 20 bp, Artificial
  CRISPR gRNA sequence
aaactggctgttattgctcc

SEQ ID NO: 789943 - DNA, 20 bp, Artificial
  CRISPR gRNA sequence
aactggctgttattgctcca

SEQ ID NO: 789944 - DNA, 20 bp, Artificial
  CRISPR gRNA sequence
tccaaggttcacatgacttc

SEQ ID NO: 789945 - DNA, 20 bp, Artificial
  CRISPR gRNA sequence
tcacatgacttccagtgtca

SEQ ID NO: 789946 - DNA, 20 bp, Artificial
  CRISPR gRNA sequence
ccagtgtcaaagttgcattc

SEQ ID NO: 789947 - DNA, 20 bp, Artificial
  CRISPR gRNA sequence
cagtgtcaaagttgcattcc

SEQ ID NO: 789948 - DNA, 20 bp, Artificial
  CRISPR gRNA sequence
agtgtcaaagttgcattcca

SEQ ID NO: 789949 - DNA, 20 bp, Artificial
  CRISPR gRNA sequence
ctgccatgctctattatgta

SEQ ID NO: 789950 - DNA, 20 bp, Artificial
  CRISPR gRNA sequence
ctctattatgtacagttcct

SEQ ID NO: 789951 - DNA, 20 bp, Artificial
  CRISPR gRNA sequence
tctattatgtacagttcctt

SEQ ID NO: 789952 - DNA, 20 bp, Artificial
  CRISPR gRNA sequence
ctattatgtacagttcctta

SEQ ID NO: 789953 - DNA, 20 bp, Artificial
  CRISPR gRNA sequence
agggactgtcactgtgaata

SEQ ID NO: 789954 - DNA, 20 bp, Artificial
  CRISPR gRNA sequence
tcactgtgaataaagctgaa

SEQ ID NO: 789955 - DNA, 20 bp, Artificial
  CRISPR gRNA sequence
aataaagctgaaaagaaaac

SEQ ID NO: 789956 - DNA, 20 bp, Artificial
  CRISPR gRNA sequence
tctgcctttactttacattc

SEQ ID NO: 789957 - DNA, 20 bp, Artificial
  CRISPR gRNA sequence
tttacattccagttcttacg

SEQ ID NO: 789958 - DNA, 20 bp, Artificial
  CRISPR gRNA sequence
gttcttacgaagtgtaacct

SEQ ID NO: 789959 - DNA, 20 bp, Artificial
  CRISPR gRNA sequence
atctcacccccattttccaa

SEQ ID NO: 789960 - DNA, 20 bp, Artificial
  CRISPR gRNA sequence
tctcacccccattttccaaa

SEQ ID NO: 789961 - DNA, 20 bp, Artificial
  CRISPR gRNA sequence
caaaaggcacctgtcttatc

SEQ ID NO: 789962 - DNA, 20 bp, Artificial
  CRISPR gRNA sequence
gtcttatctggacattcccg

SEQ ID NO: 789963 - DNA, 20 bp, Artificial
  CRISPR gRNA sequence
tctcctttgccccatccatc

SEQ ID NO: 789964 - DNA, 20 bp, Artificial
  CRISPR gRNA sequence
ctcctttgccccatccatct

SEQ ID NO: 789965 - DNA, 20 bp, Artificial
  CRISPR gRNA sequence
tttgccccatccatctgggc

SEQ ID NO: 789966 - DNA, 20 bp, Artificial
  CRISPR gRNA sequence
tgccccatccatctgggcaa

SEQ ID NO: 789967 - DNA, 20 bp, Artificial
  CRISPR gRNA sequence
cccatccatctgggcaagag

SEQ ID NO: 789968 - DNA, 20 bp, Artificial
  CRISPR gRNA sequence
ccatccatctgggcaagagt

SEQ ID NO: 789969 - DNA, 20 bp, Artificial
  CRISPR gRNA sequence
gattcttgacccgctgatct

SEQ ID NO: 789970 - DNA, 20 bp, Artificial
  CRISPR gRNA sequence
attcttgacccgctgatctg

SEQ ID NO: 789971 - DNA, 20 bp, Artificial
  CRISPR gRNA sequence
cttgacccgctgatctgagg

SEQ ID NO: 789972 - DNA, 20 bp, Artificial
  CRISPR gRNA sequence
tccaaacattccctcctgtg

SEQ ID NO: 789973 - DNA, 20 bp, Artificial
  CRISPR gRNA sequence
gactgccctttgctcctctc

SEQ ID NO: 789974 - DNA, 20 bp, Artificial
  CRISPR gRNA sequence
actgccctttgctcctctct

SEQ ID NO: 789975 - DNA, 20 bp, Artificial
  CRISPR gRNA sequence
ttgctcctctctgggcaccc

SEQ ID NO: 789976 - DNA, 20 bp, Artificial
  CRISPR gRNA sequence
tcctctctgggcaccccagc

SEQ ID NO: 789977 - DNA, 20 bp, Artificial
  CRISPR gRNA sequence
ctctctgggcaccccagcaa

SEQ ID NO: 789978 - DNA, 20 bp, Artificial
  CRISPR gRNA sequence
ggcaccccagcaagagcttc

SEQ ID NO: 789979 - DNA, 20 bp, Artificial
  CRISPR gRNA sequence
accccagcaagagcttctgg

SEQ ID NO: 789980 - DNA, 20 bp, Artificial
  CRISPR gRNA sequence
cagcaagagcttctggtgga

SEQ ID NO: 789981 - DNA, 20 bp, Artificial
  CRISPR gRNA sequence
tggacagcactgcttgctct

SEQ ID NO: 789982 - DNA, 20 bp, Artificial
  CRISPR gRNA sequence
gacagcactgcttgctctca

SEQ ID NO: 789983 - DNA, 20 bp, Artificial
  CRISPR gRNA sequence
acagcactgcttgctctcag

SEQ ID NO: 789984 - DNA, 20 bp, Artificial
  CRISPR gRNA sequence
tcagaggcctctcccacctc

SEQ ID NO: 789985 - DNA, 20 bp, Artificial
  CRISPR gRNA sequence
cctccagtccctgacccccc

SEQ ID NO: 789986 - DNA, 20 bp, Artificial
  CRISPR gRNA sequence
ccctgaccccccaagccctg

SEQ ID NO: 789987 - DNA, 20 bp, Artificial
  CRISPR gRNA sequence
cccaagccctgcagtcattc

SEQ ID NO: 789988 - DNA, 20 bp, Artificial
  CRISPR gRNA sequence
ccaagccctgcagtcattcc

SEQ ID NO: 789989 - DNA, 20 bp, Artificial
  CRISPR gRNA sequence
ttccaggtcatctgtcatat

SEQ ID NO: 789990 - DNA, 20 bp, Artificial
  CRISPR gRNA sequence
ctttcgacttccctaccatc

SEQ ID NO: 789991 - DNA, 20 bp, Artificial
  CRISPR gRNA sequence
tttcgacttccctaccatca

SEQ ID NO: 789992 - DNA, 20 bp, Artificial
  CRISPR gRNA sequence
cttccctaccatcaaggtct

SEQ ID NO: 789993 - DNA, 20 bp, Artificial
  CRISPR gRNA sequence
taccttcacatcctattctc

SEQ ID NO: 789994 - DNA, 20 bp, Artificial
  CRISPR gRNA sequence
accttcacatcctattctcc

SEQ ID NO: 789995 - DNA, 20 bp, Artificial
  CRISPR gRNA sequence
taatccatatatttttgtgc

SEQ ID NO: 789996 - DNA, 20 bp, Artificial
  CRISPR gRNA sequence
aatccatatatttttgtgcc

SEQ ID NO: 789997 - DNA, 20 bp, Artificial
  CRISPR gRNA sequence
caggtatcacttcctctcac

SEQ ID NO: 789998 - DNA, 20 bp, Artificial
  CRISPR gRNA sequence
tcacttcctctcaccagtga

SEQ ID NO: 789999 - DNA, 20 bp, Artificial
  CRISPR gRNA sequence
tgttgaattcttacaattgt

SEQ ID NO: 790000 - DNA, 20 bp, Artificial
  CRISPR gRNA sequence
tgctaacacatcgtctcact

SEQ ID NO: 790001 - DNA, 20 bp, Artificial
  CRISPR gRNA sequence
cgtctcactgagcttcttcc

SEQ ID NO: 790002 - DNA, 20 bp, Artificial
  CRISPR gRNA sequence
ctcactgagcttcttcccag

SEQ ID NO: 790003 - DNA, 20 bp, Artificial
  CRISPR gRNA sequence
ctgagcttcttcccagaagc

SEQ ID NO: 790004 - DNA, 20 bp, Artificial
  CRISPR gRNA sequence
gcttcttcccagaagccagc

SEQ ID NO: 790005 - DNA, 20 bp, Artificial
  CRISPR gRNA sequence
cttcttcccagaagccagca

SEQ ID NO: 790006 - DNA, 20 bp, Artificial
  CRISPR gRNA sequence
cttcccagaagccagcaagg

SEQ ID NO: 790007 - DNA, 20 bp, Artificial
  CRISPR gRNA sequence
ttcccagaagccagcaaggt

SEQ ID NO: 790008 - DNA, 20 bp, Artificial
  CRISPR gRNA sequence
taatattctatccttttttt

SEQ ID NO: 790009 - DNA, 20 bp, Artificial
  CRISPR gRNA sequence
ttttttcagaaaacaaaaat

SEQ ID NO: 790010 - DNA, 20 bp, Artificial
  CRISPR gRNA sequence
tttttcagaaaacaaaaatg

SEQ ID NO: 790011 - DNA, 20 bp, Artificial
  CRISPR gRNA sequence
aaacaaaaatgaggcacaaa

SEQ ID NO: 790012 - DNA, 20 bp, Artificial
  CRISPR gRNA sequence
aacaaaaatgaggcacaaaa

SEQ ID NO: 790013 - DNA, 20 bp, Artificial
  CRISPR gRNA sequence
aaatgaggcacaaaaaggtt

SEQ ID NO: 790014 - DNA, 20 bp, Artificial
  CRISPR gRNA sequence
aaaggttaagtaacttgccc

SEQ ID NO: 790015 - DNA, 20 bp, Artificial
  CRISPR gRNA sequence
gtaacttgcccaagattgca

SEQ ID NO: 790016 - DNA, 20 bp, Artificial
  CRISPR gRNA sequence
cttgcccaagattgcacagc

SEQ ID NO: 790017 - DNA, 20 bp, Artificial
  CRISPR gRNA sequence
caagattgcacagccagaat

SEQ ID NO: 790018 - DNA, 20 bp, Artificial
  CRISPR gRNA sequence
ttgcacagccagaatcagat

SEQ ID NO: 790019 - DNA, 20 bp, Artificial
  CRISPR gRNA sequence
tgcacagccagaatcagatc

SEQ ID NO: 790020 - DNA, 20 bp, Artificial
  CRISPR gRNA sequence
ttctaaccaccacatcatac

SEQ ID NO: 790021 - DNA, 20 bp, Artificial
  CRISPR gRNA sequence
cacatcatacaagcccactg

SEQ ID NO: 790022 - DNA, 20 bp, Artificial
  CRISPR gRNA sequence
ctttctattttctgacaata

SEQ ID NO: 790023 - DNA, 20 bp, Artificial
  CRISPR gRNA sequence
tttctattttctgacaataa

SEQ ID NO: 790024 - DNA, 20 bp, Artificial
  CRISPR gRNA sequence
ttctattttctgacaataaa

SEQ ID NO: 790025 - DNA, 20 bp, Artificial
  CRISPR gRNA sequence
attttctgacaataaaggga

SEQ ID NO: 790026 - DNA, 20 bp, Artificial
  CRISPR gRNA sequence
ttttctgacaataaagggaa

SEQ ID NO: 790027 - DNA, 20 bp, Artificial
  CRISPR gRNA sequence
caataaagggaaaggaaaaa

SEQ ID NO: 790028 - DNA, 20 bp, Artificial
  CRISPR gRNA sequence
actgatacttaatgtatatc

SEQ ID NO: 790029 - DNA, 20 bp, Artificial
  CRISPR gRNA sequence
atatctagtatgttctatgc

SEQ ID NO: 790030 - DNA, 20 bp, Artificial
  CRISPR gRNA sequence
tatctagtatgttctatgcc

SEQ ID NO: 790031 - DNA, 20 bp, Artificial
  CRISPR gRNA sequence
ttctatgccaggcactgtgc

SEQ ID NO: 790032 - DNA, 20 bp, Artificial
  CRISPR gRNA sequence
tctatgccaggcactgtgct

SEQ ID NO: 790033 - DNA, 20 bp, Artificial
  CRISPR gRNA sequence
tgaaacctgttttgtcatta

SEQ ID NO: 790034 - DNA, 20 bp, Artificial
  CRISPR gRNA sequence
gttttgtcattatggttata

SEQ ID NO: 790035 - DNA, 20 bp, Artificial
  CRISPR gRNA sequence
gtcattatggttatatagtt

SEQ ID NO: 790036 - DNA, 20 bp, Artificial
  CRISPR gRNA sequence
tcattatggttatatagttg

SEQ ID NO: 790037 - DNA, 20 bp, Artificial
  CRISPR gRNA sequence
ggttatatagttgaggaaac

SEQ ID NO: 790038 - DNA, 20 bp, Artificial
  CRISPR gRNA sequence
tagttgaggaaactggctcc

SEQ ID NO: 790039 - DNA, 20 bp, Artificial
  CRISPR gRNA sequence
ttgaggaaactggctccaag

SEQ ID NO: 790040 - DNA, 20 bp, Artificial
  CRISPR gRNA sequence
tggctccaagcagttcactt

SEQ ID NO: 790041 - DNA, 20 bp, Artificial
  CRISPR gRNA sequence
ggctccaagcagttcacttc

SEQ ID NO: 790042 - DNA, 20 bp, Artificial
  CRISPR gRNA sequence
gttcacttcaggacatatgt

SEQ ID NO: 790043 - DNA, 20 bp, Artificial
  CRISPR gRNA sequence
cttcaggacatatgttagta

SEQ ID NO: 790044 - DNA, 20 bp, Artificial
  CRISPR gRNA sequence
atgttagtaaagttaaaatc

SEQ ID NO: 790045 - DNA, 20 bp, Artificial
  CRISPR gRNA sequence
gttagtaaagttaaaatcca

SEQ ID NO: 790046 - DNA, 20 bp, Artificial
  CRISPR gRNA sequence
gtaaagttaaaatccagagc

SEQ ID NO: 790047 - DNA, 20 bp, Artificial
  CRISPR gRNA sequence
agttaaaatccagagccagt

SEQ ID NO: 790048 - DNA, 20 bp, Artificial
  CRISPR gRNA sequence
atgtttgactacaaaatccg

SEQ ID NO: 790049 - DNA, 20 bp, Artificial
  CRISPR gRNA sequence
caaaatccgtagtttccact

SEQ ID NO: 790050 - DNA, 20 bp, Artificial
  CRISPR gRNA sequence
aaatccgtagtttccactca

SEQ ID NO: 790051 - DNA, 20 bp, Artificial
  CRISPR gRNA sequence
ctcagagtttaccaaaatgt

SEQ ID NO: 790052 - DNA, 20 bp, Artificial
  CRISPR gRNA sequence
tcagagtttaccaaaatgtg

SEQ ID NO: 790053 - DNA, 20 bp, Artificial
  CRISPR gRNA sequence
cagagtttaccaaaatgtga

SEQ ID NO: 790054 - DNA, 20 bp, Artificial
  CRISPR gRNA sequence
aaatgtgagggacacgccac

SEQ ID NO: 790055 - DNA, 20 bp, Artificial
  CRISPR gRNA sequence
tgtgagggacacgccactag

SEQ ID NO: 790056 - DNA, 20 bp, Artificial
  CRISPR gRNA sequence
acacgccactagaagtatgt

SEQ ID NO: 790057 - DNA, 20 bp, Artificial
  CRISPR gRNA sequence
agaagtatgtaagatgattt

SEQ ID NO: 790058 - DNA, 20 bp, Artificial
  CRISPR gRNA sequence
tatgtaagatgattttagat

SEQ ID NO: 790059 - DNA, 20 bp, Artificial
  CRISPR gRNA sequence
atgtaagatgattttagatg

SEQ ID NO: 790060 - DNA, 20 bp, Artificial
  CRISPR gRNA sequence
taagatgattttagatgagg

SEQ ID NO: 790061 - DNA, 20 bp, Artificial
  CRISPR gRNA sequence
ttttagatgaggcagaatca

SEQ ID NO: 790062 - DNA, 20 bp, Artificial
  CRISPR gRNA sequence
tgaggcagaatcaaagccta

SEQ ID NO: 790063 - DNA, 20 bp, Artificial
  CRISPR gRNA sequence
gaggcagaatcaaagcctaa

SEQ ID NO: 790064 - DNA, 20 bp, Artificial
  CRISPR gRNA sequence
aggcagaatcaaagcctaaa

SEQ ID NO: 790065 - DNA, 20 bp, Artificial
  CRISPR gRNA sequence
gcagaatcaaagcctaaagg

SEQ ID NO: 790066 - DNA, 20 bp, Artificial
  CRISPR gRNA sequence
ctaaagggagttaaattatt

SEQ ID NO: 790067 - DNA, 20 bp, Artificial
  CRISPR gRNA sequence
aaagggagttaaattattca

SEQ ID NO: 790068 - DNA, 20 bp, Artificial
  CRISPR gRNA sequence
agggagttaaattattcaga

SEQ ID NO: 790069 - DNA, 20 bp, Artificial
  CRISPR gRNA sequence
gggagttaaattattcagag

SEQ ID NO: 790070 - DNA, 20 bp, Artificial
  CRISPR gRNA sequence
caattgcatataatttcaac

SEQ ID NO: 790071 - DNA, 20 bp, Artificial
  CRISPR gRNA sequence
gacttccacacctctaacac

SEQ ID NO: 790072 - DNA, 20 bp, Artificial
  CRISPR gRNA sequence
tatttttccttttaatcaaa

SEQ ID NO: 790073 - DNA, 20 bp, Artificial
  CRISPR gRNA sequence
atttttccttttaatcaaac

SEQ ID NO: 790074 - DNA, 20 bp, Artificial
  CRISPR gRNA sequence
tttccttttaatcaaacagg

SEQ ID NO: 790075 - DNA, 20 bp, Artificial
  CRISPR gRNA sequence
ttaatcaaacaggaagcttc

SEQ ID NO: 790076 - DNA, 20 bp, Artificial
  CRISPR gRNA sequence
taatcaaacaggaagcttcc

SEQ ID NO: 790077 - DNA, 20 bp, Artificial
  CRISPR gRNA sequence
tcaaacaggaagcttccggg

SEQ ID NO: 790078 - DNA, 20 bp, Artificial
  CRISPR gRNA sequence
ggaagcttccgggtagataa

SEQ ID NO: 790079 - DNA, 20 bp, Artificial
  CRISPR gRNA sequence
tccgggtagataacagtatc

SEQ ID NO: 790080 - DNA, 20 bp, Artificial
  CRISPR gRNA sequence
ccgggtagataacagtatct

SEQ ID NO: 790081 - DNA, 20 bp, Artificial
  CRISPR gRNA sequence
ggtagataacagtatctggg

SEQ ID NO: 790082 - DNA, 20 bp, Artificial
  CRISPR gRNA sequence
gtagataacagtatctgggt

SEQ ID NO: 790083 - DNA, 20 bp, Artificial
  CRISPR gRNA sequence
tcttcctattctctatttac

SEQ ID NO: 790084 - DNA, 20 bp, Artificial
  CRISPR gRNA sequence
tacttgtttttcatctacca

SEQ ID NO: 790085 - DNA, 20 bp, Artificial
  CRISPR gRNA sequence
acttgtttttcatctaccac

SEQ ID NO: 790086 - DNA, 20 bp, Artificial
  CRISPR gRNA sequence
cttgtttttcatctaccaca

SEQ ID NO: 790087 - DNA, 20 bp, Artificial
  CRISPR gRNA sequence
ttgtttttcatctaccacag

SEQ ID NO: 790088 - DNA, 20 bp, Artificial
  CRISPR gRNA sequence
tcatctaccacaggggtatg

SEQ ID NO: 790089 - DNA, 20 bp, Artificial
  CRISPR gRNA sequence
tatgtggctttattttttaa

SEQ ID NO: 790090 - DNA, 20 bp, Artificial
  CRISPR gRNA sequence
aaaagttgaattgatctaaa

SEQ ID NO: 790091 - DNA, 20 bp, Artificial
  CRISPR gRNA sequence
tctaaatagttctataaaaa

SEQ ID NO: 790092 - DNA, 20 bp, Artificial
  CRISPR gRNA sequence
tagttctataaaaaaagcat

SEQ ID NO: 790093 - DNA, 20 bp, Artificial
  CRISPR gRNA sequence
agttctataaaaaaagcata

SEQ ID NO: 790094 - DNA, 20 bp, Artificial
  CRISPR gRNA sequence
ttctataaaaaaagcataag

SEQ ID NO: 790095 - DNA, 20 bp, Artificial
  CRISPR gRNA sequence
tataaaaaaagcataaggag

SEQ ID NO: 790096 - DNA, 20 bp, Artificial
  CRISPR gRNA sequence
agcataaggagtggccaaac

SEQ ID NO: 790097 - DNA, 20 bp, Artificial
  CRISPR gRNA sequence
aaggagtggccaaactagta

SEQ ID NO: 790098 - DNA, 20 bp, Artificial
  CRISPR gRNA sequence
aggagtggccaaactagtaa

SEQ ID NO: 790099 - DNA, 20 bp, Artificial
  CRISPR gRNA sequence
agtggccaaactagtaaagg

SEQ ID NO: 790100 - DNA, 20 bp, Artificial
  CRISPR gRNA sequence
aaggtagtgttacatcaata

SEQ ID NO: 790101 - DNA, 20 bp, Artificial
  CRISPR gRNA sequence
agtgtgaaaaatgacaaaat

SEQ ID NO: 790102 - DNA, 20 bp, Artificial
  CRISPR gRNA sequence
gtgtgaaaaatgacaaaatt

SEQ ID NO: 790103 - DNA, 20 bp, Artificial
  CRISPR gRNA sequence
ctgcttccatcattaatgaa

SEQ ID NO: 790104 - DNA, 20 bp, Artificial
  CRISPR gRNA sequence
tgcttccatcattaatgaat

SEQ ID NO: 790105 - DNA, 20 bp, Artificial
  CRISPR gRNA sequence
tgaatgggtattcattatga

SEQ ID NO: 790106 - DNA, 20 bp, Artificial
  CRISPR gRNA sequence
aatgggtattcattatgatg

SEQ ID NO: 790107 - DNA, 20 bp, Artificial
  CRISPR gRNA sequence
atgggtattcattatgatgg

SEQ ID NO: 790108 - DNA, 20 bp, Artificial
  CRISPR gRNA sequence
tattcattatgatggaggta

SEQ ID NO: 790109 - DNA, 20 bp, Artificial
  CRISPR gRNA sequence
attcattatgatggaggtat

SEQ ID NO: 790110 - DNA, 20 bp, Artificial
  CRISPR gRNA sequence
ggaggtataggaaaatcttg

SEQ ID NO: 790111 - DNA, 20 bp, Artificial
  CRISPR gRNA sequence
ggtataggaaaatcttgaag

SEQ ID NO: 790112 - DNA, 20 bp, Artificial
  CRISPR gRNA sequence
aagtagtttctgaataatca

SEQ ID NO: 790113 - DNA, 20 bp, Artificial
  CRISPR gRNA sequence
tagtttctgaataatcacag

SEQ ID NO: 790114 - DNA, 20 bp, Artificial
  CRISPR gRNA sequence
tctgaataatcacagaagat

SEQ ID NO: 790115 - DNA, 20 bp, Artificial
  CRISPR gRNA sequence
agattagatcaaattatgtt

SEQ ID NO: 790116 - DNA, 20 bp, Artificial
  CRISPR gRNA sequence
ttagatcaaattatgttcag

SEQ ID NO: 790117 - DNA, 20 bp, Artificial
  CRISPR gRNA sequence
agatcaaattatgttcagta

SEQ ID NO: 790118 - DNA, 20 bp, Artificial
  CRISPR gRNA sequence
tcattcattcaacaaatatt

SEQ ID NO: 790119 - DNA, 20 bp, Artificial
  CRISPR gRNA sequence
cattcattcaacaaatattt

SEQ ID NO: 790120 - DNA, 20 bp, Artificial
  CRISPR gRNA sequence
ttcattcaacaaatatttgg

SEQ ID NO: 790121 - DNA, 20 bp, Artificial
  CRISPR gRNA sequence
aatatttgggagctgcttct

SEQ ID NO: 790122 - DNA, 20 bp, Artificial
  CRISPR gRNA sequence
tgggagctgcttctaagcat

SEQ ID NO: 790123 - DNA, 20 bp, Artificial
  CRISPR gRNA sequence
cttctaagcattagctattc

SEQ ID NO: 790124 - DNA, 20 bp, Artificial
  CRISPR gRNA sequence
ctaagcattagctattccag

SEQ ID NO: 790125 - DNA, 20 bp, Artificial
  CRISPR gRNA sequence
agctattccagaagttgttt

SEQ ID NO: 790126 - DNA, 20 bp, Artificial
  CRISPR gRNA sequence
tttcagtataaaatgtgata

SEQ ID NO: 790127 - DNA, 20 bp, Artificial
  CRISPR gRNA sequence
cagtataaaatgtgatacgg

SEQ ID NO: 790128 - DNA, 20 bp, Artificial
  CRISPR gRNA sequence
gtataaaatgtgatacggaa

SEQ ID NO: 790129 - DNA, 20 bp, Artificial
  CRISPR gRNA sequence
aaatgtgatacggaagagca

SEQ ID NO: 790130 - DNA, 20 bp, Artificial
  CRISPR gRNA sequence
aatgtgatacggaagagcat

SEQ ID NO: 790131 - DNA, 20 bp, Artificial
  CRISPR gRNA sequence
atacggaagagcataggata

SEQ ID NO: 790132 - DNA, 20 bp, Artificial
  CRISPR gRNA sequence
aagagcataggatatagtga

SEQ ID NO: 790133 - DNA, 20 bp, Artificial
  CRISPR gRNA sequence
agagcataggatatagtgac

SEQ ID NO: 790134 - DNA, 20 bp, Artificial
  CRISPR gRNA sequence
cataggatatagtgacaggt

SEQ ID NO: 790135 - DNA, 20 bp, Artificial
  CRISPR gRNA sequence
gatatagtgacaggtgagcc

SEQ ID NO: 790136 - DNA, 20 bp, Artificial
  CRISPR gRNA sequence
atatagtgacaggtgagcct

SEQ ID NO: 790137 - DNA, 20 bp, Artificial
  CRISPR gRNA sequence
cctgggttcaaatgctgact

SEQ ID NO: 790138 - DNA, 20 bp, Artificial
  CRISPR gRNA sequence
ctgggttcaaatgctgactc

SEQ ID NO: 790139 - DNA, 20 bp, Artificial
  CRISPR gRNA sequence
ttcaaatgctgactcaggat

SEQ ID NO: 790140 - DNA, 20 bp, Artificial
  CRISPR gRNA sequence
tcaaatgctgactcaggatt

SEQ ID NO: 790141 - DNA, 20 bp, Artificial
  CRISPR gRNA sequence
aaatgctgactcaggattag

SEQ ID NO: 790142 - DNA, 20 bp, Artificial
  CRISPR gRNA sequence
attaggagtcctttgactgt

SEQ ID NO: 790143 - DNA, 20 bp, Artificial
  CRISPR gRNA sequence
gtccgtcctttaatctttat

SEQ ID NO: 790144 - DNA, 20 bp, Artificial
  CRISPR gRNA sequence
cctttaatctttatgagctt

SEQ ID NO: 790145 - DNA, 20 bp, Artificial
  CRISPR gRNA sequence
agcctctttatctataaaat

SEQ ID NO: 790146 - DNA, 20 bp, Artificial
  CRISPR gRNA sequence
gcctctttatctataaaatg

SEQ ID NO: 790147 - DNA, 20 bp, Artificial
  CRISPR gRNA sequence
tgaggttgaactctacctct

SEQ ID NO: 790148 - DNA, 20 bp, Artificial
  CRISPR gRNA sequence
aactctacctctcagtattg

SEQ ID NO: 790149 - DNA, 20 bp, Artificial
  CRISPR gRNA sequence
tctacctctcagtattgtgg

SEQ ID NO: 790150 - DNA, 20 bp, Artificial
  CRISPR gRNA sequence
tacctctcagtattgtggtg

SEQ ID NO: 790151 - DNA, 20 bp, Artificial
  CRISPR gRNA sequence
acctctcagtattgtggtgg

SEQ ID NO: 790152 - DNA, 20 bp, Artificial
  CRISPR gRNA sequence
ctcagtattgtggtggaggc

SEQ ID NO: 790153 - DNA, 20 bp, Artificial
  CRISPR gRNA sequence
tattgtggtggaggctggac

SEQ ID NO: 790154 - DNA, 20 bp, Artificial
  CRISPR gRNA sequence
attgtggtggaggctggacg

SEQ ID NO: 790155 - DNA, 20 bp, Artificial
  CRISPR gRNA sequence
tggacgaggtgttacatgtg

SEQ ID NO: 790156 - DNA, 20 bp, Artificial
  CRISPR gRNA sequence
ggtgttacatgtgaagtgcc

SEQ ID NO: 790157 - DNA, 20 bp, Artificial
  CRISPR gRNA sequence
acatgtgaagtgcctagatc

SEQ ID NO: 790158 - DNA, 20 bp, Artificial
  CRISPR gRNA sequence
tgtgaagtgcctagatctgg

SEQ ID NO: 790159 - DNA, 20 bp, Artificial
  CRISPR gRNA sequence
gtgaagtgcctagatctggc

SEQ ID NO: 790160 - DNA, 20 bp, Artificial
  CRISPR gRNA sequence
aagtgcctagatctggcagg

SEQ ID NO: 790161 - DNA, 20 bp, Artificial
  CRISPR gRNA sequence
tgcctagatctggcaggcag

SEQ ID NO: 790162 - DNA, 20 bp, Artificial
  CRISPR gRNA sequence
gcctagatctggcaggcagt

SEQ ID NO: 790163 - DNA, 20 bp, Artificial
  CRISPR gRNA sequence
tctggcaggcagtaggcact

SEQ ID NO: 790164 - DNA, 20 bp, Artificial
  CRISPR gRNA sequence
tcgtaccatgttttaattct

SEQ ID NO: 790165 - DNA, 20 bp, Artificial
  CRISPR gRNA sequence
cgtaccatgttttaattctt

SEQ ID NO: 790166 - DNA, 20 bp, Artificial
  CRISPR gRNA sequence
ccatgttttaattcttggga

SEQ ID NO: 790167 - DNA, 20 bp, Artificial
  CRISPR gRNA sequence
tgttttaattcttgggaaag

SEQ ID NO: 790168 - DNA, 20 bp, Artificial
  CRISPR gRNA sequence
ggaaagtggtaattcatatg

SEQ ID NO: 790169 - DNA, 20 bp, Artificial
  CRISPR gRNA sequence
taattcatatgtggaatgca

SEQ ID NO: 790170 - DNA, 20 bp, Artificial
  CRISPR gRNA sequence
catggccaatctttatcctc

SEQ ID NO: 790171 - DNA, 20 bp, Artificial
  CRISPR gRNA sequence
atggccaatctttatcctcc

SEQ ID NO: 790172 - DNA, 20 bp, Artificial
  CRISPR gRNA sequence
ctccaggatattttactaac

SEQ ID NO: 790173 - DNA, 20 bp, Artificial
  CRISPR gRNA sequence
tccaggatattttactaacc

SEQ ID NO: 790174 - DNA, 20 bp, Artificial
  CRISPR gRNA sequence
ggatattttactaaccagga

SEQ ID NO: 790175 - DNA, 20 bp, Artificial
  CRISPR gRNA sequence
aggacagtccattctctgat

SEQ ID NO: 790176 - DNA, 20 bp, Artificial
  CRISPR gRNA sequence
cattctctgatcagatttca

SEQ ID NO: 790177 - DNA, 20 bp, Artificial
  CRISPR gRNA sequence
ctgatcagatttcacagtat

SEQ ID NO: 790178 - DNA, 20 bp, Artificial
  CRISPR gRNA sequence
ttcacagtataagtaacttt

SEQ ID NO: 790179 - DNA, 20 bp, Artificial
  CRISPR gRNA sequence
tcacagtataagtaactttt

SEQ ID NO: 790180 - DNA, 20 bp, Artificial
  CRISPR gRNA sequence
tgcttgaatgattcccactg

SEQ ID NO: 790181 - DNA, 20 bp, Artificial
  CRISPR gRNA sequence
ctgcagatgtcctctgattc

SEQ ID NO: 790182 - DNA, 20 bp, Artificial
  CRISPR gRNA sequence
cactatcctgcaaatctttg

SEQ ID NO: 790183 - DNA, 20 bp, Artificial
  CRISPR gRNA sequence
actatcctgcaaatctttga

SEQ ID NO: 790184 - DNA, 20 bp, Artificial
  CRISPR gRNA sequence
cctgcaaatctttgaaggca

SEQ ID NO: 790185 - DNA, 20 bp, Artificial
  CRISPR gRNA sequence
aaatctttgaaggcaaagac

SEQ ID NO: 790186 - DNA, 20 bp, Artificial
  CRISPR gRNA sequence
aatctttgaaggcaaagacc

SEQ ID NO: 790187 - DNA, 20 bp, Artificial
  CRISPR gRNA sequence
ttgaaggcaaagaccaggct

SEQ ID NO: 790188 - DNA, 20 bp, Artificial
  CRISPR gRNA sequence
tgagtttgctttgatatatc

SEQ ID NO: 790189 - DNA, 20 bp, Artificial
  CRISPR gRNA sequence
gctttgatatatccagtacc

SEQ ID NO: 790190 - DNA, 20 bp, Artificial
  CRISPR gRNA sequence
tatatccagtacctagcaca

SEQ ID NO: 790191 - DNA, 20 bp, Artificial
  CRISPR gRNA sequence
tccagtacctagcacatagc

SEQ ID NO: 790192 - DNA, 20 bp, Artificial
  CRISPR gRNA sequence
acctagcacatagcaagttc

SEQ ID NO: 790193 - DNA, 20 bp, Artificial
  CRISPR gRNA sequence
gcacatagcaagttctagtt

SEQ ID NO: 790194 - DNA, 20 bp, Artificial
  CRISPR gRNA sequence
acatagcaagttctagttaa

SEQ ID NO: 790195 - DNA, 20 bp, Artificial
  CRISPR gRNA sequence
gcaagttctagttaagagct

SEQ ID NO: 790196 - DNA, 20 bp, Artificial
  CRISPR gRNA sequence
agagcttggcaaataaatga

SEQ ID NO: 790197 - DNA, 20 bp, Artificial
  CRISPR gRNA sequence
cttggcaaataaatgacaga

SEQ ID NO: 790198 - DNA, 20 bp, Artificial
  CRISPR gRNA sequence
tggcaaataaatgacagaaa

SEQ ID NO: 790199 - DNA, 20 bp, Artificial
  CRISPR gRNA sequence
gcaaataaatgacagaaaga

SEQ ID NO: 790200 - DNA, 20 bp, Artificial
  CRISPR gRNA sequence
aaataaatgacagaaagaga

SEQ ID NO: 790201 - DNA, 20 bp, Artificial
  CRISPR gRNA sequence
ataaatgacagaaagagaga

SEQ ID NO: 790202 - DNA, 20 bp, Artificial
  CRISPR gRNA sequence
taaatgacagaaagagagag

SEQ ID NO: 790203 - DNA, 20 bp, Artificial
  CRISPR gRNA sequence
aaatgacagaaagagagaga

SEQ ID NO: 790204 - DNA, 20 bp, Artificial
  CRISPR gRNA sequence
atgacagaaagagagagagg

SEQ ID NO: 790205 - DNA, 20 bp, Artificial
  CRISPR gRNA sequence
cagaaagagagagagggaga

SEQ ID NO: 790206 - DNA, 20 bp, Artificial
  CRISPR gRNA sequence
aagagagagagggagaaaga

SEQ ID NO: 790207 - DNA, 20 bp, Artificial
  CRISPR gRNA sequence
agagagagagggagaaagaa

SEQ ID NO: 790208 - DNA, 20 bp, Artificial
  CRISPR gRNA sequence
ggagaaagaaaggatgaccc

SEQ ID NO: 790209 - DNA, 20 bp, Artificial
  CRISPR gRNA sequence
ttgcctgtgatcacacaaat

SEQ ID NO: 790210 - DNA, 20 bp, Artificial
  CRISPR gRNA sequence
tggcattcttaattgccaca

SEQ ID NO: 790211 - DNA, 20 bp, Artificial
  CRISPR gRNA sequence
ttgccacacagcacacttga

SEQ ID NO: 790212 - DNA, 20 bp, Artificial
  CRISPR gRNA sequence
atagtgatatgcacaaactt

SEQ ID NO: 790213 - DNA, 20 bp, Artificial
  CRISPR gRNA sequence
tttcaaatgaccgacatttt

SEQ ID NO: 790214 - DNA, 20 bp, Artificial
  CRISPR gRNA sequence
ctctatccctgttttaacca

SEQ ID NO: 790215 - DNA, 20 bp, Artificial
  CRISPR gRNA sequence
atccctgttttaaccatggc

SEQ ID NO: 790216 - DNA, 20 bp, Artificial
  CRISPR gRNA sequence
aacattaatgtgcctttcta

SEQ ID NO: 790217 - DNA, 20 bp, Artificial
  CRISPR gRNA sequence
cattaatgtgcctttctaca

SEQ ID NO: 790218 - DNA, 20 bp, Artificial
  CRISPR gRNA sequence
ttaatgtgcctttctacaga

SEQ ID NO: 790219 - DNA, 20 bp, Artificial
  CRISPR gRNA sequence
taatgtgcctttctacagag

SEQ ID NO: 790220 - DNA, 20 bp, Artificial
  CRISPR gRNA sequence
atgtgcctttctacagagag

SEQ ID NO: 790221 - DNA, 20 bp, Artificial
  CRISPR gRNA sequence
gagaggagttcacgtgtgcc

SEQ ID NO: 790222 - DNA, 20 bp, Artificial
  CRISPR gRNA sequence
gtgcccagcattcttttgtg

SEQ ID NO: 790223 - DNA, 20 bp, Artificial
  CRISPR gRNA sequence
tgcccagcattcttttgtgc

SEQ ID NO: 790224 - DNA, 20 bp, Artificial
  CRISPR gRNA sequence
cccagcattcttttgtgcag

SEQ ID NO: 790225 - DNA, 20 bp, Artificial
  CRISPR gRNA sequence
ccagcattcttttgtgcagg

SEQ ID NO: 790226 - DNA, 20 bp, Artificial
  CRISPR gRNA sequence
cagcattcttttgtgcagga

SEQ ID NO: 790227 - DNA, 20 bp, Artificial
  CRISPR gRNA sequence
agcattcttttgtgcaggag

SEQ ID NO: 790228 - DNA, 20 bp, Artificial
  CRISPR gRNA sequence
tcttttgtgcaggaggggca

SEQ ID NO: 790229 - DNA, 20 bp, Artificial
  CRISPR gRNA sequence
cttttgtgcaggaggggcac

SEQ ID NO: 790230 - DNA, 20 bp, Artificial
  CRISPR gRNA sequence
ttttgtgcaggaggggcaca

SEQ ID NO: 790231 - DNA, 20 bp, Artificial
  CRISPR gRNA sequence
tttgtgcaggaggggcacag

SEQ ID NO: 790232 - DNA, 20 bp, Artificial
  CRISPR gRNA sequence
gtgcaggaggggcacagggg

SEQ ID NO: 790233 - DNA, 20 bp, Artificial
  CRISPR gRNA sequence
tgcaggaggggcacaggggc

SEQ ID NO: 790234 - DNA, 20 bp, Artificial
  CRISPR gRNA sequence
gcaggaggggcacaggggca

SEQ ID NO: 790235 - DNA, 20 bp, Artificial
  CRISPR gRNA sequence
gggcacaggggcagggctat

SEQ ID NO: 790236 - DNA, 20 bp, Artificial
  CRISPR gRNA sequence
ggcacaggggcagggctata

SEQ ID NO: 790237 - DNA, 20 bp, Artificial
  CRISPR gRNA sequence
caggggcagggctataaggt

SEQ ID NO: 790238 - DNA, 20 bp, Artificial
  CRISPR gRNA sequence
catatctgcacttgctgtgc

SEQ ID NO: 790239 - DNA, 20 bp, Artificial
  CRISPR gRNA sequence
atatctgcacttgctgtgcc

SEQ ID NO: 790240 - DNA, 20 bp, Artificial
  CRISPR gRNA sequence
acttgctgtgccaggttgca

SEQ ID NO: 790241 - DNA, 20 bp, Artificial
  CRISPR gRNA sequence
gtgccaggttgcaaagaccc

SEQ ID NO: 790242 - DNA, 20 bp, Artificial
  CRISPR gRNA sequence
ggttgcaaagaccctggaat

SEQ ID NO: 790243 - DNA, 20 bp, Artificial
  CRISPR gRNA sequence
gttgcaaagaccctggaata

SEQ ID NO: 790244 - DNA, 20 bp, Artificial
  CRISPR gRNA sequence
cctggaataaggcatgtaaa

SEQ ID NO: 790245 - DNA, 20 bp, Artificial
  CRISPR gRNA sequence
tggaataaggcatgtaaaaa

SEQ ID NO: 790246 - DNA, 20 bp, Artificial
  CRISPR gRNA sequence
attttaatccactgcacact

SEQ ID NO: 790247 - DNA, 20 bp, Artificial
  CRISPR gRNA sequence
aatccactgcacacttggaa

SEQ ID NO: 790248 - DNA, 20 bp, Artificial
  CRISPR gRNA sequence
acttggaatagctctcacct

SEQ ID NO: 790249 - DNA, 20 bp, Artificial
  CRISPR gRNA sequence
tcacctcagaatctccataa

SEQ ID NO: 790250 - DNA, 20 bp, Artificial
  CRISPR gRNA sequence
cacctcagaatctccataat

SEQ ID NO: 790251 - DNA, 20 bp, Artificial
  CRISPR gRNA sequence
ctccataatgggaccctctt

SEQ ID NO: 790252 - DNA, 20 bp, Artificial
  CRISPR gRNA sequence
tccataatgggaccctctta

SEQ ID NO: 790253 - DNA, 20 bp, Artificial
  CRISPR gRNA sequence
ccataatgggaccctcttaa

SEQ ID NO: 790254 - DNA, 20 bp, Artificial
  CRISPR gRNA sequence
taatgggaccctcttaaggg

SEQ ID NO: 790255 - DNA, 20 bp, Artificial
  CRISPR gRNA sequence
aagggcagatccctttatga

SEQ ID NO: 790256 - DNA, 20 bp, Artificial
  CRISPR gRNA sequence
ggcagatccctttatgatgg

SEQ ID NO: 790257 - DNA, 20 bp, Artificial
  CRISPR gRNA sequence
gaagccgtccttaaatactt

SEQ ID NO: 790258 - DNA, 20 bp, Artificial
  CRISPR gRNA sequence
ccttaaatacttgagttatt

SEQ ID NO: 790259 - DNA, 20 bp, Artificial
  CRISPR gRNA sequence
aagtcccttataacttaatg

SEQ ID NO: 790260 - DNA, 20 bp, Artificial
  CRISPR gRNA sequence
gtcccttataacttaatgca

SEQ ID NO: 790261 - DNA, 20 bp, Artificial
  CRISPR gRNA sequence
ccaaatccaatctgtccttg

SEQ ID NO: 790262 - DNA, 20 bp, Artificial
  CRISPR gRNA sequence
tcaactattcatcaaatatg

SEQ ID NO: 790263 - DNA, 20 bp, Artificial
  CRISPR gRNA sequence
atatgtagtaatcatatgcc

SEQ ID NO: 790264 - DNA, 20 bp, Artificial
  CRISPR gRNA sequence
agtaatcatatgccaagttc

SEQ ID NO: 790265 - DNA, 20 bp, Artificial
  CRISPR gRNA sequence
gtttaattacatttgataaa

SEQ ID NO: 790266 - DNA, 20 bp, Artificial
  CRISPR gRNA sequence
tttaattacatttgataaac

SEQ ID NO: 790267 - DNA, 20 bp, Artificial
  CRISPR gRNA sequence
tacatttgataaacaggaaa

SEQ ID NO: 790268 - DNA, 20 bp, Artificial
  CRISPR gRNA sequence
acatttgataaacaggaaac

SEQ ID NO: 790269 - DNA, 20 bp, Artificial
  CRISPR gRNA sequence
catttgataaacaggaaaca

SEQ ID NO: 790270 - DNA, 20 bp, Artificial
  CRISPR gRNA sequence
ttgataaacaggaaacaggg

SEQ ID NO: 790271 - DNA, 20 bp, Artificial
  CRISPR gRNA sequence
acaggaaacagggaagaaaa

SEQ ID NO: 790272 - DNA, 20 bp, Artificial
  CRISPR gRNA sequence
caggaaacagggaagaaaat

SEQ ID NO: 790273 - DNA, 20 bp, Artificial
  CRISPR gRNA sequence
aggaaacagggaagaaaatg

SEQ ID NO: 790274 - DNA, 20 bp, Artificial
  CRISPR gRNA sequence
gggaagaaaatggggcttac

SEQ ID NO: 790275 - DNA, 20 bp, Artificial
  CRISPR gRNA sequence
ggaagaaaatggggcttaca

SEQ ID NO: 790276 - DNA, 20 bp, Artificial
  CRISPR gRNA sequence
agaaaatggggcttacaagg

SEQ ID NO: 790277 - DNA, 20 bp, Artificial
  CRISPR gRNA sequence
gaaaatggggcttacaagga

SEQ ID NO: 790278 - DNA, 20 bp, Artificial
  CRISPR gRNA sequence
atggggcttacaaggaaggt

SEQ ID NO: 790279 - DNA, 20 bp, Artificial
  CRISPR gRNA sequence
tacaaggaaggttagttgct

SEQ ID NO: 790280 - DNA, 20 bp, Artificial
  CRISPR gRNA sequence
tgctgagtctgcataacaac

SEQ ID NO: 790281 - DNA, 20 bp, Artificial
  CRISPR gRNA sequence
gcataacaacaagaattaaa

SEQ ID NO: 790282 - DNA, 20 bp, Artificial
  CRISPR gRNA sequence
aagaattaaatagatgactt

SEQ ID NO: 790283 - DNA, 20 bp, Artificial
  CRISPR gRNA sequence
agaattaaatagatgacttt

SEQ ID NO: 790284 - DNA, 20 bp, Artificial
  CRISPR gRNA sequence
attaaatagatgactttggg

SEQ ID NO: 790285 - DNA, 20 bp, Artificial
  CRISPR gRNA sequence
taaatagatgactttgggta

SEQ ID NO: 790286 - DNA, 20 bp, Artificial
  CRISPR gRNA sequence
tagagactgttgaatctatt

SEQ ID NO: 790287 - DNA, 20 bp, Artificial
  CRISPR gRNA sequence
gcactatgctttcttgtcat

SEQ ID NO: 790288 - DNA, 20 bp, Artificial
  CRISPR gRNA sequence
tatgctttcttgtcataaga

SEQ ID NO: 790289 - DNA, 20 bp, Artificial
  CRISPR gRNA sequence
atgctttcttgtcataagaa

SEQ ID NO: 790290 - DNA, 20 bp, Artificial
  CRISPR gRNA sequence
tgctttcttgtcataagaaa

SEQ ID NO: 790291 - DNA, 20 bp, Artificial
  CRISPR gRNA sequence
ggaacgcctataacttcctc

SEQ ID NO: 790292 - DNA, 20 bp, Artificial
  CRISPR gRNA sequence
acttcctctggaactcccct

SEQ ID NO: 790293 - DNA, 20 bp, Artificial
  CRISPR gRNA sequence
ctggaactccccttagctta

SEQ ID NO: 790294 - DNA, 20 bp, Artificial
  CRISPR gRNA sequence
gaactccccttagcttacag

SEQ ID NO: 790295 - DNA, 20 bp, Artificial
  CRISPR gRNA sequence
gaactcccctctttactgcc

SEQ ID NO: 790296 - DNA, 20 bp, Artificial
  CRISPR gRNA sequence
aactcccctctttactgcct

SEQ ID NO: 790297 - DNA, 20 bp, Artificial
  CRISPR gRNA sequence
actgcctgggcctttgataa

SEQ ID NO: 790298 - DNA, 20 bp, Artificial
  CRISPR gRNA sequence
atttttcctgtctgccttgt

SEQ ID NO: 790299 - DNA, 20 bp, Artificial
  CRISPR gRNA sequence
tgccttgtaagaatgcgtgc

SEQ ID NO: 790300 - DNA, 20 bp, Artificial
  CRISPR gRNA sequence
gccttgtaagaatgcgtgcc

SEQ ID NO: 790301 - DNA, 20 bp, Artificial
  CRISPR gRNA sequence
cttgtaagaatgcgtgccag

SEQ ID NO: 790302 - DNA, 20 bp, Artificial
  CRISPR gRNA sequence
agaatgcgtgccaggagtga

SEQ ID NO: 790303 - DNA, 20 bp, Artificial
  CRISPR gRNA sequence
gaatgcgtgccaggagtgat

SEQ ID NO: 790304 - DNA, 20 bp, Artificial
  CRISPR gRNA sequence
gcataaaatatgctacttgt

SEQ ID NO: 790305 - DNA, 20 bp, Artificial
  CRISPR gRNA sequence
aaaatatgctacttgtcaga

SEQ ID NO: 790306 - DNA, 20 bp, Artificial
  CRISPR gRNA sequence
aaatatgctacttgtcagac

SEQ ID NO: 790307 - DNA, 20 bp, Artificial
  CRISPR gRNA sequence
gtcagacaggtgacattttt

SEQ ID NO: 790308 - DNA, 20 bp, Artificial
  CRISPR gRNA sequence
atttttcagctaatatttac

SEQ ID NO: 790309 - DNA, 20 bp, Artificial
  CRISPR gRNA sequence
ttttcagctaatatttacaa

SEQ ID NO: 790310 - DNA, 20 bp, Artificial
  CRISPR gRNA sequence
agctaatatttacaagagaa

SEQ ID NO: 790311 - DNA, 20 bp, Artificial
  CRISPR gRNA sequence
ctaatatttacaagagaaaa

SEQ ID NO: 790312 - DNA, 20 bp, Artificial
  CRISPR gRNA sequence
ttacaagagaaaagagcaat

SEQ ID NO: 790313 - DNA, 20 bp, Artificial
  CRISPR gRNA sequence
acatgaatcatatgtctgaa

SEQ ID NO: 790314 - DNA, 20 bp, Artificial
  CRISPR gRNA sequence
aatcatatgtctgaatagct

SEQ ID NO: 790315 - DNA, 20 bp, Artificial
  CRISPR gRNA sequence
tctgaatagctcagaatacc

SEQ ID NO: 790316 - DNA, 20 bp, Artificial
  CRISPR gRNA sequence
gaatagctcagaatacctag

SEQ ID NO: 790317 - DNA, 20 bp, Artificial
  CRISPR gRNA sequence
ctagaagattaattgttact

SEQ ID NO: 790318 - DNA, 20 bp, Artificial
  CRISPR gRNA sequence
acttggtctaattttgcccc

SEQ ID NO: 790319 - DNA, 20 bp, Artificial
  CRISPR gRNA sequence
gtctaattttgccccaagta

SEQ ID NO: 790320 - DNA, 20 bp, Artificial
  CRISPR gRNA sequence
ttgccccaagtaaagtttct

SEQ ID NO: 790321 - DNA, 20 bp, Artificial
  CRISPR gRNA sequence
ttctaagacatgcaaacttt

SEQ ID NO: 790322 - DNA, 20 bp, Artificial
  CRISPR gRNA sequence
ttgattactccatacaaaat

SEQ ID NO: 790323 - DNA, 20 bp, Artificial
  CRISPR gRNA sequence
gattactccatacaaaataa

SEQ ID NO: 790324 - DNA, 20 bp, Artificial
  CRISPR gRNA sequence
attactccatacaaaataag

SEQ ID NO: 790325 - DNA, 20 bp, Artificial
  CRISPR gRNA sequence
tccatacaaaataagaggtt

SEQ ID NO: 790326 - DNA, 20 bp, Artificial
  CRISPR gRNA sequence
ccatacaaaataagaggttt

SEQ ID NO: 790327 - DNA, 20 bp, Artificial
  CRISPR gRNA sequence
aagaggtttaggcaatgcaa

SEQ ID NO: 790328 - DNA, 20 bp, Artificial
  CRISPR gRNA sequence
gaaacattcttgcttattgt

SEQ ID NO: 790329 - DNA, 20 bp, Artificial
  CRISPR gRNA sequence
ttcttgcttattgtaagtta

SEQ ID NO: 790330 - DNA, 20 bp, Artificial
  CRISPR gRNA sequence
cttgcttattgtaagttaca

SEQ ID NO: 790331 - DNA, 20 bp, Artificial
  CRISPR gRNA sequence
ttgcttattgtaagttacag

SEQ ID NO: 790332 - DNA, 20 bp, Artificial
  CRISPR gRNA sequence
tgtaagttacagaggcaatc

SEQ ID NO: 790333 - DNA, 20 bp, Artificial
  CRISPR gRNA sequence
ctgatgcaaacaattctatg

SEQ ID NO: 790334 - DNA, 20 bp, Artificial
  CRISPR gRNA sequence
gatgcaaacaattctatgaa

SEQ ID NO: 790335 - DNA, 20 bp, Artificial
  CRISPR gRNA sequence
atgcaaacaattctatgaag

SEQ ID NO: 790336 - DNA, 20 bp, Artificial
  CRISPR gRNA sequence
ctatgaagaggttttttctc

SEQ ID NO: 790337 - DNA, 20 bp, Artificial
  CRISPR gRNA sequence
aagaggttttttctcaagcc

SEQ ID NO: 790338 - DNA, 20 bp, Artificial
  CRISPR gRNA sequence
tctcaagcccagctgcaaat

SEQ ID NO: 790339 - DNA, 20 bp, Artificial
  CRISPR gRNA sequence
agctgcaaattagattcact

SEQ ID NO: 790340 - DNA, 20 bp, Artificial
  CRISPR gRNA sequence
tgcaaattagattcactaag

SEQ ID NO: 790341 - DNA, 20 bp, Artificial
  CRISPR gRNA sequence
caaattagattcactaagca

SEQ ID NO: 790342 - DNA, 20 bp, Artificial
  CRISPR gRNA sequence
aaattagattcactaagcag

SEQ ID NO: 790343 - DNA, 20 bp, Artificial
  CRISPR gRNA sequence
aattagattcactaagcaga

SEQ ID NO: 790344 - DNA, 20 bp, Artificial
  CRISPR gRNA sequence
taagcagagggcctcaatct

SEQ ID NO: 790345 - DNA, 20 bp, Artificial
  CRISPR gRNA sequence
gcctcaatcttggctaacat

SEQ ID NO: 790346 - DNA, 20 bp, Artificial
  CRISPR gRNA sequence
tggctaacattggaatcacc

SEQ ID NO: 790347 - DNA, 20 bp, Artificial
  CRISPR gRNA sequence
ggctaacattggaatcacct

SEQ ID NO: 790348 - DNA, 20 bp, Artificial
  CRISPR gRNA sequence
ctaacattggaatcacctgg

SEQ ID NO: 790349 - DNA, 20 bp, Artificial
  CRISPR gRNA sequence
taacattggaatcacctggg

SEQ ID NO: 790350 - DNA, 20 bp, Artificial
  CRISPR gRNA sequence
ttttaaaacacactaatgcc

SEQ ID NO: 790351 - DNA, 20 bp, Artificial
  CRISPR gRNA sequence
tttaaaacacactaatgccc

SEQ ID NO: 790352 - DNA, 20 bp, Artificial
  CRISPR gRNA sequence
ctaatgcccaggcactactt

SEQ ID NO: 790353 - DNA, 20 bp, Artificial
  CRISPR gRNA sequence
ctgttaaaattacattattt

SEQ ID NO: 790354 - DNA, 20 bp, Artificial
  CRISPR gRNA sequence
gttaaaattacattattttg

SEQ ID NO: 790355 - DNA, 20 bp, Artificial
  CRISPR gRNA sequence
aattacattattttggagat

SEQ ID NO: 790356 - DNA, 20 bp, Artificial
  CRISPR gRNA sequence
attacattattttggagatg

SEQ ID NO: 790357 - DNA, 20 bp, Artificial
  CRISPR gRNA sequence
cattattttggagatgaggt

SEQ ID NO: 790358 - DNA, 20 bp, Artificial
  CRISPR gRNA sequence
agatgaggtcagcatcatta

SEQ ID NO: 790359 - DNA, 20 bp, Artificial
  CRISPR gRNA sequence
cattaaagattttcttttcc

SEQ ID NO: 790360 - DNA, 20 bp, Artificial
  CRISPR gRNA sequence
attaaagattttcttttcct

SEQ ID NO: 790361 - DNA, 20 bp, Artificial
  CRISPR gRNA sequence
taaagattttcttttcctgg

SEQ ID NO: 790362 - DNA, 20 bp, Artificial
  CRISPR gRNA sequence
tcttttcctgggagcttcta

SEQ ID NO: 790363 - DNA, 20 bp, Artificial
  CRISPR gRNA sequence
tcctgggagcttctaaagtg

SEQ ID NO: 790364 - DNA, 20 bp, Artificial
  CRISPR gRNA sequence
gggagcttctaaagtgcaga

SEQ ID NO: 790365 - DNA, 20 bp, Artificial
  CRISPR gRNA sequence
cagacagtattgcgaaccat

SEQ ID NO: 790366 - DNA, 20 bp, Artificial
  CRISPR gRNA sequence
tgcgaaccattagttacaca

SEQ ID NO: 790367 - DNA, 20 bp, Artificial
  CRISPR gRNA sequence
aaagtaacatttgcacgtgc

SEQ ID NO: 790368 - DNA, 20 bp, Artificial
  CRISPR gRNA sequence
cttttaccaccttgccttca

SEQ ID NO: 790369 - DNA, 20 bp, Artificial
  CRISPR gRNA sequence
gtgttgtcctcaacttcacc

SEQ ID NO: 790370 - DNA, 20 bp, Artificial
  CRISPR gRNA sequence
ttgtcctcaacttcacctgg

SEQ ID NO: 790371 - DNA, 20 bp, Artificial
  CRISPR gRNA sequence
cctcaacttcacctggaagc

SEQ ID NO: 790372 - DNA, 20 bp, Artificial
  CRISPR gRNA sequence
ctcaacttcacctggaagct

SEQ ID NO: 790373 - DNA, 20 bp, Artificial
  CRISPR gRNA sequence
aacttcacctggaagctagg

SEQ ID NO: 790374 - DNA, 20 bp, Artificial
  CRISPR gRNA sequence
ctggaagctaggtagaaatg

SEQ ID NO: 790375 - DNA, 20 bp, Artificial
  CRISPR gRNA sequence
aggtagaaatgtagaatttc

SEQ ID NO: 790376 - DNA, 20 bp, Artificial
  CRISPR gRNA sequence
gtagaatttcaagccttccc

SEQ ID NO: 790377 - DNA, 20 bp, Artificial
  CRISPR gRNA sequence
tttcaagccttccccagacc

SEQ ID NO: 790378 - DNA, 20 bp, Artificial
  CRISPR gRNA sequence
ttcaagccttccccagacct

SEQ ID NO: 790379 - DNA, 20 bp, Artificial
  CRISPR gRNA sequence
tcaagccttccccagaccta

SEQ ID NO: 790380 - DNA, 20 bp, Artificial
  CRISPR gRNA sequence
cttccccagacctagggaat

SEQ ID NO: 790381 - DNA, 20 bp, Artificial
  CRISPR gRNA sequence
ttccccagacctagggaatc

SEQ ID NO: 790382 - DNA, 20 bp, Artificial
  CRISPR gRNA sequence
ggaatcaggatctgcatttt

SEQ ID NO: 790383 - DNA, 20 bp, Artificial
  CRISPR gRNA sequence
atcaggatctgcattttaag

SEQ ID NO: 790384 - DNA, 20 bp, Artificial
  CRISPR gRNA sequence
tcaggatctgcattttaaga

SEQ ID NO: 790385 - DNA, 20 bp, Artificial
  CRISPR gRNA sequence
tctgcattttaagaaggtca

SEQ ID NO: 790386 - DNA, 20 bp, Artificial
  CRISPR gRNA sequence
ttgcatgcacattaatgttt

SEQ ID NO: 790387 - DNA, 20 bp, Artificial
  CRISPR gRNA sequence
catgcacattaatgtttgag

SEQ ID NO: 790388 - DNA, 20 bp, Artificial
  CRISPR gRNA sequence
gcacattaatgtttgagaag

SEQ ID NO: 790389 - DNA, 20 bp, Artificial
  CRISPR gRNA sequence
acattaatgtttgagaagta

SEQ ID NO: 790390 - DNA, 20 bp, Artificial
  CRISPR gRNA sequence
gagaagtagagttataacac

SEQ ID NO: 790391 - DNA, 20 bp, Artificial
  CRISPR gRNA sequence
ttataacactggtctgcatt

SEQ ID NO: 790392 - DNA, 20 bp, Artificial
  CRISPR gRNA sequence
gtctgcatttggactgtcac

SEQ ID NO: 790393 - DNA, 20 bp, Artificial
  CRISPR gRNA sequence
tctgcatttggactgtcact

SEQ ID NO: 790394 - DNA, 20 bp, Artificial
  CRISPR gRNA sequence
gcatttggactgtcactggg

SEQ ID NO: 790395 - DNA, 20 bp, Artificial
  CRISPR gRNA sequence
tttggactgtcactgggaag

SEQ ID NO: 790396 - DNA, 20 bp, Artificial
  CRISPR gRNA sequence
gtcactgggaagtagcgtaa

SEQ ID NO: 790397 - DNA, 20 bp, Artificial
  CRISPR gRNA sequence
tagttgatatttcttaaaca

SEQ ID NO: 790398 - DNA, 20 bp, Artificial
  CRISPR gRNA sequence
tgatatttcttaaacacagt

SEQ ID NO: 790399 - DNA, 20 bp, Artificial
  CRISPR gRNA sequence
atttcttaaacacagtaagt

SEQ ID NO: 790400 - DNA, 20 bp, Artificial
  CRISPR gRNA sequence
aaacacagtaagtcagacac

SEQ ID NO: 790401 - DNA, 20 bp, Artificial
  CRISPR gRNA sequence
aacacagtaagtcagacact

SEQ ID NO: 790402 - DNA, 20 bp, Artificial
  CRISPR gRNA sequence
cagtaagtcagacactgggc

SEQ ID NO: 790403 - DNA, 20 bp, Artificial
  CRISPR gRNA sequence
atcatttcatctgatcctcc

SEQ ID NO: 790404 - DNA, 20 bp, Artificial
  CRISPR gRNA sequence
gatcctcccagcaactctgc

SEQ ID NO: 790405 - DNA, 20 bp, Artificial
  CRISPR gRNA sequence
atcctcccagcaactctgcg

SEQ ID NO: 790406 - DNA, 20 bp, Artificial
  CRISPR gRNA sequence
ctcccagcaactctgcgagg

SEQ ID NO: 790407 - DNA, 20 bp, Artificial
  CRISPR gRNA sequence
atgttgctatccacatttta

SEQ ID NO: 790408 - DNA, 20 bp, Artificial
  CRISPR gRNA sequence
tgctatccacattttacaga

SEQ ID NO: 790409 - DNA, 20 bp, Artificial
  CRISPR gRNA sequence
gctatccacattttacagat

SEQ ID NO: 790410 - DNA, 20 bp, Artificial
  CRISPR gRNA sequence
ctatccacattttacagatg

SEQ ID NO: 790411 - DNA, 20 bp, Artificial
  CRISPR gRNA sequence
attttacagatggggaaact

SEQ ID NO: 790412 - DNA, 20 bp, Artificial
  CRISPR gRNA sequence
ttttacagatggggaaactg

SEQ ID NO: 790413 - DNA, 20 bp, Artificial
  CRISPR gRNA sequence
gatggggaaactgaggctca

SEQ ID NO: 790414 - DNA, 20 bp, Artificial
  CRISPR gRNA sequence
ggggaaactgaggctcaaag

SEQ ID NO: 790415 - DNA, 20 bp, Artificial
  CRISPR gRNA sequence
agaagtgatgcaacttgccc

SEQ ID NO: 790416 - DNA, 20 bp, Artificial
  CRISPR gRNA sequence
gaagtgatgcaacttgccca

SEQ ID NO: 790417 - DNA, 20 bp, Artificial
  CRISPR gRNA sequence
atgcaacttgcccaaggtca

SEQ ID NO: 790418 - DNA, 20 bp, Artificial
  CRISPR gRNA sequence
acttgcccaaggtcaaagaa

SEQ ID NO: 790419 - DNA, 20 bp, Artificial
  CRISPR gRNA sequence
tgcccaaggtcaaagaatgg

SEQ ID NO: 790420 - DNA, 20 bp, Artificial
  CRISPR gRNA sequence
ggtcaaagaatggtagctca

SEQ ID NO: 790421 - DNA, 20 bp, Artificial
  CRISPR gRNA sequence
agaatggtagctcatggaac

SEQ ID NO: 790422 - DNA, 20 bp, Artificial
  CRISPR gRNA sequence
ttctgtgctaccaatgactg

SEQ ID NO: 790423 - DNA, 20 bp, Artificial
  CRISPR gRNA sequence
agttatgactatatatccac

SEQ ID NO: 790424 - DNA, 20 bp, Artificial
  CRISPR gRNA sequence
catgtgtacactacatccat

SEQ ID NO: 790425 - DNA, 20 bp, Artificial
  CRISPR gRNA sequence
tgtacactacatccatgagt

SEQ ID NO: 790426 - DNA, 20 bp, Artificial
  CRISPR gRNA sequence
ttttttttttgctgtatgct

SEQ ID NO: 790427 - DNA, 20 bp, Artificial
  CRISPR gRNA sequence
tttttttttgctgtatgcta

SEQ ID NO: 790428 - DNA, 20 bp, Artificial
  CRISPR gRNA sequence
ttttgctgtatgctaaggaa

SEQ ID NO: 790429 - DNA, 20 bp, Artificial
  CRISPR gRNA sequence
tttctactttacatgccaca

SEQ ID NO: 790430 - DNA, 20 bp, Artificial
  CRISPR gRNA sequence
tgccacatggttattaaatt

SEQ ID NO: 790431 - DNA, 20 bp, Artificial
  CRISPR gRNA sequence
tattaaattaagcttcaacc

SEQ ID NO: 790432 - DNA, 20 bp, Artificial
  CRISPR gRNA sequence
attaaattaagcttcaacct

SEQ ID NO: 790433 - DNA, 20 bp, Artificial
  CRISPR gRNA sequence
aacctaggattgaactcctg

SEQ ID NO: 790434 - DNA, 20 bp, Artificial
  CRISPR gRNA sequence
acctaggattgaactcctga

SEQ ID NO: 790435 - DNA, 20 bp, Artificial
  CRISPR gRNA sequence
gattgaactcctgaaggtat

SEQ ID NO: 790436 - DNA, 20 bp, Artificial
  CRISPR gRNA sequence
actcctgaaggtattagaca

SEQ ID NO: 790437 - DNA, 20 bp, Artificial
  CRISPR gRNA sequence
ctcctgaaggtattagacaa

SEQ ID NO: 790438 - DNA, 20 bp, Artificial
  CRISPR gRNA sequence
cctgaaggtattagacaaag

SEQ ID NO: 790439 - DNA, 20 bp, Artificial
  CRISPR gRNA sequence
tattagacaaaggagaaaac

SEQ ID NO: 790440 - DNA, 20 bp, Artificial
  CRISPR gRNA sequence
tagacaaaggagaaaactgg

SEQ ID NO: 790441 - DNA, 20 bp, Artificial
  CRISPR gRNA sequence
agacaaaggagaaaactgga

SEQ ID NO: 790442 - DNA, 20 bp, Artificial
  CRISPR gRNA sequence
gtttccacaactacaaaatt

SEQ ID NO: 790443 - DNA, 20 bp, Artificial
  CRISPR gRNA sequence
acaaaattaagctgacaaca

SEQ ID NO: 790444 - DNA, 20 bp, Artificial
  CRISPR gRNA sequence
caaaattaagctgacaacac

SEQ ID NO: 790445 - DNA, 20 bp, Artificial
  CRISPR gRNA sequence
acacaggctttccattcatg

SEQ ID NO: 790446 - DNA, 20 bp, Artificial
  CRISPR gRNA sequence
cacaggctttccattcatgt

SEQ ID NO: 790447 - DNA, 20 bp, Artificial
  CRISPR gRNA sequence
acaggctttccattcatgtg

SEQ ID NO: 790448 - DNA, 20 bp, Artificial
  CRISPR gRNA sequence
tggggcccttaactaaacta

SEQ ID NO: 790449 - DNA, 20 bp, Artificial
  CRISPR gRNA sequence
ggggcccttaactaaactaa

SEQ ID NO: 790450 - DNA, 20 bp, Artificial
  CRISPR gRNA sequence
gggcccttaactaaactaaa

SEQ ID NO: 790451 - DNA, 20 bp, Artificial
  CRISPR gRNA sequence
ttaactaaactaaagggcaa

SEQ ID NO: 790452 - DNA, 20 bp, Artificial
  CRISPR gRNA sequence
aaactaaagggcaaaagact

SEQ ID NO: 790453 - DNA, 20 bp, Artificial
  CRISPR gRNA sequence
aagggcaaaagacttggcaa

SEQ ID NO: 790454 - DNA, 20 bp, Artificial
  CRISPR gRNA sequence
gcatgaaaaattcatgtatg

SEQ ID NO: 790455 - DNA, 20 bp, Artificial
  CRISPR gRNA sequence
catgaaaaattcatgtatgc

SEQ ID NO: 790456 - DNA, 20 bp, Artificial
  CRISPR gRNA sequence
atgtatgcaggtccttttgc

SEQ ID NO: 790457 - DNA, 20 bp, Artificial
  CRISPR gRNA sequence
tgcaggtccttttgctagat

SEQ ID NO: 790458 - DNA, 20 bp, Artificial
  CRISPR gRNA sequence
ttttgctagattagaacacc

SEQ ID NO: 790459 - DNA, 20 bp, Artificial
  CRISPR gRNA sequence
tgatgcatttcaaaaattct

SEQ ID NO: 790460 - DNA, 20 bp, Artificial
  CRISPR gRNA sequence
gatgcatttcaaaaattctt

SEQ ID NO: 790461 - DNA, 20 bp, Artificial
  CRISPR gRNA sequence
atgcatttcaaaaattcttg

SEQ ID NO: 790462 - DNA, 20 bp, Artificial
  CRISPR gRNA sequence
tgcatttcaaaaattcttgg

SEQ ID NO: 790463 - DNA, 20 bp, Artificial
  CRISPR gRNA sequence
catttcaaaaattcttgggg

SEQ ID NO: 790464 - DNA, 20 bp, Artificial
  CRISPR gRNA sequence
ctttgcattttattgcaatg

SEQ ID NO: 790465 - DNA, 20 bp, Artificial
  CRISPR gRNA sequence
ttattgcaatgaagcatcaa

SEQ ID NO: 790466 - DNA, 20 bp, Artificial
  CRISPR gRNA sequence
ttgcaatgaagcatcaatgg

SEQ ID NO: 790467 - DNA, 20 bp, Artificial
  CRISPR gRNA sequence
aatgaagcatcaatggtagt

SEQ ID NO: 790468 - DNA, 20 bp, Artificial
  CRISPR gRNA sequence
gtcagcacctgtcacttatt

SEQ ID NO: 790469 - DNA, 20 bp, Artificial
  CRISPR gRNA sequence
tcagcacctgtcacttattc

SEQ ID NO: 790470 - DNA, 20 bp, Artificial
  CRISPR gRNA sequence
aattatttgcattacctccc

SEQ ID NO: 790471 - DNA, 20 bp, Artificial
  CRISPR gRNA sequence
atttgcattacctcccaaga

SEQ ID NO: 790472 - DNA, 20 bp, Artificial
  CRISPR gRNA sequence
gatagcttcctcttgaaact

SEQ ID NO: 790473 - DNA, 20 bp, Artificial
  CRISPR gRNA sequence
ttatcccccacatttaacaa

SEQ ID NO: 790474 - DNA, 20 bp, Artificial
  CRISPR gRNA sequence
tcccccacatttaacaacag

SEQ ID NO: 790475 - DNA, 20 bp, Artificial
  CRISPR gRNA sequence
acatttaacaacagaagtgt

SEQ ID NO: 790476 - DNA, 20 bp, Artificial
  CRISPR gRNA sequence
aacagaagtgtaagtttttt

SEQ ID NO: 790477 - DNA, 20 bp, Artificial
  CRISPR gRNA sequence
acttgccacgtaatgtactt

SEQ ID NO: 790478 - DNA, 20 bp, Artificial
  CRISPR gRNA sequence
tgccacgtaatgtacttgag

SEQ ID NO: 790479 - DNA, 20 bp, Artificial
  CRISPR gRNA sequence
acgtaatgtacttgagaagt

SEQ ID NO: 790480 - DNA, 20 bp, Artificial
  CRISPR gRNA sequence
cgtaatgtacttgagaagta

SEQ ID NO: 790481 - DNA, 20 bp, Artificial
  CRISPR gRNA sequence
gtaatgtacttgagaagtaa

SEQ ID NO: 790482 - DNA, 20 bp, Artificial
  CRISPR gRNA sequence
atgtacttgagaagtaaggg

SEQ ID NO: 790483 - DNA, 20 bp, Artificial
  CRISPR gRNA sequence
tgtacttgagaagtaagggt

SEQ ID NO: 790484 - DNA, 20 bp, Artificial
  CRISPR gRNA sequence
gtacttgagaagtaagggtg

SEQ ID NO: 790485 - DNA, 20 bp, Artificial
  CRISPR gRNA sequence
cttgagaagtaagggtgggg

SEQ ID NO: 790486 - DNA, 20 bp, Artificial
  CRISPR gRNA sequence
ttgagaagtaagggtggggt

SEQ ID NO: 790487 - DNA, 20 bp, Artificial
  CRISPR gRNA sequence
tgagaagtaagggtggggtg

SEQ ID NO: 790488 - DNA, 20 bp, Artificial
  CRISPR gRNA sequence
gagaagtaagggtggggtgg

SEQ ID NO: 790489 - DNA, 20 bp, Artificial
  CRISPR gRNA sequence
agaagtaagggtggggtggg

SEQ ID NO: 790490 - DNA, 20 bp, Artificial
  CRISPR gRNA sequence
gaagtaagggtggggtgggg

SEQ ID NO: 790491 - DNA, 20 bp, Artificial
  CRISPR gRNA sequence
gggtgggggggtgctttaca

SEQ ID NO: 790492 - DNA, 20 bp, Artificial
  CRISPR gRNA sequence
ctttacatagccacattctt

SEQ ID NO: 790493 - DNA, 20 bp, Artificial
  CRISPR gRNA sequence
acattcttcagaaaactctg

SEQ ID NO: 790494 - DNA, 20 bp, Artificial
  CRISPR gRNA sequence
tcagaaaactctgaagttcc

SEQ ID NO: 790495 - DNA, 20 bp, Artificial
  CRISPR gRNA sequence
aaactctgaagttcctggtt

SEQ ID NO: 790496 - DNA, 20 bp, Artificial
  CRISPR gRNA sequence
aactctgaagttcctggttt

SEQ ID NO: 790497 - DNA, 20 bp, Artificial
  CRISPR gRNA sequence
ttaggacaaaatcctgctct

SEQ ID NO: 790498 - DNA, 20 bp, Artificial
  CRISPR gRNA sequence
cacctgactcatgctctgct

SEQ ID NO: 790499 - DNA, 20 bp, Artificial
  CRISPR gRNA sequence
gactcatgctctgctcagtg

SEQ ID NO: 790500 - DNA, 20 bp, Artificial
  CRISPR gRNA sequence
actcatgctctgctcagtgt

SEQ ID NO: 790501 - DNA, 20 bp, Artificial
  CRISPR gRNA sequence
tcatgctctgctcagtgtag

SEQ ID NO: 790502 - DNA, 20 bp, Artificial
  CRISPR gRNA sequence
catgctctgctcagtgtagg

SEQ ID NO: 790503 - DNA, 20 bp, Artificial
  CRISPR gRNA sequence
ctcagtgtaggaggactgca

SEQ ID NO: 790504 - DNA, 20 bp, Artificial
  CRISPR gRNA sequence
cagtgtaggaggactgcatg

SEQ ID NO: 790505 - DNA, 20 bp, Artificial
  CRISPR gRNA sequence
catggagacatgtcttcgca

SEQ ID NO: 790506 - DNA, 20 bp, Artificial
  CRISPR gRNA sequence
ttattctcctttgtttatct

SEQ ID NO: 790507 - DNA, 20 bp, Artificial
  CRISPR gRNA sequence
ttctcctttgtttatctcag

SEQ ID NO: 790508 - DNA, 20 bp, Artificial
  CRISPR gRNA sequence
cctttgtttatctcagcagt

SEQ ID NO: 790509 - DNA, 20 bp, Artificial
  CRISPR gRNA sequence
ttgtttatctcagcagtcag

SEQ ID NO: 790510 - DNA, 20 bp, Artificial
  CRISPR gRNA sequence
tgtttatctcagcagtcagc

SEQ ID NO: 790511 - DNA, 20 bp, Artificial
  CRISPR gRNA sequence
gtttatctcagcagtcagca

SEQ ID NO: 790512 - DNA, 20 bp, Artificial
  CRISPR gRNA sequence
tatctcagcagtcagcaggg

SEQ ID NO: 790513 - DNA, 20 bp, Artificial
  CRISPR gRNA sequence
agcagtcagcagggtagttt

SEQ ID NO: 790514 - DNA, 20 bp, Artificial
  CRISPR gRNA sequence
gcagggtagttttggatcta

SEQ ID NO: 790515 - DNA, 20 bp, Artificial
  CRISPR gRNA sequence
ggtagttttggatctaaaga

SEQ ID NO: 790516 - DNA, 20 bp, Artificial
  CRISPR gRNA sequence
gtagttttggatctaaagat

SEQ ID NO: 790517 - DNA, 20 bp, Artificial
  CRISPR gRNA sequence
tttggatctaaagataggcg

SEQ ID NO: 790518 - DNA, 20 bp, Artificial
  CRISPR gRNA sequence
ggatctaaagataggcgaag

SEQ ID NO: 790519 - DNA, 20 bp, Artificial
  CRISPR gRNA sequence
atctaaagataggcgaagtg

SEQ ID NO: 790520 - DNA, 20 bp, Artificial
  CRISPR gRNA sequence
ataggcgaagtggagtaacc

SEQ ID NO: 790521 - DNA, 20 bp, Artificial
  CRISPR gRNA sequence
taggcgaagtggagtaacct

SEQ ID NO: 790522 - DNA, 20 bp, Artificial
  CRISPR gRNA sequence
gaagtggagtaacctaggct

SEQ ID NO: 790523 - DNA, 20 bp, Artificial
  CRISPR gRNA sequence
aagtggagtaacctaggctg

SEQ ID NO: 790524 - DNA, 20 bp, Artificial
  CRISPR gRNA sequence
ctaggctgaggtctgtgccc

SEQ ID NO: 790525 - DNA, 20 bp, Artificial
  CRISPR gRNA sequence
tctgtgccccagaatgacct

SEQ ID NO: 790526 - DNA, 20 bp, Artificial
  CRISPR gRNA sequence
ctgtgccccagaatgacctc

SEQ ID NO: 790527 - DNA, 20 bp, Artificial
  CRISPR gRNA sequence
aatgacctcaggcatcacca

SEQ ID NO: 790528 - DNA, 20 bp, Artificial
  CRISPR gRNA sequence
aggcatcaccatggtcattg

SEQ ID NO: 790529 - DNA, 20 bp, Artificial
  CRISPR gRNA sequence
ccatggtcattgtggccctc

SEQ ID NO: 790530 - DNA, 20 bp, Artificial
  CRISPR gRNA sequence
ctctggttttcatctacctc

SEQ ID NO: 790531 - DNA, 20 bp, Artificial
  CRISPR gRNA sequence
ctggttttcatctacctctg

SEQ ID NO: 790532 - DNA, 20 bp, Artificial
  CRISPR gRNA sequence
tcatctacctctggagtacg

SEQ ID NO: 790533 - DNA, 20 bp, Artificial
  CRISPR gRNA sequence
atctacctctggagtacgaa

SEQ ID NO: 790534 - DNA, 20 bp, Artificial
  CRISPR gRNA sequence
ctacctctggagtacgaaga

SEQ ID NO: 790535 - DNA, 20 bp, Artificial
  CRISPR gRNA sequence
cctctggagtacgaagagag

SEQ ID NO: 790536 - DNA, 20 bp, Artificial
  CRISPR gRNA sequence
aagaaaaacatcaatgaaaa

SEQ ID NO: 790537 - DNA, 20 bp, Artificial
  CRISPR gRNA sequence
aaacatcaatgaaaaaagac

SEQ ID NO: 790538 - DNA, 20 bp, Artificial
  CRISPR gRNA sequence
aacatcaatgaaaaaagact

SEQ ID NO: 790539 - DNA, 20 bp, Artificial
  CRISPR gRNA sequence
acatcaatgaaaaaagactg

SEQ ID NO: 790540 - DNA, 20 bp, Artificial
  CRISPR gRNA sequence
tcaatgaaaaaagactgggg

SEQ ID NO: 790541 - DNA, 20 bp, Artificial
  CRISPR gRNA sequence
ctggggtggctctttcctct

SEQ ID NO: 790542 - DNA, 20 bp, Artificial
  CRISPR gRNA sequence
tctttcctctaagacatgac

SEQ ID NO: 790543 - DNA, 20 bp, Artificial
  CRISPR gRNA sequence
ctttcctctaagacatgaca

SEQ ID NO: 790544 - DNA, 20 bp, Artificial
  CRISPR gRNA sequence
caaggtataaaaaatatttc

SEQ ID NO: 790545 - DNA, 20 bp, Artificial
  CRISPR gRNA sequence
aaggtataaaaaatatttct

SEQ ID NO: 790546 - DNA, 20 bp, Artificial
  CRISPR gRNA sequence
aaaaaatatttctgggttat

SEQ ID NO: 790547 - DNA, 20 bp, Artificial
  CRISPR gRNA sequence
tctgggttataagatgtcct

SEQ ID NO: 790548 - DNA, 20 bp, Artificial
  CRISPR gRNA sequence
agattttgaaataaaaatgt

SEQ ID NO: 790549 - DNA, 20 bp, Artificial
  CRISPR gRNA sequence
gtaagaaaaaaaacaaatat

SEQ ID NO: 790550 - DNA, 20 bp, Artificial
  CRISPR gRNA sequence
tataagtgtgatatttgcaa

SEQ ID NO: 790551 - DNA, 20 bp, Artificial
  CRISPR gRNA sequence
ataagtgtgatatttgcaaa

SEQ ID NO: 790552 - DNA, 20 bp, Artificial
  CRISPR gRNA sequence
ttgcaaaaggatatacacat

SEQ ID NO: 790553 - DNA, 20 bp, Artificial
  CRISPR gRNA sequence
aggatatacacataagttaa

SEQ ID NO: 790554 - DNA, 20 bp, Artificial
  CRISPR gRNA sequence
acataagttaatggaacaaa

SEQ ID NO: 790555 - DNA, 20 bp, Artificial
  CRISPR gRNA sequence
agttaatggaacaaaaagtc

SEQ ID NO: 790556 - DNA, 20 bp, Artificial
  CRISPR gRNA sequence
tggaacaaaaagtccagaaa

SEQ ID NO: 790557 - DNA, 20 bp, Artificial
  CRISPR gRNA sequence
atgactaattgattttgatg

SEQ ID NO: 790558 - DNA, 20 bp, Artificial
  CRISPR gRNA sequence
ttgattttgatgaagattca

SEQ ID NO: 790559 - DNA, 20 bp, Artificial
  CRISPR gRNA sequence
tgattttgatgaagattcaa

SEQ ID NO: 790560 - DNA, 20 bp, Artificial
  CRISPR gRNA sequence
aagattcaaaggctattgaa

SEQ ID NO: 790561 - DNA, 20 bp, Artificial
  CRISPR gRNA sequence
agattcaaaggctattgaat

SEQ ID NO: 790562 - DNA, 20 bp, Artificial
  CRISPR gRNA sequence
gattcaaaggctattgaatg

SEQ ID NO: 790563 - DNA, 20 bp, Artificial
  CRISPR gRNA sequence
caaaggctattgaatgggga

SEQ ID NO: 790564 - DNA, 20 bp, Artificial
  CRISPR gRNA sequence
aaaggctattgaatggggaa

SEQ ID NO: 790565 - DNA, 20 bp, Artificial
  CRISPR gRNA sequence
gctattgaatggggaaagga

SEQ ID NO: 790566 - DNA, 20 bp, Artificial
  CRISPR gRNA sequence
ctattgaatggggaaaggat

SEQ ID NO: 790567 - DNA, 20 bp, Artificial
  CRISPR gRNA sequence
gatgggtgttttttaacaaa

SEQ ID NO: 790568 - DNA, 20 bp, Artificial
  CRISPR gRNA sequence
atgggtgttttttaacaaat

SEQ ID NO: 790569 - DNA, 20 bp, Artificial
  CRISPR gRNA sequence
tgggtgttttttaacaaatg

SEQ ID NO: 790570 - DNA, 20 bp, Artificial
  CRISPR gRNA sequence
tgttttttaacaaatggggc

SEQ ID NO: 790571 - DNA, 20 bp, Artificial
  CRISPR gRNA sequence
tctacatgtaaaactaaaat

SEQ ID NO: 790572 - DNA, 20 bp, Artificial
  CRISPR gRNA sequence
accttatataaaaattaaaa

SEQ ID NO: 790573 - DNA, 20 bp, Artificial
  CRISPR gRNA sequence
tggattataaaccttacata

SEQ ID NO: 790574 - DNA, 20 bp, Artificial
  CRISPR gRNA sequence
atatacaactacaaaatgtg

SEQ ID NO: 790575 - DNA, 20 bp, Artificial
  CRISPR gRNA sequence
tacaactacaaaatgtgtag

SEQ ID NO: 790576 - DNA, 20 bp, Artificial
  CRISPR gRNA sequence
aaaatgtgtagaagaaaata

SEQ ID NO: 790577 - DNA, 20 bp, Artificial
  CRISPR gRNA sequence
atgtgtagaagaaaatatag

SEQ ID NO: 790578 - DNA, 20 bp, Artificial
  CRISPR gRNA sequence
gaagacaatcttttacatct

SEQ ID NO: 790579 - DNA, 20 bp, Artificial
  CRISPR gRNA sequence
aagacaatcttttacatctt

SEQ ID NO: 790580 - DNA, 20 bp, Artificial
  CRISPR gRNA sequence
tttacatcttgggttatgta

SEQ ID NO: 790581 - DNA, 20 bp, Artificial
  CRISPR gRNA sequence
tacatcttgggttatgtaaa

SEQ ID NO: 790582 - DNA, 20 bp, Artificial
  CRISPR gRNA sequence
tgggttatgtaaagagtttt

SEQ ID NO: 790583 - DNA, 20 bp, Artificial
  CRISPR gRNA sequence
gtttttggatatgataccaa

SEQ ID NO: 790584 - DNA, 20 bp, Artificial
  CRISPR gRNA sequence
accaaaagcatgatccataa

SEQ ID NO: 790585 - DNA, 20 bp, Artificial
  CRISPR gRNA sequence
ttaaaatctttgctctgcaa

SEQ ID NO: 790586 - DNA, 20 bp, Artificial
  CRISPR gRNA sequence
tctttgctctgcaaaagaca

SEQ ID NO: 790587 - DNA, 20 bp, Artificial
  CRISPR gRNA sequence
gctctgcaaaagacacagtt

SEQ ID NO: 790588 - DNA, 20 bp, Artificial
  CRISPR gRNA sequence
gacacagttaagaaaatgaa

SEQ ID NO: 790589 - DNA, 20 bp, Artificial
  CRISPR gRNA sequence
agttaagaaaatgaaaagac

SEQ ID NO: 790590 - DNA, 20 bp, Artificial
  CRISPR gRNA sequence
gaaaatgaaaagacaagcta

SEQ ID NO: 790591 - DNA, 20 bp, Artificial
  CRISPR gRNA sequence
agacaagctacagacttcaa

SEQ ID NO: 790592 - DNA, 20 bp, Artificial
  CRISPR gRNA sequence
ttgaaaatcaatatctgata

SEQ ID NO: 790593 - DNA, 20 bp, Artificial
  CRISPR gRNA sequence
tctgataaagaacttgtatc

SEQ ID NO: 790594 - DNA, 20 bp, Artificial
  CRISPR gRNA sequence
aagaacttgtatctagaata

SEQ ID NO: 790595 - DNA, 20 bp, Artificial
  CRISPR gRNA sequence
atctagaataaagaactctt

SEQ ID NO: 790596 - DNA, 20 bp, Artificial
  CRISPR gRNA sequence
tctagaataaagaactctta

SEQ ID NO: 790597 - DNA, 20 bp, Artificial
  CRISPR gRNA sequence
ataaagaactcttaaggtcg

SEQ ID NO: 790598 - DNA, 20 bp, Artificial
  CRISPR gRNA sequence
aagaactcttaaggtcgtgg

SEQ ID NO: 790599 - DNA, 20 bp, Artificial
  CRISPR gRNA sequence
aactcttaaggtcgtggcag

SEQ ID NO: 790600 - DNA, 20 bp, Artificial
  CRISPR gRNA sequence
gtggctcacacctgtaatcc

SEQ ID NO: 790601 - DNA, 20 bp, Artificial
  CRISPR gRNA sequence
cacctgtaatcccagcactt

SEQ ID NO: 790602 - DNA, 20 bp, Artificial
  CRISPR gRNA sequence
acctgtaatcccagcacttt

SEQ ID NO: 790603 - DNA, 20 bp, Artificial
  CRISPR gRNA sequence
ctgtaatcccagcactttgg

SEQ ID NO: 790604 - DNA, 20 bp, Artificial
  CRISPR gRNA sequence
tgtaatcccagcactttggg

SEQ ID NO: 790605 - DNA, 20 bp, Artificial
  CRISPR gRNA sequence
tcccagcactttgggaggcc

SEQ ID NO: 790606 - DNA, 20 bp, Artificial
  CRISPR gRNA sequence
cccagcactttgggaggcca

SEQ ID NO: 790607 - DNA, 20 bp, Artificial
  CRISPR gRNA sequence
agcactttgggaggccaagg

SEQ ID NO: 790608 - DNA, 20 bp, Artificial
  CRISPR gRNA sequence
gcactttgggaggccaaggt

SEQ ID NO: 790609 - DNA, 20 bp, Artificial
  CRISPR gRNA sequence
ctttgggaggccaaggtggg

SEQ ID NO: 790610 - DNA, 20 bp, Artificial
  CRISPR gRNA sequence
tttgggaggccaaggtgggt

SEQ ID NO: 790611 - DNA, 20 bp, Artificial
  CRISPR gRNA sequence
ccaaggtgggtgggccactt

SEQ ID NO: 790612 - DNA, 20 bp, Artificial
  CRISPR gRNA sequence
caaggtgggtgggccacttg

SEQ ID NO: 790613 - DNA, 20 bp, Artificial
  CRISPR gRNA sequence
gtgggtgggccacttgaggt

SEQ ID NO: 790614 - DNA, 20 bp, Artificial
  CRISPR gRNA sequence
ggtgggccacttgaggtcag

SEQ ID NO: 790615 - DNA, 20 bp, Artificial
  CRISPR gRNA sequence
ccacttgaggtcagaagctt

SEQ ID NO: 790616 - DNA, 20 bp, Artificial
  CRISPR gRNA sequence
ttgaggtcagaagcttgaga

SEQ ID NO: 790617 - DNA, 20 bp, Artificial
  CRISPR gRNA sequence
gtcagaagcttgagacagcc

SEQ ID NO: 790618 - DNA, 20 bp, Artificial
  CRISPR gRNA sequence
ttgagacagcctggccaaca

SEQ ID NO: 790619 - DNA, 20 bp, Artificial
  CRISPR gRNA sequence
tctactgaaaatacaaacat

SEQ ID NO: 790620 - DNA, 20 bp, Artificial
  CRISPR gRNA sequence
tgaaaatacaaacataagcc

SEQ ID NO: 790621 - DNA, 20 bp, Artificial
  CRISPR gRNA sequence
atacaaacataagccaagca

SEQ ID NO: 790622 - DNA, 20 bp, Artificial
  CRISPR gRNA sequence
caaacataagccaagcatgg

SEQ ID NO: 790623 - DNA, 20 bp, Artificial
  CRISPR gRNA sequence
gtggtacatgcctgtaattc

SEQ ID NO: 790624 - DNA, 20 bp, Artificial
  CRISPR gRNA sequence
tacatgcctgtaattccagc

SEQ ID NO: 790625 - DNA, 20 bp, Artificial
  CRISPR gRNA sequence
gcctgtaattccagccagtc

SEQ ID NO: 790626 - DNA, 20 bp, Artificial
  CRISPR gRNA sequence
ctgtaattccagccagtcaa

SEQ ID NO: 790627 - DNA, 20 bp, Artificial
  CRISPR gRNA sequence
tgtaattccagccagtcaag

SEQ ID NO: 790628 - DNA, 20 bp, Artificial
  CRISPR gRNA sequence
ttccagccagtcaagaggct

SEQ ID NO: 790629 - DNA, 20 bp, Artificial
  CRISPR gRNA sequence
tccagccagtcaagaggctg

SEQ ID NO: 790630 - DNA, 20 bp, Artificial
  CRISPR gRNA sequence
gccagtcaagaggctgaggc

SEQ ID NO: 790631 - DNA, 20 bp, Artificial
  CRISPR gRNA sequence
cagtcaagaggctgaggctg

SEQ ID NO: 790632 - DNA, 20 bp, Artificial
  CRISPR gRNA sequence
gctggagaatcgcttaaact

SEQ ID NO: 790633 - DNA, 20 bp, Artificial
  CRISPR gRNA sequence
ctggagaatcgcttaaactt

SEQ ID NO: 790634 - DNA, 20 bp, Artificial
  CRISPR gRNA sequence
ggagaatcgcttaaacttgg

SEQ ID NO: 790635 - DNA, 20 bp, Artificial
  CRISPR gRNA sequence
gagaatcgcttaaacttggg

SEQ ID NO: 790636 - DNA, 20 bp, Artificial
  CRISPR gRNA sequence
aatcgcttaaacttgggagg

SEQ ID NO: 790637 - DNA, 20 bp, Artificial
  CRISPR gRNA sequence
tcgcttaaacttgggaggca

SEQ ID NO: 790638 - DNA, 20 bp, Artificial
  CRISPR gRNA sequence
cgcttaaacttgggaggcag

SEQ ID NO: 790639 - DNA, 20 bp, Artificial
  CRISPR gRNA sequence
aacttgggaggcagaggctg

SEQ ID NO: 790640 - DNA, 20 bp, Artificial
  CRISPR gRNA sequence
tgggaggcagaggctgtagt

SEQ ID NO: 790641 - DNA, 20 bp, Artificial
  CRISPR gRNA sequence
gaggctgtagtgagccacga

SEQ ID NO: 790642 - DNA, 20 bp, Artificial
  CRISPR gRNA sequence
tgagccacgacagtgaactc

SEQ ID NO: 790643 - DNA, 20 bp, Artificial
  CRISPR gRNA sequence
cacgacagtgaactccagcc

SEQ ID NO: 790644 - DNA, 20 bp, Artificial
  CRISPR gRNA sequence
acgacagtgaactccagcct

SEQ ID NO: 790645 - DNA, 20 bp, Artificial
  CRISPR gRNA sequence
actccagcctgggcgactga

SEQ ID NO: 790646 - DNA, 20 bp, Artificial
  CRISPR gRNA sequence
tccagcctgggcgactgatg

SEQ ID NO: 790647 - DNA, 20 bp, Artificial
  CRISPR gRNA sequence
gagactgcgtctcaaaaaaa

SEQ ID NO: 790648 - DNA, 20 bp, Artificial
  CRISPR gRNA sequence
gactgcgtctcaaaaaaata

SEQ ID NO: 790649 - DNA, 20 bp, Artificial
  CRISPR gRNA sequence
aatttttaaaaccttacaat

SEQ ID NO: 790650 - DNA, 20 bp, Artificial
  CRISPR gRNA sequence
taaacaatcgtttaattcct

SEQ ID NO: 790651 - DNA, 20 bp, Artificial
  CRISPR gRNA sequence
ttccttagtatacaattaca

SEQ ID NO: 790652 - DNA, 20 bp, Artificial
  CRISPR gRNA sequence
tccttagtatacaattacaa

SEQ ID NO: 790653 - DNA, 20 bp, Artificial
  CRISPR gRNA sequence
tgatttgaatgtcaccaatg

SEQ ID NO: 790654 - DNA, 20 bp, Artificial
  CRISPR gRNA sequence
caccaatgaagatatacaat

SEQ ID NO: 790655 - DNA, 20 bp, Artificial
  CRISPR gRNA sequence
aagtacataaaaacttaact

SEQ ID NO: 790656 - DNA, 20 bp, Artificial
  CRISPR gRNA sequence
agtacataaaaacttaacta

SEQ ID NO: 790657 - DNA, 20 bp, Artificial
  CRISPR gRNA sequence
cataaaaacttaactaaggc

SEQ ID NO: 790658 - DNA, 20 bp, Artificial
  CRISPR gRNA sequence
ataaaaacttaactaaggcc

SEQ ID NO: 790659 - DNA, 20 bp, Artificial
  CRISPR gRNA sequence
aacttaactaaggccaggtg

SEQ ID NO: 790660 - DNA, 20 bp, Artificial
  CRISPR gRNA sequence
ttaactaaggccaggtgcag

SEQ ID NO: 790661 - DNA, 20 bp, Artificial
  CRISPR gRNA sequence
gtggcttatgcctgtaatcc

SEQ ID NO: 790662 - DNA, 20 bp, Artificial
  CRISPR gRNA sequence
tgcctgtaatcccagcattt

SEQ ID NO: 790663 - DNA, 20 bp, Artificial
  CRISPR gRNA sequence
gcctgtaatcccagcatttt

SEQ ID NO: 790664 - DNA, 20 bp, Artificial
  CRISPR gRNA sequence
ctgtaatcccagcattttgg

SEQ ID NO: 790665 - DNA, 20 bp, Artificial
  CRISPR gRNA sequence
tgtaatcccagcattttggg

SEQ ID NO: 790666 - DNA, 20 bp, Artificial
  CRISPR gRNA sequence
tcccagcattttgggaggct

SEQ ID NO: 790667 - DNA, 20 bp, Artificial
  CRISPR gRNA sequence
cccagcattttgggaggctg

SEQ ID NO: 790668 - DNA, 20 bp, Artificial
  CRISPR gRNA sequence
gcattttgggaggctgaggc

SEQ ID NO: 790669 - DNA, 20 bp, Artificial
  CRISPR gRNA sequence
ttttgggaggctgaggcgag

SEQ ID NO: 790670 - DNA, 20 bp, Artificial
  CRISPR gRNA sequence
gggaggctgaggcgagaaga

SEQ ID NO: 790671 - DNA, 20 bp, Artificial
  CRISPR gRNA sequence
ctgaggcgagaagatggctt

SEQ ID NO: 790672 - DNA, 20 bp, Artificial
  CRISPR gRNA sequence
gcgagaagatggcttgagtc

SEQ ID NO: 790673 - DNA, 20 bp, Artificial
  CRISPR gRNA sequence
cgagaagatggcttgagtcc

SEQ ID NO: 790674 - DNA, 20 bp, Artificial
  CRISPR gRNA sequence
agaagatggcttgagtccag

SEQ ID NO: 790675 - DNA, 20 bp, Artificial
  CRISPR gRNA sequence
tggcttgagtccaggagttt

SEQ ID NO: 790676 - DNA, 20 bp, Artificial
  CRISPR gRNA sequence
tgagtccaggagtttgagac

SEQ ID NO: 790677 - DNA, 20 bp, Artificial
  CRISPR gRNA sequence
ccaggagtttgagactggcc

SEQ ID NO: 790678 - DNA, 20 bp, Artificial
  CRISPR gRNA sequence
caggagtttgagactggcct

SEQ ID NO: 790679 - DNA, 20 bp, Artificial
  CRISPR gRNA sequence
gagactggcctgggaaacac

SEQ ID NO: 790680 - DNA, 20 bp, Artificial
  CRISPR gRNA sequence
agactggcctgggaaacaca

SEQ ID NO: 790681 - DNA, 20 bp, Artificial
  CRISPR gRNA sequence
actggcctgggaaacacaag

SEQ ID NO: 790682 - DNA, 20 bp, Artificial
  CRISPR gRNA sequence
caaaattaaaaaaaaaaaat

SEQ ID NO: 790683 - DNA, 20 bp, Artificial
  CRISPR gRNA sequence
attaaaaaaaaaaaattagc

SEQ ID NO: 790684 - DNA, 20 bp, Artificial
  CRISPR gRNA sequence
ttaaaaaaaaaaaattagcc

SEQ ID NO: 790685 - DNA, 20 bp, Artificial
  CRISPR gRNA sequence
aaaaaaaaattagccaggca

SEQ ID NO: 790686 - DNA, 20 bp, Artificial
  CRISPR gRNA sequence
aaaaaattagccaggcatgg

SEQ ID NO: 790687 - DNA, 20 bp, Artificial
  CRISPR gRNA sequence
attagccaggcatggtggca

SEQ ID NO: 790688 - DNA, 20 bp, Artificial
  CRISPR gRNA sequence
aggcatggtggcatggcctg

SEQ ID NO: 790689 - DNA, 20 bp, Artificial
  CRISPR gRNA sequence
ggtggcatggcctgtagtcc

SEQ ID NO: 790690 - DNA, 20 bp, Artificial
  CRISPR gRNA sequence
gcctgtagtcccagttacta

SEQ ID NO: 790691 - DNA, 20 bp, Artificial
  CRISPR gRNA sequence
ctgtagtcccagttactaca

SEQ ID NO: 790692 - DNA, 20 bp, Artificial
  CRISPR gRNA sequence
tcccagttactacagagtct

SEQ ID NO: 790693 - DNA, 20 bp, Artificial
  CRISPR gRNA sequence
cccagttactacagagtctg

SEQ ID NO: 790694 - DNA, 20 bp, Artificial
  CRISPR gRNA sequence
agttactacagagtctgagg

SEQ ID NO: 790695 - DNA, 20 bp, Artificial
  CRISPR gRNA sequence
gttactacagagtctgaggt

SEQ ID NO: 790696 - DNA, 20 bp, Artificial
  CRISPR gRNA sequence
tactacagagtctgaggtgg

SEQ ID NO: 790697 - DNA, 20 bp, Artificial
  CRISPR gRNA sequence
ctgaggtgggagaatcgctt

SEQ ID NO: 790698 - DNA, 20 bp, Artificial
  CRISPR gRNA sequence
tgggagaatcgcttgagcct

SEQ ID NO: 790699 - DNA, 20 bp, Artificial
  CRISPR gRNA sequence
ggagaatcgcttgagcctga

SEQ ID NO: 790700 - DNA, 20 bp, Artificial
  CRISPR gRNA sequence
tcgcttgagcctgagagatc

SEQ ID NO: 790701 - DNA, 20 bp, Artificial
  CRISPR gRNA sequence
cgcttgagcctgagagatcg

SEQ ID NO: 790702 - DNA, 20 bp, Artificial
  CRISPR gRNA sequence
agcctgagagatcgaggctg

SEQ ID NO: 790703 - DNA, 20 bp, Artificial
  CRISPR gRNA sequence
tgagagatcgaggctgcagt

SEQ ID NO: 790704 - DNA, 20 bp, Artificial
  CRISPR gRNA sequence
tataccactgtattccaatc

SEQ ID NO: 790705 - DNA, 20 bp, Artificial
  CRISPR gRNA sequence
ataccactgtattccaatct

SEQ ID NO: 790706 - DNA, 20 bp, Artificial
  CRISPR gRNA sequence
ctgtattccaatctgggcaa

SEQ ID NO: 790707 - DNA, 20 bp, Artificial
  CRISPR gRNA sequence
gtattccaatctgggcaaca

SEQ ID NO: 790708 - DNA, 20 bp, Artificial
  CRISPR gRNA sequence
gtgataccctgtctcaaaaa

SEQ ID NO: 790709 - DNA, 20 bp, Artificial
  CRISPR gRNA sequence
aaaatatgtatattatatat

SEQ ID NO: 790710 - DNA, 20 bp, Artificial
  CRISPR gRNA sequence
atatgtatacttaatatcat

SEQ ID NO: 790711 - DNA, 20 bp, Artificial
  CRISPR gRNA sequence
tacttaatatcattagtcat

SEQ ID NO: 790712 - DNA, 20 bp, Artificial
  CRISPR gRNA sequence
acttaatatcattagtcatt

SEQ ID NO: 790713 - DNA, 20 bp, Artificial
  CRISPR gRNA sequence
attagtcattaggaaaatgc

SEQ ID NO: 790714 - DNA, 20 bp, Artificial
  CRISPR gRNA sequence
gtcattaggaaaatgcaagt

SEQ ID NO: 790715 - DNA, 20 bp, Artificial
  CRISPR gRNA sequence
aaccacttctacacacctat

SEQ ID NO: 790716 - DNA, 20 bp, Artificial
  CRISPR gRNA sequence
cacacctattagaatgactt

SEQ ID NO: 790717 - DNA, 20 bp, Artificial
  CRISPR gRNA sequence
ctattagaatgacttaagaa

SEQ ID NO: 790718 - DNA, 20 bp, Artificial
  CRISPR gRNA sequence
attagaatgacttaagaaaa

SEQ ID NO: 790719 - DNA, 20 bp, Artificial
  CRISPR gRNA sequence
agaatgacttaagaaaagag

SEQ ID NO: 790720 - DNA, 20 bp, Artificial
  CRISPR gRNA sequence
gaatgacttaagaaaagagc

SEQ ID NO: 790721 - DNA, 20 bp, Artificial
  CRISPR gRNA sequence
aatgacttaagaaaagagca

SEQ ID NO: 790722 - DNA, 20 bp, Artificial
  CRISPR gRNA sequence
cttaagaaaagagcagggcg

SEQ ID NO: 790723 - DNA, 20 bp, Artificial
  CRISPR gRNA sequence
aagaaaagagcagggcgtgg

SEQ ID NO: 790724 - DNA, 20 bp, Artificial
  CRISPR gRNA sequence
gtggctcatgcctgtaatcc

SEQ ID NO: 790725 - DNA, 20 bp, Artificial
  CRISPR gRNA sequence
tgcctgtaatcccagcattt

SEQ ID NO: 790726 - DNA, 20 bp, Artificial
  CRISPR gRNA sequence
gcctgtaatcccagcatttt

SEQ ID NO: 790727 - DNA, 20 bp, Artificial
  CRISPR gRNA sequence
ctgtaatcccagcattttgg

SEQ ID NO: 790728 - DNA, 20 bp, Artificial
  CRISPR gRNA sequence
tgtaatcccagcattttggg

SEQ ID NO: 790729 - DNA, 20 bp, Artificial
  CRISPR gRNA sequence
tcccagcattttgggaggcc

SEQ ID NO: 790730 - DNA, 20 bp, Artificial
  CRISPR gRNA sequence
cccagcattttgggaggcca

SEQ ID NO: 790731 - DNA, 20 bp, Artificial
  CRISPR gRNA sequence
agcattttgggaggccaagg

SEQ ID NO: 790732 - DNA, 20 bp, Artificial
  CRISPR gRNA sequence
gcattttgggaggccaaggt

SEQ ID NO: 790733 - DNA, 20 bp, Artificial
  CRISPR gRNA sequence
ttttgggaggccaaggtggg

SEQ ID NO: 790734 - DNA, 20 bp, Artificial
  CRISPR gRNA sequence
ccaaggtgggtggatcacct

SEQ ID NO: 790735 - DNA, 20 bp, Artificial
  CRISPR gRNA sequence
caaggtgggtggatcacctg

SEQ ID NO: 790736 - DNA, 20 bp, Artificial
  CRISPR gRNA sequence
gtgggtggatcacctgaggt

SEQ ID NO: 790737 - DNA, 20 bp, Artificial
  CRISPR gRNA sequence
tgggtggatcacctgaggtc

SEQ ID NO: 790738 - DNA, 20 bp, Artificial
  CRISPR gRNA sequence
ggtggatcacctgaggtcag

SEQ ID NO: 790739 - DNA, 20 bp, Artificial
  CRISPR gRNA sequence
tcacctgaggtcaggagttc

SEQ ID NO: 790740 - DNA, 20 bp, Artificial
  CRISPR gRNA sequence
tgaggtcaggagttcaagac

SEQ ID NO: 790741 - DNA, 20 bp, Artificial
  CRISPR gRNA sequence
tcaggagttcaagaccagcc

SEQ ID NO: 790742 - DNA, 20 bp, Artificial
  CRISPR gRNA sequence
caagaccagcctggtcaata

SEQ ID NO: 790743 - DNA, 20 bp, Artificial
  CRISPR gRNA sequence
ctattaaaaatacaaaacaa

SEQ ID NO: 790744 - DNA, 20 bp, Artificial
  CRISPR gRNA sequence
ttaaaaatacaaaacaaaag

SEQ ID NO: 790745 - DNA, 20 bp, Artificial
  CRISPR gRNA sequence
taaaaatacaaaacaaaaga

SEQ ID NO: 790746 - DNA, 20 bp, Artificial
  CRISPR gRNA sequence
aaaaatacaaaacaaaagaa

SEQ ID NO: 790747 - DNA, 20 bp, Artificial
  CRISPR gRNA sequence
tacaaaacaaaagaagggca

SEQ ID NO: 790748 - DNA, 20 bp, Artificial
  CRISPR gRNA sequence
aaaacaaaagaagggcatgg

SEQ ID NO: 790749 - DNA, 20 bp, Artificial
  CRISPR gRNA sequence
acaaaagaagggcatggtgg

SEQ ID NO: 790750 - DNA, 20 bp, Artificial
  CRISPR gRNA sequence
caaaagaagggcatggtggt

SEQ ID NO: 790751 - DNA, 20 bp, Artificial
  CRISPR gRNA sequence
gtggtgggtgcctgtaatcc

SEQ ID NO: 790752 - DNA, 20 bp, Artificial
  CRISPR gRNA sequence
tgcctgtaatcccagctact

SEQ ID NO: 790753 - DNA, 20 bp, Artificial
  CRISPR gRNA sequence
gcctgtaatcccagctactt

SEQ ID NO: 790754 - DNA, 20 bp, Artificial
  CRISPR gRNA sequence
ctgtaatcccagctacttgg

SEQ ID NO: 790755 - DNA, 20 bp, Artificial
  CRISPR gRNA sequence
tgtaatcccagctacttggg

SEQ ID NO: 790756 - DNA, 20 bp, Artificial
  CRISPR gRNA sequence
tcccagctacttgggaggct

SEQ ID NO: 790757 - DNA, 20 bp, Artificial
  CRISPR gRNA sequence
cccagctacttgggaggctg

SEQ ID NO: 790758 - DNA, 20 bp, Artificial
  CRISPR gRNA sequence
agctacttgggaggctgagg

SEQ ID NO: 790759 - DNA, 20 bp, Artificial
  CRISPR gRNA sequence
gctacttgggaggctgaggc

SEQ ID NO: 790760 - DNA, 20 bp, Artificial
  CRISPR gRNA sequence
tacttgggaggctgaggcag

SEQ ID NO: 790761 - DNA, 20 bp, Artificial
  CRISPR gRNA sequence
gggaggctgaggcaggagaa

SEQ ID NO: 790762 - DNA, 20 bp, Artificial
  CRISPR gRNA sequence
gcaggagaatagcctgaacc

SEQ ID NO: 790763 - DNA, 20 bp, Artificial
  CRISPR gRNA sequence
caggagaatagcctgaaccc

SEQ ID NO: 790764 - DNA, 20 bp, Artificial
  CRISPR gRNA sequence
ggagaatagcctgaacccgg

SEQ ID NO: 790765 - DNA, 20 bp, Artificial
  CRISPR gRNA sequence
gagaatagcctgaacccggg

SEQ ID NO: 790766 - DNA, 20 bp, Artificial
  CRISPR gRNA sequence
aatagcctgaacccgggagg

SEQ ID NO: 790767 - DNA, 20 bp, Artificial
  CRISPR gRNA sequence
tagcctgaacccgggaggcg

SEQ ID NO: 790768 - DNA, 20 bp, Artificial
  CRISPR gRNA sequence
agcctgaacccgggaggcgg

SEQ ID NO: 790769 - DNA, 20 bp, Artificial
  CRISPR gRNA sequence
aacccgggaggcggaggttg

SEQ ID NO: 790770 - DNA, 20 bp, Artificial
  CRISPR gRNA sequence
cgggaggcggaggttgcagt

SEQ ID NO: 790771 - DNA, 20 bp, Artificial
  CRISPR gRNA sequence
ggcggaggttgcagtaagcc

SEQ ID NO: 790772 - DNA, 20 bp, Artificial
  CRISPR gRNA sequence
gttgcagtaagccaagatca

SEQ ID NO: 790773 - DNA, 20 bp, Artificial
  CRISPR gRNA sequence
aagatcacggcattgcactt

SEQ ID NO: 790774 - DNA, 20 bp, Artificial
  CRISPR gRNA sequence
cacggcattgcactttagcc

SEQ ID NO: 790775 - DNA, 20 bp, Artificial
  CRISPR gRNA sequence
acggcattgcactttagcct

SEQ ID NO: 790776 - DNA, 20 bp, Artificial
  CRISPR gRNA sequence
ttgcactttagcctgggtga

SEQ ID NO: 790777 - DNA, 20 bp, Artificial
  CRISPR gRNA sequence
gcactttagcctgggtgaca

SEQ ID NO: 790778 - DNA, 20 bp, Artificial
  CRISPR gRNA sequence
gaaactctgtctcaaaaaaa

SEQ ID NO: 790779 - DNA, 20 bp, Artificial
  CRISPR gRNA sequence
tctcaaaaaaaaagaaaaaa

SEQ ID NO: 790780 - DNA, 20 bp, Artificial
  CRISPR gRNA sequence
aaaaaaaagaaaaaatagaa

SEQ ID NO: 790781 - DNA, 20 bp, Artificial
  CRISPR gRNA sequence
gaaaaaatagaaaagaatac

SEQ ID NO: 790782 - DNA, 20 bp, Artificial
  CRISPR gRNA sequence
atagaaaagaataccagtgc

SEQ ID NO: 790783 - DNA, 20 bp, Artificial
  CRISPR gRNA sequence
tagaaaagaataccagtgct

SEQ ID NO: 790784 - DNA, 20 bp, Artificial
  CRISPR gRNA sequence
aaaagaataccagtgctggg

SEQ ID NO: 790785 - DNA, 20 bp, Artificial
  CRISPR gRNA sequence
aaagaataccagtgctggga

SEQ ID NO: 790786 - DNA, 20 bp, Artificial
  CRISPR gRNA sequence
ataccagtgctgggaaggat

SEQ ID NO: 790787 - DNA, 20 bp, Artificial
  CRISPR gRNA sequence
taccagtgctgggaaggatg

SEQ ID NO: 790788 - DNA, 20 bp, Artificial
  CRISPR gRNA sequence
tgggaaggatgaggaacaat

SEQ ID NO: 790789 - DNA, 20 bp, Artificial
  CRISPR gRNA sequence
tagaactctcatatacttgc

SEQ ID NO: 790790 - DNA, 20 bp, Artificial
  CRISPR gRNA sequence
aactctcatatacttgctgg

SEQ ID NO: 790791 - DNA, 20 bp, Artificial
  CRISPR gRNA sequence
actctcatatacttgctggt

SEQ ID NO: 790792 - DNA, 20 bp, Artificial
  CRISPR gRNA sequence
tgctggtgggaatgaaaaaa

SEQ ID NO: 790793 - DNA, 20 bp, Artificial
  CRISPR gRNA sequence
gtgggaatgaaaaaatggta

SEQ ID NO: 790794 - DNA, 20 bp, Artificial
  CRISPR gRNA sequence
aaaaaatggtacagccacta

SEQ ID NO: 790795 - DNA, 20 bp, Artificial
  CRISPR gRNA sequence
aatggtacagccactatgga

SEQ ID NO: 790796 - DNA, 20 bp, Artificial
  CRISPR gRNA sequence
atggtacagccactatggaa

SEQ ID NO: 790797 - DNA, 20 bp, Artificial
  CRISPR gRNA sequence
acagccactatggaaaggtt

SEQ ID NO: 790798 - DNA, 20 bp, Artificial
  CRISPR gRNA sequence
gccactatggaaaggtttgg

SEQ ID NO: 790799 - DNA, 20 bp, Artificial
  CRISPR gRNA sequence
catacacttaccatgtgacc

SEQ ID NO: 790800 - DNA, 20 bp, Artificial
  CRISPR gRNA sequence
tgacctagcaatcccacttc

SEQ ID NO: 790801 - DNA, 20 bp, Artificial
  CRISPR gRNA sequence
gacctagcaatcccacttct

SEQ ID NO: 790802 - DNA, 20 bp, Artificial
  CRISPR gRNA sequence
ccacttctaggtatttatcc

SEQ ID NO: 790803 - DNA, 20 bp, Artificial
  CRISPR gRNA sequence
atccaagtgaaatgaaaacc

SEQ ID NO: 790804 - DNA, 20 bp, Artificial
  CRISPR gRNA sequence
tccaagtgaaatgaaaacct

SEQ ID NO: 790805 - DNA, 20 bp, Artificial
  CRISPR gRNA sequence
ttatttgtaatcacccaaaa

SEQ ID NO: 790806 - DNA, 20 bp, Artificial
  CRISPR gRNA sequence
tatttgtaatcacccaaaat

SEQ ID NO: 790807 - DNA, 20 bp, Artificial
  CRISPR gRNA sequence
atacccaaatgtgccccaat

SEQ ID NO: 790808 - DNA, 20 bp, Artificial
  CRISPR gRNA sequence
tacccaaatgtgccccaatt

SEQ ID NO: 790809 - DNA, 20 bp, Artificial
  CRISPR gRNA sequence
acccaaatgtgccccaattg

SEQ ID NO: 790810 - DNA, 20 bp, Artificial
  CRISPR gRNA sequence
gggaatttataaacaaaata

SEQ ID NO: 790811 - DNA, 20 bp, Artificial
  CRISPR gRNA sequence
aaaatatagtatacatacac

SEQ ID NO: 790812 - DNA, 20 bp, Artificial
  CRISPR gRNA sequence
atacactagaatatactcaa

SEQ ID NO: 790813 - DNA, 20 bp, Artificial
  CRISPR gRNA sequence
agaatatactcaacagcaaa

SEQ ID NO: 790814 - DNA, 20 bp, Artificial
  CRISPR gRNA sequence
gaatatactcaacagcaaac

SEQ ID NO: 790815 - DNA, 20 bp, Artificial
  CRISPR gRNA sequence
aatttcaaatgctttatgtt

SEQ ID NO: 790816 - DNA, 20 bp, Artificial
  CRISPR gRNA sequence
aaatgctttatgttaagtga

SEQ ID NO: 790817 - DNA, 20 bp, Artificial
  CRISPR gRNA sequence
tgctttatgttaagtgaaag

SEQ ID NO: 790818 - DNA, 20 bp, Artificial
  CRISPR gRNA sequence
ttatgttaagtgaaagaagc

SEQ ID NO: 790819 - DNA, 20 bp, Artificial
  CRISPR gRNA sequence
gtgaaagaagccagatacaa

SEQ ID NO: 790820 - DNA, 20 bp, Artificial
  CRISPR gRNA sequence
tgaaagaagccagatacaaa

SEQ ID NO: 790821 - DNA, 20 bp, Artificial
  CRISPR gRNA sequence
atcccatttatatgacattc

SEQ ID NO: 790822 - DNA, 20 bp, Artificial
  CRISPR gRNA sequence
atttatatgacattctggaa

SEQ ID NO: 790823 - DNA, 20 bp, Artificial
  CRISPR gRNA sequence
tctggaaaagtcattactat

SEQ ID NO: 790824 - DNA, 20 bp, Artificial
  CRISPR gRNA sequence
ctggaaaagtcattactata

SEQ ID NO: 790825 - DNA, 20 bp, Artificial
  CRISPR gRNA sequence
aaaagtcattactataagga

SEQ ID NO: 790826 - DNA, 20 bp, Artificial
  CRISPR gRNA sequence
attactataaggacagaaaa

SEQ ID NO: 790827 - DNA, 20 bp, Artificial
  CRISPR gRNA sequence
tataaggacagaaaatagat

SEQ ID NO: 790828 - DNA, 20 bp, Artificial
  CRISPR gRNA sequence
aggacagaaaatagatcagt

SEQ ID NO: 790829 - DNA, 20 bp, Artificial
  CRISPR gRNA sequence
aaaatagatcagtaagtgcc

SEQ ID NO: 790830 - DNA, 20 bp, Artificial
  CRISPR gRNA sequence
atcagtaagtgcctggactt

SEQ ID NO: 790831 - DNA, 20 bp, Artificial
  CRISPR gRNA sequence
aagtgcctggacttaagact

SEQ ID NO: 790832 - DNA, 20 bp, Artificial
  CRISPR gRNA sequence
agtgcctggacttaagactt

SEQ ID NO: 790833 - DNA, 20 bp, Artificial
  CRISPR gRNA sequence
ctggacttaagacttgggtg

SEQ ID NO: 790834 - DNA, 20 bp, Artificial
  CRISPR gRNA sequence
tttttgtttgtttgtttgtt

SEQ ID NO: 790835 - DNA, 20 bp, Artificial
  CRISPR gRNA sequence
tgtttgtttgtttgtttggc

SEQ ID NO: 790836 - DNA, 20 bp, Artificial
  CRISPR gRNA sequence
gtttgtttgtttgtttggca

SEQ ID NO: 790837 - DNA, 20 bp, Artificial
  CRISPR gRNA sequence
tttgtttgtttgtttggcaa

SEQ ID NO: 790838 - DNA, 20 bp, Artificial
  CRISPR gRNA sequence
tttgtttgtttggcaaggga

SEQ ID NO: 790839 - DNA, 20 bp, Artificial
  CRISPR gRNA sequence
ggcaagggatggaactgtcc

SEQ ID NO: 790840 - DNA, 20 bp, Artificial
  CRISPR gRNA sequence
actgtcctggatgttcactg

SEQ ID NO: 790841 - DNA, 20 bp, Artificial
  CRISPR gRNA sequence
gtcctggatgttcactgtgg

SEQ ID NO: 790842 - DNA, 20 bp, Artificial
  CRISPR gRNA sequence
ctggatgttcactgtggtgg

SEQ ID NO: 790843 - DNA, 20 bp, Artificial
  CRISPR gRNA sequence
gatgttcactgtggtggtgg

SEQ ID NO: 790844 - DNA, 20 bp, Artificial
  CRISPR gRNA sequence
cactgtggtggtggtagtta

SEQ ID NO: 790845 - DNA, 20 bp, Artificial
  CRISPR gRNA sequence
actgtggtggtggtagttat

SEQ ID NO: 790846 - DNA, 20 bp, Artificial
  CRISPR gRNA sequence
atgcatttgttaaaattcat

SEQ ID NO: 790847 - DNA, 20 bp, Artificial
  CRISPR gRNA sequence
tcataagacttttttaaaaa

SEQ ID NO: 790848 - DNA, 20 bp, Artificial
  CRISPR gRNA sequence
taaaaaaagaataaatgtta

SEQ ID NO: 790849 - DNA, 20 bp, Artificial
  CRISPR gRNA sequence
aaatttaaacatgcatatgt

SEQ ID NO: 790850 - DNA, 20 bp, Artificial
  CRISPR gRNA sequence
tcacttcaaactttatttta

SEQ ID NO: 790851 - DNA, 20 bp, Artificial
  CRISPR gRNA sequence
actttattttatagataaca

SEQ ID NO: 790852 - DNA, 20 bp, Artificial
  CRISPR gRNA sequence
ttattttatagataacacag

SEQ ID NO: 790853 - DNA, 20 bp, Artificial
  CRISPR gRNA sequence
attttatagataacacagta

SEQ ID NO: 790854 - DNA, 20 bp, Artificial
  CRISPR gRNA sequence
ataacacagtagagcatcca

SEQ ID NO: 790855 - DNA, 20 bp, Artificial
  CRISPR gRNA sequence
aacacagtagagcatccaaa

SEQ ID NO: 790856 - DNA, 20 bp, Artificial
  CRISPR gRNA sequence
agagcatccaaagagcatac

SEQ ID NO: 790857 - DNA, 20 bp, Artificial
  CRISPR gRNA sequence
catccaaagagcatacaagt

SEQ ID NO: 790858 - DNA, 20 bp, Artificial
  CRISPR gRNA sequence
atccaaagagcatacaagta

SEQ ID NO: 790859 - DNA, 20 bp, Artificial
  CRISPR gRNA sequence
aaagagcatacaagtaagga

SEQ ID NO: 790860 - DNA, 20 bp, Artificial
  CRISPR gRNA sequence
agagcatacaagtaaggaaa

SEQ ID NO: 790861 - DNA, 20 bp, Artificial
  CRISPR gRNA sequence
taatgattaatgatttgttt

SEQ ID NO: 790862 - DNA, 20 bp, Artificial
  CRISPR gRNA sequence
tgatttgtttgagttttatt

SEQ ID NO: 790863 - DNA, 20 bp, Artificial
  CRISPR gRNA sequence
atttgtttgagttttattca

SEQ ID NO: 790864 - DNA, 20 bp, Artificial
  CRISPR gRNA sequence
tttgtttgagttttattcag

SEQ ID NO: 790865 - DNA, 20 bp, Artificial
  CRISPR gRNA sequence
ttcagaggcaactttcatca

SEQ ID NO: 790866 - DNA, 20 bp, Artificial
  CRISPR gRNA sequence
gcaactttcatcacagtctt

SEQ ID NO: 790867 - DNA, 20 bp, Artificial
  CRISPR gRNA sequence
caactttcatcacagtcttt

SEQ ID NO: 790868 - DNA, 20 bp, Artificial
  CRISPR gRNA sequence
actttcatcacagtctttag

SEQ ID NO: 790869 - DNA, 20 bp, Artificial
  CRISPR gRNA sequence
ctttcatcacagtctttagg

SEQ ID NO: 790870 - DNA, 20 bp, Artificial
  CRISPR gRNA sequence
aggaggcacacatttttttc

SEQ ID NO: 790871 - DNA, 20 bp, Artificial
  CRISPR gRNA sequence
atttttttcaagcattaatc

SEQ ID NO: 790872 - DNA, 20 bp, Artificial
  CRISPR gRNA sequence
tttttcaagcattaatctag

SEQ ID NO: 790873 - DNA, 20 bp, Artificial
  CRISPR gRNA sequence
ttcaagcattaatctagcag

SEQ ID NO: 790874 - DNA, 20 bp, Artificial
  CRISPR gRNA sequence
attaatctagcagaagaaaa

SEQ ID NO: 790875 - DNA, 20 bp, Artificial
  CRISPR gRNA sequence
atggaaataatgtctaccaa

SEQ ID NO: 790876 - DNA, 20 bp, Artificial
  CRISPR gRNA sequence
tggaaataatgtctaccaac

SEQ ID NO: 790877 - DNA, 20 bp, Artificial
  CRISPR gRNA sequence
ggaaataatgtctaccaaca

SEQ ID NO: 790878 - DNA, 20 bp, Artificial
  CRISPR gRNA sequence
aataatgtctaccaacaggg

SEQ ID NO: 790879 - DNA, 20 bp, Artificial
  CRISPR gRNA sequence
aatgtctaccaacagggaag

SEQ ID NO: 790880 - DNA, 20 bp, Artificial
  CRISPR gRNA sequence
ggaagtggttaaataaatta

SEQ ID NO: 790881 - DNA, 20 bp, Artificial
  CRISPR gRNA sequence
tataaatctccttaaaaatg

SEQ ID NO: 790882 - DNA, 20 bp, Artificial
  CRISPR gRNA sequence
ataaatctccttaaaaatgc

SEQ ID NO: 790883 - DNA, 20 bp, Artificial
  CRISPR gRNA sequence
gatgtctatatttgctgatt

SEQ ID NO: 790884 - DNA, 20 bp, Artificial
  CRISPR gRNA sequence
ttgctgatttggaaactata

SEQ ID NO: 790885 - DNA, 20 bp, Artificial
  CRISPR gRNA sequence
atgcttactaaaacttcttt

SEQ ID NO: 790886 - DNA, 20 bp, Artificial
  CRISPR gRNA sequence
aaacttcttttagtcctctt

SEQ ID NO: 790887 - DNA, 20 bp, Artificial
  CRISPR gRNA sequence
atttctttcatgaaaaaata

SEQ ID NO: 790888 - DNA, 20 bp, Artificial
  CRISPR gRNA sequence
tttctttcatgaaaaaataa

SEQ ID NO: 790889 - DNA, 20 bp, Artificial
  CRISPR gRNA sequence
ttctttcatgaaaaaataaa

SEQ ID NO: 790890 - DNA, 20 bp, Artificial
  CRISPR gRNA sequence
tttcatgaaaaaataaaggg

SEQ ID NO: 790891 - DNA, 20 bp, Artificial
  CRISPR gRNA sequence
ttcatgaaaaaataaagggc

SEQ ID NO: 790892 - DNA, 20 bp, Artificial
  CRISPR gRNA sequence
gaaaaaataaagggcaggct

SEQ ID NO: 790893 - DNA, 20 bp, Artificial
  CRISPR gRNA sequence
aaaaataaagggcaggctga

SEQ ID NO: 790894 - DNA, 20 bp, Artificial
  CRISPR gRNA sequence
aaagggcaggctgagagtga

SEQ ID NO: 790895 - DNA, 20 bp, Artificial
  CRISPR gRNA sequence
atggctcacacctgtgatct

SEQ ID NO: 790896 - DNA, 20 bp, Artificial
  CRISPR gRNA sequence
cacctgtgatctcagtgctt

SEQ ID NO: 790897 - DNA, 20 bp, Artificial
  CRISPR gRNA sequence
acctgtgatctcagtgcttt

SEQ ID NO: 790898 - DNA, 20 bp, Artificial
  CRISPR gRNA sequence
ctgtgatctcagtgctttgg

SEQ ID NO: 790899 - DNA, 20 bp, Artificial
  CRISPR gRNA sequence
tgtgatctcagtgctttggg

SEQ ID NO: 790900 - DNA, 20 bp, Artificial
  CRISPR gRNA sequence
atctcagtgctttgggaggc

SEQ ID NO: 790901 - DNA, 20 bp, Artificial
  CRISPR gRNA sequence
tctcagtgctttgggaggct

SEQ ID NO: 790902 - DNA, 20 bp, Artificial
  CRISPR gRNA sequence
ctcagtgctttgggaggctg

SEQ ID NO: 790903 - DNA, 20 bp, Artificial
  CRISPR gRNA sequence
agtgctttgggaggctgggg

SEQ ID NO: 790904 - DNA, 20 bp, Artificial
  CRISPR gRNA sequence
gtgctttgggaggctggggc

SEQ ID NO: 790905 - DNA, 20 bp, Artificial
  CRISPR gRNA sequence
gctttgggaggctggggcag

SEQ ID NO: 790906 - DNA, 20 bp, Artificial
  CRISPR gRNA sequence
ctttgggaggctggggcagg

SEQ ID NO: 790907 - DNA, 20 bp, Artificial
  CRISPR gRNA sequence
ctggggcaggaggattgctt

SEQ ID NO: 790908 - DNA, 20 bp, Artificial
  CRISPR gRNA sequence
gcaggaggattgcttgagac

SEQ ID NO: 790909 - DNA, 20 bp, Artificial
  CRISPR gRNA sequence
caggaggattgcttgagacg

SEQ ID NO: 790910 - DNA, 20 bp, Artificial
  CRISPR gRNA sequence
ttgcttgagacgaggcgttt

SEQ ID NO: 790911 - DNA, 20 bp, Artificial
  CRISPR gRNA sequence
tgcttgagacgaggcgtttg

SEQ ID NO: 790912 - DNA, 20 bp, Artificial
  CRISPR gRNA sequence
tgagacgaggcgtttgaggc

SEQ ID NO: 790913 - DNA, 20 bp, Artificial
  CRISPR gRNA sequence
tgaggccagcctgtgtaaca

SEQ ID NO: 790914 - DNA, 20 bp, Artificial
  CRISPR gRNA sequence
gccagcctgtgtaacatagc

SEQ ID NO: 790915 - DNA, 20 bp, Artificial
  CRISPR gRNA sequence
actaaaaatgtttaaaaaat

SEQ ID NO: 790916 - DNA, 20 bp, Artificial
  CRISPR gRNA sequence
aaaatgtttaaaaaattagc

SEQ ID NO: 790917 - DNA, 20 bp, Artificial
  CRISPR gRNA sequence
gtttaaaaaattagccagac

SEQ ID NO: 790918 - DNA, 20 bp, Artificial
  CRISPR gRNA sequence
tttaaaaaattagccagacc

SEQ ID NO: 790919 - DNA, 20 bp, Artificial
  CRISPR gRNA sequence
aaaaaattagccagaccggg

SEQ ID NO: 790920 - DNA, 20 bp, Artificial
  CRISPR gRNA sequence
gaccgggtggtacatgcctg

SEQ ID NO: 790921 - DNA, 20 bp, Artificial
  CRISPR gRNA sequence
gtggtacatgcctgtagtcc

SEQ ID NO: 790922 - DNA, 20 bp, Artificial
  CRISPR gRNA sequence
tgcctgtagtcctagctact

SEQ ID NO: 790923 - DNA, 20 bp, Artificial
  CRISPR gRNA sequence
gcctgtagtcctagctactc

SEQ ID NO: 790924 - DNA, 20 bp, Artificial
  CRISPR gRNA sequence
ctgtagtcctagctactcag

SEQ ID NO: 790925 - DNA, 20 bp, Artificial
  CRISPR gRNA sequence
tcctagctactcaggagatt

SEQ ID NO: 790926 - DNA, 20 bp, Artificial
  CRISPR gRNA sequence
cctagctactcaggagattg

SEQ ID NO: 790927 - DNA, 20 bp, Artificial
  CRISPR gRNA sequence
agctactcaggagattgagg

SEQ ID NO: 790928 - DNA, 20 bp, Artificial
  CRISPR gRNA sequence
gctactcaggagattgaggc

SEQ ID NO: 790929 - DNA, 20 bp, Artificial
  CRISPR gRNA sequence
tactcaggagattgaggcag

SEQ ID NO: 790930 - DNA, 20 bp, Artificial
  CRISPR gRNA sequence
ttgaggcaggagactcactt

SEQ ID NO: 790931 - DNA, 20 bp, Artificial
  CRISPR gRNA sequence
gcaggagactcacttgagcc

SEQ ID NO: 790932 - DNA, 20 bp, Artificial
  CRISPR gRNA sequence
caggagactcacttgagcct

SEQ ID NO: 790933 - DNA, 20 bp, Artificial
  CRISPR gRNA sequence
ggagactcacttgagcctgg

SEQ ID NO: 790934 - DNA, 20 bp, Artificial
  CRISPR gRNA sequence
actcacttgagcctgggagt

SEQ ID NO: 790935 - DNA, 20 bp, Artificial
  CRISPR gRNA sequence
tcacttgagcctgggagttg

SEQ ID NO: 790936 - DNA, 20 bp, Artificial
  CRISPR gRNA sequence
cacttgagcctgggagttgg

SEQ ID NO: 790937 - DNA, 20 bp, Artificial
  CRISPR gRNA sequence
agcctgggagttggaggctg

SEQ ID NO: 790938 - DNA, 20 bp, Artificial
  CRISPR gRNA sequence
tgggagttggaggctgcagt

SEQ ID NO: 790939 - DNA, 20 bp, Artificial
  CRISPR gRNA sequence
ttggaggctgcagtgagctg

SEQ ID NO: 790940 - DNA, 20 bp, Artificial
  CRISPR gRNA sequence
aggctgcagtgagctgtggt

SEQ ID NO: 790941 - DNA, 20 bp, Artificial
  CRISPR gRNA sequence
ggctgcagtgagctgtggtt

SEQ ID NO: 790942 - DNA, 20 bp, Artificial
  CRISPR gRNA sequence
gtggttgggccactgcactc

SEQ ID NO: 790943 - DNA, 20 bp, Artificial
  CRISPR gRNA sequence
tgggccactgcactccagca

SEQ ID NO: 790944 - DNA, 20 bp, Artificial
  CRISPR gRNA sequence
ctgcactccagcatggatga

SEQ ID NO: 790945 - DNA, 20 bp, Artificial
  CRISPR gRNA sequence
gcactccagcatggatgaca

SEQ ID NO: 790946 - DNA, 20 bp, Artificial
  CRISPR gRNA sequence
cactccagcatggatgacag

SEQ ID NO: 790947 - DNA, 20 bp, Artificial
  CRISPR gRNA sequence
tccagcatggatgacagagg

SEQ ID NO: 790948 - DNA, 20 bp, Artificial
  CRISPR gRNA sequence
aggaagaccctgtctctaaa

SEQ ID NO: 790949 - DNA, 20 bp, Artificial
  CRISPR gRNA sequence
agttttgttttaatttaaaa

SEQ ID NO: 790950 - DNA, 20 bp, Artificial
  CRISPR gRNA sequence
gttttgttttaatttaaaaa

SEQ ID NO: 790951 - DNA, 20 bp, Artificial
  CRISPR gRNA sequence
atttaaaaaaggtaaaaata

SEQ ID NO: 790952 - DNA, 20 bp, Artificial
  CRISPR gRNA sequence
tttaaaaaaggtaaaaataa

SEQ ID NO: 790953 - DNA, 20 bp, Artificial
  CRISPR gRNA sequence
ttaaaaaaggtaaaaataaa

SEQ ID NO: 790954 - DNA, 20 bp, Artificial
  CRISPR gRNA sequence
ggtaaaaataaagggcatat

SEQ ID NO: 790955 - DNA, 20 bp, Artificial
  CRISPR gRNA sequence
aaaataaagggcatatcaga

SEQ ID NO: 790956 - DNA, 20 bp, Artificial
  CRISPR gRNA sequence
gcatatcagatagtgctatg

SEQ ID NO: 790957 - DNA, 20 bp, Artificial
  CRISPR gRNA sequence
atatcagatagtgctatgaa

SEQ ID NO: 790958 - DNA, 20 bp, Artificial
  CRISPR gRNA sequence
tgctatgaagagtatttgca

SEQ ID NO: 790959 - DNA, 20 bp, Artificial
  CRISPR gRNA sequence
gctatgaagagtatttgcaa

SEQ ID NO: 790960 - DNA, 20 bp, Artificial
  CRISPR gRNA sequence
tatgaagagtatttgcaaag

SEQ ID NO: 790961 - DNA, 20 bp, Artificial
  CRISPR gRNA sequence
atgaagagtatttgcaaagg

SEQ ID NO: 790962 - DNA, 20 bp, Artificial
  CRISPR gRNA sequence
atttgcaaaggaggttttat

SEQ ID NO: 790963 - DNA, 20 bp, Artificial
  CRISPR gRNA sequence
tttgcaaaggaggttttatt

SEQ ID NO: 790964 - DNA, 20 bp, Artificial
  CRISPR gRNA sequence
caaaggaggttttattgggc

SEQ ID NO: 790965 - DNA, 20 bp, Artificial
  CRISPR gRNA sequence
aaaggaggttttattgggct

SEQ ID NO: 790966 - DNA, 20 bp, Artificial
  CRISPR gRNA sequence
aaggaggttttattgggcta

SEQ ID NO: 790967 - DNA, 20 bp, Artificial
  CRISPR gRNA sequence
ttattgggctagggtatgtg

SEQ ID NO: 790968 - DNA, 20 bp, Artificial
  CRISPR gRNA sequence
tagggtatgtgaagcatttc

SEQ ID NO: 790969 - DNA, 20 bp, Artificial
  CRISPR gRNA sequence
agggtatgtgaagcatttct

SEQ ID NO: 790970 - DNA, 20 bp, Artificial
  CRISPR gRNA sequence
gggtatgtgaagcatttctg

SEQ ID NO: 790971 - DNA, 20 bp, Artificial
  CRISPR gRNA sequence
gtatgtgaagcatttctggg

SEQ ID NO: 790972 - DNA, 20 bp, Artificial
  CRISPR gRNA sequence
gcatttctggggagctgaca

SEQ ID NO: 790973 - DNA, 20 bp, Artificial
  CRISPR gRNA sequence
tgacaaagttcttcttaacc

SEQ ID NO: 790974 - DNA, 20 bp, Artificial
  CRISPR gRNA sequence
gacaaagttcttcttaacct

SEQ ID NO: 790975 - DNA, 20 bp, Artificial
  CRISPR gRNA sequence
aaagttcttcttaacctggg

SEQ ID NO: 790976 - DNA, 20 bp, Artificial
  CRISPR gRNA sequence
gttcttcttaacctgggtgg

SEQ ID NO: 790977 - DNA, 20 bp, Artificial
  CRISPR gRNA sequence
aacctgggtggtggttacaa

SEQ ID NO: 790978 - DNA, 20 bp, Artificial
  CRISPR gRNA sequence
ttacaaaagtaatcacctta

SEQ ID NO: 790979 - DNA, 20 bp, Artificial
  CRISPR gRNA sequence
aatcaccttatagtaatgtt

SEQ ID NO: 790980 - DNA, 20 bp, Artificial
  CRISPR gRNA sequence
tatagtaatgttaagcttta

SEQ ID NO: 790981 - DNA, 20 bp, Artificial
  CRISPR gRNA sequence
agctttatagttgtttcatg

SEQ ID NO: 790982 - DNA, 20 bp, Artificial
  CRISPR gRNA sequence
ctctgtgatatattttacaa

SEQ ID NO: 790983 - DNA, 20 bp, Artificial
  CRISPR gRNA sequence
gtgatatattttacaacaga

SEQ ID NO: 790984 - DNA, 20 bp, Artificial
  CRISPR gRNA sequence
ttttcaaaatatatttaatt

SEQ ID NO: 790985 - DNA, 20 bp, Artificial
  CRISPR gRNA sequence
gtgaacctaccacctaccct

SEQ ID NO: 790986 - DNA, 20 bp, Artificial
  CRISPR gRNA sequence
ctaccacctaccctaagaac

SEQ ID NO: 790987 - DNA, 20 bp, Artificial
  CRISPR gRNA sequence
tgatgtatgtctgcctgcac

SEQ ID NO: 790988 - DNA, 20 bp, Artificial
  CRISPR gRNA sequence
atgtatgtctgcctgcacca

SEQ ID NO: 790989 - DNA, 20 bp, Artificial
  CRISPR gRNA sequence
tgtatgtctgcctgcaccag

SEQ ID NO: 790990 - DNA, 20 bp, Artificial
  CRISPR gRNA sequence
ctgcctgcaccagaggtaac

SEQ ID NO: 790991 - DNA, 20 bp, Artificial
  CRISPR gRNA sequence
gtaactggcgtcctgaatat

SEQ ID NO: 790992 - DNA, 20 bp, Artificial
  CRISPR gRNA sequence
taactggcgtcctgaatatc

SEQ ID NO: 790993 - DNA, 20 bp, Artificial
  CRISPR gRNA sequence
gtcctgaatatcgggcttat

SEQ ID NO: 790994 - DNA, 20 bp, Artificial
  CRISPR gRNA sequence
tacttttttttttttttttt

SEQ ID NO: 790995 - DNA, 20 bp, Artificial
  CRISPR gRNA sequence
ttttttttttttttttgaga

SEQ ID NO: 790996 - DNA, 20 bp, Artificial
  CRISPR gRNA sequence
ttttttttttttttgagacg

SEQ ID NO: 790997 - DNA, 20 bp, Artificial
  CRISPR gRNA sequence
cggagtctcactctgtcgcc

SEQ ID NO: 790998 - DNA, 20 bp, Artificial
  CRISPR gRNA sequence
ggagtctcactctgtcgccc

SEQ ID NO: 790999 - DNA, 20 bp, Artificial
  CRISPR gRNA sequence
tctcactctgtcgcccaggc

SEQ ID NO: 791000 - DNA, 20 bp, Artificial
  CRISPR gRNA sequence
tcactctgtcgcccaggcta

SEQ ID NO: 791001 - DNA, 20 bp, Artificial
  CRISPR gRNA sequence
ctgtcgcccaggctagagtg

SEQ ID NO: 791002 - DNA, 20 bp, Artificial
  CRISPR gRNA sequence
tcgcccaggctagagtgcag

SEQ ID NO: 791003 - DNA, 20 bp, Artificial
  CRISPR gRNA sequence
agagtgcagtggcgtgatct

SEQ ID NO: 791004 - DNA, 20 bp, Artificial
  CRISPR gRNA sequence
caccgccacctccgactccc

SEQ ID NO: 791005 - DNA, 20 bp, Artificial
  CRISPR gRNA sequence
cacctccgactccctggttc

SEQ ID NO: 791006 - DNA, 20 bp, Artificial
  CRISPR gRNA sequence
ttcaagcgattctcctgcct

SEQ ID NO: 791007 - DNA, 20 bp, Artificial
  CRISPR gRNA sequence
ttctcctgcctcagactccc

SEQ ID NO: 791008 - DNA, 20 bp, Artificial
  CRISPR gRNA sequence
tcctgcctcagactcccgag

SEQ ID NO: 791009 - DNA, 20 bp, Artificial
  CRISPR gRNA sequence
gcctcagactcccgagtagc

SEQ ID NO: 791010 - DNA, 20 bp, Artificial
  CRISPR gRNA sequence
cctcagactcccgagtagct

SEQ ID NO: 791011 - DNA, 20 bp, Artificial
  CRISPR gRNA sequence
ctcccgagtagctgggatta

SEQ ID NO: 791012 - DNA, 20 bp, Artificial
  CRISPR gRNA sequence
tcccgagtagctgggattac

SEQ ID NO: 791013 - DNA, 20 bp, Artificial
  CRISPR gRNA sequence
caggcttgtgccaccatgcc

SEQ ID NO: 791014 - DNA, 20 bp, Artificial
  CRISPR gRNA sequence
gctaatttttgtattttttg

SEQ ID NO: 791015 - DNA, 20 bp, Artificial
  CRISPR gRNA sequence
taatttttgtattttttgta

SEQ ID NO: 791016 - DNA, 20 bp, Artificial
  CRISPR gRNA sequence
tttgtattttttgtagagac

SEQ ID NO: 791017 - DNA, 20 bp, Artificial
  CRISPR gRNA sequence
ttgtattttttgtagagacg

SEQ ID NO: 791018 - DNA, 20 bp, Artificial
  CRISPR gRNA sequence
agagacgaggtttcaccatg

SEQ ID NO: 791019 - DNA, 20 bp, Artificial
  CRISPR gRNA sequence
gagacgaggtttcaccatgc

SEQ ID NO: 791020 - DNA, 20 bp, Artificial
  CRISPR gRNA sequence
cgaggtttcaccatgcgggc

SEQ ID NO: 791021 - DNA, 20 bp, Artificial
  CRISPR gRNA sequence
gaggtttcaccatgcgggcc

SEQ ID NO: 791022 - DNA, 20 bp, Artificial
  CRISPR gRNA sequence
tttcaccatgcgggccaggc

SEQ ID NO: 791023 - DNA, 20 bp, Artificial
  CRISPR gRNA sequence
catgcgggccaggctggtct

SEQ ID NO: 791024 - DNA, 20 bp, Artificial
  CRISPR gRNA sequence
acctcgtgatctgcccacct

SEQ ID NO: 791025 - DNA, 20 bp, Artificial
  CRISPR gRNA sequence
ctgcccaccttggcctccca

SEQ ID NO: 791026 - DNA, 20 bp, Artificial
  CRISPR gRNA sequence
accttggcctcccaaagtgc

SEQ ID NO: 791027 - DNA, 20 bp, Artificial
  CRISPR gRNA sequence
ccttggcctcccaaagtgct

SEQ ID NO: 791028 - DNA, 20 bp, Artificial
  CRISPR gRNA sequence
ctcccaaagtgctgggatta

SEQ ID NO: 791029 - DNA, 20 bp, Artificial
  CRISPR gRNA sequence
tcccaaagtgctgggattac

SEQ ID NO: 791030 - DNA, 20 bp, Artificial
  CRISPR gRNA sequence
agtgctgggattacaggcgt

SEQ ID NO: 791031 - DNA, 20 bp, Artificial
  CRISPR gRNA sequence
caggcgtgagccaccatgcc

SEQ ID NO: 791032 - DNA, 20 bp, Artificial
  CRISPR gRNA sequence
cggcctcttctttacttttt

SEQ ID NO: 791033 - DNA, 20 bp, Artificial
  CRISPR gRNA sequence
aagctttatcttctatatat

SEQ ID NO: 791034 - DNA, 20 bp, Artificial
  CRISPR gRNA sequence
agctttatcttctatatata

SEQ ID NO: 791035 - DNA, 20 bp, Artificial
  CRISPR gRNA sequence
tctatatataaggtatgctt

SEQ ID NO: 791036 - DNA, 20 bp, Artificial
  CRISPR gRNA sequence
gcaatatatttatttatgaa

SEQ ID NO: 791037 - DNA, 20 bp, Artificial
  CRISPR gRNA sequence
caatatatttatttatgaaa

SEQ ID NO: 791038 - DNA, 20 bp, Artificial
  CRISPR gRNA sequence
ttgtgctatgtgttatcttc

SEQ ID NO: 791039 - DNA, 20 bp, Artificial
  CRISPR gRNA sequence
tttactcaatattatgctct

SEQ ID NO: 791040 - DNA, 20 bp, Artificial
  CRISPR gRNA sequence
atattatgctctaagattca

SEQ ID NO: 791041 - DNA, 20 bp, Artificial
  CRISPR gRNA sequence
tgctctaagattcatagatg

SEQ ID NO: 791042 - DNA, 20 bp, Artificial
  CRISPR gRNA sequence
atctacatgctatataataa

SEQ ID NO: 791043 - DNA, 20 bp, Artificial
  CRISPR gRNA sequence
atgctatataataatagatg

SEQ ID NO: 791044 - DNA, 20 bp, Artificial
  CRISPR gRNA sequence
tgatttctctatccattctc

SEQ ID NO: 791045 - DNA, 20 bp, Artificial
  CRISPR gRNA sequence
ctctatccattctccagttg

SEQ ID NO: 791046 - DNA, 20 bp, Artificial
  CRISPR gRNA sequence
ttctccagttgaagttcttc

SEQ ID NO: 791047 - DNA, 20 bp, Artificial
  CRISPR gRNA sequence
agttcttctagacctactcc

SEQ ID NO: 791048 - DNA, 20 bp, Artificial
  CRISPR gRNA sequence
actcctggaatcaaattctc

SEQ ID NO: 791049 - DNA, 20 bp, Artificial
  CRISPR gRNA sequence
ctcctggaatcaaattctcc

SEQ ID NO: 791050 - DNA, 20 bp, Artificial
  CRISPR gRNA sequence
tcctggaatcaaattctcca

SEQ ID NO: 791051 - DNA, 20 bp, Artificial
  CRISPR gRNA sequence
atcaaattctccagggcata

SEQ ID NO: 791052 - DNA, 20 bp, Artificial
  CRISPR gRNA sequence
tttatttatttgtaatgact

SEQ ID NO: 791053 - DNA, 20 bp, Artificial
  CRISPR gRNA sequence
atgactgagaataccgccat

SEQ ID NO: 791054 - DNA, 20 bp, Artificial
  CRISPR gRNA sequence
tctttttttttttttttaaa

SEQ ID NO: 791055 - DNA, 20 bp, Artificial
  CRISPR gRNA sequence
tggaatctcactctgtcacc

SEQ ID NO: 791056 - DNA, 20 bp, Artificial
  CRISPR gRNA sequence
ggaatctcactctgtcaccc

SEQ ID NO: 791057 - DNA, 20 bp, Artificial
  CRISPR gRNA sequence
tctcactctgtcacccaggc

SEQ ID NO: 791058 - DNA, 20 bp, Artificial
  CRISPR gRNA sequence
ctgtcacccaggctggaata

SEQ ID NO: 791059 - DNA, 20 bp, Artificial
  CRISPR gRNA sequence
ggaatacagtgacatgatct

SEQ ID NO: 791060 - DNA, 20 bp, Artificial
  CRISPR gRNA sequence
tcactgcaacctctgcctcc

SEQ ID NO: 791061 - DNA, 20 bp, Artificial
  CRISPR gRNA sequence
cactgcaacctctgcctcct

SEQ ID NO: 791062 - DNA, 20 bp, Artificial
  CRISPR gRNA sequence
aacctctgcctcctgggttc

SEQ ID NO: 791063 - DNA, 20 bp, Artificial
  CRISPR gRNA sequence
ttcaagcaatttttctgcct

SEQ ID NO: 791064 - DNA, 20 bp, Artificial
  CRISPR gRNA sequence
gcaatttttctgcctcagct

SEQ ID NO: 791065 - DNA, 20 bp, Artificial
  CRISPR gRNA sequence
atttttctgcctcagctgag

SEQ ID NO: 791066 - DNA, 20 bp, Artificial
  CRISPR gRNA sequence
tctgcctcagctgagtagct

SEQ ID NO: 791067 - DNA, 20 bp, Artificial
  CRISPR gRNA sequence
cagctgagtagcttggatta

SEQ ID NO: 791068 - DNA, 20 bp, Artificial
  CRISPR gRNA sequence
agctgagtagcttggattat

SEQ ID NO: 791069 - DNA, 20 bp, Artificial
  CRISPR gRNA sequence
tgagtagcttggattatagg

SEQ ID NO: 791070 - DNA, 20 bp, Artificial
  CRISPR gRNA sequence
taggtggccaccaccatgcc

SEQ ID NO: 791071 - DNA, 20 bp, Artificial
  CRISPR gRNA sequence
ggctaatatttttctatttt

SEQ ID NO: 791072 - DNA, 20 bp, Artificial
  CRISPR gRNA sequence
atatttttctatttttagta

SEQ ID NO: 791073 - DNA, 20 bp, Artificial
  CRISPR gRNA sequence
atttttctatttttagtaca

SEQ ID NO: 791074 - DNA, 20 bp, Artificial
  CRISPR gRNA sequence
tttttctatttttagtacag

SEQ ID NO: 791075 - DNA, 20 bp, Artificial
  CRISPR gRNA sequence
ttttctatttttagtacaga

SEQ ID NO: 791076 - DNA, 20 bp, Artificial
  CRISPR gRNA sequence
tttctatttttagtacagag

SEQ ID NO: 791077 - DNA, 20 bp, Artificial
  CRISPR gRNA sequence
acagaggggtttcaccatgt

SEQ ID NO: 791078 - DNA, 20 bp, Artificial
  CRISPR gRNA sequence
aggggtttcaccatgttggc

SEQ ID NO: 791079 - DNA, 20 bp, Artificial
  CRISPR gRNA sequence
ggggtttcaccatgttggcc

SEQ ID NO: 791080 - DNA, 20 bp, Artificial
  CRISPR gRNA sequence
tttcaccatgttggccaggc

SEQ ID NO: 791081 - DNA, 20 bp, Artificial
  CRISPR gRNA sequence
tggtctcgaactcctgacct

SEQ ID NO: 791082 - DNA, 20 bp, Artificial
  CRISPR gRNA sequence
ggtctcgaactcctgacctg

SEQ ID NO: 791083 - DNA, 20 bp, Artificial
  CRISPR gRNA sequence
ctgaggtgatccacccgcct

SEQ ID NO: 791084 - DNA, 20 bp, Artificial
  CRISPR gRNA sequence
ccacccgcctcggcctccca

SEQ ID NO: 791085 - DNA, 20 bp, Artificial
  CRISPR gRNA sequence
cacccgcctcggcctcccat

SEQ ID NO: 791086 - DNA, 20 bp, Artificial
  CRISPR gRNA sequence
acccgcctcggcctcccata

SEQ ID NO: 791087 - DNA, 20 bp, Artificial
  CRISPR gRNA sequence
gcctcggcctcccatagggc

SEQ ID NO: 791088 - DNA, 20 bp, Artificial
  CRISPR gRNA sequence
cctcggcctcccatagggct

SEQ ID NO: 791089 - DNA, 20 bp, Artificial
  CRISPR gRNA sequence
ctcccatagggctgggatta

SEQ ID NO: 791090 - DNA, 20 bp, Artificial
  CRISPR gRNA sequence
tcccatagggctgggattat

SEQ ID NO: 791091 - DNA, 20 bp, Artificial
  CRISPR gRNA sequence
agggctgggattataggcgt

SEQ ID NO: 791092 - DNA, 20 bp, Artificial
  CRISPR gRNA sequence
taggcgtgagccactgcgcc

SEQ ID NO: 791093 - DNA, 20 bp, Artificial
  CRISPR gRNA sequence
gtgagccactgcgcctggcc

SEQ ID NO: 791094 - DNA, 20 bp, Artificial
  CRISPR gRNA sequence
ttatttttaaaatttaaaaa

SEQ ID NO: 791095 - DNA, 20 bp, Artificial
  CRISPR gRNA sequence
tttaaaatttaaaaatagaa

SEQ ID NO: 791096 - DNA, 20 bp, Artificial
  CRISPR gRNA sequence
agaaaagaaatgtgcactga

SEQ ID NO: 791097 - DNA, 20 bp, Artificial
  CRISPR gRNA sequence
gaaaagaaatgtgcactgat

SEQ ID NO: 791098 - DNA, 20 bp, Artificial
  CRISPR gRNA sequence
aaaagaaatgtgcactgata

SEQ ID NO: 791099 - DNA, 20 bp, Artificial
  CRISPR gRNA sequence
atgtgcactgatagggtact

SEQ ID NO: 791100 - DNA, 20 bp, Artificial
  CRISPR gRNA sequence
agcatcacattgatttaatt

SEQ ID NO: 791101 - DNA, 20 bp, Artificial
  CRISPR gRNA sequence
gcatcacattgatttaattc

SEQ ID NO: 791102 - DNA, 20 bp, Artificial
  CRISPR gRNA sequence
atcttcttttcttttcaatg

SEQ ID NO: 791103 - DNA, 20 bp, Artificial
  CRISPR gRNA sequence
tttcttttcaatgaagcatg

SEQ ID NO: 791104 - DNA, 20 bp, Artificial
  CRISPR gRNA sequence
ttcttttcaatgaagcatgc

SEQ ID NO: 791105 - DNA, 20 bp, Artificial
  CRISPR gRNA sequence
ttcaatgaagcatgcaggtc

SEQ ID NO: 791106 - DNA, 20 bp, Artificial
  CRISPR gRNA sequence
tcaatgaagcatgcaggtct

SEQ ID NO: 791107 - DNA, 20 bp, Artificial
  CRISPR gRNA sequence
caatgaagcatgcaggtctg

SEQ ID NO: 791108 - DNA, 20 bp, Artificial
  CRISPR gRNA sequence
atgcaggtctggggctgtac

SEQ ID NO: 791109 - DNA, 20 bp, Artificial
  CRISPR gRNA sequence
tgcaggtctggggctgtaca

SEQ ID NO: 791110 - DNA, 20 bp, Artificial
  CRISPR gRNA sequence
caggtctggggctgtacaag

SEQ ID NO: 791111 - DNA, 20 bp, Artificial
  CRISPR gRNA sequence
tctggggctgtacaaggagc

SEQ ID NO: 791112 - DNA, 20 bp, Artificial
  CRISPR gRNA sequence
ctggggctgtacaaggagca

SEQ ID NO: 791113 - DNA, 20 bp, Artificial
  CRISPR gRNA sequence
gggctgtacaaggagcaagg

SEQ ID NO: 791114 - DNA, 20 bp, Artificial
  CRISPR gRNA sequence
aatgtaatcttctgtctgtc

SEQ ID NO: 791115 - DNA, 20 bp, Artificial
  CRISPR gRNA sequence
tgtctgtctggacaccctga

SEQ ID NO: 791116 - DNA, 20 bp, Artificial
  CRISPR gRNA sequence
tctggacaccctgatagctg

SEQ ID NO: 791117 - DNA, 20 bp, Artificial
  CRISPR gRNA sequence
tgatagctgtagctctgtct

SEQ ID NO: 791118 - DNA, 20 bp, Artificial
  CRISPR gRNA sequence
gatagctgtagctctgtctc

SEQ ID NO: 791119 - DNA, 20 bp, Artificial
  CRISPR gRNA sequence
gtagctctgtctcaggcact

SEQ ID NO: 791120 - DNA, 20 bp, Artificial
  CRISPR gRNA sequence
gtctcaggcactgagtgttg

SEQ ID NO: 791121 - DNA, 20 bp, Artificial
  CRISPR gRNA sequence
ttactttcatatttttatat

SEQ ID NO: 791122 - DNA, 20 bp, Artificial
  CRISPR gRNA sequence
aaaaacctgaatatacataa

SEQ ID NO: 791123 - DNA, 20 bp, Artificial
  CRISPR gRNA sequence
cctgaatatacataatagat

SEQ ID NO: 791124 - DNA, 20 bp, Artificial
  CRISPR gRNA sequence
tatcctttttacccccatcc

SEQ ID NO: 791125 - DNA, 20 bp, Artificial
  CRISPR gRNA sequence
cccagacctcctcccctccc

SEQ ID NO: 791126 - DNA, 20 bp, Artificial
  CRISPR gRNA sequence
agacctcctcccctccccag

SEQ ID NO: 791127 - DNA, 20 bp, Artificial
  CRISPR gRNA sequence
agtaaacactaattatttct

SEQ ID NO: 791128 - DNA, 20 bp, Artificial
  CRISPR gRNA sequence
taattatttctcagatcctt

SEQ ID NO: 791129 - DNA, 20 bp, Artificial
  CRISPR gRNA sequence
ttttttgttgttttcttttg

SEQ ID NO: 791130 - DNA, 20 bp, Artificial
  CRISPR gRNA sequence
tttttgttgttttcttttgc

SEQ ID NO: 791131 - DNA, 20 bp, Artificial
  CRISPR gRNA sequence
aaatcaaaactctttaatta

SEQ ID NO: 791132 - DNA, 20 bp, Artificial
  CRISPR gRNA sequence
atcaaaactctttaattaaa

SEQ ID NO: 791133 - DNA, 20 bp, Artificial
  CRISPR gRNA sequence
ttaaagagacatgaaatgac

SEQ ID NO: 791134 - DNA, 20 bp, Artificial
  CRISPR gRNA sequence
agattttaaaaaaatcccat

SEQ ID NO: 791135 - DNA, 20 bp, Artificial
  CRISPR gRNA sequence
gattttaaaaaaatcccatg

SEQ ID NO: 791136 - DNA, 20 bp, Artificial
  CRISPR gRNA sequence
ttttaaaaaaatcccatgag

SEQ ID NO: 791137 - DNA, 20 bp, Artificial
  CRISPR gRNA sequence
taaaaaaatcccatgaggag

SEQ ID NO: 791138 - DNA, 20 bp, Artificial
  CRISPR gRNA sequence
aaaaaaatcccatgaggaga

SEQ ID NO: 791139 - DNA, 20 bp, Artificial
  CRISPR gRNA sequence
gaggagaaggcattctaatt

SEQ ID NO: 791140 - DNA, 20 bp, Artificial
  CRISPR gRNA sequence
aggagaaggcattctaattt

SEQ ID NO: 791141 - DNA, 20 bp, Artificial
  CRISPR gRNA sequence
agaaggcattctaatttagg

SEQ ID NO: 791142 - DNA, 20 bp, Artificial
  CRISPR gRNA sequence
gaaggcattctaatttaggt

SEQ ID NO: 791143 - DNA, 20 bp, Artificial
  CRISPR gRNA sequence
ctgaactgatgttatctgca

SEQ ID NO: 791144 - DNA, 20 bp, Artificial
  CRISPR gRNA sequence
aactgatgttatctgcatag

SEQ ID NO: 791145 - DNA, 20 bp, Artificial
  CRISPR gRNA sequence
gatgttatctgcatagtgga

SEQ ID NO: 791146 - DNA, 20 bp, Artificial
  CRISPR gRNA sequence
gttatctgcatagtggaaag

SEQ ID NO: 791147 - DNA, 20 bp, Artificial
  CRISPR gRNA sequence
ctgcatagtggaaagcagaa

SEQ ID NO: 791148 - DNA, 20 bp, Artificial
  CRISPR gRNA sequence
aaaagaattccaaattcgtg

SEQ ID NO: 791149 - DNA, 20 bp, Artificial
  CRISPR gRNA sequence
tccaaattcgtgaagaaaat

SEQ ID NO: 791150 - DNA, 20 bp, Artificial
  CRISPR gRNA sequence
aattcgtgaagaaaatgaga

SEQ ID NO: 791151 - DNA, 20 bp, Artificial
  CRISPR gRNA sequence
ctacatttttactttccttt

SEQ ID NO: 791152 - DNA, 20 bp, Artificial
  CRISPR gRNA sequence
tactttcctttcagttaatt

SEQ ID NO: 791153 - DNA, 20 bp, Artificial
  CRISPR gRNA sequence
tttttgattctgtgaatatc

SEQ ID NO: 791154 - DNA, 20 bp, Artificial
  CRISPR gRNA sequence
attcaatacgtatccatatt

SEQ ID NO: 791155 - DNA, 20 bp, Artificial
  CRISPR gRNA sequence
acgtatccatattcagactt

SEQ ID NO: 791156 - DNA, 20 bp, Artificial
  CRISPR gRNA sequence
cagtgcaaaaacctattcca

SEQ ID NO: 791157 - DNA, 20 bp, Artificial
  CRISPR gRNA sequence
gcaaaaacctattccaaagt

SEQ ID NO: 791158 - DNA, 20 bp, Artificial
  CRISPR gRNA sequence
aaaacctattccaaagttgg

SEQ ID NO: 791159 - DNA, 20 bp, Artificial
  CRISPR gRNA sequence
ttccaaagttggaagattta

SEQ ID NO: 791160 - DNA, 20 bp, Artificial
  CRISPR gRNA sequence
tccaaagttggaagatttat

SEQ ID NO: 791161 - DNA, 20 bp, Artificial
  CRISPR gRNA sequence
atttttgattaccatcatca

SEQ ID NO: 791162 - DNA, 20 bp, Artificial
  CRISPR gRNA sequence
tttgattaccatcatcatgg

SEQ ID NO: 791163 - DNA, 20 bp, Artificial
  CRISPR gRNA sequence
ttaccatcatcatggtagca

SEQ ID NO: 791164 - DNA, 20 bp, Artificial
  CRISPR gRNA sequence
atcatcatggtagcacagta

SEQ ID NO: 791165 - DNA, 20 bp, Artificial
  CRISPR gRNA sequence
atcatggtagcacagtaaag

SEQ ID NO: 791166 - DNA, 20 bp, Artificial
  CRISPR gRNA sequence
tggtagcacagtaaagtaga

SEQ ID NO: 791167 - DNA, 20 bp, Artificial
  CRISPR gRNA sequence
ggtagcacagtaaagtagaa

SEQ ID NO: 791168 - DNA, 20 bp, Artificial
  CRISPR gRNA sequence
cagtaaagtagaaaggacat

SEQ ID NO: 791169 - DNA, 20 bp, Artificial
  CRISPR gRNA sequence
tagctttgttgaaatcttgc

SEQ ID NO: 791170 - DNA, 20 bp, Artificial
  CRISPR gRNA sequence
acctaataactatgtaatct

SEQ ID NO: 791171 - DNA, 20 bp, Artificial
  CRISPR gRNA sequence
cctaataactatgtaatctt

SEQ ID NO: 791172 - DNA, 20 bp, Artificial
  CRISPR gRNA sequence
ctaataactatgtaatcttg

SEQ ID NO: 791173 - DNA, 20 bp, Artificial
  CRISPR gRNA sequence
tatgtaatcttggggaaatt

SEQ ID NO: 791174 - DNA, 20 bp, Artificial
  CRISPR gRNA sequence
ggaaattaagtaccttttct

SEQ ID NO: 791175 - DNA, 20 bp, Artificial
  CRISPR gRNA sequence
taagtaccttttctgagttc

SEQ ID NO: 791176 - DNA, 20 bp, Artificial
  CRISPR gRNA sequence
cctgcaaaatgatcattgtg

SEQ ID NO: 791177 - DNA, 20 bp, Artificial
  CRISPR gRNA sequence
tataccatatgtaaattgcc

SEQ ID NO: 791178 - DNA, 20 bp, Artificial
  CRISPR gRNA sequence
catatgtaaattgcctagca

SEQ ID NO: 791179 - DNA, 20 bp, Artificial
  CRISPR gRNA sequence
aaattgcctagcacagtatc

SEQ ID NO: 791180 - DNA, 20 bp, Artificial
  CRISPR gRNA sequence
ctagcacagtatctggcatt

SEQ ID NO: 791181 - DNA, 20 bp, Artificial
  CRISPR gRNA sequence
tgctcttccttttgccccat

SEQ ID NO: 791182 - DNA, 20 bp, Artificial
  CRISPR gRNA sequence
gccccattagtatacctaac

SEQ ID NO: 791183 - DNA, 20 bp, Artificial
  CRISPR gRNA sequence
ccccattagtatacctaact

SEQ ID NO: 791184 - DNA, 20 bp, Artificial
  CRISPR gRNA sequence
ccattagtatacctaactgg

SEQ ID NO: 791185 - DNA, 20 bp, Artificial
  CRISPR gRNA sequence
tagtatacctaactgggagc

SEQ ID NO: 791186 - DNA, 20 bp, Artificial
  CRISPR gRNA sequence
ttgtcttgtgctgattatct

SEQ ID NO: 791187 - DNA, 20 bp, Artificial
  CRISPR gRNA sequence
tcttgtgctgattatcttag

SEQ ID NO: 791188 - DNA, 20 bp, Artificial
  CRISPR gRNA sequence
tgctgattatcttagaagaa

SEQ ID NO: 791189 - DNA, 20 bp, Artificial
  CRISPR gRNA sequence
aagaaaagatccttcctctg

SEQ ID NO: 791190 - DNA, 20 bp, Artificial
  CRISPR gRNA sequence
aaagatccttcctctgtaga

SEQ ID NO: 791191 - DNA, 20 bp, Artificial
  CRISPR gRNA sequence
agatccttcctctgtagaaa

SEQ ID NO: 791192 - DNA, 20 bp, Artificial
  CRISPR gRNA sequence
cctctgtagaaagagccaat

SEQ ID NO: 791193 - DNA, 20 bp, Artificial
  CRISPR gRNA sequence
ctctgtagaaagagccaatg

SEQ ID NO: 791194 - DNA, 20 bp, Artificial
  CRISPR gRNA sequence
tctgtagaaagagccaatga

SEQ ID NO: 791195 - DNA, 20 bp, Artificial
  CRISPR gRNA sequence
aatgttgccccttgtcaccc

SEQ ID NO: 791196 - DNA, 20 bp, Artificial
  CRISPR gRNA sequence
ccctagctcactcctttcct

SEQ ID NO: 791197 - DNA, 20 bp, Artificial
  CRISPR gRNA sequence
ctagctcactcctttcctaa

SEQ ID NO: 791198 - DNA, 20 bp, Artificial
  CRISPR gRNA sequence
tcactcctttcctaagagaa

SEQ ID NO: 791199 - DNA, 20 bp, Artificial
  CRISPR gRNA sequence
cactcctttcctaagagaaa

SEQ ID NO: 791200 - DNA, 20 bp, Artificial
  CRISPR gRNA sequence
aagagaaaaggcaaaaaaca

SEQ ID NO: 791201 - DNA, 20 bp, Artificial
  CRISPR gRNA sequence
gaaaaggcaaaaaacaaaga

SEQ ID NO: 791202 - DNA, 20 bp, Artificial
  CRISPR gRNA sequence
aaaaacaaagacagaaaacc

SEQ ID NO: 791203 - DNA, 20 bp, Artificial
  CRISPR gRNA sequence
aaaacaaagacagaaaaccc

SEQ ID NO: 791204 - DNA, 20 bp, Artificial
  CRISPR gRNA sequence
agacagaaaacccaggatct

SEQ ID NO: 791205 - DNA, 20 bp, Artificial
  CRISPR gRNA sequence
cccaggatctcagtgttttt

SEQ ID NO: 791206 - DNA, 20 bp, Artificial
  CRISPR gRNA sequence
gtttttaagctacaaaccca

SEQ ID NO: 791207 - DNA, 20 bp, Artificial
  CRISPR gRNA sequence
ttttaagctacaaacccaca

SEQ ID NO: 791208 - DNA, 20 bp, Artificial
  CRISPR gRNA sequence
tttaagctacaaacccacag

SEQ ID NO: 791209 - DNA, 20 bp, Artificial
  CRISPR gRNA sequence
acagaggttacacattcccc

SEQ ID NO: 791210 - DNA, 20 bp, Artificial
  CRISPR gRNA sequence
attccccaagttttctcctg

SEQ ID NO: 791211 - DNA, 20 bp, Artificial
  CRISPR gRNA sequence
aagttttctcctgaagcccc

SEQ ID NO: 791212 - DNA, 20 bp, Artificial
  CRISPR gRNA sequence
tgaagcccccagtcctgcca

SEQ ID NO: 791213 - DNA, 20 bp, Artificial
  CRISPR gRNA sequence
gaagcccccagtcctgccac

SEQ ID NO: 791214 - DNA, 20 bp, Artificial
  CRISPR gRNA sequence
cccccagtcctgccacagga

SEQ ID NO: 791215 - DNA, 20 bp, Artificial
  CRISPR gRNA sequence
ccccagtcctgccacaggat

SEQ ID NO: 791216 - DNA, 20 bp, Artificial
  CRISPR gRNA sequence
cccagtcctgccacaggatg

SEQ ID NO: 791217 - DNA, 20 bp, Artificial
  CRISPR gRNA sequence
tcctgccacaggatggggaa

SEQ ID NO: 791218 - DNA, 20 bp, Artificial
  CRISPR gRNA sequence
ggatggggaacagtgtcttt

SEQ ID NO: 791219 - DNA, 20 bp, Artificial
  CRISPR gRNA sequence
tcatttcccttatcactcta

SEQ ID NO: 791220 - DNA, 20 bp, Artificial
  CRISPR gRNA sequence
tatcactctatggaaacttg

SEQ ID NO: 791221 - DNA, 20 bp, Artificial
  CRISPR gRNA sequence
ggaaacttgaagctgttttg

SEQ ID NO: 791222 - DNA, 20 bp, Artificial
  CRISPR gRNA sequence
acttgaagctgttttgtagc

SEQ ID NO: 791223 - DNA, 20 bp, Artificial
  CRISPR gRNA sequence
cttgaagctgttttgtagca

SEQ ID NO: 791224 - DNA, 20 bp, Artificial
  CRISPR gRNA sequence
gaagctgttttgtagcaagg

SEQ ID NO: 791225 - DNA, 20 bp, Artificial
  CRISPR gRNA sequence
tttgcttgtctctaaaatgc

SEQ ID NO: 791226 - DNA, 20 bp, Artificial
  CRISPR gRNA sequence
cttgtctctaaaatgccagc

SEQ ID NO: 791227 - DNA, 20 bp, Artificial
  CRISPR gRNA sequence
ttgtctctaaaatgccagcc

SEQ ID NO: 791228 - DNA, 20 bp, Artificial
  CRISPR gRNA sequence
tctctaaaatgccagccagg

SEQ ID NO: 791229 - DNA, 20 bp, Artificial
  CRISPR gRNA sequence
ctctaaaatgccagccaggc

SEQ ID NO: 791230 - DNA, 20 bp, Artificial
  CRISPR gRNA sequence
tctaaaatgccagccaggca

SEQ ID NO: 791231 - DNA, 20 bp, Artificial
  CRISPR gRNA sequence
gccaggcagggttccttgca

SEQ ID NO: 791232 - DNA, 20 bp, Artificial
  CRISPR gRNA sequence
ccttgcaaagaaaacatgaa

SEQ ID NO: 791233 - DNA, 20 bp, Artificial
  CRISPR gRNA sequence
gaaaacatgaaaagttcctt

SEQ ID NO: 791234 - DNA, 20 bp, Artificial
  CRISPR gRNA sequence
acatgaaaagttcctttagc

SEQ ID NO: 791235 - DNA, 20 bp, Artificial
  CRISPR gRNA sequence
agttcctttagctggccctg

SEQ ID NO: 791236 - DNA, 20 bp, Artificial
  CRISPR gRNA sequence
gttcctttagctggccctgc

SEQ ID NO: 791237 - DNA, 20 bp, Artificial
  CRISPR gRNA sequence
cctttagctggccctgcagg

SEQ ID NO: 791238 - DNA, 20 bp, Artificial
  CRISPR gRNA sequence
ctttagctggccctgcaggc

SEQ ID NO: 791239 - DNA, 20 bp, Artificial
  CRISPR gRNA sequence
ttagctggccctgcaggcag

SEQ ID NO: 791240 - DNA, 20 bp, Artificial
  CRISPR gRNA sequence
gctggccctgcaggcaggag

SEQ ID NO: 791241 - DNA, 20 bp, Artificial
  CRISPR gRNA sequence
tggccctgcaggcaggagca

SEQ ID NO: 791242 - DNA, 20 bp, Artificial
  CRISPR gRNA sequence
ccctgcaggcaggagcagag

SEQ ID NO: 791243 - DNA, 20 bp, Artificial
  CRISPR gRNA sequence
tgcaggcaggagcagagtag

SEQ ID NO: 791244 - DNA, 20 bp, Artificial
  CRISPR gRNA sequence
ggcaggagcagagtagaagt

SEQ ID NO: 791245 - DNA, 20 bp, Artificial
  CRISPR gRNA sequence
aggagcagagtagaagtaag

SEQ ID NO: 791246 - DNA, 20 bp, Artificial
  CRISPR gRNA sequence
tagaagtaagcagaatatct

SEQ ID NO: 791247 - DNA, 20 bp, Artificial
  CRISPR gRNA sequence
agaagtaagcagaatatctc

SEQ ID NO: 791248 - DNA, 20 bp, Artificial
  CRISPR gRNA sequence
gaagtaagcagaatatctca

SEQ ID NO: 791249 - DNA, 20 bp, Artificial
  CRISPR gRNA sequence
atatctcagggtcttccttt

SEQ ID NO: 791250 - DNA, 20 bp, Artificial
  CRISPR gRNA sequence
tatctcagggtcttcctttg

SEQ ID NO: 791251 - DNA, 20 bp, Artificial
  CRISPR gRNA sequence
tctcagggtcttcctttgag

SEQ ID NO: 791252 - DNA, 20 bp, Artificial
  CRISPR gRNA sequence
ctcagggtcttcctttgagg

SEQ ID NO: 791253 - DNA, 20 bp, Artificial
  CRISPR gRNA sequence
tcagggtcttcctttgagga

SEQ ID NO: 791254 - DNA, 20 bp, Artificial
  CRISPR gRNA sequence
cttcctttgaggagggcccc

SEQ ID NO: 791255 - DNA, 20 bp, Artificial
  CRISPR gRNA sequence
gggccccaagtgcatgtctc

SEQ ID NO: 791256 - DNA, 20 bp, Artificial
  CRISPR gRNA sequence
caagtgcatgtctctagtgc

SEQ ID NO: 791257 - DNA, 20 bp, Artificial
  CRISPR gRNA sequence
gcatgtctctagtgccagac

SEQ ID NO: 791258 - DNA, 20 bp, Artificial
  CRISPR gRNA sequence
catgtctctagtgccagacc

SEQ ID NO: 791259 - DNA, 20 bp, Artificial
  CRISPR gRNA sequence
tctctagtgccagaccaggc

SEQ ID NO: 791260 - DNA, 20 bp, Artificial
  CRISPR gRNA sequence
ctctagtgccagaccaggct

SEQ ID NO: 791261 - DNA, 20 bp, Artificial
  CRISPR gRNA sequence
tagtgccagaccaggctggg

SEQ ID NO: 791262 - DNA, 20 bp, Artificial
  CRISPR gRNA sequence
cagaccaggctgggcagctc

SEQ ID NO: 791263 - DNA, 20 bp, Artificial
  CRISPR gRNA sequence
ccaggctgggcagctcaagt

SEQ ID NO: 791264 - DNA, 20 bp, Artificial
  CRISPR gRNA sequence
gctgggcagctcaagtgagt

SEQ ID NO: 791265 - DNA, 20 bp, Artificial
  CRISPR gRNA sequence
tgggcagctcaagtgagtga

SEQ ID NO: 791266 - DNA, 20 bp, Artificial
  CRISPR gRNA sequence
gggcagctcaagtgagtgag

SEQ ID NO: 791267 - DNA, 20 bp, Artificial
  CRISPR gRNA sequence
gtgagtgagaggaatgtgac

SEQ ID NO: 791268 - DNA, 20 bp, Artificial
  CRISPR gRNA sequence
tgagtgagaggaatgtgact

SEQ ID NO: 791269 - DNA, 20 bp, Artificial
  CRISPR gRNA sequence
gagaggaatgtgactgggtg

SEQ ID NO: 791270 - DNA, 20 bp, Artificial
  CRISPR gRNA sequence
gaggaatgtgactgggtgaa

SEQ ID NO: 791271 - DNA, 20 bp, Artificial
  CRISPR gRNA sequence
tgactgggtgaagagtgatc

SEQ ID NO: 791272 - DNA, 20 bp, Artificial
  CRISPR gRNA sequence
ggtgaagagtgatctggaac

SEQ ID NO: 791273 - DNA, 20 bp, Artificial
  CRISPR gRNA sequence
aagagtgatctggaaccagc

SEQ ID NO: 791274 - DNA, 20 bp, Artificial
  CRISPR gRNA sequence
agtgatctggaaccagctag

SEQ ID NO: 791275 - DNA, 20 bp, Artificial
  CRISPR gRNA sequence
gtgatctggaaccagctagt

SEQ ID NO: 791276 - DNA, 20 bp, Artificial
  CRISPR gRNA sequence
tgatctggaaccagctagta

SEQ ID NO: 791277 - DNA, 20 bp, Artificial
  CRISPR gRNA sequence
atctggaaccagctagtagg

SEQ ID NO: 791278 - DNA, 20 bp, Artificial
  CRISPR gRNA sequence
tctggaaccagctagtaggg

SEQ ID NO: 791279 - DNA, 20 bp, Artificial
  CRISPR gRNA sequence
tggaaccagctagtagggag

SEQ ID NO: 791280 - DNA, 20 bp, Artificial
  CRISPR gRNA sequence
accagctagtagggaggaga

SEQ ID NO: 791281 - DNA, 20 bp, Artificial
  CRISPR gRNA sequence
gggaggagaaagctcttcga

SEQ ID NO: 791282 - DNA, 20 bp, Artificial
  CRISPR gRNA sequence
ggaggagaaagctcttcgaa

SEQ ID NO: 791283 - DNA, 20 bp, Artificial
  CRISPR gRNA sequence
aagctcttcgaaaggttatc

SEQ ID NO: 791284 - DNA, 20 bp, Artificial
  CRISPR gRNA sequence
tcgaaaggttatcaagtgcc

SEQ ID NO: 791285 - DNA, 20 bp, Artificial
  CRISPR gRNA sequence
cgaaaggttatcaagtgcca

SEQ ID NO: 791286 - DNA, 20 bp, Artificial
  CRISPR gRNA sequence
gaaaggttatcaagtgccaa

SEQ ID NO: 791287 - DNA, 20 bp, Artificial
  CRISPR gRNA sequence
aaggttatcaagtgccaagg

SEQ ID NO: 791288 - DNA, 20 bp, Artificial
  CRISPR gRNA sequence
agccattatttctcaatcat

SEQ ID NO: 791289 - DNA, 20 bp, Artificial
  CRISPR gRNA sequence
cattatttctcaatcatgag

SEQ ID NO: 791290 - DNA, 20 bp, Artificial
  CRISPR gRNA sequence
atttctcaatcatgagcaga

SEQ ID NO: 791291 - DNA, 20 bp, Artificial
  CRISPR gRNA sequence
agcagaaagatgatttccca

SEQ ID NO: 791292 - DNA, 20 bp, Artificial
  CRISPR gRNA sequence
gcagaaagatgatttcccat

SEQ ID NO: 791293 - DNA, 20 bp, Artificial
  CRISPR gRNA sequence
cagaaagatgatttcccatg

SEQ ID NO: 791294 - DNA, 20 bp, Artificial
  CRISPR gRNA sequence
aagatgatttcccatggggc

SEQ ID NO: 791295 - DNA, 20 bp, Artificial
  CRISPR gRNA sequence
agatgatttcccatggggct

SEQ ID NO: 791296 - DNA, 20 bp, Artificial
  CRISPR gRNA sequence
gatgatttcccatggggctg

SEQ ID NO: 791297 - DNA, 20 bp, Artificial
  CRISPR gRNA sequence
ggggctggggctattgtctt

SEQ ID NO: 791298 - DNA, 20 bp, Artificial
  CRISPR gRNA sequence
gggctggggctattgtcttg

SEQ ID NO: 791299 - DNA, 20 bp, Artificial
  CRISPR gRNA sequence
acacctctatgttactctct

SEQ ID NO: 791300 - DNA, 20 bp, Artificial
  CRISPR gRNA sequence
tatgttactctcttagctcc

SEQ ID NO: 791301 - DNA, 20 bp, Artificial
  CRISPR gRNA sequence
ctcctggtgttcatccaaaa

SEQ ID NO: 791302 - DNA, 20 bp, Artificial
  CRISPR gRNA sequence
catccaaaatagtgcactca

SEQ ID NO: 791303 - DNA, 20 bp, Artificial
  CRISPR gRNA sequence
gttctaactacaccctcgaa

SEQ ID NO: 791304 - DNA, 20 bp, Artificial
  CRISPR gRNA sequence
atggtctgaactaccttccc

SEQ ID NO: 791305 - DNA, 20 bp, Artificial
  CRISPR gRNA sequence
tggtctgaactaccttcccc

SEQ ID NO: 791306 - DNA, 20 bp, Artificial
  CRISPR gRNA sequence
gtctgaactaccttccccag

SEQ ID NO: 791307 - DNA, 20 bp, Artificial
  CRISPR gRNA sequence
tgctcaccctcatcctccaa

SEQ ID NO: 791308 - DNA, 20 bp, Artificial
  CRISPR gRNA sequence
tcaccctcatcctccaatag

SEQ ID NO: 791309 - DNA, 20 bp, Artificial
  CRISPR gRNA sequence
ccaatagaagtcctttcttc

SEQ ID NO: 791310 - DNA, 20 bp, Artificial
  CRISPR gRNA sequence
aagtcctttcttcaagtcca

SEQ ID NO: 791311 - DNA, 20 bp, Artificial
  CRISPR gRNA sequence
agtcctttcttcaagtccaa

SEQ ID NO: 791312 - DNA, 20 bp, Artificial
  CRISPR gRNA sequence
gtcctttcttcaagtccaaa

SEQ ID NO: 791313 - DNA, 20 bp, Artificial
  CRISPR gRNA sequence
tttcttcaagtccaaaggga

SEQ ID NO: 791314 - DNA, 20 bp, Artificial
  CRISPR gRNA sequence
aagtccaaagggatagcctt

SEQ ID NO: 791315 - DNA, 20 bp, Artificial
  CRISPR gRNA sequence
agtccaaagggatagcctta

SEQ ID NO: 791316 - DNA, 20 bp, Artificial
  CRISPR gRNA sequence
cttaaggttcattgttcatt

SEQ ID NO: 791317 - DNA, 20 bp, Artificial
  CRISPR gRNA sequence
ttaaggttcattgttcattt

SEQ ID NO: 791318 - DNA, 20 bp, Artificial
  CRISPR gRNA sequence
ttcattgttcatttgggttt

SEQ ID NO: 791319 - DNA, 20 bp, Artificial
  CRISPR gRNA sequence
tcattgttcatttgggtttt

SEQ ID NO: 791320 - DNA, 20 bp, Artificial
  CRISPR gRNA sequence
ttgttcatttgggttttagg

SEQ ID NO: 791321 - DNA, 20 bp, Artificial
  CRISPR gRNA sequence
atttgggttttaggaagact

SEQ ID NO: 791322 - DNA, 20 bp, Artificial
  CRISPR gRNA sequence
aagactcagtaaaccacatt

SEQ ID NO: 791323 - DNA, 20 bp, Artificial
  CRISPR gRNA sequence
agactcagtaaaccacatta

SEQ ID NO: 791324 - DNA, 20 bp, Artificial
  CRISPR gRNA sequence
attaaggtatgaatgaccaa

SEQ ID NO: 791325 - DNA, 20 bp, Artificial
  CRISPR gRNA sequence
gctattgttgcttttcaaaa

SEQ ID NO: 791326 - DNA, 20 bp, Artificial
  CRISPR gRNA sequence
cttttcaaaaaagaaactca

SEQ ID NO: 791327 - DNA, 20 bp, Artificial
  CRISPR gRNA sequence
cagaaacaactaataatatg

SEQ ID NO: 791328 - DNA, 20 bp, Artificial
  CRISPR gRNA sequence
ataatatgcagaatgtcttc

SEQ ID NO: 791329 - DNA, 20 bp, Artificial
  CRISPR gRNA sequence
tgtcttcaagacattatctt

SEQ ID NO: 791330 - DNA, 20 bp, Artificial
  CRISPR gRNA sequence
tcttcaagacattatcttta

SEQ ID NO: 791331 - DNA, 20 bp, Artificial
  CRISPR gRNA sequence
agacattatctttagagtaa

SEQ ID NO: 791332 - DNA, 20 bp, Artificial
  CRISPR gRNA sequence
tttagagtaacggtgttccc

SEQ ID NO: 791333 - DNA, 20 bp, Artificial
  CRISPR gRNA sequence
tgtctccttactctccctgc

SEQ ID NO: 791334 - DNA, 20 bp, Artificial
  CRISPR gRNA sequence
tccttactctccctgccaga

SEQ ID NO: 791335 - DNA, 20 bp, Artificial
  CRISPR gRNA sequence
ccttactctccctgccagaa

SEQ ID NO: 791336 - DNA, 20 bp, Artificial
  CRISPR gRNA sequence
tactctccctgccagaaagg

SEQ ID NO: 791337 - DNA, 20 bp, Artificial
  CRISPR gRNA sequence
actctccctgccagaaagga

SEQ ID NO: 791338 - DNA, 20 bp, Artificial
  CRISPR gRNA sequence
ctctccctgccagaaaggaa

SEQ ID NO: 791339 - DNA, 20 bp, Artificial
  CRISPR gRNA sequence
tctccctgccagaaaggaag

SEQ ID NO: 791340 - DNA, 20 bp, Artificial
  CRISPR gRNA sequence
cctgccagaaaggaagggga

SEQ ID NO: 791341 - DNA, 20 bp, Artificial
  CRISPR gRNA sequence
aaaggaaggggacagctgct

SEQ ID NO: 791342 - DNA, 20 bp, Artificial
  CRISPR gRNA sequence
ctgcttggcatctcaccttt

SEQ ID NO: 791343 - DNA, 20 bp, Artificial
  CRISPR gRNA sequence
tgcttggcatctcaccttta

SEQ ID NO: 791344 - DNA, 20 bp, Artificial
  CRISPR gRNA sequence
gcttggcatctcacctttaa

SEQ ID NO: 791345 - DNA, 20 bp, Artificial
  CRISPR gRNA sequence
caacccctgccctcttgtat

SEQ ID NO: 791346 - DNA, 20 bp, Artificial
  CRISPR gRNA sequence
cctgccctcttgtatcagtt

SEQ ID NO: 791347 - DNA, 20 bp, Artificial
  CRISPR gRNA sequence
tgtatcagtttagatttaca

SEQ ID NO: 791348 - DNA, 20 bp, Artificial
  CRISPR gRNA sequence
agtttagatttacatggtct

SEQ ID NO: 791349 - DNA, 20 bp, Artificial
  CRISPR gRNA sequence
cttcttgtcattaccctcac

SEQ ID NO: 791350 - DNA, 20 bp, Artificial
  CRISPR gRNA sequence
ttgtcattaccctcactgga

SEQ ID NO: 791351 - DNA, 20 bp, Artificial
  CRISPR gRNA sequence
tcattaccctcactggatag

SEQ ID NO: 791352 - DNA, 20 bp, Artificial
  CRISPR gRNA sequence
cattaccctcactggatagt

SEQ ID NO: 791353 - DNA, 20 bp, Artificial
  CRISPR gRNA sequence
ccctcactggatagtgggaa

SEQ ID NO: 791354 - DNA, 20 bp, Artificial
  CRISPR gRNA sequence
cactggatagtgggaataga

SEQ ID NO: 791355 - DNA, 20 bp, Artificial
  CRISPR gRNA sequence
ctggatagtgggaatagatg

SEQ ID NO: 791356 - DNA, 20 bp, Artificial
  CRISPR gRNA sequence
aatagatggagcaatattct

SEQ ID NO: 791357 - DNA, 20 bp, Artificial
  CRISPR gRNA sequence
ttctcagtcaccgtttctgt

SEQ ID NO: 791358 - DNA, 20 bp, Artificial
  CRISPR gRNA sequence
cagtcaccgtttctgtcaga

SEQ ID NO: 791359 - DNA, 20 bp, Artificial
  CRISPR gRNA sequence
agtcaccgtttctgtcagat

SEQ ID NO: 791360 - DNA, 20 bp, Artificial
  CRISPR gRNA sequence
gtcaccgtttctgtcagata

SEQ ID NO: 791361 - DNA, 20 bp, Artificial
  CRISPR gRNA sequence
tttctgtcagatagggacat

SEQ ID NO: 791362 - DNA, 20 bp, Artificial
  CRISPR gRNA sequence
atagggacattggcatgtat

SEQ ID NO: 791363 - DNA, 20 bp, Artificial
  CRISPR gRNA sequence
ttggcatgtataagccacca

SEQ ID NO: 791364 - DNA, 20 bp, Artificial
  CRISPR gRNA sequence
tggcatgtataagccaccat

SEQ ID NO: 791365 - DNA, 20 bp, Artificial
  CRISPR gRNA sequence
ggcatgtataagccaccatg

SEQ ID NO: 791366 - DNA, 20 bp, Artificial
  CRISPR gRNA sequence
ggggactctttttttttttg

SEQ ID NO: 791367 - DNA, 20 bp, Artificial
  CRISPR gRNA sequence
ctttttttttttgtggtgct

SEQ ID NO: 791368 - DNA, 20 bp, Artificial
  CRISPR gRNA sequence
tttttttgtggtgcttggaa

SEQ ID NO: 791369 - DNA, 20 bp, Artificial
  CRISPR gRNA sequence
ttgtggtgcttggaatagcc

SEQ ID NO: 791370 - DNA, 20 bp, Artificial
  CRISPR gRNA sequence
agaaatcatacgtcctctca

SEQ ID NO: 791371 - DNA, 20 bp, Artificial
  CRISPR gRNA sequence
atcatacgtcctctcaaaga

SEQ ID NO: 791372 - DNA, 20 bp, Artificial
  CRISPR gRNA sequence
gtcctctcaaagaaagccct

SEQ ID NO: 791373 - DNA, 20 bp, Artificial
  CRISPR gRNA sequence
tcaaagaaagccctcagcct

SEQ ID NO: 791374 - DNA, 20 bp, Artificial
  CRISPR gRNA sequence
caaagaaagccctcagcctg

SEQ ID NO: 791375 - DNA, 20 bp, Artificial
  CRISPR gRNA sequence
aaagaaagccctcagcctga

SEQ ID NO: 791376 - DNA, 20 bp, Artificial
  CRISPR gRNA sequence
gagggccacattctcatttt

SEQ ID NO: 791377 - DNA, 20 bp, Artificial
  CRISPR gRNA sequence
cacattctcatttttggctt

SEQ ID NO: 791378 - DNA, 20 bp, Artificial
  CRISPR gRNA sequence
ttctcatttttggctttggc

SEQ ID NO: 791379 - DNA, 20 bp, Artificial
  CRISPR gRNA sequence
tctcatttttggctttggct

SEQ ID NO: 791380 - DNA, 20 bp, Artificial
  CRISPR gRNA sequence
accacctgctcttctttctt

SEQ ID NO: 791381 - DNA, 20 bp, Artificial
  CRISPR gRNA sequence
gtcctttcttacctgctatc

SEQ ID NO: 791382 - DNA, 20 bp, Artificial
  CRISPR gRNA sequence
ttcttacctgctatctggtg

SEQ ID NO: 791383 - DNA, 20 bp, Artificial
  CRISPR gRNA sequence
atctggtgaagctgcaattc

SEQ ID NO: 791384 - DNA, 20 bp, Artificial
  CRISPR gRNA sequence
tctggtgaagctgcaattcc

SEQ ID NO: 791385 - DNA, 20 bp, Artificial
  CRISPR gRNA sequence
tgcaattccaggctcaacat

SEQ ID NO: 791386 - DNA, 20 bp, Artificial
  CRISPR gRNA sequence
aattccaggctcaacattag

SEQ ID NO: 791387 - DNA, 20 bp, Artificial
  CRISPR gRNA sequence
attccaggctcaacattagc

SEQ ID NO: 791388 - DNA, 20 bp, Artificial
  CRISPR gRNA sequence
tccaggctcaacattagcag

SEQ ID NO: 791389 - DNA, 20 bp, Artificial
  CRISPR gRNA sequence
ccaggctcaacattagcagg

SEQ ID NO: 791390 - DNA, 20 bp, Artificial
  CRISPR gRNA sequence
ggctcaacattagcaggagg

SEQ ID NO: 791391 - DNA, 20 bp, Artificial
  CRISPR gRNA sequence
gttctgtatttgatctgaaa

SEQ ID NO: 791392 - DNA, 20 bp, Artificial
  CRISPR gRNA sequence
gatctgaaatagacaattga

SEQ ID NO: 791393 - DNA, 20 bp, Artificial
  CRISPR gRNA sequence
aaatagacaattgaaagtct

SEQ ID NO: 791394 - DNA, 20 bp, Artificial
  CRISPR gRNA sequence
aatagacaattgaaagtctc

SEQ ID NO: 791395 - DNA, 20 bp, Artificial
  CRISPR gRNA sequence
atagacaattgaaagtctca

SEQ ID NO: 791396 - DNA, 20 bp, Artificial
  CRISPR gRNA sequence
agggccttgtgaaactttgc

SEQ ID NO: 791397 - DNA, 20 bp, Artificial
  CRISPR gRNA sequence
gggccttgtgaaactttgct

SEQ ID NO: 791398 - DNA, 20 bp, Artificial
  CRISPR gRNA sequence
gtgaaactttgctgggtctt

SEQ ID NO: 791399 - DNA, 20 bp, Artificial
  CRISPR gRNA sequence
tctttgttcacttttgaaaa

SEQ ID NO: 791400 - DNA, 20 bp, Artificial
  CRISPR gRNA sequence
ctttgttcacttttgaaaac

SEQ ID NO: 791401 - DNA, 20 bp, Artificial
  CRISPR gRNA sequence
tttgttcacttttgaaaaca

SEQ ID NO: 791402 - DNA, 20 bp, Artificial
  CRISPR gRNA sequence
ttgttcacttttgaaaacag

SEQ ID NO: 791403 - DNA, 20 bp, Artificial
  CRISPR gRNA sequence
caggggaataacaaatcatt

SEQ ID NO: 791404 - DNA, 20 bp, Artificial
  CRISPR gRNA sequence
aggggaataacaaatcattt

SEQ ID NO: 791405 - DNA, 20 bp, Artificial
  CRISPR gRNA sequence
ggggaataacaaatcatttg

SEQ ID NO: 791406 - DNA, 20 bp, Artificial
  CRISPR gRNA sequence
gaataacaaatcatttgggg

SEQ ID NO: 791407 - DNA, 20 bp, Artificial
  CRISPR gRNA sequence
aataacaaatcatttgggga

SEQ ID NO: 791408 - DNA, 20 bp, Artificial
  CRISPR gRNA sequence
aaatcatttggggaaggtga

SEQ ID NO: 791409 - DNA, 20 bp, Artificial
  CRISPR gRNA sequence
ttggggaaggtgacagacca

SEQ ID NO: 791410 - DNA, 20 bp, Artificial
  CRISPR gRNA sequence
gggaaggtgacagaccatgg

SEQ ID NO: 791411 - DNA, 20 bp, Artificial
  CRISPR gRNA sequence
gaaggtgacagaccatggta

SEQ ID NO: 791412 - DNA, 20 bp, Artificial
  CRISPR gRNA sequence
ggtgacagaccatggtagag

SEQ ID NO: 791413 - DNA, 20 bp, Artificial
  CRISPR gRNA sequence
tgacagaccatggtagagtg

SEQ ID NO: 791414 - DNA, 20 bp, Artificial
  CRISPR gRNA sequence
agaccatggtagagtggagc

SEQ ID NO: 791415 - DNA, 20 bp, Artificial
  CRISPR gRNA sequence
gaccatggtagagtggagct

SEQ ID NO: 791416 - DNA, 20 bp, Artificial
  CRISPR gRNA sequence
ccatggtagagtggagctgg

SEQ ID NO: 791417 - DNA, 20 bp, Artificial
  CRISPR gRNA sequence
catggtagagtggagctggg

SEQ ID NO: 791418 - DNA, 20 bp, Artificial
  CRISPR gRNA sequence
tggtagagtggagctgggag

SEQ ID NO: 791419 - DNA, 20 bp, Artificial
  CRISPR gRNA sequence
tagagtggagctgggaggag

SEQ ID NO: 791420 - DNA, 20 bp, Artificial
  CRISPR gRNA sequence
ggagctgggaggagaagtta

SEQ ID NO: 791421 - DNA, 20 bp, Artificial
  CRISPR gRNA sequence
gagctgggaggagaagttat

SEQ ID NO: 791422 - DNA, 20 bp, Artificial
  CRISPR gRNA sequence
gaagttataggttgatttcc

SEQ ID NO: 791423 - DNA, 20 bp, Artificial
  CRISPR gRNA sequence
agttataggttgatttcctg

SEQ ID NO: 791424 - DNA, 20 bp, Artificial
  CRISPR gRNA sequence
tataggttgatttcctggag

SEQ ID NO: 791425 - DNA, 20 bp, Artificial
  CRISPR gRNA sequence
taggttgatttcctggagaa

SEQ ID NO: 791426 - DNA, 20 bp, Artificial
  CRISPR gRNA sequence
gttgatttcctggagaagag

SEQ ID NO: 791427 - DNA, 20 bp, Artificial
  CRISPR gRNA sequence
gagaagagaagatataaatt

SEQ ID NO: 791428 - DNA, 20 bp, Artificial
  CRISPR gRNA sequence
gaagagaagatataaattaa

SEQ ID NO: 791429 - DNA, 20 bp, Artificial
  CRISPR gRNA sequence
gatataaattaagagtaaac

SEQ ID NO: 791430 - DNA, 20 bp, Artificial
  CRISPR gRNA sequence
cactctttataaatccaaat

SEQ ID NO: 791431 - DNA, 20 bp, Artificial
  CRISPR gRNA sequence
tctttataaatccaaatgag

SEQ ID NO: 791432 - DNA, 20 bp, Artificial
  CRISPR gRNA sequence
agttcttcttccttttctaa

SEQ ID NO: 791433 - DNA, 20 bp, Artificial
  CRISPR gRNA sequence
ggccgtttctgaatatgaac

SEQ ID NO: 791434 - DNA, 20 bp, Artificial
  CRISPR gRNA sequence
tccttgtgaaccacacatat

SEQ ID NO: 791435 - DNA, 20 bp, Artificial
  CRISPR gRNA sequence
ttgtgaaccacacatattgg

SEQ ID NO: 791436 - DNA, 20 bp, Artificial
  CRISPR gRNA sequence
agttacctgcacgtctcatg

SEQ ID NO: 791437 - DNA, 20 bp, Artificial
  CRISPR gRNA sequence
acgtctcatgaagctttcca

SEQ ID NO: 791438 - DNA, 20 bp, Artificial
  CRISPR gRNA sequence
ctttccatagcttttttcaa

SEQ ID NO: 791439 - DNA, 20 bp, Artificial
  CRISPR gRNA sequence
ccatagcttttttcaatagc

SEQ ID NO: 791440 - DNA, 20 bp, Artificial
  CRISPR gRNA sequence
tttgtttgtcaaatgaataa

SEQ ID NO: 791441 - DNA, 20 bp, Artificial
  CRISPR gRNA sequence
tggacaccatcttctttacc

SEQ ID NO: 791442 - DNA, 20 bp, Artificial
  CRISPR gRNA sequence
accatcttctttacctggac

SEQ ID NO: 791443 - DNA, 20 bp, Artificial
  CRISPR gRNA sequence
ctttacctggactggatgtc

SEQ ID NO: 791444 - DNA, 20 bp, Artificial
  CRISPR gRNA sequence
tttacctggactggatgtct

SEQ ID NO: 791445 - DNA, 20 bp, Artificial
  CRISPR gRNA sequence
tacctggactggatgtctgg

SEQ ID NO: 791446 - DNA, 20 bp, Artificial
  CRISPR gRNA sequence
ggagtctgacacttgaaaat

SEQ ID NO: 791447 - DNA, 20 bp, Artificial
  CRISPR gRNA sequence
cacttgaaaataagactcca

SEQ ID NO: 791448 - DNA, 20 bp, Artificial
  CRISPR gRNA sequence
gaaaataagactccatagaa

SEQ ID NO: 791449 - DNA, 20 bp, Artificial
  CRISPR gRNA sequence
aaataagactccatagaaca

SEQ ID NO: 791450 - DNA, 20 bp, Artificial
  CRISPR gRNA sequence
cattctcaataaatacttgc

SEQ ID NO: 791451 - DNA, 20 bp, Artificial
  CRISPR gRNA sequence
taaatacttgctagttgact

SEQ ID NO: 791452 - DNA, 20 bp, Artificial
  CRISPR gRNA sequence
acttgctagttgactgagca

SEQ ID NO: 791453 - DNA, 20 bp, Artificial
  CRISPR gRNA sequence
tgctagttgactgagcaaag

SEQ ID NO: 791454 - DNA, 20 bp, Artificial
  CRISPR gRNA sequence
gttgactgagcaaagtagtc

SEQ ID NO: 791455 - DNA, 20 bp, Artificial
  CRISPR gRNA sequence
caaagtagtcaagtgctttt

SEQ ID NO: 791456 - DNA, 20 bp, Artificial
  CRISPR gRNA sequence
agtcaagtgcttttgagtgc

SEQ ID NO: 791457 - DNA, 20 bp, Artificial
  CRISPR gRNA sequence
tgcttttgagtgctggaatt

SEQ ID NO: 791458 - DNA, 20 bp, Artificial
  CRISPR gRNA sequence
ctcttgaactacctcttact

SEQ ID NO: 791459 - DNA, 20 bp, Artificial
  CRISPR gRNA sequence
cttgaactacctcttactaa

SEQ ID NO: 791460 - DNA, 20 bp, Artificial
  CRISPR gRNA sequence
ttgaactacctcttactaag

SEQ ID NO: 791461 - DNA, 20 bp, Artificial
  CRISPR gRNA sequence
ctacctcttactaagaggtt

SEQ ID NO: 791462 - DNA, 20 bp, Artificial
  CRISPR gRNA sequence
ctcttactaagaggtttaga

SEQ ID NO: 791463 - DNA, 20 bp, Artificial
  CRISPR gRNA sequence
tcttactaagaggtttagac

SEQ ID NO: 791464 - DNA, 20 bp, Artificial
  CRISPR gRNA sequence
cttactaagaggtttagaca

SEQ ID NO: 791465 - DNA, 20 bp, Artificial
  CRISPR gRNA sequence
tactaagaggtttagacagg

SEQ ID NO: 791466 - DNA, 20 bp, Artificial
  CRISPR gRNA sequence
ctaagaggtttagacaggga

SEQ ID NO: 791467 - DNA, 20 bp, Artificial
  CRISPR gRNA sequence
agaggtttagacagggagag

SEQ ID NO: 791468 - DNA, 20 bp, Artificial
  CRISPR gRNA sequence
gaggtttagacagggagagt

SEQ ID NO: 791469 - DNA, 20 bp, Artificial
  CRISPR gRNA sequence
aggtttagacagggagagta

SEQ ID NO: 791470 - DNA, 20 bp, Artificial
  CRISPR gRNA sequence
agacagggagagtagggaac

SEQ ID NO: 791471 - DNA, 20 bp, Artificial
  CRISPR gRNA sequence
agtagggaactggctctgat

SEQ ID NO: 791472 - DNA, 20 bp, Artificial
  CRISPR gRNA sequence
gtagggaactggctctgatg

SEQ ID NO: 791473 - DNA, 20 bp, Artificial
  CRISPR gRNA sequence
tagggaactggctctgatga

SEQ ID NO: 791474 - DNA, 20 bp, Artificial
  CRISPR gRNA sequence
ggaactggctctgatgaggg

SEQ ID NO: 791475 - DNA, 20 bp, Artificial
  CRISPR gRNA sequence
gaactggctctgatgagggt

SEQ ID NO: 791476 - DNA, 20 bp, Artificial
  CRISPR gRNA sequence
aactggctctgatgagggtg

SEQ ID NO: 791477 - DNA, 20 bp, Artificial
  CRISPR gRNA sequence
actggctctgatgagggtgg

SEQ ID NO: 791478 - DNA, 20 bp, Artificial
  CRISPR gRNA sequence
gggctgcgaatgccccacct

SEQ ID NO: 791479 - DNA, 20 bp, Artificial
  CRISPR gRNA sequence
atgctttctcctttactctg

SEQ ID NO: 791480 - DNA, 20 bp, Artificial
  CRISPR gRNA sequence
tctgaagctttctttatcca

SEQ ID NO: 791481 - DNA, 20 bp, Artificial
  CRISPR gRNA sequence
ctttatccatggacttctta

SEQ ID NO: 791482 - DNA, 20 bp, Artificial
  CRISPR gRNA sequence
tccatggacttcttatggtt

SEQ ID NO: 791483 - DNA, 20 bp, Artificial
  CRISPR gRNA sequence
ccatggacttcttatggttg

SEQ ID NO: 791484 - DNA, 20 bp, Artificial
  CRISPR gRNA sequence
ggacttcttatggttgagga

SEQ ID NO: 791485 - DNA, 20 bp, Artificial
  CRISPR gRNA sequence
gacttcttatggttgaggaa

SEQ ID NO: 791486 - DNA, 20 bp, Artificial
  CRISPR gRNA sequence
acttcttatggttgaggaaa

SEQ ID NO: 791487 - DNA, 20 bp, Artificial
  CRISPR gRNA sequence
cttatggttgaggaaaggga

SEQ ID NO: 791488 - DNA, 20 bp, Artificial
  CRISPR gRNA sequence
tatggttgaggaaagggaca

SEQ ID NO: 791489 - DNA, 20 bp, Artificial
  CRISPR gRNA sequence
gaggaaagggacagagcaca

SEQ ID NO: 791490 - DNA, 20 bp, Artificial
  CRISPR gRNA sequence
gcacacagctaatctgataa

SEQ ID NO: 791491 - DNA, 20 bp, Artificial
  CRISPR gRNA sequence
tctgataatggtctgaaact

SEQ ID NO: 791492 - DNA, 20 bp, Artificial
  CRISPR gRNA sequence
ctgataatggtctgaaactg

SEQ ID NO: 791493 - DNA, 20 bp, Artificial
  CRISPR gRNA sequence
gataatggtctgaaactgag

SEQ ID NO: 791494 - DNA, 20 bp, Artificial
  CRISPR gRNA sequence
ataatggtctgaaactgagg

SEQ ID NO: 791495 - DNA, 20 bp, Artificial
  CRISPR gRNA sequence
ggaggctttccaacttttat

SEQ ID NO: 791496 - DNA, 20 bp, Artificial
  CRISPR gRNA sequence
tttccaacttttatcagcca

SEQ ID NO: 791497 - DNA, 20 bp, Artificial
  CRISPR gRNA sequence
cagccatggaatcatttctt

SEQ ID NO: 791498 - DNA, 20 bp, Artificial
  CRISPR gRNA sequence
agccatggaatcatttcttc

SEQ ID NO: 791499 - DNA, 20 bp, Artificial
  CRISPR gRNA sequence
gccatggaatcatttcttca

SEQ ID NO: 791500 - DNA, 20 bp, Artificial
  CRISPR gRNA sequence
ccatggaatcatttcttcag

SEQ ID NO: 791501 - DNA, 20 bp, Artificial
  CRISPR gRNA sequence
tttcttcaggggaaatctgt

SEQ ID NO: 791502 - DNA, 20 bp, Artificial
  CRISPR gRNA sequence
tcttcaggggaaatctgttg

SEQ ID NO: 791503 - DNA, 20 bp, Artificial
  CRISPR gRNA sequence
ttggagccatacatctaaat

SEQ ID NO: 791504 - DNA, 20 bp, Artificial
  CRISPR gRNA sequence
tggagccatacatctaaatc

SEQ ID NO: 791505 - DNA, 20 bp, Artificial
  CRISPR gRNA sequence
catacatctaaatcaggcaa

SEQ ID NO: 791506 - DNA, 20 bp, Artificial
  CRISPR gRNA sequence
acatctaaatcaggcaacag

SEQ ID NO: 791507 - DNA, 20 bp, Artificial
  CRISPR gRNA sequence
atctaaatcaggcaacagca

SEQ ID NO: 791508 - DNA, 20 bp, Artificial
  CRISPR gRNA sequence
ggcaacagcagagctgctct

SEQ ID NO: 791509 - DNA, 20 bp, Artificial
  CRISPR gRNA sequence
gctgctctgagtgtgatgaa

SEQ ID NO: 791510 - DNA, 20 bp, Artificial
  CRISPR gRNA sequence
gctctgagtgtgatgaaaag

SEQ ID NO: 791511 - DNA, 20 bp, Artificial
  CRISPR gRNA sequence
ctgagtgtgatgaaaagcag

SEQ ID NO: 791512 - DNA, 20 bp, Artificial
  CRISPR gRNA sequence
gagtgtgatgaaaagcagtg

SEQ ID NO: 791513 - DNA, 20 bp, Artificial
  CRISPR gRNA sequence
agtgtgatgaaaagcagtgg

SEQ ID NO: 791514 - DNA, 20 bp, Artificial
  CRISPR gRNA sequence
gtgtgatgaaaagcagtgga

SEQ ID NO: 791515 - DNA, 20 bp, Artificial
  CRISPR gRNA sequence
atgaaaagcagtggagggtt

SEQ ID NO: 791516 - DNA, 20 bp, Artificial
  CRISPR gRNA sequence
tgaaaagcagtggagggttt

SEQ ID NO: 791517 - DNA, 20 bp, Artificial
  CRISPR gRNA sequence
aagcagtggagggtttgggt

SEQ ID NO: 791518 - DNA, 20 bp, Artificial
  CRISPR gRNA sequence
agcagtggagggtttgggtc

SEQ ID NO: 791519 - DNA, 20 bp, Artificial
  CRISPR gRNA sequence
cagtggagggtttgggtcag

SEQ ID NO: 791520 - DNA, 20 bp, Artificial
  CRISPR gRNA sequence
ggtttgggtcaggagaatga

SEQ ID NO: 791521 - DNA, 20 bp, Artificial
  CRISPR gRNA sequence
agaacctcatttacatcatt

SEQ ID NO: 791522 - DNA, 20 bp, Artificial
  CRISPR gRNA sequence
aacctcatttacatcattaa

SEQ ID NO: 791523 - DNA, 20 bp, Artificial
  CRISPR gRNA sequence
tacatcattaagagacaact

SEQ ID NO: 791524 - DNA, 20 bp, Artificial
  CRISPR gRNA sequence
attaagagacaactaagctt

SEQ ID NO: 791525 - DNA, 20 bp, Artificial
  CRISPR gRNA sequence
gagacaactaagctttggtg

SEQ ID NO: 791526 - DNA, 20 bp, Artificial
  CRISPR gRNA sequence
agacaactaagctttggtgt

SEQ ID NO: 791527 - DNA, 20 bp, Artificial
  CRISPR gRNA sequence
ctaagctttggtgtaggcaa

SEQ ID NO: 791528 - DNA, 20 bp, Artificial
  CRISPR gRNA sequence
gtaggcaatagactattgct

SEQ ID NO: 791529 - DNA, 20 bp, Artificial
  CRISPR gRNA sequence
aggcaatagactattgctga

SEQ ID NO: 791530 - DNA, 20 bp, Artificial
  CRISPR gRNA sequence
ggcaatagactattgctgag

SEQ ID NO: 791531 - DNA, 20 bp, Artificial
  CRISPR gRNA sequence
gcaatagactattgctgaga

SEQ ID NO: 791532 - DNA, 20 bp, Artificial
  CRISPR gRNA sequence
aatagactattgctgagagg

SEQ ID NO: 791533 - DNA, 20 bp, Artificial
  CRISPR gRNA sequence
tagactattgctgagaggga

SEQ ID NO: 791534 - DNA, 20 bp, Artificial
  CRISPR gRNA sequence
agactattgctgagagggag

SEQ ID NO: 791535 - DNA, 20 bp, Artificial
  CRISPR gRNA sequence
tgctgagagggagaggttgc

SEQ ID NO: 791536 - DNA, 20 bp, Artificial
  CRISPR gRNA sequence
gagagggagaggttgctggc

SEQ ID NO: 791537 - DNA, 20 bp, Artificial
  CRISPR gRNA sequence
gaggttgctggcaagattac

SEQ ID NO: 791538 - DNA, 20 bp, Artificial
  CRISPR gRNA sequence
gttgctggcaagattacaag

SEQ ID NO: 791539 - DNA, 20 bp, Artificial
  CRISPR gRNA sequence
ctggcaagattacaagcagt

SEQ ID NO: 791540 - DNA, 20 bp, Artificial
  CRISPR gRNA sequence
aagattacaagcagtgagat

SEQ ID NO: 791541 - DNA, 20 bp, Artificial
  CRISPR gRNA sequence
ttacaagcagtgagatcggt

SEQ ID NO: 791542 - DNA, 20 bp, Artificial
  CRISPR gRNA sequence
tacaagcagtgagatcggtt

SEQ ID NO: 791543 - DNA, 20 bp, Artificial
  CRISPR gRNA sequence
atcggttaggaatgtgtttg

SEQ ID NO: 791544 - DNA, 20 bp, Artificial
  CRISPR gRNA sequence
tgtgtttgcagaaatgctga

SEQ ID NO: 791545 - DNA, 20 bp, Artificial
  CRISPR gRNA sequence
ttgcagaaatgctgatagct

SEQ ID NO: 791546 - DNA, 20 bp, Artificial
  CRISPR gRNA sequence
gcagaaatgctgatagctta

SEQ ID NO: 791547 - DNA, 20 bp, Artificial
  CRISPR gRNA sequence
gaaatgctgatagcttagag

SEQ ID NO: 791548 - DNA, 20 bp, Artificial
  CRISPR gRNA sequence
aatgctgatagcttagagta

SEQ ID NO: 791549 - DNA, 20 bp, Artificial
  CRISPR gRNA sequence
atgctgatagcttagagtag

SEQ ID NO: 791550 - DNA, 20 bp, Artificial
  CRISPR gRNA sequence
tgctgatagcttagagtaga

SEQ ID NO: 791551 - DNA, 20 bp, Artificial
  CRISPR gRNA sequence
gctgatagcttagagtagag

SEQ ID NO: 791552 - DNA, 20 bp, Artificial
  CRISPR gRNA sequence
atagcttagagtagaggggc

SEQ ID NO: 791553 - DNA, 20 bp, Artificial
  CRISPR gRNA sequence
gcttagagtagaggggctag

SEQ ID NO: 791554 - DNA, 20 bp, Artificial
  CRISPR gRNA sequence
cttagagtagaggggctagt

SEQ ID NO: 791555 - DNA, 20 bp, Artificial
  CRISPR gRNA sequence
ttagagtagaggggctagta

SEQ ID NO: 791556 - DNA, 20 bp, Artificial
  CRISPR gRNA sequence
tagagtagaggggctagtag

SEQ ID NO: 791557 - DNA, 20 bp, Artificial
  CRISPR gRNA sequence
gtagaggggctagtaggggt

SEQ ID NO: 791558 - DNA, 20 bp, Artificial
  CRISPR gRNA sequence
gaggggctagtaggggtgag

SEQ ID NO: 791559 - DNA, 20 bp, Artificial
  CRISPR gRNA sequence
gggctagtaggggtgagaag

SEQ ID NO: 791560 - DNA, 20 bp, Artificial
  CRISPR gRNA sequence
aggggtgagaagtggtctgt

SEQ ID NO: 791561 - DNA, 20 bp, Artificial
  CRISPR gRNA sequence
gtgagaagtggtctgttggc

SEQ ID NO: 791562 - DNA, 20 bp, Artificial
  CRISPR gRNA sequence
ttttattttaaaaatttcaa

SEQ ID NO: 791563 - DNA, 20 bp, Artificial
  CRISPR gRNA sequence
aaatttcaacagctttatta

SEQ ID NO: 791564 - DNA, 20 bp, Artificial
  CRISPR gRNA sequence
aaagtataattgatatacga

SEQ ID NO: 791565 - DNA, 20 bp, Artificial
  CRISPR gRNA sequence
agtataattgatatacgaaa

SEQ ID NO: 791566 - DNA, 20 bp, Artificial
  CRISPR gRNA sequence
gtataattgatatacgaaag

SEQ ID NO: 791567 - DNA, 20 bp, Artificial
  CRISPR gRNA sequence
tataattgatatacgaaaga

SEQ ID NO: 791568 - DNA, 20 bp, Artificial
  CRISPR gRNA sequence
aaagagggttatatgtgtct

SEQ ID NO: 791569 - DNA, 20 bp, Artificial
  CRISPR gRNA sequence
ttaaaacacaaacttttttt

SEQ ID NO: 791570 - DNA, 20 bp, Artificial
  CRISPR gRNA sequence
tttttaagtgcacgactctg

SEQ ID NO: 791571 - DNA, 20 bp, Artificial
  CRISPR gRNA sequence
gtgcacgactctgtggtttt

SEQ ID NO: 791572 - DNA, 20 bp, Artificial
  CRISPR gRNA sequence
tgtggtttttagtatgttca

SEQ ID NO: 791573 - DNA, 20 bp, Artificial
  CRISPR gRNA sequence
tggtttttagtatgttcacg

SEQ ID NO: 791574 - DNA, 20 bp, Artificial
  CRISPR gRNA sequence
caaacactattatccaattt

SEQ ID NO: 791575 - DNA, 20 bp, Artificial
  CRISPR gRNA sequence
aacattttcattaccctgaa

SEQ ID NO: 791576 - DNA, 20 bp, Artificial
  CRISPR gRNA sequence
acattttcattaccctgaaa

SEQ ID NO: 791577 - DNA, 20 bp, Artificial
  CRISPR gRNA sequence
aaaaggaaccccttacccat

SEQ ID NO: 791578 - DNA, 20 bp, Artificial
  CRISPR gRNA sequence
aggaaccccttacccattag

SEQ ID NO: 791579 - DNA, 20 bp, Artificial
  CRISPR gRNA sequence
tttccccttccctttcccta

SEQ ID NO: 791580 - DNA, 20 bp, Artificial
  CRISPR gRNA sequence
ttccctttccctatggccct

SEQ ID NO: 791581 - DNA, 20 bp, Artificial
  CRISPR gRNA sequence
gcccttggcaaccactaatc

SEQ ID NO: 791582 - DNA, 20 bp, Artificial
  CRISPR gRNA sequence
tctctatcaattgcttattc

SEQ ID NO: 791583 - DNA, 20 bp, Artificial
  CRISPR gRNA sequence
ttctggatatttcataaaaa

SEQ ID NO: 791584 - DNA, 20 bp, Artificial
  CRISPR gRNA sequence
tatttcataaaaatggaatc

SEQ ID NO: 791585 - DNA, 20 bp, Artificial
  CRISPR gRNA sequence
aaatggaatcaagcaatatg

SEQ ID NO: 791586 - DNA, 20 bp, Artificial
  CRISPR gRNA sequence
aagcaatatgtggacttttg

SEQ ID NO: 791587 - DNA, 20 bp, Artificial
  CRISPR gRNA sequence
aatatgtggacttttgtggc

SEQ ID NO: 791588 - DNA, 20 bp, Artificial
  CRISPR gRNA sequence
tcaccgaacataatgttgtc

SEQ ID NO: 791589 - DNA, 20 bp, Artificial
  CRISPR gRNA sequence
caccgaacataatgttgtca

SEQ ID NO: 791590 - DNA, 20 bp, Artificial
  CRISPR gRNA sequence
gtcaaggttcatctgtattg

SEQ ID NO: 791591 - DNA, 20 bp, Artificial
  CRISPR gRNA sequence
atctgtattgtagcatatat

SEQ ID NO: 791592 - DNA, 20 bp, Artificial
  CRISPR gRNA sequence
cattttgcttacccattcat

SEQ ID NO: 791593 - DNA, 20 bp, Artificial
  CRISPR gRNA sequence
cttacccattcatcagttga

SEQ ID NO: 791594 - DNA, 20 bp, Artificial
  CRISPR gRNA sequence
ttcatcagttgatggtcatt

SEQ ID NO: 791595 - DNA, 20 bp, Artificial
  CRISPR gRNA sequence
tttggattgtttctgcttgt

SEQ ID NO: 791596 - DNA, 20 bp, Artificial
  CRISPR gRNA sequence
cttgttggctattatgaata

SEQ ID NO: 791597 - DNA, 20 bp, Artificial
  CRISPR gRNA sequence
tcctatgaaaactcatatac

SEQ ID NO: 791598 - DNA, 20 bp, Artificial
  CRISPR gRNA sequence
atgtatacttttaattatct

SEQ ID NO: 791599 - DNA, 20 bp, Artificial
  CRISPR gRNA sequence
tgtatacttttaattatctt

SEQ ID NO: 791600 - DNA, 20 bp, Artificial
  CRISPR gRNA sequence
aattatcttgggtacatatg

SEQ ID NO: 791601 - DNA, 20 bp, Artificial
  CRISPR gRNA sequence
attatcttgggtacatatgt

SEQ ID NO: 791602 - DNA, 20 bp, Artificial
  CRISPR gRNA sequence
tatcttgggtacatatgtag

SEQ ID NO: 791603 - DNA, 20 bp, Artificial
  CRISPR gRNA sequence
cttgggtacatatgtaggag

SEQ ID NO: 791604 - DNA, 20 bp, Artificial
  CRISPR gRNA sequence
agtagaattgctgaattaaa

SEQ ID NO: 791605 - DNA, 20 bp, Artificial
  CRISPR gRNA sequence
aactctatatttaacttttt

SEQ ID NO: 791606 - DNA, 20 bp, Artificial
  CRISPR gRNA sequence
actctatatttaactttttg

SEQ ID NO: 791607 - DNA, 20 bp, Artificial
  CRISPR gRNA sequence
tatttatcaaatatatgatt

SEQ ID NO: 791608 - DNA, 20 bp, Artificial
  CRISPR gRNA sequence
cattctgcacattgtctttt

SEQ ID NO: 791609 - DNA, 20 bp, Artificial
  CRISPR gRNA sequence
ttgtcttttcagtttcttta

SEQ ID NO: 791610 - DNA, 20 bp, Artificial
  CRISPR gRNA sequence
tttctttatagaatcctgtg

SEQ ID NO: 791611 - DNA, 20 bp, Artificial
  CRISPR gRNA sequence
ttctttatagaatcctgtga

SEQ ID NO: 791612 - DNA, 20 bp, Artificial
  CRISPR gRNA sequence
ttgaaacacaaattgatttt

SEQ ID NO: 791613 - DNA, 20 bp, Artificial
  CRISPR gRNA sequence
ttcttttattgtttgtgctt

SEQ ID NO: 791614 - DNA, 20 bp, Artificial
  CRISPR gRNA sequence
tcttttattgtttgtgcttt

SEQ ID NO: 791615 - DNA, 20 bp, Artificial
  CRISPR gRNA sequence
gtgctttaggtgtaatacct

SEQ ID NO: 791616 - DNA, 20 bp, Artificial
  CRISPR gRNA sequence
atacctaagaaaccattgcc

SEQ ID NO: 791617 - DNA, 20 bp, Artificial
  CRISPR gRNA sequence
taagaaaccattgcctagtc

SEQ ID NO: 791618 - DNA, 20 bp, Artificial
  CRISPR gRNA sequence
aagaaaccattgcctagtca

SEQ ID NO: 791619 - DNA, 20 bp, Artificial
  CRISPR gRNA sequence
attgcctagtcaaggtcaca

SEQ ID NO: 791620 - DNA, 20 bp, Artificial
  CRISPR gRNA sequence
ttacatctgtattttctgct

SEQ ID NO: 791621 - DNA, 20 bp, Artificial
  CRISPR gRNA sequence
tctgctaagataaatataaa

SEQ ID NO: 791622 - DNA, 20 bp, Artificial
  CRISPR gRNA sequence
tgctaagataaatataaatg

SEQ ID NO: 791623 - DNA, 20 bp, Artificial
  CRISPR gRNA sequence
atataaatggagcaattgta

SEQ ID NO: 791624 - DNA, 20 bp, Artificial
  CRISPR gRNA sequence
tataaatggagcaattgtac

SEQ ID NO: 791625 - DNA, 20 bp, Artificial
  CRISPR gRNA sequence
ataaatggagcaattgtaca

SEQ ID NO: 791626 - DNA, 20 bp, Artificial
  CRISPR gRNA sequence
agcaattgtacagggacaac

SEQ ID NO: 791627 - DNA, 20 bp, Artificial
  CRISPR gRNA sequence
aactggatgtccacatgcaa

SEQ ID NO: 791628 - DNA, 20 bp, Artificial
  CRISPR gRNA sequence
cacatgcaaaagaacaaatt

SEQ ID NO: 791629 - DNA, 20 bp, Artificial
  CRISPR gRNA sequence
catgcaaaagaacaaatttg

SEQ ID NO: 791630 - DNA, 20 bp, Artificial
  CRISPR gRNA sequence
tatacaaaaattaaacaaaa

SEQ ID NO: 791631 - DNA, 20 bp, Artificial
  CRISPR gRNA sequence
aaaattaaacaaaatggatc

SEQ ID NO: 791632 - DNA, 20 bp, Artificial
  CRISPR gRNA sequence
tggatcaagaacctaaatat

SEQ ID NO: 791633 - DNA, 20 bp, Artificial
  CRISPR gRNA sequence
gaacctaaatataagaactt

SEQ ID NO: 791634 - DNA, 20 bp, Artificial
  CRISPR gRNA sequence
caaatttgttctactgattg

SEQ ID NO: 791635 - DNA, 20 bp, Artificial
  CRISPR gRNA sequence
aaatttgttctactgattgt

SEQ ID NO: 791636 - DNA, 20 bp, Artificial
  CRISPR gRNA sequence
ttctactgattgtgggcatt

SEQ ID NO: 791637 - DNA, 20 bp, Artificial
  CRISPR gRNA sequence
ttgtgcctgtacaatttgtt

SEQ ID NO: 791638 - DNA, 20 bp, Artificial
  CRISPR gRNA sequence
tgtgcctgtacaatttgttg

SEQ ID NO: 791639 - DNA, 20 bp, Artificial
  CRISPR gRNA sequence
ctttccctattgaactgtct

SEQ ID NO: 791640 - DNA, 20 bp, Artificial
  CRISPR gRNA sequence
catcaattgatcatatatat

SEQ ID NO: 791641 - DNA, 20 bp, Artificial
  CRISPR gRNA sequence
atcaattgatcatatatata

SEQ ID NO: 791642 - DNA, 20 bp, Artificial
  CRISPR gRNA sequence
tatatataaggatgtatttc

SEQ ID NO: 791643 - DNA, 20 bp, Artificial
  CRISPR gRNA sequence
actatatgtctatcctatgt

SEQ ID NO: 791644 - DNA, 20 bp, Artificial
  CRISPR gRNA sequence
tatcctatgtcagtaccaca

SEQ ID NO: 791645 - DNA, 20 bp, Artificial
  CRISPR gRNA sequence
ccacacagcgttgattactg

SEQ ID NO: 791646 - DNA, 20 bp, Artificial
  CRISPR gRNA sequence
cgttgattactgtagctttg

SEQ ID NO: 791647 - DNA, 20 bp, Artificial
  CRISPR gRNA sequence
gattactgtagctttgtagt

SEQ ID NO: 791648 - DNA, 20 bp, Artificial
  CRISPR gRNA sequence
tttgtagtaagttttgaaac

SEQ ID NO: 791649 - DNA, 20 bp, Artificial
  CRISPR gRNA sequence
tagtaagttttgaaactgga

SEQ ID NO: 791650 - DNA, 20 bp, Artificial
  CRISPR gRNA sequence
gttttgaaactggaaagtgt

SEQ ID NO: 791651 - DNA, 20 bp, Artificial
  CRISPR gRNA sequence
tgtgagtcctccaactttgt

SEQ ID NO: 791652 - DNA, 20 bp, Artificial
  CRISPR gRNA sequence
caactttgttagtctttttc

SEQ ID NO: 791653 - DNA, 20 bp, Artificial
  CRISPR gRNA sequence
tctttttcaagatttttttt

SEQ ID NO: 791654 - DNA, 20 bp, Artificial
  CRISPR gRNA sequence
ctttttcaagattttttttt

SEQ ID NO: 791655 - DNA, 20 bp, Artificial
  CRISPR gRNA sequence
tttttcaagattttttttta

SEQ ID NO: 791656 - DNA, 20 bp, Artificial
  CRISPR gRNA sequence
ttttcaagatttttttttag

SEQ ID NO: 791657 - DNA, 20 bp, Artificial
  CRISPR gRNA sequence
tttcaagatttttttttagg

SEQ ID NO: 791658 - DNA, 20 bp, Artificial
  CRISPR gRNA sequence
tttttttttagggggctatt

SEQ ID NO: 791659 - DNA, 20 bp, Artificial
  CRISPR gRNA sequence
ttttttttagggggctattc

SEQ ID NO: 791660 - DNA, 20 bp, Artificial
  CRISPR gRNA sequence
ttacattttcaaatgaattt

SEQ ID NO: 791661 - DNA, 20 bp, Artificial
  CRISPR gRNA sequence
tacattttcaaatgaatttt

SEQ ID NO: 791662 - DNA, 20 bp, Artificial
  CRISPR gRNA sequence
acattttcaaatgaatttta

SEQ ID NO: 791663 - DNA, 20 bp, Artificial
  CRISPR gRNA sequence
ggtcaacttgctcatttctg

SEQ ID NO: 791664 - DNA, 20 bp, Artificial
  CRISPR gRNA sequence
cttgctcatttctgcagaca

SEQ ID NO: 791665 - DNA, 20 bp, Artificial
  CRISPR gRNA sequence
ttgctcatttctgcagacaa

SEQ ID NO: 791666 - DNA, 20 bp, Artificial
  CRISPR gRNA sequence
ctcatttctgcagacaaagg

SEQ ID NO: 791667 - DNA, 20 bp, Artificial
  CRISPR gRNA sequence
tttctgcagacaaaggaagc

SEQ ID NO: 791668 - DNA, 20 bp, Artificial
  CRISPR gRNA sequence
gacaaaggaagctggaattt

SEQ ID NO: 791669 - DNA, 20 bp, Artificial
  CRISPR gRNA sequence
aaaggaagctggaattttgg

SEQ ID NO: 791670 - DNA, 20 bp, Artificial
  CRISPR gRNA sequence
aaggaagctggaattttggt

SEQ ID NO: 791671 - DNA, 20 bp, Artificial
  CRISPR gRNA sequence
aggaagctggaattttggta

SEQ ID NO: 791672 - DNA, 20 bp, Artificial
  CRISPR gRNA sequence
tagggattgcattgaatcca

SEQ ID NO: 791673 - DNA, 20 bp, Artificial
  CRISPR gRNA sequence
attgaatccatagatcaatt

SEQ ID NO: 791674 - DNA, 20 bp, Artificial
  CRISPR gRNA sequence
ttgaatccatagatcaattt

SEQ ID NO: 791675 - DNA, 20 bp, Artificial
  CRISPR gRNA sequence
tgaatccatagatcaatttg

SEQ ID NO: 791676 - DNA, 20 bp, Artificial
  CRISPR gRNA sequence
atagatcaatttggggaata

SEQ ID NO: 791677 - DNA, 20 bp, Artificial
  CRISPR gRNA sequence
atcaatttggggaatacagc

SEQ ID NO: 791678 - DNA, 20 bp, Artificial
  CRISPR gRNA sequence
acagccagctgaataatatt

SEQ ID NO: 791679 - DNA, 20 bp, Artificial
  CRISPR gRNA sequence
agtcttccaattcatgaata

SEQ ID NO: 791680 - DNA, 20 bp, Artificial
  CRISPR gRNA sequence
cagcatgtctttcctttgtt

SEQ ID NO: 791681 - DNA, 20 bp, Artificial
  CRISPR gRNA sequence
agcatgtctttcctttgttt

SEQ ID NO: 791682 - DNA, 20 bp, Artificial
  CRISPR gRNA sequence
tcctttgtttaggccttcta

SEQ ID NO: 791683 - DNA, 20 bp, Artificial
  CRISPR gRNA sequence
ggccttctatagtttgaaaa

SEQ ID NO: 791684 - DNA, 20 bp, Artificial
  CRISPR gRNA sequence
atagtttgaaaaaagacctg

SEQ ID NO: 791685 - DNA, 20 bp, Artificial
  CRISPR gRNA sequence
tagtttgaaaaaagacctga

SEQ ID NO: 791686 - DNA, 20 bp, Artificial
  CRISPR gRNA sequence
agtttgaaaaaagacctgaa

SEQ ID NO: 791687 - DNA, 20 bp, Artificial
  CRISPR gRNA sequence
gacctgaagggaactgctga

SEQ ID NO: 791688 - DNA, 20 bp, Artificial
  CRISPR gRNA sequence
acctgaagggaactgctgac

SEQ ID NO: 791689 - DNA, 20 bp, Artificial
  CRISPR gRNA sequence
gaagggaactgctgacaggc

SEQ ID NO: 791690 - DNA, 20 bp, Artificial
  CRISPR gRNA sequence
ctgctgacaggctagatata

SEQ ID NO: 791691 - DNA, 20 bp, Artificial
  CRISPR gRNA sequence
acaggctagatatatagttt

SEQ ID NO: 791692 - DNA, 20 bp, Artificial
  CRISPR gRNA sequence
tagatatatagtttgagaaa

SEQ ID NO: 791693 - DNA, 20 bp, Artificial
  CRISPR gRNA sequence
gatatatagtttgagaaaaa

SEQ ID NO: 791694 - DNA, 20 bp, Artificial
  CRISPR gRNA sequence
atatatagtttgagaaaaag

SEQ ID NO: 791695 - DNA, 20 bp, Artificial
  CRISPR gRNA sequence
tatatagtttgagaaaaaga

SEQ ID NO: 791696 - DNA, 20 bp, Artificial
  CRISPR gRNA sequence
ttgagaaaaagagggaaatc

SEQ ID NO: 791697 - DNA, 20 bp, Artificial
  CRISPR gRNA sequence
tgagaaaaagagggaaatct

SEQ ID NO: 791698 - DNA, 20 bp, Artificial
  CRISPR gRNA sequence
ggaaatctgggaaaattcct

SEQ ID NO: 791699 - DNA, 20 bp, Artificial
  CRISPR gRNA sequence
tctgggaaaattcctaagtt

SEQ ID NO: 791700 - DNA, 20 bp, Artificial
  CRISPR gRNA sequence
ctgggaaaattcctaagttt

SEQ ID NO: 791701 - DNA, 20 bp, Artificial
  CRISPR gRNA sequence
tgggaaaattcctaagtttg

SEQ ID NO: 791702 - DNA, 20 bp, Artificial
  CRISPR gRNA sequence
aattcctaagtttggggctt

SEQ ID NO: 791703 - DNA, 20 bp, Artificial
  CRISPR gRNA sequence
agtttggggcttgagtcact

SEQ ID NO: 791704 - DNA, 20 bp, Artificial
  CRISPR gRNA sequence
gtttggggcttgagtcacta

SEQ ID NO: 791705 - DNA, 20 bp, Artificial
  CRISPR gRNA sequence
ggcttgagtcactaaggcaa

SEQ ID NO: 791706 - DNA, 20 bp, Artificial
  CRISPR gRNA sequence
cttgagtcactaaggcaatg

SEQ ID NO: 791707 - DNA, 20 bp, Artificial
  CRISPR gRNA sequence
ggagatgctgtttattaaaa

SEQ ID NO: 791708 - DNA, 20 bp, Artificial
  CRISPR gRNA sequence
agatgctgtttattaaaatg

SEQ ID NO: 791709 - DNA, 20 bp, Artificial
  CRISPR gRNA sequence
tgctgtttattaaaatggag

SEQ ID NO: 791710 - DNA, 20 bp, Artificial
  CRISPR gRNA sequence
gctgtttattaaaatggaga

SEQ ID NO: 791711 - DNA, 20 bp, Artificial
  CRISPR gRNA sequence
tttattaaaatggagaaggc

SEQ ID NO: 791712 - DNA, 20 bp, Artificial
  CRISPR gRNA sequence
ttattaaaatggagaaggct

SEQ ID NO: 791713 - DNA, 20 bp, Artificial
  CRISPR gRNA sequence
tattaaaatggagaaggctg

SEQ ID NO: 791714 - DNA, 20 bp, Artificial
  CRISPR gRNA sequence
attaaaatggagaaggctgg

SEQ ID NO: 791715 - DNA, 20 bp, Artificial
  CRISPR gRNA sequence
taaaatggagaaggctgggg

SEQ ID NO: 791716 - DNA, 20 bp, Artificial
  CRISPR gRNA sequence
aatggagaaggctgggggag

SEQ ID NO: 791717 - DNA, 20 bp, Artificial
  CRISPR gRNA sequence
ggctgggggagaagcaaatt

SEQ ID NO: 791718 - DNA, 20 bp, Artificial
  CRISPR gRNA sequence
gctgggggagaagcaaatta

SEQ ID NO: 791719 - DNA, 20 bp, Artificial
  CRISPR gRNA sequence
gggggagaagcaaattaagg

SEQ ID NO: 791720 - DNA, 20 bp, Artificial
  CRISPR gRNA sequence
ggggagaagcaaattaagga

SEQ ID NO: 791721 - DNA, 20 bp, Artificial
  CRISPR gRNA sequence
gggagaagcaaattaaggaa

SEQ ID NO: 791722 - DNA, 20 bp, Artificial
  CRISPR gRNA sequence
ggagaagcaaattaaggaag

SEQ ID NO: 791723 - DNA, 20 bp, Artificial
  CRISPR gRNA sequence
gcaaattaaggaaggggaaa

SEQ ID NO: 791724 - DNA, 20 bp, Artificial
  CRISPR gRNA sequence
aaattaaggaaggggaaaaa

SEQ ID NO: 791725 - DNA, 20 bp, Artificial
  CRISPR gRNA sequence
aaaaagagttacgtttgttg

SEQ ID NO: 791726 - DNA, 20 bp, Artificial
  CRISPR gRNA sequence
agttacgtttgttgtagatt

SEQ ID NO: 791727 - DNA, 20 bp, Artificial
  CRISPR gRNA sequence
atttggtttgaaatgcctat

SEQ ID NO: 791728 - DNA, 20 bp, Artificial
  CRISPR gRNA sequence
ggtttgaaatgcctattaga

SEQ ID NO: 791729 - DNA, 20 bp, Artificial
  CRISPR gRNA sequence
gaaatgcctattagatagcc

SEQ ID NO: 791730 - DNA, 20 bp, Artificial
  CRISPR gRNA sequence
atgcctattagatagccaag

SEQ ID NO: 791731 - DNA, 20 bp, Artificial
  CRISPR gRNA sequence
gcctattagatagccaagtg

SEQ ID NO: 791732 - DNA, 20 bp, Artificial
  CRISPR gRNA sequence
cctattagatagccaagtgg

SEQ ID NO: 791733 - DNA, 20 bp, Artificial
  CRISPR gRNA sequence
gatagccaagtggaggtgtt

SEQ ID NO: 791734 - DNA, 20 bp, Artificial
  CRISPR gRNA sequence
agccaagtggaggtgtttag

SEQ ID NO: 791735 - DNA, 20 bp, Artificial
  CRISPR gRNA sequence
gccaagtggaggtgtttagt

SEQ ID NO: 791736 - DNA, 20 bp, Artificial
  CRISPR gRNA sequence
aagtggaggtgtttagtagg

SEQ ID NO: 791737 - DNA, 20 bp, Artificial
  CRISPR gRNA sequence
ggaggtgtttagtaggcagt

SEQ ID NO: 791738 - DNA, 20 bp, Artificial
  CRISPR gRNA sequence
gaggtgtttagtaggcagtt

SEQ ID NO: 791739 - DNA, 20 bp, Artificial
  CRISPR gRNA sequence
aggtgtttagtaggcagttg

SEQ ID NO: 791740 - DNA, 20 bp, Artificial
  CRISPR gRNA sequence
tgtttagtaggcagttgggg

SEQ ID NO: 791741 - DNA, 20 bp, Artificial
  CRISPR gRNA sequence
tttagtaggcagttggggta

SEQ ID NO: 791742 - DNA, 20 bp, Artificial
  CRISPR gRNA sequence
ttggggtagagatgtaaatt

SEQ ID NO: 791743 - DNA, 20 bp, Artificial
  CRISPR gRNA sequence
tggggtagagatgtaaattt

SEQ ID NO: 791744 - DNA, 20 bp, Artificial
  CRISPR gRNA sequence
gggtagagatgtaaatttag

SEQ ID NO: 791745 - DNA, 20 bp, Artificial
  CRISPR gRNA sequence
aaatttaggagtcatcaatg

SEQ ID NO: 791746 - DNA, 20 bp, Artificial
  CRISPR gRNA sequence
tttaggagtcatcaatgcag

SEQ ID NO: 791747 - DNA, 20 bp, Artificial
  CRISPR gRNA sequence
tcatcaatgcagaagtgtta

SEQ ID NO: 791748 - DNA, 20 bp, Artificial
  CRISPR gRNA sequence
gcagaagtgttaaagattta

SEQ ID NO: 791749 - DNA, 20 bp, Artificial
  CRISPR gRNA sequence
gtgttaaagatttaaagtca

SEQ ID NO: 791750 - DNA, 20 bp, Artificial
  CRISPR gRNA sequence
tatctgcattacatcaccta

SEQ ID NO: 791751 - DNA, 20 bp, Artificial
  CRISPR gRNA sequence
tctgcattacatcacctaca

SEQ ID NO: 791752 - DNA, 20 bp, Artificial
  CRISPR gRNA sequence
tgcattacatcacctacaga

SEQ ID NO: 791753 - DNA, 20 bp, Artificial
  CRISPR gRNA sequence
ttacatcacctacagagaga

SEQ ID NO: 791754 - DNA, 20 bp, Artificial
  CRISPR gRNA sequence
tacatcacctacagagagat

SEQ ID NO: 791755 - DNA, 20 bp, Artificial
  CRISPR gRNA sequence
tcacctacagagagatagga

SEQ ID NO: 791756 - DNA, 20 bp, Artificial
  CRISPR gRNA sequence
acctacagagagataggaaa

SEQ ID NO: 791757 - DNA, 20 bp, Artificial
  CRISPR gRNA sequence
ctacagagagataggaaaga

SEQ ID NO: 791758 - DNA, 20 bp, Artificial
  CRISPR gRNA sequence
agataggaaagagagtgccc

SEQ ID NO: 791759 - DNA, 20 bp, Artificial
  CRISPR gRNA sequence
gataggaaagagagtgccca

SEQ ID NO: 791760 - DNA, 20 bp, Artificial
  CRISPR gRNA sequence
aaagagagtgcccaaggact

SEQ ID NO: 791761 - DNA, 20 bp, Artificial
  CRISPR gRNA sequence
agtgcccaaggactgagaca

SEQ ID NO: 791762 - DNA, 20 bp, Artificial
  CRISPR gRNA sequence
gtgcccaaggactgagacat

SEQ ID NO: 791763 - DNA, 20 bp, Artificial
  CRISPR gRNA sequence
tgcccaaggactgagacatg

SEQ ID NO: 791764 - DNA, 20 bp, Artificial
  CRISPR gRNA sequence
atggggtattccaacattta

SEQ ID NO: 791765 - DNA, 20 bp, Artificial
  CRISPR gRNA sequence
aacatttatagatctttgtg

SEQ ID NO: 791766 - DNA, 20 bp, Artificial
  CRISPR gRNA sequence
catttatagatctttgtgaa

SEQ ID NO: 791767 - DNA, 20 bp, Artificial
  CRISPR gRNA sequence
ttatagatctttgtgaagag

SEQ ID NO: 791768 - DNA, 20 bp, Artificial
  CRISPR gRNA sequence
tctttgtgaagagcggtcac

SEQ ID NO: 791769 - DNA, 20 bp, Artificial
  CRISPR gRNA sequence
ttgtgaagagcggtcaccag

SEQ ID NO: 791770 - DNA, 20 bp, Artificial
  CRISPR gRNA sequence
gtgaagagcggtcaccagca

SEQ ID NO: 791771 - DNA, 20 bp, Artificial
  CRISPR gRNA sequence
aagagcggtcaccagcagag

SEQ ID NO: 791772 - DNA, 20 bp, Artificial
  CRISPR gRNA sequence
tcaccagcagagaagattga

SEQ ID NO: 791773 - DNA, 20 bp, Artificial
  CRISPR gRNA sequence
caccagcagagaagattgaa

SEQ ID NO: 791774 - DNA, 20 bp, Artificial
  CRISPR gRNA sequence
cagcagagaagattgaaagg

SEQ ID NO: 791775 - DNA, 20 bp, Artificial
  CRISPR gRNA sequence
agcagagaagattgaaagga

SEQ ID NO: 791776 - DNA, 20 bp, Artificial
  CRISPR gRNA sequence
gcagagaagattgaaaggaa

SEQ ID NO: 791777 - DNA, 20 bp, Artificial
  CRISPR gRNA sequence
agattgaaaggaagggtaca

SEQ ID NO: 791778 - DNA, 20 bp, Artificial
  CRISPR gRNA sequence
gattgaaaggaagggtacaa

SEQ ID NO: 791779 - DNA, 20 bp, Artificial
  CRISPR gRNA sequence
aggaagggtacaaaggcaaa

SEQ ID NO: 791780 - DNA, 20 bp, Artificial
  CRISPR gRNA sequence
aagggtacaaaggcaaatgg

SEQ ID NO: 791781 - DNA, 20 bp, Artificial
  CRISPR gRNA sequence
tattctgatgctttgacacc

SEQ ID NO: 791782 - DNA, 20 bp, Artificial
  CRISPR gRNA sequence
attctgatgctttgacacct

SEQ ID NO: 791783 - DNA, 20 bp, Artificial
  CRISPR gRNA sequence
ttctgatgctttgacacctg

SEQ ID NO: 791784 - DNA, 20 bp, Artificial
  CRISPR gRNA sequence
ctggggccttgctgaccctg

SEQ ID NO: 791785 - DNA, 20 bp, Artificial
  CRISPR gRNA sequence
tggggccttgctgaccctga

SEQ ID NO: 791786 - DNA, 20 bp, Artificial
  CRISPR gRNA sequence
ggggccttgctgaccctgaa

SEQ ID NO: 791787 - DNA, 20 bp, Artificial
  CRISPR gRNA sequence
cctgaagggactgccgctcc

SEQ ID NO: 791788 - DNA, 20 bp, Artificial
  CRISPR gRNA sequence
ctgaagggactgccgctccc

SEQ ID NO: 791789 - DNA, 20 bp, Artificial
  CRISPR gRNA sequence
tgaagggactgccgctccca

SEQ ID NO: 791790 - DNA, 20 bp, Artificial
  CRISPR gRNA sequence
gggactgccgctcccagggt

SEQ ID NO: 791791 - DNA, 20 bp, Artificial
  CRISPR gRNA sequence
gttagccaattctaacctct

SEQ ID NO: 791792 - DNA, 20 bp, Artificial
  CRISPR gRNA sequence
tagccaattctaacctctaa

SEQ ID NO: 791793 - DNA, 20 bp, Artificial
  CRISPR gRNA sequence
gccaattctaacctctaaga

SEQ ID NO: 791794 - DNA, 20 bp, Artificial
  CRISPR gRNA sequence
caattctaacctctaagaga

SEQ ID NO: 791795 - DNA, 20 bp, Artificial
  CRISPR gRNA sequence
agagtaaaccacttgcccat

SEQ ID NO: 791796 - DNA, 20 bp, Artificial
  CRISPR gRNA sequence
aaatgcaaaccaacccattt

SEQ ID NO: 791797 - DNA, 20 bp, Artificial
  CRISPR gRNA sequence
atgcaaaccaacccatttca

SEQ ID NO: 791798 - DNA, 20 bp, Artificial
  CRISPR gRNA sequence
cccacaactgcctcatttat

SEQ ID NO: 791799 - DNA, 20 bp, Artificial
  CRISPR gRNA sequence
ccacaactgcctcatttatt

SEQ ID NO: 791800 - DNA, 20 bp, Artificial
  CRISPR gRNA sequence
cacaactgcctcatttattg

SEQ ID NO: 791801 - DNA, 20 bp, Artificial
  CRISPR gRNA sequence
acaactgcctcatttattgg

SEQ ID NO: 791802 - DNA, 20 bp, Artificial
  CRISPR gRNA sequence
tgcaactgccttaatcaccc

SEQ ID NO: 791803 - DNA, 20 bp, Artificial
  CRISPR gRNA sequence
gcaactgccttaatcacccc

SEQ ID NO: 791804 - DNA, 20 bp, Artificial
  CRISPR gRNA sequence
caactgccttaatcacccca

SEQ ID NO: 791805 - DNA, 20 bp, Artificial
  CRISPR gRNA sequence
gccttaatcaccccagggcc

SEQ ID NO: 791806 - DNA, 20 bp, Artificial
  CRISPR gRNA sequence
atcaccccagggccaagtac

SEQ ID NO: 791807 - DNA, 20 bp, Artificial
  CRISPR gRNA sequence
accccagggccaagtaccag

SEQ ID NO: 791808 - DNA, 20 bp, Artificial
  CRISPR gRNA sequence
agggccaagtaccagaagac

SEQ ID NO: 791809 - DNA, 20 bp, Artificial
  CRISPR gRNA sequence
gggccaagtaccagaagact

SEQ ID NO: 791810 - DNA, 20 bp, Artificial
  CRISPR gRNA sequence
ggccaagtaccagaagacta

SEQ ID NO: 791811 - DNA, 20 bp, Artificial
  CRISPR gRNA sequence
aagtaccagaagactaggga

SEQ ID NO: 791812 - DNA, 20 bp, Artificial
  CRISPR gRNA sequence
tagggacagcccctatgccc

SEQ ID NO: 791813 - DNA, 20 bp, Artificial
  CRISPR gRNA sequence
gggacagcccctatgcccca

SEQ ID NO: 791814 - DNA, 20 bp, Artificial
  CRISPR gRNA sequence
cctgctgaaattatttatat

SEQ ID NO: 791815 - DNA, 20 bp, Artificial
  CRISPR gRNA sequence
ttcctgttgaaaccacaata

SEQ ID NO: 791816 - DNA, 20 bp, Artificial
  CRISPR gRNA sequence
cgcaccccccacccacctcc

SEQ ID NO: 791817 - DNA, 20 bp, Artificial
  CRISPR gRNA sequence
acccacctcctggctgaccc

SEQ ID NO: 791818 - DNA, 20 bp, Artificial
  CRISPR gRNA sequence
gaccctggtgcttccccatg

SEQ ID NO: 791819 - DNA, 20 bp, Artificial
  CRISPR gRNA sequence
cttccccatgtggccctttg

SEQ ID NO: 791820 - DNA, 20 bp, Artificial
  CRISPR gRNA sequence
ccatgtggccctttgtggca

SEQ ID NO: 791821 - DNA, 20 bp, Artificial
  CRISPR gRNA sequence
atggtgtgccccccttctct

SEQ ID NO: 791822 - DNA, 20 bp, Artificial
  CRISPR gRNA sequence
tggtgtgccccccttctctt

SEQ ID NO: 791823 - DNA, 20 bp, Artificial
  CRISPR gRNA sequence
ccccttctcttgggatctgt

SEQ ID NO: 791824 - DNA, 20 bp, Artificial
  CRISPR gRNA sequence
caacatacttttttcaacga

SEQ ID NO: 791825 - DNA, 20 bp, Artificial
  CRISPR gRNA sequence
acagtcatttcctgatatat

SEQ ID NO: 791826 - DNA, 20 bp, Artificial
  CRISPR gRNA sequence
aaaacctatattttaaaaca

SEQ ID NO: 791827 - DNA, 20 bp, Artificial
  CRISPR gRNA sequence
ttttaaaacacagtgctaca

SEQ ID NO: 791828 - DNA, 20 bp, Artificial
  CRISPR gRNA sequence
tttaaaacacagtgctacaa

SEQ ID NO: 791829 - DNA, 20 bp, Artificial
  CRISPR gRNA sequence
taaaacacagtgctacaaag

SEQ ID NO: 791830 - DNA, 20 bp, Artificial
  CRISPR gRNA sequence
cagtgctacaaaggagtgat

SEQ ID NO: 791831 - DNA, 20 bp, Artificial
  CRISPR gRNA sequence
tgctacaaaggagtgatcag

SEQ ID NO: 791832 - DNA, 20 bp, Artificial
  CRISPR gRNA sequence
ctacaaaggagtgatcagta

SEQ ID NO: 791833 - DNA, 20 bp, Artificial
  CRISPR gRNA sequence
cagtagagccaaatactctt

SEQ ID NO: 791834 - DNA, 20 bp, Artificial
  CRISPR gRNA sequence
gtagagccaaatactcttga

SEQ ID NO: 791835 - DNA, 20 bp, Artificial
  CRISPR gRNA sequence
atactcttgagagttgcatt

SEQ ID NO: 791836 - DNA, 20 bp, Artificial
  CRISPR gRNA sequence
ctcttgagagttgcatttag

SEQ ID NO: 791837 - DNA, 20 bp, Artificial
  CRISPR gRNA sequence
gagagttgcatttagcagta

SEQ ID NO: 791838 - DNA, 20 bp, Artificial
  CRISPR gRNA sequence
gagttgcatttagcagtatg

SEQ ID NO: 791839 - DNA, 20 bp, Artificial
  CRISPR gRNA sequence
agttgcatttagcagtatgg

SEQ ID NO: 791840 - DNA, 20 bp, Artificial
  CRISPR gRNA sequence
atttagcagtatggaggtca

SEQ ID NO: 791841 - DNA, 20 bp, Artificial
  CRISPR gRNA sequence
aggtcatggatgatcctgac

SEQ ID NO: 791842 - DNA, 20 bp, Artificial
  CRISPR gRNA sequence
atggatgatcctgacaagca

SEQ ID NO: 791843 - DNA, 20 bp, Artificial
  CRISPR gRNA sequence
gatcctgacaagcacagtat

SEQ ID NO: 791844 - DNA, 20 bp, Artificial
  CRISPR gRNA sequence
ctgacaagcacagtatcagt

SEQ ID NO: 791845 - DNA, 20 bp, Artificial
  CRISPR gRNA sequence
cagtatcagtgagttttgta

SEQ ID NO: 791846 - DNA, 20 bp, Artificial
  CRISPR gRNA sequence
agtgagttttgtacagatga

SEQ ID NO: 791847 - DNA, 20 bp, Artificial
  CRISPR gRNA sequence
tgtacagatgaaagcttgaa

SEQ ID NO: 791848 - DNA, 20 bp, Artificial
  CRISPR gRNA sequence
gtacagatgaaagcttgaat

SEQ ID NO: 791849 - DNA, 20 bp, Artificial
  CRISPR gRNA sequence
gaaagcttgaataggttcaa

SEQ ID NO: 791850 - DNA, 20 bp, Artificial
  CRISPR gRNA sequence
aagcttgaataggttcaaaa

SEQ ID NO: 791851 - DNA, 20 bp, Artificial
  CRISPR gRNA sequence
tgaataggttcaaaagagaa

SEQ ID NO: 791852 - DNA, 20 bp, Artificial
  CRISPR gRNA sequence
gaataggttcaaaagagaat

SEQ ID NO: 791853 - DNA, 20 bp, Artificial
  CRISPR gRNA sequence
ggttcaaaagagaatgggta

SEQ ID NO: 791854 - DNA, 20 bp, Artificial
  CRISPR gRNA sequence
aaagagaatgggtaaagatg

SEQ ID NO: 791855 - DNA, 20 bp, Artificial
  CRISPR gRNA sequence
taaagatgtggcaacaaata

SEQ ID NO: 791856 - DNA, 20 bp, Artificial
  CRISPR gRNA sequence
aaagatgtggcaacaaatat

SEQ ID NO: 791857 - DNA, 20 bp, Artificial
  CRISPR gRNA sequence
caaatataggcaactctctc

SEQ ID NO: 791858 - DNA, 20 bp, Artificial
  CRISPR gRNA sequence
atataggcaactctctcaag

SEQ ID NO: 791859 - DNA, 20 bp, Artificial
  CRISPR gRNA sequence
ataggcaactctctcaagaa

SEQ ID NO: 791860 - DNA, 20 bp, Artificial
  CRISPR gRNA sequence
ctcaagaagagtgctataaa

SEQ ID NO: 791861 - DNA, 20 bp, Artificial
  CRISPR gRNA sequence
tcaagaagagtgctataaaa

SEQ ID NO: 791862 - DNA, 20 bp, Artificial
  CRISPR gRNA sequence
aagaagagtgctataaaaag

SEQ ID NO: 791863 - DNA, 20 bp, Artificial
  CRISPR gRNA sequence
aagagtgctataaaaaggag

SEQ ID NO: 791864 - DNA, 20 bp, Artificial
  CRISPR gRNA sequence
gagtgctataaaaaggagaa

SEQ ID NO: 791865 - DNA, 20 bp, Artificial
  CRISPR gRNA sequence
ataaaaaggagaagagaaat

SEQ ID NO: 791866 - DNA, 20 bp, Artificial
  CRISPR gRNA sequence
aaaggagaagagaaatgagt

SEQ ID NO: 791867 - DNA, 20 bp, Artificial
  CRISPR gRNA sequence
ggagaagagaaatgagtcag

SEQ ID NO: 791868 - DNA, 20 bp, Artificial
  CRISPR gRNA sequence
aagagaaatgagtcagtagc

SEQ ID NO: 791869 - DNA, 20 bp, Artificial
  CRISPR gRNA sequence
gagaaatgagtcagtagcta

SEQ ID NO: 791870 - DNA, 20 bp, Artificial
  CRISPR gRNA sequence
agaaatgagtcagtagctag

SEQ ID NO: 791871 - DNA, 20 bp, Artificial
  CRISPR gRNA sequence
gaaatgagtcagtagctaga

SEQ ID NO: 791872 - DNA, 20 bp, Artificial
  CRISPR gRNA sequence
cagtagctagagggaaatgt

SEQ ID NO: 791873 - DNA, 20 bp, Artificial
  CRISPR gRNA sequence
agtagctagagggaaatgta

SEQ ID NO: 791874 - DNA, 20 bp, Artificial
  CRISPR gRNA sequence
agagggaaatgtaaggtcct

SEQ ID NO: 791875 - DNA, 20 bp, Artificial
  CRISPR gRNA sequence
ggaaatgtaaggtcctcagt

SEQ ID NO: 791876 - DNA, 20 bp, Artificial
  CRISPR gRNA sequence
ctgtattcttgtttttattt

SEQ ID NO: 791877 - DNA, 20 bp, Artificial
  CRISPR gRNA sequence
attcttgtttttattttaga

SEQ ID NO: 791878 - DNA, 20 bp, Artificial
  CRISPR gRNA sequence
ttcttgtttttattttagaa

SEQ ID NO: 791879 - DNA, 20 bp, Artificial
  CRISPR gRNA sequence
tcttgtttttattttagaaa

SEQ ID NO: 791880 - DNA, 20 bp, Artificial
  CRISPR gRNA sequence
ttgtttttattttagaaagg

SEQ ID NO: 791881 - DNA, 20 bp, Artificial
  CRISPR gRNA sequence
ttttagaaagggagatctta

SEQ ID NO: 791882 - DNA, 20 bp, Artificial
  CRISPR gRNA sequence
tagaaagggagatcttacag

SEQ ID NO: 791883 - DNA, 20 bp, Artificial
  CRISPR gRNA sequence
agaaagggagatcttacagc

SEQ ID NO: 791884 - DNA, 20 bp, Artificial
  CRISPR gRNA sequence
atcttacagcaggtaacaac

SEQ ID NO: 791885 - DNA, 20 bp, Artificial
  CRISPR gRNA sequence
tcttacagcaggtaacaact

SEQ ID NO: 791886 - DNA, 20 bp, Artificial
  CRISPR gRNA sequence
cagcaggtaacaactgggaa

SEQ ID NO: 791887 - DNA, 20 bp, Artificial
  CRISPR gRNA sequence
taacaactgggaacagaatt

SEQ ID NO: 791888 - DNA, 20 bp, Artificial
  CRISPR gRNA sequence
acagaattaagtgctttcca

SEQ ID NO: 791889 - DNA, 20 bp, Artificial
  CRISPR gRNA sequence
cagaattaagtgctttccac

SEQ ID NO: 791890 - DNA, 20 bp, Artificial
  CRISPR gRNA sequence
agaattaagtgctttccaca

SEQ ID NO: 791891 - DNA, 20 bp, Artificial
  CRISPR gRNA sequence
tttccacagggaaatgctca

SEQ ID NO: 791892 - DNA, 20 bp, Artificial
  CRISPR gRNA sequence
gaaatgctcatggcatacct

SEQ ID NO: 791893 - DNA, 20 bp, Artificial
  CRISPR gRNA sequence
atggcataccttagcttgac

SEQ ID NO: 791894 - DNA, 20 bp, Artificial
  CRISPR gRNA sequence
gcataccttagcttgaccag

SEQ ID NO: 791895 - DNA, 20 bp, Artificial
  CRISPR gRNA sequence
accttagcttgaccagaaga

SEQ ID NO: 791896 - DNA, 20 bp, Artificial
  CRISPR gRNA sequence
agaagatagccttccttatt

SEQ ID NO: 791897 - DNA, 20 bp, Artificial
  CRISPR gRNA sequence
attcagatgcatatatatcc

SEQ ID NO: 791898 - DNA, 20 bp, Artificial
  CRISPR gRNA sequence
agatgcatatatatccaaga

SEQ ID NO: 791899 - DNA, 20 bp, Artificial
  CRISPR gRNA sequence
gatgcatatatatccaagaa

SEQ ID NO: 791900 - DNA, 20 bp, Artificial
  CRISPR gRNA sequence
tccaagaaaggtatcatctt

SEQ ID NO: 791901 - DNA, 20 bp, Artificial
  CRISPR gRNA sequence
atcatcttaagctgcaccaa

SEQ ID NO: 791902 - DNA, 20 bp, Artificial
  CRISPR gRNA sequence
tcatcttaagctgcaccaac

SEQ ID NO: 791903 - DNA, 20 bp, Artificial
  CRISPR gRNA sequence
ttaagctgcaccaacaggcc

SEQ ID NO: 791904 - DNA, 20 bp, Artificial
  CRISPR gRNA sequence
ccaacaggcctggcacttgc

SEQ ID NO: 791905 - DNA, 20 bp, Artificial
  CRISPR gRNA sequence
cttgccagcactcttatttt

SEQ ID NO: 791906 - DNA, 20 bp, Artificial
  CRISPR gRNA sequence
tgccagcactcttattttta

SEQ ID NO: 791907 - DNA, 20 bp, Artificial
  CRISPR gRNA sequence
ctcttatttttagagcatga

SEQ ID NO: 791908 - DNA, 20 bp, Artificial
  CRISPR gRNA sequence
tcttatttttagagcatgaa

SEQ ID NO: 791909 - DNA, 20 bp, Artificial
  CRISPR gRNA sequence
atttttagagcatgaaagga

SEQ ID NO: 791910 - DNA, 20 bp, Artificial
  CRISPR gRNA sequence
tgaaaggacagcatgtaaca

SEQ ID NO: 791911 - DNA, 20 bp, Artificial
  CRISPR gRNA sequence
gacagcatgtaacatagctc

SEQ ID NO: 791912 - DNA, 20 bp, Artificial
  CRISPR gRNA sequence
atgtaacatagctctagcaa

SEQ ID NO: 791913 - DNA, 20 bp, Artificial
  CRISPR gRNA sequence
acatagctctagcaacagaa

SEQ ID NO: 791914 - DNA, 20 bp, Artificial
  CRISPR gRNA sequence
ctagcaacagaaaagattct

SEQ ID NO: 791915 - DNA, 20 bp, Artificial
  CRISPR gRNA sequence
attcttggatcacctgccac

SEQ ID NO: 791916 - DNA, 20 bp, Artificial
  CRISPR gRNA sequence
ccttcttccttgcccttcca

SEQ ID NO: 791917 - DNA, 20 bp, Artificial
  CRISPR gRNA sequence
cttcttccttgcccttccac

SEQ ID NO: 791918 - DNA, 20 bp, Artificial
  CRISPR gRNA sequence
ttcttccttgcccttccacg

SEQ ID NO: 791919 - DNA, 20 bp, Artificial
  CRISPR gRNA sequence
cccttccacggggactttcc

SEQ ID NO: 791920 - DNA, 20 bp, Artificial
  CRISPR gRNA sequence
tcctggcacactgtcccctt

SEQ ID NO: 791921 - DNA, 20 bp, Artificial
  CRISPR gRNA sequence
actgtccccttgagcaaacc

SEQ ID NO: 791922 - DNA, 20 bp, Artificial
  CRISPR gRNA sequence
ctgtccccttgagcaaaccg

SEQ ID NO: 791923 - DNA, 20 bp, Artificial
  CRISPR gRNA sequence
cccttgagcaaaccgaggaa

SEQ ID NO: 791924 - DNA, 20 bp, Artificial
  CRISPR gRNA sequence
gaggaacagacactgctata

SEQ ID NO: 791925 - DNA, 20 bp, Artificial
  CRISPR gRNA sequence
ctataaagatactttccaac

SEQ ID NO: 791926 - DNA, 20 bp, Artificial
  CRISPR gRNA sequence
taaagatactttccaaccag

SEQ ID NO: 791927 - DNA, 20 bp, Artificial
  CRISPR gRNA sequence
ctttcctactaatcctcctc

SEQ ID NO: 791928 - DNA, 20 bp, Artificial
  CRISPR gRNA sequence
tttcctactaatcctcctct

SEQ ID NO: 791929 - DNA, 20 bp, Artificial
  CRISPR gRNA sequence
ttcctactaatcctcctctg

SEQ ID NO: 791930 - DNA, 20 bp, Artificial
  CRISPR gRNA sequence
atcctcctctggggaaaata

SEQ ID NO: 791931 - DNA, 20 bp, Artificial
  CRISPR gRNA sequence
gaaaatatggtttatgcaat

SEQ ID NO: 791932 - DNA, 20 bp, Artificial
  CRISPR gRNA sequence
atatggtttatgcaatgagt

SEQ ID NO: 791933 - DNA, 20 bp, Artificial
  CRISPR gRNA sequence
atggtttatgcaatgagtaa

SEQ ID NO: 791934 - DNA, 20 bp, Artificial
  CRISPR gRNA sequence
ttatgcaatgagtaagagct

SEQ ID NO: 791935 - DNA, 20 bp, Artificial
  CRISPR gRNA sequence
tatgcaatgagtaagagctc

SEQ ID NO: 791936 - DNA, 20 bp, Artificial
  CRISPR gRNA sequence
aagagctcaggctctaaaat

SEQ ID NO: 791937 - DNA, 20 bp, Artificial
  CRISPR gRNA sequence
gctctaaaatcagacacatc

SEQ ID NO: 791938 - DNA, 20 bp, Artificial
  CRISPR gRNA sequence
ctctaaaatcagacacatct

SEQ ID NO: 791939 - DNA, 20 bp, Artificial
  CRISPR gRNA sequence
gacacatctgggtttaatcc

SEQ ID NO: 791940 - DNA, 20 bp, Artificial
  CRISPR gRNA sequence
atcctggttttacaaattgt

SEQ ID NO: 791941 - DNA, 20 bp, Artificial
  CRISPR gRNA sequence
attgtaagcctctaacacct

SEQ ID NO: 791942 - DNA, 20 bp, Artificial
  CRISPR gRNA sequence
caccttggacaaattttgaa

SEQ ID NO: 791943 - DNA, 20 bp, Artificial
  CRISPR gRNA sequence
ttgttttcctattatgctaa

SEQ ID NO: 791944 - DNA, 20 bp, Artificial
  CRISPR gRNA sequence
ttttcctattatgctaatag

SEQ ID NO: 791945 - DNA, 20 bp, Artificial
  CRISPR gRNA sequence
atagtagcaacacccacctt

SEQ ID NO: 791946 - DNA, 20 bp, Artificial
  CRISPR gRNA sequence
tagcaacacccaccttaagc

SEQ ID NO: 791947 - DNA, 20 bp, Artificial
  CRISPR gRNA sequence
cccaccttaagctagaatct

SEQ ID NO: 791948 - DNA, 20 bp, Artificial
  CRISPR gRNA sequence
catttctcatcttgcaaata

SEQ ID NO: 791949 - DNA, 20 bp, Artificial
  CRISPR gRNA sequence
tgcaaatatggcccatcccc

SEQ ID NO: 791950 - DNA, 20 bp, Artificial
  CRISPR gRNA sequence
gtcctgttaattctccctcc

SEQ ID NO: 791951 - DNA, 20 bp, Artificial
  CRISPR gRNA sequence
cctcctggatactttttgca

SEQ ID NO: 791952 - DNA, 20 bp, Artificial
  CRISPR gRNA sequence
cctggatactttttgcatgg

SEQ ID NO: 791953 - DNA, 20 bp, Artificial
  CRISPR gRNA sequence
ccactgccatcaccttaatt

SEQ ID NO: 791954 - DNA, 20 bp, Artificial
  CRISPR gRNA sequence
tatcatttcttcttatacca

SEQ ID NO: 791955 - DNA, 20 bp, Artificial
  CRISPR gRNA sequence
catttcttcttataccatag

SEQ ID NO: 791956 - DNA, 20 bp, Artificial
  CRISPR gRNA sequence
tttcttcttataccatagca

SEQ ID NO: 791957 - DNA, 20 bp, Artificial
  CRISPR gRNA sequence
tcactgctatttttaccttc

SEQ ID NO: 791958 - DNA, 20 bp, Artificial
  CRISPR gRNA sequence
tgctccatcctccacttatt

SEQ ID NO: 791959 - DNA, 20 bp, Artificial
  CRISPR gRNA sequence
gctccatcctccacttattg

SEQ ID NO: 791960 - DNA, 20 bp, Artificial
  CRISPR gRNA sequence
atcctccacttattgaggtg

SEQ ID NO: 791961 - DNA, 20 bp, Artificial
  CRISPR gRNA sequence
tcctccacttattgaggtga

SEQ ID NO: 791962 - DNA, 20 bp, Artificial
  CRISPR gRNA sequence
cacttattgaggtgaaggac

SEQ ID NO: 791963 - DNA, 20 bp, Artificial
  CRISPR gRNA sequence
gaggtgaaggacaagaacct

SEQ ID NO: 791964 - DNA, 20 bp, Artificial
  CRISPR gRNA sequence
ggtgaaggacaagaaccttg

SEQ ID NO: 791965 - DNA, 20 bp, Artificial
  CRISPR gRNA sequence
aagaaccttggagtcatctt

SEQ ID NO: 791966 - DNA, 20 bp, Artificial
  CRISPR gRNA sequence
gattcattaaccaaccctat

SEQ ID NO: 791967 - DNA, 20 bp, Artificial
  CRISPR gRNA sequence
gcccttccttcaaatatatc

SEQ ID NO: 791968 - DNA, 20 bp, Artificial
  CRISPR gRNA sequence
cacctccactgcttccatat

SEQ ID NO: 791969 - DNA, 20 bp, Artificial
  CRISPR gRNA sequence
tccactgcttccatatcggt

SEQ ID NO: 791970 - DNA, 20 bp, Artificial
  CRISPR gRNA sequence
cactgcttccatatcggtca

SEQ ID NO: 791971 - DNA, 20 bp, Artificial
  CRISPR gRNA sequence
agagtcattgtcatttctca

SEQ ID NO: 791972 - DNA, 20 bp, Artificial
  CRISPR gRNA sequence
tctcatggtgatttctgcat

SEQ ID NO: 791973 - DNA, 20 bp, Artificial
  CRISPR gRNA sequence
ttctgcattagtctgacaac

SEQ ID NO: 791974 - DNA, 20 bp, Artificial
  CRISPR gRNA sequence
acaactggatgctatgattc

SEQ ID NO: 791975 - DNA, 20 bp, Artificial
  CRISPR gRNA sequence
attccagttttgccttcctg

SEQ ID NO: 791976 - DNA, 20 bp, Artificial
  CRISPR gRNA sequence
ccttcctgcagttgattctg

SEQ ID NO: 791977 - DNA, 20 bp, Artificial
  CRISPR gRNA sequence
cctgcagttgattctgcagc

SEQ ID NO: 791978 - DNA, 20 bp, Artificial
  CRISPR gRNA sequence
tgcagttgattctgcagcca

SEQ ID NO: 791979 - DNA, 20 bp, Artificial
  CRISPR gRNA sequence
agttgattctgcagccagag

SEQ ID NO: 791980 - DNA, 20 bp, Artificial
  CRISPR gRNA sequence
gagtggtttttaaaaaataa

SEQ ID NO: 791981 - DNA, 20 bp, Artificial
  CRISPR gRNA sequence
attttcttaaaaccttccga

SEQ ID NO: 791982 - DNA, 20 bp, Artificial
  CRISPR gRNA sequence
cttaaaaccttccgatggct

SEQ ID NO: 791983 - DNA, 20 bp, Artificial
  CRISPR gRNA sequence
cgatggctcagcatttcact

SEQ ID NO: 791984 - DNA, 20 bp, Artificial
  CRISPR gRNA sequence
atttcactcagtgtaaaacc

SEQ ID NO: 791985 - DNA, 20 bp, Artificial
  CRISPR gRNA sequence
gtaaaacccagttttttcaa

SEQ ID NO: 791986 - DNA, 20 bp, Artificial
  CRISPR gRNA sequence
acccagttttttcaacagcc

SEQ ID NO: 791987 - DNA, 20 bp, Artificial
  CRISPR gRNA sequence
gttttttcaacagccaagac

SEQ ID NO: 791988 - DNA, 20 bp, Artificial
  CRISPR gRNA sequence
tttttcaacagccaagacaa

SEQ ID NO: 791989 - DNA, 20 bp, Artificial
  CRISPR gRNA sequence
ttttcaacagccaagacaag

SEQ ID NO: 791990 - DNA, 20 bp, Artificial
  CRISPR gRNA sequence
aagacaagaggcccctgtcc

SEQ ID NO: 791991 - DNA, 20 bp, Artificial
  CRISPR gRNA sequence
gtcctggaccccatgcttta

SEQ ID NO: 791992 - DNA, 20 bp, Artificial
  CRISPR gRNA sequence
tcctggaccccatgctttaa

SEQ ID NO: 791993 - DNA, 20 bp, Artificial
  CRISPR gRNA sequence
ctgtgcccatccttctcccc

SEQ ID NO: 791994 - DNA, 20 bp, Artificial
  CRISPR gRNA sequence
gtgcccatccttctccccga

SEQ ID NO: 791995 - DNA, 20 bp, Artificial
  CRISPR gRNA sequence
ccatccttctccccgagagt

SEQ ID NO: 791996 - DNA, 20 bp, Artificial
  CRISPR gRNA sequence
catccttctccccgagagta

SEQ ID NO: 791997 - DNA, 20 bp, Artificial
  CRISPR gRNA sequence
ccccgagagtaaggtgttcg

SEQ ID NO: 791998 - DNA, 20 bp, Artificial
  CRISPR gRNA sequence
cccgagagtaaggtgttcgc

SEQ ID NO: 791999 - DNA, 20 bp, Artificial
  CRISPR gRNA sequence
ccgagagtaaggtgttcgca

SEQ ID NO: 792000 - DNA, 20 bp, Artificial
  CRISPR gRNA sequence
agtaaggtgttcgcagggct

SEQ ID NO: 792001 - DNA, 20 bp, Artificial
  CRISPR gRNA sequence
taaggtgttcgcagggctga

SEQ ID NO: 792002 - DNA, 20 bp, Artificial
  CRISPR gRNA sequence
cagggctgagagatgttatc

SEQ ID NO: 792003 - DNA, 20 bp, Artificial
  CRISPR gRNA sequence
gggctgagagatgttatctg

SEQ ID NO: 792004 - DNA, 20 bp, Artificial
  CRISPR gRNA sequence
ctaccaaccgccatccattg

SEQ ID NO: 792005 - DNA, 20 bp, Artificial
  CRISPR gRNA sequence
gcagtctgtctttgaaacac

SEQ ID NO: 792006 - DNA, 20 bp, Artificial
  CRISPR gRNA sequence
ctttgaaacactggaattcc

SEQ ID NO: 792007 - DNA, 20 bp, Artificial
  CRISPR gRNA sequence
actggaattcctagcctgaa

SEQ ID NO: 792008 - DNA, 20 bp, Artificial
  CRISPR gRNA sequence
ttcctagcctgaatggcctt

SEQ ID NO: 792009 - DNA, 20 bp, Artificial
  CRISPR gRNA sequence
aatggccttaagcctgcttc

SEQ ID NO: 792010 - DNA, 20 bp, Artificial
  CRISPR gRNA sequence
atggccttaagcctgcttcc

SEQ ID NO: 792011 - DNA, 20 bp, Artificial
  CRISPR gRNA sequence
agcctgcttccaggcctgtg

SEQ ID NO: 792012 - DNA, 20 bp, Artificial
  CRISPR gRNA sequence
ggcctgtgtggcctcttccg

SEQ ID NO: 792013 - DNA, 20 bp, Artificial
  CRISPR gRNA sequence
cttccgcagatccaatccct

SEQ ID NO: 792014 - DNA, 20 bp, Artificial
  CRISPR gRNA sequence
ttccgcagatccaatcccta

SEQ ID NO: 792015 - DNA, 20 bp, Artificial
  CRISPR gRNA sequence
tccgcagatccaatccctaa

SEQ ID NO: 792016 - DNA, 20 bp, Artificial
  CRISPR gRNA sequence
gcagatccaatccctaaggg

SEQ ID NO: 792017 - DNA, 20 bp, Artificial
  CRISPR gRNA sequence
ctaagggaagaccttgctgc

SEQ ID NO: 792018 - DNA, 20 bp, Artificial
  CRISPR gRNA sequence
agtgtacatgtccctctacc

SEQ ID NO: 792019 - DNA, 20 bp, Artificial
  CRISPR gRNA sequence
ctttcattgttttttctcct

SEQ ID NO: 792020 - DNA, 20 bp, Artificial
  CRISPR gRNA sequence
actgtcttatgtaaaattgc

SEQ ID NO: 792021 - DNA, 20 bp, Artificial
  CRISPR gRNA sequence
tgtcttatgtaaaattgcaa

SEQ ID NO: 792022 - DNA, 20 bp, Artificial
  CRISPR gRNA sequence
agagcactccaaccctaccc

SEQ ID NO: 792023 - DNA, 20 bp, Artificial
  CRISPR gRNA sequence
ccagcattcccaacaatcct

SEQ ID NO: 792024 - DNA, 20 bp, Artificial
  CRISPR gRNA sequence
tagtcatcttttctccccca

SEQ ID NO: 792025 - DNA, 20 bp, Artificial
  CRISPR gRNA sequence
tcatcttttctcccccaaag

SEQ ID NO: 792026 - DNA, 20 bp, Artificial
  CRISPR gRNA sequence
ttaccatttaacataccata

SEQ ID NO: 792027 - DNA, 20 bp, Artificial
  CRISPR gRNA sequence
taccatttaacataccatat

SEQ ID NO: 792028 - DNA, 20 bp, Artificial
  CRISPR gRNA sequence
ataggtctctttctgttgcc

SEQ ID NO: 792029 - DNA, 20 bp, Artificial
  CRISPR gRNA sequence
taggtctctttctgttgccc

SEQ ID NO: 792030 - DNA, 20 bp, Artificial
  CRISPR gRNA sequence
tctctttctgttgcccaggc

SEQ ID NO: 792031 - DNA, 20 bp, Artificial
  CRISPR gRNA sequence
tctttctgttgcccaggctg

SEQ ID NO: 792032 - DNA, 20 bp, Artificial
  CRISPR gRNA sequence
tctgttgcccaggctggagt

SEQ ID NO: 792033 - DNA, 20 bp, Artificial
  CRISPR gRNA sequence
gttgcccaggctggagtcag

SEQ ID NO: 792034 - DNA, 20 bp, Artificial
  CRISPR gRNA sequence
tggagtcagtggcacaatca

SEQ ID NO: 792035 - DNA, 20 bp, Artificial
  CRISPR gRNA sequence
agtggcacaatcatagctca

SEQ ID NO: 792036 - DNA, 20 bp, Artificial
  CRISPR gRNA sequence
acaatcatagctcacagtga

SEQ ID NO: 792037 - DNA, 20 bp, Artificial
  CRISPR gRNA sequence
atcatagctcacagtgatgg

SEQ ID NO: 792038 - DNA, 20 bp, Artificial
  CRISPR gRNA sequence
atagctcacagtgatggcag

SEQ ID NO: 792039 - DNA, 20 bp, Artificial
  CRISPR gRNA sequence
gatggcagcagctgcccgtt

SEQ ID NO: 792040 - DNA, 20 bp, Artificial
  CRISPR gRNA sequence
tggcagcagctgcccgttta

SEQ ID NO: 792041 - DNA, 20 bp, Artificial
  CRISPR gRNA sequence
cagcagctgcccgtttagag

SEQ ID NO: 792042 - DNA, 20 bp, Artificial
  CRISPR gRNA sequence
ctgcccgtttagagcagctg

SEQ ID NO: 792043 - DNA, 20 bp, Artificial
  CRISPR gRNA sequence
cccgtttagagcagctgcag

SEQ ID NO: 792044 - DNA, 20 bp, Artificial
  CRISPR gRNA sequence
gtttagagcagctgcagcag

SEQ ID NO: 792045 - DNA, 20 bp, Artificial
  CRISPR gRNA sequence
ttagagcagctgcagcagtg

SEQ ID NO: 792046 - DNA, 20 bp, Artificial
  CRISPR gRNA sequence
tagagcagctgcagcagtgg

SEQ ID NO: 792047 - DNA, 20 bp, Artificial
  CRISPR gRNA sequence
cagctgcagcagtggaggtg

SEQ ID NO: 792048 - DNA, 20 bp, Artificial
  CRISPR gRNA sequence
tgcagcagtggaggtgtggc

SEQ ID NO: 792049 - DNA, 20 bp, Artificial
  CRISPR gRNA sequence
gcagcagtggaggtgtggcc

SEQ ID NO: 792050 - DNA, 20 bp, Artificial
  CRISPR gRNA sequence
cagcagtggaggtgtggcca

SEQ ID NO: 792051 - DNA, 20 bp, Artificial
  CRISPR gRNA sequence
gcagtggaggtgtggccagg

SEQ ID NO: 792052 - DNA, 20 bp, Artificial
  CRISPR gRNA sequence
cagtggaggtgtggccaggg

SEQ ID NO: 792053 - DNA, 20 bp, Artificial
  CRISPR gRNA sequence
gaggtgtggccagggaggcc

SEQ ID NO: 792054 - DNA, 20 bp, Artificial
  CRISPR gRNA sequence
gtggccagggaggccaagaa

SEQ ID NO: 792055 - DNA, 20 bp, Artificial
  CRISPR gRNA sequence
tggccagggaggccaagaac

SEQ ID NO: 792056 - DNA, 20 bp, Artificial
  CRISPR gRNA sequence
ccagggaggccaagaacagg

SEQ ID NO: 792057 - DNA, 20 bp, Artificial
  CRISPR gRNA sequence
cagggaggccaagaacaggt

SEQ ID NO: 792058 - DNA, 20 bp, Artificial
  CRISPR gRNA sequence
gggaggccaagaacaggtgg

SEQ ID NO: 792059 - DNA, 20 bp, Artificial
  CRISPR gRNA sequence
tgggagtcccgccccgtact

SEQ ID NO: 792060 - DNA, 20 bp, Artificial
  CRISPR gRNA sequence
agtcccgccccgtactgagt

SEQ ID NO: 792061 - DNA, 20 bp, Artificial
  CRISPR gRNA sequence
cccgccccgtactgagttgg

SEQ ID NO: 792062 - DNA, 20 bp, Artificial
  CRISPR gRNA sequence
ccgccccgtactgagttggc

SEQ ID NO: 792063 - DNA, 20 bp, Artificial
  CRISPR gRNA sequence
cgccccgtactgagttggcg

SEQ ID NO: 792064 - DNA, 20 bp, Artificial
  CRISPR gRNA sequence
cccgtactgagttggcgggg

SEQ ID NO: 792065 - DNA, 20 bp, Artificial
  CRISPR gRNA sequence
ccgtactgagttggcggggt

SEQ ID NO: 792066 - DNA, 20 bp, Artificial
  CRISPR gRNA sequence
gggtgggaaccgcatgctcc

SEQ ID NO: 792067 - DNA, 20 bp, Artificial
  CRISPR gRNA sequence
ggtgggaaccgcatgctccc

SEQ ID NO: 792068 - DNA, 20 bp, Artificial
  CRISPR gRNA sequence
catgctcccaggcacccctg

SEQ ID NO: 792069 - DNA, 20 bp, Artificial
  CRISPR gRNA sequence
caggcacccctgtagctgcc

SEQ ID NO: 792070 - DNA, 20 bp, Artificial
  CRISPR gRNA sequence
gcacccctgtagctgcccag

SEQ ID NO: 792071 - DNA, 20 bp, Artificial
  CRISPR gRNA sequence
cccctgtagctgcccagcag

SEQ ID NO: 792072 - DNA, 20 bp, Artificial
  CRISPR gRNA sequence
tagctgcccagcagtggctc

SEQ ID NO: 792073 - DNA, 20 bp, Artificial
  CRISPR gRNA sequence
cccagcagtggctctggacc

SEQ ID NO: 792074 - DNA, 20 bp, Artificial
  CRISPR gRNA sequence
ccagcagtggctctggaccc

SEQ ID NO: 792075 - DNA, 20 bp, Artificial
  CRISPR gRNA sequence
cccaggcatctctgtactct

SEQ ID NO: 792076 - DNA, 20 bp, Artificial
  CRISPR gRNA sequence
ccaggcatctctgtactctc

SEQ ID NO: 792077 - DNA, 20 bp, Artificial
  CRISPR gRNA sequence
caggcatctctgtactctca

SEQ ID NO: 792078 - DNA, 20 bp, Artificial
  CRISPR gRNA sequence
aggcatctctgtactctcag

SEQ ID NO: 792079 - DNA, 20 bp, Artificial
  CRISPR gRNA sequence
tctctgtactctcaggggcc

SEQ ID NO: 792080 - DNA, 20 bp, Artificial
  CRISPR gRNA sequence
ctctgtactctcaggggccc

SEQ ID NO: 792081 - DNA, 20 bp, Artificial
  CRISPR gRNA sequence
tgtactctcaggggcccagg

SEQ ID NO: 792082 - DNA, 20 bp, Artificial
  CRISPR gRNA sequence
aggaagtcccctgctcccac

SEQ ID NO: 792083 - DNA, 20 bp, Artificial
  CRISPR gRNA sequence
ggaagtcccctgctcccaca

SEQ ID NO: 792084 - DNA, 20 bp, Artificial
  CRISPR gRNA sequence
ccctgctcccacaaggttga

SEQ ID NO: 792085 - DNA, 20 bp, Artificial
  CRISPR gRNA sequence
aagtgcctgctcccactccc

SEQ ID NO: 792086 - DNA, 20 bp, Artificial
  CRISPR gRNA sequence
ccctggcctcttcccactcc

SEQ ID NO: 792087 - DNA, 20 bp, Artificial
  CRISPR gRNA sequence
ccactcctggcacctgctac

SEQ ID NO: 792088 - DNA, 20 bp, Artificial
  CRISPR gRNA sequence
cactcctggcacctgctact

SEQ ID NO: 792089 - DNA, 20 bp, Artificial
  CRISPR gRNA sequence
ctggcacctgctactgggtg

SEQ ID NO: 792090 - DNA, 20 bp, Artificial
  CRISPR gRNA sequence
acctgctactgggtgaagca

SEQ ID NO: 792091 - DNA, 20 bp, Artificial
  CRISPR gRNA sequence
tactgggtgaagcaaagttg

SEQ ID NO: 792092 - DNA, 20 bp, Artificial
  CRISPR gRNA sequence
ggtgaagcaaagttgtggcc

SEQ ID NO: 792093 - DNA, 20 bp, Artificial
  CRISPR gRNA sequence
agcaaagttgtggccaagcc

SEQ ID NO: 792094 - DNA, 20 bp, Artificial
  CRISPR gRNA sequence
gcaaagttgtggccaagcct

SEQ ID NO: 792095 - DNA, 20 bp, Artificial
  CRISPR gRNA sequence
gcctaggtgctgtcacaacc

SEQ ID NO: 792096 - DNA, 20 bp, Artificial
  CRISPR gRNA sequence
aggtgctgtcacaacccggc

SEQ ID NO: 792097 - DNA, 20 bp, Artificial
  CRISPR gRNA sequence
ggtgctgtcacaacccggcc

SEQ ID NO: 792098 - DNA, 20 bp, Artificial
  CRISPR gRNA sequence
tcacaacccggccaggcatg

SEQ ID NO: 792099 - DNA, 20 bp, Artificial
  CRISPR gRNA sequence
cacaacccggccaggcatgt

SEQ ID NO: 792100 - DNA, 20 bp, Artificial
  CRISPR gRNA sequence
cggccaggcatgtgggtgct

SEQ ID NO: 792101 - DNA, 20 bp, Artificial
  CRISPR gRNA sequence
ggccaggcatgtgggtgctc

SEQ ID NO: 792102 - DNA, 20 bp, Artificial
  CRISPR gRNA sequence
aggcatgtgggtgctcagga

SEQ ID NO: 792103 - DNA, 20 bp, Artificial
  CRISPR gRNA sequence
tcaggatggtactgacacac

SEQ ID NO: 792104 - DNA, 20 bp, Artificial
  CRISPR gRNA sequence
cctgctgcctcgacctcttc

SEQ ID NO: 792105 - DNA, 20 bp, Artificial
  CRISPR gRNA sequence
cctcgacctcttccagatgt

SEQ ID NO: 792106 - DNA, 20 bp, Artificial
  CRISPR gRNA sequence
ctcgacctcttccagatgtt

SEQ ID NO: 792107 - DNA, 20 bp, Artificial
  CRISPR gRNA sequence
tccagatgttgggtgctgac

SEQ ID NO: 792108 - DNA, 20 bp, Artificial
  CRISPR gRNA sequence
atgttgggtgctgacaagca

SEQ ID NO: 792109 - DNA, 20 bp, Artificial
  CRISPR gRNA sequence
gttgggtgctgacaagcaca

SEQ ID NO: 792110 - DNA, 20 bp, Artificial
  CRISPR gRNA sequence
ttgggtgctgacaagcacag

SEQ ID NO: 792111 - DNA, 20 bp, Artificial
  CRISPR gRNA sequence
tgggtgctgacaagcacaga

SEQ ID NO: 792112 - DNA, 20 bp, Artificial
  CRISPR gRNA sequence
ggtgctgacaagcacagagg

SEQ ID NO: 792113 - DNA, 20 bp, Artificial
  CRISPR gRNA sequence
gtgctgacaagcacagaggg

SEQ ID NO: 792114 - DNA, 20 bp, Artificial
  CRISPR gRNA sequence
gacaagcacagagggaggct

SEQ ID NO: 792115 - DNA, 20 bp, Artificial
  CRISPR gRNA sequence
aagcacagagggaggctgag

SEQ ID NO: 792116 - DNA, 20 bp, Artificial
  CRISPR gRNA sequence
agcacagagggaggctgagc

SEQ ID NO: 792117 - DNA, 20 bp, Artificial
  CRISPR gRNA sequence
gcacagagggaggctgagca

SEQ ID NO: 792118 - DNA, 20 bp, Artificial
  CRISPR gRNA sequence
cacagagggaggctgagcag

SEQ ID NO: 792119 - DNA, 20 bp, Artificial
  CRISPR gRNA sequence
agggaggctgagcaggggct

SEQ ID NO: 792120 - DNA, 20 bp, Artificial
  CRISPR gRNA sequence
gggaggctgagcaggggctg

SEQ ID NO: 792121 - DNA, 20 bp, Artificial
  CRISPR gRNA sequence
ggaggctgagcaggggctga

SEQ ID NO: 792122 - DNA, 20 bp, Artificial
  CRISPR gRNA sequence
ggctgagcaggggctgaggg

SEQ ID NO: 792123 - DNA, 20 bp, Artificial
  CRISPR gRNA sequence
agcaggggctgagggtggct

SEQ ID NO: 792124 - DNA, 20 bp, Artificial
  CRISPR gRNA sequence
gcaggggctgagggtggctc

SEQ ID NO: 792125 - DNA, 20 bp, Artificial
  CRISPR gRNA sequence
caggggctgagggtggctca

SEQ ID NO: 792126 - DNA, 20 bp, Artificial
  CRISPR gRNA sequence
gggctgagggtggctcaggg

SEQ ID NO: 792127 - DNA, 20 bp, Artificial
  CRISPR gRNA sequence
ggctgagggtggctcagggc

SEQ ID NO: 792128 - DNA, 20 bp, Artificial
  CRISPR gRNA sequence
ggtggctcagggcaggcctg

SEQ ID NO: 792129 - DNA, 20 bp, Artificial
  CRISPR gRNA sequence
gtggctcagggcaggcctgc

SEQ ID NO: 792130 - DNA, 20 bp, Artificial
  CRISPR gRNA sequence
gcaggcctgcaggcacccct

SEQ ID NO: 792131 - DNA, 20 bp, Artificial
  CRISPR gRNA sequence
caggcacccctcggcacgaa

SEQ ID NO: 792132 - DNA, 20 bp, Artificial
  CRISPR gRNA sequence
acccctcggcacgaacagcc

SEQ ID NO: 792133 - DNA, 20 bp, Artificial
  CRISPR gRNA sequence
cccctcggcacgaacagcct

SEQ ID NO: 792134 - DNA, 20 bp, Artificial
  CRISPR gRNA sequence
cacgaacagcctgggcatca

SEQ ID NO: 792135 - DNA, 20 bp, Artificial
  CRISPR gRNA sequence
aacagcctgggcatcatgga

SEQ ID NO: 792136 - DNA, 20 bp, Artificial
  CRISPR gRNA sequence
catcatggacagcatgttga

SEQ ID NO: 792137 - DNA, 20 bp, Artificial
  CRISPR gRNA sequence
atggacagcatgttgatggc

SEQ ID NO: 792138 - DNA, 20 bp, Artificial
  CRISPR gRNA sequence
ggacagcatgttgatggcaa

SEQ ID NO: 792139 - DNA, 20 bp, Artificial
  CRISPR gRNA sequence
gacagcatgttgatggcaag

SEQ ID NO: 792140 - DNA, 20 bp, Artificial
  CRISPR gRNA sequence
acagcatgttgatggcaaga

SEQ ID NO: 792141 - DNA, 20 bp, Artificial
  CRISPR gRNA sequence
agcatgttgatggcaagagg

SEQ ID NO: 792142 - DNA, 20 bp, Artificial
  CRISPR gRNA sequence
tgttgatggcaagagggaga

SEQ ID NO: 792143 - DNA, 20 bp, Artificial
  CRISPR gRNA sequence
gttgatggcaagagggagac

SEQ ID NO: 792144 - DNA, 20 bp, Artificial
  CRISPR gRNA sequence
caagagggagacaggttcct

SEQ ID NO: 792145 - DNA, 20 bp, Artificial
  CRISPR gRNA sequence
gagggagacaggttccttgg

SEQ ID NO: 792146 - DNA, 20 bp, Artificial
  CRISPR gRNA sequence
gagacaggttccttggcgga

SEQ ID NO: 792147 - DNA, 20 bp, Artificial
  CRISPR gRNA sequence
agacaggttccttggcggaa

SEQ ID NO: 792148 - DNA, 20 bp, Artificial
  CRISPR gRNA sequence
gacaggttccttggcggaaa

SEQ ID NO: 792149 - DNA, 20 bp, Artificial
  CRISPR gRNA sequence
acaggttccttggcggaaag

SEQ ID NO: 792150 - DNA, 20 bp, Artificial
  CRISPR gRNA sequence
gttccttggcggaaaggggt

SEQ ID NO: 792151 - DNA, 20 bp, Artificial
  CRISPR gRNA sequence
ttccttggcggaaaggggtt

SEQ ID NO: 792152 - DNA, 20 bp, Artificial
  CRISPR gRNA sequence
gcggaaaggggttaggtccc

SEQ ID NO: 792153 - DNA, 20 bp, Artificial
  CRISPR gRNA sequence
cctggtgaaacccaaccttc

SEQ ID NO: 792154 - DNA, 20 bp, Artificial
  CRISPR gRNA sequence
gtgaaacccaaccttcaagc

SEQ ID NO: 792155 - DNA, 20 bp, Artificial
  CRISPR gRNA sequence
tgaaacccaaccttcaagcc

SEQ ID NO: 792156 - DNA, 20 bp, Artificial
  CRISPR gRNA sequence
gaaacccaaccttcaagcca

SEQ ID NO: 792157 - DNA, 20 bp, Artificial
  CRISPR gRNA sequence
cccaaccttcaagccaggga

SEQ ID NO: 792158 - DNA, 20 bp, Artificial
  CRISPR gRNA sequence
ttcaagccagggatggccca

SEQ ID NO: 792159 - DNA, 20 bp, Artificial
  CRISPR gRNA sequence
gccagggatggcccaaagcc

SEQ ID NO: 792160 - DNA, 20 bp, Artificial
  CRISPR gRNA sequence
ccagggatggcccaaagcct

SEQ ID NO: 792161 - DNA, 20 bp, Artificial
  CRISPR gRNA sequence
agggatggcccaaagcctgg

SEQ ID NO: 792162 - DNA, 20 bp, Artificial
  CRISPR gRNA sequence
atggcccaaagcctgggagc

SEQ ID NO: 792163 - DNA, 20 bp, Artificial
  CRISPR gRNA sequence
tggcccaaagcctgggagcc

SEQ ID NO: 792164 - DNA, 20 bp, Artificial
  CRISPR gRNA sequence
gggagccaggttgccaattg

SEQ ID NO: 792165 - DNA, 20 bp, Artificial
  CRISPR gRNA sequence
ggagccaggttgccaattgt

SEQ ID NO: 792166 - DNA, 20 bp, Artificial
  CRISPR gRNA sequence
gccaggttgccaattgtggg

SEQ ID NO: 792167 - DNA, 20 bp, Artificial
  CRISPR gRNA sequence
caggttgccaattgtgggtg

SEQ ID NO: 792168 - DNA, 20 bp, Artificial
  CRISPR gRNA sequence
ccaattgtgggtggagtcca

SEQ ID NO: 792169 - DNA, 20 bp, Artificial
  CRISPR gRNA sequence
tgtgggtggagtccacagcc

SEQ ID NO: 792170 - DNA, 20 bp, Artificial
  CRISPR gRNA sequence
gtgggtggagtccacagcct

SEQ ID NO: 792171 - DNA, 20 bp, Artificial
  CRISPR gRNA sequence
tgggtggagtccacagcctg

SEQ ID NO: 792172 - DNA, 20 bp, Artificial
  CRISPR gRNA sequence
tggagtccacagcctggggt

SEQ ID NO: 792173 - DNA, 20 bp, Artificial
  CRISPR gRNA sequence
cagcctggggtaagaactta

SEQ ID NO: 792174 - DNA, 20 bp, Artificial
  CRISPR gRNA sequence
agaacttacagtgctttttc

SEQ ID NO: 792175 - DNA, 20 bp, Artificial
  CRISPR gRNA sequence
gaacttacagtgctttttct

SEQ ID NO: 792176 - DNA, 20 bp, Artificial
  CRISPR gRNA sequence
gctttttctgggcccttcca

SEQ ID NO: 792177 - DNA, 20 bp, Artificial
  CRISPR gRNA sequence
ggcccttccatggctgccca

SEQ ID NO: 792178 - DNA, 20 bp, Artificial
  CRISPR gRNA sequence
gcccttccatggctgcccat

SEQ ID NO: 792179 - DNA, 20 bp, Artificial
  CRISPR gRNA sequence
atggctgcccatgggccaat

SEQ ID NO: 792180 - DNA, 20 bp, Artificial
  CRISPR gRNA sequence
gcacactcttcctcccttct

SEQ ID NO: 792181 - DNA, 20 bp, Artificial
  CRISPR gRNA sequence
ttctgagcctgtaaaaaccc

SEQ ID NO: 792182 - DNA, 20 bp, Artificial
  CRISPR gRNA sequence
gtaaaaaccctggactcgac

SEQ ID NO: 792183 - DNA, 20 bp, Artificial
  CRISPR gRNA sequence
taaaaaccctggactcgacc

SEQ ID NO: 792184 - DNA, 20 bp, Artificial
  CRISPR gRNA sequence
accctggactcgaccgggct

SEQ ID NO: 792185 - DNA, 20 bp, Artificial
  CRISPR gRNA sequence
ctggactcgaccgggctcag

SEQ ID NO: 792186 - DNA, 20 bp, Artificial
  CRISPR gRNA sequence
gtggctcatgcctgtaatcc

SEQ ID NO: 792187 - DNA, 20 bp, Artificial
  CRISPR gRNA sequence
atgcctgtaatcccagcact

SEQ ID NO: 792188 - DNA, 20 bp, Artificial
  CRISPR gRNA sequence
tgcctgtaatcccagcactt

SEQ ID NO: 792189 - DNA, 20 bp, Artificial
  CRISPR gRNA sequence
cctgtaatcccagcacttgg

SEQ ID NO: 792190 - DNA, 20 bp, Artificial
  CRISPR gRNA sequence
ctgtaatcccagcacttggg

SEQ ID NO: 792191 - DNA, 20 bp, Artificial
  CRISPR gRNA sequence
atcccagcacttgggaggcc

SEQ ID NO: 792192 - DNA, 20 bp, Artificial
  CRISPR gRNA sequence
tcccagcacttgggaggccg

SEQ ID NO: 792193 - DNA, 20 bp, Artificial
  CRISPR gRNA sequence
cagcacttgggaggccgagg

SEQ ID NO: 792194 - DNA, 20 bp, Artificial
  CRISPR gRNA sequence
agcacttgggaggccgaggc

SEQ ID NO: 792195 - DNA, 20 bp, Artificial
  CRISPR gRNA sequence
ggccgaggcaggaaaatcac

SEQ ID NO: 792196 - DNA, 20 bp, Artificial
  CRISPR gRNA sequence
gccgaggcaggaaaatcacg

SEQ ID NO: 792197 - DNA, 20 bp, Artificial
  CRISPR gRNA sequence
aggcaggaaaatcacgaggt

SEQ ID NO: 792198 - DNA, 20 bp, Artificial
  CRISPR gRNA sequence
ggcaggaaaatcacgaggtc

SEQ ID NO: 792199 - DNA, 20 bp, Artificial
  CRISPR gRNA sequence
caggaaaatcacgaggtcag

SEQ ID NO: 792200 - DNA, 20 bp, Artificial
  CRISPR gRNA sequence
aatcacgaggtcaggagttt

SEQ ID NO: 792201 - DNA, 20 bp, Artificial
  CRISPR gRNA sequence
cgaggtcaggagtttgagac

SEQ ID NO: 792202 - DNA, 20 bp, Artificial
  CRISPR gRNA sequence
tcaggagtttgagaccagcc

SEQ ID NO: 792203 - DNA, 20 bp, Artificial
  CRISPR gRNA sequence
tgagaccagcctggccaaca

SEQ ID NO: 792204 - DNA, 20 bp, Artificial
  CRISPR gRNA sequence
ctactaaaaatacaaaaaat

SEQ ID NO: 792205 - DNA, 20 bp, Artificial
  CRISPR gRNA sequence
taaaaatacaaaaaattagc

SEQ ID NO: 792206 - DNA, 20 bp, Artificial
  CRISPR gRNA sequence
tacaaaaaattagctggatg

SEQ ID NO: 792207 - DNA, 20 bp, Artificial
  CRISPR gRNA sequence
aaaaaattagctggatgtag

SEQ ID NO: 792208 - DNA, 20 bp, Artificial
  CRISPR gRNA sequence
aaattagctggatgtagtgg

SEQ ID NO: 792209 - DNA, 20 bp, Artificial
  CRISPR gRNA sequence
aattagctggatgtagtggt

SEQ ID NO: 792210 - DNA, 20 bp, Artificial
  CRISPR gRNA sequence
gtggtgggtgtctgtaatac

SEQ ID NO: 792211 - DNA, 20 bp, Artificial
  CRISPR gRNA sequence
tgtctgtaataccagctact

SEQ ID NO: 792212 - DNA, 20 bp, Artificial
  CRISPR gRNA sequence
gtctgtaataccagctactc

SEQ ID NO: 792213 - DNA, 20 bp, Artificial
  CRISPR gRNA sequence
ctgtaataccagctactcgg

SEQ ID NO: 792214 - DNA, 20 bp, Artificial
  CRISPR gRNA sequence
tgtaataccagctactcggg

SEQ ID NO: 792215 - DNA, 20 bp, Artificial
  CRISPR gRNA sequence
accagctactcgggaggctg

SEQ ID NO: 792216 - DNA, 20 bp, Artificial
  CRISPR gRNA sequence
agctactcgggaggctgaag

SEQ ID NO: 792217 - DNA, 20 bp, Artificial
  CRISPR gRNA sequence
gctactcgggaggctgaagc

SEQ ID NO: 792218 - DNA, 20 bp, Artificial
  CRISPR gRNA sequence
tactcgggaggctgaagcag

SEQ ID NO: 792219 - DNA, 20 bp, Artificial
  CRISPR gRNA sequence
gcaggagaatcgcttgaacc

SEQ ID NO: 792220 - DNA, 20 bp, Artificial
  CRISPR gRNA sequence
caggagaatcgcttgaaccc

SEQ ID NO: 792221 - DNA, 20 bp, Artificial
  CRISPR gRNA sequence
ggagaatcgcttgaacccgg

SEQ ID NO: 792222 - DNA, 20 bp, Artificial
  CRISPR gRNA sequence
gagaatcgcttgaacccggg

SEQ ID NO: 792223 - DNA, 20 bp, Artificial
  CRISPR gRNA sequence
aatcgcttgaacccgggagg

SEQ ID NO: 792224 - DNA, 20 bp, Artificial
  CRISPR gRNA sequence
tcgcttgaacccgggaggca

SEQ ID NO: 792225 - DNA, 20 bp, Artificial
  CRISPR gRNA sequence
cgcttgaacccgggaggcag

SEQ ID NO: 792226 - DNA, 20 bp, Artificial
  CRISPR gRNA sequence
aacccgggaggcagaggttg

SEQ ID NO: 792227 - DNA, 20 bp, Artificial
  CRISPR gRNA sequence
cgggaggcagaggttgcagt

SEQ ID NO: 792228 - DNA, 20 bp, Artificial
  CRISPR gRNA sequence
ggcagaggttgcagtgagcc

SEQ ID NO: 792229 - DNA, 20 bp, Artificial
  CRISPR gRNA sequence
gagattgcgccactgcactc

SEQ ID NO: 792230 - DNA, 20 bp, Artificial
  CRISPR gRNA sequence
gcgccactgcactccagccc

SEQ ID NO: 792231 - DNA, 20 bp, Artificial
  CRISPR gRNA sequence
ctgcactccagccctggtga

SEQ ID NO: 792232 - DNA, 20 bp, Artificial
  CRISPR gRNA sequence
gcactccagccctggtgaca

SEQ ID NO: 792233 - DNA, 20 bp, Artificial
  CRISPR gRNA sequence
tccagccctggtgacagagt

SEQ ID NO: 792234 - DNA, 20 bp, Artificial
  CRISPR gRNA sequence
aacaaacaaacacaaaaccc

SEQ ID NO: 792235 - DNA, 20 bp, Artificial
  CRISPR gRNA sequence
caaacacaaaaccctggact

SEQ ID NO: 792236 - DNA, 20 bp, Artificial
  CRISPR gRNA sequence
cacaaaaccctggactcagc

SEQ ID NO: 792237 - DNA, 20 bp, Artificial
  CRISPR gRNA sequence
tggactcagccagacttgaa

SEQ ID NO: 792238 - DNA, 20 bp, Artificial
  CRISPR gRNA sequence
agccagacttgaacagacat

SEQ ID NO: 792239 - DNA, 20 bp, Artificial
  CRISPR gRNA sequence
gccagacttgaacagacatt

SEQ ID NO: 792240 - DNA, 20 bp, Artificial
  CRISPR gRNA sequence
tgaacagacattgggactac

SEQ ID NO: 792241 - DNA, 20 bp, Artificial
  CRISPR gRNA sequence
cagacattgggactaccagc

SEQ ID NO: 792242 - DNA, 20 bp, Artificial
  CRISPR gRNA sequence
agacattgggactaccagct

SEQ ID NO: 792243 - DNA, 20 bp, Artificial
  CRISPR gRNA sequence
gacattgggactaccagcta

SEQ ID NO: 792244 - DNA, 20 bp, Artificial
  CRISPR gRNA sequence
acattgggactaccagctag

SEQ ID NO: 792245 - DNA, 20 bp, Artificial
  CRISPR gRNA sequence
ttgggactaccagctagggg

SEQ ID NO: 792246 - DNA, 20 bp, Artificial
  CRISPR gRNA sequence
ggactaccagctaggggaag

SEQ ID NO: 792247 - DNA, 20 bp, Artificial
  CRISPR gRNA sequence
ggggaagcagttgctcactt

SEQ ID NO: 792248 - DNA, 20 bp, Artificial
  CRISPR gRNA sequence
tttttttttttttttttttt

SEQ ID NO: 792249 - DNA, 20 bp, Artificial
  CRISPR gRNA sequence
ttttttttttttttttgaga

SEQ ID NO: 792250 - DNA, 20 bp, Artificial
  CRISPR gRNA sequence
ttttttttttttttgagatg

SEQ ID NO: 792251 - DNA, 20 bp, Artificial
  CRISPR gRNA sequence
tggagtcttgctctctcacc

SEQ ID NO: 792252 - DNA, 20 bp, Artificial
  CRISPR gRNA sequence
ggagtcttgctctctcaccc

SEQ ID NO: 792253 - DNA, 20 bp, Artificial
  CRISPR gRNA sequence
tcttgctctctcacccaggc

SEQ ID NO: 792254 - DNA, 20 bp, Artificial
  CRISPR gRNA sequence
ttgctctctcacccaggctg

SEQ ID NO: 792255 - DNA, 20 bp, Artificial
  CRISPR gRNA sequence
ctctcacccaggctggagtg

SEQ ID NO: 792256 - DNA, 20 bp, Artificial
  CRISPR gRNA sequence
tcacccaggctggagtgcag

SEQ ID NO: 792257 - DNA, 20 bp, Artificial
  CRISPR gRNA sequence
ggagtgcagtggtgtgatct

SEQ ID NO: 792258 - DNA, 20 bp, Artificial
  CRISPR gRNA sequence
tcactgcatcctccgcctcc

SEQ ID NO: 792259 - DNA, 20 bp, Artificial
  CRISPR gRNA sequence
cactgcatcctccgcctccc

SEQ ID NO: 792260 - DNA, 20 bp, Artificial
  CRISPR gRNA sequence
atcctccgcctcccgggttc

SEQ ID NO: 792261 - DNA, 20 bp, Artificial
  CRISPR gRNA sequence
ttcaagtgattctcctgcct

SEQ ID NO: 792262 - DNA, 20 bp, Artificial
  CRISPR gRNA sequence
ttctcctgcctcagcctcct

SEQ ID NO: 792263 - DNA, 20 bp, Artificial
  CRISPR gRNA sequence
gcctcagcctcctgagtaac

SEQ ID NO: 792264 - DNA, 20 bp, Artificial
  CRISPR gRNA sequence
cctcagcctcctgagtaact

SEQ ID NO: 792265 - DNA, 20 bp, Artificial
  CRISPR gRNA sequence
ctcctgagtaactgggacaa

SEQ ID NO: 792266 - DNA, 20 bp, Artificial
  CRISPR gRNA sequence
tcctgagtaactgggacaac

SEQ ID NO: 792267 - DNA, 20 bp, Artificial
  CRISPR gRNA sequence
caggcgtgcacaactgcacc

SEQ ID NO: 792268 - DNA, 20 bp, Artificial
  CRISPR gRNA sequence
tggctaatttttcatatttt

SEQ ID NO: 792269 - DNA, 20 bp, Artificial
  CRISPR gRNA sequence
ctaatttttcatatttttag

SEQ ID NO: 792270 - DNA, 20 bp, Artificial
  CRISPR gRNA sequence
aatttttcatatttttagta

SEQ ID NO: 792271 - DNA, 20 bp, Artificial
  CRISPR gRNA sequence
tttcatatttttagtagaga

SEQ ID NO: 792272 - DNA, 20 bp, Artificial
  CRISPR gRNA sequence
tcatatttttagtagagatg

SEQ ID NO: 792273 - DNA, 20 bp, Artificial
  CRISPR gRNA sequence
gagatggagtttcaccatct

SEQ ID NO: 792274 - DNA, 20 bp, Artificial
  CRISPR gRNA sequence
ggagtttcaccatcttggcc

SEQ ID NO: 792275 - DNA, 20 bp, Artificial
  CRISPR gRNA sequence
tttcaccatcttggccaagc

SEQ ID NO: 792276 - DNA, 20 bp, Artificial
  CRISPR gRNA sequence
acctcgtgatccacccgcct

SEQ ID NO: 792277 - DNA, 20 bp, Artificial
  CRISPR gRNA sequence
ccacccgcctcggcctccca

SEQ ID NO: 792278 - DNA, 20 bp, Artificial
  CRISPR gRNA sequence
gcctcggcctcccaaagtgc

SEQ ID NO: 792279 - DNA, 20 bp, Artificial
  CRISPR gRNA sequence
cctcggcctcccaaagtgct

SEQ ID NO: 792280 - DNA, 20 bp, Artificial
  CRISPR gRNA sequence
ctcccaaagtgctgggatta

SEQ ID NO: 792281 - DNA, 20 bp, Artificial
  CRISPR gRNA sequence
tcccaaagtgctgggattac

SEQ ID NO: 792282 - DNA, 20 bp, Artificial
  CRISPR gRNA sequence
agtgctgggattacaggcgt

SEQ ID NO: 792283 - DNA, 20 bp, Artificial
  CRISPR gRNA sequence
caggcgtgagccactgtgcc

SEQ ID NO: 792284 - DNA, 20 bp, Artificial
  CRISPR gRNA sequence
cttgtgtctcctcacctctc

SEQ ID NO: 792285 - DNA, 20 bp, Artificial
  CRISPR gRNA sequence
ttgtgtctcctcacctctct

SEQ ID NO: 792286 - DNA, 20 bp, Artificial
  CRISPR gRNA sequence
tctctgggatgacctgcctg

SEQ ID NO: 792287 - DNA, 20 bp, Artificial
  CRISPR gRNA sequence
tgggatgacctgcctgtggt

SEQ ID NO: 792288 - DNA, 20 bp, Artificial
  CRISPR gRNA sequence
gggatgacctgcctgtggta

SEQ ID NO: 792289 - DNA, 20 bp, Artificial
  CRISPR gRNA sequence
gatgacctgcctgtggtaag

SEQ ID NO: 792290 - DNA, 20 bp, Artificial
  CRISPR gRNA sequence
tggtaaggagctatccattg

SEQ ID NO: 792291 - DNA, 20 bp, Artificial
  CRISPR gRNA sequence
ggtaaggagctatccattgt

SEQ ID NO: 792292 - DNA, 20 bp, Artificial
  CRISPR gRNA sequence
ttgtgggtctcctctctgct

SEQ ID NO: 792293 - DNA, 20 bp, Artificial
  CRISPR gRNA sequence
gtgggtctcctctctgctga

SEQ ID NO: 792294 - DNA, 20 bp, Artificial
  CRISPR gRNA sequence
gaacactcatttcctgccta

SEQ ID NO: 792295 - DNA, 20 bp, Artificial
  CRISPR gRNA sequence
ctcatttcctgcctatggaa

SEQ ID NO: 792296 - DNA, 20 bp, Artificial
  CRISPR gRNA sequence
tggaaaagtgctacccactt

SEQ ID NO: 792297 - DNA, 20 bp, Artificial
  CRISPR gRNA sequence
ggaaaagtgctacccacttt

SEQ ID NO: 792298 - DNA, 20 bp, Artificial
  CRISPR gRNA sequence
acccactttgggtctcctga

SEQ ID NO: 792299 - DNA, 20 bp, Artificial
  CRISPR gRNA sequence
agctgttctgtcactcaacg

SEQ ID NO: 792300 - DNA, 20 bp, Artificial
  CRISPR gRNA sequence
tctccgccttgctcaccctc

SEQ ID NO: 792301 - DNA, 20 bp, Artificial
  CRISPR gRNA sequence
tccacatacctcattttttc

SEQ ID NO: 792302 - DNA, 20 bp, Artificial
  CRISPR gRNA sequence
atacctcattttttctggac

SEQ ID NO: 792303 - DNA, 20 bp, Artificial
  CRISPR gRNA sequence
tacctcattttttctggaca

SEQ ID NO: 792304 - DNA, 20 bp, Artificial
  CRISPR gRNA sequence
acctcattttttctggacaa

SEQ ID NO: 792305 - DNA, 20 bp, Artificial
  CRISPR gRNA sequence
attttttctggacaagggac

SEQ ID NO: 792306 - DNA, 20 bp, Artificial
  CRISPR gRNA sequence
ctggacaagggacaagaatt

SEQ ID NO: 792307 - DNA, 20 bp, Artificial
  CRISPR gRNA sequence
tggacaagggacaagaattc

SEQ ID NO: 792308 - DNA, 20 bp, Artificial
  CRISPR gRNA sequence
agaattcaggacctgccgaa

SEQ ID NO: 792309 - DNA, 20 bp, Artificial
  CRISPR gRNA sequence
attcaggacctgccgaatgg

SEQ ID NO: 792310 - DNA, 20 bp, Artificial
  CRISPR gRNA sequence
cctgccgaatggtggactga

SEQ ID NO: 792311 - DNA, 20 bp, Artificial
  CRISPR gRNA sequence
tgccgaatggtggactgaaa

SEQ ID NO: 792312 - DNA, 20 bp, Artificial
  CRISPR gRNA sequence
gtggactgaaagagctgtaa

SEQ ID NO: 792313 - DNA, 20 bp, Artificial
  CRISPR gRNA sequence
ctgtaacagaaacacttatg

SEQ ID NO: 792314 - DNA, 20 bp, Artificial
  CRISPR gRNA sequence
aaacacttatgtagctgaat

SEQ ID NO: 792315 - DNA, 20 bp, Artificial
  CRISPR gRNA sequence
gcattgtgctgacttttctc

SEQ ID NO: 792316 - DNA, 20 bp, Artificial
  CRISPR gRNA sequence
cattgtgctgacttttctcc

SEQ ID NO: 792317 - DNA, 20 bp, Artificial
  CRISPR gRNA sequence
ttgtgctgacttttctccag

SEQ ID NO: 792318 - DNA, 20 bp, Artificial
  CRISPR gRNA sequence
aaacaaccatgccacctctt

SEQ ID NO: 792319 - DNA, 20 bp, Artificial
  CRISPR gRNA sequence
tattgatgtctgttcctatg

SEQ ID NO: 792320 - DNA, 20 bp, Artificial
  CRISPR gRNA sequence
cattttcatcttaatgttat

SEQ ID NO: 792321 - DNA, 20 bp, Artificial
  CRISPR gRNA sequence
attttcatcttaatgttatt

SEQ ID NO: 792322 - DNA, 20 bp, Artificial
  CRISPR gRNA sequence
ttcatcttaatgttattggg

SEQ ID NO: 792323 - DNA, 20 bp, Artificial
  CRISPR gRNA sequence
catcttaatgttattgggcg

SEQ ID NO: 792324 - DNA, 20 bp, Artificial
  CRISPR gRNA sequence
ttaatgttattgggcggagt

SEQ ID NO: 792325 - DNA, 20 bp, Artificial
  CRISPR gRNA sequence
tattgggcggagttagaaac

SEQ ID NO: 792326 - DNA, 20 bp, Artificial
  CRISPR gRNA sequence
tcaacacgttctctaatatc

SEQ ID NO: 792327 - DNA, 20 bp, Artificial
  CRISPR gRNA sequence
caacacgttctctaatatct

SEQ ID NO: 792328 - DNA, 20 bp, Artificial
  CRISPR gRNA sequence
tgggtctcttgaccaaacca

SEQ ID NO: 792329 - DNA, 20 bp, Artificial
  CRISPR gRNA sequence
gggtctcttgaccaaaccac

SEQ ID NO: 792330 - DNA, 20 bp, Artificial
  CRISPR gRNA sequence
tctcttgaccaaaccacagg

SEQ ID NO: 792331 - DNA, 20 bp, Artificial
  CRISPR gRNA sequence
accaaaccacaggtagtgaa

SEQ ID NO: 792332 - DNA, 20 bp, Artificial
  CRISPR gRNA sequence
gtagtgaacagaaatgcttg

SEQ ID NO: 792333 - DNA, 20 bp, Artificial
  CRISPR gRNA sequence
tagtgaacagaaatgcttgt

SEQ ID NO: 792334 - DNA, 20 bp, Artificial
  CRISPR gRNA sequence
cagaaatgcttgtgggaact

SEQ ID NO: 792335 - DNA, 20 bp, Artificial
  CRISPR gRNA sequence
atgcttgtgggaacttggac

SEQ ID NO: 792336 - DNA, 20 bp, Artificial
  CRISPR gRNA sequence
tgcttgtgggaacttggaca

SEQ ID NO: 792337 - DNA, 20 bp, Artificial
  CRISPR gRNA sequence
gtatgtgaaaaatactttgc

SEQ ID NO: 792338 - DNA, 20 bp, Artificial
  CRISPR gRNA sequence
tgtgaaaaatactttgcaag

SEQ ID NO: 792339 - DNA, 20 bp, Artificial
  CRISPR gRNA sequence
tcatcgtcattatcacttat

SEQ ID NO: 792340 - DNA, 20 bp, Artificial
  CRISPR gRNA sequence
catcgtcattatcacttatg

SEQ ID NO: 792341 - DNA, 20 bp, Artificial
  CRISPR gRNA sequence
atcgtcattatcacttatga

SEQ ID NO: 792342 - DNA, 20 bp, Artificial
  CRISPR gRNA sequence
gtcattatcacttatgaggg

SEQ ID NO: 792343 - DNA, 20 bp, Artificial
  CRISPR gRNA sequence
cttatgagggtggtaatctt

SEQ ID NO: 792344 - DNA, 20 bp, Artificial
  CRISPR gRNA sequence
ctcctctcactaacttcact

SEQ ID NO: 792345 - DNA, 20 bp, Artificial
  CRISPR gRNA sequence
aacttcactaagatcttgcc

SEQ ID NO: 792346 - DNA, 20 bp, Artificial
  CRISPR gRNA sequence
actaagatcttgcctggtaa

SEQ ID NO: 792347 - DNA, 20 bp, Artificial
  CRISPR gRNA sequence
taaaagtctacccatttttt

SEQ ID NO: 792348 - DNA, 20 bp, Artificial
  CRISPR gRNA sequence
cccattttttaagactcact

SEQ ID NO: 792349 - DNA, 20 bp, Artificial
  CRISPR gRNA sequence
ccattttttaagactcactc

SEQ ID NO: 792350 - DNA, 20 bp, Artificial
  CRISPR gRNA sequence
cattttttaagactcactca

SEQ ID NO: 792351 - DNA, 20 bp, Artificial
  CRISPR gRNA sequence
tccttcataaatcctcccct

SEQ ID NO: 792352 - DNA, 20 bp, Artificial
  CRISPR gRNA sequence
aatcctcccctgagcttccc

SEQ ID NO: 792353 - DNA, 20 bp, Artificial
  CRISPR gRNA sequence
gcttcccaagcaaatgtctg

SEQ ID NO: 792354 - DNA, 20 bp, Artificial
  CRISPR gRNA sequence
tgcagaacgattgcgcctct

SEQ ID NO: 792355 - DNA, 20 bp, Artificial
  CRISPR gRNA sequence
gcagaacgattgcgcctctc

SEQ ID NO: 792356 - DNA, 20 bp, Artificial
  CRISPR gRNA sequence
cttgtctaccttgtatttat

SEQ ID NO: 792357 - DNA, 20 bp, Artificial
  CRISPR gRNA sequence
tttttttttttttttttctt

SEQ ID NO: 792358 - DNA, 20 bp, Artificial
  CRISPR gRNA sequence
tttttttttttttttcttta

SEQ ID NO: 792359 - DNA, 20 bp, Artificial
  CRISPR gRNA sequence
ttttttttttctttagagac

SEQ ID NO: 792360 - DNA, 20 bp, Artificial
  CRISPR gRNA sequence
tttttttttctttagagact

SEQ ID NO: 792361 - DNA, 20 bp, Artificial
  CRISPR gRNA sequence
actaggtctcactcattgcc

SEQ ID NO: 792362 - DNA, 20 bp, Artificial
  CRISPR gRNA sequence
gtctcactcattgcctagcc

SEQ ID NO: 792363 - DNA, 20 bp, Artificial
  CRISPR gRNA sequence
ctcactcattgcctagcctg

SEQ ID NO: 792364 - DNA, 20 bp, Artificial
  CRISPR gRNA sequence
tcattgcctagcctggagtg

SEQ ID NO: 792365 - DNA, 20 bp, Artificial
  CRISPR gRNA sequence
ttgcctagcctggagtgtag

SEQ ID NO: 792366 - DNA, 20 bp, Artificial
  CRISPR gRNA sequence
tggagtgtagtggctattca

SEQ ID NO: 792367 - DNA, 20 bp, Artificial
  CRISPR gRNA sequence
ggagtgtagtggctattcac

SEQ ID NO: 792368 - DNA, 20 bp, Artificial
  CRISPR gRNA sequence
gctattcacaggtgtgatca

SEQ ID NO: 792369 - DNA, 20 bp, Artificial
  CRISPR gRNA sequence
tattcacaggtgtgatcata

SEQ ID NO: 792370 - DNA, 20 bp, Artificial
  CRISPR gRNA sequence
ggtgtgatcatagagcactg

SEQ ID NO: 792371 - DNA, 20 bp, Artificial
  CRISPR gRNA sequence
gcactgcagcctcgaattcc

SEQ ID NO: 792372 - DNA, 20 bp, Artificial
  CRISPR gRNA sequence
agcctcgaattcctggcctc

SEQ ID NO: 792373 - DNA, 20 bp, Artificial
  CRISPR gRNA sequence
tcctggcctcaagcaaactc

SEQ ID NO: 792374 - DNA, 20 bp, Artificial
  CRISPR gRNA sequence
ctcaagcaaactctggcttc

SEQ ID NO: 792375 - DNA, 20 bp, Artificial
  CRISPR gRNA sequence
ttcaagtgatcctcctgccc

SEQ ID NO: 792376 - DNA, 20 bp, Artificial
  CRISPR gRNA sequence
tcctcctgccccagcctccc

SEQ ID NO: 792377 - DNA, 20 bp, Artificial
  CRISPR gRNA sequence
tcctgccccagcctcccaag

SEQ ID NO: 792378 - DNA, 20 bp, Artificial
  CRISPR gRNA sequence
gccccagcctcccaagtagc

SEQ ID NO: 792379 - DNA, 20 bp, Artificial
  CRISPR gRNA sequence
ccccagcctcccaagtagct

SEQ ID NO: 792380 - DNA, 20 bp, Artificial
  CRISPR gRNA sequence
ctcccaagtagctgggacta

SEQ ID NO: 792381 - DNA, 20 bp, Artificial
  CRISPR gRNA sequence
agtagctgggactatagttg

SEQ ID NO: 792382 - DNA, 20 bp, Artificial
  CRISPR gRNA sequence
gtagctgggactatagttgt

SEQ ID NO: 792383 - DNA, 20 bp, Artificial
  CRISPR gRNA sequence
tagttgtgggctaccttgcc

SEQ ID NO: 792384 - DNA, 20 bp, Artificial
  CRISPR gRNA sequence
tattctgcttatttctacat

SEQ ID NO: 792385 - DNA, 20 bp, Artificial
  CRISPR gRNA sequence
tctgcttatttctacataag

SEQ ID NO: 792386 - DNA, 20 bp, Artificial
  CRISPR gRNA sequence
atcaatttactcaattgcat

SEQ ID NO: 792387 - DNA, 20 bp, Artificial
  CRISPR gRNA sequence
tcaatttactcaattgcatt

SEQ ID NO: 792388 - DNA, 20 bp, Artificial
  CRISPR gRNA sequence
atttactcaattgcattagg

SEQ ID NO: 792389 - DNA, 20 bp, Artificial
  CRISPR gRNA sequence
attaggaagttgtatctttc

SEQ ID NO: 792390 - DNA, 20 bp, Artificial
  CRISPR gRNA sequence
taggaagttgtatctttcca

SEQ ID NO: 792391 - DNA, 20 bp, Artificial
  CRISPR gRNA sequence
tgtatctttccagagaaatc

SEQ ID NO: 792392 - DNA, 20 bp, Artificial
  CRISPR gRNA sequence
gtatctttccagagaaatca

SEQ ID NO: 792393 - DNA, 20 bp, Artificial
  CRISPR gRNA sequence
aggaaacatctgtaaattct

SEQ ID NO: 792394 - DNA, 20 bp, Artificial
  CRISPR gRNA sequence
ggaaacatctgtaaattctg

SEQ ID NO: 792395 - DNA, 20 bp, Artificial
  CRISPR gRNA sequence
catctgtaaattctgaggat

SEQ ID NO: 792396 - DNA, 20 bp, Artificial
  CRISPR gRNA sequence
tctgaggataagttcgtaaa

SEQ ID NO: 792397 - DNA, 20 bp, Artificial
  CRISPR gRNA sequence
taagttcgtaaacagaaaat

SEQ ID NO: 792398 - DNA, 20 bp, Artificial
  CRISPR gRNA sequence
aagttcgtaaacagaaaatg

SEQ ID NO: 792399 - DNA, 20 bp, Artificial
  CRISPR gRNA sequence
aaaatgaggaaatttttttc

SEQ ID NO: 792400 - DNA, 20 bp, Artificial
  CRISPR gRNA sequence
ttttttcaagcaaaatttgc

SEQ ID NO: 792401 - DNA, 20 bp, Artificial
  CRISPR gRNA sequence
ttttcaagcaaaatttgcaa

SEQ ID NO: 792402 - DNA, 20 bp, Artificial
  CRISPR gRNA sequence
tttcaagcaaaatttgcaag

SEQ ID NO: 792403 - DNA, 20 bp, Artificial
  CRISPR gRNA sequence
agcaaaatttgcaagaggat

SEQ ID NO: 792404 - DNA, 20 bp, Artificial
  CRISPR gRNA sequence
tgcaagaggatcagaaatga

SEQ ID NO: 792405 - DNA, 20 bp, Artificial
  CRISPR gRNA sequence
aagaggatcagaaatgatgg

SEQ ID NO: 792406 - DNA, 20 bp, Artificial
  CRISPR gRNA sequence
agaggatcagaaatgatggt

SEQ ID NO: 792407 - DNA, 20 bp, Artificial
  CRISPR gRNA sequence
tcagaaatgatggtaggttc

SEQ ID NO: 792408 - DNA, 20 bp, Artificial
  CRISPR gRNA sequence
gaaatgatggtaggttctag

SEQ ID NO: 792409 - DNA, 20 bp, Artificial
  CRISPR gRNA sequence
gttctagcagtttcacttct

SEQ ID NO: 792410 - DNA, 20 bp, Artificial
  CRISPR gRNA sequence
gtttcacttcttggttgcta

SEQ ID NO: 792411 - DNA, 20 bp, Artificial
  CRISPR gRNA sequence
tttcacttcttggttgctat

SEQ ID NO: 792412 - DNA, 20 bp, Artificial
  CRISPR gRNA sequence
cttcttggttgctataggcc

SEQ ID NO: 792413 - DNA, 20 bp, Artificial
  CRISPR gRNA sequence
cttgccatttctactgtctg

SEQ ID NO: 792414 - DNA, 20 bp, Artificial
  CRISPR gRNA sequence
tgccatttctactgtctgtg

SEQ ID NO: 792415 - DNA, 20 bp, Artificial
  CRISPR gRNA sequence
gagatctatttccaaactga

SEQ ID NO: 792416 - DNA, 20 bp, Artificial
  CRISPR gRNA sequence
agatgaaatacaaataattg

SEQ ID NO: 792417 - DNA, 20 bp, Artificial
  CRISPR gRNA sequence
tacaaataattgtggtgctg

SEQ ID NO: 792418 - DNA, 20 bp, Artificial
  CRISPR gRNA sequence
ttttattcaaaacatttact

SEQ ID NO: 792419 - DNA, 20 bp, Artificial
  CRISPR gRNA sequence
cttggtatttactatgtgcc

SEQ ID NO: 792420 - DNA, 20 bp, Artificial
  CRISPR gRNA sequence
atttactatgtgccaagctc

SEQ ID NO: 792421 - DNA, 20 bp, Artificial
  CRISPR gRNA sequence
tgtgccaagctctagtatac

SEQ ID NO: 792422 - DNA, 20 bp, Artificial
  CRISPR gRNA sequence
gtgccaagctctagtataca

SEQ ID NO: 792423 - DNA, 20 bp, Artificial
  CRISPR gRNA sequence
tgccaagctctagtatacaa

SEQ ID NO: 792424 - DNA, 20 bp, Artificial
  CRISPR gRNA sequence
tctagtatacaagggtaaat

SEQ ID NO: 792425 - DNA, 20 bp, Artificial
  CRISPR gRNA sequence
atacaagggtaaataagaca

SEQ ID NO: 792426 - DNA, 20 bp, Artificial
  CRISPR gRNA sequence
aagggtaaataagacacagc

SEQ ID NO: 792427 - DNA, 20 bp, Artificial
  CRISPR gRNA sequence
agacacagccagtgctttta

SEQ ID NO: 792428 - DNA, 20 bp, Artificial
  CRISPR gRNA sequence
agtgcttttatggaattctc

SEQ ID NO: 792429 - DNA, 20 bp, Artificial
  CRISPR gRNA sequence
aattctctggtctgtgcaat

SEQ ID NO: 792430 - DNA, 20 bp, Artificial
  CRISPR gRNA sequence
ctctggtctgtgcaataagt

SEQ ID NO: 792431 - DNA, 20 bp, Artificial
  CRISPR gRNA sequence
tctggtctgtgcaataagtg

SEQ ID NO: 792432 - DNA, 20 bp, Artificial
  CRISPR gRNA sequence
tctgtgcaataagtgaggca

SEQ ID NO: 792433 - DNA, 20 bp, Artificial
  CRISPR gRNA sequence
agtgaggcatagacattcta

SEQ ID NO: 792434 - DNA, 20 bp, Artificial
  CRISPR gRNA sequence
gaggcatagacattctatgg

SEQ ID NO: 792435 - DNA, 20 bp, Artificial
  CRISPR gRNA sequence
acattctatggaagtatctc

SEQ ID NO: 792436 - DNA, 20 bp, Artificial
  CRISPR gRNA sequence
tggaagtatctcaagaatcc

SEQ ID NO: 792437 - DNA, 20 bp, Artificial
  CRISPR gRNA sequence
ttcctttgtgtaacaataac

SEQ ID NO: 792438 - DNA, 20 bp, Artificial
  CRISPR gRNA sequence
gtgtaacaataaccagccta

SEQ ID NO: 792439 - DNA, 20 bp, Artificial
  CRISPR gRNA sequence
tgtaacaataaccagcctaa

SEQ ID NO: 792440 - DNA, 20 bp, Artificial
  CRISPR gRNA sequence
cattctttgttaaatactgc

SEQ ID NO: 792441 - DNA, 20 bp, Artificial
  CRISPR gRNA sequence
catttgcctcttccctctcc

SEQ ID NO: 792442 - DNA, 20 bp, Artificial
  CRISPR gRNA sequence
ctcttccctctcccagtgtc

SEQ ID NO: 792443 - DNA, 20 bp, Artificial
  CRISPR gRNA sequence
ttccctctcccagtgtctag

SEQ ID NO: 792444 - DNA, 20 bp, Artificial
  CRISPR gRNA sequence
ccctctcccagtgtctagta

SEQ ID NO: 792445 - DNA, 20 bp, Artificial
  CRISPR gRNA sequence
tcccagtgtctagtagagcc

SEQ ID NO: 792446 - DNA, 20 bp, Artificial
  CRISPR gRNA sequence
gtagagcccggctatccatg

SEQ ID NO: 792447 - DNA, 20 bp, Artificial
  CRISPR gRNA sequence
cccggctatccatgaagacc

SEQ ID NO: 792448 - DNA, 20 bp, Artificial
  CRISPR gRNA sequence
ctgaactaaccactgttttg

SEQ ID NO: 792449 - DNA, 20 bp, Artificial
  CRISPR gRNA sequence
ctaaccactgttttgaagcc

SEQ ID NO: 792450 - DNA, 20 bp, Artificial
  CRISPR gRNA sequence
tgttttgaagccaagtgtct

SEQ ID NO: 792451 - DNA, 20 bp, Artificial
  CRISPR gRNA sequence
tctaagacactaattgtaat

SEQ ID NO: 792452 - DNA, 20 bp, Artificial
  CRISPR gRNA sequence
aatctgaatttgaatgcctt

SEQ ID NO: 792453 - DNA, 20 bp, Artificial
  CRISPR gRNA sequence
atctgaatttgaatgccttt

SEQ ID NO: 792454 - DNA, 20 bp, Artificial
  CRISPR gRNA sequence
gaatttgaatgcctttgggc

SEQ ID NO: 792455 - DNA, 20 bp, Artificial
  CRISPR gRNA sequence
atgcctttgggcaagttatg

SEQ ID NO: 792456 - DNA, 20 bp, Artificial
  CRISPR gRNA sequence
gcctttgggcaagttatgca

SEQ ID NO: 792457 - DNA, 20 bp, Artificial
  CRISPR gRNA sequence
aagttatgcagagtttgccc

SEQ ID NO: 792458 - DNA, 20 bp, Artificial
  CRISPR gRNA sequence
agttatgcagagtttgcccc

SEQ ID NO: 792459 - DNA, 20 bp, Artificial
  CRISPR gRNA sequence
cctaccattttccattgtat

SEQ ID NO: 792460 - DNA, 20 bp, Artificial
  CRISPR gRNA sequence
attttccattgtattagacc

SEQ ID NO: 792461 - DNA, 20 bp, Artificial
  CRISPR gRNA sequence
tccattgtattagacctagc

SEQ ID NO: 792462 - DNA, 20 bp, Artificial
  CRISPR gRNA sequence
ttgttgcctgacaaacccaa

SEQ ID NO: 792463 - DNA, 20 bp, Artificial
  CRISPR gRNA sequence
tgttgcctgacaaacccaat

SEQ ID NO: 792464 - DNA, 20 bp, Artificial
  CRISPR gRNA sequence
gacaaacccaataggtattt

SEQ ID NO: 792465 - DNA, 20 bp, Artificial
  CRISPR gRNA sequence
cccaataggtatttgagttt

SEQ ID NO: 792466 - DNA, 20 bp, Artificial
  CRISPR gRNA sequence
ccaataggtatttgagtttt

SEQ ID NO: 792467 - DNA, 20 bp, Artificial
  CRISPR gRNA sequence
caataggtatttgagttttg

SEQ ID NO: 792468 - DNA, 20 bp, Artificial
  CRISPR gRNA sequence
aataggtatttgagttttgg

SEQ ID NO: 792469 - DNA, 20 bp, Artificial
  CRISPR gRNA sequence
ataggtatttgagttttggg

SEQ ID NO: 792470 - DNA, 20 bp, Artificial
  CRISPR gRNA sequence
tgagttttggggggatctta

SEQ ID NO: 792471 - DNA, 20 bp, Artificial
  CRISPR gRNA sequence
ttttggggggatcttacagc

SEQ ID NO: 792472 - DNA, 20 bp, Artificial
  CRISPR gRNA sequence
cagccagtactctgctgtca

SEQ ID NO: 792473 - DNA, 20 bp, Artificial
  CRISPR gRNA sequence
agccagtactctgctgtcat

SEQ ID NO: 792474 - DNA, 20 bp, Artificial
  CRISPR gRNA sequence
ctctgctgtcataggtatat

SEQ ID NO: 792475 - DNA, 20 bp, Artificial
  CRISPR gRNA sequence
tttgatctctaaaccatctg

SEQ ID NO: 792476 - DNA, 20 bp, Artificial
  CRISPR gRNA sequence
tctctaaaccatctgtggca

SEQ ID NO: 792477 - DNA, 20 bp, Artificial
  CRISPR gRNA sequence
taaaccatctgtggcataga

SEQ ID NO: 792478 - DNA, 20 bp, Artificial
  CRISPR gRNA sequence
ctgtggcatagatagactac

SEQ ID NO: 792479 - DNA, 20 bp, Artificial
  CRISPR gRNA sequence
tggcatagatagactaccag

SEQ ID NO: 792480 - DNA, 20 bp, Artificial
  CRISPR gRNA sequence
gatagactaccagtagcctt

SEQ ID NO: 792481 - DNA, 20 bp, Artificial
  CRISPR gRNA sequence
tgctattctactcaatttaa

SEQ ID NO: 792482 - DNA, 20 bp, Artificial
  CRISPR gRNA sequence
ctattctactcaatttaata

SEQ ID NO: 792483 - DNA, 20 bp, Artificial
  CRISPR gRNA sequence
ctcaatttaatagagcattt

SEQ ID NO: 792484 - DNA, 20 bp, Artificial
  CRISPR gRNA sequence
aaattaaatctcaatttttt

SEQ ID NO: 792485 - DNA, 20 bp, Artificial
  CRISPR gRNA sequence
tcaattttttaagcaataaa

SEQ ID NO: 792486 - DNA, 20 bp, Artificial
  CRISPR gRNA sequence
ttttttaagcaataaacagt

SEQ ID NO: 792487 - DNA, 20 bp, Artificial
  CRISPR gRNA sequence
agtgagttcccactttttat

SEQ ID NO: 792488 - DNA, 20 bp, Artificial
  CRISPR gRNA sequence
ctttttataagcctttatat

SEQ ID NO: 792489 - DNA, 20 bp, Artificial
  CRISPR gRNA sequence
ttataagcctttatattaga

SEQ ID NO: 792490 - DNA, 20 bp, Artificial
  CRISPR gRNA sequence
cctttatattagaaagttgt

SEQ ID NO: 792491 - DNA, 20 bp, Artificial
  CRISPR gRNA sequence
tagaaagttgtgagaattca

SEQ ID NO: 792492 - DNA, 20 bp, Artificial
  CRISPR gRNA sequence
ttcatagaataatttatcat

SEQ ID NO: 792493 - DNA, 20 bp, Artificial
  CRISPR gRNA sequence
catagaataatttatcattg

SEQ ID NO: 792494 - DNA, 20 bp, Artificial
  CRISPR gRNA sequence
atttatcattggagaattca

SEQ ID NO: 792495 - DNA, 20 bp, Artificial
  CRISPR gRNA sequence
ttatcattggagaattcata

SEQ ID NO: 792496 - DNA, 20 bp, Artificial
  CRISPR gRNA sequence
tatcattggagaattcatag

SEQ ID NO: 792497 - DNA, 20 bp, Artificial
  CRISPR gRNA sequence
atcattggagaattcataga

SEQ ID NO: 792498 - DNA, 20 bp, Artificial
  CRISPR gRNA sequence
attcatagagggtttcctct

SEQ ID NO: 792499 - DNA, 20 bp, Artificial
  CRISPR gRNA sequence
atagagggtttcctctaaga

SEQ ID NO: 792500 - DNA, 20 bp, Artificial
  CRISPR gRNA sequence
tagagggtttcctctaagaa

SEQ ID NO: 792501 - DNA, 20 bp, Artificial
  CRISPR gRNA sequence
agagggtttcctctaagaaa

SEQ ID NO: 792502 - DNA, 20 bp, Artificial
  CRISPR gRNA sequence
agaaagggcccttgccctta

SEQ ID NO: 792503 - DNA, 20 bp, Artificial
  CRISPR gRNA sequence
taaagacattgtaccataat

SEQ ID NO: 792504 - DNA, 20 bp, Artificial
  CRISPR gRNA sequence
agacattgtaccataattgg

SEQ ID NO: 792505 - DNA, 20 bp, Artificial
  CRISPR gRNA sequence
gacattgtaccataattgga

SEQ ID NO: 792506 - DNA, 20 bp, Artificial
  CRISPR gRNA sequence
aaactctcacacatgaaaaa

SEQ ID NO: 792507 - DNA, 20 bp, Artificial
  CRISPR gRNA sequence
tagtaaaactgatgtaaaac

SEQ ID NO: 792508 - DNA, 20 bp, Artificial
  CRISPR gRNA sequence
aacaagtgataaaattgcaa

SEQ ID NO: 792509 - DNA, 20 bp, Artificial
  CRISPR gRNA sequence
tgataaaattgcaaaagccc

SEQ ID NO: 792510 - DNA, 20 bp, Artificial
  CRISPR gRNA sequence
taaaattgcaaaagccctag

SEQ ID NO: 792511 - DNA, 20 bp, Artificial
  CRISPR gRNA sequence
aaagccctagaagttgacta

SEQ ID NO: 792512 - DNA, 20 bp, Artificial
  CRISPR gRNA sequence
aagccctagaagttgactaa

SEQ ID NO: 792513 - DNA, 20 bp, Artificial
  CRISPR gRNA sequence
ccctagaagttgactaaagg

SEQ ID NO: 792514 - DNA, 20 bp, Artificial
  CRISPR gRNA sequence
cctagaagttgactaaagga

SEQ ID NO: 792515 - DNA, 20 bp, Artificial
  CRISPR gRNA sequence
ctagaagttgactaaaggaa

SEQ ID NO: 792516 - DNA, 20 bp, Artificial
  CRISPR gRNA sequence
agaagttgactaaaggaagg

SEQ ID NO: 792517 - DNA, 20 bp, Artificial
  CRISPR gRNA sequence
ctaaaggaagggagacttcc

SEQ ID NO: 792518 - DNA, 20 bp, Artificial
  CRISPR gRNA sequence
aaaggaagggagacttccca

SEQ ID NO: 792519 - DNA, 20 bp, Artificial
  CRISPR gRNA sequence
aaggaagggagacttcccag

SEQ ID NO: 792520 - DNA, 20 bp, Artificial
  CRISPR gRNA sequence
aggaagggagacttcccaga

SEQ ID NO: 792521 - DNA, 20 bp, Artificial
  CRISPR gRNA sequence
ggaagggagacttcccagag

SEQ ID NO: 792522 - DNA, 20 bp, Artificial
  CRISPR gRNA sequence
agggagacttcccagagggg

SEQ ID NO: 792523 - DNA, 20 bp, Artificial
  CRISPR gRNA sequence
gggagacttcccagaggggt

SEQ ID NO: 792524 - DNA, 20 bp, Artificial
  CRISPR gRNA sequence
cagaggggtaggatttgaac

SEQ ID NO: 792525 - DNA, 20 bp, Artificial
  CRISPR gRNA sequence
agaggggtaggatttgaact

SEQ ID NO: 792526 - DNA, 20 bp, Artificial
  CRISPR gRNA sequence
ggatttgaactgggcctttg

SEQ ID NO: 792527 - DNA, 20 bp, Artificial
  CRISPR gRNA sequence
gaactgggcctttgaagcac

SEQ ID NO: 792528 - DNA, 20 bp, Artificial
  CRISPR gRNA sequence
ctgggcctttgaagcactgg

SEQ ID NO: 792529 - DNA, 20 bp, Artificial
  CRISPR gRNA sequence
tgggcctttgaagcactggt

SEQ ID NO: 792530 - DNA, 20 bp, Artificial
  CRISPR gRNA sequence
tttgaagcactggtaggatt

SEQ ID NO: 792531 - DNA, 20 bp, Artificial
  CRISPR gRNA sequence
ttgaagcactggtaggattt

SEQ ID NO: 792532 - DNA, 20 bp, Artificial
  CRISPR gRNA sequence
tgaagcactggtaggatttg

SEQ ID NO: 792533 - DNA, 20 bp, Artificial
  CRISPR gRNA sequence
actggtaggatttggggttg

SEQ ID NO: 792534 - DNA, 20 bp, Artificial
  CRISPR gRNA sequence
ttggggttgaagctattcta

SEQ ID NO: 792535 - DNA, 20 bp, Artificial
  CRISPR gRNA sequence
tggggttgaagctattctaa

SEQ ID NO: 792536 - DNA, 20 bp, Artificial
  CRISPR gRNA sequence
ggggttgaagctattctaaa

SEQ ID NO: 792537 - DNA, 20 bp, Artificial
  CRISPR gRNA sequence
gttgaagctattctaaaggg

SEQ ID NO: 792538 - DNA, 20 bp, Artificial
  CRISPR gRNA sequence
ctattctaaagggcagtgca

SEQ ID NO: 792539 - DNA, 20 bp, Artificial
  CRISPR gRNA sequence
agggcagtgcatagctgact

SEQ ID NO: 792540 - DNA, 20 bp, Artificial
  CRISPR gRNA sequence
gcagtgcatagctgactcag

SEQ ID NO: 792541 - DNA, 20 bp, Artificial
  CRISPR gRNA sequence
gtgcatagctgactcagaag

SEQ ID NO: 792542 - DNA, 20 bp, Artificial
  CRISPR gRNA sequence
agctgactcagaagcagtct

SEQ ID NO: 792543 - DNA, 20 bp, Artificial
  CRISPR gRNA sequence
ctgactcagaagcagtctca

SEQ ID NO: 792544 - DNA, 20 bp, Artificial
  CRISPR gRNA sequence
tgactcagaagcagtctcag

SEQ ID NO: 792545 - DNA, 20 bp, Artificial
  CRISPR gRNA sequence
gtctcagaggtgcaaatgca

SEQ ID NO: 792546 - DNA, 20 bp, Artificial
  CRISPR gRNA sequence
tctcagaggtgcaaatgcac

SEQ ID NO: 792547 - DNA, 20 bp, Artificial
  CRISPR gRNA sequence
tgcaaatgcacaggcgtgtt

SEQ ID NO: 792548 - DNA, 20 bp, Artificial
  CRISPR gRNA sequence
gcaaatgcacaggcgtgttg

SEQ ID NO: 792549 - DNA, 20 bp, Artificial
  CRISPR gRNA sequence
caaatgcacaggcgtgttga

SEQ ID NO: 792550 - DNA, 20 bp, Artificial
  CRISPR gRNA sequence
aaatgcacaggcgtgttgag

SEQ ID NO: 792551 - DNA, 20 bp, Artificial
  CRISPR gRNA sequence
cgtgttgaggggacaatgaa

SEQ ID NO: 792552 - DNA, 20 bp, Artificial
  CRISPR gRNA sequence
tgttgaggggacaatgaaca

SEQ ID NO: 792553 - DNA, 20 bp, Artificial
  CRISPR gRNA sequence
ggacaatgaacagagtaact

SEQ ID NO: 792554 - DNA, 20 bp, Artificial
  CRISPR gRNA sequence
aatgaacagagtaacttggc

SEQ ID NO: 792555 - DNA, 20 bp, Artificial
  CRISPR gRNA sequence
gagtaacttggctggacact

SEQ ID NO: 792556 - DNA, 20 bp, Artificial
  CRISPR gRNA sequence
agtaacttggctggacactt

SEQ ID NO: 792557 - DNA, 20 bp, Artificial
  CRISPR gRNA sequence
cttggctggacacttaggtt

SEQ ID NO: 792558 - DNA, 20 bp, Artificial
  CRISPR gRNA sequence
acacttaggttgagaatgtc

SEQ ID NO: 792559 - DNA, 20 bp, Artificial
  CRISPR gRNA sequence
acttaggttgagaatgtcaa

SEQ ID NO: 792560 - DNA, 20 bp, Artificial
  CRISPR gRNA sequence
gaatgtcaagagcttaatgc

SEQ ID NO: 792561 - DNA, 20 bp, Artificial
  CRISPR gRNA sequence
aatgtcaagagcttaatgcc

SEQ ID NO: 792562 - DNA, 20 bp, Artificial
  CRISPR gRNA sequence
gtcaagagcttaatgccagg

SEQ ID NO: 792563 - DNA, 20 bp, Artificial
  CRISPR gRNA sequence
caagagcttaatgccaggca

SEQ ID NO: 792564 - DNA, 20 bp, Artificial
  CRISPR gRNA sequence
tgccaggcagagctgccaat

SEQ ID NO: 792565 - DNA, 20 bp, Artificial
  CRISPR gRNA sequence
gccaggcagagctgccaatc

SEQ ID NO: 792566 - DNA, 20 bp, Artificial
  CRISPR gRNA sequence
cagagctgccaatcgggaaa

SEQ ID NO: 792567 - DNA, 20 bp, Artificial
  CRISPR gRNA sequence
agctgccaatcgggaaatag

SEQ ID NO: 792568 - DNA, 20 bp, Artificial
  CRISPR gRNA sequence
tgccaatcgggaaatagtgg

SEQ ID NO: 792569 - DNA, 20 bp, Artificial
  CRISPR gRNA sequence
gtggcagtcactcaaaaact

SEQ ID NO: 792570 - DNA, 20 bp, Artificial
  CRISPR gRNA sequence
aaaactaagtgacaatacca

SEQ ID NO: 792571 - DNA, 20 bp, Artificial
  CRISPR gRNA sequence
aaactaagtgacaataccaa

SEQ ID NO: 792572 - DNA, 20 bp, Artificial
  CRISPR gRNA sequence
actaagtgacaataccaaag

SEQ ID NO: 792573 - DNA, 20 bp, Artificial
  CRISPR gRNA sequence
taccaaaggagtatctgaaa

SEQ ID NO: 792574 - DNA, 20 bp, Artificial
  CRISPR gRNA sequence
ttacatctaatttttttttt

SEQ ID NO: 792575 - DNA, 20 bp, Artificial
  CRISPR gRNA sequence
tctaattttttttttgagta

SEQ ID NO: 792576 - DNA, 20 bp, Artificial
  CRISPR gRNA sequence
ttttttttgagtatagaatt

SEQ ID NO: 792577 - DNA, 20 bp, Artificial
  CRISPR gRNA sequence
tttttttgagtatagaattg

SEQ ID NO: 792578 - DNA, 20 bp, Artificial
  CRISPR gRNA sequence
ttttttgagtatagaattga

SEQ ID NO: 792579 - DNA, 20 bp, Artificial
  CRISPR gRNA sequence
tttgagtatagaattgaggg

SEQ ID NO: 792580 - DNA, 20 bp, Artificial
  CRISPR gRNA sequence
ttgagtatagaattgagggt

SEQ ID NO: 792581 - DNA, 20 bp, Artificial
  CRISPR gRNA sequence
agtatagaattgagggtggg

SEQ ID NO: 792582 - DNA, 20 bp, Artificial
  CRISPR gRNA sequence
gaattgagggtgggtggaat

SEQ ID NO: 792583 - DNA, 20 bp, Artificial
  CRISPR gRNA sequence
ttgagggtgggtggaattgg

SEQ ID NO: 792584 - DNA, 20 bp, Artificial
  CRISPR gRNA sequence
gggtgggtggaattggtaga

SEQ ID NO: 792585 - DNA, 20 bp, Artificial
  CRISPR gRNA sequence
ttggtagacagcctctcaat

SEQ ID NO: 792586 - DNA, 20 bp, Artificial
  CRISPR gRNA sequence
tggtagacagcctctcaatt

SEQ ID NO: 792587 - DNA, 20 bp, Artificial
  CRISPR gRNA sequence
ggtagacagcctctcaatta

SEQ ID NO: 792588 - DNA, 20 bp, Artificial
  CRISPR gRNA sequence
gtagacagcctctcaattag

SEQ ID NO: 792589 - DNA, 20 bp, Artificial
  CRISPR gRNA sequence
tagacagcctctcaattagg

SEQ ID NO: 792590 - DNA, 20 bp, Artificial
  CRISPR gRNA sequence
agggggtcactgtattcatc

SEQ ID NO: 792591 - DNA, 20 bp, Artificial
  CRISPR gRNA sequence
actgtattcatctagatgtt

SEQ ID NO: 792592 - DNA, 20 bp, Artificial
  CRISPR gRNA sequence
tcatctagatgtttggtaac

SEQ ID NO: 792593 - DNA, 20 bp, Artificial
  CRISPR gRNA sequence
catctagatgtttggtaaca

SEQ ID NO: 792594 - DNA, 20 bp, Artificial
  CRISPR gRNA sequence
tggtaacaaggccctaactt

SEQ ID NO: 792595 - DNA, 20 bp, Artificial
  CRISPR gRNA sequence
ggtaacaaggccctaacttc

SEQ ID NO: 792596 - DNA, 20 bp, Artificial
  CRISPR gRNA sequence
acaaggccctaacttcaggt

SEQ ID NO: 792597 - DNA, 20 bp, Artificial
  CRISPR gRNA sequence
ccctaacttcaggtcagaaa

SEQ ID NO: 792598 - DNA, 20 bp, Artificial
  CRISPR gRNA sequence
cctaacttcaggtcagaaaa

SEQ ID NO: 792599 - DNA, 20 bp, Artificial
  CRISPR gRNA sequence
aacttcaggtcagaaaaagg

SEQ ID NO: 792600 - DNA, 20 bp, Artificial
  CRISPR gRNA sequence
tcaggtcagaaaaaggaagc

SEQ ID NO: 792601 - DNA, 20 bp, Artificial
  CRISPR gRNA sequence
caggtcagaaaaaggaagca

SEQ ID NO: 792602 - DNA, 20 bp, Artificial
  CRISPR gRNA sequence
gtcagaaaaaggaagcaagg

SEQ ID NO: 792603 - DNA, 20 bp, Artificial
  CRISPR gRNA sequence
cagaaaaaggaagcaaggaa

SEQ ID NO: 792604 - DNA, 20 bp, Artificial
  CRISPR gRNA sequence
agaaaaaggaagcaaggaag

SEQ ID NO: 792605 - DNA, 20 bp, Artificial
  CRISPR gRNA sequence
aaaaggaagcaaggaagagg

SEQ ID NO: 792606 - DNA, 20 bp, Artificial
  CRISPR gRNA sequence
aggaagcaaggaagaggaag

SEQ ID NO: 792607 - DNA, 20 bp, Artificial
  CRISPR gRNA sequence
aagaggaagaagaaacatat

SEQ ID NO: 792608 - DNA, 20 bp, Artificial
  CRISPR gRNA sequence
caaaacaattgactgctgat

SEQ ID NO: 792609 - DNA, 20 bp, Artificial
  CRISPR gRNA sequence
actgctgatcagccatgcac

SEQ ID NO: 792610 - DNA, 20 bp, Artificial
  CRISPR gRNA sequence
tgctgatcagccatgcacaa

SEQ ID NO: 792611 - DNA, 20 bp, Artificial
  CRISPR gRNA sequence
tcagccatgcacaagagaca

SEQ ID NO: 792612 - DNA, 20 bp, Artificial
  CRISPR gRNA sequence
agccatgcacaagagacaaa

SEQ ID NO: 792613 - DNA, 20 bp, Artificial
  CRISPR gRNA sequence
tgcacaagagacaaagagaa

SEQ ID NO: 792614 - DNA, 20 bp, Artificial
  CRISPR gRNA sequence
gagacaaagagaaaagcaac

SEQ ID NO: 792615 - DNA, 20 bp, Artificial
  CRISPR gRNA sequence
aaaagcaacaagattgactg

SEQ ID NO: 792616 - DNA, 20 bp, Artificial
  CRISPR gRNA sequence
acaagattgactgtggtttt

SEQ ID NO: 792617 - DNA, 20 bp, Artificial
  CRISPR gRNA sequence
attgactgtggttttaagac

SEQ ID NO: 792618 - DNA, 20 bp, Artificial
  CRISPR gRNA sequence
ctgtggttttaagaccagac

SEQ ID NO: 792619 - DNA, 20 bp, Artificial
  CRISPR gRNA sequence
ggttttaagaccagactggc

SEQ ID NO: 792620 - DNA, 20 bp, Artificial
  CRISPR gRNA sequence
ccagactggcaagacaatat

SEQ ID NO: 792621 - DNA, 20 bp, Artificial
  CRISPR gRNA sequence
agactggcaagacaatattg

SEQ ID NO: 792622 - DNA, 20 bp, Artificial
  CRISPR gRNA sequence
gcaagacaatattggagcca

SEQ ID NO: 792623 - DNA, 20 bp, Artificial
  CRISPR gRNA sequence
caagacaatattggagccat

SEQ ID NO: 792624 - DNA, 20 bp, Artificial
  CRISPR gRNA sequence
aagacaatattggagccatg

SEQ ID NO: 792625 - DNA, 20 bp, Artificial
  CRISPR gRNA sequence
agacaatattggagccatgg

SEQ ID NO: 792626 - DNA, 20 bp, Artificial
  CRISPR gRNA sequence
acaatattggagccatgggg

SEQ ID NO: 792627 - DNA, 20 bp, Artificial
  CRISPR gRNA sequence
caatattggagccatggggg

SEQ ID NO: 792628 - DNA, 20 bp, Artificial
  CRISPR gRNA sequence
tattggagccatgggggagg

SEQ ID NO: 792629 - DNA, 20 bp, Artificial
  CRISPR gRNA sequence
attggagccatgggggagga

SEQ ID NO: 792630 - DNA, 20 bp, Artificial
  CRISPR gRNA sequence
ttggagccatgggggaggaa

SEQ ID NO: 792631 - DNA, 20 bp, Artificial
  CRISPR gRNA sequence
gagccatgggggaggaaggg

SEQ ID NO: 792632 - DNA, 20 bp, Artificial
  CRISPR gRNA sequence
ccatgggggaggaagggtgg

SEQ ID NO: 792633 - DNA, 20 bp, Artificial
  CRISPR gRNA sequence
catgggggaggaagggtggc

SEQ ID NO: 792634 - DNA, 20 bp, Artificial
  CRISPR gRNA sequence
atgggggaggaagggtggca

SEQ ID NO: 792635 - DNA, 20 bp, Artificial
  CRISPR gRNA sequence
gggggaggaagggtggcagg

SEQ ID NO: 792636 - DNA, 20 bp, Artificial
  CRISPR gRNA sequence
ggaagggtggcagggagaaa

SEQ ID NO: 792637 - DNA, 20 bp, Artificial
  CRISPR gRNA sequence
agggtggcagggagaaatag

SEQ ID NO: 792638 - DNA, 20 bp, Artificial
  CRISPR gRNA sequence
tggcagggagaaatagaaga

SEQ ID NO: 792639 - DNA, 20 bp, Artificial
  CRISPR gRNA sequence
ggcagggagaaatagaagat

SEQ ID NO: 792640 - DNA, 20 bp, Artificial
  CRISPR gRNA sequence
gcagggagaaatagaagatg

SEQ ID NO: 792641 - DNA, 20 bp, Artificial
  CRISPR gRNA sequence
agggagaaatagaagatggg

SEQ ID NO: 792642 - DNA, 20 bp, Artificial
  CRISPR gRNA sequence
agaagatggggagctgattt

SEQ ID NO: 792643 - DNA, 20 bp, Artificial
  CRISPR gRNA sequence
aagatggggagctgatttta

SEQ ID NO: 792644 - DNA, 20 bp, Artificial
  CRISPR gRNA sequence
agatggggagctgattttag

SEQ ID NO: 792645 - DNA, 20 bp, Artificial
  CRISPR gRNA sequence
gatggggagctgattttaga

SEQ ID NO: 792646 - DNA, 20 bp, Artificial
  CRISPR gRNA sequence
ggggagctgattttagaggg

SEQ ID NO: 792647 - DNA, 20 bp, Artificial
  CRISPR gRNA sequence
agctgattttagagggaaga

SEQ ID NO: 792648 - DNA, 20 bp, Artificial
  CRISPR gRNA sequence
gattttagagggaagacagt

SEQ ID NO: 792649 - DNA, 20 bp, Artificial
  CRISPR gRNA sequence
tagagggaagacagtaagtt

SEQ ID NO: 792650 - DNA, 20 bp, Artificial
  CRISPR gRNA sequence
gaagacagtaagtttggttt

SEQ ID NO: 792651 - DNA, 20 bp, Artificial
  CRISPR gRNA sequence
cagtaagtttggttttagtc

SEQ ID NO: 792652 - DNA, 20 bp, Artificial
  CRISPR gRNA sequence
agtaagtttggttttagtct

SEQ ID NO: 792653 - DNA, 20 bp, Artificial
  CRISPR gRNA sequence
agtttggttttagtctgggc

SEQ ID NO: 792654 - DNA, 20 bp, Artificial
  CRISPR gRNA sequence
gtttggttttagtctgggca

SEQ ID NO: 792655 - DNA, 20 bp, Artificial
  CRISPR gRNA sequence
ttttagtctgggcaaggcat

SEQ ID NO: 792656 - DNA, 20 bp, Artificial
  CRISPR gRNA sequence
ataagcattccaaaaaattg

SEQ ID NO: 792657 - DNA, 20 bp, Artificial
  CRISPR gRNA sequence
taagcattccaaaaaattgt

SEQ ID NO: 792658 - DNA, 20 bp, Artificial
  CRISPR gRNA sequence
attccaaaaaattgtaggtc

SEQ ID NO: 792659 - DNA, 20 bp, Artificial
  CRISPR gRNA sequence
tccaaaaaattgtaggtcca

SEQ ID NO: 792660 - DNA, 20 bp, Artificial
  CRISPR gRNA sequence
aaaattgtaggtccagagtt

SEQ ID NO: 792661 - DNA, 20 bp, Artificial
  CRISPR gRNA sequence
aaattgtaggtccagagttt

SEQ ID NO: 792662 - DNA, 20 bp, Artificial
  CRISPR gRNA sequence
ccagagtttgggacaaaatt

SEQ ID NO: 792663 - DNA, 20 bp, Artificial
  CRISPR gRNA sequence
cagagtttgggacaaaattt

SEQ ID NO: 792664 - DNA, 20 bp, Artificial
  CRISPR gRNA sequence
agagtttgggacaaaattta

SEQ ID NO: 792665 - DNA, 20 bp, Artificial
  CRISPR gRNA sequence
tgggacaaaatttagggcta

SEQ ID NO: 792666 - DNA, 20 bp, Artificial
  CRISPR gRNA sequence
caaaatttagggctaaagat

SEQ ID NO: 792667 - DNA, 20 bp, Artificial
  CRISPR gRNA sequence
aaaatttagggctaaagata

SEQ ID NO: 792668 - DNA, 20 bp, Artificial
  CRISPR gRNA sequence
atttagggctaaagataagg

SEQ ID NO: 792669 - DNA, 20 bp, Artificial
  CRISPR gRNA sequence
taaggaagttatttctaata

SEQ ID NO: 792670 - DNA, 20 bp, Artificial
  CRISPR gRNA sequence
tatttctaatatggaaatgt

SEQ ID NO: 792671 - DNA, 20 bp, Artificial
  CRISPR gRNA sequence
tggaaatgttagttaatatt

SEQ ID NO: 792672 - DNA, 20 bp, Artificial
  CRISPR gRNA sequence
ggaaatgttagttaatattg

SEQ ID NO: 792673 - DNA, 20 bp, Artificial
  CRISPR gRNA sequence
ggaatgaatgaaccatctga

SEQ ID NO: 792674 - DNA, 20 bp, Artificial
  CRISPR gRNA sequence
gaatgaatgaaccatctgat

SEQ ID NO: 792675 - DNA, 20 bp, Artificial
  CRISPR gRNA sequence
aatgaatgaaccatctgatg

SEQ ID NO: 792676 - DNA, 20 bp, Artificial
  CRISPR gRNA sequence
tgaatgaaccatctgatggg

SEQ ID NO: 792677 - DNA, 20 bp, Artificial
  CRISPR gRNA sequence
atctgatggggagaatataa

SEQ ID NO: 792678 - DNA, 20 bp, Artificial
  CRISPR gRNA sequence
gatggggagaatataaaaga

SEQ ID NO: 792679 - DNA, 20 bp, Artificial
  CRISPR gRNA sequence
aatataaaagaaagattata

SEQ ID NO: 792680 - DNA, 20 bp, Artificial
  CRISPR gRNA sequence
aaaagaaagattataaagaa

SEQ ID NO: 792681 - DNA, 20 bp, Artificial
  CRISPR gRNA sequence
ataaagaaaagatctgaact

SEQ ID NO: 792682 - DNA, 20 bp, Artificial
  CRISPR gRNA sequence
taaagaaaagatctgaactc

SEQ ID NO: 792683 - DNA, 20 bp, Artificial
  CRISPR gRNA sequence
ctcaggaacgtcccaaaatt

SEQ ID NO: 792684 - DNA, 20 bp, Artificial
  CRISPR gRNA sequence
caggaacgtcccaaaatttg

SEQ ID NO: 792685 - DNA, 20 bp, Artificial
  CRISPR gRNA sequence
ggaacgtcccaaaatttgga

SEQ ID NO: 792686 - DNA, 20 bp, Artificial
  CRISPR gRNA sequence
acgtcccaaaatttggagag

SEQ ID NO: 792687 - DNA, 20 bp, Artificial
  CRISPR gRNA sequence
cgtcccaaaatttggagagc

SEQ ID NO: 792688 - DNA, 20 bp, Artificial
  CRISPR gRNA sequence
caaaatttggagagcaggaa

SEQ ID NO: 792689 - DNA, 20 bp, Artificial
  CRISPR gRNA sequence
aaatttggagagcaggaaca

SEQ ID NO: 792690 - DNA, 20 bp, Artificial
  CRISPR gRNA sequence
aatttggagagcaggaacag

SEQ ID NO: 792691 - DNA, 20 bp, Artificial
  CRISPR gRNA sequence
ggagagcaggaacagaggac

SEQ ID NO: 792692 - DNA, 20 bp, Artificial
  CRISPR gRNA sequence
ggaacagaggactagtgaaa

SEQ ID NO: 792693 - DNA, 20 bp, Artificial
  CRISPR gRNA sequence
gaacagaggactagtgaaaa

SEQ ID NO: 792694 - DNA, 20 bp, Artificial
  CRISPR gRNA sequence
cagaggactagtgaaaaagg

SEQ ID NO: 792695 - DNA, 20 bp, Artificial
  CRISPR gRNA sequence
gaggactagtgaaaaaggca

SEQ ID NO: 792696 - DNA, 20 bp, Artificial
  CRISPR gRNA sequence
ctagtgaaaaaggcagagac

SEQ ID NO: 792697 - DNA, 20 bp, Artificial
  CRISPR gRNA sequence
tagtgaaaaaggcagagaca

SEQ ID NO: 792698 - DNA, 20 bp, Artificial
  CRISPR gRNA sequence
tgaaaaaggcagagacaagg

SEQ ID NO: 792699 - DNA, 20 bp, Artificial
  CRISPR gRNA sequence
aaaggcagagacaaggtggt

SEQ ID NO: 792700 - DNA, 20 bp, Artificial
  CRISPR gRNA sequence
ggcagagacaaggtggtcag

SEQ ID NO: 792701 - DNA, 20 bp, Artificial
  CRISPR gRNA sequence
cagagacaaggtggtcagaa

SEQ ID NO: 792702 - DNA, 20 bp, Artificial
  CRISPR gRNA sequence
caaggtggtcagaagagcat

SEQ ID NO: 792703 - DNA, 20 bp, Artificial
  CRISPR gRNA sequence
ggtggtcagaagagcatcag

SEQ ID NO: 792704 - DNA, 20 bp, Artificial
  CRISPR gRNA sequence
aagagcatcagaagctcccc

SEQ ID NO: 792705 - DNA, 20 bp, Artificial
  CRISPR gRNA sequence
agagcatcagaagctccccc

SEQ ID NO: 792706 - DNA, 20 bp, Artificial
  CRISPR gRNA sequence
gagcatcagaagctccccca

SEQ ID NO: 792707 - DNA, 20 bp, Artificial
  CRISPR gRNA sequence
catcagaagctcccccaggg

SEQ ID NO: 792708 - DNA, 20 bp, Artificial
  CRISPR gRNA sequence
tcccccagggcagtacttct

SEQ ID NO: 792709 - DNA, 20 bp, Artificial
  CRISPR gRNA sequence
cccccagggcagtacttctg

SEQ ID NO: 792710 - DNA, 20 bp, Artificial
  CRISPR gRNA sequence
gggcagtacttctgaggcaa

SEQ ID NO: 792711 - DNA, 20 bp, Artificial
  CRISPR gRNA sequence
gcagtacttctgaggcaatg

SEQ ID NO: 792712 - DNA, 20 bp, Artificial
  CRISPR gRNA sequence
cagtacttctgaggcaatgg

SEQ ID NO: 792713 - DNA, 20 bp, Artificial
  CRISPR gRNA sequence
caatggaggaaaatccctca

SEQ ID NO: 792714 - DNA, 20 bp, Artificial
  CRISPR gRNA sequence
tggaggaaaatccctcaaag

SEQ ID NO: 792715 - DNA, 20 bp, Artificial
  CRISPR gRNA sequence
ggaggaaaatccctcaaagc

SEQ ID NO: 792716 - DNA, 20 bp, Artificial
  CRISPR gRNA sequence
gaggaaaatccctcaaagca

SEQ ID NO: 792717 - DNA, 20 bp, Artificial
  CRISPR gRNA sequence
aggaaaatccctcaaagcag

SEQ ID NO: 792718 - DNA, 20 bp, Artificial
  CRISPR gRNA sequence
aaaatccctcaaagcagggg

SEQ ID NO: 792719 - DNA, 20 bp, Artificial
  CRISPR gRNA sequence
aaagcaggggcagttcatca

SEQ ID NO: 792720 - DNA, 20 bp, Artificial
  CRISPR gRNA sequence
aagcaggggcagttcatcat

SEQ ID NO: 792721 - DNA, 20 bp, Artificial
  CRISPR gRNA sequence
agcaggggcagttcatcata

SEQ ID NO: 792722 - DNA, 20 bp, Artificial
  CRISPR gRNA sequence
caggggcagttcatcatagg

SEQ ID NO: 792723 - DNA, 20 bp, Artificial
  CRISPR gRNA sequence
gttcatcatagggagccgtg

SEQ ID NO: 792724 - DNA, 20 bp, Artificial
  CRISPR gRNA sequence
catagggagccgtgaagact

SEQ ID NO: 792725 - DNA, 20 bp, Artificial
  CRISPR gRNA sequence
gagccgtgaagactaagaac

SEQ ID NO: 792726 - DNA, 20 bp, Artificial
  CRISPR gRNA sequence
ccgtgaagactaagaactgg

SEQ ID NO: 792727 - DNA, 20 bp, Artificial
  CRISPR gRNA sequence
gaagactaagaactggaagt

SEQ ID NO: 792728 - DNA, 20 bp, Artificial
  CRISPR gRNA sequence
aagaactggaagtcagccca

SEQ ID NO: 792729 - DNA, 20 bp, Artificial
  CRISPR gRNA sequence
agaactggaagtcagcccac

SEQ ID NO: 792730 - DNA, 20 bp, Artificial
  CRISPR gRNA sequence
aagtcagcccacaggtgtgt

SEQ ID NO: 792731 - DNA, 20 bp, Artificial
  CRISPR gRNA sequence
gtcagcccacaggtgtgtta

SEQ ID NO: 792732 - DNA, 20 bp, Artificial
  CRISPR gRNA sequence
gcccacaggtgtgttagaga

SEQ ID NO: 792733 - DNA, 20 bp, Artificial
  CRISPR gRNA sequence
acaggtgtgttagagacagc

SEQ ID NO: 792734 - DNA, 20 bp, Artificial
  CRISPR gRNA sequence
ggtgtgttagagacagctgg

SEQ ID NO: 792735 - DNA, 20 bp, Artificial
  CRISPR gRNA sequence
gtgtgttagagacagctgga

SEQ ID NO: 792736 - DNA, 20 bp, Artificial
  CRISPR gRNA sequence
tagagacagctggaaggcat

SEQ ID NO: 792737 - DNA, 20 bp, Artificial
  CRISPR gRNA sequence
gagacagctggaaggcatca

SEQ ID NO: 792738 - DNA, 20 bp, Artificial
  CRISPR gRNA sequence
agacagctggaaggcatcag

SEQ ID NO: 792739 - DNA, 20 bp, Artificial
  CRISPR gRNA sequence
tggaaggcatcagaggtgac

SEQ ID NO: 792740 - DNA, 20 bp, Artificial
  CRISPR gRNA sequence
ggaaggcatcagaggtgact

SEQ ID NO: 792741 - DNA, 20 bp, Artificial
  CRISPR gRNA sequence
gaaggcatcagaggtgactg

SEQ ID NO: 792742 - DNA, 20 bp, Artificial
  CRISPR gRNA sequence
gcatcagaggtgactggggc

SEQ ID NO: 792743 - DNA, 20 bp, Artificial
  CRISPR gRNA sequence
actggggctagataaccttt

SEQ ID NO: 792744 - DNA, 20 bp, Artificial
  CRISPR gRNA sequence
tcagatgctcttgtctgtcc

SEQ ID NO: 792745 - DNA, 20 bp, Artificial
  CRISPR gRNA sequence
tgtctgtcctggaattctgt

SEQ ID NO: 792746 - DNA, 20 bp, Artificial
  CRISPR gRNA sequence
gaattctgtgagttgatttg

SEQ ID NO: 792747 - DNA, 20 bp, Artificial
  CRISPR gRNA sequence
aattctgtgagttgatttga

SEQ ID NO: 792748 - DNA, 20 bp, Artificial
  CRISPR gRNA sequence
gagttgatttgaaggttatc

SEQ ID NO: 792749 - DNA, 20 bp, Artificial
  CRISPR gRNA sequence
gatttgaaggttatcgagcc

SEQ ID NO: 792750 - DNA, 20 bp, Artificial
  CRISPR gRNA sequence
aaggttatcgagcccagcta

SEQ ID NO: 792751 - DNA, 20 bp, Artificial
  CRISPR gRNA sequence
gttatcgagcccagctacag

SEQ ID NO: 792752 - DNA, 20 bp, Artificial
  CRISPR gRNA sequence
tatcgagcccagctacagtg

SEQ ID NO: 792753 - DNA, 20 bp, Artificial
  CRISPR gRNA sequence
cgagcccagctacagtggag

SEQ ID NO: 792754 - DNA, 20 bp, Artificial
  CRISPR gRNA sequence
gagcccagctacagtggagc

SEQ ID NO: 792755 - DNA, 20 bp, Artificial
  CRISPR gRNA sequence
agcccagctacagtggagca

SEQ ID NO: 792756 - DNA, 20 bp, Artificial
  CRISPR gRNA sequence
agctacagtggagcagggtg

SEQ ID NO: 792757 - DNA, 20 bp, Artificial
  CRISPR gRNA sequence
agtggagcagggtgtggcat

SEQ ID NO: 792758 - DNA, 20 bp, Artificial
  CRISPR gRNA sequence
gtggagcagggtgtggcatg

SEQ ID NO: 792759 - DNA, 20 bp, Artificial
  CRISPR gRNA sequence
ggagcagggtgtggcatgag

SEQ ID NO: 792760 - DNA, 20 bp, Artificial
  CRISPR gRNA sequence
gagcagggtgtggcatgagg

SEQ ID NO: 792761 - DNA, 20 bp, Artificial
  CRISPR gRNA sequence
ggcatgaggaggtgatacta

SEQ ID NO: 792762 - DNA, 20 bp, Artificial
  CRISPR gRNA sequence
atactacagttgccccttta

SEQ ID NO: 792763 - DNA, 20 bp, Artificial
  CRISPR gRNA sequence
actacagttgcccctttaca

SEQ ID NO: 792764 - DNA, 20 bp, Artificial
  CRISPR gRNA sequence
aacccacgtatgcaacaatt

SEQ ID NO: 792765 - DNA, 20 bp, Artificial
  CRISPR gRNA sequence
attaagacatatgacatatt

SEQ ID NO: 792766 - DNA, 20 bp, Artificial
  CRISPR gRNA sequence
catatgacatatttggacat

SEQ ID NO: 792767 - DNA, 20 bp, Artificial
  CRISPR gRNA sequence
catatttggacattagcatg

SEQ ID NO: 792768 - DNA, 20 bp, Artificial
  CRISPR gRNA sequence
aatgacacacaacaatctac

SEQ ID NO: 792769 - DNA, 20 bp, Artificial
  CRISPR gRNA sequence
ttgctgtccaatgtattgta

SEQ ID NO: 792770 - DNA, 20 bp, Artificial
  CRISPR gRNA sequence
tgtaaagcaaataaactctg

SEQ ID NO: 792771 - DNA, 20 bp, Artificial
  CRISPR gRNA sequence
ttacacgaacatttcatttc

SEQ ID NO: 792772 - DNA, 20 bp, Artificial
  CRISPR gRNA sequence
aataaatccattcaacaatt

SEQ ID NO: 792773 - DNA, 20 bp, Artificial
  CRISPR gRNA sequence
aatccattcaacaattcggc

SEQ ID NO: 792774 - DNA, 20 bp, Artificial
  CRISPR gRNA sequence
caattcggcaagcacccact

SEQ ID NO: 792775 - DNA, 20 bp, Artificial
  CRISPR gRNA sequence
taagcacctatgtgtattgc

SEQ ID NO: 792776 - DNA, 20 bp, Artificial
  CRISPR gRNA sequence
aagcacctatgtgtattgcc

SEQ ID NO: 792777 - DNA, 20 bp, Artificial
  CRISPR gRNA sequence
tgtattgccaggtactgcac

SEQ ID NO: 792778 - DNA, 20 bp, Artificial
  CRISPR gRNA sequence
gtattgccaggtactgcact

SEQ ID NO: 792779 - DNA, 20 bp, Artificial
  CRISPR gRNA sequence
caggtactgcactaggaact

SEQ ID NO: 792780 - DNA, 20 bp, Artificial
  CRISPR gRNA sequence
aggtactgcactaggaactt

SEQ ID NO: 792781 - DNA, 20 bp, Artificial
  CRISPR gRNA sequence
tgcactaggaacttgggact

SEQ ID NO: 792782 - DNA, 20 bp, Artificial
  CRISPR gRNA sequence
cactaggaacttgggactca

SEQ ID NO: 792783 - DNA, 20 bp, Artificial
  CRISPR gRNA sequence
ttgggactcagagaacctta

SEQ ID NO: 792784 - DNA, 20 bp, Artificial
  CRISPR gRNA sequence
tgggactcagagaaccttaa

SEQ ID NO: 792785 - DNA, 20 bp, Artificial
  CRISPR gRNA sequence
aaggtgtgcttcttgcctgt

SEQ ID NO: 792786 - DNA, 20 bp, Artificial
  CRISPR gRNA sequence
aggtgtgcttcttgcctgtg

SEQ ID NO: 792787 - DNA, 20 bp, Artificial
  CRISPR gRNA sequence
gtgtgcttcttgcctgtgag

SEQ ID NO: 792788 - DNA, 20 bp, Artificial
  CRISPR gRNA sequence
ttcttgcctgtgaggagctc

SEQ ID NO: 792789 - DNA, 20 bp, Artificial
  CRISPR gRNA sequence
tgtgaggagctccagttcaa

SEQ ID NO: 792790 - DNA, 20 bp, Artificial
  CRISPR gRNA sequence
ggagctccagttcaatggaa

SEQ ID NO: 792791 - DNA, 20 bp, Artificial
  CRISPR gRNA sequence
tcaatggaaaagctcaccaa

SEQ ID NO: 792792 - DNA, 20 bp, Artificial
  CRISPR gRNA sequence
caatggaaaagctcaccaac

SEQ ID NO: 792793 - DNA, 20 bp, Artificial
  CRISPR gRNA sequence
atggaaaagctcaccaacag

SEQ ID NO: 792794 - DNA, 20 bp, Artificial
  CRISPR gRNA sequence
gctcaccaacaggagaaatc

SEQ ID NO: 792795 - DNA, 20 bp, Artificial
  CRISPR gRNA sequence
ctcaccaacaggagaaatct

SEQ ID NO: 792796 - DNA, 20 bp, Artificial
  CRISPR gRNA sequence
tcaccaacaggagaaatctg

SEQ ID NO: 792797 - DNA, 20 bp, Artificial
  CRISPR gRNA sequence
accaacaggagaaatctggg

SEQ ID NO: 792798 - DNA, 20 bp, Artificial
  CRISPR gRNA sequence
aacaggagaaatctggggag

SEQ ID NO: 792799 - DNA, 20 bp, Artificial
  CRISPR gRNA sequence
tctggggagaagacaccctg

SEQ ID NO: 792800 - DNA, 20 bp, Artificial
  CRISPR gRNA sequence
ggggagaagacaccctgaag

SEQ ID NO: 792801 - DNA, 20 bp, Artificial
  CRISPR gRNA sequence
gagaagacaccctgaagcag

SEQ ID NO: 792802 - DNA, 20 bp, Artificial
  CRISPR gRNA sequence
ccctgaagcagcagacaaca

SEQ ID NO: 792803 - DNA, 20 bp, Artificial
  CRISPR gRNA sequence
ctgaagcagcagacaacaaa

SEQ ID NO: 792804 - DNA, 20 bp, Artificial
  CRISPR gRNA sequence
gacaacaaagagcctgatga

SEQ ID NO: 792805 - DNA, 20 bp, Artificial
  CRISPR gRNA sequence
acaacaaagagcctgatgat

SEQ ID NO: 792806 - DNA, 20 bp, Artificial
  CRISPR gRNA sequence
caacaaagagcctgatgatg

SEQ ID NO: 792807 - DNA, 20 bp, Artificial
  CRISPR gRNA sequence
acaaagagcctgatgatggg

SEQ ID NO: 792808 - DNA, 20 bp, Artificial
  CRISPR gRNA sequence
tggggagacctcaaataatg

SEQ ID NO: 792809 - DNA, 20 bp, Artificial
  CRISPR gRNA sequence
ggggagacctcaaataatga

SEQ ID NO: 792810 - DNA, 20 bp, Artificial
  CRISPR gRNA sequence
cctcaaataatgaaggcaaa

SEQ ID NO: 792811 - DNA, 20 bp, Artificial
  CRISPR gRNA sequence
aataatgaaggcaaatagat

SEQ ID NO: 792812 - DNA, 20 bp, Artificial
  CRISPR gRNA sequence
ataatgaaggcaaatagatc

SEQ ID NO: 792813 - DNA, 20 bp, Artificial
  CRISPR gRNA sequence
aaggcaaatagatcaggttc

SEQ ID NO: 792814 - DNA, 20 bp, Artificial
  CRISPR gRNA sequence
gcaaatagatcaggttccag

SEQ ID NO: 792815 - DNA, 20 bp, Artificial
  CRISPR gRNA sequence
atagatcaggttccagtggc

SEQ ID NO: 792816 - DNA, 20 bp, Artificial
  CRISPR gRNA sequence
agatcaggttccagtggcaa

SEQ ID NO: 792817 - DNA, 20 bp, Artificial
  CRISPR gRNA sequence
tcaggttccagtggcaagag

SEQ ID NO: 792818 - DNA, 20 bp, Artificial
  CRISPR gRNA sequence
ggttccagtggcaagagcag

SEQ ID NO: 792819 - DNA, 20 bp, Artificial
  CRISPR gRNA sequence
gttccagtggcaagagcagc

SEQ ID NO: 792820 - DNA, 20 bp, Artificial
  CRISPR gRNA sequence
agtggcaagagcagcaggac

SEQ ID NO: 792821 - DNA, 20 bp, Artificial
  CRISPR gRNA sequence
gtggcaagagcagcaggacc

SEQ ID NO: 792822 - DNA, 20 bp, Artificial
  CRISPR gRNA sequence
caggattgttcatccactca

SEQ ID NO: 792823 - DNA, 20 bp, Artificial
  CRISPR gRNA sequence
ttcatccactcacagaatct

SEQ ID NO: 792824 - DNA, 20 bp, Artificial
  CRISPR gRNA sequence
tcatccactcacagaatctt

SEQ ID NO: 792825 - DNA, 20 bp, Artificial
  CRISPR gRNA sequence
cactcacagaatcttaggct

SEQ ID NO: 792826 - DNA, 20 bp, Artificial
  CRISPR gRNA sequence
cacagaatcttaggcttgga

SEQ ID NO: 792827 - DNA, 20 bp, Artificial
  CRISPR gRNA sequence
acagaatcttaggcttggaa

SEQ ID NO: 792828 - DNA, 20 bp, Artificial
  CRISPR gRNA sequence
agaatcttaggcttggaaag

SEQ ID NO: 792829 - DNA, 20 bp, Artificial
  CRISPR gRNA sequence
cttaggcttggaaaggagct

SEQ ID NO: 792830 - DNA, 20 bp, Artificial
  CRISPR gRNA sequence
taggcttggaaaggagcttg

SEQ ID NO: 792831 - DNA, 20 bp, Artificial
  CRISPR gRNA sequence
aggcttggaaaggagcttgg

SEQ ID NO: 792832 - DNA, 20 bp, Artificial
  CRISPR gRNA sequence
aaaggagcttggaggacatc

SEQ ID NO: 792833 - DNA, 20 bp, Artificial
  CRISPR gRNA sequence
aaggagcttggaggacatcc

SEQ ID NO: 792834 - DNA, 20 bp, Artificial
  CRISPR gRNA sequence
tactctgcattttgtcaatt

SEQ ID NO: 792835 - DNA, 20 bp, Artificial
  CRISPR gRNA sequence
actctgcattttgtcaattt

SEQ ID NO: 792836 - DNA, 20 bp, Artificial
  CRISPR gRNA sequence
gtctctcattccctgcccct

SEQ ID NO: 792837 - DNA, 20 bp, Artificial
  CRISPR gRNA sequence
ctctcattccctgcccctca

SEQ ID NO: 792838 - DNA, 20 bp, Artificial
  CRISPR gRNA sequence
ttccctgcccctcagagcca

SEQ ID NO: 792839 - DNA, 20 bp, Artificial
  CRISPR gRNA sequence
cctcagagccatagtatttt

SEQ ID NO: 792840 - DNA, 20 bp, Artificial
  CRISPR gRNA sequence
ctcagagccatagtattttt

SEQ ID NO: 792841 - DNA, 20 bp, Artificial
  CRISPR gRNA sequence
ccatagtatttttgggttaa

SEQ ID NO: 792842 - DNA, 20 bp, Artificial
  CRISPR gRNA sequence
tttgggttaaaagtcctgat

SEQ ID NO: 792843 - DNA, 20 bp, Artificial
  CRISPR gRNA sequence
ggttaaaagtcctgattagt

SEQ ID NO: 792844 - DNA, 20 bp, Artificial
  CRISPR gRNA sequence
gattagttggtaatctcact

SEQ ID NO: 792845 - DNA, 20 bp, Artificial
  CRISPR gRNA sequence
attagttggtaatctcactc

SEQ ID NO: 792846 - DNA, 20 bp, Artificial
  CRISPR gRNA sequence
ttggtaatctcactcaggct

SEQ ID NO: 792847 - DNA, 20 bp, Artificial
  CRISPR gRNA sequence
attgcctttgctcttctact

SEQ ID NO: 792848 - DNA, 20 bp, Artificial
  CRISPR gRNA sequence
gctcttctactcagtgcatc

SEQ ID NO: 792849 - DNA, 20 bp, Artificial
  CRISPR gRNA sequence
ctcttctactcagtgcatcc

SEQ ID NO: 792850 - DNA, 20 bp, Artificial
  CRISPR gRNA sequence
ttctactcagtgcatccagg

SEQ ID NO: 792851 - DNA, 20 bp, Artificial
  CRISPR gRNA sequence
actcagtgcatccaggcggt

SEQ ID NO: 792852 - DNA, 20 bp, Artificial
  CRISPR gRNA sequence
tccaggcggtgagcaatcaa

SEQ ID NO: 792853 - DNA, 20 bp, Artificial
  CRISPR gRNA sequence
gcaatcaatagcaattattt

SEQ ID NO: 792854 - DNA, 20 bp, Artificial
  CRISPR gRNA sequence
ttttcgctgatcattttata

SEQ ID NO: 792855 - DNA, 20 bp, Artificial
  CRISPR gRNA sequence
cgctgatcattttatatgga

SEQ ID NO: 792856 - DNA, 20 bp, Artificial
  CRISPR gRNA sequence
tcattttatatggaaagaat

SEQ ID NO: 792857 - DNA, 20 bp, Artificial
  CRISPR gRNA sequence
ggaaagaataagcctttcca

SEQ ID NO: 792858 - DNA, 20 bp, Artificial
  CRISPR gRNA sequence
tcaataatgattacctctat

SEQ ID NO: 792859 - DNA, 20 bp, Artificial
  CRISPR gRNA sequence
gattacctctataagttatt

SEQ ID NO: 792860 - DNA, 20 bp, Artificial
  CRISPR gRNA sequence
tctataagttattaagataa

SEQ ID NO: 792861 - DNA, 20 bp, Artificial
  CRISPR gRNA sequence
agttattaagataatagttt

SEQ ID NO: 792862 - DNA, 20 bp, Artificial
  CRISPR gRNA sequence
gttattaagataatagtttt

SEQ ID NO: 792863 - DNA, 20 bp, Artificial
  CRISPR gRNA sequence
ttttgttccccctccaccaa

SEQ ID NO: 792864 - DNA, 20 bp, Artificial
  CRISPR gRNA sequence
ctccaccaacagctgcctct

SEQ ID NO: 792865 - DNA, 20 bp, Artificial
  CRISPR gRNA sequence
tccaccaacagctgcctctt

SEQ ID NO: 792866 - DNA, 20 bp, Artificial
  CRISPR gRNA sequence
caacagctgcctcttaggca

SEQ ID NO: 792867 - DNA, 20 bp, Artificial
  CRISPR gRNA sequence
ttaggcatagcttgtaaaca

SEQ ID NO: 792868 - DNA, 20 bp, Artificial
  CRISPR gRNA sequence
taggcatagcttgtaaacaa

SEQ ID NO: 792869 - DNA, 20 bp, Artificial
  CRISPR gRNA sequence
catagcttgtaaacaaaggc

SEQ ID NO: 792870 - DNA, 20 bp, Artificial
  CRISPR gRNA sequence
cttgtaaacaaaggccagcc

SEQ ID NO: 792871 - DNA, 20 bp, Artificial
  CRISPR gRNA sequence
tgtaaacaaaggccagcctg

SEQ ID NO: 792872 - DNA, 20 bp, Artificial
  CRISPR gRNA sequence
gtaaacaaaggccagcctgg

SEQ ID NO: 792873 - DNA, 20 bp, Artificial
  CRISPR gRNA sequence
taaacaaaggccagcctgga

SEQ ID NO: 792874 - DNA, 20 bp, Artificial
  CRISPR gRNA sequence
agggatcaccgtctgctaaa

SEQ ID NO: 792875 - DNA, 20 bp, Artificial
  CRISPR gRNA sequence
gctaaatggataatcacaaa

SEQ ID NO: 792876 - DNA, 20 bp, Artificial
  CRISPR gRNA sequence
ggataatcacaaacagatgt

SEQ ID NO: 792877 - DNA, 20 bp, Artificial
  CRISPR gRNA sequence
tcacaaacagatgtcagtca

SEQ ID NO: 792878 - DNA, 20 bp, Artificial
  CRISPR gRNA sequence
cacaaacagatgtcagtcat

SEQ ID NO: 792879 - DNA, 20 bp, Artificial
  CRISPR gRNA sequence
agatgtcagtcataggaaaa

SEQ ID NO: 792880 - DNA, 20 bp, Artificial
  CRISPR gRNA sequence
tcataggaaaacagattttt

SEQ ID NO: 792881 - DNA, 20 bp, Artificial
  CRISPR gRNA sequence
tttttaagttcttcaccatt

SEQ ID NO: 792882 - DNA, 20 bp, Artificial
  CRISPR gRNA sequence
attaagcctccgaaaactct

SEQ ID NO: 792883 - DNA, 20 bp, Artificial
  CRISPR gRNA sequence
gcctccgaaaactctaagct

SEQ ID NO: 792884 - DNA, 20 bp, Artificial
  CRISPR gRNA sequence
ctccgaaaactctaagctga

SEQ ID NO: 792885 - DNA, 20 bp, Artificial
  CRISPR gRNA sequence
ctaagctgagagacaatctt

SEQ ID NO: 792886 - DNA, 20 bp, Artificial
  CRISPR gRNA sequence
ctgagagacaatcttaagaa

SEQ ID NO: 792887 - DNA, 20 bp, Artificial
  CRISPR gRNA sequence
agaatagttatattatttta

SEQ ID NO: 792888 - DNA, 20 bp, Artificial
  CRISPR gRNA sequence
tattttacagtgcacatatt

SEQ ID NO: 792889 - DNA, 20 bp, Artificial
  CRISPR gRNA sequence
tacagtgcacatatttggtg

SEQ ID NO: 792890 - DNA, 20 bp, Artificial
  CRISPR gRNA sequence
atatctcaccttataaaact

SEQ ID NO: 792891 - DNA, 20 bp, Artificial
  CRISPR gRNA sequence
accttataaaactgagcaac

SEQ ID NO: 792892 - DNA, 20 bp, Artificial
  CRISPR gRNA sequence
agcaacaagaacaatatgca

SEQ ID NO: 792893 - DNA, 20 bp, Artificial
  CRISPR gRNA sequence
gcaacaagaacaatatgcat

SEQ ID NO: 792894 - DNA, 20 bp, Artificial
  CRISPR gRNA sequence
agaacaatatgcataggaac

SEQ ID NO: 792895 - DNA, 20 bp, Artificial
  CRISPR gRNA sequence
caatatgcataggaacaagt

SEQ ID NO: 792896 - DNA, 20 bp, Artificial
  CRISPR gRNA sequence
atatgcataggaacaagtga

SEQ ID NO: 792897 - DNA, 20 bp, Artificial
  CRISPR gRNA sequence
aggaacaagtgagagaaatc

SEQ ID NO: 792898 - DNA, 20 bp, Artificial
  CRISPR gRNA sequence
ggaacaagtgagagaaatct

SEQ ID NO: 792899 - DNA, 20 bp, Artificial
  CRISPR gRNA sequence
gaacaagtgagagaaatctg

SEQ ID NO: 792900 - DNA, 20 bp, Artificial
  CRISPR gRNA sequence
caagtgagagaaatctgggg

SEQ ID NO: 792901 - DNA, 20 bp, Artificial
  CRISPR gRNA sequence
aagtgagagaaatctggggc

SEQ ID NO: 792902 - DNA, 20 bp, Artificial
  CRISPR gRNA sequence
gtgagagaaatctggggcag

SEQ ID NO: 792903 - DNA, 20 bp, Artificial
  CRISPR gRNA sequence
tgagagaaatctggggcagg

SEQ ID NO: 792904 - DNA, 20 bp, Artificial
  CRISPR gRNA sequence
aatctggggcaggaggacat

SEQ ID NO: 792905 - DNA, 20 bp, Artificial
  CRISPR gRNA sequence
attagcttatttgtgcccct

SEQ ID NO: 792906 - DNA, 20 bp, Artificial
  CRISPR gRNA sequence
tgcccctcagcacaatttct

SEQ ID NO: 792907 - DNA, 20 bp, Artificial
  CRISPR gRNA sequence
gcccctcagcacaatttctg

SEQ ID NO: 792908 - DNA, 20 bp, Artificial
  CRISPR gRNA sequence
cctcagcacaatttctgagg

SEQ ID NO: 792909 - DNA, 20 bp, Artificial
  CRISPR gRNA sequence
agaatgtctcttgcctcaaa

SEQ ID NO: 792910 - DNA, 20 bp, Artificial
  CRISPR gRNA sequence
gtctcttgcctcaaatggtg

SEQ ID NO: 792911 - DNA, 20 bp, Artificial
  CRISPR gRNA sequence
ctcttgcctcaaatggtgtg

SEQ ID NO: 792912 - DNA, 20 bp, Artificial
  CRISPR gRNA sequence
cttgcctcaaatggtgtgga

SEQ ID NO: 792913 - DNA, 20 bp, Artificial
  CRISPR gRNA sequence
gcctcaaatggtgtggagag

SEQ ID NO: 792914 - DNA, 20 bp, Artificial
  CRISPR gRNA sequence
cctcaaatggtgtggagaga

SEQ ID NO: 792915 - DNA, 20 bp, Artificial
  CRISPR gRNA sequence
caaatggtgtggagagaagg

SEQ ID NO: 792916 - DNA, 20 bp, Artificial
  CRISPR gRNA sequence
aaatggtgtggagagaaggt

SEQ ID NO: 792917 - DNA, 20 bp, Artificial
  CRISPR gRNA sequence
aggccacccttcccccaccc

SEQ ID NO: 792918 - DNA, 20 bp, Artificial
  CRISPR gRNA sequence
ccacccttcccccaccctgg

SEQ ID NO: 792919 - DNA, 20 bp, Artificial
  CRISPR gRNA sequence
ccaccctggcagcctcatca

SEQ ID NO: 792920 - DNA, 20 bp, Artificial
  CRISPR gRNA sequence
catcatggtccacaacataa

SEQ ID NO: 792921 - DNA, 20 bp, Artificial
  CRISPR gRNA sequence
ggtccacaacataatagtat

SEQ ID NO: 792922 - DNA, 20 bp, Artificial
  CRISPR gRNA sequence
tccacaacataatagtatga

SEQ ID NO: 792923 - DNA, 20 bp, Artificial
  CRISPR gRNA sequence
aacccactcgttactcacat

SEQ ID NO: 792924 - DNA, 20 bp, Artificial
  CRISPR gRNA sequence
acccactcgttactcacatg

SEQ ID NO: 792925 - DNA, 20 bp, Artificial
  CRISPR gRNA sequence
actcacatgaggacttgcca

SEQ ID NO: 792926 - DNA, 20 bp, Artificial
  CRISPR gRNA sequence
aggacttgccacagctccac

SEQ ID NO: 792927 - DNA, 20 bp, Artificial
  CRISPR gRNA sequence
ttgccacagctccacaagta

SEQ ID NO: 792928 - DNA, 20 bp, Artificial
  CRISPR gRNA sequence
ctccacaagtaaagatgcaa

SEQ ID NO: 792929 - DNA, 20 bp, Artificial
  CRISPR gRNA sequence
caaaagtaaacaacaaaaaa

SEQ ID NO: 792930 - DNA, 20 bp, Artificial
  CRISPR gRNA sequence
aaaacagttgctgtttgtgt

SEQ ID NO: 792931 - DNA, 20 bp, Artificial
  CRISPR gRNA sequence
gtttgtgttagatttcctta

SEQ ID NO: 792932 - DNA, 20 bp, Artificial
  CRISPR gRNA sequence
tgtgttagatttccttatag

SEQ ID NO: 792933 - DNA, 20 bp, Artificial
  CRISPR gRNA sequence
atagtagccaccaaaatgaa

SEQ ID NO: 792934 - DNA, 20 bp, Artificial
  CRISPR gRNA sequence
ccaccaaaatgaacagccaa

SEQ ID NO: 792935 - DNA, 20 bp, Artificial
  CRISPR gRNA sequence
caccaaaatgaacagccaaa

SEQ ID NO: 792936 - DNA, 20 bp, Artificial
  CRISPR gRNA sequence
aaaacaaaacaatcaacatg

SEQ ID NO: 792937 - DNA, 20 bp, Artificial
  CRISPR gRNA sequence
acaaaacaatcaacatgcag

SEQ ID NO: 792938 - DNA, 20 bp, Artificial
  CRISPR gRNA sequence
aacatgcagtagctccaacc

SEQ ID NO: 792939 - DNA, 20 bp, Artificial
  CRISPR gRNA sequence
acatgcagtagctccaaccc

SEQ ID NO: 792940 - DNA, 20 bp, Artificial
  CRISPR gRNA sequence
ctccaacccaggattctttc

SEQ ID NO: 792941 - DNA, 20 bp, Artificial
  CRISPR gRNA sequence
aacccaggattctttctagc

SEQ ID NO: 792942 - DNA, 20 bp, Artificial
  CRISPR gRNA sequence
acccaggattctttctagct

SEQ ID NO: 792943 - DNA, 20 bp, Artificial
  CRISPR gRNA sequence
tctttctagctgggacatat

SEQ ID NO: 792944 - DNA, 20 bp, Artificial
  CRISPR gRNA sequence
ctttctagctgggacatatg

SEQ ID NO: 792945 - DNA, 20 bp, Artificial
  CRISPR gRNA sequence
ctagctgggacatatgagga

SEQ ID NO: 792946 - DNA, 20 bp, Artificial
  CRISPR gRNA sequence
tagctgggacatatgaggat

SEQ ID NO: 792947 - DNA, 20 bp, Artificial
  CRISPR gRNA sequence
tatgaggatgggtaacaaaa

SEQ ID NO: 792948 - DNA, 20 bp, Artificial
  CRISPR gRNA sequence
acaaaaaagcactcaaaatt

SEQ ID NO: 792949 - DNA, 20 bp, Artificial
  CRISPR gRNA sequence
agcactcaaaatttggcgtt

SEQ ID NO: 792950 - DNA, 20 bp, Artificial
  CRISPR gRNA sequence
tttggcgttaagatatattc

SEQ ID NO: 792951 - DNA, 20 bp, Artificial
  CRISPR gRNA sequence
tggcgttaagatatattcaa

SEQ ID NO: 792952 - DNA, 20 bp, Artificial
  CRISPR gRNA sequence
cgttaagatatattcaagag

SEQ ID NO: 792953 - DNA, 20 bp, Artificial
  CRISPR gRNA sequence
agatatattcaagagaagaa

SEQ ID NO: 792954 - DNA, 20 bp, Artificial
  CRISPR gRNA sequence
gagaagaaaagttgttcatt

SEQ ID NO: 792955 - DNA, 20 bp, Artificial
  CRISPR gRNA sequence
aaaagttgttcattcagctt

SEQ ID NO: 792956 - DNA, 20 bp, Artificial
  CRISPR gRNA sequence
aaagttgttcattcagctta

SEQ ID NO: 792957 - DNA, 20 bp, Artificial
  CRISPR gRNA sequence
cttaaggtttgccgtaacat

SEQ ID NO: 792958 - DNA, 20 bp, Artificial
  CRISPR gRNA sequence
taaggtttgccgtaacatga

SEQ ID NO: 792959 - DNA, 20 bp, Artificial
  CRISPR gRNA sequence
gtttgccgtaacatgagagt

SEQ ID NO: 792960 - DNA, 20 bp, Artificial
  CRISPR gRNA sequence
aacatgagagtgagtcaaac

SEQ ID NO: 792961 - DNA, 20 bp, Artificial
  CRISPR gRNA sequence
agagtgagtcaaaccagaac

SEQ ID NO: 792962 - DNA, 20 bp, Artificial
  CRISPR gRNA sequence
gtcaaaccagaactagttct

SEQ ID NO: 792963 - DNA, 20 bp, Artificial
  CRISPR gRNA sequence
tcaaaccagaactagttctg

SEQ ID NO: 792964 - DNA, 20 bp, Artificial
  CRISPR gRNA sequence
tagttctgaggaactgacga

SEQ ID NO: 792965 - DNA, 20 bp, Artificial
  CRISPR gRNA sequence
ctgaggaactgacgaaagcc

SEQ ID NO: 792966 - DNA, 20 bp, Artificial
  CRISPR gRNA sequence
tgacgaaagcctggcttatt

SEQ ID NO: 792967 - DNA, 20 bp, Artificial
  CRISPR gRNA sequence
gaaagcctggcttatttgga

SEQ ID NO: 792968 - DNA, 20 bp, Artificial
  CRISPR gRNA sequence
ctggcttatttggaaagttt

SEQ ID NO: 792969 - DNA, 20 bp, Artificial
  CRISPR gRNA sequence
gaaagttttggttttgcttt

SEQ ID NO: 792970 - DNA, 20 bp, Artificial
  CRISPR gRNA sequence
agttttggttttgcttttag

SEQ ID NO: 792971 - DNA, 20 bp, Artificial
  CRISPR gRNA sequence
atgttacggcaaaccttaag

SEQ ID NO: 792972 - DNA, 20 bp, Artificial
  CRISPR gRNA sequence
aatgaacaacttttcttctc

SEQ ID NO: 792973 - DNA, 20 bp, Artificial
  CRISPR gRNA sequence
atatatcttaacgccaaatt

SEQ ID NO: 792974 - DNA, 20 bp, Artificial
  CRISPR gRNA sequence
cctcatatgtcccagctaga

SEQ ID NO: 792975 - DNA, 20 bp, Artificial
  CRISPR gRNA sequence
tgtcccagctagaaagaatc

SEQ ID NO: 792976 - DNA, 20 bp, Artificial
  CRISPR gRNA sequence
gagctgtggcaagtcctcat

SEQ ID NO: 792977 - DNA, 20 bp, Artificial
  CRISPR gRNA sequence
ggcaagtcctcatgtgagta

SEQ ID NO: 792978 - DNA, 20 bp, Artificial
  CRISPR gRNA sequence
agtcctcatgtgagtaacga

SEQ ID NO: 792979 - DNA, 20 bp, Artificial
  CRISPR gRNA sequence
gtggaccatgatgaggctgc

SEQ ID NO: 792980 - DNA, 20 bp, Artificial
  CRISPR gRNA sequence
tgaggctgccagggtggggg

SEQ ID NO: 792981 - DNA, 20 bp, Artificial
  CRISPR gRNA sequence
cttaagattgtctctcagct

SEQ ID NO: 792982 - DNA, 20 bp, Artificial
  CRISPR gRNA sequence
tgctattgattgctcaccgc

SEQ ID NO: 792983 - DNA, 20 bp, Artificial
  CRISPR gRNA sequence
ttgctcaccgcctggatgca

SEQ ID NO: 792984 - DNA, 20 bp, Artificial
  CRISPR gRNA sequence
tgagtagaagagcaaaggca

SEQ ID NO: 792985 - DNA, 20 bp, Artificial
  CRISPR gRNA sequence
aggcaatgggttcatgtgga

SEQ ID NO: 792986 - DNA, 20 bp, Artificial
  CRISPR gRNA sequence
tggaggtggagaggctaagc

SEQ ID NO: 792987 - DNA, 20 bp, Artificial
  CRISPR gRNA sequence
tactatggctctgaggggca

SEQ ID NO: 792988 - DNA, 20 bp, Artificial
  CRISPR gRNA sequence
agacctaaattgacaaaatg

SEQ ID NO: 792989 - DNA, 20 bp, Artificial
  CRISPR gRNA sequence
cagtaatgagacagttgtat

SEQ ID NO: 792990 - DNA, 20 bp, Artificial
  CRISPR gRNA sequence
agttgtatcagggtcaaata

SEQ ID NO: 792991 - DNA, 20 bp, Artificial
  CRISPR gRNA sequence
gggtcaaatacggagttggc

SEQ ID NO: 792992 - DNA, 20 bp, Artificial
  CRISPR gRNA sequence
ctttccaagcctaagattct

SEQ ID NO: 792993 - DNA, 20 bp, Artificial
  CRISPR gRNA sequence
ccaagcctaagattctgtga

SEQ ID NO: 792994 - DNA, 20 bp, Artificial
  CRISPR gRNA sequence
ctctttgttgtctgctgctt

SEQ ID NO: 792995 - DNA, 20 bp, Artificial
  CRISPR gRNA sequence
aagcacacctttaaggttct

SEQ ID NO: 792996 - DNA, 20 bp, Artificial
  CRISPR gRNA sequence
gcaatacacataggtgctta

SEQ ID NO: 792997 - DNA, 20 bp, Artificial
  CRISPR gRNA sequence
aggtgcttagtgggtgcttg

SEQ ID NO: 792998 - DNA, 20 bp, Artificial
  CRISPR gRNA sequence
agtgggtgcttgccgaattg

SEQ ID NO: 792999 - DNA, 20 bp, Artificial
  CRISPR gRNA sequence
ggtgcttgccgaattgttga

SEQ ID NO: 793000 - DNA, 20 bp, Artificial
  CRISPR gRNA sequence
tttatttgatgaaatgtcag

SEQ ID NO: 793001 - DNA, 20 bp, Artificial
  CRISPR gRNA sequence
gagatggtagagacagtatt

SEQ ID NO: 793002 - DNA, 20 bp, Artificial
  CRISPR gRNA sequence
cagtattatgggtcatgctt

SEQ ID NO: 793003 - DNA, 20 bp, Artificial
  CRISPR gRNA sequence
atgtcttaattgttgcatac

SEQ ID NO: 793004 - DNA, 20 bp, Artificial
  CRISPR gRNA sequence
ataaccttcaaatcaactca

SEQ ID NO: 793005 - DNA, 20 bp, Artificial
  CRISPR gRNA sequence
gatgaactgcccctgctttg

SEQ ID NO: 793006 - DNA, 20 bp, Artificial
  CRISPR gRNA sequence
ctccaaattttgggacgttc

SEQ ID NO: 793007 - DNA, 20 bp, Artificial
  CRISPR gRNA sequence
actctggacctacaattttt

SEQ ID NO: 793008 - DNA, 20 bp, Artificial
  CRISPR gRNA sequence
ccttgttaccaaacatctag

SEQ ID NO: 793009 - DNA, 20 bp, Artificial
  CRISPR gRNA sequence
ttggtattgtcacttagttt

SEQ ID NO: 793010 - DNA, 20 bp, Artificial
  CRISPR gRNA sequence
ttgcacctctgagactgctt

SEQ ID NO: 793011 - DNA, 20 bp, Artificial
  CRISPR gRNA sequence
gtcagctatgcactgccctt

SEQ ID NO: 793012 - DNA, 20 bp, Artificial
  CRISPR gRNA sequence
ttttactatttttcatgtgt

SEQ ID NO: 793013 - DNA, 20 bp, Artificial
  CRISPR gRNA sequence
tttcttagaggaaaccctct

SEQ ID NO: 793014 - DNA, 20 bp, Artificial
  CRISPR gRNA sequence
ctccaatgataaattattct

SEQ ID NO: 793015 - DNA, 20 bp, Artificial
  CRISPR gRNA sequence
aacttaaatgctctattaaa

SEQ ID NO: 793016 - DNA, 20 bp, Artificial
  CRISPR gRNA sequence
aaatgctctattaaattgag

SEQ ID NO: 793017 - DNA, 20 bp, Artificial
  CRISPR gRNA sequence
tactcatatacctatgacag

SEQ ID NO: 793018 - DNA, 20 bp, Artificial
  CRISPR gRNA sequence
ccccaaaactcaaataccta

SEQ ID NO: 793019 - DNA, 20 bp, Artificial
  CRISPR gRNA sequence
ttgtcaggcaacaaaaataa

SEQ ID NO: 793020 - DNA, 20 bp, Artificial
  CRISPR gRNA sequence
gttcaggtatttcagatcaa

SEQ ID NO: 793021 - DNA, 20 bp, Artificial
  CRISPR gRNA sequence
atgcatttatctaggtcttc

SEQ ID NO: 793022 - DNA, 20 bp, Artificial
  CRISPR gRNA sequence
tgggagagggaagaggcaaa

SEQ ID NO: 793023 - DNA, 20 bp, Artificial
  CRISPR gRNA sequence
aagactggcagtatttaaca

SEQ ID NO: 793024 - DNA, 20 bp, Artificial
  CRISPR gRNA sequence
ggctggttattgttacacaa

SEQ ID NO: 793025 - DNA, 20 bp, Artificial
  CRISPR gRNA sequence
tacacaaaggaatgatttgc

SEQ ID NO: 793026 - DNA, 20 bp, Artificial
  CRISPR gRNA sequence
ggattcttgagatacttcca

SEQ ID NO: 793027 - DNA, 20 bp, Artificial
  CRISPR gRNA sequence
ctcacttattgcacagacca

SEQ ID NO: 793028 - DNA, 20 bp, Artificial
  CRISPR gRNA sequence
gtaaataccaagtaaatgtt

SEQ ID NO: 793029 - DNA, 20 bp, Artificial
  CRISPR gRNA sequence
tctgtttacgaacttatcct

SEQ ID NO: 793030 - DNA, 20 bp, Artificial
  CRISPR gRNA sequence
gatacaacttcctaatgcaa

SEQ ID NO: 793031 - DNA, 20 bp, Artificial
  CRISPR gRNA sequence
acttcttatgtagaaataag

SEQ ID NO: 793032 - DNA, 20 bp, Artificial
  CRISPR gRNA sequence
tacttgggaggctggggcag

SEQ ID NO: 793033 - DNA, 20 bp, Artificial
  CRISPR gRNA sequence
gcaggaggatcacttgaagc

SEQ ID NO: 793034 - DNA, 20 bp, Artificial
  CRISPR gRNA sequence
gccagagtttgcttgaggcc

SEQ ID NO: 793035 - DNA, 20 bp, Artificial
  CRISPR gRNA sequence
agtgctctatgatcacacct

SEQ ID NO: 793036 - DNA, 20 bp, Artificial
  CRISPR gRNA sequence
actacactccaggctaggca

SEQ ID NO: 793037 - DNA, 20 bp, Artificial
  CRISPR gRNA sequence
aagacaaaataagatcaaaa

SEQ ID NO: 793038 - DNA, 20 bp, Artificial
  CRISPR gRNA sequence
tttgcttgggaagctcaggg

SEQ ID NO: 793039 - DNA, 20 bp, Artificial
  CRISPR gRNA sequence
gatttatgaaggaggtagcc

SEQ ID NO: 793040 - DNA, 20 bp, Artificial
  CRISPR gRNA sequence
tatgaaggaggtagccctga

SEQ ID NO: 793041 - DNA, 20 bp, Artificial
  CRISPR gRNA sequence
ccctgagtgagtcttaaaaa

SEQ ID NO: 793042 - DNA, 20 bp, Artificial
  CRISPR gRNA sequence
atcttagtgaagttagtgag

SEQ ID NO: 793043 - DNA, 20 bp, Artificial
  CRISPR gRNA sequence
agtgagaggagtggtcatat

SEQ ID NO: 793044 - DNA, 20 bp, Artificial
  CRISPR gRNA sequence
agtggtcatataggaattca

SEQ ID NO: 793045 - DNA, 20 bp, Artificial
  CRISPR gRNA sequence
cctcataagtgataatgacg

SEQ ID NO: 793046 - DNA, 20 bp, Artificial
  CRISPR gRNA sequence
tgataatgacgatgaatgtg

SEQ ID NO: 793047 - DNA, 20 bp, Artificial
  CRISPR gRNA sequence
ccaataacattaagatgaaa

SEQ ID NO: 793048 - DNA, 20 bp, Artificial
  CRISPR gRNA sequence
aacatatttagaaaacacaa

SEQ ID NO: 793049 - DNA, 20 bp, Artificial
  CRISPR gRNA sequence
agtccaccattcggcaggtc

SEQ ID NO: 793050 - DNA, 20 bp, Artificial
  CRISPR gRNA sequence
atgaggtatgtggacaactg

SEQ ID NO: 793051 - DNA, 20 bp, Artificial
  CRISPR gRNA sequence
caaggcggagaggagcttcg

SEQ ID NO: 793052 - DNA, 20 bp, Artificial
  CRISPR gRNA sequence
cagctttcaggagacccaaa

SEQ ID NO: 793053 - DNA, 20 bp, Artificial
  CRISPR gRNA sequence
cacttttccataggcaggaa

SEQ ID NO: 793054 - DNA, 20 bp, Artificial
  CRISPR gRNA sequence
cagcagagaggagacccaca

SEQ ID NO: 793055 - DNA, 20 bp, Artificial
  CRISPR gRNA sequence
cagcactttgggaggccgag

SEQ ID NO: 793056 - DNA, 20 bp, Artificial
  CRISPR gRNA sequence
actttgggaggccgaggcgg

SEQ ID NO: 793057 - DNA, 20 bp, Artificial
  CRISPR gRNA sequence
aggcgggtggatcacgaggt

SEQ ID NO: 793058 - DNA, 20 bp, Artificial
  CRISPR gRNA sequence
tactcaggaggctgaggcag

SEQ ID NO: 793059 - DNA, 20 bp, Artificial
  CRISPR gRNA sequence
tcacttgaacccgggaggcg

SEQ ID NO: 793060 - DNA, 20 bp, Artificial
  CRISPR gRNA sequence
tcacaccactgcactccagc

SEQ ID NO: 793061 - DNA, 20 bp, Artificial
  CRISPR gRNA sequence
caatgtctgttcaagtctgg

SEQ ID NO: 793062 - DNA, 20 bp, Artificial
  CRISPR gRNA sequence
tgttcaagtctggctgagtc

SEQ ID NO: 793063 - DNA, 20 bp, Artificial
  CRISPR gRNA sequence
tttgttttgtttttttgaga

SEQ ID NO: 793064 - DNA, 20 bp, Artificial
  CRISPR gRNA sequence
tctcactctgtcaccagggc

SEQ ID NO: 793065 - DNA, 20 bp, Artificial
  CRISPR gRNA sequence
ctcactgcaacctctgcctc

SEQ ID NO: 793066 - DNA, 20 bp, Artificial
  CRISPR gRNA sequence
gattctcctgcttcagcctc

SEQ ID NO: 793067 - DNA, 20 bp, Artificial
  CRISPR gRNA sequence
ttttgtatttttagtagaga

SEQ ID NO: 793068 - DNA, 20 bp, Artificial
  CRISPR gRNA sequence
tgcctcggcctcccaagtgc

SEQ ID NO: 793069 - DNA, 20 bp, Artificial
  CRISPR gRNA sequence
gcatgagccactgagcccgg

SEQ ID NO: 793070 - DNA, 20 bp, Artificial
  CRISPR gRNA sequence
ccactgagcccggtcgagtc

SEQ ID NO: 793071 - DNA, 20 bp, Artificial
  CRISPR gRNA sequence
ttacaggctcagaagggagg

SEQ ID NO: 793072 - DNA, 20 bp, Artificial
  CRISPR gRNA sequence
ggccatccctggcttgaagg

SEQ ID NO: 793073 - DNA, 20 bp, Artificial
  CRISPR gRNA sequence
tgcccaggctgttcgtgccg

SEQ ID NO: 793074 - DNA, 20 bp, Artificial
  CRISPR gRNA sequence
ctgagcacccacatgcctgg

SEQ ID NO: 793075 - DNA, 20 bp, Artificial
  CRISPR gRNA sequence
ttcacccagtagcaggtgcc

SEQ ID NO: 793076 - DNA, 20 bp, Artificial
  CRISPR gRNA sequence
ccaggagtgggaagaggcca

SEQ ID NO: 793077 - DNA, 20 bp, Artificial
  CRISPR gRNA sequence
aggggacttcctgggcccct

SEQ ID NO: 793078 - DNA, 20 bp, Artificial
  CRISPR gRNA sequence
ccctgagagtacagagatgc

SEQ ID NO: 793079 - DNA, 20 bp, Artificial
  CRISPR gRNA sequence
agccactgctgggcagctac

SEQ ID NO: 793080 - DNA, 20 bp, Artificial
  CRISPR gRNA sequence
ttgggggagaaaagatgact

SEQ ID NO: 793081 - DNA, 20 bp, Artificial
  CRISPR gRNA sequence
aaagatgactaaggattgtt

SEQ ID NO: 793082 - DNA, 20 bp, Artificial
  CRISPR gRNA sequence
ctaaggattgttgggaatgc

SEQ ID NO: 793083 - DNA, 20 bp, Artificial
  CRISPR gRNA sequence
gattgttgggaatgctgggg

SEQ ID NO: 793084 - DNA, 20 bp, Artificial
  CRISPR gRNA sequence
tgggaatgctggggtagggt

SEQ ID NO: 793085 - DNA, 20 bp, Artificial
  CRISPR gRNA sequence
agaaaaaacaatgaaagtgt

SEQ ID NO: 793086 - DNA, 20 bp, Artificial
  CRISPR gRNA sequence
tggcagcaaggtcttccctt

SEQ ID NO: 793087 - DNA, 20 bp, Artificial
  CRISPR gRNA sequence
gcaaggtcttcccttaggga

SEQ ID NO: 793088 - DNA, 20 bp, Artificial
  CRISPR gRNA sequence
ggcttaaggccattcaggct

SEQ ID NO: 793089 - DNA, 20 bp, Artificial
  CRISPR gRNA sequence
tgtttcaaagacagactgca

SEQ ID NO: 793090 - DNA, 20 bp, Artificial
  CRISPR gRNA sequence
aacaccttactctcggggag

SEQ ID NO: 793091 - DNA, 20 bp, Artificial
  CRISPR gRNA sequence
cggggagaaggatgggcaca

SEQ ID NO: 793092 - DNA, 20 bp, Artificial
  CRISPR gRNA sequence
acagtgggtcctttaaagca

SEQ ID NO: 793093 - DNA, 20 bp, Artificial
  CRISPR gRNA sequence
tgtcttggctgttgaaaaaa

SEQ ID NO: 793094 - DNA, 20 bp, Artificial
  CRISPR gRNA sequence
tgaaaaaactgggttttaca

SEQ ID NO: 793095 - DNA, 20 bp, Artificial
  CRISPR gRNA sequence
tttaaaaaccactctggctg

SEQ ID NO: 793096 - DNA, 20 bp, Artificial
  CRISPR gRNA sequence
caactgcaggaaggcaaaac

SEQ ID NO: 793097 - DNA, 20 bp, Artificial
  CRISPR gRNA sequence
tggtgagaaatggtcagatt

SEQ ID NO: 793098 - DNA, 20 bp, Artificial
  CRISPR gRNA sequence
atatttgaaggaagggccaa

SEQ ID NO: 793099 - DNA, 20 bp, Artificial
  CRISPR gRNA sequence
agggccaatagggttggtta

SEQ ID NO: 793100 - DNA, 20 bp, Artificial
  CRISPR gRNA sequence
gttggttaatgaatcagatg

SEQ ID NO: 793101 - DNA, 20 bp, Artificial
  CRISPR gRNA sequence
gtccttcacctcaataagtg

SEQ ID NO: 793102 - DNA, 20 bp, Artificial
  CRISPR gRNA sequence
taagaagaaatgataagaag

SEQ ID NO: 793103 - DNA, 20 bp, Artificial
  CRISPR gRNA sequence
ctgaattaaggtgatggcag

SEQ ID NO: 793104 - DNA, 20 bp, Artificial
  CRISPR gRNA sequence
tgcaaaaagtatccaggagg

SEQ ID NO: 793105 - DNA, 20 bp, Artificial
  CRISPR gRNA sequence
agggagaattaacaggacta

SEQ ID NO: 793106 - DNA, 20 bp, Artificial
  CRISPR gRNA sequence
gtctaagattctagcttaag

SEQ ID NO: 793107 - DNA, 20 bp, Artificial
  CRISPR gRNA sequence
aggcttacaatttgtaaaac

SEQ ID NO: 793108 - DNA, 20 bp, Artificial
  CRISPR gRNA sequence
aaaccatattttccccagag

SEQ ID NO: 793109 - DNA, 20 bp, Artificial
  CRISPR gRNA sequence
aagccagtggcaggtgatcc

SEQ ID NO: 793110 - DNA, 20 bp, Artificial
  CRISPR gRNA sequence
tcctttcatgctctaaaaat

SEQ ID NO: 793111 - DNA, 20 bp, Artificial
  CRISPR gRNA sequence
agcttaagatgatacctttc

SEQ ID NO: 793112 - DNA, 20 bp, Artificial
  CRISPR gRNA sequence
tttcttggatatatatgcat

SEQ ID NO: 793113 - DNA, 20 bp, Artificial
  CRISPR gRNA sequence
tccctttctaaaataaaaac

SEQ ID NO: 793114 - DNA, 20 bp, Artificial
  CRISPR gRNA sequence
ttttatagcactcttcttga

SEQ ID NO: 793115 - DNA, 20 bp, Artificial
  CRISPR gRNA sequence
ctcactgatactgtgcttgt

SEQ ID NO: 793116 - DNA, 20 bp, Artificial
  CRISPR gRNA sequence
tactgctaaatgcaactctc

SEQ ID NO: 793117 - DNA, 20 bp, Artificial
  CRISPR gRNA sequence
agggccacatggggaagcac

SEQ ID NO: 793118 - DNA, 20 bp, Artificial
  CRISPR gRNA sequence
gcaccagggtcagccaggag

SEQ ID NO: 793119 - DNA, 20 bp, Artificial
  CRISPR gRNA sequence
ggtcagccaggaggtgggtg

SEQ ID NO: 793120 - DNA, 20 bp, Artificial
  CRISPR gRNA sequence
tgtggtttcaacaggaagaa

SEQ ID NO: 793121 - DNA, 20 bp, Artificial
  CRISPR gRNA sequence
acaggaagaaatgggtgaag

SEQ ID NO: 793122 - DNA, 20 bp, Artificial
  CRISPR gRNA sequence
gaagaaatgggtgaagcagg

SEQ ID NO: 793123 - DNA, 20 bp, Artificial
  CRISPR gRNA sequence
aaatgggtgaagcagggtga

SEQ ID NO: 793124 - DNA, 20 bp, Artificial
  CRISPR gRNA sequence
tgaagcagggtgagtggatt

SEQ ID NO: 793125 - DNA, 20 bp, Artificial
  CRISPR gRNA sequence
agtcttctggtacttggccc

SEQ ID NO: 793126 - DNA, 20 bp, Artificial
  CRISPR gRNA sequence
taaggcagttgcatagtgtt

SEQ ID NO: 793127 - DNA, 20 bp, Artificial
  CRISPR gRNA sequence
ccccaataaatgaggcagtt

SEQ ID NO: 793128 - DNA, 20 bp, Artificial
  CRISPR gRNA sequence
ttgtgggtatgggctctgaa

SEQ ID NO: 793129 - DNA, 20 bp, Artificial
  CRISPR gRNA sequence
gtttactctctcttagaggt

SEQ ID NO: 793130 - DNA, 20 bp, Artificial
  CRISPR gRNA sequence
cctgggagcggcagtccctt

SEQ ID NO: 793131 - DNA, 20 bp, Artificial
  CRISPR gRNA sequence
ggccccaggtgtcaaagcat

SEQ ID NO: 793132 - DNA, 20 bp, Artificial
  CRISPR gRNA sequence
gaatacagaaaataaaatgc

SEQ ID NO: 793133 - DNA, 20 bp, Artificial
  CRISPR gRNA sequence
tcacaaagatctataaatgt

SEQ ID NO: 793134 - DNA, 20 bp, Artificial
  CRISPR gRNA sequence
gtgactcaagccccaaactt

SEQ ID NO: 793135 - DNA, 20 bp, Artificial
  CRISPR gRNA sequence
aggaaagacatgctgtattc

SEQ ID NO: 793136 - DNA, 20 bp, Artificial
  CRISPR gRNA sequence
tgtattccccaaattgatct

SEQ ID NO: 793137 - DNA, 20 bp, Artificial
  CRISPR gRNA sequence
atttgaaaatgtaaggaagc

SEQ ID NO: 793138 - DNA, 20 bp, Artificial
  CRISPR gRNA sequence
aacgctgtgtggtactgaca

SEQ ID NO: 793139 - DNA, 20 bp, Artificial
  CRISPR gRNA sequence
agacatatagttcaataaaa

SEQ ID NO: 793140 - DNA, 20 bp, Artificial
  CRISPR gRNA sequence
tagttcaataaaacagaatc

SEQ ID NO: 793141 - DNA, 20 bp, Artificial
  CRISPR gRNA sequence
atgatcaattgatgttttgc

SEQ ID NO: 793142 - DNA, 20 bp, Artificial
  CRISPR gRNA sequence
ccaagacagttcaataggga

SEQ ID NO: 793143 - DNA, 20 bp, Artificial
  CRISPR gRNA sequence
aacaaattgtacaggcacaa

SEQ ID NO: 793144 - DNA, 20 bp, Artificial
  CRISPR gRNA sequence
aaaagaaaaaagtagataaa

SEQ ID NO: 793145 - DNA, 20 bp, Artificial
  CRISPR gRNA sequence
attaaaacatttatccttca

SEQ ID NO: 793146 - DNA, 20 bp, Artificial
  CRISPR gRNA sequence
gaaactgaaaagacaatgtg

SEQ ID NO: 793147 - DNA, 20 bp, Artificial
  CRISPR gRNA sequence
attcctcaaaaagttaaata

SEQ ID NO: 793148 - DNA, 20 bp, Artificial
  CRISPR gRNA sequence
acatagacaaagacttgtat

SEQ ID NO: 793149 - DNA, 20 bp, Artificial
  CRISPR gRNA sequence
atccaaatgaccatcaactg

SEQ ID NO: 793150 - DNA, 20 bp, Artificial
  CRISPR gRNA sequence
aaatgaccatcaactgatga

SEQ ID NO: 793151 - DNA, 20 bp, Artificial
  CRISPR gRNA sequence
aaatgtggtatatcatacaa

SEQ ID NO: 793152 - DNA, 20 bp, Artificial
  CRISPR gRNA sequence
ttccatttttatgaaatatc

SEQ ID NO: 793153 - DNA, 20 bp, Artificial
  CRISPR gRNA sequence
gaaataggaagtttctgcta

SEQ ID NO: 793154 - DNA, 20 bp, Artificial
  CRISPR gRNA sequence
gaagtttctgctaatgggta

SEQ ID NO: 793155 - DNA, 20 bp, Artificial
  CRISPR gRNA sequence
atgggtaaggggttcctttt

SEQ ID NO: 793156 - DNA, 20 bp, Artificial
  CRISPR gRNA sequence
gtaatgaaaatgttctaaaa

SEQ ID NO: 793157 - DNA, 20 bp, Artificial
  CRISPR gRNA sequence
cgtgaacatactaaaaacca

SEQ ID NO: 793158 - DNA, 20 bp, Artificial
  CRISPR gRNA sequence
tcctcaaccataagaagtcc

SEQ ID NO: 793159 - DNA, 20 bp, Artificial
  CRISPR gRNA sequence
tccatggataaagaaagctt

SEQ ID NO: 793160 - DNA, 20 bp, Artificial
  CRISPR gRNA sequence
tcaactagcaagtatttatt

SEQ ID NO: 793161 - DNA, 20 bp, Artificial
  CRISPR gRNA sequence
gagaatgtagctctgttcta

SEQ ID NO: 793162 - DNA, 20 bp, Artificial
  CRISPR gRNA sequence
attcatttgacaaacaaagt

SEQ ID NO: 793163 - DNA, 20 bp, Artificial
  CRISPR gRNA sequence
aaggaagaagaacttctcat

SEQ ID NO: 793164 - DNA, 20 bp, Artificial
  CRISPR gRNA sequence
acttctcatttggatttata

SEQ ID NO: 793165 - DNA, 20 bp, Artificial
  CRISPR gRNA sequence
cctcctgctaatgttgagcc

SEQ ID NO: 793166 - DNA, 20 bp, Artificial
  CRISPR gRNA sequence
tcctagccaaagccaaaaat

SEQ ID NO: 793167 - DNA, 20 bp, Artificial
  CRISPR gRNA sequence
ccaagcaccacaaaaaaaaa

SEQ ID NO: 793168 - DNA, 20 bp, Artificial
  CRISPR gRNA sequence
atctgacagaaacggtgact

SEQ ID NO: 793169 - DNA, 20 bp, Artificial
  CRISPR gRNA sequence
atctattcccactatccagt

SEQ ID NO: 793170 - DNA, 20 bp, Artificial
  CRISPR gRNA sequence
tgagggtaatgacaagaaga

SEQ ID NO: 793171 - DNA, 20 bp, Artificial
  CRISPR gRNA sequence
ctaaactgatacaagagggc

SEQ ID NO: 793172 - DNA, 20 bp, Artificial
  CRISPR gRNA sequence
ctgatacaagagggcagggg

SEQ ID NO: 793173 - DNA, 20 bp, Artificial
  CRISPR gRNA sequence
tccccttcctttctggcagg

SEQ ID NO: 793174 - DNA, 20 bp, Artificial
  CRISPR gRNA sequence
gcatattattagttgtttct

SEQ ID NO: 793175 - DNA, 20 bp, Artificial
  CRISPR gRNA sequence
tcataccttaatgtggttta

SEQ ID NO: 793176 - DNA, 20 bp, Artificial
  CRISPR gRNA sequence
tgaagaaaggacttctattg

SEQ ID NO: 793177 - DNA, 20 bp, Artificial
  CRISPR gRNA sequence
aaggacttctattggaggat

SEQ ID NO: 793178 - DNA, 20 bp, Artificial
  CRISPR gRNA sequence
gaaggtagttcagaccattc

SEQ ID NO: 793179 - DNA, 20 bp, Artificial
  CRISPR gRNA sequence
tcgagggtgtagttagaacc

SEQ ID NO: 793180 - DNA, 20 bp, Artificial
  CRISPR gRNA sequence
agaaccatgagtgcactatt

SEQ ID NO: 793181 - DNA, 20 bp, Artificial
  CRISPR gRNA sequence
ggatgaacaccaggagctaa

SEQ ID NO: 793182 - DNA, 20 bp, Artificial
  CRISPR gRNA sequence
gtaacatagaggtgtggaca

SEQ ID NO: 793183 - DNA, 20 bp, Artificial
  CRISPR gRNA sequence
aaaacagcttcaagtttcca

SEQ ID NO: 793184 - DNA, 20 bp, Artificial
  CRISPR gRNA sequence
gggcttcaggagaaaacttg

SEQ ID NO: 793185 - DNA, 20 bp, Artificial
  CRISPR gRNA sequence
ttggggaatgtgtaacctct

SEQ ID NO: 793186 - DNA, 20 bp, Artificial
  CRISPR gRNA sequence
agcttaaaaacactgagatc

SEQ ID NO: 793187 - DNA, 20 bp, Artificial
  CRISPR gRNA sequence
tttgccttttctcttaggaa

SEQ ID NO: 793188 - DNA, 20 bp, Artificial
  CRISPR gRNA sequence
ctcttaggaaaggagtgagc

SEQ ID NO: 793189 - DNA, 20 bp, Artificial
  CRISPR gRNA sequence
attggctctttctacagagg

SEQ ID NO: 793190 - DNA, 20 bp, Artificial
  CRISPR gRNA sequence
acccataaatcttccaactt

SEQ ID NO: 793191 - DNA, 20 bp, Artificial
  CRISPR gRNA sequence
ataggtttttgcactgaagt

SEQ ID NO: 793192 - DNA, 20 bp, Artificial
  CRISPR gRNA sequence
ttttgcactgaagtctgaat

SEQ ID NO: 793193 - DNA, 20 bp, Artificial
  CRISPR gRNA sequence
agtctgaatatggatacgta

SEQ ID NO: 793194 - DNA, 20 bp, Artificial
  CRISPR gRNA sequence
atacgtattgaatgtttatt

SEQ ID NO: 793195 - DNA, 20 bp, Artificial
  CRISPR gRNA sequence
atgtttattctggatattca

SEQ ID NO: 793196 - DNA, 20 bp, Artificial
  CRISPR gRNA sequence
agaatcaaaaaatatgtgta

SEQ ID NO: 793197 - DNA, 20 bp, Artificial
  CRISPR gRNA sequence
atgtgtaatgaattatgttg

SEQ ID NO: 793198 - DNA, 20 bp, Artificial
  CRISPR gRNA sequence
agcgctttctcattttcttc

SEQ ID NO: 793199 - DNA, 20 bp, Artificial
  CRISPR gRNA sequence
tctcattttcttcacgaatt

SEQ ID NO: 793200 - DNA, 20 bp, Artificial
  CRISPR gRNA sequence
tattaaatacctacctaaat

SEQ ID NO: 793201 - DNA, 20 bp, Artificial
  CRISPR gRNA sequence
attagaatgccttctcctca

SEQ ID NO: 793202 - DNA, 20 bp, Artificial
  CRISPR gRNA sequence
atttcatgtctctttaatta

SEQ ID NO: 793203 - DNA, 20 bp, Artificial
  CRISPR gRNA sequence
aaagagttttgatttcagag

SEQ ID NO: 793204 - DNA, 20 bp, Artificial
  CRISPR gRNA sequence
agaaaacaacaaaaaaacta

SEQ ID NO: 793205 - DNA, 20 bp, Artificial
  CRISPR gRNA sequence
tctggggaggggaggaggtc

SEQ ID NO: 793206 - DNA, 20 bp, Artificial
  CRISPR gRNA sequence
gaggggaggaggtctgggat

SEQ ID NO: 793207 - DNA, 20 bp, Artificial
  CRISPR gRNA sequence
aggtctgggatgggggtaaa

SEQ ID NO: 793208 - DNA, 20 bp, Artificial
  CRISPR gRNA sequence
tgagacagagctacagctat

SEQ ID NO: 793209 - DNA, 20 bp, Artificial
  CRISPR gRNA sequence
ttgaaaagaaaagaagatac

SEQ ID NO: 793210 - DNA, 20 bp, Artificial
  CRISPR gRNA sequence
cagccctatgggaggccgag

SEQ ID NO: 793211 - DNA, 20 bp, Artificial
  CRISPR gRNA sequence
cctatgggaggccgaggcgg

SEQ ID NO: 793212 - DNA, 20 bp, Artificial
  CRISPR gRNA sequence
cgggtggatcacctcaggtc

SEQ ID NO: 793213 - DNA, 20 bp, Artificial
  CRISPR gRNA sequence
tcatgtcactgtattccagc

SEQ ID NO: 793214 - DNA, 20 bp, Artificial
  CRISPR gRNA sequence
ctgtattccagcctgggtga

SEQ ID NO: 793215 - DNA, 20 bp, Artificial
  CRISPR gRNA sequence
aaaacaatccatatgccctg

SEQ ID NO: 793216 - DNA, 20 bp, Artificial
  CRISPR gRNA sequence
gccctggagaatttgattcc

SEQ ID NO: 793217 - DNA, 20 bp, Artificial
  CRISPR gRNA sequence
gtctagaagaacttcaactg

SEQ ID NO: 793218 - DNA, 20 bp, Artificial
  CRISPR gRNA sequence
agaagaacttcaactggaga

SEQ ID NO: 793219 - DNA, 20 bp, Artificial
  CRISPR gRNA sequence
gagaaatcatggtatatttg

SEQ ID NO: 793220 - DNA, 20 bp, Artificial
  CRISPR gRNA sequence
atatatataatagatagcat

SEQ ID NO: 793221 - DNA, 20 bp, Artificial
  CRISPR gRNA sequence
aaaaacatgtaactacatct

SEQ ID NO: 793222 - DNA, 20 bp, Artificial
  CRISPR gRNA sequence
atgaatcttagagcataata

SEQ ID NO: 793223 - DNA, 20 bp, Artificial
  CRISPR gRNA sequence
gcctgtaatcccagctactc

SEQ ID NO: 793224 - DNA, 20 bp, Artificial
  CRISPR gRNA sequence
tactcgggagtctgaggcag

SEQ ID NO: 793225 - DNA, 20 bp, Artificial
  CRISPR gRNA sequence
caggagaatcgcttgaacca

SEQ ID NO: 793226 - DNA, 20 bp, Artificial
  CRISPR gRNA sequence
ctgcactctagcctgggcga

SEQ ID NO: 793227 - DNA, 20 bp, Artificial
  CRISPR gRNA sequence
attagtaatgtgctagttct

SEQ ID NO: 793228 - DNA, 20 bp, Artificial
  CRISPR gRNA sequence
aaaacaaaactttttagaga

SEQ ID NO: 793229 - DNA, 20 bp, Artificial
  CRISPR gRNA sequence
tcttcctctgtcatccatgc

SEQ ID NO: 793230 - DNA, 20 bp, Artificial
  CRISPR gRNA sequence
cctccaactcccaggctcaa

SEQ ID NO: 793231 - DNA, 20 bp, Artificial
  CRISPR gRNA sequence
gagtctcctgcctcaatctc

SEQ ID NO: 793232 - DNA, 20 bp, Artificial
  CRISPR gRNA sequence
tttttaaacatttttagtga

SEQ ID NO: 793233 - DNA, 20 bp, Artificial
  CRISPR gRNA sequence
gactgtgatgaaagttgcct

SEQ ID NO: 793234 - DNA, 20 bp, Artificial
  CRISPR gRNA sequence
tttccttacttgtatgctct

SEQ ID NO: 793235 - DNA, 20 bp, Artificial
  CRISPR gRNA sequence
taaagtttgaagtgaaaaat

SEQ ID NO: 793236 - DNA, 20 bp, Artificial
  CRISPR gRNA sequence
aacattttatatcattttta

SEQ ID NO: 793237 - DNA, 20 bp, Artificial
  CRISPR gRNA sequence
catttttaaaggatatatac

SEQ ID NO: 793238 - DNA, 20 bp, Artificial
  CRISPR gRNA sequence
tctttttttaaaaaagtctt

SEQ ID NO: 793239 - DNA, 20 bp, Artificial
  CRISPR gRNA sequence
ccttatagtaatgacttttc

SEQ ID NO: 793240 - DNA, 20 bp, Artificial
  CRISPR gRNA sequence
tttccagaatgtcatataaa

SEQ ID NO: 793241 - DNA, 20 bp, Artificial
  CRISPR gRNA sequence
aaattcattcatattgttgt

SEQ ID NO: 793242 - DNA, 20 bp, Artificial
  CRISPR gRNA sequence
taatttatacctgtttgctg

SEQ ID NO: 793243 - DNA, 20 bp, Artificial
  CRISPR gRNA sequence
attccccaattggggcacat

SEQ ID NO: 793244 - DNA, 20 bp, Artificial
  CRISPR gRNA sequence
acatttgggtatttcccatt

SEQ ID NO: 793245 - DNA, 20 bp, Artificial
  CRISPR gRNA sequence
aacctaggttttcatttcac

SEQ ID NO: 793246 - DNA, 20 bp, Artificial
  CRISPR gRNA sequence
cttggataaatacctagaag

SEQ ID NO: 793247 - DNA, 20 bp, Artificial
  CRISPR gRNA sequence
attcccaccagcaagtatat

SEQ ID NO: 793248 - DNA, 20 bp, Artificial
  CRISPR gRNA sequence
ttttttctttttttttgaga

SEQ ID NO: 793249 - DNA, 20 bp, Artificial
  CRISPR gRNA sequence
cttactgcaacctccgcctc

SEQ ID NO: 793250 - DNA, 20 bp, Artificial
  CRISPR gRNA sequence
gcctcagcctcccaagtagc

SEQ ID NO: 793251 - DNA, 20 bp, Artificial
  CRISPR gRNA sequence
ttttgtatttttaatagaga

SEQ ID NO: 793252 - DNA, 20 bp, Artificial
  CRISPR gRNA sequence
accttggcctcccaaaatgc

SEQ ID NO: 793253 - DNA, 20 bp, Artificial
  CRISPR gRNA sequence
atttttttctttttttgaga

SEQ ID NO: 793254 - DNA, 20 bp, Artificial
  CRISPR gRNA sequence
tatcactctgttgcccagat

SEQ ID NO: 793255 - DNA, 20 bp, Artificial
  CRISPR gRNA sequence
tttttttaattttgtagaca

SEQ ID NO: 793256 - DNA, 20 bp, Artificial
  CRISPR gRNA sequence
gcctcagcctcccaaaatgc

SEQ ID NO: 793257 - DNA, 20 bp, Artificial
  CRISPR gRNA sequence
tcctttgtaattgtatacta

SEQ ID NO: 793258 - DNA, 20 bp, Artificial
  CRISPR gRNA sequence
tctccatcagtcgcccaggc

SEQ ID NO: 793259 - DNA, 20 bp, Artificial
  CRISPR gRNA sequence
gcctcagcctcttgactggc

SEQ ID NO: 793260 - DNA, 20 bp, Artificial
  CRISPR gRNA sequence
gcttatgtttgtattttcag

SEQ ID NO: 793261 - DNA, 20 bp, Artificial
  CRISPR gRNA sequence
gtttgtattttcagtagagt

SEQ ID NO: 793262 - DNA, 20 bp, Artificial
  CRISPR gRNA sequence
accttggcctcccaaagtgc

SEQ ID NO: 793263 - DNA, 20 bp, Artificial
  CRISPR gRNA sequence
tgagccactgccacgacctt

SEQ ID NO: 793264 - DNA, 20 bp, Artificial
  CRISPR gRNA sequence
atttatcaatgttttctttt

SEQ ID NO: 793265 - DNA, 20 bp, Artificial
  CRISPR gRNA sequence
ctttccccattcaatagcct

SEQ ID NO: 793266 - DNA, 20 bp, Artificial
  CRISPR gRNA sequence
aatcaattagtcatatttat

SEQ ID NO: 793267 - DNA, 20 bp, Artificial
  CRISPR gRNA sequence
gactgctgagataaacaaag

SEQ ID NO: 793268 - DNA, 20 bp, Artificial
  CRISPR gRNA sequence
gagaataatcaggttgggga

SEQ ID NO: 793269 - DNA, 20 bp, Artificial
  CRISPR gRNA sequence
cctcctacactgagcagagc

SEQ ID NO: 793270 - DNA, 20 bp, Artificial
  CRISPR gRNA sequence
catgagtcaggtgcttagag

SEQ ID NO: 793271 - DNA, 20 bp, Artificial
  CRISPR gRNA sequence
ttgtcctaaaccaggaactt

SEQ ID NO: 793272 - DNA, 20 bp, Artificial
  CRISPR gRNA sequence
aggaacttcagagttttctg

SEQ ID NO: 793273 - DNA, 20 bp, Artificial
  CRISPR gRNA sequence
cacttctgttgttaaatgtg

SEQ ID NO: 793274 - DNA, 20 bp, Artificial
  CRISPR gRNA sequence
aataattcgttgtgtgtttc

SEQ ID NO: 793275 - DNA, 20 bp, Artificial
  CRISPR gRNA sequence
ataaaatgcaaagctccccc

SEQ ID NO: 793276 - DNA, 20 bp, Artificial
  CRISPR gRNA sequence
tagcaaaaggacctgcatac

SEQ ID NO: 793277 - DNA, 20 bp, Artificial
  CRISPR gRNA sequence
agtttagttaagggccccac

SEQ ID NO: 793278 - DNA, 20 bp, Artificial
  CRISPR gRNA sequence
ctcctttgtctaataccttc

SEQ ID NO: 793279 - DNA, 20 bp, Artificial
  CRISPR gRNA sequence
aaaaaaaaaaaaactcactc

SEQ ID NO: 793280 - DNA, 20 bp, Artificial
  CRISPR gRNA sequence
gatgtagtgtacacatgcca

SEQ ID NO: 793281 - DNA, 20 bp, Artificial
  CRISPR gRNA sequence
tgtgcattgaagacacagag

SEQ ID NO: 793282 - DNA, 20 bp, Artificial
  CRISPR gRNA sequence
ttgaagacacagagatgaat

SEQ ID NO: 793283 - DNA, 20 bp, Artificial
  CRISPR gRNA sequence
agtttccccatctgtaaaat

SEQ ID NO: 793284 - DNA, 20 bp, Artificial
  CRISPR gRNA sequence
ggatagcaacatctacctcg

SEQ ID NO: 793285 - DNA, 20 bp, Artificial
  CRISPR gRNA sequence
ctacctcgcagagttgctgg

SEQ ID NO: 793286 - DNA, 20 bp, Artificial
  CRISPR gRNA sequence
agattgaggccctctgctta

SEQ ID NO: 793287 - DNA, 20 bp, Artificial
  CRISPR gRNA sequence
cttgagaaaaaacctcttca

SEQ ID NO: 793288 - DNA, 20 bp, Artificial
  CRISPR gRNA sequence
ctctgtaacttacaataagc

SEQ ID NO: 793289 - DNA, 20 bp, Artificial
  CRISPR gRNA sequence
tacaataagcaagaatgttt

SEQ ID NO: 793290 - DNA, 20 bp, Artificial
  CRISPR gRNA sequence
cctaaacctcttattttgta

SEQ ID NO: 793291 - DNA, 20 bp, Artificial
  CRISPR gRNA sequence
aaggcccaggcagtaaagag

SEQ ID NO: 793292 - DNA, 20 bp, Artificial
  CRISPR gRNA sequence
gagttctgctgtaagctaag

SEQ ID NO: 793293 - DNA, 20 bp, Artificial
  CRISPR gRNA sequence
aaacaagagaagtattatag

SEQ ID NO: 793294 - DNA, 20 bp, Artificial
  CRISPR gRNA sequence
atatgattactacatatttg

SEQ ID NO: 793295 - DNA, 20 bp, Artificial
  CRISPR gRNA sequence
actacatatttgatgaatag

SEQ ID NO: 793296 - DNA, 20 bp, Artificial
  CRISPR gRNA sequence
tattattcttcaaggacaga

SEQ ID NO: 793297 - DNA, 20 bp, Artificial
  CRISPR gRNA sequence
aaggacggcttccatcataa

SEQ ID NO: 793298 - DNA, 20 bp, Artificial
  CRISPR gRNA sequence
ataaagggatctgcccttaa

SEQ ID NO: 793299 - DNA, 20 bp, Artificial
  CRISPR gRNA sequence
agagctattccaagtgtgca

SEQ ID NO: 793300 - DNA, 20 bp, Artificial
  CRISPR gRNA sequence
tgtgcagtggattaaaataa

SEQ ID NO: 793301 - DNA, 20 bp, Artificial
  CRISPR gRNA sequence
tctttttacatgccttattc

SEQ ID NO: 793302 - DNA, 20 bp, Artificial
  CRISPR gRNA sequence
cctgtgcccctcctgcacaa

SEQ ID NO: 793303 - DNA, 20 bp, Artificial
  CRISPR gRNA sequence
gttctagccatggttaaaac

SEQ ID NO: 793304 - DNA, 20 bp, Artificial
  CRISPR gRNA sequence
aagtgtgctgtgtggcaatt

SEQ ID NO: 793305 - DNA, 20 bp, Artificial
  CRISPR gRNA sequence
ttgatgaaaggaaagcagag

SEQ ID NO: 793306 - DNA, 20 bp, Artificial
  CRISPR gRNA sequence
agcagaggtgaatatataac

SEQ ID NO: 793307 - DNA, 20 bp, Artificial
  CRISPR gRNA sequence
aacttgctatgtgctaggta

SEQ ID NO: 793308 - DNA, 20 bp, Artificial
  CRISPR gRNA sequence
tctttgccttcaaagatttg

SEQ ID NO: 793309 - DNA, 20 bp, Artificial
  CRISPR gRNA sequence
aggatagtgggaagaaaaac

SEQ ID NO: 793310 - DNA, 20 bp, Artificial
  CRISPR gRNA sequence
aatcagaggacatctgcagt

SEQ ID NO: 793311 - DNA, 20 bp, Artificial
  CRISPR gRNA sequence
tatactgtgaaatctgatca

SEQ ID NO: 793312 - DNA, 20 bp, Artificial
  CRISPR gRNA sequence
ctggttagtaaaatatcctg

SEQ ID NO: 793313 - DNA, 20 bp, Artificial
  CRISPR gRNA sequence
attggccatgcattccacat

SEQ ID NO: 793314 - DNA, 20 bp, Artificial
  CRISPR gRNA sequence
atatgaattaccactttccc

SEQ ID NO: 793315 - DNA, 20 bp, Artificial
  CRISPR gRNA sequence
aagaaaggaacgaacatttg

SEQ ID NO: 793316 - DNA, 20 bp, Artificial
  CRISPR gRNA sequence
tccaccacaatactgagagg

SEQ ID NO: 793317 - DNA, 20 bp, Artificial
  CRISPR gRNA sequence
cagtcaaaggactcctaatc

SEQ ID NO: 793318 - DNA, 20 bp, Artificial
  CRISPR gRNA sequence
ttttatactgaaacaacttc

SEQ ID NO: 793319 - DNA, 20 bp, Artificial
  CRISPR gRNA sequence
aagcagctcccaaatatttg

SEQ ID NO: 793320 - DNA, 20 bp, Artificial
  CRISPR gRNA sequence
agctcccaaatatttgttga

SEQ ID NO: 793321 - DNA, 20 bp, Artificial
  CRISPR gRNA sequence
ttgttgaatgaatgatttga

SEQ ID NO: 793322 - DNA, 20 bp, Artificial
  CRISPR gRNA sequence
tgaatgaatgatttgattga

SEQ ID NO: 793323 - DNA, 20 bp, Artificial
  CRISPR gRNA sequence
tgaatgatttgattgaatga

SEQ ID NO: 793324 - DNA, 20 bp, Artificial
  CRISPR gRNA sequence
ttgattgaatgaatgaataa

SEQ ID NO: 793325 - DNA, 20 bp, Artificial
  CRISPR gRNA sequence
tttcctatacctccatcata

SEQ ID NO: 793326 - DNA, 20 bp, Artificial
  CRISPR gRNA sequence
atcatttgcactggtaaata

SEQ ID NO: 793327 - DNA, 20 bp, Artificial
  CRISPR gRNA sequence
gttgaaattatatgcaattg

SEQ ID NO: 793328 - DNA, 20 bp, Artificial
  CRISPR gRNA sequence
atgcaattgaaggattaaaa

SEQ ID NO: 793329 - DNA, 20 bp, Artificial
  CRISPR gRNA sequence
gattaaaatagaattgaaaa

SEQ ID NO: 793330 - DNA, 20 bp, Artificial
  CRISPR gRNA sequence
aaaagggaataaattcctct

SEQ ID NO: 793331 - DNA, 20 bp, Artificial
  CRISPR gRNA sequence
ccctcacattttggtaaact

SEQ ID NO: 793332 - DNA, 20 bp, Artificial
  CRISPR gRNA sequence
gtaaactctgagtggaaact

SEQ ID NO: 793333 - DNA, 20 bp, Artificial
  CRISPR gRNA sequence
agtcaaacatctgactggct

SEQ ID NO: 793334 - DNA, 20 bp, Artificial
  CRISPR gRNA sequence
catttttgttttctgaaaaa

SEQ ID NO: 793335 - DNA, 20 bp, Artificial
  CRISPR gRNA sequence
ttgttttctgaaaaaaagga

SEQ ID NO: 793336 - DNA, 20 bp, Artificial
  CRISPR gRNA sequence
tcagtgagacgatgtgttag

SEQ ID NO: 793337 - DNA, 20 bp, Artificial
  CRISPR gRNA sequence
gcagagtgtctgacaattgt

SEQ ID NO: 793338 - DNA, 20 bp, Artificial
  CRISPR gRNA sequence
gatacctggcacaaaaatat

SEQ ID NO: 793339 - DNA, 20 bp, Artificial
  CRISPR gRNA sequence
aaatatatggattaatcaat

SEQ ID NO: 793340 - DNA, 20 bp, Artificial
  CRISPR gRNA sequence
gattgagggaaacaaacctg

SEQ ID NO: 793341 - DNA, 20 bp, Artificial
  CRISPR gRNA sequence
agggaaacaaacctggagaa

SEQ ID NO: 793342 - DNA, 20 bp, Artificial
  CRISPR gRNA sequence
ttcttatatgacagatgacc

SEQ ID NO: 793343 - DNA, 20 bp, Artificial
  CRISPR gRNA sequence
tggaatgactgcagggcttg

SEQ ID NO: 793344 - DNA, 20 bp, Artificial
  CRISPR gRNA sequence
tgtccaccagaagctcttgc

SEQ ID NO: 793345 - DNA, 20 bp, Artificial
  CRISPR gRNA sequence
gggcagtcagctgcacagga

SEQ ID NO: 793346 - DNA, 20 bp, Artificial
  CRISPR gRNA sequence
gagagagccacctcagatca

SEQ ID NO: 793347 - DNA, 20 bp, Artificial
  CRISPR gRNA sequence
ccacctcagatcagcgggtc

SEQ ID NO: 793348 - DNA, 20 bp, Artificial
  CRISPR gRNA sequence
agaatcccactcttgcccag

SEQ ID NO: 793349 - DNA, 20 bp, Artificial
  CRISPR gRNA sequence
tggatggggcaaaggagaaa

SEQ ID NO: 793350 - DNA, 20 bp, Artificial
  CRISPR gRNA sequence
ggagaaaaaggattcgccac

SEQ ID NO: 793351 - DNA, 20 bp, Artificial
  CRISPR gRNA sequence
acaggtgccttttggaaaat

SEQ ID NO: 793352 - DNA, 20 bp, Artificial
  CRISPR gRNA sequence
ttttggaaaatgggggtgag

SEQ ID NO: 793353 - DNA, 20 bp, Artificial
  CRISPR gRNA sequence
aggttacacttcgtaagaac

SEQ ID NO: 793354 - DNA, 20 bp, Artificial
  CRISPR gRNA sequence
gcatggcagcaatgtgaccc

SEQ ID NO: 793355 - DNA, 20 bp, Artificial
  CRISPR gRNA sequence
taccaatgcataatcatcta

SEQ ID NO: 793356 - DNA, 20 bp, Artificial
  CRISPR gRNA sequence
cctgactctgaaagtcaaag

SEQ ID NO: 793357 - DNA, 20 bp, Artificial
  CRISPR gRNA sequence
aggtgagtggtgtcaaggac

SEQ ID NO: 793358 - DNA, 20 bp, Artificial
  CRISPR gRNA sequence
atggaagcatctctccaaca

SEQ ID NO: 793359 - DNA, 20 bp, Artificial
  CRISPR gRNA sequence
tcggaaataatttttgacat

SEQ ID NO: 793360 - DNA, 20 bp, Artificial
  CRISPR gRNA sequence
cagccgaagtacaagtgaaa

SEQ ID NO: 793361 - DNA, 20 bp, Artificial
  CRISPR gRNA sequence
tgaaagggggtaggacctat

SEQ ID NO: 793362 - DNA, 20 bp, Artificial
  CRISPR gRNA sequence
aattagtccctgaaatgtgg

SEQ ID NO: 793363 - DNA, 20 bp, Artificial
  CRISPR gRNA sequence
ctttttcaatagtttatacc

SEQ ID NO: 793364 - DNA, 20 bp, Artificial
  CRISPR gRNA sequence
aatagtttataccctgaatc

SEQ ID NO: 793365 - DNA, 20 bp, Artificial
  CRISPR gRNA sequence
ccatggtttgccgcccattc

SEQ ID NO: 793366 - DNA, 20 bp, Artificial
  CRISPR gRNA sequence
tggattaaaatatcaattta

SEQ ID NO: 793367 - DNA, 20 bp, Artificial
  CRISPR gRNA sequence
ttaaaaaataatgtatagaa

SEQ ID NO: 793368 - DNA, 20 bp, Artificial
  CRISPR gRNA sequence
aatgtatagaagagaataga

SEQ ID NO: 793369 - DNA, 20 bp, Artificial
  CRISPR gRNA sequence
gagtagatcagacgacatca

SEQ ID NO: 793370 - DNA, 20 bp, Artificial
  CRISPR gRNA sequence
gacgacatcacagagtagga

SEQ ID NO: 793371 - DNA, 20 bp, Artificial
  CRISPR gRNA sequence
cgtgtgtgtgtgtgtgcgtg

SEQ ID NO: 793372 - DNA, 20 bp, Artificial
  CRISPR gRNA sequence
taaattttttttttcttact

SEQ ID NO: 793373 - DNA, 20 bp, Artificial
  CRISPR gRNA sequence
ctgagatccagagaagggaa

SEQ ID NO: 793374 - DNA, 20 bp, Artificial
  CRISPR gRNA sequence
aagggaagtgggtagcccaa

SEQ ID NO: 793375 - DNA, 20 bp, Artificial
  CRISPR gRNA sequence
ctatagctgtccctattcct

SEQ ID NO: 793376 - DNA, 20 bp, Artificial
  CRISPR gRNA sequence
gtccctattcctctggattc

SEQ ID NO: 793377 - DNA, 20 bp, Artificial
  CRISPR gRNA sequence
attgaaaatctaaatataaa

SEQ ID NO: 793378 - DNA, 20 bp, Artificial
  CRISPR gRNA sequence
ttggcttatggtctccaggc

SEQ ID NO: 793379 - DNA, 20 bp, Artificial
  CRISPR gRNA sequence
atggtctgtactgtcttcta

SEQ ID NO: 793380 - DNA, 20 bp, Artificial
  CRISPR gRNA sequence
tactgtcttctagagggttt

SEQ ID NO: 793381 - DNA, 20 bp, Artificial
  CRISPR gRNA sequence
aaactagagggactggacat

SEQ ID NO: 793382 - DNA, 20 bp, Artificial
  CRISPR gRNA sequence
tagagggactggacatgagg

SEQ ID NO: 793383 - DNA, 20 bp, Artificial
  CRISPR gRNA sequence
caatagtagtaccaaacaca

SEQ ID NO: 793384 - DNA, 20 bp, Artificial
  CRISPR gRNA sequence
tcctcacacctcaaccatca

SEQ ID NO: 793385 - DNA, 20 bp, Artificial
  CRISPR gRNA sequence
tctagaacactgaagtttgt

SEQ ID NO: 793386 - DNA, 20 bp, Artificial
  CRISPR gRNA sequence
aatgtaaggctgtacattct

SEQ ID NO: 793387 - DNA, 20 bp, Artificial
  CRISPR gRNA sequence
ctcaggatgccttgatgtac

SEQ ID NO: 793388 - DNA, 20 bp, Artificial
  CRISPR gRNA sequence
ctgtttttattgatctctat

SEQ ID NO: 793389 - DNA, 20 bp, Artificial
  CRISPR gRNA sequence
gcctactccttacctagatc

SEQ ID NO: 793390 - DNA, 20 bp, Artificial
  CRISPR gRNA sequence
tatagtgttggtcatcaaac

SEQ ID NO: 793391 - DNA, 20 bp, Artificial
  CRISPR gRNA sequence
gtcatcaaactgggatattt

SEQ ID NO: 793392 - DNA, 20 bp, Artificial
  CRISPR gRNA sequence
gggattacaaagacttttca

SEQ ID NO: 793393 - DNA, 20 bp, Artificial
  CRISPR gRNA sequence
ggcacaggcagttttaggaa

SEQ ID NO: 793394 - DNA, 20 bp, Artificial
  CRISPR gRNA sequence
tgcatgccaggcaaggctct

SEQ ID NO: 793395 - DNA, 20 bp, Artificial
  CRISPR gRNA sequence
aagcctaccactcactcatc

SEQ ID NO: 793396 - DNA, 20 bp, Artificial
  CRISPR gRNA sequence
atgaatatagtccattgtcc

SEQ ID NO: 793397 - DNA, 20 bp, Artificial
  CRISPR gRNA sequence
ccctctatagtgttaaataa

SEQ ID NO: 793398 - DNA, 20 bp, Artificial
  CRISPR gRNA sequence
ttaataactgataatcaaaa

SEQ ID NO: 793399 - DNA, 20 bp, Artificial
  CRISPR gRNA sequence
ttgccatgtaaatcaggtca

SEQ ID NO: 793400 - DNA, 20 bp, Artificial
  CRISPR gRNA sequence
aaaaaaatgaaaaatagaaa

SEQ ID NO: 793401 - DNA, 20 bp, Artificial
  CRISPR gRNA sequence
aaatagaaatagaattgagg

SEQ ID NO: 793402 - DNA, 20 bp, Artificial
  CRISPR gRNA sequence
caaccatgtcatatggttct

SEQ ID NO: 793403 - DNA, 20 bp, Artificial
  CRISPR gRNA sequence
tcatatggttcttcggattc

SEQ ID NO: 793404 - DNA, 20 bp, Artificial
  CRISPR gRNA sequence
aaatgtccaacaacgataga

SEQ ID NO: 793405 - DNA, 20 bp, Artificial
  CRISPR gRNA sequence
aatgtggcacgtatacacca

SEQ ID NO: 793406 - DNA, 20 bp, Artificial
  CRISPR gRNA sequence
ctatgcagccataaaaaatg

SEQ ID NO: 793407 - DNA, 20 bp, Artificial
  CRISPR gRNA sequence
ttcatgtccttcgtagggac

SEQ ID NO: 793408 - DNA, 20 bp, Artificial
  CRISPR gRNA sequence
gcatgttctcactcataggt

SEQ ID NO: 793409 - DNA, 20 bp, Artificial
  CRISPR gRNA sequence
gtgtggtcgggggaggggag

SEQ ID NO: 793410 - DNA, 20 bp, Artificial
  CRISPR gRNA sequence
taatgtttaatgacaagtta

SEQ ID NO: 793411 - DNA, 20 bp, Artificial
  CRISPR gRNA sequence
tagggaaggtgaaattggaa

SEQ ID NO: 793412 - DNA, 20 bp, Artificial
  CRISPR gRNA sequence
gaaattggaagtgagtttca

SEQ ID NO: 793413 - DNA, 20 bp, Artificial
  CRISPR gRNA sequence
aagaaacaatttagacagag

SEQ ID NO: 793414 - DNA, 20 bp, Artificial
  CRISPR gRNA sequence
tttatttatttttacttaga

SEQ ID NO: 793415 - DNA, 20 bp, Artificial
  CRISPR gRNA sequence
ttatttttacttagaaggaa

SEQ ID NO: 793416 - DNA, 20 bp, Artificial
  CRISPR gRNA sequence
cagcactttgggaggccaag

SEQ ID NO: 793417 - DNA, 20 bp, Artificial
  CRISPR gRNA sequence
actttgggaggccaaggcgg

SEQ ID NO: 793418 - DNA, 20 bp, Artificial
  CRISPR gRNA sequence
tactggggaggctgaggcag

SEQ ID NO: 793419 - DNA, 20 bp, Artificial
  CRISPR gRNA sequence
cttcttttgagatcattttt

SEQ ID NO: 793420 - DNA, 20 bp, Artificial
  CRISPR gRNA sequence
gatcatttttttgggtatat

SEQ ID NO: 793421 - DNA, 20 bp, Artificial
  CRISPR gRNA sequence
acaataattgtacttattta

SEQ ID NO: 793422 - DNA, 20 bp, Artificial
  CRISPR gRNA sequence
acaatgtatagtgatcagat

SEQ ID NO: 793423 - DNA, 20 bp, Artificial
  CRISPR gRNA sequence
aatatttatatgtatttttc

SEQ ID NO: 793424 - DNA, 20 bp, Artificial
  CRISPR gRNA sequence
tcttttatatttagtcacct

SEQ ID NO: 793425 - DNA, 20 bp, Artificial
  CRISPR gRNA sequence
tcacctttggatacatatgt

SEQ ID NO: 793426 - DNA, 20 bp, Artificial
  CRISPR gRNA sequence
agaaacttatgaaaaattat

SEQ ID NO: 793427 - DNA, 20 bp, Artificial
  CRISPR gRNA sequence
tgcatcatacttattttagg

SEQ ID NO: 793428 - DNA, 20 bp, Artificial
  CRISPR gRNA sequence
aaaaagttggaccatcacct

SEQ ID NO: 793429 - DNA, 20 bp, Artificial
  CRISPR gRNA sequence
aagagtaggctaccctgatc

SEQ ID NO: 793430 - DNA, 20 bp, Artificial
  CRISPR gRNA sequence
gatagatctgaggccccaat

SEQ ID NO: 793431 - DNA, 20 bp, Artificial
  CRISPR gRNA sequence
aggccccaatgagggttccc

SEQ ID NO: 793432 - DNA, 20 bp, Artificial
  CRISPR gRNA sequence
ccatggcataaagcttgaaa

SEQ ID NO: 793433 - DNA, 20 bp, Artificial
  CRISPR gRNA sequence
ttcttatcaaatataatgaa

SEQ ID NO: 793434 - DNA, 20 bp, Artificial
  CRISPR gRNA sequence
ggacagaacaaattatgagg

SEQ ID NO: 793435 - DNA, 20 bp, Artificial
  CRISPR gRNA sequence
cagagaggccccaggagccc

SEQ ID NO: 793436 - DNA, 20 bp, Artificial
  CRISPR gRNA sequence
caggggtctctcagaggagc

SEQ ID NO: 793437 - DNA, 20 bp, Artificial
  CRISPR gRNA sequence
tctgtgcaaaggtttccaga

SEQ ID NO: 793438 - DNA, 20 bp, Artificial
  CRISPR gRNA sequence
tgaaggcctgggcagggcag

SEQ ID NO: 793439 - DNA, 20 bp, Artificial
  CRISPR gRNA sequence
ggatgggaagagccaacacc

SEQ ID NO: 793440 - DNA, 20 bp, Artificial
  CRISPR gRNA sequence
agtacttcaaaccagaaaca

SEQ ID NO: 793441 - DNA, 20 bp, Artificial
  CRISPR gRNA sequence
aacattctacccaacaatcg

SEQ ID NO: 793442 - DNA, 20 bp, Artificial
  CRISPR gRNA sequence
agtactctcttagatcacag

SEQ ID NO: 793443 - DNA, 20 bp, Artificial
  CRISPR gRNA sequence
aattacatggaagttaaata

SEQ ID NO: 793444 - DNA, 20 bp, Artificial
  CRISPR gRNA sequence
agttaaataatgagtgatca

SEQ ID NO: 793445 - DNA, 20 bp, Artificial
  CRISPR gRNA sequence
gacacaacctatcaaaactc

SEQ ID NO: 793446 - DNA, 20 bp, Artificial
  CRISPR gRNA sequence
aactagaaaagctagaggag

SEQ ID NO: 793447 - DNA, 20 bp, Artificial
  CRISPR gRNA sequence
atcaataacaagcagcaaga

SEQ ID NO: 793448 - DNA, 20 bp, Artificial
  CRISPR gRNA sequence
aggaccagacagattcatag

SEQ ID NO: 793449 - DNA, 20 bp, Artificial
  CRISPR gRNA sequence
attctatcagacattcaaag

SEQ ID NO: 793450 - DNA, 20 bp, Artificial
  CRISPR gRNA sequence
attctattgacactattcca

SEQ ID NO: 793451 - DNA, 20 bp, Artificial
  CRISPR gRNA sequence
ttccatgggatagagaaaga

SEQ ID NO: 793452 - DNA, 20 bp, Artificial
  CRISPR gRNA sequence
agataatccaccatgatcaa

SEQ ID NO: 793453 - DNA, 20 bp, Artificial
  CRISPR gRNA sequence
gatcaagtgggttttacacc

SEQ ID NO: 793454 - DNA, 20 bp, Artificial
  CRISPR gRNA sequence
gggttttacaccagggatgc

SEQ ID NO: 793455 - DNA, 20 bp, Artificial
  CRISPR gRNA sequence
aatgtgatacaccacacaaa

SEQ ID NO: 793456 - DNA, 20 bp, Artificial
  CRISPR gRNA sequence
aacccacagccaacattatg

SEQ ID NO: 793457 - DNA, 20 bp, Artificial
  CRISPR gRNA sequence
aagttgaaagcattttccct

SEQ ID NO: 793458 - DNA, 20 bp, Artificial
  CRISPR gRNA sequence
tcatatacctagaaaaccct

SEQ ID NO: 793459 - DNA, 20 bp, Artificial
  CRISPR gRNA sequence
aaacaaattcagcaaagttt

SEQ ID NO: 793460 - DNA, 20 bp, Artificial
  CRISPR gRNA sequence
aaaaataaaataaaatactt

SEQ ID NO: 793461 - DNA, 20 bp, Artificial
  CRISPR gRNA sequence
tggaaacacatcccatgttc

SEQ ID NO: 793462 - DNA, 20 bp, Artificial
  CRISPR gRNA sequence
tggaacaaaacggagaacct

SEQ ID NO: 793463 - DNA, 20 bp, Artificial
  CRISPR gRNA sequence
tcctattcaacaaacggtgc

SEQ ID NO: 793464 - DNA, 20 bp, Artificial
  CRISPR gRNA sequence
aattggctagccacatggag

SEQ ID NO: 793465 - DNA, 20 bp, Artificial
  CRISPR gRNA sequence
gccacatggagaagaataaa

SEQ ID NO: 793466 - DNA, 20 bp, Artificial
  CRISPR gRNA sequence
ttataaaaaatcaactcaag

SEQ ID NO: 793467 - DNA, 20 bp, Artificial
  CRISPR gRNA sequence
acagcaaaagaaataatcag

SEQ ID NO: 793468 - DNA, 20 bp, Artificial
  CRISPR gRNA sequence
cagagttaacagacaaccca

SEQ ID NO: 793469 - DNA, 20 bp, Artificial
  CRISPR gRNA sequence
tctgacaaaggactaatatc

SEQ ID NO: 793470 - DNA, 20 bp, Artificial
  CRISPR gRNA sequence
tcaaaaaatgggctaaggac

SEQ ID NO: 793471 - DNA, 20 bp, Artificial
  CRISPR gRNA sequence
cgataccaccttactcctgc

SEQ ID NO: 793472 - DNA, 20 bp, Artificial
  CRISPR gRNA sequence
aaaaaataatagatgttggc

SEQ ID NO: 793473 - DNA, 20 bp, Artificial
  CRISPR gRNA sequence
aacactcttacactgttggt

SEQ ID NO: 793474 - DNA, 20 bp, Artificial
  CRISPR gRNA sequence
gcccaaatgcccatcaatca

SEQ ID NO: 793475 - DNA, 20 bp, Artificial
  CRISPR gRNA sequence
aaatgcccatcaatcagtga

SEQ ID NO: 793476 - DNA, 20 bp, Artificial
  CRISPR gRNA sequence
catattatatatatacacca

SEQ ID NO: 793477 - DNA, 20 bp, Artificial
  CRISPR gRNA sequence
aatactacttagctatgaaa

SEQ ID NO: 793478 - DNA, 20 bp, Artificial
  CRISPR gRNA sequence
atcatagcatttgcagcatc

SEQ ID NO: 793479 - DNA, 20 bp, Artificial
  CRISPR gRNA sequence
agcatttgcagcatcctgga

SEQ ID NO: 793480 - DNA, 20 bp, Artificial
  CRISPR gRNA sequence
tattctaagtgaagtaactc

SEQ ID NO: 793481 - DNA, 20 bp, Artificial
  CRISPR gRNA sequence
ataagtgcgagctaagctat

SEQ ID NO: 793482 - DNA, 20 bp, Artificial
  CRISPR gRNA sequence
ctatgaggatggaaaggcat

SEQ ID NO: 793483 - DNA, 20 bp, Artificial
  CRISPR gRNA sequence
gactttcaggacttagggga

SEQ ID NO: 793484 - DNA, 20 bp, Artificial
  CRISPR gRNA sequence
acttaggggaaaggatggtt

SEQ ID NO: 793485 - DNA, 20 bp, Artificial
  CRISPR gRNA sequence
tactcgggaggctgaggcag

SEQ ID NO: 793486 - DNA, 20 bp, Artificial
  CRISPR gRNA sequence
gaatggcaggaacctgggag

SEQ ID NO: 793487 - DNA, 20 bp, Artificial
  CRISPR gRNA sequence
tttttcccttggggaaacag

SEQ ID NO: 793488 - DNA, 20 bp, Artificial
  CRISPR gRNA sequence
acagaagggtgtaagaaaat

SEQ ID NO: 793489 - DNA, 20 bp, Artificial
  CRISPR gRNA sequence
cctgcagtagcgggaagcct

SEQ ID NO: 793490 - DNA, 20 bp, Artificial
  CRISPR gRNA sequence
ttaaaaaagaaaacaatgtc

SEQ ID NO: 793491 - DNA, 20 bp, Artificial
  CRISPR gRNA sequence
aacaatgtcctgaatttcaa

SEQ ID NO: 793492 - DNA, 20 bp, Artificial
  CRISPR gRNA sequence
gggggggaggggaagctcct

SEQ ID NO: 793493 - DNA, 20 bp, Artificial
  CRISPR gRNA sequence
cttttcaggcaatttaacag

SEQ ID NO: 793494 - DNA, 20 bp, Artificial
  CRISPR gRNA sequence
tatagtgaaaagggggaagg

SEQ ID NO: 793495 - DNA, 20 bp, Artificial
  CRISPR gRNA sequence
aggcagggttaatggagccc

SEQ ID NO: 793496 - DNA, 20 bp, Artificial
  CRISPR gRNA sequence
tcctaggctatacaggccac

SEQ ID NO: 793497 - DNA, 20 bp, Artificial
  CRISPR gRNA sequence
cagagaagaaaaagtgagag

SEQ ID NO: 793498 - DNA, 20 bp, Artificial
  CRISPR gRNA sequence
aagcacacacaccttgtgta

SEQ ID NO: 793499 - DNA, 20 bp, Artificial
  CRISPR gRNA sequence
gtgtattgggtggtaaaagg

SEQ ID NO: 793500 - DNA, 20 bp, Artificial
  CRISPR gRNA sequence
gactgaaaagctagtagttg

SEQ ID NO: 793501 - DNA, 20 bp, Artificial
  CRISPR gRNA sequence
gagacaatctccaagtgcta

SEQ ID NO: 793502 - DNA, 20 bp, Artificial
  CRISPR gRNA sequence
gggtctgttattcaggttgt

SEQ ID NO: 793503 - DNA, 20 bp, Artificial
  CRISPR gRNA sequence
ccttaggttacattaaaacc

SEQ ID NO: 793504 - DNA, 20 bp, Artificial
  CRISPR gRNA sequence
tgtgctgcttagataatatc

SEQ ID NO: 793505 - DNA, 20 bp, Artificial
  CRISPR gRNA sequence
ccaaagactactatctggaa

SEQ ID NO: 793506 - DNA, 20 bp, Artificial
  CRISPR gRNA sequence
ggaggtaggcatgttttact

SEQ ID NO: 793507 - DNA, 20 bp, Artificial
  CRISPR gRNA sequence
ttagggttgaaaagactaga

SEQ ID NO: 793508 - DNA, 20 bp, Artificial
  CRISPR gRNA sequence
cagttatattcaaatatcag

SEQ ID NO: 793509 - DNA, 20 bp, Artificial
  CRISPR gRNA sequence
gcaataattgctaacactaa

SEQ ID NO: 793510 - DNA, 20 bp, Artificial
  CRISPR gRNA sequence
aattatttaacacccttgtt

SEQ ID NO: 793511 - DNA, 20 bp, Artificial
  CRISPR gRNA sequence
atttcctaaacaagaaaact

SEQ ID NO: 793512 - DNA, 20 bp, Artificial
  CRISPR gRNA sequence
actaaactagacaaatacca

SEQ ID NO: 793513 - DNA, 20 bp, Artificial
  CRISPR gRNA sequence
agactgcttctagaggaagt

SEQ ID NO: 793514 - DNA, 20 bp, Artificial
  CRISPR gRNA sequence
gggacacttcataatgataa

SEQ ID NO: 793515 - DNA, 20 bp, Artificial
  CRISPR gRNA sequence
cacttcataatgataaaaga

SEQ ID NO: 793516 - DNA, 20 bp, Artificial
  CRISPR gRNA sequence
tcatcaaagcaattatctag

SEQ ID NO: 793517 - DNA, 20 bp, Artificial
  CRISPR gRNA sequence
tgagcaataagtcagatgac

SEQ ID NO: 793518 - DNA, 20 bp, Artificial
  CRISPR gRNA sequence
agtcagatgacttgaatttt

SEQ ID NO: 793519 - DNA, 20 bp, Artificial
  CRISPR gRNA sequence
aaatttactcatcttttcct

SEQ ID NO: 793520 - DNA, 20 bp, Artificial
  CRISPR gRNA sequence
tttctgatactgcaaaaatg

SEQ ID NO: 793521 - DNA, 20 bp, Artificial
  CRISPR gRNA sequence
aatacaaaatgagagataaa

SEQ ID NO: 793522 - DNA, 20 bp, Artificial
  CRISPR gRNA sequence
gagtactcgaaatacacact

SEQ ID NO: 793523 - DNA, 20 bp, Artificial
  CRISPR gRNA sequence
ttttggcttcaaggagattg

SEQ ID NO: 793524 - DNA, 20 bp, Artificial
  CRISPR gRNA sequence
tcagtaggctgcttcagtgt

SEQ ID NO: 793525 - DNA, 20 bp, Artificial
  CRISPR gRNA sequence
tgccttatcttctactactg

SEQ ID NO: 793526 - DNA, 20 bp, Artificial
  CRISPR gRNA sequence
ctcttatggtgattccaatt

SEQ ID NO: 793527 - DNA, 20 bp, Artificial
  CRISPR gRNA sequence
atgcattacaaaatagtaat

SEQ ID NO: 793528 - DNA, 20 bp, Artificial
  CRISPR gRNA sequence
tatgaattttacccacctca

SEQ ID NO: 793529 - DNA, 20 bp, Artificial
  CRISPR gRNA sequence
ggacataccaggaggcccag

SEQ ID NO: 793530 - DNA, 20 bp, Artificial
  CRISPR gRNA sequence
caaagtgcacgcaggttctg

SEQ ID NO: 793531 - DNA, 20 bp, Artificial
  CRISPR gRNA sequence
ctctagtgaacccagatcta

SEQ ID NO: 793532 - DNA, 20 bp, Artificial
  CRISPR gRNA sequence
agtgggtgttgtttgctata

SEQ ID NO: 793533 - DNA, 20 bp, Artificial
  CRISPR gRNA sequence
tgaacattccttctcttcca

SEQ ID NO: 793534 - DNA, 20 bp, Artificial
  CRISPR gRNA sequence
attgaaatttaatttcttaa

SEQ ID NO: 793535 - DNA, 20 bp, Artificial
  CRISPR gRNA sequence
tcttaaaagaatatttccta

SEQ ID NO: 793536 - DNA, 20 bp, Artificial
  CRISPR gRNA sequence
tcttgtgtcttctagtctct

SEQ ID NO: 793537 - DNA, 20 bp, Artificial
  CRISPR gRNA sequence
ctggcaataatgtatattta

SEQ ID NO: 793538 - DNA, 20 bp, Artificial
  CRISPR gRNA sequence
atctatgtatagattataga

SEQ ID NO: 793539 - DNA, 20 bp, Artificial
  CRISPR gRNA sequence
actttgggaggccaaggcag

SEQ ID NO: 793540 - DNA, 20 bp, Artificial
  CRISPR gRNA sequence
caggtggatcacctgaggtc

SEQ ID NO: 793541 - DNA, 20 bp, Artificial
  CRISPR gRNA sequence
tactcaggaagctgaggcag

SEQ ID NO: 793542 - DNA, 20 bp, Artificial
  CRISPR gRNA sequence
tcacgctgttgcactccagc

SEQ ID NO: 793543 - DNA, 20 bp, Artificial
  CRISPR gRNA sequence
caaaaaaaaaaaaaaaaaaa

SEQ ID NO: 793544 - DNA, 20 bp, Artificial
  CRISPR gRNA sequence
ctcttcttaatctcaaaaca

SEQ ID NO: 793545 - DNA, 20 bp, Artificial
  CRISPR gRNA sequence
aattcatgcttttagcaaat

SEQ ID NO: 793546 - DNA, 20 bp, Artificial
  CRISPR gRNA sequence
gcttttagcaaatttgaata

SEQ ID NO: 793547 - DNA, 20 bp, Artificial
  CRISPR gRNA sequence
acctttctactctgtttcta

SEQ ID NO: 793548 - DNA, 20 bp, Artificial
  CRISPR gRNA sequence
tcagttccatccatgttgtc

SEQ ID NO: 793549 - DNA, 20 bp, Artificial
  CRISPR gRNA sequence
ggttccacatcttggttatt

SEQ ID NO: 793550 - DNA, 20 bp, Artificial
  CRISPR gRNA sequence
ttattgtgaatcatgctgaa

SEQ ID NO: 793551 - DNA, 20 bp, Artificial
  CRISPR gRNA sequence
aatcatgctgaaatgaataa

SEQ ID NO: 793552 - DNA, 20 bp, Artificial
  CRISPR gRNA sequence
acatactaaattcaattcct

SEQ ID NO: 793553 - DNA, 20 bp, Artificial
  CRISPR gRNA sequence
tatacccagaagtaggactg

SEQ ID NO: 793554 - DNA, 20 bp, Artificial
  CRISPR gRNA sequence
gcatgtgttagggagaagtg

SEQ ID NO: 793555 - DNA, 20 bp, Artificial
  CRISPR gRNA sequence
ataccaaataaagtgagata

SEQ ID NO: 793556 - DNA, 20 bp, Artificial
  CRISPR gRNA sequence
cttggaccactgttgaggtc

SEQ ID NO: 793557 - DNA, 20 bp, Artificial
  CRISPR gRNA sequence
ccactgttgaggtctggaat

SEQ ID NO: 793558 - DNA, 20 bp, Artificial
  CRISPR gRNA sequence
tatcttcagtaaccgtccac

SEQ ID NO: 793559 - DNA, 20 bp, Artificial
  CRISPR gRNA sequence
agtaaccgtccacaagaatt

SEQ ID NO: 793560 - DNA, 20 bp, Artificial
  CRISPR gRNA sequence
tgccatctttattgcattgt

SEQ ID NO: 793561 - DNA, 20 bp, Artificial
  CRISPR gRNA sequence
gtggaaaatagcatgatatc

SEQ ID NO: 793562 - DNA, 20 bp, Artificial
  CRISPR gRNA sequence
catgaagtaccaagctctat

SEQ ID NO: 793563 - DNA, 20 bp, Artificial
  CRISPR gRNA sequence
gaaacttcagctgtgtgttc

SEQ ID NO: 793564 - DNA, 20 bp, Artificial
  CRISPR gRNA sequence
cacttcctaggtctatcagt

SEQ ID NO: 793565 - DNA, 20 bp, Artificial
  CRISPR gRNA sequence
acaagaaacagatggcatac

SEQ ID NO: 793566 - DNA, 20 bp, Artificial
  CRISPR gRNA sequence
gcatactcgagtgatttgag

SEQ ID NO: 793567 - DNA, 20 bp, Artificial
  CRISPR gRNA sequence
caccatttggagaaactaca

SEQ ID NO: 793568 - DNA, 20 bp, Artificial
  CRISPR gRNA sequence
accactgttggagaagttac

SEQ ID NO: 793569 - DNA, 20 bp, Artificial
  CRISPR gRNA sequence
cttcccaggagctgtagcca

SEQ ID NO: 793570 - DNA, 20 bp, Artificial
  CRISPR gRNA sequence
tgccacatgcagcgactcca

SEQ ID NO: 793571 - DNA, 20 bp, Artificial
  CRISPR gRNA sequence
gcgactccaaagggtggaaa

SEQ ID NO: 793572 - DNA, 20 bp, Artificial
  CRISPR gRNA sequence
ctccaaagggtggaaactgg

SEQ ID NO: 793573 - DNA, 20 bp, Artificial
  CRISPR gRNA sequence
aaagggtggaaactggatga

SEQ ID NO: 793574 - DNA, 20 bp, Artificial
  CRISPR gRNA sequence
ctgaacccagctagaagtca

SEQ ID NO: 793575 - DNA, 20 bp, Artificial
  CRISPR gRNA sequence
agctagaagtcagagaatac

SEQ ID NO: 793576 - DNA, 20 bp, Artificial
  CRISPR gRNA sequence
cagagcaatattgacatgta

SEQ ID NO: 793577 - DNA, 20 bp, Artificial
  CRISPR gRNA sequence
tgcacagtgtcatgagccag

SEQ ID NO: 793578 - DNA, 20 bp, Artificial
  CRISPR gRNA sequence
cagtgtcatgagccagcagg

SEQ ID NO: 793579 - DNA, 20 bp, Artificial
  CRISPR gRNA sequence
ttgctgccagtcagctggtt

SEQ ID NO: 793580 - DNA, 20 bp, Artificial
  CRISPR gRNA sequence
cagagcctttactgactatg

SEQ ID NO: 793581 - DNA, 20 bp, Artificial
  CRISPR gRNA sequence
ctatgctggatatttttgga

SEQ ID NO: 793582 - DNA, 20 bp, Artificial
  CRISPR gRNA sequence
tacttttgaacttcatacag

SEQ ID NO: 793583 - DNA, 20 bp, Artificial
  CRISPR gRNA sequence
agagacaggtaatttcatca

SEQ ID NO: 793584 - DNA, 20 bp, Artificial
  CRISPR gRNA sequence
tggaggtcagaaagccagac

SEQ ID NO: 793585 - DNA, 20 bp, Artificial
  CRISPR gRNA sequence
ggctcaaatcaaggtgtcag

SEQ ID NO: 793586 - DNA, 20 bp, Artificial
  CRISPR gRNA sequence
tcttattctgccccccaggc

SEQ ID NO: 793587 - DNA, 20 bp, Artificial
  CRISPR gRNA sequence
ctcactgcaacccctgcctc

SEQ ID NO: 793588 - DNA, 20 bp, Artificial
  CRISPR gRNA sequence
tattctcctgtctcagcctc

SEQ ID NO: 793589 - DNA, 20 bp, Artificial
  CRISPR gRNA sequence
gtctcagcctcctgagtagc

SEQ ID NO: 793590 - DNA, 20 bp, Artificial
  CRISPR gRNA sequence
tttttgtatttttagtagag

SEQ ID NO: 793591 - DNA, 20 bp, Artificial
  CRISPR gRNA sequence
gcctcagcctcccaaattgc

SEQ ID NO: 793592 - DNA, 20 bp, Artificial
  CRISPR gRNA sequence
actccatccccctggttatt

SEQ ID NO: 793593 - DNA, 20 bp, Artificial
  CRISPR gRNA sequence
gtgacatattcacatgttcc

SEQ ID NO: 793594 - DNA, 20 bp, Artificial
  CRISPR gRNA sequence
tattcacatgttccagggat

SEQ ID NO: 793595 - DNA, 20 bp, Artificial
  CRISPR gRNA sequence
ttttatttatcctactgaga

SEQ ID NO: 793596 - DNA, 20 bp, Artificial
  CRISPR gRNA sequence
agggcagaagcaagagattt

SEQ ID NO: 793597 - DNA, 20 bp, Artificial
  CRISPR gRNA sequence
agagatttaggagtttaaga

SEQ ID NO: 793598 - DNA, 20 bp, Artificial
  CRISPR gRNA sequence
agtttaagagagggtaatat

SEQ ID NO: 793599 - DNA, 20 bp, Artificial
  CRISPR gRNA sequence
ctaagatgtctactcagaca

SEQ ID NO: 793600 - DNA, 20 bp, Artificial
  CRISPR gRNA sequence
cttcacgcccattggttgac

SEQ ID NO: 793601 - DNA, 20 bp, Artificial
  CRISPR gRNA sequence
gggctagacatgcatgtggg

SEQ ID NO: 793602 - DNA, 20 bp, Artificial
  CRISPR gRNA sequence
agaaaagtatccaatttgag

SEQ ID NO: 793603 - DNA, 20 bp, Artificial
  CRISPR gRNA sequence
ggtgaattactgaccttgaa

SEQ ID NO: 793604 - DNA, 20 bp, Artificial
  CRISPR gRNA sequence
gaagtgagtgtaagcctaac

SEQ ID NO: 793605 - DNA, 20 bp, Artificial
  CRISPR gRNA sequence
ctgtagttcctgctgctgct

SEQ ID NO: 793606 - DNA, 20 bp, Artificial
  CRISPR gRNA sequence
ccctcacctaacaccccaga

SEQ ID NO: 793607 - DNA, 20 bp, Artificial
  CRISPR gRNA sequence
ggaatggtttctttgcctga

SEQ ID NO: 793608 - DNA, 20 bp, Artificial
  CRISPR gRNA sequence
tcagcatgcccttaacagac

SEQ ID NO: 793609 - DNA, 20 bp, Artificial
  CRISPR gRNA sequence
caaatatcttttcattatca

SEQ ID NO: 793610 - DNA, 20 bp, Artificial
  CRISPR gRNA sequence
tatggaagtaaaaagaacca

SEQ ID NO: 793611 - DNA, 20 bp, Artificial
  CRISPR gRNA sequence
accagtgaatcagcggaccc

SEQ ID NO: 793612 - DNA, 20 bp, Artificial
  CRISPR gRNA sequence
tttagatgcagtagaacaag

SEQ ID NO: 793613 - DNA, 20 bp, Artificial
  CRISPR gRNA sequence
acaagcagagtatcccctgc

SEQ ID NO: 793614 - DNA, 20 bp, Artificial
  CRISPR gRNA sequence
ttcagcagagcctaaatgtg

SEQ ID NO: 793615 - DNA, 20 bp, Artificial
  CRISPR gRNA sequence
cagagcctaaatgtgtgggg

SEQ ID NO: 793616 - DNA, 20 bp, Artificial
  CRISPR gRNA sequence
ggttgagtgaacttctatac

SEQ ID NO: 793617 - DNA, 20 bp, Artificial
  CRISPR gRNA sequence
gaggggccaacctgcagcac

SEQ ID NO: 793618 - DNA, 20 bp, Artificial
  CRISPR gRNA sequence
gaggaggttgtcaggaggaa

SEQ ID NO: 793619 - DNA, 20 bp, Artificial
  CRISPR gRNA sequence
ctaccaccatcaagtacagt

SEQ ID NO: 793620 - DNA, 20 bp, Artificial
  CRISPR gRNA sequence
tggggtgaggcagacatggt

SEQ ID NO: 793621 - DNA, 20 bp, Artificial
  CRISPR gRNA sequence
aattaaaattaattttttca

SEQ ID NO: 793622 - DNA, 20 bp, Artificial
  CRISPR gRNA sequence
attagtttagaaggaaagag

SEQ ID NO: 793623 - DNA, 20 bp, Artificial
  CRISPR gRNA sequence
ggaaagagaggagtcatgct

SEQ ID NO: 793624 - DNA, 20 bp, Artificial
  CRISPR gRNA sequence
actttgggaggccaaggcag

SEQ ID NO: 793625 - DNA, 20 bp, Artificial
  CRISPR gRNA sequence
ctccactccagcctgggcaa

SEQ ID NO: 793626 - DNA, 20 bp, Artificial
  CRISPR gRNA sequence
gaccaacttcaggtaaaaaa

SEQ ID NO: 793627 - DNA, 20 bp, Artificial
  CRISPR gRNA sequence
ctaaagctaaagcctctaaa

SEQ ID NO: 793628 - DNA, 20 bp, Artificial
  CRISPR gRNA sequence
ccacgagaacttttttcccc

SEQ ID NO: 793629 - DNA, 20 bp, Artificial
  CRISPR gRNA sequence
ttcaactgtcgttcgttata

SEQ ID NO: 793630 - DNA, 20 bp, Artificial
  CRISPR gRNA sequence
gttaagtgtaggccagtact

SEQ ID NO: 793631 - DNA, 20 bp, Artificial
  CRISPR gRNA sequence
agtgtaggccagtactttgg

SEQ ID NO: 793632 - DNA, 20 bp, Artificial
  CRISPR gRNA sequence
gaaacaggggcctgtatgag

SEQ ID NO: 793633 - DNA, 20 bp, Artificial
  CRISPR gRNA sequence
acgctgtgagaagttaacag

SEQ ID NO: 793634 - DNA, 20 bp, Artificial
  CRISPR gRNA sequence
acaaccatgggagagacctg

SEQ ID NO: 793635 - DNA, 20 bp, Artificial
  CRISPR gRNA sequence
gtggggtcttcatcagagct

SEQ ID NO: 793636 - DNA, 20 bp, Artificial
  CRISPR gRNA sequence
catcagagctcaggatctcc

SEQ ID NO: 793637 - DNA, 20 bp, Artificial
  CRISPR gRNA sequence
tcgtcctactgtttactgac

SEQ ID NO: 793638 - DNA, 20 bp, Artificial
  CRISPR gRNA sequence
tcagtcactccagggcacaa

SEQ ID NO: 793639 - DNA, 20 bp, Artificial
  CRISPR gRNA sequence
attccacactaaggcaaaag

SEQ ID NO: 793640 - DNA, 20 bp, Artificial
  CRISPR gRNA sequence
taataagtgctcaacaaatg

SEQ ID NO: 793641 - DNA, 20 bp, Artificial
  CRISPR gRNA sequence
ctcaacaaatgttgggttga

SEQ ID NO: 793642 - DNA, 20 bp, Artificial
  CRISPR gRNA sequence
ccaaagtcacacatctgcct

SEQ ID NO: 793643 - DNA, 20 bp, Artificial
  CRISPR gRNA sequence
ataaaacaaacacggaaacg

SEQ ID NO: 793644 - DNA, 20 bp, Artificial
  CRISPR gRNA sequence
acacggaaacgaagagtatg

SEQ ID NO: 793645 - DNA, 20 bp, Artificial
  CRISPR gRNA sequence
aacgaagagtatggtgggtg

SEQ ID NO: 793646 - DNA, 20 bp, Artificial
  CRISPR gRNA sequence
ggagggtactccactgactc

SEQ ID NO: 793647 - DNA, 20 bp, Artificial
  CRISPR gRNA sequence
ggtactccactgactctaga

SEQ ID NO: 793648 - DNA, 20 bp, Artificial
  CRISPR gRNA sequence
agatcattttccttttgaaa

SEQ ID NO: 793649 - DNA, 20 bp, Artificial
  CRISPR gRNA sequence
gttgtattttcattaggaaa

SEQ ID NO: 793650 - DNA, 20 bp, Artificial
  CRISPR gRNA sequence
cttgtagggctggcagaaaa

SEQ ID NO: 793651 - DNA, 20 bp, Artificial
  CRISPR gRNA sequence
cagtctctcatgtgtagcat

SEQ ID NO: 793652 - DNA, 20 bp, Artificial
  CRISPR gRNA sequence
ctctcatgtgtagcatgagg

SEQ ID NO: 793653 - DNA, 20 bp, Artificial
  CRISPR gRNA sequence
gagtagtggtagacagttta

SEQ ID NO: 793654 - DNA, 20 bp, Artificial
  CRISPR gRNA sequence
acagtttatagggttatagt

SEQ ID NO: 793655 - DNA, 20 bp, Artificial
  CRISPR gRNA sequence
gcaagttgcatgccttactt

SEQ ID NO: 793656 - DNA, 20 bp, Artificial
  CRISPR gRNA sequence
tgagttcatgaagttgtggc

SEQ ID NO: 793657 - DNA, 20 bp, Artificial
  CRISPR gRNA sequence
tgcatcattatatcattgct

SEQ ID NO: 793658 - DNA, 20 bp, Artificial
  CRISPR gRNA sequence
tagcactttgggaggctgag

SEQ ID NO: 793659 - DNA, 20 bp, Artificial
  CRISPR gRNA sequence
actttgggaggctgagatgg

SEQ ID NO: 793660 - DNA, 20 bp, Artificial
  CRISPR gRNA sequence
tgggtggattgcttgaggcc

SEQ ID NO: 793661 - DNA, 20 bp, Artificial
  CRISPR gRNA sequence
tactcaagaggccgaggcag

SEQ ID NO: 793662 - DNA, 20 bp, Artificial
  CRISPR gRNA sequence
ttaaattaaagaaacgacaa

SEQ ID NO: 793663 - DNA, 20 bp, Artificial
  CRISPR gRNA sequence
gaaacgacaaaagagtatgc

SEQ ID NO: 793664 - DNA, 20 bp, Artificial
  CRISPR gRNA sequence
agaattttaaaacaacttag

SEQ ID NO: 793665 - DNA, 20 bp, Artificial
  CRISPR gRNA sequence
caacttagaggaatatgtat

SEQ ID NO: 793666 - DNA, 20 bp, Artificial
  CRISPR gRNA sequence
agctaagcagctatgttcca

SEQ ID NO: 793667 - DNA, 20 bp, Artificial
  CRISPR gRNA sequence
tctgttgctctgccattctc

SEQ ID NO: 793668 - DNA, 20 bp, Artificial
  CRISPR gRNA sequence
tttcaaccttcagaaagtaa

SEQ ID NO: 793669 - DNA, 20 bp, Artificial
  CRISPR gRNA sequence
ctaatactaaagttgaaaga

SEQ ID NO: 793670 - DNA, 20 bp, Artificial
  CRISPR gRNA sequence
tactaaagttgaaagaaaga

SEQ ID NO: 793671 - DNA, 20 bp, Artificial
  CRISPR gRNA sequence
acaaggtaacaaatgactag

SEQ ID NO: 793672 - DNA, 20 bp, Artificial
  CRISPR gRNA sequence
ctaagcagactgatttccta

SEQ ID NO: 793673 - DNA, 20 bp, Artificial
  CRISPR gRNA sequence
tcctactggatgttcaactt

SEQ ID NO: 793674 - DNA, 20 bp, Artificial
  CRISPR gRNA sequence
tgttcaactttggagtcttc

SEQ ID NO: 793675 - DNA, 20 bp, Artificial
  CRISPR gRNA sequence
caactttggagtcttcaggg

SEQ ID NO: 793676 - DNA, 20 bp, Artificial
  CRISPR gRNA sequence
tgagggaacctgcacaggac

SEQ ID NO: 793677 - DNA, 20 bp, Artificial
  CRISPR gRNA sequence
agaagcagattataatcaat

SEQ ID NO: 793678 - DNA, 20 bp, Artificial
  CRISPR gRNA sequence
caatatgggttatccaatgt

SEQ ID NO: 793679 - DNA, 20 bp, Artificial
  CRISPR gRNA sequence
ttaatgttaatcacactctt

SEQ ID NO: 793680 - DNA, 20 bp, Artificial
  CRISPR gRNA sequence
atatctgtgggggctgagct

SEQ ID NO: 793681 - DNA, 20 bp, Artificial
  CRISPR gRNA sequence
gagctttgggtcagatagat

SEQ ID NO: 793682 - DNA, 20 bp, Artificial
  CRISPR gRNA sequence
tagcactgtgctggaggtag

SEQ ID NO: 793683 - DNA, 20 bp, Artificial
  CRISPR gRNA sequence
gcctgtcatgtttattccat

SEQ ID NO: 793684 - DNA, 20 bp, Artificial
  CRISPR gRNA sequence
cagaggcaaaattcaagctt

SEQ ID NO: 793685 - DNA, 20 bp, Artificial
  CRISPR gRNA sequence
tgaatagggcacaaattaac

SEQ ID NO: 793686 - DNA, 20 bp, Artificial
  CRISPR gRNA sequence
acaaggctttccccagcctc

SEQ ID NO: 793687 - DNA, 20 bp, Artificial
  CRISPR gRNA sequence
gtaataattcacactaaggc

SEQ ID NO: 793688 - DNA, 20 bp, Artificial
  CRISPR gRNA sequence
tttagtatattaacactacc

SEQ ID NO: 793689 - DNA, 20 bp, Artificial
  CRISPR gRNA sequence
ggatattctatttcttccaa

SEQ ID NO: 793690 - DNA, 20 bp, Artificial
  CRISPR gRNA sequence
tggtatagattctaagcact

SEQ ID NO: 793691 - DNA, 20 bp, Artificial
  CRISPR gRNA sequence
tttgccactgggaagagaga

SEQ ID NO: 793692 - DNA, 20 bp, Artificial
  CRISPR gRNA sequence
gagaggatgaggaggagaag

SEQ ID NO: 793693 - DNA, 20 bp, Artificial
  CRISPR gRNA sequence
gaaagatgattagatgatag

SEQ ID NO: 793694 - DNA, 20 bp, Artificial
  CRISPR gRNA sequence
gatgattagatgatagatgg

SEQ ID NO: 793695 - DNA, 20 bp, Artificial
  CRISPR gRNA sequence
gatgatagatggatggattg

SEQ ID NO: 793696 - DNA, 20 bp, Artificial
  CRISPR gRNA sequence
atagatggatggattgatgg

SEQ ID NO: 793697 - DNA, 20 bp, Artificial
  CRISPR gRNA sequence
gatggaaaaaaataacatga

SEQ ID NO: 793698 - DNA, 20 bp, Artificial
  CRISPR gRNA sequence
tgagagagtggtaaaaagca

SEQ ID NO: 793699 - DNA, 20 bp, Artificial
  CRISPR gRNA sequence
ggaaccagactgtatcttag

SEQ ID NO: 793700 - DNA, 20 bp, Artificial
  CRISPR gRNA sequence
cctttcttcaccagtgaaat

SEQ ID NO: 793701 - DNA, 20 bp, Artificial
  CRISPR gRNA sequence
tcatagcagagccaacttca

SEQ ID NO: 793702 - DNA, 20 bp, Artificial
  CRISPR gRNA sequence
aacttcacagagtggttgcg

SEQ ID NO: 793703 - DNA, 20 bp, Artificial
  CRISPR gRNA sequence
tcacagagtggttgcgagga

SEQ ID NO: 793704 - DNA, 20 bp, Artificial
  CRISPR gRNA sequence
gctgataggtgcagagcact

SEQ ID NO: 793705 - DNA, 20 bp, Artificial
  CRISPR gRNA sequence
acttagaatagggcctggtg

SEQ ID NO: 793706 - DNA, 20 bp, Artificial
  CRISPR gRNA sequence
acctcttagttgccatgtaa

SEQ ID NO: 793707 - DNA, 20 bp, Artificial
  CRISPR gRNA sequence
ctgtattcttcaaaaggtaa

SEQ ID NO: 793708 - DNA, 20 bp, Artificial
  CRISPR gRNA sequence
attcatggtaacccaatgca

SEQ ID NO: 793709 - DNA, 20 bp, Artificial
  CRISPR gRNA sequence
agtgagctgaacttcttaca

SEQ ID NO: 793710 - DNA, 20 bp, Artificial
  CRISPR gRNA sequence
cttacactgagttttttaaa

SEQ ID NO: 793711 - DNA, 20 bp, Artificial
  CRISPR gRNA sequence
tgttttgttcttatgtctga

SEQ ID NO: 793712 - DNA, 20 bp, Artificial
  CRISPR gRNA sequence
agagctttcatcagcctcat

SEQ ID NO: 793713 - DNA, 20 bp, Artificial
  CRISPR gRNA sequence
ttttgctggtgggaggttgc

SEQ ID NO: 793714 - DNA, 20 bp, Artificial
  CRISPR gRNA sequence
aggttgccaggatcctttct

SEQ ID NO: 793715 - DNA, 20 bp, Artificial
  CRISPR gRNA sequence
tcacccctcttttccccagt

SEQ ID NO: 793716 - DNA, 20 bp, Artificial
  CRISPR gRNA sequence
ttccccagtctggatatgac

SEQ ID NO: 793717 - DNA, 20 bp, Artificial
  CRISPR gRNA sequence
ttaaacccaccccctctccc

SEQ ID NO: 793718 - DNA, 20 bp, Artificial
  CRISPR gRNA sequence
caggaatctcaacctcacgg

SEQ ID NO: 793719 - DNA, 20 bp, Artificial
  CRISPR gRNA sequence
aaaggtttgtgaggccattt

SEQ ID NO: 793720 - DNA, 20 bp, Artificial
  CRISPR gRNA sequence
acgtctttcagcagctccct

SEQ ID NO: 793721 - DNA, 20 bp, Artificial
  CRISPR gRNA sequence
atgtgtctgtctttggtttc

SEQ ID NO: 793722 - DNA, 20 bp, Artificial
  CRISPR gRNA sequence
gagcctgcccacaaaacccc

SEQ ID NO: 793723 - DNA, 20 bp, Artificial
  CRISPR gRNA sequence
acatgtggaaataattcagt

SEQ ID NO: 793724 - DNA, 20 bp, Artificial
  CRISPR gRNA sequence
cagcactatctgaggactag

SEQ ID NO: 793725 - DNA, 20 bp, Artificial
  CRISPR gRNA sequence
ctatgtgtgtatgtattcac

SEQ ID NO: 793726 - DNA, 20 bp, Artificial
  CRISPR gRNA sequence
gaccacaatatttctaactg

SEQ ID NO: 793727 - DNA, 20 bp, Artificial
  CRISPR gRNA sequence
atttctaactgtagaatgca

SEQ ID NO: 793728 - DNA, 20 bp, Artificial
  CRISPR gRNA sequence
ggagggaagaagatggccag

SEQ ID NO: 793729 - DNA, 20 bp, Artificial
  CRISPR gRNA sequence
ttttaaatagaaccacttca

SEQ ID NO: 793730 - DNA, 20 bp, Artificial
  CRISPR gRNA sequence
tacctctcacacccatacct

SEQ ID NO: 793731 - DNA, 20 bp, Artificial
  CRISPR gRNA sequence
ataacttcagaaatgagcag

SEQ ID NO: 793732 - DNA, 20 bp, Artificial
  CRISPR gRNA sequence
tccgttccagctgtctttgg

SEQ ID NO: 793733 - DNA, 20 bp, Artificial
  CRISPR gRNA sequence
tccagctgtctttgggagaa

SEQ ID NO: 793734 - DNA, 20 bp, Artificial
  CRISPR gRNA sequence
ctgtctttgggagaatggaa

SEQ ID NO: 793735 - DNA, 20 bp, Artificial
  CRISPR gRNA sequence
aatggagtcacactcaaaga

SEQ ID NO: 793736 - DNA, 20 bp, Artificial
  CRISPR gRNA sequence
tcatccttcaccccaatctt

SEQ ID NO: 793737 - DNA, 20 bp, Artificial
  CRISPR gRNA sequence
ccttcaccccaatcttaaga

SEQ ID NO: 793738 - DNA, 20 bp, Artificial
  CRISPR gRNA sequence
ccccaatcttaagagtgagt

SEQ ID NO: 793739 - DNA, 20 bp, Artificial
  CRISPR gRNA sequence
aggagacctttcttacaaat

SEQ ID NO: 793740 - DNA, 20 bp, Artificial
  CRISPR gRNA sequence
ttcttacaaataagaattaa

SEQ ID NO: 793741 - DNA, 20 bp, Artificial
  CRISPR gRNA sequence
caaacttgtgtgccatggaa

SEQ ID NO: 793742 - DNA, 20 bp, Artificial
  CRISPR gRNA sequence
atgcagacagagctttaaac

SEQ ID NO: 793743 - DNA, 20 bp, Artificial
  CRISPR gRNA sequence
ccatggcttcttattgctca

SEQ ID NO: 793744 - DNA, 20 bp, Artificial
  CRISPR gRNA sequence
ggatgaagttccaacgagcc

SEQ ID NO: 793745 - DNA, 20 bp, Artificial
  CRISPR gRNA sequence
tgtctaaagctctaaccaca

SEQ ID NO: 793746 - DNA, 20 bp, Artificial
  CRISPR gRNA sequence
ggcatggcagtctttcaatt

SEQ ID NO: 793747 - DNA, 20 bp, Artificial
  CRISPR gRNA sequence
tattttttcttgttgtccac

SEQ ID NO: 793748 - DNA, 20 bp, Artificial
  CRISPR gRNA sequence
ttcttgttgtccacctgagt

SEQ ID NO: 793749 - DNA, 20 bp, Artificial
  CRISPR gRNA sequence
tcagcacacaatcacatgtc

SEQ ID NO: 793750 - DNA, 20 bp, Artificial
  CRISPR gRNA sequence
tgctgtctactccggccatg

SEQ ID NO: 793751 - DNA, 20 bp, Artificial
  CRISPR gRNA sequence
ggtcccaaagcaggacccct

SEQ ID NO: 793752 - DNA, 20 bp, Artificial
  CRISPR gRNA sequence
ctcttagggccattggtatc

SEQ ID NO: 793753 - DNA, 20 bp, Artificial
  CRISPR gRNA sequence
cattcaacagtttggggctc

SEQ ID NO: 793754 - DNA, 20 bp, Artificial
  CRISPR gRNA sequence
tctgcttgtctttacgtttc

SEQ ID NO: 793755 - DNA, 20 bp, Artificial
  CRISPR gRNA sequence
attgaacctactatatgcag

SEQ ID NO: 793756 - DNA, 20 bp, Artificial
  CRISPR gRNA sequence
aaggagaagtgtctttatgc

SEQ ID NO: 793757 - DNA, 20 bp, Artificial
  CRISPR gRNA sequence
acttcccaaagtcatacagc

SEQ ID NO: 793758 - DNA, 20 bp, Artificial
  CRISPR gRNA sequence
caaagtcatacagctgggat

SEQ ID NO: 793759 - DNA, 20 bp, Artificial
  CRISPR gRNA sequence
taagtttcaatccaaaataa

SEQ ID NO: 793760 - DNA, 20 bp, Artificial
  CRISPR gRNA sequence
agccaatggcaaagtcaagt

SEQ ID NO: 793761 - DNA, 20 bp, Artificial
  CRISPR gRNA sequence
ccagcagaagtcaccagcta

SEQ ID NO: 793762 - DNA, 20 bp, Artificial
  CRISPR gRNA sequence
acagccctagaagattgagc

SEQ ID NO: 793763 - DNA, 20 bp, Artificial
  CRISPR gRNA sequence
atggttacctgtggcccaca

SEQ ID NO: 793764 - DNA, 20 bp, Artificial
  CRISPR gRNA sequence
aacattcaagagcaattcct

SEQ ID NO: 793765 - DNA, 20 bp, Artificial
  CRISPR gRNA sequence
tcatgaaagagactacagtg

SEQ ID NO: 793766 - DNA, 20 bp, Artificial
  CRISPR gRNA sequence
tccaaattccaggccaagct

SEQ ID NO: 793767 - DNA, 20 bp, Artificial
  CRISPR gRNA sequence
caagctcaggatagtcatga

SEQ ID NO: 793768 - DNA, 20 bp, Artificial
  CRISPR gRNA sequence
cctggtatatagggcaaaag

SEQ ID NO: 793769 - DNA, 20 bp, Artificial
  CRISPR gRNA sequence
tatagggcaaaagcagaatt

SEQ ID NO: 793770 - DNA, 20 bp, Artificial
  CRISPR gRNA sequence
tcaggaacccaggcaatggc

SEQ ID NO: 793771 - DNA, 20 bp, Artificial
  CRISPR gRNA sequence
ttgggcattaaatcctaaaa

SEQ ID NO: 793772 - DNA, 20 bp, Artificial
  CRISPR gRNA sequence
attaaatcctaaaagagaat

SEQ ID NO: 793773 - DNA, 20 bp, Artificial
  CRISPR gRNA sequence
aaaagagaatcagagtggga

SEQ ID NO: 793774 - DNA, 20 bp, Artificial
  CRISPR gRNA sequence
accaacctaagatcccattg

SEQ ID NO: 793775 - DNA, 20 bp, Artificial
  CRISPR gRNA sequence
aagatcccattgacgaataa

SEQ ID NO: 793776 - DNA, 20 bp, Artificial
  CRISPR gRNA sequence
aatgtggtatatatacacca

SEQ ID NO: 793777 - DNA, 20 bp, Artificial
  CRISPR gRNA sequence
aatactactcagccatgaaa

SEQ ID NO: 793778 - DNA, 20 bp, Artificial
  CRISPR gRNA sequence
ataatgtgttttgcaacaac

SEQ ID NO: 793779 - DNA, 20 bp, Artificial
  CRISPR gRNA sequence
tattccaagtgaagtaactc

SEQ ID NO: 793780 - DNA, 20 bp, Artificial
  CRISPR gRNA sequence
ttgtaagtgggagctaagct

SEQ ID NO: 793781 - DNA, 20 bp, Artificial
  CRISPR gRNA sequence
tatggatatgcaaaggcata

SEQ ID NO: 793782 - DNA, 20 bp, Artificial
  CRISPR gRNA sequence
gcatgggagactcagaagga

SEQ ID NO: 793783 - DNA, 20 bp, Artificial
  CRISPR gRNA sequence
agactcagaaggagagagta

SEQ ID NO: 793784 - DNA, 20 bp, Artificial
  CRISPR gRNA sequence
gagagtagggagtggcagtg

SEQ ID NO: 793785 - DNA, 20 bp, Artificial
  CRISPR gRNA sequence
aggaataaaaaagctgcata

SEQ ID NO: 793786 - DNA, 20 bp, Artificial
  CRISPR gRNA sequence
ttgagttcaatgtacactat

SEQ ID NO: 793787 - DNA, 20 bp, Artificial
  CRISPR gRNA sequence
caatgtacactatttgggtg

SEQ ID NO: 793788 - DNA, 20 bp, Artificial
  CRISPR gRNA sequence
tgtgcttctgaaccagtaac

SEQ ID NO: 793789 - DNA, 20 bp, Artificial
  CRISPR gRNA sequence
attctgcagccagacatttc

SEQ ID NO: 793790 - DNA, 20 bp, Artificial
  CRISPR gRNA sequence
gcagccagacatttcctgga

SEQ ID NO: 793791 - DNA, 20 bp, Artificial
  CRISPR gRNA sequence
cctttaagtgcctgagggcc

SEQ ID NO: 793792 - DNA, 20 bp, Artificial
  CRISPR gRNA sequence
tgagggccaggagtagacag

SEQ ID NO: 793793 - DNA, 20 bp, Artificial
  CRISPR gRNA sequence
gaacatttgggcttcgctat

SEQ ID NO: 793794 - DNA, 20 bp, Artificial
  CRISPR gRNA sequence
cattaatcttattccatttc

SEQ ID NO: 793795 - DNA, 20 bp, Artificial
  CRISPR gRNA sequence
agagggaagtgaacagtgct

SEQ ID NO: 793796 - DNA, 20 bp, Artificial
  CRISPR gRNA sequence
actttcttttctctctcagc

SEQ ID NO: 793797 - DNA, 20 bp, Artificial
  CRISPR gRNA sequence
tattaattcatggaaggcaa

SEQ ID NO: 793798 - DNA, 20 bp, Artificial
  CRISPR gRNA sequence
aactgaatagttccagctta

SEQ ID NO: 793799 - DNA, 20 bp, Artificial
  CRISPR gRNA sequence
tggtctcacatagttagaaa

SEQ ID NO: 793800 - DNA, 20 bp, Artificial
  CRISPR gRNA sequence
caactgcgatgcaattgaca

SEQ ID NO: 793801 - DNA, 20 bp, Artificial
  CRISPR gRNA sequence
gaagtacattgttgtgggct

SEQ ID NO: 793802 - DNA, 20 bp, Artificial
  CRISPR gRNA sequence
attgttgtgggctctgagtc

SEQ ID NO: 793803 - DNA, 20 bp, Artificial
  CRISPR gRNA sequence
gaggttgacaggtttggagc

SEQ ID NO: 793804 - DNA, 20 bp, Artificial
  CRISPR gRNA sequence
gctggaatctgtggaggagg

SEQ ID NO: 793805 - DNA, 20 bp, Artificial
  CRISPR gRNA sequence
gaggaggaaggatatgatct

SEQ ID NO: 793806 - DNA, 20 bp, Artificial
  CRISPR gRNA sequence
tgatctaggggtcagaagaa

SEQ ID NO: 793807 - DNA, 20 bp, Artificial
  CRISPR gRNA sequence
actaaaatcattaagcctgg

SEQ ID NO: 793808 - DNA, 20 bp, Artificial
  CRISPR gRNA sequence
cagcagtctggaaacccagg

SEQ ID NO: 793809 - DNA, 20 bp, Artificial
  CRISPR gRNA sequence
tctaccttacagtcttgagg

SEQ ID NO: 793810 - DNA, 20 bp, Artificial
  CRISPR gRNA sequence
ctcttaaggccctcaactga

SEQ ID NO: 793811 - DNA, 20 bp, Artificial
  CRISPR gRNA sequence
accaactactatttggtcat

SEQ ID NO: 793812 - DNA, 20 bp, Artificial
  CRISPR gRNA sequence
attggagttgtccaagaggc

SEQ ID NO: 793813 - DNA, 20 bp, Artificial
  CRISPR gRNA sequence
ttgcatgcagactaccagtt

SEQ ID NO: 793814 - DNA, 20 bp, Artificial
  CRISPR gRNA sequence
tgggtttttgtttagttcag

SEQ ID NO: 793815 - DNA, 20 bp, Artificial
  CRISPR gRNA sequence
caaaaggacatctgtgatat

SEQ ID NO: 793816 - DNA, 20 bp, Artificial
  CRISPR gRNA sequence
gaatctaccactctaagtat

SEQ ID NO: 793817 - DNA, 20 bp, Artificial
  CRISPR gRNA sequence
agtatttggatgcaatagca

SEQ ID NO: 793818 - DNA, 20 bp, Artificial
  CRISPR gRNA sequence
gatgcaatagcaatgaatat

SEQ ID NO: 793819 - DNA, 20 bp, Artificial
  CRISPR gRNA sequence
tatctgagtaaatctaggtg

SEQ ID NO: 793820 - DNA, 20 bp, Artificial
  CRISPR gRNA sequence
ttctttaccaatacctaatg

SEQ ID NO: 793821 - DNA, 20 bp, Artificial
  CRISPR gRNA sequence
agatcatatcaaatccttcc

SEQ ID NO: 793822 - DNA, 20 bp, Artificial
  CRISPR gRNA sequence
gctcatgttggttatttttt

SEQ ID NO: 793823 - DNA, 20 bp, Artificial
  CRISPR gRNA sequence
gtctactttaagatacagta

SEQ ID NO: 793824 - DNA, 20 bp, Artificial
  CRISPR gRNA sequence
gcaatccaggtgtccaagtc

SEQ ID NO: 793825 - DNA, 20 bp, Artificial
  CRISPR gRNA sequence
attcaatttttttttagaga

SEQ ID NO: 793826 - DNA, 20 bp, Artificial
  CRISPR gRNA sequence
tcttgctctatcacccaggt

SEQ ID NO: 793827 - DNA, 20 bp, Artificial
  CRISPR gRNA sequence
tatcttcccacctcagcctc

SEQ ID NO: 793828 - DNA, 20 bp, Artificial
  CRISPR gRNA sequence
acaggtgcatgccaccgtac

SEQ ID NO: 793829 - DNA, 20 bp, Artificial
  CRISPR gRNA sequence
atttttattttttgtagaac

SEQ ID NO: 793830 - DNA, 20 bp, Artificial
  CRISPR gRNA sequence
tggggtctcactatgttgcc

SEQ ID NO: 793831 - DNA, 20 bp, Artificial
  CRISPR gRNA sequence
gccttggcctcccaaagtgc

SEQ ID NO: 793832 - DNA, 20 bp, Artificial
  CRISPR gRNA sequence
acctggtcaatataataaag

SEQ ID NO: 793833 - DNA, 20 bp, Artificial
  CRISPR gRNA sequence
taaattttgtttaattttag

SEQ ID NO: 793834 - DNA, 20 bp, Artificial
  CRISPR gRNA sequence
ttgagtctatcaactcaaaa

SEQ ID NO: 793835 - DNA, 20 bp, Artificial
  CRISPR gRNA sequence
ttttttaaattactgatttt

SEQ ID NO: 793836 - DNA, 20 bp, Artificial
  CRISPR gRNA sequence
taaagaaaacaaaaataatt

SEQ ID NO: 793837 - DNA, 20 bp, Artificial
  CRISPR gRNA sequence
ccaaaaccatccattatgag

SEQ ID NO: 793838 - DNA, 20 bp, Artificial
  CRISPR gRNA sequence
tgactcggcatcttgggaga

SEQ ID NO: 793839 - DNA, 20 bp, Artificial
  CRISPR gRNA sequence
cttacaagacttttattcag

SEQ ID NO: 793840 - DNA, 20 bp, Artificial
  CRISPR gRNA sequence
tgacttgtgaaaatgcctaa

SEQ ID NO: 793841 - DNA, 20 bp, Artificial
  CRISPR gRNA sequence
tagcgctgtttcaccatttc

SEQ ID NO: 793842 - DNA, 20 bp, Artificial
  CRISPR gRNA sequence
tcttgcctttgtgcacatga

SEQ ID NO: 793843 - DNA, 20 bp, Artificial
  CRISPR gRNA sequence
ataagtgatgcgtgttattt

SEQ ID NO: 793844 - DNA, 20 bp, Artificial
  CRISPR gRNA sequence
tatttctgggtagaagatgt

SEQ ID NO: 793845 - DNA, 20 bp, Artificial
  CRISPR gRNA sequence
tgctccatcagtctcagtct

SEQ ID NO: 793846 - DNA, 20 bp, Artificial
  CRISPR gRNA sequence
ctctgagtgactaaaattga

SEQ ID NO: 793847 - DNA, 20 bp, Artificial
  CRISPR gRNA sequence
aatgtacatggaacatgaac

SEQ ID NO: 793848 - DNA, 20 bp, Artificial
  CRISPR gRNA sequence
tgttttttatattgagattt

SEQ ID NO: 793849 - DNA, 20 bp, Artificial
  CRISPR gRNA sequence
catttaaacttctagttctg

SEQ ID NO: 793850 - DNA, 20 bp, Artificial
  CRISPR gRNA sequence
aaatgcctgtaatcatgttt

SEQ ID NO: 793851 - DNA, 20 bp, Artificial
  CRISPR gRNA sequence
gtaatcatgtttttggatta

SEQ ID NO: 793852 - DNA, 20 bp, Artificial
  CRISPR gRNA sequence
gctttttacttttatgtttt

SEQ ID NO: 793853 - DNA, 20 bp, Artificial
  CRISPR gRNA sequence
tgttgtacttcactacattt

SEQ ID NO: 793854 - DNA, 20 bp, Artificial
  CRISPR gRNA sequence
gtattactttcaaaaagaag

SEQ ID NO: 793855 - DNA, 20 bp, Artificial
  CRISPR gRNA sequence
tcctagcacagctaaatgtg

SEQ ID NO: 793856 - DNA, 20 bp, Artificial
  CRISPR gRNA sequence
aaatgtgatggatatgctct

SEQ ID NO: 793857 - DNA, 20 bp, Artificial
  CRISPR gRNA sequence
ggagctagaactcagaccca

SEQ ID NO: 793858 - DNA, 20 bp, Artificial
  CRISPR gRNA sequence
cagataaacagtaaaacttt

SEQ ID NO: 793859 - DNA, 20 bp, Artificial
  CRISPR gRNA sequence
taaacagtaaaactttagga

SEQ ID NO: 793860 - DNA, 20 bp, Artificial
  CRISPR gRNA sequence
tacagtcatcaagccttggt

SEQ ID NO: 793861 - DNA, 20 bp, Artificial
  CRISPR gRNA sequence
ttaggccatgtgggaactag

SEQ ID NO: 793862 - DNA, 20 bp, Artificial
  CRISPR gRNA sequence
gccatgtgggaactagaagg

SEQ ID NO: 793863 - DNA, 20 bp, Artificial
  CRISPR gRNA sequence
acagttctcattcacataat

SEQ ID NO: 793864 - DNA, 20 bp, Artificial
  CRISPR gRNA sequence
gttttgttttgtttgttttc

SEQ ID NO: 793865 - DNA, 20 bp, Artificial
  CRISPR gRNA sequence
ccacagcgtcagcattccac

SEQ ID NO: 793866 - DNA, 20 bp, Artificial
  CRISPR gRNA sequence
aattaaaatagtggtgaaat

SEQ ID NO: 793867 - DNA, 20 bp, Artificial
  CRISPR gRNA sequence
cctacaaaggcctctaaggc

SEQ ID NO: 793868 - DNA, 20 bp, Artificial
  CRISPR gRNA sequence
cattagattctcatagaagc

SEQ ID NO: 793869 - DNA, 20 bp, Artificial
  CRISPR gRNA sequence
tattgtgaactgcacatatg

SEQ ID NO: 793870 - DNA, 20 bp, Artificial
  CRISPR gRNA sequence
cagttgtctcagggagggag

SEQ ID NO: 793871 - DNA, 20 bp, Artificial
  CRISPR gRNA sequence
aggagagtgctattagcaag

SEQ ID NO: 793872 - DNA, 20 bp, Artificial
  CRISPR gRNA sequence
agcttcactcacctgtgccc

SEQ ID NO: 793873 - DNA, 20 bp, Artificial
  CRISPR gRNA sequence
gacaaatatcactttaagct

SEQ ID NO: 793874 - DNA, 20 bp, Artificial
  CRISPR gRNA sequence
tttcatggagaaggtgactt

SEQ ID NO: 793875 - DNA, 20 bp, Artificial
  CRISPR gRNA sequence
ttagattttacttactaagc

SEQ ID NO: 793876 - DNA, 20 bp, Artificial
  CRISPR gRNA sequence
ttagatcctagcaggaaatg

SEQ ID NO: 793877 - DNA, 20 bp, Artificial
  CRISPR gRNA sequence
agcattaagggaaaccagca

SEQ ID NO: 793878 - DNA, 20 bp, Artificial
  CRISPR gRNA sequence
gcaagggatactgagcatgc

SEQ ID NO: 793879 - DNA, 20 bp, Artificial
  CRISPR gRNA sequence
acttgtctgggaggttgctg

SEQ ID NO: 793880 - DNA, 20 bp, Artificial
  CRISPR gRNA sequence
caatgtcatcatcctggagc

SEQ ID NO: 793881 - DNA, 20 bp, Artificial
  CRISPR gRNA sequence
tcatcatcctggagcatgaa

SEQ ID NO: 793882 - DNA, 20 bp, Artificial
  CRISPR gRNA sequence
ggagcatgaatagagtgcag

SEQ ID NO: 793883 - DNA, 20 bp, Artificial
  CRISPR gRNA sequence
catgaatagagtgcagcagg

SEQ ID NO: 793884 - DNA, 20 bp, Artificial
  CRISPR gRNA sequence
agagtgcagcagggtgaata

SEQ ID NO: 793885 - DNA, 20 bp, Artificial
  CRISPR gRNA sequence
agggtgaataatgagtctgc

SEQ ID NO: 793886 - DNA, 20 bp, Artificial
  CRISPR gRNA sequence
atagggaactataagaggtt

SEQ ID NO: 793887 - DNA, 20 bp, Artificial
  CRISPR gRNA sequence
actgaactatgtgtggccca

SEQ ID NO: 793888 - DNA, 20 bp, Artificial
  CRISPR gRNA sequence
gaacctgtggtcttgggagc

SEQ ID NO: 793889 - DNA, 20 bp, Artificial
  CRISPR gRNA sequence
gaagcttctggactctgaac

SEQ ID NO: 793890 - DNA, 20 bp, Artificial
  CRISPR gRNA sequence
tttgcacttttcaaatgcct

SEQ ID NO: 793891 - DNA, 20 bp, Artificial
  CRISPR gRNA sequence
gcaagcactactgcacttta

SEQ ID NO: 793892 - DNA, 20 bp, Artificial
  CRISPR gRNA sequence
cactttacagaattacccca

SEQ ID NO: 793893 - DNA, 20 bp, Artificial
  CRISPR gRNA sequence
cccactggatcctggaccca

SEQ ID NO: 793894 - DNA, 20 bp, Artificial
  CRISPR gRNA sequence
ctggacccacagaattcctt

SEQ ID NO: 793895 - DNA, 20 bp, Artificial
  CRISPR gRNA sequence
gctgccagactgaaagcaaa

SEQ ID NO: 793896 - DNA, 20 bp, Artificial
  CRISPR gRNA sequence
atttccagtaacagaaacag

SEQ ID NO: 793897 - DNA, 20 bp, Artificial
  CRISPR gRNA sequence
agaaacagatgggttgccaa

SEQ ID NO: 793898 - DNA, 20 bp, Artificial
  CRISPR gRNA sequence
ttttttatctatagcttcct

SEQ ID NO: 793899 - DNA, 20 bp, Artificial
  CRISPR gRNA sequence
aatcataattgacatgtttt

SEQ ID NO: 793900 - DNA, 20 bp, Artificial
  CRISPR gRNA sequence
tgacatgttttatggattac

SEQ ID NO: 793901 - DNA, 20 bp, Artificial
  CRISPR gRNA sequence
tacactaagtgcacaaattg

SEQ ID NO: 793902 - DNA, 20 bp, Artificial
  CRISPR gRNA sequence
actacatatgtgtggagcag

SEQ ID NO: 793903 - DNA, 20 bp, Artificial
  CRISPR gRNA sequence
gagcaaaatttggggcttat

SEQ ID NO: 793904 - DNA, 20 bp, Artificial
  CRISPR gRNA sequence
tttggggcttatgagaatga

SEQ ID NO: 793905 - DNA, 20 bp, Artificial
  CRISPR gRNA sequence
ctcaattctcatgtaaatca

SEQ ID NO: 793906 - DNA, 20 bp, Artificial
  CRISPR gRNA sequence
taaatcagagaatgccttta

SEQ ID NO: 793907 - DNA, 20 bp, Artificial
  CRISPR gRNA sequence
gttctttatatattctactt

SEQ ID NO: 793908 - DNA, 20 bp, Artificial
  CRISPR gRNA sequence
ttttgggtaagaggtttgct

SEQ ID NO: 793909 - DNA, 20 bp, Artificial
  CRISPR gRNA sequence
tgaaggcctttgaggcaaac

SEQ ID NO: 793910 - DNA, 20 bp, Artificial
  CRISPR gRNA sequence
ttgggagccaaatggcgtaa

SEQ ID NO: 793911 - DNA, 20 bp, Artificial
  CRISPR gRNA sequence
gcaaacctcttacccaaaag

SEQ ID NO: 793912 - DNA, 20 bp, Artificial
  CRISPR gRNA sequence
agaatatataaagaacgttg

SEQ ID NO: 793913 - DNA, 20 bp, Artificial
  CRISPR gRNA sequence
agaacgttgaagaataacaa

SEQ ID NO: 793914 - DNA, 20 bp, Artificial
  CRISPR gRNA sequence
aggcattctctgatttacat

SEQ ID NO: 793915 - DNA, 20 bp, Artificial
  CRISPR gRNA sequence
atactagctaatgtgcccat

SEQ ID NO: 793916 - DNA, 20 bp, Artificial
  CRISPR gRNA sequence
tgtgcccatttgaatagttc

SEQ ID NO: 793917 - DNA, 20 bp, Artificial
  CRISPR gRNA sequence
aaattaagctgttactgtag

SEQ ID NO: 793918 - DNA, 20 bp, Artificial
  CRISPR gRNA sequence
tctgctccacacatatgtag

SEQ ID NO: 793919 - DNA, 20 bp, Artificial
  CRISPR gRNA sequence
acatatgtagtgggatcttg

SEQ ID NO: 793920 - DNA, 20 bp, Artificial
  CRISPR gRNA sequence
taaaacatgtcaattatgat

SEQ ID NO: 793921 - DNA, 20 bp, Artificial
  CRISPR gRNA sequence
gctttcagtctggcagcaag

SEQ ID NO: 793922 - DNA, 20 bp, Artificial
  CRISPR gRNA sequence
ggcagcaagaaggatcctga

SEQ ID NO: 793923 - DNA, 20 bp, Artificial
  CRISPR gRNA sequence
aaggatcctgaaggaattct

SEQ ID NO: 793924 - DNA, 20 bp, Artificial
  CRISPR gRNA sequence
ctgaaggaattctgtgggtc

SEQ ID NO: 793925 - DNA, 20 bp, Artificial
  CRISPR gRNA sequence
tctgtgggtccaggatccag

SEQ ID NO: 793926 - DNA, 20 bp, Artificial
  CRISPR gRNA sequence
taaagccataggctccagag

SEQ ID NO: 793927 - DNA, 20 bp, Artificial
  CRISPR gRNA sequence
gcaggtttcagattaaagtg

SEQ ID NO: 793928 - DNA, 20 bp, Artificial
  CRISPR gRNA sequence
atggcaagctctgcaggcca

SEQ ID NO: 793929 - DNA, 20 bp, Artificial
  CRISPR gRNA sequence
caggccaccgaattcttgtt

SEQ ID NO: 793930 - DNA, 20 bp, Artificial
  CRISPR gRNA sequence
atatataacctccccaaaat

SEQ ID NO: 793931 - DNA, 20 bp, Artificial
  CRISPR gRNA sequence
gctgcactctattcatgctc

SEQ ID NO: 793932 - DNA, 20 bp, Artificial
  CRISPR gRNA sequence
tgggctcagtctaggggaaa

SEQ ID NO: 793933 - DNA, 20 bp, Artificial
  CRISPR gRNA sequence
aggggaaaaagagtgttgca

SEQ ID NO: 793934 - DNA, 20 bp, Artificial
  CRISPR gRNA sequence
cagtgggttgagagagaggt

SEQ ID NO: 793935 - DNA, 20 bp, Artificial
  CRISPR gRNA sequence
agcaacctcccagacaagtt

SEQ ID NO: 793936 - DNA, 20 bp, Artificial
  CRISPR gRNA sequence
tttctcattgccatttttac

SEQ ID NO: 793937 - DNA, 20 bp, Artificial
  CRISPR gRNA sequence
cccctttctccttcagacct

SEQ ID NO: 793938 - DNA, 20 bp, Artificial
  CRISPR gRNA sequence
gcataccctccatttcctgc

SEQ ID NO: 793939 - DNA, 20 bp, Artificial
  CRISPR gRNA sequence
agtaaaatctaacttttgcc

SEQ ID NO: 793940 - DNA, 20 bp, Artificial
  CRISPR gRNA sequence
cacctggctttctctctgaa

SEQ ID NO: 793941 - DNA, 20 bp, Artificial
  CRISPR gRNA sequence
ttagtgtctcctctatctag

SEQ ID NO: 793942 - DNA, 20 bp, Artificial
  CRISPR gRNA sequence
ttaaaaattcatgggcacag

SEQ ID NO: 793943 - DNA, 20 bp, Artificial
  CRISPR gRNA sequence
aaagtgtgaagttgcctgac

SEQ ID NO: 793944 - DNA, 20 bp, Artificial
  CRISPR gRNA sequence
gtgaagttgcctgacatggg

SEQ ID NO: 793945 - DNA, 20 bp, Artificial
  CRISPR gRNA sequence
gacatgggttgggtatttct

SEQ ID NO: 793946 - DNA, 20 bp, Artificial
  CRISPR gRNA sequence
taaggtgggcttcaggacat

SEQ ID NO: 793947 - DNA, 20 bp, Artificial
  CRISPR gRNA sequence
tcagggaagacaatttttcc

SEQ ID NO: 793948 - DNA, 20 bp, Artificial
  CRISPR gRNA sequence
gaagacaatttttccatgga

SEQ ID NO: 793949 - DNA, 20 bp, Artificial
  CRISPR gRNA sequence
tttttccatggattgggtgt

SEQ ID NO: 793950 - DNA, 20 bp, Artificial
  CRISPR gRNA sequence
catggattgggtgtgggagt

SEQ ID NO: 793951 - DNA, 20 bp, Artificial
  CRISPR gRNA sequence
gtgggggtaggctatagttt

SEQ ID NO: 793952 - DNA, 20 bp, Artificial
  CRISPR gRNA sequence
ctcatatgtgcagttcacaa

SEQ ID NO: 793953 - DNA, 20 bp, Artificial
  CRISPR gRNA sequence
aataggattcacgcttctat

SEQ ID NO: 793954 - DNA, 20 bp, Artificial
  CRISPR gRNA sequence
tggacaaatagcctatatga

SEQ ID NO: 793955 - DNA, 20 bp, Artificial
  CRISPR gRNA sequence
ttttaatttgcttgacatgt

SEQ ID NO: 793956 - DNA, 20 bp, Artificial
  CRISPR gRNA sequence
ggaaaggaaacacacccatg

SEQ ID NO: 793957 - DNA, 20 bp, Artificial
  CRISPR gRNA sequence
ggaagttcttagaaggaagt

SEQ ID NO: 793958 - DNA, 20 bp, Artificial
  CRISPR gRNA sequence
tttgttttaacccaaattat

SEQ ID NO: 793959 - DNA, 20 bp, Artificial
  CRISPR gRNA sequence
atgtgaatgagaactgtttc

SEQ ID NO: 793960 - DNA, 20 bp, Artificial
  CRISPR gRNA sequence
tatcggtaatacttaattgt

SEQ ID NO: 793961 - DNA, 20 bp, Artificial
  CRISPR gRNA sequence
aatacttaattgtaagaatc

SEQ ID NO: 793962 - DNA, 20 bp, Artificial
  CRISPR gRNA sequence
ttcccacatggcctaactga

SEQ ID NO: 793963 - DNA, 20 bp, Artificial
  CRISPR gRNA sequence
cagaaacttaatacaggttt

SEQ ID NO: 793964 - DNA, 20 bp, Artificial
  CRISPR gRNA sequence
aacttaatacaggtttgtga

SEQ ID NO: 793965 - DNA, 20 bp, Artificial
  CRISPR gRNA sequence
taatacaggtttgtgagtgg

SEQ ID NO: 793966 - DNA, 20 bp, Artificial
  CRISPR gRNA sequence
acaggtttgtgagtgggtga

SEQ ID NO: 793967 - DNA, 20 bp, Artificial
  CRISPR gRNA sequence
gtttgtgagtgggtgaatga

SEQ ID NO: 793968 - DNA, 20 bp, Artificial
  CRISPR gRNA sequence
gtgggtgaatgaatgaataa

SEQ ID NO: 793969 - DNA, 20 bp, Artificial
  CRISPR gRNA sequence
gtgaatgaatgaataaatga

SEQ ID NO: 793970 - DNA, 20 bp, Artificial
  CRISPR gRNA sequence
tgagtgagtagcactatgct

SEQ ID NO: 793971 - DNA, 20 bp, Artificial
  CRISPR gRNA sequence
aatctgtgaaatgaggtagc

SEQ ID NO: 793972 - DNA, 20 bp, Artificial
  CRISPR gRNA sequence
actgtaataactattttgta

SEQ ID NO: 793973 - DNA, 20 bp, Artificial
  CRISPR gRNA sequence
ctgcttgtctgcataagagg

SEQ ID NO: 793974 - DNA, 20 bp, Artificial
  CRISPR gRNA sequence
gtgtcacagacaaggactca

SEQ ID NO: 793975 - DNA, 20 bp, Artificial
  CRISPR gRNA sequence
cagacaaggactcagtgggt

SEQ ID NO: 793976 - DNA, 20 bp, Artificial
  CRISPR gRNA sequence
ccatcacatttagctgtgct

SEQ ID NO: 793977 - DNA, 20 bp, Artificial
  CRISPR gRNA sequence
aaacttgataaggactgatg

SEQ ID NO: 793978 - DNA, 20 bp, Artificial
  CRISPR gRNA sequence
tatataatgtatttggttac

SEQ ID NO: 793979 - DNA, 20 bp, Artificial
  CRISPR gRNA sequence
ggttactgggatctagagag

SEQ ID NO: 793980 - DNA, 20 bp, Artificial
  CRISPR gRNA sequence
tgggatctagagaggtgagt

SEQ ID NO: 793981 - DNA, 20 bp, Artificial
  CRISPR gRNA sequence
cttctgtttttctggaggaa

SEQ ID NO: 793982 - DNA, 20 bp, Artificial
  CRISPR gRNA sequence
ttctggaggaagggaatatg

SEQ ID NO: 793983 - DNA, 20 bp, Artificial
  CRISPR gRNA sequence
aataacatttttaataggac

SEQ ID NO: 793984 - DNA, 20 bp, Artificial
  CRISPR gRNA sequence
tagaagtttaaatggcaacg

SEQ ID NO: 793985 - DNA, 20 bp, Artificial
  CRISPR gRNA sequence
cagttttttccatgttgtat

SEQ ID NO: 793986 - DNA, 20 bp, Artificial
  CRISPR gRNA sequence
gttcatgttccatgtacatt

SEQ ID NO: 793987 - DNA, 20 bp, Artificial
  CRISPR gRNA sequence
ctgatggagcaattactacc

SEQ ID NO: 793988 - DNA, 20 bp, Artificial
  CRISPR gRNA sequence
gttactggttaccatgccag

SEQ ID NO: 793989 - DNA, 20 bp, Artificial
  CRISPR gRNA sequence
cttacatttaattgaccaaa

SEQ ID NO: 793990 - DNA, 20 bp, Artificial
  CRISPR gRNA sequence
ttggaagggaaaatattcat

SEQ ID NO: 793991 - DNA, 20 bp, Artificial
  CRISPR gRNA sequence
agactccatctcccaagatg

SEQ ID NO: 793992 - DNA, 20 bp, Artificial
  CRISPR gRNA sequence
aagatgccgagtcacaaaat

SEQ ID NO: 793993 - DNA, 20 bp, Artificial
  CRISPR gRNA sequence
cgagtcacaaaatgagagtg

SEQ ID NO: 793994 - DNA, 20 bp, Artificial
  CRISPR gRNA sequence
agctgtacactctcctcata

SEQ ID NO: 793995 - DNA, 20 bp, Artificial
  CRISPR gRNA sequence
ctcctcataatggatggttt

SEQ ID NO: 793996 - DNA, 20 bp, Artificial
  CRISPR gRNA sequence
gttttgggatgagatagaac

SEQ ID NO: 793997 - DNA, 20 bp, Artificial
  CRISPR gRNA sequence
gagatagaactgggatggca

SEQ ID NO: 793998 - DNA, 20 bp, Artificial
  CRISPR gRNA sequence
tagaactgggatggcagaga

SEQ ID NO: 793999 - DNA, 20 bp, Artificial
  CRISPR gRNA sequence
ggatggcagagaatgggtgt

SEQ ID NO: 794000 - DNA, 20 bp, Artificial
  CRISPR gRNA sequence
accatggcaatttctaggca

SEQ ID NO: 794001 - DNA, 20 bp, Artificial
  CRISPR gRNA sequence
ttgttgtacgttattctttt

SEQ ID NO: 794002 - DNA, 20 bp, Artificial
  CRISPR gRNA sequence
aacgctgtaatcatgtgctt

SEQ ID NO: 794003 - DNA, 20 bp, Artificial
  CRISPR gRNA sequence
cagaggaaaaataaaaaggt

SEQ ID NO: 794004 - DNA, 20 bp, Artificial
  CRISPR gRNA sequence
aaaaaggtatgagtggggga

SEQ ID NO: 794005 - DNA, 20 bp, Artificial
  CRISPR gRNA sequence
gagtcttacagattaagcaa

SEQ ID NO: 794006 - DNA, 20 bp, Artificial
  CRISPR gRNA sequence
tgggcacagtggcttacgcc

SEQ ID NO: 794007 - DNA, 20 bp, Artificial
  CRISPR gRNA sequence
actttgggaggccaaggcag

SEQ ID NO: 794008 - DNA, 20 bp, Artificial
  CRISPR gRNA sequence
caggaggattgcttgagccg

SEQ ID NO: 794009 - DNA, 20 bp, Artificial
  CRISPR gRNA sequence
ggctgaggtgggaagatagc

SEQ ID NO: 794010 - DNA, 20 bp, Artificial
  CRISPR gRNA sequence
tcataccactgcactccaac

SEQ ID NO: 794011 - DNA, 20 bp, Artificial
  CRISPR gRNA sequence
actctgtctctaaaaaaaaa

SEQ ID NO: 794012 - DNA, 20 bp, Artificial
  CRISPR gRNA sequence
tgaattaaattttaaaaaag

SEQ ID NO: 794013 - DNA, 20 bp, Artificial
  CRISPR gRNA sequence
aaaaaagcagagtgtagtgt

SEQ ID NO: 794014 - DNA, 20 bp, Artificial
  CRISPR gRNA sequence
gcagagtgtagtgtatgggt

SEQ ID NO: 794015 - DNA, 20 bp, Artificial
  CRISPR gRNA sequence
tggattctggacttggacac

SEQ ID NO: 794016 - DNA, 20 bp, Artificial
  CRISPR gRNA sequence
ggacttggacacctggattg

SEQ ID NO: 794017 - DNA, 20 bp, Artificial
  CRISPR gRNA sequence
cacctataaaatgggaagca

SEQ ID NO: 794018 - DNA, 20 bp, Artificial
  CRISPR gRNA sequence
gtacttcagagggctactgt

SEQ ID NO: 794019 - DNA, 20 bp, Artificial
  CRISPR gRNA sequence
aagtagaccatgccaaaagt

SEQ ID NO: 794020 - DNA, 20 bp, Artificial
  CRISPR gRNA sequence
tgggattgggacaagtaaga

SEQ ID NO: 794021 - DNA, 20 bp, Artificial
  CRISPR gRNA sequence
atgagcaaagccacagaagt

SEQ ID NO: 794022 - DNA, 20 bp, Artificial
  CRISPR gRNA sequence
cttgaggaaaagttttgttg

SEQ ID NO: 794023 - DNA, 20 bp, Artificial
  CRISPR gRNA sequence
gttttgttgaagagtggtag

SEQ ID NO: 794024 - DNA, 20 bp, Artificial
  CRISPR gRNA sequence
aaggcctgaaaaactctggg

SEQ ID NO: 794025 - DNA, 20 bp, Artificial
  CRISPR gRNA sequence
atgatgaaaacagtgtttgg

SEQ ID NO: 794026 - DNA, 20 bp, Artificial
  CRISPR gRNA sequence
ttgttaaatcattttggcta

SEQ ID NO: 794027 - DNA, 20 bp, Artificial
  CRISPR gRNA sequence
tgctattgcatccaaatact

SEQ ID NO: 794028 - DNA, 20 bp, Artificial
  CRISPR gRNA sequence
ctgtttataaaggctcatgc

SEQ ID NO: 794029 - DNA, 20 bp, Artificial
  CRISPR gRNA sequence
ctgaggtttcccagaaaaga

SEQ ID NO: 794030 - DNA, 20 bp, Artificial
  CRISPR gRNA sequence
ctgtaaggtagaaatcctgc

SEQ ID NO: 794031 - DNA, 20 bp, Artificial
  CRISPR gRNA sequence
acaatcatgtgctgcttccc

SEQ ID NO: 794032 - DNA, 20 bp, Artificial
  CRISPR gRNA sequence
cattgtcaattgcatcgcag

SEQ ID NO: 794033 - DNA, 20 bp, Artificial
  CRISPR gRNA sequence
ggtccagtgcagtatcatct

SEQ ID NO: 794034 - DNA, 20 bp, Artificial
  CRISPR gRNA sequence
agtatcatctaggagtgctt

SEQ ID NO: 794035 - DNA, 20 bp, Artificial
  CRISPR gRNA sequence
gaactattcagttgccttcc

SEQ ID NO: 794036 - DNA, 20 bp, Artificial
  CRISPR gRNA sequence
aaaaggaaaaattccagaaa

SEQ ID NO: 794037 - DNA, 20 bp, Artificial
  CRISPR gRNA sequence
gttcactgtggcctgggact

SEQ ID NO: 794038 - DNA, 20 bp, Artificial
  CRISPR gRNA sequence
caaaatctggcccctaggca

SEQ ID NO: 794039 - DNA, 20 bp, Artificial
  CRISPR gRNA sequence
ttaaaggctgagggactaat

SEQ ID NO: 794040 - DNA, 20 bp, Artificial
  CRISPR gRNA sequence
atccaggaaatgtctggctg

SEQ ID NO: 794041 - DNA, 20 bp, Artificial
  CRISPR gRNA sequence
ctgccttccctggtccaggt

SEQ ID NO: 794042 - DNA, 20 bp, Artificial
  CRISPR gRNA sequence
agaagcacaagttcacataa

SEQ ID NO: 794043 - DNA, 20 bp, Artificial
  CRISPR gRNA sequence
ttttttatatcaataggttt

SEQ ID NO: 794044 - DNA, 20 bp, Artificial
  CRISPR gRNA sequence
tacaggtggtttttggttac

SEQ ID NO: 794045 - DNA, 20 bp, Artificial
  CRISPR gRNA sequence
ggtggtttttggttacatgg

SEQ ID NO: 794046 - DNA, 20 bp, Artificial
  CRISPR gRNA sequence
gaattgtatactggtgaagt

SEQ ID NO: 794047 - DNA, 20 bp, Artificial
  CRISPR gRNA sequence
ccactccctactctctcctt

SEQ ID NO: 794048 - DNA, 20 bp, Artificial
  CRISPR gRNA sequence
cttagctcccacttacaagt

SEQ ID NO: 794049 - DNA, 20 bp, Artificial
  CRISPR gRNA sequence
tggtatttggttttccattc

SEQ ID NO: 794050 - DNA, 20 bp, Artificial
  CRISPR gRNA sequence
cattcctgagttacttcact

SEQ ID NO: 794051 - DNA, 20 bp, Artificial
  CRISPR gRNA sequence
tatctcattctttttcatgg

SEQ ID NO: 794052 - DNA, 20 bp, Artificial
  CRISPR gRNA sequence
tttatccacttattcgtcaa

SEQ ID NO: 794053 - DNA, 20 bp, Artificial
  CRISPR gRNA sequence
ggtttcatatctttgcaatc

SEQ ID NO: 794054 - DNA, 20 bp, Artificial
  CRISPR gRNA sequence
ctcccactctgattctcttt

SEQ ID NO: 794055 - DNA, 20 bp, Artificial
  CRISPR gRNA sequence
tgcccaactcctgccattgc

SEQ ID NO: 794056 - DNA, 20 bp, Artificial
  CRISPR gRNA sequence
tgactatcctgagcttggcc

SEQ ID NO: 794057 - DNA, 20 bp, Artificial
  CRISPR gRNA sequence
agcactgtagtctctttcat

SEQ ID NO: 794058 - DNA, 20 bp, Artificial
  CRISPR gRNA sequence
gagcccaatggttaacccat

SEQ ID NO: 794059 - DNA, 20 bp, Artificial
  CRISPR gRNA sequence
ttaacccataggaattgctc

SEQ ID NO: 794060 - DNA, 20 bp, Artificial
  CRISPR gRNA sequence
gctcttgaatgttggcttca

SEQ ID NO: 794061 - DNA, 20 bp, Artificial
  CRISPR gRNA sequence
tcttctagggctgtgccact

SEQ ID NO: 794062 - DNA, 20 bp, Artificial
  CRISPR gRNA sequence
tgataactgttccttcacaa

SEQ ID NO: 794063 - DNA, 20 bp, Artificial
  CRISPR gRNA sequence
tctgtagctggtgacttctg

SEQ ID NO: 794064 - DNA, 20 bp, Artificial
  CRISPR gRNA sequence
gtataagtcactcaattatt

SEQ ID NO: 794065 - DNA, 20 bp, Artificial
  CRISPR gRNA sequence
aacaaataggccacaagttt

SEQ ID NO: 794066 - DNA, 20 bp, Artificial
  CRISPR gRNA sequence
aattaaatgagaagtttgta

SEQ ID NO: 794067 - DNA, 20 bp, Artificial
  CRISPR gRNA sequence
ctattgagcacttacagtgt

SEQ ID NO: 794068 - DNA, 20 bp, Artificial
  CRISPR gRNA sequence
gaatacttaagatgtgactg

SEQ ID NO: 794069 - DNA, 20 bp, Artificial
  CRISPR gRNA sequence
tagacactgggcatatattg

SEQ ID NO: 794070 - DNA, 20 bp, Artificial
  CRISPR gRNA sequence
gtaaagacaagcagatgaag

SEQ ID NO: 794071 - DNA, 20 bp, Artificial
  CRISPR gRNA sequence
caccctcgagccccaaactg

SEQ ID NO: 794072 - DNA, 20 bp, Artificial
  CRISPR gRNA sequence
agctagtcactgaggtatag

SEQ ID NO: 794073 - DNA, 20 bp, Artificial
  CRISPR gRNA sequence
ttgcaatggactaagaaatt

SEQ ID NO: 794074 - DNA, 20 bp, Artificial
  CRISPR gRNA sequence
ctcctacctcatcaacccat

SEQ ID NO: 794075 - DNA, 20 bp, Artificial
  CRISPR gRNA sequence
tgtagcactgtggtctgtgt

SEQ ID NO: 794076 - DNA, 20 bp, Artificial
  CRISPR gRNA sequence
agcaaggttacctttgcaca

SEQ ID NO: 794077 - DNA, 20 bp, Artificial
  CRISPR gRNA sequence
gaccagagattctgcatggc

SEQ ID NO: 794078 - DNA, 20 bp, Artificial
  CRISPR gRNA sequence
cttcttgctaagatgggcat

SEQ ID NO: 794079 - DNA, 20 bp, Artificial
  CRISPR gRNA sequence
gatgggcatgtgggtacttg

SEQ ID NO: 794080 - DNA, 20 bp, Artificial
  CRISPR gRNA sequence
gaatcaattggaaaattaaa

SEQ ID NO: 794081 - DNA, 20 bp, Artificial
  CRISPR gRNA sequence
cctagacatgtgattgtgtg

SEQ ID NO: 794082 - DNA, 20 bp, Artificial
  CRISPR gRNA sequence
gctatggaaacatataataa

SEQ ID NO: 794083 - DNA, 20 bp, Artificial
  CRISPR gRNA sequence
taataaggggatttaatgta

SEQ ID NO: 794084 - DNA, 20 bp, Artificial
  CRISPR gRNA sequence
atgggtgtggtgcgtggagg

SEQ ID NO: 794085 - DNA, 20 bp, Artificial
  CRISPR gRNA sequence
caatattgtatgagaaaact

SEQ ID NO: 794086 - DNA, 20 bp, Artificial
  CRISPR gRNA sequence
atgcagttaaagctggagac

SEQ ID NO: 794087 - DNA, 20 bp, Artificial
  CRISPR gRNA sequence
cagaccaagttggaggtagc

SEQ ID NO: 794088 - DNA, 20 bp, Artificial
  CRISPR gRNA sequence
ccaagttggaggtagcagga

SEQ ID NO: 794089 - DNA, 20 bp, Artificial
  CRISPR gRNA sequence
acacatgtaagaaagcagat

SEQ ID NO: 794090 - DNA, 20 bp, Artificial
  CRISPR gRNA sequence
gaaagcagatctgaatgcaa

SEQ ID NO: 794091 - DNA, 20 bp, Artificial
  CRISPR gRNA sequence
aatgcaagtgagttggagac

SEQ ID NO: 794092 - DNA, 20 bp, Artificial
  CRISPR gRNA sequence
tcctcactcactcttaagat

SEQ ID NO: 794093 - DNA, 20 bp, Artificial
  CRISPR gRNA sequence
tcactcttaagattggggtg

SEQ ID NO: 794094 - DNA, 20 bp, Artificial
  CRISPR gRNA sequence
attggggtgaaggatgagga

SEQ ID NO: 794095 - DNA, 20 bp, Artificial
  CRISPR gRNA sequence
gatttatttccactctatct

SEQ ID NO: 794096 - DNA, 20 bp, Artificial
  CRISPR gRNA sequence
gctcatttctgaagttatta

SEQ ID NO: 794097 - DNA, 20 bp, Artificial
  CRISPR gRNA sequence
caggccttgaaccctgaggt

SEQ ID NO: 794098 - DNA, 20 bp, Artificial
  CRISPR gRNA sequence
atgggtgtgagaggtaaaag

SEQ ID NO: 794099 - DNA, 20 bp, Artificial
  CRISPR gRNA sequence
atattgtggtcagcacccaa

SEQ ID NO: 794100 - DNA, 20 bp, Artificial
  CRISPR gRNA sequence
cagatgaaaatatagaagtt

SEQ ID NO: 794101 - DNA, 20 bp, Artificial
  CRISPR gRNA sequence
agtgctgctgcaaactccta

SEQ ID NO: 794102 - DNA, 20 bp, Artificial
  CRISPR gRNA sequence
tagatctttggagaagttca

SEQ ID NO: 794103 - DNA, 20 bp, Artificial
  CRISPR gRNA sequence
gctaggcctgcatacattct

SEQ ID NO: 794104 - DNA, 20 bp, Artificial
  CRISPR gRNA sequence
cccagctggtacaacagaac

SEQ ID NO: 794105 - DNA, 20 bp, Artificial
  CRISPR gRNA sequence
cagaacaggagtgtgttggt

SEQ ID NO: 794106 - DNA, 20 bp, Artificial
  CRISPR gRNA sequence
aggttgagattcctgggaga

SEQ ID NO: 794107 - DNA, 20 bp, Artificial
  CRISPR gRNA sequence
tgagattcctgggagagggg

SEQ ID NO: 794108 - DNA, 20 bp, Artificial
  CRISPR gRNA sequence
atatccagactggggaaaag

SEQ ID NO: 794109 - DNA, 20 bp, Artificial
  CRISPR gRNA sequence
aaaagaggggtgaaaatgga

SEQ ID NO: 794110 - DNA, 20 bp, Artificial
  CRISPR gRNA sequence
aaatggaaggaatcctcaga

SEQ ID NO: 794111 - DNA, 20 bp, Artificial
  CRISPR gRNA sequence
tgatgaaagctcttggctca

SEQ ID NO: 794112 - DNA, 20 bp, Artificial
  CRISPR gRNA sequence
ctcaaagtggttcataagct

SEQ ID NO: 794113 - DNA, 20 bp, Artificial
  CRISPR gRNA sequence
aagtggttcataagctctga

SEQ ID NO: 794114 - DNA, 20 bp, Artificial
  CRISPR gRNA sequence
tgctgcagacacccagtgca

SEQ ID NO: 794115 - DNA, 20 bp, Artificial
  CRISPR gRNA sequence
acccagtgcattgggttacc

SEQ ID NO: 794116 - DNA, 20 bp, Artificial
  CRISPR gRNA sequence
taaaactcacttaccttttg

SEQ ID NO: 794117 - DNA, 20 bp, Artificial
  CRISPR gRNA sequence
ttgaagaatacagcttttga

SEQ ID NO: 794118 - DNA, 20 bp, Artificial
  CRISPR gRNA sequence
atgaaagcaatgatgcagaa

SEQ ID NO: 794119 - DNA, 20 bp, Artificial
  CRISPR gRNA sequence
gaaaatgtgaagcagccaag

SEQ ID NO: 794120 - DNA, 20 bp, Artificial
  CRISPR gRNA sequence
atgtgaagcagccaagttgg

SEQ ID NO: 794121 - DNA, 20 bp, Artificial
  CRISPR gRNA sequence
gcagccaagttggatgggtc

SEQ ID NO: 794122 - DNA, 20 bp, Artificial
  CRISPR gRNA sequence
cctgggcaaaggaaaagcac

SEQ ID NO: 794123 - DNA, 20 bp, Artificial
  CRISPR gRNA sequence
tagaccaacaggctggccac

SEQ ID NO: 794124 - DNA, 20 bp, Artificial
  CRISPR gRNA sequence
ccaacaggctggccacatga

SEQ ID NO: 794125 - DNA, 20 bp, Artificial
  CRISPR gRNA sequence
tgacaagtactcacagtgct

SEQ ID NO: 794126 - DNA, 20 bp, Artificial
  CRISPR gRNA sequence
accattagttgttaaatttc

SEQ ID NO: 794127 - DNA, 20 bp, Artificial
  CRISPR gRNA sequence
tgttaaatttcaaggattaa

SEQ ID NO: 794128 - DNA, 20 bp, Artificial
  CRISPR gRNA sequence
caggatccttttggaagaaa

SEQ ID NO: 794129 - DNA, 20 bp, Artificial
  CRISPR gRNA sequence
ctagtcactcatgccttagt

SEQ ID NO: 794130 - DNA, 20 bp, Artificial
  CRISPR gRNA sequence
caacgtcctagcactgagga

SEQ ID NO: 794131 - DNA, 20 bp, Artificial
  CRISPR gRNA sequence
gtcctagcactgaggaaagg

SEQ ID NO: 794132 - DNA, 20 bp, Artificial
  CRISPR gRNA sequence
aggaaagggtgagtttagta

SEQ ID NO: 794133 - DNA, 20 bp, Artificial
  CRISPR gRNA sequence
aagggtgagtttagtagagg

SEQ ID NO: 794134 - DNA, 20 bp, Artificial
  CRISPR gRNA sequence
tttagtagagggtggatcag

SEQ ID NO: 794135 - DNA, 20 bp, Artificial
  CRISPR gRNA sequence
ctgacaaaaggcagggctag

SEQ ID NO: 794136 - DNA, 20 bp, Artificial
  CRISPR gRNA sequence
gttcacctacagggaaatga

SEQ ID NO: 794137 - DNA, 20 bp, Artificial
  CRISPR gRNA sequence
tttgtgccctattcaaaagc

SEQ ID NO: 794138 - DNA, 20 bp, Artificial
  CRISPR gRNA sequence
aaaagcttgaattttgcctc

SEQ ID NO: 794139 - DNA, 20 bp, Artificial
  CRISPR gRNA sequence
tgcctctggagtcattcaca

SEQ ID NO: 794140 - DNA, 20 bp, Artificial
  CRISPR gRNA sequence
cacagtgctatctgagaacc

SEQ ID NO: 794141 - DNA, 20 bp, Artificial
  CRISPR gRNA sequence
ttagtctgagcccctcattt

SEQ ID NO: 794142 - DNA, 20 bp, Artificial
  CRISPR gRNA sequence
agagttgaggaagtaagtct

SEQ ID NO: 794143 - DNA, 20 bp, Artificial
  CRISPR gRNA sequence
tgctaagtaaaagtcaatgc

SEQ ID NO: 794144 - DNA, 20 bp, Artificial
  CRISPR gRNA sequence
agatatttgtctccatccaa

SEQ ID NO: 794145 - DNA, 20 bp, Artificial
  CRISPR gRNA sequence
gagccttgctcatccaaaca

SEQ ID NO: 794146 - DNA, 20 bp, Artificial
  CRISPR gRNA sequence
aagtgcttagtaagcacttt

SEQ ID NO: 794147 - DNA, 20 bp, Artificial
  CRISPR gRNA sequence
aggccttatctaaactacct

SEQ ID NO: 794148 - DNA, 20 bp, Artificial
  CRISPR gRNA sequence
ctacatgaaaagtgccaata

SEQ ID NO: 794149 - DNA, 20 bp, Artificial
  CRISPR gRNA sequence
gccaatatggaattgttgca

SEQ ID NO: 794150 - DNA, 20 bp, Artificial
  CRISPR gRNA sequence
ttctttcaactttagtatta

SEQ ID NO: 794151 - DNA, 20 bp, Artificial
  CRISPR gRNA sequence
gtaatctaagttcaggctaa

SEQ ID NO: 794152 - DNA, 20 bp, Artificial
  CRISPR gRNA sequence
tctaagttcaggctaagaga

SEQ ID NO: 794153 - DNA, 20 bp, Artificial
  CRISPR gRNA sequence
aaggtcttggccttaaaaca

SEQ ID NO: 794154 - DNA, 20 bp, Artificial
  CRISPR gRNA sequence
tactttctgaaggttgaaac

SEQ ID NO: 794155 - DNA, 20 bp, Artificial
  CRISPR gRNA sequence
tttatagggacaacatcctg

SEQ ID NO: 794156 - DNA, 20 bp, Artificial
  CRISPR gRNA sequence
gagcaacagatgaaaataat

SEQ ID NO: 794157 - DNA, 20 bp, Artificial
  CRISPR gRNA sequence
gatgaaaataatctggatca

SEQ ID NO: 794158 - DNA, 20 bp, Artificial
  CRISPR gRNA sequence
gcttagctgctctgaaccac

SEQ ID NO: 794159 - DNA, 20 bp, Artificial
  CRISPR gRNA sequence
attaatttatttatttgaga

SEQ ID NO: 794160 - DNA, 20 bp, Artificial
  CRISPR gRNA sequence
ttccctcttgttgcccaggc

SEQ ID NO: 794161 - DNA, 20 bp, Artificial
  CRISPR gRNA sequence
ctcactgcaacctccgcctc

SEQ ID NO: 794162 - DNA, 20 bp, Artificial
  CRISPR gRNA sequence
gattctcctgcctcggcctc

SEQ ID NO: 794163 - DNA, 20 bp, Artificial
  CRISPR gRNA sequence
gcctcggcctcttgagtagc

SEQ ID NO: 794164 - DNA, 20 bp, Artificial
  CRISPR gRNA sequence
ttttgtatttttagtagaga

SEQ ID NO: 794165 - DNA, 20 bp, Artificial
  CRISPR gRNA sequence
atctcagcctcccaaagtgc

SEQ ID NO: 794166 - DNA, 20 bp, Artificial
  CRISPR gRNA sequence
ttttactgtttgcacacttt

SEQ ID NO: 794167 - DNA, 20 bp, Artificial
  CRISPR gRNA sequence
ctcatgctacacatgagaga

SEQ ID NO: 794168 - DNA, 20 bp, Artificial
  CRISPR gRNA sequence
acacatgagagactgagtgc

SEQ ID NO: 794169 - DNA, 20 bp, Artificial
  CRISPR gRNA sequence
tgagtgctagagtggctaag

SEQ ID NO: 794170 - DNA, 20 bp, Artificial
  CRISPR gRNA sequence
gttctcaaagctaatagaga

SEQ ID NO: 794171 - DNA, 20 bp, Artificial
  CRISPR gRNA sequence
ccatgctctcaaccactgcc

SEQ ID NO: 794172 - DNA, 20 bp, Artificial
  CRISPR gRNA sequence
tcacctccaggtctcctagg

SEQ ID NO: 794173 - DNA, 20 bp, Artificial
  CRISPR gRNA sequence
ctcttttctgccagccctac

SEQ ID NO: 794174 - DNA, 20 bp, Artificial
  CRISPR gRNA sequence
cctaacttgtgcttgaaatt

SEQ ID NO: 794175 - DNA, 20 bp, Artificial
  CRISPR gRNA sequence
gaatgttcagtcatccattc

SEQ ID NO: 794176 - DNA, 20 bp, Artificial
  CRISPR gRNA sequence
gtcatccattctagagtcag

SEQ ID NO: 794177 - DNA, 20 bp, Artificial
  CRISPR gRNA sequence
attgacttccggagaagctt

SEQ ID NO: 794178 - DNA, 20 bp, Artificial
  CRISPR gRNA sequence
cagtccacagctcaatttat

SEQ ID NO: 794179 - DNA, 20 bp, Artificial
  CRISPR gRNA sequence
ccacagctcaatttatgaga

SEQ ID NO: 794180 - DNA, 20 bp, Artificial
  CRISPR gRNA sequence
ctggtatttgtgccacaagc

SEQ ID NO: 794181 - DNA, 20 bp, Artificial
  CRISPR gRNA sequence
gggactgcgattatctaaga

SEQ ID NO: 794182 - DNA, 20 bp, Artificial
  CRISPR gRNA sequence
actctgcttttgccttagtg

SEQ ID NO: 794183 - DNA, 20 bp, Artificial
  CRISPR gRNA sequence
aggtagtaggtctcaaaatg

SEQ ID NO: 794184 - DNA, 20 bp, Artificial
  CRISPR gRNA sequence
ggaaagacccccttgtgccc

SEQ ID NO: 794185 - DNA, 20 bp, Artificial
  CRISPR gRNA sequence
tgactgagctgccccagaga

SEQ ID NO: 794186 - DNA, 20 bp, Artificial
  CRISPR gRNA sequence
cagagagcatgtggtgagga

SEQ ID NO: 794187 - DNA, 20 bp, Artificial
  CRISPR gRNA sequence
aagggatggttaatgaagca

SEQ ID NO: 794188 - DNA, 20 bp, Artificial
  CRISPR gRNA sequence
ccatgtcagtaaacagtagg

SEQ ID NO: 794189 - DNA, 20 bp, Artificial
  CRISPR gRNA sequence
aggacgaatacaaagttggg

SEQ ID NO: 794190 - DNA, 20 bp, Artificial
  CRISPR gRNA sequence
cgaatacaaagttgggaagg

SEQ ID NO: 794191 - DNA, 20 bp, Artificial
  CRISPR gRNA sequence
aggatgggtaaaaccaggtt

SEQ ID NO: 794192 - DNA, 20 bp, Artificial
  CRISPR gRNA sequence
tctccctgatggctgtattt

SEQ ID NO: 794193 - DNA, 20 bp, Artificial
  CRISPR gRNA sequence
gccatgttggcttccatgaa

SEQ ID NO: 794194 - DNA, 20 bp, Artificial
  CRISPR gRNA sequence
gttggcttccatgaagagag

SEQ ID NO: 794195 - DNA, 20 bp, Artificial
  CRISPR gRNA sequence
cctttcacatctctaccatg

SEQ ID NO: 794196 - DNA, 20 bp, Artificial
  CRISPR gRNA sequence
ttccatataacgaacgacag

SEQ ID NO: 794197 - DNA, 20 bp, Artificial
  CRISPR gRNA sequence
ccaggggaaaaaagttctcg

SEQ ID NO: 794198 - DNA, 20 bp, Artificial
  CRISPR gRNA sequence
ttagaggctttagctttagt

SEQ ID NO: 794199 - DNA, 20 bp, Artificial
  CRISPR gRNA sequence
tagctttagtatgaattagt

SEQ ID NO: 794200 - DNA, 20 bp, Artificial
  CRISPR gRNA sequence
ccatgatataaagagaggta

SEQ ID NO: 794201 - DNA, 20 bp, Artificial
  CRISPR gRNA sequence
tgaagttggtcctaaaattg

SEQ ID NO: 794202 - DNA, 20 bp, Artificial
  CRISPR gRNA sequence
ttccttttcttttttggaga

SEQ ID NO: 794203 - DNA, 20 bp, Artificial
  CRISPR gRNA sequence
tctcactcggttgcccaggc

SEQ ID NO: 794204 - DNA, 20 bp, Artificial
  CRISPR gRNA sequence
ctcggttgcccaggctggag

SEQ ID NO: 794205 - DNA, 20 bp, Artificial
  CRISPR gRNA sequence
gccttggcctcccaaagtgc

SEQ ID NO: 794206 - DNA, 20 bp, Artificial
  CRISPR gRNA sequence
ggctaactttagtgttggca

SEQ ID NO: 794207 - DNA, 20 bp, Artificial
  CRISPR gRNA sequence
ttggcattgggtagtaaatt

SEQ ID NO: 794208 - DNA, 20 bp, Artificial
  CRISPR gRNA sequence
ctctgaaaactgtatcaggg

SEQ ID NO: 794209 - DNA, 20 bp, Artificial
  CRISPR gRNA sequence
accaggaaagttatgatgag

SEQ ID NO: 794210 - DNA, 20 bp, Artificial
  CRISPR gRNA sequence
tttagtcactgcaaagttct

SEQ ID NO: 794211 - DNA, 20 bp, Artificial
  CRISPR gRNA sequence
aagttcttggagtctggtct

SEQ ID NO: 794212 - DNA, 20 bp, Artificial
  CRISPR gRNA sequence
ccccacacatttaggctctg

SEQ ID NO: 794213 - DNA, 20 bp, Artificial
  CRISPR gRNA sequence
caaaggtctggcttcctacg

SEQ ID NO: 794214 - DNA, 20 bp, Artificial
  CRISPR gRNA sequence
tcctacggggaattctagca

SEQ ID NO: 794215 - DNA, 20 bp, Artificial
  CRISPR gRNA sequence
gctacataatggagacaagg

SEQ ID NO: 794216 - DNA, 20 bp, Artificial
  CRISPR gRNA sequence
gaagagtatgtctggaactc

SEQ ID NO: 794217 - DNA, 20 bp, Artificial
  CRISPR gRNA sequence
gatcaaaagctcagatctct

SEQ ID NO: 794218 - DNA, 20 bp, Artificial
  CRISPR gRNA sequence
atctcttagggtcgttaagt

SEQ ID NO: 794219 - DNA, 20 bp, Artificial
  CRISPR gRNA sequence
ggcaaagaaaccattccatc

SEQ ID NO: 794220 - DNA, 20 bp, Artificial
  CRISPR gRNA sequence
ggtgttaggtgagggaaatc

SEQ ID NO: 794221 - DNA, 20 bp, Artificial
  CRISPR gRNA sequence
agggaaatctggaatgtatg

SEQ ID NO: 794222 - DNA, 20 bp, Artificial
  CRISPR gRNA sequence
aaatctggaatgtatggtgg

SEQ ID NO: 794223 - DNA, 20 bp, Artificial
  CRISPR gRNA sequence
aacaaatatcaactgtggct

SEQ ID NO: 794224 - DNA, 20 bp, Artificial
  CRISPR gRNA sequence
gagctgacttaatgaagggc

SEQ ID NO: 794225 - DNA, 20 bp, Artificial
  CRISPR gRNA sequence
tgacttaatgaagggcatga

SEQ ID NO: 794226 - DNA, 20 bp, Artificial
  CRISPR gRNA sequence
cacctttcacttcagccagc

SEQ ID NO: 794227 - DNA, 20 bp, Artificial
  CRISPR gRNA sequence
ttcacttcagccagctgggg

SEQ ID NO: 794228 - DNA, 20 bp, Artificial
  CRISPR gRNA sequence
ggtcagtaattcacctcaaa

SEQ ID NO: 794229 - DNA, 20 bp, Artificial
  CRISPR gRNA sequence
cctgcgacttttctgatgct

SEQ ID NO: 794230 - DNA, 20 bp, Artificial
  CRISPR gRNA sequence
atgcatgtctagcccagcag

SEQ ID NO: 794231 - DNA, 20 bp, Artificial
  CRISPR gRNA sequence
tgtctagcccagcagcagaa

SEQ ID NO: 794232 - DNA, 20 bp, Artificial
  CRISPR gRNA sequence
ttccacctgaaattctttgt

SEQ ID NO: 794233 - DNA, 20 bp, Artificial
  CRISPR gRNA sequence
ggctgtctacatgctggtcc

SEQ ID NO: 794234 - DNA, 20 bp, Artificial
  CRISPR gRNA sequence
acatgctggtccttgaatat

SEQ ID NO: 794235 - DNA, 20 bp, Artificial
  CRISPR gRNA sequence
aatctcttgcttctgccctc

SEQ ID NO: 794236 - DNA, 20 bp, Artificial
  CRISPR gRNA sequence
tgaaatacaatgacaatata

SEQ ID NO: 794237 - DNA, 20 bp, Artificial
  CRISPR gRNA sequence
gaattttctataaagccaga

SEQ ID NO: 794238 - DNA, 20 bp, Artificial
  CRISPR gRNA sequence
tagggactgtcctttagtct

SEQ ID NO: 794239 - DNA, 20 bp, Artificial
  CRISPR gRNA sequence
gagagtatatcccttctcag

SEQ ID NO: 794240 - DNA, 20 bp, Artificial
  CRISPR gRNA sequence
tattctaatccctggaacat

SEQ ID NO: 794241 - DNA, 20 bp, Artificial
  CRISPR gRNA sequence
atgtcaccttacatggcaaa

SEQ ID NO: 794242 - DNA, 20 bp, Artificial
  CRISPR gRNA sequence
agatcaccccaaataaccag

SEQ ID NO: 794243 - DNA, 20 bp, Artificial
  CRISPR gRNA sequence
accccaaataaccaggggga

SEQ ID NO: 794244 - DNA, 20 bp, Artificial
  CRISPR gRNA sequence
ggagtacctaatgcaatcac

SEQ ID NO: 794245 - DNA, 20 bp, Artificial
  CRISPR gRNA sequence
aatttgggaggctgaggcgg

SEQ ID NO: 794246 - DNA, 20 bp, Artificial
  CRISPR gRNA sequence
cgggcggatcacctgaggtc

SEQ ID NO: 794247 - DNA, 20 bp, Artificial
  CRISPR gRNA sequence
tactcaggaggctgagacag

SEQ ID NO: 794248 - DNA, 20 bp, Artificial
  CRISPR gRNA sequence
atagcttgaacccgggaggc

SEQ ID NO: 794249 - DNA, 20 bp, Artificial
  CRISPR gRNA sequence
aggcaggggttgcagtgagc

SEQ ID NO: 794250 - DNA, 20 bp, Artificial
  CRISPR gRNA sequence
ctgcattccagcctgggggg

SEQ ID NO: 794251 - DNA, 20 bp, Artificial
  CRISPR gRNA sequence
gtggtgacagaagcagaagg

SEQ ID NO: 794252 - DNA, 20 bp, Artificial
  CRISPR gRNA sequence
agaagcagaaggctgaatga

SEQ ID NO: 794253 - DNA, 20 bp, Artificial
  CRISPR gRNA sequence
agctggaaaagacaggaaag

SEQ ID NO: 794254 - DNA, 20 bp, Artificial
  CRISPR gRNA sequence
ctgtatgaagttcaaaagta

SEQ ID NO: 794255 - DNA, 20 bp, Artificial
  CRISPR gRNA sequence
catagtcagtaaaggctctg

SEQ ID NO: 794256 - DNA, 20 bp, Artificial
  CRISPR gRNA sequence
actggcagcaagtacagcaa

SEQ ID NO: 794257 - DNA, 20 bp, Artificial
  CRISPR gRNA sequence
gctggctcatgacactgtgc

SEQ ID NO: 794258 - DNA, 20 bp, Artificial
  CRISPR gRNA sequence
ccctgagaagttgactttta

SEQ ID NO: 794259 - DNA, 20 bp, Artificial
  CRISPR gRNA sequence
ttgtattctctgacttctag

SEQ ID NO: 794260 - DNA, 20 bp, Artificial
  CRISPR gRNA sequence
gaggtgctagcaggagattg

SEQ ID NO: 794261 - DNA, 20 bp, Artificial
  CRISPR gRNA sequence
aggagattggagggtgggag

SEQ ID NO: 794262 - DNA, 20 bp, Artificial
  CRISPR gRNA sequence
gattggagggtgggaggaga

SEQ ID NO: 794263 - DNA, 20 bp, Artificial
  CRISPR gRNA sequence
agggtgggaggagaatgagt

SEQ ID NO: 794264 - DNA, 20 bp, Artificial
  CRISPR gRNA sequence
ttcatccagtttccaccctt

SEQ ID NO: 794265 - DNA, 20 bp, Artificial
  CRISPR gRNA sequence
ttacactctcctcaaatcac

SEQ ID NO: 794266 - DNA, 20 bp, Artificial
  CRISPR gRNA sequence
gccaaagtaagttccctcac

SEQ ID NO: 794267 - DNA, 20 bp, Artificial
  CRISPR gRNA sequence
cacagctgaagtttctgcca

SEQ ID NO: 794268 - DNA, 20 bp, Artificial
  CRISPR gRNA sequence
gtgacctggtagaggccttc

SEQ ID NO: 794269 - DNA, 20 bp, Artificial
  CRISPR gRNA sequence
gtagaggccttcaggggtcc

SEQ ID NO: 794270 - DNA, 20 bp, Artificial
  CRISPR gRNA sequence
caggaacgctgacgtttggc

SEQ ID NO: 794271 - DNA, 20 bp, Artificial
  CRISPR gRNA sequence
tggccaggatacttctgcca

SEQ ID NO: 794272 - DNA, 20 bp, Artificial
  CRISPR gRNA sequence
tcatctgtttctggaacctt

SEQ ID NO: 794273 - DNA, 20 bp, Artificial
  CRISPR gRNA sequence
gtttctggaacctttaggat

SEQ ID NO: 794274 - DNA, 20 bp, Artificial
  CRISPR gRNA sequence
ggtacttcatgccatgtgaa

SEQ ID NO: 794275 - DNA, 20 bp, Artificial
  CRISPR gRNA sequence
catgctattttccacatata

SEQ ID NO: 794276 - DNA, 20 bp, Artificial
  CRISPR gRNA sequence
ggttactgaagatagagaag

SEQ ID NO: 794277 - DNA, 20 bp, Artificial
  CRISPR gRNA sequence
taggaccaatatttgaacat

SEQ ID NO: 794278 - DNA, 20 bp, Artificial
  CRISPR gRNA sequence
gataatgtctatacatagta

SEQ ID NO: 794279 - DNA, 20 bp, Artificial
  CRISPR gRNA sequence
tgtctatacatagtaaagag

SEQ ID NO: 794280 - DNA, 20 bp, Artificial
  CRISPR gRNA sequence
ctgcttctttgcagtatatg

SEQ ID NO: 794281 - DNA, 20 bp, Artificial
  CRISPR gRNA sequence
ttctttgcagtatatgctga

SEQ ID NO: 794282 - DNA, 20 bp, Artificial
  CRISPR gRNA sequence
ggtcctcaaaaaactaaaaa

SEQ ID NO: 794283 - DNA, 20 bp, Artificial
  CRISPR gRNA sequence
atgatccagcagtcctactt

SEQ ID NO: 794284 - DNA, 20 bp, Artificial
  CRISPR gRNA sequence
acttctgggtatatatccaa

SEQ ID NO: 794285 - DNA, 20 bp, Artificial
  CRISPR gRNA sequence
tgggtatatatccaaaggaa

SEQ ID NO: 794286 - DNA, 20 bp, Artificial
  CRISPR gRNA sequence
aaactaaatgtccatcaaca

SEQ ID NO: 794287 - DNA, 20 bp, Artificial
  CRISPR gRNA sequence
taaatgtccatcaacagaga

SEQ ID NO: 794288 - DNA, 20 bp, Artificial
  CRISPR gRNA sequence
aatgtggtatatatacacaa

SEQ ID NO: 794289 - DNA, 20 bp, Artificial
  CRISPR gRNA sequence
aatctgtcattcatgacaac

SEQ ID NO: 794290 - DNA, 20 bp, Artificial
  CRISPR gRNA sequence
tgacaacatggatggaactg

SEQ ID NO: 794291 - DNA, 20 bp, Artificial
  CRISPR gRNA sequence
aaaagtagatcccatagaaa

SEQ ID NO: 794292 - DNA, 20 bp, Artificial
  CRISPR gRNA sequence
aaaggtggttatcagaggct

SEQ ID NO: 794293 - DNA, 20 bp, Artificial
  CRISPR gRNA sequence
tggaagatgttgctcagtct

SEQ ID NO: 794294 - DNA, 20 bp, Artificial
  CRISPR gRNA sequence
tattcaaatttgctaaaagc

SEQ ID NO: 794295 - DNA, 20 bp, Artificial
  CRISPR gRNA sequence
ttttttttttttttttgaga

SEQ ID NO: 794296 - DNA, 20 bp, Artificial
  CRISPR gRNA sequence
gtttcgctcgtcacccaggc

SEQ ID NO: 794297 - DNA, 20 bp, Artificial
  CRISPR gRNA sequence
aattctcctgcctcagcttc

SEQ ID NO: 794298 - DNA, 20 bp, Artificial
  CRISPR gRNA sequence
gcctcagcttcctgagtagc

SEQ ID NO: 794299 - DNA, 20 bp, Artificial
  CRISPR gRNA sequence
ttttctattttcagtagaga

SEQ ID NO: 794300 - DNA, 20 bp, Artificial
  CRISPR gRNA sequence
gccttggcctcccaaagtgc

SEQ ID NO: 794301 - DNA, 20 bp, Artificial
  CRISPR gRNA sequence
gatatttggtgagaggaaga

SEQ ID NO: 794302 - DNA, 20 bp, Artificial
  CRISPR gRNA sequence
tttacatcctatggaagaga

SEQ ID NO: 794303 - DNA, 20 bp, Artificial
  CRISPR gRNA sequence
ctctgttcccctcctgtgtt

SEQ ID NO: 794304 - DNA, 20 bp, Artificial
  CRISPR gRNA sequence
gtgttgtgggtctcaatgtt

SEQ ID NO: 794305 - DNA, 20 bp, Artificial
  CRISPR gRNA sequence
gcaaacaacacccactagat

SEQ ID NO: 794306 - DNA, 20 bp, Artificial
  CRISPR gRNA sequence
gatctgggttcactagagag

SEQ ID NO: 794307 - DNA, 20 bp, Artificial
  CRISPR gRNA sequence
tgatatgcagaccctatgag

SEQ ID NO: 794308 - DNA, 20 bp, Artificial
  CRISPR gRNA sequence
ttttgtaatgcattcttaat

SEQ ID NO: 794309 - DNA, 20 bp, Artificial
  CRISPR gRNA sequence
cttaattggaatcaccataa

SEQ ID NO: 794310 - DNA, 20 bp, Artificial
  CRISPR gRNA sequence
ctgtgtaattgcagatgtct

SEQ ID NO: 794311 - DNA, 20 bp, Artificial
  CRISPR gRNA sequence
ggtgcaacataagcagatag

SEQ ID NO: 794312 - DNA, 20 bp, Artificial
  CRISPR gRNA sequence
cagtacccgaagtgtgtatt

SEQ ID NO: 794313 - DNA, 20 bp, Artificial
  CRISPR gRNA sequence
gtaagctctcaagtcttttg

SEQ ID NO: 794314 - DNA, 20 bp, Artificial
  CRISPR gRNA sequence
aagtagaacaagaacaggag

SEQ ID NO: 794315 - DNA, 20 bp, Artificial
  CRISPR gRNA sequence
aagaacaggagcagagtact

SEQ ID NO: 794316 - DNA, 20 bp, Artificial
  CRISPR gRNA sequence
aggagcagagtactgtgggt

SEQ ID NO: 794317 - DNA, 20 bp, Artificial
  CRISPR gRNA sequence
tgagaagtgatttcagaagt

SEQ ID NO: 794318 - DNA, 20 bp, Artificial
  CRISPR gRNA sequence
atttcagaagtagggatgcc

SEQ ID NO: 794319 - DNA, 20 bp, Artificial
  CRISPR gRNA sequence
gcttggctgaggctttgact

SEQ ID NO: 794320 - DNA, 20 bp, Artificial
  CRISPR gRNA sequence
agagagagctcttccactac

SEQ ID NO: 794321 - DNA, 20 bp, Artificial
  CRISPR gRNA sequence
tatttggaaggtggtggaaa

SEQ ID NO: 794322 - DNA, 20 bp, Artificial
  CRISPR gRNA sequence
cacagtggggaagctggact

SEQ ID NO: 794323 - DNA, 20 bp, Artificial
  CRISPR gRNA sequence
ggtgatattcttaggaaaag

SEQ ID NO: 794324 - DNA, 20 bp, Artificial
  CRISPR gRNA sequence
aggaaaagatgagtaaattt

SEQ ID NO: 794325 - DNA, 20 bp, Artificial
  CRISPR gRNA sequence
caatgtgtgttctgtagttg

SEQ ID NO: 794326 - DNA, 20 bp, Artificial
  CRISPR gRNA sequence
ttctatcagttgtaatagag

SEQ ID NO: 794327 - DNA, 20 bp, Artificial
  CRISPR gRNA sequence
ttgaaatctcaaatgtaatt

SEQ ID NO: 794328 - DNA, 20 bp, Artificial
  CRISPR gRNA sequence
ctgttaaatggacacacatt

SEQ ID NO: 794329 - DNA, 20 bp, Artificial
  CRISPR gRNA sequence
acttttgcctgaaaacatct

SEQ ID NO: 794330 - DNA, 20 bp, Artificial
  CRISPR gRNA sequence
taagcaccgtagttaaaaac

SEQ ID NO: 794331 - DNA, 20 bp, Artificial
  CRISPR gRNA sequence
cgtagttaaaaacatgagtt

SEQ ID NO: 794332 - DNA, 20 bp, Artificial
  CRISPR gRNA sequence
gagttcagaatctgagcagt

SEQ ID NO: 794333 - DNA, 20 bp, Artificial
  CRISPR gRNA sequence
tcagttttcttgtttaggaa

SEQ ID NO: 794334 - DNA, 20 bp, Artificial
  CRISPR gRNA sequence
cagcaatacttatccttaac

SEQ ID NO: 794335 - DNA, 20 bp, Artificial
  CRISPR gRNA sequence
gcaggtaacccttctgatat

SEQ ID NO: 794336 - DNA, 20 bp, Artificial
  CRISPR gRNA sequence
gttttgccacgttctttaaa

SEQ ID NO: 794337 - DNA, 20 bp, Artificial
  CRISPR gRNA sequence
atctaagcagcacaaatatc

SEQ ID NO: 794338 - DNA, 20 bp, Artificial
  CRISPR gRNA sequence
gttggctatatccttacaac

SEQ ID NO: 794339 - DNA, 20 bp, Artificial
  CRISPR gRNA sequence
gtgtgtgtgctttgtgtgtc

SEQ ID NO: 794340 - DNA, 20 bp, Artificial
  CRISPR gRNA sequence
gaagcaagacaggaacacta

SEQ ID NO: 794341 - DNA, 20 bp, Artificial
  CRISPR gRNA sequence
gataccaatggacaggccca

SEQ ID NO: 794342 - DNA, 20 bp, Artificial
  CRISPR gRNA sequence
ctttctgctattgctaattt

SEQ ID NO: 794343 - DNA, 20 bp, Artificial
  CRISPR gRNA sequence
ttctcagtctccctcattaa

SEQ ID NO: 794344 - DNA, 20 bp, Artificial
  CRISPR gRNA sequence
ttttacatgccttggtctta

SEQ ID NO: 794345 - DNA, 20 bp, Artificial
  CRISPR gRNA sequence
atctgttaaattgcctgaaa

SEQ ID NO: 794346 - DNA, 20 bp, Artificial
  CRISPR gRNA sequence
tgaaaaggaatagcaggtta

SEQ ID NO: 794347 - DNA, 20 bp, Artificial
  CRISPR gRNA sequence
gcccttggtttcttccttct

SEQ ID NO: 794348 - DNA, 20 bp, Artificial
  CRISPR gRNA sequence
ttttttttttttttttgaga

SEQ ID NO: 794349 - DNA, 20 bp, Artificial
  CRISPR gRNA sequence
tctcgctctgtcgcccaggc

SEQ ID NO: 794350 - DNA, 20 bp, Artificial
  CRISPR gRNA sequence
cattctcctgcctcagcctc

SEQ ID NO: 794351 - DNA, 20 bp, Artificial
  CRISPR gRNA sequence
ttttgtatttttagtagaga

SEQ ID NO: 794352 - DNA, 20 bp, Artificial
  CRISPR gRNA sequence
cggggtttcaccgtgttagc

SEQ ID NO: 794353 - DNA, 20 bp, Artificial
  CRISPR gRNA sequence
acctcggcctcccaaagtgc

SEQ ID NO: 794354 - DNA, 20 bp, Artificial
  CRISPR gRNA sequence
aaccacgcctggcccaaatg

SEQ ID NO: 794355 - DNA, 20 bp, Artificial
  CRISPR gRNA sequence
tcatagcttagctcgcactt

SEQ ID NO: 794356 - DNA, 20 bp, Artificial
  CRISPR gRNA sequence
caatgtttggttttacattc

SEQ ID NO: 794357 - DNA, 20 bp, Artificial
  CRISPR gRNA sequence
cattcctgagttacttcact

SEQ ID NO: 794358 - DNA, 20 bp, Artificial
  CRISPR gRNA sequence
taatagtctctaattccatc

SEQ ID NO: 794359 - DNA, 20 bp, Artificial
  CRISPR gRNA sequence
gtataatgacttcttttcct

SEQ ID NO: 794360 - DNA, 20 bp, Artificial
  CRISPR gRNA sequence
tttgggtaaatacctagtag

SEQ ID NO: 794361 - DNA, 20 bp, Artificial
  CRISPR gRNA sequence
aatacctagtagtgggattg

SEQ ID NO: 794362 - DNA, 20 bp, Artificial
  CRISPR gRNA sequence
gatctacttttagtttttaa

SEQ ID NO: 794363 - DNA, 20 bp, Artificial
  CRISPR gRNA sequence
tacattcccaccaacagtgt

SEQ ID NO: 794364 - DNA, 20 bp, Artificial
  CRISPR gRNA sequence
tttgttatggccattcttgc

SEQ ID NO: 794365 - DNA, 20 bp, Artificial
  CRISPR gRNA sequence
gttttgatttgcatttccct

SEQ ID NO: 794366 - DNA, 20 bp, Artificial
  CRISPR gRNA sequence
tcatttgtgtatctccttgt

SEQ ID NO: 794367 - DNA, 20 bp, Artificial
  CRISPR gRNA sequence
gtccttagcccattttttga

SEQ ID NO: 794368 - DNA, 20 bp, Artificial
  CRISPR gRNA sequence
atttgcataccttgtagatt

SEQ ID NO: 794369 - DNA, 20 bp, Artificial
  CRISPR gRNA sequence
tgaagattttctcccactct

SEQ ID NO: 794370 - DNA, 20 bp, Artificial
  CRISPR gRNA sequence
tgtctttgttgcatttgctt

SEQ ID NO: 794371 - DNA, 20 bp, Artificial
  CRISPR gRNA sequence
gctttttcgatgttatcttc

SEQ ID NO: 794372 - DNA, 20 bp, Artificial
  CRISPR gRNA sequence
atttaagtctttgatccatc

SEQ ID NO: 794373 - DNA, 20 bp, Artificial
  CRISPR gRNA sequence
ttttttataaggtaagatat

SEQ ID NO: 794374 - DNA, 20 bp, Artificial
  CRISPR gRNA sequence
aattatcccagcaccgtttg

SEQ ID NO: 794375 - DNA, 20 bp, Artificial
  CRISPR gRNA sequence
tcccagcaccgtttgttgaa

SEQ ID NO: 794376 - DNA, 20 bp, Artificial
  CRISPR gRNA sequence
gggctcttttttggttccat

SEQ ID NO: 794377 - DNA, 20 bp, Artificial
  CRISPR gRNA sequence
ttttggttccatatgaattt

SEQ ID NO: 794378 - DNA, 20 bp, Artificial
  CRISPR gRNA sequence
tttctttttctacttttgtg

SEQ ID NO: 794379 - DNA, 20 bp, Artificial
  CRISPR gRNA sequence
aatgatggtagtattttgat

SEQ ID NO: 794380 - DNA, 20 bp, Artificial
  CRISPR gRNA sequence
attgtacctattcatgaaca

SEQ ID NO: 794381 - DNA, 20 bp, Artificial
  CRISPR gRNA sequence
ttttgtatcctgaaactttg

SEQ ID NO: 794382 - DNA, 20 bp, Artificial
  CRISPR gRNA sequence
cagttctaggagctttcaag

SEQ ID NO: 794383 - DNA, 20 bp, Artificial
  CRISPR gRNA sequence
gagctttcaagatgaatcct

SEQ ID NO: 794384 - DNA, 20 bp, Artificial
  CRISPR gRNA sequence
ttgacttcctctttaccaat

SEQ ID NO: 794385 - DNA, 20 bp, Artificial
  CRISPR gRNA sequence
tgccctttatttctttctct

SEQ ID NO: 794386 - DNA, 20 bp, Artificial
  CRISPR gRNA sequence
ccaggacttccagtactatg

SEQ ID NO: 794387 - DNA, 20 bp, Artificial
  CRISPR gRNA sequence
cattcagcataatgttggct

SEQ ID NO: 794388 - DNA, 20 bp, Artificial
  CRISPR gRNA sequence
ccttctgtgctaattttgct

SEQ ID NO: 794389 - DNA, 20 bp, Artificial
  CRISPR gRNA sequence
tgctgagggttttaatcata

SEQ ID NO: 794390 - DNA, 20 bp, Artificial
  CRISPR gRNA sequence
gattttgtcaaatgcttttt

SEQ ID NO: 794391 - DNA, 20 bp, Artificial
  CRISPR gRNA sequence
tgtatcacatttattaactt

SEQ ID NO: 794392 - DNA, 20 bp, Artificial
  CRISPR gRNA sequence
gtaaaacccacttgatcatg

SEQ ID NO: 794393 - DNA, 20 bp, Artificial
  CRISPR gRNA sequence
attatctttttgatatgctg

SEQ ID NO: 794394 - DNA, 20 bp, Artificial
  CRISPR gRNA sequence
tggttagctagtattttgtt

SEQ ID NO: 794395 - DNA, 20 bp, Artificial
  CRISPR gRNA sequence
tttttacatctatgttcatc

SEQ ID NO: 794396 - DNA, 20 bp, Artificial
  CRISPR gRNA sequence
tccttccctggtttttgtat

SEQ ID NO: 794397 - DNA, 20 bp, Artificial
  CRISPR gRNA sequence
ttagggtgctactggcttca

SEQ ID NO: 794398 - DNA, 20 bp, Artificial
  CRISPR gRNA sequence
gcttcatagaatgatttagg

SEQ ID NO: 794399 - DNA, 20 bp, Artificial
  CRISPR gRNA sequence
ttccctctttctctatccca

SEQ ID NO: 794400 - DNA, 20 bp, Artificial
  CRISPR gRNA sequence
atcccatggaatagtgtcaa

SEQ ID NO: 794401 - DNA, 20 bp, Artificial
  CRISPR gRNA sequence
gaattggtaccaattcttct

SEQ ID NO: 794402 - DNA, 20 bp, Artificial
  CRISPR gRNA sequence
attcttctttgaatgtctga

SEQ ID NO: 794403 - DNA, 20 bp, Artificial
  CRISPR gRNA sequence
atgtctgatagaattcagct

SEQ ID NO: 794404 - DNA, 20 bp, Artificial
  CRISPR gRNA sequence
agctatgaatctgtctggtc

SEQ ID NO: 794405 - DNA, 20 bp, Artificial
  CRISPR gRNA sequence
atatctttctggtttaatcg

SEQ ID NO: 794406 - DNA, 20 bp, Artificial
  CRISPR gRNA sequence
tcgaagggttgtatatttcc

SEQ ID NO: 794407 - DNA, 20 bp, Artificial
  CRISPR gRNA sequence
taaaggtgttcatagtggcc

SEQ ID NO: 794408 - DNA, 20 bp, Artificial
  CRISPR gRNA sequence
atcttttgtatttctgtgat

SEQ ID NO: 794409 - DNA, 20 bp, Artificial
  CRISPR gRNA sequence
tcatttctaattgagattat

SEQ ID NO: 794410 - DNA, 20 bp, Artificial
  CRISPR gRNA sequence
ttgtaatttcttttcttctg

SEQ ID NO: 794411 - DNA, 20 bp, Artificial
  CRISPR gRNA sequence
tttcttttcttctgctgggt

SEQ ID NO: 794412 - DNA, 20 bp, Artificial
  CRISPR gRNA sequence
ttcttctgctgggtttgggt

SEQ ID NO: 794413 - DNA, 20 bp, Artificial
  CRISPR gRNA sequence
tgatgtaggcatttaatgct

SEQ ID NO: 794414 - DNA, 20 bp, Artificial
  CRISPR gRNA sequence
gcactgcttttgctgtatcc

SEQ ID NO: 794415 - DNA, 20 bp, Artificial
  CRISPR gRNA sequence
cactattatcgttcagttca

SEQ ID NO: 794416 - DNA, 20 bp, Artificial
  CRISPR gRNA sequence
atggttttgaaggttccttt

SEQ ID NO: 794417 - DNA, 20 bp, Artificial
  CRISPR gRNA sequence
tttactccactgtgatctaa

SEQ ID NO: 794418 - DNA, 20 bp, Artificial
  CRISPR gRNA sequence
ctactatatagtctatcttg

SEQ ID NO: 794419 - DNA, 20 bp, Artificial
  CRISPR gRNA sequence
ggagaatgttccatatgctg

SEQ ID NO: 794420 - DNA, 20 bp, Artificial
  CRISPR gRNA sequence
atgttccatatgctgatgaa

SEQ ID NO: 794421 - DNA, 20 bp, Artificial
  CRISPR gRNA sequence
gaatgtatattctgcgattg

SEQ ID NO: 794422 - DNA, 20 bp, Artificial
  CRISPR gRNA sequence
tatattctgcgattgttggg

SEQ ID NO: 794423 - DNA, 20 bp, Artificial
  CRISPR gRNA sequence
ccctgccctgcccaggcctt

SEQ ID NO: 794424 - DNA, 20 bp, Artificial
  CRISPR gRNA sequence
tgctcccgccccttcctcag

SEQ ID NO: 794425 - DNA, 20 bp, Artificial
  CRISPR gRNA sequence
tcctttatcactgtctcttc

SEQ ID NO: 794426 - DNA, 20 bp, Artificial
  CRISPR gRNA sequence
ctcttttcattatatttgat

SEQ ID NO: 794427 - DNA, 20 bp, Artificial
  CRISPR gRNA sequence
ccattttcaagctttatgcc

SEQ ID NO: 794428 - DNA, 20 bp, Artificial
  CRISPR gRNA sequence
tcttgcttcttttagagacc

SEQ ID NO: 794429 - DNA, 20 bp, Artificial
  CRISPR gRNA sequence
ttcttttagagaccctggat

SEQ ID NO: 794430 - DNA, 20 bp, Artificial
  CRISPR gRNA sequence
catataatgttcagcatctt

SEQ ID NO: 794431 - DNA, 20 bp, Artificial
  CRISPR gRNA sequence
tatagcttcaaatagccaga

SEQ ID NO: 794432 - DNA, 20 bp, Artificial
  CRISPR gRNA sequence
aaatagccagaaggggtaca

SEQ ID NO: 794433 - DNA, 20 bp, Artificial
  CRISPR gRNA sequence
ttttttttctttttttgaga

SEQ ID NO: 794434 - DNA, 20 bp, Artificial
  CRISPR gRNA sequence
tctcgctctgtcgcccaggc

SEQ ID NO: 794435 - DNA, 20 bp, Artificial
  CRISPR gRNA sequence
gttgtattttttagtagaga

SEQ ID NO: 794436 - DNA, 20 bp, Artificial
  CRISPR gRNA sequence
cagggtttcaccatgttagc

SEQ ID NO: 794437 - DNA, 20 bp, Artificial
  CRISPR gRNA sequence
gccttggcctcccaaagtgc

SEQ ID NO: 794438 - DNA, 20 bp, Artificial
  CRISPR gRNA sequence
aaataagctcttacaaacaa

SEQ ID NO: 794439 - DNA, 20 bp, Artificial
  CRISPR gRNA sequence
agaatatgtatgaaacatgc

SEQ ID NO: 794440 - DNA, 20 bp, Artificial
  CRISPR gRNA sequence
aatttcctgtgttaaaaaag

SEQ ID NO: 794441 - DNA, 20 bp, Artificial
  CRISPR gRNA sequence
aaaaaaggggaatgagactg

SEQ ID NO: 794442 - DNA, 20 bp, Artificial
  CRISPR gRNA sequence
actggagaatgtggaaaaaa

SEQ ID NO: 794443 - DNA, 20 bp, Artificial
  CRISPR gRNA sequence
agacaaataacagaggcttt

SEQ ID NO: 794444 - DNA, 20 bp, Artificial
  CRISPR gRNA sequence
ttccaatttcaccttcccta

SEQ ID NO: 794445 - DNA, 20 bp, Artificial
  CRISPR gRNA sequence
actatgaagctttaaatgtt

SEQ ID NO: 794446 - DNA, 20 bp, Artificial
  CRISPR gRNA sequence
ttttttttaacagtaagttt

SEQ ID NO: 794447 - DNA, 20 bp, Artificial
  CRISPR gRNA sequence
tcattgttcaattcccacct

SEQ ID NO: 794448 - DNA, 20 bp, Artificial
  CRISPR gRNA sequence
ggtgtttggttttttgtcct

SEQ ID NO: 794449 - DNA, 20 bp, Artificial
  CRISPR gRNA sequence
tgtccttgggatagtttgct

SEQ ID NO: 794450 - DNA, 20 bp, Artificial
  CRISPR gRNA sequence
tgatcaaaatgtaaaatgtt

SEQ ID NO: 794451 - DNA, 20 bp, Artificial
  CRISPR gRNA sequence
atgaaagatgaaaatttatt

SEQ ID NO: 794452 - DNA, 20 bp, Artificial
  CRISPR gRNA sequence
ggaatgtgtcccttaataag

SEQ ID NO: 794453 - DNA, 20 bp, Artificial
  CRISPR gRNA sequence
ctctcttttccaaattattc

SEQ ID NO: 794454 - DNA, 20 bp, Artificial
  CRISPR gRNA sequence
gaagaaccatatgacatggt

SEQ ID NO: 794455 - DNA, 20 bp, Artificial
  CRISPR gRNA sequence
gttggaatgattttatataa

SEQ ID NO: 794456 - DNA, 20 bp, Artificial
  CRISPR gRNA sequence
tttgtagcttataaaggcta

SEQ ID NO: 794457 - DNA, 20 bp, Artificial
  CRISPR gRNA sequence
ggctaaggaatcttgttcgt

SEQ ID NO: 794458 - DNA, 20 bp, Artificial
  CRISPR gRNA sequence
gttcgtatgagtaaatcaat

SEQ ID NO: 794459 - DNA, 20 bp, Artificial
  CRISPR gRNA sequence
agataccacattatttgcaa

SEQ ID NO: 794460 - DNA, 20 bp, Artificial
  CRISPR gRNA sequence
ttcttttatttaacactata

SEQ ID NO: 794461 - DNA, 20 bp, Artificial
  CRISPR gRNA sequence
gacaatggactatattcatg

SEQ ID NO: 794462 - DNA, 20 bp, Artificial
  CRISPR gRNA sequence
atggactatattcatgatga

SEQ ID NO: 794463 - DNA, 20 bp, Artificial
  CRISPR gRNA sequence
caggctcgtcaattttggga

SEQ ID NO: 794464 - DNA, 20 bp, Artificial
  CRISPR gRNA sequence
aacgagtatttggggaagat

SEQ ID NO: 794465 - DNA, 20 bp, Artificial
  CRISPR gRNA sequence
agaaatccctgatctaggta

SEQ ID NO: 794466 - DNA, 20 bp, Artificial
  CRISPR gRNA sequence
tgatctaggtaaggagtagg

SEQ ID NO: 794467 - DNA, 20 bp, Artificial
  CRISPR gRNA sequence
agtaggcagggtgcctcccc

SEQ ID NO: 794468 - DNA, 20 bp, Artificial
  CRISPR gRNA sequence
agagacagttctcagtttga

SEQ ID NO: 794469 - DNA, 20 bp, Artificial
  CRISPR gRNA sequence
taaaaacagaggtggtgatt

SEQ ID NO: 794470 - DNA, 20 bp, Artificial
  CRISPR gRNA sequence
tgatttagggttgcagatat

SEQ ID NO: 794471 - DNA, 20 bp, Artificial
  CRISPR gRNA sequence
cgagtacatcaaggcatcct

SEQ ID NO: 794472 - DNA, 20 bp, Artificial
  CRISPR gRNA sequence
tcagacaaacttcagtgttc

SEQ ID NO: 794473 - DNA, 20 bp, Artificial
  CRISPR gRNA sequence
gagttcctcccagctgctgc

SEQ ID NO: 794474 - DNA, 20 bp, Artificial
  CRISPR gRNA sequence
tcactgcccctgtaacaact

SEQ ID NO: 794475 - DNA, 20 bp, Artificial
  CRISPR gRNA sequence
ctctggacacttattatatg

SEQ ID NO: 794476 - DNA, 20 bp, Artificial
  CRISPR gRNA sequence
aaaggcaaaataacctgccc

SEQ ID NO: 794477 - DNA, 20 bp, Artificial
  CRISPR gRNA sequence
tcaccttttctagaacaaac

SEQ ID NO: 794478 - DNA, 20 bp, Artificial
  CRISPR gRNA sequence
atttagattttcaattgtgc

SEQ ID NO: 794479 - DNA, 20 bp, Artificial
  CRISPR gRNA sequence
gtgctggagtggagagatcc

SEQ ID NO: 794480 - DNA, 20 bp, Artificial
  CRISPR gRNA sequence
ggagagatccctgaatccag

SEQ ID NO: 794481 - DNA, 20 bp, Artificial
  CRISPR gRNA sequence
gggctacccacttcccttct

SEQ ID NO: 794482 - DNA, 20 bp, Artificial
  CRISPR gRNA sequence
ctaaattgatattttaatcc

SEQ ID NO: 794483 - DNA, 20 bp, Artificial
  CRISPR gRNA sequence
aaaccatggttttaaaaact

SEQ ID NO: 794484 - DNA, 20 bp, Artificial
  CRISPR gRNA sequence
ggttttaaaaactctggatt

SEQ ID NO: 794485 - DNA, 20 bp, Artificial
  CRISPR gRNA sequence
cagggtataaactattgaaa

SEQ ID NO: 794486 - DNA, 20 bp, Artificial
  CRISPR gRNA sequence
agtatcttaataatcaagtc

SEQ ID NO: 794487 - DNA, 20 bp, Artificial
  CRISPR gRNA sequence
aagtcagggatgttccatgg

SEQ ID NO: 794488 - DNA, 20 bp, Artificial
  CRISPR gRNA sequence
ggatgttccatgggagaatt

SEQ ID NO: 794489 - DNA, 20 bp, Artificial
  CRISPR gRNA sequence
ttttgcttgagctaccttta

SEQ ID NO: 794490 - DNA, 20 bp, Artificial
  CRISPR gRNA sequence
tctgttggagagatgcttcc

SEQ ID NO: 794491 - DNA, 20 bp, Artificial
  CRISPR gRNA sequence
caccactcacctttgacttt

SEQ ID NO: 794492 - DNA, 20 bp, Artificial
  CRISPR gRNA sequence
aagtggctctttcacggtgt

SEQ ID NO: 794493 - DNA, 20 bp, Artificial
  CRISPR gRNA sequence
ccagtgtcaaagttgcattc

SEQ ID NO: 794494 - DNA, 20 bp, Artificial
  CRISPR gRNA sequence
gttccttagggactgtcact

SEQ ID NO: 794495 - DNA, 20 bp, Artificial
  CRISPR gRNA sequence
cttatctggacattcccgtg

SEQ ID NO: 794496 - DNA, 20 bp, Artificial
  CRISPR gRNA sequence
tttgccccatccatctgggc

SEQ ID NO: 794497 - DNA, 20 bp, Artificial
  CRISPR gRNA sequence
cccatccatctgggcaagag

SEQ ID NO: 794498 - DNA, 20 bp, Artificial
  CRISPR gRNA sequence
gtaataataactattacttg

SEQ ID NO: 794499 - DNA, 20 bp, Artificial
  CRISPR gRNA sequence
cttgcccaagattgcacagc

SEQ ID NO: 794500 - DNA, 20 bp, Artificial
  CRISPR gRNA sequence
caaaatccgtagtttccact

SEQ ID NO: 794501 - DNA, 20 bp, Artificial
  CRISPR gRNA sequence
taagatgattttagatgagg

SEQ ID NO: 794502 - DNA, 20 bp, Artificial
  CRISPR gRNA sequence
aggcagaatcaaagcctaaa

SEQ ID NO: 794503 - DNA, 20 bp, Artificial
  CRISPR gRNA sequence
gggagttaaattattcagag

SEQ ID NO: 794504 - DNA, 20 bp, Artificial
  CRISPR gRNA sequence
tttaatcaaacaggaagctt

SEQ ID NO: 794505 - DNA, 20 bp, Artificial
  CRISPR gRNA sequence
ttccgggtagataacagtat

SEQ ID NO: 794506 - DNA, 20 bp, Artificial
  CRISPR gRNA sequence
ggtagataacagtatctggg

SEQ ID NO: 794507 - DNA, 20 bp, Artificial
  CRISPR gRNA sequence
acttgtttttcatctaccac

SEQ ID NO: 794508 - DNA, 20 bp, Artificial
  CRISPR gRNA sequence
gtggctttattttttaaaag

SEQ ID NO: 794509 - DNA, 20 bp, Artificial
  CRISPR gRNA sequence
agttctataaaaaaagcata

SEQ ID NO: 794510 - DNA, 20 bp, Artificial
  CRISPR gRNA sequence
ttaggctgcttccatcatta

SEQ ID NO: 794511 - DNA, 20 bp, Artificial
  CRISPR gRNA sequence
gctgcttccatcattaatga

SEQ ID NO: 794512 - DNA, 20 bp, Artificial
  CRISPR gRNA sequence
ggaaaatcttgaagtagttt

SEQ ID NO: 794513 - DNA, 20 bp, Artificial
  CRISPR gRNA sequence
aaatgtgatacggaagagca

SEQ ID NO: 794514 - DNA, 20 bp, Artificial
  CRISPR gRNA sequence
ggatatagtgacaggtgagc

SEQ ID NO: 794515 - DNA, 20 bp, Artificial
  CRISPR gRNA sequence
cctgggttcaaatgctgact

SEQ ID NO: 794516 - DNA, 20 bp, Artificial
  CRISPR gRNA sequence
tcaaatgctgactcaggatt

SEQ ID NO: 794517 - DNA, 20 bp, Artificial
  CRISPR gRNA sequence
ggattaggagtcctttgact

SEQ ID NO: 794518 - DNA, 20 bp, Artificial
  CRISPR gRNA sequence
ggaaagtggtaattcatatg

SEQ ID NO: 794519 - DNA, 20 bp, Artificial
  CRISPR gRNA sequence
catggccaatctttatcctc

SEQ ID NO: 794520 - DNA, 20 bp, Artificial
  CRISPR gRNA sequence
tttcacagtataagtaactt

SEQ ID NO: 794521 - DNA, 20 bp, Artificial
  CRISPR gRNA sequence
acttttgggttttctgctgc

SEQ ID NO: 794522 - DNA, 20 bp, Artificial
  CRISPR gRNA sequence
ctttgaaggcaaagaccagg

SEQ ID NO: 794523 - DNA, 20 bp, Artificial
  CRISPR gRNA sequence
aagagagagagggagaaaga

SEQ ID NO: 794524 - DNA, 20 bp, Artificial
  CRISPR gRNA sequence
taatgtgcctttctacagag

SEQ ID NO: 794525 - DNA, 20 bp, Artificial
  CRISPR gRNA sequence
cacaggggcagggctataag

SEQ ID NO: 794526 - DNA, 20 bp, Artificial
  CRISPR gRNA sequence
gtgccaggttgcaaagaccc

SEQ ID NO: 794527 - DNA, 20 bp, Artificial
  CRISPR gRNA sequence
attttaatccactgcacact

SEQ ID NO: 794528 - DNA, 20 bp, Artificial
  CRISPR gRNA sequence
acttggaatagctctcacct

SEQ ID NO: 794529 - DNA, 20 bp, Artificial
  CRISPR gRNA sequence
tggaagccgtccttaaatac

SEQ ID NO: 794530 - DNA, 20 bp, Artificial
  CRISPR gRNA sequence
ccaaatccaatctgtccttg

SEQ ID NO: 794531 - DNA, 20 bp, Artificial
  CRISPR gRNA sequence
agtaatcatatgccaagttc

SEQ ID NO: 794532 - DNA, 20 bp, Artificial
  CRISPR gRNA sequence
cttacaaggaaggttagttg

SEQ ID NO: 794533 - DNA, 20 bp, Artificial
  CRISPR gRNA sequence
tgctgagtctgcataacaac

SEQ ID NO: 794534 - DNA, 20 bp, Artificial
  CRISPR gRNA sequence
caagaattaaatagatgact

SEQ ID NO: 794535 - DNA, 20 bp, Artificial
  CRISPR gRNA sequence
atgactttgggtagagactg

SEQ ID NO: 794536 - DNA, 20 bp, Artificial
  CRISPR gRNA sequence
atttttcctgtctgccttgt

SEQ ID NO: 794537 - DNA, 20 bp, Artificial
  CRISPR gRNA sequence
gccttgtaagaatgcgtgcc

SEQ ID NO: 794538 - DNA, 20 bp, Artificial
  CRISPR gRNA sequence
gaaaagagcaattagcaaac

SEQ ID NO: 794539 - DNA, 20 bp, Artificial
  CRISPR gRNA sequence
agcaaacatgaatcatatgt

SEQ ID NO: 794540 - DNA, 20 bp, Artificial
  CRISPR gRNA sequence
aatcatatgtctgaatagct

SEQ ID NO: 794541 - DNA, 20 bp, Artificial
  CRISPR gRNA sequence
gcctcaatcttggctaacat

SEQ ID NO: 794542 - DNA, 20 bp, Artificial
  CRISPR gRNA sequence
actaatgcccaggcactact

SEQ ID NO: 794543 - DNA, 20 bp, Artificial
  CRISPR gRNA sequence
ctggaagctaggtagaaatg

SEQ ID NO: 794544 - DNA, 20 bp, Artificial
  CRISPR gRNA sequence
tcaagccttccccagaccta

SEQ ID NO: 794545 - DNA, 20 bp, Artificial
  CRISPR gRNA sequence
cttccccagacctagggaat

SEQ ID NO: 794546 - DNA, 20 bp, Artificial
  CRISPR gRNA sequence
gcacattaatgtttgagaag

SEQ ID NO: 794547 - DNA, 20 bp, Artificial
  CRISPR gRNA sequence
atgcaacttgcccaaggtca

SEQ ID NO: 794548 - DNA, 20 bp, Artificial
  CRISPR gRNA sequence
agaatggtagctcatggaac

SEQ ID NO: 794549 - DNA, 20 bp, Artificial
  CRISPR gRNA sequence
ggcatgtgtacactacatcc

SEQ ID NO: 794550 - DNA, 20 bp, Artificial
  CRISPR gRNA sequence
tgtgtacactacatccatga

SEQ ID NO: 794551 - DNA, 20 bp, Artificial
  CRISPR gRNA sequence
tattaaattaagcttcaacc

SEQ ID NO: 794552 - DNA, 20 bp, Artificial
  CRISPR gRNA sequence
acttattcaggaaacacaca

SEQ ID NO: 794553 - DNA, 20 bp, Artificial
  CRISPR gRNA sequence
acgtaatgtacttgagaagt

SEQ ID NO: 794554 - DNA, 20 bp, Artificial
  CRISPR gRNA sequence
atgtacttgagaagtaaggg

SEQ ID NO: 794555 - DNA, 20 bp, Artificial
  CRISPR gRNA sequence
gagaagtaagggtggggtgg

SEQ ID NO: 794556 - DNA, 20 bp, Artificial
  CRISPR gRNA sequence
ttgtttatctcagcagtcag

SEQ ID NO: 794557 - DNA, 20 bp, Artificial
  CRISPR gRNA sequence
cagcagtcagcagggtagtt

SEQ ID NO: 794558 - DNA, 20 bp, Artificial
  CRISPR gRNA sequence
ggatctaaagataggcgaag

SEQ ID NO: 794559 - DNA, 20 bp, Artificial
  CRISPR gRNA sequence
ctaggctgaggtctgtgccc

SEQ ID NO: 794560 - DNA, 20 bp, Artificial
  CRISPR gRNA sequence
ctctggttttcatctacctc

SEQ ID NO: 794561 - DNA, 20 bp, Artificial
  CRISPR gRNA sequence
aaacatcaatgaaaaaagac

SEQ ID NO: 794562 - DNA, 20 bp, Artificial
  CRISPR gRNA sequence
acaaggtataaaaaatattt

SEQ ID NO: 794563 - DNA, 20 bp, Artificial
  CRISPR gRNA sequence
tataagtgtgatatttgcaa

SEQ ID NO: 794564 - DNA, 20 bp, Artificial
  CRISPR gRNA sequence
tgatgaagattcaaaggcta

SEQ ID NO: 794565 - DNA, 20 bp, Artificial
  CRISPR gRNA sequence
caaaggctattgaatgggga

SEQ ID NO: 794566 - DNA, 20 bp, Artificial
  CRISPR gRNA sequence
ggctattgaatggggaaagg

SEQ ID NO: 794567 - DNA, 20 bp, Artificial
  CRISPR gRNA sequence
caccttatataaaaattaaa

SEQ ID NO: 794568 - DNA, 20 bp, Artificial
  CRISPR gRNA sequence
tggattataaaccttacata

SEQ ID NO: 794569 - DNA, 20 bp, Artificial
  CRISPR gRNA sequence
agaagacaatcttttacatc

SEQ ID NO: 794570 - DNA, 20 bp, Artificial
  CRISPR gRNA sequence
tttacatcttgggttatgta

SEQ ID NO: 794571 - DNA, 20 bp, Artificial
  CRISPR gRNA sequence
ttgggttatgtaaagagttt

SEQ ID NO: 794572 - DNA, 20 bp, Artificial
  CRISPR gRNA sequence
agacaagctacagacttcaa

SEQ ID NO: 794573 - DNA, 20 bp, Artificial
  CRISPR gRNA sequence
tctgataaagaacttgtatc

SEQ ID NO: 794574 - DNA, 20 bp, Artificial
  CRISPR gRNA sequence
cagcactttgggaggccaag

SEQ ID NO: 794575 - DNA, 20 bp, Artificial
  CRISPR gRNA sequence
cagtcaagaggctgaggctg

SEQ ID NO: 794576 - DNA, 20 bp, Artificial
  CRISPR gRNA sequence
gactgcgtctcaaaaaaata

SEQ ID NO: 794577 - DNA, 20 bp, Artificial
  CRISPR gRNA sequence
ttccttagtatacaattaca

SEQ ID NO: 794578 - DNA, 20 bp, Artificial
  CRISPR gRNA sequence
attacaaaggatgaaatgat

SEQ ID NO: 794579 - DNA, 20 bp, Artificial
  CRISPR gRNA sequence
ggctgaggcgagaagatggc

SEQ ID NO: 794580 - DNA, 20 bp, Artificial
  CRISPR gRNA sequence
cgagaagatggcttgagtcc

SEQ ID NO: 794581 - DNA, 20 bp, Artificial
  CRISPR gRNA sequence
gcctgtagtcccagttacta

SEQ ID NO: 794582 - DNA, 20 bp, Artificial
  CRISPR gRNA sequence
tactacagagtctgaggtgg

SEQ ID NO: 794583 - DNA, 20 bp, Artificial
  CRISPR gRNA sequence
ctgtattccaatctgggcaa

SEQ ID NO: 794584 - DNA, 20 bp, Artificial
  CRISPR gRNA sequence
aaccacttctacacacctat

SEQ ID NO: 794585 - DNA, 20 bp, Artificial
  CRISPR gRNA sequence
cagcattttgggaggccaag

SEQ ID NO: 794586 - DNA, 20 bp, Artificial
  CRISPR gRNA sequence
attttgggaggccaaggtgg

SEQ ID NO: 794587 - DNA, 20 bp, Artificial
  CRISPR gRNA sequence
tgggtggatcacctgaggtc

SEQ ID NO: 794588 - DNA, 20 bp, Artificial
  CRISPR gRNA sequence
aacaaaagaagggcatggtg

SEQ ID NO: 794589 - DNA, 20 bp, Artificial
  CRISPR gRNA sequence
tacttgggaggctgaggcag

SEQ ID NO: 794590 - DNA, 20 bp, Artificial
  CRISPR gRNA sequence
tcacggcattgcactttagc

SEQ ID NO: 794591 - DNA, 20 bp, Artificial
  CRISPR gRNA sequence
aaaaaaaagaaaaaatagaa

SEQ ID NO: 794592 - DNA, 20 bp, Artificial
  CRISPR gRNA sequence
aaaagaataccagtgctggg

SEQ ID NO: 794593 - DNA, 20 bp, Artificial
  CRISPR gRNA sequence
actctcatatacttgctggt

SEQ ID NO: 794594 - DNA, 20 bp, Artificial
  CRISPR gRNA sequence
acccaaatgtgccccaattg

SEQ ID NO: 794595 - DNA, 20 bp, Artificial
  CRISPR gRNA sequence
aaaatatagtatacatacac

SEQ ID NO: 794596 - DNA, 20 bp, Artificial
  CRISPR gRNA sequence
ttattgattcacacaacaat

SEQ ID NO: 794597 - DNA, 20 bp, Artificial
  CRISPR gRNA sequence
tgattcacacaacaatatga

SEQ ID NO: 794598 - DNA, 20 bp, Artificial
  CRISPR gRNA sequence
gtgaaagaagccagatacaa

SEQ ID NO: 794599 - DNA, 20 bp, Artificial
  CRISPR gRNA sequence
cagatacaaaaggatatcta

SEQ ID NO: 794600 - DNA, 20 bp, Artificial
  CRISPR gRNA sequence
taagtgcctggacttaagac

SEQ ID NO: 794601 - DNA, 20 bp, Artificial
  CRISPR gRNA sequence
gtttgtttgtttgtttggca

SEQ ID NO: 794602 - DNA, 20 bp, Artificial
  CRISPR gRNA sequence
tggcaagggatggaactgtc

SEQ ID NO: 794603 - DNA, 20 bp, Artificial
  CRISPR gRNA sequence
tcataagacttttttaaaaa

SEQ ID NO: 794604 - DNA, 20 bp, Artificial
  CRISPR gRNA sequence
aaagagcatacaagtaagga

SEQ ID NO: 794605 - DNA, 20 bp, Artificial
  CRISPR gRNA sequence
gttaatgattaatgatttgt

SEQ ID NO: 794606 - DNA, 20 bp, Artificial
  CRISPR gRNA sequence
tataaatctccttaaaaatg

SEQ ID NO: 794607 - DNA, 20 bp, Artificial
  CRISPR gRNA sequence
ctataaagaacatacattta

SEQ ID NO: 794608 - DNA, 20 bp, Artificial
  CRISPR gRNA sequence
gaaaaaataaagggcaggct

SEQ ID NO: 794609 - DNA, 20 bp, Artificial
  CRISPR gRNA sequence
gctttgggaggctggggcag

SEQ ID NO: 794610 - DNA, 20 bp, Artificial
  CRISPR gRNA sequence
tgtttaaaaaattagccaga

SEQ ID NO: 794611 - DNA, 20 bp, Artificial
  CRISPR gRNA sequence
caggagactcacttgagcct

SEQ ID NO: 794612 - DNA, 20 bp, Artificial
  CRISPR gRNA sequence
ttgggccactgcactccagc

SEQ ID NO: 794613 - DNA, 20 bp, Artificial
  CRISPR gRNA sequence
gcatatcagatagtgctatg

SEQ ID NO: 794614 - DNA, 20 bp, Artificial
  CRISPR gRNA sequence
caaaggaggttttattgggc

SEQ ID NO: 794615 - DNA, 20 bp, Artificial
  CRISPR gRNA sequence
ctgacaaagttcttcttaac

SEQ ID NO: 794616 - DNA, 20 bp, Artificial
  CRISPR gRNA sequence
caccagaggtaactggcgtc

SEQ ID NO: 794617 - DNA, 20 bp, Artificial
  CRISPR gRNA sequence
ttttttttttttttttgaga

SEQ ID NO: 794618 - DNA, 20 bp, Artificial
  CRISPR gRNA sequence
tctcactctgtcgcccaggc

SEQ ID NO: 794619 - DNA, 20 bp, Artificial
  CRISPR gRNA sequence
gattctcctgcctcagactc

SEQ ID NO: 794620 - DNA, 20 bp, Artificial
  CRISPR gRNA sequence
gcctcagactcccgagtagc

SEQ ID NO: 794621 - DNA, 20 bp, Artificial
  CRISPR gRNA sequence
accttggcctcccaaagtgc

SEQ ID NO: 794622 - DNA, 20 bp, Artificial
  CRISPR gRNA sequence
agttcttctagacctactcc

SEQ ID NO: 794623 - DNA, 20 bp, Artificial
  CRISPR gRNA sequence
aatcaaattctccagggcat

SEQ ID NO: 794624 - DNA, 20 bp, Artificial
  CRISPR gRNA sequence
tttatttatttgtaatgact

SEQ ID NO: 794625 - DNA, 20 bp, Artificial
  CRISPR gRNA sequence
tctttttttttttttttaaa

SEQ ID NO: 794626 - DNA, 20 bp, Artificial
  CRISPR gRNA sequence
tctcactctgtcacccaggc

SEQ ID NO: 794627 - DNA, 20 bp, Artificial
  CRISPR gRNA sequence
ctcactgcaacctctgcctc

SEQ ID NO: 794628 - DNA, 20 bp, Artificial
  CRISPR gRNA sequence
aagcaatttttctgcctcag

SEQ ID NO: 794629 - DNA, 20 bp, Artificial
  CRISPR gRNA sequence
ttctgcctcagctgagtagc

SEQ ID NO: 794630 - DNA, 20 bp, Artificial
  CRISPR gRNA sequence
tttttctatttttagtacag

SEQ ID NO: 794631 - DNA, 20 bp, Artificial
  CRISPR gRNA sequence
gcctcggcctcccatagggc

SEQ ID NO: 794632 - DNA, 20 bp, Artificial
  CRISPR gRNA sequence
agaaaagaaatgtgcactga

SEQ ID NO: 794633 - DNA, 20 bp, Artificial
  CRISPR gRNA sequence
ctgtagctctgtctcaggca

SEQ ID NO: 794634 - DNA, 20 bp, Artificial
  CRISPR gRNA sequence
ttcttgtaaaaaacaaaaac

SEQ ID NO: 794635 - DNA, 20 bp, Artificial
  CRISPR gRNA sequence
ctgcatagtggaaagcagaa

SEQ ID NO: 794636 - DNA, 20 bp, Artificial
  CRISPR gRNA sequence
tacacatattttttgattct

SEQ ID NO: 794637 - DNA, 20 bp, Artificial
  CRISPR gRNA sequence
tttttgattctgtgaatatc

SEQ ID NO: 794638 - DNA, 20 bp, Artificial
  CRISPR gRNA sequence
attccaaagttggaagattt

SEQ ID NO: 794639 - DNA, 20 bp, Artificial
  CRISPR gRNA sequence
ggggaaattaagtacctttt

SEQ ID NO: 794640 - DNA, 20 bp, Artificial
  CRISPR gRNA sequence
agcacagtatctggcattta

SEQ ID NO: 794641 - DNA, 20 bp, Artificial
  CRISPR gRNA sequence
ctctgtagaaagagccaatg

SEQ ID NO: 794642 - DNA, 20 bp, Artificial
  CRISPR gRNA sequence
aaaaacaaagacagaaaacc

SEQ ID NO: 794643 - DNA, 20 bp, Artificial
  CRISPR gRNA sequence
tgaagcccccagtcctgcca

SEQ ID NO: 794644 - DNA, 20 bp, Artificial
  CRISPR gRNA sequence
tctctaaaatgccagccagg

SEQ ID NO: 794645 - DNA, 20 bp, Artificial
  CRISPR gRNA sequence
gctggccctgcaggcaggag

SEQ ID NO: 794646 - DNA, 20 bp, Artificial
  CRISPR gRNA sequence
aggagcagagtagaagtaag

SEQ ID NO: 794647 - DNA, 20 bp, Artificial
  CRISPR gRNA sequence
tagaagtaagcagaatatct

SEQ ID NO: 794648 - DNA, 20 bp, Artificial
  CRISPR gRNA sequence
gaccaggctgggcagctcaa

SEQ ID NO: 794649 - DNA, 20 bp, Artificial
  CRISPR gRNA sequence
gggcagctcaagtgagtgag

SEQ ID NO: 794650 - DNA, 20 bp, Artificial
  CRISPR gRNA sequence
agtgagtgagaggaatgtga

SEQ ID NO: 794651 - DNA, 20 bp, Artificial
  CRISPR gRNA sequence
gagaggaatgtgactgggtg

SEQ ID NO: 794652 - DNA, 20 bp, Artificial
  CRISPR gRNA sequence
tcatggttctaactacaccc

SEQ ID NO: 794653 - DNA, 20 bp, Artificial
  CRISPR gRNA sequence
agtcctttcttcaagtccaa

SEQ ID NO: 794654 - DNA, 20 bp, Artificial
  CRISPR gRNA sequence
ccttaaggttcattgttcat

SEQ ID NO: 794655 - DNA, 20 bp, Artificial
  CRISPR gRNA sequence
tcagtaaaccacattaaggt

SEQ ID NO: 794656 - DNA, 20 bp, Artificial
  CRISPR gRNA sequence
cagaaacaactaataatatg

SEQ ID NO: 794657 - DNA, 20 bp, Artificial
  CRISPR gRNA sequence
tgtcttcaagacattatctt

SEQ ID NO: 794658 - DNA, 20 bp, Artificial
  CRISPR gRNA sequence
tcagtttagatttacatggt

SEQ ID NO: 794659 - DNA, 20 bp, Artificial
  CRISPR gRNA sequence
tcttcttgtcattaccctca

SEQ ID NO: 794660 - DNA, 20 bp, Artificial
  CRISPR gRNA sequence
cattaccctcactggatagt

SEQ ID NO: 794661 - DNA, 20 bp, Artificial
  CRISPR gRNA sequence
ctttttttttttgtggtgct

SEQ ID NO: 794662 - DNA, 20 bp, Artificial
  CRISPR gRNA sequence
cagggccttgtgaaactttg

SEQ ID NO: 794663 - DNA, 20 bp, Artificial
  CRISPR gRNA sequence
ttgttcacttttgaaaacag

SEQ ID NO: 794664 - DNA, 20 bp, Artificial
  CRISPR gRNA sequence
gggaaggtgacagaccatgg

SEQ ID NO: 794665 - DNA, 20 bp, Artificial
  CRISPR gRNA sequence
gagaagagaagatataaatt

SEQ ID NO: 794666 - DNA, 20 bp, Artificial
  CRISPR gRNA sequence
tccttttctaatggccgttt

SEQ ID NO: 794667 - DNA, 20 bp, Artificial
  CRISPR gRNA sequence
accccaactttgtttgtcaa

SEQ ID NO: 794668 - DNA, 20 bp, Artificial
  CRISPR gRNA sequence
caccatcttctttacctgga

SEQ ID NO: 794669 - DNA, 20 bp, Artificial
  CRISPR gRNA sequence
tttacctggactggatgtct

SEQ ID NO: 794670 - DNA, 20 bp, Artificial
  CRISPR gRNA sequence
agcaaagtagtcaagtgctt

SEQ ID NO: 794671 - DNA, 20 bp, Artificial
  CRISPR gRNA sequence
agtcaagtgcttttgagtgc

SEQ ID NO: 794672 - DNA, 20 bp, Artificial
  CRISPR gRNA sequence
agtgcttttgagtgctggaa

SEQ ID NO: 794673 - DNA, 20 bp, Artificial
  CRISPR gRNA sequence
tactaagaggtttagacagg

SEQ ID NO: 794674 - DNA, 20 bp, Artificial
  CRISPR gRNA sequence
agtagggaactggctctgat

SEQ ID NO: 794675 - DNA, 20 bp, Artificial
  CRISPR gRNA sequence
ctctgatgagggtgggggct

SEQ ID NO: 794676 - DNA, 20 bp, Artificial
  CRISPR gRNA sequence
tttccaacttttatcagcca

SEQ ID NO: 794677 - DNA, 20 bp, Artificial
  CRISPR gRNA sequence
caggcaacagcagagctgct

SEQ ID NO: 794678 - DNA, 20 bp, Artificial
  CRISPR gRNA sequence
gagtgtgatgaaaagcagtg

SEQ ID NO: 794679 - DNA, 20 bp, Artificial
  CRISPR gRNA sequence
gatgaaaagcagtggagggt

SEQ ID NO: 794680 - DNA, 20 bp, Artificial
  CRISPR gRNA sequence
cagtggagggtttgggtcag

SEQ ID NO: 794681 - DNA, 20 bp, Artificial
  CRISPR gRNA sequence
tacaagcagtgagatcggtt

SEQ ID NO: 794682 - DNA, 20 bp, Artificial
  CRISPR gRNA sequence
ttgcagaaatgctgatagct

SEQ ID NO: 794683 - DNA, 20 bp, Artificial
  CRISPR gRNA sequence
cttagagtagaggggctagt

SEQ ID NO: 794684 - DNA, 20 bp, Artificial
  CRISPR gRNA sequence
gggtgagaagtggtctgttg

SEQ ID NO: 794685 - DNA, 20 bp, Artificial
  CRISPR gRNA sequence
agtataattgatatacgaaa

SEQ ID NO: 794686 - DNA, 20 bp, Artificial
  CRISPR gRNA sequence
tgtggtttttagtatgttca

SEQ ID NO: 794687 - DNA, 20 bp, Artificial
  CRISPR gRNA sequence
gtctctatcaattgcttatt

SEQ ID NO: 794688 - DNA, 20 bp, Artificial
  CRISPR gRNA sequence
ttctggatatttcataaaaa

SEQ ID NO: 794689 - DNA, 20 bp, Artificial
  CRISPR gRNA sequence
attcatcagttgatggtcat

SEQ ID NO: 794690 - DNA, 20 bp, Artificial
  CRISPR gRNA sequence
gtttctgcttgttggctatt

SEQ ID NO: 794691 - DNA, 20 bp, Artificial
  CRISPR gRNA sequence
tatgtatacttttaattatc

SEQ ID NO: 794692 - DNA, 20 bp, Artificial
  CRISPR gRNA sequence
attatcttgggtacatatgt

SEQ ID NO: 794693 - DNA, 20 bp, Artificial
  CRISPR gRNA sequence
cttgggtacatatgtaggag

SEQ ID NO: 794694 - DNA, 20 bp, Artificial
  CRISPR gRNA sequence
catatgtaggagtagaattg

SEQ ID NO: 794695 - DNA, 20 bp, Artificial
  CRISPR gRNA sequence
actctatatttaactttttg

SEQ ID NO: 794696 - DNA, 20 bp, Artificial
  CRISPR gRNA sequence
ttgtcttttcagtttcttta

SEQ ID NO: 794697 - DNA, 20 bp, Artificial
  CRISPR gRNA sequence
tttctttatagaatcctgtg

SEQ ID NO: 794698 - DNA, 20 bp, Artificial
  CRISPR gRNA sequence
gagcaattgtacagggacaa

SEQ ID NO: 794699 - DNA, 20 bp, Artificial
  CRISPR gRNA sequence
atatacaaaaattaaacaaa

SEQ ID NO: 794700 - DNA, 20 bp, Artificial
  CRISPR gRNA sequence
catcaattgatcatatatat

SEQ ID NO: 794701 - DNA, 20 bp, Artificial
  CRISPR gRNA sequence
aagttttgaaactggaaagt

SEQ ID NO: 794702 - DNA, 20 bp, Artificial
  CRISPR gRNA sequence
gggcttccttacattttcaa

SEQ ID NO: 794703 - DNA, 20 bp, Artificial
  CRISPR gRNA sequence
ttacattttcaaatgaattt

SEQ ID NO: 794704 - DNA, 20 bp, Artificial
  CRISPR gRNA sequence
tttctgcagacaaaggaagc

SEQ ID NO: 794705 - DNA, 20 bp, Artificial
  CRISPR gRNA sequence
aaggaagctggaattttggt

SEQ ID NO: 794706 - DNA, 20 bp, Artificial
  CRISPR gRNA sequence
gaattttggtagggattgca

SEQ ID NO: 794707 - DNA, 20 bp, Artificial
  CRISPR gRNA sequence
tgaatccatagatcaatttg

SEQ ID NO: 794708 - DNA, 20 bp, Artificial
  CRISPR gRNA sequence
aatttggggaatacagccag

SEQ ID NO: 794709 - DNA, 20 bp, Artificial
  CRISPR gRNA sequence
aatatttagtcttccaattc

SEQ ID NO: 794710 - DNA, 20 bp, Artificial
  CRISPR gRNA sequence
aaaattcctaagtttggggc

SEQ ID NO: 794711 - DNA, 20 bp, Artificial
  CRISPR gRNA sequence
gcaaattaaggaaggggaaa

SEQ ID NO: 794712 - DNA, 20 bp, Artificial
  CRISPR gRNA sequence
ggaggtgtttagtaggcagt

SEQ ID NO: 794713 - DNA, 20 bp, Artificial
  CRISPR gRNA sequence
tggggtagagatgtaaattt

SEQ ID NO: 794714 - DNA, 20 bp, Artificial
  CRISPR gRNA sequence
agtgttaaagatttaaagtc

SEQ ID NO: 794715 - DNA, 20 bp, Artificial
  CRISPR gRNA sequence
acctacagagagataggaaa

SEQ ID NO: 794716 - DNA, 20 bp, Artificial
  CRISPR gRNA sequence
agtgcccaaggactgagaca

SEQ ID NO: 794717 - DNA, 20 bp, Artificial
  CRISPR gRNA sequence
cagcagagaagattgaaagg

SEQ ID NO: 794718 - DNA, 20 bp, Artificial
  CRISPR gRNA sequence
cctgaagggactgccgctcc

SEQ ID NO: 794719 - DNA, 20 bp, Artificial
  CRISPR gRNA sequence
gccaattctaacctctaaga

SEQ ID NO: 794720 - DNA, 20 bp, Artificial
  CRISPR gRNA sequence
atggtgtgccccccttctct

SEQ ID NO: 794721 - DNA, 20 bp, Artificial
  CRISPR gRNA sequence
ccccccttctcttgggatct

SEQ ID NO: 794722 - DNA, 20 bp, Artificial
  CRISPR gRNA sequence
tttaaaacacagtgctacaa

SEQ ID NO: 794723 - DNA, 20 bp, Artificial
  CRISPR gRNA sequence
cagtagagccaaatactctt

SEQ ID NO: 794724 - DNA, 20 bp, Artificial
  CRISPR gRNA sequence
catttagcagtatggaggtc

SEQ ID NO: 794725 - DNA, 20 bp, Artificial
  CRISPR gRNA sequence
tcctgacaagcacagtatca

SEQ ID NO: 794726 - DNA, 20 bp, Artificial
  CRISPR gRNA sequence
agttttgtacagatgaaagc

SEQ ID NO: 794727 - DNA, 20 bp, Artificial
  CRISPR gRNA sequence
aagcttgaataggttcaaaa

SEQ ID NO: 794728 - DNA, 20 bp, Artificial
  CRISPR gRNA sequence
ttgaataggttcaaaagaga

SEQ ID NO: 794729 - DNA, 20 bp, Artificial
  CRISPR gRNA sequence
atataggcaactctctcaag

SEQ ID NO: 794730 - DNA, 20 bp, Artificial
  CRISPR gRNA sequence
ctataaaaaggagaagagaa

SEQ ID NO: 794731 - DNA, 20 bp, Artificial
  CRISPR gRNA sequence
cagcaggtaacaactgggaa

SEQ ID NO: 794732 - DNA, 20 bp, Artificial
  CRISPR gRNA sequence
tctagcaacagaaaagattc

SEQ ID NO: 794733 - DNA, 20 bp, Artificial
  CRISPR gRNA sequence
gggaaaatatggtttatgca

SEQ ID NO: 794734 - DNA, 20 bp, Artificial
  CRISPR gRNA sequence
ggctctaaaatcagacacat

SEQ ID NO: 794735 - DNA, 20 bp, Artificial
  CRISPR gRNA sequence
tagcaacacccaccttaagc

SEQ ID NO: 794736 - DNA, 20 bp, Artificial
  CRISPR gRNA sequence
agtcctgttaattctccctc

SEQ ID NO: 794737 - DNA, 20 bp, Artificial
  CRISPR gRNA sequence
gaggtgaaggacaagaacct

SEQ ID NO: 794738 - DNA, 20 bp, Artificial
  CRISPR gRNA sequence
acaagaaccttggagtcatc

SEQ ID NO: 794739 - DNA, 20 bp, Artificial
  CRISPR gRNA sequence
gcccttccttcaaatatatc

SEQ ID NO: 794740 - DNA, 20 bp, Artificial
  CRISPR gRNA sequence
tccactgcttccatatcggt

SEQ ID NO: 794741 - DNA, 20 bp, Artificial
  CRISPR gRNA sequence
tttctgcattagtctgacaa

SEQ ID NO: 794742 - DNA, 20 bp, Artificial
  CRISPR gRNA sequence
cctgcagttgattctgcagc

SEQ ID NO: 794743 - DNA, 20 bp, Artificial
  CRISPR gRNA sequence
ctgtgcccatccttctcccc

SEQ ID NO: 794744 - DNA, 20 bp, Artificial
  CRISPR gRNA sequence
gcagtctgtctttgaaacac

SEQ ID NO: 794745 - DNA, 20 bp, Artificial
  CRISPR gRNA sequence
gaaacactggaattcctagc

SEQ ID NO: 794746 - DNA, 20 bp, Artificial
  CRISPR gRNA sequence
tctctttctgttgcccaggc

SEQ ID NO: 794747 - DNA, 20 bp, Artificial
  CRISPR gRNA sequence
cagggaggccaagaacaggt

SEQ ID NO: 794748 - DNA, 20 bp, Artificial
  CRISPR gRNA sequence
ggtgggagtcccgccccgta

SEQ ID NO: 794749 - DNA, 20 bp, Artificial
  CRISPR gRNA sequence
cccgccccgtactgagttgg

SEQ ID NO: 794750 - DNA, 20 bp, Artificial
  CRISPR gRNA sequence
cccactcctggcacctgcta

SEQ ID NO: 794751 - DNA, 20 bp, Artificial
  CRISPR gRNA sequence
gtcacaacccggccaggcat

SEQ ID NO: 794752 - DNA, 20 bp, Artificial
  CRISPR gRNA sequence
cggccaggcatgtgggtgct

SEQ ID NO: 794753 - DNA, 20 bp, Artificial
  CRISPR gRNA sequence
gcctcgacctcttccagatg

SEQ ID NO: 794754 - DNA, 20 bp, Artificial
  CRISPR gRNA sequence
agggaggctgagcaggggct

SEQ ID NO: 794755 - DNA, 20 bp, Artificial
  CRISPR gRNA sequence
agacaggttccttggcggaa

SEQ ID NO: 794756 - DNA, 20 bp, Artificial
  CRISPR gRNA sequence
tgaaacccaaccttcaagcc

SEQ ID NO: 794757 - DNA, 20 bp, Artificial
  CRISPR gRNA sequence
tgggagccaggttgccaatt

SEQ ID NO: 794758 - DNA, 20 bp, Artificial
  CRISPR gRNA sequence
gccaggttgccaattgtggg

SEQ ID NO: 794759 - DNA, 20 bp, Artificial
  CRISPR gRNA sequence
tgtgggtggagtccacagcc

SEQ ID NO: 794760 - DNA, 20 bp, Artificial
  CRISPR gRNA sequence
ggcaggaaaatcacgaggtc

SEQ ID NO: 794761 - DNA, 20 bp, Artificial
  CRISPR gRNA sequence
ctaaaaatacaaaaaattag

SEQ ID NO: 794762 - DNA, 20 bp, Artificial
  CRISPR gRNA sequence
aaaattagctggatgtagtg

SEQ ID NO: 794763 - DNA, 20 bp, Artificial
  CRISPR gRNA sequence
tactcgggaggctgaagcag

SEQ ID NO: 794764 - DNA, 20 bp, Artificial
  CRISPR gRNA sequence
ctgcactccagccctggtga

SEQ ID NO: 794765 - DNA, 20 bp, Artificial
  CRISPR gRNA sequence
ttttttttttttttttgaga

SEQ ID NO: 794766 - DNA, 20 bp, Artificial
  CRISPR gRNA sequence
tcttgctctctcacccaggc

SEQ ID NO: 794767 - DNA, 20 bp, Artificial
  CRISPR gRNA sequence
ctcactgcatcctccgcctc

SEQ ID NO: 794768 - DNA, 20 bp, Artificial
  CRISPR gRNA sequence
gattctcctgcctcagcctc

SEQ ID NO: 794769 - DNA, 20 bp, Artificial
  CRISPR gRNA sequence
tttcatatttttagtagaga

SEQ ID NO: 794770 - DNA, 20 bp, Artificial
  CRISPR gRNA sequence
gcctcggcctcccaaagtgc

SEQ ID NO: 794771 - DNA, 20 bp, Artificial
  CRISPR gRNA sequence
cttgtgtctcctcacctctc

SEQ ID NO: 794772 - DNA, 20 bp, Artificial
  CRISPR gRNA sequence
gtggtaaggagctatccatt

SEQ ID NO: 794773 - DNA, 20 bp, Artificial
  CRISPR gRNA sequence
ttgtgggtctcctctctgct

SEQ ID NO: 794774 - DNA, 20 bp, Artificial
  CRISPR gRNA sequence
atggaaaagtgctacccact

SEQ ID NO: 794775 - DNA, 20 bp, Artificial
  CRISPR gRNA sequence
attttttctggacaagggac

SEQ ID NO: 794776 - DNA, 20 bp, Artificial
  CRISPR gRNA sequence
ggacaagaattcaggacctg

SEQ ID NO: 794777 - DNA, 20 bp, Artificial
  CRISPR gRNA sequence
taacagaaacacttatgtag

SEQ ID NO: 794778 - DNA, 20 bp, Artificial
  CRISPR gRNA sequence
ttcatcttaatgttattggg

SEQ ID NO: 794779 - DNA, 20 bp, Artificial
  CRISPR gRNA sequence
atcaacacgttctctaatat

SEQ ID NO: 794780 - DNA, 20 bp, Artificial
  CRISPR gRNA sequence
tcatcgtcattatcacttat

SEQ ID NO: 794781 - DNA, 20 bp, Artificial
  CRISPR gRNA sequence
atctttggtctaaaaatccc

SEQ ID NO: 794782 - DNA, 20 bp, Artificial
  CRISPR gRNA sequence
tgcagaacgattgcgcctct

SEQ ID NO: 794783 - DNA, 20 bp, Artificial
  CRISPR gRNA sequence
gtctcactcattgcctagcc

SEQ ID NO: 794784 - DNA, 20 bp, Artificial
  CRISPR gRNA sequence
gatcatagagcactgcagcc

SEQ ID NO: 794785 - DNA, 20 bp, Artificial
  CRISPR gRNA sequence
aggaaacatctgtaaattct

SEQ ID NO: 794786 - DNA, 20 bp, Artificial
  CRISPR gRNA sequence
ttttcaagcaaaatttgcaa

SEQ ID NO: 794787 - DNA, 20 bp, Artificial
  CRISPR gRNA sequence
tgtgccaagctctagtatac

SEQ ID NO: 794788 - DNA, 20 bp, Artificial
  CRISPR gRNA sequence
agacacagccagtgctttta

SEQ ID NO: 794789 - DNA, 20 bp, Artificial
  CRISPR gRNA sequence
acattctatggaagtatctc

SEQ ID NO: 794790 - DNA, 20 bp, Artificial
  CRISPR gRNA sequence
gtgtaacaataaccagccta

SEQ ID NO: 794791 - DNA, 20 bp, Artificial
  CRISPR gRNA sequence
tagcaatgtctgaacataat

SEQ ID NO: 794792 - DNA, 20 bp, Artificial
  CRISPR gRNA sequence
tgtctgaacataatctgaat

SEQ ID NO: 794793 - DNA, 20 bp, Artificial
  CRISPR gRNA sequence
atgcctttgggcaagttatg

SEQ ID NO: 794794 - DNA, 20 bp, Artificial
  CRISPR gRNA sequence
ttccattgtattagacctag

SEQ ID NO: 794795 - DNA, 20 bp, Artificial
  CRISPR gRNA sequence
ctgacaaacccaataggtat

SEQ ID NO: 794796 - DNA, 20 bp, Artificial
  CRISPR gRNA sequence
aataggtatttgagttttgg

SEQ ID NO: 794797 - DNA, 20 bp, Artificial
  CRISPR gRNA sequence
tactctgctgtcataggtat

SEQ ID NO: 794798 - DNA, 20 bp, Artificial
  CRISPR gRNA sequence
aattttttaagcaataaaca

SEQ ID NO: 794799 - DNA, 20 bp, Artificial
  CRISPR gRNA sequence
cctttatattagaaagttgt

SEQ ID NO: 794800 - DNA, 20 bp, Artificial
  CRISPR gRNA sequence
tagaaagttgtgagaattca

SEQ ID NO: 794801 - DNA, 20 bp, Artificial
  CRISPR gRNA sequence
catagaataatttatcattg

SEQ ID NO: 794802 - DNA, 20 bp, Artificial
  CRISPR gRNA sequence
ttatcattggagaattcata

SEQ ID NO: 794803 - DNA, 20 bp, Artificial
  CRISPR gRNA sequence
aaggaagggagacttcccag

SEQ ID NO: 794804 - DNA, 20 bp, Artificial
  CRISPR gRNA sequence
agggagacttcccagagggg

SEQ ID NO: 794805 - DNA, 20 bp, Artificial
  CRISPR gRNA sequence
ctgggcctttgaagcactgg

SEQ ID NO: 794806 - DNA, 20 bp, Artificial
  CRISPR gRNA sequence
tttgaagcactggtaggatt

SEQ ID NO: 794807 - DNA, 20 bp, Artificial
  CRISPR gRNA sequence
cgtgttgaggggacaatgaa

SEQ ID NO: 794808 - DNA, 20 bp, Artificial
  CRISPR gRNA sequence
cttggctggacacttaggtt

SEQ ID NO: 794809 - DNA, 20 bp, Artificial
  CRISPR gRNA sequence
aaactaagtgacaataccaa

SEQ ID NO: 794810 - DNA, 20 bp, Artificial
  CRISPR gRNA sequence
gattacatctaatttttttt

SEQ ID NO: 794811 - DNA, 20 bp, Artificial
  CRISPR gRNA sequence
tctaattttttttttgagta

SEQ ID NO: 794812 - DNA, 20 bp, Artificial
  CRISPR gRNA sequence
ttttttttgagtatagaatt

SEQ ID NO: 794813 - DNA, 20 bp, Artificial
  CRISPR gRNA sequence
ttttgagtatagaattgagg

SEQ ID NO: 794814 - DNA, 20 bp, Artificial
  CRISPR gRNA sequence
agtatagaattgagggtggg

SEQ ID NO: 794815 - DNA, 20 bp, Artificial
  CRISPR gRNA sequence
ggtagacagcctctcaatta

SEQ ID NO: 794816 - DNA, 20 bp, Artificial
  CRISPR gRNA sequence
tattggagccatgggggagg

SEQ ID NO: 794817 - DNA, 20 bp, Artificial
  CRISPR gRNA sequence
attccaaaaaattgtaggtc

SEQ ID NO: 794818 - DNA, 20 bp, Artificial
  CRISPR gRNA sequence
ggaaatgttagttaatattg

SEQ ID NO: 794819 - DNA, 20 bp, Artificial
  CRISPR gRNA sequence
atgttagttaatattgagga

SEQ ID NO: 794820 - DNA, 20 bp, Artificial
  CRISPR gRNA sequence
tgaatgaaccatctgatggg

SEQ ID NO: 794821 - DNA, 20 bp, Artificial
  CRISPR gRNA sequence
tcagatgctcttgtctgtcc

SEQ ID NO: 794822 - DNA, 20 bp, Artificial
  CRISPR gRNA sequence
cttgtctgtcctggaattct

SEQ ID NO: 794823 - DNA, 20 bp, Artificial
  CRISPR gRNA sequence
cgagcccagctacagtggag

SEQ ID NO: 794824 - DNA, 20 bp, Artificial
  CRISPR gRNA sequence
atactacagttgccccttta

SEQ ID NO: 794825 - DNA, 20 bp, Artificial
  CRISPR gRNA sequence
catatttggacattagcatg

SEQ ID NO: 794826 - DNA, 20 bp, Artificial
  CRISPR gRNA sequence
agtggcaagagcagcaggac

SEQ ID NO: 794827 - DNA, 20 bp, Artificial
  CRISPR gRNA sequence
caggattgttcatccactca

SEQ ID NO: 794828 - DNA, 20 bp, Artificial
  CRISPR gRNA sequence
ctgtctcattactgctcaca

SEQ ID NO: 794829 - DNA, 20 bp, Artificial
  CRISPR gRNA sequence
ccctcagagccatagtattt

SEQ ID NO: 794830 - DNA, 20 bp, Artificial
  CRISPR gRNA sequence
cgctgatcattttatatgga

SEQ ID NO: 794831 - DNA, 20 bp, Artificial
  CRISPR gRNA sequence
aagttattaagataatagtt

SEQ ID NO: 794832 - DNA, 20 bp, Artificial
  CRISPR gRNA sequence
gtaaacaaaggccagcctgg

SEQ ID NO: 794833 - DNA, 20 bp, Artificial
  CRISPR gRNA sequence
gagggatcaccgtctgctaa

SEQ ID NO: 794834 - DNA, 20 bp, Artificial
  CRISPR gRNA sequence
ctaagctgagagacaatctt

SEQ ID NO: 794835 - DNA, 20 bp, Artificial
  CRISPR gRNA sequence
cctcagcacaatttctgagg

SEQ ID NO: 794836 - DNA, 20 bp, Artificial
  CRISPR gRNA sequence
ggtccacaacataatagtat

SEQ ID NO: 794837 - DNA, 20 bp, Artificial
  CRISPR gRNA sequence
aacatgcagtagctccaacc

SEQ ID NO: 794838 - DNA, 20 bp, Artificial
  CRISPR gRNA sequence
tctttctagctgggacatat

SEQ ID NO: 794839 - DNA, 20 bp, Artificial
  CRISPR gRNA sequence
tctagctgggacatatgagg

SEQ ID NO: 794840 - DNA, 20 bp, Artificial
  CRISPR gRNA sequence
cttaaggtttgccgtaacat

SEQ ID NO: 794841 - DNA, 20 bp, Artificial
  CRISPR gRNA sequence
aggtttgccgtaacatgaga

SEQ ID NO: 794842 - DNA, 20 bp, Artificial
  CRISPR gRNA sequence
accaaaactttccaaataag

SEQ ID NO: 794843 - DNA, 20 bp, Artificial
  CRISPR gRNA sequence
gtcagttcctcagaactagt

SEQ ID NO: 794844 - DNA, 20 bp, Artificial
  CRISPR gRNA sequence
atatcttaacgccaaatttt

SEQ ID NO: 794845 - DNA, 20 bp, Artificial
  CRISPR gRNA sequence
cctgggttggagctactgca

SEQ ID NO: 794846 - DNA, 20 bp, Artificial
  CRISPR gRNA sequence
ggttggagctactgcatgtt

SEQ ID NO: 794847 - DNA, 20 bp, Artificial
  CRISPR gRNA sequence
gagctactgcatgttgattg

SEQ ID NO: 794848 - DNA, 20 bp, Artificial
  CRISPR gRNA sequence
ggaaatctaacacaaacagc

SEQ ID NO: 794849 - DNA, 20 bp, Artificial
  CRISPR gRNA sequence
cacaaacagcaactgttttt

SEQ ID NO: 794850 - DNA, 20 bp, Artificial
  CRISPR gRNA sequence
ataagctaatgtcctcctgc

SEQ ID NO: 794851 - DNA, 20 bp, Artificial
  CRISPR gRNA sequence
tatgcatattgttcttgttg

SEQ ID NO: 794852 - DNA, 20 bp, Artificial
  CRISPR gRNA sequence
gtaaaataatataactattc

SEQ ID NO: 794853 - DNA, 20 bp, Artificial
  CRISPR gRNA sequence
aactattcttaagattgtct

SEQ ID NO: 794854 - DNA, 20 bp, Artificial
  CRISPR gRNA sequence
cttaagattgtctctcagct

SEQ ID NO: 794855 - DNA, 20 bp, Artificial
  CRISPR gRNA sequence
tctctcagcttagagttttc

SEQ ID NO: 794856 - DNA, 20 bp, Artificial
  CRISPR gRNA sequence
taatggtgaagaacttaaaa

SEQ ID NO: 794857 - DNA, 20 bp, Artificial
  CRISPR gRNA sequence
tctgttttcctatgactgac

SEQ ID NO: 794858 - DNA, 20 bp, Artificial
  CRISPR gRNA sequence
ttcctatgactgacatctgt

SEQ ID NO: 794859 - DNA, 20 bp, Artificial
  CRISPR gRNA sequence
ggtgatccctccaggctggc

SEQ ID NO: 794860 - DNA, 20 bp, Artificial
  CRISPR gRNA sequence
gtaatcattattgaacaaaa

SEQ ID NO: 794861 - DNA, 20 bp, Artificial
  CRISPR gRNA sequence
gcatgatttggggactatgg

SEQ ID NO: 794862 - DNA, 20 bp, Artificial
  CRISPR gRNA sequence
aacagaactgaaataattgc

SEQ ID NO: 794863 - DNA, 20 bp, Artificial
  CRISPR gRNA sequence
ggtggagaggctaagcctga

SEQ ID NO: 794864 - DNA, 20 bp, Artificial
  CRISPR gRNA sequence
ctccaagctcctttccaagc

SEQ ID NO: 794865 - DNA, 20 bp, Artificial
  CRISPR gRNA sequence
tcatcaggctctttgttgtc

SEQ ID NO: 794866 - DNA, 20 bp, Artificial
  CRISPR gRNA sequence
ctgcttcagggtgtcttctc

SEQ ID NO: 794867 - DNA, 20 bp, Artificial
  CRISPR gRNA sequence
tccccagatttctcctgttg

SEQ ID NO: 794868 - DNA, 20 bp, Artificial
  CRISPR gRNA sequence
cagtacctggcaatacacat

SEQ ID NO: 794869 - DNA, 20 bp, Artificial
  CRISPR gRNA sequence
aatacacataggtgcttagt

SEQ ID NO: 794870 - DNA, 20 bp, Artificial
  CRISPR gRNA sequence
gggtgcttgccgaattgttg

SEQ ID NO: 794871 - DNA, 20 bp, Artificial
  CRISPR gRNA sequence
tgttcgtgtaatggacaggg

SEQ ID NO: 794872 - DNA, 20 bp, Artificial
  CRISPR gRNA sequence
atggacagggggaagtttga

SEQ ID NO: 794873 - DNA, 20 bp, Artificial
  CRISPR gRNA sequence
ggtagagacagtattatggg

SEQ ID NO: 794874 - DNA, 20 bp, Artificial
  CRISPR gRNA sequence
cagtattatgggtcatgctt

SEQ ID NO: 794875 - DNA, 20 bp, Artificial
  CRISPR gRNA sequence
tgggtcatgcttcagagttt

SEQ ID NO: 794876 - DNA, 20 bp, Artificial
  CRISPR gRNA sequence
caatacattggacagcaacc

SEQ ID NO: 794877 - DNA, 20 bp, Artificial
  CRISPR gRNA sequence
ggctccctatgatgaactgc

SEQ ID NO: 794878 - DNA, 20 bp, Artificial
  CRISPR gRNA sequence
tgatgaactgcccctgcttt

SEQ ID NO: 794879 - DNA, 20 bp, Artificial
  CRISPR gRNA sequence
cctcagaagtactgccctgg

SEQ ID NO: 794880 - DNA, 20 bp, Artificial
  CRISPR gRNA sequence
tctggacctacaattttttg

SEQ ID NO: 794881 - DNA, 20 bp, Artificial
  CRISPR gRNA sequence
cttaaaaccacagtcaatct

SEQ ID NO: 794882 - DNA, 20 bp, Artificial
  CRISPR gRNA sequence
tgcatggctgatcagcagtc

SEQ ID NO: 794883 - DNA, 20 bp, Artificial
  CRISPR gRNA sequence
attgttttgtcaattgtctt

SEQ ID NO: 794884 - DNA, 20 bp, Artificial
  CRISPR gRNA sequence
atatgtttcttcttcctctt

SEQ ID NO: 794885 - DNA, 20 bp, Artificial
  CRISPR gRNA sequence
atactcctttggtattgtca

SEQ ID NO: 794886 - DNA, 20 bp, Artificial
  CRISPR gRNA sequence
tttgagtgactgccactatt

SEQ ID NO: 794887 - DNA, 20 bp, Artificial
  CRISPR gRNA sequence
ctgtgcatttgcacctctga

SEQ ID NO: 794888 - DNA, 20 bp, Artificial
  CRISPR gRNA sequence
agctatgcactgccctttag

SEQ ID NO: 794889 - DNA, 20 bp, Artificial
  CRISPR gRNA sequence
gcttcaaccccaaatcctac

SEQ ID NO: 794890 - DNA, 20 bp, Artificial
  CRISPR gRNA sequence
cccttcctttagtcaacttc

SEQ ID NO: 794891 - DNA, 20 bp, Artificial
  CRISPR gRNA sequence
agggcttttgcaattttatc

SEQ ID NO: 794892 - DNA, 20 bp, Artificial
  CRISPR gRNA sequence
aattttatcacttgttttac

SEQ ID NO: 794893 - DNA, 20 bp, Artificial
  CRISPR gRNA sequence
ttttactatttttcatgtgt

SEQ ID NO: 794894 - DNA, 20 bp, Artificial
  CRISPR gRNA sequence
ttctcacaactttctaatat

SEQ ID NO: 794895 - DNA, 20 bp, Artificial
  CRISPR gRNA sequence
gcttataaaaagtgggaact

SEQ ID NO: 794896 - DNA, 20 bp, Artificial
  CRISPR gRNA sequence
aaaagtgggaactcactgtt

SEQ ID NO: 794897 - DNA, 20 bp, Artificial
  CRISPR gRNA sequence
actgtttattgcttaaaaaa

SEQ ID NO: 794898 - DNA, 20 bp, Artificial
  CRISPR gRNA sequence
ggtagtctatctatgccaca

SEQ ID NO: 794899 - DNA, 20 bp, Artificial
  CRISPR gRNA sequence
ccccaaaactcaaataccta

SEQ ID NO: 794900 - DNA, 20 bp, Artificial
  CRISPR gRNA sequence
cttgcccaaaggcattcaaa

SEQ ID NO: 794901 - DNA, 20 bp, Artificial
  CRISPR gRNA sequence
tacaattagtgtcttagaca

SEQ ID NO: 794902 - DNA, 20 bp, Artificial
  CRISPR gRNA sequence
ctggttattgttacacaaag

SEQ ID NO: 794903 - DNA, 20 bp, Artificial
  CRISPR gRNA sequence
ttacacaaaggaatgatttg

SEQ ID NO: 794904 - DNA, 20 bp, Artificial
  CRISPR gRNA sequence
tcttatttacccttgtatac

SEQ ID NO: 794905 - DNA, 20 bp, Artificial
  CRISPR gRNA sequence
gcacatagtaaataccaagt

SEQ ID NO: 794906 - DNA, 20 bp, Artificial
  CRISPR gRNA sequence
gaataaaagaaagagataat

SEQ ID NO: 794907 - DNA, 20 bp, Artificial
  CRISPR gRNA sequence
caattatttgtatttcatct

SEQ ID NO: 794908 - DNA, 20 bp, Artificial
  CRISPR gRNA sequence
atttctgatcctcttgcaaa

SEQ ID NO: 794909 - DNA, 20 bp, Artificial
  CRISPR gRNA sequence
ttgaaaaaaatttcctcatt

SEQ ID NO: 794910 - DNA, 20 bp, Artificial
  CRISPR gRNA sequence
aacttatcctcagaatttac

SEQ ID NO: 794911 - DNA, 20 bp, Artificial
  CRISPR gRNA sequence
ctcagaatttacagatgttt

SEQ ID NO: 794912 - DNA, 20 bp, Artificial
  CRISPR gRNA sequence
gcaggaggatcacttgaagc

SEQ ID NO: 794913 - DNA, 20 bp, Artificial
  CRISPR gRNA sequence
gaggatcacttgaagccaga

SEQ ID NO: 794914 - DNA, 20 bp, Artificial
  CRISPR gRNA sequence
ggcgcaatcgttctgcagac

SEQ ID NO: 794915 - DNA, 20 bp, Artificial
  CRISPR gRNA sequence
atttgcttgggaagctcagg

SEQ ID NO: 794916 - DNA, 20 bp, Artificial
  CRISPR gRNA sequence
gagtggtcatataggaattc

SEQ ID NO: 794917 - DNA, 20 bp, Artificial
  CRISPR gRNA sequence
aattcatgggatttttagac

SEQ ID NO: 794918 - DNA, 20 bp, Artificial
  CRISPR gRNA sequence
ataatgacgatgaatgtgaa

SEQ ID NO: 794919 - DNA, 20 bp, Artificial
  CRISPR gRNA sequence
aagcatttctgttcactacc

SEQ ID NO: 794920 - DNA, 20 bp, Artificial
  CRISPR gRNA sequence
gacccagatattagagaacg

SEQ ID NO: 794921 - DNA, 20 bp, Artificial
  CRISPR gRNA sequence
tattagagaacgtgttgatt

SEQ ID NO: 794922 - DNA, 20 bp, Artificial
  CRISPR gRNA sequence
ggagacttaagaggtggcat

SEQ ID NO: 794923 - DNA, 20 bp, Artificial
  CRISPR gRNA sequence
tggcatggttgtttgaacat

SEQ ID NO: 794924 - DNA, 20 bp, Artificial
  CRISPR gRNA sequence
caatgctcattcagctacat

SEQ ID NO: 794925 - DNA, 20 bp, Artificial
  CRISPR gRNA sequence
ggagggtgagcaaggcggag

SEQ ID NO: 794926 - DNA, 20 bp, Artificial
  CRISPR gRNA sequence
ggagcttcgttgagtgacag

SEQ ID NO: 794927 - DNA, 20 bp, Artificial
  CRISPR gRNA sequence
tcacgaggtcagagttcgag

SEQ ID NO: 794928 - DNA, 20 bp, Artificial
  CRISPR gRNA sequence
agaggagatctgaagtgagc

SEQ ID NO: 794929 - DNA, 20 bp, Artificial
  CRISPR gRNA sequence
tgttcaagtctggctgagtc

SEQ ID NO: 794930 - DNA, 20 bp, Artificial
  CRISPR gRNA sequence
gtctggctgagtccagggtt

SEQ ID NO: 794931 - DNA, 20 bp, Artificial
  CRISPR gRNA sequence
ggctgagtccagggttttgt

SEQ ID NO: 794932 - DNA, 20 bp, Artificial
  CRISPR gRNA sequence
gagtccagggttttgtgttt

SEQ ID NO: 794933 - DNA, 20 bp, Artificial
  CRISPR gRNA sequence
cagggttttgtgtttgtttg

SEQ ID NO: 794934 - DNA, 20 bp, Artificial
  CRISPR gRNA sequence
aacctctgcctcccgggttc

SEQ ID NO: 794935 - DNA, 20 bp, Artificial
  CRISPR gRNA sequence
ctcccgggttcaagcgattc

SEQ ID NO: 794936 - DNA, 20 bp, Artificial
  CRISPR gRNA sequence
ttttgtatttttagtagaga

SEQ ID NO: 794937 - DNA, 20 bp, Artificial
  CRISPR gRNA sequence
ctggtctcaaactcctgacc

SEQ ID NO: 794938 - DNA, 20 bp, Artificial
  CRISPR gRNA sequence
ctgcctcggcctcccaagtg

SEQ ID NO: 794939 - DNA, 20 bp, Artificial
  CRISPR gRNA sequence
ccactgagcccggtcgagtc

SEQ ID NO: 794940 - DNA, 20 bp, Artificial
  CRISPR gRNA sequence
ctcagaagggaggaagagtg

SEQ ID NO: 794941 - DNA, 20 bp, Artificial
  CRISPR gRNA sequence
cacaattggcaacctggctc

SEQ ID NO: 794942 - DNA, 20 bp, Artificial
  CRISPR gRNA sequence
ctcccaggctttgggccatc

SEQ ID NO: 794943 - DNA, 20 bp, Artificial
  CRISPR gRNA sequence
ggccatccctggcttgaagg

SEQ ID NO: 794944 - DNA, 20 bp, Artificial
  CRISPR gRNA sequence
agcccctgctcagcctccct

SEQ ID NO: 794945 - DNA, 20 bp, Artificial
  CRISPR gRNA sequence
tggccgggttgtgacagcac

SEQ ID NO: 794946 - DNA, 20 bp, Artificial
  CRISPR gRNA sequence
gcacctaggcttggccacaa

SEQ ID NO: 794947 - DNA, 20 bp, Artificial
  CRISPR gRNA sequence
gctgctgccatcactgtgag

SEQ ID NO: 794948 - DNA, 20 bp, Artificial
  CRISPR gRNA sequence
atggtatgttaaatggtaat

SEQ ID NO: 794949 - DNA, 20 bp, Artificial
  CRISPR gRNA sequence
tttgggggagaaaagatgac

SEQ ID NO: 794950 - DNA, 20 bp, Artificial
  CRISPR gRNA sequence
ctggcagcaaggtcttccct

SEQ ID NO: 794951 - DNA, 20 bp, Artificial
  CRISPR gRNA sequence
gaggccacacaggcctggaa

SEQ ID NO: 794952 - DNA, 20 bp, Artificial
  CRISPR gRNA sequence
gccattcaggctaggaattc

SEQ ID NO: 794953 - DNA, 20 bp, Artificial
  CRISPR gRNA sequence
tgtcttggctgttgaaaaaa

SEQ ID NO: 794954 - DNA, 20 bp, Artificial
  CRISPR gRNA sequence
agtgaaatgctgagccatcg

SEQ ID NO: 794955 - DNA, 20 bp, Artificial
  CRISPR gRNA sequence
atcggaaggttttaagaaaa

SEQ ID NO: 794956 - DNA, 20 bp, Artificial
  CRISPR gRNA sequence
agtggaggtggtgagaaatg

SEQ ID NO: 794957 - DNA, 20 bp, Artificial
  CRISPR gRNA sequence
aagatgagaaatgcagaggt

SEQ ID NO: 794958 - DNA, 20 bp, Artificial
  CRISPR gRNA sequence
gaaatgcagaggtctaagat

SEQ ID NO: 794959 - DNA, 20 bp, Artificial
  CRISPR gRNA sequence
caaaatttgtccaaggtgtt

SEQ ID NO: 794960 - DNA, 20 bp, Artificial
  CRISPR gRNA sequence
gaggcttacaatttgtaaaa

SEQ ID NO: 794961 - DNA, 20 bp, Artificial
  CRISPR gRNA sequence
ccaggattaaacccagatgt

SEQ ID NO: 794962 - DNA, 20 bp, Artificial
  CRISPR gRNA sequence
taaaccatattttccccaga

SEQ ID NO: 794963 - DNA, 20 bp, Artificial
  CRISPR gRNA sequence
ctttatagcagtgtctgttc

SEQ ID NO: 794964 - DNA, 20 bp, Artificial
  CRISPR gRNA sequence
gcaagtgccaggcctgttgg

SEQ ID NO: 794965 - DNA, 20 bp, Artificial
  CRISPR gRNA sequence
ccattctcttttgaacctat

SEQ ID NO: 794966 - DNA, 20 bp, Artificial
  CRISPR gRNA sequence
ctgtacaaaactcactgata

SEQ ID NO: 794967 - DNA, 20 bp, Artificial
  CRISPR gRNA sequence
ctgatcactcctttgtagca

SEQ ID NO: 794968 - DNA, 20 bp, Artificial
  CRISPR gRNA sequence
gtagcactgtgttttaaaat

SEQ ID NO: 794969 - DNA, 20 bp, Artificial
  CRISPR gRNA sequence
ggggtgcgcaagatctttat

SEQ ID NO: 794970 - DNA, 20 bp, Artificial
  CRISPR gRNA sequence
gaaatgggtgaagcagggtg

SEQ ID NO: 794971 - DNA, 20 bp, Artificial
  CRISPR gRNA sequence
gtgaagcagggtgagtggat

SEQ ID NO: 794972 - DNA, 20 bp, Artificial
  CRISPR gRNA sequence
tcttctggtacttggccctg

SEQ ID NO: 794973 - DNA, 20 bp, Artificial
  CRISPR gRNA sequence
gggtatgggctctgaaatgg

SEQ ID NO: 794974 - DNA, 20 bp, Artificial
  CRISPR gRNA sequence
gaaaggtgtgctcatgggca

SEQ ID NO: 794975 - DNA, 20 bp, Artificial
  CRISPR gRNA sequence
actctttttccccttcctta

SEQ ID NO: 794976 - DNA, 20 bp, Artificial
  CRISPR gRNA sequence
gccccaaacttaggaatttt

SEQ ID NO: 794977 - DNA, 20 bp, Artificial
  CRISPR gRNA sequence
ctgtattccccaaattgatc

SEQ ID NO: 794978 - DNA, 20 bp, Artificial
  CRISPR gRNA sequence
aatgcaatccctaccaaaat

SEQ ID NO: 794979 - DNA, 20 bp, Artificial
  CRISPR gRNA sequence
aagttggaggactcacactt

SEQ ID NO: 794980 - DNA, 20 bp, Artificial
  CRISPR gRNA sequence
tccttatatatatgatcaat

SEQ ID NO: 794981 - DNA, 20 bp, Artificial
  CRISPR gRNA sequence
atatttaggttcttgatcca

SEQ ID NO: 794982 - DNA, 20 bp, Artificial
  CRISPR gRNA sequence
ctttgtgaccttgactaggc

SEQ ID NO: 794983 - DNA, 20 bp, Artificial
  CRISPR gRNA sequence
taaaagaaaaaagtagataa

SEQ ID NO: 794984 - DNA, 20 bp, Artificial
  CRISPR gRNA sequence
tttttttacttaaaatcaat

SEQ ID NO: 794985 - DNA, 20 bp, Artificial
  CRISPR gRNA sequence
aattaaaacatttatccttc

SEQ ID NO: 794986 - DNA, 20 bp, Artificial
  CRISPR gRNA sequence
tccaaatcatatatttgata

SEQ ID NO: 794987 - DNA, 20 bp, Artificial
  CRISPR gRNA sequence
acatagacaaagacttgtat

SEQ ID NO: 794988 - DNA, 20 bp, Artificial
  CRISPR gRNA sequence
gccagccacaaaagtccaca

SEQ ID NO: 794989 - DNA, 20 bp, Artificial
  CRISPR gRNA sequence
gccacaaaagtccacatatt

SEQ ID NO: 794990 - DNA, 20 bp, Artificial
  CRISPR gRNA sequence
agcaattgatagagacagaa

SEQ ID NO: 794991 - DNA, 20 bp, Artificial
  CRISPR gRNA sequence
gggaaagggaaggggaaata

SEQ ID NO: 794992 - DNA, 20 bp, Artificial
  CRISPR gRNA sequence
aatgttctaaaattggataa

SEQ ID NO: 794993 - DNA, 20 bp, Artificial
  CRISPR gRNA sequence
cacagagtcgtgcacttaaa

SEQ ID NO: 794994 - DNA, 20 bp, Artificial
  CRISPR gRNA sequence
gtcgtgcacttaaaaaaagt

SEQ ID NO: 794995 - DNA, 20 bp, Artificial
  CRISPR gRNA sequence
aacacattcctaaccgatct

SEQ ID NO: 794996 - DNA, 20 bp, Artificial
  CRISPR gRNA sequence
caatagtctattgcctacac

SEQ ID NO: 794997 - DNA, 20 bp, Artificial
  CRISPR gRNA sequence
ttctcctgacccaaaccctc

SEQ ID NO: 794998 - DNA, 20 bp, Artificial
  CRISPR gRNA sequence
ctcagagcagctctgctgtt

SEQ ID NO: 794999 - DNA, 20 bp, Artificial
  CRISPR gRNA sequence
tgatttagatgtatggctcc

SEQ ID NO: 795000 - DNA, 20 bp, Artificial
  CRISPR gRNA sequence
ccaacagatttcccctgaag

SEQ ID NO: 795001 - DNA, 20 bp, Artificial
  CRISPR gRNA sequence
gataaaagttggaaagcctc

SEQ ID NO: 795002 - DNA, 20 bp, Artificial
  CRISPR gRNA sequence
ctcctcagtttcagaccatt

SEQ ID NO: 795003 - DNA, 20 bp, Artificial
  CRISPR gRNA sequence
ataagaagtccatggataaa

SEQ ID NO: 795004 - DNA, 20 bp, Artificial
  CRISPR gRNA sequence
agctattgaaaaaagctatg

SEQ ID NO: 795005 - DNA, 20 bp, Artificial
  CRISPR gRNA sequence
aaaggaagaagaacttctca

SEQ ID NO: 795006 - DNA, 20 bp, Artificial
  CRISPR gRNA sequence
atttggatttataaagagtg

SEQ ID NO: 795007 - DNA, 20 bp, Artificial
  CRISPR gRNA sequence
catggtctgtcaccttcccc

SEQ ID NO: 795008 - DNA, 20 bp, Artificial
  CRISPR gRNA sequence
ccccaaatgatttgttattc

SEQ ID NO: 795009 - DNA, 20 bp, Artificial
  CRISPR gRNA sequence
acaaagaaccaaagacccag

SEQ ID NO: 795010 - DNA, 20 bp, Artificial
  CRISPR gRNA sequence
gctaatgttgagcctggaat

SEQ ID NO: 795011 - DNA, 20 bp, Artificial
  CRISPR gRNA sequence
aggtaagaaaggacaaaggg

SEQ ID NO: 795012 - DNA, 20 bp, Artificial
  CRISPR gRNA sequence
gagaatgtggccctcaggct

SEQ ID NO: 795013 - DNA, 20 bp, Artificial
  CRISPR gRNA sequence
agggctttctttgagaggac

SEQ ID NO: 795014 - DNA, 20 bp, Artificial
  CRISPR gRNA sequence
aaaaaaaaaagagtccccat

SEQ ID NO: 795015 - DNA, 20 bp, Artificial
  CRISPR gRNA sequence
aagacattctgcatattatt

SEQ ID NO: 795016 - DNA, 20 bp, Artificial
  CRISPR gRNA sequence
gcatattattagttgtttct

SEQ ID NO: 795017 - DNA, 20 bp, Artificial
  CRISPR gRNA sequence
gttggtcattcataccttaa

SEQ ID NO: 795018 - DNA, 20 bp, Artificial
  CRISPR gRNA sequence
tgagggtgagcagaaagaaa

SEQ ID NO: 795019 - DNA, 20 bp, Artificial
  CRISPR gRNA sequence
agtaacatagaggtgtggac

SEQ ID NO: 795020 - DNA, 20 bp, Artificial
  CRISPR gRNA sequence
atgggaaatcatctttctgc

SEQ ID NO: 795021 - DNA, 20 bp, Artificial
  CRISPR gRNA sequence
tggcacttgataacctttcg

SEQ ID NO: 795022 - DNA, 20 bp, Artificial
  CRISPR gRNA sequence
caaaggaagaccctgagata

SEQ ID NO: 795023 - DNA, 20 bp, Artificial
  CRISPR gRNA sequence
gggccagctaaaggaacttt

SEQ ID NO: 795024 - DNA, 20 bp, Artificial
  CRISPR gRNA sequence
caataacttccttgctacaa

SEQ ID NO: 795025 - DNA, 20 bp, Artificial
  CRISPR gRNA sequence
ttccttgctacaaaacagct

SEQ ID NO: 795026 - DNA, 20 bp, Artificial
  CRISPR gRNA sequence
ccccatcctgtggcaggact

SEQ ID NO: 795027 - DNA, 20 bp, Artificial
  CRISPR gRNA sequence
ttggggaatgtgtaacctct

SEQ ID NO: 795028 - DNA, 20 bp, Artificial
  CRISPR gRNA sequence
atgtgtaacctctgtgggtt

SEQ ID NO: 795029 - DNA, 20 bp, Artificial
  CRISPR gRNA sequence
agcttaaaaacactgagatc

SEQ ID NO: 795030 - DNA, 20 bp, Artificial
  CRISPR gRNA sequence
tgagatcctgggttttctgt

SEQ ID NO: 795031 - DNA, 20 bp, Artificial
  CRISPR gRNA sequence
ggaagagcatttacatttat

SEQ ID NO: 795032 - DNA, 20 bp, Artificial
  CRISPR gRNA sequence
agaaaaggtacttaatttcc

SEQ ID NO: 795033 - DNA, 20 bp, Artificial
  CRISPR gRNA sequence
atagttattaggtgacaccg

SEQ ID NO: 795034 - DNA, 20 bp, Artificial
  CRISPR gRNA sequence
ataaatcttccaactttgga

SEQ ID NO: 795035 - DNA, 20 bp, Artificial
  CRISPR gRNA sequence
tctgaatatggatacgtatt

SEQ ID NO: 795036 - DNA, 20 bp, Artificial
  CRISPR gRNA sequence
ctgaaaggaaagtaaaaatg

SEQ ID NO: 795037 - DNA, 20 bp, Artificial
  CRISPR gRNA sequence
ttcacgaatttggaattctt

SEQ ID NO: 795038 - DNA, 20 bp, Artificial
  CRISPR gRNA sequence
aattagaatgccttctcctc

SEQ ID NO: 795039 - DNA, 20 bp, Artificial
  CRISPR gRNA sequence
atttcatgtctctttaatta

SEQ ID NO: 795040 - DNA, 20 bp, Artificial
  CRISPR gRNA sequence
atgtctctttaattaaagag

SEQ ID NO: 795041 - DNA, 20 bp, Artificial
  CRISPR gRNA sequence
taaaggatctgagaaataat

SEQ ID NO: 795042 - DNA, 20 bp, Artificial
  CRISPR gRNA sequence
gtcttatctattatgtatat

SEQ ID NO: 795043 - DNA, 20 bp, Artificial
  CRISPR gRNA sequence
tctattatgtatattcaggt

SEQ ID NO: 795044 - DNA, 20 bp, Artificial
  CRISPR gRNA sequence
atcagggtgtccagacagac

SEQ ID NO: 795045 - DNA, 20 bp, Artificial
  CRISPR gRNA sequence
ccttgtacagccccagacct

SEQ ID NO: 795046 - DNA, 20 bp, Artificial
  CRISPR gRNA sequence
atacctgaattaaatcaatg

SEQ ID NO: 795047 - DNA, 20 bp, Artificial
  CRISPR gRNA sequence
ctactcagctgaggcagaaa

SEQ ID NO: 795048 - DNA, 20 bp, Artificial
  CRISPR gRNA sequence
attccagcctgggtgacaga

SEQ ID NO: 795049 - DNA, 20 bp, Artificial
  CRISPR gRNA sequence
caatccatatgccctggaga

SEQ ID NO: 795050 - DNA, 20 bp, Artificial
  CRISPR gRNA sequence
gtccttttcataaataaata

SEQ ID NO: 795051 - DNA, 20 bp, Artificial
  CRISPR gRNA sequence
cataccttatatatagaaga

SEQ ID NO: 795052 - DNA, 20 bp, Artificial
  CRISPR gRNA sequence
tcgggagtctgaggcaggag

SEQ ID NO: 795053 - DNA, 20 bp, Artificial
  CRISPR gRNA sequence
atatattttgaaaatttatt

SEQ ID NO: 795054 - DNA, 20 bp, Artificial
  CRISPR gRNA sequence
aaaaccacatgaaacaacta

SEQ ID NO: 795055 - DNA, 20 bp, Artificial
  CRISPR gRNA sequence
taaagcttaacattactata

SEQ ID NO: 795056 - DNA, 20 bp, Artificial
  CRISPR gRNA sequence
gaactttgtcagctccccag

SEQ ID NO: 795057 - DNA, 20 bp, Artificial
  CRISPR gRNA sequence
aattgctgaagaggactaaa

SEQ ID NO: 795058 - DNA, 20 bp, Artificial
  CRISPR gRNA sequence
ttcaataaatgtatgttctt

SEQ ID NO: 795059 - DNA, 20 bp, Artificial
  CRISPR gRNA sequence
atagacatcctgcattttta

SEQ ID NO: 795060 - DNA, 20 bp, Artificial
  CRISPR gRNA sequence
cattatttccattttcttct

SEQ ID NO: 795061 - DNA, 20 bp, Artificial
  CRISPR gRNA sequence
tccattttcttctgctagat

SEQ ID NO: 795062 - DNA, 20 bp, Artificial
  CRISPR gRNA sequence
ctactgtgttatctataaaa

SEQ ID NO: 795063 - DNA, 20 bp, Artificial
  CRISPR gRNA sequence
acatggatgtacttacatat

SEQ ID NO: 795064 - DNA, 20 bp, Artificial
  CRISPR gRNA sequence
gccaaacaaacaaacaaaca

SEQ ID NO: 795065 - DNA, 20 bp, Artificial
  CRISPR gRNA sequence
tcattagatatccttttgta

SEQ ID NO: 795066 - DNA, 20 bp, Artificial
  CRISPR gRNA sequence
tgtgtgaatcaataatttat

SEQ ID NO: 795067 - DNA, 20 bp, Artificial
  CRISPR gRNA sequence
tctagtgtatgtatactata

SEQ ID NO: 795068 - DNA, 20 bp, Artificial
  CRISPR gRNA sequence
atttgggtatttcccatttt

SEQ ID NO: 795069 - DNA, 20 bp, Artificial
  CRISPR gRNA sequence
gttattataaatatttgcat

SEQ ID NO: 795070 - DNA, 20 bp, Artificial
  CRISPR gRNA sequence
ataggtttttttgggcaaac

SEQ ID NO: 795071 - DNA, 20 bp, Artificial
  CRISPR gRNA sequence
acttggataaatacctagaa

SEQ ID NO: 795072 - DNA, 20 bp, Artificial
  CRISPR gRNA sequence
gctaggtcacatggtaagtg

SEQ ID NO: 795073 - DNA, 20 bp, Artificial
  CRISPR gRNA sequence
ttttttctttttttttgaga

SEQ ID NO: 795074 - DNA, 20 bp, Artificial
  CRISPR gRNA sequence
ctaaagtgcaatgccgtgat

SEQ ID NO: 795075 - DNA, 20 bp, Artificial
  CRISPR gRNA sequence
tgcctcagcctcccaagtag

SEQ ID NO: 795076 - DNA, 20 bp, Artificial
  CRISPR gRNA sequence
cacccaccaccatgcccttc

SEQ ID NO: 795077 - DNA, 20 bp, Artificial
  CRISPR gRNA sequence
ttttgtatttttaatagaga

SEQ ID NO: 795078 - DNA, 20 bp, Artificial
  CRISPR gRNA sequence
caccttggcctcccaaaatg

SEQ ID NO: 795079 - DNA, 20 bp, Artificial
  CRISPR gRNA sequence
gacagggtatcactctgttg

SEQ ID NO: 795080 - DNA, 20 bp, Artificial
  CRISPR gRNA sequence
agcctcgatctctcaggctc

SEQ ID NO: 795081 - DNA, 20 bp, Artificial
  CRISPR gRNA sequence
tttgtagacatggggtctcc

SEQ ID NO: 795082 - DNA, 20 bp, Artificial
  CRISPR gRNA sequence
cgcctcagcctcccaaaatg

SEQ ID NO: 795083 - DNA, 20 bp, Artificial
  CRISPR gRNA sequence
gccactgcacctggccttag

SEQ ID NO: 795084 - DNA, 20 bp, Artificial
  CRISPR gRNA sequence
taattgtatactaaggaatt

SEQ ID NO: 795085 - DNA, 20 bp, Artificial
  CRISPR gRNA sequence
tgtatactaaggaattaaac

SEQ ID NO: 795086 - DNA, 20 bp, Artificial
  CRISPR gRNA sequence
gaattaaacgattgtttaat

SEQ ID NO: 795087 - DNA, 20 bp, Artificial
  CRISPR gRNA sequence
tattgtttattttcttattg

SEQ ID NO: 795088 - DNA, 20 bp, Artificial
  CRISPR gRNA sequence
ctcactacagcctctgcctc

SEQ ID NO: 795089 - DNA, 20 bp, Artificial
  CRISPR gRNA sequence
agcctctgcctcccaagttt

SEQ ID NO: 795090 - DNA, 20 bp, Artificial
  CRISPR gRNA sequence
ggaattacaggcatgtacca

SEQ ID NO: 795091 - DNA, 20 bp, Artificial
  CRISPR gRNA sequence
tacaggcatgtaccaccatg

SEQ ID NO: 795092 - DNA, 20 bp, Artificial
  CRISPR gRNA sequence
catgtaccaccatgcttggc

SEQ ID NO: 795093 - DNA, 20 bp, Artificial
  CRISPR gRNA sequence
gtttgtattttcagtagagt

SEQ ID NO: 795094 - DNA, 20 bp, Artificial
  CRISPR gRNA sequence
actatgttggccaggctgtc

SEQ ID NO: 795095 - DNA, 20 bp, Artificial
  CRISPR gRNA sequence
caccttggcctcccaaagtg

SEQ ID NO: 795096 - DNA, 20 bp, Artificial
  CRISPR gRNA sequence
gatacaagttctttatcaga

SEQ ID NO: 795097 - DNA, 20 bp, Artificial
  CRISPR gRNA sequence
tcaaatattcttttgaagtc

SEQ ID NO: 795098 - DNA, 20 bp, Artificial
  CRISPR gRNA sequence
taactgtgtcttttgcagag

SEQ ID NO: 795099 - DNA, 20 bp, Artificial
  CRISPR gRNA sequence
agcaaagattttaattttga

SEQ ID NO: 795100 - DNA, 20 bp, Artificial
  CRISPR gRNA sequence
aagattttaattttgatgaa

SEQ ID NO: 795101 - DNA, 20 bp, Artificial
  CRISPR gRNA sequence
tttgatgaagtttgatttat

SEQ ID NO: 795102 - DNA, 20 bp, Artificial
  CRISPR gRNA sequence
tcaatgttttcttttatgga

SEQ ID NO: 795103 - DNA, 20 bp, Artificial
  CRISPR gRNA sequence
ctttacataacccaagatgt

SEQ ID NO: 795104 - DNA, 20 bp, Artificial
  CRISPR gRNA sequence
gtagttgtatattctatatg

SEQ ID NO: 795105 - DNA, 20 bp, Artificial
  CRISPR gRNA sequence
gatgtataggttaagctcat

SEQ ID NO: 795106 - DNA, 20 bp, Artificial
  CRISPR gRNA sequence
tttgcaaatatcacacttat

SEQ ID NO: 795107 - DNA, 20 bp, Artificial
  CRISPR gRNA sequence
ccaccccagtcttttttcat

SEQ ID NO: 795108 - DNA, 20 bp, Artificial
  CRISPR gRNA sequence
ggagaataatcaggttgggg

SEQ ID NO: 795109 - DNA, 20 bp, Artificial
  CRISPR gRNA sequence
cactgagcagagcatgagtc

SEQ ID NO: 795110 - DNA, 20 bp, Artificial
  CRISPR gRNA sequence
gcatgagtcaggtgcttaga

SEQ ID NO: 795111 - DNA, 20 bp, Artificial
  CRISPR gRNA sequence
ttgtcctaaaccaggaactt

SEQ ID NO: 795112 - DNA, 20 bp, Artificial
  CRISPR gRNA sequence
tgtgggggataaaatataaa

SEQ ID NO: 795113 - DNA, 20 bp, Artificial
  CRISPR gRNA sequence
ggtaatgcaaataattcgtt

SEQ ID NO: 795114 - DNA, 20 bp, Artificial
  CRISPR gRNA sequence
tgacaggtgctgactaccat

SEQ ID NO: 795115 - DNA, 20 bp, Artificial
  CRISPR gRNA sequence
gacctgcatacatgaatttt

SEQ ID NO: 795116 - DNA, 20 bp, Artificial
  CRISPR gRNA sequence
ttttgccaagtcttttgccc

SEQ ID NO: 795117 - DNA, 20 bp, Artificial
  CRISPR gRNA sequence
atgaatggaaagcctgtgtt

SEQ ID NO: 795118 - DNA, 20 bp, Artificial
  CRISPR gRNA sequence
ttttgtagttgtggaaacct

SEQ ID NO: 795119 - DNA, 20 bp, Artificial
  CRISPR gRNA sequence
tcaggagttcaatcctaggt

SEQ ID NO: 795120 - DNA, 20 bp, Artificial
  CRISPR gRNA sequence
gttgcatcacttctttgagc

SEQ ID NO: 795121 - DNA, 20 bp, Artificial
  CRISPR gRNA sequence
ctagcccagtgtctgactta

SEQ ID NO: 795122 - DNA, 20 bp, Artificial
  CRISPR gRNA sequence
tgaccttcttaaaatgcaga

SEQ ID NO: 795123 - DNA, 20 bp, Artificial
  CRISPR gRNA sequence
cctgattccctaggtctggg

SEQ ID NO: 795124 - DNA, 20 bp, Artificial
  CRISPR gRNA sequence
cttgaaattctacatttcta

SEQ ID NO: 795125 - DNA, 20 bp, Artificial
  CRISPR gRNA sequence
tttgaaggcaaggtggtaaa

SEQ ID NO: 795126 - DNA, 20 bp, Artificial
  CRISPR gRNA sequence
aaagtagtgcctgggcatta

SEQ ID NO: 795127 - DNA, 20 bp, Artificial
  CRISPR gRNA sequence
gtgtgttttaaaagcctccc

SEQ ID NO: 795128 - DNA, 20 bp, Artificial
  CRISPR gRNA sequence
ccaggtgattccaatgttag

SEQ ID NO: 795129 - DNA, 20 bp, Artificial
  CRISPR gRNA sequence
tgttagccaagattgaggcc

SEQ ID NO: 795130 - DNA, 20 bp, Artificial
  CRISPR gRNA sequence
ttagtgaatctaatttgcag

SEQ ID NO: 795131 - DNA, 20 bp, Artificial
  CRISPR gRNA sequence
gagaaaaaacctcttcatag

SEQ ID NO: 795132 - DNA, 20 bp, Artificial
  CRISPR gRNA sequence
tagaattgtttgcatcagtg

SEQ ID NO: 795133 - DNA, 20 bp, Artificial
  CRISPR gRNA sequence
ctgtaacttacaataagcaa

SEQ ID NO: 795134 - DNA, 20 bp, Artificial
  CRISPR gRNA sequence
ttacaataagcaagaatgtt

SEQ ID NO: 795135 - DNA, 20 bp, Artificial
  CRISPR gRNA sequence
ttgtatggagtaatcaagct

SEQ ID NO: 795136 - DNA, 20 bp, Artificial
  CRISPR gRNA sequence
gtattctgagctattcagac

SEQ ID NO: 795137 - DNA, 20 bp, Artificial
  CRISPR gRNA sequence
gagctattcagacatatgat

SEQ ID NO: 795138 - DNA, 20 bp, Artificial
  CRISPR gRNA sequence
tgcagtaaataaatttgcta

SEQ ID NO: 795139 - DNA, 20 bp, Artificial
  CRISPR gRNA sequence
cttgtaagccccattttctt

SEQ ID NO: 795140 - DNA, 20 bp, Artificial
  CRISPR gRNA sequence
gccccattttcttccctgtt

SEQ ID NO: 795141 - DNA, 20 bp, Artificial
  CRISPR gRNA sequence
aggtaattcttgaacttggc

SEQ ID NO: 795142 - DNA, 20 bp, Artificial
  CRISPR gRNA sequence
gttgaatattattcttcaag

SEQ ID NO: 795143 - DNA, 20 bp, Artificial
  CRISPR gRNA sequence
atattattcttcaaggacag

SEQ ID NO: 795144 - DNA, 20 bp, Artificial
  CRISPR gRNA sequence
taataactcaagtatttaag

SEQ ID NO: 795145 - DNA, 20 bp, Artificial
  CRISPR gRNA sequence
cccttaagagggtcccatta

SEQ ID NO: 795146 - DNA, 20 bp, Artificial
  CRISPR gRNA sequence
gagagctattccaagtgtgc

SEQ ID NO: 795147 - DNA, 20 bp, Artificial
  CRISPR gRNA sequence
acctggcacagcaagtgcag

SEQ ID NO: 795148 - DNA, 20 bp, Artificial
  CRISPR gRNA sequence
gcaagtgcagatatgattag

SEQ ID NO: 795149 - DNA, 20 bp, Artificial
  CRISPR gRNA sequence
tcggtcatttgaaataaatc

SEQ ID NO: 795150 - DNA, 20 bp, Artificial
  CRISPR gRNA sequence
ttgtgtgatcacaggcaagt

SEQ ID NO: 795151 - DNA, 20 bp, Artificial
  CRISPR gRNA sequence
ctcagcctggtctttgcctt

SEQ ID NO: 795152 - DNA, 20 bp, Artificial
  CRISPR gRNA sequence
tagtaaaatatcctggagga

SEQ ID NO: 795153 - DNA, 20 bp, Artificial
  CRISPR gRNA sequence
gataaagaggctgaagctca

SEQ ID NO: 795154 - DNA, 20 bp, Artificial
  CRISPR gRNA sequence
gaaacaacttctggaatagc

SEQ ID NO: 795155 - DNA, 20 bp, Artificial
  CRISPR gRNA sequence
ctcccaaatatttgttgaat

SEQ ID NO: 795156 - DNA, 20 bp, Artificial
  CRISPR gRNA sequence
aaatatttgttgaatgaatg

SEQ ID NO: 795157 - DNA, 20 bp, Artificial
  CRISPR gRNA sequence
acataatttgatctaatctt

SEQ ID NO: 795158 - DNA, 20 bp, Artificial
  CRISPR gRNA sequence
gtgattattcagaaactact

SEQ ID NO: 795159 - DNA, 20 bp, Artificial
  CRISPR gRNA sequence
attgatgtaacactaccttt

SEQ ID NO: 795160 - DNA, 20 bp, Artificial
  CRISPR gRNA sequence
tttactagtttggccactcc

SEQ ID NO: 795161 - DNA, 20 bp, Artificial
  CRISPR gRNA sequence
ccagatactgttatctaccc

SEQ ID NO: 795162 - DNA, 20 bp, Artificial
  CRISPR gRNA sequence
ctgttatctacccggaagct

SEQ ID NO: 795163 - DNA, 20 bp, Artificial
  CRISPR gRNA sequence
tatctacccggaagcttcct

SEQ ID NO: 795164 - DNA, 20 bp, Artificial
  CRISPR gRNA sequence
agttgaaattatatgcaatt

SEQ ID NO: 795165 - DNA, 20 bp, Artificial
  CRISPR gRNA sequence
tctgaataatttaactccct

SEQ ID NO: 795166 - DNA, 20 bp, Artificial
  CRISPR gRNA sequence
ataatttaactccctttagg

SEQ ID NO: 795167 - DNA, 20 bp, Artificial
  CRISPR gRNA sequence
ggtaaactctgagtggaaac

SEQ ID NO: 795168 - DNA, 20 bp, Artificial
  CRISPR gRNA sequence
tagtcaaacatctgactggc

SEQ ID NO: 795169 - DNA, 20 bp, Artificial
  CRISPR gRNA sequence
ctaacatatgtcctgaagtg

SEQ ID NO: 795170 - DNA, 20 bp, Artificial
  CRISPR gRNA sequence
cctgaagtgaactgcttgga

SEQ ID NO: 795171 - DNA, 20 bp, Artificial
  CRISPR gRNA sequence
tatataaccataatgacaaa

SEQ ID NO: 795172 - DNA, 20 bp, Artificial
  CRISPR gRNA sequence
tgacaaaacaggtttcacgg

SEQ ID NO: 795173 - DNA, 20 bp, Artificial
  CRISPR gRNA sequence
gaaaatagaaagcatctaca

SEQ ID NO: 795174 - DNA, 20 bp, Artificial
  CRISPR gRNA sequence
gtggtggttagaaatacctg

SEQ ID NO: 795175 - DNA, 20 bp, Artificial
  CRISPR gRNA sequence
ttaacctttttgtgcctcat

SEQ ID NO: 795176 - DNA, 20 bp, Artificial
  CRISPR gRNA sequence
agaatattattacctacctt

SEQ ID NO: 795177 - DNA, 20 bp, Artificial
  CRISPR gRNA sequence
tgatacctggcacaaaaata

SEQ ID NO: 795178 - DNA, 20 bp, Artificial
  CRISPR gRNA sequence
aaaatatatggattaatcaa

SEQ ID NO: 795179 - DNA, 20 bp, Artificial
  CRISPR gRNA sequence
cagatgacctggaatgactg

SEQ ID NO: 795180 - DNA, 20 bp, Artificial
  CRISPR gRNA sequence
gcagtcagctgcacaggagg

SEQ ID NO: 795181 - DNA, 20 bp, Artificial
  CRISPR gRNA sequence
atggatggggcaaaggagaa

SEQ ID NO: 795182 - DNA, 20 bp, Artificial
  CRISPR gRNA sequence
aggcagacaatgacaaaata

SEQ ID NO: 795183 - DNA, 20 bp, Artificial
  CRISPR gRNA sequence
acaaaatatcttgttttctt

SEQ ID NO: 795184 - DNA, 20 bp, Artificial
  CRISPR gRNA sequence
tgaaccttggagcaataaca

SEQ ID NO: 795185 - DNA, 20 bp, Artificial
  CRISPR gRNA sequence
agctcaagcaaaaacaagca

SEQ ID NO: 795186 - DNA, 20 bp, Artificial
  CRISPR gRNA sequence
aatgtgggagggtatgaaaa

SEQ ID NO: 795187 - DNA, 20 bp, Artificial
  CRISPR gRNA sequence
tctcccatggaacatccctg

SEQ ID NO: 795188 - DNA, 20 bp, Artificial
  CRISPR gRNA sequence
ttattaagatactctttttc

SEQ ID NO: 795189 - DNA, 20 bp, Artificial
  CRISPR gRNA sequence
aatagtttataccctgaatc

SEQ ID NO: 795190 - DNA, 20 bp, Artificial
  CRISPR gRNA sequence
gaatccagagtttttaaaac

SEQ ID NO: 795191 - DNA, 20 bp, Artificial
  CRISPR gRNA sequence
accatggtttgccgcccatt

SEQ ID NO: 795192 - DNA, 20 bp, Artificial
  CRISPR gRNA sequence
ttagtgagtagcaaccagat

SEQ ID NO: 795193 - DNA, 20 bp, Artificial
  CRISPR gRNA sequence
actttggatcataaaaagtt

SEQ ID NO: 795194 - DNA, 20 bp, Artificial
  CRISPR gRNA sequence
tctatagctgtccctattcc

SEQ ID NO: 795195 - DNA, 20 bp, Artificial
  CRISPR gRNA sequence
tataaagagaatcttcacac

SEQ ID NO: 795196 - DNA, 20 bp, Artificial
  CRISPR gRNA sequence
actcttgtttgttctagaaa

SEQ ID NO: 795197 - DNA, 20 bp, Artificial
  CRISPR gRNA sequence
gacatataacaactataaaa

SEQ ID NO: 795198 - DNA, 20 bp, Artificial
  CRISPR gRNA sequence
taacaactataaaaaataga

SEQ ID NO: 795199 - DNA, 20 bp, Artificial
  CRISPR gRNA sequence
aaaatagattttgcttgttc

SEQ ID NO: 795200 - DNA, 20 bp, Artificial
  CRISPR gRNA sequence
tgttcattggcttatggtct

SEQ ID NO: 795201 - DNA, 20 bp, Artificial
  CRISPR gRNA sequence
atggtctgtactgtcttcta

SEQ ID NO: 795202 - DNA, 20 bp, Artificial
  CRISPR gRNA sequence
tactgtcttctagagggttt

SEQ ID NO: 795203 - DNA, 20 bp, Artificial
  CRISPR gRNA sequence
ttgcctttcataacctcaca

SEQ ID NO: 795204 - DNA, 20 bp, Artificial
  CRISPR gRNA sequence
acaatagtagtaccaaacac

SEQ ID NO: 795205 - DNA, 20 bp, Artificial
  CRISPR gRNA sequence
aaagccattagcctagatgt

SEQ ID NO: 795206 - DNA, 20 bp, Artificial
  CRISPR gRNA sequence
tgggaggaactctagaacac

SEQ ID NO: 795207 - DNA, 20 bp, Artificial
  CRISPR gRNA sequence
ctgcaaccctaaatcaccac

SEQ ID NO: 795208 - DNA, 20 bp, Artificial
  CRISPR gRNA sequence
tgcctactccttacctagat

SEQ ID NO: 795209 - DNA, 20 bp, Artificial
  CRISPR gRNA sequence
tcagggatttctcagttgtg

SEQ ID NO: 795210 - DNA, 20 bp, Artificial
  CRISPR gRNA sequence
ggtcatcaaactgggatatt

SEQ ID NO: 795211 - DNA, 20 bp, Artificial
  CRISPR gRNA sequence
tcaagggatgtatgggcaca

SEQ ID NO: 795212 - DNA, 20 bp, Artificial
  CRISPR gRNA sequence
ctctatagtgttaaataaaa

SEQ ID NO: 795213 - DNA, 20 bp, Artificial
  CRISPR gRNA sequence
aaataatgtggtatctaatt

SEQ ID NO: 795214 - DNA, 20 bp, Artificial
  CRISPR gRNA sequence
aaatggcattgctgtaacga

SEQ ID NO: 795215 - DNA, 20 bp, Artificial
  CRISPR gRNA sequence
aacgaaactgcttccattcc

SEQ ID NO: 795216 - DNA, 20 bp, Artificial
  CRISPR gRNA sequence
ccattgatttactcatacga

SEQ ID NO: 795217 - DNA, 20 bp, Artificial
  CRISPR gRNA sequence
ccaaccatgtcatatggttc

SEQ ID NO: 795218 - DNA, 20 bp, Artificial
  CRISPR gRNA sequence
tcccaataaattttcatctt

SEQ ID NO: 795219 - DNA, 20 bp, Artificial
  CRISPR gRNA sequence
taaatgtccaacaacgatag

SEQ ID NO: 795220 - DNA, 20 bp, Artificial
  CRISPR gRNA sequence
atagcattaggagatatacc

SEQ ID NO: 795221 - DNA, 20 bp, Artificial
  CRISPR gRNA sequence
tgcagaacaccctgaacatt

SEQ ID NO: 795222 - DNA, 20 bp, Artificial
  CRISPR gRNA sequence
aagcttcatagtcacaagag

SEQ ID NO: 795223 - DNA, 20 bp, Artificial
  CRISPR gRNA sequence
tagggaaggtgaaattggaa

SEQ ID NO: 795224 - DNA, 20 bp, Artificial
  CRISPR gRNA sequence
tttttacttagaaggaattg

SEQ ID NO: 795225 - DNA, 20 bp, Artificial
  CRISPR gRNA sequence
taacacaggaaattattcca

SEQ ID NO: 795226 - DNA, 20 bp, Artificial
  CRISPR gRNA sequence
agcatgtttcatacatattc

SEQ ID NO: 795227 - DNA, 20 bp, Artificial
  CRISPR gRNA sequence
atacatattcttttgtttgt

SEQ ID NO: 795228 - DNA, 20 bp, Artificial
  CRISPR gRNA sequence
agcttatttaaaatatgtaa

SEQ ID NO: 795229 - DNA, 20 bp, Artificial
  CRISPR gRNA sequence
aatggcgttaagccgggagg

SEQ ID NO: 795230 - DNA, 20 bp, Artificial
  CRISPR gRNA sequence
aaaaaaaagaaattgacaca

SEQ ID NO: 795231 - DNA, 20 bp, Artificial
  CRISPR gRNA sequence
acattaagtttattgtgaaa

SEQ ID NO: 795232 - DNA, 20 bp, Artificial
  CRISPR gRNA sequence
cttatttatgggatacatag

SEQ ID NO: 795233 - DNA, 20 bp, Artificial
  CRISPR gRNA sequence
tacatatgtaagagtaaaat

SEQ ID NO: 795234 - DNA, 20 bp, Artificial
  CRISPR gRNA sequence
ttcataagatgctgaacatt

SEQ ID NO: 795235 - DNA, 20 bp, Artificial
  CRISPR gRNA sequence
gaagtaggactagaagaagg

SEQ ID NO: 795236 - DNA, 20 bp, Artificial
  CRISPR gRNA sequence
aaagtgcctgatccatggca

SEQ ID NO: 795237 - DNA, 20 bp, Artificial
  CRISPR gRNA sequence
ccatggcataaagcttgaaa

SEQ ID NO: 795238 - DNA, 20 bp, Artificial
  CRISPR gRNA sequence
ggcataaagcttgaaaatgg

SEQ ID NO: 795239 - DNA, 20 bp, Artificial
  CRISPR gRNA sequence
aaattatgaggtggaatgac

SEQ ID NO: 795240 - DNA, 20 bp, Artificial
  CRISPR gRNA sequence
aagagacagtgataaaggac

SEQ ID NO: 795241 - DNA, 20 bp, Artificial
  CRISPR gRNA sequence
ggttgagaactggtctgtgc

SEQ ID NO: 795242 - DNA, 20 bp, Artificial
  CRISPR gRNA sequence
tactcatatcacagaaatac

SEQ ID NO: 795243 - DNA, 20 bp, Artificial
  CRISPR gRNA sequence
attcctggaaatatacaacc

SEQ ID NO: 795244 - DNA, 20 bp, Artificial
  CRISPR gRNA sequence
aaacagatcaataacaagca

SEQ ID NO: 795245 - DNA, 20 bp, Artificial
  CRISPR gRNA sequence
caaaaaaaaatccaggacca

SEQ ID NO: 795246 - DNA, 20 bp, Artificial
  CRISPR gRNA sequence
agataatccaccatgatcaa

SEQ ID NO: 795247 - DNA, 20 bp, Artificial
  CRISPR gRNA sequence
ttttacaccagggatgcagg

SEQ ID NO: 795248 - DNA, 20 bp, Artificial
  CRISPR gRNA sequence
aaaaatcacatgatcatctc

SEQ ID NO: 795249 - DNA, 20 bp, Artificial
  CRISPR gRNA sequence
ttgacaaaatctaacatcct

SEQ ID NO: 795250 - DNA, 20 bp, Artificial
  CRISPR gRNA sequence
taaagaggaagtcaaactgt

SEQ ID NO: 795251 - DNA, 20 bp, Artificial
  CRISPR gRNA sequence
atcatatacctagaaaaccc

SEQ ID NO: 795252 - DNA, 20 bp, Artificial
  CRISPR gRNA sequence
gaactggtaaacaaattcag

SEQ ID NO: 795253 - DNA, 20 bp, Artificial
  CRISPR gRNA sequence
ttgtgaaaatgaccatactt

SEQ ID NO: 795254 - DNA, 20 bp, Artificial
  CRISPR gRNA sequence
aaatctaagacctgaaacca

SEQ ID NO: 795255 - DNA, 20 bp, Artificial
  CRISPR gRNA sequence
tcgaaaaagcccttctagac

SEQ ID NO: 795256 - DNA, 20 bp, Artificial
  CRISPR gRNA sequence
atagggacttaattaaacta

SEQ ID NO: 795257 - DNA, 20 bp, Artificial
  CRISPR gRNA sequence
aaccactatggaaaacagtg

SEQ ID NO: 795258 - DNA, 20 bp, Artificial
  CRISPR gRNA sequence
agaatggcaggaacctggga

SEQ ID NO: 795259 - DNA, 20 bp, Artificial
  CRISPR gRNA sequence
gcagcagtgaaaagacaact

SEQ ID NO: 795260 - DNA, 20 bp, Artificial
  CRISPR gRNA sequence
ggaagcctaggagtaaaata

SEQ ID NO: 795261 - DNA, 20 bp, Artificial
  CRISPR gRNA sequence
tgggggggaggggaagctcc

SEQ ID NO: 795262 - DNA, 20 bp, Artificial
  CRISPR gRNA sequence
gatgaattgaaagcagtcct

SEQ ID NO: 795263 - DNA, 20 bp, Artificial
  CRISPR gRNA sequence
aaagcagtcctaaaagattt

SEQ ID NO: 795264 - DNA, 20 bp, Artificial
  CRISPR gRNA sequence
ctttatttcagaaattacag

SEQ ID NO: 795265 - DNA, 20 bp, Artificial
  CRISPR gRNA sequence
aaggcagggttaatggagcc

SEQ ID NO: 795266 - DNA, 20 bp, Artificial
  CRISPR gRNA sequence
tccaccctctagtgttcctg

SEQ ID NO: 795267 - DNA, 20 bp, Artificial
  CRISPR gRNA sequence
attaaaaccctggatatttg

SEQ ID NO: 795268 - DNA, 20 bp, Artificial
  CRISPR gRNA sequence
tgcttagataatatctagaa

SEQ ID NO: 795269 - DNA, 20 bp, Artificial
  CRISPR gRNA sequence
gatatagttaaaggaggtag

SEQ ID NO: 795270 - DNA, 20 bp, Artificial
  CRISPR gRNA sequence
aataattgctaacactaatt

SEQ ID NO: 795271 - DNA, 20 bp, Artificial
  CRISPR gRNA sequence
atttcctaaacaagaaaact

SEQ ID NO: 795272 - DNA, 20 bp, Artificial
  CRISPR gRNA sequence
gctaaagcctactcaaactg

SEQ ID NO: 795273 - DNA, 20 bp, Artificial
  CRISPR gRNA sequence
aaactgctcagattctgaac

SEQ ID NO: 795274 - DNA, 20 bp, Artificial
  CRISPR gRNA sequence
tgaactcatgtttttaacta

SEQ ID NO: 795275 - DNA, 20 bp, Artificial
  CRISPR gRNA sequence
gaagctacaaagaggcacaa

SEQ ID NO: 795276 - DNA, 20 bp, Artificial
  CRISPR gRNA sequence
atgaagaaaatctttccaat

SEQ ID NO: 795277 - DNA, 20 bp, Artificial
  CRISPR gRNA sequence
atctttccaatggaagttta

SEQ ID NO: 795278 - DNA, 20 bp, Artificial
  CRISPR gRNA sequence
tattgtataatcatggcaaa

SEQ ID NO: 795279 - DNA, 20 bp, Artificial
  CRISPR gRNA sequence
agactgcttctagaggaagt

SEQ ID NO: 795280 - DNA, 20 bp, Artificial
  CRISPR gRNA sequence
aagtaggagtttccattcat

SEQ ID NO: 795281 - DNA, 20 bp, Artificial
  CRISPR gRNA sequence
ttttcaggcaaaagttattt

SEQ ID NO: 795282 - DNA, 20 bp, Artificial
  CRISPR gRNA sequence
aatgtgtgtccatttaacag

SEQ ID NO: 795283 - DNA, 20 bp, Artificial
  CRISPR gRNA sequence
agtcaaatccacaattacat

SEQ ID NO: 795284 - DNA, 20 bp, Artificial
  CRISPR gRNA sequence
cccagcaactacagaacaca

SEQ ID NO: 795285 - DNA, 20 bp, Artificial
  CRISPR gRNA sequence
tctaggagaattgctgtaga

SEQ ID NO: 795286 - DNA, 20 bp, Artificial
  CRISPR gRNA sequence
cctaagaatatcaccctcag

SEQ ID NO: 795287 - DNA, 20 bp, Artificial
  CRISPR gRNA sequence
tccagcttccccactgtggg

SEQ ID NO: 795288 - DNA, 20 bp, Artificial
  CRISPR gRNA sequence
cctgtcccttccccaaacct

SEQ ID NO: 795289 - DNA, 20 bp, Artificial
  CRISPR gRNA sequence
ttctcaaccaggacaccaag

SEQ ID NO: 795290 - DNA, 20 bp, Artificial
  CRISPR gRNA sequence
cttcattccccaaaagactt

SEQ ID NO: 795291 - DNA, 20 bp, Artificial
  CRISPR gRNA sequence
atctacagtatgatcatata

SEQ ID NO: 795292 - DNA, 20 bp, Artificial
  CRISPR gRNA sequence
ctcgaaatacacacttcggg

SEQ ID NO: 795293 - DNA, 20 bp, Artificial
  CRISPR gRNA sequence
aaatacacacttcgggtact

SEQ ID NO: 795294 - DNA, 20 bp, Artificial
  CRISPR gRNA sequence
tttgattatgaaagataggc

SEQ ID NO: 795295 - DNA, 20 bp, Artificial
  CRISPR gRNA sequence
tatgaaagataggccaaagt

SEQ ID NO: 795296 - DNA, 20 bp, Artificial
  CRISPR gRNA sequence
aggccaaagttttggcttca

SEQ ID NO: 795297 - DNA, 20 bp, Artificial
  CRISPR gRNA sequence
acaggtcaagtccttcagta

SEQ ID NO: 795298 - DNA, 20 bp, Artificial
  CRISPR gRNA sequence
acctcagagcatattcctct

SEQ ID NO: 795299 - DNA, 20 bp, Artificial
  CRISPR gRNA sequence
cacagagacacatcctctta

SEQ ID NO: 795300 - DNA, 20 bp, Artificial
  CRISPR gRNA sequence
tacattagggggaaagatgt

SEQ ID NO: 795301 - DNA, 20 bp, Artificial
  CRISPR gRNA sequence
aagtgcacgcaggttctggt

SEQ ID NO: 795302 - DNA, 20 bp, Artificial
  CRISPR gRNA sequence
gtgaacccagatctagtggg

SEQ ID NO: 795303 - DNA, 20 bp, Artificial
  CRISPR gRNA sequence
taagtaaatcatacacatca

SEQ ID NO: 795304 - DNA, 20 bp, Artificial
  CRISPR gRNA sequence
ttaccattattttaatgtga

SEQ ID NO: 795305 - DNA, 20 bp, Artificial
  CRISPR gRNA sequence
taatgtgaaattgtttttca

SEQ ID NO: 795306 - DNA, 20 bp, Artificial
  CRISPR gRNA sequence
taactgcatatggtattgat

SEQ ID NO: 795307 - DNA, 20 bp, Artificial
  CRISPR gRNA sequence
gctattatctaagaccactg

SEQ ID NO: 795308 - DNA, 20 bp, Artificial
  CRISPR gRNA sequence
atgcctattttacttatttt

SEQ ID NO: 795309 - DNA, 20 bp, Artificial
  CRISPR gRNA sequence
ttaaagtttttataaggttg

SEQ ID NO: 795310 - DNA, 20 bp, Artificial
  CRISPR gRNA sequence
tatatttatggggtacaata

SEQ ID NO: 795311 - DNA, 20 bp, Artificial
  CRISPR gRNA sequence
atatgatgttttgatctatg

SEQ ID NO: 795312 - DNA, 20 bp, Artificial
  CRISPR gRNA sequence
tcaggaagctgaggcaggag

SEQ ID NO: 795313 - DNA, 20 bp, Artificial
  CRISPR gRNA sequence
gttaacatatcacatcacca

SEQ ID NO: 795314 - DNA, 20 bp, Artificial
  CRISPR gRNA sequence
aaacagagaatgtaaaaaat

SEQ ID NO: 795315 - DNA, 20 bp, Artificial
  CRISPR gRNA sequence
ctctgataaccacctttcta

SEQ ID NO: 795316 - DNA, 20 bp, Artificial
  CRISPR gRNA sequence
gtttctatgggatctacttt

SEQ ID NO: 795317 - DNA, 20 bp, Artificial
  CRISPR gRNA sequence
acattatctgtctttttgtg

SEQ ID NO: 795318 - DNA, 20 bp, Artificial
  CRISPR gRNA sequence
ccatccatgttgtcatgaat

SEQ ID NO: 795319 - DNA, 20 bp, Artificial
  CRISPR gRNA sequence
tcattctctgttgatggaca

SEQ ID NO: 795320 - DNA, 20 bp, Artificial
  CRISPR gRNA sequence
gatcatgtggtcattctatt

SEQ ID NO: 795321 - DNA, 20 bp, Artificial
  CRISPR gRNA sequence
caaaatgactatacttagat

SEQ ID NO: 795322 - DNA, 20 bp, Artificial
  CRISPR gRNA sequence
ttcttgaggcagggagccat

SEQ ID NO: 795323 - DNA, 20 bp, Artificial
  CRISPR gRNA sequence
caggtgtgtgtatgaactgt

SEQ ID NO: 795324 - DNA, 20 bp, Artificial
  CRISPR gRNA sequence
aaaagtaaatttttgcctga

SEQ ID NO: 795325 - DNA, 20 bp, Artificial
  CRISPR gRNA sequence
aagtgagatagtgggtaatc

SEQ ID NO: 795326 - DNA, 20 bp, Artificial
  CRISPR gRNA sequence
agaaagaagccacaaattgt

SEQ ID NO: 795327 - DNA, 20 bp, Artificial
  CRISPR gRNA sequence
catgatatcagggatataca

SEQ ID NO: 795328 - DNA, 20 bp, Artificial
  CRISPR gRNA sequence
tttctttttcttctctattg

SEQ ID NO: 795329 - DNA, 20 bp, Artificial
  CRISPR gRNA sequence
aagaaacagatggcatactc

SEQ ID NO: 795330 - DNA, 20 bp, Artificial
  CRISPR gRNA sequence
tgaggagagtgtaataaagg

SEQ ID NO: 795331 - DNA, 20 bp, Artificial
  CRISPR gRNA sequence
caaaggatagtgcagaacac

SEQ ID NO: 795332 - DNA, 20 bp, Artificial
  CRISPR gRNA sequence
tctagtacaatagctaatca

SEQ ID NO: 795333 - DNA, 20 bp, Artificial
  CRISPR gRNA sequence
ttgctgccagtcagctggtt

SEQ ID NO: 795334 - DNA, 20 bp, Artificial
  CRISPR gRNA sequence
gtaatttcatcaccgagtgc

SEQ ID NO: 795335 - DNA, 20 bp, Artificial
  CRISPR gRNA sequence
tgctcttatatcaaattacc

SEQ ID NO: 795336 - DNA, 20 bp, Artificial
  CRISPR gRNA sequence
tatcaaattaccacaagctt

SEQ ID NO: 795337 - DNA, 20 bp, Artificial
  CRISPR gRNA sequence
agcttcacagtttaagacaa

SEQ ID NO: 795338 - DNA, 20 bp, Artificial
  CRISPR gRNA sequence
tggaggtcagaaagccagac

SEQ ID NO: 795339 - DNA, 20 bp, Artificial
  CRISPR gRNA sequence
gggctcaaatcaaggtgtca

SEQ ID NO: 795340 - DNA, 20 bp, Artificial
  CRISPR gRNA sequence
aggattgcagaggccctaag

SEQ ID NO: 795341 - DNA, 20 bp, Artificial
  CRISPR gRNA sequence
agcaaccctatcattcagcc

SEQ ID NO: 795342 - DNA, 20 bp, Artificial
  CRISPR gRNA sequence
tgtctcagcctcctgagtag

SEQ ID NO: 795343 - DNA, 20 bp, Artificial
  CRISPR gRNA sequence
tttttgtatttttagtagag

SEQ ID NO: 795344 - DNA, 20 bp, Artificial
  CRISPR gRNA sequence
cgcctcagcctcccaaattg

SEQ ID NO: 795345 - DNA, 20 bp, Artificial
  CRISPR gRNA sequence
cagccacatctctttcccta

SEQ ID NO: 795346 - DNA, 20 bp, Artificial
  CRISPR gRNA sequence
cacatctctttccctaacta

SEQ ID NO: 795347 - DNA, 20 bp, Artificial
  CRISPR gRNA sequence
ttgccacctcttaaggaccc

SEQ ID NO: 795348 - DNA, 20 bp, Artificial
  CRISPR gRNA sequence
ggtgacatattcacatgttc

SEQ ID NO: 795349 - DNA, 20 bp, Artificial
  CRISPR gRNA sequence
gactaaaggacagtccctag

SEQ ID NO: 795350 - DNA, 20 bp, Artificial
  CRISPR gRNA sequence
agtccctagtactgattcaa

SEQ ID NO: 795351 - DNA, 20 bp, Artificial
  CRISPR gRNA sequence
actatattgtcattgtattt

SEQ ID NO: 795352 - DNA, 20 bp, Artificial
  CRISPR gRNA sequence
caaccccagagggcagaagc

SEQ ID NO: 795353 - DNA, 20 bp, Artificial
  CRISPR gRNA sequence
agggcagaagcaagagattt

SEQ ID NO: 795354 - DNA, 20 bp, Artificial
  CRISPR gRNA sequence
tcaggtggaaggacttgttc

SEQ ID NO: 795355 - DNA, 20 bp, Artificial
  CRISPR gRNA sequence
tagacatgcatgtgggctga

SEQ ID NO: 795356 - DNA, 20 bp, Artificial
  CRISPR gRNA sequence
gaggcagccacaatctctgc

SEQ ID NO: 795357 - DNA, 20 bp, Artificial
  CRISPR gRNA sequence
ctgcagaagatttaatatac

SEQ ID NO: 795358 - DNA, 20 bp, Artificial
  CRISPR gRNA sequence
ctcactcatccaccatacat

SEQ ID NO: 795359 - DNA, 20 bp, Artificial
  CRISPR gRNA sequence
tcacctaacaccccagatgg

SEQ ID NO: 795360 - DNA, 20 bp, Artificial
  CRISPR gRNA sequence
acttaacgaccctaagagat

SEQ ID NO: 795361 - DNA, 20 bp, Artificial
  CRISPR gRNA sequence
tctccattatgtagcagtgt

SEQ ID NO: 795362 - DNA, 20 bp, Artificial
  CRISPR gRNA sequence
gttcaagattttcatgataa

SEQ ID NO: 795363 - DNA, 20 bp, Artificial
  CRISPR gRNA sequence
aagattttcatgataatcaa

SEQ ID NO: 795364 - DNA, 20 bp, Artificial
  CRISPR gRNA sequence
caaggtggccaggccagtag

SEQ ID NO: 795365 - DNA, 20 bp, Artificial
  CRISPR gRNA sequence
ttccccgtaggaagccagac

SEQ ID NO: 795366 - DNA, 20 bp, Artificial
  CRISPR gRNA sequence
agccctggtacagacgtaga

SEQ ID NO: 795367 - DNA, 20 bp, Artificial
  CRISPR gRNA sequence
gttgaggcatcagagatatc

SEQ ID NO: 795368 - DNA, 20 bp, Artificial
  CRISPR gRNA sequence
tggaaaaaattcttccctga

SEQ ID NO: 795369 - DNA, 20 bp, Artificial
  CRISPR gRNA sequence
aacttccttctaactaaatt

SEQ ID NO: 795370 - DNA, 20 bp, Artificial
  CRISPR gRNA sequence
caggaggatcacttgagccc

SEQ ID NO: 795371 - DNA, 20 bp, Artificial
  CRISPR gRNA sequence
actaaagctaaagcctctaa

SEQ ID NO: 795372 - DNA, 20 bp, Artificial
  CRISPR gRNA sequence
cgagaacttttttcccctgg

SEQ ID NO: 795373 - DNA, 20 bp, Artificial
  CRISPR gRNA sequence
ggccagtactttggatgaat

SEQ ID NO: 795374 - DNA, 20 bp, Artificial
  CRISPR gRNA sequence
tgaattgtagttttctagaa

SEQ ID NO: 795375 - DNA, 20 bp, Artificial
  CRISPR gRNA sequence
attgagaaataactttacac

SEQ ID NO: 795376 - DNA, 20 bp, Artificial
  CRISPR gRNA sequence
actctcttcatggaagccaa

SEQ ID NO: 795377 - DNA, 20 bp, Artificial
  CRISPR gRNA sequence
gtgcagccagaaattctcaa

SEQ ID NO: 795378 - DNA, 20 bp, Artificial
  CRISPR gRNA sequence
tcccaactttgtattcgtcc

SEQ ID NO: 795379 - DNA, 20 bp, Artificial
  CRISPR gRNA sequence
actgtttactgacatggatc

SEQ ID NO: 795380 - DNA, 20 bp, Artificial
  CRISPR gRNA sequence
tacctccatgccttctttgc

SEQ ID NO: 795381 - DNA, 20 bp, Artificial
  CRISPR gRNA sequence
tgagacctactacctggacc

SEQ ID NO: 795382 - DNA, 20 bp, Artificial
  CRISPR gRNA sequence
accatttgtttgccttgtaa

SEQ ID NO: 795383 - DNA, 20 bp, Artificial
  CRISPR gRNA sequence
taagtgctcaacaaatgttg

SEQ ID NO: 795384 - DNA, 20 bp, Artificial
  CRISPR gRNA sequence
aaatgttgggttgattgggt

SEQ ID NO: 795385 - DNA, 20 bp, Artificial
  CRISPR gRNA sequence
tcagagcagccaaatgatat

SEQ ID NO: 795386 - DNA, 20 bp, Artificial
  CRISPR gRNA sequence
cacacatctgcctctgagtt

SEQ ID NO: 795387 - DNA, 20 bp, Artificial
  CRISPR gRNA sequence
gctgtggactgctgtgaccc

SEQ ID NO: 795388 - DNA, 20 bp, Artificial
  CRISPR gRNA sequence
agatcattttccttttgaaa

SEQ ID NO: 795389 - DNA, 20 bp, Artificial
  CRISPR gRNA sequence
atccttcctaggagacctgg

SEQ ID NO: 795390 - DNA, 20 bp, Artificial
  CRISPR gRNA sequence
agcatgggctctgatgtcag

SEQ ID NO: 795391 - DNA, 20 bp, Artificial
  CRISPR gRNA sequence
aaatttcaaactctctctct

SEQ ID NO: 795392 - DNA, 20 bp, Artificial
  CRISPR gRNA sequence
catgagggtgagtagtggta

SEQ ID NO: 795393 - DNA, 20 bp, Artificial
  CRISPR gRNA sequence
gacagtttatagggttatag

SEQ ID NO: 795394 - DNA, 20 bp, Artificial
  CRISPR gRNA sequence
tatagtgaggattaaatgaa

SEQ ID NO: 795395 - DNA, 20 bp, Artificial
  CRISPR gRNA sequence
ttaaatgaaatgtgcttata

SEQ ID NO: 795396 - DNA, 20 bp, Artificial
  CRISPR gRNA sequence
cactttgggaggctgagatg

SEQ ID NO: 795397 - DNA, 20 bp, Artificial
  CRISPR gRNA sequence
ttgggaggctgagatgggtg

SEQ ID NO: 795398 - DNA, 20 bp, Artificial
  CRISPR gRNA sequence
tccatagagtcattcagtga

SEQ ID NO: 795399 - DNA, 20 bp, Artificial
  CRISPR gRNA sequence
aagctcagtcagtgccaaac

SEQ ID NO: 795400 - DNA, 20 bp, Artificial
  CRISPR gRNA sequence
cgagtggtggaaaacacatt

SEQ ID NO: 795401 - DNA, 20 bp, Artificial
  CRISPR gRNA sequence
actcactctcttagcctgaa

SEQ ID NO: 795402 - DNA, 20 bp, Artificial
  CRISPR gRNA sequence
tgggcccacttaactatagg

SEQ ID NO: 795403 - DNA, 20 bp, Artificial
  CRISPR gRNA sequence
atactaaagttgaaagaaag

SEQ ID NO: 795404 - DNA, 20 bp, Artificial
  CRISPR gRNA sequence
attggcacttttcatgtagc

SEQ ID NO: 795405 - DNA, 20 bp, Artificial
  CRISPR gRNA sequence
ctatctagagaggactcaga

SEQ ID NO: 795406 - DNA, 20 bp, Artificial
  CRISPR gRNA sequence
ctccaaatacagtctaagca

SEQ ID NO: 795407 - DNA, 20 bp, Artificial
  CRISPR gRNA sequence
ttggagtcttcagggatgag

SEQ ID NO: 795408 - DNA, 20 bp, Artificial
  CRISPR gRNA sequence
tgagggaacctgcacaggac

SEQ ID NO: 795409 - DNA, 20 bp, Artificial
  CRISPR gRNA sequence
ccaggtctccttgactcaca

SEQ ID NO: 795410 - DNA, 20 bp, Artificial
  CRISPR gRNA sequence
gcacttactagaaattaaga

SEQ ID NO: 795411 - DNA, 20 bp, Artificial
  CRISPR gRNA sequence
tataatcaatatgggttatc

SEQ ID NO: 795412 - DNA, 20 bp, Artificial
  CRISPR gRNA sequence
gagacaaatatctgtggggg

SEQ ID NO: 795413 - DNA, 20 bp, Artificial
  CRISPR gRNA sequence
gagctttgggtcagatagat

SEQ ID NO: 795414 - DNA, 20 bp, Artificial
  CRISPR gRNA sequence
acttagcagtgatgacctca

SEQ ID NO: 795415 - DNA, 20 bp, Artificial
  CRISPR gRNA sequence
tagcactgtgctggaggtag

SEQ ID NO: 795416 - DNA, 20 bp, Artificial
  CRISPR gRNA sequence
ggactgagcccttcccgctg

SEQ ID NO: 795417 - DNA, 20 bp, Artificial
  CRISPR gRNA sequence
cttcccgctgagcagtttcg

SEQ ID NO: 795418 - DNA, 20 bp, Artificial
  CRISPR gRNA sequence
gtttttcctgtaccagcctg

SEQ ID NO: 795419 - DNA, 20 bp, Artificial
  CRISPR gRNA sequence
aatgactccagaggcaaaat

SEQ ID NO: 795420 - DNA, 20 bp, Artificial
  CRISPR gRNA sequence
gtacacaccagaggacttta

SEQ ID NO: 795421 - DNA, 20 bp, Artificial
  CRISPR gRNA sequence
tcacactaaggcatgagtga

SEQ ID NO: 795422 - DNA, 20 bp, Artificial
  CRISPR gRNA sequence
tgaaatttaacaactaatgg

SEQ ID NO: 795423 - DNA, 20 bp, Artificial
  CRISPR gRNA sequence
aaaagagaaaaaagaaagaa

SEQ ID NO: 795424 - DNA, 20 bp, Artificial
  CRISPR gRNA sequence
agatgattagatgatagatg

SEQ ID NO: 795425 - DNA, 20 bp, Artificial
  CRISPR gRNA sequence
cacttactatgtaacttagg

SEQ ID NO: 795426 - DNA, 20 bp, Artificial
  CRISPR gRNA sequence
tacctcttagttgccatgta

SEQ ID NO: 795427 - DNA, 20 bp, Artificial
  CRISPR gRNA sequence
gttgccatgtaacaggattc

SEQ ID NO: 795428 - DNA, 20 bp, Artificial
  CRISPR gRNA sequence
acccaggacccatccaactt

SEQ ID NO: 795429 - DNA, 20 bp, Artificial
  CRISPR gRNA sequence
attttcatccccttctgcat

SEQ ID NO: 795430 - DNA, 20 bp, Artificial
  CRISPR gRNA sequence
ctgtattcttcaaaaggtaa

SEQ ID NO: 795431 - DNA, 20 bp, Artificial
  CRISPR gRNA sequence
tgggtgtctgcagcatgagc

SEQ ID NO: 795432 - DNA, 20 bp, Artificial
  CRISPR gRNA sequence
actgctttgcactgcaggcc

SEQ ID NO: 795433 - DNA, 20 bp, Artificial
  CRISPR gRNA sequence
tgcactgcaggcctatggct

SEQ ID NO: 795434 - DNA, 20 bp, Artificial
  CRISPR gRNA sequence
gctttcatgctaaacccact

SEQ ID NO: 795435 - DNA, 20 bp, Artificial
  CRISPR gRNA sequence
ctcagagcttatgaaccact

SEQ ID NO: 795436 - DNA, 20 bp, Artificial
  CRISPR gRNA sequence
gaaccactttgagcttgtct

SEQ ID NO: 795437 - DNA, 20 bp, Artificial
  CRISPR gRNA sequence
agtgagctgaacttcttaca

SEQ ID NO: 795438 - DNA, 20 bp, Artificial
  CRISPR gRNA sequence
tacactgagttttttaaagg

SEQ ID NO: 795439 - DNA, 20 bp, Artificial
  CRISPR gRNA sequence
tgttttgttcttatgtctga

SEQ ID NO: 795440 - DNA, 20 bp, Artificial
  CRISPR gRNA sequence
tttgtcttattctttgagcc

SEQ ID NO: 795441 - DNA, 20 bp, Artificial
  CRISPR gRNA sequence
gcaatgcagagagctacgtg

SEQ ID NO: 795442 - DNA, 20 bp, Artificial
  CRISPR gRNA sequence
gaggttgccaggatcctttc

SEQ ID NO: 795443 - DNA, 20 bp, Artificial
  CRISPR gRNA sequence
cggttgggtaaggaaaggag

SEQ ID NO: 795444 - DNA, 20 bp, Artificial
  CRISPR gRNA sequence
acgtctttcagcagctccct

SEQ ID NO: 795445 - DNA, 20 bp, Artificial
  CRISPR gRNA sequence
agcatgctgaagcctttcag

SEQ ID NO: 795446 - DNA, 20 bp, Artificial
  CRISPR gRNA sequence
aagcctttcagccctgattt

SEQ ID NO: 795447 - DNA, 20 bp, Artificial
  CRISPR gRNA sequence
tcattgttcatgtgtctgtc

SEQ ID NO: 795448 - DNA, 20 bp, Artificial
  CRISPR gRNA sequence
agaatgtatgcaggcctagc

SEQ ID NO: 795449 - DNA, 20 bp, Artificial
  CRISPR gRNA sequence
acatgtggaaataattcagt

SEQ ID NO: 795450 - DNA, 20 bp, Artificial
  CRISPR gRNA sequence
aaaataaatgtgggagggaa

SEQ ID NO: 795451 - DNA, 20 bp, Artificial
  CRISPR gRNA sequence
aggtaaagctcaagttctaa

SEQ ID NO: 795452 - DNA, 20 bp, Artificial
  CRISPR gRNA sequence
tccaactcacttgcattcag

SEQ ID NO: 795453 - DNA, 20 bp, Artificial
  CRISPR gRNA sequence
agaactgctggtgatgcaga

SEQ ID NO: 795454 - DNA, 20 bp, Artificial
  CRISPR gRNA sequence
gggaccttgtgctgccattt

SEQ ID NO: 795455 - DNA, 20 bp, Artificial
  CRISPR gRNA sequence
cagcaagagaaggaacattt

SEQ ID NO: 795456 - DNA, 20 bp, Artificial
  CRISPR gRNA sequence
actacagagaaatcttccta

SEQ ID NO: 795457 - DNA, 20 bp, Artificial
  CRISPR gRNA sequence
tgttctcactttttgctata

SEQ ID NO: 795458 - DNA, 20 bp, Artificial
  CRISPR gRNA sequence
tcctctgtccagaccttctc

SEQ ID NO: 795459 - DNA, 20 bp, Artificial
  CRISPR gRNA sequence
tgaagttccaacgagcccag

SEQ ID NO: 795460 - DNA, 20 bp, Artificial
  CRISPR gRNA sequence
aggatggtttgactcatgtc

SEQ ID NO: 795461 - DNA, 20 bp, Artificial
  CRISPR gRNA sequence
ttgtctaaagctctaaccac

SEQ ID NO: 795462 - DNA, 20 bp, Artificial
  CRISPR gRNA sequence
ggcatggcagtctttcaatt

SEQ ID NO: 795463 - DNA, 20 bp, Artificial
  CRISPR gRNA sequence
agtcatcttttaaatctcag

SEQ ID NO: 795464 - DNA, 20 bp, Artificial
  CRISPR gRNA sequence
ttacattaaatccccttatt

SEQ ID NO: 795465 - DNA, 20 bp, Artificial
  CRISPR gRNA sequence
cacacaatcacatgtctagg

SEQ ID NO: 795466 - DNA, 20 bp, Artificial
  CRISPR gRNA sequence
acatgtctaggatctgtttt

SEQ ID NO: 795467 - DNA, 20 bp, Artificial
  CRISPR gRNA sequence
tgcatcccttttaattttcc

SEQ ID NO: 795468 - DNA, 20 bp, Artificial
  CRISPR gRNA sequence
ccacctcccacaaactgcca

SEQ ID NO: 795469 - DNA, 20 bp, Artificial
  CRISPR gRNA sequence
aggttagtcctccagagggc

SEQ ID NO: 795470 - DNA, 20 bp, Artificial
  CRISPR gRNA sequence
cccacacagaccacagtgct

SEQ ID NO: 795471 - DNA, 20 bp, Artificial
  CRISPR gRNA sequence
caaagttaagtaaagaagca

SEQ ID NO: 795472 - DNA, 20 bp, Artificial
  CRISPR gRNA sequence
gcttggtccctttccttcca

SEQ ID NO: 795473 - DNA, 20 bp, Artificial
  CRISPR gRNA sequence
agatggcttcttagctcctg

SEQ ID NO: 795474 - DNA, 20 bp, Artificial
  CRISPR gRNA sequence
cattattggtccataaaagg

SEQ ID NO: 795475 - DNA, 20 bp, Artificial
  CRISPR gRNA sequence
tcccctaagaggaaccattc

SEQ ID NO: 795476 - DNA, 20 bp, Artificial
  CRISPR gRNA sequence
tgttgcaaaataatgttaaa

SEQ ID NO: 795477 - DNA, 20 bp, Artificial
  CRISPR gRNA sequence
ataatgttaaattctgcttc

SEQ ID NO: 795478 - DNA, 20 bp, Artificial
  CRISPR gRNA sequence
tctgcttcatctgcttgtct

SEQ ID NO: 795479 - DNA, 20 bp, Artificial
  CRISPR gRNA sequence
acgtttcaagaatacagtaa

SEQ ID NO: 795480 - DNA, 20 bp, Artificial
  CRISPR gRNA sequence
agaatacagtaactgtgttt

SEQ ID NO: 795481 - DNA, 20 bp, Artificial
  CRISPR gRNA sequence
ttctcatttaatttcacaaa

SEQ ID NO: 795482 - DNA, 20 bp, Artificial
  CRISPR gRNA sequence
gacttcccaaagtcatacag

SEQ ID NO: 795483 - DNA, 20 bp, Artificial
  CRISPR gRNA sequence
cagctgggatttgaatacag

SEQ ID NO: 795484 - DNA, 20 bp, Artificial
  CRISPR gRNA sequence
ttgtggcctatttgttgcaa

SEQ ID NO: 795485 - DNA, 20 bp, Artificial
  CRISPR gRNA sequence
ttgaacaatggaaggagaaa

SEQ ID NO: 795486 - DNA, 20 bp, Artificial
  CRISPR gRNA sequence
atgtcttcagatcttcagaa

SEQ ID NO: 795487 - DNA, 20 bp, Artificial
  CRISPR gRNA sequence
actctaagtggcacagccct

SEQ ID NO: 795488 - DNA, 20 bp, Artificial
  CRISPR gRNA sequence
agattgagccagaattttac

SEQ ID NO: 795489 - DNA, 20 bp, Artificial
  CRISPR gRNA sequence
gaggtttaaagaccaaatat

SEQ ID NO: 795490 - DNA, 20 bp, Artificial
  CRISPR gRNA sequence
caaaagcagaattaggaatg

SEQ ID NO: 795491 - DNA, 20 bp, Artificial
  CRISPR gRNA sequence
agaaaaaagtgaaaacctat

SEQ ID NO: 795492 - DNA, 20 bp, Artificial
  CRISPR gRNA sequence
ccatgaaaaagaatgagata

SEQ ID NO: 795493 - DNA, 20 bp, Artificial
  CRISPR gRNA sequence
cagcatcccattatgtgaac

SEQ ID NO: 795494 - DNA, 20 bp, Artificial
  CRISPR gRNA sequence
aattctgcagccagacattt

SEQ ID NO: 795495 - DNA, 20 bp, Artificial
  CRISPR gRNA sequence
ttcacactctttgcctaggg

SEQ ID NO: 795496 - DNA, 20 bp, Artificial
  CRISPR gRNA sequence
ctctttgcctaggggccaga

SEQ ID NO: 795497 - DNA, 20 bp, Artificial
  CRISPR gRNA sequence
tcccaggccacagtgaacat

SEQ ID NO: 795498 - DNA, 20 bp, Artificial
  CRISPR gRNA sequence
tgaacatttgggcttcgcta

SEQ ID NO: 795499 - DNA, 20 bp, Artificial
  CRISPR gRNA sequence
ggcttcgctatgtggattta

SEQ ID NO: 795500 - DNA, 20 bp, Artificial
  CRISPR gRNA sequence
atattttaatctataagcca

SEQ ID NO: 795501 - DNA, 20 bp, Artificial
  CRISPR gRNA sequence
gtgaacagtgctgtgagtaa

SEQ ID NO: 795502 - DNA, 20 bp, Artificial
  CRISPR gRNA sequence
tttcttactttcttttctct

SEQ ID NO: 795503 - DNA, 20 bp, Artificial
  CRISPR gRNA sequence
atggaaggcaactgaatagt

SEQ ID NO: 795504 - DNA, 20 bp, Artificial
  CRISPR gRNA sequence
agttccagcttatagaatct

SEQ ID NO: 795505 - DNA, 20 bp, Artificial
  CRISPR gRNA sequence
actgcgatgcaattgacaat

SEQ ID NO: 795506 - DNA, 20 bp, Artificial
  CRISPR gRNA sequence
atggatgtttttgcaacaaa

SEQ ID NO: 795507 - DNA, 20 bp, Artificial
  CRISPR gRNA sequence
caagtctcttcatgaggttg

SEQ ID NO: 795508 - DNA, 20 bp, Artificial
  CRISPR gRNA sequence
tcattaagcctggttggatg

SEQ ID NO: 795509 - DNA, 20 bp, Artificial
  CRISPR gRNA sequence
ttagactcaggggaagcagc

SEQ ID NO: 795510 - DNA, 20 bp, Artificial
  CRISPR gRNA sequence
gcacatgattgtgggggctg

SEQ ID NO: 795511 - DNA, 20 bp, Artificial
  CRISPR gRNA sequence
ccagcagtctggaaacccag

SEQ ID NO: 795512 - DNA, 20 bp, Artificial
  CRISPR gRNA sequence
ttccatcttttctgggaaac

SEQ ID NO: 795513 - DNA, 20 bp, Artificial
  CRISPR gRNA sequence
tttttgctcttaaggccctc

SEQ ID NO: 795514 - DNA, 20 bp, Artificial
  CRISPR gRNA sequence
aacctacatcatgggagata

SEQ ID NO: 795515 - DNA, 20 bp, Artificial
  CRISPR gRNA sequence
ttcatgcatgaacatgccaa

SEQ ID NO: 795516 - DNA, 20 bp, Artificial
  CRISPR gRNA sequence
acctagattgcatgcagact

SEQ ID NO: 795517 - DNA, 20 bp, Artificial
  CRISPR gRNA sequence
ttgcatgcagactaccagtt

SEQ ID NO: 795518 - DNA, 20 bp, Artificial
  CRISPR gRNA sequence
gcagactaccagttttgggt

SEQ ID NO: 795519 - DNA, 20 bp, Artificial
  CRISPR gRNA sequence
ttgggtttttgtttagttca

SEQ ID NO: 795520 - DNA, 20 bp, Artificial
  CRISPR gRNA sequence
gtgggggcaccctgtagcca

SEQ ID NO: 795521 - DNA, 20 bp, Artificial
  CRISPR gRNA sequence
caatgaagagactacttgag

SEQ ID NO: 795522 - DNA, 20 bp, Artificial
  CRISPR gRNA sequence
gaggaatttaaatatttcta

SEQ ID NO: 795523 - DNA, 20 bp, Artificial
  CRISPR gRNA sequence
ccagatctaatccccccaaa

SEQ ID NO: 795524 - DNA, 20 bp, Artificial
  CRISPR gRNA sequence
agatcatatcaaatccttcc

SEQ ID NO: 795525 - DNA, 20 bp, Artificial
  CRISPR gRNA sequence
catgagctcattcccacttc

SEQ ID NO: 795526 - DNA, 20 bp, Artificial
  CRISPR gRNA sequence
gtaactttattattataaca

SEQ ID NO: 795527 - DNA, 20 bp, Artificial
  CRISPR gRNA sequence
tctgttctaagacattagaa

SEQ ID NO: 795528 - DNA, 20 bp, Artificial
  CRISPR gRNA sequence
agccctctgaagtacttact

SEQ ID NO: 795529 - DNA, 20 bp, Artificial
  CRISPR gRNA sequence
taataatataagggccaata

SEQ ID NO: 795530 - DNA, 20 bp, Artificial
  CRISPR gRNA sequence
atccacacccatacactaca

SEQ ID NO: 795531 - DNA, 20 bp, Artificial
  CRISPR gRNA sequence
tacaggtgcatgccaccgta

SEQ ID NO: 795532 - DNA, 20 bp, Artificial
  CRISPR gRNA sequence
tgccttggcctcccaaagtg

SEQ ID NO: 795533 - DNA, 20 bp, Artificial
  CRISPR gRNA sequence
agcctacatacacaacactc

SEQ ID NO: 795534 - DNA, 20 bp, Artificial
  CRISPR gRNA sequence
aatctataccactcttaagc

SEQ ID NO: 795535 - DNA, 20 bp, Artificial
  CRISPR gRNA sequence
tgattacagcgttattttct

SEQ ID NO: 795536 - DNA, 20 bp, Artificial
  CRISPR gRNA sequence
tatttgatatttgtctttct

SEQ ID NO: 795537 - DNA, 20 bp, Artificial
  CRISPR gRNA sequence
ttgtctttctgtccgtttat

SEQ ID NO: 795538 - DNA, 20 bp, Artificial
  CRISPR gRNA sequence
gtccgtttatcaatgtttct

SEQ ID NO: 795539 - DNA, 20 bp, Artificial
  CRISPR gRNA sequence
atataataaatttaaaaggt

SEQ ID NO: 795540 - DNA, 20 bp, Artificial
  CRISPR gRNA sequence
aaaaacaatattaaaataaa

SEQ ID NO: 795541 - DNA, 20 bp, Artificial
  CRISPR gRNA sequence
aagaataacgtacaacaata

SEQ ID NO: 795542 - DNA, 20 bp, Artificial
  CRISPR gRNA sequence
tttcagaacattttttaaat

SEQ ID NO: 795543 - DNA, 20 bp, Artificial
  CRISPR gRNA sequence
ttgcctagaaattgccatgg

SEQ ID NO: 795544 - DNA, 20 bp, Artificial
  CRISPR gRNA sequence
ttgctcaggcccagacagct

SEQ ID NO: 795545 - DNA, 20 bp, Artificial
  CRISPR gRNA sequence
cccttccaacttaagaagca

SEQ ID NO: 795546 - DNA, 20 bp, Artificial
  CRISPR gRNA sequence
acttaagaagcacagggctt

SEQ ID NO: 795547 - DNA, 20 bp, Artificial
  CRISPR gRNA sequence
agaagcacagggcttgctgg

SEQ ID NO: 795548 - DNA, 20 bp, Artificial
  CRISPR gRNA sequence
ctaatagagttcagtattag

SEQ ID NO: 795549 - DNA, 20 bp, Artificial
  CRISPR gRNA sequence
catgatagaattgcacttct

SEQ ID NO: 795550 - DNA, 20 bp, Artificial
  CRISPR gRNA sequence
tagttaagtgtggtcatgta

SEQ ID NO: 795551 - DNA, 20 bp, Artificial
  CRISPR gRNA sequence
tagaagatgtaagagttggc

SEQ ID NO: 795552 - DNA, 20 bp, Artificial
  CRISPR gRNA sequence
tacatggaacatgaacaaga

SEQ ID NO: 795553 - DNA, 20 bp, Artificial
  CRISPR gRNA sequence
gaacatgaacaagaataagc

SEQ ID NO: 795554 - DNA, 20 bp, Artificial
  CRISPR gRNA sequence
ataagcttttgttttttata

SEQ ID NO: 795555 - DNA, 20 bp, Artificial
  CRISPR gRNA sequence
tttttatattgagattttgg

SEQ ID NO: 795556 - DNA, 20 bp, Artificial
  CRISPR gRNA sequence
tgtttgttcctacagcatta

SEQ ID NO: 795557 - DNA, 20 bp, Artificial
  CRISPR gRNA sequence
aaatatgaaaatgcctgtaa

SEQ ID NO: 795558 - DNA, 20 bp, Artificial
  CRISPR gRNA sequence
aaaatgcctgtaatcatgtt

SEQ ID NO: 795559 - DNA, 20 bp, Artificial
  CRISPR gRNA sequence
ttttggattatggaatcaag

SEQ ID NO: 795560 - DNA, 20 bp, Artificial
  CRISPR gRNA sequence
tcaagtattgctttttactt

SEQ ID NO: 795561 - DNA, 20 bp, Artificial
  CRISPR gRNA sequence
ggactcttcatcagtcctta

SEQ ID NO: 795562 - DNA, 20 bp, Artificial
  CRISPR gRNA sequence
ataaacagtaaaactttagg

SEQ ID NO: 795563 - DNA, 20 bp, Artificial
  CRISPR gRNA sequence
tacagtcatcaagccttggt

SEQ ID NO: 795564 - DNA, 20 bp, Artificial
  CRISPR gRNA sequence
gtatcctagctacctcattt

SEQ ID NO: 795565 - DNA, 20 bp, Artificial
  CRISPR gRNA sequence
cagtagcagaccaaaagaag

SEQ ID NO: 795566 - DNA, 20 bp, Artificial
  CRISPR gRNA sequence
cacccactcacaaacctgta

SEQ ID NO: 795567 - DNA, 20 bp, Artificial
  CRISPR gRNA sequence
aggatgaatttatcagtcat

SEQ ID NO: 795568 - DNA, 20 bp, Artificial
  CRISPR gRNA sequence
ttgggttaaaacaaaaagaa

SEQ ID NO: 795569 - DNA, 20 bp, Artificial
  CRISPR gRNA sequence
atatacttttggtccagtct

SEQ ID NO: 795570 - DNA, 20 bp, Artificial
  CRISPR gRNA sequence
tttggtccagtctttacgtt

SEQ ID NO: 795571 - DNA, 20 bp, Artificial
  CRISPR gRNA sequence
tccagtctttacgttttttg

SEQ ID NO: 795572 - DNA, 20 bp, Artificial
  CRISPR gRNA sequence
tctttacgttttttgttttg

SEQ ID NO: 795573 - DNA, 20 bp, Artificial
  CRISPR gRNA sequence
tacgttttttgttttgtttt

SEQ ID NO: 795574 - DNA, 20 bp, Artificial
  CRISPR gRNA sequence
agcgtcagcattccacatgg

SEQ ID NO: 795575 - DNA, 20 bp, Artificial
  CRISPR gRNA sequence
cctttcccctttcccatttc

SEQ ID NO: 795576 - DNA, 20 bp, Artificial
  CRISPR gRNA sequence
cctgtgagatcagcagcagc

SEQ ID NO: 795577 - DNA, 20 bp, Artificial
  CRISPR gRNA sequence
gaccactgctctaagatacc

SEQ ID NO: 795578 - DNA, 20 bp, Artificial
  CRISPR gRNA sequence
tattagcaagaggagtcact

SEQ ID NO: 795579 - DNA, 20 bp, Artificial
  CRISPR gRNA sequence
tggggataatcagggaagaa

SEQ ID NO: 795580 - DNA, 20 bp, Artificial
  CRISPR gRNA sequence
accactaattccaggcaaaa

SEQ ID NO: 795581 - DNA, 20 bp, Artificial
  CRISPR gRNA sequence
agattttacttactaagcaa

SEQ ID NO: 795582 - DNA, 20 bp, Artificial
  CRISPR gRNA sequence
atcctagcaggaaatggagg

SEQ ID NO: 795583 - DNA, 20 bp, Artificial
  CRISPR gRNA sequence
gcttagaagaggtaactgag

SEQ ID NO: 795584 - DNA, 20 bp, Artificial
  CRISPR gRNA sequence
tgacacaatagggaactata

SEQ ID NO: 795585 - DNA, 20 bp, Artificial
  CRISPR gRNA sequence
caatggtaaaaactgtggaa

SEQ ID NO: 795586 - DNA, 20 bp, Artificial
  CRISPR gRNA sequence
gtggaaagaagttttaaatg

SEQ ID NO: 795587 - DNA, 20 bp, Artificial
  CRISPR gRNA sequence
aaatgaaaagttttaaacca

SEQ ID NO: 795588 - DNA, 20 bp, Artificial
  CRISPR gRNA sequence
atatattttctaatcataaa

SEQ ID NO: 795589 - DNA, 20 bp, Artificial
  CRISPR gRNA sequence
aaaaatgatttttcttattt

SEQ ID NO: 795590 - DNA, 20 bp, Artificial
  CRISPR gRNA sequence
tgacctgatatgacatctaa

SEQ ID NO: 795591 - DNA, 20 bp, Artificial
  CRISPR gRNA sequence
aacaagaattcggtggcctg

SEQ ID NO: 795592 - DNA, 20 bp, Artificial
  CRISPR gRNA sequence
ctggactcacctctggagcc

SEQ ID NO: 795593 - DNA, 20 bp, Artificial
  CRISPR gRNA sequence
gcaaaaggaattatttcccc

SEQ ID NO: 795594 - DNA, 20 bp, Artificial
  CRISPR gRNA sequence
tatttcccctcaagttttct

SEQ ID NO: 795595 - DNA, 20 bp, Artificial
  CRISPR gRNA sequence
caatagagttattttttatc

SEQ ID NO: 795596 - DNA, 20 bp, Artificial
  CRISPR gRNA sequence
tgagactatgagctcacaga

SEQ ID NO: 795597 - DNA, 20 bp, Artificial
  CRISPR gRNA sequence
acaaactcaaatcataattg

SEQ ID NO: 795598 - DNA, 20 bp, Artificial
  CRISPR gRNA sequence
aaatcataattgacatgttt

SEQ ID NO: 795599 - DNA, 20 bp, Artificial
  CRISPR gRNA sequence
tgtggagtaaagtcatcaag

SEQ ID NO: 795600 - DNA, 20 bp, Artificial
  CRISPR gRNA sequence
tgaggtctaagtcacaaagc

SEQ ID NO: 795601 - DNA, 20 bp, Artificial
  CRISPR gRNA sequence
tgttttaacctgtaatggca

SEQ ID NO: 795602 - DNA, 20 bp, Artificial
  CRISPR gRNA sequence
gtaatggcaccatgtttaat

SEQ ID NO: 795603 - DNA, 20 bp, Artificial
  CRISPR gRNA sequence
acatctttcctttaaaaatt

SEQ ID NO: 795604 - DNA, 20 bp, Artificial
  CRISPR gRNA sequence
aaaattattggtttcttttt

SEQ ID NO: 795605 - DNA, 20 bp, Artificial
  CRISPR gRNA sequence
taaatttgacttttcagtgc

SEQ ID NO: 795606 - DNA, 20 bp, Artificial
  CRISPR gRNA sequence
aagggtaactcggctacagt

SEQ ID NO: 795607 - DNA, 20 bp, Artificial
  CRISPR gRNA sequence
ctccttaactgagcaaaatt

SEQ ID NO: 795608 - DNA, 20 bp, Artificial
  CRISPR gRNA sequence
ctaacagacaaatcatacat

SEQ ID NO: 795609 - DNA, 20 bp, Artificial
  CRISPR gRNA sequence
atatattctacttttgggta

SEQ ID NO: 795610 - DNA, 20 bp, Artificial
  CRISPR gRNA sequence
gctcagggtcttgcaagtca

SEQ ID NO: 795611 - DNA, 20 bp, Artificial
  CRISPR gRNA sequence
ctattacgccatttggctcc

SEQ ID NO: 795612 - DNA, 20 bp, Artificial
  CRISPR gRNA sequence
agaacgttgaagaataacaa

SEQ ID NO: 795613 - DNA, 20 bp, Artificial
  CRISPR gRNA sequence
ttttattctttaaaggcatt

SEQ ID NO: 795614 - DNA, 20 bp, Artificial
  CRISPR gRNA sequence
gagaattgagaaactgagat

SEQ ID NO: 795615 - DNA, 20 bp, Artificial
  CRISPR gRNA sequence
ccccaaattttgctcagtta

SEQ ID NO: 795616 - DNA, 20 bp, Artificial
  CRISPR gRNA sequence
aaattttgctcagttaagga

SEQ ID NO: 795617 - DNA, 20 bp, Artificial
  CRISPR gRNA sequence
ttcaagggtcagctaatgct

SEQ ID NO: 795618 - DNA, 20 bp, Artificial
  CRISPR gRNA sequence
cacatatgtagtgggatctt

SEQ ID NO: 795619 - DNA, 20 bp, Artificial
  CRISPR gRNA sequence
tcatattgagggccagaaaa

SEQ ID NO: 795620 - DNA, 20 bp, Artificial
  CRISPR gRNA sequence
ttgagggccagaaaaggagg

SEQ ID NO: 795621 - DNA, 20 bp, Artificial
  CRISPR gRNA sequence
ccagaaaaggaggcttagtt

SEQ ID NO: 795622 - DNA, 20 bp, Artificial
  CRISPR gRNA sequence
aaatatttttgactgtatat

SEQ ID NO: 795623 - DNA, 20 bp, Artificial
  CRISPR gRNA sequence
gtgccattacaggttaaaac

SEQ ID NO: 795624 - DNA, 20 bp, Artificial
  CRISPR gRNA sequence
tgtgacttagacctcaaaaa

SEQ ID NO: 795625 - DNA, 20 bp, Artificial
  CRISPR gRNA sequence
agaacaacttcattatgcta

SEQ ID NO: 795626 - DNA, 20 bp, Artificial
  CRISPR gRNA sequence
taatccataaaacatgtcaa

SEQ ID NO: 795627 - DNA, 20 bp, Artificial
  CRISPR gRNA sequence
taaaacatgtcaattatgat

SEQ ID NO: 795628 - DNA, 20 bp, Artificial
  CRISPR gRNA sequence
aataactctattggcaaccc

SEQ ID NO: 795629 - DNA, 20 bp, Artificial
  CRISPR gRNA sequence
tactggaaatttccacacac

SEQ ID NO: 795630 - DNA, 20 bp, Artificial
  CRISPR gRNA sequence
acttgaggggaaataattcc

SEQ ID NO: 795631 - DNA, 20 bp, Artificial
  CRISPR gRNA sequence
ggtaattctgtaaagtgcag

SEQ ID NO: 795632 - DNA, 20 bp, Artificial
  CRISPR gRNA sequence
attctgtaaagtgcagtagt

SEQ ID NO: 795633 - DNA, 20 bp, Artificial
  CRISPR gRNA sequence
gagtccagatcagtgaaggg

SEQ ID NO: 795634 - DNA, 20 bp, Artificial
  CRISPR gRNA sequence
aggtgttggctagtcttgtt

SEQ ID NO: 795635 - DNA, 20 bp, Artificial
  CRISPR gRNA sequence
tggctagtcttgttgcaggt

SEQ ID NO: 795636 - DNA, 20 bp, Artificial
  CRISPR gRNA sequence
cgaattcttgttcagagtcc

SEQ ID NO: 795637 - DNA, 20 bp, Artificial
  CRISPR gRNA sequence
caaataagaaaaatcatttt

SEQ ID NO: 795638 - DNA, 20 bp, Artificial
  CRISPR gRNA sequence
gttcatctagctggaagccg

SEQ ID NO: 795639 - DNA, 20 bp, Artificial
  CRISPR gRNA sequence
tttcatttaaaacttctttc

SEQ ID NO: 795640 - DNA, 20 bp, Artificial
  CRISPR gRNA sequence
ccattgccctagtccaagtc

SEQ ID NO: 795641 - DNA, 20 bp, Artificial
  CRISPR gRNA sequence
tggcatgctcagtatccctt

SEQ ID NO: 795642 - DNA, 20 bp, Artificial
  CRISPR gRNA sequence
ctaggatctaactgaagcac

SEQ ID NO: 795643 - DNA, 20 bp, Artificial
  CRISPR gRNA sequence
tctaacttttgcctggaatt

SEQ ID NO: 795644 - DNA, 20 bp, Artificial
  CRISPR gRNA sequence
tctttcccccttatctcaca

SEQ ID NO: 795645 - DNA, 20 bp, Artificial
  CRISPR gRNA sequence
ttagtgtctcctctatctag

SEQ ID NO: 795646 - DNA, 20 bp, Artificial
  CRISPR gRNA sequence
ctcctctatctagaagagtt

SEQ ID NO: 795647 - DNA, 20 bp, Artificial
  CRISPR gRNA sequence
agtttgctgtttccatttct

SEQ ID NO: 795648 - DNA, 20 bp, Artificial
  CRISPR gRNA sequence
tccatgaaaactttcttctt

SEQ ID NO: 795649 - DNA, 20 bp, Artificial
  CRISPR gRNA sequence
tttcttcttccctgattatc

SEQ ID NO: 795650 - DNA, 20 bp, Artificial
  CRISPR gRNA sequence
cccatctctgaactttcatg

SEQ ID NO: 795651 - DNA, 20 bp, Artificial
  CRISPR gRNA sequence
tgacatgggttgggtatttc

SEQ ID NO: 795652 - DNA, 20 bp, Artificial
  CRISPR gRNA sequence
ttctgaggattgatggtaag

SEQ ID NO: 795653 - DNA, 20 bp, Artificial
  CRISPR gRNA sequence
atagggataatttgagagct

SEQ ID NO: 795654 - DNA, 20 bp, Artificial
  CRISPR gRNA sequence
caacatttttggcaccaggg

SEQ ID NO: 795655 - DNA, 20 bp, Artificial
  CRISPR gRNA sequence
ttcagggaagacaatttttc

SEQ ID NO: 795656 - DNA, 20 bp, Artificial
  CRISPR gRNA sequence
gtgtgggagtgggggtaggc

SEQ ID NO: 795657 - DNA, 20 bp, Artificial
  CRISPR gRNA sequence
tccacctcagatcgtcagac

SEQ ID NO: 795658 - DNA, 20 bp, Artificial
  CRISPR gRNA sequence
cctcatatgtgcagttcaca

SEQ ID NO: 795659 - DNA, 20 bp, Artificial
  CRISPR gRNA sequence
tgtgcagttcacaataggat

SEQ ID NO: 795660 - DNA, 20 bp, Artificial
  CRISPR gRNA sequence
ggtagagctcaggtagtagt

SEQ ID NO: 795661 - DNA, 20 bp, Artificial
  CRISPR gRNA sequence
gacaaatagcctatatgata

SEQ ID NO: 795662 - DNA, 20 bp, Artificial
  CRISPR gRNA sequence
ctaatttcaccactatttta

SEQ ID NO: 795663 - DNA, 20 bp, Artificial
  CRISPR gRNA sequence
tgtctaatatttcctttgcg

SEQ ID NO: 795664 - DNA, 20 bp, Artificial
  CRISPR gRNA sequence
ggaccaaaagtatatagaaa

SEQ ID NO: 795665 - DNA, 20 bp, Artificial
  CRISPR gRNA sequence
tatatagaaagctggcttct

SEQ ID NO: 795666 - DNA, 20 bp, Artificial
  CRISPR gRNA sequence
acccaaattatgtgaatgag

SEQ ID NO: 795667 - DNA, 20 bp, Artificial
  CRISPR gRNA sequence
gcaaataacagaaacttaat

SEQ ID NO: 795668 - DNA, 20 bp, Artificial
  CRISPR gRNA sequence
catgacttcttttggtctgc

SEQ ID NO: 795669 - DNA, 20 bp, Artificial
  CRISPR gRNA sequence
catggtctgtaaactctaac

SEQ ID NO: 795670 - DNA, 20 bp, Artificial
  CRISPR gRNA sequence
atggtatcataatccactcc

SEQ ID NO: 795671 - DNA, 20 bp, Artificial
  CRISPR gRNA sequence
ataatccactcctaaagttt

SEQ ID NO: 795672 - DNA, 20 bp, Artificial
  CRISPR gRNA sequence
ctcctaaagttttactgttt

SEQ ID NO: 795673 - DNA, 20 bp, Artificial
  CRISPR gRNA sequence
aggtgagtggggatggttga

SEQ ID NO: 795674 - DNA, 20 bp, Artificial
  CRISPR gRNA sequence
acataaaagtaaaaagcaat

SEQ ID NO: 795675 - DNA, 20 bp, Artificial
  CRISPR gRNA sequence
cttgattccataatccaaaa

SEQ ID NO: 795676 - DNA, 20 bp, Artificial
  CRISPR gRNA sequence
aggcattttcatatttttac

SEQ ID NO: 795677 - DNA, 20 bp, Artificial
  CRISPR gRNA sequence
cattattattcctcagaact

SEQ ID NO: 795678 - DNA, 20 bp, Artificial
  CRISPR gRNA sequence
agggtctatttattataggt

SEQ ID NO: 795679 - DNA, 20 bp, Artificial
  CRISPR gRNA sequence
aaaatctcaatataaaaaac

SEQ ID NO: 795680 - DNA, 20 bp, Artificial
  CRISPR gRNA sequence
ccagaaataacacgcatcac

SEQ ID NO: 795681 - DNA, 20 bp, Artificial
  CRISPR gRNA sequence
aggcattttcacaagtcagg

SEQ ID NO: 795682 - DNA, 20 bp, Artificial
  CRISPR gRNA sequence
tgaagcaaaaccagcaagcc

SEQ ID NO: 795683 - DNA, 20 bp, Artificial
  CRISPR gRNA sequence
tgtacactctcctcataatg

SEQ ID NO: 795684 - DNA, 20 bp, Artificial
  CRISPR gRNA sequence
aaccatggcaatttctaggc

SEQ ID NO: 795685 - DNA, 20 bp, Artificial
  CRISPR gRNA sequence
ggcaatggattctaaattat

SEQ ID NO: 795686 - DNA, 20 bp, Artificial
  CRISPR gRNA sequence
ttaaacaaaatttattttaa

SEQ ID NO: 795687 - DNA, 20 bp, Artificial
  CRISPR gRNA sequence
cagaaaataacgctgtaatc

SEQ ID NO: 795688 - DNA, 20 bp, Artificial
  CRISPR gRNA sequence
aatcatgtgcttaagagtgg

SEQ ID NO: 795689 - DNA, 20 bp, Artificial
  CRISPR gRNA sequence
atgagtgggggagagagtct

SEQ ID NO: 795690 - DNA, 20 bp, Artificial
  CRISPR gRNA sequence
tgtgtatgtaggctgggcac

SEQ ID NO: 795691 - DNA, 20 bp, Artificial
  CRISPR gRNA sequence
cactttgggaggccaaggca

SEQ ID NO: 795692 - DNA, 20 bp, Artificial
  CRISPR gRNA sequence
ttgggaggccaaggcaggag

SEQ ID NO: 795693 - DNA, 20 bp, Artificial
  CRISPR gRNA sequence
caggaggattgcttgagccg

SEQ ID NO: 795694 - DNA, 20 bp, Artificial
  CRISPR gRNA sequence
tcaggaggctgaggtgggaa

SEQ ID NO: 795695 - DNA, 20 bp, Artificial
  CRISPR gRNA sequence
agcagagtgtagtgtatggg

SEQ ID NO: 795696 - DNA, 20 bp, Artificial
  CRISPR gRNA sequence
gtggattctggacttggaca

SEQ ID NO: 795697 - DNA, 20 bp, Artificial
  CRISPR gRNA sequence
gggcaagttagttaacctct

SEQ ID NO: 795698 - DNA, 20 bp, Artificial
  CRISPR gRNA sequence
agtacttcagagggctactg

SEQ ID NO: 795699 - DNA, 20 bp, Artificial
  CRISPR gRNA sequence
aaagtagaccatgccaaaag

SEQ ID NO: 795700 - DNA, 20 bp, Artificial
  CRISPR gRNA sequence
tggagcagctcaacttgagg

SEQ ID NO: 795701 - DNA, 20 bp, Artificial
  CRISPR gRNA sequence
tgttgaagagtggtagatga

SEQ ID NO: 795702 - DNA, 20 bp, Artificial
  CRISPR gRNA sequence
aaaggcctgaaaaactctgg

SEQ ID NO: 795703 - DNA, 20 bp, Artificial
  CRISPR gRNA sequence
tgacatgatgatgatgaaaa

SEQ ID NO: 795704 - DNA, 20 bp, Artificial
  CRISPR gRNA sequence
gatgatgaaaacagtgtttg

SEQ ID NO: 795705 - DNA, 20 bp, Artificial
  CRISPR gRNA sequence
caaggcatcatttccaaaat

SEQ ID NO: 795706 - DNA, 20 bp, Artificial
  CRISPR gRNA sequence
gcatcatttccaaaattttg

SEQ ID NO: 795707 - DNA, 20 bp, Artificial
  CRISPR gRNA sequence
cagggtgcccccactcccca

SEQ ID NO: 795708 - DNA, 20 bp, Artificial
  CRISPR gRNA sequence
tgcatccaaatacttagagt

SEQ ID NO: 795709 - DNA, 20 bp, Artificial
  CRISPR gRNA sequence
acagatgtccttttgttgct

SEQ ID NO: 795710 - DNA, 20 bp, Artificial
  CRISPR gRNA sequence
aatagtagttggttacttac

SEQ ID NO: 795711 - DNA, 20 bp, Artificial
  CRISPR gRNA sequence
ccctcatctcttggtgcctg

SEQ ID NO: 795712 - DNA, 20 bp, Artificial
  CRISPR gRNA sequence
tcatcttggctatggtgctc

SEQ ID NO: 795713 - DNA, 20 bp, Artificial
  CRISPR gRNA sequence
tatcagttaacttgaagtaa

SEQ ID NO: 795714 - DNA, 20 bp, Artificial
  CRISPR gRNA sequence
gattatctcccatgatgtag

SEQ ID NO: 795715 - DNA, 20 bp, Artificial
  CRISPR gRNA sequence
gggccttaagagcaaaaaac

SEQ ID NO: 795716 - DNA, 20 bp, Artificial
  CRISPR gRNA sequence
ctgtaaggtagaaatcctgc

SEQ ID NO: 795717 - DNA, 20 bp, Artificial
  CRISPR gRNA sequence
tgccagcccccacaatcatg

SEQ ID NO: 795718 - DNA, 20 bp, Artificial
  CRISPR gRNA sequence
atgtgctgcttcccctgagt

SEQ ID NO: 795719 - DNA, 20 bp, Artificial
  CRISPR gRNA sequence
agtctaagcttttcatccaa

SEQ ID NO: 795720 - DNA, 20 bp, Artificial
  CRISPR gRNA sequence
gcttttcatccaaccaggct

SEQ ID NO: 795721 - DNA, 20 bp, Artificial
  CRISPR gRNA sequence
agatcatatccttcctcctc

SEQ ID NO: 795722 - DNA, 20 bp, Artificial
  CRISPR gRNA sequence
tgtcaacctcatgaagagac

SEQ ID NO: 795723 - DNA, 20 bp, Artificial
  CRISPR gRNA sequence
acaacaatgtacttcttaat

SEQ ID NO: 795724 - DNA, 20 bp, Artificial
  CRISPR gRNA sequence
ttgaatatcttctctttgct

SEQ ID NO: 795725 - DNA, 20 bp, Artificial
  CRISPR gRNA sequence
tctttgctgttcgattttaa

SEQ ID NO: 795726 - DNA, 20 bp, Artificial
  CRISPR gRNA sequence
tccagtgcagtatcatctag

SEQ ID NO: 795727 - DNA, 20 bp, Artificial
  CRISPR gRNA sequence
tatagaccgagcaaaagatg

SEQ ID NO: 795728 - DNA, 20 bp, Artificial
  CRISPR gRNA sequence
gattgttctggggctaagaa

SEQ ID NO: 795729 - DNA, 20 bp, Artificial
  CRISPR gRNA sequence
cgctgaaatgctaccaaaca

SEQ ID NO: 795730 - DNA, 20 bp, Artificial
  CRISPR gRNA sequence
gtaagaaagaaaagtaaaaa

SEQ ID NO: 795731 - DNA, 20 bp, Artificial
  CRISPR gRNA sequence
ggaaaaattccagaaatgga

SEQ ID NO: 795732 - DNA, 20 bp, Artificial
  CRISPR gRNA sequence
tggaataagattaatgagaa

SEQ ID NO: 795733 - DNA, 20 bp, Artificial
  CRISPR gRNA sequence
taagattaatgagaaaactg

SEQ ID NO: 795734 - DNA, 20 bp, Artificial
  CRISPR gRNA sequence
aatgagaaaactgtttggct

SEQ ID NO: 795735 - DNA, 20 bp, Artificial
  CRISPR gRNA sequence
tgcagaattagctctccctt

SEQ ID NO: 795736 - DNA, 20 bp, Artificial
  CRISPR gRNA sequence
taatgggatgctgctcacca

SEQ ID NO: 795737 - DNA, 20 bp, Artificial
  CRISPR gRNA sequence
tgctgctcaccagtaagttt

SEQ ID NO: 795738 - DNA, 20 bp, Artificial
  CRISPR gRNA sequence
ttaattttttttttatatca

SEQ ID NO: 795739 - DNA, 20 bp, Artificial
  CRISPR gRNA sequence
tcaataggtttaggggtaca

SEQ ID NO: 795740 - DNA, 20 bp, Artificial
  CRISPR gRNA sequence
agtgtacattgaactcaata

SEQ ID NO: 795741 - DNA, 20 bp, Artificial
  CRISPR gRNA sequence
tctgtatgcctttgcatatc

SEQ ID NO: 795742 - DNA, 20 bp, Artificial
  CRISPR gRNA sequence
acaagtgagaatatatggta

SEQ ID NO: 795743 - DNA, 20 bp, Artificial
  CRISPR gRNA sequence
attcgtcaatgggatcttag

SEQ ID NO: 795744 - DNA, 20 bp, Artificial
  CRISPR gRNA sequence
tcatatctttgcaatcatga

SEQ ID NO: 795745 - DNA, 20 bp, Artificial
  CRISPR gRNA sequence
gttttcacttttttcttaac

SEQ ID NO: 795746 - DNA, 20 bp, Artificial
  CRISPR gRNA sequence
atttcacatattccctccca

SEQ ID NO: 795747 - DNA, 20 bp, Artificial
  CRISPR gRNA sequence
cctcccactctgattctctt

SEQ ID NO: 795748 - DNA, 20 bp, Artificial
  CRISPR gRNA sequence
tgaaatcagtccattcctaa

SEQ ID NO: 795749 - DNA, 20 bp, Artificial
  CRISPR gRNA sequence
ttctgcttttgccctatata

SEQ ID NO: 795750 - DNA, 20 bp, Artificial
  CRISPR gRNA sequence
gtaattccctcatgactatc

SEQ ID NO: 795751 - DNA, 20 bp, Artificial
  CRISPR gRNA sequence
agcactgtagtctctttcat

SEQ ID NO: 795752 - DNA, 20 bp, Artificial
  CRISPR gRNA sequence
cataggaattgctcttgaat

SEQ ID NO: 795753 - DNA, 20 bp, Artificial
  CRISPR gRNA sequence
tgataactgttccttcacaa

SEQ ID NO: 795754 - DNA, 20 bp, Artificial
  CRISPR gRNA sequence
ctgaagacatgttctaaaga

SEQ ID NO: 795755 - DNA, 20 bp, Artificial
  CRISPR gRNA sequence
ttctgtagctggtgacttct

SEQ ID NO: 795756 - DNA, 20 bp, Artificial
  CRISPR gRNA sequence
tgtataagtcactcaattat

SEQ ID NO: 795757 - DNA, 20 bp, Artificial
  CRISPR gRNA sequence
acttttgcaacaaataggcc

SEQ ID NO: 795758 - DNA, 20 bp, Artificial
  CRISPR gRNA sequence
aatttttgtgaaattaaatg

SEQ ID NO: 795759 - DNA, 20 bp, Artificial
  CRISPR gRNA sequence
gtttgtaaagggtctagcac

SEQ ID NO: 795760 - DNA, 20 bp, Artificial
  CRISPR gRNA sequence
tcacctgcatatagtaggtt

SEQ ID NO: 795761 - DNA, 20 bp, Artificial
  CRISPR gRNA sequence
attattttgcaacagaagtt

SEQ ID NO: 795762 - DNA, 20 bp, Artificial
  CRISPR gRNA sequence
ggaaggaaagggaccaagcc

SEQ ID NO: 795763 - DNA, 20 bp, Artificial
  CRISPR gRNA sequence
acctcatcaacccatagggg

SEQ ID NO: 795764 - DNA, 20 bp, Artificial
  CRISPR gRNA sequence
atggagacatctggaaggac

SEQ ID NO: 795765 - DNA, 20 bp, Artificial
  CRISPR gRNA sequence
gcactggccctgtgggctaa

SEQ ID NO: 795766 - DNA, 20 bp, Artificial
  CRISPR gRNA sequence
gtgggctaagtaagctttct

SEQ ID NO: 795767 - DNA, 20 bp, Artificial
  CRISPR gRNA sequence
tattaaaacagatcctagac

SEQ ID NO: 795768 - DNA, 20 bp, Artificial
  CRISPR gRNA sequence
tgctatggaaacatataata

SEQ ID NO: 795769 - DNA, 20 bp, Artificial
  CRISPR gRNA sequence
taggaaagacttgatgaagt

SEQ ID NO: 795770 - DNA, 20 bp, Artificial
  CRISPR gRNA sequence
ttgatgaagtataagcttag

SEQ ID NO: 795771 - DNA, 20 bp, Artificial
  CRISPR gRNA sequence
actagaaaatcctgtgtggt

SEQ ID NO: 795772 - DNA, 20 bp, Artificial
  CRISPR gRNA sequence
ggtctggacagaggacacat

SEQ ID NO: 795773 - DNA, 20 bp, Artificial
  CRISPR gRNA sequence
acagaggacacatggtagat

SEQ ID NO: 795774 - DNA, 20 bp, Artificial
  CRISPR gRNA sequence
gaatacagggaaaccagtta

SEQ ID NO: 795775 - DNA, 20 bp, Artificial
  CRISPR gRNA sequence
ctgtaaaatgttccttctct

SEQ ID NO: 795776 - DNA, 20 bp, Artificial
  CRISPR gRNA sequence
tcccagcctagccctctgac

SEQ ID NO: 795777 - DNA, 20 bp, Artificial
  CRISPR gRNA sequence
tcaacccttttccatggcac

SEQ ID NO: 795778 - DNA, 20 bp, Artificial
  CRISPR gRNA sequence
gacaagggttatataggcaa

SEQ ID NO: 795779 - DNA, 20 bp, Artificial
  CRISPR gRNA sequence
ttcattaaaaatataaaaga

SEQ ID NO: 795780 - DNA, 20 bp, Artificial
  CRISPR gRNA sequence
ctcctaatcacagttagaac

SEQ ID NO: 795781 - DNA, 20 bp, Artificial
  CRISPR gRNA sequence
actgatatcctcactcactc

SEQ ID NO: 795782 - DNA, 20 bp, Artificial
  CRISPR gRNA sequence
gattggggtgaaggatgagg

SEQ ID NO: 795783 - DNA, 20 bp, Artificial
  CRISPR gRNA sequence
tatctttcttcttctccatc

SEQ ID NO: 795784 - DNA, 20 bp, Artificial
  CRISPR gRNA sequence
tcattgagtgcagacaaggg

SEQ ID NO: 795785 - DNA, 20 bp, Artificial
  CRISPR gRNA sequence
gctaggcctgcatacattct

SEQ ID NO: 795786 - DNA, 20 bp, Artificial
  CRISPR gRNA sequence
aagcaatgaaatcagggctg

SEQ ID NO: 795787 - DNA, 20 bp, Artificial
  CRISPR gRNA sequence
acgttaatgcaccaccaacc

SEQ ID NO: 795788 - DNA, 20 bp, Artificial
  CRISPR gRNA sequence
ttccttacccaaccgtgagg

SEQ ID NO: 795789 - DNA, 20 bp, Artificial
  CRISPR gRNA sequence
tgagattcctgggagagggg

SEQ ID NO: 795790 - DNA, 20 bp, Artificial
  CRISPR gRNA sequence
aagtggttcataagctctga

SEQ ID NO: 795791 - DNA, 20 bp, Artificial
  CRISPR gRNA sequence
ctcacttaccttttgaagaa

SEQ ID NO: 795792 - DNA, 20 bp, Artificial
  CRISPR gRNA sequence
aagaatacagcttttgacag

SEQ ID NO: 795793 - DNA, 20 bp, Artificial
  CRISPR gRNA sequence
agggaggcacagagagacta

SEQ ID NO: 795794 - DNA, 20 bp, Artificial
  CRISPR gRNA sequence
cagctaagatacagtctggt

SEQ ID NO: 795795 - DNA, 20 bp, Artificial
  CRISPR gRNA sequence
atacagtctggttccagatt

SEQ ID NO: 795796 - DNA, 20 bp, Artificial
  CRISPR gRNA sequence
cccccactgacaagtactca

SEQ ID NO: 795797 - DNA, 20 bp, Artificial
  CRISPR gRNA sequence
taccattagttgttaaattt

SEQ ID NO: 795798 - DNA, 20 bp, Artificial
  CRISPR gRNA sequence
ttattacaattggccctttg

SEQ ID NO: 795799 - DNA, 20 bp, Artificial
  CRISPR gRNA sequence
caattggccctttgccttgt

SEQ ID NO: 795800 - DNA, 20 bp, Artificial
  CRISPR gRNA sequence
gtcctagcactgaggaaagg

SEQ ID NO: 795801 - DNA, 20 bp, Artificial
  CRISPR gRNA sequence
ttgtaaagtcctctggtgtg

SEQ ID NO: 795802 - DNA, 20 bp, Artificial
  CRISPR gRNA sequence
agttaatttgtgccctattc

SEQ ID NO: 795803 - DNA, 20 bp, Artificial
  CRISPR gRNA sequence
gcacagtgctatctgagaac

SEQ ID NO: 795804 - DNA, 20 bp, Artificial
  CRISPR gRNA sequence
agtgctatctgagaaccacg

SEQ ID NO: 795805 - DNA, 20 bp, Artificial
  CRISPR gRNA sequence
cacggattgttttactggag

SEQ ID NO: 795806 - DNA, 20 bp, Artificial
  CRISPR gRNA sequence
ctgctaagtaaaagtcaatg

SEQ ID NO: 795807 - DNA, 20 bp, Artificial
  CRISPR gRNA sequence
atttgtctccatccaaaaga

SEQ ID NO: 795808 - DNA, 20 bp, Artificial
  CRISPR gRNA sequence
tccaaacattggataaccca

SEQ ID NO: 795809 - DNA, 20 bp, Artificial
  CRISPR gRNA sequence
gataacccatattgattata

SEQ ID NO: 795810 - DNA, 20 bp, Artificial
  CRISPR gRNA sequence
tctgcttcttaatttctagt

SEQ ID NO: 795811 - DNA, 20 bp, Artificial
  CRISPR gRNA sequence
gaacatccagtaggaaatca

SEQ ID NO: 795812 - DNA, 20 bp, Artificial
  CRISPR gRNA sequence
attagggaattagctggaca

SEQ ID NO: 795813 - DNA, 20 bp, Artificial
  CRISPR gRNA sequence
gacacatggcttctcagaga

SEQ ID NO: 795814 - DNA, 20 bp, Artificial
  CRISPR gRNA sequence
tctaagttcaggctaagaga

SEQ ID NO: 795815 - DNA, 20 bp, Artificial
  CRISPR gRNA sequence
tcttggccttaaaacattga

SEQ ID NO: 795816 - DNA, 20 bp, Artificial
  CRISPR gRNA sequence
cattgaatgtgttttccacc

SEQ ID NO: 795817 - DNA, 20 bp, Artificial
  CRISPR gRNA sequence
tactttctgaaggttgaaac

SEQ ID NO: 795818 - DNA, 20 bp, Artificial
  CRISPR gRNA sequence
aaacatgggtttggcactga

SEQ ID NO: 795819 - DNA, 20 bp, Artificial
  CRISPR gRNA sequence
tgaatgactctatggaacat

SEQ ID NO: 795820 - DNA, 20 bp, Artificial
  CRISPR gRNA sequence
tggaacgaaagatacttctg

SEQ ID NO: 795821 - DNA, 20 bp, Artificial
  CRISPR gRNA sequence
tttcgaggtctcttcattat

SEQ ID NO: 795822 - DNA, 20 bp, Artificial
  CRISPR gRNA sequence
tcctcatacatattcctcta

SEQ ID NO: 795823 - DNA, 20 bp, Artificial
  CRISPR gRNA sequence
aaaattcttgcatactcttt

SEQ ID NO: 795824 - DNA, 20 bp, Artificial
  CRISPR gRNA sequence
attaatttatttatttgaga

SEQ ID NO: 795825 - DNA, 20 bp, Artificial
  CRISPR gRNA sequence
aacctccgcctcctgggttc

SEQ ID NO: 795826 - DNA, 20 bp, Artificial
  CRISPR gRNA sequence
tgcctcggcctcttgagtag

SEQ ID NO: 795827 - DNA, 20 bp, Artificial
  CRISPR gRNA sequence
ttttgtatttttagtagaga

SEQ ID NO: 795828 - DNA, 20 bp, Artificial
  CRISPR gRNA sequence
gggtttcaccatgttagcca

SEQ ID NO: 795829 - DNA, 20 bp, Artificial
  CRISPR gRNA sequence
catctcagcctcccaaagtg

SEQ ID NO: 795830 - DNA, 20 bp, Artificial
  CRISPR gRNA sequence
ctagatataccatttttttt

SEQ ID NO: 795831 - DNA, 20 bp, Artificial
  CRISPR gRNA sequence
gttctcaaagctaatagaga

SEQ ID NO: 795832 - DNA, 20 bp, Artificial
  CRISPR gRNA sequence
atcacctccaggtctcctag

SEQ ID NO: 795833 - DNA, 20 bp, Artificial
  CRISPR gRNA sequence
atgatctgttgctccctaac

SEQ ID NO: 795834 - DNA, 20 bp, Artificial
  CRISPR gRNA sequence
taccctccacccaccatact

SEQ ID NO: 795835 - DNA, 20 bp, Artificial
  CRISPR gRNA sequence
acccaccatactcttcgttt

SEQ ID NO: 795836 - DNA, 20 bp, Artificial
  CRISPR gRNA sequence
accatactcttcgtttccgt

SEQ ID NO: 795837 - DNA, 20 bp, Artificial
  CRISPR gRNA sequence
ttttatacattgacttccgg

SEQ ID NO: 795838 - DNA, 20 bp, Artificial
  CRISPR gRNA sequence
tggtagctggcatgatggga

SEQ ID NO: 795839 - DNA, 20 bp, Artificial
  CRISPR gRNA sequence
cacttattatgaacacagga

SEQ ID NO: 795840 - DNA, 20 bp, Artificial
  CRISPR gRNA sequence
tgagctgccccagagagagg

SEQ ID NO: 795841 - DNA, 20 bp, Artificial
  CRISPR gRNA sequence
gttgagaatttctggctgca

SEQ ID NO: 795842 - DNA, 20 bp, Artificial
  CRISPR gRNA sequence
ttgactatttagtaagccat

SEQ ID NO: 795843 - DNA, 20 bp, Artificial
  CRISPR gRNA sequence
ctgttaacttctcacagcgt

SEQ ID NO: 795844 - DNA, 20 bp, Artificial
  CRISPR gRNA sequence
tcaattcatctcatacaggc

SEQ ID NO: 795845 - DNA, 20 bp, Artificial
  CRISPR gRNA sequence
tccaggggaaaaaagttctc

SEQ ID NO: 795846 - DNA, 20 bp, Artificial
  CRISPR gRNA sequence
gctcatatttaatcctcttt

SEQ ID NO: 795847 - DNA, 20 bp, Artificial
  CRISPR gRNA sequence
atttaatcctctttagaggc

SEQ ID NO: 795848 - DNA, 20 bp, Artificial
  CRISPR gRNA sequence
ctgaagttggtcctaaaatt

SEQ ID NO: 795849 - DNA, 20 bp, Artificial
  CRISPR gRNA sequence
ggtcctaaaattgatggatt

SEQ ID NO: 795850 - DNA, 20 bp, Artificial
  CRISPR gRNA sequence
tgccttggcctcccaaagtg

SEQ ID NO: 795851 - DNA, 20 bp, Artificial
  CRISPR gRNA sequence
gaaccaccatgcccagcctc

SEQ ID NO: 795852 - DNA, 20 bp, Artificial
  CRISPR gRNA sequence
accatgcccagcctctaatg

SEQ ID NO: 795853 - DNA, 20 bp, Artificial
  CRISPR gRNA sequence
aggctctgctgaatcaaagg

SEQ ID NO: 795854 - DNA, 20 bp, Artificial
  CRISPR gRNA sequence
gggaattctagcaggggata

SEQ ID NO: 795855 - DNA, 20 bp, Artificial
  CRISPR gRNA sequence
catactggtggagaaatcaa

SEQ ID NO: 795856 - DNA, 20 bp, Artificial
  CRISPR gRNA sequence
atgtctggaactcaggggtc

SEQ ID NO: 795857 - DNA, 20 bp, Artificial
  CRISPR gRNA sequence
gtgagacaacaaatatcaac

SEQ ID NO: 795858 - DNA, 20 bp, Artificial
  CRISPR gRNA sequence
tccacagcagcagcaggaac

SEQ ID NO: 795859 - DNA, 20 bp, Artificial
  CRISPR gRNA sequence
ggtgtatattaaatcttctg

SEQ ID NO: 795860 - DNA, 20 bp, Artificial
  CRISPR gRNA sequence
ctgacttaatgaagggcatg

SEQ ID NO: 795861 - DNA, 20 bp, Artificial
  CRISPR gRNA sequence
cagctggggtagaattctag

SEQ ID NO: 795862 - DNA, 20 bp, Artificial
  CRISPR gRNA sequence
acatgctggtccttgaatat

SEQ ID NO: 795863 - DNA, 20 bp, Artificial
  CRISPR gRNA sequence
ctctcttaaactcctaaatc

SEQ ID NO: 795864 - DNA, 20 bp, Artificial
  CRISPR gRNA sequence
tatagtgaattttctataaa

SEQ ID NO: 795865 - DNA, 20 bp, Artificial
  CRISPR gRNA sequence
cgggcggatcacctgaggtc

SEQ ID NO: 795866 - DNA, 20 bp, Artificial
  CRISPR gRNA sequence
tcaggaggctgagacaggag

SEQ ID NO: 795867 - DNA, 20 bp, Artificial
  CRISPR gRNA sequence
cctctgcaatcctgctgaca

SEQ ID NO: 795868 - DNA, 20 bp, Artificial
  CRISPR gRNA sequence
tgagcccagtgaaactcaag

SEQ ID NO: 795869 - DNA, 20 bp, Artificial
  CRISPR gRNA sequence
atctgtgttgtcttaaactg

SEQ ID NO: 795870 - DNA, 20 bp, Artificial
  CRISPR gRNA sequence
gaaattacctgtctcttacg

SEQ ID NO: 795871 - DNA, 20 bp, Artificial
  CRISPR gRNA sequence
agataaaagttgttattttc

SEQ ID NO: 795872 - DNA, 20 bp, Artificial
  CRISPR gRNA sequence
aaaagttgttattttcccaa

SEQ ID NO: 795873 - DNA, 20 bp, Artificial
  CRISPR gRNA sequence
atgacactgtgcatgaatca

SEQ ID NO: 795874 - DNA, 20 bp, Artificial
  CRISPR gRNA sequence
tagctattgtactagatatt

SEQ ID NO: 795875 - DNA, 20 bp, Artificial
  CRISPR gRNA sequence
agccaatgggaggtgctagc

SEQ ID NO: 795876 - DNA, 20 bp, Artificial
  CRISPR gRNA sequence
tgagttggggtattcattca

SEQ ID NO: 795877 - DNA, 20 bp, Artificial
  CRISPR gRNA sequence
cctttggagtcgctgcatgt

SEQ ID NO: 795878 - DNA, 20 bp, Artificial
  CRISPR gRNA sequence
tggctacagctcctgggaag

SEQ ID NO: 795879 - DNA, 20 bp, Artificial
  CRISPR gRNA sequence
gggctttccctacagctccc

SEQ ID NO: 795880 - DNA, 20 bp, Artificial
  CRISPR gRNA sequence
cagtgttctgcactatcctt

SEQ ID NO: 795881 - DNA, 20 bp, Artificial
  CRISPR gRNA sequence
tcaaatcactcgagtatgcc

SEQ ID NO: 795882 - DNA, 20 bp, Artificial
  CRISPR gRNA sequence
agtattccagaacacacagc

SEQ ID NO: 795883 - DNA, 20 bp, Artificial
  CRISPR gRNA sequence
agctgaagtttctgccaggg

SEQ ID NO: 795884 - DNA, 20 bp, Artificial
  CRISPR gRNA sequence
gctggtgttggcaggaacgc

SEQ ID NO: 795885 - DNA, 20 bp, Artificial
  CRISPR gRNA sequence
tggcaggtgagctctacctc

SEQ ID NO: 795886 - DNA, 20 bp, Artificial
  CRISPR gRNA sequence
ttctggaacctttaggatgt

SEQ ID NO: 795887 - DNA, 20 bp, Artificial
  CRISPR gRNA sequence
aaaagaaataagactttatt

SEQ ID NO: 795888 - DNA, 20 bp, Artificial
  CRISPR gRNA sequence
actttattttctgattccta

SEQ ID NO: 795889 - DNA, 20 bp, Artificial
  CRISPR gRNA sequence
ttactgaagatagagaagtt

SEQ ID NO: 795890 - DNA, 20 bp, Artificial
  CRISPR gRNA sequence
gagtgttttgttcatagtca

SEQ ID NO: 795891 - DNA, 20 bp, Artificial
  CRISPR gRNA sequence
ccaatatttgaacattggaa

SEQ ID NO: 795892 - DNA, 20 bp, Artificial
  CRISPR gRNA sequence
tggtccaagctaccacaatt

SEQ ID NO: 795893 - DNA, 20 bp, Artificial
  CRISPR gRNA sequence
aggacggaaaaataaaaatc

SEQ ID NO: 795894 - DNA, 20 bp, Artificial
  CRISPR gRNA sequence
actttttacttcctcctttc

SEQ ID NO: 795895 - DNA, 20 bp, Artificial
  CRISPR gRNA sequence
cctcctttcctctgttttct

SEQ ID NO: 795896 - DNA, 20 bp, Artificial
  CRISPR gRNA sequence
cacacacagttcatacacac

SEQ ID NO: 795897 - DNA, 20 bp, Artificial
  CRISPR gRNA sequence
gtattcctttattcatttca

SEQ ID NO: 795898 - DNA, 20 bp, Artificial
  CRISPR gRNA sequence
gctcagtctcagagtagagg

SEQ ID NO: 795899 - DNA, 20 bp, Artificial
  CRISPR gRNA sequence
aagcatgaattttttacatt

SEQ ID NO: 795900 - DNA, 20 bp, Artificial
  CRISPR gRNA sequence
aattttttacattctctgtt

SEQ ID NO: 795901 - DNA, 20 bp, Artificial
  CRISPR gRNA sequence
cttggtgatgtgatatgtta

SEQ ID NO: 795902 - DNA, 20 bp, Artificial
  CRISPR gRNA sequence
gtgatgtgatatgttaacta

SEQ ID NO: 795903 - DNA, 20 bp, Artificial
  CRISPR gRNA sequence
ttttttttttttttttgaga

SEQ ID NO: 795904 - DNA, 20 bp, Artificial
  CRISPR gRNA sequence
ggttcaagcaattctcctgc

SEQ ID NO: 795905 - DNA, 20 bp, Artificial
  CRISPR gRNA sequence
tgcctcagcttcctgagtag

SEQ ID NO: 795906 - DNA, 20 bp, Artificial
  CRISPR gRNA sequence
ttttctattttcagtagaga

SEQ ID NO: 795907 - DNA, 20 bp, Artificial
  CRISPR gRNA sequence
ggtttcaccatgttggtcag

SEQ ID NO: 795908 - DNA, 20 bp, Artificial
  CRISPR gRNA sequence
tgccttggcctcccaaagtg

SEQ ID NO: 795909 - DNA, 20 bp, Artificial
  CRISPR gRNA sequence
tacaggcatgagccactgtg

SEQ ID NO: 795910 - DNA, 20 bp, Artificial
  CRISPR gRNA sequence
ggcatgagccactgtgcccg

SEQ ID NO: 795911 - DNA, 20 bp, Artificial
  CRISPR gRNA sequence
gagaggaagaggggatgagc

SEQ ID NO: 795912 - DNA, 20 bp, Artificial
  CRISPR gRNA sequence
atgtgaaaaccatctgatgt

SEQ ID NO: 795913 - DNA, 20 bp, Artificial
  CRISPR gRNA sequence
tctgatgtgtatgatttact

SEQ ID NO: 795914 - DNA, 20 bp, Artificial
  CRISPR gRNA sequence
tacttattgttttctatgtg

SEQ ID NO: 795915 - DNA, 20 bp, Artificial
  CRISPR gRNA sequence
ctcaatgttaagagttgaca

SEQ ID NO: 795916 - DNA, 20 bp, Artificial
  CRISPR gRNA sequence
atcattttatatgatcatac

SEQ ID NO: 795917 - DNA, 20 bp, Artificial
  CRISPR gRNA sequence
gggtccagcccactattgca

SEQ ID NO: 795918 - DNA, 20 bp, Artificial
  CRISPR gRNA sequence
atcttggtgtcctggttgag

SEQ ID NO: 795919 - DNA, 20 bp, Artificial
  CRISPR gRNA sequence
aagtagggatgccaggaatt

SEQ ID NO: 795920 - DNA, 20 bp, Artificial
  CRISPR gRNA sequence
ccaggaattgggagcttggc

SEQ ID NO: 795921 - DNA, 20 bp, Artificial
  CRISPR gRNA sequence
tcttccactacaagaatcag

SEQ ID NO: 795922 - DNA, 20 bp, Artificial
  CRISPR gRNA sequence
ttggaaggtggtggaaaagg

SEQ ID NO: 795923 - DNA, 20 bp, Artificial
  CRISPR gRNA sequence
ctacagcaattctcctagat

SEQ ID NO: 795924 - DNA, 20 bp, Artificial
  CRISPR gRNA sequence
attctcctagataattgctt

SEQ ID NO: 795925 - DNA, 20 bp, Artificial
  CRISPR gRNA sequence
tgctttgatgattgttccac

SEQ ID NO: 795926 - DNA, 20 bp, Artificial
  CRISPR gRNA sequence
caagatggctaattgtgttg

SEQ ID NO: 795927 - DNA, 20 bp, Artificial
  CRISPR gRNA sequence
ttcagattttctattttctt

SEQ ID NO: 795928 - DNA, 20 bp, Artificial
  CRISPR gRNA sequence
gttgaaatctcaaatgtaat

SEQ ID NO: 795929 - DNA, 20 bp, Artificial
  CRISPR gRNA sequence
gttctcctaagtctgccaat

SEQ ID NO: 795930 - DNA, 20 bp, Artificial
  CRISPR gRNA sequence
actgttaaatggacacacat

SEQ ID NO: 795931 - DNA, 20 bp, Artificial
  CRISPR gRNA sequence
tcctctagaagcagtctttg

SEQ ID NO: 795932 - DNA, 20 bp, Artificial
  CRISPR gRNA sequence
agcaagttaaacttccattg

SEQ ID NO: 795933 - DNA, 20 bp, Artificial
  CRISPR gRNA sequence
caagcaaaattgtgcctctt

SEQ ID NO: 795934 - DNA, 20 bp, Artificial
  CRISPR gRNA sequence
cttctacccattggtatttg

SEQ ID NO: 795935 - DNA, 20 bp, Artificial
  CRISPR gRNA sequence
aaacatgagttcagaatctg

SEQ ID NO: 795936 - DNA, 20 bp, Artificial
  CRISPR gRNA sequence
tcagaatctgagcagtttga

SEQ ID NO: 795937 - DNA, 20 bp, Artificial
  CRISPR gRNA sequence
gttatatgacctcttaaacc

SEQ ID NO: 795938 - DNA, 20 bp, Artificial
  CRISPR gRNA sequence
acctcttaaaccctcagttt

SEQ ID NO: 795939 - DNA, 20 bp, Artificial
  CRISPR gRNA sequence
tccagatagtagtctttggt

SEQ ID NO: 795940 - DNA, 20 bp, Artificial
  CRISPR gRNA sequence
atagtagtctttggttatag

SEQ ID NO: 795941 - DNA, 20 bp, Artificial
  CRISPR gRNA sequence
atctaagcagcacaaatatc

SEQ ID NO: 795942 - DNA, 20 bp, Artificial
  CRISPR gRNA sequence
atgtaacctaaggtcataag

SEQ ID NO: 795943 - DNA, 20 bp, Artificial
  CRISPR gRNA sequence
ataacagaccccttagcact

SEQ ID NO: 795944 - DNA, 20 bp, Artificial
  CRISPR gRNA sequence
ttgtccctgactcaacaact

SEQ ID NO: 795945 - DNA, 20 bp, Artificial
  CRISPR gRNA sequence
ccacccaatacacaaggtgt

SEQ ID NO: 795946 - DNA, 20 bp, Artificial
  CRISPR gRNA sequence
gtgtgctttgtgtgtcctgg

SEQ ID NO: 795947 - DNA, 20 bp, Artificial
  CRISPR gRNA sequence
cactatagcctagtggtagg

SEQ ID NO: 795948 - DNA, 20 bp, Artificial
  CRISPR gRNA sequence
tctgctattgctaatttctg

SEQ ID NO: 795949 - DNA, 20 bp, Artificial
  CRISPR gRNA sequence
ttctgaattgcttccctgtt

SEQ ID NO: 795950 - DNA, 20 bp, Artificial
  CRISPR gRNA sequence
aattgcttccctgttctctg

SEQ ID NO: 795951 - DNA, 20 bp, Artificial
  CRISPR gRNA sequence
tctccctcattaaaagaatt

SEQ ID NO: 795952 - DNA, 20 bp, Artificial
  CRISPR gRNA sequence
tcattaaaagaattactagt

SEQ ID NO: 795953 - DNA, 20 bp, Artificial
  CRISPR gRNA sequence
aaagaattactagtttcagc

SEQ ID NO: 795954 - DNA, 20 bp, Artificial
  CRISPR gRNA sequence
agtttcagctttagatttcc

SEQ ID NO: 795955 - DNA, 20 bp, Artificial
  CRISPR gRNA sequence
tttagatttccacaggttta

SEQ ID NO: 795956 - DNA, 20 bp, Artificial
  CRISPR gRNA sequence
tttccacaggtttaaatggt

SEQ ID NO: 795957 - DNA, 20 bp, Artificial
  CRISPR gRNA sequence
gtttaaatggtttctgtttc

SEQ ID NO: 795958 - DNA, 20 bp, Artificial
  CRISPR gRNA sequence
tgaaatgtatacatggtagt

SEQ ID NO: 795959 - DNA, 20 bp, Artificial
  CRISPR gRNA sequence
acagtaaataaatggaaaaa

SEQ ID NO: 795960 - DNA, 20 bp, Artificial
  CRISPR gRNA sequence
cttggtcttagaggatctat

SEQ ID NO: 795961 - DNA, 20 bp, Artificial
  CRISPR gRNA sequence
taatcagttaaatcttttag

SEQ ID NO: 795962 - DNA, 20 bp, Artificial
  CRISPR gRNA sequence
tgaaaaggaatagcaggtta

SEQ ID NO: 795963 - DNA, 20 bp, Artificial
  CRISPR gRNA sequence
ttaacgagtttgtaatcccc

SEQ ID NO: 795964 - DNA, 20 bp, Artificial
  CRISPR gRNA sequence
caccccattgaaattcagga

SEQ ID NO: 795965 - DNA, 20 bp, Artificial
  CRISPR gRNA sequence
aaaaacgtgttattttactc

SEQ ID NO: 795966 - DNA, 20 bp, Artificial
  CRISPR gRNA sequence
agctcaggacattttcttga

SEQ ID NO: 795967 - DNA, 20 bp, Artificial
  CRISPR gRNA sequence
actccgattttcttacaccc

SEQ ID NO: 795968 - DNA, 20 bp, Artificial
  CRISPR gRNA sequence
tgagacttggctcttttagc

SEQ ID NO: 795969 - DNA, 20 bp, Artificial
  CRISPR gRNA sequence
aaatgctttccttgggcctt

SEQ ID NO: 795970 - DNA, 20 bp, Artificial
  CRISPR gRNA sequence
cagttgtcttttcactgctg

SEQ ID NO: 795971 - DNA, 20 bp, Artificial
  CRISPR gRNA sequence
ttcactgctgccttgcttct

SEQ ID NO: 795972 - DNA, 20 bp, Artificial
  CRISPR gRNA sequence
ctgctgccttgcttctcttt

SEQ ID NO: 795973 - DNA, 20 bp, Artificial
  CRISPR gRNA sequence
gattgtttccttcctctgcc

SEQ ID NO: 795974 - DNA, 20 bp, Artificial
  CRISPR gRNA sequence
ttttgtatttttagtagaga

SEQ ID NO: 795975 - DNA, 20 bp, Artificial
  CRISPR gRNA sequence
cacctcggcctcccaaagtg

SEQ ID NO: 795976 - DNA, 20 bp, Artificial
  CRISPR gRNA sequence
aaccacgcctggcccaaatg

SEQ ID NO: 795977 - DNA, 20 bp, Artificial
  CRISPR gRNA sequence
ttcttatgcctttccatcct

SEQ ID NO: 795978 - DNA, 20 bp, Artificial
  CRISPR gRNA sequence
cacttatgagtgagagcata

SEQ ID NO: 795979 - DNA, 20 bp, Artificial
  CRISPR gRNA sequence
atgagtgagagcatacaatg

SEQ ID NO: 795980 - DNA, 20 bp, Artificial
  CRISPR gRNA sequence
catccaggatgctgcaaatg

SEQ ID NO: 795981 - DNA, 20 bp, Artificial
  CRISPR gRNA sequence
ccacattttctttatccact

SEQ ID NO: 795982 - DNA, 20 bp, Artificial
  CRISPR gRNA sequence
ctttgggtaaatacctagta

SEQ ID NO: 795983 - DNA, 20 bp, Artificial
  CRISPR gRNA sequence
gatcaaatggtagatctact

SEQ ID NO: 795984 - DNA, 20 bp, Artificial
  CRISPR gRNA sequence
agtttttaaaggaatctcca

SEQ ID NO: 795985 - DNA, 20 bp, Artificial
  CRISPR gRNA sequence
ctgttttccatagtggttgt

SEQ ID NO: 795986 - DNA, 20 bp, Artificial
  CRISPR gRNA sequence
cattcccaccaacagtgtaa

SEQ ID NO: 795987 - DNA, 20 bp, Artificial
  CRISPR gRNA sequence
ggagtaaggtggtatcgcag

SEQ ID NO: 795988 - DNA, 20 bp, Artificial
  CRISPR gRNA sequence
aaggtggtatcgcagtgtgg

SEQ ID NO: 795989 - DNA, 20 bp, Artificial
  CRISPR gRNA sequence
cttagcccattttttgatgg

SEQ ID NO: 795990 - DNA, 20 bp, Artificial
  CRISPR gRNA sequence
gcccattttttgatgggatc

SEQ ID NO: 795991 - DNA, 20 bp, Artificial
  CRISPR gRNA sequence
gggatcgtttgtttttttct

SEQ ID NO: 795992 - DNA, 20 bp, Artificial
  CRISPR gRNA sequence
gctgatttatttgcatacct

SEQ ID NO: 795993 - DNA, 20 bp, Artificial
  CRISPR gRNA sequence
tattagtcctttgtcagatg

SEQ ID NO: 795994 - DNA, 20 bp, Artificial
  CRISPR gRNA sequence
tttgtcagatgtatagattg

SEQ ID NO: 795995 - DNA, 20 bp, Artificial
  CRISPR gRNA sequence
tgtgggttgtctgttaactc

SEQ ID NO: 795996 - DNA, 20 bp, Artificial
  CRISPR gRNA sequence
gattatttcttttgctgtgc

SEQ ID NO: 795997 - DNA, 20 bp, Artificial
  CRISPR gRNA sequence
cttttgctgtgcagaagctt

SEQ ID NO: 795998 - DNA, 20 bp, Artificial
  CRISPR gRNA sequence
tttacctttgtctttgttgc

SEQ ID NO: 795999 - DNA, 20 bp, Artificial
  CRISPR gRNA sequence
ttgcctaagctaatgtctag

SEQ ID NO: 796000 - DNA, 20 bp, Artificial
  CRISPR gRNA sequence
atgttatcttctagaatcgt

SEQ ID NO: 796001 - DNA, 20 bp, Artificial
  CRISPR gRNA sequence
gaatcgttatggtttcaggt

SEQ ID NO: 796002 - DNA, 20 bp, Artificial
  CRISPR gRNA sequence
taagtctttgatccatcttg

SEQ ID NO: 796003 - DNA, 20 bp, Artificial
  CRISPR gRNA sequence
tataaggtaagatatgagga

SEQ ID NO: 796004 - DNA, 20 bp, Artificial
  CRISPR gRNA sequence
tggctagccaattatcccag

SEQ ID NO: 796005 - DNA, 20 bp, Artificial
  CRISPR gRNA sequence
taggatgtactttccccact

SEQ ID NO: 796006 - DNA, 20 bp, Artificial
  CRISPR gRNA sequence
gtactttccccactttatgt

SEQ ID NO: 796007 - DNA, 20 bp, Artificial
  CRISPR gRNA sequence
tttccccactttatgttttt

SEQ ID NO: 796008 - DNA, 20 bp, Artificial
  CRISPR gRNA sequence
agatcagttggctataagta

SEQ ID NO: 796009 - DNA, 20 bp, Artificial
  CRISPR gRNA sequence
tttggctttattcctaggtt

SEQ ID NO: 796010 - DNA, 20 bp, Artificial
  CRISPR gRNA sequence
ctatttttatactagtatta

SEQ ID NO: 796011 - DNA, 20 bp, Artificial
  CRISPR gRNA sequence
tggtgactatggtgttatag

SEQ ID NO: 796012 - DNA, 20 bp, Artificial
  CRISPR gRNA sequence
agttaggcaatgtgatgcct

SEQ ID NO: 796013 - DNA, 20 bp, Artificial
  CRISPR gRNA sequence
gatgcctccaggtttgttct

SEQ ID NO: 796014 - DNA, 20 bp, Artificial
  CRISPR gRNA sequence
tgttctttttgcttagtctt

SEQ ID NO: 796015 - DNA, 20 bp, Artificial
  CRISPR gRNA sequence
tttttggttccatatgaatt

SEQ ID NO: 796016 - DNA, 20 bp, Artificial
  CRISPR gRNA sequence
gaatgatggtagtattttga

SEQ ID NO: 796017 - DNA, 20 bp, Artificial
  CRISPR gRNA sequence
gatggggattgcattgactt

SEQ ID NO: 796018 - DNA, 20 bp, Artificial
  CRISPR gRNA sequence
gggattgcattgactttgta

SEQ ID NO: 796019 - DNA, 20 bp, Artificial
  CRISPR gRNA sequence
aagtatggtcattttcacaa

SEQ ID NO: 796020 - DNA, 20 bp, Artificial
  CRISPR gRNA sequence
tacctattcatgaacatggg

SEQ ID NO: 796021 - DNA, 20 bp, Artificial
  CRISPR gRNA sequence
tgaacatgggatgtgtttcc

SEQ ID NO: 796022 - DNA, 20 bp, Artificial
  CRISPR gRNA sequence
tttccatttgtttgtgtcat

SEQ ID NO: 796023 - DNA, 20 bp, Artificial
  CRISPR gRNA sequence
tcatctgtgatttctttcag

SEQ ID NO: 796024 - DNA, 20 bp, Artificial
  CRISPR gRNA sequence
gatttctttcagtagtgatt

SEQ ID NO: 796025 - DNA, 20 bp, Artificial
  CRISPR gRNA sequence
atgttggtgtatagcagagc

SEQ ID NO: 796026 - DNA, 20 bp, Artificial
  CRISPR gRNA sequence
gtatcctgaaactttgctga

SEQ ID NO: 796027 - DNA, 20 bp, Artificial
  CRISPR gRNA sequence
tgaatttgtttaccagttct

SEQ ID NO: 796028 - DNA, 20 bp, Artificial
  CRISPR gRNA sequence
gagctttcaagatgaatcct

SEQ ID NO: 796029 - DNA, 20 bp, Artificial
  CRISPR gRNA sequence
tcatatcatcagcaaacagc

SEQ ID NO: 796030 - DNA, 20 bp, Artificial
  CRISPR gRNA sequence
cttgttccaattctcaggga

SEQ ID NO: 796031 - DNA, 20 bp, Artificial
  CRISPR gRNA sequence
cattcagcataatgttggct

SEQ ID NO: 796032 - DNA, 20 bp, Artificial
  CRISPR gRNA sequence
ttggctgtgggtttgtcgta

SEQ ID NO: 796033 - DNA, 20 bp, Artificial
  CRISPR gRNA sequence
ccttctgtgctaattttgct

SEQ ID NO: 796034 - DNA, 20 bp, Artificial
  CRISPR gRNA sequence
gggttttaatcataaaggat

SEQ ID NO: 796035 - DNA, 20 bp, Artificial
  CRISPR gRNA sequence
aaaggatgttagattttgtc

SEQ ID NO: 796036 - DNA, 20 bp, Artificial
  CRISPR gRNA sequence
ctgaatctattgagatgatc

SEQ ID NO: 796037 - DNA, 20 bp, Artificial
  CRISPR gRNA sequence
tattgagatgatcatgtgat

SEQ ID NO: 796038 - DNA, 20 bp, Artificial
  CRISPR gRNA sequence
catgtgatttttgtttttaa

SEQ ID NO: 796039 - DNA, 20 bp, Artificial
  CRISPR gRNA sequence
tgtaaaacccacttgatcat

SEQ ID NO: 796040 - DNA, 20 bp, Artificial
  CRISPR gRNA sequence
gattatctttttgatatgct

SEQ ID NO: 796041 - DNA, 20 bp, Artificial
  CRISPR gRNA sequence
ttggttagctagtattttgt

SEQ ID NO: 796042 - DNA, 20 bp, Artificial
  CRISPR gRNA sequence
gttcatcagggatactggcc

SEQ ID NO: 796043 - DNA, 20 bp, Artificial
  CRISPR gRNA sequence
ctttttttgttatgtccttc

SEQ ID NO: 796044 - DNA, 20 bp, Artificial
  CRISPR gRNA sequence
ggtttttgtattagggtgct

SEQ ID NO: 796045 - DNA, 20 bp, Artificial
  CRISPR gRNA sequence
agggtgctactggcttcata

SEQ ID NO: 796046 - DNA, 20 bp, Artificial
  CRISPR gRNA sequence
ggcttcatagaatgatttag

SEQ ID NO: 796047 - DNA, 20 bp, Artificial
  CRISPR gRNA sequence
cagctatgaatctgtctggt

SEQ ID NO: 796048 - DNA, 20 bp, Artificial
  CRISPR gRNA sequence
taaaagttaccattcaatct

SEQ ID NO: 796049 - DNA, 20 bp, Artificial
  CRISPR gRNA sequence
aatcttgctgcttgttattg

SEQ ID NO: 796050 - DNA, 20 bp, Artificial
  CRISPR gRNA sequence
gtttatagttcctatatctt

SEQ ID NO: 796051 - DNA, 20 bp, Artificial
  CRISPR gRNA sequence
ccaggaatgtatccatctcc

SEQ ID NO: 796052 - DNA, 20 bp, Artificial
  CRISPR gRNA sequence
tatccatctcctctagcttt

SEQ ID NO: 796053 - DNA, 20 bp, Artificial
  CRISPR gRNA sequence
tatctccatttcatttctaa

SEQ ID NO: 796054 - DNA, 20 bp, Artificial
  CRISPR gRNA sequence
tttatttatcttttcaaata

SEQ ID NO: 796055 - DNA, 20 bp, Artificial
  CRISPR gRNA sequence
atcttttcaaataaccagat

SEQ ID NO: 796056 - DNA, 20 bp, Artificial
  CRISPR gRNA sequence
tcatttctcttttgtatttt

SEQ ID NO: 796057 - DNA, 20 bp, Artificial
  CRISPR gRNA sequence
ttgtaatttcttttcttctg

SEQ ID NO: 796058 - DNA, 20 bp, Artificial
  CRISPR gRNA sequence
tttcttttcttctgctgggt

SEQ ID NO: 796059 - DNA, 20 bp, Artificial
  CRISPR gRNA sequence
tttcttctgctgggtttggg

SEQ ID NO: 796060 - DNA, 20 bp, Artificial
  CRISPR gRNA sequence
tgggtttgggtttggattgt

SEQ ID NO: 796061 - DNA, 20 bp, Artificial
  CRISPR gRNA sequence
ccagctccaggaggtgtgac

SEQ ID NO: 796062 - DNA, 20 bp, Artificial
  CRISPR gRNA sequence
atgtaggcatttaatgctat

SEQ ID NO: 796063 - DNA, 20 bp, Artificial
  CRISPR gRNA sequence
gctatgaatgtttctcttag

SEQ ID NO: 796064 - DNA, 20 bp, Artificial
  CRISPR gRNA sequence
gcactgcttttgctgtatcc

SEQ ID NO: 796065 - DNA, 20 bp, Artificial
  CRISPR gRNA sequence
cactattatcgttcagttca

SEQ ID NO: 796066 - DNA, 20 bp, Artificial
  CRISPR gRNA sequence
aaagagtttttaaatttcta

SEQ ID NO: 796067 - DNA, 20 bp, Artificial
  CRISPR gRNA sequence
atttaacttccatgtaattg

SEQ ID NO: 796068 - DNA, 20 bp, Artificial
  CRISPR gRNA sequence
atggttttgaaggttccttt

SEQ ID NO: 796069 - DNA, 20 bp, Artificial
  CRISPR gRNA sequence
ggttccttttggagtttatt

SEQ ID NO: 796070 - DNA, 20 bp, Artificial
  CRISPR gRNA sequence
taagagagtacttgatataa

SEQ ID NO: 796071 - DNA, 20 bp, Artificial
  CRISPR gRNA sequence
attttcttaaatttatggag

SEQ ID NO: 796072 - DNA, 20 bp, Artificial
  CRISPR gRNA sequence
tgatgaatagaatgtatatt

SEQ ID NO: 796073 - DNA, 20 bp, Artificial
  CRISPR gRNA sequence
taagtctatttgtggtaggg

SEQ ID NO: 796074 - DNA, 20 bp, Artificial
  CRISPR gRNA sequence
ggtagggcatagtttaaatt

SEQ ID NO: 796075 - DNA, 20 bp, Artificial
  CRISPR gRNA sequence
catagtttaaattcattgtt

SEQ ID NO: 796076 - DNA, 20 bp, Artificial
  CRISPR gRNA sequence
ttctggtttgaagtacttct

SEQ ID NO: 796077 - DNA, 20 bp, Artificial
  CRISPR gRNA sequence
tgccctgcccaggccttcag

SEQ ID NO: 796078 - DNA, 20 bp, Artificial
  CRISPR gRNA sequence
gatggtttggctcttggtgt

SEQ ID NO: 796079 - DNA, 20 bp, Artificial
  CRISPR gRNA sequence
atgctcccgccccttcctca

SEQ ID NO: 796080 - DNA, 20 bp, Artificial
  CRISPR gRNA sequence
ccccagaaatgtaggtgcca

SEQ ID NO: 796081 - DNA, 20 bp, Artificial
  CRISPR gRNA sequence
tgctataaacaaacccattt

SEQ ID NO: 796082 - DNA, 20 bp, Artificial
  CRISPR gRNA sequence
tcattggggcctcagatcta

SEQ ID NO: 796083 - DNA, 20 bp, Artificial
  CRISPR gRNA sequence
aggtgatggtccaacttttt

SEQ ID NO: 796084 - DNA, 20 bp, Artificial
  CRISPR gRNA sequence
tatgctcttctcacctatta

SEQ ID NO: 796085 - DNA, 20 bp, Artificial
  CRISPR gRNA sequence
gttgattcttataatttttc

SEQ ID NO: 796086 - DNA, 20 bp, Artificial
  CRISPR gRNA sequence
ataaatatttaacaacagta

SEQ ID NO: 796087 - DNA, 20 bp, Artificial
  CRISPR gRNA sequence
ttttctgctgttatatctgt

SEQ ID NO: 796088 - DNA, 20 bp, Artificial
  CRISPR gRNA sequence
atatctgttattgcttgtaa

SEQ ID NO: 796089 - DNA, 20 bp, Artificial
  CRISPR gRNA sequence
gctcactacaagctccgcct

SEQ ID NO: 796090 - DNA, 20 bp, Artificial
  CRISPR gRNA sequence
gttgtattttttagtagaga

SEQ ID NO: 796091 - DNA, 20 bp, Artificial
  CRISPR gRNA sequence
cgccttggcctcccaaagtg

SEQ ID NO: 796092 - DNA, 20 bp, Artificial
  CRISPR gRNA sequence
aatatatatatatagtacaa

SEQ ID NO: 796093 - DNA, 20 bp, Artificial
  CRISPR gRNA sequence
aaataaataagacaaataac

SEQ ID NO: 796094 - DNA, 20 bp, Artificial
  CRISPR gRNA sequence
aaaaaattcttctctgtcta

SEQ ID NO: 796095 - DNA, 20 bp, Artificial
  CRISPR gRNA sequence
tttatcttaatgtaacatat

SEQ ID NO: 796096 - DNA, 20 bp, Artificial
  CRISPR gRNA sequence
aatgtaacatatttttgttt

SEQ ID NO: 796097 - DNA, 20 bp, Artificial
  CRISPR gRNA sequence
tttttgtttgacagattttg

SEQ ID NO: 796098 - DNA, 20 bp, Artificial
  CRISPR gRNA sequence
aaacttttctcttgtgacta

SEQ ID NO: 796099 - DNA, 20 bp, Artificial
  CRISPR gRNA sequence
tctaatttttttttttaaca

SEQ ID NO: 796100 - DNA, 20 bp, Artificial
  CRISPR gRNA sequence
agggtacatgtgcacaacgt

SEQ ID NO: 796101 - DNA, 20 bp, Artificial
  CRISPR gRNA sequence
cacctatgagtgagaacatg

SEQ ID NO: 796102 - DNA, 20 bp, Artificial
  CRISPR gRNA sequence
atgagtgagaacatgcggtg

SEQ ID NO: 796103 - DNA, 20 bp, Artificial
  CRISPR gRNA sequence
gtttggttttttgtccttgg

SEQ ID NO: 796104 - DNA, 20 bp, Artificial
  CRISPR gRNA sequence
tgggatagtttgctgagaat

SEQ ID NO: 796105 - DNA, 20 bp, Artificial
  CRISPR gRNA sequence
gtttgctgagaatgatggtt

SEQ ID NO: 796106 - DNA, 20 bp, Artificial
  CRISPR gRNA sequence
agaaccatatgacatggttg

SEQ ID NO: 796107 - DNA, 20 bp, Artificial
  CRISPR gRNA sequence
atttctatttttcatttttt

SEQ ID NO: 796108 - DNA, 20 bp, Artificial
  CRISPR gRNA sequence
agtaaatcaatgggaatgga

SEQ ID NO: 796109 - DNA, 20 bp, Artificial
  CRISPR gRNA sequence
caatgccatttcattctttg

SEQ ID NO: 796110 - DNA, 20 bp, Artificial
  CRISPR gRNA sequence
acatggcaaaaattactcat

SEQ ID NO: 796111 - DNA, 20 bp, Artificial
  CRISPR gRNA sequence
agataccacattatttgcaa

SEQ ID NO: 796112 - DNA, 20 bp, Artificial
  CRISPR gRNA sequence
ttcttttatttaacactata

SEQ ID NO: 796113 - DNA, 20 bp, Artificial
  CRISPR gRNA sequence
atattcatgatgagtgagtg

SEQ ID NO: 796114 - DNA, 20 bp, Artificial
  CRISPR gRNA sequence
agtggtaggcttaaaagagg

SEQ ID NO: 796115 - DNA, 20 bp, Artificial
  CRISPR gRNA sequence
tctttgtaatccccaaatat

SEQ ID NO: 796116 - DNA, 20 bp, Artificial
  CRISPR gRNA sequence
cccaggaatgagagacagtt

SEQ ID NO: 796117 - DNA, 20 bp, Artificial
  CRISPR gRNA sequence
gagatcaataaaaacagagg

SEQ ID NO: 796118 - DNA, 20 bp, Artificial
  CRISPR gRNA sequence
aaaacagttacatctaggct

SEQ ID NO: 796119 - DNA, 20 bp, Artificial
  CRISPR gRNA sequence
tcaatgttgacaacaatcct

SEQ ID NO: 796120 - DNA, 20 bp, Artificial
  CRISPR gRNA sequence
tcatcctcatgtccagtccc

SEQ ID NO: 796121 - DNA, 20 bp, Artificial
  CRISPR gRNA sequence
acacactttctgccaaggtt

SEQ ID NO: 796122 - DNA, 20 bp, Artificial
  CRISPR gRNA sequence
ttctagaacaaacaagagtg

SEQ ID NO: 796123 - DNA, 20 bp, Artificial
  CRISPR gRNA sequence
gtgtgaagattctctttata

SEQ ID NO: 796124 - DNA, 20 bp, Artificial
  CRISPR gRNA sequence
gctacttcatctgcaataaa

SEQ ID NO: 796125 - DNA, 20 bp, Artificial
  CRISPR gRNA sequence
aaatagggcttgcatttgag

SEQ ID NO: 796126 - DNA, 20 bp, Artificial
  CRISPR gRNA sequence
cacacacacgtccctcagaa

SEQ ID NO: 796127 - DNA, 20 bp, Artificial
  CRISPR gRNA sequence
tccatgaatgggcggcaaac

SEQ ID NO: 796128 - DNA, 20 bp, Artificial
  CRISPR gRNA sequence
caaaccatggttttaaaaac

SEQ ID NO: 796129 - DNA, 20 bp, Artificial
  CRISPR gRNA sequence
tgggagaattgtgaattagg

SEQ ID NO: 796130 - DNA, 20 bp, Artificial
  CRISPR gRNA sequence
acatttcagggactaatttt

SEQ ID NO: 796131 - DNA, 20 bp, Artificial
  CRISPR gRNA sequence
ccccctttcacttgtacttc

SEQ ID NO: 796132 - DNA, 20 bp, Artificial
  CRISPR gRNA sequence
gtcaaaaattatttccgagc

SEQ ID NO: 796133 - DNA, 20 bp, Artificial
  CRISPR gRNA sequence
tagctgtctccttaaaagca

SEQ ID NO: 796134 - DNA, 20 bp, Artificial
  CRISPR gRNA sequence
tgtctccttaaaagcagcct

SEQ ID NO: 796135 - DNA, 20 bp, Artificial
  CRISPR gRNA sequence
cttaaaagcagcctgcttgt

SEQ ID NO: 796136 - DNA, 20 bp, Artificial
  CRISPR gRNA sequence
ttttgcttgagctaccttta

SEQ ID NO: 796137 - DNA, 20 bp, Artificial
  CRISPR gRNA sequence
ttgcagatcctctgttggag

SEQ ID NO: 796138 - DNA, 20 bp, Artificial
  CRISPR gRNA sequence
ctctgttggagagatgcttc

SEQ ID NO: 796139 - DNA, 20 bp, Artificial
  CRISPR gRNA sequence
gtagtcccaggcgaccccat

SEQ ID NO: 796140 - DNA, 20 bp, Artificial
  CRISPR gRNA sequence
ccccatccatctgggcaaga

SEQ ID NO: 796141 - DNA, 20 bp, Artificial
  CRISPR gRNA sequence
tcctctctgggcaccccagc

SEQ ID NO: 796142 - DNA, 20 bp, Artificial
  CRISPR gRNA sequence
caagagcttctggtggacag

SEQ ID NO: 796143 - DNA, 20 bp, Artificial
  CRISPR gRNA sequence
tcatctgtcatataagaaca

SEQ ID NO: 796144 - DNA, 20 bp, Artificial
  CRISPR gRNA sequence
ataccttcacatcctattct

SEQ ID NO: 796145 - DNA, 20 bp, Artificial
  CRISPR gRNA sequence
cttcacatcctattctccag

SEQ ID NO: 796146 - DNA, 20 bp, Artificial
  CRISPR gRNA sequence
ggtttgtttccctcaatcca

SEQ ID NO: 796147 - DNA, 20 bp, Artificial
  CRISPR gRNA sequence
tctgctaacacatcgtctca

SEQ ID NO: 796148 - DNA, 20 bp, Artificial
  CRISPR gRNA sequence
aaaaaggttaagtaacttgc

SEQ ID NO: 796149 - DNA, 20 bp, Artificial
  CRISPR gRNA sequence
acatcatacaagcccactgt

SEQ ID NO: 796150 - DNA, 20 bp, Artificial
  CRISPR gRNA sequence
gtgctaggtacttttaacta

SEQ ID NO: 796151 - DNA, 20 bp, Artificial
  CRISPR gRNA sequence
actgaaaacatgaccgtgaa

SEQ ID NO: 796152 - DNA, 20 bp, Artificial
  CRISPR gRNA sequence
gttaaaatccagagccagtc

SEQ ID NO: 796153 - DNA, 20 bp, Artificial
  CRISPR gRNA sequence
agatgtttgactacaaaatc

SEQ ID NO: 796154 - DNA, 20 bp, Artificial
  CRISPR gRNA sequence
caaaatccgtagtttccact

SEQ ID NO: 796155 - DNA, 20 bp, Artificial
  CRISPR gRNA sequence
cacgccactagaagtatgta

SEQ ID NO: 796156 - DNA, 20 bp, Artificial
  CRISPR gRNA sequence
tttttccttttaatcaaaca

SEQ ID NO: 796157 - DNA, 20 bp, Artificial
  CRISPR gRNA sequence
gggtagataacagtatctgg

SEQ ID NO: 796158 - DNA, 20 bp, Artificial
  CRISPR gRNA sequence
atctgggtaggatttgataa

SEQ ID NO: 796159 - DNA, 20 bp, Artificial
  CRISPR gRNA sequence
tatttaccagtgcaaatgat

SEQ ID NO: 796160 - DNA, 20 bp, Artificial
  CRISPR gRNA sequence
tttcatctaccacaggggta

SEQ ID NO: 796161 - DNA, 20 bp, Artificial
  CRISPR gRNA sequence
tgtgaaaaatgacaaaatta

SEQ ID NO: 796162 - DNA, 20 bp, Artificial
  CRISPR gRNA sequence
gaggtataggaaaatcttga

SEQ ID NO: 796163 - DNA, 20 bp, Artificial
  CRISPR gRNA sequence
agtagtttctgaataatcac

SEQ ID NO: 796164 - DNA, 20 bp, Artificial
  CRISPR gRNA sequence
ttagatcaaattatgttcag

SEQ ID NO: 796165 - DNA, 20 bp, Artificial
  CRISPR gRNA sequence
atcaaattatgttcagtaga

SEQ ID NO: 796166 - DNA, 20 bp, Artificial
  CRISPR gRNA sequence
tcattcaacaaatatttggg

SEQ ID NO: 796167 - DNA, 20 bp, Artificial
  CRISPR gRNA sequence
taagcattagctattccaga

SEQ ID NO: 796168 - DNA, 20 bp, Artificial
  CRISPR gRNA sequence
gcctgggttcaaatgctgac

SEQ ID NO: 796169 - DNA, 20 bp, Artificial
  CRISPR gRNA sequence
gagtccgtcctttaatcttt

SEQ ID NO: 796170 - DNA, 20 bp, Artificial
  CRISPR gRNA sequence
gttcgttcctttctttcgta

SEQ ID NO: 796171 - DNA, 20 bp, Artificial
  CRISPR gRNA sequence
ccaggacagtccattctctg

SEQ ID NO: 796172 - DNA, 20 bp, Artificial
  CRISPR gRNA sequence
tttcacagtataagtaactt

SEQ ID NO: 796173 - DNA, 20 bp, Artificial
  CRISPR gRNA sequence
taagtaacttttgggttttc

SEQ ID NO: 796174 - DNA, 20 bp, Artificial
  CRISPR gRNA sequence
ttttgggttttctgctgctt

SEQ ID NO: 796175 - DNA, 20 bp, Artificial
  CRISPR gRNA sequence
tgattcccactgcagatgtc

SEQ ID NO: 796176 - DNA, 20 bp, Artificial
  CRISPR gRNA sequence
cactgcagatgtcctctgat

SEQ ID NO: 796177 - DNA, 20 bp, Artificial
  CRISPR gRNA sequence
ctttgaaggcaaagaccagg

SEQ ID NO: 796178 - DNA, 20 bp, Artificial
  CRISPR gRNA sequence
gaaggcaaagaccaggctga

SEQ ID NO: 796179 - DNA, 20 bp, Artificial
  CRISPR gRNA sequence
gcacatagcaagttctagtt

SEQ ID NO: 796180 - DNA, 20 bp, Artificial
  CRISPR gRNA sequence
gaccctggttatatattcac

SEQ ID NO: 796181 - DNA, 20 bp, Artificial
  CRISPR gRNA sequence
tgatagtgatatgcacaaac

SEQ ID NO: 796182 - DNA, 20 bp, Artificial
  CRISPR gRNA sequence
tatttcaaatgaccgacatt

SEQ ID NO: 796183 - DNA, 20 bp, Artificial
  CRISPR gRNA sequence
catttttggcttgcctctat

SEQ ID NO: 796184 - DNA, 20 bp, Artificial
  CRISPR gRNA sequence
cctggaataaggcatgtaaa

SEQ ID NO: 796185 - DNA, 20 bp, Artificial
  CRISPR gRNA sequence
catgtaaaaagagatttcct

SEQ ID NO: 796186 - DNA, 20 bp, Artificial
  CRISPR gRNA sequence
ttactcttctataatacttc

SEQ ID NO: 796187 - DNA, 20 bp, Artificial
  CRISPR gRNA sequence
acaggaaacagggaagaaaa

SEQ ID NO: 796188 - DNA, 20 bp, Artificial
  CRISPR gRNA sequence
tagcaaatttatttactgca

SEQ ID NO: 796189 - DNA, 20 bp, Artificial
  CRISPR gRNA sequence
taacttcctctggaactccc

SEQ ID NO: 796190 - DNA, 20 bp, Artificial
  CRISPR gRNA sequence
ctgaatagctcagaatacct

SEQ ID NO: 796191 - DNA, 20 bp, Artificial
  CRISPR gRNA sequence
tggtctaattttgccccaag

SEQ ID NO: 796192 - DNA, 20 bp, Artificial
  CRISPR gRNA sequence
gtttctaagacatgcaaact

SEQ ID NO: 796193 - DNA, 20 bp, Artificial
  CRISPR gRNA sequence
ctaagacatgcaaactttga

SEQ ID NO: 796194 - DNA, 20 bp, Artificial
  CRISPR gRNA sequence
tgattactccatacaaaata

SEQ ID NO: 796195 - DNA, 20 bp, Artificial
  CRISPR gRNA sequence
ataagaggtttaggcaatgc

SEQ ID NO: 796196 - DNA, 20 bp, Artificial
  CRISPR gRNA sequence
tttttgaaatcctgaaacat

SEQ ID NO: 796197 - DNA, 20 bp, Artificial
  CRISPR gRNA sequence
tgatgcaaacaattctatga

SEQ ID NO: 796198 - DNA, 20 bp, Artificial
  CRISPR gRNA sequence
tttctcaagcccagctgcaa

SEQ ID NO: 796199 - DNA, 20 bp, Artificial
  CRISPR gRNA sequence
gctaacattggaatcacctg

SEQ ID NO: 796200 - DNA, 20 bp, Artificial
  CRISPR gRNA sequence
ggagatgaggtcagcatcat

SEQ ID NO: 796201 - DNA, 20 bp, Artificial
  CRISPR gRNA sequence
attaaagattttcttttcct

SEQ ID NO: 796202 - DNA, 20 bp, Artificial
  CRISPR gRNA sequence
tctgcattttaagaaggtca

SEQ ID NO: 796203 - DNA, 20 bp, Artificial
  CRISPR gRNA sequence
acggtgatttgcatgcacat

SEQ ID NO: 796204 - DNA, 20 bp, Artificial
  CRISPR gRNA sequence
tgtgtacactacatccatga

SEQ ID NO: 796205 - DNA, 20 bp, Artificial
  CRISPR gRNA sequence
tttgctgtatgctaaggaaa

SEQ ID NO: 796206 - DNA, 20 bp, Artificial
  CRISPR gRNA sequence
tgtatgctaaggaaaagatg

SEQ ID NO: 796207 - DNA, 20 bp, Artificial
  CRISPR gRNA sequence
catgccacatggttattaaa

SEQ ID NO: 796208 - DNA, 20 bp, Artificial
  CRISPR gRNA sequence
ttattaaattaagcttcaac

SEQ ID NO: 796209 - DNA, 20 bp, Artificial
  CRISPR gRNA sequence
ttagacaaaggagaaaactg

SEQ ID NO: 796210 - DNA, 20 bp, Artificial
  CRISPR gRNA sequence
tacaaaattaagctgacaac

SEQ ID NO: 796211 - DNA, 20 bp, Artificial
  CRISPR gRNA sequence
tcatgtatgcaggtcctttt

SEQ ID NO: 796212 - DNA, 20 bp, Artificial
  CRISPR gRNA sequence
ccttttgctagattagaaca

SEQ ID NO: 796213 - DNA, 20 bp, Artificial
  CRISPR gRNA sequence
tgcatttcaaaaattcttgg

SEQ ID NO: 796214 - DNA, 20 bp, Artificial
  CRISPR gRNA sequence
ttatttgcattacctcccaa

SEQ ID NO: 796215 - DNA, 20 bp, Artificial
  CRISPR gRNA sequence
aagatagcttcctcttgaaa

SEQ ID NO: 796216 - DNA, 20 bp, Artificial
  CRISPR gRNA sequence
ccacatttaacaacagaagt

SEQ ID NO: 796217 - DNA, 20 bp, Artificial
  CRISPR gRNA sequence
gaagtaagggtggggtgggg

SEQ ID NO: 796218 - DNA, 20 bp, Artificial
  CRISPR gRNA sequence
cttcagaaaactctgaagtt

SEQ ID NO: 796219 - DNA, 20 bp, Artificial
  CRISPR gRNA sequence
gcatagaaatcctttcccca

SEQ ID NO: 796220 - DNA, 20 bp, Artificial
  CRISPR gRNA sequence
tccccaacctgattattctc

SEQ ID NO: 796221 - DNA, 20 bp, Artificial
  CRISPR gRNA sequence
tttatctcagcagtcagcag

SEQ ID NO: 796222 - DNA, 20 bp, Artificial
  CRISPR gRNA sequence
caccatggtcattgtggccc

SEQ ID NO: 796223 - DNA, 20 bp, Artificial
  CRISPR gRNA sequence
tttctgggttataagatgtc

SEQ ID NO: 796224 - DNA, 20 bp, Artificial
  CRISPR gRNA sequence
agacccacataaatatgact

SEQ ID NO: 796225 - DNA, 20 bp, Artificial
  CRISPR gRNA sequence
atatgactaattgattttga

SEQ ID NO: 796226 - DNA, 20 bp, Artificial
  CRISPR gRNA sequence
ctattgaatggggaaaggat

SEQ ID NO: 796227 - DNA, 20 bp, Artificial
  CRISPR gRNA sequence
catctacatgtaaaactaaa

SEQ ID NO: 796228 - DNA, 20 bp, Artificial
  CRISPR gRNA sequence
acaccttatataaaaattaa

SEQ ID NO: 796229 - DNA, 20 bp, Artificial
  CRISPR gRNA sequence
tttacatcttgggttatgta

SEQ ID NO: 796230 - DNA, 20 bp, Artificial
  CRISPR gRNA sequence
tgggtgggccacttgaggtc

SEQ ID NO: 796231 - DNA, 20 bp, Artificial
  CRISPR gRNA sequence
tcaagaggctgaggctggag

SEQ ID NO: 796232 - DNA, 20 bp, Artificial
  CRISPR gRNA sequence
aaaataaacaataattaaac

SEQ ID NO: 796233 - DNA, 20 bp, Artificial
  CRISPR gRNA sequence
gtatacaattacaaaggatg

SEQ ID NO: 796234 - DNA, 20 bp, Artificial
  CRISPR gRNA sequence
acttaactaaggccaggtgc

SEQ ID NO: 796235 - DNA, 20 bp, Artificial
  CRISPR gRNA sequence
ttgggaggctgaggcgagaa

SEQ ID NO: 796236 - DNA, 20 bp, Artificial
  CRISPR gRNA sequence
cgagaagatggcttgagtcc

SEQ ID NO: 796237 - DNA, 20 bp, Artificial
  CRISPR gRNA sequence
tacagagtctgaggtgggag

SEQ ID NO: 796238 - DNA, 20 bp, Artificial
  CRISPR gRNA sequence
gagatcgaggctgcagtgag

SEQ ID NO: 796239 - DNA, 20 bp, Artificial
  CRISPR gRNA sequence
ataaaatatgtatattatat

SEQ ID NO: 796240 - DNA, 20 bp, Artificial
  CRISPR gRNA sequence
aaatggtacagccactatgg

SEQ ID NO: 796241 - DNA, 20 bp, Artificial
  CRISPR gRNA sequence
cagccactatggaaaggttt

SEQ ID NO: 796242 - DNA, 20 bp, Artificial
  CRISPR gRNA sequence
tatccaagtgaaatgaaaac

SEQ ID NO: 796243 - DNA, 20 bp, Artificial
  CRISPR gRNA sequence
aacagcaaacaggtataaat

SEQ ID NO: 796244 - DNA, 20 bp, Artificial
  CRISPR gRNA sequence
caacaatatgaatgaatttc

SEQ ID NO: 796245 - DNA, 20 bp, Artificial
  CRISPR gRNA sequence
gcctggacttaagacttggg

SEQ ID NO: 796246 - DNA, 20 bp, Artificial
  CRISPR gRNA sequence
cttaagacttgggtgaagct

SEQ ID NO: 796247 - DNA, 20 bp, Artificial
  CRISPR gRNA sequence
agacttgggtgaagcttttt

SEQ ID NO: 796248 - DNA, 20 bp, Artificial
  CRISPR gRNA sequence
ttgggtgaagctttttgttt

SEQ ID NO: 796249 - DNA, 20 bp, Artificial
  CRISPR gRNA sequence
gtgaagctttttgtttgttt

SEQ ID NO: 796250 - DNA, 20 bp, Artificial
  CRISPR gRNA sequence
tatcctttaaaaatgatata

SEQ ID NO: 796251 - DNA, 20 bp, Artificial
  CRISPR gRNA sequence
catacaagtaaggaaagagt

SEQ ID NO: 796252 - DNA, 20 bp, Artificial
  CRISPR gRNA sequence
gtaaggaaagagttaatgat

SEQ ID NO: 796253 - DNA, 20 bp, Artificial
  CRISPR gRNA sequence
gaaagagttaatgattaatg

SEQ ID NO: 796254 - DNA, 20 bp, Artificial
  CRISPR gRNA sequence
gttaatgattaatgatttgt

SEQ ID NO: 796255 - DNA, 20 bp, Artificial
  CRISPR gRNA sequence
aaatgcaggatgtctatatt

SEQ ID NO: 796256 - DNA, 20 bp, Artificial
  CRISPR gRNA sequence
ataaagaacatacatttatt

SEQ ID NO: 796257 - DNA, 20 bp, Artificial
  CRISPR gRNA sequence
atggctcacacctgtgatct

SEQ ID NO: 796258 - DNA, 20 bp, Artificial
  CRISPR gRNA sequence
tgctttgggaggctggggca

SEQ ID NO: 796259 - DNA, 20 bp, Artificial
  CRISPR gRNA sequence
ttgggaggctggggcaggag

SEQ ID NO: 796260 - DNA, 20 bp, Artificial
  CRISPR gRNA sequence
caggaggattgcttgagacg

SEQ ID NO: 796261 - DNA, 20 bp, Artificial
  CRISPR gRNA sequence
tagcaagaccccatcactaa

SEQ ID NO: 796262 - DNA, 20 bp, Artificial
  CRISPR gRNA sequence
gcctgtagtcctagctactc

SEQ ID NO: 796263 - DNA, 20 bp, Artificial
  CRISPR gRNA sequence
agaggaagaccctgtctcta

SEQ ID NO: 796264 - DNA, 20 bp, Artificial
  CRISPR gRNA sequence
aagaccctgtctctaaaaag

SEQ ID NO: 796265 - DNA, 20 bp, Artificial
  CRISPR gRNA sequence
ctatgaagagtatttgcaaa

SEQ ID NO: 796266 - DNA, 20 bp, Artificial
  CRISPR gRNA sequence
gtaatcaccttatagtaatg

SEQ ID NO: 796267 - DNA, 20 bp, Artificial
  CRISPR gRNA sequence
atagtaatgttaagctttat

SEQ ID NO: 796268 - DNA, 20 bp, Artificial
  CRISPR gRNA sequence
taagctttatagttgtttca

SEQ ID NO: 796269 - DNA, 20 bp, Artificial
  CRISPR gRNA sequence
ctgtgatatattttacaaca

SEQ ID NO: 796270 - DNA, 20 bp, Artificial
  CRISPR gRNA sequence
ggtaactggcgtcctgaata

SEQ ID NO: 796271 - DNA, 20 bp, Artificial
  CRISPR gRNA sequence
cacctccgactccctggttc

SEQ ID NO: 796272 - DNA, 20 bp, Artificial
  CRISPR gRNA sequence
tgcctcagactcccgagtag

SEQ ID NO: 796273 - DNA, 20 bp, Artificial
  CRISPR gRNA sequence
actcccgagtagctgggatt

SEQ ID NO: 796274 - DNA, 20 bp, Artificial
  CRISPR gRNA sequence
ttttgtattttttgtagaga

SEQ ID NO: 796275 - DNA, 20 bp, Artificial
  CRISPR gRNA sequence
caccttggcctcccaaagtg

SEQ ID NO: 796276 - DNA, 20 bp, Artificial
  CRISPR gRNA sequence
cccggcctcttctttacttt

SEQ ID NO: 796277 - DNA, 20 bp, Artificial
  CRISPR gRNA sequence
ctttatcttctatatataag

SEQ ID NO: 796278 - DNA, 20 bp, Artificial
  CRISPR gRNA sequence
tttttactcaatattatgct

SEQ ID NO: 796279 - DNA, 20 bp, Artificial
  CRISPR gRNA sequence
taagattcatagatgtagtt

SEQ ID NO: 796280 - DNA, 20 bp, Artificial
  CRISPR gRNA sequence
atataataatagatgtagtc

SEQ ID NO: 796281 - DNA, 20 bp, Artificial
  CRISPR gRNA sequence
atatatattctgcaaatata

SEQ ID NO: 796282 - DNA, 20 bp, Artificial
  CRISPR gRNA sequence
gaatcaaattctccagggca

SEQ ID NO: 796283 - DNA, 20 bp, Artificial
  CRISPR gRNA sequence
caaattctccagggcatatg

SEQ ID NO: 796284 - DNA, 20 bp, Artificial
  CRISPR gRNA sequence
atgactgagaataccgccat

SEQ ID NO: 796285 - DNA, 20 bp, Artificial
  CRISPR gRNA sequence
caatttttctgcctcagctg

SEQ ID NO: 796286 - DNA, 20 bp, Artificial
  CRISPR gRNA sequence
tttctgcctcagctgagtag

SEQ ID NO: 796287 - DNA, 20 bp, Artificial
  CRISPR gRNA sequence
tttttctatttttagtacag

SEQ ID NO: 796288 - DNA, 20 bp, Artificial
  CRISPR gRNA sequence
cgcctcggcctcccataggg

SEQ ID NO: 796289 - DNA, 20 bp, Artificial
  CRISPR gRNA sequence
tgatagggtactaagcatca

SEQ ID NO: 796290 - DNA, 20 bp, Artificial
  CRISPR gRNA sequence
ctcaggcactgagtgttgca

SEQ ID NO: 796291 - DNA, 20 bp, Artificial
  CRISPR gRNA sequence
ttatacaaataatacctaat

SEQ ID NO: 796292 - DNA, 20 bp, Artificial
  CRISPR gRNA sequence
actaattatttctcagatcc

SEQ ID NO: 796293 - DNA, 20 bp, Artificial
  CRISPR gRNA sequence
ctcagatcctttagtttttt

SEQ ID NO: 796294 - DNA, 20 bp, Artificial
  CRISPR gRNA sequence
aattaaagagacatgaaatg

SEQ ID NO: 796295 - DNA, 20 bp, Artificial
  CRISPR gRNA sequence
cataattcattacacatatt

SEQ ID NO: 796296 - DNA, 20 bp, Artificial
  CRISPR gRNA sequence
caaaaacctattccaaagtt

SEQ ID NO: 796297 - DNA, 20 bp, Artificial
  CRISPR gRNA sequence
atttatgggttgtctgccat

SEQ ID NO: 796298 - DNA, 20 bp, Artificial
  CRISPR gRNA sequence
cacagtaaagtagaaaggac

SEQ ID NO: 796299 - DNA, 20 bp, Artificial
  CRISPR gRNA sequence
cacctgcaaaatgatcattg

SEQ ID NO: 796300 - DNA, 20 bp, Artificial
  CRISPR gRNA sequence
tgcctatcttcattgtcttg

SEQ ID NO: 796301 - DNA, 20 bp, Artificial
  CRISPR gRNA sequence
agacagaaaacccaggatct

SEQ ID NO: 796302 - DNA, 20 bp, Artificial
  CRISPR gRNA sequence
ccacagaggttacacattcc

SEQ ID NO: 796303 - DNA, 20 bp, Artificial
  CRISPR gRNA sequence
atcactctatggaaacttga

SEQ ID NO: 796304 - DNA, 20 bp, Artificial
  CRISPR gRNA sequence
agcaaggaagttattgcccc

SEQ ID NO: 796305 - DNA, 20 bp, Artificial
  CRISPR gRNA sequence
tttctcaatcatgagcagaa

SEQ ID NO: 796306 - DNA, 20 bp, Artificial
  CRISPR gRNA sequence
aggagaacaaccaactgtga

SEQ ID NO: 796307 - DNA, 20 bp, Artificial
  CRISPR gRNA sequence
ccttaaggttcattgttcat

SEQ ID NO: 796308 - DNA, 20 bp, Artificial
  CRISPR gRNA sequence
gaatgaccaacggctgctat

SEQ ID NO: 796309 - DNA, 20 bp, Artificial
  CRISPR gRNA sequence
ctgccagaaaggaaggggac

SEQ ID NO: 796310 - DNA, 20 bp, Artificial
  CRISPR gRNA sequence
ctcaacccctgccctcttgt

SEQ ID NO: 796311 - DNA, 20 bp, Artificial
  CRISPR gRNA sequence
cccctgccctcttgtatcag

SEQ ID NO: 796312 - DNA, 20 bp, Artificial
  CRISPR gRNA sequence
gatggagcaatattctcagt

SEQ ID NO: 796313 - DNA, 20 bp, Artificial
  CRISPR gRNA sequence
ggggactctttttttttttg

SEQ ID NO: 796314 - DNA, 20 bp, Artificial
  CRISPR gRNA sequence
ctgagggccacattctcatt

SEQ ID NO: 796315 - DNA, 20 bp, Artificial
  CRISPR gRNA sequence
agctgggaggagaagttata

SEQ ID NO: 796316 - DNA, 20 bp, Artificial
  CRISPR gRNA sequence
gttcttcttccttttctaat

SEQ ID NO: 796317 - DNA, 20 bp, Artificial
  CRISPR gRNA sequence
gcagttacctgcacgtctca

SEQ ID NO: 796318 - DNA, 20 bp, Artificial
  CRISPR gRNA sequence
gcacgtctcatgaagctttc

SEQ ID NO: 796319 - DNA, 20 bp, Artificial
  CRISPR gRNA sequence
agctggcccttgaaccccaa

SEQ ID NO: 796320 - DNA, 20 bp, Artificial
  CRISPR gRNA sequence
gttgactgagcaaagtagtc

SEQ ID NO: 796321 - DNA, 20 bp, Artificial
  CRISPR gRNA sequence
agtgcttttgagtgctggaa

SEQ ID NO: 796322 - DNA, 20 bp, Artificial
  CRISPR gRNA sequence
tcttgaactacctcttacta

SEQ ID NO: 796323 - DNA, 20 bp, Artificial
  CRISPR gRNA sequence
ccttggtcctgctgtacctc

SEQ ID NO: 796324 - DNA, 20 bp, Artificial
  CRISPR gRNA sequence
ccatgctttctcctttactc

SEQ ID NO: 796325 - DNA, 20 bp, Artificial
  CRISPR gRNA sequence
tgataatggtctgaaactga

SEQ ID NO: 796326 - DNA, 20 bp, Artificial
  CRISPR gRNA sequence
gagtgtgatgaaaagcagtg

SEQ ID NO: 796327 - DNA, 20 bp, Artificial
  CRISPR gRNA sequence
tttacatcattaagagacaa

SEQ ID NO: 796328 - DNA, 20 bp, Artificial
  CRISPR gRNA sequence
ctgagagggagaggttgctg

SEQ ID NO: 796329 - DNA, 20 bp, Artificial
  CRISPR gRNA sequence
agcagtgagatcggttagga

SEQ ID NO: 796330 - DNA, 20 bp, Artificial
  CRISPR gRNA sequence
aatgtgtttgcagaaatgct

SEQ ID NO: 796331 - DNA, 20 bp, Artificial
  CRISPR gRNA sequence
gggtgagaagtggtctgttg

SEQ ID NO: 796332 - DNA, 20 bp, Artificial
  CRISPR gRNA sequence
ggcgagtttatatatttttt

SEQ ID NO: 796333 - DNA, 20 bp, Artificial
  CRISPR gRNA sequence
aattttattttaaaaatttc

SEQ ID NO: 796334 - DNA, 20 bp, Artificial
  CRISPR gRNA sequence
tttttttaagtgcacgactc

SEQ ID NO: 796335 - DNA, 20 bp, Artificial
  CRISPR gRNA sequence
tggcccttggcaaccactaa

SEQ ID NO: 796336 - DNA, 20 bp, Artificial
  CRISPR gRNA sequence
atctagtttctgtctctatc

SEQ ID NO: 796337 - DNA, 20 bp, Artificial
  CRISPR gRNA sequence
gcaatatgtggacttttgtg

SEQ ID NO: 796338 - DNA, 20 bp, Artificial
  CRISPR gRNA sequence
ccattgtatgatataccaca

SEQ ID NO: 796339 - DNA, 20 bp, Artificial
  CRISPR gRNA sequence
cattcatcagttgatggtca

SEQ ID NO: 796340 - DNA, 20 bp, Artificial
  CRISPR gRNA sequence
catcagttgatggtcatttg

SEQ ID NO: 796341 - DNA, 20 bp, Artificial
  CRISPR gRNA sequence
ttgatggtcatttggattgt

SEQ ID NO: 796342 - DNA, 20 bp, Artificial
  CRISPR gRNA sequence
tgccaaactatttatcaaat

SEQ ID NO: 796343 - DNA, 20 bp, Artificial
  CRISPR gRNA sequence
cccattctgcacattgtctt

SEQ ID NO: 796344 - DNA, 20 bp, Artificial
  CRISPR gRNA sequence
tatagaatcctgtgaaggat

SEQ ID NO: 796345 - DNA, 20 bp, Artificial
  CRISPR gRNA sequence
ggataaatgttttaatttaa

SEQ ID NO: 796346 - DNA, 20 bp, Artificial
  CRISPR gRNA sequence
ttatttaattttgaaacaca

SEQ ID NO: 796347 - DNA, 20 bp, Artificial
  CRISPR gRNA sequence
atttatctacttttttcttt

SEQ ID NO: 796348 - DNA, 20 bp, Artificial
  CRISPR gRNA sequence
ctacttttttcttttattgt

SEQ ID NO: 796349 - DNA, 20 bp, Artificial
  CRISPR gRNA sequence
ccattgcctagtcaaggtca

SEQ ID NO: 796350 - DNA, 20 bp, Artificial
  CRISPR gRNA sequence
ctttagttccaaatttgttc

SEQ ID NO: 796351 - DNA, 20 bp, Artificial
  CRISPR gRNA sequence
ataaggatgtatttctggac

SEQ ID NO: 796352 - DNA, 20 bp, Artificial
  CRISPR gRNA sequence
atgtatttctggactctcga

SEQ ID NO: 796353 - DNA, 20 bp, Artificial
  CRISPR gRNA sequence
cctatgtcagtaccacacag

SEQ ID NO: 796354 - DNA, 20 bp, Artificial
  CRISPR gRNA sequence
taccacacagcgttgattac

SEQ ID NO: 796355 - DNA, 20 bp, Artificial
  CRISPR gRNA sequence
ttgattactgtagctttgta

SEQ ID NO: 796356 - DNA, 20 bp, Artificial
  CRISPR gRNA sequence
tccaactttgttagtctttt

SEQ ID NO: 796357 - DNA, 20 bp, Artificial
  CRISPR gRNA sequence
atttttttttagggggctat

SEQ ID NO: 796358 - DNA, 20 bp, Artificial
  CRISPR gRNA sequence
aaaggaagctggaattttgg

SEQ ID NO: 796359 - DNA, 20 bp, Artificial
  CRISPR gRNA sequence
atgaatacagcatgtctttc

SEQ ID NO: 796360 - DNA, 20 bp, Artificial
  CRISPR gRNA sequence
tttcctttgtttaggccttc

SEQ ID NO: 796361 - DNA, 20 bp, Artificial
  CRISPR gRNA sequence
aactgctgacaggctagata

SEQ ID NO: 796362 - DNA, 20 bp, Artificial
  CRISPR gRNA sequence
agggaaatctgggaaaattc

SEQ ID NO: 796363 - DNA, 20 bp, Artificial
  CRISPR gRNA sequence
tctgggaaaattcctaagtt

SEQ ID NO: 796364 - DNA, 20 bp, Artificial
  CRISPR gRNA sequence
agtcactaaggcaatggaga

SEQ ID NO: 796365 - DNA, 20 bp, Artificial
  CRISPR gRNA sequence
ttaaggaaggggaaaaagag

SEQ ID NO: 796366 - DNA, 20 bp, Artificial
  CRISPR gRNA sequence
ggaaaaagagttacgtttgt

SEQ ID NO: 796367 - DNA, 20 bp, Artificial
  CRISPR gRNA sequence
agagttacgtttgttgtaga

SEQ ID NO: 796368 - DNA, 20 bp, Artificial
  CRISPR gRNA sequence
cctattagatagccaagtgg

SEQ ID NO: 796369 - DNA, 20 bp, Artificial
  CRISPR gRNA sequence
agtcatcaatgcagaagtgt

SEQ ID NO: 796370 - DNA, 20 bp, Artificial
  CRISPR gRNA sequence
tgaagagcggtcaccagcag

SEQ ID NO: 796371 - DNA, 20 bp, Artificial
  CRISPR gRNA sequence
gcattttattttctgtattc

SEQ ID NO: 796372 - DNA, 20 bp, Artificial
  CRISPR gRNA sequence
ccacaactgcctcatttatt

SEQ ID NO: 796373 - DNA, 20 bp, Artificial
  CRISPR gRNA sequence
gctaatcctaaatccactca

SEQ ID NO: 796374 - DNA, 20 bp, Artificial
  CRISPR gRNA sequence
acccacctcctggctgaccc

SEQ ID NO: 796375 - DNA, 20 bp, Artificial
  CRISPR gRNA sequence
tcctgacaagcacagtatca

SEQ ID NO: 796376 - DNA, 20 bp, Artificial
  CRISPR gRNA sequence
tcagtgagttttgtacagat

SEQ ID NO: 796377 - DNA, 20 bp, Artificial
  CRISPR gRNA sequence
aggtcctcagtgagctgtat

SEQ ID NO: 796378 - DNA, 20 bp, Artificial
  CRISPR gRNA sequence
taacaactgggaacagaatt

SEQ ID NO: 796379 - DNA, 20 bp, Artificial
  CRISPR gRNA sequence
gggaaatgctcatggcatac

SEQ ID NO: 796380 - DNA, 20 bp, Artificial
  CRISPR gRNA sequence
taacatagctctagcaacag

SEQ ID NO: 796381 - DNA, 20 bp, Artificial
  CRISPR gRNA sequence
agattcttggatcacctgcc

SEQ ID NO: 796382 - DNA, 20 bp, Artificial
  CRISPR gRNA sequence
tataaagatactttccaacc

SEQ ID NO: 796383 - DNA, 20 bp, Artificial
  CRISPR gRNA sequence
taatcctcctctggggaaaa

SEQ ID NO: 796384 - DNA, 20 bp, Artificial
  CRISPR gRNA sequence
ggctctaaaatcagacacat

SEQ ID NO: 796385 - DNA, 20 bp, Artificial
  CRISPR gRNA sequence
cagacacatctgggtttaat

SEQ ID NO: 796386 - DNA, 20 bp, Artificial
  CRISPR gRNA sequence
aattttgaaaagtctttgtg

SEQ ID NO: 796387 - DNA, 20 bp, Artificial
  CRISPR gRNA sequence
ccccactgccatcaccttaa

SEQ ID NO: 796388 - DNA, 20 bp, Artificial
  CRISPR gRNA sequence
cctttcttttctcactctac

SEQ ID NO: 796389 - DNA, 20 bp, Artificial
  CRISPR gRNA sequence
tgaccatttctcaccacctc

SEQ ID NO: 796390 - DNA, 20 bp, Artificial
  CRISPR gRNA sequence
agagtcattgtcatttctca

SEQ ID NO: 796391 - DNA, 20 bp, Artificial
  CRISPR gRNA sequence
attagtctgacaactggatg

SEQ ID NO: 796392 - DNA, 20 bp, Artificial
  CRISPR gRNA sequence
tgacaactggatgctatgat

SEQ ID NO: 796393 - DNA, 20 bp, Artificial
  CRISPR gRNA sequence
ttccagttttgccttcctgc

SEQ ID NO: 796394 - DNA, 20 bp, Artificial
  CRISPR gRNA sequence
gcagttgattctgcagccag

SEQ ID NO: 796395 - DNA, 20 bp, Artificial
  CRISPR gRNA sequence
gcatttcactcagtgtaaaa

SEQ ID NO: 796396 - DNA, 20 bp, Artificial
  CRISPR gRNA sequence
agaggcccctgtcctggacc

SEQ ID NO: 796397 - DNA, 20 bp, Artificial
  CRISPR gRNA sequence
cagggctgagagatgttatc

SEQ ID NO: 796398 - DNA, 20 bp, Artificial
  CRISPR gRNA sequence
cctagcctgaatggccttaa

SEQ ID NO: 796399 - DNA, 20 bp, Artificial
  CRISPR gRNA sequence
tccctctacccggacacttt

SEQ ID NO: 796400 - DNA, 20 bp, Artificial
  CRISPR gRNA sequence
tcacagtgatggcagcagct

SEQ ID NO: 796401 - DNA, 20 bp, Artificial
  CRISPR gRNA sequence
cagcctggggtaagaactta

SEQ ID NO: 796402 - DNA, 20 bp, Artificial
  CRISPR gRNA sequence
ggcaggaaaatcacgaggtc

SEQ ID NO: 796403 - DNA, 20 bp, Artificial
  CRISPR gRNA sequence
tcgggaggctgaagcaggag

SEQ ID NO: 796404 - DNA, 20 bp, Artificial
  CRISPR gRNA sequence
gaggcagaggttgcagtgag

SEQ ID NO: 796405 - DNA, 20 bp, Artificial
  CRISPR gRNA sequence
atcctccgcctcccgggttc

SEQ ID NO: 796406 - DNA, 20 bp, Artificial
  CRISPR gRNA sequence
tttcatatttttagtagaga

SEQ ID NO: 796407 - DNA, 20 bp, Artificial
  CRISPR gRNA sequence
cgcctcggcctcccaaagtg

SEQ ID NO: 796408 - DNA, 20 bp, Artificial
  CRISPR gRNA sequence
tacaggcgtgagccactgtg

SEQ ID NO: 796409 - DNA, 20 bp, Artificial
  CRISPR gRNA sequence
tctccccttttaaaattcac

SEQ ID NO: 796410 - DNA, 20 bp, Artificial
  CRISPR gRNA sequence
aattcacttgtgttttctaa

SEQ ID NO: 796411 - DNA, 20 bp, Artificial
  CRISPR gRNA sequence
aaaccacaggtagtgaacag

SEQ ID NO: 796412 - DNA, 20 bp, Artificial
  CRISPR gRNA sequence
cctccttcataaatcctccc

SEQ ID NO: 796413 - DNA, 20 bp, Artificial
  CRISPR gRNA sequence
ttcccaagcaaatgtctgca

SEQ ID NO: 796414 - DNA, 20 bp, Artificial
  CRISPR gRNA sequence
attcctggcctcaagcaaac

SEQ ID NO: 796415 - DNA, 20 bp, Artificial
  CRISPR gRNA sequence
tatagttgtgggctaccttg

SEQ ID NO: 796416 - DNA, 20 bp, Artificial
  CRISPR gRNA sequence
gggctaccttgcccagctta

SEQ ID NO: 796417 - DNA, 20 bp, Artificial
  CRISPR gRNA sequence
cagaaatgatggtaggttct

SEQ ID NO: 796418 - DNA, 20 bp, Artificial
  CRISPR gRNA sequence
cacttcttggttgctatagg

SEQ ID NO: 796419 - DNA, 20 bp, Artificial
  CRISPR gRNA sequence
aatacaaataattgtggtgc

SEQ ID NO: 796420 - DNA, 20 bp, Artificial
  CRISPR gRNA sequence
aagggtaaataagacacagc

SEQ ID NO: 796421 - DNA, 20 bp, Artificial
  CRISPR gRNA sequence
acaataaccagcctaaagga

SEQ ID NO: 796422 - DNA, 20 bp, Artificial
  CRISPR gRNA sequence
tctgaaatacctgaactaac

SEQ ID NO: 796423 - DNA, 20 bp, Artificial
  CRISPR gRNA sequence
atgcctttgggcaagttatg

SEQ ID NO: 796424 - DNA, 20 bp, Artificial
  CRISPR gRNA sequence
tttccattgtattagaccta

SEQ ID NO: 796425 - DNA, 20 bp, Artificial
  CRISPR gRNA sequence
ctgacaaacccaataggtat

SEQ ID NO: 796426 - DNA, 20 bp, Artificial
  CRISPR gRNA sequence
ttatcattggagaattcata

SEQ ID NO: 796427 - DNA, 20 bp, Artificial
  CRISPR gRNA sequence
aagggagacttcccagaggg

SEQ ID NO: 796428 - DNA, 20 bp, Artificial
  CRISPR gRNA sequence
actgggcctttgaagcactg

SEQ ID NO: 796429 - DNA, 20 bp, Artificial
  CRISPR gRNA sequence
acacttaggttgagaatgtc

SEQ ID NO: 796430 - DNA, 20 bp, Artificial
  CRISPR gRNA sequence
aataccaaaggagtatctga

SEQ ID NO: 796431 - DNA, 20 bp, Artificial
  CRISPR gRNA sequence
gggggtcactgtattcatct

SEQ ID NO: 796432 - DNA, 20 bp, Artificial
  CRISPR gRNA sequence
aagagacaaagagaaaagca

SEQ ID NO: 796433 - DNA, 20 bp, Artificial
  CRISPR gRNA sequence
agaaaagcaacaagattgac

SEQ ID NO: 796434 - DNA, 20 bp, Artificial
  CRISPR gRNA sequence
gggagaaatagaagatgggg

SEQ ID NO: 796435 - DNA, 20 bp, Artificial
  CRISPR gRNA sequence
ctgattttagagggaagaca

SEQ ID NO: 796436 - DNA, 20 bp, Artificial
  CRISPR gRNA sequence
tttagagggaagacagtaag

SEQ ID NO: 796437 - DNA, 20 bp, Artificial
  CRISPR gRNA sequence
attccaaaaaattgtaggtc

SEQ ID NO: 796438 - DNA, 20 bp, Artificial
  CRISPR gRNA sequence
ctgatggggagaatataaaa

SEQ ID NO: 796439 - DNA, 20 bp, Artificial
  CRISPR gRNA sequence
gtctgtcctggaattctgtg

SEQ ID NO: 796440 - DNA, 20 bp, Artificial
  CRISPR gRNA sequence
ttacacgaacatttcatttc

SEQ ID NO: 796441 - DNA, 20 bp, Artificial
  CRISPR gRNA sequence
ggactcagagaaccttaaag

SEQ ID NO: 796442 - DNA, 20 bp, Artificial
  CRISPR gRNA sequence
cagtggcaagagcagcagga

SEQ ID NO: 796443 - DNA, 20 bp, Artificial
  CRISPR gRNA sequence
gttcatccactcacagaatc

SEQ ID NO: 796444 - DNA, 20 bp, Artificial
  CRISPR gRNA sequence
acagaatcttaggcttggaa

SEQ ID NO: 796445 - DNA, 20 bp, Artificial
  CRISPR gRNA sequence
tagtatttttgggttaaaag

SEQ ID NO: 796446 - DNA, 20 bp, Artificial
  CRISPR gRNA sequence
tgattagttggtaatctcac

SEQ ID NO: 796447 - DNA, 20 bp, Artificial
  CRISPR gRNA sequence
atcaatagcaattatttcag

SEQ ID NO: 796448 - DNA, 20 bp, Artificial
  CRISPR gRNA sequence
gcctttccatagtccccaaa

SEQ ID NO: 796449 - DNA, 20 bp, Artificial
  CRISPR gRNA sequence
caaatcatgcttttgttcaa

SEQ ID NO: 796450 - DNA, 20 bp, Artificial
  CRISPR gRNA sequence
cctctataagttattaagat

SEQ ID NO: 796451 - DNA, 20 bp, Artificial
  CRISPR gRNA sequence
aagttattaagataatagtt

SEQ ID NO: 796452 - DNA, 20 bp, Artificial
  CRISPR gRNA sequence
taagataatagttttgggtt

SEQ ID NO: 796453 - DNA, 20 bp, Artificial
  CRISPR gRNA sequence
accaacagctgcctcttagg

SEQ ID NO: 796454 - DNA, 20 bp, Artificial
  CRISPR gRNA sequence
acagatgtcagtcataggaa

SEQ ID NO: 796455 - DNA, 20 bp, Artificial
  CRISPR gRNA sequence
gaaatctggggcaggaggac

SEQ ID NO: 796456 - DNA, 20 bp, Artificial
  CRISPR gRNA sequence
agtaaacaacaaaaaacagt

SEQ ID NO: 796457 - DNA, 20 bp, Artificial
  CRISPR gRNA sequence
aaaaaacagttgctgtttgt

SEQ ID NO: 796458 - DNA, 20 bp, Artificial
  CRISPR gRNA sequence
caacatgcagtagctccaac

SEQ ID NO: 796459 - DNA, 20 bp, Artificial
  CRISPR gRNA sequence
aagagaagaaaagttgttca

SEQ ID NO: 796460 - DNA, 20 bp, Artificial
  CRISPR gRNA sequence
gaaaagttgttcattcagct

SEQ ID NO: 796461 - DNA, 20 bp, Artificial
  CRISPR gRNA sequence
ttctgaggaactgacgaaag

SEQ ID NO: 796462 - DNA, 20 bp, Artificial
  CRISPR gRNA sequence
acgaaagcctggcttatttg

SEQ ID NO: 796463 - DNA, 20 bp, Artificial
  CRISPR gRNA sequence
gcctggcttatttggaaagt

SEQ ID NO: 796464 - DNA, 20 bp, Artificial
  CRISPR gRNA sequence
gcttatttggaaagttttgg

SEQ ID NO: 796465 - DNA, 20 bp, Artificial
  CRISPR gRNA sequence
aaagttttggttttgctttt

SEQ ID NO: 796466 - DNA, 20 bp, Artificial
  CRISPR gRNA sequence
cccatcctcatatgtcccag

SEQ ID NO: 796467 - DNA, 20 bp, Artificial
  CRISPR gRNA sequence
tcctcatatgtcccagctag

SEQ ID NO: 796468 - DNA, 20 bp, Artificial
  CRISPR gRNA sequence
gaggcaagagacattctgcc

SEQ ID NO: 796469 - DNA, 20 bp, Artificial
  CRISPR gRNA sequence
ataaaatgatcagcgaaaag

SEQ ID NO: 796470 - DNA, 20 bp, Artificial
  CRISPR gRNA sequence
atttatttgatgaaatgtca

SEQ ID NO: 796471 - DNA, 20 bp, Artificial
  CRISPR gRNA sequence
atgaaatgtcaggagaatca

SEQ ID NO: 796472 - DNA, 20 bp, Artificial
  CRISPR gRNA sequence
gataaccttcaaatcaactc

SEQ ID NO: 796473 - DNA, 20 bp, Artificial
  CRISPR gRNA sequence
tattaactaacatttccata

SEQ ID NO: 796474 - DNA, 20 bp, Artificial
  CRISPR gRNA sequence
agtcagctatgcactgccct

SEQ ID NO: 796475 - DNA, 20 bp, Artificial
  CRISPR gRNA sequence
taaatgctctattaaattga

SEQ ID NO: 796476 - DNA, 20 bp, Artificial
  CRISPR gRNA sequence
taagactggcagtatttaac

SEQ ID NO: 796477 - DNA, 20 bp, Artificial
  CRISPR gRNA sequence
aggattcttgagatacttcc

SEQ ID NO: 796478 - DNA, 20 bp, Artificial
  CRISPR gRNA sequence
cctcacttattgcacagacc

SEQ ID NO: 796479 - DNA, 20 bp, Artificial
  CRISPR gRNA sequence
ccaagtaaatgttttgaata

SEQ ID NO: 796480 - DNA, 20 bp, Artificial
  CRISPR gRNA sequence
gaaatagatctccacagaca

SEQ ID NO: 796481 - DNA, 20 bp, Artificial
  CRISPR gRNA sequence
tccacagacagtagaaatgg

SEQ ID NO: 796482 - DNA, 20 bp, Artificial
  CRISPR gRNA sequence
ttctgtttacgaacttatcc

SEQ ID NO: 796483 - DNA, 20 bp, Artificial
  CRISPR gRNA sequence
agtaaattgatacttcttat

SEQ ID NO: 796484 - DNA, 20 bp, Artificial
  CRISPR gRNA sequence
tacttcttatgtagaaataa

SEQ ID NO: 796485 - DNA, 20 bp, Artificial
  CRISPR gRNA sequence
atgagtgagacctagtctct

SEQ ID NO: 796486 - DNA, 20 bp, Artificial
  CRISPR gRNA sequence
actgataaatacaaggtaga

SEQ ID NO: 796487 - DNA, 20 bp, Artificial
  CRISPR gRNA sequence
gtgataatgacgatgaatgt

SEQ ID NO: 796488 - DNA, 20 bp, Artificial
  CRISPR gRNA sequence
acagacatcaataaacatat

SEQ ID NO: 796489 - DNA, 20 bp, Artificial
  CRISPR gRNA sequence
catgttcgtttttgtctcct

SEQ ID NO: 796490 - DNA, 20 bp, Artificial
  CRISPR gRNA sequence
cctgaattcttgtcccttgt

SEQ ID NO: 796491 - DNA, 20 bp, Artificial
  CRISPR gRNA sequence
ttactcaggaggctgaggca

SEQ ID NO: 796492 - DNA, 20 bp, Artificial
  CRISPR gRNA sequence
aaaaaaaaaaaaaaaaaaaa

SEQ ID NO: 796493 - DNA, 20 bp, Artificial
  CRISPR gRNA sequence
aaaaaaaaaaaaaaaaaaga

SEQ ID NO: 796494 - DNA, 20 bp, Artificial
  CRISPR gRNA sequence
aaaaaaaaaaaaaagaaaag

SEQ ID NO: 796495 - DNA, 20 bp, Artificial
  CRISPR gRNA sequence
aaaaaaaaaagaaaagaaag

SEQ ID NO: 796496 - DNA, 20 bp, Artificial
  CRISPR gRNA sequence
atgggcagccatggaagggc

SEQ ID NO: 796497 - DNA, 20 bp, Artificial
  CRISPR gRNA sequence
cactgactccagcctgggca

SEQ ID NO: 796498 - DNA, 20 bp, Artificial
  CRISPR gRNA sequence
atggtaatgactgctttggg

SEQ ID NO: 796499 - DNA, 20 bp, Artificial
  CRISPR gRNA sequence
ttttacataagacagtctca

SEQ ID NO: 796500 - DNA, 20 bp, Artificial
  CRISPR gRNA sequence
gctgagccatcggaaggttt

SEQ ID NO: 796501 - DNA, 20 bp, Artificial
  CRISPR gRNA sequence
ttttaaaaaccactctggct

SEQ ID NO: 796502 - DNA, 20 bp, Artificial
  CRISPR gRNA sequence
catccagttgtcagactaat

SEQ ID NO: 796503 - DNA, 20 bp, Artificial
  CRISPR gRNA sequence
gactaatgcagaaatcacca

SEQ ID NO: 796504 - DNA, 20 bp, Artificial
  CRISPR gRNA sequence
tatggaagcagtggaggtgg

SEQ ID NO: 796505 - DNA, 20 bp, Artificial
  CRISPR gRNA sequence
ttaatgaatcagatgtagag

SEQ ID NO: 796506 - DNA, 20 bp, Artificial
  CRISPR gRNA sequence
gaatcagatgtagagtgaga

SEQ ID NO: 796507 - DNA, 20 bp, Artificial
  CRISPR gRNA sequence
aaggctctgctatggtataa

SEQ ID NO: 796508 - DNA, 20 bp, Artificial
  CRISPR gRNA sequence
aaggtgatggcagtggggtg

SEQ ID NO: 796509 - DNA, 20 bp, Artificial
  CRISPR gRNA sequence
atgcaaaaagtatccaggag

SEQ ID NO: 796510 - DNA, 20 bp, Artificial
  CRISPR gRNA sequence
gatgggccatatttgcaaga

SEQ ID NO: 796511 - DNA, 20 bp, Artificial
  CRISPR gRNA sequence
aaagccagtggcaggtgatc

SEQ ID NO: 796512 - DNA, 20 bp, Artificial
  CRISPR gRNA sequence
ctccctttctaaaataaaaa

SEQ ID NO: 796513 - DNA, 20 bp, Artificial
  CRISPR gRNA sequence
ctttattgtggtttcaacag

SEQ ID NO: 796514 - DNA, 20 bp, Artificial
  CRISPR gRNA sequence
ggtttactctctcttagagg

SEQ ID NO: 796515 - DNA, 20 bp, Artificial
  CRISPR gRNA sequence
aggccccaggtgtcaaagca

SEQ ID NO: 796516 - DNA, 20 bp, Artificial
  CRISPR gRNA sequence
aggtgtcaaagcatcagaat

SEQ ID NO: 796517 - DNA, 20 bp, Artificial
  CRISPR gRNA sequence
aattccagcttcctttgtct

SEQ ID NO: 796518 - DNA, 20 bp, Artificial
  CRISPR gRNA sequence
tagacatatagttcaataaa

SEQ ID NO: 796519 - DNA, 20 bp, Artificial
  CRISPR gRNA sequence
aataaaacagaatcgagagt

SEQ ID NO: 796520 - DNA, 20 bp, Artificial
  CRISPR gRNA sequence
gccaagacagttcaataggg

SEQ ID NO: 796521 - DNA, 20 bp, Artificial
  CRISPR gRNA sequence
ctccatttatatttatctta

SEQ ID NO: 796522 - DNA, 20 bp, Artificial
  CRISPR gRNA sequence
cacctaaagcacaaacaata

SEQ ID NO: 796523 - DNA, 20 bp, Artificial
  CRISPR gRNA sequence
tatccttcacaggattctat

SEQ ID NO: 796524 - DNA, 20 bp, Artificial
  CRISPR gRNA sequence
agaaactgaaaagacaatgt

SEQ ID NO: 796525 - DNA, 20 bp, Artificial
  CRISPR gRNA sequence
ttattcataatagccaacaa

SEQ ID NO: 796526 - DNA, 20 bp, Artificial
  CRISPR gRNA sequence
attccatttttatgaaatat

SEQ ID NO: 796527 - DNA, 20 bp, Artificial
  CRISPR gRNA sequence
agaataagcaattgatagag

SEQ ID NO: 796528 - DNA, 20 bp, Artificial
  CRISPR gRNA sequence
ttaaaataaaattttaaaac

SEQ ID NO: 796529 - DNA, 20 bp, Artificial
  CRISPR gRNA sequence
ggctccaacagatttcccct

SEQ ID NO: 796530 - DNA, 20 bp, Artificial
  CRISPR gRNA sequence
accataagaagtccatggat

SEQ ID NO: 796531 - DNA, 20 bp, Artificial
  CRISPR gRNA sequence
aaagaaagcttcagagtaaa

SEQ ID NO: 796532 - DNA, 20 bp, Artificial
  CRISPR gRNA sequence
gtcaactagcaagtatttat

SEQ ID NO: 796533 - DNA, 20 bp, Artificial
  CRISPR gRNA sequence
tcacaaggactggttcatat

SEQ ID NO: 796534 - DNA, 20 bp, Artificial
  CRISPR gRNA sequence
ttcatattcagaaacggcca

SEQ ID NO: 796535 - DNA, 20 bp, Artificial
  CRISPR gRNA sequence
cagcttcaccagatagcagg

SEQ ID NO: 796536 - DNA, 20 bp, Artificial
  CRISPR gRNA sequence
aaaggacaaagggagaggct

SEQ ID NO: 796537 - DNA, 20 bp, Artificial
  CRISPR gRNA sequence
ttcctagccaaagccaaaaa

SEQ ID NO: 796538 - DNA, 20 bp, Artificial
  CRISPR gRNA sequence
catgccaatgtccctatctg

SEQ ID NO: 796539 - DNA, 20 bp, Artificial
  CRISPR gRNA sequence
tatctgacagaaacggtgac

SEQ ID NO: 796540 - DNA, 20 bp, Artificial
  CRISPR gRNA sequence
aaggctatccctttggactt

SEQ ID NO: 796541 - DNA, 20 bp, Artificial
  CRISPR gRNA sequence
ctattggaggatgagggtga

SEQ ID NO: 796542 - DNA, 20 bp, Artificial
  CRISPR gRNA sequence
tggaggatgagggtgagcag

SEQ ID NO: 796543 - DNA, 20 bp, Artificial
  CRISPR gRNA sequence
atcatctttctgctcatgat

SEQ ID NO: 796544 - DNA, 20 bp, Artificial
  CRISPR gRNA sequence
tggcaggactgggggcttca

SEQ ID NO: 796545 - DNA, 20 bp, Artificial
  CRISPR gRNA sequence
gcaggtgagggaactagaac

SEQ ID NO: 796546 - DNA, 20 bp, Artificial
  CRISPR gRNA sequence
aatgtttattctggatattc

SEQ ID NO: 796547 - DNA, 20 bp, Artificial
  CRISPR gRNA sequence
atattaaatacctacctaaa

SEQ ID NO: 796548 - DNA, 20 bp, Artificial
  CRISPR gRNA sequence
ttcagaggagggtacctgca

SEQ ID NO: 796549 - DNA, 20 bp, Artificial
  CRISPR gRNA sequence
aacaaaaaaactaaaggatc

SEQ ID NO: 796550 - DNA, 20 bp, Artificial
  CRISPR gRNA sequence
aaaatataattttaaaaata

SEQ ID NO: 796551 - DNA, 20 bp, Artificial
  CRISPR gRNA sequence
agacctgcatgcttcattga

SEQ ID NO: 796552 - DNA, 20 bp, Artificial
  CRISPR gRNA sequence
gaaacccctctgtactaaaa

SEQ ID NO: 796553 - DNA, 20 bp, Artificial
  CRISPR gRNA sequence
atccaagctactcagctgag

SEQ ID NO: 796554 - DNA, 20 bp, Artificial
  CRISPR gRNA sequence
ttccatttaaaaaaaaaaaa

SEQ ID NO: 796555 - DNA, 20 bp, Artificial
  CRISPR gRNA sequence
aaaaacaatccatatgccct

SEQ ID NO: 796556 - DNA, 20 bp, Artificial
  CRISPR gRNA sequence
ggtctagaagaacttcaact

SEQ ID NO: 796557 - DNA, 20 bp, Artificial
  CRISPR gRNA sequence
acttcaactggagaatggat

SEQ ID NO: 796558 - DNA, 20 bp, Artificial
  CRISPR gRNA sequence
agagaaatcatggtatattt

SEQ ID NO: 796559 - DNA, 20 bp, Artificial
  CRISPR gRNA sequence
ctactcgggagtctgaggca

SEQ ID NO: 796560 - DNA, 20 bp, Artificial
  CRISPR gRNA sequence
tctgttgtaaaatatatcac

SEQ ID NO: 796561 - DNA, 20 bp, Artificial
  CRISPR gRNA sequence
agaagaactttgtcagctcc

SEQ ID NO: 796562 - DNA, 20 bp, Artificial
  CRISPR gRNA sequence
ctgccctttattttttcatg

SEQ ID NO: 796563 - DNA, 20 bp, Artificial
  CRISPR gRNA sequence
tccttatagtaatgactttt

SEQ ID NO: 796564 - DNA, 20 bp, Artificial
  CRISPR gRNA sequence
ggtaagtgtatggtttattg

SEQ ID NO: 796565 - DNA, 20 bp, Artificial
  CRISPR gRNA sequence
atctaaggacatcttataac

SEQ ID NO: 796566 - DNA, 20 bp, Artificial
  CRISPR gRNA sequence
tgactgctgagataaacaaa

SEQ ID NO: 796567 - DNA, 20 bp, Artificial
  CRISPR gRNA sequence
caggaacttcagagttttct

SEQ ID NO: 796568 - DNA, 20 bp, Artificial
  CRISPR gRNA sequence
aataaaatgcaaagctcccc

SEQ ID NO: 796569 - DNA, 20 bp, Artificial
  CRISPR gRNA sequence
ataaccatgtggcatgtaaa

SEQ ID NO: 796570 - DNA, 20 bp, Artificial
  CRISPR gRNA sequence
taactgcagtcattggtagc

SEQ ID NO: 796571 - DNA, 20 bp, Artificial
  CRISPR gRNA sequence
agtgtctgacttactgtgtt

SEQ ID NO: 796572 - DNA, 20 bp, Artificial
  CRISPR gRNA sequence
cactttagaagctcccagga

SEQ ID NO: 796573 - DNA, 20 bp, Artificial
  CRISPR gRNA sequence
atctaatttgcagctgggct

SEQ ID NO: 796574 - DNA, 20 bp, Artificial
  CRISPR gRNA sequence
gcttgagaaaaaacctcttc

SEQ ID NO: 796575 - DNA, 20 bp, Artificial
  CRISPR gRNA sequence
cctctgtaacttacaataag

SEQ ID NO: 796576 - DNA, 20 bp, Artificial
  CRISPR gRNA sequence
aagctcaaagtttgcatgtc

SEQ ID NO: 796577 - DNA, 20 bp, Artificial
  CRISPR gRNA sequence
aaggcagacaggaaaaatag

SEQ ID NO: 796578 - DNA, 20 bp, Artificial
  CRISPR gRNA sequence
aggcgttccctttcttatga

SEQ ID NO: 796579 - DNA, 20 bp, Artificial
  CRISPR gRNA sequence
gtgtgcagtggattaaaata

SEQ ID NO: 796580 - DNA, 20 bp, Artificial
  CRISPR gRNA sequence
ccctgtgcccctcctgcaca

SEQ ID NO: 796581 - DNA, 20 bp, Artificial
  CRISPR gRNA sequence
gcacacgtgaactcctctct

SEQ ID NO: 796582 - DNA, 20 bp, Artificial
  CRISPR gRNA sequence
caagtgtgctgtgtggcaat

SEQ ID NO: 796583 - DNA, 20 bp, Artificial
  CRISPR gRNA sequence
aaagatttgcaggatagtgg

SEQ ID NO: 796584 - DNA, 20 bp, Artificial
  CRISPR gRNA sequence
cagtgggaatcattcaagca

SEQ ID NO: 796585 - DNA, 20 bp, Artificial
  CRISPR gRNA sequence
ttatactgtgaaatctgatc

SEQ ID NO: 796586 - DNA, 20 bp, Artificial
  CRISPR gRNA sequence
catatgaattaccactttcc

SEQ ID NO: 796587 - DNA, 20 bp, Artificial
  CRISPR gRNA sequence
aagaattaaaacatggtacg

SEQ ID NO: 796588 - DNA, 20 bp, Artificial
  CRISPR gRNA sequence
atctaatcttctgtgattat

SEQ ID NO: 796589 - DNA, 20 bp, Artificial
  CRISPR gRNA sequence
tatcatttgcactggtaaat

SEQ ID NO: 796590 - DNA, 20 bp, Artificial
  CRISPR gRNA sequence
cactggtaaatagagaatag

SEQ ID NO: 796591 - DNA, 20 bp, Artificial
  CRISPR gRNA sequence
tatgcaattgaaggattaaa

SEQ ID NO: 796592 - DNA, 20 bp, Artificial
  CRISPR gRNA sequence
tttttcctttccctttattg

SEQ ID NO: 796593 - DNA, 20 bp, Artificial
  CRISPR gRNA sequence
tttccctttattgtcagaaa

SEQ ID NO: 796594 - DNA, 20 bp, Artificial
  CRISPR gRNA sequence
gggcttgtatgatgtggtgg

SEQ ID NO: 796595 - DNA, 20 bp, Artificial
  CRISPR gRNA sequence
tttgttttctgaaaaaaagg

SEQ ID NO: 796596 - DNA, 20 bp, Artificial
  CRISPR gRNA sequence
agcagagtgtctgacaattg

SEQ ID NO: 796597 - DNA, 20 bp, Artificial
  CRISPR gRNA sequence
ggattgagggaaacaaacct

SEQ ID NO: 796598 - DNA, 20 bp, Artificial
  CRISPR gRNA sequence
gccacctcagatcagcgggt

SEQ ID NO: 796599 - DNA, 20 bp, Artificial
  CRISPR gRNA sequence
gcccagatggatggggcaaa

SEQ ID NO: 796600 - DNA, 20 bp, Artificial
  CRISPR gRNA sequence
aaggtgagtggtgtcaagga

SEQ ID NO: 796601 - DNA, 20 bp, Artificial
  CRISPR gRNA sequence
caacagaggatctgcaagtc

SEQ ID NO: 796602 - DNA, 20 bp, Artificial
  CRISPR gRNA sequence
tttaaggagacagctatttc

SEQ ID NO: 796603 - DNA, 20 bp, Artificial
  CRISPR gRNA sequence
tttaaaaaataatgtataga

SEQ ID NO: 796604 - DNA, 20 bp, Artificial
  CRISPR gRNA sequence
aattgaaaatctaaatataa

SEQ ID NO: 796605 - DNA, 20 bp, Artificial
  CRISPR gRNA sequence
tcttcacactcttgtttgtt

SEQ ID NO: 796606 - DNA, 20 bp, Artificial
  CRISPR gRNA sequence
ccaaaaaaccattaaccttg

SEQ ID NO: 796607 - DNA, 20 bp, Artificial
  CRISPR gRNA sequence
accctctatagtgttaaata

SEQ ID NO: 796608 - DNA, 20 bp, Artificial
  CRISPR gRNA sequence
tttgccatgtaaatcaggtc

SEQ ID NO: 796609 - DNA, 20 bp, Artificial
  CRISPR gRNA sequence
aagctacaaaaaaatgaaaa

SEQ ID NO: 796610 - DNA, 20 bp, Artificial
  CRISPR gRNA sequence
caaaaaaatgaaaaatagaa

SEQ ID NO: 796611 - DNA, 20 bp, Artificial
  CRISPR gRNA sequence
tcaaatatgtgttaataata

SEQ ID NO: 796612 - DNA, 20 bp, Artificial
  CRISPR gRNA sequence
ccaacaacgatagactggat

SEQ ID NO: 796613 - DNA, 20 bp, Artificial
  CRISPR gRNA sequence
aaatgtggcacgtatacacc

SEQ ID NO: 796614 - DNA, 20 bp, Artificial
  CRISPR gRNA sequence
tttaaagcttcatagtcaca

SEQ ID NO: 796615 - DNA, 20 bp, Artificial
  CRISPR gRNA sequence
aagtgagtttcaatgaatga

SEQ ID NO: 796616 - DNA, 20 bp, Artificial
  CRISPR gRNA sequence
aaagaaacaatttagacaga

SEQ ID NO: 796617 - DNA, 20 bp, Artificial
  CRISPR gRNA sequence
ttgtactatatatatatatt

SEQ ID NO: 796618 - DNA, 20 bp, Artificial
  CRISPR gRNA sequence
ctactggggaggctgaggca

SEQ ID NO: 796619 - DNA, 20 bp, Artificial
  CRISPR gRNA sequence
agcgagactctgtctcaaaa

SEQ ID NO: 796620 - DNA, 20 bp, Artificial
  CRISPR gRNA sequence
caaaaaaagaaaaaaaaaaa

SEQ ID NO: 796621 - DNA, 20 bp, Artificial
  CRISPR gRNA sequence
aagcaataacagatataaca

SEQ ID NO: 796622 - DNA, 20 bp, Artificial
  CRISPR gRNA sequence
acattatatgtttttccagt

SEQ ID NO: 796623 - DNA, 20 bp, Artificial
  CRISPR gRNA sequence
tagaaacttatgaaaaatta

SEQ ID NO: 796624 - DNA, 20 bp, Artificial
  CRISPR gRNA sequence
gcaccttcgttgatgtctgg

SEQ ID NO: 796625 - DNA, 20 bp, Artificial
  CRISPR gRNA sequence
gctgacagaagtacttcaaa

SEQ ID NO: 796626 - DNA, 20 bp, Artificial
  CRISPR gRNA sequence
gaacattctacccaacaatc

SEQ ID NO: 796627 - DNA, 20 bp, Artificial
  CRISPR gRNA sequence
aaaacaagtctccataaatt

SEQ ID NO: 796628 - DNA, 20 bp, Artificial
  CRISPR gRNA sequence
gggtgaacaatgaaatcaag

SEQ ID NO: 796629 - DNA, 20 bp, Artificial
  CRISPR gRNA sequence
atacagcaaaagcagtgcta

SEQ ID NO: 796630 - DNA, 20 bp, Artificial
  CRISPR gRNA sequence
aggtcacacctcctggagct

SEQ ID NO: 796631 - DNA, 20 bp, Artificial
  CRISPR gRNA sequence
atccaaacccaaacccagca

SEQ ID NO: 796632 - DNA, 20 bp, Artificial
  CRISPR gRNA sequence
aacccaaacccagcagaaga

SEQ ID NO: 796633 - DNA, 20 bp, Artificial
  CRISPR gRNA sequence
tgaaacaaaaaaaatacaaa

SEQ ID NO: 796634 - DNA, 20 bp, Artificial
  CRISPR gRNA sequence
agataaataaaattgataac

SEQ ID NO: 796635 - DNA, 20 bp, Artificial
  CRISPR gRNA sequence
gaagatccaaataatctcaa

SEQ ID NO: 796636 - DNA, 20 bp, Artificial
  CRISPR gRNA sequence
gagatattactactcatatc

SEQ ID NO: 796637 - DNA, 20 bp, Artificial
  CRISPR gRNA sequence
aacacctttacacgtacaaa

SEQ ID NO: 796638 - DNA, 20 bp, Artificial
  CRISPR gRNA sequence
tatacaacccttcgattaaa

SEQ ID NO: 796639 - DNA, 20 bp, Artificial
  CRISPR gRNA sequence
aattctatcagacattcaaa

SEQ ID NO: 796640 - DNA, 20 bp, Artificial
  CRISPR gRNA sequence
ttgacactattccatgggat

SEQ ID NO: 796641 - DNA, 20 bp, Artificial
  CRISPR gRNA sequence
cagggaaggacataacaaaa

SEQ ID NO: 796642 - DNA, 20 bp, Artificial
  CRISPR gRNA sequence
aaatgtgatacaccacacaa

SEQ ID NO: 796643 - DNA, 20 bp, Artificial
  CRISPR gRNA sequence
acatgatcatctcaatagat

SEQ ID NO: 796644 - DNA, 20 bp, Artificial
  CRISPR gRNA sequence
aaagttgaaagcattttccc

SEQ ID NO: 796645 - DNA, 20 bp, Artificial
  CRISPR gRNA sequence
gtcctggccagagcactcaa

SEQ ID NO: 796646 - DNA, 20 bp, Artificial
  CRISPR gRNA sequence
tggccagagcactcaaagag

SEQ ID NO: 796647 - DNA, 20 bp, Artificial
  CRISPR gRNA sequence
ctgatgatatgatcatatac

SEQ ID NO: 796648 - DNA, 20 bp, Artificial
  CRISPR gRNA sequence
aaaactacaaatcactactg

SEQ ID NO: 796649 - DNA, 20 bp, Artificial
  CRISPR gRNA sequence
taccatcattcttcacaaaa

SEQ ID NO: 796650 - DNA, 20 bp, Artificial
  CRISPR gRNA sequence
cattcttcacaaaagtagaa

SEQ ID NO: 796651 - DNA, 20 bp, Artificial
  CRISPR gRNA sequence
taattggctagccacatgga

SEQ ID NO: 796652 - DNA, 20 bp, Artificial
  CRISPR gRNA sequence
taaaaagcttctgcacagca

SEQ ID NO: 796653 - DNA, 20 bp, Artificial
  CRISPR gRNA sequence
aacagacaacccacagagtg

SEQ ID NO: 796654 - DNA, 20 bp, Artificial
  CRISPR gRNA sequence
atctgacaaaggactaatat

SEQ ID NO: 796655 - DNA, 20 bp, Artificial
  CRISPR gRNA sequence
aaggtatgcaaataaatcag

SEQ ID NO: 796656 - DNA, 20 bp, Artificial
  CRISPR gRNA sequence
gcgataccaccttactcctg

SEQ ID NO: 796657 - DNA, 20 bp, Artificial
  CRISPR gRNA sequence
tgttggcatggatgtggtga

SEQ ID NO: 796658 - DNA, 20 bp, Artificial
  CRISPR gRNA sequence
ccatcaatcagtgagtggat

SEQ ID NO: 796659 - DNA, 20 bp, Artificial
  CRISPR gRNA sequence
gctatgaggatggaaaggca

SEQ ID NO: 796660 - DNA, 20 bp, Artificial
  CRISPR gRNA sequence
ctactcgggaggctgaggca

SEQ ID NO: 796661 - DNA, 20 bp, Artificial
  CRISPR gRNA sequence
atggccttcaccctaagaag

SEQ ID NO: 796662 - DNA, 20 bp, Artificial
  CRISPR gRNA sequence
cttggggaaacagaagggtg

SEQ ID NO: 796663 - DNA, 20 bp, Artificial
  CRISPR gRNA sequence
gggtgtaagaaaatcggagt

SEQ ID NO: 796664 - DNA, 20 bp, Artificial
  CRISPR gRNA sequence
ataacacgttttttaaaaat

SEQ ID NO: 796665 - DNA, 20 bp, Artificial
  CRISPR gRNA sequence
cacgttttttaaaaataaag

SEQ ID NO: 796666 - DNA, 20 bp, Artificial
  CRISPR gRNA sequence
aagaaagaaattattttaaa

SEQ ID NO: 796667 - DNA, 20 bp, Artificial
  CRISPR gRNA sequence
ctaaaagatttaactgatta

SEQ ID NO: 796668 - DNA, 20 bp, Artificial
  CRISPR gRNA sequence
gtatacatttcatctttatt

SEQ ID NO: 796669 - DNA, 20 bp, Artificial
  CRISPR gRNA sequence
agccagaacaaaccagggaa

SEQ ID NO: 796670 - DNA, 20 bp, Artificial
  CRISPR gRNA sequence
acagagaacagggaagcaat

SEQ ID NO: 796671 - DNA, 20 bp, Artificial
  CRISPR gRNA sequence
caattcagaaattagcaata

SEQ ID NO: 796672 - DNA, 20 bp, Artificial
  CRISPR gRNA sequence
acaaaagtatagagcatagg

SEQ ID NO: 796673 - DNA, 20 bp, Artificial
  CRISPR gRNA sequence
ttcctgcaacacagagcaga

SEQ ID NO: 796674 - DNA, 20 bp, Artificial
  CRISPR gRNA sequence
ttgtgctgcttagataatat

SEQ ID NO: 796675 - DNA, 20 bp, Artificial
  CRISPR gRNA sequence
tgctgtatccatttcctaaa

SEQ ID NO: 796676 - DNA, 20 bp, Artificial
  CRISPR gRNA sequence
ggcacaattttgcttggcat

SEQ ID NO: 796677 - DNA, 20 bp, Artificial
  CRISPR gRNA sequence
ttagcagtttactaatatca

SEQ ID NO: 796678 - DNA, 20 bp, Artificial
  CRISPR gRNA sequence
caactgatagaacaaacaat

SEQ ID NO: 796679 - DNA, 20 bp, Artificial
  CRISPR gRNA sequence
tagaacaaacaattaagaaa

SEQ ID NO: 796680 - DNA, 20 bp, Artificial
  CRISPR gRNA sequence
atcatcaaagcaattatcta

SEQ ID NO: 796681 - DNA, 20 bp, Artificial
  CRISPR gRNA sequence
aaaatttactcatcttttcc

SEQ ID NO: 796682 - DNA, 20 bp, Artificial
  CRISPR gRNA sequence
cttttccaccaccttccaaa

SEQ ID NO: 796683 - DNA, 20 bp, Artificial
  CRISPR gRNA sequence
cccaaaagacttgagagctt

SEQ ID NO: 796684 - DNA, 20 bp, Artificial
  CRISPR gRNA sequence
cctcttatggtgattccaat

SEQ ID NO: 796685 - DNA, 20 bp, Artificial
  CRISPR gRNA sequence
cgtggcacaaagctcaacac

SEQ ID NO: 796686 - DNA, 20 bp, Artificial
  CRISPR gRNA sequence
tttatacttccaacaattta

SEQ ID NO: 796687 - DNA, 20 bp, Artificial
  CRISPR gRNA sequence
tattgaaatttaatttctta

SEQ ID NO: 796688 - DNA, 20 bp, Artificial
  CRISPR gRNA sequence
ttttgatctatgtatagatt

SEQ ID NO: 796689 - DNA, 20 bp, Artificial
  CRISPR gRNA sequence
aaaccccatctctactgaaa

SEQ ID NO: 796690 - DNA, 20 bp, Artificial
  CRISPR gRNA sequence
ctactcaggaagctgaggca

SEQ ID NO: 796691 - DNA, 20 bp, Artificial
  CRISPR gRNA sequence
tcaaaaaaaaaaaaaaaaaa

SEQ ID NO: 796692 - DNA, 20 bp, Artificial
  CRISPR gRNA sequence
tctcttcttaatctcaaaac

SEQ ID NO: 796693 - DNA, 20 bp, Artificial
  CRISPR gRNA sequence
tgcttttagcaaatttgaat

SEQ ID NO: 796694 - DNA, 20 bp, Artificial
  CRISPR gRNA sequence
tgcatgtgttagggagaagt

SEQ ID NO: 796695 - DNA, 20 bp, Artificial
  CRISPR gRNA sequence
ttttttctcttcttaatctc

SEQ ID NO: 796696 - DNA, 20 bp, Artificial
  CRISPR gRNA sequence
tgaaataatttatagcactg

SEQ ID NO: 796697 - DNA, 20 bp, Artificial
  CRISPR gRNA sequence
accactgttgaggtctggaa

SEQ ID NO: 796698 - DNA, 20 bp, Artificial
  CRISPR gRNA sequence
ctatcttcagtaaccgtcca

SEQ ID NO: 796699 - DNA, 20 bp, Artificial
  CRISPR gRNA sequence
atgccatctttattgcattg

SEQ ID NO: 796700 - DNA, 20 bp, Artificial
  CRISPR gRNA sequence
agtaccaagctctataggaa

SEQ ID NO: 796701 - DNA, 20 bp, Artificial
  CRISPR gRNA sequence
acactcacatcctaaaggtt

SEQ ID NO: 796702 - DNA, 20 bp, Artificial
  CRISPR gRNA sequence
gcgcctaaagccaccccctg

SEQ ID NO: 796703 - DNA, 20 bp, Artificial
  CRISPR gRNA sequence
tctatcagttagggttcaga

SEQ ID NO: 796704 - DNA, 20 bp, Artificial
  CRISPR gRNA sequence
caaaggtgtgatcaccattt

SEQ ID NO: 796705 - DNA, 20 bp, Artificial
  CRISPR gRNA sequence
acttcccaggagctgtagcc

SEQ ID NO: 796706 - DNA, 20 bp, Artificial
  CRISPR gRNA sequence
gctgaacccagctagaagtc

SEQ ID NO: 796707 - DNA, 20 bp, Artificial
  CRISPR gRNA sequence
tcagagcaatattgacatgt

SEQ ID NO: 796708 - DNA, 20 bp, Artificial
  CRISPR gRNA sequence
agaatagatctggagaggaa

SEQ ID NO: 796709 - DNA, 20 bp, Artificial
  CRISPR gRNA sequence
cagctggttatgggtttttc

SEQ ID NO: 796710 - DNA, 20 bp, Artificial
  CRISPR gRNA sequence
atacttttgaacttcataca

SEQ ID NO: 796711 - DNA, 20 bp, Artificial
  CRISPR gRNA sequence
ttatctgatacttatggagg

SEQ ID NO: 796712 - DNA, 20 bp, Artificial
  CRISPR gRNA sequence
atattcacatgttccaggga

SEQ ID NO: 796713 - DNA, 20 bp, Artificial
  CRISPR gRNA sequence
tactgattcaatctggcttt

SEQ ID NO: 796714 - DNA, 20 bp, Artificial
  CRISPR gRNA sequence
tcaaagttgtagtgtggaca

SEQ ID NO: 796715 - DNA, 20 bp, Artificial
  CRISPR gRNA sequence
cctaagatgtctactcagac

SEQ ID NO: 796716 - DNA, 20 bp, Artificial
  CRISPR gRNA sequence
tttccccagtatccgtagca

SEQ ID NO: 796717 - DNA, 20 bp, Artificial
  CRISPR gRNA sequence
agcatcagaaaagtcgcagg

SEQ ID NO: 796718 - DNA, 20 bp, Artificial
  CRISPR gRNA sequence
tcagaaaagtcgcagggcag

SEQ ID NO: 796719 - DNA, 20 bp, Artificial
  CRISPR gRNA sequence
tgaagtgagtgtaagcctaa

SEQ ID NO: 796720 - DNA, 20 bp, Artificial
  CRISPR gRNA sequence
aacaagcagagtatcccctg

SEQ ID NO: 796721 - DNA, 20 bp, Artificial
  CRISPR gRNA sequence
agtgagactctgtctccaaa

SEQ ID NO: 796722 - DNA, 20 bp, Artificial
  CRISPR gRNA sequence
ggagaggaggtagggagggg

SEQ ID NO: 796723 - DNA, 20 bp, Artificial
  CRISPR gRNA sequence
aggaggtagggaggggaaag

SEQ ID NO: 796724 - DNA, 20 bp, Artificial
  CRISPR gRNA sequence
agggaggggaaagaaagaaa

SEQ ID NO: 796725 - DNA, 20 bp, Artificial
  CRISPR gRNA sequence
tttggatgaattgtagtttt

SEQ ID NO: 796726 - DNA, 20 bp, Artificial
  CRISPR gRNA sequence
ggggcctgtatgagatgaat

SEQ ID NO: 796727 - DNA, 20 bp, Artificial
  CRISPR gRNA sequence
aatacagccatcagggagat

SEQ ID NO: 796728 - DNA, 20 bp, Artificial
  CRISPR gRNA sequence
atggagaaatctttgtgcag

SEQ ID NO: 796729 - DNA, 20 bp, Artificial
  CRISPR gRNA sequence
tggagggtactccactgact

SEQ ID NO: 796730 - DNA, 20 bp, Artificial
  CRISPR gRNA sequence
aaaggacccttgtagggctg

SEQ ID NO: 796731 - DNA, 20 bp, Artificial
  CRISPR gRNA sequence
ccttgtagggctggcagaaa

SEQ ID NO: 796732 - DNA, 20 bp, Artificial
  CRISPR gRNA sequence
gcttataaagtgcttagtac

SEQ ID NO: 796733 - DNA, 20 bp, Artificial
  CRISPR gRNA sequence
ctactcaagaggccgaggca

SEQ ID NO: 796734 - DNA, 20 bp, Artificial
  CRISPR gRNA sequence
ataaattaattaattaaatt

SEQ ID NO: 796735 - DNA, 20 bp, Artificial
  CRISPR gRNA sequence
agaaacgacaaaagagtatg

SEQ ID NO: 796736 - DNA, 20 bp, Artificial
  CRISPR gRNA sequence
ccaaacccatgtttcaacct

SEQ ID NO: 796737 - DNA, 20 bp, Artificial
  CRISPR gRNA sequence
attccctaatactaaagttg

SEQ ID NO: 796738 - DNA, 20 bp, Artificial
  CRISPR gRNA sequence
cctaatactaaagttgaaag

SEQ ID NO: 796739 - DNA, 20 bp, Artificial
  CRISPR gRNA sequence
ggaggatcaggctaggtgga

SEQ ID NO: 796740 - DNA, 20 bp, Artificial
  CRISPR gRNA sequence
aagtgcttactaagcactta

SEQ ID NO: 796741 - DNA, 20 bp, Artificial
  CRISPR gRNA sequence
tacaaggctttccccagcct

SEQ ID NO: 796742 - DNA, 20 bp, Artificial
  CRISPR gRNA sequence
aagggggatagggaggaaaa

SEQ ID NO: 796743 - DNA, 20 bp, Artificial
  CRISPR gRNA sequence
atagggaggaaaaagagaaa

SEQ ID NO: 796744 - DNA, 20 bp, Artificial
  CRISPR gRNA sequence
ggaggaaaaagagaaaaaag

SEQ ID NO: 796745 - DNA, 20 bp, Artificial
  CRISPR gRNA sequence
atgagagagtggtaaaaagc

SEQ ID NO: 796746 - DNA, 20 bp, Artificial
  CRISPR gRNA sequence
agctgataggtgcagagcac

SEQ ID NO: 796747 - DNA, 20 bp, Artificial
  CRISPR gRNA sequence
catagccacagtgatagccc

SEQ ID NO: 796748 - DNA, 20 bp, Artificial
  CRISPR gRNA sequence
ttgatgattatttttcccca

SEQ ID NO: 796749 - DNA, 20 bp, Artificial
  CRISPR gRNA sequence
ctcacggttgggtaaggaaa

SEQ ID NO: 796750 - DNA, 20 bp, Artificial
  CRISPR gRNA sequence
ggagcctgcccacaaaaccc

SEQ ID NO: 796751 - DNA, 20 bp, Artificial
  CRISPR gRNA sequence
atctatacatggcctcatct

SEQ ID NO: 796752 - DNA, 20 bp, Artificial
  CRISPR gRNA sequence
acatggcctcatctatagaa

SEQ ID NO: 796753 - DNA, 20 bp, Artificial
  CRISPR gRNA sequence
tgaccacaatatttctaact

SEQ ID NO: 796754 - DNA, 20 bp, Artificial
  CRISPR gRNA sequence
aatgcaaggaattgttgcca

SEQ ID NO: 796755 - DNA, 20 bp, Artificial
  CRISPR gRNA sequence
aagatggccaggggagtgag

SEQ ID NO: 796756 - DNA, 20 bp, Artificial
  CRISPR gRNA sequence
gccaggggagtgagggagaa

SEQ ID NO: 796757 - DNA, 20 bp, Artificial
  CRISPR gRNA sequence
agaaaacaggagatggagaa

SEQ ID NO: 796758 - DNA, 20 bp, Artificial
  CRISPR gRNA sequence
ggagatggagaagaagaaag

SEQ ID NO: 796759 - DNA, 20 bp, Artificial
  CRISPR gRNA sequence
atggagaagaagaaagatag

SEQ ID NO: 796760 - DNA, 20 bp, Artificial
  CRISPR gRNA sequence
ctgaggactccttaataact

SEQ ID NO: 796761 - DNA, 20 bp, Artificial
  CRISPR gRNA sequence
ttccgttccagctgtctttg

SEQ ID NO: 796762 - DNA, 20 bp, Artificial
  CRISPR gRNA sequence
taggagacctttcttacaaa

SEQ ID NO: 796763 - DNA, 20 bp, Artificial
  CRISPR gRNA sequence
ttatatttttaatgaaccag

SEQ ID NO: 796764 - DNA, 20 bp, Artificial
  CRISPR gRNA sequence
tgtggttcaacttggactac

SEQ ID NO: 796765 - DNA, 20 bp, Artificial
  CRISPR gRNA sequence
tctccacctcccacaaactg

SEQ ID NO: 796766 - DNA, 20 bp, Artificial
  CRISPR gRNA sequence
ttgctgtctactccggccat

SEQ ID NO: 796767 - DNA, 20 bp, Artificial
  CRISPR gRNA sequence
atctgcttgtctttacgttt

SEQ ID NO: 796768 - DNA, 20 bp, Artificial
  CRISPR gRNA sequence
tatacaacatttccatcatt

SEQ ID NO: 796769 - DNA, 20 bp, Artificial
  CRISPR gRNA sequence
aagtgtctttatgctggagt

SEQ ID NO: 796770 - DNA, 20 bp, Artificial
  CRISPR gRNA sequence
tggagttaagaaagtgaggc

SEQ ID NO: 796771 - DNA, 20 bp, Artificial
  CRISPR gRNA sequence
attatctttgaacaatggaa

SEQ ID NO: 796772 - DNA, 20 bp, Artificial
  CRISPR gRNA sequence
gagccaatggcaaagtcaag

SEQ ID NO: 796773 - DNA, 20 bp, Artificial
  CRISPR gRNA sequence
tccagcagaagtcaccagct

SEQ ID NO: 796774 - DNA, 20 bp, Artificial
  CRISPR gRNA sequence
cacagccctagaagattgag

SEQ ID NO: 796775 - DNA, 20 bp, Artificial
  CRISPR gRNA sequence
tatggttacctgtggcccac

SEQ ID NO: 796776 - DNA, 20 bp, Artificial
  CRISPR gRNA sequence
acctggtatatagggcaaaa

SEQ ID NO: 796777 - DNA, 20 bp, Artificial
  CRISPR gRNA sequence
gttgggcattaaatcctaaa

SEQ ID NO: 796778 - DNA, 20 bp, Artificial
  CRISPR gRNA sequence
gaatatgtgaaatcagaggt

SEQ ID NO: 796779 - DNA, 20 bp, Artificial
  CRISPR gRNA sequence
ccattgacgaataagtggat

SEQ ID NO: 796780 - DNA, 20 bp, Artificial
  CRISPR gRNA sequence
gaatactactcagccatgaa

SEQ ID NO: 796781 - DNA, 20 bp, Artificial
  CRISPR gRNA sequence
ttgatataaaaaaaaaatta

SEQ ID NO: 796782 - DNA, 20 bp, Artificial
  CRISPR gRNA sequence
aagtagcagtcaagactaaa

SEQ ID NO: 796783 - DNA, 20 bp, Artificial
  CRISPR gRNA sequence
caactgaatagttccagctt

SEQ ID NO: 796784 - DNA, 20 bp, Artificial
  CRISPR gRNA sequence
ggacctctggtctcacatag

SEQ ID NO: 796785 - DNA, 20 bp, Artificial
  CRISPR gRNA sequence
ttctaccttacagtcttgag

SEQ ID NO: 796786 - DNA, 20 bp, Artificial
  CRISPR gRNA sequence
acaaaaggacatctgtgata

SEQ ID NO: 796787 - DNA, 20 bp, Artificial
  CRISPR gRNA sequence
cttcccattttataggtgag

SEQ ID NO: 796788 - DNA, 20 bp, Artificial
  CRISPR gRNA sequence
agcaatccaggtgtccaagt

SEQ ID NO: 796789 - DNA, 20 bp, Artificial
  CRISPR gRNA sequence
gttgagtctatcaactcaaa

SEQ ID NO: 796790 - DNA, 20 bp, Artificial
  CRISPR gRNA sequence
aataaaaaataaaaaagtat

SEQ ID NO: 796791 - DNA, 20 bp, Artificial
  CRISPR gRNA sequence
ataaagaaaacaaaaataat

SEQ ID NO: 796792 - DNA, 20 bp, Artificial
  CRISPR gRNA sequence
aataatttagaatccattgc

SEQ ID NO: 796793 - DNA, 20 bp, Artificial
  CRISPR gRNA sequence
ctcttgcctttgtgcacatg

SEQ ID NO: 796794 - DNA, 20 bp, Artificial
  CRISPR gRNA sequence
caatgtacatggaacatgaa

SEQ ID NO: 796795 - DNA, 20 bp, Artificial
  CRISPR gRNA sequence
actttctatataataaaaaa

SEQ ID NO: 796796 - DNA, 20 bp, Artificial
  CRISPR gRNA sequence
actcaccatattcccttcct

SEQ ID NO: 796797 - DNA, 20 bp, Artificial
  CRISPR gRNA sequence
tgtattactttcaaaaagaa

SEQ ID NO: 796798 - DNA, 20 bp, Artificial
  CRISPR gRNA sequence
ggtcatatcataacttactg

SEQ ID NO: 796799 - DNA, 20 bp, Artificial
  CRISPR gRNA sequence
agtattaccgataaggtact

SEQ ID NO: 796800 - DNA, 20 bp, Artificial
  CRISPR gRNA sequence
gcccaccttaccatcaatcc

SEQ ID NO: 796801 - DNA, 20 bp, Artificial
  CRISPR gRNA sequence
agctggggataatcagggaa

SEQ ID NO: 796802 - DNA, 20 bp, Artificial
  CRISPR gRNA sequence
gaaggtgacttttgaatcag

SEQ ID NO: 796803 - DNA, 20 bp, Artificial
  CRISPR gRNA sequence
gtgcacgtgaccccgttcag

SEQ ID NO: 796804 - DNA, 20 bp, Artificial
  CRISPR gRNA sequence
tgactattcctaggtctgaa

SEQ ID NO: 796805 - DNA, 20 bp, Artificial
  CRISPR gRNA sequence
aaccctagtaaaaatggcaa

SEQ ID NO: 796806 - DNA, 20 bp, Artificial
  CRISPR gRNA sequence
taatgagtctgcaggaatta

SEQ ID NO: 796807 - DNA, 20 bp, Artificial
  CRISPR gRNA sequence
tactgaactatgtgtggccc

SEQ ID NO: 796808 - DNA, 20 bp, Artificial
  CRISPR gRNA sequence
agaagcttctggactctgaa

SEQ ID NO: 796809 - DNA, 20 bp, Artificial
  CRISPR gRNA sequence
agcaagcactactgcacttt

SEQ ID NO: 796810 - DNA, 20 bp, Artificial
  CRISPR gRNA sequence
ccccactggatcctggaccc

SEQ ID NO: 796811 - DNA, 20 bp, Artificial
  CRISPR gRNA sequence
gtgtgtggaaatttccagta

SEQ ID NO: 796812 - DNA, 20 bp, Artificial
  CRISPR gRNA sequence
tctttttatttgtttttacc

SEQ ID NO: 796813 - DNA, 20 bp, Artificial
  CRISPR gRNA sequence
tgagcaaaatttggggctta

SEQ ID NO: 796814 - DNA, 20 bp, Artificial
  CRISPR gRNA sequence
tctcaattctcatgtaaatc

SEQ ID NO: 796815 - DNA, 20 bp, Artificial
  CRISPR gRNA sequence
gtaaatcagagaatgccttt

SEQ ID NO: 796816 - DNA, 20 bp, Artificial
  CRISPR gRNA sequence
agcaaacctcttacccaaaa

SEQ ID NO: 796817 - DNA, 20 bp, Artificial
  CRISPR gRNA sequence
tagaatatataaagaacgtt

SEQ ID NO: 796818 - DNA, 20 bp, Artificial
  CRISPR gRNA sequence
aaggcattctctgatttaca

SEQ ID NO: 796819 - DNA, 20 bp, Artificial
  CRISPR gRNA sequence
tctctgatttacatgagaat

SEQ ID NO: 796820 - DNA, 20 bp, Artificial
  CRISPR gRNA sequence
atttaaagtcatattgaggg

SEQ ID NO: 796821 - DNA, 20 bp, Artificial
  CRISPR gRNA sequence
tctaaggtaaaaacaaataa

SEQ ID NO: 796822 - DNA, 20 bp, Artificial
  CRISPR gRNA sequence
cctctgcttttggaaatcac

SEQ ID NO: 796823 - DNA, 20 bp, Artificial
  CRISPR gRNA sequence
gaccacaggttcagatctgg

SEQ ID NO: 796824 - DNA, 20 bp, Artificial
  CRISPR gRNA sequence
tggggagaaaagcccacaaa

SEQ ID NO: 796825 - DNA, 20 bp, Artificial
  CRISPR gRNA sequence
agaaaaatcattttttatga

SEQ ID NO: 796826 - DNA, 20 bp, Artificial
  CRISPR gRNA sequence
ctgagacaactgtgctgcct

SEQ ID NO: 796827 - DNA, 20 bp, Artificial
  CRISPR gRNA sequence
gacaactgtgctgcctgaag

SEQ ID NO: 796828 - DNA, 20 bp, Artificial
  CRISPR gRNA sequence
caataggattcacgcttcta

SEQ ID NO: 796829 - DNA, 20 bp, Artificial
  CRISPR gRNA sequence
gcgaaaggtttatagtgcca

SEQ ID NO: 796830 - DNA, 20 bp, Artificial
  CRISPR gRNA sequence
ggtttatagtgccaaaagaa

SEQ ID NO: 796831 - DNA, 20 bp, Artificial
  CRISPR gRNA sequence
aaagactggaccaaaagtat

SEQ ID NO: 796832 - DNA, 20 bp, Artificial
  CRISPR gRNA sequence
ttatcggtaatacttaattg

SEQ ID NO: 796833 - DNA, 20 bp, Artificial
  CRISPR gRNA sequence
ctgacagggtcttgcaaata

SEQ ID NO: 796834 - DNA, 20 bp, Artificial
  CRISPR gRNA sequence
tctgcttgtctgcataagag

SEQ ID NO: 796835 - DNA, 20 bp, Artificial
  CRISPR gRNA sequence
tggggatggttgaaatggct

SEQ ID NO: 796836 - DNA, 20 bp, Artificial
  CRISPR gRNA sequence
tagtgaagtacaacaaaaat

SEQ ID NO: 796837 - DNA, 20 bp, Artificial
  CRISPR gRNA sequence
attttctatttttttattat

SEQ ID NO: 796838 - DNA, 20 bp, Artificial
  CRISPR gRNA sequence
actgatggagcaattactac

SEQ ID NO: 796839 - DNA, 20 bp, Artificial
  CRISPR gRNA sequence
ggttaccatgccagatggat

SEQ ID NO: 796840 - DNA, 20 bp, Artificial
  CRISPR gRNA sequence
ccaactcttacatcttctac

SEQ ID NO: 796841 - DNA, 20 bp, Artificial
  CRISPR gRNA sequence
tgagatagaactgggatggc

SEQ ID NO: 796842 - DNA, 20 bp, Artificial
  CRISPR gRNA sequence
atttattatataataaacta

SEQ ID NO: 796843 - DNA, 20 bp, Artificial
  CRISPR gRNA sequence
taagaaacattgataaacgg

SEQ ID NO: 796844 - DNA, 20 bp, Artificial
  CRISPR gRNA sequence
atatagacacatagaagcag

SEQ ID NO: 796845 - DNA, 20 bp, Artificial
  CRISPR gRNA sequence
agggacctttccaaagctat

SEQ ID NO: 796846 - DNA, 20 bp, Artificial
  CRISPR gRNA sequence
attcctcattaggtattggt

SEQ ID NO: 796847 - DNA, 20 bp, Artificial
  CRISPR gRNA sequence
aagtttgagaggcagtgagc

SEQ ID NO: 796848 - DNA, 20 bp, Artificial
  CRISPR gRNA sequence
gagcaaaaaactgaggtttc

SEQ ID NO: 796849 - DNA, 20 bp, Artificial
  CRISPR gRNA sequence
ttctgcctcaagactgtaag

SEQ ID NO: 796850 - DNA, 20 bp, Artificial
  CRISPR gRNA sequence
actttaaaattcaagctgag

SEQ ID NO: 796851 - DNA, 20 bp, Artificial
  CRISPR gRNA sequence
aaaattcaagctgagagaga

SEQ ID NO: 796852 - DNA, 20 bp, Artificial
  CRISPR gRNA sequence
agctgagagagaaaagaaag

SEQ ID NO: 796853 - DNA, 20 bp, Artificial
  CRISPR gRNA sequence
gagagagaaaagaaagtaag

SEQ ID NO: 796854 - DNA, 20 bp, Artificial
  CRISPR gRNA sequence
gtgtctgaaaaggaaaaatt

SEQ ID NO: 796855 - DNA, 20 bp, Artificial
  CRISPR gRNA sequence
cagaaatggaataagattaa

SEQ ID NO: 796856 - DNA, 20 bp, Artificial
  CRISPR gRNA sequence
aatccaggaaatgtctggct

SEQ ID NO: 796857 - DNA, 20 bp, Artificial
  CRISPR gRNA sequence
cctgccttccctggtccagg

SEQ ID NO: 796858 - DNA, 20 bp, Artificial
  CRISPR gRNA sequence
gcttagctcccacttacaag

SEQ ID NO: 796859 - DNA, 20 bp, Artificial
  CRISPR gRNA sequence
tgttccttcacaagagagtt

SEQ ID NO: 796860 - DNA, 20 bp, Artificial
  CRISPR gRNA sequence
tgggcatatattggtgaatc

SEQ ID NO: 796861 - DNA, 20 bp, Artificial
  CRISPR gRNA sequence
cgtaaagacaagcagatgaa

SEQ ID NO: 796862 - DNA, 20 bp, Artificial
  CRISPR gRNA sequence
tacttaactttgcaatggac

SEQ ID NO: 796863 - DNA, 20 bp, Artificial
  CRISPR gRNA sequence
aatgggtgtggtgcgtggag

SEQ ID NO: 796864 - DNA, 20 bp, Artificial
  CRISPR gRNA sequence
actccaactcaggtggacaa

SEQ ID NO: 796865 - DNA, 20 bp, Artificial
  CRISPR gRNA sequence
taagaagagacaatattgta

SEQ ID NO: 796866 - DNA, 20 bp, Artificial
  CRISPR gRNA sequence
gactgccatgcctctgagga

SEQ ID NO: 796867 - DNA, 20 bp, Artificial
  CRISPR gRNA sequence
tgctgcttccccttttacag

SEQ ID NO: 796868 - DNA, 20 bp, Artificial
  CRISPR gRNA sequence
gataggcaatttgtacaagg

SEQ ID NO: 796869 - DNA, 20 bp, Artificial
  CRISPR gRNA sequence
gtgtgcatggcagacacatg

SEQ ID NO: 796870 - DNA, 20 bp, Artificial
  CRISPR gRNA sequence
tctggttcattaaaaatata

SEQ ID NO: 796871 - DNA, 20 bp, Artificial
  CRISPR gRNA sequence
attcacttaattcttatttg

SEQ ID NO: 796872 - DNA, 20 bp, Artificial
  CRISPR gRNA sequence
tatgggtgtgagaggtaaaa

SEQ ID NO: 796873 - DNA, 20 bp, Artificial
  CRISPR gRNA sequence
caattccttgcattctacag

SEQ ID NO: 796874 - DNA, 20 bp, Artificial
  CRISPR gRNA sequence
acagaacaggagtgtgttgg

SEQ ID NO: 796875 - DNA, 20 bp, Artificial
  CRISPR gRNA sequence
gtaagaatacaacaggctaa

SEQ ID NO: 796876 - DNA, 20 bp, Artificial
  CRISPR gRNA sequence
ggtgaaaatggaaggaatcc

SEQ ID NO: 796877 - DNA, 20 bp, Artificial
  CRISPR gRNA sequence
ctgatgaaagctcttggctc

SEQ ID NO: 796878 - DNA, 20 bp, Artificial
  CRISPR gRNA sequence
ataaaactcacttacctttt

SEQ ID NO: 796879 - DNA, 20 bp, Artificial
  CRISPR gRNA sequence
acctgggcaaaggaaaagca

SEQ ID NO: 796880 - DNA, 20 bp, Artificial
  CRISPR gRNA sequence
atgatccccatttcactggt

SEQ ID NO: 796881 - DNA, 20 bp, Artificial
  CRISPR gRNA sequence
ctgacaagtactcacagtgc

SEQ ID NO: 796882 - DNA, 20 bp, Artificial
  CRISPR gRNA sequence
ggattaacaggatccttttg

SEQ ID NO: 796883 - DNA, 20 bp, Artificial
  CRISPR gRNA sequence
acaggatccttttggaagaa

SEQ ID NO: 796884 - DNA, 20 bp, Artificial
  CRISPR gRNA sequence
gtttagtagagggtggatca

SEQ ID NO: 796885 - DNA, 20 bp, Artificial
  CRISPR gRNA sequence
agagtgtgattaacattaac

SEQ ID NO: 796886 - DNA, 20 bp, Artificial
  CRISPR gRNA sequence
ttttatagggacaacatcct

SEQ ID NO: 796887 - DNA, 20 bp, Artificial
  CRISPR gRNA sequence
atacaacaactggctgagca

SEQ ID NO: 796888 - DNA, 20 bp, Artificial
  CRISPR gRNA sequence
gcagtccacagctcaattta

SEQ ID NO: 796889 - DNA, 20 bp, Artificial
  CRISPR gRNA sequence
agctcaatttatgagaatga

SEQ ID NO: 796890 - DNA, 20 bp, Artificial
  CRISPR gRNA sequence
agacaacttaaaaatgccct

SEQ ID NO: 796891 - DNA, 20 bp, Artificial
  CRISPR gRNA sequence
gctggtatttgtgccacaag

SEQ ID NO: 796892 - DNA, 20 bp, Artificial
  CRISPR gRNA sequence
tgagcaaagaaggcatggag

SEQ ID NO: 796893 - DNA, 20 bp, Artificial
  CRISPR gRNA sequence
aaggatgggtaaaaccaggt

SEQ ID NO: 796894 - DNA, 20 bp, Artificial
  CRISPR gRNA sequence
ccctttcacatctctaccat

SEQ ID NO: 796895 - DNA, 20 bp, Artificial
  CRISPR gRNA sequence
cttatataagaagcgtcttt

SEQ ID NO: 796896 - DNA, 20 bp, Artificial
  CRISPR gRNA sequence
accatgatataaagagaggt

SEQ ID NO: 796897 - DNA, 20 bp, Artificial
  CRISPR gRNA sequence
cctctgaaaactgtatcagg

SEQ ID NO: 796898 - DNA, 20 bp, Artificial
  CRISPR gRNA sequence
tcagggaagaattttttcca

SEQ ID NO: 796899 - DNA, 20 bp, Artificial
  CRISPR gRNA sequence
atattggcagaccagtgagc

SEQ ID NO: 796900 - DNA, 20 bp, Artificial
  CRISPR gRNA sequence
aaaaaaattaccatactggt

SEQ ID NO: 796901 - DNA, 20 bp, Artificial
  CRISPR gRNA sequence
tctgggtcaccctatcaggc

SEQ ID NO: 796902 - DNA, 20 bp, Artificial
  CRISPR gRNA sequence
tttcacttcagccagctggg

SEQ ID NO: 796903 - DNA, 20 bp, Artificial
  CRISPR gRNA sequence
catgcatgtctagcccagca

SEQ ID NO: 796904 - DNA, 20 bp, Artificial
  CRISPR gRNA sequence
ctactcaggaggctgagaca

SEQ ID NO: 796905 - DNA, 20 bp, Artificial
  CRISPR gRNA sequence
actgcattccagcctggggg

SEQ ID NO: 796906 - DNA, 20 bp, Artificial
  CRISPR gRNA sequence
ggtaatttgatataagagca

SEQ ID NO: 796907 - DNA, 20 bp, Artificial
  CRISPR gRNA sequence
gcatagtcagtaaaggctct

SEQ ID NO: 796908 - DNA, 20 bp, Artificial
  CRISPR gRNA sequence
caggagattggagggtggga

SEQ ID NO: 796909 - DNA, 20 bp, Artificial
  CRISPR gRNA sequence
gtaggaagctggacaataga

SEQ ID NO: 796910 - DNA, 20 bp, Artificial
  CRISPR gRNA sequence
agctggacaatagagaagaa

SEQ ID NO: 796911 - DNA, 20 bp, Artificial
  CRISPR gRNA sequence
aattatttcacaattggagg

SEQ ID NO: 796912 - DNA, 20 bp, Artificial
  CRISPR gRNA sequence
tgttttctttgagattaaga

SEQ ID NO: 796913 - DNA, 20 bp, Artificial
  CRISPR gRNA sequence
acagatatggctccctgcct

SEQ ID NO: 796914 - DNA, 20 bp, Artificial
  CRISPR gRNA sequence
aggtcctcaaaaaactaaaa

SEQ ID NO: 796915 - DNA, 20 bp, Artificial
  CRISPR gRNA sequence
caaactaaatgtccatcaac

SEQ ID NO: 796916 - DNA, 20 bp, Artificial
  CRISPR gRNA sequence
tccatcaacagagaatgaat

SEQ ID NO: 796917 - DNA, 20 bp, Artificial
  CRISPR gRNA sequence
caatggaatacttacagccc

SEQ ID NO: 796918 - DNA, 20 bp, Artificial
  CRISPR gRNA sequence
aatctaaaaaagtagatccc

SEQ ID NO: 796919 - DNA, 20 bp, Artificial
  CRISPR gRNA sequence
gtagatcccatagaaacaga

SEQ ID NO: 796920 - DNA, 20 bp, Artificial
  CRISPR gRNA sequence
tctctgttttgagattaaga

SEQ ID NO: 796921 - DNA, 20 bp, Artificial
  CRISPR gRNA sequence
ttcggtaggaaatattcttt

SEQ ID NO: 796922 - DNA, 20 bp, Artificial
  CRISPR gRNA sequence
ctattgcaggtggcttggac

SEQ ID NO: 796923 - DNA, 20 bp, Artificial
  CRISPR gRNA sequence
gagagagagctcttccacta

SEQ ID NO: 796924 - DNA, 20 bp, Artificial
  CRISPR gRNA sequence
catcctacatttttgcagta

SEQ ID NO: 796925 - DNA, 20 bp, Artificial
  CRISPR gRNA sequence
taggaaaagatgagtaaatt

SEQ ID NO: 796926 - DNA, 20 bp, Artificial
  CRISPR gRNA sequence
ccgtagttaaaaacatgagt

SEQ ID NO: 796927 - DNA, 20 bp, Artificial
  CRISPR gRNA sequence
cttctcagtctccctcatta

SEQ ID NO: 796928 - DNA, 20 bp, Artificial
  CRISPR gRNA sequence
acattcctgagttacttcac

SEQ ID NO: 796929 - DNA, 20 bp, Artificial
  CRISPR gRNA sequence
ggttttgatttgcatttccc

SEQ ID NO: 796930 - DNA, 20 bp, Artificial
  CRISPR gRNA sequence
gtcatttgtgtatctccttg

SEQ ID NO: 796931 - DNA, 20 bp, Artificial
  CRISPR gRNA sequence
ggctttttcgatgttatctt

SEQ ID NO: 796932 - DNA, 20 bp, Artificial
  CRISPR gRNA sequence
atttctttttctacttttgt

SEQ ID NO: 796933 - DNA, 20 bp, Artificial
  CRISPR gRNA sequence
attagggtgctactggcttc

SEQ ID NO: 796934 - DNA, 20 bp, Artificial
  CRISPR gRNA sequence
tatcccatggaatagtgtca

SEQ ID NO: 796935 - DNA, 20 bp, Artificial
  CRISPR gRNA sequence
aattcttctttgaatgtctg

SEQ ID NO: 796936 - DNA, 20 bp, Artificial
  CRISPR gRNA sequence
cctactatatagtctatctt

SEQ ID NO: 796937 - DNA, 20 bp, Artificial
  CRISPR gRNA sequence
aatgttccatatgctgatga

SEQ ID NO: 796938 - DNA, 20 bp, Artificial
  CRISPR gRNA sequence
gtatattctgcgattgttgg

SEQ ID NO: 796939 - DNA, 20 bp, Artificial
  CRISPR gRNA sequence
cttcctcagatggattgccc

SEQ ID NO: 796940 - DNA, 20 bp, Artificial
  CRISPR gRNA sequence
tgtaggtgccacctggcttt

SEQ ID NO: 796941 - DNA, 20 bp, Artificial
  CRISPR gRNA sequence
gtcctttatcactgtctctt

SEQ ID NO: 796942 - DNA, 20 bp, Artificial
  CRISPR gRNA sequence
actcttttcattatatttga

SEQ ID NO: 796943 - DNA, 20 bp, Artificial
  CRISPR gRNA sequence
acattgaatgttctcaacac

SEQ ID NO: 796944 - DNA, 20 bp, Artificial
  CRISPR gRNA sequence
atagtacaatatagtttcca

SEQ ID NO: 796945 - DNA, 20 bp, Artificial
  CRISPR gRNA sequence
taaataagctcttacaaaca

SEQ ID NO: 796946 - DNA, 20 bp, Artificial
  CRISPR gRNA sequence
taaaaaaggggaatgagact

SEQ ID NO: 796947 - DNA, 20 bp, Artificial
  CRISPR gRNA sequence
gactggagaatgtggaaaaa

SEQ ID NO: 796948 - DNA, 20 bp, Artificial
  CRISPR gRNA sequence
cttccaatttcaccttccct

SEQ ID NO: 796949 - DNA, 20 bp, Artificial
  CRISPR gRNA sequence
ttgtccttgggatagtttgc

SEQ ID NO: 796950 - DNA, 20 bp, Artificial
  CRISPR gRNA sequence
ggttggaatgattttatata

SEQ ID NO: 796951 - DNA, 20 bp, Artificial
  CRISPR gRNA sequence
ctccttcaattttgttgaaa

SEQ ID NO: 796952 - DNA, 20 bp, Artificial
  CRISPR gRNA sequence
ggaacaaatctctccacaac

SEQ ID NO: 796953 - DNA, 20 bp, Artificial
  CRISPR gRNA sequence
gagagacagttctcagtttg

SEQ ID NO: 796954 - DNA, 20 bp, Artificial
  CRISPR gRNA sequence
tcgagtacatcaaggcatcc

SEQ ID NO: 796955 - DNA, 20 bp, Artificial
  CRISPR gRNA sequence
atgtaggaaatgcaataaag

SEQ ID NO: 796956 - DNA, 20 bp, Artificial
  CRISPR gRNA sequence
gcgtgggaggggaagaggcc

SEQ ID NO: 796957 - DNA, 20 bp, Artificial
  CRISPR gRNA sequence
taactttttatgatccaaag

SEQ ID NO: 796958 - DNA, 20 bp, Artificial
  CRISPR gRNA sequence
cacacacacacacacgtccc

SEQ ID NO: 796959 - DNA, 20 bp, Artificial
  CRISPR gRNA sequence
caagtcagggatgttccatg

SEQ ID NO: 796960 - DNA, 20 bp, Artificial
  CRISPR gRNA sequence
gtcactgtgaataaagctga

SEQ ID NO: 796961 - DNA, 20 bp, Artificial
  CRISPR gRNA sequence
ataatattctatcctttttt

SEQ ID NO: 796962 - DNA, 20 bp, Artificial
  CRISPR gRNA sequence
acttgcccaagattgcacag

SEQ ID NO: 796963 - DNA, 20 bp, Artificial
  CRISPR gRNA sequence
gtaagatgattttagatgag

SEQ ID NO: 796964 - DNA, 20 bp, Artificial
  CRISPR gRNA sequence
aagagcttggcaaataaatg

SEQ ID NO: 796965 - DNA, 20 bp, Artificial
  CRISPR gRNA sequence
aatgacagaaagagagagag

SEQ ID NO: 796966 - DNA, 20 bp, Artificial
  CRISPR gRNA sequence
acagaaagagagagagggag

SEQ ID NO: 796967 - DNA, 20 bp, Artificial
  CRISPR gRNA sequence
cacttggaatagctctcacc

SEQ ID NO: 796968 - DNA, 20 bp, Artificial
  CRISPR gRNA sequence
accaaatccaatctgtcctt

SEQ ID NO: 796969 - DNA, 20 bp, Artificial
  CRISPR gRNA sequence
tagtaatcatatgccaagtt

SEQ ID NO: 796970 - DNA, 20 bp, Artificial
  CRISPR gRNA sequence
tttgataaacaggaaacagg

SEQ ID NO: 796971 - DNA, 20 bp, Artificial
  CRISPR gRNA sequence
ttgctgagtctgcataacaa

SEQ ID NO: 796972 - DNA, 20 bp, Artificial
  CRISPR gRNA sequence
tgcactatgctttcttgtca

SEQ ID NO: 796973 - DNA, 20 bp, Artificial
  CRISPR gRNA sequence
tatttttcctgtctgccttg

SEQ ID NO: 796974 - DNA, 20 bp, Artificial
  CRISPR gRNA sequence
tttttcagctaatatttaca

SEQ ID NO: 796975 - DNA, 20 bp, Artificial
  CRISPR gRNA sequence
gaatcatatgtctgaatagc

SEQ ID NO: 796976 - DNA, 20 bp, Artificial
  CRISPR gRNA sequence
caacttcacctggaagctag

SEQ ID NO: 796977 - DNA, 20 bp, Artificial
  CRISPR gRNA sequence
cctggaagctaggtagaaat

SEQ ID NO: 796978 - DNA, 20 bp, Artificial
  CRISPR gRNA sequence
gatgcaacttgcccaaggtc

SEQ ID NO: 796979 - DNA, 20 bp, Artificial
  CRISPR gRNA sequence
tcctgaaggtattagacaaa

SEQ ID NO: 796980 - DNA, 20 bp, Artificial
  CRISPR gRNA sequence
gctttacatagccacattct

SEQ ID NO: 796981 - DNA, 20 bp, Artificial
  CRISPR gRNA sequence
gcatggagacatgtcttcgc

SEQ ID NO: 796982 - DNA, 20 bp, Artificial
  CRISPR gRNA sequence
cctaggctgaggtctgtgcc

SEQ ID NO: 796983 - DNA, 20 bp, Artificial
  CRISPR gRNA sequence
acctctggagtacgaagaga

SEQ ID NO: 796984 - DNA, 20 bp, Artificial
  CRISPR gRNA sequence
tagattttgaaataaaaatg

SEQ ID NO: 796985 - DNA, 20 bp, Artificial
  CRISPR gRNA sequence
aagttaatggaacaaaaagt

SEQ ID NO: 796986 - DNA, 20 bp, Artificial
  CRISPR gRNA sequence
atggattataaaccttacat

SEQ ID NO: 796987 - DNA, 20 bp, Artificial
  CRISPR gRNA sequence
atacaactacaaaatgtgta

SEQ ID NO: 796988 - DNA, 20 bp, Artificial
  CRISPR gRNA sequence
taccaaaagcatgatccata

SEQ ID NO: 796989 - DNA, 20 bp, Artificial
  CRISPR gRNA sequence
tgctctgcaaaagacacagt

SEQ ID NO: 796990 - DNA, 20 bp, Artificial
  CRISPR gRNA sequence
aagacaagctacagacttca

SEQ ID NO: 796991 - DNA, 20 bp, Artificial
  CRISPR gRNA sequence
atctgataaagaacttgtat

SEQ ID NO: 796992 - DNA, 20 bp, Artificial
  CRISPR gRNA sequence
ccagtcaagaggctgaggct

SEQ ID NO: 796993 - DNA, 20 bp, Artificial
  CRISPR gRNA sequence
agactgcgtctcaaaaaaat

SEQ ID NO: 796994 - DNA, 20 bp, Artificial
  CRISPR gRNA sequence
gaatttttaaaaccttacaa

SEQ ID NO: 796995 - DNA, 20 bp, Artificial
  CRISPR gRNA sequence
ttactacagagtctgaggtg

SEQ ID NO: 796996 - DNA, 20 bp, Artificial
  CRISPR gRNA sequence
agtgataccctgtctcaaaa

SEQ ID NO: 796997 - DNA, 20 bp, Artificial
  CRISPR gRNA sequence
gaaccacttctacacaccta

SEQ ID NO: 796998 - DNA, 20 bp, Artificial
  CRISPR gRNA sequence
acacacctattagaatgact

SEQ ID NO: 796999 - DNA, 20 bp, Artificial
  CRISPR gRNA sequence
ctacttgggaggctgaggca

SEQ ID NO: 797000 - DNA, 20 bp, Artificial
  CRISPR gRNA sequence
cgaaactctgtctcaaaaaa

SEQ ID NO: 797001 - DNA, 20 bp, Artificial
  CRISPR gRNA sequence
gtctcaaaaaaaaagaaaaa

SEQ ID NO: 797002 - DNA, 20 bp, Artificial
  CRISPR gRNA sequence
aaaaaaaaagaaaaaataga

SEQ ID NO: 797003 - DNA, 20 bp, Artificial
  CRISPR gRNA sequence
caaaatatagtatacataca

SEQ ID NO: 797004 - DNA, 20 bp, Artificial
  CRISPR gRNA sequence
gaaaagtcattactataagg

SEQ ID NO: 797005 - DNA, 20 bp, Artificial
  CRISPR gRNA sequence
ttcataagacttttttaaaa

SEQ ID NO: 797006 - DNA, 20 bp, Artificial
  CRISPR gRNA sequence
tttcaagcattaatctagca

SEQ ID NO: 797007 - DNA, 20 bp, Artificial
  CRISPR gRNA sequence
tctctgtgatatattttaca

SEQ ID NO: 797008 - DNA, 20 bp, Artificial
  CRISPR gRNA sequence
ttttatttatttgtaatgac

SEQ ID NO: 797009 - DNA, 20 bp, Artificial
  CRISPR gRNA sequence
gttatttttaaaatttaaaa

SEQ ID NO: 797010 - DNA, 20 bp, Artificial
  CRISPR gRNA sequence
ttttaaaatttaaaaataga

SEQ ID NO: 797011 - DNA, 20 bp, Artificial
  CRISPR gRNA sequence
ggggctgtacaaggagcaag

SEQ ID NO: 797012 - DNA, 20 bp, Artificial
  CRISPR gRNA sequence
attactttcatatttttata

SEQ ID NO: 797013 - DNA, 20 bp, Artificial
  CRISPR gRNA sequence
tgttatctgcatagtggaaa

SEQ ID NO: 797014 - DNA, 20 bp, Artificial
  CRISPR gRNA sequence
tctgcatagtggaaagcaga

SEQ ID NO: 797015 - DNA, 20 bp, Artificial
  CRISPR gRNA sequence
gaaaagaattccaaattcgt

SEQ ID NO: 797016 - DNA, 20 bp, Artificial
  CRISPR gRNA sequence
ttccaaattcgtgaagaaaa

SEQ ID NO: 797017 - DNA, 20 bp, Artificial
  CRISPR gRNA sequence
ttttttgattctgtgaatat

SEQ ID NO: 797018 - DNA, 20 bp, Artificial
  CRISPR gRNA sequence
catcatggtagcacagtaaa

SEQ ID NO: 797019 - DNA, 20 bp, Artificial
  CRISPR gRNA sequence
gtcttgtgctgattatctta

SEQ ID NO: 797020 - DNA, 20 bp, Artificial
  CRISPR gRNA sequence
gaagaaaagatccttcctct

SEQ ID NO: 797021 - DNA, 20 bp, Artificial
  CRISPR gRNA sequence
cctagctcactcctttccta

SEQ ID NO: 797022 - DNA, 20 bp, Artificial
  CRISPR gRNA sequence
agaaaaggcaaaaaacaaag

SEQ ID NO: 797023 - DNA, 20 bp, Artificial
  CRISPR gRNA sequence
agccaggcagggttccttgc

SEQ ID NO: 797024 - DNA, 20 bp, Artificial
  CRISPR gRNA sequence
caggagcagagtagaagtaa

SEQ ID NO: 797025 - DNA, 20 bp, Artificial
  CRISPR gRNA sequence
ctggaaccagctagtaggga

SEQ ID NO: 797026 - DNA, 20 bp, Artificial
  CRISPR gRNA sequence
ccattatttctcaatcatga

SEQ ID NO: 797027 - DNA, 20 bp, Artificial
  CRISPR gRNA sequence
tgctattgttgcttttcaaa

SEQ ID NO: 797028 - DNA, 20 bp, Artificial
  CRISPR gRNA sequence
gcttttcaaaaaagaaactc

SEQ ID NO: 797029 - DNA, 20 bp, Artificial
  CRISPR gRNA sequence
acagaaacaactaataatat

SEQ ID NO: 797030 - DNA, 20 bp, Artificial
  CRISPR gRNA sequence
ttgtctccttactctccctg

SEQ ID NO: 797031 - DNA, 20 bp, Artificial
  CRISPR gRNA sequence
tttgtggtgcttggaatagc

SEQ ID NO: 797032 - DNA, 20 bp, Artificial
  CRISPR gRNA sequence
cagaaatcatacgtcctctc

SEQ ID NO: 797033 - DNA, 20 bp, Artificial
  CRISPR gRNA sequence
gcagtggagggtttgggtca

SEQ ID NO: 797034 - DNA, 20 bp, Artificial
  CRISPR gRNA sequence
gatcggttaggaatgtgttt

SEQ ID NO: 797035 - DNA, 20 bp, Artificial
  CRISPR gRNA sequence
aaggaaccccttacccatta

SEQ ID NO: 797036 - DNA, 20 bp, Artificial
  CRISPR gRNA sequence
tcttgggtacatatgtagga

SEQ ID NO: 797037 - DNA, 20 bp, Artificial
  CRISPR gRNA sequence
attgtcttttcagtttcttt

SEQ ID NO: 797038 - DNA, 20 bp, Artificial
  CRISPR gRNA sequence
tgtgctttaggtgtaatacc

SEQ ID NO: 797039 - DNA, 20 bp, Artificial
  CRISPR gRNA sequence
gacaggctagatatatagtt

SEQ ID NO: 797040 - DNA, 20 bp, Artificial
  CRISPR gRNA sequence
aaagcttgaataggttcaaa

SEQ ID NO: 797041 - DNA, 20 bp, Artificial
  CRISPR gRNA sequence
agagtgctataaaaaggaga

SEQ ID NO: 797042 - DNA, 20 bp, Artificial
  CRISPR gRNA sequence
gctgtattcttgtttttatt

SEQ ID NO: 797043 - DNA, 20 bp, Artificial
  CRISPR gRNA sequence
acagcaggtaacaactggga

SEQ ID NO: 797044 - DNA, 20 bp, Artificial
  CRISPR gRNA sequence
tattcagatgcatatatatc

SEQ ID NO: 797045 - DNA, 20 bp, Artificial
  CRISPR gRNA sequence
catgtaacatagctctagca

SEQ ID NO: 797046 - DNA, 20 bp, Artificial
  CRISPR gRNA sequence
gtagcaacacccaccttaag

SEQ ID NO: 797047 - DNA, 20 bp, Artificial
  CRISPR gRNA sequence
ggcccttccttcaaatatat

SEQ ID NO: 797048 - DNA, 20 bp, Artificial
  CRISPR gRNA sequence
ctactcgggaggctgaagca

SEQ ID NO: 797049 - DNA, 20 bp, Artificial
  CRISPR gRNA sequence
cattttttctggacaaggga

SEQ ID NO: 797050 - DNA, 20 bp, Artificial
  CRISPR gRNA sequence
ggtggactgaaagagctgta

SEQ ID NO: 797051 - DNA, 20 bp, Artificial
  CRISPR gRNA sequence
cttaatgttattgggcggag

SEQ ID NO: 797052 - DNA, 20 bp, Artificial
  CRISPR gRNA sequence
ttattgggcggagttagaaa

SEQ ID NO: 797053 - DNA, 20 bp, Artificial
  CRISPR gRNA sequence
gaccaaaccacaggtagtga

SEQ ID NO: 797054 - DNA, 20 bp, Artificial
  CRISPR gRNA sequence
ttaggaagttgtatctttcc

SEQ ID NO: 797055 - DNA, 20 bp, Artificial
  CRISPR gRNA sequence
ttctgaggataagttcgtaa

SEQ ID NO: 797056 - DNA, 20 bp, Artificial
  CRISPR gRNA sequence
aagcaaaatttgcaagagga

SEQ ID NO: 797057 - DNA, 20 bp, Artificial
  CRISPR gRNA sequence
gacattctatggaagtatct

SEQ ID NO: 797058 - DNA, 20 bp, Artificial
  CRISPR gRNA sequence
actttttataagcctttata

SEQ ID NO: 797059 - DNA, 20 bp, Artificial
  CRISPR gRNA sequence
gcctttatattagaaagttg

SEQ ID NO: 797060 - DNA, 20 bp, Artificial
  CRISPR gRNA sequence
ttagaaagttgtgagaattc

SEQ ID NO: 797061 - DNA, 20 bp, Artificial
  CRISPR gRNA sequence
tcatagaataatttatcatt

SEQ ID NO: 797062 - DNA, 20 bp, Artificial
  CRISPR gRNA sequence
aattcatagagggtttcctc

SEQ ID NO: 797063 - DNA, 20 bp, Artificial
  CRISPR gRNA sequence
acttggctggacacttaggt

SEQ ID NO: 797064 - DNA, 20 bp, Artificial
  CRISPR gRNA sequence
atctaattttttttttgagt

SEQ ID NO: 797065 - DNA, 20 bp, Artificial
  CRISPR gRNA sequence
aacaaggccctaacttcagg

SEQ ID NO: 797066 - DNA, 20 bp, Artificial
  CRISPR gRNA sequence
aaggaagcaaggaagaggaa

SEQ ID NO: 797067 - DNA, 20 bp, Artificial
  CRISPR gRNA sequence
cagccatgcacaagagacaa

SEQ ID NO: 797068 - DNA, 20 bp, Artificial
  CRISPR gRNA sequence
tgggggaggaagggtggcag

SEQ ID NO: 797069 - DNA, 20 bp, Artificial
  CRISPR gRNA sequence
atgaatgaaccatctgatgg

SEQ ID NO: 797070 - DNA, 20 bp, Artificial
  CRISPR gRNA sequence
catctgatggggagaatata

SEQ ID NO: 797071 - DNA, 20 bp, Artificial
  CRISPR gRNA sequence
gaatataaaagaaagattat

SEQ ID NO: 797072 - DNA, 20 bp, Artificial
  CRISPR gRNA sequence
aatggaaaagctcaccaaca

SEQ ID NO: 797073 - DNA, 20 bp, Artificial
  CRISPR gRNA sequence
ccaggattgttcatccactc

SEQ ID NO: 797074 - DNA, 20 bp, Artificial
  CRISPR gRNA sequence
tcgctgatcattttatatgg

SEQ ID NO: 797075 - DNA, 20 bp, Artificial
  CRISPR gRNA sequence
tctaagctgagagacaatct

SEQ ID NO: 797076 - DNA, 20 bp, Artificial
  CRISPR gRNA sequence
ttacagtgcacatatttggt

SEQ ID NO: 797077 - DNA, 20 bp, Artificial
  CRISPR gRNA sequence
aatatgcataggaacaagtg

SEQ ID NO: 797078 - DNA, 20 bp, Artificial
  CRISPR gRNA sequence
ccctcagcacaatttctgag

SEQ ID NO: 797079 - DNA, 20 bp, Artificial
  CRISPR gRNA sequence
gcgttaagatatattcaaga

SEQ ID NO: 797080 - DNA, 20 bp, Artificial
  CRISPR gRNA sequence
caaactgctaaaagcaaaac

SEQ ID NO: 797081 - DNA, 20 bp, Artificial
  CRISPR gRNA sequence
gctgttggtggagggggaac

SEQ ID NO: 797082 - DNA, 20 bp, Artificial
  CRISPR gRNA sequence
gtggagggggaacaaaaaca

SEQ ID NO: 797083 - DNA, 20 bp, Artificial
  CRISPR gRNA sequence
gggaacaaaaacaaaaaacc

SEQ ID NO: 797084 - DNA, 20 bp, Artificial
  CRISPR gRNA sequence
tgcttatgccttgcccagac

SEQ ID NO: 797085 - DNA, 20 bp, Artificial
  CRISPR gRNA sequence
ttgtcttgccagtctggtct

SEQ ID NO: 797086 - DNA, 20 bp, Artificial
  CRISPR gRNA sequence
tactggctgtaagatccccc

SEQ ID NO: 797087 - DNA, 20 bp, Artificial
  CRISPR gRNA sequence
gtgtcttagacacttggctt

SEQ ID NO: 797088 - DNA, 20 bp, Artificial
  CRISPR gRNA sequence
gacatcaataaacatattta

SEQ ID NO: 797089 - DNA, 20 bp, Artificial
  CRISPR gRNA sequence
cataagacagtctcaggaga

SEQ ID NO: 797090 - DNA, 20 bp, Artificial
  CRISPR gRNA sequence
cctcttgtcttggctgttga

SEQ ID NO: 797091 - DNA, 20 bp, Artificial
  CRISPR gRNA sequence
tggtttgacttttatttttt

SEQ ID NO: 797092 - DNA, 20 bp, Artificial
  CRISPR gRNA sequence
cagaatcaactgcaggaagg

SEQ ID NO: 797093 - DNA, 20 bp, Artificial
  CRISPR gRNA sequence
tgctactattagcataatag

SEQ ID NO: 797094 - DNA, 20 bp, Artificial
  CRISPR gRNA sequence
tgttagaggcttacaatttg

SEQ ID NO: 797095 - DNA, 20 bp, Artificial
  CRISPR gRNA sequence
aagatctccctttctaaaat

SEQ ID NO: 797096 - DNA, 20 bp, Artificial
  CRISPR gRNA sequence
tattcaagctttcatctgta

SEQ ID NO: 797097 - DNA, 20 bp, Artificial
  CRISPR gRNA sequence
ggactcacactttccagttt

SEQ ID NO: 797098 - DNA, 20 bp, Artificial
  CRISPR gRNA sequence
aggatagacatatagttcaa

SEQ ID NO: 797099 - DNA, 20 bp, Artificial
  CRISPR gRNA sequence
aaataaaatcaaaattaaat

SEQ ID NO: 797100 - DNA, 20 bp, Artificial
  CRISPR gRNA sequence
cacaactccgtgaacatact

SEQ ID NO: 797101 - DNA, 20 bp, Artificial
  CRISPR gRNA sequence
aaatttttaaaataaaattt

SEQ ID NO: 797102 - DNA, 20 bp, Artificial
  CRISPR gRNA sequence
tgtggtttactgagtcttcc

SEQ ID NO: 797103 - DNA, 20 bp, Artificial
  CRISPR gRNA sequence
gggcaataacttccttgcta

SEQ ID NO: 797104 - DNA, 20 bp, Artificial
  CRISPR gRNA sequence
caggactgggggcttcagga

SEQ ID NO: 797105 - DNA, 20 bp, Artificial
  CRISPR gRNA sequence
cctctgtgggtttgtagctt

SEQ ID NO: 797106 - DNA, 20 bp, Artificial
  CRISPR gRNA sequence
agaggagggtacctgcaaaa

SEQ ID NO: 797107 - DNA, 20 bp, Artificial
  CRISPR gRNA sequence
cctgcaaaagaaaacaacaa

SEQ ID NO: 797108 - DNA, 20 bp, Artificial
  CRISPR gRNA sequence
aaaaaaaaaaaaaaagaaaa

SEQ ID NO: 797109 - DNA, 20 bp, Artificial
  CRISPR gRNA sequence
ctcagtcattacaaataaat

SEQ ID NO: 797110 - DNA, 20 bp, Artificial
  CRISPR gRNA sequence
catgtgaataaattaattac

SEQ ID NO: 797111 - DNA, 20 bp, Artificial
  CRISPR gRNA sequence
atagcatgtagataaattac

SEQ ID NO: 797112 - DNA, 20 bp, Artificial
  CRISPR gRNA sequence
gttgtaaaatatatcacaga

SEQ ID NO: 797113 - DNA, 20 bp, Artificial
  CRISPR gRNA sequence
cttcacataccctagcccaa

SEQ ID NO: 797114 - DNA, 20 bp, Artificial
  CRISPR gRNA sequence
tatttttaccttttttaaat

SEQ ID NO: 797115 - DNA, 20 bp, Artificial
  CRISPR gRNA sequence
ttaccttttttaaattaaaa

SEQ ID NO: 797116 - DNA, 20 bp, Artificial
  CRISPR gRNA sequence
tgatgaaagttgcctctgaa

SEQ ID NO: 797117 - DNA, 20 bp, Artificial
  CRISPR gRNA sequence
tttgaagtgaaaaattaggg

SEQ ID NO: 797118 - DNA, 20 bp, Artificial
  CRISPR gRNA sequence
atgcttttggtatcatatcc

SEQ ID NO: 797119 - DNA, 20 bp, Artificial
  CRISPR gRNA sequence
tgttccagccccatttgtta

SEQ ID NO: 797120 - DNA, 20 bp, Artificial
  CRISPR gRNA sequence
ttcgtactccagaggtagat

SEQ ID NO: 797121 - DNA, 20 bp, Artificial
  CRISPR gRNA sequence
acttcgcctatctttagatc

SEQ ID NO: 797122 - DNA, 20 bp, Artificial
  CRISPR gRNA sequence
acattacgtggcaagtctga

SEQ ID NO: 797123 - DNA, 20 bp, Artificial
  CRISPR gRNA sequence
accatgtggcatgtaaagta

SEQ ID NO: 797124 - DNA, 20 bp, Artificial
  CRISPR gRNA sequence
gtggcatgtaaagtagaaaa

SEQ ID NO: 797125 - DNA, 20 bp, Artificial
  CRISPR gRNA sequence
gcatacagcaaaaaaaaaaa

SEQ ID NO: 797126 - DNA, 20 bp, Artificial
  CRISPR gRNA sequence
atttgcagctgggcttgaga

SEQ ID NO: 797127 - DNA, 20 bp, Artificial
  CRISPR gRNA sequence
attaatgttctagccatggt

SEQ ID NO: 797128 - DNA, 20 bp, Artificial
  CRISPR gRNA sequence
atttgcaggatagtgggaag

SEQ ID NO: 797129 - DNA, 20 bp, Artificial
  CRISPR gRNA sequence
tgggaatcattcaagcagca

SEQ ID NO: 797130 - DNA, 20 bp, Artificial
  CRISPR gRNA sequence
attaccactttcccaagaat

SEQ ID NO: 797131 - DNA, 20 bp, Artificial
  CRISPR gRNA sequence
acatacccctgtggtagatg

SEQ ID NO: 797132 - DNA, 20 bp, Artificial
  CRISPR gRNA sequence
caactatataaccataatga

SEQ ID NO: 797133 - DNA, 20 bp, Artificial
  CRISPR gRNA sequence
ccattaaaggtagctcaagc

SEQ ID NO: 797134 - DNA, 20 bp, Artificial
  CRISPR gRNA sequence
taccctgaatccagagtttt

SEQ ID NO: 797135 - DNA, 20 bp, Artificial
  CRISPR gRNA sequence
cagagtaggactgagtactg

SEQ ID NO: 797136 - DNA, 20 bp, Artificial
  CRISPR gRNA sequence
cataaaaagttacaagtttg

SEQ ID NO: 797137 - DNA, 20 bp, Artificial
  CRISPR gRNA sequence
gtttgtgggttttggcccca

SEQ ID NO: 797138 - DNA, 20 bp, Artificial
  CRISPR gRNA sequence
caaggctcttggggttcccc

SEQ ID NO: 797139 - DNA, 20 bp, Artificial
  CRISPR gRNA sequence
tagtccattgtcccagggtg

SEQ ID NO: 797140 - DNA, 20 bp, Artificial
  CRISPR gRNA sequence
ctgatggaactgttatgact

SEQ ID NO: 797141 - DNA, 20 bp, Artificial
  CRISPR gRNA sequence
agcaaactatcccaaggaca

SEQ ID NO: 797142 - DNA, 20 bp, Artificial
  CRISPR gRNA sequence
cacgttgtgcacatgtaccc

SEQ ID NO: 797143 - DNA, 20 bp, Artificial
  CRISPR gRNA sequence
tgacacattaagtttattgt

SEQ ID NO: 797144 - DNA, 20 bp, Artificial
  CRISPR gRNA sequence
agggttgcagaggaggcact

SEQ ID NO: 797145 - DNA, 20 bp, Artificial
  CRISPR gRNA sequence
atagactatatagtaggcca

SEQ ID NO: 797146 - DNA, 20 bp, Artificial
  CRISPR gRNA sequence
tctcttagatcacagtggag

SEQ ID NO: 797147 - DNA, 20 bp, Artificial
  CRISPR gRNA sequence
taaactccaaaaggaacctt

SEQ ID NO: 797148 - DNA, 20 bp, Artificial
  CRISPR gRNA sequence
tgaaatcaagatagaaattt

SEQ ID NO: 797149 - DNA, 20 bp, Artificial
  CRISPR gRNA sequence
ataatagtgacacaacctat

SEQ ID NO: 797150 - DNA, 20 bp, Artificial
  CRISPR gRNA sequence
agccagtagcaccctaatac

SEQ ID NO: 797151 - DNA, 20 bp, Artificial
  CRISPR gRNA sequence
ggaaggacataacaaaaaaa

SEQ ID NO: 797152 - DNA, 20 bp, Artificial
  CRISPR gRNA sequence
tacaccacacaaacagaatt

SEQ ID NO: 797153 - DNA, 20 bp, Artificial
  CRISPR gRNA sequence
aatctaacatcctttatgat

SEQ ID NO: 797154 - DNA, 20 bp, Artificial
  CRISPR gRNA sequence
atgatatgatcatataccta

SEQ ID NO: 797155 - DNA, 20 bp, Artificial
  CRISPR gRNA sequence
acatgaaagacctctacaag

SEQ ID NO: 797156 - DNA, 20 bp, Artificial
  CRISPR gRNA sequence
tactataacaccatagtcac

SEQ ID NO: 797157 - DNA, 20 bp, Artificial
  CRISPR gRNA sequence
aggcacatagaccaatggaa

SEQ ID NO: 797158 - DNA, 20 bp, Artificial
  CRISPR gRNA sequence
tgatctttgacaaagcaaac

SEQ ID NO: 797159 - DNA, 20 bp, Artificial
  CRISPR gRNA sequence
tgcaaataaatcagcaagaa

SEQ ID NO: 797160 - DNA, 20 bp, Artificial
  CRISPR gRNA sequence
attctcagggaaatgcaaat

SEQ ID NO: 797161 - DNA, 20 bp, Artificial
  CRISPR gRNA sequence
aaactagtacaaccactatg

SEQ ID NO: 797162 - DNA, 20 bp, Artificial
  CRISPR gRNA sequence
aacagtgtggagattccttt

SEQ ID NO: 797163 - DNA, 20 bp, Artificial
  CRISPR gRNA sequence
agtgaagtaactcaggaatg

SEQ ID NO: 797164 - DNA, 20 bp, Artificial
  CRISPR gRNA sequence
atggttgggggtgagagata

SEQ ID NO: 797165 - DNA, 20 bp, Artificial
  CRISPR gRNA sequence
aaagaaattattttaaaaaa

SEQ ID NO: 797166 - DNA, 20 bp, Artificial
  CRISPR gRNA sequence
tcctctaagaccaaggcatg

SEQ ID NO: 797167 - DNA, 20 bp, Artificial
  CRISPR gRNA sequence
atttactgtcattatgacta

SEQ ID NO: 797168 - DNA, 20 bp, Artificial
  CRISPR gRNA sequence
gcagcagatcatatatttag

SEQ ID NO: 797169 - DNA, 20 bp, Artificial
  CRISPR gRNA sequence
cttatgaccttaggttacat

SEQ ID NO: 797170 - DNA, 20 bp, Artificial
  CRISPR gRNA sequence
atcctttttaaagaacgtgg

SEQ ID NO: 797171 - DNA, 20 bp, Artificial
  CRISPR gRNA sequence
tgtatccatttcctaaacaa

SEQ ID NO: 797172 - DNA, 20 bp, Artificial
  CRISPR gRNA sequence
ggcacaaagctcaacacata

SEQ ID NO: 797173 - DNA, 20 bp, Artificial
  CRISPR gRNA sequence
atcacctgaggtcaggagtt

SEQ ID NO: 797174 - DNA, 20 bp, Artificial
  CRISPR gRNA sequence
tttttttctcttcttaatct

SEQ ID NO: 797175 - DNA, 20 bp, Artificial
  CRISPR gRNA sequence
cacacatggcaatagatcac

SEQ ID NO: 797176 - DNA, 20 bp, Artificial
  CRISPR gRNA sequence
tttctcttcttaatctcaaa

SEQ ID NO: 797177 - DNA, 20 bp, Artificial
  CRISPR gRNA sequence
ataagctctatgactatgaa

SEQ ID NO: 797178 - DNA, 20 bp, Artificial
  CRISPR gRNA sequence
ctaaggatcttaactgaaat

SEQ ID NO: 797179 - DNA, 20 bp, Artificial
  CRISPR gRNA sequence
cttctccggaagtcaatgta

SEQ ID NO: 797180 - DNA, 20 bp, Artificial
  CRISPR gRNA sequence
aaaagagtatgcaagaattt

SEQ ID NO: 797181 - DNA, 20 bp, Artificial
  CRISPR gRNA sequence
cagaaagtaaacgagtggtg

SEQ ID NO: 797182 - DNA, 20 bp, Artificial
  CRISPR gRNA sequence
tgttttaaggccaagacctt

SEQ ID NO: 797183 - DNA, 20 bp, Artificial
  CRISPR gRNA sequence
atgtctaatctcttctccag

SEQ ID NO: 797184 - DNA, 20 bp, Artificial
  CRISPR gRNA sequence
tcctcagtgctaggacgttg

SEQ ID NO: 797185 - DNA, 20 bp, Artificial
  CRISPR gRNA sequence
agccacagtgatagccctaa

SEQ ID NO: 797186 - DNA, 20 bp, Artificial
  CRISPR gRNA sequence
tcctgggtggagcctgccca

SEQ ID NO: 797187 - DNA, 20 bp, Artificial
  CRISPR gRNA sequence
aggggagtgagggagaaaga

SEQ ID NO: 797188 - DNA, 20 bp, Artificial
  CRISPR gRNA sequence
tcattgcagaaagttctact

SEQ ID NO: 797189 - DNA, 20 bp, Artificial
  CRISPR gRNA sequence
aatacaggtctgtttgactc

SEQ ID NO: 797190 - DNA, 20 bp, Artificial
  CRISPR gRNA sequence
atagtcatgagggaattact

SEQ ID NO: 797191 - DNA, 20 bp, Artificial
  CRISPR gRNA sequence
tcagaggttaagaaaaaagt

SEQ ID NO: 797192 - DNA, 20 bp, Artificial
  CRISPR gRNA sequence
agtgaagtaactcaggaatg

SEQ ID NO: 797193 - DNA, 20 bp, Artificial
  CRISPR gRNA sequence
tacaattcatccatgtaacc

SEQ ID NO: 797194 - DNA, 20 bp, Artificial
  CRISPR gRNA sequence
tgagtcaagagtaatatggg

SEQ ID NO: 797195 - DNA, 20 bp, Artificial
  CRISPR gRNA sequence
actcatctaccactcttcaa

SEQ ID NO: 797196 - DNA, 20 bp, Artificial
  CRISPR gRNA sequence
ccattttataggtgaggaag

SEQ ID NO: 797197 - DNA, 20 bp, Artificial
  CRISPR gRNA sequence
ccaaatttgactaaatacta

SEQ ID NO: 797198 - DNA, 20 bp, Artificial
  CRISPR gRNA sequence
aaaaaataaaaaagtataaa

SEQ ID NO: 797199 - DNA, 20 bp, Artificial
  CRISPR gRNA sequence
atcccagttctatctcatcc

SEQ ID NO: 797200 - DNA, 20 bp, Artificial
  CRISPR gRNA sequence
ttactctaatacaacatgga

SEQ ID NO: 797201 - DNA, 20 bp, Artificial
  CRISPR gRNA sequence
accatattcccttcctccag

SEQ ID NO: 797202 - DNA, 20 bp, Artificial
  CRISPR gRNA sequence
gcagacaagcagataaacag

SEQ ID NO: 797203 - DNA, 20 bp, Artificial
  CRISPR gRNA sequence
ctcattcacataatttgggt

SEQ ID NO: 797204 - DNA, 20 bp, Artificial
  CRISPR gRNA sequence
acttggactagggcaatggt

SEQ ID NO: 797205 - DNA, 20 bp, Artificial
  CRISPR gRNA sequence
cagagaatgcctttaaagaa

SEQ ID NO: 797206 - DNA, 20 bp, Artificial
  CRISPR gRNA sequence
atataattgatttctaaggt

SEQ ID NO: 797207 - DNA, 20 bp, Artificial
  CRISPR gRNA sequence
ggaaagatgtagttcaaaaa

SEQ ID NO: 797208 - DNA, 20 bp, Artificial
  CRISPR gRNA sequence
aacatggtgccattacaggt

SEQ ID NO: 797209 - DNA, 20 bp, Artificial
  CRISPR gRNA sequence
tgctttgtgacttagacctc

SEQ ID NO: 797210 - DNA, 20 bp, Artificial
  CRISPR gRNA sequence
atcaagattccagtaatcca

SEQ ID NO: 797211 - DNA, 20 bp, Artificial
  CRISPR gRNA sequence
ctgcttttggaaatcactta

SEQ ID NO: 797212 - DNA, 20 bp, Artificial
  CRISPR gRNA sequence
tagctggaagccgcatggtt

SEQ ID NO: 797213 - DNA, 20 bp, Artificial
  CRISPR gRNA sequence
atggtttaaaacttttcatt

SEQ ID NO: 797214 - DNA, 20 bp, Artificial
  CRISPR gRNA sequence
tttcaggggcctctcctatt

SEQ ID NO: 797215 - DNA, 20 bp, Artificial
  CRISPR gRNA sequence
tcaaaagtcaccttctccat

SEQ ID NO: 797216 - DNA, 20 bp, Artificial
  CRISPR gRNA sequence
aaggaagtcgggatactcat

SEQ ID NO: 797217 - DNA, 20 bp, Artificial
  CRISPR gRNA sequence
gggatactcatgaaaacaaa

SEQ ID NO: 797218 - DNA, 20 bp, Artificial
  CRISPR gRNA sequence
actcatgaaaacaaacaaaa

SEQ ID NO: 797219 - DNA, 20 bp, Artificial
  CRISPR gRNA sequence
aaaacaaacaaaacaaaaca

SEQ ID NO: 797220 - DNA, 20 bp, Artificial
  CRISPR gRNA sequence
tgaagtacaacaaaaattca

SEQ ID NO: 797221 - DNA, 20 bp, Artificial
  CRISPR gRNA sequence
aatacttgattccataatcc

SEQ ID NO: 797222 - DNA, 20 bp, Artificial
  CRISPR gRNA sequence
aactccaaaatctcaatata

SEQ ID NO: 797223 - DNA, 20 bp, Artificial
  CRISPR gRNA sequence
tcagttgctggttagtgaag

SEQ ID NO: 797224 - DNA, 20 bp, Artificial
  CRISPR gRNA sequence
gctagttgtcaaaaggcctg

SEQ ID NO: 797225 - DNA, 20 bp, Artificial
  CRISPR gRNA sequence
agagatgacatgatgatgat

SEQ ID NO: 797226 - DNA, 20 bp, Artificial
  CRISPR gRNA sequence
aaaatcctgctgaactaaac

SEQ ID NO: 797227 - DNA, 20 bp, Artificial
  CRISPR gRNA sequence
tgctgaactaaacaaaaacc

SEQ ID NO: 797228 - DNA, 20 bp, Artificial
  CRISPR gRNA sequence
agttgagggccttaagagca

SEQ ID NO: 797229 - DNA, 20 bp, Artificial
  CRISPR gRNA sequence
tcttaatcattgtttgttgc

SEQ ID NO: 797230 - DNA, 20 bp, Artificial
  CRISPR gRNA sequence
aaatggaataagattaatga

SEQ ID NO: 797231 - DNA, 20 bp, Artificial
  CRISPR gRNA sequence
cagttccatccaagttgttg

SEQ ID NO: 797232 - DNA, 20 bp, Artificial
  CRISPR gRNA sequence
cggagtagacagcaactgct

SEQ ID NO: 797233 - DNA, 20 bp, Artificial
  CRISPR gRNA sequence
taattggtagtccaagctat

SEQ ID NO: 797234 - DNA, 20 bp, Artificial
  CRISPR gRNA sequence
gaagagacaatattgtatga

SEQ ID NO: 797235 - DNA, 20 bp, Artificial
  CRISPR gRNA sequence
aactctttcagacataagaa

SEQ ID NO: 797236 - DNA, 20 bp, Artificial
  CRISPR gRNA sequence
agaacaaaacattcccttta

SEQ ID NO: 797237 - DNA, 20 bp, Artificial
  CRISPR gRNA sequence
gtgcattgggttaccatgaa

SEQ ID NO: 797238 - DNA, 20 bp, Artificial
  CRISPR gRNA sequence
acatgacaggctggtacagg

SEQ ID NO: 797239 - DNA, 20 bp, Artificial
  CRISPR gRNA sequence
agttttcaaggtcttggcct

SEQ ID NO: 797240 - DNA, 20 bp, Artificial
  CRISPR gRNA sequence
aaataatgatatttatgtgg

SEQ ID NO: 797241 - DNA, 20 bp, Artificial
  CRISPR gRNA sequence
acaaagttgggaaggatggg

SEQ ID NO: 797242 - DNA, 20 bp, Artificial
  CRISPR gRNA sequence
atataagaagcgtctttcta

SEQ ID NO: 797243 - DNA, 20 bp, Artificial
  CRISPR gRNA sequence
cagtgcatctagctgcctct

SEQ ID NO: 797244 - DNA, 20 bp, Artificial
  CRISPR gRNA sequence
aatttgatataagagcatta

SEQ ID NO: 797245 - DNA, 20 bp, Artificial
  CRISPR gRNA sequence
ttagagaccaaatttcttgg

SEQ ID NO: 797246 - DNA, 20 bp, Artificial
  CRISPR gRNA sequence
aaatagtatagaggtcctca

SEQ ID NO: 797247 - DNA, 20 bp, Artificial
  CRISPR gRNA sequence
gaaaaaaataaagaccacaa

SEQ ID NO: 797248 - DNA, 20 bp, Artificial
  CRISPR gRNA sequence
tctataatctatacatagat

SEQ ID NO: 797249 - DNA, 20 bp, Artificial
  CRISPR gRNA sequence
aataaattttaaaattaaaa

SEQ ID NO: 797250 - DNA, 20 bp, Artificial
  CRISPR gRNA sequence
ataaaacattacaaccttat

SEQ ID NO: 797251 - DNA, 20 bp, Artificial
  CRISPR gRNA sequence
aaataggtacaaactttgtg

SEQ ID NO: 797252 - DNA, 20 bp, Artificial
  CRISPR gRNA sequence
aataatggtaacaaccatgt

SEQ ID NO: 797253 - DNA, 20 bp, Artificial
  CRISPR gRNA sequence
ctcaccaatctccttgaagc

SEQ ID NO: 797254 - DNA, 20 bp, Artificial
  CRISPR gRNA sequence
atctgacttattgctcaatg

SEQ ID NO: 797255 - DNA, 20 bp, Artificial
  CRISPR gRNA sequence
tgattgttccacatacgctt

SEQ ID NO: 797256 - DNA, 20 bp, Artificial
  CRISPR gRNA sequence
ctgctaaataacttttgcct

SEQ ID NO: 797257 - DNA, 20 bp, Artificial
  CRISPR gRNA sequence
atatggtaagcaccgtagtt

SEQ ID NO: 797258 - DNA, 20 bp, Artificial
  CRISPR gRNA sequence
ctagtcttttcaaccctaag

SEQ ID NO: 797259 - DNA, 20 bp, Artificial
  CRISPR gRNA sequence
aatttctttctttattttta

SEQ ID NO: 797260 - DNA, 20 bp, Artificial
  CRISPR gRNA sequence
ccatccctgcatccctggtg

SEQ ID NO: 797261 - DNA, 20 bp, Artificial
  CRISPR gRNA sequence
tggatcaggcactttaagat

SEQ ID NO: 797262 - DNA, 20 bp, Artificial
  CRISPR gRNA sequence
ttcataagtttctatactgg

SEQ ID NO: 797263 - DNA, 20 bp, Artificial
  CRISPR gRNA sequence
catcttatgaatttttttag

SEQ ID NO: 797264 - DNA, 20 bp, Artificial
  CRISPR gRNA sequence
agaaaaaaaatatatgcatc

SEQ ID NO: 797265 - DNA, 20 bp, Artificial
  CRISPR gRNA sequence
atatttatagctattgaaat

SEQ ID NO: 797266 - DNA, 20 bp, Artificial
  CRISPR gRNA sequence
ggatctaggaactcacttcc

SEQ ID NO: 797267 - DNA, 20 bp, Artificial
  CRISPR gRNA sequence
gcattcagatagagatcaat

SEQ ID NO: 797268 - DNA, 20 bp, Artificial
  CRISPR gRNA sequence
taggaaatgcaataaagata

SEQ ID NO: 797269 - DNA, 20 bp, Artificial
  CRISPR gRNA sequence
ggttaatggttttttggggc

SEQ ID NO: 797270 - DNA, 20 bp, Artificial
  CRISPR gRNA sequence
gggcggcaaaccatggtttt

SEQ ID NO: 797271 - DNA, 20 bp, Artificial
  CRISPR gRNA sequence
actgtgaataaagctgaaaa

SEQ ID NO: 797272 - DNA, 20 bp, Artificial
  CRISPR gRNA sequence
atattctatcctttttttca

SEQ ID NO: 797273 - DNA, 20 bp, Artificial
  CRISPR gRNA sequence
taactatattgtttaatact

SEQ ID NO: 797274 - DNA, 20 bp, Artificial
  CRISPR gRNA sequence
ataaggtgagtgtacatgtg

SEQ ID NO: 797275 - DNA, 20 bp, Artificial
  CRISPR gRNA sequence
ggaatcacctgggaggcttt

SEQ ID NO: 797276 - DNA, 20 bp, Artificial
  CRISPR gRNA sequence
tgaaggtattagacaaagga

SEQ ID NO: 797277 - DNA, 20 bp, Artificial
  CRISPR gRNA sequence
ttacatagccacattcttca

SEQ ID NO: 797278 - DNA, 20 bp, Artificial
  CRISPR gRNA sequence
ctggagtacgaagagagaag

SEQ ID NO: 797279 - DNA, 20 bp, Artificial
  CRISPR gRNA sequence
tgaaataaaaatgtaagaaa

SEQ ID NO: 797280 - DNA, 20 bp, Artificial
  CRISPR gRNA sequence
aacaactgaacatctacatg

SEQ ID NO: 797281 - DNA, 20 bp, Artificial
  CRISPR gRNA sequence
caaaagcatgatccataaaa

SEQ ID NO: 797282 - DNA, 20 bp, Artificial
  CRISPR gRNA sequence
tcaaaaaaatagagaatttt

SEQ ID NO: 797283 - DNA, 20 bp, Artificial
  CRISPR gRNA sequence
aagatatacaataagtacat

SEQ ID NO: 797284 - DNA, 20 bp, Artificial
  CRISPR gRNA sequence
gaccagcctggtcaatatgg

SEQ ID NO: 797285 - DNA, 20 bp, Artificial
  CRISPR gRNA sequence
ccccgtctctattaaaaata

SEQ ID NO: 797286 - DNA, 20 bp, Artificial
  CRISPR gRNA sequence
ggtatttatccaagtgaaat

SEQ ID NO: 797287 - DNA, 20 bp, Artificial
  CRISPR gRNA sequence
gaaaacctaggtttgcccaa

SEQ ID NO: 797288 - DNA, 20 bp, Artificial
  CRISPR gRNA sequence
tacatttattgaatgcttac

SEQ ID NO: 797289 - DNA, 20 bp, Artificial
  CRISPR gRNA sequence
cctaatacatgcttcttgta

SEQ ID NO: 797290 - DNA, 20 bp, Artificial
  CRISPR gRNA sequence
acatgcttcttgtaaaaaac

SEQ ID NO: 797291 - DNA, 20 bp, Artificial
  CRISPR gRNA sequence
caggtaccctcctctgaaat

SEQ ID NO: 797292 - DNA, 20 bp, Artificial
  CRISPR gRNA sequence
ccatattcagacttcagtgc

SEQ ID NO: 797293 - DNA, 20 bp, Artificial
  CRISPR gRNA sequence
ctttcctaagagaaaaggca

SEQ ID NO: 797294 - DNA, 20 bp, Artificial
  CRISPR gRNA sequence
aaaggcaaaaaacaaagaca

SEQ ID NO: 797295 - DNA, 20 bp, Artificial
  CRISPR gRNA sequence
caggcagggttccttgcaaa

SEQ ID NO: 797296 - DNA, 20 bp, Artificial
  CRISPR gRNA sequence
ttggttctttgttcactttt

SEQ ID NO: 797297 - DNA, 20 bp, Artificial
  CRISPR gRNA sequence
tctaagtgtgtatatatatt

SEQ ID NO: 797298 - DNA, 20 bp, Artificial
  CRISPR gRNA sequence
attatgaataaagttcctat

SEQ ID NO: 797299 - DNA, 20 bp, Artificial
  CRISPR gRNA sequence
gaactgtcttggcacccttg

SEQ ID NO: 797300 - DNA, 20 bp, Artificial
  CRISPR gRNA sequence
tcaccatacctaaataataa

SEQ ID NO: 797301 - DNA, 20 bp, Artificial
  CRISPR gRNA sequence
taataataaaacctatattt

SEQ ID NO: 797302 - DNA, 20 bp, Artificial
  CRISPR gRNA sequence
aaagtcaaaccatattttct

SEQ ID NO: 797303 - DNA, 20 bp, Artificial
  CRISPR gRNA sequence
gctcagcatttcactcagtg

SEQ ID NO: 797304 - DNA, 20 bp, Artificial
  CRISPR gRNA sequence
ttcctcccttctgagcctgt

SEQ ID NO: 797305 - DNA, 20 bp, Artificial
  CRISPR gRNA sequence
agagtgagactccgtctcaa

SEQ ID NO: 797306 - DNA, 20 bp, Artificial
  CRISPR gRNA sequence
gagactccgtctcaaaaaaa

SEQ ID NO: 797307 - DNA, 20 bp, Artificial
  CRISPR gRNA sequence
aaaaacaaaacaaacaaaca

SEQ ID NO: 797308 - DNA, 20 bp, Artificial
  CRISPR gRNA sequence
ctgacttttctccaggagac

SEQ ID NO: 797309 - DNA, 20 bp, Artificial
  CRISPR gRNA sequence
aattatctctttcttttatt

SEQ ID NO: 797310 - DNA, 20 bp, Artificial
  CRISPR gRNA sequence
ttgtaccataattggaaggt

SEQ ID NO: 797311 - DNA, 20 bp, Artificial
  CRISPR gRNA sequence
ctctcacacatgaaaaatag

SEQ ID NO: 797312 - DNA, 20 bp, Artificial
  CRISPR gRNA sequence
gaaaaatagtaaaactgatg

SEQ ID NO: 797313 - DNA, 20 bp, Artificial
  CRISPR gRNA sequence
ggaaatagtggcagtcactc

SEQ ID NO: 797314 - DNA, 20 bp, Artificial
  CRISPR gRNA sequence
gaaacatataagacaattga

SEQ ID NO: 797315 - DNA, 20 bp, Artificial
  CRISPR gRNA sequence
caaacagatgtcagtcatag

SEQ ID NO: 797316 - DNA, 20 bp, Artificial
  CRISPR gRNA sequence
ttcttcaccattaagcctcc

SEQ ID NO: 797317 - DNA, 20 bp, Artificial
  CRISPR gRNA sequence
gcagaaaatatctcacctta

SEQ ID NO: 797318 - DNA, 20 bp, Artificial
  CRISPR gRNA sequence
agatgcaaaagtaaacaaca

SEQ ID NO: 797319 - DNA, 20 bp, Artificial
  CRISPR gRNA sequence
caaaatgaacagccaaaagg

SEQ ID NO: 797320 - DNA, 20 bp, Artificial
  CRISPR gRNA sequence
tgaacagccaaaaggaaaaa

SEQ ID NO: 797321 - DNA, 20 bp, Artificial
  CRISPR gRNA sequence
ctaaaagcaaaaccaaaact

SEQ ID NO: 797322 - DNA, 20 bp, Artificial
  CRISPR gRNA sequence
aaagcaaaaccaaaactttc

SEQ ID NO: 797323 - DNA, 20 bp, Artificial
  CRISPR gRNA sequence
tccaaataagccaggctttc

SEQ ID NO: 797324 - DNA, 20 bp, Artificial
  CRISPR gRNA sequence
ccaaataagccaggctttcg

SEQ ID NO: 797325 - DNA, 20 bp, Artificial
  CRISPR gRNA sequence
caaataagccaggctttcgt

SEQ ID NO: 797326 - DNA, 20 bp, Artificial
  CRISPR gRNA sequence
tcgtcagttcctcagaacta

SEQ ID NO: 797327 - DNA, 20 bp, Artificial
  CRISPR gRNA sequence
cgtcagttcctcagaactag

SEQ ID NO: 797328 - DNA, 20 bp, Artificial
  CRISPR gRNA sequence
gtcagttcctcagaactagt

SEQ ID NO: 797329 - DNA, 20 bp, Artificial
  CRISPR gRNA sequence
ctcagaactagttctggttt

SEQ ID NO: 797330 - DNA, 20 bp, Artificial
  CRISPR gRNA sequence
agaactagttctggtttgac

SEQ ID NO: 797331 - DNA, 20 bp, Artificial
  CRISPR gRNA sequence
gttctggtttgactcactct

SEQ ID NO: 797332 - DNA, 20 bp, Artificial
  CRISPR gRNA sequence
tggtttgactcactctcatg

SEQ ID NO: 797333 - DNA, 20 bp, Artificial
  CRISPR gRNA sequence
gtttgactcactctcatgtt

SEQ ID NO: 797334 - DNA, 20 bp, Artificial
  CRISPR gRNA sequence
gactcactctcatgttacgg

SEQ ID NO: 797335 - DNA, 20 bp, Artificial
  CRISPR gRNA sequence
actcactctcatgttacggc

SEQ ID NO: 797336 - DNA, 20 bp, Artificial
  CRISPR gRNA sequence
actctcatgttacggcaaac

SEQ ID NO: 797337 - DNA, 20 bp, Artificial
  CRISPR gRNA sequence
tcatgttacggcaaacctta

SEQ ID NO: 797338 - DNA, 20 bp, Artificial
  CRISPR gRNA sequence
atgttacggcaaaccttaag

SEQ ID NO: 797339 - DNA, 20 bp, Artificial
  CRISPR gRNA sequence
cggcaaaccttaagctgaat

SEQ ID NO: 797340 - DNA, 20 bp, Artificial
  CRISPR gRNA sequence
aagctgaatgaacaactttt

SEQ ID NO: 797341 - DNA, 20 bp, Artificial
  CRISPR gRNA sequence
agctgaatgaacaacttttc

SEQ ID NO: 797342 - DNA, 20 bp, Artificial
  CRISPR gRNA sequence
aatgaacaacttttcttctc

SEQ ID NO: 797343 - DNA, 20 bp, Artificial
  CRISPR gRNA sequence
ttcttctcttgaatatatct

SEQ ID NO: 797344 - DNA, 20 bp, Artificial
  CRISPR gRNA sequence
tcttctcttgaatatatctt

SEQ ID NO: 797345 - DNA, 20 bp, Artificial
  CRISPR gRNA sequence
cttctcttgaatatatctta

SEQ ID NO: 797346 - DNA, 20 bp, Artificial
  CRISPR gRNA sequence
ttctcttgaatatatcttaa

SEQ ID NO: 797347 - DNA, 20 bp, Artificial
  CRISPR gRNA sequence
ctcttgaatatatcttaacg

SEQ ID NO: 797348 - DNA, 20 bp, Artificial
  CRISPR gRNA sequence
tcttgaatatatcttaacgc

SEQ ID NO: 797349 - DNA, 20 bp, Artificial
  CRISPR gRNA sequence
ttgaatatatcttaacgcca

SEQ ID NO: 797350 - DNA, 20 bp, Artificial
  CRISPR gRNA sequence
gaatatatcttaacgccaaa

SEQ ID NO: 797351 - DNA, 20 bp, Artificial
  CRISPR gRNA sequence
aatatatcttaacgccaaat

SEQ ID NO: 797352 - DNA, 20 bp, Artificial
  CRISPR gRNA sequence
aacgccaaattttgagtgct

SEQ ID NO: 797353 - DNA, 20 bp, Artificial
  CRISPR gRNA sequence
acgccaaattttgagtgctt

SEQ ID NO: 797354 - DNA, 20 bp, Artificial
  CRISPR gRNA sequence
tgagtgcttttttgttaccc

SEQ ID NO: 797355 - DNA, 20 bp, Artificial
  CRISPR gRNA sequence
gagtgcttttttgttaccca

SEQ ID NO: 797356 - DNA, 20 bp, Artificial
  CRISPR gRNA sequence
agtgcttttttgttacccat

SEQ ID NO: 797357 - DNA, 20 bp, Artificial
  CRISPR gRNA sequence
ttttgttacccatcctcata

SEQ ID NO: 797358 - DNA, 20 bp, Artificial
  CRISPR gRNA sequence
tttgttacccatcctcatat

SEQ ID NO: 797359 - DNA, 20 bp, Artificial
  CRISPR gRNA sequence
ttgttacccatcctcatatg

SEQ ID NO: 797360 - DNA, 20 bp, Artificial
  CRISPR gRNA sequence
tgttacccatcctcatatgt

SEQ ID NO: 797361 - DNA, 20 bp, Artificial
  CRISPR gRNA sequence
gttacccatcctcatatgtc

SEQ ID NO: 797362 - DNA, 20 bp, Artificial
  CRISPR gRNA sequence
ttacccatcctcatatgtcc

SEQ ID NO: 797363 - DNA, 20 bp, Artificial
  CRISPR gRNA sequence
cccatcctcatatgtcccag

SEQ ID NO: 797364 - DNA, 20 bp, Artificial
  CRISPR gRNA sequence
atatgtcccagctagaaaga

SEQ ID NO: 797365 - DNA, 20 bp, Artificial
  CRISPR gRNA sequence
gaaagaatcctgggttggag

SEQ ID NO: 797366 - DNA, 20 bp, Artificial
  CRISPR gRNA sequence
ggttggagctactgcatgtt

SEQ ID NO: 797367 - DNA, 20 bp, Artificial
  CRISPR gRNA sequence
gagctactgcatgttgattg

SEQ ID NO: 797368 - DNA, 20 bp, Artificial
  CRISPR gRNA sequence
ctgcatgttgattgttttgt

SEQ ID NO: 797369 - DNA, 20 bp, Artificial
  CRISPR gRNA sequence
catgttgattgttttgtttt

SEQ ID NO: 797370 - DNA, 20 bp, Artificial
  CRISPR gRNA sequence
attgttttgtttttcctttt

SEQ ID NO: 797371 - DNA, 20 bp, Artificial
  CRISPR gRNA sequence
ttttgtttttccttttggct

SEQ ID NO: 797372 - DNA, 20 bp, Artificial
  CRISPR gRNA sequence
tgtttttccttttggctgtt

SEQ ID NO: 797373 - DNA, 20 bp, Artificial
  CRISPR gRNA sequence
gtttttccttttggctgttc

SEQ ID NO: 797374 - DNA, 20 bp, Artificial
  CRISPR gRNA sequence
tttttccttttggctgttca

SEQ ID NO: 797375 - DNA, 20 bp, Artificial
  CRISPR gRNA sequence
ttccttttggctgttcattt

SEQ ID NO: 797376 - DNA, 20 bp, Artificial
  CRISPR gRNA sequence
tccttttggctgttcatttt

SEQ ID NO: 797377 - DNA, 20 bp, Artificial
  CRISPR gRNA sequence
ccttttggctgttcattttg

SEQ ID NO: 797378 - DNA, 20 bp, Artificial
  CRISPR gRNA sequence
cttttggctgttcattttgg

SEQ ID NO: 797379 - DNA, 20 bp, Artificial
  CRISPR gRNA sequence
ttggctgttcattttggtgg

SEQ ID NO: 797380 - DNA, 20 bp, Artificial
  CRISPR gRNA sequence
tggctgttcattttggtggc

SEQ ID NO: 797381 - DNA, 20 bp, Artificial
  CRISPR gRNA sequence
ggctgttcattttggtggct

SEQ ID NO: 797382 - DNA, 20 bp, Artificial
  CRISPR gRNA sequence
gctgttcattttggtggcta

SEQ ID NO: 797383 - DNA, 20 bp, Artificial
  CRISPR gRNA sequence
ttcattttggtggctactat

SEQ ID NO: 797384 - DNA, 20 bp, Artificial
  CRISPR gRNA sequence
attttggtggctactataag

SEQ ID NO: 797385 - DNA, 20 bp, Artificial
  CRISPR gRNA sequence
tggtggctactataaggaaa

SEQ ID NO: 797386 - DNA, 20 bp, Artificial
  CRISPR gRNA sequence
ggtggctactataaggaaat

SEQ ID NO: 797387 - DNA, 20 bp, Artificial
  CRISPR gRNA sequence
gtggctactataaggaaatc

SEQ ID NO: 797388 - DNA, 20 bp, Artificial
  CRISPR gRNA sequence
ctataaggaaatctaacaca

SEQ ID NO: 797389 - DNA, 20 bp, Artificial
  CRISPR gRNA sequence
taaggaaatctaacacaaac

SEQ ID NO: 797390 - DNA, 20 bp, Artificial
  CRISPR gRNA sequence
acacaaacagcaactgtttt

SEQ ID NO: 797391 - DNA, 20 bp, Artificial
  CRISPR gRNA sequence
ttttttgttgtttacttttg

SEQ ID NO: 797392 - DNA, 20 bp, Artificial
  CRISPR gRNA sequence
tttgttgtttacttttgcat

SEQ ID NO: 797393 - DNA, 20 bp, Artificial
  CRISPR gRNA sequence
ttgttgtttacttttgcatc

SEQ ID NO: 797394 - DNA, 20 bp, Artificial
  CRISPR gRNA sequence
tgttgtttacttttgcatct

SEQ ID NO: 797395 - DNA, 20 bp, Artificial
  CRISPR gRNA sequence
gttgtttacttttgcatctt

SEQ ID NO: 797396 - DNA, 20 bp, Artificial
  CRISPR gRNA sequence
ttgtttacttttgcatcttt

SEQ ID NO: 797397 - DNA, 20 bp, Artificial
  CRISPR gRNA sequence
tttacttttgcatctttact

SEQ ID NO: 797398 - DNA, 20 bp, Artificial
  CRISPR gRNA sequence
acttttgcatctttacttgt

SEQ ID NO: 797399 - DNA, 20 bp, Artificial
  CRISPR gRNA sequence
cttttgcatctttacttgtg

SEQ ID NO: 797400 - DNA, 20 bp, Artificial
  CRISPR gRNA sequence
ttgcatctttacttgtggag

SEQ ID NO: 797401 - DNA, 20 bp, Artificial
  CRISPR gRNA sequence
tgcatctttacttgtggagc

SEQ ID NO: 797402 - DNA, 20 bp, Artificial
  CRISPR gRNA sequence
gcatctttacttgtggagct

SEQ ID NO: 797403 - DNA, 20 bp, Artificial
  CRISPR gRNA sequence
catctttacttgtggagctg

SEQ ID NO: 797404 - DNA, 20 bp, Artificial
  CRISPR gRNA sequence
tacttgtggagctgtggcaa

SEQ ID NO: 797405 - DNA, 20 bp, Artificial
  CRISPR gRNA sequence
acttgtggagctgtggcaag

SEQ ID NO: 797406 - DNA, 20 bp, Artificial
  CRISPR gRNA sequence
cttgtggagctgtggcaagt

SEQ ID NO: 797407 - DNA, 20 bp, Artificial
  CRISPR gRNA sequence
gtggagctgtggcaagtcct

SEQ ID NO: 797408 - DNA, 20 bp, Artificial
  CRISPR gRNA sequence
tggagctgtggcaagtcctc

SEQ ID NO: 797409 - DNA, 20 bp, Artificial
  CRISPR gRNA sequence
tggcaagtcctcatgtgagt

SEQ ID NO: 797410 - DNA, 20 bp, Artificial
  CRISPR gRNA sequence
atgtgagtaacgagtgggtt

SEQ ID NO: 797411 - DNA, 20 bp, Artificial
  CRISPR gRNA sequence
agatactctcatactattat

SEQ ID NO: 797412 - DNA, 20 bp, Artificial
  CRISPR gRNA sequence
tcatactattatgttgtgga

SEQ ID NO: 797413 - DNA, 20 bp, Artificial
  CRISPR gRNA sequence
atactattatgttgtggacc

SEQ ID NO: 797414 - DNA, 20 bp, Artificial
  CRISPR gRNA sequence
ttatgttgtggaccatgatg

SEQ ID NO: 797415 - DNA, 20 bp, Artificial
  CRISPR gRNA sequence
tgttgtggaccatgatgagg

SEQ ID NO: 797416 - DNA, 20 bp, Artificial
  CRISPR gRNA sequence
tggaccatgatgaggctgcc

SEQ ID NO: 797417 - DNA, 20 bp, Artificial
  CRISPR gRNA sequence
ccagggtgggggaagggtgg

SEQ ID NO: 797418 - DNA, 20 bp, Artificial
  CRISPR gRNA sequence
ccttctctccacaccatttg

SEQ ID NO: 797419 - DNA, 20 bp, Artificial
  CRISPR gRNA sequence
ctctccacaccatttgaggc

SEQ ID NO: 797420 - DNA, 20 bp, Artificial
  CRISPR gRNA sequence
tctccacaccatttgaggca

SEQ ID NO: 797421 - DNA, 20 bp, Artificial
  CRISPR gRNA sequence
tccacaccatttgaggcaag

SEQ ID NO: 797422 - DNA, 20 bp, Artificial
  CRISPR gRNA sequence
cacaccatttgaggcaagag

SEQ ID NO: 797423 - DNA, 20 bp, Artificial
  CRISPR gRNA sequence
gaggcaagagacattctgcc

SEQ ID NO: 797424 - DNA, 20 bp, Artificial
  CRISPR gRNA sequence
aggcaagagacattctgcct

SEQ ID NO: 797425 - DNA, 20 bp, Artificial
  CRISPR gRNA sequence
tgcctcagaaattgtgctga

SEQ ID NO: 797426 - DNA, 20 bp, Artificial
  CRISPR gRNA sequence
cctcagaaattgtgctgagg

SEQ ID NO: 797427 - DNA, 20 bp, Artificial
  CRISPR gRNA sequence
agaaattgtgctgaggggca

SEQ ID NO: 797428 - DNA, 20 bp, Artificial
  CRISPR gRNA sequence
tgctgaggggcacaaataag

SEQ ID NO: 797429 - DNA, 20 bp, Artificial
  CRISPR gRNA sequence
aggggcacaaataagctaat

SEQ ID NO: 797430 - DNA, 20 bp, Artificial
  CRISPR gRNA sequence
atgtcctcctgccccagatt

SEQ ID NO: 797431 - DNA, 20 bp, Artificial
  CRISPR gRNA sequence
ctgccccagatttctctcac

SEQ ID NO: 797432 - DNA, 20 bp, Artificial
  CRISPR gRNA sequence
ccccagatttctctcacttg

SEQ ID NO: 797433 - DNA, 20 bp, Artificial
  CRISPR gRNA sequence
ctctcacttgttcctatgca

SEQ ID NO: 797434 - DNA, 20 bp, Artificial
  CRISPR gRNA sequence
tctcacttgttcctatgcat

SEQ ID NO: 797435 - DNA, 20 bp, Artificial
  CRISPR gRNA sequence
tcacttgttcctatgcatat

SEQ ID NO: 797436 - DNA, 20 bp, Artificial
  CRISPR gRNA sequence
acttgttcctatgcatattg

SEQ ID NO: 797437 - DNA, 20 bp, Artificial
  CRISPR gRNA sequence
gttcctatgcatattgttct

SEQ ID NO: 797438 - DNA, 20 bp, Artificial
  CRISPR gRNA sequence
ttcctatgcatattgttctt

SEQ ID NO: 797439 - DNA, 20 bp, Artificial
  CRISPR gRNA sequence
ctatgcatattgttcttgtt

SEQ ID NO: 797440 - DNA, 20 bp, Artificial
  CRISPR gRNA sequence
tgcatattgttcttgttgct

SEQ ID NO: 797441 - DNA, 20 bp, Artificial
  CRISPR gRNA sequence
ttcttgttgctcagttttat

SEQ ID NO: 797442 - DNA, 20 bp, Artificial
  CRISPR gRNA sequence
ttgttgctcagttttataag

SEQ ID NO: 797443 - DNA, 20 bp, Artificial
  CRISPR gRNA sequence
gttgctcagttttataaggt

SEQ ID NO: 797444 - DNA, 20 bp, Artificial
  CRISPR gRNA sequence
ttgctcagttttataaggtg

SEQ ID NO: 797445 - DNA, 20 bp, Artificial
  CRISPR gRNA sequence
ctcagttttataaggtgaga

SEQ ID NO: 797446 - DNA, 20 bp, Artificial
  CRISPR gRNA sequence
agttttataaggtgagatat

SEQ ID NO: 797447 - DNA, 20 bp, Artificial
  CRISPR gRNA sequence
tataaggtgagatattttct

SEQ ID NO: 797448 - DNA, 20 bp, Artificial
  CRISPR gRNA sequence
ataaggtgagatattttctg

SEQ ID NO: 797449 - DNA, 20 bp, Artificial
  CRISPR gRNA sequence
taaggtgagatattttctgc

SEQ ID NO: 797450 - DNA, 20 bp, Artificial
  CRISPR gRNA sequence
tctgcaccaaatatgtgcac

SEQ ID NO: 797451 - DNA, 20 bp, Artificial
  CRISPR gRNA sequence
ctgcaccaaatatgtgcact

SEQ ID NO: 797452 - DNA, 20 bp, Artificial
  CRISPR gRNA sequence
tgcaccaaatatgtgcactg

SEQ ID NO: 797453 - DNA, 20 bp, Artificial
  CRISPR gRNA sequence
caccaaatatgtgcactgta

SEQ ID NO: 797454 - DNA, 20 bp, Artificial
  CRISPR gRNA sequence
taaaataatataactattct

SEQ ID NO: 797455 - DNA, 20 bp, Artificial
  CRISPR gRNA sequence
ttcttaagattgtctctcag

SEQ ID NO: 797456 - DNA, 20 bp, Artificial
  CRISPR gRNA sequence
ttaagattgtctctcagctt

SEQ ID NO: 797457 - DNA, 20 bp, Artificial
  CRISPR gRNA sequence
aagattgtctctcagcttag

SEQ ID NO: 797458 - DNA, 20 bp, Artificial
  CRISPR gRNA sequence
agattgtctctcagcttaga

SEQ ID NO: 797459 - DNA, 20 bp, Artificial
  CRISPR gRNA sequence
tctctcagcttagagttttc

SEQ ID NO: 797460 - DNA, 20 bp, Artificial
  CRISPR gRNA sequence
tcagcttagagttttcggag

SEQ ID NO: 797461 - DNA, 20 bp, Artificial
  CRISPR gRNA sequence
agcttagagttttcggaggc

SEQ ID NO: 797462 - DNA, 20 bp, Artificial
  CRISPR gRNA sequence
agagttttcggaggcttaat

SEQ ID NO: 797463 - DNA, 20 bp, Artificial
  CRISPR gRNA sequence
gagttttcggaggcttaatg

SEQ ID NO: 797464 - DNA, 20 bp, Artificial
  CRISPR gRNA sequence
tcggaggcttaatggtgaag

SEQ ID NO: 797465 - DNA, 20 bp, Artificial
  CRISPR gRNA sequence
cggaggcttaatggtgaaga

SEQ ID NO: 797466 - DNA, 20 bp, Artificial
  CRISPR gRNA sequence
ggaggcttaatggtgaagaa

SEQ ID NO: 797467 - DNA, 20 bp, Artificial
  CRISPR gRNA sequence
aatggtgaagaacttaaaaa

SEQ ID NO: 797468 - DNA, 20 bp, Artificial
  CRISPR gRNA sequence
atggtgaagaacttaaaaat

SEQ ID NO: 797469 - DNA, 20 bp, Artificial
  CRISPR gRNA sequence
aaaaatctgttttcctatga

SEQ ID NO: 797470 - DNA, 20 bp, Artificial
  CRISPR gRNA sequence
aaaatctgttttcctatgac

SEQ ID NO: 797471 - DNA, 20 bp, Artificial
  CRISPR gRNA sequence
ttttcctatgactgacatct

SEQ ID NO: 797472 - DNA, 20 bp, Artificial
  CRISPR gRNA sequence
tcctatgactgacatctgtt

SEQ ID NO: 797473 - DNA, 20 bp, Artificial
  CRISPR gRNA sequence
cctatgactgacatctgttt

SEQ ID NO: 797474 - DNA, 20 bp, Artificial
  CRISPR gRNA sequence
ctatgactgacatctgtttg

SEQ ID NO: 797475 - DNA, 20 bp, Artificial
  CRISPR gRNA sequence
tgactgacatctgtttgtga

SEQ ID NO: 797476 - DNA, 20 bp, Artificial
  CRISPR gRNA sequence
acatctgtttgtgattatcc

SEQ ID NO: 797477 - DNA, 20 bp, Artificial
  CRISPR gRNA sequence
tttgtgattatccatttagc

SEQ ID NO: 797478 - DNA, 20 bp, Artificial
  CRISPR gRNA sequence
gtgattatccatttagcaga

SEQ ID NO: 797479 - DNA, 20 bp, Artificial
  CRISPR gRNA sequence
tgattatccatttagcagac

SEQ ID NO: 797480 - DNA, 20 bp, Artificial
  CRISPR gRNA sequence
tccatttagcagacggtgat

SEQ ID NO: 797481 - DNA, 20 bp, Artificial
  CRISPR gRNA sequence
agcagacggtgatccctcca

SEQ ID NO: 797482 - DNA, 20 bp, Artificial
  CRISPR gRNA sequence
gcagacggtgatccctccag

SEQ ID NO: 797483 - DNA, 20 bp, Artificial
  CRISPR gRNA sequence
caggctggcctttgtttaca

SEQ ID NO: 797484 - DNA, 20 bp, Artificial
  CRISPR gRNA sequence
gcctttgtttacaagctatg

SEQ ID NO: 797485 - DNA, 20 bp, Artificial
  CRISPR gRNA sequence
tgtttacaagctatgcctaa

SEQ ID NO: 797486 - DNA, 20 bp, Artificial
  CRISPR gRNA sequence
gtttacaagctatgcctaag

SEQ ID NO: 797487 - DNA, 20 bp, Artificial
  CRISPR gRNA sequence
tttacaagctatgcctaaga

SEQ ID NO: 797488 - DNA, 20 bp, Artificial
  CRISPR gRNA sequence
acaagctatgcctaagaggc

SEQ ID NO: 797489 - DNA, 20 bp, Artificial
  CRISPR gRNA sequence
caagctatgcctaagaggca

SEQ ID NO: 797490 - DNA, 20 bp, Artificial
  CRISPR gRNA sequence
tgcctaagaggcagctgttg

SEQ ID NO: 797491 - DNA, 20 bp, Artificial
  CRISPR gRNA sequence
agaggcagctgttggtggag

SEQ ID NO: 797492 - DNA, 20 bp, Artificial
  CRISPR gRNA sequence
ttggtggagggggaacaaaa

SEQ ID NO: 797493 - DNA, 20 bp, Artificial
  CRISPR gRNA sequence
gtggagggggaacaaaaaca

SEQ ID NO: 797494 - DNA, 20 bp, Artificial
  CRISPR gRNA sequence
ttatcttaataacttataga

SEQ ID NO: 797495 - DNA, 20 bp, Artificial
  CRISPR gRNA sequence
tcttaataacttatagaggt

SEQ ID NO: 797496 - DNA, 20 bp, Artificial
  CRISPR gRNA sequence
aataacttatagaggtaatc

SEQ ID NO: 797497 - DNA, 20 bp, Artificial
  CRISPR gRNA sequence
ataacttatagaggtaatca

SEQ ID NO: 797498 - DNA, 20 bp, Artificial
  CRISPR gRNA sequence
atagaggtaatcattattga

SEQ ID NO: 797499 - DNA, 20 bp, Artificial
  CRISPR gRNA sequence
tagaggtaatcattattgaa

SEQ ID NO: 797500 - DNA, 20 bp, Artificial
  CRISPR gRNA sequence
ttgaacaaaagcatgatttg

SEQ ID NO: 797501 - DNA, 20 bp, Artificial
  CRISPR gRNA sequence
aacaaaagcatgatttgggg

SEQ ID NO: 797502 - DNA, 20 bp, Artificial
  CRISPR gRNA sequence
ggggactatggaaaggctta

SEQ ID NO: 797503 - DNA, 20 bp, Artificial
  CRISPR gRNA sequence
gggactatggaaaggcttat

SEQ ID NO: 797504 - DNA, 20 bp, Artificial
  CRISPR gRNA sequence
tggaaaggcttattctttcc

SEQ ID NO: 797505 - DNA, 20 bp, Artificial
  CRISPR gRNA sequence
attctttccatataaaatga

SEQ ID NO: 797506 - DNA, 20 bp, Artificial
  CRISPR gRNA sequence
ttctttccatataaaatgat

SEQ ID NO: 797507 - DNA, 20 bp, Artificial
  CRISPR gRNA sequence
tttccatataaaatgatcag

SEQ ID NO: 797508 - DNA, 20 bp, Artificial
  CRISPR gRNA sequence
tccatataaaatgatcagcg

SEQ ID NO: 797509 - DNA, 20 bp, Artificial
  CRISPR gRNA sequence
ccatataaaatgatcagcga

SEQ ID NO: 797510 - DNA, 20 bp, Artificial
  CRISPR gRNA sequence
catataaaatgatcagcgaa

SEQ ID NO: 797511 - DNA, 20 bp, Artificial
  CRISPR gRNA sequence
aacagaactgaaataattgc

SEQ ID NO: 797512 - DNA, 20 bp, Artificial
  CRISPR gRNA sequence
aaataattgctattgattgc

SEQ ID NO: 797513 - DNA, 20 bp, Artificial
  CRISPR gRNA sequence
ctattgattgctcaccgcct

SEQ ID NO: 797514 - DNA, 20 bp, Artificial
  CRISPR gRNA sequence
ttgattgctcaccgcctgga

SEQ ID NO: 797515 - DNA, 20 bp, Artificial
  CRISPR gRNA sequence
attgctcaccgcctggatgc

SEQ ID NO: 797516 - DNA, 20 bp, Artificial
  CRISPR gRNA sequence
ctcaccgcctggatgcactg

SEQ ID NO: 797517 - DNA, 20 bp, Artificial
  CRISPR gRNA sequence
accgcctggatgcactgagt

SEQ ID NO: 797518 - DNA, 20 bp, Artificial
  CRISPR gRNA sequence
gatgcactgagtagaagagc

SEQ ID NO: 797519 - DNA, 20 bp, Artificial
  CRISPR gRNA sequence
agtagaagagcaaaggcaat

SEQ ID NO: 797520 - DNA, 20 bp, Artificial
  CRISPR gRNA sequence
atgtggaggggatggaggtg

SEQ ID NO: 797521 - DNA, 20 bp, Artificial
  CRISPR gRNA sequence
agcctgagtgagattaccaa

SEQ ID NO: 797522 - DNA, 20 bp, Artificial
  CRISPR gRNA sequence
agtgagattaccaactaatc

SEQ ID NO: 797523 - DNA, 20 bp, Artificial
  CRISPR gRNA sequence
ccaactaatcaggactttta

SEQ ID NO: 797524 - DNA, 20 bp, Artificial
  CRISPR gRNA sequence
atcaggacttttaacccaaa

SEQ ID NO: 797525 - DNA, 20 bp, Artificial
  CRISPR gRNA sequence
ttaacccaaaaatactatgg

SEQ ID NO: 797526 - DNA, 20 bp, Artificial
  CRISPR gRNA sequence
taacccaaaaatactatggc

SEQ ID NO: 797527 - DNA, 20 bp, Artificial
  CRISPR gRNA sequence
aacccaaaaatactatggct

SEQ ID NO: 797528 - DNA, 20 bp, Artificial
  CRISPR gRNA sequence
acccaaaaatactatggctc

SEQ ID NO: 797529 - DNA, 20 bp, Artificial
  CRISPR gRNA sequence
tggctctgaggggcagggaa

SEQ ID NO: 797530 - DNA, 20 bp, Artificial
  CRISPR gRNA sequence
tgaggggcagggaatgagag

SEQ ID NO: 797531 - DNA, 20 bp, Artificial
  CRISPR gRNA sequence
aggggcagggaatgagagac

SEQ ID NO: 797532 - DNA, 20 bp, Artificial
  CRISPR gRNA sequence
aattgacaaaatgcagagta

SEQ ID NO: 797533 - DNA, 20 bp, Artificial
  CRISPR gRNA sequence
acaaaatgcagagtaaaaat

SEQ ID NO: 797534 - DNA, 20 bp, Artificial
  CRISPR gRNA sequence
agtgtgagcagtaatgagac

SEQ ID NO: 797535 - DNA, 20 bp, Artificial
  CRISPR gRNA sequence
tatcagggtcaaatacggag

SEQ ID NO: 797536 - DNA, 20 bp, Artificial
  CRISPR gRNA sequence
gcctggatgtcctccaagct

SEQ ID NO: 797537 - DNA, 20 bp, Artificial
  CRISPR gRNA sequence
gatgtcctccaagctccttt

SEQ ID NO: 797538 - DNA, 20 bp, Artificial
  CRISPR gRNA sequence
caagctcctttccaagccta

SEQ ID NO: 797539 - DNA, 20 bp, Artificial
  CRISPR gRNA sequence
ctttccaagcctaagattct

SEQ ID NO: 797540 - DNA, 20 bp, Artificial
  CRISPR gRNA sequence
tccaagcctaagattctgtg

SEQ ID NO: 797541 - DNA, 20 bp, Artificial
  CRISPR gRNA sequence
ccaagcctaagattctgtga

SEQ ID NO: 797542 - DNA, 20 bp, Artificial
  CRISPR gRNA sequence
caagcctaagattctgtgag

SEQ ID NO: 797543 - DNA, 20 bp, Artificial
  CRISPR gRNA sequence
agattctgtgagtggatgaa

SEQ ID NO: 797544 - DNA, 20 bp, Artificial
  CRISPR gRNA sequence
tgtgagtggatgaacaatcc

SEQ ID NO: 797545 - DNA, 20 bp, Artificial
  CRISPR gRNA sequence
tgagtggatgaacaatcctg

SEQ ID NO: 797546 - DNA, 20 bp, Artificial
  CRISPR gRNA sequence
gtcctgctgctcttgccact

SEQ ID NO: 797547 - DNA, 20 bp, Artificial
  CRISPR gRNA sequence
ctgctcttgccactggaacc

SEQ ID NO: 797548 - DNA, 20 bp, Artificial
  CRISPR gRNA sequence
ctcttgccactggaacctga

SEQ ID NO: 797549 - DNA, 20 bp, Artificial
  CRISPR gRNA sequence
ttgccactggaacctgatct

SEQ ID NO: 797550 - DNA, 20 bp, Artificial
  CRISPR gRNA sequence
gccactggaacctgatctat

SEQ ID NO: 797551 - DNA, 20 bp, Artificial
  CRISPR gRNA sequence
ccactggaacctgatctatt

SEQ ID NO: 797552 - DNA, 20 bp, Artificial
  CRISPR gRNA sequence
gaacctgatctatttgcctt

SEQ ID NO: 797553 - DNA, 20 bp, Artificial
  CRISPR gRNA sequence
atctatttgccttcattatt

SEQ ID NO: 797554 - DNA, 20 bp, Artificial
  CRISPR gRNA sequence
tttgccttcattatttgagg

SEQ ID NO: 797555 - DNA, 20 bp, Artificial
  CRISPR gRNA sequence
gccttcattatttgaggtct

SEQ ID NO: 797556 - DNA, 20 bp, Artificial
  CRISPR gRNA sequence
ccttcattatttgaggtctc

SEQ ID NO: 797557 - DNA, 20 bp, Artificial
  CRISPR gRNA sequence
cattatttgaggtctcccca

SEQ ID NO: 797558 - DNA, 20 bp, Artificial
  CRISPR gRNA sequence
attatttgaggtctccccat

SEQ ID NO: 797559 - DNA, 20 bp, Artificial
  CRISPR gRNA sequence
tttgaggtctccccatcatc

SEQ ID NO: 797560 - DNA, 20 bp, Artificial
  CRISPR gRNA sequence
gaggtctccccatcatcagg

SEQ ID NO: 797561 - DNA, 20 bp, Artificial
  CRISPR gRNA sequence
aggtctccccatcatcaggc

SEQ ID NO: 797562 - DNA, 20 bp, Artificial
  CRISPR gRNA sequence
cccatcatcaggctctttgt

SEQ ID NO: 797563 - DNA, 20 bp, Artificial
  CRISPR gRNA sequence
tttgttgtctgctgcttcag

SEQ ID NO: 797564 - DNA, 20 bp, Artificial
  CRISPR gRNA sequence
tgttgtctgctgcttcaggg

SEQ ID NO: 797565 - DNA, 20 bp, Artificial
  CRISPR gRNA sequence
gttgtctgctgcttcagggt

SEQ ID NO: 797566 - DNA, 20 bp, Artificial
  CRISPR gRNA sequence
ttgtctgctgcttcagggtg

SEQ ID NO: 797567 - DNA, 20 bp, Artificial
  CRISPR gRNA sequence
tctgctgcttcagggtgtct

SEQ ID NO: 797568 - DNA, 20 bp, Artificial
  CRISPR gRNA sequence
ctgcttcagggtgtcttctc

SEQ ID NO: 797569 - DNA, 20 bp, Artificial
  CRISPR gRNA sequence
cttcagggtgtcttctcccc

SEQ ID NO: 797570 - DNA, 20 bp, Artificial
  CRISPR gRNA sequence
cagggtgtcttctccccaga

SEQ ID NO: 797571 - DNA, 20 bp, Artificial
  CRISPR gRNA sequence
agggtgtcttctccccagat

SEQ ID NO: 797572 - DNA, 20 bp, Artificial
  CRISPR gRNA sequence
ctccccagatttctcctgtt

SEQ ID NO: 797573 - DNA, 20 bp, Artificial
  CRISPR gRNA sequence
tccccagatttctcctgttg

SEQ ID NO: 797574 - DNA, 20 bp, Artificial
  CRISPR gRNA sequence
cccagatttctcctgttggt

SEQ ID NO: 797575 - DNA, 20 bp, Artificial
  CRISPR gRNA sequence
ctcctgttggtgagcttttc

SEQ ID NO: 797576 - DNA, 20 bp, Artificial
  CRISPR gRNA sequence
tcctgttggtgagcttttcc

SEQ ID NO: 797577 - DNA, 20 bp, Artificial
  CRISPR gRNA sequence
ctgttggtgagcttttccat

SEQ ID NO: 797578 - DNA, 20 bp, Artificial
  CRISPR gRNA sequence
ttggtgagcttttccattga

SEQ ID NO: 797579 - DNA, 20 bp, Artificial
  CRISPR gRNA sequence
gtgagcttttccattgaact

SEQ ID NO: 797580 - DNA, 20 bp, Artificial
  CRISPR gRNA sequence
ttccattgaactggagctcc

SEQ ID NO: 797581 - DNA, 20 bp, Artificial
  CRISPR gRNA sequence
tccattgaactggagctcct

SEQ ID NO: 797582 - DNA, 20 bp, Artificial
  CRISPR gRNA sequence
ccattgaactggagctcctc

SEQ ID NO: 797583 - DNA, 20 bp, Artificial
  CRISPR gRNA sequence
cattgaactggagctcctca

SEQ ID NO: 797584 - DNA, 20 bp, Artificial
  CRISPR gRNA sequence
aactggagctcctcacaggc

SEQ ID NO: 797585 - DNA, 20 bp, Artificial
  CRISPR gRNA sequence
gagctcctcacaggcaagaa

SEQ ID NO: 797586 - DNA, 20 bp, Artificial
  CRISPR gRNA sequence
ctcacaggcaagaagcacac

SEQ ID NO: 797587 - DNA, 20 bp, Artificial
  CRISPR gRNA sequence
acaggcaagaagcacacctt

SEQ ID NO: 797588 - DNA, 20 bp, Artificial
  CRISPR gRNA sequence
taaggttctctgagtcccaa

SEQ ID NO: 797589 - DNA, 20 bp, Artificial
  CRISPR gRNA sequence
aaggttctctgagtcccaag

SEQ ID NO: 797590 - DNA, 20 bp, Artificial
  CRISPR gRNA sequence
aggttctctgagtcccaagt

SEQ ID NO: 797591 - DNA, 20 bp, Artificial
  CRISPR gRNA sequence
tctgagtcccaagttcctag

SEQ ID NO: 797592 - DNA, 20 bp, Artificial
  CRISPR gRNA sequence
tgagtcccaagttcctagtg

SEQ ID NO: 797593 - DNA, 20 bp, Artificial
  CRISPR gRNA sequence
agtcccaagttcctagtgca

SEQ ID NO: 797594 - DNA, 20 bp, Artificial
  CRISPR gRNA sequence
ctagtgcagtacctggcaat

SEQ ID NO: 797595 - DNA, 20 bp, Artificial
  CRISPR gRNA sequence
gtgcagtacctggcaataca

SEQ ID NO: 797596 - DNA, 20 bp, Artificial
  CRISPR gRNA sequence
gcaatacacataggtgctta

SEQ ID NO: 797597 - DNA, 20 bp, Artificial
  CRISPR gRNA sequence
agtgggtgcttgccgaattg

SEQ ID NO: 797598 - DNA, 20 bp, Artificial
  CRISPR gRNA sequence
gtgggtgcttgccgaattgt

SEQ ID NO: 797599 - DNA, 20 bp, Artificial
  CRISPR gRNA sequence
gccgaattgttgaatggatt

SEQ ID NO: 797600 - DNA, 20 bp, Artificial
  CRISPR gRNA sequence
ccgaattgttgaatggattt

SEQ ID NO: 797601 - DNA, 20 bp, Artificial
  CRISPR gRNA sequence
ttgaatggatttatttgatg

SEQ ID NO: 797602 - DNA, 20 bp, Artificial
  CRISPR gRNA sequence
aatggatttatttgatgaaa

SEQ ID NO: 797603 - DNA, 20 bp, Artificial
  CRISPR gRNA sequence
atttgatgaaatgtcaggag

SEQ ID NO: 797604 - DNA, 20 bp, Artificial
  CRISPR gRNA sequence
tttgatgaaatgtcaggaga

SEQ ID NO: 797605 - DNA, 20 bp, Artificial
  CRISPR gRNA sequence
gatgaaatgtcaggagaatc

SEQ ID NO: 797606 - DNA, 20 bp, Artificial
  CRISPR gRNA sequence
atgaaatgtcaggagaatca

SEQ ID NO: 797607 - DNA, 20 bp, Artificial
  CRISPR gRNA sequence
gtgtaatggacagggggaag

SEQ ID NO: 797608 - DNA, 20 bp, Artificial
  CRISPR gRNA sequence
gaggttgatttgaaaaagga

SEQ ID NO: 797609 - DNA, 20 bp, Artificial
  CRISPR gRNA sequence
aggttgatttgaaaaaggag

SEQ ID NO: 797610 - DNA, 20 bp, Artificial
  CRISPR gRNA sequence
atttgaaaaaggagatggta

SEQ ID NO: 797611 - DNA, 20 bp, Artificial
  CRISPR gRNA sequence
gaaaaaggagatggtagaga

SEQ ID NO: 797612 - DNA, 20 bp, Artificial
  CRISPR gRNA sequence
aaaaaggagatggtagagac

SEQ ID NO: 797613 - DNA, 20 bp, Artificial
  CRISPR gRNA sequence
tgggtcatgcttcagagttt

SEQ ID NO: 797614 - DNA, 20 bp, Artificial
  CRISPR gRNA sequence
cagagtttatttgctttaca

SEQ ID NO: 797615 - DNA, 20 bp, Artificial
  CRISPR gRNA sequence
agagtttatttgctttacaa

SEQ ID NO: 797616 - DNA, 20 bp, Artificial
  CRISPR gRNA sequence
atttgctttacaatacattg

SEQ ID NO: 797617 - DNA, 20 bp, Artificial
  CRISPR gRNA sequence
tttgctttacaatacattgg

SEQ ID NO: 797618 - DNA, 20 bp, Artificial
  CRISPR gRNA sequence
gctttacaatacattggaca

SEQ ID NO: 797619 - DNA, 20 bp, Artificial
  CRISPR gRNA sequence
ctttacaatacattggacag

SEQ ID NO: 797620 - DNA, 20 bp, Artificial
  CRISPR gRNA sequence
tacaatacattggacagcaa

SEQ ID NO: 797621 - DNA, 20 bp, Artificial
  CRISPR gRNA sequence
acaatacattggacagcaac

SEQ ID NO: 797622 - DNA, 20 bp, Artificial
  CRISPR gRNA sequence
caatacattggacagcaacc

SEQ ID NO: 797623 - DNA, 20 bp, Artificial
  CRISPR gRNA sequence
gacagcaaccagtagattgt

SEQ ID NO: 797624 - DNA, 20 bp, Artificial
  CRISPR gRNA sequence
ttgtgtgtcattttaattcc

SEQ ID NO: 797625 - DNA, 20 bp, Artificial
  CRISPR gRNA sequence
tgtgtcattttaattccaca

SEQ ID NO: 797626 - DNA, 20 bp, Artificial
  CRISPR gRNA sequence
taattccacatgctaatgtc

SEQ ID NO: 797627 - DNA, 20 bp, Artificial
  CRISPR gRNA sequence
aattccacatgctaatgtcc

SEQ ID NO: 797628 - DNA, 20 bp, Artificial
  CRISPR gRNA sequence
attccacatgctaatgtcca

SEQ ID NO: 797629 - DNA, 20 bp, Artificial
  CRISPR gRNA sequence
cacatgctaatgtccaaata

SEQ ID NO: 797630 - DNA, 20 bp, Artificial
  CRISPR gRNA sequence
atgtccaaatatgtcatatg

SEQ ID NO: 797631 - DNA, 20 bp, Artificial
  CRISPR gRNA sequence
aattgttgcatacgtgggtt

SEQ ID NO: 797632 - DNA, 20 bp, Artificial
  CRISPR gRNA sequence
attgttgcatacgtgggtta

SEQ ID NO: 797633 - DNA, 20 bp, Artificial
  CRISPR gRNA sequence
ttgcatacgtgggttactct

SEQ ID NO: 797634 - DNA, 20 bp, Artificial
  CRISPR gRNA sequence
catacgtgggttactctgta

SEQ ID NO: 797635 - DNA, 20 bp, Artificial
  CRISPR gRNA sequence
ctctgtaaaggggcaactgt

SEQ ID NO: 797636 - DNA, 20 bp, Artificial
  CRISPR gRNA sequence
tgtaaaggggcaactgtagt

SEQ ID NO: 797637 - DNA, 20 bp, Artificial
  CRISPR gRNA sequence
taaaggggcaactgtagtat

SEQ ID NO: 797638 - DNA, 20 bp, Artificial
  CRISPR gRNA sequence
tagtatcacctcctcatgcc

SEQ ID NO: 797639 - DNA, 20 bp, Artificial
  CRISPR gRNA sequence
ctcatgccacaccctgctcc

SEQ ID NO: 797640 - DNA, 20 bp, Artificial
  CRISPR gRNA sequence
atgccacaccctgctccact

SEQ ID NO: 797641 - DNA, 20 bp, Artificial
  CRISPR gRNA sequence
ctccactgtagctgggctcg

SEQ ID NO: 797642 - DNA, 20 bp, Artificial
  CRISPR gRNA sequence
cactgtagctgggctcgata

SEQ ID NO: 797643 - DNA, 20 bp, Artificial
  CRISPR gRNA sequence
tagctgggctcgataacctt

SEQ ID NO: 797644 - DNA, 20 bp, Artificial
  CRISPR gRNA sequence
ggctcgataaccttcaaatc

SEQ ID NO: 797645 - DNA, 20 bp, Artificial
  CRISPR gRNA sequence
gataaccttcaaatcaactc

SEQ ID NO: 797646 - DNA, 20 bp, Artificial
  CRISPR gRNA sequence
caaatcaactcacagaattc

SEQ ID NO: 797647 - DNA, 20 bp, Artificial
  CRISPR gRNA sequence
aaatcaactcacagaattcc

SEQ ID NO: 797648 - DNA, 20 bp, Artificial
  CRISPR gRNA sequence
acagaattccaggacagaca

SEQ ID NO: 797649 - DNA, 20 bp, Artificial
  CRISPR gRNA sequence
caggacagacaagagcatct

SEQ ID NO: 797650 - DNA, 20 bp, Artificial
  CRISPR gRNA sequence
aaaggttatctagccccagt

SEQ ID NO: 797651 - DNA, 20 bp, Artificial
  CRISPR gRNA sequence
tctagccccagtcacctctg

SEQ ID NO: 797652 - DNA, 20 bp, Artificial
  CRISPR gRNA sequence
gccccagtcacctctgatgc

SEQ ID NO: 797653 - DNA, 20 bp, Artificial
  CRISPR gRNA sequence
tgatgccttccagctgtctc

SEQ ID NO: 797654 - DNA, 20 bp, Artificial
  CRISPR gRNA sequence
atgccttccagctgtctcta

SEQ ID NO: 797655 - DNA, 20 bp, Artificial
  CRISPR gRNA sequence
ccagctgtctctaacacacc

SEQ ID NO: 797656 - DNA, 20 bp, Artificial
  CRISPR gRNA sequence
cagctgtctctaacacacct

SEQ ID NO: 797657 - DNA, 20 bp, Artificial
  CRISPR gRNA sequence
tctctaacacacctgtgggc

SEQ ID NO: 797658 - DNA, 20 bp, Artificial
  CRISPR gRNA sequence
taacacacctgtgggctgac

SEQ ID NO: 797659 - DNA, 20 bp, Artificial
  CRISPR gRNA sequence
acacacctgtgggctgactt

SEQ ID NO: 797660 - DNA, 20 bp, Artificial
  CRISPR gRNA sequence
tgggctgacttccagttctt

SEQ ID NO: 797661 - DNA, 20 bp, Artificial
  CRISPR gRNA sequence
acttccagttcttagtcttc

SEQ ID NO: 797662 - DNA, 20 bp, Artificial
  CRISPR gRNA sequence
ccagttcttagtcttcacgg

SEQ ID NO: 797663 - DNA, 20 bp, Artificial
  CRISPR gRNA sequence
cagttcttagtcttcacggc

SEQ ID NO: 797664 - DNA, 20 bp, Artificial
  CRISPR gRNA sequence
ttagtcttcacggctcccta

SEQ ID NO: 797665 - DNA, 20 bp, Artificial
  CRISPR gRNA sequence
agtcttcacggctccctatg

SEQ ID NO: 797666 - DNA, 20 bp, Artificial
  CRISPR gRNA sequence
gtcttcacggctccctatga

SEQ ID NO: 797667 - DNA, 20 bp, Artificial
  CRISPR gRNA sequence
cacggctccctatgatgaac

SEQ ID NO: 797668 - DNA, 20 bp, Artificial
  CRISPR gRNA sequence
acggctccctatgatgaact

SEQ ID NO: 797669 - DNA, 20 bp, Artificial
  CRISPR gRNA sequence
cctatgatgaactgcccctg

SEQ ID NO: 797670 - DNA, 20 bp, Artificial
  CRISPR gRNA sequence
tgatgaactgcccctgcttt

SEQ ID NO: 797671 - DNA, 20 bp, Artificial
  CRISPR gRNA sequence
cccctgctttgagggatttt

SEQ ID NO: 797672 - DNA, 20 bp, Artificial
  CRISPR gRNA sequence
ctttgagggattttcctcca

SEQ ID NO: 797673 - DNA, 20 bp, Artificial
  CRISPR gRNA sequence
tgagggattttcctccattg

SEQ ID NO: 797674 - DNA, 20 bp, Artificial
  CRISPR gRNA sequence
gagggattttcctccattgc

SEQ ID NO: 797675 - DNA, 20 bp, Artificial
  CRISPR gRNA sequence
agggattttcctccattgcc

SEQ ID NO: 797676 - DNA, 20 bp, Artificial
  CRISPR gRNA sequence
tcctccattgcctcagaagt

SEQ ID NO: 797677 - DNA, 20 bp, Artificial
  CRISPR gRNA sequence
cctccattgcctcagaagta

SEQ ID NO: 797678 - DNA, 20 bp, Artificial
  CRISPR gRNA sequence
ctccattgcctcagaagtac

SEQ ID NO: 797679 - DNA, 20 bp, Artificial
  CRISPR gRNA sequence
cattgcctcagaagtactgc

SEQ ID NO: 797680 - DNA, 20 bp, Artificial
  CRISPR gRNA sequence
cctcagaagtactgccctgg

SEQ ID NO: 797681 - DNA, 20 bp, Artificial
  CRISPR gRNA sequence
agaagtactgccctggggga

SEQ ID NO: 797682 - DNA, 20 bp, Artificial
  CRISPR gRNA sequence
ccctgggggagcttctgatg

SEQ ID NO: 797683 - DNA, 20 bp, Artificial
  CRISPR gRNA sequence
ggggagcttctgatgctctt

SEQ ID NO: 797684 - DNA, 20 bp, Artificial
  CRISPR gRNA sequence
ctgatgctcttctgaccacc

SEQ ID NO: 797685 - DNA, 20 bp, Artificial
  CRISPR gRNA sequence
tgatgctcttctgaccacct

SEQ ID NO: 797686 - DNA, 20 bp, Artificial
  CRISPR gRNA sequence
atgctcttctgaccaccttg

SEQ ID NO: 797687 - DNA, 20 bp, Artificial
  CRISPR gRNA sequence
ttctgaccaccttgtctctg

SEQ ID NO: 797688 - DNA, 20 bp, Artificial
  CRISPR gRNA sequence
ctgaccaccttgtctctgcc

SEQ ID NO: 797689 - DNA, 20 bp, Artificial
  CRISPR gRNA sequence
tgaccaccttgtctctgcct

SEQ ID NO: 797690 - DNA, 20 bp, Artificial
  CRISPR gRNA sequence
accaccttgtctctgccttt

SEQ ID NO: 797691 - DNA, 20 bp, Artificial
  CRISPR gRNA sequence
gtctctgcctttttcactag

SEQ ID NO: 797692 - DNA, 20 bp, Artificial
  CRISPR gRNA sequence
tctctgcctttttcactagt

SEQ ID NO: 797693 - DNA, 20 bp, Artificial
  CRISPR gRNA sequence
tgcctttttcactagtcctc

SEQ ID NO: 797694 - DNA, 20 bp, Artificial
  CRISPR gRNA sequence
cctttttcactagtcctctg

SEQ ID NO: 797695 - DNA, 20 bp, Artificial
  CRISPR gRNA sequence
tttcactagtcctctgttcc

SEQ ID NO: 797696 - DNA, 20 bp, Artificial
  CRISPR gRNA sequence
ttcactagtcctctgttcct

SEQ ID NO: 797697 - DNA, 20 bp, Artificial
  CRISPR gRNA sequence
tcactagtcctctgttcctg

SEQ ID NO: 797698 - DNA, 20 bp, Artificial
  CRISPR gRNA sequence
cactagtcctctgttcctgc

SEQ ID NO: 797699 - DNA, 20 bp, Artificial
  CRISPR gRNA sequence
actagtcctctgttcctgct

SEQ ID NO: 797700 - DNA, 20 bp, Artificial
  CRISPR gRNA sequence
gtcctctgttcctgctctcc

SEQ ID NO: 797701 - DNA, 20 bp, Artificial
  CRISPR gRNA sequence
tgttcctgctctccaaattt

SEQ ID NO: 797702 - DNA, 20 bp, Artificial
  CRISPR gRNA sequence
ttcctgctctccaaattttg

SEQ ID NO: 797703 - DNA, 20 bp, Artificial
  CRISPR gRNA sequence
ctgctctccaaattttggga

SEQ ID NO: 797704 - DNA, 20 bp, Artificial
  CRISPR gRNA sequence
ctctccaaattttgggacgt

SEQ ID NO: 797705 - DNA, 20 bp, Artificial
  CRISPR gRNA sequence
tccaaattttgggacgttcc

SEQ ID NO: 797706 - DNA, 20 bp, Artificial
  CRISPR gRNA sequence
caaattttgggacgttcctg

SEQ ID NO: 797707 - DNA, 20 bp, Artificial
  CRISPR gRNA sequence
tgggacgttcctgagttcag

SEQ ID NO: 797708 - DNA, 20 bp, Artificial
  CRISPR gRNA sequence
gggacgttcctgagttcaga

SEQ ID NO: 797709 - DNA, 20 bp, Artificial
  CRISPR gRNA sequence
ggacgttcctgagttcagat

SEQ ID NO: 797710 - DNA, 20 bp, Artificial
  CRISPR gRNA sequence
ctgagttcagatcttttctt

SEQ ID NO: 797711 - DNA, 20 bp, Artificial
  CRISPR gRNA sequence
agttcagatcttttctttat

SEQ ID NO: 797712 - DNA, 20 bp, Artificial
  CRISPR gRNA sequence
agatcttttctttataatct

SEQ ID NO: 797713 - DNA, 20 bp, Artificial
  CRISPR gRNA sequence
ttctttataatctttctttt

SEQ ID NO: 797714 - DNA, 20 bp, Artificial
  CRISPR gRNA sequence
tctttataatctttctttta

SEQ ID NO: 797715 - DNA, 20 bp, Artificial
  CRISPR gRNA sequence
ctttataatctttcttttat

SEQ ID NO: 797716 - DNA, 20 bp, Artificial
  CRISPR gRNA sequence
tttataatctttcttttata

SEQ ID NO: 797717 - DNA, 20 bp, Artificial
  CRISPR gRNA sequence
tataatctttcttttatatt

SEQ ID NO: 797718 - DNA, 20 bp, Artificial
  CRISPR gRNA sequence
ataatctttcttttatattc

SEQ ID NO: 797719 - DNA, 20 bp, Artificial
  CRISPR gRNA sequence
taatctttcttttatattct

SEQ ID NO: 797720 - DNA, 20 bp, Artificial
  CRISPR gRNA sequence
tcttttatattctccccatc

SEQ ID NO: 797721 - DNA, 20 bp, Artificial
  CRISPR gRNA sequence
cttttatattctccccatca

SEQ ID NO: 797722 - DNA, 20 bp, Artificial
  CRISPR gRNA sequence
ttttatattctccccatcag

SEQ ID NO: 797723 - DNA, 20 bp, Artificial
  CRISPR gRNA sequence
ttatattctccccatcagat

SEQ ID NO: 797724 - DNA, 20 bp, Artificial
  CRISPR gRNA sequence
tatattctccccatcagatg

SEQ ID NO: 797725 - DNA, 20 bp, Artificial
  CRISPR gRNA sequence
atattctccccatcagatgg

SEQ ID NO: 797726 - DNA, 20 bp, Artificial
  CRISPR gRNA sequence
tattctccccatcagatggt

SEQ ID NO: 797727 - DNA, 20 bp, Artificial
  CRISPR gRNA sequence
tccccatcagatggttcatt

SEQ ID NO: 797728 - DNA, 20 bp, Artificial
  CRISPR gRNA sequence
cccatcagatggttcattca

SEQ ID NO: 797729 - DNA, 20 bp, Artificial
  CRISPR gRNA sequence
attcattcctcaatattaac

SEQ ID NO: 797730 - DNA, 20 bp, Artificial
  CRISPR gRNA sequence
attcctcaatattaactaac

SEQ ID NO: 797731 - DNA, 20 bp, Artificial
  CRISPR gRNA sequence
ctcaatattaactaacattt

SEQ ID NO: 797732 - DNA, 20 bp, Artificial
  CRISPR gRNA sequence
aatattaactaacatttcca

SEQ ID NO: 797733 - DNA, 20 bp, Artificial
  CRISPR gRNA sequence
actaacatttccatattaga

SEQ ID NO: 797734 - DNA, 20 bp, Artificial
  CRISPR gRNA sequence
acatttccatattagaaata

SEQ ID NO: 797735 - DNA, 20 bp, Artificial
  CRISPR gRNA sequence
ccatattagaaataacttcc

SEQ ID NO: 797736 - DNA, 20 bp, Artificial
  CRISPR gRNA sequence
catattagaaataacttcct

SEQ ID NO: 797737 - DNA, 20 bp, Artificial
  CRISPR gRNA sequence
gaaataacttccttatcttt

SEQ ID NO: 797738 - DNA, 20 bp, Artificial
  CRISPR gRNA sequence
ccttatctttagccctaaat

SEQ ID NO: 797739 - DNA, 20 bp, Artificial
  CRISPR gRNA sequence
cttatctttagccctaaatt

SEQ ID NO: 797740 - DNA, 20 bp, Artificial
  CRISPR gRNA sequence
atctttagccctaaattttg

SEQ ID NO: 797741 - DNA, 20 bp, Artificial
  CRISPR gRNA sequence
tctttagccctaaattttgt

SEQ ID NO: 797742 - DNA, 20 bp, Artificial
  CRISPR gRNA sequence
tagccctaaattttgtccca

SEQ ID NO: 797743 - DNA, 20 bp, Artificial
  CRISPR gRNA sequence
agccctaaattttgtcccaa

SEQ ID NO: 797744 - DNA, 20 bp, Artificial
  CRISPR gRNA sequence
gccctaaattttgtcccaaa

SEQ ID NO: 797745 - DNA, 20 bp, Artificial
  CRISPR gRNA sequence
aattttgtcccaaactctgg

SEQ ID NO: 797746 - DNA, 20 bp, Artificial
  CRISPR gRNA sequence
tgtcccaaactctggaccta

SEQ ID NO: 797747 - DNA, 20 bp, Artificial
  CRISPR gRNA sequence
gtcccaaactctggacctac

SEQ ID NO: 797748 - DNA, 20 bp, Artificial
  CRISPR gRNA sequence
tcccaaactctggacctaca

SEQ ID NO: 797749 - DNA, 20 bp, Artificial
  CRISPR gRNA sequence
tggacctacaattttttgga

SEQ ID NO: 797750 - DNA, 20 bp, Artificial
  CRISPR gRNA sequence
gacctacaattttttggaat

SEQ ID NO: 797751 - DNA, 20 bp, Artificial
  CRISPR gRNA sequence
caattttttggaatgcttat

SEQ ID NO: 797752 - DNA, 20 bp, Artificial
  CRISPR gRNA sequence
tttggaatgcttatgccttg

SEQ ID NO: 797753 - DNA, 20 bp, Artificial
  CRISPR gRNA sequence
ttggaatgcttatgccttgc

SEQ ID NO: 797754 - DNA, 20 bp, Artificial
  CRISPR gRNA sequence
tggaatgcttatgccttgcc

SEQ ID NO: 797755 - DNA, 20 bp, Artificial
  CRISPR gRNA sequence
ggaatgcttatgccttgccc

SEQ ID NO: 797756 - DNA, 20 bp, Artificial
  CRISPR gRNA sequence
gaatgcttatgccttgccca

SEQ ID NO: 797757 - DNA, 20 bp, Artificial
  CRISPR gRNA sequence
atgccttgcccagactaaaa

SEQ ID NO: 797758 - DNA, 20 bp, Artificial
  CRISPR gRNA sequence
tgccttgcccagactaaaac

SEQ ID NO: 797759 - DNA, 20 bp, Artificial
  CRISPR gRNA sequence
gcccagactaaaaccaaact

SEQ ID NO: 797760 - DNA, 20 bp, Artificial
  CRISPR gRNA sequence
cccagactaaaaccaaactt

SEQ ID NO: 797761 - DNA, 20 bp, Artificial
  CRISPR gRNA sequence
aaaccaaacttactgtcttc

SEQ ID NO: 797762 - DNA, 20 bp, Artificial
  CRISPR gRNA sequence
actgtcttccctctaaaatc

SEQ ID NO: 797763 - DNA, 20 bp, Artificial
  CRISPR gRNA sequence
ctgtcttccctctaaaatca

SEQ ID NO: 797764 - DNA, 20 bp, Artificial
  CRISPR gRNA sequence
tcttccctctaaaatcagct

SEQ ID NO: 797765 - DNA, 20 bp, Artificial
  CRISPR gRNA sequence
ccctctaaaatcagctcccc

SEQ ID NO: 797766 - DNA, 20 bp, Artificial
  CRISPR gRNA sequence
cctctaaaatcagctcccca

SEQ ID NO: 797767 - DNA, 20 bp, Artificial
  CRISPR gRNA sequence
taaaatcagctccccatctt

SEQ ID NO: 797768 - DNA, 20 bp, Artificial
  CRISPR gRNA sequence
aaatcagctccccatcttct

SEQ ID NO: 797769 - DNA, 20 bp, Artificial
  CRISPR gRNA sequence
cccatcttctatttctccct

SEQ ID NO: 797770 - DNA, 20 bp, Artificial
  CRISPR gRNA sequence
ctatttctccctgccaccct

SEQ ID NO: 797771 - DNA, 20 bp, Artificial
  CRISPR gRNA sequence
tatttctccctgccaccctt

SEQ ID NO: 797772 - DNA, 20 bp, Artificial
  CRISPR gRNA sequence
tttctccctgccacccttcc

SEQ ID NO: 797773 - DNA, 20 bp, Artificial
  CRISPR gRNA sequence
ctccctgccacccttcctcc

SEQ ID NO: 797774 - DNA, 20 bp, Artificial
  CRISPR gRNA sequence
tccctgccacccttcctccc

SEQ ID NO: 797775 - DNA, 20 bp, Artificial
  CRISPR gRNA sequence
cctgccacccttcctccccc

SEQ ID NO: 797776 - DNA, 20 bp, Artificial
  CRISPR gRNA sequence
ccacccttcctcccccatgg

SEQ ID NO: 797777 - DNA, 20 bp, Artificial
  CRISPR gRNA sequence
cctcccccatggctccaata

SEQ ID NO: 797778 - DNA, 20 bp, Artificial
  CRISPR gRNA sequence
ctcccccatggctccaatat

SEQ ID NO: 797779 - DNA, 20 bp, Artificial
  CRISPR gRNA sequence
ccccatggctccaatattgt

SEQ ID NO: 797780 - DNA, 20 bp, Artificial
  CRISPR gRNA sequence
caatattgtcttgccagtct

SEQ ID NO: 797781 - DNA, 20 bp, Artificial
  CRISPR gRNA sequence
tcttgccagtctggtcttaa

SEQ ID NO: 797782 - DNA, 20 bp, Artificial
  CRISPR gRNA sequence
gccagtctggtcttaaaacc

SEQ ID NO: 797783 - DNA, 20 bp, Artificial
  CRISPR gRNA sequence
ccagtctggtcttaaaacca

SEQ ID NO: 797784 - DNA, 20 bp, Artificial
  CRISPR gRNA sequence
gtcttaaaaccacagtcaat

SEQ ID NO: 797785 - DNA, 20 bp, Artificial
  CRISPR gRNA sequence
aaaaccacagtcaatcttgt

SEQ ID NO: 797786 - DNA, 20 bp, Artificial
  CRISPR gRNA sequence
aaaccacagtcaatcttgtt

SEQ ID NO: 797787 - DNA, 20 bp, Artificial
  CRISPR gRNA sequence
gttgcttttctctttgtctc

SEQ ID NO: 797788 - DNA, 20 bp, Artificial
  CRISPR gRNA sequence
ttgcttttctctttgtctct

SEQ ID NO: 797789 - DNA, 20 bp, Artificial
  CRISPR gRNA sequence
cttttctctttgtctcttgt

SEQ ID NO: 797790 - DNA, 20 bp, Artificial
  CRISPR gRNA sequence
ttctctttgtctcttgtgca

SEQ ID NO: 797791 - DNA, 20 bp, Artificial
  CRISPR gRNA sequence
tctctttgtctcttgtgcat

SEQ ID NO: 797792 - DNA, 20 bp, Artificial
  CRISPR gRNA sequence
ctctttgtctcttgtgcatg

SEQ ID NO: 797793 - DNA, 20 bp, Artificial
  CRISPR gRNA sequence
tctttgtctcttgtgcatgg

SEQ ID NO: 797794 - DNA, 20 bp, Artificial
  CRISPR gRNA sequence
tttgtctcttgtgcatggct

SEQ ID NO: 797795 - DNA, 20 bp, Artificial
  CRISPR gRNA sequence
tgtctcttgtgcatggctga

SEQ ID NO: 797796 - DNA, 20 bp, Artificial
  CRISPR gRNA sequence
gtctcttgtgcatggctgat

SEQ ID NO: 797797 - DNA, 20 bp, Artificial
  CRISPR gRNA sequence
tctcttgtgcatggctgatc

SEQ ID NO: 797798 - DNA, 20 bp, Artificial
  CRISPR gRNA sequence
ttgtgcatggctgatcagca

SEQ ID NO: 797799 - DNA, 20 bp, Artificial
  CRISPR gRNA sequence
gtgcatggctgatcagcagt

SEQ ID NO: 797800 - DNA, 20 bp, Artificial
  CRISPR gRNA sequence
tgcatggctgatcagcagtc

SEQ ID NO: 797801 - DNA, 20 bp, Artificial
  CRISPR gRNA sequence
atcagcagtcaattgttttg

SEQ ID NO: 797802 - DNA, 20 bp, Artificial
  CRISPR gRNA sequence
ttttgtcaattgtcttatat

SEQ ID NO: 797803 - DNA, 20 bp, Artificial
  CRISPR gRNA sequence
tgtcaattgtcttatatgtt

SEQ ID NO: 797804 - DNA, 20 bp, Artificial
  CRISPR gRNA sequence
gtcaattgtcttatatgttt

SEQ ID NO: 797805 - DNA, 20 bp, Artificial
  CRISPR gRNA sequence
tcaattgtcttatatgtttc

SEQ ID NO: 797806 - DNA, 20 bp, Artificial
  CRISPR gRNA sequence
tcttatatgtttcttcttcc

SEQ ID NO: 797807 - DNA, 20 bp, Artificial
  CRISPR gRNA sequence
atatgtttcttcttcctctt

SEQ ID NO: 797808 - DNA, 20 bp, Artificial
  CRISPR gRNA sequence
tatgtttcttcttcctcttc

SEQ ID NO: 797809 - DNA, 20 bp, Artificial
  CRISPR gRNA sequence
cttcttcctcttccttgctt

SEQ ID NO: 797810 - DNA, 20 bp, Artificial
  CRISPR gRNA sequence
ttcttcctcttccttgcttc

SEQ ID NO: 797811 - DNA, 20 bp, Artificial
  CRISPR gRNA sequence
cttcctcttccttgcttcct

SEQ ID NO: 797812 - DNA, 20 bp, Artificial
  CRISPR gRNA sequence
ttcctcttccttgcttcctt

SEQ ID NO: 797813 - DNA, 20 bp, Artificial
  CRISPR gRNA sequence
cctcttccttgcttcctttt

SEQ ID NO: 797814 - DNA, 20 bp, Artificial
  CRISPR gRNA sequence
ctcttccttgcttccttttt

SEQ ID NO: 797815 - DNA, 20 bp, Artificial
  CRISPR gRNA sequence
ttccttgcttcctttttctg

SEQ ID NO: 797816 - DNA, 20 bp, Artificial
  CRISPR gRNA sequence
ccttgcttcctttttctgac

SEQ ID NO: 797817 - DNA, 20 bp, Artificial
  CRISPR gRNA sequence
cttgcttcctttttctgacc

SEQ ID NO: 797818 - DNA, 20 bp, Artificial
  CRISPR gRNA sequence
gcttcctttttctgacctga

SEQ ID NO: 797819 - DNA, 20 bp, Artificial
  CRISPR gRNA sequence
cttcctttttctgacctgaa

SEQ ID NO: 797820 - DNA, 20 bp, Artificial
  CRISPR gRNA sequence
cctttttctgacctgaagtt

SEQ ID NO: 797821 - DNA, 20 bp, Artificial
  CRISPR gRNA sequence
ctttttctgacctgaagtta

SEQ ID NO: 797822 - DNA, 20 bp, Artificial
  CRISPR gRNA sequence
tttctgacctgaagttaggg

SEQ ID NO: 797823 - DNA, 20 bp, Artificial
  CRISPR gRNA sequence
ttctgacctgaagttagggc

SEQ ID NO: 797824 - DNA, 20 bp, Artificial
  CRISPR gRNA sequence
tctgacctgaagttagggcc

SEQ ID NO: 797825 - DNA, 20 bp, Artificial
  CRISPR gRNA sequence
ctgacctgaagttagggcct

SEQ ID NO: 797826 - DNA, 20 bp, Artificial
  CRISPR gRNA sequence
tgacctgaagttagggcctt

SEQ ID NO: 797827 - DNA, 20 bp, Artificial
  CRISPR gRNA sequence
acctgaagttagggccttgt

SEQ ID NO: 797828 - DNA, 20 bp, Artificial
  CRISPR gRNA sequence
aagttagggccttgttacca

SEQ ID NO: 797829 - DNA, 20 bp, Artificial
  CRISPR gRNA sequence
gggccttgttaccaaacatc

SEQ ID NO: 797830 - DNA, 20 bp, Artificial
  CRISPR gRNA sequence
gttaccaaacatctagatga

SEQ ID NO: 797831 - DNA, 20 bp, Artificial
  CRISPR gRNA sequence
ttaccaaacatctagatgaa

SEQ ID NO: 797832 - DNA, 20 bp, Artificial
  CRISPR gRNA sequence
ccaaacatctagatgaatac

SEQ ID NO: 797833 - DNA, 20 bp, Artificial
  CRISPR gRNA sequence
gatgaatacagtgaccccct

SEQ ID NO: 797834 - DNA, 20 bp, Artificial
  CRISPR gRNA sequence
attgagaggctgtctaccaa

SEQ ID NO: 797835 - DNA, 20 bp, Artificial
  CRISPR gRNA sequence
agaggctgtctaccaattcc

SEQ ID NO: 797836 - DNA, 20 bp, Artificial
  CRISPR gRNA sequence
tctaccaattccacccaccc

SEQ ID NO: 797837 - DNA, 20 bp, Artificial
  CRISPR gRNA sequence
ccaattccacccaccctcaa

SEQ ID NO: 797838 - DNA, 20 bp, Artificial
  CRISPR gRNA sequence
cacccaccctcaattctata

SEQ ID NO: 797839 - DNA, 20 bp, Artificial
  CRISPR gRNA sequence
aattctatactcaaaaaaaa

SEQ ID NO: 797840 - DNA, 20 bp, Artificial
  CRISPR gRNA sequence
tatactcaaaaaaaaaatta

SEQ ID NO: 797841 - DNA, 20 bp, Artificial
  CRISPR gRNA sequence
tactcaaaaaaaaaattaga

SEQ ID NO: 797842 - DNA, 20 bp, Artificial
  CRISPR gRNA sequence
aaaaaaaaaattagatgtaa

SEQ ID NO: 797843 - DNA, 20 bp, Artificial
  CRISPR gRNA sequence
gatgtaatctttttcagata

SEQ ID NO: 797844 - DNA, 20 bp, Artificial
  CRISPR gRNA sequence
tttcagatactcctttggta

SEQ ID NO: 797845 - DNA, 20 bp, Artificial
  CRISPR gRNA sequence
ttcagatactcctttggtat

SEQ ID NO: 797846 - DNA, 20 bp, Artificial
  CRISPR gRNA sequence
tcagatactcctttggtatt

SEQ ID NO: 797847 - DNA, 20 bp, Artificial
  CRISPR gRNA sequence
cagatactcctttggtattg

SEQ ID NO: 797848 - DNA, 20 bp, Artificial
  CRISPR gRNA sequence
agatactcctttggtattgt

SEQ ID NO: 797849 - DNA, 20 bp, Artificial
  CRISPR gRNA sequence
ctttggtattgtcacttagt

SEQ ID NO: 797850 - DNA, 20 bp, Artificial
  CRISPR gRNA sequence
tggtattgtcacttagtttt

SEQ ID NO: 797851 - DNA, 20 bp, Artificial
  CRISPR gRNA sequence
ggtattgtcacttagttttt

SEQ ID NO: 797852 - DNA, 20 bp, Artificial
  CRISPR gRNA sequence
gtattgtcacttagtttttg

SEQ ID NO: 797853 - DNA, 20 bp, Artificial
  CRISPR gRNA sequence
tcacttagtttttgagtgac

SEQ ID NO: 797854 - DNA, 20 bp, Artificial
  CRISPR gRNA sequence
agtttttgagtgactgccac

SEQ ID NO: 797855 - DNA, 20 bp, Artificial
  CRISPR gRNA sequence
gtttttgagtgactgccact

SEQ ID NO: 797856 - DNA, 20 bp, Artificial
  CRISPR gRNA sequence
ttgagtgactgccactattt

SEQ ID NO: 797857 - DNA, 20 bp, Artificial
  CRISPR gRNA sequence
tgagtgactgccactatttc

SEQ ID NO: 797858 - DNA, 20 bp, Artificial
  CRISPR gRNA sequence
gagtgactgccactatttcc

SEQ ID NO: 797859 - DNA, 20 bp, Artificial
  CRISPR gRNA sequence
agtgactgccactatttccc

SEQ ID NO: 797860 - DNA, 20 bp, Artificial
  CRISPR gRNA sequence
ccactatttcccgattggca

SEQ ID NO: 797861 - DNA, 20 bp, Artificial
  CRISPR gRNA sequence
tttcccgattggcagctctg

SEQ ID NO: 797862 - DNA, 20 bp, Artificial
  CRISPR gRNA sequence
cccgattggcagctctgcct

SEQ ID NO: 797863 - DNA, 20 bp, Artificial
  CRISPR gRNA sequence
ccgattggcagctctgcctg

SEQ ID NO: 797864 - DNA, 20 bp, Artificial
  CRISPR gRNA sequence
gcagctctgcctggcattaa

SEQ ID NO: 797865 - DNA, 20 bp, Artificial
  CRISPR gRNA sequence
tgcctggcattaagctcttg

SEQ ID NO: 797866 - DNA, 20 bp, Artificial
  CRISPR gRNA sequence
cctggcattaagctcttgac

SEQ ID NO: 797867 - DNA, 20 bp, Artificial
  CRISPR gRNA sequence
gcattaagctcttgacattc

SEQ ID NO: 797868 - DNA, 20 bp, Artificial
  CRISPR gRNA sequence
agctcttgacattctcaacc

SEQ ID NO: 797869 - DNA, 20 bp, Artificial
  CRISPR gRNA sequence
ttgacattctcaacctaagt

SEQ ID NO: 797870 - DNA, 20 bp, Artificial
  CRISPR gRNA sequence
gacattctcaacctaagtgt

SEQ ID NO: 797871 - DNA, 20 bp, Artificial
  CRISPR gRNA sequence
acattctcaacctaagtgtc

SEQ ID NO: 797872 - DNA, 20 bp, Artificial
  CRISPR gRNA sequence
tcaacctaagtgtccagcca

SEQ ID NO: 797873 - DNA, 20 bp, Artificial
  CRISPR gRNA sequence
aacctaagtgtccagccaag

SEQ ID NO: 797874 - DNA, 20 bp, Artificial
  CRISPR gRNA sequence
agtgtccagccaagttactc

SEQ ID NO: 797875 - DNA, 20 bp, Artificial
  CRISPR gRNA sequence
ctctgttcattgtcccctca

SEQ ID NO: 797876 - DNA, 20 bp, Artificial
  CRISPR gRNA sequence
tgttcattgtcccctcaaca

SEQ ID NO: 797877 - DNA, 20 bp, Artificial
  CRISPR gRNA sequence
ttcattgtcccctcaacacg

SEQ ID NO: 797878 - DNA, 20 bp, Artificial
  CRISPR gRNA sequence
attgtcccctcaacacgcct

SEQ ID NO: 797879 - DNA, 20 bp, Artificial
  CRISPR gRNA sequence
tcccctcaacacgcctgtgc

SEQ ID NO: 797880 - DNA, 20 bp, Artificial
  CRISPR gRNA sequence
aacacgcctgtgcatttgca

SEQ ID NO: 797881 - DNA, 20 bp, Artificial
  CRISPR gRNA sequence
tgcatttgcacctctgagac

SEQ ID NO: 797882 - DNA, 20 bp, Artificial
  CRISPR gRNA sequence
gcacctctgagactgcttct

SEQ ID NO: 797883 - DNA, 20 bp, Artificial
  CRISPR gRNA sequence
cacctctgagactgcttctg

SEQ ID NO: 797884 - DNA, 20 bp, Artificial
  CRISPR gRNA sequence
tgagactgcttctgagtcag

SEQ ID NO: 797885 - DNA, 20 bp, Artificial
  CRISPR gRNA sequence
agactgcttctgagtcagct

SEQ ID NO: 797886 - DNA, 20 bp, Artificial
  CRISPR gRNA sequence
cttctgagtcagctatgcac

SEQ ID NO: 797887 - DNA, 20 bp, Artificial
  CRISPR gRNA sequence
ctgagtcagctatgcactgc

SEQ ID NO: 797888 - DNA, 20 bp, Artificial
  CRISPR gRNA sequence
tgagtcagctatgcactgcc

SEQ ID NO: 797889 - DNA, 20 bp, Artificial
  CRISPR gRNA sequence
agtcagctatgcactgccct

SEQ ID NO: 797890 - DNA, 20 bp, Artificial
  CRISPR gRNA sequence
tgcactgccctttagaatag

SEQ ID NO: 797891 - DNA, 20 bp, Artificial
  CRISPR gRNA sequence
ccctttagaatagcttcaac

SEQ ID NO: 797892 - DNA, 20 bp, Artificial
  CRISPR gRNA sequence
tagaatagcttcaaccccaa

SEQ ID NO: 797893 - DNA, 20 bp, Artificial
  CRISPR gRNA sequence
agaatagcttcaaccccaaa

SEQ ID NO: 797894 - DNA, 20 bp, Artificial
  CRISPR gRNA sequence
gaatagcttcaaccccaaat

SEQ ID NO: 797895 - DNA, 20 bp, Artificial
  CRISPR gRNA sequence
caaccccaaatcctaccagt

SEQ ID NO: 797896 - DNA, 20 bp, Artificial
  CRISPR gRNA sequence
aaccccaaatcctaccagtg

SEQ ID NO: 797897 - DNA, 20 bp, Artificial
  CRISPR gRNA sequence
ccagtgcttcaaaggcccag

SEQ ID NO: 797898 - DNA, 20 bp, Artificial
  CRISPR gRNA sequence
caaaggcccagttcaaatcc

SEQ ID NO: 797899 - DNA, 20 bp, Artificial
  CRISPR gRNA sequence
aaaggcccagttcaaatcct

SEQ ID NO: 797900 - DNA, 20 bp, Artificial
  CRISPR gRNA sequence
aaatcctacccctctgggaa

SEQ ID NO: 797901 - DNA, 20 bp, Artificial
  CRISPR gRNA sequence
cccctctgggaagtctccct

SEQ ID NO: 797902 - DNA, 20 bp, Artificial
  CRISPR gRNA sequence
tgggaagtctcccttccttt

SEQ ID NO: 797903 - DNA, 20 bp, Artificial
  CRISPR gRNA sequence
ggaagtctcccttcctttag

SEQ ID NO: 797904 - DNA, 20 bp, Artificial
  CRISPR gRNA sequence
ccttcctttagtcaacttct

SEQ ID NO: 797905 - DNA, 20 bp, Artificial
  CRISPR gRNA sequence
cctttagtcaacttctaggg

SEQ ID NO: 797906 - DNA, 20 bp, Artificial
  CRISPR gRNA sequence
ctttagtcaacttctagggc

SEQ ID NO: 797907 - DNA, 20 bp, Artificial
  CRISPR gRNA sequence
tagtcaacttctagggcttt

SEQ ID NO: 797908 - DNA, 20 bp, Artificial
  CRISPR gRNA sequence
agtcaacttctagggctttt

SEQ ID NO: 797909 - DNA, 20 bp, Artificial
  CRISPR gRNA sequence
gtcaacttctagggcttttg

SEQ ID NO: 797910 - DNA, 20 bp, Artificial
  CRISPR gRNA sequence
ctagggcttttgcaatttta

SEQ ID NO: 797911 - DNA, 20 bp, Artificial
  CRISPR gRNA sequence
tagggcttttgcaattttat

SEQ ID NO: 797912 - DNA, 20 bp, Artificial
  CRISPR gRNA sequence
gggcttttgcaattttatca

SEQ ID NO: 797913 - DNA, 20 bp, Artificial
  CRISPR gRNA sequence
ttgcaattttatcacttgtt

SEQ ID NO: 797914 - DNA, 20 bp, Artificial
  CRISPR gRNA sequence
tgcaattttatcacttgttt

SEQ ID NO: 797915 - DNA, 20 bp, Artificial
  CRISPR gRNA sequence
gcaattttatcacttgtttt

SEQ ID NO: 797916 - DNA, 20 bp, Artificial
  CRISPR gRNA sequence
caattttatcacttgtttta

SEQ ID NO: 797917 - DNA, 20 bp, Artificial
  CRISPR gRNA sequence
tatcacttgttttacatcag

SEQ ID NO: 797918 - DNA, 20 bp, Artificial
  CRISPR gRNA sequence
atcacttgttttacatcagt

SEQ ID NO: 797919 - DNA, 20 bp, Artificial
  CRISPR gRNA sequence
tcacttgttttacatcagtt

SEQ ID NO: 797920 - DNA, 20 bp, Artificial
  CRISPR gRNA sequence
gttttacatcagttttacta

SEQ ID NO: 797921 - DNA, 20 bp, Artificial
  CRISPR gRNA sequence
ttttacatcagttttactat

SEQ ID NO: 797922 - DNA, 20 bp, Artificial
  CRISPR gRNA sequence
tacatcagttttactatttt

SEQ ID NO: 797923 - DNA, 20 bp, Artificial
  CRISPR gRNA sequence
acatcagttttactattttt

SEQ ID NO: 797924 - DNA, 20 bp, Artificial
  CRISPR gRNA sequence
catcagttttactatttttc

SEQ ID NO: 797925 - DNA, 20 bp, Artificial
  CRISPR gRNA sequence
tactatttttcatgtgtgag

SEQ ID NO: 797926 - DNA, 20 bp, Artificial
  CRISPR gRNA sequence
actatttttcatgtgtgaga

SEQ ID NO: 797927 - DNA, 20 bp, Artificial
  CRISPR gRNA sequence
ctatttttcatgtgtgagag

SEQ ID NO: 797928 - DNA, 20 bp, Artificial
  CRISPR gRNA sequence
tttttcatgtgtgagagttt

SEQ ID NO: 797929 - DNA, 20 bp, Artificial
  CRISPR gRNA sequence
ttcatgtgtgagagttttaa

SEQ ID NO: 797930 - DNA, 20 bp, Artificial
  CRISPR gRNA sequence
tcatgtgtgagagttttaac

SEQ ID NO: 797931 - DNA, 20 bp, Artificial
  CRISPR gRNA sequence
catgtgtgagagttttaacc

SEQ ID NO: 797932 - DNA, 20 bp, Artificial
  CRISPR gRNA sequence
atgtgtgagagttttaacct

SEQ ID NO: 797933 - DNA, 20 bp, Artificial
  CRISPR gRNA sequence
taaccttccaattatggtac

SEQ ID NO: 797934 - DNA, 20 bp, Artificial
  CRISPR gRNA sequence
aaccttccaattatggtaca

SEQ ID NO: 797935 - DNA, 20 bp, Artificial
  CRISPR gRNA sequence
accttccaattatggtacaa

SEQ ID NO: 797936 - DNA, 20 bp, Artificial
  CRISPR gRNA sequence
ccaattatggtacaatgtct

SEQ ID NO: 797937 - DNA, 20 bp, Artificial
  CRISPR gRNA sequence
caattatggtacaatgtctt

SEQ ID NO: 797938 - DNA, 20 bp, Artificial
  CRISPR gRNA sequence
tggtacaatgtctttaaggg

SEQ ID NO: 797939 - DNA, 20 bp, Artificial
  CRISPR gRNA sequence
taagggcaagggccctttct

SEQ ID NO: 797940 - DNA, 20 bp, Artificial
  CRISPR gRNA sequence
aagggcaagggccctttctt

SEQ ID NO: 797941 - DNA, 20 bp, Artificial
  CRISPR gRNA sequence
agggcaagggccctttctta

SEQ ID NO: 797942 - DNA, 20 bp, Artificial
  CRISPR gRNA sequence
tcttagaggaaaccctctat

SEQ ID NO: 797943 - DNA, 20 bp, Artificial
  CRISPR gRNA sequence
cttagaggaaaccctctatg

SEQ ID NO: 797944 - DNA, 20 bp, Artificial
  CRISPR gRNA sequence
ttagaggaaaccctctatga

SEQ ID NO: 797945 - DNA, 20 bp, Artificial
  CRISPR gRNA sequence
agaggaaaccctctatgaat

SEQ ID NO: 797946 - DNA, 20 bp, Artificial
  CRISPR gRNA sequence
gaggaaaccctctatgaatt

SEQ ID NO: 797947 - DNA, 20 bp, Artificial
  CRISPR gRNA sequence
tatgaattctccaatgataa

SEQ ID NO: 797948 - DNA, 20 bp, Artificial
  CRISPR gRNA sequence
tgaattctccaatgataaat

SEQ ID NO: 797949 - DNA, 20 bp, Artificial
  CRISPR gRNA sequence
tccaatgataaattattcta

SEQ ID NO: 797950 - DNA, 20 bp, Artificial
  CRISPR gRNA sequence
caatgataaattattctatg

SEQ ID NO: 797951 - DNA, 20 bp, Artificial
  CRISPR gRNA sequence
ttctatgaattctcacaact

SEQ ID NO: 797952 - DNA, 20 bp, Artificial
  CRISPR gRNA sequence
tatgaattctcacaactttc

SEQ ID NO: 797953 - DNA, 20 bp, Artificial
  CRISPR gRNA sequence
tgaattctcacaactttcta

SEQ ID NO: 797954 - DNA, 20 bp, Artificial
  CRISPR gRNA sequence
tcacaactttctaatataaa

SEQ ID NO: 797955 - DNA, 20 bp, Artificial
  CRISPR gRNA sequence
acaactttctaatataaagg

SEQ ID NO: 797956 - DNA, 20 bp, Artificial
  CRISPR gRNA sequence
tctaatataaaggcttataa

SEQ ID NO: 797957 - DNA, 20 bp, Artificial
  CRISPR gRNA sequence
ctaatataaaggcttataaa

SEQ ID NO: 797958 - DNA, 20 bp, Artificial
  CRISPR gRNA sequence
taatataaaggcttataaaa

SEQ ID NO: 797959 - DNA, 20 bp, Artificial
  CRISPR gRNA sequence
atataaaggcttataaaaag

SEQ ID NO: 797960 - DNA, 20 bp, Artificial
  CRISPR gRNA sequence
ataaaaagtgggaactcact

SEQ ID NO: 797961 - DNA, 20 bp, Artificial
  CRISPR gRNA sequence
taaaaagtgggaactcactg

SEQ ID NO: 797962 - DNA, 20 bp, Artificial
  CRISPR gRNA sequence
actgtttattgcttaaaaaa

SEQ ID NO: 797963 - DNA, 20 bp, Artificial
  CRISPR gRNA sequence
tttattgcttaaaaaattga

SEQ ID NO: 797964 - DNA, 20 bp, Artificial
  CRISPR gRNA sequence
attgcttaaaaaattgagat

SEQ ID NO: 797965 - DNA, 20 bp, Artificial
  CRISPR gRNA sequence
ttgcttaaaaaattgagatt

SEQ ID NO: 797966 - DNA, 20 bp, Artificial
  CRISPR gRNA sequence
cttaaaaaattgagatttaa

SEQ ID NO: 797967 - DNA, 20 bp, Artificial
  CRISPR gRNA sequence
aaaaaattgagatttaattt

SEQ ID NO: 797968 - DNA, 20 bp, Artificial
  CRISPR gRNA sequence
aaaaattgagatttaatttg

SEQ ID NO: 797969 - DNA, 20 bp, Artificial
  CRISPR gRNA sequence
agatttaatttgaacttaaa

SEQ ID NO: 797970 - DNA, 20 bp, Artificial
  CRISPR gRNA sequence
aatttgaacttaaatgctct

SEQ ID NO: 797971 - DNA, 20 bp, Artificial
  CRISPR gRNA sequence
atttgaacttaaatgctcta

SEQ ID NO: 797972 - DNA, 20 bp, Artificial
  CRISPR gRNA sequence
gaacttaaatgctctattaa

SEQ ID NO: 797973 - DNA, 20 bp, Artificial
  CRISPR gRNA sequence
aacttaaatgctctattaaa

SEQ ID NO: 797974 - DNA, 20 bp, Artificial
  CRISPR gRNA sequence
aaatgctctattaaattgag

SEQ ID NO: 797975 - DNA, 20 bp, Artificial
  CRISPR gRNA sequence
aatgctctattaaattgagt

SEQ ID NO: 797976 - DNA, 20 bp, Artificial
  CRISPR gRNA sequence
tattaaattgagtagaatag

SEQ ID NO: 797977 - DNA, 20 bp, Artificial
  CRISPR gRNA sequence
ttaaattgagtagaatagca

SEQ ID NO: 797978 - DNA, 20 bp, Artificial
  CRISPR gRNA sequence
aattgagtagaatagcatct

SEQ ID NO: 797979 - DNA, 20 bp, Artificial
  CRISPR gRNA sequence
agtagaatagcatcttaagg

SEQ ID NO: 797980 - DNA, 20 bp, Artificial
  CRISPR gRNA sequence
aaggctactggtagtctatc

SEQ ID NO: 797981 - DNA, 20 bp, Artificial
  CRISPR gRNA sequence
aggctactggtagtctatct

SEQ ID NO: 797982 - DNA, 20 bp, Artificial
  CRISPR gRNA sequence
ctggtagtctatctatgcca

SEQ ID NO: 797983 - DNA, 20 bp, Artificial
  CRISPR gRNA sequence
gtagtctatctatgccacag

SEQ ID NO: 797984 - DNA, 20 bp, Artificial
  CRISPR gRNA sequence
tctatgccacagatggttta

SEQ ID NO: 797985 - DNA, 20 bp, Artificial
  CRISPR gRNA sequence
tgccacagatggtttagaga

SEQ ID NO: 797986 - DNA, 20 bp, Artificial
  CRISPR gRNA sequence
agagatcaaataattactca

SEQ ID NO: 797987 - DNA, 20 bp, Artificial
  CRISPR gRNA sequence
gagatcaaataattactcat

SEQ ID NO: 797988 - DNA, 20 bp, Artificial
  CRISPR gRNA sequence
ctcatatacctatgacagca

SEQ ID NO: 797989 - DNA, 20 bp, Artificial
  CRISPR gRNA sequence
atatacctatgacagcagag

SEQ ID NO: 797990 - DNA, 20 bp, Artificial
  CRISPR gRNA sequence
tgacagcagagtactggctg

SEQ ID NO: 797991 - DNA, 20 bp, Artificial
  CRISPR gRNA sequence
gctgtaagatccccccaaaa

SEQ ID NO: 797992 - DNA, 20 bp, Artificial
  CRISPR gRNA sequence
taagatccccccaaaactca

SEQ ID NO: 797993 - DNA, 20 bp, Artificial
  CRISPR gRNA sequence
aaatacctattgggtttgtc

SEQ ID NO: 797994 - DNA, 20 bp, Artificial
  CRISPR gRNA sequence
ttgggtttgtcaggcaacaa

SEQ ID NO: 797995 - DNA, 20 bp, Artificial
  CRISPR gRNA sequence
ggtttgtcaggcaacaaaaa

SEQ ID NO: 797996 - DNA, 20 bp, Artificial
  CRISPR gRNA sequence
gtcaggcaacaaaaataagt

SEQ ID NO: 797997 - DNA, 20 bp, Artificial
  CRISPR gRNA sequence
tcaggcaacaaaaataagtg

SEQ ID NO: 797998 - DNA, 20 bp, Artificial
  CRISPR gRNA sequence
ggtctaatacaatggaaaat

SEQ ID NO: 797999 - DNA, 20 bp, Artificial
  CRISPR gRNA sequence
atacaatggaaaatggtagg

SEQ ID NO: 798000 - DNA, 20 bp, Artificial
  CRISPR gRNA sequence
gggcaaactctgcataactt

SEQ ID NO: 798001 - DNA, 20 bp, Artificial
  CRISPR gRNA sequence
tgcataacttgcccaaaggc

SEQ ID NO: 798002 - DNA, 20 bp, Artificial
  CRISPR gRNA sequence
cataacttgcccaaaggcat

SEQ ID NO: 798003 - DNA, 20 bp, Artificial
  CRISPR gRNA sequence
gcccaaaggcattcaaattc

SEQ ID NO: 798004 - DNA, 20 bp, Artificial
  CRISPR gRNA sequence
cccaaaggcattcaaattca

SEQ ID NO: 798005 - DNA, 20 bp, Artificial
  CRISPR gRNA sequence
aaattcagattatgttcaga

SEQ ID NO: 798006 - DNA, 20 bp, Artificial
  CRISPR gRNA sequence
agattatgttcagacattgc

SEQ ID NO: 798007 - DNA, 20 bp, Artificial
  CRISPR gRNA sequence
tgttcagacattgctaatta

SEQ ID NO: 798008 - DNA, 20 bp, Artificial
  CRISPR gRNA sequence
agacattgctaattacaatt

SEQ ID NO: 798009 - DNA, 20 bp, Artificial
  CRISPR gRNA sequence
ctaattacaattagtgtctt

SEQ ID NO: 798010 - DNA, 20 bp, Artificial
  CRISPR gRNA sequence
attacaattagtgtcttaga

SEQ ID NO: 798011 - DNA, 20 bp, Artificial
  CRISPR gRNA sequence
caattagtgtcttagacact

SEQ ID NO: 798012 - DNA, 20 bp, Artificial
  CRISPR gRNA sequence
gtgtcttagacacttggctt

SEQ ID NO: 798013 - DNA, 20 bp, Artificial
  CRISPR gRNA sequence
agacacttggcttcaaaaca

SEQ ID NO: 798014 - DNA, 20 bp, Artificial
  CRISPR gRNA sequence
gacacttggcttcaaaacag

SEQ ID NO: 798015 - DNA, 20 bp, Artificial
  CRISPR gRNA sequence
ggcttcaaaacagtggttag

SEQ ID NO: 798016 - DNA, 20 bp, Artificial
  CRISPR gRNA sequence
gcttcaaaacagtggttagt

SEQ ID NO: 798017 - DNA, 20 bp, Artificial
  CRISPR gRNA sequence
caaaacagtggttagttcag

SEQ ID NO: 798018 - DNA, 20 bp, Artificial
  CRISPR gRNA sequence
aaaacagtggttagttcagg

SEQ ID NO: 798019 - DNA, 20 bp, Artificial
  CRISPR gRNA sequence
gttcaggtatttcagatcaa

SEQ ID NO: 798020 - DNA, 20 bp, Artificial
  CRISPR gRNA sequence
aggtatttcagatcaattgg

SEQ ID NO: 798021 - DNA, 20 bp, Artificial
  CRISPR gRNA sequence
cagatcaattgggtatgcat

SEQ ID NO: 798022 - DNA, 20 bp, Artificial
  CRISPR gRNA sequence
agatcaattgggtatgcatt

SEQ ID NO: 798023 - DNA, 20 bp, Artificial
  CRISPR gRNA sequence
ggtatgcatttatctaggtc

SEQ ID NO: 798024 - DNA, 20 bp, Artificial
  CRISPR gRNA sequence
atctaggtcttcatggatag

SEQ ID NO: 798025 - DNA, 20 bp, Artificial
  CRISPR gRNA sequence
tctaggtcttcatggatagc

SEQ ID NO: 798026 - DNA, 20 bp, Artificial
  CRISPR gRNA sequence
ggtcttcatggatagccggg

SEQ ID NO: 798027 - DNA, 20 bp, Artificial
  CRISPR gRNA sequence
catggatagccgggctctac

SEQ ID NO: 798028 - DNA, 20 bp, Artificial
  CRISPR gRNA sequence
atggatagccgggctctact

SEQ ID NO: 798029 - DNA, 20 bp, Artificial
  CRISPR gRNA sequence
tactagacactgggagaggg

SEQ ID NO: 798030 - DNA, 20 bp, Artificial
  CRISPR gRNA sequence
ctagacactgggagagggaa

SEQ ID NO: 798031 - DNA, 20 bp, Artificial
  CRISPR gRNA sequence
gacactgggagagggaagag

SEQ ID NO: 798032 - DNA, 20 bp, Artificial
  CRISPR gRNA sequence
ggagagggaagaggcaaatg

SEQ ID NO: 798033 - DNA, 20 bp, Artificial
  CRISPR gRNA sequence
gcagtatttaacaaagaatg

SEQ ID NO: 798034 - DNA, 20 bp, Artificial
  CRISPR gRNA sequence
aacaaagaatgaagtatttt

SEQ ID NO: 798035 - DNA, 20 bp, Artificial
  CRISPR gRNA sequence
acaaagaatgaagtatttta

SEQ ID NO: 798036 - DNA, 20 bp, Artificial
  CRISPR gRNA sequence
tacaaacatgatcctttagg

SEQ ID NO: 798037 - DNA, 20 bp, Artificial
  CRISPR gRNA sequence
acaaacatgatcctttaggc

SEQ ID NO: 798038 - DNA, 20 bp, Artificial
  CRISPR gRNA sequence
caaacatgatcctttaggct

SEQ ID NO: 798039 - DNA, 20 bp, Artificial
  CRISPR gRNA sequence
taggctggttattgttacac

SEQ ID NO: 798040 - DNA, 20 bp, Artificial
  CRISPR gRNA sequence
aggctggttattgttacaca

SEQ ID NO: 798041 - DNA, 20 bp, Artificial
  CRISPR gRNA sequence
ggctggttattgttacacaa

SEQ ID NO: 798042 - DNA, 20 bp, Artificial
  CRISPR gRNA sequence
gttattgttacacaaaggaa

SEQ ID NO: 798043 - DNA, 20 bp, Artificial
  CRISPR gRNA sequence
ttgttacacaaaggaatgat

SEQ ID NO: 798044 - DNA, 20 bp, Artificial
  CRISPR gRNA sequence
ttacacaaaggaatgatttg

SEQ ID NO: 798045 - DNA, 20 bp, Artificial
  CRISPR gRNA sequence
cacaaaggaatgatttgcta

SEQ ID NO: 798046 - DNA, 20 bp, Artificial
  CRISPR gRNA sequence
gctaggattcttgagatact

SEQ ID NO: 798047 - DNA, 20 bp, Artificial
  CRISPR gRNA sequence
ctaggattcttgagatactt

SEQ ID NO: 798048 - DNA, 20 bp, Artificial
  CRISPR gRNA sequence
ggattcttgagatacttcca

SEQ ID NO: 798049 - DNA, 20 bp, Artificial
  CRISPR gRNA sequence
ttgagatacttccatagaat

SEQ ID NO: 798050 - DNA, 20 bp, Artificial
  CRISPR gRNA sequence
gagatacttccatagaatgt

SEQ ID NO: 798051 - DNA, 20 bp, Artificial
  CRISPR gRNA sequence
agatacttccatagaatgtc

SEQ ID NO: 798052 - DNA, 20 bp, Artificial
  CRISPR gRNA sequence
ccatagaatgtctatgcctc

SEQ ID NO: 798053 - DNA, 20 bp, Artificial
  CRISPR gRNA sequence
catagaatgtctatgcctca

SEQ ID NO: 798054 - DNA, 20 bp, Artificial
  CRISPR gRNA sequence
tgcctcacttattgcacaga

SEQ ID NO: 798055 - DNA, 20 bp, Artificial
  CRISPR gRNA sequence
acttattgcacagaccagag

SEQ ID NO: 798056 - DNA, 20 bp, Artificial
  CRISPR gRNA sequence
attgcacagaccagagaatt

SEQ ID NO: 798057 - DNA, 20 bp, Artificial
  CRISPR gRNA sequence
ttgcacagaccagagaattc

SEQ ID NO: 798058 - DNA, 20 bp, Artificial
  CRISPR gRNA sequence
cacagaccagagaattccat

SEQ ID NO: 798059 - DNA, 20 bp, Artificial
  CRISPR gRNA sequence
cataaaagcactggctgtgt

SEQ ID NO: 798060 - DNA, 20 bp, Artificial
  CRISPR gRNA sequence
gctgtgtcttatttaccctt

SEQ ID NO: 798061 - DNA, 20 bp, Artificial
  CRISPR gRNA sequence
tgtcttatttacccttgtat

SEQ ID NO: 798062 - DNA, 20 bp, Artificial
  CRISPR gRNA sequence
atttacccttgtatactaga

SEQ ID NO: 798063 - DNA, 20 bp, Artificial
  CRISPR gRNA sequence
tttacccttgtatactagag

SEQ ID NO: 798064 - DNA, 20 bp, Artificial
  CRISPR gRNA sequence
acccttgtatactagagctt

SEQ ID NO: 798065 - DNA, 20 bp, Artificial
  CRISPR gRNA sequence
cccttgtatactagagcttg

SEQ ID NO: 798066 - DNA, 20 bp, Artificial
  CRISPR gRNA sequence
gtatactagagcttggcaca

SEQ ID NO: 798067 - DNA, 20 bp, Artificial
  CRISPR gRNA sequence
tatactagagcttggcacat

SEQ ID NO: 798068 - DNA, 20 bp, Artificial
  CRISPR gRNA sequence
gagcttggcacatagtaaat

SEQ ID NO: 798069 - DNA, 20 bp, Artificial
  CRISPR gRNA sequence
ggcacatagtaaataccaag

SEQ ID NO: 798070 - DNA, 20 bp, Artificial
  CRISPR gRNA sequence
gcacatagtaaataccaagt

SEQ ID NO: 798071 - DNA, 20 bp, Artificial
  CRISPR gRNA sequence
tgaataaaagaaagagataa

SEQ ID NO: 798072 - DNA, 20 bp, Artificial
  CRISPR gRNA sequence
gaataaaagaaagagataat

SEQ ID NO: 798073 - DNA, 20 bp, Artificial
  CRISPR gRNA sequence
aataaaagaaagagataatt

SEQ ID NO: 798074 - DNA, 20 bp, Artificial
  CRISPR gRNA sequence
aagcttcagcaccacaatta

SEQ ID NO: 798075 - DNA, 20 bp, Artificial
  CRISPR gRNA sequence
cagcaccacaattatttgta

SEQ ID NO: 798076 - DNA, 20 bp, Artificial
  CRISPR gRNA sequence
agcaccacaattatttgtat

SEQ ID NO: 798077 - DNA, 20 bp, Artificial
  CRISPR gRNA sequence
tttgtatttcatctatcagt

SEQ ID NO: 798078 - DNA, 20 bp, Artificial
  CRISPR gRNA sequence
gtatttcatctatcagtttg

SEQ ID NO: 798079 - DNA, 20 bp, Artificial
  CRISPR gRNA sequence
tatttcatctatcagtttgg

SEQ ID NO: 798080 - DNA, 20 bp, Artificial
  CRISPR gRNA sequence
catctatcagtttggaaata

SEQ ID NO: 798081 - DNA, 20 bp, Artificial
  CRISPR gRNA sequence
atctatcagtttggaaatag

SEQ ID NO: 798082 - DNA, 20 bp, Artificial
  CRISPR gRNA sequence
tcagtttggaaatagatctc

SEQ ID NO: 798083 - DNA, 20 bp, Artificial
  CRISPR gRNA sequence
ggaaatagatctccacagac

SEQ ID NO: 798084 - DNA, 20 bp, Artificial
  CRISPR gRNA sequence
gaaatagatctccacagaca

SEQ ID NO: 798085 - DNA, 20 bp, Artificial
  CRISPR gRNA sequence
cacagacagtagaaatggca

SEQ ID NO: 798086 - DNA, 20 bp, Artificial
  CRISPR gRNA sequence
ggcctatagcaaccaagaag

SEQ ID NO: 798087 - DNA, 20 bp, Artificial
  CRISPR gRNA sequence
tagcaaccaagaagtgaaac

SEQ ID NO: 798088 - DNA, 20 bp, Artificial
  CRISPR gRNA sequence
ctagaacctaccatcatttc

SEQ ID NO: 798089 - DNA, 20 bp, Artificial
  CRISPR gRNA sequence
gaacctaccatcatttctga

SEQ ID NO: 798090 - DNA, 20 bp, Artificial
  CRISPR gRNA sequence
ccatcatttctgatcctctt

SEQ ID NO: 798091 - DNA, 20 bp, Artificial
  CRISPR gRNA sequence
ctgatcctcttgcaaatttt

SEQ ID NO: 798092 - DNA, 20 bp, Artificial
  CRISPR gRNA sequence
tgatcctcttgcaaattttg

SEQ ID NO: 798093 - DNA, 20 bp, Artificial
  CRISPR gRNA sequence
atcctcttgcaaattttgct

SEQ ID NO: 798094 - DNA, 20 bp, Artificial
  CRISPR gRNA sequence
ttgcaaattttgcttgaaaa

SEQ ID NO: 798095 - DNA, 20 bp, Artificial
  CRISPR gRNA sequence
gcaaattttgcttgaaaaaa

SEQ ID NO: 798096 - DNA, 20 bp, Artificial
  CRISPR gRNA sequence
caaattttgcttgaaaaaaa

SEQ ID NO: 798097 - DNA, 20 bp, Artificial
  CRISPR gRNA sequence
tgcttgaaaaaaatttcctc

SEQ ID NO: 798098 - DNA, 20 bp, Artificial
  CRISPR gRNA sequence
gcttgaaaaaaatttcctca

SEQ ID NO: 798099 - DNA, 20 bp, Artificial
  CRISPR gRNA sequence
cttgaaaaaaatttcctcat

SEQ ID NO: 798100 - DNA, 20 bp, Artificial
  CRISPR gRNA sequence
gaaaaaaatttcctcatttt

SEQ ID NO: 798101 - DNA, 20 bp, Artificial
  CRISPR gRNA sequence
aaaaaaatttcctcattttc

SEQ ID NO: 798102 - DNA, 20 bp, Artificial
  CRISPR gRNA sequence
cctcattttctgtttacgaa

SEQ ID NO: 798103 - DNA, 20 bp, Artificial
  CRISPR gRNA sequence
ctcattttctgtttacgaac

SEQ ID NO: 798104 - DNA, 20 bp, Artificial
  CRISPR gRNA sequence
attttctgtttacgaactta

SEQ ID NO: 798105 - DNA, 20 bp, Artificial
  CRISPR gRNA sequence
tctgtttacgaacttatcct

SEQ ID NO: 798106 - DNA, 20 bp, Artificial
  CRISPR gRNA sequence
ctgtttacgaacttatcctc

SEQ ID NO: 798107 - DNA, 20 bp, Artificial
  CRISPR gRNA sequence
tgtttacgaacttatcctca

SEQ ID NO: 798108 - DNA, 20 bp, Artificial
  CRISPR gRNA sequence
tttacgaacttatcctcaga

SEQ ID NO: 798109 - DNA, 20 bp, Artificial
  CRISPR gRNA sequence
acgaacttatcctcagaatt

SEQ ID NO: 798110 - DNA, 20 bp, Artificial
  CRISPR gRNA sequence
cgaacttatcctcagaattt

SEQ ID NO: 798111 - DNA, 20 bp, Artificial
  CRISPR gRNA sequence
atcctcagaatttacagatg

SEQ ID NO: 798112 - DNA, 20 bp, Artificial
  CRISPR gRNA sequence
tcctcagaatttacagatgt

SEQ ID NO: 798113 - DNA, 20 bp, Artificial
  CRISPR gRNA sequence
agaatttacagatgtttcct

SEQ ID NO: 798114 - DNA, 20 bp, Artificial
  CRISPR gRNA sequence
acagatgtttccttgatttc

SEQ ID NO: 798115 - DNA, 20 bp, Artificial
  CRISPR gRNA sequence
cagatgtttccttgatttct

SEQ ID NO: 798116 - DNA, 20 bp, Artificial
  CRISPR gRNA sequence
ccttgatttctctggaaaga

SEQ ID NO: 798117 - DNA, 20 bp, Artificial
  CRISPR gRNA sequence
cttgatttctctggaaagat

SEQ ID NO: 798118 - DNA, 20 bp, Artificial
  CRISPR gRNA sequence
gatttctctggaaagataca

SEQ ID NO: 798119 - DNA, 20 bp, Artificial
  CRISPR gRNA sequence
atttctctggaaagatacaa

SEQ ID NO: 798120 - DNA, 20 bp, Artificial
  CRISPR gRNA sequence
ctctggaaagatacaacttc

SEQ ID NO: 798121 - DNA, 20 bp, Artificial
  CRISPR gRNA sequence
tctggaaagatacaacttcc

SEQ ID NO: 798122 - DNA, 20 bp, Artificial
  CRISPR gRNA sequence
tggaaagatacaacttccta

SEQ ID NO: 798123 - DNA, 20 bp, Artificial
  CRISPR gRNA sequence
gaaagatacaacttcctaat

SEQ ID NO: 798124 - DNA, 20 bp, Artificial
  CRISPR gRNA sequence
cctaatgcaattgagtaaat

SEQ ID NO: 798125 - DNA, 20 bp, Artificial
  CRISPR gRNA sequence
ctaatgcaattgagtaaatt

SEQ ID NO: 798126 - DNA, 20 bp, Artificial
  CRISPR gRNA sequence
atgcaattgagtaaattgat

SEQ ID NO: 798127 - DNA, 20 bp, Artificial
  CRISPR gRNA sequence
agtaaattgatacttcttat

SEQ ID NO: 798128 - DNA, 20 bp, Artificial
  CRISPR gRNA sequence
atacttcttatgtagaaata

SEQ ID NO: 798129 - DNA, 20 bp, Artificial
  CRISPR gRNA sequence
cttatgtagaaataagcaga

SEQ ID NO: 798130 - DNA, 20 bp, Artificial
  CRISPR gRNA sequence
ttatgtagaaataagcagaa

SEQ ID NO: 798131 - DNA, 20 bp, Artificial
  CRISPR gRNA sequence
atgtagaaataagcagaata

SEQ ID NO: 798132 - DNA, 20 bp, Artificial
  CRISPR gRNA sequence
tgtagaaataagcagaataa

SEQ ID NO: 798133 - DNA, 20 bp, Artificial
  CRISPR gRNA sequence
ggcaaggtagcccacaacta

SEQ ID NO: 798134 - DNA, 20 bp, Artificial
  CRISPR gRNA sequence
tagtcccagctacttgggag

SEQ ID NO: 798135 - DNA, 20 bp, Artificial
  CRISPR gRNA sequence
cttgggaggctggggcagga

SEQ ID NO: 798136 - DNA, 20 bp, Artificial
  CRISPR gRNA sequence
gggaggctggggcaggagga

SEQ ID NO: 798137 - DNA, 20 bp, Artificial
  CRISPR gRNA sequence
ggaggctggggcaggaggat

SEQ ID NO: 798138 - DNA, 20 bp, Artificial
  CRISPR gRNA sequence
gggcaggaggatcacttgaa

SEQ ID NO: 798139 - DNA, 20 bp, Artificial
  CRISPR gRNA sequence
gaagccagagtttgcttgag

SEQ ID NO: 798140 - DNA, 20 bp, Artificial
  CRISPR gRNA sequence
aagccagagtttgcttgagg

SEQ ID NO: 798141 - DNA, 20 bp, Artificial
  CRISPR gRNA sequence
gcttgaggccaggaattcga

SEQ ID NO: 798142 - DNA, 20 bp, Artificial
  CRISPR gRNA sequence
cttgaggccaggaattcgag

SEQ ID NO: 798143 - DNA, 20 bp, Artificial
  CRISPR gRNA sequence
gaggccaggaattcgaggct

SEQ ID NO: 798144 - DNA, 20 bp, Artificial
  CRISPR gRNA sequence
aggccaggaattcgaggctg

SEQ ID NO: 798145 - DNA, 20 bp, Artificial
  CRISPR gRNA sequence
gaggctgcagtgctctatga

SEQ ID NO: 798146 - DNA, 20 bp, Artificial
  CRISPR gRNA sequence
cagtgctctatgatcacacc

SEQ ID NO: 798147 - DNA, 20 bp, Artificial
  CRISPR gRNA sequence
tatgatcacacctgtgaata

SEQ ID NO: 798148 - DNA, 20 bp, Artificial
  CRISPR gRNA sequence
tgatcacacctgtgaatagc

SEQ ID NO: 798149 - DNA, 20 bp, Artificial
  CRISPR gRNA sequence
tgaatagccactacactcca

SEQ ID NO: 798150 - DNA, 20 bp, Artificial
  CRISPR gRNA sequence
cactccaggctaggcaatga

SEQ ID NO: 798151 - DNA, 20 bp, Artificial
  CRISPR gRNA sequence
caggctaggcaatgagtgag

SEQ ID NO: 798152 - DNA, 20 bp, Artificial
  CRISPR gRNA sequence
ggcaatgagtgagacctagt

SEQ ID NO: 798153 - DNA, 20 bp, Artificial
  CRISPR gRNA sequence
gtctctaaagaaaaaaaaaa

SEQ ID NO: 798154 - DNA, 20 bp, Artificial
  CRISPR gRNA sequence
taaagaaaaaaaaaaaaaaa

SEQ ID NO: 798155 - DNA, 20 bp, Artificial
  CRISPR gRNA sequence
aagaaaaaaaaaaaaaaaaa

SEQ ID NO: 798156 - DNA, 20 bp, Artificial
  CRISPR gRNA sequence
agtatgaactgataaataca

SEQ ID NO: 798157 - DNA, 20 bp, Artificial
  CRISPR gRNA sequence
ataaatacaaggtagacaag

SEQ ID NO: 798158 - DNA, 20 bp, Artificial
  CRISPR gRNA sequence
agaggcgcaatcgttctgca

SEQ ID NO: 798159 - DNA, 20 bp, Artificial
  CRISPR gRNA sequence
tgcagacatttgcttgggaa

SEQ ID NO: 798160 - DNA, 20 bp, Artificial
  CRISPR gRNA sequence
cagacatttgcttgggaagc

SEQ ID NO: 798161 - DNA, 20 bp, Artificial
  CRISPR gRNA sequence
gcttgggaagctcaggggag

SEQ ID NO: 798162 - DNA, 20 bp, Artificial
  CRISPR gRNA sequence
cttgggaagctcaggggagg

SEQ ID NO: 798163 - DNA, 20 bp, Artificial
  CRISPR gRNA sequence
gggaagctcaggggaggatt

SEQ ID NO: 798164 - DNA, 20 bp, Artificial
  CRISPR gRNA sequence
ggaagctcaggggaggattt

SEQ ID NO: 798165 - DNA, 20 bp, Artificial
  CRISPR gRNA sequence
aggggaggatttatgaagga

SEQ ID NO: 798166 - DNA, 20 bp, Artificial
  CRISPR gRNA sequence
atgaaggaggtagccctgag

SEQ ID NO: 798167 - DNA, 20 bp, Artificial
  CRISPR gRNA sequence
tgaaggaggtagccctgagt

SEQ ID NO: 798168 - DNA, 20 bp, Artificial
  CRISPR gRNA sequence
agtgagtcttaaaaaatggg

SEQ ID NO: 798169 - DNA, 20 bp, Artificial
  CRISPR gRNA sequence
aaaaaatgggtagactttta

SEQ ID NO: 798170 - DNA, 20 bp, Artificial
  CRISPR gRNA sequence
aaaaatgggtagacttttac

SEQ ID NO: 798171 - DNA, 20 bp, Artificial
  CRISPR gRNA sequence
ttaccaggcaagatcttagt

SEQ ID NO: 798172 - DNA, 20 bp, Artificial
  CRISPR gRNA sequence
taccaggcaagatcttagtg

SEQ ID NO: 798173 - DNA, 20 bp, Artificial
  CRISPR gRNA sequence
accaggcaagatcttagtga

SEQ ID NO: 798174 - DNA, 20 bp, Artificial
  CRISPR gRNA sequence
ccaggcaagatcttagtgaa

SEQ ID NO: 798175 - DNA, 20 bp, Artificial
  CRISPR gRNA sequence
agtgaagttagtgagaggag

SEQ ID NO: 798176 - DNA, 20 bp, Artificial
  CRISPR gRNA sequence
gtgaagttagtgagaggagt

SEQ ID NO: 798177 - DNA, 20 bp, Artificial
  CRISPR gRNA sequence
gtgagaggagtggtcatata

SEQ ID NO: 798178 - DNA, 20 bp, Artificial
  CRISPR gRNA sequence
atgggatttttagaccaaag

SEQ ID NO: 798179 - DNA, 20 bp, Artificial
  CRISPR gRNA sequence
ttagaccaaagattaccacc

SEQ ID NO: 798180 - DNA, 20 bp, Artificial
  CRISPR gRNA sequence
tagaccaaagattaccaccc

SEQ ID NO: 798181 - DNA, 20 bp, Artificial
  CRISPR gRNA sequence
agaccaaagattaccaccct

SEQ ID NO: 798182 - DNA, 20 bp, Artificial
  CRISPR gRNA sequence
gaccaaagattaccaccctc

SEQ ID NO: 798183 - DNA, 20 bp, Artificial
  CRISPR gRNA sequence
ccaccctcataagtgataat

SEQ ID NO: 798184 - DNA, 20 bp, Artificial
  CRISPR gRNA sequence
ataagtgataatgacgatga

SEQ ID NO: 798185 - DNA, 20 bp, Artificial
  CRISPR gRNA sequence
accacttgcaaagtattttt

SEQ ID NO: 798186 - DNA, 20 bp, Artificial
  CRISPR gRNA sequence
ccacttgcaaagtatttttc

SEQ ID NO: 798187 - DNA, 20 bp, Artificial
  CRISPR gRNA sequence
gcaaagtatttttcacatac

SEQ ID NO: 798188 - DNA, 20 bp, Artificial
  CRISPR gRNA sequence
caaagtatttttcacatacc

SEQ ID NO: 798189 - DNA, 20 bp, Artificial
  CRISPR gRNA sequence
ttcacataccttgtccaagt

SEQ ID NO: 798190 - DNA, 20 bp, Artificial
  CRISPR gRNA sequence
tcacataccttgtccaagtt

SEQ ID NO: 798191 - DNA, 20 bp, Artificial
  CRISPR gRNA sequence
cacataccttgtccaagttc

SEQ ID NO: 798192 - DNA, 20 bp, Artificial
  CRISPR gRNA sequence
acataccttgtccaagttcc

SEQ ID NO: 798193 - DNA, 20 bp, Artificial
  CRISPR gRNA sequence
gtccaagttcccacaagcat

SEQ ID NO: 798194 - DNA, 20 bp, Artificial
  CRISPR gRNA sequence
tccaagttcccacaagcatt

SEQ ID NO: 798195 - DNA, 20 bp, Artificial
  CRISPR gRNA sequence
ccacaagcatttctgttcac

SEQ ID NO: 798196 - DNA, 20 bp, Artificial
  CRISPR gRNA sequence
ctgttcactacctgtggttt

SEQ ID NO: 798197 - DNA, 20 bp, Artificial
  CRISPR gRNA sequence
tgttcactacctgtggtttg

SEQ ID NO: 798198 - DNA, 20 bp, Artificial
  CRISPR gRNA sequence
ttcactacctgtggtttggt

SEQ ID NO: 798199 - DNA, 20 bp, Artificial
  CRISPR gRNA sequence
actacctgtggtttggtcaa

SEQ ID NO: 798200 - DNA, 20 bp, Artificial
  CRISPR gRNA sequence
cctgtggtttggtcaagaga

SEQ ID NO: 798201 - DNA, 20 bp, Artificial
  CRISPR gRNA sequence
tggtttggtcaagagaccca

SEQ ID NO: 798202 - DNA, 20 bp, Artificial
  CRISPR gRNA sequence
ggtcaagagacccagatatt

SEQ ID NO: 798203 - DNA, 20 bp, Artificial
  CRISPR gRNA sequence
gtcaagagacccagatatta

SEQ ID NO: 798204 - DNA, 20 bp, Artificial
  CRISPR gRNA sequence
gagaacgtgttgatttctag

SEQ ID NO: 798205 - DNA, 20 bp, Artificial
  CRISPR gRNA sequence
atttctagtttctaactccg

SEQ ID NO: 798206 - DNA, 20 bp, Artificial
  CRISPR gRNA sequence
ctagtttctaactccgccca

SEQ ID NO: 798207 - DNA, 20 bp, Artificial
  CRISPR gRNA sequence
tagtttctaactccgcccaa

SEQ ID NO: 798208 - DNA, 20 bp, Artificial
  CRISPR gRNA sequence
gtttctaactccgcccaata

SEQ ID NO: 798209 - DNA, 20 bp, Artificial
  CRISPR gRNA sequence
ctaactccgcccaataacat

SEQ ID NO: 798210 - DNA, 20 bp, Artificial
  CRISPR gRNA sequence
taactccgcccaataacatt

SEQ ID NO: 798211 - DNA, 20 bp, Artificial
  CRISPR gRNA sequence
actccgcccaataacattaa

SEQ ID NO: 798212 - DNA, 20 bp, Artificial
  CRISPR gRNA sequence
cgcccaataacattaagatg

SEQ ID NO: 798213 - DNA, 20 bp, Artificial
  CRISPR gRNA sequence
agatgaaaatggatagccac

SEQ ID NO: 798214 - DNA, 20 bp, Artificial
  CRISPR gRNA sequence
agaaaacacaagtgaatttt

SEQ ID NO: 798215 - DNA, 20 bp, Artificial
  CRISPR gRNA sequence
gaaaacacaagtgaatttta

SEQ ID NO: 798216 - DNA, 20 bp, Artificial
  CRISPR gRNA sequence
taaaaggggagacttaagag

SEQ ID NO: 798217 - DNA, 20 bp, Artificial
  CRISPR gRNA sequence
aaaaggggagacttaagagg

SEQ ID NO: 798218 - DNA, 20 bp, Artificial
  CRISPR gRNA sequence
aaaggggagacttaagaggt

SEQ ID NO: 798219 - DNA, 20 bp, Artificial
  CRISPR gRNA sequence
aagaggtggcatggttgttt

SEQ ID NO: 798220 - DNA, 20 bp, Artificial
  CRISPR gRNA sequence
agaggtggcatggttgtttg

SEQ ID NO: 798221 - DNA, 20 bp, Artificial
  CRISPR gRNA sequence
tttgaacatgttcgtttttg

SEQ ID NO: 798222 - DNA, 20 bp, Artificial
  CRISPR gRNA sequence
gaacatgttcgtttttgtct

SEQ ID NO: 798223 - DNA, 20 bp, Artificial
  CRISPR gRNA sequence
aacatgttcgtttttgtctc

SEQ ID NO: 798224 - DNA, 20 bp, Artificial
  CRISPR gRNA sequence
gtttttgtctcctggagaaa

SEQ ID NO: 798225 - DNA, 20 bp, Artificial
  CRISPR gRNA sequence
ttgtctcctggagaaaagtc

SEQ ID NO: 798226 - DNA, 20 bp, Artificial
  CRISPR gRNA sequence
tgtctcctggagaaaagtca

SEQ ID NO: 798227 - DNA, 20 bp, Artificial
  CRISPR gRNA sequence
gtctcctggagaaaagtcag

SEQ ID NO: 798228 - DNA, 20 bp, Artificial
  CRISPR gRNA sequence
tctcctggagaaaagtcagc

SEQ ID NO: 798229 - DNA, 20 bp, Artificial
  CRISPR gRNA sequence
ctggagaaaagtcagcacaa

SEQ ID NO: 798230 - DNA, 20 bp, Artificial
  CRISPR gRNA sequence
gagaaaagtcagcacaatgc

SEQ ID NO: 798231 - DNA, 20 bp, Artificial
  CRISPR gRNA sequence
attcagctacataagtgttt

SEQ ID NO: 798232 - DNA, 20 bp, Artificial
  CRISPR gRNA sequence
agctacataagtgtttctgt

SEQ ID NO: 798233 - DNA, 20 bp, Artificial
  CRISPR gRNA sequence
cataagtgtttctgttacag

SEQ ID NO: 798234 - DNA, 20 bp, Artificial
  CRISPR gRNA sequence
ctgttacagctctttcagtc

SEQ ID NO: 798235 - DNA, 20 bp, Artificial
  CRISPR gRNA sequence
tgttacagctctttcagtcc

SEQ ID NO: 798236 - DNA, 20 bp, Artificial
  CRISPR gRNA sequence
ttacagctctttcagtccac

SEQ ID NO: 798237 - DNA, 20 bp, Artificial
  CRISPR gRNA sequence
cagctctttcagtccaccat

SEQ ID NO: 798238 - DNA, 20 bp, Artificial
  CRISPR gRNA sequence
tttcagtccaccattcggca

SEQ ID NO: 798239 - DNA, 20 bp, Artificial
  CRISPR gRNA sequence
tcagtccaccattcggcagg

SEQ ID NO: 798240 - DNA, 20 bp, Artificial
  CRISPR gRNA sequence
cagtccaccattcggcaggt

SEQ ID NO: 798241 - DNA, 20 bp, Artificial
  CRISPR gRNA sequence
agtccaccattcggcaggtc

SEQ ID NO: 798242 - DNA, 20 bp, Artificial
  CRISPR gRNA sequence
ggcaggtcctgaattcttgt

SEQ ID NO: 798243 - DNA, 20 bp, Artificial
  CRISPR gRNA sequence
aattcttgtcccttgtccag

SEQ ID NO: 798244 - DNA, 20 bp, Artificial
  CRISPR gRNA sequence
ttgtcccttgtccagaaaaa

SEQ ID NO: 798245 - DNA, 20 bp, Artificial
  CRISPR gRNA sequence
gtcccttgtccagaaaaaat

SEQ ID NO: 798246 - DNA, 20 bp, Artificial
  CRISPR gRNA sequence
tcccttgtccagaaaaaatg

SEQ ID NO: 798247 - DNA, 20 bp, Artificial
  CRISPR gRNA sequence
gtccagaaaaaatgaggtat

SEQ ID NO: 798248 - DNA, 20 bp, Artificial
  CRISPR gRNA sequence
tccagaaaaaatgaggtatg

SEQ ID NO: 798249 - DNA, 20 bp, Artificial
  CRISPR gRNA sequence
gagggtgagcaaggcggaga

SEQ ID NO: 798250 - DNA, 20 bp, Artificial
  CRISPR gRNA sequence
cgttgagtgacagaacagct

SEQ ID NO: 798251 - DNA, 20 bp, Artificial
  CRISPR gRNA sequence
gttgagtgacagaacagctt

SEQ ID NO: 798252 - DNA, 20 bp, Artificial
  CRISPR gRNA sequence
agtgacagaacagctttcag

SEQ ID NO: 798253 - DNA, 20 bp, Artificial
  CRISPR gRNA sequence
tcaggagacccaaagtgggt

SEQ ID NO: 798254 - DNA, 20 bp, Artificial
  CRISPR gRNA sequence
caggagacccaaagtgggta

SEQ ID NO: 798255 - DNA, 20 bp, Artificial
  CRISPR gRNA sequence
aggagacccaaagtgggtag

SEQ ID NO: 798256 - DNA, 20 bp, Artificial
  CRISPR gRNA sequence
ttccataggcaggaaatgag

SEQ ID NO: 798257 - DNA, 20 bp, Artificial
  CRISPR gRNA sequence
tccataggcaggaaatgagt

SEQ ID NO: 798258 - DNA, 20 bp, Artificial
  CRISPR gRNA sequence
ccataggcaggaaatgagtg

SEQ ID NO: 798259 - DNA, 20 bp, Artificial
  CRISPR gRNA sequence
cataggcaggaaatgagtgt

SEQ ID NO: 798260 - DNA, 20 bp, Artificial
  CRISPR gRNA sequence
aactctcagcagagaggaga

SEQ ID NO: 798261 - DNA, 20 bp, Artificial
  CRISPR gRNA sequence
tcagcagagaggagacccac

SEQ ID NO: 798262 - DNA, 20 bp, Artificial
  CRISPR gRNA sequence
agcagagaggagacccacaa

SEQ ID NO: 798263 - DNA, 20 bp, Artificial
  CRISPR gRNA sequence
cttaccacaggcaggtcatc

SEQ ID NO: 798264 - DNA, 20 bp, Artificial
  CRISPR gRNA sequence
accacaggcaggtcatccca

SEQ ID NO: 798265 - DNA, 20 bp, Artificial
  CRISPR gRNA sequence
ccacaggcaggtcatcccag

SEQ ID NO: 798266 - DNA, 20 bp, Artificial
  CRISPR gRNA sequence
acgcctgtaatcccagcact

SEQ ID NO: 798267 - DNA, 20 bp, Artificial
  CRISPR gRNA sequence
taatcccagcactttgggag

SEQ ID NO: 798268 - DNA, 20 bp, Artificial
  CRISPR gRNA sequence
tgggaggccgaggcgggtgg

SEQ ID NO: 798269 - DNA, 20 bp, Artificial
  CRISPR gRNA sequence
gggaggccgaggcgggtgga

SEQ ID NO: 798270 - DNA, 20 bp, Artificial
  CRISPR gRNA sequence
ggaggccgaggcgggtggat

SEQ ID NO: 798271 - DNA, 20 bp, Artificial
  CRISPR gRNA sequence
gagaccagcttggccaagat

SEQ ID NO: 798272 - DNA, 20 bp, Artificial
  CRISPR gRNA sequence
ggccaagatggtgaaactcc

SEQ ID NO: 798273 - DNA, 20 bp, Artificial
  CRISPR gRNA sequence
gccaagatggtgaaactcca

SEQ ID NO: 798274 - DNA, 20 bp, Artificial
  CRISPR gRNA sequence
catctctactaaaaatatga

SEQ ID NO: 798275 - DNA, 20 bp, Artificial
  CRISPR gRNA sequence
tactaaaaatatgaaaaatt

SEQ ID NO: 798276 - DNA, 20 bp, Artificial
  CRISPR gRNA sequence
ctaaaaatatgaaaaattag

SEQ ID NO: 798277 - DNA, 20 bp, Artificial
  CRISPR gRNA sequence
aaaatatgaaaaattagcca

SEQ ID NO: 798278 - DNA, 20 bp, Artificial
  CRISPR gRNA sequence
gccaggtgcagttgtgcacg

SEQ ID NO: 798279 - DNA, 20 bp, Artificial
  CRISPR gRNA sequence
tgcacgcctgttgtcccagt

SEQ ID NO: 798280 - DNA, 20 bp, Artificial
  CRISPR gRNA sequence
ttgtcccagttactcaggag

SEQ ID NO: 798281 - DNA, 20 bp, Artificial
  CRISPR gRNA sequence
tcccagttactcaggaggct

SEQ ID NO: 798282 - DNA, 20 bp, Artificial
  CRISPR gRNA sequence
ctcaggaggctgaggcagga

SEQ ID NO: 798283 - DNA, 20 bp, Artificial
  CRISPR gRNA sequence
aggaggctgaggcaggagaa

SEQ ID NO: 798284 - DNA, 20 bp, Artificial
  CRISPR gRNA sequence
aggcaggagaatcacttgaa

SEQ ID NO: 798285 - DNA, 20 bp, Artificial
  CRISPR gRNA sequence
gaacccgggaggcggaggat

SEQ ID NO: 798286 - DNA, 20 bp, Artificial
  CRISPR gRNA sequence
aacccgggaggcggaggatg

SEQ ID NO: 798287 - DNA, 20 bp, Artificial
  CRISPR gRNA sequence
cactccagcctgggtgagag

SEQ ID NO: 798288 - DNA, 20 bp, Artificial
  CRISPR gRNA sequence
cagcctgggtgagagagcaa

SEQ ID NO: 798289 - DNA, 20 bp, Artificial
  CRISPR gRNA sequence
ggtgagagagcaagactcca

SEQ ID NO: 798290 - DNA, 20 bp, Artificial
  CRISPR gRNA sequence
catctcaaaaaaaaaaaaaa

SEQ ID NO: 798291 - DNA, 20 bp, Artificial
  CRISPR gRNA sequence
aaaaaaaaaaaaaaaaaaaa

SEQ ID NO: 798292 - DNA, 20 bp, Artificial
  CRISPR gRNA sequence
aagtgagcaactgcttcccc

SEQ ID NO: 798293 - DNA, 20 bp, Artificial
  CRISPR gRNA sequence
cttcccctagctggtagtcc

SEQ ID NO: 798294 - DNA, 20 bp, Artificial
  CRISPR gRNA sequence
cccctagctggtagtcccaa

SEQ ID NO: 798295 - DNA, 20 bp, Artificial
  CRISPR gRNA sequence
ccctagctggtagtcccaat

SEQ ID NO: 798296 - DNA, 20 bp, Artificial
  CRISPR gRNA sequence
gctggtagtcccaatgtctg

SEQ ID NO: 798297 - DNA, 20 bp, Artificial
  CRISPR gRNA sequence
gtagtcccaatgtctgttca

SEQ ID NO: 798298 - DNA, 20 bp, Artificial
  CRISPR gRNA sequence
ttcaagtctggctgagtcca

SEQ ID NO: 798299 - DNA, 20 bp, Artificial
  CRISPR gRNA sequence
aagtctggctgagtccaggg

SEQ ID NO: 798300 - DNA, 20 bp, Artificial
  CRISPR gRNA sequence
gctgagtccagggttttgtg

SEQ ID NO: 798301 - DNA, 20 bp, Artificial
  CRISPR gRNA sequence
agtccagggttttgtgtttg

SEQ ID NO: 798302 - DNA, 20 bp, Artificial
  CRISPR gRNA sequence
tgtgtttgtttgttttgttt

SEQ ID NO: 798303 - DNA, 20 bp, Artificial
  CRISPR gRNA sequence
gtgtttgtttgttttgtttt

SEQ ID NO: 798304 - DNA, 20 bp, Artificial
  CRISPR gRNA sequence
tgtttgtttgttttgttttt

SEQ ID NO: 798305 - DNA, 20 bp, Artificial
  CRISPR gRNA sequence
gtttgttttgtttttttgag

SEQ ID NO: 798306 - DNA, 20 bp, Artificial
  CRISPR gRNA sequence
tttgttttgtttttttgaga

SEQ ID NO: 798307 - DNA, 20 bp, Artificial
  CRISPR gRNA sequence
gttttgtttttttgagacgg

SEQ ID NO: 798308 - DNA, 20 bp, Artificial
  CRISPR gRNA sequence
ttttgtttttttgagacgga

SEQ ID NO: 798309 - DNA, 20 bp, Artificial
  CRISPR gRNA sequence
tgtttttttgagacggagtc

SEQ ID NO: 798310 - DNA, 20 bp, Artificial
  CRISPR gRNA sequence
gtttttttgagacggagtct

SEQ ID NO: 798311 - DNA, 20 bp, Artificial
  CRISPR gRNA sequence
tttttttgagacggagtctc

SEQ ID NO: 798312 - DNA, 20 bp, Artificial
  CRISPR gRNA sequence
ttttgagacggagtctcact

SEQ ID NO: 798313 - DNA, 20 bp, Artificial
  CRISPR gRNA sequence
tttgagacggagtctcactc

SEQ ID NO: 798314 - DNA, 20 bp, Artificial
  CRISPR gRNA sequence
ttgagacggagtctcactct

SEQ ID NO: 798315 - DNA, 20 bp, Artificial
  CRISPR gRNA sequence
tgagacggagtctcactctg

SEQ ID NO: 798316 - DNA, 20 bp, Artificial
  CRISPR gRNA sequence
gagacggagtctcactctgt

SEQ ID NO: 798317 - DNA, 20 bp, Artificial
  CRISPR gRNA sequence
agacggagtctcactctgtc

SEQ ID NO: 798318 - DNA, 20 bp, Artificial
  CRISPR gRNA sequence
actctgtcaccagggctgga

SEQ ID NO: 798319 - DNA, 20 bp, Artificial
  CRISPR gRNA sequence
tgtcaccagggctggagtgc

SEQ ID NO: 798320 - DNA, 20 bp, Artificial
  CRISPR gRNA sequence
tcaccagggctggagtgcag

SEQ ID NO: 798321 - DNA, 20 bp, Artificial
  CRISPR gRNA sequence
gagtgcagtggcgcaatctc

SEQ ID NO: 798322 - DNA, 20 bp, Artificial
  CRISPR gRNA sequence
ggctcactgcaacctctgcc

SEQ ID NO: 798323 - DNA, 20 bp, Artificial
  CRISPR gRNA sequence
actgcaacctctgcctcccg

SEQ ID NO: 798324 - DNA, 20 bp, Artificial
  CRISPR gRNA sequence
caacctctgcctcccgggtt

SEQ ID NO: 798325 - DNA, 20 bp, Artificial
  CRISPR gRNA sequence
tgcctcccgggttcaagcga

SEQ ID NO: 798326 - DNA, 20 bp, Artificial
  CRISPR gRNA sequence
cctcccgggttcaagcgatt

SEQ ID NO: 798327 - DNA, 20 bp, Artificial
  CRISPR gRNA sequence
ccgggttcaagcgattctcc

SEQ ID NO: 798328 - DNA, 20 bp, Artificial
  CRISPR gRNA sequence
aagcgattctcctgcttcag

SEQ ID NO: 798329 - DNA, 20 bp, Artificial
  CRISPR gRNA sequence
tcctgcttcagcctcccgag

SEQ ID NO: 798330 - DNA, 20 bp, Artificial
  CRISPR gRNA sequence
ctgcttcagcctcccgagta

SEQ ID NO: 798331 - DNA, 20 bp, Artificial
  CRISPR gRNA sequence
cttcagcctcccgagtagct

SEQ ID NO: 798332 - DNA, 20 bp, Artificial
  CRISPR gRNA sequence
cagcctcccgagtagctggt

SEQ ID NO: 798333 - DNA, 20 bp, Artificial
  CRISPR gRNA sequence
agcctcccgagtagctggta

SEQ ID NO: 798334 - DNA, 20 bp, Artificial
  CRISPR gRNA sequence
ccgagtagctggtattacag

SEQ ID NO: 798335 - DNA, 20 bp, Artificial
  CRISPR gRNA sequence
gtattacagacacccaccac

SEQ ID NO: 798336 - DNA, 20 bp, Artificial
  CRISPR gRNA sequence
cagacacccaccactacatc

SEQ ID NO: 798337 - DNA, 20 bp, Artificial
  CRISPR gRNA sequence
catccagctaattttttgta

SEQ ID NO: 798338 - DNA, 20 bp, Artificial
  CRISPR gRNA sequence
attttttgtatttttagtag

SEQ ID NO: 798339 - DNA, 20 bp, Artificial
  CRISPR gRNA sequence
tttgtatttttagtagagac

SEQ ID NO: 798340 - DNA, 20 bp, Artificial
  CRISPR gRNA sequence
ttgtatttttagtagagacg

SEQ ID NO: 798341 - DNA, 20 bp, Artificial
  CRISPR gRNA sequence
tgtatttttagtagagacgg

SEQ ID NO: 798342 - DNA, 20 bp, Artificial
  CRISPR gRNA sequence
gtatttttagtagagacggg

SEQ ID NO: 798343 - DNA, 20 bp, Artificial
  CRISPR gRNA sequence
tatttttagtagagacgggg

SEQ ID NO: 798344 - DNA, 20 bp, Artificial
  CRISPR gRNA sequence
ttagtagagacggggtttcg

SEQ ID NO: 798345 - DNA, 20 bp, Artificial
  CRISPR gRNA sequence
tagtagagacggggtttcgc

SEQ ID NO: 798346 - DNA, 20 bp, Artificial
  CRISPR gRNA sequence
agtagagacggggtttcgcc

SEQ ID NO: 798347 - DNA, 20 bp, Artificial
  CRISPR gRNA sequence
gtagagacggggtttcgcca

SEQ ID NO: 798348 - DNA, 20 bp, Artificial
  CRISPR gRNA sequence
cgccatgttggccaggctgg

SEQ ID NO: 798349 - DNA, 20 bp, Artificial
  CRISPR gRNA sequence
gccatgttggccaggctggt

SEQ ID NO: 798350 - DNA, 20 bp, Artificial
  CRISPR gRNA sequence
gccaggctggtctcaaactc

SEQ ID NO: 798351 - DNA, 20 bp, Artificial
  CRISPR gRNA sequence
gtctcaaactcctgacctcg

SEQ ID NO: 798352 - DNA, 20 bp, Artificial
  CRISPR gRNA sequence
aaactcctgacctcgtgatt

SEQ ID NO: 798353 - DNA, 20 bp, Artificial
  CRISPR gRNA sequence
ctgacctcgtgattttcctg

SEQ ID NO: 798354 - DNA, 20 bp, Artificial
  CRISPR gRNA sequence
acctcgtgattttcctgcct

SEQ ID NO: 798355 - DNA, 20 bp, Artificial
  CRISPR gRNA sequence
gtgattttcctgcctcggcc

SEQ ID NO: 798356 - DNA, 20 bp, Artificial
  CRISPR gRNA sequence
tcctgcctcggcctcccaag

SEQ ID NO: 798357 - DNA, 20 bp, Artificial
  CRISPR gRNA sequence
cctgcctcggcctcccaagt

SEQ ID NO: 798358 - DNA, 20 bp, Artificial
  CRISPR gRNA sequence
ctgcctcggcctcccaagtg

SEQ ID NO: 798359 - DNA, 20 bp, Artificial
  CRISPR gRNA sequence
cctcggcctcccaagtgctg

SEQ ID NO: 798360 - DNA, 20 bp, Artificial
  CRISPR gRNA sequence
ggcctcccaagtgctgggat

SEQ ID NO: 798361 - DNA, 20 bp, Artificial
  CRISPR gRNA sequence
ccaagtgctgggattacagg

SEQ ID NO: 798362 - DNA, 20 bp, Artificial
  CRISPR gRNA sequence
ggattacaggcatgagccac

SEQ ID NO: 798363 - DNA, 20 bp, Artificial
  CRISPR gRNA sequence
caggcatgagccactgagcc

SEQ ID NO: 798364 - DNA, 20 bp, Artificial
  CRISPR gRNA sequence
agcccggtcgagtccagggt

SEQ ID NO: 798365 - DNA, 20 bp, Artificial
  CRISPR gRNA sequence
ttacaggctcagaagggagg

SEQ ID NO: 798366 - DNA, 20 bp, Artificial
  CRISPR gRNA sequence
tacaggctcagaagggagga

SEQ ID NO: 798367 - DNA, 20 bp, Artificial
  CRISPR gRNA sequence
acaggctcagaagggaggaa

SEQ ID NO: 798368 - DNA, 20 bp, Artificial
  CRISPR gRNA sequence
caggctcagaagggaggaag

SEQ ID NO: 798369 - DNA, 20 bp, Artificial
  CRISPR gRNA sequence
agaagggaggaagagtgtgc

SEQ ID NO: 798370 - DNA, 20 bp, Artificial
  CRISPR gRNA sequence
attggcccatgggcagccat

SEQ ID NO: 798371 - DNA, 20 bp, Artificial
  CRISPR gRNA sequence
gcccatgggcagccatggaa

SEQ ID NO: 798372 - DNA, 20 bp, Artificial
  CRISPR gRNA sequence
taagttcttaccccaggctg

SEQ ID NO: 798373 - DNA, 20 bp, Artificial
  CRISPR gRNA sequence
ttaccccaggctgtggactc

SEQ ID NO: 798374 - DNA, 20 bp, Artificial
  CRISPR gRNA sequence
accccaggctgtggactcca

SEQ ID NO: 798375 - DNA, 20 bp, Artificial
  CRISPR gRNA sequence
ccccaggctgtggactccac

SEQ ID NO: 798376 - DNA, 20 bp, Artificial
  CRISPR gRNA sequence
tggactccacccacaattgg

SEQ ID NO: 798377 - DNA, 20 bp, Artificial
  CRISPR gRNA sequence
cacccacaattggcaacctg

SEQ ID NO: 798378 - DNA, 20 bp, Artificial
  CRISPR gRNA sequence
gcaacctggctcccaggctt

SEQ ID NO: 798379 - DNA, 20 bp, Artificial
  CRISPR gRNA sequence
gctcccaggctttgggccat

SEQ ID NO: 798380 - DNA, 20 bp, Artificial
  CRISPR gRNA sequence
ccaggctttgggccatccct

SEQ ID NO: 798381 - DNA, 20 bp, Artificial
  CRISPR gRNA sequence
tgggccatccctggcttgaa

SEQ ID NO: 798382 - DNA, 20 bp, Artificial
  CRISPR gRNA sequence
gggccatccctggcttgaag

SEQ ID NO: 798383 - DNA, 20 bp, Artificial
  CRISPR gRNA sequence
ggccatccctggcttgaagg

SEQ ID NO: 798384 - DNA, 20 bp, Artificial
  CRISPR gRNA sequence
gcttgaaggttgggtttcac

SEQ ID NO: 798385 - DNA, 20 bp, Artificial
  CRISPR gRNA sequence
gaaggttgggtttcaccagg

SEQ ID NO: 798386 - DNA, 20 bp, Artificial
  CRISPR gRNA sequence
aaggttgggtttcaccaggg

SEQ ID NO: 798387 - DNA, 20 bp, Artificial
  CRISPR gRNA sequence
ggtttcaccagggacctaac

SEQ ID NO: 798388 - DNA, 20 bp, Artificial
  CRISPR gRNA sequence
caccagggacctaacccctt

SEQ ID NO: 798389 - DNA, 20 bp, Artificial
  CRISPR gRNA sequence
accagggacctaaccccttt

SEQ ID NO: 798390 - DNA, 20 bp, Artificial
  CRISPR gRNA sequence
acccctttccgccaaggaac

SEQ ID NO: 798391 - DNA, 20 bp, Artificial
  CRISPR gRNA sequence
tccgccaaggaacctgtctc

SEQ ID NO: 798392 - DNA, 20 bp, Artificial
  CRISPR gRNA sequence
ccgccaaggaacctgtctcc

SEQ ID NO: 798393 - DNA, 20 bp, Artificial
  CRISPR gRNA sequence
cgccaaggaacctgtctccc

SEQ ID NO: 798394 - DNA, 20 bp, Artificial
  CRISPR gRNA sequence
tctccctcttgccatcaaca

SEQ ID NO: 798395 - DNA, 20 bp, Artificial
  CRISPR gRNA sequence
cctcttgccatcaacatgct

SEQ ID NO: 798396 - DNA, 20 bp, Artificial
  CRISPR gRNA sequence
ttgccatcaacatgctgtcc

SEQ ID NO: 798397 - DNA, 20 bp, Artificial
  CRISPR gRNA sequence
gccatcaacatgctgtccat

SEQ ID NO: 798398 - DNA, 20 bp, Artificial
  CRISPR gRNA sequence
ccatcaacatgctgtccatg

SEQ ID NO: 798399 - DNA, 20 bp, Artificial
  CRISPR gRNA sequence
tccatgatgcccaggctgtt

SEQ ID NO: 798400 - DNA, 20 bp, Artificial
  CRISPR gRNA sequence
ttcgtgccgaggggtgcctg

SEQ ID NO: 798401 - DNA, 20 bp, Artificial
  CRISPR gRNA sequence
gtgccgaggggtgcctgcag

SEQ ID NO: 798402 - DNA, 20 bp, Artificial
  CRISPR gRNA sequence
caggcctgccctgagccacc

SEQ ID NO: 798403 - DNA, 20 bp, Artificial
  CRISPR gRNA sequence
ccctgagccaccctcagccc

SEQ ID NO: 798404 - DNA, 20 bp, Artificial
  CRISPR gRNA sequence
agccaccctcagcccctgct

SEQ ID NO: 798405 - DNA, 20 bp, Artificial
  CRISPR gRNA sequence
agcccctgctcagcctccct

SEQ ID NO: 798406 - DNA, 20 bp, Artificial
  CRISPR gRNA sequence
ctcagcctccctctgtgctt

SEQ ID NO: 798407 - DNA, 20 bp, Artificial
  CRISPR gRNA sequence
agcctccctctgtgcttgtc

SEQ ID NO: 798408 - DNA, 20 bp, Artificial
  CRISPR gRNA sequence
cctctgtgcttgtcagcacc

SEQ ID NO: 798409 - DNA, 20 bp, Artificial
  CRISPR gRNA sequence
tgtgcttgtcagcacccaac

SEQ ID NO: 798410 - DNA, 20 bp, Artificial
  CRISPR gRNA sequence
tgcttgtcagcacccaacat

SEQ ID NO: 798411 - DNA, 20 bp, Artificial
  CRISPR gRNA sequence
gtcagcacccaacatctgga

SEQ ID NO: 798412 - DNA, 20 bp, Artificial
  CRISPR gRNA sequence
tcagcacccaacatctggaa

SEQ ID NO: 798413 - DNA, 20 bp, Artificial
  CRISPR gRNA sequence
gaagaggtcgaggcagcagg

SEQ ID NO: 798414 - DNA, 20 bp, Artificial
  CRISPR gRNA sequence
gtgtgtcagtaccatcctga

SEQ ID NO: 798415 - DNA, 20 bp, Artificial
  CRISPR gRNA sequence
agcacccacatgcctggccg

SEQ ID NO: 798416 - DNA, 20 bp, Artificial
  CRISPR gRNA sequence
gccgggttgtgacagcacct

SEQ ID NO: 798417 - DNA, 20 bp, Artificial
  CRISPR gRNA sequence
tgacagcacctaggcttggc

SEQ ID NO: 798418 - DNA, 20 bp, Artificial
  CRISPR gRNA sequence
ggcttggccacaactttgct

SEQ ID NO: 798419 - DNA, 20 bp, Artificial
  CRISPR gRNA sequence
ggccacaactttgcttcacc

SEQ ID NO: 798420 - DNA, 20 bp, Artificial
  CRISPR gRNA sequence
gccacaactttgcttcaccc

SEQ ID NO: 798421 - DNA, 20 bp, Artificial
  CRISPR gRNA sequence
tgcttcacccagtagcaggt

SEQ ID NO: 798422 - DNA, 20 bp, Artificial
  CRISPR gRNA sequence
gcttcacccagtagcaggtg

SEQ ID NO: 798423 - DNA, 20 bp, Artificial
  CRISPR gRNA sequence
cttcacccagtagcaggtgc

SEQ ID NO: 798424 - DNA, 20 bp, Artificial
  CRISPR gRNA sequence
cacccagtagcaggtgccag

SEQ ID NO: 798425 - DNA, 20 bp, Artificial
  CRISPR gRNA sequence
acccagtagcaggtgccagg

SEQ ID NO: 798426 - DNA, 20 bp, Artificial
  CRISPR gRNA sequence
tcaaccttgtgggagcaggg

SEQ ID NO: 798427 - DNA, 20 bp, Artificial
  CRISPR gRNA sequence
caaccttgtgggagcagggg

SEQ ID NO: 798428 - DNA, 20 bp, Artificial
  CRISPR gRNA sequence
aaccttgtgggagcagggga

SEQ ID NO: 798429 - DNA, 20 bp, Artificial
  CRISPR gRNA sequence
gtgggagcaggggacttcct

SEQ ID NO: 798430 - DNA, 20 bp, Artificial
  CRISPR gRNA sequence
tgggagcaggggacttcctg

SEQ ID NO: 798431 - DNA, 20 bp, Artificial
  CRISPR gRNA sequence
cctgggcccctgagagtaca

SEQ ID NO: 798432 - DNA, 20 bp, Artificial
  CRISPR gRNA sequence
ctgggcccctgagagtacag

SEQ ID NO: 798433 - DNA, 20 bp, Artificial
  CRISPR gRNA sequence
ggcccctgagagtacagaga

SEQ ID NO: 798434 - DNA, 20 bp, Artificial
  CRISPR gRNA sequence
agagtacagagatgcctggg

SEQ ID NO: 798435 - DNA, 20 bp, Artificial
  CRISPR gRNA sequence
ggtccagagccactgctggg

SEQ ID NO: 798436 - DNA, 20 bp, Artificial
  CRISPR gRNA sequence
ctgggcagctacaggggtgc

SEQ ID NO: 798437 - DNA, 20 bp, Artificial
  CRISPR gRNA sequence
ggcagctacaggggtgcctg

SEQ ID NO: 798438 - DNA, 20 bp, Artificial
  CRISPR gRNA sequence
caggggtgcctgggagcatg

SEQ ID NO: 798439 - DNA, 20 bp, Artificial
  CRISPR gRNA sequence
ggagcatgcggttcccaccc

SEQ ID NO: 798440 - DNA, 20 bp, Artificial
  CRISPR gRNA sequence
ccaccccgccaactcagtac

SEQ ID NO: 798441 - DNA, 20 bp, Artificial
  CRISPR gRNA sequence
agtacggggcgggactccca

SEQ ID NO: 798442 - DNA, 20 bp, Artificial
  CRISPR gRNA sequence
ccacctgttcttggcctccc

SEQ ID NO: 798443 - DNA, 20 bp, Artificial
  CRISPR gRNA sequence
ttcttggcctccctggccac

SEQ ID NO: 798444 - DNA, 20 bp, Artificial
  CRISPR gRNA sequence
ttggcctccctggccacacc

SEQ ID NO: 798445 - DNA, 20 bp, Artificial
  CRISPR gRNA sequence
ggcctccctggccacacctc

SEQ ID NO: 798446 - DNA, 20 bp, Artificial
  CRISPR gRNA sequence
gcctccctggccacacctcc

SEQ ID NO: 798447 - DNA, 20 bp, Artificial
  CRISPR gRNA sequence
cctggccacacctccactgc

SEQ ID NO: 798448 - DNA, 20 bp, Artificial
  CRISPR gRNA sequence
gccacacctccactgctgca

SEQ ID NO: 798449 - DNA, 20 bp, Artificial
  CRISPR gRNA sequence
cactgctgcagctgctctaa

SEQ ID NO: 798450 - DNA, 20 bp, Artificial
  CRISPR gRNA sequence
ctgcagctgctctaaacggg

SEQ ID NO: 798451 - DNA, 20 bp, Artificial
  CRISPR gRNA sequence
cagctgctctaaacgggcag

SEQ ID NO: 798452 - DNA, 20 bp, Artificial
  CRISPR gRNA sequence
ctctaaacgggcagctgctg

SEQ ID NO: 798453 - DNA, 20 bp, Artificial
  CRISPR gRNA sequence
taaacgggcagctgctgcca

SEQ ID NO: 798454 - DNA, 20 bp, Artificial
  CRISPR gRNA sequence
aacgggcagctgctgccatc

SEQ ID NO: 798455 - DNA, 20 bp, Artificial
  CRISPR gRNA sequence
ctgccatcactgtgagctat

SEQ ID NO: 798456 - DNA, 20 bp, Artificial
  CRISPR gRNA sequence
ccatcactgtgagctatgat

SEQ ID NO: 798457 - DNA, 20 bp, Artificial
  CRISPR gRNA sequence
tgagctatgattgtgccact

SEQ ID NO: 798458 - DNA, 20 bp, Artificial
  CRISPR gRNA sequence
tgattgtgccactgactcca

SEQ ID NO: 798459 - DNA, 20 bp, Artificial
  CRISPR gRNA sequence
tgccactgactccagcctgg

SEQ ID NO: 798460 - DNA, 20 bp, Artificial
  CRISPR gRNA sequence
actccagcctgggcaacaga

SEQ ID NO: 798461 - DNA, 20 bp, Artificial
  CRISPR gRNA sequence
cagcctgggcaacagaaaga

SEQ ID NO: 798462 - DNA, 20 bp, Artificial
  CRISPR gRNA sequence
ggcaacagaaagagacctat

SEQ ID NO: 798463 - DNA, 20 bp, Artificial
  CRISPR gRNA sequence
tatggtatgttaaatggtaa

SEQ ID NO: 798464 - DNA, 20 bp, Artificial
  CRISPR gRNA sequence
aatggtaatgactgctttgg

SEQ ID NO: 798465 - DNA, 20 bp, Artificial
  CRISPR gRNA sequence
ctttgggggagaaaagatga

SEQ ID NO: 798466 - DNA, 20 bp, Artificial
  CRISPR gRNA sequence
tgggggagaaaagatgacta

SEQ ID NO: 798467 - DNA, 20 bp, Artificial
  CRISPR gRNA sequence
gggggagaaaagatgactaa

SEQ ID NO: 798468 - DNA, 20 bp, Artificial
  CRISPR gRNA sequence
ggggagaaaagatgactaag

SEQ ID NO: 798469 - DNA, 20 bp, Artificial
  CRISPR gRNA sequence
aggattgttgggaatgctgg

SEQ ID NO: 798470 - DNA, 20 bp, Artificial
  CRISPR gRNA sequence
ttgggaatgctggggtaggg

SEQ ID NO: 798471 - DNA, 20 bp, Artificial
  CRISPR gRNA sequence
ggaatgctggggtagggttg

SEQ ID NO: 798472 - DNA, 20 bp, Artificial
  CRISPR gRNA sequence
gggtagggttggagtgctct

SEQ ID NO: 798473 - DNA, 20 bp, Artificial
  CRISPR gRNA sequence
gagtgctcttgcaattttac

SEQ ID NO: 798474 - DNA, 20 bp, Artificial
  CRISPR gRNA sequence
ttgcaattttacataagaca

SEQ ID NO: 798475 - DNA, 20 bp, Artificial
  CRISPR gRNA sequence
gcaattttacataagacagt

SEQ ID NO: 798476 - DNA, 20 bp, Artificial
  CRISPR gRNA sequence
caattttacataagacagtc

SEQ ID NO: 798477 - DNA, 20 bp, Artificial
  CRISPR gRNA sequence
tacataagacagtctcagga

SEQ ID NO: 798478 - DNA, 20 bp, Artificial
  CRISPR gRNA sequence
acataagacagtctcaggag

SEQ ID NO: 798479 - DNA, 20 bp, Artificial
  CRISPR gRNA sequence
cataagacagtctcaggaga

SEQ ID NO: 798480 - DNA, 20 bp, Artificial
  CRISPR gRNA sequence
aggagaaaaaacaatgaaag

SEQ ID NO: 798481 - DNA, 20 bp, Artificial
  CRISPR gRNA sequence
gcagcaaggtcttcccttag

SEQ ID NO: 798482 - DNA, 20 bp, Artificial
  CRISPR gRNA sequence
cccttagggattggatctgc

SEQ ID NO: 798483 - DNA, 20 bp, Artificial
  CRISPR gRNA sequence
ccttagggattggatctgcg

SEQ ID NO: 798484 - DNA, 20 bp, Artificial
  CRISPR gRNA sequence
agggattggatctgcggaag

SEQ ID NO: 798485 - DNA, 20 bp, Artificial
  CRISPR gRNA sequence
gggattggatctgcggaaga

SEQ ID NO: 798486 - DNA, 20 bp, Artificial
  CRISPR gRNA sequence
gatctgcggaagaggccaca

SEQ ID NO: 798487 - DNA, 20 bp, Artificial
  CRISPR gRNA sequence
cggaagaggccacacaggcc

SEQ ID NO: 798488 - DNA, 20 bp, Artificial
  CRISPR gRNA sequence
gaagcaggcttaaggccatt

SEQ ID NO: 798489 - DNA, 20 bp, Artificial
  CRISPR gRNA sequence
aaggccattcaggctaggaa

SEQ ID NO: 798490 - DNA, 20 bp, Artificial
  CRISPR gRNA sequence
aggccattcaggctaggaat

SEQ ID NO: 798491 - DNA, 20 bp, Artificial
  CRISPR gRNA sequence
aggctaggaattccagtgtt

SEQ ID NO: 798492 - DNA, 20 bp, Artificial
  CRISPR gRNA sequence
ggaattccagtgtttcaaag

SEQ ID NO: 798493 - DNA, 20 bp, Artificial
  CRISPR gRNA sequence
cagtgtttcaaagacagact

SEQ ID NO: 798494 - DNA, 20 bp, Artificial
  CRISPR gRNA sequence
caaagacagactgcaatgga

SEQ ID NO: 798495 - DNA, 20 bp, Artificial
  CRISPR gRNA sequence
aaagacagactgcaatggat

SEQ ID NO: 798496 - DNA, 20 bp, Artificial
  CRISPR gRNA sequence
caatggatggcggttggtag

SEQ ID NO: 798497 - DNA, 20 bp, Artificial
  CRISPR gRNA sequence
gtaggtcaaaagctccagat

SEQ ID NO: 798498 - DNA, 20 bp, Artificial
  CRISPR gRNA sequence
cagataacatctctcagccc

SEQ ID NO: 798499 - DNA, 20 bp, Artificial
  CRISPR gRNA sequence
tcagccctgcgaacacctta

SEQ ID NO: 798500 - DNA, 20 bp, Artificial
  CRISPR gRNA sequence
agccctgcgaacaccttact

SEQ ID NO: 798501 - DNA, 20 bp, Artificial
  CRISPR gRNA sequence
cgaacaccttactctcgggg

SEQ ID NO: 798502 - DNA, 20 bp, Artificial
  CRISPR gRNA sequence
actctcggggagaaggatgg

SEQ ID NO: 798503 - DNA, 20 bp, Artificial
  CRISPR gRNA sequence
ctctcggggagaaggatggg

SEQ ID NO: 798504 - DNA, 20 bp, Artificial
  CRISPR gRNA sequence
tcggggagaaggatgggcac

SEQ ID NO: 798505 - DNA, 20 bp, Artificial
  CRISPR gRNA sequence
ggggagaaggatgggcacag

SEQ ID NO: 798506 - DNA, 20 bp, Artificial
  CRISPR gRNA sequence
taaagcatggggtccaggac

SEQ ID NO: 798507 - DNA, 20 bp, Artificial
  CRISPR gRNA sequence
aaagcatggggtccaggaca

SEQ ID NO: 798508 - DNA, 20 bp, Artificial
  CRISPR gRNA sequence
aagcatggggtccaggacag

SEQ ID NO: 798509 - DNA, 20 bp, Artificial
  CRISPR gRNA sequence
ttgtcttggctgttgaaaaa

SEQ ID NO: 798510 - DNA, 20 bp, Artificial
  CRISPR gRNA sequence
gtcttggctgttgaaaaaac

SEQ ID NO: 798511 - DNA, 20 bp, Artificial
  CRISPR gRNA sequence
tcttggctgttgaaaaaact

SEQ ID NO: 798512 - DNA, 20 bp, Artificial
  CRISPR gRNA sequence
ggctgttgaaaaaactgggt

SEQ ID NO: 798513 - DNA, 20 bp, Artificial
  CRISPR gRNA sequence
gctgttgaaaaaactgggtt

SEQ ID NO: 798514 - DNA, 20 bp, Artificial
  CRISPR gRNA sequence
ttgaaaaaactgggttttac

SEQ ID NO: 798515 - DNA, 20 bp, Artificial
  CRISPR gRNA sequence
aaaaaactgggttttacact

SEQ ID NO: 798516 - DNA, 20 bp, Artificial
  CRISPR gRNA sequence
ggttttacactgagtgaaat

SEQ ID NO: 798517 - DNA, 20 bp, Artificial
  CRISPR gRNA sequence
tacactgagtgaaatgctga

SEQ ID NO: 798518 - DNA, 20 bp, Artificial
  CRISPR gRNA sequence
acactgagtgaaatgctgag

SEQ ID NO: 798519 - DNA, 20 bp, Artificial
  CRISPR gRNA sequence
cactgagtgaaatgctgagc

SEQ ID NO: 798520 - DNA, 20 bp, Artificial
  CRISPR gRNA sequence
agtgaaatgctgagccatcg

SEQ ID NO: 798521 - DNA, 20 bp, Artificial
  CRISPR gRNA sequence
agccatcggaaggttttaag

SEQ ID NO: 798522 - DNA, 20 bp, Artificial
  CRISPR gRNA sequence
taagaaaatatggtttgact

SEQ ID NO: 798523 - DNA, 20 bp, Artificial
  CRISPR gRNA sequence
aagaaaatatggtttgactt

SEQ ID NO: 798524 - DNA, 20 bp, Artificial
  CRISPR gRNA sequence
agaaaatatggtttgacttt

SEQ ID NO: 798525 - DNA, 20 bp, Artificial
  CRISPR gRNA sequence
gacttttattttttaaaaac

SEQ ID NO: 798526 - DNA, 20 bp, Artificial
  CRISPR gRNA sequence
acttttattttttaaaaacc

SEQ ID NO: 798527 - DNA, 20 bp, Artificial
  CRISPR gRNA sequence
ttattttttaaaaaccactc

SEQ ID NO: 798528 - DNA, 20 bp, Artificial
  CRISPR gRNA sequence
tattttttaaaaaccactct

SEQ ID NO: 798529 - DNA, 20 bp, Artificial
  CRISPR gRNA sequence
attttttaaaaaccactctg

SEQ ID NO: 798530 - DNA, 20 bp, Artificial
  CRISPR gRNA sequence
ttttttaaaaaccactctgg

SEQ ID NO: 798531 - DNA, 20 bp, Artificial
  CRISPR gRNA sequence
tttaaaaaccactctggctg

SEQ ID NO: 798532 - DNA, 20 bp, Artificial
  CRISPR gRNA sequence
ttaaaaaccactctggctgc

SEQ ID NO: 798533 - DNA, 20 bp, Artificial
  CRISPR gRNA sequence
taaaaaccactctggctgca

SEQ ID NO: 798534 - DNA, 20 bp, Artificial
  CRISPR gRNA sequence
aaaaaccactctggctgcag

SEQ ID NO: 798535 - DNA, 20 bp, Artificial
  CRISPR gRNA sequence
aaaaccactctggctgcaga

SEQ ID NO: 798536 - DNA, 20 bp, Artificial
  CRISPR gRNA sequence
tggctgcagaatcaactgca

SEQ ID NO: 798537 - DNA, 20 bp, Artificial
  CRISPR gRNA sequence
gctgcagaatcaactgcagg

SEQ ID NO: 798538 - DNA, 20 bp, Artificial
  CRISPR gRNA sequence
cagaatcaactgcaggaagg

SEQ ID NO: 798539 - DNA, 20 bp, Artificial
  CRISPR gRNA sequence
caggaaggcaaaactggaat

SEQ ID NO: 798540 - DNA, 20 bp, Artificial
  CRISPR gRNA sequence
gaatcatagcatccagttgt

SEQ ID NO: 798541 - DNA, 20 bp, Artificial
  CRISPR gRNA sequence
tcagactaatgcagaaatca

SEQ ID NO: 798542 - DNA, 20 bp, Artificial
  CRISPR gRNA sequence
atgcagaaatcaccatgaga

SEQ ID NO: 798543 - DNA, 20 bp, Artificial
  CRISPR gRNA sequence
tgaccgatatggaagcagtg

SEQ ID NO: 798544 - DNA, 20 bp, Artificial
  CRISPR gRNA sequence
accgatatggaagcagtgga

SEQ ID NO: 798545 - DNA, 20 bp, Artificial
  CRISPR gRNA sequence
tggatatatttgaaggaagg

SEQ ID NO: 798546 - DNA, 20 bp, Artificial
  CRISPR gRNA sequence
gatatatttgaaggaagggc

SEQ ID NO: 798547 - DNA, 20 bp, Artificial
  CRISPR gRNA sequence
gaaggaagggccaatagggt

SEQ ID NO: 798548 - DNA, 20 bp, Artificial
  CRISPR gRNA sequence
aaggaagggccaatagggtt

SEQ ID NO: 798549 - DNA, 20 bp, Artificial
  CRISPR gRNA sequence
gttaatgaatcagatgtaga

SEQ ID NO: 798550 - DNA, 20 bp, Artificial
  CRISPR gRNA sequence
atgaatcagatgtagagtga

SEQ ID NO: 798551 - DNA, 20 bp, Artificial
  CRISPR gRNA sequence
aagatgactccaaggttctt

SEQ ID NO: 798552 - DNA, 20 bp, Artificial
  CRISPR gRNA sequence
caaggttcttgtccttcacc

SEQ ID NO: 798553 - DNA, 20 bp, Artificial
  CRISPR gRNA sequence
ttgtccttcacctcaataag

SEQ ID NO: 798554 - DNA, 20 bp, Artificial
  CRISPR gRNA sequence
gtccttcacctcaataagtg

SEQ ID NO: 798555 - DNA, 20 bp, Artificial
  CRISPR gRNA sequence
tccttcacctcaataagtgg

SEQ ID NO: 798556 - DNA, 20 bp, Artificial
  CRISPR gRNA sequence
cacctcaataagtggaggat

SEQ ID NO: 798557 - DNA, 20 bp, Artificial
  CRISPR gRNA sequence
acctcaataagtggaggatg

SEQ ID NO: 798558 - DNA, 20 bp, Artificial
  CRISPR gRNA sequence
aataagtggaggatggagca

SEQ ID NO: 798559 - DNA, 20 bp, Artificial
  CRISPR gRNA sequence
gaaggtaaaaatagcagtga

SEQ ID NO: 798560 - DNA, 20 bp, Artificial
  CRISPR gRNA sequence
tgctatggtataagaagaaa

SEQ ID NO: 798561 - DNA, 20 bp, Artificial
  CRISPR gRNA sequence
ctatggtataagaagaaatg

SEQ ID NO: 798562 - DNA, 20 bp, Artificial
  CRISPR gRNA sequence
tggtataagaagaaatgata

SEQ ID NO: 798563 - DNA, 20 bp, Artificial
  CRISPR gRNA sequence
aattaaggtgatggcagtgg

SEQ ID NO: 798564 - DNA, 20 bp, Artificial
  CRISPR gRNA sequence
aggtgatggcagtggggtgg

SEQ ID NO: 798565 - DNA, 20 bp, Artificial
  CRISPR gRNA sequence
acaggactaggggatgggcc

SEQ ID NO: 798566 - DNA, 20 bp, Artificial
  CRISPR gRNA sequence
ggggatgggccatatttgca

SEQ ID NO: 798567 - DNA, 20 bp, Artificial
  CRISPR gRNA sequence
gcaagatgagaaatgcagag

SEQ ID NO: 798568 - DNA, 20 bp, Artificial
  CRISPR gRNA sequence
caagatgagaaatgcagagg

SEQ ID NO: 798569 - DNA, 20 bp, Artificial
  CRISPR gRNA sequence
agattctagcttaaggtggg

SEQ ID NO: 798570 - DNA, 20 bp, Artificial
  CRISPR gRNA sequence
tagcttaaggtgggtgttgc

SEQ ID NO: 798571 - DNA, 20 bp, Artificial
  CRISPR gRNA sequence
gcttaaggtgggtgttgcta

SEQ ID NO: 798572 - DNA, 20 bp, Artificial
  CRISPR gRNA sequence
aaggtgggtgttgctactat

SEQ ID NO: 798573 - DNA, 20 bp, Artificial
  CRISPR gRNA sequence
aggtgggtgttgctactatt

SEQ ID NO: 798574 - DNA, 20 bp, Artificial
  CRISPR gRNA sequence
ctactattagcataatagga

SEQ ID NO: 798575 - DNA, 20 bp, Artificial
  CRISPR gRNA sequence
ctattagcataataggaaaa

SEQ ID NO: 798576 - DNA, 20 bp, Artificial
  CRISPR gRNA sequence
ttagcataataggaaaacaa

SEQ ID NO: 798577 - DNA, 20 bp, Artificial
  CRISPR gRNA sequence
gcataataggaaaacaaggc

SEQ ID NO: 798578 - DNA, 20 bp, Artificial
  CRISPR gRNA sequence
ttcaaaatttgtccaaggtg

SEQ ID NO: 798579 - DNA, 20 bp, Artificial
  CRISPR gRNA sequence
tcaaaatttgtccaaggtgt

SEQ ID NO: 798580 - DNA, 20 bp, Artificial
  CRISPR gRNA sequence
caaaatttgtccaaggtgtt

SEQ ID NO: 798581 - DNA, 20 bp, Artificial
  CRISPR gRNA sequence
aaaatttgtccaaggtgtta

SEQ ID NO: 798582 - DNA, 20 bp, Artificial
  CRISPR gRNA sequence
gtccaaggtgttagaggctt

SEQ ID NO: 798583 - DNA, 20 bp, Artificial
  CRISPR gRNA sequence
tccaaggtgttagaggctta

SEQ ID NO: 798584 - DNA, 20 bp, Artificial
  CRISPR gRNA sequence
gaggcttacaatttgtaaaa

SEQ ID NO: 798585 - DNA, 20 bp, Artificial
  CRISPR gRNA sequence
acaatttgtaaaaccaggat

SEQ ID NO: 798586 - DNA, 20 bp, Artificial
  CRISPR gRNA sequence
caatttgtaaaaccaggatt

SEQ ID NO: 798587 - DNA, 20 bp, Artificial
  CRISPR gRNA sequence
gtaaaaccaggattaaaccc

SEQ ID NO: 798588 - DNA, 20 bp, Artificial
  CRISPR gRNA sequence
taaaaccaggattaaaccca

SEQ ID NO: 798589 - DNA, 20 bp, Artificial
  CRISPR gRNA sequence
aacccagatgtgtctgattt

SEQ ID NO: 798590 - DNA, 20 bp, Artificial
  CRISPR gRNA sequence
attttagagcctgagctctt

SEQ ID NO: 798591 - DNA, 20 bp, Artificial
  CRISPR gRNA sequence
tagagcctgagctcttactc

SEQ ID NO: 798592 - DNA, 20 bp, Artificial
  CRISPR gRNA sequence
agagcctgagctcttactca

SEQ ID NO: 798593 - DNA, 20 bp, Artificial
  CRISPR gRNA sequence
gagcctgagctcttactcat

SEQ ID NO: 798594 - DNA, 20 bp, Artificial
  CRISPR gRNA sequence
agctcttactcattgcataa

SEQ ID NO: 798595 - DNA, 20 bp, Artificial
  CRISPR gRNA sequence
ttactcattgcataaaccat

SEQ ID NO: 798596 - DNA, 20 bp, Artificial
  CRISPR gRNA sequence
actcattgcataaaccatat

SEQ ID NO: 798597 - DNA, 20 bp, Artificial
  CRISPR gRNA sequence
ctcattgcataaaccatatt

SEQ ID NO: 798598 - DNA, 20 bp, Artificial
  CRISPR gRNA sequence
attgcataaaccatattttc

SEQ ID NO: 798599 - DNA, 20 bp, Artificial
  CRISPR gRNA sequence
cataaaccatattttcccca

SEQ ID NO: 798600 - DNA, 20 bp, Artificial
  CRISPR gRNA sequence
tccccagaggaggattagta

SEQ ID NO: 798601 - DNA, 20 bp, Artificial
  CRISPR gRNA sequence
ccccagaggaggattagtag

SEQ ID NO: 798602 - DNA, 20 bp, Artificial
  CRISPR gRNA sequence
cccagaggaggattagtagg

SEQ ID NO: 798603 - DNA, 20 bp, Artificial
  CRISPR gRNA sequence
gtaggaaaggaagctgctgg

SEQ ID NO: 798604 - DNA, 20 bp, Artificial
  CRISPR gRNA sequence
ctggttggaaagtatcttta

SEQ ID NO: 798605 - DNA, 20 bp, Artificial
  CRISPR gRNA sequence
gttggaaagtatctttatag

SEQ ID NO: 798606 - DNA, 20 bp, Artificial
  CRISPR gRNA sequence
gaaagtatctttatagcagt

SEQ ID NO: 798607 - DNA, 20 bp, Artificial
  CRISPR gRNA sequence
tatagcagtgtctgttcctc

SEQ ID NO: 798608 - DNA, 20 bp, Artificial
  CRISPR gRNA sequence
atagcagtgtctgttcctcg

SEQ ID NO: 798609 - DNA, 20 bp, Artificial
  CRISPR gRNA sequence
tagcagtgtctgttcctcgg

SEQ ID NO: 798610 - DNA, 20 bp, Artificial
  CRISPR gRNA sequence
ttcctcggtttgctcaaggg

SEQ ID NO: 798611 - DNA, 20 bp, Artificial
  CRISPR gRNA sequence
ctcggtttgctcaaggggac

SEQ ID NO: 798612 - DNA, 20 bp, Artificial
  CRISPR gRNA sequence
ggtttgctcaaggggacagt

SEQ ID NO: 798613 - DNA, 20 bp, Artificial
  CRISPR gRNA sequence
gctcaaggggacagtgtgcc

SEQ ID NO: 798614 - DNA, 20 bp, Artificial
  CRISPR gRNA sequence
ctcaaggggacagtgtgcca

SEQ ID NO: 798615 - DNA, 20 bp, Artificial
  CRISPR gRNA sequence
aaggggacagtgtgccagga

SEQ ID NO: 798616 - DNA, 20 bp, Artificial
  CRISPR gRNA sequence
aagccagtggcaggtgatcc

SEQ ID NO: 798617 - DNA, 20 bp, Artificial
  CRISPR gRNA sequence
ttctgttgctagagctatgt

SEQ ID NO: 798618 - DNA, 20 bp, Artificial
  CRISPR gRNA sequence
tctgttgctagagctatgtt

SEQ ID NO: 798619 - DNA, 20 bp, Artificial
  CRISPR gRNA sequence
ctgttgctagagctatgtta

SEQ ID NO: 798620 - DNA, 20 bp, Artificial
  CRISPR gRNA sequence
tgttgctagagctatgttac

SEQ ID NO: 798621 - DNA, 20 bp, Artificial
  CRISPR gRNA sequence
ttgctagagctatgttacat

SEQ ID NO: 798622 - DNA, 20 bp, Artificial
  CRISPR gRNA sequence
ctagagctatgttacatgct

SEQ ID NO: 798623 - DNA, 20 bp, Artificial
  CRISPR gRNA sequence
gagctatgttacatgctgtc

SEQ ID NO: 798624 - DNA, 20 bp, Artificial
  CRISPR gRNA sequence
tgttacatgctgtcctttca

SEQ ID NO: 798625 - DNA, 20 bp, Artificial
  CRISPR gRNA sequence
catgctgtcctttcatgctc

SEQ ID NO: 798626 - DNA, 20 bp, Artificial
  CRISPR gRNA sequence
tcctttcatgctctaaaaat

SEQ ID NO: 798627 - DNA, 20 bp, Artificial
  CRISPR gRNA sequence
tcatgctctaaaaataagag

SEQ ID NO: 798628 - DNA, 20 bp, Artificial
  CRISPR gRNA sequence
catgctctaaaaataagagt

SEQ ID NO: 798629 - DNA, 20 bp, Artificial
  CRISPR gRNA sequence
atgctctaaaaataagagtg

SEQ ID NO: 798630 - DNA, 20 bp, Artificial
  CRISPR gRNA sequence
taaaaataagagtgctggca

SEQ ID NO: 798631 - DNA, 20 bp, Artificial
  CRISPR gRNA sequence
aaaataagagtgctggcaag

SEQ ID NO: 798632 - DNA, 20 bp, Artificial
  CRISPR gRNA sequence
gcaagtgccaggcctgttgg

SEQ ID NO: 798633 - DNA, 20 bp, Artificial
  CRISPR gRNA sequence
ttggtgcagcttaagatgat

SEQ ID NO: 798634 - DNA, 20 bp, Artificial
  CRISPR gRNA sequence
gtgcagcttaagatgatacc

SEQ ID NO: 798635 - DNA, 20 bp, Artificial
  CRISPR gRNA sequence
aagatgatacctttcttgga

SEQ ID NO: 798636 - DNA, 20 bp, Artificial
  CRISPR gRNA sequence
agatgatacctttcttggat

SEQ ID NO: 798637 - DNA, 20 bp, Artificial
  CRISPR gRNA sequence
tcttggatatatatgcatct

SEQ ID NO: 798638 - DNA, 20 bp, Artificial
  CRISPR gRNA sequence
cttggatatatatgcatctg

SEQ ID NO: 798639 - DNA, 20 bp, Artificial
  CRISPR gRNA sequence
ttggatatatatgcatctga

SEQ ID NO: 798640 - DNA, 20 bp, Artificial
  CRISPR gRNA sequence
ggatatatatgcatctgaat

SEQ ID NO: 798641 - DNA, 20 bp, Artificial
  CRISPR gRNA sequence
gatatatatgcatctgaata

SEQ ID NO: 798642 - DNA, 20 bp, Artificial
  CRISPR gRNA sequence
aataaggaaggctatcttct

SEQ ID NO: 798643 - DNA, 20 bp, Artificial
  CRISPR gRNA sequence
tcttctggtcaagctaaggt

SEQ ID NO: 798644 - DNA, 20 bp, Artificial
  CRISPR gRNA sequence
ctggtcaagctaaggtatgc

SEQ ID NO: 798645 - DNA, 20 bp, Artificial
  CRISPR gRNA sequence
tggtcaagctaaggtatgcc

SEQ ID NO: 798646 - DNA, 20 bp, Artificial
  CRISPR gRNA sequence
gtcaagctaaggtatgccat

SEQ ID NO: 798647 - DNA, 20 bp, Artificial
  CRISPR gRNA sequence
aggtatgccatgagcatttc

SEQ ID NO: 798648 - DNA, 20 bp, Artificial
  CRISPR gRNA sequence
ccctgtggaaagcacttaat

SEQ ID NO: 798649 - DNA, 20 bp, Artificial
  CRISPR gRNA sequence
cctgtggaaagcacttaatt

SEQ ID NO: 798650 - DNA, 20 bp, Artificial
  CRISPR gRNA sequence
tggaaagcacttaattctgt

SEQ ID NO: 798651 - DNA, 20 bp, Artificial
  CRISPR gRNA sequence
aattctgttcccagttgtta

SEQ ID NO: 798652 - DNA, 20 bp, Artificial
  CRISPR gRNA sequence
attctgttcccagttgttac

SEQ ID NO: 798653 - DNA, 20 bp, Artificial
  CRISPR gRNA sequence
tgttcccagttgttacctgc

SEQ ID NO: 798654 - DNA, 20 bp, Artificial
  CRISPR gRNA sequence
ttcccagttgttacctgctg

SEQ ID NO: 798655 - DNA, 20 bp, Artificial
  CRISPR gRNA sequence
ccagttgttacctgctgtaa

SEQ ID NO: 798656 - DNA, 20 bp, Artificial
  CRISPR gRNA sequence
ttacctgctgtaagatctcc

SEQ ID NO: 798657 - DNA, 20 bp, Artificial
  CRISPR gRNA sequence
cctgctgtaagatctccctt

SEQ ID NO: 798658 - DNA, 20 bp, Artificial
  CRISPR gRNA sequence
ctgtaagatctccctttcta

SEQ ID NO: 798659 - DNA, 20 bp, Artificial
  CRISPR gRNA sequence
taagatctccctttctaaaa

SEQ ID NO: 798660 - DNA, 20 bp, Artificial
  CRISPR gRNA sequence
cctttctaaaataaaaacaa

SEQ ID NO: 798661 - DNA, 20 bp, Artificial
  CRISPR gRNA sequence
tctaaaataaaaacaagaat

SEQ ID NO: 798662 - DNA, 20 bp, Artificial
  CRISPR gRNA sequence
ctaaaataaaaacaagaata

SEQ ID NO: 798663 - DNA, 20 bp, Artificial
  CRISPR gRNA sequence
taaaataaaaacaagaatac

SEQ ID NO: 798664 - DNA, 20 bp, Artificial
  CRISPR gRNA sequence
aaataaaaacaagaatacag

SEQ ID NO: 798665 - DNA, 20 bp, Artificial
  CRISPR gRNA sequence
actgaggaccttacatttcc

SEQ ID NO: 798666 - DNA, 20 bp, Artificial
  CRISPR gRNA sequence
aggaccttacatttccctct

SEQ ID NO: 798667 - DNA, 20 bp, Artificial
  CRISPR gRNA sequence
acatttccctctagctactg

SEQ ID NO: 798668 - DNA, 20 bp, Artificial
  CRISPR gRNA sequence
catttccctctagctactga

SEQ ID NO: 798669 - DNA, 20 bp, Artificial
  CRISPR gRNA sequence
ccctctagctactgactcat

SEQ ID NO: 798670 - DNA, 20 bp, Artificial
  CRISPR gRNA sequence
cctctagctactgactcatt

SEQ ID NO: 798671 - DNA, 20 bp, Artificial
  CRISPR gRNA sequence
tagctactgactcatttctc

SEQ ID NO: 798672 - DNA, 20 bp, Artificial
  CRISPR gRNA sequence
gctactgactcatttctctt

SEQ ID NO: 798673 - DNA, 20 bp, Artificial
  CRISPR gRNA sequence
ctgactcatttctcttctcc

SEQ ID NO: 798674 - DNA, 20 bp, Artificial
  CRISPR gRNA sequence
actcatttctcttctccttt

SEQ ID NO: 798675 - DNA, 20 bp, Artificial
  CRISPR gRNA sequence
atttctcttctcctttttat

SEQ ID NO: 798676 - DNA, 20 bp, Artificial
  CRISPR gRNA sequence
ctcttctcctttttatagca

SEQ ID NO: 798677 - DNA, 20 bp, Artificial
  CRISPR gRNA sequence
tcttctcctttttatagcac

SEQ ID NO: 798678 - DNA, 20 bp, Artificial
  CRISPR gRNA sequence
ttctcctttttatagcactc

SEQ ID NO: 798679 - DNA, 20 bp, Artificial
  CRISPR gRNA sequence
ctcctttttatagcactctt

SEQ ID NO: 798680 - DNA, 20 bp, Artificial
  CRISPR gRNA sequence
tcctttttatagcactcttc

SEQ ID NO: 798681 - DNA, 20 bp, Artificial
  CRISPR gRNA sequence
ctttttatagcactcttctt

SEQ ID NO: 798682 - DNA, 20 bp, Artificial
  CRISPR gRNA sequence
tttatagcactcttcttgag

SEQ ID NO: 798683 - DNA, 20 bp, Artificial
  CRISPR gRNA sequence
ttatagcactcttcttgaga

SEQ ID NO: 798684 - DNA, 20 bp, Artificial
  CRISPR gRNA sequence
tatagcactcttcttgagag

SEQ ID NO: 798685 - DNA, 20 bp, Artificial
  CRISPR gRNA sequence
atagcactcttcttgagaga

SEQ ID NO: 798686 - DNA, 20 bp, Artificial
  CRISPR gRNA sequence
tagcactcttcttgagagag

SEQ ID NO: 798687 - DNA, 20 bp, Artificial
  CRISPR gRNA sequence
ttcttgagagagttgcctat

SEQ ID NO: 798688 - DNA, 20 bp, Artificial
  CRISPR gRNA sequence
cttgagagagttgcctatat

SEQ ID NO: 798689 - DNA, 20 bp, Artificial
  CRISPR gRNA sequence
ttgagagagttgcctatatt

SEQ ID NO: 798690 - DNA, 20 bp, Artificial
  CRISPR gRNA sequence
gagagagttgcctatatttg

SEQ ID NO: 798691 - DNA, 20 bp, Artificial
  CRISPR gRNA sequence
agagagttgcctatatttgt

SEQ ID NO: 798692 - DNA, 20 bp, Artificial
  CRISPR gRNA sequence
cctatatttgttgccacatc

SEQ ID NO: 798693 - DNA, 20 bp, Artificial
  CRISPR gRNA sequence
tatttgttgccacatcttta

SEQ ID NO: 798694 - DNA, 20 bp, Artificial
  CRISPR gRNA sequence
gttgccacatctttacccat

SEQ ID NO: 798695 - DNA, 20 bp, Artificial
  CRISPR gRNA sequence
ttgccacatctttacccatt

SEQ ID NO: 798696 - DNA, 20 bp, Artificial
  CRISPR gRNA sequence
ccacatctttacccattctc

SEQ ID NO: 798697 - DNA, 20 bp, Artificial
  CRISPR gRNA sequence
tacccattctcttttgaacc

SEQ ID NO: 798698 - DNA, 20 bp, Artificial
  CRISPR gRNA sequence
acccattctcttttgaacct

SEQ ID NO: 798699 - DNA, 20 bp, Artificial
  CRISPR gRNA sequence
cccattctcttttgaaccta

SEQ ID NO: 798700 - DNA, 20 bp, Artificial
  CRISPR gRNA sequence
tcttttgaacctattcaagc

SEQ ID NO: 798701 - DNA, 20 bp, Artificial
  CRISPR gRNA sequence
ttttgaacctattcaagctt

SEQ ID NO: 798702 - DNA, 20 bp, Artificial
  CRISPR gRNA sequence
ttgaacctattcaagctttc

SEQ ID NO: 798703 - DNA, 20 bp, Artificial
  CRISPR gRNA sequence
tgaacctattcaagctttca

SEQ ID NO: 798704 - DNA, 20 bp, Artificial
  CRISPR gRNA sequence
gaacctattcaagctttcat

SEQ ID NO: 798705 - DNA, 20 bp, Artificial
  CRISPR gRNA sequence
aacctattcaagctttcatc

SEQ ID NO: 798706 - DNA, 20 bp, Artificial
  CRISPR gRNA sequence
ttcaagctttcatctgtaca

SEQ ID NO: 798707 - DNA, 20 bp, Artificial
  CRISPR gRNA sequence
aagctttcatctgtacaaaa

SEQ ID NO: 798708 - DNA, 20 bp, Artificial
  CRISPR gRNA sequence
tcatctgtacaaaactcact

SEQ ID NO: 798709 - DNA, 20 bp, Artificial
  CRISPR gRNA sequence
catctgtacaaaactcactg

SEQ ID NO: 798710 - DNA, 20 bp, Artificial
  CRISPR gRNA sequence
atctgtacaaaactcactga

SEQ ID NO: 798711 - DNA, 20 bp, Artificial
  CRISPR gRNA sequence
tacaaaactcactgatactg

SEQ ID NO: 798712 - DNA, 20 bp, Artificial
  CRISPR gRNA sequence
actgatactgtgcttgtcag

SEQ ID NO: 798713 - DNA, 20 bp, Artificial
  CRISPR gRNA sequence
atactgtgcttgtcaggatc

SEQ ID NO: 798714 - DNA, 20 bp, Artificial
  CRISPR gRNA sequence
tgcttgtcaggatcatccat

SEQ ID NO: 798715 - DNA, 20 bp, Artificial
  CRISPR gRNA sequence
gtcaggatcatccatgacct

SEQ ID NO: 798716 - DNA, 20 bp, Artificial
  CRISPR gRNA sequence
tcaggatcatccatgacctc

SEQ ID NO: 798717 - DNA, 20 bp, Artificial
  CRISPR gRNA sequence
catactgctaaatgcaactc

SEQ ID NO: 798718 - DNA, 20 bp, Artificial
  CRISPR gRNA sequence
ctaaatgcaactctcaagag

SEQ ID NO: 798719 - DNA, 20 bp, Artificial
  CRISPR gRNA sequence
aatgcaactctcaagagtat

SEQ ID NO: 798720 - DNA, 20 bp, Artificial
  CRISPR gRNA sequence
tcaagagtatttggctctac

SEQ ID NO: 798721 - DNA, 20 bp, Artificial
  CRISPR gRNA sequence
aagagtatttggctctactg

SEQ ID NO: 798722 - DNA, 20 bp, Artificial
  CRISPR gRNA sequence
ggctctactgatcactcctt

SEQ ID NO: 798723 - DNA, 20 bp, Artificial
  CRISPR gRNA sequence
gctctactgatcactccttt

SEQ ID NO: 798724 - DNA, 20 bp, Artificial
  CRISPR gRNA sequence
tactgatcactcctttgtag

SEQ ID NO: 798725 - DNA, 20 bp, Artificial
  CRISPR gRNA sequence
ctgatcactcctttgtagca

SEQ ID NO: 798726 - DNA, 20 bp, Artificial
  CRISPR gRNA sequence
atcactcctttgtagcactg

SEQ ID NO: 798727 - DNA, 20 bp, Artificial
  CRISPR gRNA sequence
ctttgtagcactgtgtttta

SEQ ID NO: 798728 - DNA, 20 bp, Artificial
  CRISPR gRNA sequence
tgtagcactgtgttttaaaa

SEQ ID NO: 798729 - DNA, 20 bp, Artificial
  CRISPR gRNA sequence
gtagcactgtgttttaaaat

SEQ ID NO: 798730 - DNA, 20 bp, Artificial
  CRISPR gRNA sequence
tagcactgtgttttaaaata

SEQ ID NO: 798731 - DNA, 20 bp, Artificial
  CRISPR gRNA sequence
tgttttaaaatataggtttt

SEQ ID NO: 798732 - DNA, 20 bp, Artificial
  CRISPR gRNA sequence
taaaatataggttttattat

SEQ ID NO: 798733 - DNA, 20 bp, Artificial
  CRISPR gRNA sequence
aaaatataggttttattatt

SEQ ID NO: 798734 - DNA, 20 bp, Artificial
  CRISPR gRNA sequence
aaatataggttttattatta

SEQ ID NO: 798735 - DNA, 20 bp, Artificial
  CRISPR gRNA sequence
tattattatttaggtatggt

SEQ ID NO: 798736 - DNA, 20 bp, Artificial
  CRISPR gRNA sequence
attattatttaggtatggtg

SEQ ID NO: 798737 - DNA, 20 bp, Artificial
  CRISPR gRNA sequence
ttattatttaggtatggtga

SEQ ID NO: 798738 - DNA, 20 bp, Artificial
  CRISPR gRNA sequence
ttatttaggtatggtgaggc

SEQ ID NO: 798739 - DNA, 20 bp, Artificial
  CRISPR gRNA sequence
tttaggtatggtgaggccaa

SEQ ID NO: 798740 - DNA, 20 bp, Artificial
  CRISPR gRNA sequence
aggtatggtgaggccaatat

SEQ ID NO: 798741 - DNA, 20 bp, Artificial
  CRISPR gRNA sequence
ggtatggtgaggccaatata

SEQ ID NO: 798742 - DNA, 20 bp, Artificial
  CRISPR gRNA sequence
tcgttgaaaaaagtatgttg

SEQ ID NO: 798743 - DNA, 20 bp, Artificial
  CRISPR gRNA sequence
aaaaaagtatgttgtactca

SEQ ID NO: 798744 - DNA, 20 bp, Artificial
  CRISPR gRNA sequence
tactcacagatcccaagaga

SEQ ID NO: 798745 - DNA, 20 bp, Artificial
  CRISPR gRNA sequence
acagatcccaagagaagggg

SEQ ID NO: 798746 - DNA, 20 bp, Artificial
  CRISPR gRNA sequence
tattgtggtttcaacaggaa

SEQ ID NO: 798747 - DNA, 20 bp, Artificial
  CRISPR gRNA sequence
attgtggtttcaacaggaag

SEQ ID NO: 798748 - DNA, 20 bp, Artificial
  CRISPR gRNA sequence
ttgtggtttcaacaggaaga

SEQ ID NO: 798749 - DNA, 20 bp, Artificial
  CRISPR gRNA sequence
tggtttcaacaggaagaaat

SEQ ID NO: 798750 - DNA, 20 bp, Artificial
  CRISPR gRNA sequence
caacaggaagaaatgggtga

SEQ ID NO: 798751 - DNA, 20 bp, Artificial
  CRISPR gRNA sequence
aacaggaagaaatgggtgaa

SEQ ID NO: 798752 - DNA, 20 bp, Artificial
  CRISPR gRNA sequence
aggattagctgatataaata

SEQ ID NO: 798753 - DNA, 20 bp, Artificial
  CRISPR gRNA sequence
ggattagctgatataaataa

SEQ ID NO: 798754 - DNA, 20 bp, Artificial
  CRISPR gRNA sequence
gctgatataaataatttcag

SEQ ID NO: 798755 - DNA, 20 bp, Artificial
  CRISPR gRNA sequence
atataaataatttcagcagg

SEQ ID NO: 798756 - DNA, 20 bp, Artificial
  CRISPR gRNA sequence
cagcaggctctggggcatag

SEQ ID NO: 798757 - DNA, 20 bp, Artificial
  CRISPR gRNA sequence
agcaggctctggggcatagg

SEQ ID NO: 798758 - DNA, 20 bp, Artificial
  CRISPR gRNA sequence
tggggcataggggctgtccc

SEQ ID NO: 798759 - DNA, 20 bp, Artificial
  CRISPR gRNA sequence
gggcataggggctgtcccta

SEQ ID NO: 798760 - DNA, 20 bp, Artificial
  CRISPR gRNA sequence
tccctagtcttctggtactt

SEQ ID NO: 798761 - DNA, 20 bp, Artificial
  CRISPR gRNA sequence
gtcttctggtacttggccct

SEQ ID NO: 798762 - DNA, 20 bp, Artificial
  CRISPR gRNA sequence
ctggtacttggccctggggt

SEQ ID NO: 798763 - DNA, 20 bp, Artificial
  CRISPR gRNA sequence
tggtacttggccctggggtg

SEQ ID NO: 798764 - DNA, 20 bp, Artificial
  CRISPR gRNA sequence
gtacttggccctggggtgat

SEQ ID NO: 798765 - DNA, 20 bp, Artificial
  CRISPR gRNA sequence
ggccctggggtgattaaggc

SEQ ID NO: 798766 - DNA, 20 bp, Artificial
  CRISPR gRNA sequence
gccctggggtgattaaggca

SEQ ID NO: 798767 - DNA, 20 bp, Artificial
  CRISPR gRNA sequence
gggtgattaaggcagttgca

SEQ ID NO: 798768 - DNA, 20 bp, Artificial
  CRISPR gRNA sequence
aggcagttgcatagtgttgg

SEQ ID NO: 798769 - DNA, 20 bp, Artificial
  CRISPR gRNA sequence
catagtgttgggaatgtgaa

SEQ ID NO: 798770 - DNA, 20 bp, Artificial
  CRISPR gRNA sequence
ggaatgtgaaagcccccaat

SEQ ID NO: 798771 - DNA, 20 bp, Artificial
  CRISPR gRNA sequence
tgggtatgggctctgaaatg

SEQ ID NO: 798772 - DNA, 20 bp, Artificial
  CRISPR gRNA sequence
tgaaatgggttggtttgcat

SEQ ID NO: 798773 - DNA, 20 bp, Artificial
  CRISPR gRNA sequence
aaatgggttggtttgcattt

SEQ ID NO: 798774 - DNA, 20 bp, Artificial
  CRISPR gRNA sequence
gtttgcatttgaaaggtgtg

SEQ ID NO: 798775 - DNA, 20 bp, Artificial
  CRISPR gRNA sequence
gcatttgaaaggtgtgctca

SEQ ID NO: 798776 - DNA, 20 bp, Artificial
  CRISPR gRNA sequence
catttgaaaggtgtgctcat

SEQ ID NO: 798777 - DNA, 20 bp, Artificial
  CRISPR gRNA sequence
gaaaggtgtgctcatgggca

SEQ ID NO: 798778 - DNA, 20 bp, Artificial
  CRISPR gRNA sequence
aaaggtgtgctcatgggcaa

SEQ ID NO: 798779 - DNA, 20 bp, Artificial
  CRISPR gRNA sequence
atgggcaagtggtttactct

SEQ ID NO: 798780 - DNA, 20 bp, Artificial
  CRISPR gRNA sequence
actctctcttagaggttaga

SEQ ID NO: 798781 - DNA, 20 bp, Artificial
  CRISPR gRNA sequence
ctctctcttagaggttagaa

SEQ ID NO: 798782 - DNA, 20 bp, Artificial
  CRISPR gRNA sequence
tctcttagaggttagaattg

SEQ ID NO: 798783 - DNA, 20 bp, Artificial
  CRISPR gRNA sequence
tcttagaggttagaattggc

SEQ ID NO: 798784 - DNA, 20 bp, Artificial
  CRISPR gRNA sequence
ttagaggttagaattggcta

SEQ ID NO: 798785 - DNA, 20 bp, Artificial
  CRISPR gRNA sequence
agaggttagaattggctaac

SEQ ID NO: 798786 - DNA, 20 bp, Artificial
  CRISPR gRNA sequence
gaggttagaattggctaacc

SEQ ID NO: 798787 - DNA, 20 bp, Artificial
  CRISPR gRNA sequence
gaattggctaaccctgggag

SEQ ID NO: 798788 - DNA, 20 bp, Artificial
  CRISPR gRNA sequence
gctaaccctgggagcggcag

SEQ ID NO: 798789 - DNA, 20 bp, Artificial
  CRISPR gRNA sequence
accctgggagcggcagtccc

SEQ ID NO: 798790 - DNA, 20 bp, Artificial
  CRISPR gRNA sequence
ggagcggcagtcccttcagg

SEQ ID NO: 798791 - DNA, 20 bp, Artificial
  CRISPR gRNA sequence
cagggtcagcaaggccccag

SEQ ID NO: 798792 - DNA, 20 bp, Artificial
  CRISPR gRNA sequence
agggtcagcaaggccccagg

SEQ ID NO: 798793 - DNA, 20 bp, Artificial
  CRISPR gRNA sequence
ccatttgcctttgtaccctt

SEQ ID NO: 798794 - DNA, 20 bp, Artificial
  CRISPR gRNA sequence
gcctttgtacccttcctttc

SEQ ID NO: 798795 - DNA, 20 bp, Artificial
  CRISPR gRNA sequence
cctttgtacccttcctttca

SEQ ID NO: 798796 - DNA, 20 bp, Artificial
  CRISPR gRNA sequence
tgtacccttcctttcaatct

SEQ ID NO: 798797 - DNA, 20 bp, Artificial
  CRISPR gRNA sequence
gtacccttcctttcaatctt

SEQ ID NO: 798798 - DNA, 20 bp, Artificial
  CRISPR gRNA sequence
tacccttcctttcaatcttc

SEQ ID NO: 798799 - DNA, 20 bp, Artificial
  CRISPR gRNA sequence
cctttcaatcttctctgctg

SEQ ID NO: 798800 - DNA, 20 bp, Artificial
  CRISPR gRNA sequence
ctttcaatcttctctgctgg

SEQ ID NO: 798801 - DNA, 20 bp, Artificial
  CRISPR gRNA sequence
tcaatcttctctgctggtga

SEQ ID NO: 798802 - DNA, 20 bp, Artificial
  CRISPR gRNA sequence
caatcttctctgctggtgac

SEQ ID NO: 798803 - DNA, 20 bp, Artificial
  CRISPR gRNA sequence
aatcttctctgctggtgacc

SEQ ID NO: 798804 - DNA, 20 bp, Artificial
  CRISPR gRNA sequence
ctctgctggtgaccgctctt

SEQ ID NO: 798805 - DNA, 20 bp, Artificial
  CRISPR gRNA sequence
tctgctggtgaccgctcttc

SEQ ID NO: 798806 - DNA, 20 bp, Artificial
  CRISPR gRNA sequence
tgctggtgaccgctcttcac

SEQ ID NO: 798807 - DNA, 20 bp, Artificial
  CRISPR gRNA sequence
ctggtgaccgctcttcacaa

SEQ ID NO: 798808 - DNA, 20 bp, Artificial
  CRISPR gRNA sequence
gtgaccgctcttcacaaaga

SEQ ID NO: 798809 - DNA, 20 bp, Artificial
  CRISPR gRNA sequence
ttcacaaagatctataaatg

SEQ ID NO: 798810 - DNA, 20 bp, Artificial
  CRISPR gRNA sequence
cacaaagatctataaatgtt

SEQ ID NO: 798811 - DNA, 20 bp, Artificial
  CRISPR gRNA sequence
acaaagatctataaatgttg

SEQ ID NO: 798812 - DNA, 20 bp, Artificial
  CRISPR gRNA sequence
taaatgttggaataccccat

SEQ ID NO: 798813 - DNA, 20 bp, Artificial
  CRISPR gRNA sequence
gaataccccatgtctcagtc

SEQ ID NO: 798814 - DNA, 20 bp, Artificial
  CRISPR gRNA sequence
agtccttgggcactctcttt

SEQ ID NO: 798815 - DNA, 20 bp, Artificial
  CRISPR gRNA sequence
gggcactctctttcctatct

SEQ ID NO: 798816 - DNA, 20 bp, Artificial
  CRISPR gRNA sequence
ggcactctctttcctatctc

SEQ ID NO: 798817 - DNA, 20 bp, Artificial
  CRISPR gRNA sequence
tctttcctatctctctgtag

SEQ ID NO: 798818 - DNA, 20 bp, Artificial
  CRISPR gRNA sequence
tttcctatctctctgtaggt

SEQ ID NO: 798819 - DNA, 20 bp, Artificial
  CRISPR gRNA sequence
tcctatctctctgtaggtga

SEQ ID NO: 798820 - DNA, 20 bp, Artificial
  CRISPR gRNA sequence
cctatctctctgtaggtgat

SEQ ID NO: 798821 - DNA, 20 bp, Artificial
  CRISPR gRNA sequence
ctatctctctgtaggtgatg

SEQ ID NO: 798822 - DNA, 20 bp, Artificial
  CRISPR gRNA sequence
tctctctgtaggtgatgtaa

SEQ ID NO: 798823 - DNA, 20 bp, Artificial
  CRISPR gRNA sequence
tctgtaggtgatgtaatgca

SEQ ID NO: 798824 - DNA, 20 bp, Artificial
  CRISPR gRNA sequence
tgtaggtgatgtaatgcaga

SEQ ID NO: 798825 - DNA, 20 bp, Artificial
  CRISPR gRNA sequence
taggtgatgtaatgcagata

SEQ ID NO: 798826 - DNA, 20 bp, Artificial
  CRISPR gRNA sequence
taaatctttaacacttctgc

SEQ ID NO: 798827 - DNA, 20 bp, Artificial
  CRISPR gRNA sequence
aaatctttaacacttctgca

SEQ ID NO: 798828 - DNA, 20 bp, Artificial
  CRISPR gRNA sequence
aatctttaacacttctgcat

SEQ ID NO: 798829 - DNA, 20 bp, Artificial
  CRISPR gRNA sequence
taacacttctgcattgatga

SEQ ID NO: 798830 - DNA, 20 bp, Artificial
  CRISPR gRNA sequence
aacacttctgcattgatgac

SEQ ID NO: 798831 - DNA, 20 bp, Artificial
  CRISPR gRNA sequence
acacttctgcattgatgact

SEQ ID NO: 798832 - DNA, 20 bp, Artificial
  CRISPR gRNA sequence
ctgcattgatgactcctaaa

SEQ ID NO: 798833 - DNA, 20 bp, Artificial
  CRISPR gRNA sequence
tgcattgatgactcctaaat

SEQ ID NO: 798834 - DNA, 20 bp, Artificial
  CRISPR gRNA sequence
cattgatgactcctaaattt

SEQ ID NO: 798835 - DNA, 20 bp, Artificial
  CRISPR gRNA sequence
atgactcctaaatttacatc

SEQ ID NO: 798836 - DNA, 20 bp, Artificial
  CRISPR gRNA sequence
ctaaatttacatctctaccc

SEQ ID NO: 798837 - DNA, 20 bp, Artificial
  CRISPR gRNA sequence
aatttacatctctaccccaa

SEQ ID NO: 798838 - DNA, 20 bp, Artificial
  CRISPR gRNA sequence
acatctctaccccaactgcc

SEQ ID NO: 798839 - DNA, 20 bp, Artificial
  CRISPR gRNA sequence
catctctaccccaactgcct

SEQ ID NO: 798840 - DNA, 20 bp, Artificial
  CRISPR gRNA sequence
taccccaactgcctactaaa

SEQ ID NO: 798841 - DNA, 20 bp, Artificial
  CRISPR gRNA sequence
ccccaactgcctactaaaca

SEQ ID NO: 798842 - DNA, 20 bp, Artificial
  CRISPR gRNA sequence
cctactaaacacctccactt

SEQ ID NO: 798843 - DNA, 20 bp, Artificial
  CRISPR gRNA sequence
ctaaacacctccacttggct

SEQ ID NO: 798844 - DNA, 20 bp, Artificial
  CRISPR gRNA sequence
aacacctccacttggctatc

SEQ ID NO: 798845 - DNA, 20 bp, Artificial
  CRISPR gRNA sequence
cacttggctatctaataggc

SEQ ID NO: 798846 - DNA, 20 bp, Artificial
  CRISPR gRNA sequence
ggctatctaataggcatttc

SEQ ID NO: 798847 - DNA, 20 bp, Artificial
  CRISPR gRNA sequence
gctatctaataggcatttca

SEQ ID NO: 798848 - DNA, 20 bp, Artificial
  CRISPR gRNA sequence
tctaataggcatttcaaacc

SEQ ID NO: 798849 - DNA, 20 bp, Artificial
  CRISPR gRNA sequence
ataggcatttcaaaccaaat

SEQ ID NO: 798850 - DNA, 20 bp, Artificial
  CRISPR gRNA sequence
caaaccaaatctacaacaaa

SEQ ID NO: 798851 - DNA, 20 bp, Artificial
  CRISPR gRNA sequence
aaaccaaatctacaacaaac

SEQ ID NO: 798852 - DNA, 20 bp, Artificial
  CRISPR gRNA sequence
caacaaacgtaactcttttt

SEQ ID NO: 798853 - DNA, 20 bp, Artificial
  CRISPR gRNA sequence
tttttccccttccttaattt

SEQ ID NO: 798854 - DNA, 20 bp, Artificial
  CRISPR gRNA sequence
tttccccttccttaatttgc

SEQ ID NO: 798855 - DNA, 20 bp, Artificial
  CRISPR gRNA sequence
ttccccttccttaatttgct

SEQ ID NO: 798856 - DNA, 20 bp, Artificial
  CRISPR gRNA sequence
tccccttccttaatttgctt

SEQ ID NO: 798857 - DNA, 20 bp, Artificial
  CRISPR gRNA sequence
ccccttccttaatttgcttc

SEQ ID NO: 798858 - DNA, 20 bp, Artificial
  CRISPR gRNA sequence
cccttccttaatttgcttct

SEQ ID NO: 798859 - DNA, 20 bp, Artificial
  CRISPR gRNA sequence
ccttaatttgcttctccccc

SEQ ID NO: 798860 - DNA, 20 bp, Artificial
  CRISPR gRNA sequence
cttaatttgcttctccccca

SEQ ID NO: 798861 - DNA, 20 bp, Artificial
  CRISPR gRNA sequence
aatttgcttctcccccagcc

SEQ ID NO: 798862 - DNA, 20 bp, Artificial
  CRISPR gRNA sequence
atttgcttctcccccagcct

SEQ ID NO: 798863 - DNA, 20 bp, Artificial
  CRISPR gRNA sequence
gcttctcccccagccttctc

SEQ ID NO: 798864 - DNA, 20 bp, Artificial
  CRISPR gRNA sequence
cttctcccccagccttctcc

SEQ ID NO: 798865 - DNA, 20 bp, Artificial
  CRISPR gRNA sequence
ctcccccagccttctccatt

SEQ ID NO: 798866 - DNA, 20 bp, Artificial
  CRISPR gRNA sequence
tcccccagccttctccattt

SEQ ID NO: 798867 - DNA, 20 bp, Artificial
  CRISPR gRNA sequence
ccccagccttctccatttta

SEQ ID NO: 798868 - DNA, 20 bp, Artificial
  CRISPR gRNA sequence
ctccattttaataaacagca

SEQ ID NO: 798869 - DNA, 20 bp, Artificial
  CRISPR gRNA sequence
tccattttaataaacagcat

SEQ ID NO: 798870 - DNA, 20 bp, Artificial
  CRISPR gRNA sequence
cattttaataaacagcatct

SEQ ID NO: 798871 - DNA, 20 bp, Artificial
  CRISPR gRNA sequence
taataaacagcatctccatt

SEQ ID NO: 798872 - DNA, 20 bp, Artificial
  CRISPR gRNA sequence
aataaacagcatctccattg

SEQ ID NO: 798873 - DNA, 20 bp, Artificial
  CRISPR gRNA sequence
ataaacagcatctccattgc

SEQ ID NO: 798874 - DNA, 20 bp, Artificial
  CRISPR gRNA sequence
cattgccttagtgactcaag

SEQ ID NO: 798875 - DNA, 20 bp, Artificial
  CRISPR gRNA sequence
ccttagtgactcaagcccca

SEQ ID NO: 798876 - DNA, 20 bp, Artificial
  CRISPR gRNA sequence
agtgactcaagccccaaact

SEQ ID NO: 798877 - DNA, 20 bp, Artificial
  CRISPR gRNA sequence
gtgactcaagccccaaactt

SEQ ID NO: 798878 - DNA, 20 bp, Artificial
  CRISPR gRNA sequence
aagccccaaacttaggaatt

SEQ ID NO: 798879 - DNA, 20 bp, Artificial
  CRISPR gRNA sequence
aggaattttcccagatttcc

SEQ ID NO: 798880 - DNA, 20 bp, Artificial
  CRISPR gRNA sequence
ggaattttcccagatttccc

SEQ ID NO: 798881 - DNA, 20 bp, Artificial
  CRISPR gRNA sequence
tcccagatttccctcttttt

SEQ ID NO: 798882 - DNA, 20 bp, Artificial
  CRISPR gRNA sequence
cccagatttccctctttttc

SEQ ID NO: 798883 - DNA, 20 bp, Artificial
  CRISPR gRNA sequence
ccagatttccctctttttct

SEQ ID NO: 798884 - DNA, 20 bp, Artificial
  CRISPR gRNA sequence
ccctctttttctcaaactat

SEQ ID NO: 798885 - DNA, 20 bp, Artificial
  CRISPR gRNA sequence
cctctttttctcaaactata

SEQ ID NO: 798886 - DNA, 20 bp, Artificial
  CRISPR gRNA sequence
tttttctcaaactatatatc

SEQ ID NO: 798887 - DNA, 20 bp, Artificial
  CRISPR gRNA sequence
tttctcaaactatatatcta

SEQ ID NO: 798888 - DNA, 20 bp, Artificial
  CRISPR gRNA sequence
ttctcaaactatatatctag

SEQ ID NO: 798889 - DNA, 20 bp, Artificial
  CRISPR gRNA sequence
tctcaaactatatatctagc

SEQ ID NO: 798890 - DNA, 20 bp, Artificial
  CRISPR gRNA sequence
ctcaaactatatatctagcc

SEQ ID NO: 798891 - DNA, 20 bp, Artificial
  CRISPR gRNA sequence
tcaaactatatatctagcct

SEQ ID NO: 798892 - DNA, 20 bp, Artificial
  CRISPR gRNA sequence
aaactatatatctagcctgt

SEQ ID NO: 798893 - DNA, 20 bp, Artificial
  CRISPR gRNA sequence
tatatctagcctgtcagcag

SEQ ID NO: 798894 - DNA, 20 bp, Artificial
  CRISPR gRNA sequence
gcctgtcagcagttcccttc

SEQ ID NO: 798895 - DNA, 20 bp, Artificial
  CRISPR gRNA sequence
tcagcagttcccttcaggtc

SEQ ID NO: 798896 - DNA, 20 bp, Artificial
  CRISPR gRNA sequence
ccttcaggtcttttttcaaa

SEQ ID NO: 798897 - DNA, 20 bp, Artificial
  CRISPR gRNA sequence
caggtcttttttcaaactat

SEQ ID NO: 798898 - DNA, 20 bp, Artificial
  CRISPR gRNA sequence
aggtcttttttcaaactata

SEQ ID NO: 798899 - DNA, 20 bp, Artificial
  CRISPR gRNA sequence
ttttcaaactatagaaggcc

SEQ ID NO: 798900 - DNA, 20 bp, Artificial
  CRISPR gRNA sequence
tttcaaactatagaaggcct

SEQ ID NO: 798901 - DNA, 20 bp, Artificial
  CRISPR gRNA sequence
ttcaaactatagaaggccta

SEQ ID NO: 798902 - DNA, 20 bp, Artificial
  CRISPR gRNA sequence
tcaaactatagaaggcctaa

SEQ ID NO: 798903 - DNA, 20 bp, Artificial
  CRISPR gRNA sequence
caaactatagaaggcctaaa

SEQ ID NO: 798904 - DNA, 20 bp, Artificial
  CRISPR gRNA sequence
aaactatagaaggcctaaac

SEQ ID NO: 798905 - DNA, 20 bp, Artificial
  CRISPR gRNA sequence
tagaaggcctaaacaaagga

SEQ ID NO: 798906 - DNA, 20 bp, Artificial
  CRISPR gRNA sequence
aacaaaggaaagacatgctg

SEQ ID NO: 798907 - DNA, 20 bp, Artificial
  CRISPR gRNA sequence
tattcatgaattggaagact

SEQ ID NO: 798908 - DNA, 20 bp, Artificial
  CRISPR gRNA sequence
atgaattggaagactaaata

SEQ ID NO: 798909 - DNA, 20 bp, Artificial
  CRISPR gRNA sequence
gaagactaaatattattcag

SEQ ID NO: 798910 - DNA, 20 bp, Artificial
  CRISPR gRNA sequence
aatattattcagctggctgt

SEQ ID NO: 798911 - DNA, 20 bp, Artificial
  CRISPR gRNA sequence
ttcagctggctgtattcccc

SEQ ID NO: 798912 - DNA, 20 bp, Artificial
  CRISPR gRNA sequence
agctggctgtattccccaaa

SEQ ID NO: 798913 - DNA, 20 bp, Artificial
  CRISPR gRNA sequence
gctgtattccccaaattgat

SEQ ID NO: 798914 - DNA, 20 bp, Artificial
  CRISPR gRNA sequence
tattccccaaattgatctat

SEQ ID NO: 798915 - DNA, 20 bp, Artificial
  CRISPR gRNA sequence
cccaaattgatctatggatt

SEQ ID NO: 798916 - DNA, 20 bp, Artificial
  CRISPR gRNA sequence
atctatggattcaatgcaat

SEQ ID NO: 798917 - DNA, 20 bp, Artificial
  CRISPR gRNA sequence
tggattcaatgcaatcccta

SEQ ID NO: 798918 - DNA, 20 bp, Artificial
  CRISPR gRNA sequence
aatgcaatccctaccaaaat

SEQ ID NO: 798919 - DNA, 20 bp, Artificial
  CRISPR gRNA sequence
ccaaaattccagcttccttt

SEQ ID NO: 798920 - DNA, 20 bp, Artificial
  CRISPR gRNA sequence
cagcttcctttgtctgcaga

SEQ ID NO: 798921 - DNA, 20 bp, Artificial
  CRISPR gRNA sequence
cctttgtctgcagaaatgag

SEQ ID NO: 798922 - DNA, 20 bp, Artificial
  CRISPR gRNA sequence
ctttgtctgcagaaatgagc

SEQ ID NO: 798923 - DNA, 20 bp, Artificial
  CRISPR gRNA sequence
tgtctgcagaaatgagcaag

SEQ ID NO: 798924 - DNA, 20 bp, Artificial
  CRISPR gRNA sequence
gtctgcagaaatgagcaagt

SEQ ID NO: 798925 - DNA, 20 bp, Artificial
  CRISPR gRNA sequence
tctgcagaaatgagcaagtt

SEQ ID NO: 798926 - DNA, 20 bp, Artificial
  CRISPR gRNA sequence
cagaaatgagcaagttgacc

SEQ ID NO: 798927 - DNA, 20 bp, Artificial
  CRISPR gRNA sequence
accctaaaattcatttgaaa

SEQ ID NO: 798928 - DNA, 20 bp, Artificial
  CRISPR gRNA sequence
aaattcatttgaaaatgtaa

SEQ ID NO: 798929 - DNA, 20 bp, Artificial
  CRISPR gRNA sequence
atttgaaaatgtaaggaagc

SEQ ID NO: 798930 - DNA, 20 bp, Artificial
  CRISPR gRNA sequence
gaaaatgtaaggaagcccga

SEQ ID NO: 798931 - DNA, 20 bp, Artificial
  CRISPR gRNA sequence
aaaatgtaaggaagcccgaa

SEQ ID NO: 798932 - DNA, 20 bp, Artificial
  CRISPR gRNA sequence
aaaaaaaatcttgaaaaaga

SEQ ID NO: 798933 - DNA, 20 bp, Artificial
  CRISPR gRNA sequence
gaaaaagactaacaaagttg

SEQ ID NO: 798934 - DNA, 20 bp, Artificial
  CRISPR gRNA sequence
aaaaagactaacaaagttgg

SEQ ID NO: 798935 - DNA, 20 bp, Artificial
  CRISPR gRNA sequence
acaaagttggaggactcaca

SEQ ID NO: 798936 - DNA, 20 bp, Artificial
  CRISPR gRNA sequence
gaggactcacactttccagt

SEQ ID NO: 798937 - DNA, 20 bp, Artificial
  CRISPR gRNA sequence
acactttccagtttcaaaac

SEQ ID NO: 798938 - DNA, 20 bp, Artificial
  CRISPR gRNA sequence
tccagtttcaaaacttacta

SEQ ID NO: 798939 - DNA, 20 bp, Artificial
  CRISPR gRNA sequence
ccagtttcaaaacttactac

SEQ ID NO: 798940 - DNA, 20 bp, Artificial
  CRISPR gRNA sequence
cagtttcaaaacttactaca

SEQ ID NO: 798941 - DNA, 20 bp, Artificial
  CRISPR gRNA sequence
caaaacttactacaaagcta

SEQ ID NO: 798942 - DNA, 20 bp, Artificial
  CRISPR gRNA sequence
aaaacttactacaaagctac

SEQ ID NO: 798943 - DNA, 20 bp, Artificial
  CRISPR gRNA sequence
actacaaagctacagtaatc

SEQ ID NO: 798944 - DNA, 20 bp, Artificial
  CRISPR gRNA sequence
ctacaaagctacagtaatca

SEQ ID NO: 798945 - DNA, 20 bp, Artificial
  CRISPR gRNA sequence
caaagctacagtaatcaacg

SEQ ID NO: 798946 - DNA, 20 bp, Artificial
  CRISPR gRNA sequence
cagtaatcaacgctgtgtgg

SEQ ID NO: 798947 - DNA, 20 bp, Artificial
  CRISPR gRNA sequence
tgtggtactgacataggata

SEQ ID NO: 798948 - DNA, 20 bp, Artificial
  CRISPR gRNA sequence
acataggatagacatatagt

SEQ ID NO: 798949 - DNA, 20 bp, Artificial
  CRISPR gRNA sequence
aataaaacagaatcgagagt

SEQ ID NO: 798950 - DNA, 20 bp, Artificial
  CRISPR gRNA sequence
atatatatgatcaattgatg

SEQ ID NO: 798951 - DNA, 20 bp, Artificial
  CRISPR gRNA sequence
tatatatgatcaattgatgt

SEQ ID NO: 798952 - DNA, 20 bp, Artificial
  CRISPR gRNA sequence
atgttttgcaagggtgccaa

SEQ ID NO: 798953 - DNA, 20 bp, Artificial
  CRISPR gRNA sequence
tgcaagggtgccaagacagt

SEQ ID NO: 798954 - DNA, 20 bp, Artificial
  CRISPR gRNA sequence
gcaagggtgccaagacagtt

SEQ ID NO: 798955 - DNA, 20 bp, Artificial
  CRISPR gRNA sequence
caagggtgccaagacagttc

SEQ ID NO: 798956 - DNA, 20 bp, Artificial
  CRISPR gRNA sequence
aatagggaaagaataatttc

SEQ ID NO: 798957 - DNA, 20 bp, Artificial
  CRISPR gRNA sequence
cctcaacaaattgtacaggc

SEQ ID NO: 798958 - DNA, 20 bp, Artificial
  CRISPR gRNA sequence
ctcaacaaattgtacaggca

SEQ ID NO: 798959 - DNA, 20 bp, Artificial
  CRISPR gRNA sequence
aacaaattgtacaggcacaa

SEQ ID NO: 798960 - DNA, 20 bp, Artificial
  CRISPR gRNA sequence
tacaggcacaactgaatgcc

SEQ ID NO: 798961 - DNA, 20 bp, Artificial
  CRISPR gRNA sequence
aatgcccacaatcagtagaa

SEQ ID NO: 798962 - DNA, 20 bp, Artificial
  CRISPR gRNA sequence
ggaactaaagttcttatatt

SEQ ID NO: 798963 - DNA, 20 bp, Artificial
  CRISPR gRNA sequence
gaactaaagttcttatattt

SEQ ID NO: 798964 - DNA, 20 bp, Artificial
  CRISPR gRNA sequence
aagttcttatatttaggttc

SEQ ID NO: 798965 - DNA, 20 bp, Artificial
  CRISPR gRNA sequence
ttatatttaggttcttgatc

SEQ ID NO: 798966 - DNA, 20 bp, Artificial
  CRISPR gRNA sequence
atatttaggttcttgatcca

SEQ ID NO: 798967 - DNA, 20 bp, Artificial
  CRISPR gRNA sequence
tatttaggttcttgatccat

SEQ ID NO: 798968 - DNA, 20 bp, Artificial
  CRISPR gRNA sequence
aggttcttgatccattttgt

SEQ ID NO: 798969 - DNA, 20 bp, Artificial
  CRISPR gRNA sequence
ggttcttgatccattttgtt

SEQ ID NO: 798970 - DNA, 20 bp, Artificial
  CRISPR gRNA sequence
ttgatccattttgtttaatt

SEQ ID NO: 798971 - DNA, 20 bp, Artificial
  CRISPR gRNA sequence
gatccattttgtttaatttt

SEQ ID NO: 798972 - DNA, 20 bp, Artificial
  CRISPR gRNA sequence
atccattttgtttaattttt

SEQ ID NO: 798973 - DNA, 20 bp, Artificial
  CRISPR gRNA sequence
tgtttaatttttgtatatgg

SEQ ID NO: 798974 - DNA, 20 bp, Artificial
  CRISPR gRNA sequence
gtttaatttttgtatatggt

SEQ ID NO: 798975 - DNA, 20 bp, Artificial
  CRISPR gRNA sequence
tttaatttttgtatatggta

SEQ ID NO: 798976 - DNA, 20 bp, Artificial
  CRISPR gRNA sequence
aatttttgtatatggtatga

SEQ ID NO: 798977 - DNA, 20 bp, Artificial
  CRISPR gRNA sequence
atttttgtatatggtatgag

SEQ ID NO: 798978 - DNA, 20 bp, Artificial
  CRISPR gRNA sequence
ttgtatatggtatgaggtaa

SEQ ID NO: 798979 - DNA, 20 bp, Artificial
  CRISPR gRNA sequence
tgtatatggtatgaggtaag

SEQ ID NO: 798980 - DNA, 20 bp, Artificial
  CRISPR gRNA sequence
gtatatggtatgaggtaagg

SEQ ID NO: 798981 - DNA, 20 bp, Artificial
  CRISPR gRNA sequence
tatatggtatgaggtaaggc

SEQ ID NO: 798982 - DNA, 20 bp, Artificial
  CRISPR gRNA sequence
caaatttgttcttttgcatg

SEQ ID NO: 798983 - DNA, 20 bp, Artificial
  CRISPR gRNA sequence
gttcttttgcatgtggacat

SEQ ID NO: 798984 - DNA, 20 bp, Artificial
  CRISPR gRNA sequence
ttcttttgcatgtggacatc

SEQ ID NO: 798985 - DNA, 20 bp, Artificial
  CRISPR gRNA sequence
ttttgcatgtggacatccag

SEQ ID NO: 798986 - DNA, 20 bp, Artificial
  CRISPR gRNA sequence
ttgcatgtggacatccagtt

SEQ ID NO: 798987 - DNA, 20 bp, Artificial
  CRISPR gRNA sequence
tgcatgtggacatccagttg

SEQ ID NO: 798988 - DNA, 20 bp, Artificial
  CRISPR gRNA sequence
gcatgtggacatccagttgt

SEQ ID NO: 798989 - DNA, 20 bp, Artificial
  CRISPR gRNA sequence
catgtggacatccagttgtc

SEQ ID NO: 798990 - DNA, 20 bp, Artificial
  CRISPR gRNA sequence
tccctgtacaattgctccat

SEQ ID NO: 798991 - DNA, 20 bp, Artificial
  CRISPR gRNA sequence
tacaattgctccatttatat

SEQ ID NO: 798992 - DNA, 20 bp, Artificial
  CRISPR gRNA sequence
ctccatttatatttatctta

SEQ ID NO: 798993 - DNA, 20 bp, Artificial
  CRISPR gRNA sequence
catttatatttatcttagca

SEQ ID NO: 798994 - DNA, 20 bp, Artificial
  CRISPR gRNA sequence
atatttatcttagcagaaaa

SEQ ID NO: 798995 - DNA, 20 bp, Artificial
  CRISPR gRNA sequence
tatttatcttagcagaaaat

SEQ ID NO: 798996 - DNA, 20 bp, Artificial
  CRISPR gRNA sequence
atcttagcagaaaatacaga

SEQ ID NO: 798997 - DNA, 20 bp, Artificial
  CRISPR gRNA sequence
tcttagcagaaaatacagat

SEQ ID NO: 798998 - DNA, 20 bp, Artificial
  CRISPR gRNA sequence
agcagaaaatacagatgtaa

SEQ ID NO: 798999 - DNA, 20 bp, Artificial
  CRISPR gRNA sequence
gcagaaaatacagatgtaaa

SEQ ID NO: 799000 - DNA, 20 bp, Artificial
  CRISPR gRNA sequence
tgtgaccttgactaggcaat

SEQ ID NO: 799001 - DNA, 20 bp, Artificial
  CRISPR gRNA sequence
gtgaccttgactaggcaatg

SEQ ID NO: 799002 - DNA, 20 bp, Artificial
  CRISPR gRNA sequence
tgaccttgactaggcaatgg

SEQ ID NO: 799003 - DNA, 20 bp, Artificial
  CRISPR gRNA sequence
gactaggcaatggtttctta

SEQ ID NO: 799004 - DNA, 20 bp, Artificial
  CRISPR gRNA sequence
actaggcaatggtttcttag

SEQ ID NO: 799005 - DNA, 20 bp, Artificial
  CRISPR gRNA sequence
ggcaatggtttcttaggtat

SEQ ID NO: 799006 - DNA, 20 bp, Artificial
  CRISPR gRNA sequence
cttaggtattacacctaaag

SEQ ID NO: 799007 - DNA, 20 bp, Artificial
  CRISPR gRNA sequence
ttaggtattacacctaaagc

SEQ ID NO: 799008 - DNA, 20 bp, Artificial
  CRISPR gRNA sequence
aggtattacacctaaagcac

SEQ ID NO: 799009 - DNA, 20 bp, Artificial
  CRISPR gRNA sequence
ggtattacacctaaagcaca

SEQ ID NO: 799010 - DNA, 20 bp, Artificial
  CRISPR gRNA sequence
cacctaaagcacaaacaata

SEQ ID NO: 799011 - DNA, 20 bp, Artificial
  CRISPR gRNA sequence
aagcacaaacaataaaagaa

SEQ ID NO: 799012 - DNA, 20 bp, Artificial
  CRISPR gRNA sequence
gatttttttacttaaaatca

SEQ ID NO: 799013 - DNA, 20 bp, Artificial
  CRISPR gRNA sequence
ttttacttaaaatcaatttg

SEQ ID NO: 799014 - DNA, 20 bp, Artificial
  CRISPR gRNA sequence
tttacttaaaatcaatttgt

SEQ ID NO: 799015 - DNA, 20 bp, Artificial
  CRISPR gRNA sequence
ttacttaaaatcaatttgtg

SEQ ID NO: 799016 - DNA, 20 bp, Artificial
  CRISPR gRNA sequence
tacttaaaatcaatttgtgt

SEQ ID NO: 799017 - DNA, 20 bp, Artificial
  CRISPR gRNA sequence
acttaaaatcaatttgtgtt

SEQ ID NO: 799018 - DNA, 20 bp, Artificial
  CRISPR gRNA sequence
cttaaaatcaatttgtgttt

SEQ ID NO: 799019 - DNA, 20 bp, Artificial
  CRISPR gRNA sequence
aaaatcaatttgtgtttcaa

SEQ ID NO: 799020 - DNA, 20 bp, Artificial
  CRISPR gRNA sequence
aaatcaatttgtgtttcaaa

SEQ ID NO: 799021 - DNA, 20 bp, Artificial
  CRISPR gRNA sequence
gtgtttcaaaattaaataaa

SEQ ID NO: 799022 - DNA, 20 bp, Artificial
  CRISPR gRNA sequence
tgtttcaaaattaaataaaa

SEQ ID NO: 799023 - DNA, 20 bp, Artificial
  CRISPR gRNA sequence
caaaattaaataaaatcaaa

SEQ ID NO: 799024 - DNA, 20 bp, Artificial
  CRISPR gRNA sequence
aaaattaaataaaatcaaaa

SEQ ID NO: 799025 - DNA, 20 bp, Artificial
  CRISPR gRNA sequence
aataaaatcaaaattaaatt

SEQ ID NO: 799026 - DNA, 20 bp, Artificial
  CRISPR gRNA sequence
aattaaaacatttatccttc

SEQ ID NO: 799027 - DNA, 20 bp, Artificial
  CRISPR gRNA sequence
aaacatttatccttcacagg

SEQ ID NO: 799028 - DNA, 20 bp, Artificial
  CRISPR gRNA sequence
atccttcacaggattctata

SEQ ID NO: 799029 - DNA, 20 bp, Artificial
  CRISPR gRNA sequence
tccttcacaggattctataa

SEQ ID NO: 799030 - DNA, 20 bp, Artificial
  CRISPR gRNA sequence
cacaggattctataaagaaa

SEQ ID NO: 799031 - DNA, 20 bp, Artificial
  CRISPR gRNA sequence
acaggattctataaagaaac

SEQ ID NO: 799032 - DNA, 20 bp, Artificial
  CRISPR gRNA sequence
tataaagaaactgaaaagac

SEQ ID NO: 799033 - DNA, 20 bp, Artificial
  CRISPR gRNA sequence
taaagaaactgaaaagacaa

SEQ ID NO: 799034 - DNA, 20 bp, Artificial
  CRISPR gRNA sequence
aaaagacaatgtgcagaatg

SEQ ID NO: 799035 - DNA, 20 bp, Artificial
  CRISPR gRNA sequence
ccaaatcatatatttgataa

SEQ ID NO: 799036 - DNA, 20 bp, Artificial
  CRISPR gRNA sequence
caaatcatatatttgataaa

SEQ ID NO: 799037 - DNA, 20 bp, Artificial
  CRISPR gRNA sequence
gataaatagtttggcaattc

SEQ ID NO: 799038 - DNA, 20 bp, Artificial
  CRISPR gRNA sequence
ataaatagtttggcaattcc

SEQ ID NO: 799039 - DNA, 20 bp, Artificial
  CRISPR gRNA sequence
ggcaattcctcaaaaagtta

SEQ ID NO: 799040 - DNA, 20 bp, Artificial
  CRISPR gRNA sequence
gcaattcctcaaaaagttaa

SEQ ID NO: 799041 - DNA, 20 bp, Artificial
  CRISPR gRNA sequence
ctcaaaaagttaaatataga

SEQ ID NO: 799042 - DNA, 20 bp, Artificial
  CRISPR gRNA sequence
aaaaagttaaatatagagtt

SEQ ID NO: 799043 - DNA, 20 bp, Artificial
  CRISPR gRNA sequence
aatatagagttaccatttaa

SEQ ID NO: 799044 - DNA, 20 bp, Artificial
  CRISPR gRNA sequence
ccatttaattcagcaattct

SEQ ID NO: 799045 - DNA, 20 bp, Artificial
  CRISPR gRNA sequence
aattcagcaattctactcct

SEQ ID NO: 799046 - DNA, 20 bp, Artificial
  CRISPR gRNA sequence
attcagcaattctactccta

SEQ ID NO: 799047 - DNA, 20 bp, Artificial
  CRISPR gRNA sequence
agcaattctactcctacata

SEQ ID NO: 799048 - DNA, 20 bp, Artificial
  CRISPR gRNA sequence
tactcctacatatgtaccca

SEQ ID NO: 799049 - DNA, 20 bp, Artificial
  CRISPR gRNA sequence
ctcctacatatgtacccaag

SEQ ID NO: 799050 - DNA, 20 bp, Artificial
  CRISPR gRNA sequence
ctacatatgtacccaagata

SEQ ID NO: 799051 - DNA, 20 bp, Artificial
  CRISPR gRNA sequence
catatgtacccaagataatt

SEQ ID NO: 799052 - DNA, 20 bp, Artificial
  CRISPR gRNA sequence
aaagtatacatagacaaaga

SEQ ID NO: 799053 - DNA, 20 bp, Artificial
  CRISPR gRNA sequence
gtatatgagttttcatagga

SEQ ID NO: 799054 - DNA, 20 bp, Artificial
  CRISPR gRNA sequence
tatatgagttttcataggaa

SEQ ID NO: 799055 - DNA, 20 bp, Artificial
  CRISPR gRNA sequence
tcataggaactttattcata

SEQ ID NO: 799056 - DNA, 20 bp, Artificial
  CRISPR gRNA sequence
cataggaactttattcataa

SEQ ID NO: 799057 - DNA, 20 bp, Artificial
  CRISPR gRNA sequence
ataggaactttattcataat

SEQ ID NO: 799058 - DNA, 20 bp, Artificial
  CRISPR gRNA sequence
tattcataatagccaacaag

SEQ ID NO: 799059 - DNA, 20 bp, Artificial
  CRISPR gRNA sequence
attcataatagccaacaagc

SEQ ID NO: 799060 - DNA, 20 bp, Artificial
  CRISPR gRNA sequence
ttcataatagccaacaagca

SEQ ID NO: 799061 - DNA, 20 bp, Artificial
  CRISPR gRNA sequence
ataatagccaacaagcagaa

SEQ ID NO: 799062 - DNA, 20 bp, Artificial
  CRISPR gRNA sequence
atgaatgggtaagcaaaatg

SEQ ID NO: 799063 - DNA, 20 bp, Artificial
  CRISPR gRNA sequence
tttagtcacaaaaaggaacg

SEQ ID NO: 799064 - DNA, 20 bp, Artificial
  CRISPR gRNA sequence
agtcacaaaaaggaacgcag

SEQ ID NO: 799065 - DNA, 20 bp, Artificial
  CRISPR gRNA sequence
gtcacaaaaaggaacgcagt

SEQ ID NO: 799066 - DNA, 20 bp, Artificial
  CRISPR gRNA sequence
atatatgctacaatacagat

SEQ ID NO: 799067 - DNA, 20 bp, Artificial
  CRISPR gRNA sequence
caatacagatgaaccttgac

SEQ ID NO: 799068 - DNA, 20 bp, Artificial
  CRISPR gRNA sequence
gacaacattatgttcggtga

SEQ ID NO: 799069 - DNA, 20 bp, Artificial
  CRISPR gRNA sequence
acaacattatgttcggtgaa

SEQ ID NO: 799070 - DNA, 20 bp, Artificial
  CRISPR gRNA sequence
tgttcggtgaaaaaagccag

SEQ ID NO: 799071 - DNA, 20 bp, Artificial
  CRISPR gRNA sequence
ggtgaaaaaagccagccaca

SEQ ID NO: 799072 - DNA, 20 bp, Artificial
  CRISPR gRNA sequence
cttgattccatttttatgaa

SEQ ID NO: 799073 - DNA, 20 bp, Artificial
  CRISPR gRNA sequence
gattccatttttatgaaata

SEQ ID NO: 799074 - DNA, 20 bp, Artificial
  CRISPR gRNA sequence
attccatttttatgaaatat

SEQ ID NO: 799075 - DNA, 20 bp, Artificial
  CRISPR gRNA sequence
catttttatgaaatatccag

SEQ ID NO: 799076 - DNA, 20 bp, Artificial
  CRISPR gRNA sequence
ttatgaaatatccagaataa

SEQ ID NO: 799077 - DNA, 20 bp, Artificial
  CRISPR gRNA sequence
tatgaaatatccagaataag

SEQ ID NO: 799078 - DNA, 20 bp, Artificial
  CRISPR gRNA sequence
atgaaatatccagaataagc

SEQ ID NO: 799079 - DNA, 20 bp, Artificial
  CRISPR gRNA sequence
tgaaatatccagaataagca

SEQ ID NO: 799080 - DNA, 20 bp, Artificial
  CRISPR gRNA sequence
atagagacagaaactagatt

SEQ ID NO: 799081 - DNA, 20 bp, Artificial
  CRISPR gRNA sequence
gattagtggttgccaagggc

SEQ ID NO: 799082 - DNA, 20 bp, Artificial
  CRISPR gRNA sequence
gtggttgccaagggccatag

SEQ ID NO: 799083 - DNA, 20 bp, Artificial
  CRISPR gRNA sequence
ccaagggccatagggaaagg

SEQ ID NO: 799084 - DNA, 20 bp, Artificial
  CRISPR gRNA sequence
ctgctaatgggtaaggggtt

SEQ ID NO: 799085 - DNA, 20 bp, Artificial
  CRISPR gRNA sequence
tgctaatgggtaaggggttc

SEQ ID NO: 799086 - DNA, 20 bp, Artificial
  CRISPR gRNA sequence
ctaatgggtaaggggttcct

SEQ ID NO: 799087 - DNA, 20 bp, Artificial
  CRISPR gRNA sequence
atgggtaaggggttcctttt

SEQ ID NO: 799088 - DNA, 20 bp, Artificial
  CRISPR gRNA sequence
cttttcagggtaatgaaaat

SEQ ID NO: 799089 - DNA, 20 bp, Artificial
  CRISPR gRNA sequence
ttcagggtaatgaaaatgtt

SEQ ID NO: 799090 - DNA, 20 bp, Artificial
  CRISPR gRNA sequence
tcagggtaatgaaaatgttc

SEQ ID NO: 799091 - DNA, 20 bp, Artificial
  CRISPR gRNA sequence
cagggtaatgaaaatgttct

SEQ ID NO: 799092 - DNA, 20 bp, Artificial
  CRISPR gRNA sequence
agggtaatgaaaatgttcta

SEQ ID NO: 799093 - DNA, 20 bp, Artificial
  CRISPR gRNA sequence
taaaattggataatagtgtt

SEQ ID NO: 799094 - DNA, 20 bp, Artificial
  CRISPR gRNA sequence
aaattggataatagtgtttg

SEQ ID NO: 799095 - DNA, 20 bp, Artificial
  CRISPR gRNA sequence
gataatagtgtttgttgcac

SEQ ID NO: 799096 - DNA, 20 bp, Artificial
  CRISPR gRNA sequence
gttgcacaactccgtgaaca

SEQ ID NO: 799097 - DNA, 20 bp, Artificial
  CRISPR gRNA sequence
ttgcacaactccgtgaacat

SEQ ID NO: 799098 - DNA, 20 bp, Artificial
  CRISPR gRNA sequence
cacaactccgtgaacatact

SEQ ID NO: 799099 - DNA, 20 bp, Artificial
  CRISPR gRNA sequence
cgtgaacatactaaaaacca

SEQ ID NO: 799100 - DNA, 20 bp, Artificial
  CRISPR gRNA sequence
aaaaccacagagtcgtgcac

SEQ ID NO: 799101 - DNA, 20 bp, Artificial
  CRISPR gRNA sequence
aaaaaaagtttgtgttttaa

SEQ ID NO: 799102 - DNA, 20 bp, Artificial
  CRISPR gRNA sequence
aaaaaagtttgtgttttaaa

SEQ ID NO: 799103 - DNA, 20 bp, Artificial
  CRISPR gRNA sequence
gtgttttaaatatatataca

SEQ ID NO: 799104 - DNA, 20 bp, Artificial
  CRISPR gRNA sequence
tgttttaaatatatatacac

SEQ ID NO: 799105 - DNA, 20 bp, Artificial
  CRISPR gRNA sequence
taaatatatatacacactta

SEQ ID NO: 799106 - DNA, 20 bp, Artificial
  CRISPR gRNA sequence
aaatatatatacacacttag

SEQ ID NO: 799107 - DNA, 20 bp, Artificial
  CRISPR gRNA sequence
aatatatatacacacttaga

SEQ ID NO: 799108 - DNA, 20 bp, Artificial
  CRISPR gRNA sequence
agacacatataaccctcttt

SEQ ID NO: 799109 - DNA, 20 bp, Artificial
  CRISPR gRNA sequence
gacacatataaccctctttc

SEQ ID NO: 799110 - DNA, 20 bp, Artificial
  CRISPR gRNA sequence
tttcgtatatcaattatact

SEQ ID NO: 799111 - DNA, 20 bp, Artificial
  CRISPR gRNA sequence
tcgtatatcaattatacttt

SEQ ID NO: 799112 - DNA, 20 bp, Artificial
  CRISPR gRNA sequence
cgtatatcaattatacttta

SEQ ID NO: 799113 - DNA, 20 bp, Artificial
  CRISPR gRNA sequence
gtatatcaattatactttaa

SEQ ID NO: 799114 - DNA, 20 bp, Artificial
  CRISPR gRNA sequence
tactttaataaagctgttga

SEQ ID NO: 799115 - DNA, 20 bp, Artificial
  CRISPR gRNA sequence
taataaagctgttgaaattt

SEQ ID NO: 799116 - DNA, 20 bp, Artificial
  CRISPR gRNA sequence
aataaagctgttgaaatttt

SEQ ID NO: 799117 - DNA, 20 bp, Artificial
  CRISPR gRNA sequence
ataaagctgttgaaattttt

SEQ ID NO: 799118 - DNA, 20 bp, Artificial
  CRISPR gRNA sequence
ttgaaatttttaaaataaaa

SEQ ID NO: 799119 - DNA, 20 bp, Artificial
  CRISPR gRNA sequence
aaatttttaaaataaaattt

SEQ ID NO: 799120 - DNA, 20 bp, Artificial
  CRISPR gRNA sequence
ttaaaataaaattttaaaac

SEQ ID NO: 799121 - DNA, 20 bp, Artificial
  CRISPR gRNA sequence
taaaataaaattttaaaaca

SEQ ID NO: 799122 - DNA, 20 bp, Artificial
  CRISPR gRNA sequence
aaaataaaattttaaaacaa

SEQ ID NO: 799123 - DNA, 20 bp, Artificial
  CRISPR gRNA sequence
aaataaaattttaaaacaaa

SEQ ID NO: 799124 - DNA, 20 bp, Artificial
  CRISPR gRNA sequence
taaaacaaagaaaaaatata

SEQ ID NO: 799125 - DNA, 20 bp, Artificial
  CRISPR gRNA sequence
aaaacaaagaaaaaatatat

SEQ ID NO: 799126 - DNA, 20 bp, Artificial
  CRISPR gRNA sequence
aaacaaagaaaaaatatata

SEQ ID NO: 799127 - DNA, 20 bp, Artificial
  CRISPR gRNA sequence
gccaacagaccacttctcac

SEQ ID NO: 799128 - DNA, 20 bp, Artificial
  CRISPR gRNA sequence
ctcacccctactagcccctc

SEQ ID NO: 799129 - DNA, 20 bp, Artificial
  CRISPR gRNA sequence
tcacccctactagcccctct

SEQ ID NO: 799130 - DNA, 20 bp, Artificial
  CRISPR gRNA sequence
acccctactagcccctctac

SEQ ID NO: 799131 - DNA, 20 bp, Artificial
  CRISPR gRNA sequence
ctagcccctctactctaagc

SEQ ID NO: 799132 - DNA, 20 bp, Artificial
  CRISPR gRNA sequence
gcccctctactctaagctat

SEQ ID NO: 799133 - DNA, 20 bp, Artificial
  CRISPR gRNA sequence
tactctaagctatcagcatt

SEQ ID NO: 799134 - DNA, 20 bp, Artificial
  CRISPR gRNA sequence
ctctaagctatcagcatttc

SEQ ID NO: 799135 - DNA, 20 bp, Artificial
  CRISPR gRNA sequence
taagctatcagcatttctgc

SEQ ID NO: 799136 - DNA, 20 bp, Artificial
  CRISPR gRNA sequence
agctatcagcatttctgcaa

SEQ ID NO: 799137 - DNA, 20 bp, Artificial
  CRISPR gRNA sequence
tcagcatttctgcaaacaca

SEQ ID NO: 799138 - DNA, 20 bp, Artificial
  CRISPR gRNA sequence
ctgcaaacacattcctaacc

SEQ ID NO: 799139 - DNA, 20 bp, Artificial
  CRISPR gRNA sequence
tgcaaacacattcctaaccg

SEQ ID NO: 799140 - DNA, 20 bp, Artificial
  CRISPR gRNA sequence
caaacacattcctaaccgat

SEQ ID NO: 799141 - DNA, 20 bp, Artificial
  CRISPR gRNA sequence
ctaaccgatctcactgcttg

SEQ ID NO: 799142 - DNA, 20 bp, Artificial
  CRISPR gRNA sequence
accgatctcactgcttgtaa

SEQ ID NO: 799143 - DNA, 20 bp, Artificial
  CRISPR gRNA sequence
actgcttgtaatcttgccag

SEQ ID NO: 799144 - DNA, 20 bp, Artificial
  CRISPR gRNA sequence
cttgtaatcttgccagcaac

SEQ ID NO: 799145 - DNA, 20 bp, Artificial
  CRISPR gRNA sequence
gtaatcttgccagcaacctc

SEQ ID NO: 799146 - DNA, 20 bp, Artificial
  CRISPR gRNA sequence
taatcttgccagcaacctct

SEQ ID NO: 799147 - DNA, 20 bp, Artificial
  CRISPR gRNA sequence
gccagcaacctctccctctc

SEQ ID NO: 799148 - DNA, 20 bp, Artificial
  CRISPR gRNA sequence
ccagcaacctctccctctca

SEQ ID NO: 799149 - DNA, 20 bp, Artificial
  CRISPR gRNA sequence
tccctctcagcaatagtcta

SEQ ID NO: 799150 - DNA, 20 bp, Artificial
  CRISPR gRNA sequence
cctctcagcaatagtctatt

SEQ ID NO: 799151 - DNA, 20 bp, Artificial
  CRISPR gRNA sequence
tcagcaatagtctattgcct

SEQ ID NO: 799152 - DNA, 20 bp, Artificial
  CRISPR gRNA sequence
agcaatagtctattgcctac

SEQ ID NO: 799153 - DNA, 20 bp, Artificial
  CRISPR gRNA sequence
ttgcctacaccaaagcttag

SEQ ID NO: 799154 - DNA, 20 bp, Artificial
  CRISPR gRNA sequence
cctacaccaaagcttagttg

SEQ ID NO: 799155 - DNA, 20 bp, Artificial
  CRISPR gRNA sequence
caccaaagcttagttgtctc

SEQ ID NO: 799156 - DNA, 20 bp, Artificial
  CRISPR gRNA sequence
agttgtctcttaatgatgta

SEQ ID NO: 799157 - DNA, 20 bp, Artificial
  CRISPR gRNA sequence
gttgtctcttaatgatgtaa

SEQ ID NO: 799158 - DNA, 20 bp, Artificial
  CRISPR gRNA sequence
tctcttaatgatgtaaatga

SEQ ID NO: 799159 - DNA, 20 bp, Artificial
  CRISPR gRNA sequence
ttaatgatgtaaatgaggtt

SEQ ID NO: 799160 - DNA, 20 bp, Artificial
  CRISPR gRNA sequence
aatgatgtaaatgaggttct

SEQ ID NO: 799161 - DNA, 20 bp, Artificial
  CRISPR gRNA sequence
atgatgtaaatgaggttcta

SEQ ID NO: 799162 - DNA, 20 bp, Artificial
  CRISPR gRNA sequence
tatcattctcctgacccaaa

SEQ ID NO: 799163 - DNA, 20 bp, Artificial
  CRISPR gRNA sequence
tcattctcctgacccaaacc

SEQ ID NO: 799164 - DNA, 20 bp, Artificial
  CRISPR gRNA sequence
tcctgacccaaaccctccac

SEQ ID NO: 799165 - DNA, 20 bp, Artificial
  CRISPR gRNA sequence
ctgacccaaaccctccactg

SEQ ID NO: 799166 - DNA, 20 bp, Artificial
  CRISPR gRNA sequence
acccaaaccctccactgctt

SEQ ID NO: 799167 - DNA, 20 bp, Artificial
  CRISPR gRNA sequence
cactgcttttcatcacactc

SEQ ID NO: 799168 - DNA, 20 bp, Artificial
  CRISPR gRNA sequence
cttttcatcacactcagagc

SEQ ID NO: 799169 - DNA, 20 bp, Artificial
  CRISPR gRNA sequence
ttcatcacactcagagcagc

SEQ ID NO: 799170 - DNA, 20 bp, Artificial
  CRISPR gRNA sequence
tcatcacactcagagcagct

SEQ ID NO: 799171 - DNA, 20 bp, Artificial
  CRISPR gRNA sequence
catcacactcagagcagctc

SEQ ID NO: 799172 - DNA, 20 bp, Artificial
  CRISPR gRNA sequence
atcacactcagagcagctct

SEQ ID NO: 799173 - DNA, 20 bp, Artificial
  CRISPR gRNA sequence
agagcagctctgctgttgcc

SEQ ID NO: 799174 - DNA, 20 bp, Artificial
  CRISPR gRNA sequence
tgctgttgcctgatttagat

SEQ ID NO: 799175 - DNA, 20 bp, Artificial
  CRISPR gRNA sequence
ctgttgcctgatttagatgt

SEQ ID NO: 799176 - DNA, 20 bp, Artificial
  CRISPR gRNA sequence
ttgcctgatttagatgtatg

SEQ ID NO: 799177 - DNA, 20 bp, Artificial
  CRISPR gRNA sequence
cctgatttagatgtatggct

SEQ ID NO: 799178 - DNA, 20 bp, Artificial
  CRISPR gRNA sequence
atttagatgtatggctccaa

SEQ ID NO: 799179 - DNA, 20 bp, Artificial
  CRISPR gRNA sequence
agatgtatggctccaacaga

SEQ ID NO: 799180 - DNA, 20 bp, Artificial
  CRISPR gRNA sequence
gatgtatggctccaacagat

SEQ ID NO: 799181 - DNA, 20 bp, Artificial
  CRISPR gRNA sequence
caacagatttcccctgaaga

SEQ ID NO: 799182 - DNA, 20 bp, Artificial
  CRISPR gRNA sequence
cccctgaagaaatgattcca

SEQ ID NO: 799183 - DNA, 20 bp, Artificial
  CRISPR gRNA sequence
ccctgaagaaatgattccat

SEQ ID NO: 799184 - DNA, 20 bp, Artificial
  CRISPR gRNA sequence
aagaaatgattccatggctg

SEQ ID NO: 799185 - DNA, 20 bp, Artificial
  CRISPR gRNA sequence
catggctgataaaagttgga

SEQ ID NO: 799186 - DNA, 20 bp, Artificial
  CRISPR gRNA sequence
ataaaagttggaaagcctcc

SEQ ID NO: 799187 - DNA, 20 bp, Artificial
  CRISPR gRNA sequence
gaaagcctcctcagtttcag

SEQ ID NO: 799188 - DNA, 20 bp, Artificial
  CRISPR gRNA sequence
ctcagtttcagaccattatc

SEQ ID NO: 799189 - DNA, 20 bp, Artificial
  CRISPR gRNA sequence
agtttcagaccattatcaga

SEQ ID NO: 799190 - DNA, 20 bp, Artificial
  CRISPR gRNA sequence
cagaccattatcagattagc

SEQ ID NO: 799191 - DNA, 20 bp, Artificial
  CRISPR gRNA sequence
agaccattatcagattagct

SEQ ID NO: 799192 - DNA, 20 bp, Artificial
  CRISPR gRNA sequence
tcagattagctgtgtgctct

SEQ ID NO: 799193 - DNA, 20 bp, Artificial
  CRISPR gRNA sequence
gctgtgtgctctgtcccttt

SEQ ID NO: 799194 - DNA, 20 bp, Artificial
  CRISPR gRNA sequence
tgtgctctgtccctttcctc

SEQ ID NO: 799195 - DNA, 20 bp, Artificial
  CRISPR gRNA sequence
tgtccctttcctcaaccata

SEQ ID NO: 799196 - DNA, 20 bp, Artificial
  CRISPR gRNA sequence
tccctttcctcaaccataag

SEQ ID NO: 799197 - DNA, 20 bp, Artificial
  CRISPR gRNA sequence
tcctcaaccataagaagtcc

SEQ ID NO: 799198 - DNA, 20 bp, Artificial
  CRISPR gRNA sequence
cctcaaccataagaagtcca

SEQ ID NO: 799199 - DNA, 20 bp, Artificial
  CRISPR gRNA sequence
ctcaaccataagaagtccat

SEQ ID NO: 799200 - DNA, 20 bp, Artificial
  CRISPR gRNA sequence
aaccataagaagtccatgga

SEQ ID NO: 799201 - DNA, 20 bp, Artificial
  CRISPR gRNA sequence
cagagtaaaggagaaagcat

SEQ ID NO: 799202 - DNA, 20 bp, Artificial
  CRISPR gRNA sequence
agagtaaaggagaaagcatg

SEQ ID NO: 799203 - DNA, 20 bp, Artificial
  CRISPR gRNA sequence
gcagcccccaccctcatcag

SEQ ID NO: 799204 - DNA, 20 bp, Artificial
  CRISPR gRNA sequence
atcagagccagttccctact

SEQ ID NO: 799205 - DNA, 20 bp, Artificial
  CRISPR gRNA sequence
cctactctccctgtctaaac

SEQ ID NO: 799206 - DNA, 20 bp, Artificial
  CRISPR gRNA sequence
ctctccctgtctaaacctct

SEQ ID NO: 799207 - DNA, 20 bp, Artificial
  CRISPR gRNA sequence
tccctgtctaaacctcttag

SEQ ID NO: 799208 - DNA, 20 bp, Artificial
  CRISPR gRNA sequence
cctgtctaaacctcttagta

SEQ ID NO: 799209 - DNA, 20 bp, Artificial
  CRISPR gRNA sequence
tctaaacctcttagtaagag

SEQ ID NO: 799210 - DNA, 20 bp, Artificial
  CRISPR gRNA sequence
aacctcttagtaagaggtag

SEQ ID NO: 799211 - DNA, 20 bp, Artificial
  CRISPR gRNA sequence
ttagtaagaggtagttcaag

SEQ ID NO: 799212 - DNA, 20 bp, Artificial
  CRISPR gRNA sequence
agtaagaggtagttcaagag

SEQ ID NO: 799213 - DNA, 20 bp, Artificial
  CRISPR gRNA sequence
gtaagaggtagttcaagaga

SEQ ID NO: 799214 - DNA, 20 bp, Artificial
  CRISPR gRNA sequence
aagagaggggcaaactcaat

SEQ ID NO: 799215 - DNA, 20 bp, Artificial
  CRISPR gRNA sequence
aattccagcactcaaaagca

SEQ ID NO: 799216 - DNA, 20 bp, Artificial
  CRISPR gRNA sequence
cagcactcaaaagcacttga

SEQ ID NO: 799217 - DNA, 20 bp, Artificial
  CRISPR gRNA sequence
aaaagcacttgactactttg

SEQ ID NO: 799218 - DNA, 20 bp, Artificial
  CRISPR gRNA sequence
gactactttgctcagtcaac

SEQ ID NO: 799219 - DNA, 20 bp, Artificial
  CRISPR gRNA sequence
actactttgctcagtcaact

SEQ ID NO: 799220 - DNA, 20 bp, Artificial
  CRISPR gRNA sequence
ctttgctcagtcaactagca

SEQ ID NO: 799221 - DNA, 20 bp, Artificial
  CRISPR gRNA sequence
tgctcagtcaactagcaagt

SEQ ID NO: 799222 - DNA, 20 bp, Artificial
  CRISPR gRNA sequence
gctcagtcaactagcaagta

SEQ ID NO: 799223 - DNA, 20 bp, Artificial
  CRISPR gRNA sequence
ctcagtcaactagcaagtat

SEQ ID NO: 799224 - DNA, 20 bp, Artificial
  CRISPR gRNA sequence
agtcaactagcaagtattta

SEQ ID NO: 799225 - DNA, 20 bp, Artificial
  CRISPR gRNA sequence
gcaagtatttattgagaatg

SEQ ID NO: 799226 - DNA, 20 bp, Artificial
  CRISPR gRNA sequence
attgagaatgtagctctgtt

SEQ ID NO: 799227 - DNA, 20 bp, Artificial
  CRISPR gRNA sequence
ttgagaatgtagctctgttc

SEQ ID NO: 799228 - DNA, 20 bp, Artificial
  CRISPR gRNA sequence
agaatgtagctctgttctat

SEQ ID NO: 799229 - DNA, 20 bp, Artificial
  CRISPR gRNA sequence
tgttctatggagtcttattt

SEQ ID NO: 799230 - DNA, 20 bp, Artificial
  CRISPR gRNA sequence
ttctatggagtcttattttc

SEQ ID NO: 799231 - DNA, 20 bp, Artificial
  CRISPR gRNA sequence
tatggagtcttattttcaag

SEQ ID NO: 799232 - DNA, 20 bp, Artificial
  CRISPR gRNA sequence
tggagtcttattttcaagtg

SEQ ID NO: 799233 - DNA, 20 bp, Artificial
  CRISPR gRNA sequence
attttcaagtgtcagactcc

SEQ ID NO: 799234 - DNA, 20 bp, Artificial
  CRISPR gRNA sequence
ttttcaagtgtcagactccc

SEQ ID NO: 799235 - DNA, 20 bp, Artificial
  CRISPR gRNA sequence
tcaagtgtcagactcccaga

SEQ ID NO: 799236 - DNA, 20 bp, Artificial
  CRISPR gRNA sequence
caagtgtcagactcccagac

SEQ ID NO: 799237 - DNA, 20 bp, Artificial
  CRISPR gRNA sequence
aagtgtcagactcccagaca

SEQ ID NO: 799238 - DNA, 20 bp, Artificial
  CRISPR gRNA sequence
ccagacatccagtccaggta

SEQ ID NO: 799239 - DNA, 20 bp, Artificial
  CRISPR gRNA sequence
ttcatttgacaaacaaagtt

SEQ ID NO: 799240 - DNA, 20 bp, Artificial
  CRISPR gRNA sequence
atttgacaaacaaagttggg

SEQ ID NO: 799241 - DNA, 20 bp, Artificial
  CRISPR gRNA sequence
gacaaacaaagttggggttc

SEQ ID NO: 799242 - DNA, 20 bp, Artificial
  CRISPR gRNA sequence
acaaacaaagttggggttca

SEQ ID NO: 799243 - DNA, 20 bp, Artificial
  CRISPR gRNA sequence
gggttcaagggccagctatt

SEQ ID NO: 799244 - DNA, 20 bp, Artificial
  CRISPR gRNA sequence
aagggccagctattgaaaaa

SEQ ID NO: 799245 - DNA, 20 bp, Artificial
  CRISPR gRNA sequence
ttgaaaaaagctatggaaag

SEQ ID NO: 799246 - DNA, 20 bp, Artificial
  CRISPR gRNA sequence
aaaaaagctatggaaagctt

SEQ ID NO: 799247 - DNA, 20 bp, Artificial
  CRISPR gRNA sequence
tggaaagcttcatgagacgt

SEQ ID NO: 799248 - DNA, 20 bp, Artificial
  CRISPR gRNA sequence
catgagacgtgcaggtaact

SEQ ID NO: 799249 - DNA, 20 bp, Artificial
  CRISPR gRNA sequence
atgagacgtgcaggtaactg

SEQ ID NO: 799250 - DNA, 20 bp, Artificial
  CRISPR gRNA sequence
ccaatatgtgtggttcacaa

SEQ ID NO: 799251 - DNA, 20 bp, Artificial
  CRISPR gRNA sequence
acaaggactggttcatattc

SEQ ID NO: 799252 - DNA, 20 bp, Artificial
  CRISPR gRNA sequence
gttcatattcagaaacggcc

SEQ ID NO: 799253 - DNA, 20 bp, Artificial
  CRISPR gRNA sequence
atattcagaaacggccatta

SEQ ID NO: 799254 - DNA, 20 bp, Artificial
  CRISPR gRNA sequence
agaaacggccattagaaaag

SEQ ID NO: 799255 - DNA, 20 bp, Artificial
  CRISPR gRNA sequence
gaaaaggaagaagaacttct

SEQ ID NO: 799256 - DNA, 20 bp, Artificial
  CRISPR gRNA sequence
ctcatttggatttataaaga

SEQ ID NO: 799257 - DNA, 20 bp, Artificial
  CRISPR gRNA sequence
tcatttggatttataaagag

SEQ ID NO: 799258 - DNA, 20 bp, Artificial
  CRISPR gRNA sequence
atttggatttataaagagtg

SEQ ID NO: 799259 - DNA, 20 bp, Artificial
  CRISPR gRNA sequence
ggatttataaagagtgtctt

SEQ ID NO: 799260 - DNA, 20 bp, Artificial
  CRISPR gRNA sequence
gatttataaagagtgtcttg

SEQ ID NO: 799261 - DNA, 20 bp, Artificial
  CRISPR gRNA sequence
ataaagagtgtcttgtttac

SEQ ID NO: 799262 - DNA, 20 bp, Artificial
  CRISPR gRNA sequence
taaagagtgtcttgtttact

SEQ ID NO: 799263 - DNA, 20 bp, Artificial
  CRISPR gRNA sequence
gtttactcttaatttatatc

SEQ ID NO: 799264 - DNA, 20 bp, Artificial
  CRISPR gRNA sequence
tttactcttaatttatatct

SEQ ID NO: 799265 - DNA, 20 bp, Artificial
  CRISPR gRNA sequence
actcttaatttatatcttct

SEQ ID NO: 799266 - DNA, 20 bp, Artificial
  CRISPR gRNA sequence
ctcttaatttatatcttctc

SEQ ID NO: 799267 - DNA, 20 bp, Artificial
  CRISPR gRNA sequence
ttaatttatatcttctcttc

SEQ ID NO: 799268 - DNA, 20 bp, Artificial
  CRISPR gRNA sequence
aatttatatcttctcttctc

SEQ ID NO: 799269 - DNA, 20 bp, Artificial
  CRISPR gRNA sequence
atttatatcttctcttctcc

SEQ ID NO: 799270 - DNA, 20 bp, Artificial
  CRISPR gRNA sequence
atatcttctcttctccagga

SEQ ID NO: 799271 - DNA, 20 bp, Artificial
  CRISPR gRNA sequence
tatcttctcttctccaggaa

SEQ ID NO: 799272 - DNA, 20 bp, Artificial
  CRISPR gRNA sequence
ctcttctccaggaaatcaac

SEQ ID NO: 799273 - DNA, 20 bp, Artificial
  CRISPR gRNA sequence
tcttctccaggaaatcaacc

SEQ ID NO: 799274 - DNA, 20 bp, Artificial
  CRISPR gRNA sequence
ttctccaggaaatcaaccta

SEQ ID NO: 799275 - DNA, 20 bp, Artificial
  CRISPR gRNA sequence
ctccaggaaatcaacctata

SEQ ID NO: 799276 - DNA, 20 bp, Artificial
  CRISPR gRNA sequence
tccaggaaatcaacctataa

SEQ ID NO: 799277 - DNA, 20 bp, Artificial
  CRISPR gRNA sequence
caggaaatcaacctataact

SEQ ID NO: 799278 - DNA, 20 bp, Artificial
  CRISPR gRNA sequence
taacttctcctcccagctcc

SEQ ID NO: 799279 - DNA, 20 bp, Artificial
  CRISPR gRNA sequence
ctcctcccagctccactcta

SEQ ID NO: 799280 - DNA, 20 bp, Artificial
  CRISPR gRNA sequence
tcctcccagctccactctac

SEQ ID NO: 799281 - DNA, 20 bp, Artificial
  CRISPR gRNA sequence
ctcccagctccactctacca

SEQ ID NO: 799282 - DNA, 20 bp, Artificial
  CRISPR gRNA sequence
ccagctccactctaccatgg

SEQ ID NO: 799283 - DNA, 20 bp, Artificial
  CRISPR gRNA sequence
cactctaccatggtctgtca

SEQ ID NO: 799284 - DNA, 20 bp, Artificial
  CRISPR gRNA sequence
taccatggtctgtcaccttc

SEQ ID NO: 799285 - DNA, 20 bp, Artificial
  CRISPR gRNA sequence
ccatggtctgtcaccttccc

SEQ ID NO: 799286 - DNA, 20 bp, Artificial
  CRISPR gRNA sequence
tcaccttccccaaatgattt

SEQ ID NO: 799287 - DNA, 20 bp, Artificial
  CRISPR gRNA sequence
ccccaaatgatttgttattc

SEQ ID NO: 799288 - DNA, 20 bp, Artificial
  CRISPR gRNA sequence
cccaaatgatttgttattcc

SEQ ID NO: 799289 - DNA, 20 bp, Artificial
  CRISPR gRNA sequence
gttattcccctgttttcaaa

SEQ ID NO: 799290 - DNA, 20 bp, Artificial
  CRISPR gRNA sequence
ttattcccctgttttcaaaa

SEQ ID NO: 799291 - DNA, 20 bp, Artificial
  CRISPR gRNA sequence
ttcccctgttttcaaaagtg

SEQ ID NO: 799292 - DNA, 20 bp, Artificial
  CRISPR gRNA sequence
ccctgttttcaaaagtgaac

SEQ ID NO: 799293 - DNA, 20 bp, Artificial
  CRISPR gRNA sequence
ttttcaaaagtgaacaaaga

SEQ ID NO: 799294 - DNA, 20 bp, Artificial
  CRISPR gRNA sequence
tcaaaagtgaacaaagaacc

SEQ ID NO: 799295 - DNA, 20 bp, Artificial
  CRISPR gRNA sequence
caaaagtgaacaaagaacca

SEQ ID NO: 799296 - DNA, 20 bp, Artificial
  CRISPR gRNA sequence
aaaagtgaacaaagaaccaa

SEQ ID NO: 799297 - DNA, 20 bp, Artificial
  CRISPR gRNA sequence
cacaaggccctgagactttc

SEQ ID NO: 799298 - DNA, 20 bp, Artificial
  CRISPR gRNA sequence
acaaggccctgagactttca

SEQ ID NO: 799299 - DNA, 20 bp, Artificial
  CRISPR gRNA sequence
agactttcaattgtctattt

SEQ ID NO: 799300 - DNA, 20 bp, Artificial
  CRISPR gRNA sequence
tcaattgtctatttcagatc

SEQ ID NO: 799301 - DNA, 20 bp, Artificial
  CRISPR gRNA sequence
caattgtctatttcagatca

SEQ ID NO: 799302 - DNA, 20 bp, Artificial
  CRISPR gRNA sequence
aattgtctatttcagatcaa

SEQ ID NO: 799303 - DNA, 20 bp, Artificial
  CRISPR gRNA sequence
tctatttcagatcaaataca

SEQ ID NO: 799304 - DNA, 20 bp, Artificial
  CRISPR gRNA sequence
tttcagatcaaatacagaac

SEQ ID NO: 799305 - DNA, 20 bp, Artificial
  CRISPR gRNA sequence
cagatcaaatacagaacatg

SEQ ID NO: 799306 - DNA, 20 bp, Artificial
  CRISPR gRNA sequence
agatcaaatacagaacatga

SEQ ID NO: 799307 - DNA, 20 bp, Artificial
  CRISPR gRNA sequence
cctcctgctaatgttgagcc

SEQ ID NO: 799308 - DNA, 20 bp, Artificial
  CRISPR gRNA sequence
ctcctgctaatgttgagcct

SEQ ID NO: 799309 - DNA, 20 bp, Artificial
  CRISPR gRNA sequence
ctgctaatgttgagcctgga

SEQ ID NO: 799310 - DNA, 20 bp, Artificial
  CRISPR gRNA sequence
ctaatgttgagcctggaatt

SEQ ID NO: 799311 - DNA, 20 bp, Artificial
  CRISPR gRNA sequence
atgttgagcctggaattgca

SEQ ID NO: 799312 - DNA, 20 bp, Artificial
  CRISPR gRNA sequence
agcctggaattgcagcttca

SEQ ID NO: 799313 - DNA, 20 bp, Artificial
  CRISPR gRNA sequence
gaattgcagcttcaccagat

SEQ ID NO: 799314 - DNA, 20 bp, Artificial
  CRISPR gRNA sequence
cagcttcaccagatagcagg

SEQ ID NO: 799315 - DNA, 20 bp, Artificial
  CRISPR gRNA sequence
caccagatagcaggtaagaa

SEQ ID NO: 799316 - DNA, 20 bp, Artificial
  CRISPR gRNA sequence
accagatagcaggtaagaaa

SEQ ID NO: 799317 - DNA, 20 bp, Artificial
  CRISPR gRNA sequence
aagaaagaagagcaggtggt

SEQ ID NO: 799318 - DNA, 20 bp, Artificial
  CRISPR gRNA sequence
agaaagaagagcaggtggtg

SEQ ID NO: 799319 - DNA, 20 bp, Artificial
  CRISPR gRNA sequence
ctagccaaagccaaaaatga

SEQ ID NO: 799320 - DNA, 20 bp, Artificial
  CRISPR gRNA sequence
gccaaagccaaaaatgagaa

SEQ ID NO: 799321 - DNA, 20 bp, Artificial
  CRISPR gRNA sequence
aggctgagggctttctttga

SEQ ID NO: 799322 - DNA, 20 bp, Artificial
  CRISPR gRNA sequence
agggctttctttgagaggac

SEQ ID NO: 799323 - DNA, 20 bp, Artificial
  CRISPR gRNA sequence
tctttgagaggacgtatgat

SEQ ID NO: 799324 - DNA, 20 bp, Artificial
  CRISPR gRNA sequence
ctttgagaggacgtatgatt

SEQ ID NO: 799325 - DNA, 20 bp, Artificial
  CRISPR gRNA sequence
tttgagaggacgtatgattt

SEQ ID NO: 799326 - DNA, 20 bp, Artificial
  CRISPR gRNA sequence
tgagaggacgtatgatttct

SEQ ID NO: 799327 - DNA, 20 bp, Artificial
  CRISPR gRNA sequence
gagaggacgtatgatttctg

SEQ ID NO: 799328 - DNA, 20 bp, Artificial
  CRISPR gRNA sequence
agaggacgtatgatttctgg

SEQ ID NO: 799329 - DNA, 20 bp, Artificial
  CRISPR gRNA sequence
ctgggctattccaagcacca

SEQ ID NO: 799330 - DNA, 20 bp, Artificial
  CRISPR gRNA sequence
tgggctattccaagcaccac

SEQ ID NO: 799331 - DNA, 20 bp, Artificial
  CRISPR gRNA sequence
ggctattccaagcaccacaa

SEQ ID NO: 799332 - DNA, 20 bp, Artificial
  CRISPR gRNA sequence
ttccaagcaccacaaaaaaa

SEQ ID NO: 799333 - DNA, 20 bp, Artificial
  CRISPR gRNA sequence
caagcaccacaaaaaaaaaa

SEQ ID NO: 799334 - DNA, 20 bp, Artificial
  CRISPR gRNA sequence
atacatgccaatgtccctat

SEQ ID NO: 799335 - DNA, 20 bp, Artificial
  CRISPR gRNA sequence
tacatgccaatgtccctatc

SEQ ID NO: 799336 - DNA, 20 bp, Artificial
  CRISPR gRNA sequence
tctgacagaaacggtgactg

SEQ ID NO: 799337 - DNA, 20 bp, Artificial
  CRISPR gRNA sequence
acagaaacggtgactgagaa

SEQ ID NO: 799338 - DNA, 20 bp, Artificial
  CRISPR gRNA sequence
agaatattgctccatctatt

SEQ ID NO: 799339 - DNA, 20 bp, Artificial
  CRISPR gRNA sequence
ctccatctattcccactatc

SEQ ID NO: 799340 - DNA, 20 bp, Artificial
  CRISPR gRNA sequence
catctattcccactatccag

SEQ ID NO: 799341 - DNA, 20 bp, Artificial
  CRISPR gRNA sequence
ttcccactatccagtgaggg

SEQ ID NO: 799342 - DNA, 20 bp, Artificial
  CRISPR gRNA sequence
ccactatccagtgagggtaa

SEQ ID NO: 799343 - DNA, 20 bp, Artificial
  CRISPR gRNA sequence
tccagtgagggtaatgacaa

SEQ ID NO: 799344 - DNA, 20 bp, Artificial
  CRISPR gRNA sequence
agaccatgtaaatctaaact

SEQ ID NO: 799345 - DNA, 20 bp, Artificial
  CRISPR gRNA sequence
aactgatacaagagggcagg

SEQ ID NO: 799346 - DNA, 20 bp, Artificial
  CRISPR gRNA sequence
atacaagagggcaggggttg

SEQ ID NO: 799347 - DNA, 20 bp, Artificial
  CRISPR gRNA sequence
agttcccttaaaggtgagat

SEQ ID NO: 799348 - DNA, 20 bp, Artificial
  CRISPR gRNA sequence
ccttaaaggtgagatgccaa

SEQ ID NO: 799349 - DNA, 20 bp, Artificial
  CRISPR gRNA sequence
aaaggtgagatgccaagcag

SEQ ID NO: 799350 - DNA, 20 bp, Artificial
  CRISPR gRNA sequence
aaggtgagatgccaagcagc

SEQ ID NO: 799351 - DNA, 20 bp, Artificial
  CRISPR gRNA sequence
tccccttcctttctggcagg

SEQ ID NO: 799352 - DNA, 20 bp, Artificial
  CRISPR gRNA sequence
cctttctggcagggagagta

SEQ ID NO: 799353 - DNA, 20 bp, Artificial
  CRISPR gRNA sequence
ctttctggcagggagagtaa

SEQ ID NO: 799354 - DNA, 20 bp, Artificial
  CRISPR gRNA sequence
tctggcagggagagtaagga

SEQ ID NO: 799355 - DNA, 20 bp, Artificial
  CRISPR gRNA sequence
ctggcagggagagtaaggag

SEQ ID NO: 799356 - DNA, 20 bp, Artificial
  CRISPR gRNA sequence
tggcagggagagtaaggaga

SEQ ID NO: 799357 - DNA, 20 bp, Artificial
  CRISPR gRNA sequence
gcagggagagtaaggagaca

SEQ ID NO: 799358 - DNA, 20 bp, Artificial
  CRISPR gRNA sequence
ctctaaagataatgtcttga

SEQ ID NO: 799359 - DNA, 20 bp, Artificial
  CRISPR gRNA sequence
taaagataatgtcttgaaga

SEQ ID NO: 799360 - DNA, 20 bp, Artificial
  CRISPR gRNA sequence
aagataatgtcttgaagaca

SEQ ID NO: 799361 - DNA, 20 bp, Artificial
  CRISPR gRNA sequence
gaagacattctgcatattat

SEQ ID NO: 799362 - DNA, 20 bp, Artificial
  CRISPR gRNA sequence
aagacattctgcatattatt

SEQ ID NO: 799363 - DNA, 20 bp, Artificial
  CRISPR gRNA sequence
tgcatattattagttgtttc

SEQ ID NO: 799364 - DNA, 20 bp, Artificial
  CRISPR gRNA sequence
catattattagttgtttctg

SEQ ID NO: 799365 - DNA, 20 bp, Artificial
  CRISPR gRNA sequence
ttagttgtttctgtgagttt

SEQ ID NO: 799366 - DNA, 20 bp, Artificial
  CRISPR gRNA sequence
gttgtttctgtgagtttctt

SEQ ID NO: 799367 - DNA, 20 bp, Artificial
  CRISPR gRNA sequence
tttctgtgagtttctttttt

SEQ ID NO: 799368 - DNA, 20 bp, Artificial
  CRISPR gRNA sequence
ctgtgagtttcttttttgaa

SEQ ID NO: 799369 - DNA, 20 bp, Artificial
  CRISPR gRNA sequence
tgtgagtttcttttttgaaa

SEQ ID NO: 799370 - DNA, 20 bp, Artificial
  CRISPR gRNA sequence
tgagtttcttttttgaaaag

SEQ ID NO: 799371 - DNA, 20 bp, Artificial
  CRISPR gRNA sequence
cttttttgaaaagcaacaat

SEQ ID NO: 799372 - DNA, 20 bp, Artificial
  CRISPR gRNA sequence
ttttttgaaaagcaacaata

SEQ ID NO: 799373 - DNA, 20 bp, Artificial
  CRISPR gRNA sequence
ttttgaaaagcaacaatagc

SEQ ID NO: 799374 - DNA, 20 bp, Artificial
  CRISPR gRNA sequence
tttgaaaagcaacaatagca

SEQ ID NO: 799375 - DNA, 20 bp, Artificial
  CRISPR gRNA sequence
ttgaaaagcaacaatagcag

SEQ ID NO: 799376 - DNA, 20 bp, Artificial
  CRISPR gRNA sequence
tgaaaagcaacaatagcagc

SEQ ID NO: 799377 - DNA, 20 bp, Artificial
  CRISPR gRNA sequence
gaaaagcaacaatagcagcc

SEQ ID NO: 799378 - DNA, 20 bp, Artificial
  CRISPR gRNA sequence
aaaagcaacaatagcagccg

SEQ ID NO: 799379 - DNA, 20 bp, Artificial
  CRISPR gRNA sequence
gtcattcataccttaatgtg

SEQ ID NO: 799380 - DNA, 20 bp, Artificial
  CRISPR gRNA sequence
ataccttaatgtggtttact

SEQ ID NO: 799381 - DNA, 20 bp, Artificial
  CRISPR gRNA sequence
aatgtggtttactgagtctt

SEQ ID NO: 799382 - DNA, 20 bp, Artificial
  CRISPR gRNA sequence
atgtggtttactgagtcttc

SEQ ID NO: 799383 - DNA, 20 bp, Artificial
  CRISPR gRNA sequence
actgagtcttcctaaaaccc

SEQ ID NO: 799384 - DNA, 20 bp, Artificial
  CRISPR gRNA sequence
ctgagtcttcctaaaaccca

SEQ ID NO: 799385 - DNA, 20 bp, Artificial
  CRISPR gRNA sequence
agtcttcctaaaacccaaat

SEQ ID NO: 799386 - DNA, 20 bp, Artificial
  CRISPR gRNA sequence
cctaaaacccaaatgaacaa

SEQ ID NO: 799387 - DNA, 20 bp, Artificial
  CRISPR gRNA sequence
ctaaaacccaaatgaacaat

SEQ ID NO: 799388 - DNA, 20 bp, Artificial
  CRISPR gRNA sequence
aaacccaaatgaacaatgaa

SEQ ID NO: 799389 - DNA, 20 bp, Artificial
  CRISPR gRNA sequence
aaggctatccctttggactt

SEQ ID NO: 799390 - DNA, 20 bp, Artificial
  CRISPR gRNA sequence
aggctatccctttggacttg

SEQ ID NO: 799391 - DNA, 20 bp, Artificial
  CRISPR gRNA sequence
tccctttggacttgaagaaa

SEQ ID NO: 799392 - DNA, 20 bp, Artificial
  CRISPR gRNA sequence
tggacttgaagaaaggactt

SEQ ID NO: 799393 - DNA, 20 bp, Artificial
  CRISPR gRNA sequence
ggacttgaagaaaggacttc

SEQ ID NO: 799394 - DNA, 20 bp, Artificial
  CRISPR gRNA sequence
gacttgaagaaaggacttct

SEQ ID NO: 799395 - DNA, 20 bp, Artificial
  CRISPR gRNA sequence
gaagaaaggacttctattgg

SEQ ID NO: 799396 - DNA, 20 bp, Artificial
  CRISPR gRNA sequence
aagaaaggacttctattgga

SEQ ID NO: 799397 - DNA, 20 bp, Artificial
  CRISPR gRNA sequence
ctattggaggatgagggtga

SEQ ID NO: 799398 - DNA, 20 bp, Artificial
  CRISPR gRNA sequence
tattggaggatgagggtgag

SEQ ID NO: 799399 - DNA, 20 bp, Artificial
  CRISPR gRNA sequence
ttggaggatgagggtgagca

SEQ ID NO: 799400 - DNA, 20 bp, Artificial
  CRISPR gRNA sequence
gaggatgagggtgagcagaa

SEQ ID NO: 799401 - DNA, 20 bp, Artificial
  CRISPR gRNA sequence
cacagttggttgttctcctg

SEQ ID NO: 799402 - DNA, 20 bp, Artificial
  CRISPR gRNA sequence
acagttggttgttctcctgg

SEQ ID NO: 799403 - DNA, 20 bp, Artificial
  CRISPR gRNA sequence
gttgttctcctggggaaggt

SEQ ID NO: 799404 - DNA, 20 bp, Artificial
  CRISPR gRNA sequence
ttctcctggggaaggtagtt

SEQ ID NO: 799405 - DNA, 20 bp, Artificial
  CRISPR gRNA sequence
tcctggggaaggtagttcag

SEQ ID NO: 799406 - DNA, 20 bp, Artificial
  CRISPR gRNA sequence
ctggggaaggtagttcagac

SEQ ID NO: 799407 - DNA, 20 bp, Artificial
  CRISPR gRNA sequence
gggaaggtagttcagaccat

SEQ ID NO: 799408 - DNA, 20 bp, Artificial
  CRISPR gRNA sequence
agaccattcgagggtgtagt

SEQ ID NO: 799409 - DNA, 20 bp, Artificial
  CRISPR gRNA sequence
gagggtgtagttagaaccat

SEQ ID NO: 799410 - DNA, 20 bp, Artificial
  CRISPR gRNA sequence
gaaccatgagtgcactattt

SEQ ID NO: 799411 - DNA, 20 bp, Artificial
  CRISPR gRNA sequence
ttttggatgaacaccaggag

SEQ ID NO: 799412 - DNA, 20 bp, Artificial
  CRISPR gRNA sequence
tggatgaacaccaggagcta

SEQ ID NO: 799413 - DNA, 20 bp, Artificial
  CRISPR gRNA sequence
ggatgaacaccaggagctaa

SEQ ID NO: 799414 - DNA, 20 bp, Artificial
  CRISPR gRNA sequence
gatgaacaccaggagctaag

SEQ ID NO: 799415 - DNA, 20 bp, Artificial
  CRISPR gRNA sequence
agagagtaacatagaggtgt

SEQ ID NO: 799416 - DNA, 20 bp, Artificial
  CRISPR gRNA sequence
agtcctcaagacaatagccc

SEQ ID NO: 799417 - DNA, 20 bp, Artificial
  CRISPR gRNA sequence
aagacaatagccccagcccc

SEQ ID NO: 799418 - DNA, 20 bp, Artificial
  CRISPR gRNA sequence
tctgctcatgattgagaaat

SEQ ID NO: 799419 - DNA, 20 bp, Artificial
  CRISPR gRNA sequence
ctgctcatgattgagaaata

SEQ ID NO: 799420 - DNA, 20 bp, Artificial
  CRISPR gRNA sequence
tgctcatgattgagaaataa

SEQ ID NO: 799421 - DNA, 20 bp, Artificial
  CRISPR gRNA sequence
ctcatgattgagaaataatg

SEQ ID NO: 799422 - DNA, 20 bp, Artificial
  CRISPR gRNA sequence
atgattgagaaataatggct

SEQ ID NO: 799423 - DNA, 20 bp, Artificial
  CRISPR gRNA sequence
agaaataatggctcccttgg

SEQ ID NO: 799424 - DNA, 20 bp, Artificial
  CRISPR gRNA sequence
ccttggcacttgataacctt

SEQ ID NO: 799425 - DNA, 20 bp, Artificial
  CRISPR gRNA sequence
ggcacttgataacctttcga

SEQ ID NO: 799426 - DNA, 20 bp, Artificial
  CRISPR gRNA sequence
gcacttgataacctttcgaa

SEQ ID NO: 799427 - DNA, 20 bp, Artificial
  CRISPR gRNA sequence
gataacctttcgaagagctt

SEQ ID NO: 799428 - DNA, 20 bp, Artificial
  CRISPR gRNA sequence
ataacctttcgaagagcttt

SEQ ID NO: 799429 - DNA, 20 bp, Artificial
  CRISPR gRNA sequence
tcgaagagctttctcctccc

SEQ ID NO: 799430 - DNA, 20 bp, Artificial
  CRISPR gRNA sequence
cgaagagctttctcctccct

SEQ ID NO: 799431 - DNA, 20 bp, Artificial
  CRISPR gRNA sequence
gaagagctttctcctcccta

SEQ ID NO: 799432 - DNA, 20 bp, Artificial
  CRISPR gRNA sequence
tctcctccctactagctggt

SEQ ID NO: 799433 - DNA, 20 bp, Artificial
  CRISPR gRNA sequence
ctcctccctactagctggtt

SEQ ID NO: 799434 - DNA, 20 bp, Artificial
  CRISPR gRNA sequence
tcctccctactagctggttc

SEQ ID NO: 799435 - DNA, 20 bp, Artificial
  CRISPR gRNA sequence
ctccctactagctggttcca

SEQ ID NO: 799436 - DNA, 20 bp, Artificial
  CRISPR gRNA sequence
cctactagctggttccagat

SEQ ID NO: 799437 - DNA, 20 bp, Artificial
  CRISPR gRNA sequence
ctagctggttccagatcact

SEQ ID NO: 799438 - DNA, 20 bp, Artificial
  CRISPR gRNA sequence
gctggttccagatcactctt

SEQ ID NO: 799439 - DNA, 20 bp, Artificial
  CRISPR gRNA sequence
gttccagatcactcttcacc

SEQ ID NO: 799440 - DNA, 20 bp, Artificial
  CRISPR gRNA sequence
cagatcactcttcacccagt

SEQ ID NO: 799441 - DNA, 20 bp, Artificial
  CRISPR gRNA sequence
ttcacccagtcacattcctc

SEQ ID NO: 799442 - DNA, 20 bp, Artificial
  CRISPR gRNA sequence
cacccagtcacattcctctc

SEQ ID NO: 799443 - DNA, 20 bp, Artificial
  CRISPR gRNA sequence
acccagtcacattcctctca

SEQ ID NO: 799444 - DNA, 20 bp, Artificial
  CRISPR gRNA sequence
ctctcactcacttgagctgc

SEQ ID NO: 799445 - DNA, 20 bp, Artificial
  CRISPR gRNA sequence
tcactcacttgagctgccca

SEQ ID NO: 799446 - DNA, 20 bp, Artificial
  CRISPR gRNA sequence
actcacttgagctgcccagc

SEQ ID NO: 799447 - DNA, 20 bp, Artificial
  CRISPR gRNA sequence
acttgagctgcccagcctgg

SEQ ID NO: 799448 - DNA, 20 bp, Artificial
  CRISPR gRNA sequence
gagctgcccagcctggtctg

SEQ ID NO: 799449 - DNA, 20 bp, Artificial
  CRISPR gRNA sequence
agctgcccagcctggtctgg

SEQ ID NO: 799450 - DNA, 20 bp, Artificial
  CRISPR gRNA sequence
cccagcctggtctggcacta

SEQ ID NO: 799451 - DNA, 20 bp, Artificial
  CRISPR gRNA sequence
gtctggcactagagacatgc

SEQ ID NO: 799452 - DNA, 20 bp, Artificial
  CRISPR gRNA sequence
gcactagagacatgcacttg

SEQ ID NO: 799453 - DNA, 20 bp, Artificial
  CRISPR gRNA sequence
gagacatgcacttggggccc

SEQ ID NO: 799454 - DNA, 20 bp, Artificial
  CRISPR gRNA sequence
ggggccctcctcaaaggaag

SEQ ID NO: 799455 - DNA, 20 bp, Artificial
  CRISPR gRNA sequence
gggccctcctcaaaggaaga

SEQ ID NO: 799456 - DNA, 20 bp, Artificial
  CRISPR gRNA sequence
ctcaaaggaagaccctgaga

SEQ ID NO: 799457 - DNA, 20 bp, Artificial
  CRISPR gRNA sequence
aaaggaagaccctgagatat

SEQ ID NO: 799458 - DNA, 20 bp, Artificial
  CRISPR gRNA sequence
agatattctgcttacttcta

SEQ ID NO: 799459 - DNA, 20 bp, Artificial
  CRISPR gRNA sequence
tgcttacttctactctgctc

SEQ ID NO: 799460 - DNA, 20 bp, Artificial
  CRISPR gRNA sequence
cttacttctactctgctcct

SEQ ID NO: 799461 - DNA, 20 bp, Artificial
  CRISPR gRNA sequence
acttctactctgctcctgcc

SEQ ID NO: 799462 - DNA, 20 bp, Artificial
  CRISPR gRNA sequence
cttctactctgctcctgcct

SEQ ID NO: 799463 - DNA, 20 bp, Artificial
  CRISPR gRNA sequence
ctactctgctcctgcctgca

SEQ ID NO: 799464 - DNA, 20 bp, Artificial
  CRISPR gRNA sequence
tactctgctcctgcctgcag

SEQ ID NO: 799465 - DNA, 20 bp, Artificial
  CRISPR gRNA sequence
ctctgctcctgcctgcaggg

SEQ ID NO: 799466 - DNA, 20 bp, Artificial
  CRISPR gRNA sequence
tgctcctgcctgcagggcca

SEQ ID NO: 799467 - DNA, 20 bp, Artificial
  CRISPR gRNA sequence
ctcctgcctgcagggccagc

SEQ ID NO: 799468 - DNA, 20 bp, Artificial
  CRISPR gRNA sequence
ctgcctgcagggccagctaa

SEQ ID NO: 799469 - DNA, 20 bp, Artificial
  CRISPR gRNA sequence
cctgcagggccagctaaagg

SEQ ID NO: 799470 - DNA, 20 bp, Artificial
  CRISPR gRNA sequence
cagggccagctaaaggaact

SEQ ID NO: 799471 - DNA, 20 bp, Artificial
  CRISPR gRNA sequence
aaggaacttttcatgttttc

SEQ ID NO: 799472 - DNA, 20 bp, Artificial
  CRISPR gRNA sequence
ttcatgttttctttgcaagg

SEQ ID NO: 799473 - DNA, 20 bp, Artificial
  CRISPR gRNA sequence
tcatgttttctttgcaagga

SEQ ID NO: 799474 - DNA, 20 bp, Artificial
  CRISPR gRNA sequence
catgttttctttgcaaggaa

SEQ ID NO: 799475 - DNA, 20 bp, Artificial
  CRISPR gRNA sequence
atgttttctttgcaaggaac

SEQ ID NO: 799476 - DNA, 20 bp, Artificial
  CRISPR gRNA sequence
tctttgcaaggaaccctgcc

SEQ ID NO: 799477 - DNA, 20 bp, Artificial
  CRISPR gRNA sequence
ctttgcaaggaaccctgcct

SEQ ID NO: 799478 - DNA, 20 bp, Artificial
  CRISPR gRNA sequence
tttgcaaggaaccctgcctg

SEQ ID NO: 799479 - DNA, 20 bp, Artificial
  CRISPR gRNA sequence
tgcaaggaaccctgcctggc

SEQ ID NO: 799480 - DNA, 20 bp, Artificial
  CRISPR gRNA sequence
gcaaggaaccctgcctggct

SEQ ID NO: 799481 - DNA, 20 bp, Artificial
  CRISPR gRNA sequence
caaggaaccctgcctggctg

SEQ ID NO: 799482 - DNA, 20 bp, Artificial
  CRISPR gRNA sequence
cctggctggcattttagaga

SEQ ID NO: 799483 - DNA, 20 bp, Artificial
  CRISPR gRNA sequence
gctggcattttagagacaag

SEQ ID NO: 799484 - DNA, 20 bp, Artificial
  CRISPR gRNA sequence
gcattttagagacaagcaaa

SEQ ID NO: 799485 - DNA, 20 bp, Artificial
  CRISPR gRNA sequence
tagagacaagcaaaaggggc

SEQ ID NO: 799486 - DNA, 20 bp, Artificial
  CRISPR gRNA sequence
agagacaagcaaaaggggca

SEQ ID NO: 799487 - DNA, 20 bp, Artificial
  CRISPR gRNA sequence
gagacaagcaaaaggggcaa

SEQ ID NO: 799488 - DNA, 20 bp, Artificial
  CRISPR gRNA sequence
ccttgctacaaaacagcttc

SEQ ID NO: 799489 - DNA, 20 bp, Artificial
  CRISPR gRNA sequence
cttgctacaaaacagcttca

SEQ ID NO: 799490 - DNA, 20 bp, Artificial
  CRISPR gRNA sequence
gctacaaaacagcttcaagt

SEQ ID NO: 799491 - DNA, 20 bp, Artificial
  CRISPR gRNA sequence
ctacaaaacagcttcaagtt

SEQ ID NO: 799492 - DNA, 20 bp, Artificial
  CRISPR gRNA sequence
caaaacagcttcaagtttcc

SEQ ID NO: 799493 - DNA, 20 bp, Artificial
  CRISPR gRNA sequence
caagtttccatagagtgata

SEQ ID NO: 799494 - DNA, 20 bp, Artificial
  CRISPR gRNA sequence
aagtttccatagagtgataa

SEQ ID NO: 799495 - DNA, 20 bp, Artificial
  CRISPR gRNA sequence
ccatagagtgataagggaaa

SEQ ID NO: 799496 - DNA, 20 bp, Artificial
  CRISPR gRNA sequence
catagagtgataagggaaat

SEQ ID NO: 799497 - DNA, 20 bp, Artificial
  CRISPR gRNA sequence
ttccccatcctgtggcagga

SEQ ID NO: 799498 - DNA, 20 bp, Artificial
  CRISPR gRNA sequence
cccatcctgtggcaggactg

SEQ ID NO: 799499 - DNA, 20 bp, Artificial
  CRISPR gRNA sequence
tggcaggactgggggcttca

SEQ ID NO: 799500 - DNA, 20 bp, Artificial
  CRISPR gRNA sequence
ggggcttcaggagaaaactt

SEQ ID NO: 799501 - DNA, 20 bp, Artificial
  CRISPR gRNA sequence
caggagaaaacttggggaat

SEQ ID NO: 799502 - DNA, 20 bp, Artificial
  CRISPR gRNA sequence
aggagaaaacttggggaatg

SEQ ID NO: 799503 - DNA, 20 bp, Artificial
  CRISPR gRNA sequence
ggggaatgtgtaacctctgt

SEQ ID NO: 799504 - DNA, 20 bp, Artificial
  CRISPR gRNA sequence
gggaatgtgtaacctctgtg

SEQ ID NO: 799505 - DNA, 20 bp, Artificial
  CRISPR gRNA sequence
tgtgggtttgtagcttaaaa

SEQ ID NO: 799506 - DNA, 20 bp, Artificial
  CRISPR gRNA sequence
tgggtttgtagcttaaaaac

SEQ ID NO: 799507 - DNA, 20 bp, Artificial
  CRISPR gRNA sequence
gtagcttaaaaacactgaga

SEQ ID NO: 799508 - DNA, 20 bp, Artificial
  CRISPR gRNA sequence
tagcttaaaaacactgagat

SEQ ID NO: 799509 - DNA, 20 bp, Artificial
  CRISPR gRNA sequence
aaaaacactgagatcctggg

SEQ ID NO: 799510 - DNA, 20 bp, Artificial
  CRISPR gRNA sequence
aaaacactgagatcctgggt

SEQ ID NO: 799511 - DNA, 20 bp, Artificial
  CRISPR gRNA sequence
agatcctgggttttctgtct

SEQ ID NO: 799512 - DNA, 20 bp, Artificial
  CRISPR gRNA sequence
ggttttctgtctttgttttt

SEQ ID NO: 799513 - DNA, 20 bp, Artificial
  CRISPR gRNA sequence
tctgtctttgttttttgcct

SEQ ID NO: 799514 - DNA, 20 bp, Artificial
  CRISPR gRNA sequence
ctgtctttgttttttgcctt

SEQ ID NO: 799515 - DNA, 20 bp, Artificial
  CRISPR gRNA sequence
tgtctttgttttttgccttt

SEQ ID NO: 799516 - DNA, 20 bp, Artificial
  CRISPR gRNA sequence
tctttgttttttgccttttc

SEQ ID NO: 799517 - DNA, 20 bp, Artificial
  CRISPR gRNA sequence
tgttttttgccttttctctt

SEQ ID NO: 799518 - DNA, 20 bp, Artificial
  CRISPR gRNA sequence
gttttttgccttttctctta

SEQ ID NO: 799519 - DNA, 20 bp, Artificial
  CRISPR gRNA sequence
ttttttgccttttctcttag

SEQ ID NO: 799520 - DNA, 20 bp, Artificial
  CRISPR gRNA sequence
tttgccttttctcttaggaa

SEQ ID NO: 799521 - DNA, 20 bp, Artificial
  CRISPR gRNA sequence
ttgccttttctcttaggaaa

SEQ ID NO: 799522 - DNA, 20 bp, Artificial
  CRISPR gRNA sequence
tgccttttctcttaggaaag

SEQ ID NO: 799523 - DNA, 20 bp, Artificial
  CRISPR gRNA sequence
gccttttctcttaggaaagg

SEQ ID NO: 799524 - DNA, 20 bp, Artificial
  CRISPR gRNA sequence
ccttttctcttaggaaagga

SEQ ID NO: 799525 - DNA, 20 bp, Artificial
  CRISPR gRNA sequence
ttctcttaggaaaggagtga

SEQ ID NO: 799526 - DNA, 20 bp, Artificial
  CRISPR gRNA sequence
tctcttaggaaaggagtgag

SEQ ID NO: 799527 - DNA, 20 bp, Artificial
  CRISPR gRNA sequence
ctcttaggaaaggagtgagc

SEQ ID NO: 799528 - DNA, 20 bp, Artificial
  CRISPR gRNA sequence
tcttaggaaaggagtgagct

SEQ ID NO: 799529 - DNA, 20 bp, Artificial
  CRISPR gRNA sequence
ttaggaaaggagtgagctag

SEQ ID NO: 799530 - DNA, 20 bp, Artificial
  CRISPR gRNA sequence
aggaaaggagtgagctaggg

SEQ ID NO: 799531 - DNA, 20 bp, Artificial
  CRISPR gRNA sequence
ggaaaggagtgagctagggt

SEQ ID NO: 799532 - DNA, 20 bp, Artificial
  CRISPR gRNA sequence
gggtgacaaggggcaacatt

SEQ ID NO: 799533 - DNA, 20 bp, Artificial
  CRISPR gRNA sequence
tttatccctcattggctctt

SEQ ID NO: 799534 - DNA, 20 bp, Artificial
  CRISPR gRNA sequence
ttatccctcattggctcttt

SEQ ID NO: 799535 - DNA, 20 bp, Artificial
  CRISPR gRNA sequence
tatccctcattggctctttc

SEQ ID NO: 799536 - DNA, 20 bp, Artificial
  CRISPR gRNA sequence
atccctcattggctctttct

SEQ ID NO: 799537 - DNA, 20 bp, Artificial
  CRISPR gRNA sequence
tccctcattggctctttcta

SEQ ID NO: 799538 - DNA, 20 bp, Artificial
  CRISPR gRNA sequence
attggctctttctacagagg

SEQ ID NO: 799539 - DNA, 20 bp, Artificial
  CRISPR gRNA sequence
gctctttctacagaggaagg

SEQ ID NO: 799540 - DNA, 20 bp, Artificial
  CRISPR gRNA sequence
tttctacagaggaaggatct

SEQ ID NO: 799541 - DNA, 20 bp, Artificial
  CRISPR gRNA sequence
tctacagaggaaggatcttt

SEQ ID NO: 799542 - DNA, 20 bp, Artificial
  CRISPR gRNA sequence
ctacagaggaaggatctttt

SEQ ID NO: 799543 - DNA, 20 bp, Artificial
  CRISPR gRNA sequence
tacagaggaaggatcttttc

SEQ ID NO: 799544 - DNA, 20 bp, Artificial
  CRISPR gRNA sequence
cagaggaaggatcttttctt

SEQ ID NO: 799545 - DNA, 20 bp, Artificial
  CRISPR gRNA sequence
ttcttctaagataatcagca

SEQ ID NO: 799546 - DNA, 20 bp, Artificial
  CRISPR gRNA sequence
tcttctaagataatcagcac

SEQ ID NO: 799547 - DNA, 20 bp, Artificial
  CRISPR gRNA sequence
cttctaagataatcagcaca

SEQ ID NO: 799548 - DNA, 20 bp, Artificial
  CRISPR gRNA sequence
ttctaagataatcagcacaa

SEQ ID NO: 799549 - DNA, 20 bp, Artificial
  CRISPR gRNA sequence
ctaagataatcagcacaaga

SEQ ID NO: 799550 - DNA, 20 bp, Artificial
  CRISPR gRNA sequence
taagataatcagcacaagac

SEQ ID NO: 799551 - DNA, 20 bp, Artificial
  CRISPR gRNA sequence
agataatcagcacaagacaa

SEQ ID NO: 799552 - DNA, 20 bp, Artificial
  CRISPR gRNA sequence
gctcccagttaggtatacta

SEQ ID NO: 799553 - DNA, 20 bp, Artificial
  CRISPR gRNA sequence
ccagttaggtatactaatgg

SEQ ID NO: 799554 - DNA, 20 bp, Artificial
  CRISPR gRNA sequence
ggtatactaatggggcaaaa

SEQ ID NO: 799555 - DNA, 20 bp, Artificial
  CRISPR gRNA sequence
atggggcaaaaggaagagca

SEQ ID NO: 799556 - DNA, 20 bp, Artificial
  CRISPR gRNA sequence
acatttattgaagattcact

SEQ ID NO: 799557 - DNA, 20 bp, Artificial
  CRISPR gRNA sequence
catttattgaagattcacta

SEQ ID NO: 799558 - DNA, 20 bp, Artificial
  CRISPR gRNA sequence
attgaagattcactaaatgc

SEQ ID NO: 799559 - DNA, 20 bp, Artificial
  CRISPR gRNA sequence
ttgaagattcactaaatgcc

SEQ ID NO: 799560 - DNA, 20 bp, Artificial
  CRISPR gRNA sequence
aagattcactaaatgccaga

SEQ ID NO: 799561 - DNA, 20 bp, Artificial
  CRISPR gRNA sequence
actaaatgccagatactgtg

SEQ ID NO: 799562 - DNA, 20 bp, Artificial
  CRISPR gRNA sequence
aatgccagatactgtgctag

SEQ ID NO: 799563 - DNA, 20 bp, Artificial
  CRISPR gRNA sequence
tgctaggcaatttacatatg

SEQ ID NO: 799564 - DNA, 20 bp, Artificial
  CRISPR gRNA sequence
ggcaatttacatatggtata

SEQ ID NO: 799565 - DNA, 20 bp, Artificial
  CRISPR gRNA sequence
acatatggtatagttcattt

SEQ ID NO: 799566 - DNA, 20 bp, Artificial
  CRISPR gRNA sequence
catatggtatagttcattta

SEQ ID NO: 799567 - DNA, 20 bp, Artificial
  CRISPR gRNA sequence
atttaatcttcacaatgatc

SEQ ID NO: 799568 - DNA, 20 bp, Artificial
  CRISPR gRNA sequence
aatcttcacaatgatcattt

SEQ ID NO: 799569 - DNA, 20 bp, Artificial
  CRISPR gRNA sequence
atcttcacaatgatcatttt

SEQ ID NO: 799570 - DNA, 20 bp, Artificial
  CRISPR gRNA sequence
cacaatgatcattttgcagg

SEQ ID NO: 799571 - DNA, 20 bp, Artificial
  CRISPR gRNA sequence
acaatgatcattttgcaggt

SEQ ID NO: 799572 - DNA, 20 bp, Artificial
  CRISPR gRNA sequence
tgcaggtgagggaactagaa

SEQ ID NO: 799573 - DNA, 20 bp, Artificial
  CRISPR gRNA sequence
gcaggtgagggaactagaac

SEQ ID NO: 799574 - DNA, 20 bp, Artificial
  CRISPR gRNA sequence
caggtgagggaactagaact

SEQ ID NO: 799575 - DNA, 20 bp, Artificial
  CRISPR gRNA sequence
gaactcagaaaaggtactta

SEQ ID NO: 799576 - DNA, 20 bp, Artificial
  CRISPR gRNA sequence
agaaaaggtacttaatttcc

SEQ ID NO: 799577 - DNA, 20 bp, Artificial
  CRISPR gRNA sequence
aatttccccaagattacata

SEQ ID NO: 799578 - DNA, 20 bp, Artificial
  CRISPR gRNA sequence
atttccccaagattacatag

SEQ ID NO: 799579 - DNA, 20 bp, Artificial
  CRISPR gRNA sequence
ccccaagattacatagttat

SEQ ID NO: 799580 - DNA, 20 bp, Artificial
  CRISPR gRNA sequence
cccaagattacatagttatt

SEQ ID NO: 799581 - DNA, 20 bp, Artificial
  CRISPR gRNA sequence
catagttattaggtgacacc

SEQ ID NO: 799582 - DNA, 20 bp, Artificial
  CRISPR gRNA sequence
ttaggtgacaccggcaagat

SEQ ID NO: 799583 - DNA, 20 bp, Artificial
  CRISPR gRNA sequence
ggtgacaccggcaagatttc

SEQ ID NO: 799584 - DNA, 20 bp, Artificial
  CRISPR gRNA sequence
caacaaagctaatgtccttt

SEQ ID NO: 799585 - DNA, 20 bp, Artificial
  CRISPR gRNA sequence
aacaaagctaatgtcctttc

SEQ ID NO: 799586 - DNA, 20 bp, Artificial
  CRISPR gRNA sequence
atgtcctttctactttactg

SEQ ID NO: 799587 - DNA, 20 bp, Artificial
  CRISPR gRNA sequence
tctactttactgtgctacca

SEQ ID NO: 799588 - DNA, 20 bp, Artificial
  CRISPR gRNA sequence
ctactttactgtgctaccat

SEQ ID NO: 799589 - DNA, 20 bp, Artificial
  CRISPR gRNA sequence
tactttactgtgctaccatg

SEQ ID NO: 799590 - DNA, 20 bp, Artificial
  CRISPR gRNA sequence
ctttactgtgctaccatgat

SEQ ID NO: 799591 - DNA, 20 bp, Artificial
  CRISPR gRNA sequence
tactgtgctaccatgatgat

SEQ ID NO: 799592 - DNA, 20 bp, Artificial
  CRISPR gRNA sequence
actgtgctaccatgatgatg

SEQ ID NO: 799593 - DNA, 20 bp, Artificial
  CRISPR gRNA sequence
ctgtgctaccatgatgatgg

SEQ ID NO: 799594 - DNA, 20 bp, Artificial
  CRISPR gRNA sequence
tgctaccatgatgatggtaa

SEQ ID NO: 799595 - DNA, 20 bp, Artificial
  CRISPR gRNA sequence
ccatgatgatggtaatcaaa

SEQ ID NO: 799596 - DNA, 20 bp, Artificial
  CRISPR gRNA sequence
ccaactttggaataggtttt

SEQ ID NO: 799597 - DNA, 20 bp, Artificial
  CRISPR gRNA sequence
caactttggaataggttttt

SEQ ID NO: 799598 - DNA, 20 bp, Artificial
  CRISPR gRNA sequence
tggaataggtttttgcactg

SEQ ID NO: 799599 - DNA, 20 bp, Artificial
  CRISPR gRNA sequence
ggaataggtttttgcactga

SEQ ID NO: 799600 - DNA, 20 bp, Artificial
  CRISPR gRNA sequence
gaataggtttttgcactgaa

SEQ ID NO: 799601 - DNA, 20 bp, Artificial
  CRISPR gRNA sequence
ttgcactgaagtctgaatat

SEQ ID NO: 799602 - DNA, 20 bp, Artificial
  CRISPR gRNA sequence
tgcactgaagtctgaatatg

SEQ ID NO: 799603 - DNA, 20 bp, Artificial
  CRISPR gRNA sequence
gcactgaagtctgaatatgg

SEQ ID NO: 799604 - DNA, 20 bp, Artificial
  CRISPR gRNA sequence
cactgaagtctgaatatgga

SEQ ID NO: 799605 - DNA, 20 bp, Artificial
  CRISPR gRNA sequence
aagtctgaatatggatacgt

SEQ ID NO: 799606 - DNA, 20 bp, Artificial
  CRISPR gRNA sequence
aatatggatacgtattgaat

SEQ ID NO: 799607 - DNA, 20 bp, Artificial
  CRISPR gRNA sequence
aatgtttattctggatattc

SEQ ID NO: 799608 - DNA, 20 bp, Artificial
  CRISPR gRNA sequence
attctggatattcacagaat

SEQ ID NO: 799609 - DNA, 20 bp, Artificial
  CRISPR gRNA sequence
ttctggatattcacagaatc

SEQ ID NO: 799610 - DNA, 20 bp, Artificial
  CRISPR gRNA sequence
tggatattcacagaatcaaa

SEQ ID NO: 799611 - DNA, 20 bp, Artificial
  CRISPR gRNA sequence
gatattcacagaatcaaaaa

SEQ ID NO: 799612 - DNA, 20 bp, Artificial
  CRISPR gRNA sequence
acagaatcaaaaaatatgtg

SEQ ID NO: 799613 - DNA, 20 bp, Artificial
  CRISPR gRNA sequence
tgttgctgaattaactgaaa

SEQ ID NO: 799614 - DNA, 20 bp, Artificial
  CRISPR gRNA sequence
ctgaattaactgaaaggaaa

SEQ ID NO: 799615 - DNA, 20 bp, Artificial
  CRISPR gRNA sequence
aattaactgaaaggaaagta

SEQ ID NO: 799616 - DNA, 20 bp, Artificial
  CRISPR gRNA sequence
actgaaaggaaagtaaaaat

SEQ ID NO: 799617 - DNA, 20 bp, Artificial
  CRISPR gRNA sequence
aaaggaaagtaaaaatgtag

SEQ ID NO: 799618 - DNA, 20 bp, Artificial
  CRISPR gRNA sequence
tctcattttcttcacgaatt

SEQ ID NO: 799619 - DNA, 20 bp, Artificial
  CRISPR gRNA sequence
ctcattttcttcacgaattt

SEQ ID NO: 799620 - DNA, 20 bp, Artificial
  CRISPR gRNA sequence
tcattttcttcacgaatttg

SEQ ID NO: 799621 - DNA, 20 bp, Artificial
  CRISPR gRNA sequence
attttcttcacgaatttgga

SEQ ID NO: 799622 - DNA, 20 bp, Artificial
  CRISPR gRNA sequence
tcttcacgaatttggaattc

SEQ ID NO: 799623 - DNA, 20 bp, Artificial
  CRISPR gRNA sequence
cttcacgaatttggaattct

SEQ ID NO: 799624 - DNA, 20 bp, Artificial
  CRISPR gRNA sequence
ttcacgaatttggaattctt

SEQ ID NO: 799625 - DNA, 20 bp, Artificial
  CRISPR gRNA sequence
cacgaatttggaattctttt

SEQ ID NO: 799626 - DNA, 20 bp, Artificial
  CRISPR gRNA sequence
acgaatttggaattcttttc

SEQ ID NO: 799627 - DNA, 20 bp, Artificial
  CRISPR gRNA sequence
ggaattcttttctgctttcc

SEQ ID NO: 799628 - DNA, 20 bp, Artificial
  CRISPR gRNA sequence
gaattcttttctgctttcca

SEQ ID NO: 799629 - DNA, 20 bp, Artificial
  CRISPR gRNA sequence
ttttctgctttccactatgc

SEQ ID NO: 799630 - DNA, 20 bp, Artificial
  CRISPR gRNA sequence
ttctgctttccactatgcag

SEQ ID NO: 799631 - DNA, 20 bp, Artificial
  CRISPR gRNA sequence
tctgctttccactatgcaga

SEQ ID NO: 799632 - DNA, 20 bp, Artificial
  CRISPR gRNA sequence
ctgctttccactatgcagat

SEQ ID NO: 799633 - DNA, 20 bp, Artificial
  CRISPR gRNA sequence
tgctttccactatgcagata

SEQ ID NO: 799634 - DNA, 20 bp, Artificial
  CRISPR gRNA sequence
ctttccactatgcagataac

SEQ ID NO: 799635 - DNA, 20 bp, Artificial
  CRISPR gRNA sequence
tccactatgcagataacatc

SEQ ID NO: 799636 - DNA, 20 bp, Artificial
  CRISPR gRNA sequence
ccactatgcagataacatca

SEQ ID NO: 799637 - DNA, 20 bp, Artificial
  CRISPR gRNA sequence
cactatgcagataacatcag

SEQ ID NO: 799638 - DNA, 20 bp, Artificial
  CRISPR gRNA sequence
tgcagataacatcagttcag

SEQ ID NO: 799639 - DNA, 20 bp, Artificial
  CRISPR gRNA sequence
agacaaatattaaataccta

SEQ ID NO: 799640 - DNA, 20 bp, Artificial
  CRISPR gRNA sequence
aatacctacctaaattagaa

SEQ ID NO: 799641 - DNA, 20 bp, Artificial
  CRISPR gRNA sequence
cctaaattagaatgccttct

SEQ ID NO: 799642 - DNA, 20 bp, Artificial
  CRISPR gRNA sequence
aattagaatgccttctcctc

SEQ ID NO: 799643 - DNA, 20 bp, Artificial
  CRISPR gRNA sequence
gaatgccttctcctcatggg

SEQ ID NO: 799644 - DNA, 20 bp, Artificial
  CRISPR gRNA sequence
ctcctcatgggattttttta

SEQ ID NO: 799645 - DNA, 20 bp, Artificial
  CRISPR gRNA sequence
tcctcatgggatttttttaa

SEQ ID NO: 799646 - DNA, 20 bp, Artificial
  CRISPR gRNA sequence
ctcatgggatttttttaaaa

SEQ ID NO: 799647 - DNA, 20 bp, Artificial
  CRISPR gRNA sequence
atgggatttttttaaaatct

SEQ ID NO: 799648 - DNA, 20 bp, Artificial
  CRISPR gRNA sequence
ttttaaaatcttgtcatttc

SEQ ID NO: 799649 - DNA, 20 bp, Artificial
  CRISPR gRNA sequence
tttaaaatcttgtcatttca

SEQ ID NO: 799650 - DNA, 20 bp, Artificial
  CRISPR gRNA sequence
ttaaaatcttgtcatttcat

SEQ ID NO: 799651 - DNA, 20 bp, Artificial
  CRISPR gRNA sequence
taaaatcttgtcatttcatg

SEQ ID NO: 799652 - DNA, 20 bp, Artificial
  CRISPR gRNA sequence
aaaatcttgtcatttcatgt

SEQ ID NO: 799653 - DNA, 20 bp, Artificial
  CRISPR gRNA sequence
aaatcttgtcatttcatgtc

SEQ ID NO: 799654 - DNA, 20 bp, Artificial
  CRISPR gRNA sequence
gtcatttcatgtctctttaa

SEQ ID NO: 799655 - DNA, 20 bp, Artificial
  CRISPR gRNA sequence
tcatttcatgtctctttaat

SEQ ID NO: 799656 - DNA, 20 bp, Artificial
  CRISPR gRNA sequence
catgtctctttaattaaaga

SEQ ID NO: 799657 - DNA, 20 bp, Artificial
  CRISPR gRNA sequence
atgtctctttaattaaagag

SEQ ID NO: 799658 - DNA, 20 bp, Artificial
  CRISPR gRNA sequence
tttaattaaagagttttgat

SEQ ID NO: 799659 - DNA, 20 bp, Artificial
  CRISPR gRNA sequence
taattaaagagttttgattt

SEQ ID NO: 799660 - DNA, 20 bp, Artificial
  CRISPR gRNA sequence
aattaaagagttttgatttc

SEQ ID NO: 799661 - DNA, 20 bp, Artificial
  CRISPR gRNA sequence
attaaagagttttgatttca

SEQ ID NO: 799662 - DNA, 20 bp, Artificial
  CRISPR gRNA sequence
aagagttttgatttcagagg

SEQ ID NO: 799663 - DNA, 20 bp, Artificial
  CRISPR gRNA sequence
tgatttcagaggagggtacc

SEQ ID NO: 799664 - DNA, 20 bp, Artificial
  CRISPR gRNA sequence
gatttcagaggagggtacct

SEQ ID NO: 799665 - DNA, 20 bp, Artificial
  CRISPR gRNA sequence
atttcagaggagggtacctg

SEQ ID NO: 799666 - DNA, 20 bp, Artificial
  CRISPR gRNA sequence
cagaggagggtacctgcaaa

SEQ ID NO: 799667 - DNA, 20 bp, Artificial
  CRISPR gRNA sequence
agaggagggtacctgcaaaa

SEQ ID NO: 799668 - DNA, 20 bp, Artificial
  CRISPR gRNA sequence
caaaagaaaacaacaaaaaa

SEQ ID NO: 799669 - DNA, 20 bp, Artificial
  CRISPR gRNA sequence
aaggatctgagaaataatta

SEQ ID NO: 799670 - DNA, 20 bp, Artificial
  CRISPR gRNA sequence
agaaataattagtgtttact

SEQ ID NO: 799671 - DNA, 20 bp, Artificial
  CRISPR gRNA sequence
gtgtttacttctggggaggg

SEQ ID NO: 799672 - DNA, 20 bp, Artificial
  CRISPR gRNA sequence
acttctggggaggggaggag

SEQ ID NO: 799673 - DNA, 20 bp, Artificial
  CRISPR gRNA sequence
cttctggggaggggaggagg

SEQ ID NO: 799674 - DNA, 20 bp, Artificial
  CRISPR gRNA sequence
ctggggaggggaggaggtct

SEQ ID NO: 799675 - DNA, 20 bp, Artificial
  CRISPR gRNA sequence
tggggaggggaggaggtctg

SEQ ID NO: 799676 - DNA, 20 bp, Artificial
  CRISPR gRNA sequence
gggaggggaggaggtctggg

SEQ ID NO: 799677 - DNA, 20 bp, Artificial
  CRISPR gRNA sequence
ggatgggggtaaaaaggata

SEQ ID NO: 799678 - DNA, 20 bp, Artificial
  CRISPR gRNA sequence
atctattatgtatattcagg

SEQ ID NO: 799679 - DNA, 20 bp, Artificial
  CRISPR gRNA sequence
tctattatgtatattcaggt

SEQ ID NO: 799680 - DNA, 20 bp, Artificial
  CRISPR gRNA sequence
ttatgtatattcaggttttt

SEQ ID NO: 799681 - DNA, 20 bp, Artificial
  CRISPR gRNA sequence
tgtatattcaggtttttgtt

SEQ ID NO: 799682 - DNA, 20 bp, Artificial
  CRISPR gRNA sequence
aggtttttgttttttacaag

SEQ ID NO: 799683 - DNA, 20 bp, Artificial
  CRISPR gRNA sequence
ttgttttttacaagaagcat

SEQ ID NO: 799684 - DNA, 20 bp, Artificial
  CRISPR gRNA sequence
tgttttttacaagaagcatg

SEQ ID NO: 799685 - DNA, 20 bp, Artificial
  CRISPR gRNA sequence
gttttttacaagaagcatgt

SEQ ID NO: 799686 - DNA, 20 bp, Artificial
  CRISPR gRNA sequence
ttttttacaagaagcatgta

SEQ ID NO: 799687 - DNA, 20 bp, Artificial
  CRISPR gRNA sequence
tttacaagaagcatgtatta

SEQ ID NO: 799688 - DNA, 20 bp, Artificial
  CRISPR gRNA sequence
ttacaagaagcatgtattag

SEQ ID NO: 799689 - DNA, 20 bp, Artificial
  CRISPR gRNA sequence
tacaagaagcatgtattagg

SEQ ID NO: 799690 - DNA, 20 bp, Artificial
  CRISPR gRNA sequence
acaagaagcatgtattaggt

SEQ ID NO: 799691 - DNA, 20 bp, Artificial
  CRISPR gRNA sequence
caagaagcatgtattaggta

SEQ ID NO: 799692 - DNA, 20 bp, Artificial
  CRISPR gRNA sequence
ggtattatttgtataataaa

SEQ ID NO: 799693 - DNA, 20 bp, Artificial
  CRISPR gRNA sequence
tttgtataataaaatataat

SEQ ID NO: 799694 - DNA, 20 bp, Artificial
  CRISPR gRNA sequence
gtataataaaatataatttt

SEQ ID NO: 799695 - DNA, 20 bp, Artificial
  CRISPR gRNA sequence
tataataaaatataatttta

SEQ ID NO: 799696 - DNA, 20 bp, Artificial
  CRISPR gRNA sequence
taaaaatacaagaaatttct

SEQ ID NO: 799697 - DNA, 20 bp, Artificial
  CRISPR gRNA sequence
aaaaatacaagaaatttctc

SEQ ID NO: 799698 - DNA, 20 bp, Artificial
  CRISPR gRNA sequence
aaaatacaagaaatttctca

SEQ ID NO: 799699 - DNA, 20 bp, Artificial
  CRISPR gRNA sequence
ctcatataaaaatatgaaag

SEQ ID NO: 799700 - DNA, 20 bp, Artificial
  CRISPR gRNA sequence
tcatataaaaatatgaaagt

SEQ ID NO: 799701 - DNA, 20 bp, Artificial
  CRISPR gRNA sequence
atataaaaatatgaaagtaa

SEQ ID NO: 799702 - DNA, 20 bp, Artificial
  CRISPR gRNA sequence
caacactcagtgcctgagac

SEQ ID NO: 799703 - DNA, 20 bp, Artificial
  CRISPR gRNA sequence
agtgcctgagacagagctac

SEQ ID NO: 799704 - DNA, 20 bp, Artificial
  CRISPR gRNA sequence
agacagagctacagctatca

SEQ ID NO: 799705 - DNA, 20 bp, Artificial
  CRISPR gRNA sequence
cagctatcagggtgtccaga

SEQ ID NO: 799706 - DNA, 20 bp, Artificial
  CRISPR gRNA sequence
tcagggtgtccagacagaca

SEQ ID NO: 799707 - DNA, 20 bp, Artificial
  CRISPR gRNA sequence
cattttcttccttgctcctt

SEQ ID NO: 799708 - DNA, 20 bp, Artificial
  CRISPR gRNA sequence
tcttccttgctccttgtaca

SEQ ID NO: 799709 - DNA, 20 bp, Artificial
  CRISPR gRNA sequence
cttccttgctccttgtacag

SEQ ID NO: 799710 - DNA, 20 bp, Artificial
  CRISPR gRNA sequence
ttccttgctccttgtacagc

SEQ ID NO: 799711 - DNA, 20 bp, Artificial
  CRISPR gRNA sequence
ccttgctccttgtacagccc

SEQ ID NO: 799712 - DNA, 20 bp, Artificial
  CRISPR gRNA sequence
cttgctccttgtacagcccc

SEQ ID NO: 799713 - DNA, 20 bp, Artificial
  CRISPR gRNA sequence
gctccttgtacagccccaga

SEQ ID NO: 799714 - DNA, 20 bp, Artificial
  CRISPR gRNA sequence
ctccttgtacagccccagac

SEQ ID NO: 799715 - DNA, 20 bp, Artificial
  CRISPR gRNA sequence
cttgtacagccccagacctg

SEQ ID NO: 799716 - DNA, 20 bp, Artificial
  CRISPR gRNA sequence
gtacagccccagacctgcat

SEQ ID NO: 799717 - DNA, 20 bp, Artificial
  CRISPR gRNA sequence
tacagccccagacctgcatg

SEQ ID NO: 799718 - DNA, 20 bp, Artificial
  CRISPR gRNA sequence
catgcttcattgaaaagaaa

SEQ ID NO: 799719 - DNA, 20 bp, Artificial
  CRISPR gRNA sequence
cattgaaaagaaaagaagat

SEQ ID NO: 799720 - DNA, 20 bp, Artificial
  CRISPR gRNA sequence
attgaaaagaaaagaagata

SEQ ID NO: 799721 - DNA, 20 bp, Artificial
  CRISPR gRNA sequence
aaaagaaaagaagatacctg

SEQ ID NO: 799722 - DNA, 20 bp, Artificial
  CRISPR gRNA sequence
aattaaatcaatgtgatgct

SEQ ID NO: 799723 - DNA, 20 bp, Artificial
  CRISPR gRNA sequence
aatcaatgtgatgcttagta

SEQ ID NO: 799724 - DNA, 20 bp, Artificial
  CRISPR gRNA sequence
agtaccctatcagtgcacat

SEQ ID NO: 799725 - DNA, 20 bp, Artificial
  CRISPR gRNA sequence
gtaccctatcagtgcacatt

SEQ ID NO: 799726 - DNA, 20 bp, Artificial
  CRISPR gRNA sequence
tcagtgcacatttcttttct

SEQ ID NO: 799727 - DNA, 20 bp, Artificial
  CRISPR gRNA sequence
cttttctatttttaaatttt

SEQ ID NO: 799728 - DNA, 20 bp, Artificial
  CRISPR gRNA sequence
ttttctatttttaaatttta

SEQ ID NO: 799729 - DNA, 20 bp, Artificial
  CRISPR gRNA sequence
ttctatttttaaattttaaa

SEQ ID NO: 799730 - DNA, 20 bp, Artificial
  CRISPR gRNA sequence
tctatttttaaattttaaaa

SEQ ID NO: 799731 - DNA, 20 bp, Artificial
  CRISPR gRNA sequence
ctatttttaaattttaaaaa

SEQ ID NO: 799732 - DNA, 20 bp, Artificial
  CRISPR gRNA sequence
tatttttaaattttaaaaat

SEQ ID NO: 799733 - DNA, 20 bp, Artificial
  CRISPR gRNA sequence
tttttaaattttaaaaataa

SEQ ID NO: 799734 - DNA, 20 bp, Artificial
  CRISPR gRNA sequence
ttaaattttaaaaataacac

SEQ ID NO: 799735 - DNA, 20 bp, Artificial
  CRISPR gRNA sequence
taaattttaaaaataacact

SEQ ID NO: 799736 - DNA, 20 bp, Artificial
  CRISPR gRNA sequence
aaattttaaaaataacactt

SEQ ID NO: 799737 - DNA, 20 bp, Artificial
  CRISPR gRNA sequence
aattttaaaaataacacttg

SEQ ID NO: 799738 - DNA, 20 bp, Artificial
  CRISPR gRNA sequence
taaaaataacacttggccag

SEQ ID NO: 799739 - DNA, 20 bp, Artificial
  CRISPR gRNA sequence
aaaaataacacttggccagg

SEQ ID NO: 799740 - DNA, 20 bp, Artificial
  CRISPR gRNA sequence
aaaataacacttggccaggc

SEQ ID NO: 799741 - DNA, 20 bp, Artificial
  CRISPR gRNA sequence
ggccaggcgcagtggctcac

SEQ ID NO: 799742 - DNA, 20 bp, Artificial
  CRISPR gRNA sequence
gccaggcgcagtggctcacg

SEQ ID NO: 799743 - DNA, 20 bp, Artificial
  CRISPR gRNA sequence
acgcctataatcccagccct

SEQ ID NO: 799744 - DNA, 20 bp, Artificial
  CRISPR gRNA sequence
taatcccagccctatgggag

SEQ ID NO: 799745 - DNA, 20 bp, Artificial
  CRISPR gRNA sequence
tgggaggccgaggcgggtgg

SEQ ID NO: 799746 - DNA, 20 bp, Artificial
  CRISPR gRNA sequence
aggtcaggagttcgagacca

SEQ ID NO: 799747 - DNA, 20 bp, Artificial
  CRISPR gRNA sequence
gagaccagcctggccaacat

SEQ ID NO: 799748 - DNA, 20 bp, Artificial
  CRISPR gRNA sequence
gccaacatggtgaaacccct

SEQ ID NO: 799749 - DNA, 20 bp, Artificial
  CRISPR gRNA sequence
tgtactaaaaatagaaaaat

SEQ ID NO: 799750 - DNA, 20 bp, Artificial
  CRISPR gRNA sequence
tactaaaaatagaaaaatat

SEQ ID NO: 799751 - DNA, 20 bp, Artificial
  CRISPR gRNA sequence
aaaatagaaaaatattagcc

SEQ ID NO: 799752 - DNA, 20 bp, Artificial
  CRISPR gRNA sequence
gccgggcatggtggtggcca

SEQ ID NO: 799753 - DNA, 20 bp, Artificial
  CRISPR gRNA sequence
taatccaagctactcagctg

SEQ ID NO: 799754 - DNA, 20 bp, Artificial
  CRISPR gRNA sequence
ctcagctgaggcagaaaaat

SEQ ID NO: 799755 - DNA, 20 bp, Artificial
  CRISPR gRNA sequence
agctgaggcagaaaaattgc

SEQ ID NO: 799756 - DNA, 20 bp, Artificial
  CRISPR gRNA sequence
aggcagaaaaattgcttgaa

SEQ ID NO: 799757 - DNA, 20 bp, Artificial
  CRISPR gRNA sequence
cttgaacccaggaggcagag

SEQ ID NO: 799758 - DNA, 20 bp, Artificial
  CRISPR gRNA sequence
gaacccaggaggcagaggtt

SEQ ID NO: 799759 - DNA, 20 bp, Artificial
  CRISPR gRNA sequence
aacccaggaggcagaggttg

SEQ ID NO: 799760 - DNA, 20 bp, Artificial
  CRISPR gRNA sequence
cagtgagctaagatcatgtc

SEQ ID NO: 799761 - DNA, 20 bp, Artificial
  CRISPR gRNA sequence
agatcatgtcactgtattcc

SEQ ID NO: 799762 - DNA, 20 bp, Artificial
  CRISPR gRNA sequence
tattccagcctgggtgacag

SEQ ID NO: 799763 - DNA, 20 bp, Artificial
  CRISPR gRNA sequence
cagcctgggtgacagagtga

SEQ ID NO: 799764 - DNA, 20 bp, Artificial
  CRISPR gRNA sequence
ggtgacagagtgagattcca

SEQ ID NO: 799765 - DNA, 20 bp, Artificial
  CRISPR gRNA sequence
catttaaaaaaaaaaaaaaa

SEQ ID NO: 799766 - DNA, 20 bp, Artificial
  CRISPR gRNA sequence
aaaaaaaaaaaaaaagaaaa

SEQ ID NO: 799767 - DNA, 20 bp, Artificial
  CRISPR gRNA sequence
aaaaaaaaaaaaaagaaaaa

SEQ ID NO: 799768 - DNA, 20 bp, Artificial
  CRISPR gRNA sequence
atggcggtattctcagtcat

SEQ ID NO: 799769 - DNA, 20 bp, Artificial
  CRISPR gRNA sequence
tggcggtattctcagtcatt

SEQ ID NO: 799770 - DNA, 20 bp, Artificial
  CRISPR gRNA sequence
tcagtcattacaaataaata

SEQ ID NO: 799771 - DNA, 20 bp, Artificial
  CRISPR gRNA sequence
agtcattacaaataaataaa

SEQ ID NO: 799772 - DNA, 20 bp, Artificial
  CRISPR gRNA sequence
caaataaataaaaacaatcc

SEQ ID NO: 799773 - DNA, 20 bp, Artificial
  CRISPR gRNA sequence
gagaatttgattccaggagt

SEQ ID NO: 799774 - DNA, 20 bp, Artificial
  CRISPR gRNA sequence
gattccaggagtaggtctag

SEQ ID NO: 799775 - DNA, 20 bp, Artificial
  CRISPR gRNA sequence
attccaggagtaggtctaga

SEQ ID NO: 799776 - DNA, 20 bp, Artificial
  CRISPR gRNA sequence
caggagtaggtctagaagaa

SEQ ID NO: 799777 - DNA, 20 bp, Artificial
  CRISPR gRNA sequence
gaagaacttcaactggagaa

SEQ ID NO: 799778 - DNA, 20 bp, Artificial
  CRISPR gRNA sequence
caactggagaatggatagag

SEQ ID NO: 799779 - DNA, 20 bp, Artificial
  CRISPR gRNA sequence
aactggagaatggatagaga

SEQ ID NO: 799780 - DNA, 20 bp, Artificial
  CRISPR gRNA sequence
gagaatggatagagaaatca

SEQ ID NO: 799781 - DNA, 20 bp, Artificial
  CRISPR gRNA sequence
gcagaatatatattatatat

SEQ ID NO: 799782 - DNA, 20 bp, Artificial
  CRISPR gRNA sequence
cagaatatatattatatata

SEQ ID NO: 799783 - DNA, 20 bp, Artificial
  CRISPR gRNA sequence
tatatataatagatagcatg

SEQ ID NO: 799784 - DNA, 20 bp, Artificial
  CRISPR gRNA sequence
attacaaaaacatatgacta

SEQ ID NO: 799785 - DNA, 20 bp, Artificial
  CRISPR gRNA sequence
caaaaacatatgactacatc

SEQ ID NO: 799786 - DNA, 20 bp, Artificial
  CRISPR gRNA sequence
catctattattatatagcat

SEQ ID NO: 799787 - DNA, 20 bp, Artificial
  CRISPR gRNA sequence
ttattatatagcatgtagat

SEQ ID NO: 799788 - DNA, 20 bp, Artificial
  CRISPR gRNA sequence
ttatatagcatgtagataaa

SEQ ID NO: 799789 - DNA, 20 bp, Artificial
  CRISPR gRNA sequence
tatagcatgtagataaatta

SEQ ID NO: 799790 - DNA, 20 bp, Artificial
  CRISPR gRNA sequence
caaaaacatgtaactacatc

SEQ ID NO: 799791 - DNA, 20 bp, Artificial
  CRISPR gRNA sequence
catctatgaatcttagagca

SEQ ID NO: 799792 - DNA, 20 bp, Artificial
  CRISPR gRNA sequence
tgaatcttagagcataatat

SEQ ID NO: 799793 - DNA, 20 bp, Artificial
  CRISPR gRNA sequence
agagcataatattgagtaaa

SEQ ID NO: 799794 - DNA, 20 bp, Artificial
  CRISPR gRNA sequence
gagcataatattgagtaaaa

SEQ ID NO: 799795 - DNA, 20 bp, Artificial
  CRISPR gRNA sequence
agtaaaaaataaataaataa

SEQ ID NO: 799796 - DNA, 20 bp, Artificial
  CRISPR gRNA sequence
aggccagaagataacacata

SEQ ID NO: 799797 - DNA, 20 bp, Artificial
  CRISPR gRNA sequence
ttcataaataaatatattgc

SEQ ID NO: 799798 - DNA, 20 bp, Artificial
  CRISPR gRNA sequence
tcataaataaatatattgct

SEQ ID NO: 799799 - DNA, 20 bp, Artificial
  CRISPR gRNA sequence
cataaataaatatattgctt

SEQ ID NO: 799800 - DNA, 20 bp, Artificial
  CRISPR gRNA sequence
ataaataaatatattgctta

SEQ ID NO: 799801 - DNA, 20 bp, Artificial
  CRISPR gRNA sequence
cttaagcataccttatatat

SEQ ID NO: 799802 - DNA, 20 bp, Artificial
  CRISPR gRNA sequence
aagcataccttatatataga

SEQ ID NO: 799803 - DNA, 20 bp, Artificial
  CRISPR gRNA sequence
agcataccttatatatagaa

SEQ ID NO: 799804 - DNA, 20 bp, Artificial
  CRISPR gRNA sequence
atatatagaagataaagctt

SEQ ID NO: 799805 - DNA, 20 bp, Artificial
  CRISPR gRNA sequence
tatatagaagataaagctta

SEQ ID NO: 799806 - DNA, 20 bp, Artificial
  CRISPR gRNA sequence
aaaaagtaaagaagaggccg

SEQ ID NO: 799807 - DNA, 20 bp, Artificial
  CRISPR gRNA sequence
aaaagtaaagaagaggccgg

SEQ ID NO: 799808 - DNA, 20 bp, Artificial
  CRISPR gRNA sequence
acgcctgtaatcccagcact

SEQ ID NO: 799809 - DNA, 20 bp, Artificial
  CRISPR gRNA sequence
taatcccagcactttgggag

SEQ ID NO: 799810 - DNA, 20 bp, Artificial
  CRISPR gRNA sequence
tgggaggccaaggtgggcag

SEQ ID NO: 799811 - DNA, 20 bp, Artificial
  CRISPR gRNA sequence
gggaggccaaggtgggcaga

SEQ ID NO: 799812 - DNA, 20 bp, Artificial
  CRISPR gRNA sequence
ggaggccaaggtgggcagat

SEQ ID NO: 799813 - DNA, 20 bp, Artificial
  CRISPR gRNA sequence
gcccgcatggtgaaacctcg

SEQ ID NO: 799814 - DNA, 20 bp, Artificial
  CRISPR gRNA sequence
gtctctacaaaaaatacaaa

SEQ ID NO: 799815 - DNA, 20 bp, Artificial
  CRISPR gRNA sequence
tacaaaaaatacaaaaatta

SEQ ID NO: 799816 - DNA, 20 bp, Artificial
  CRISPR gRNA sequence
caaaaaatacaaaaattagc

SEQ ID NO: 799817 - DNA, 20 bp, Artificial
  CRISPR gRNA sequence
gctgggcatggtggcacaag

SEQ ID NO: 799818 - DNA, 20 bp, Artificial
  CRISPR gRNA sequence
ggcatggtggcacaagcctg

SEQ ID NO: 799819 - DNA, 20 bp, Artificial
  CRISPR gRNA sequence
taatcccagctactcgggag

SEQ ID NO: 799820 - DNA, 20 bp, Artificial
  CRISPR gRNA sequence
ctcgggagtctgaggcagga

SEQ ID NO: 799821 - DNA, 20 bp, Artificial
  CRISPR gRNA sequence
gggagtctgaggcaggagaa

SEQ ID NO: 799822 - DNA, 20 bp, Artificial
  CRISPR gRNA sequence
aggcaggagaatcgcttgaa

SEQ ID NO: 799823 - DNA, 20 bp, Artificial
  CRISPR gRNA sequence
gaaccagggagtcggaggtg

SEQ ID NO: 799824 - DNA, 20 bp, Artificial
  CRISPR gRNA sequence
aaccagggagtcggaggtgg

SEQ ID NO: 799825 - DNA, 20 bp, Artificial
  CRISPR gRNA sequence
cactctagcctgggcgacag

SEQ ID NO: 799826 - DNA, 20 bp, Artificial
  CRISPR gRNA sequence
tagcctgggcgacagagtga

SEQ ID NO: 799827 - DNA, 20 bp, Artificial
  CRISPR gRNA sequence
gcctgggcgacagagtgaga

SEQ ID NO: 799828 - DNA, 20 bp, Artificial
  CRISPR gRNA sequence
ggcgacagagtgagactccg

SEQ ID NO: 799829 - DNA, 20 bp, Artificial
  CRISPR gRNA sequence
cgtctcaaaaaaaaaaaaaa

SEQ ID NO: 799830 - DNA, 20 bp, Artificial
  CRISPR gRNA sequence
aaaaaaaaaaaaaaaaagta

SEQ ID NO: 799831 - DNA, 20 bp, Artificial
  CRISPR gRNA sequence
ataagcccgatattcaggac

SEQ ID NO: 799832 - DNA, 20 bp, Artificial
  CRISPR gRNA sequence
aggacgccagttacctctgg

SEQ ID NO: 799833 - DNA, 20 bp, Artificial
  CRISPR gRNA sequence
cctctggtgcaggcagacat

SEQ ID NO: 799834 - DNA, 20 bp, Artificial
  CRISPR gRNA sequence
tggtgcaggcagacatacat

SEQ ID NO: 799835 - DNA, 20 bp, Artificial
  CRISPR gRNA sequence
gtgcaggcagacatacatca

SEQ ID NO: 799836 - DNA, 20 bp, Artificial
  CRISPR gRNA sequence
gtaatgtgctagttcttagg

SEQ ID NO: 799837 - DNA, 20 bp, Artificial
  CRISPR gRNA sequence
gttcttagggtaggtggtag

SEQ ID NO: 799838 - DNA, 20 bp, Artificial
  CRISPR gRNA sequence
ttagggtaggtggtaggttc

SEQ ID NO: 799839 - DNA, 20 bp, Artificial
  CRISPR gRNA sequence
agggtaggtggtaggttcac

SEQ ID NO: 799840 - DNA, 20 bp, Artificial
  CRISPR gRNA sequence
gggtaggtggtaggttcaca

SEQ ID NO: 799841 - DNA, 20 bp, Artificial
  CRISPR gRNA sequence
acagatgttcattttactta

SEQ ID NO: 799842 - DNA, 20 bp, Artificial
  CRISPR gRNA sequence
attttacttaattaaatata

SEQ ID NO: 799843 - DNA, 20 bp, Artificial
  CRISPR gRNA sequence
tacttaattaaatatatttt

SEQ ID NO: 799844 - DNA, 20 bp, Artificial
  CRISPR gRNA sequence
acttaattaaatatattttg

SEQ ID NO: 799845 - DNA, 20 bp, Artificial
  CRISPR gRNA sequence
cttaattaaatatattttga

SEQ ID NO: 799846 - DNA, 20 bp, Artificial
  CRISPR gRNA sequence
aattaaatatattttgaaaa

SEQ ID NO: 799847 - DNA, 20 bp, Artificial
  CRISPR gRNA sequence
attaaatatattttgaaaat

SEQ ID NO: 799848 - DNA, 20 bp, Artificial
  CRISPR gRNA sequence
aatatattttgaaaatttat

SEQ ID NO: 799849 - DNA, 20 bp, Artificial
  CRISPR gRNA sequence
tgaaaatttatttaaagctt

SEQ ID NO: 799850 - DNA, 20 bp, Artificial
  CRISPR gRNA sequence
gaaaatttatttaaagcttt

SEQ ID NO: 799851 - DNA, 20 bp, Artificial
  CRISPR gRNA sequence
aaaatttatttaaagctttc

SEQ ID NO: 799852 - DNA, 20 bp, Artificial
  CRISPR gRNA sequence
atttaaagctttctgttgta

SEQ ID NO: 799853 - DNA, 20 bp, Artificial
  CRISPR gRNA sequence
tttaaagctttctgttgtaa

SEQ ID NO: 799854 - DNA, 20 bp, Artificial
  CRISPR gRNA sequence
aaagctttctgttgtaaaat

SEQ ID NO: 799855 - DNA, 20 bp, Artificial
  CRISPR gRNA sequence
aagctttctgttgtaaaata

SEQ ID NO: 799856 - DNA, 20 bp, Artificial
  CRISPR gRNA sequence
tctgttgtaaaatatatcac

SEQ ID NO: 799857 - DNA, 20 bp, Artificial
  CRISPR gRNA sequence
ctgttgtaaaatatatcaca

SEQ ID NO: 799858 - DNA, 20 bp, Artificial
  CRISPR gRNA sequence
tgttgtaaaatatatcacag

SEQ ID NO: 799859 - DNA, 20 bp, Artificial
  CRISPR gRNA sequence
ttgtaaaatatatcacagag

SEQ ID NO: 799860 - DNA, 20 bp, Artificial
  CRISPR gRNA sequence
taaaatatatcacagagaaa

SEQ ID NO: 799861 - DNA, 20 bp, Artificial
  CRISPR gRNA sequence
taaagcttaacattactata

SEQ ID NO: 799862 - DNA, 20 bp, Artificial
  CRISPR gRNA sequence
aacattactataaggtgatt

SEQ ID NO: 799863 - DNA, 20 bp, Artificial
  CRISPR gRNA sequence
acattactataaggtgatta

SEQ ID NO: 799864 - DNA, 20 bp, Artificial
  CRISPR gRNA sequence
ctataaggtgattacttttg

SEQ ID NO: 799865 - DNA, 20 bp, Artificial
  CRISPR gRNA sequence
taaggtgattacttttgtaa

SEQ ID NO: 799866 - DNA, 20 bp, Artificial
  CRISPR gRNA sequence
cttttgtaaccaccacccag

SEQ ID NO: 799867 - DNA, 20 bp, Artificial
  CRISPR gRNA sequence
ttgtaaccaccacccaggtt

SEQ ID NO: 799868 - DNA, 20 bp, Artificial
  CRISPR gRNA sequence
tgtaaccaccacccaggtta

SEQ ID NO: 799869 - DNA, 20 bp, Artificial
  CRISPR gRNA sequence
gtaaccaccacccaggttaa

SEQ ID NO: 799870 - DNA, 20 bp, Artificial
  CRISPR gRNA sequence
taaccaccacccaggttaag

SEQ ID NO: 799871 - DNA, 20 bp, Artificial
  CRISPR gRNA sequence
agaagaactttgtcagctcc

SEQ ID NO: 799872 - DNA, 20 bp, Artificial
  CRISPR gRNA sequence
tgtcagctccccagaaatgc

SEQ ID NO: 799873 - DNA, 20 bp, Artificial
  CRISPR gRNA sequence
gtcagctccccagaaatgct

SEQ ID NO: 799874 - DNA, 20 bp, Artificial
  CRISPR gRNA sequence
tcagctccccagaaatgctt

SEQ ID NO: 799875 - DNA, 20 bp, Artificial
  CRISPR gRNA sequence
cccagaaatgcttcacatac

SEQ ID NO: 799876 - DNA, 20 bp, Artificial
  CRISPR gRNA sequence
cacataccctagcccaataa

SEQ ID NO: 799877 - DNA, 20 bp, Artificial
  CRISPR gRNA sequence
acataccctagcccaataaa

SEQ ID NO: 799878 - DNA, 20 bp, Artificial
  CRISPR gRNA sequence
gcccaataaaacctcctttg

SEQ ID NO: 799879 - DNA, 20 bp, Artificial
  CRISPR gRNA sequence
ctttgcaaatactcttcata

SEQ ID NO: 799880 - DNA, 20 bp, Artificial
  CRISPR gRNA sequence
tgcaaatactcttcatagca

SEQ ID NO: 799881 - DNA, 20 bp, Artificial
  CRISPR gRNA sequence
gcaaatactcttcatagcac

SEQ ID NO: 799882 - DNA, 20 bp, Artificial
  CRISPR gRNA sequence
caaatactcttcatagcact

SEQ ID NO: 799883 - DNA, 20 bp, Artificial
  CRISPR gRNA sequence
ttcatagcactatctgatat

SEQ ID NO: 799884 - DNA, 20 bp, Artificial
  CRISPR gRNA sequence
catagcactatctgatatgc

SEQ ID NO: 799885 - DNA, 20 bp, Artificial
  CRISPR gRNA sequence
atagcactatctgatatgcc

SEQ ID NO: 799886 - DNA, 20 bp, Artificial
  CRISPR gRNA sequence
tctgatatgccctttatttt

SEQ ID NO: 799887 - DNA, 20 bp, Artificial
  CRISPR gRNA sequence
atatgccctttatttttacc

SEQ ID NO: 799888 - DNA, 20 bp, Artificial
  CRISPR gRNA sequence
tatttttaccttttttaaat

SEQ ID NO: 799889 - DNA, 20 bp, Artificial
  CRISPR gRNA sequence
atttttaccttttttaaatt

SEQ ID NO: 799890 - DNA, 20 bp, Artificial
  CRISPR gRNA sequence
tttttaccttttttaaatta

SEQ ID NO: 799891 - DNA, 20 bp, Artificial
  CRISPR gRNA sequence
ttaccttttttaaattaaaa

SEQ ID NO: 799892 - DNA, 20 bp, Artificial
  CRISPR gRNA sequence
taccttttttaaattaaaac

SEQ ID NO: 799893 - DNA, 20 bp, Artificial
  CRISPR gRNA sequence
accttttttaaattaaaaca

SEQ ID NO: 799894 - DNA, 20 bp, Artificial
  CRISPR gRNA sequence
ccttttttaaattaaaacaa

SEQ ID NO: 799895 - DNA, 20 bp, Artificial
  CRISPR gRNA sequence
ttttaaattaaaacaaaact

SEQ ID NO: 799896 - DNA, 20 bp, Artificial
  CRISPR gRNA sequence
tttaaattaaaacaaaactt

SEQ ID NO: 799897 - DNA, 20 bp, Artificial
  CRISPR gRNA sequence
ttaaattaaaacaaaacttt

SEQ ID NO: 799898 - DNA, 20 bp, Artificial
  CRISPR gRNA sequence
taaattaaaacaaaactttt

SEQ ID NO: 799899 - DNA, 20 bp, Artificial
  CRISPR gRNA sequence
aaattaaaacaaaacttttt

SEQ ID NO: 799900 - DNA, 20 bp, Artificial
  CRISPR gRNA sequence
aattaaaacaaaacttttta

SEQ ID NO: 799901 - DNA, 20 bp, Artificial
  CRISPR gRNA sequence
aaacaaaactttttagagac

SEQ ID NO: 799902 - DNA, 20 bp, Artificial
  CRISPR gRNA sequence
tttagagacagggtcttcct

SEQ ID NO: 799903 - DNA, 20 bp, Artificial
  CRISPR gRNA sequence
ttagagacagggtcttcctc

SEQ ID NO: 799904 - DNA, 20 bp, Artificial
  CRISPR gRNA sequence
tagagacagggtcttcctct

SEQ ID NO: 799905 - DNA, 20 bp, Artificial
  CRISPR gRNA sequence
agagacagggtcttcctctg

SEQ ID NO: 799906 - DNA, 20 bp, Artificial
  CRISPR gRNA sequence
gagacagggtcttcctctgt

SEQ ID NO: 799907 - DNA, 20 bp, Artificial
  CRISPR gRNA sequence
cctctgtcatccatgctgga

SEQ ID NO: 799908 - DNA, 20 bp, Artificial
  CRISPR gRNA sequence
ctctgtcatccatgctggag

SEQ ID NO: 799909 - DNA, 20 bp, Artificial
  CRISPR gRNA sequence
tgtcatccatgctggagtgc

SEQ ID NO: 799910 - DNA, 20 bp, Artificial
  CRISPR gRNA sequence
tcatccatgctggagtgcag

SEQ ID NO: 799911 - DNA, 20 bp, Artificial
  CRISPR gRNA sequence
gagtgcagtggcccaaccac

SEQ ID NO: 799912 - DNA, 20 bp, Artificial
  CRISPR gRNA sequence
actgcagcctccaactccca

SEQ ID NO: 799913 - DNA, 20 bp, Artificial
  CRISPR gRNA sequence
cagcctccaactcccaggct

SEQ ID NO: 799914 - DNA, 20 bp, Artificial
  CRISPR gRNA sequence
caactcccaggctcaagtga

SEQ ID NO: 799915 - DNA, 20 bp, Artificial
  CRISPR gRNA sequence
ccaggctcaagtgagtctcc

SEQ ID NO: 799916 - DNA, 20 bp, Artificial
  CRISPR gRNA sequence
aagtgagtctcctgcctcaa

SEQ ID NO: 799917 - DNA, 20 bp, Artificial
  CRISPR gRNA sequence
ctgcctcaatctcctgagta

SEQ ID NO: 799918 - DNA, 20 bp, Artificial
  CRISPR gRNA sequence
cctcaatctcctgagtagct

SEQ ID NO: 799919 - DNA, 20 bp, Artificial
  CRISPR gRNA sequence
aatctcctgagtagctagga

SEQ ID NO: 799920 - DNA, 20 bp, Artificial
  CRISPR gRNA sequence
ctgagtagctaggactacag

SEQ ID NO: 799921 - DNA, 20 bp, Artificial
  CRISPR gRNA sequence
agtagctaggactacaggca

SEQ ID NO: 799922 - DNA, 20 bp, Artificial
  CRISPR gRNA sequence
ggactacaggcatgtaccac

SEQ ID NO: 799923 - DNA, 20 bp, Artificial
  CRISPR gRNA sequence
caggcatgtaccacccggtc

SEQ ID NO: 799924 - DNA, 20 bp, Artificial
  CRISPR gRNA sequence
gctaattttttaaacatttt

SEQ ID NO: 799925 - DNA, 20 bp, Artificial
  CRISPR gRNA sequence
attttttaaacatttttagt

SEQ ID NO: 799926 - DNA, 20 bp, Artificial
  CRISPR gRNA sequence
tttaaacatttttagtgatg

SEQ ID NO: 799927 - DNA, 20 bp, Artificial
  CRISPR gRNA sequence
ttaaacatttttagtgatgg

SEQ ID NO: 799928 - DNA, 20 bp, Artificial
  CRISPR gRNA sequence
taaacatttttagtgatggg

SEQ ID NO: 799929 - DNA, 20 bp, Artificial
  CRISPR gRNA sequence
aaacatttttagtgatgggg

SEQ ID NO: 799930 - DNA, 20 bp, Artificial
  CRISPR gRNA sequence
aacatttttagtgatggggt

SEQ ID NO: 799931 - DNA, 20 bp, Artificial
  CRISPR gRNA sequence
ttagtgatggggtcttgcta

SEQ ID NO: 799932 - DNA, 20 bp, Artificial
  CRISPR gRNA sequence
tagtgatggggtcttgctat

SEQ ID NO: 799933 - DNA, 20 bp, Artificial
  CRISPR gRNA sequence
agtgatggggtcttgctatg

SEQ ID NO: 799934 - DNA, 20 bp, Artificial
  CRISPR gRNA sequence
gtgatggggtcttgctatgt

SEQ ID NO: 799935 - DNA, 20 bp, Artificial
  CRISPR gRNA sequence
gctatgttacacaggctggc

SEQ ID NO: 799936 - DNA, 20 bp, Artificial
  CRISPR gRNA sequence
ctatgttacacaggctggcc

SEQ ID NO: 799937 - DNA, 20 bp, Artificial
  CRISPR gRNA sequence
tgttacacaggctggcctca

SEQ ID NO: 799938 - DNA, 20 bp, Artificial
  CRISPR gRNA sequence
cacaggctggcctcaaacgc

SEQ ID NO: 799939 - DNA, 20 bp, Artificial
  CRISPR gRNA sequence
gcctcaaacgcctcgtctca

SEQ ID NO: 799940 - DNA, 20 bp, Artificial
  CRISPR gRNA sequence
aaacgcctcgtctcaagcaa

SEQ ID NO: 799941 - DNA, 20 bp, Artificial
  CRISPR gRNA sequence
gtctcaagcaatcctcctgc

SEQ ID NO: 799942 - DNA, 20 bp, Artificial
  CRISPR gRNA sequence
aagcaatcctcctgccccag

SEQ ID NO: 799943 - DNA, 20 bp, Artificial
  CRISPR gRNA sequence
ctgccccagcctcccaaagc

SEQ ID NO: 799944 - DNA, 20 bp, Artificial
  CRISPR gRNA sequence
ccccagcctcccaaagcact

SEQ ID NO: 799945 - DNA, 20 bp, Artificial
  CRISPR gRNA sequence
ccaaagcactgagatcacag

SEQ ID NO: 799946 - DNA, 20 bp, Artificial
  CRISPR gRNA sequence
agatcacaggtgtgagccat

SEQ ID NO: 799947 - DNA, 20 bp, Artificial
  CRISPR gRNA sequence
tcagcctgccctttattttt

SEQ ID NO: 799948 - DNA, 20 bp, Artificial
  CRISPR gRNA sequence
agcctgccctttattttttc

SEQ ID NO: 799949 - DNA, 20 bp, Artificial
  CRISPR gRNA sequence
ccctttattttttcatgaaa

SEQ ID NO: 799950 - DNA, 20 bp, Artificial
  CRISPR gRNA sequence
tattttttcatgaaagaaat

SEQ ID NO: 799951 - DNA, 20 bp, Artificial
  CRISPR gRNA sequence
attttttcatgaaagaaatt

SEQ ID NO: 799952 - DNA, 20 bp, Artificial
  CRISPR gRNA sequence
ttttttcatgaaagaaattg

SEQ ID NO: 799953 - DNA, 20 bp, Artificial
  CRISPR gRNA sequence
tttcatgaaagaaattgctg

SEQ ID NO: 799954 - DNA, 20 bp, Artificial
  CRISPR gRNA sequence
ttcatgaaagaaattgctga

SEQ ID NO: 799955 - DNA, 20 bp, Artificial
  CRISPR gRNA sequence
tcatgaaagaaattgctgaa

SEQ ID NO: 799956 - DNA, 20 bp, Artificial
  CRISPR gRNA sequence
catgaaagaaattgctgaag

SEQ ID NO: 799957 - DNA, 20 bp, Artificial
  CRISPR gRNA sequence
atgaaagaaattgctgaaga

SEQ ID NO: 799958 - DNA, 20 bp, Artificial
  CRISPR gRNA sequence
ctgaagaggactaaaagaag

SEQ ID NO: 799959 - DNA, 20 bp, Artificial
  CRISPR gRNA sequence
aagaggactaaaagaagttt

SEQ ID NO: 799960 - DNA, 20 bp, Artificial
  CRISPR gRNA sequence
aaagaagttttagtaagcat

SEQ ID NO: 799961 - DNA, 20 bp, Artificial
  CRISPR gRNA sequence
tagtaagcattcaataaatg

SEQ ID NO: 799962 - DNA, 20 bp, Artificial
  CRISPR gRNA sequence
agtaagcattcaataaatgt

SEQ ID NO: 799963 - DNA, 20 bp, Artificial
  CRISPR gRNA sequence
gtaagcattcaataaatgta

SEQ ID NO: 799964 - DNA, 20 bp, Artificial
  CRISPR gRNA sequence
aataaatgtatgttctttat

SEQ ID NO: 799965 - DNA, 20 bp, Artificial
  CRISPR gRNA sequence
tttatagtttccaaatcagc

SEQ ID NO: 799966 - DNA, 20 bp, Artificial
  CRISPR gRNA sequence
tatagtttccaaatcagcaa

SEQ ID NO: 799967 - DNA, 20 bp, Artificial
  CRISPR gRNA sequence
atagtttccaaatcagcaaa

SEQ ID NO: 799968 - DNA, 20 bp, Artificial
  CRISPR gRNA sequence
tagtttccaaatcagcaaat

SEQ ID NO: 799969 - DNA, 20 bp, Artificial
  CRISPR gRNA sequence
ccaaatcagcaaatatagac

SEQ ID NO: 799970 - DNA, 20 bp, Artificial
  CRISPR gRNA sequence
caaatcagcaaatatagaca

SEQ ID NO: 799971 - DNA, 20 bp, Artificial
  CRISPR gRNA sequence
catttttaaggagatttata

SEQ ID NO: 799972 - DNA, 20 bp, Artificial
  CRISPR gRNA sequence
ttaaggagatttatatattt

SEQ ID NO: 799973 - DNA, 20 bp, Artificial
  CRISPR gRNA sequence
taaggagatttatatatttt

SEQ ID NO: 799974 - DNA, 20 bp, Artificial
  CRISPR gRNA sequence
aaggagatttatatatttta

SEQ ID NO: 799975 - DNA, 20 bp, Artificial
  CRISPR gRNA sequence
aggagatttatatattttat

SEQ ID NO: 799976 - DNA, 20 bp, Artificial
  CRISPR gRNA sequence
atatattttattggacatgc

SEQ ID NO: 799977 - DNA, 20 bp, Artificial
  CRISPR gRNA sequence
tatattttattggacatgct

SEQ ID NO: 799978 - DNA, 20 bp, Artificial
  CRISPR gRNA sequence
tattggacatgctgtaattt

SEQ ID NO: 799979 - DNA, 20 bp, Artificial
  CRISPR gRNA sequence
attggacatgctgtaattta

SEQ ID NO: 799980 - DNA, 20 bp, Artificial
  CRISPR gRNA sequence
ttggacatgctgtaatttat

SEQ ID NO: 799981 - DNA, 20 bp, Artificial
  CRISPR gRNA sequence
gacatgctgtaatttattta

SEQ ID NO: 799982 - DNA, 20 bp, Artificial
  CRISPR gRNA sequence
taatttatttaaccacttcc

SEQ ID NO: 799983 - DNA, 20 bp, Artificial
  CRISPR gRNA sequence
atttaaccacttccctgttg

SEQ ID NO: 799984 - DNA, 20 bp, Artificial
  CRISPR gRNA sequence
tttaaccacttccctgttgg

SEQ ID NO: 799985 - DNA, 20 bp, Artificial
  CRISPR gRNA sequence
aaccacttccctgttggtag

SEQ ID NO: 799986 - DNA, 20 bp, Artificial
  CRISPR gRNA sequence
accacttccctgttggtaga

SEQ ID NO: 799987 - DNA, 20 bp, Artificial
  CRISPR gRNA sequence
ccctgttggtagacattatt

SEQ ID NO: 799988 - DNA, 20 bp, Artificial
  CRISPR gRNA sequence
cctgttggtagacattattt

SEQ ID NO: 799989 - DNA, 20 bp, Artificial
  CRISPR gRNA sequence
ttggtagacattatttccat

SEQ ID NO: 799990 - DNA, 20 bp, Artificial
  CRISPR gRNA sequence
gtagacattatttccatttt

SEQ ID NO: 799991 - DNA, 20 bp, Artificial
  CRISPR gRNA sequence
tttccattttcttctgctag

SEQ ID NO: 799992 - DNA, 20 bp, Artificial
  CRISPR gRNA sequence
ccattttcttctgctagatt

SEQ ID NO: 799993 - DNA, 20 bp, Artificial
  CRISPR gRNA sequence
cattttcttctgctagatta

SEQ ID NO: 799994 - DNA, 20 bp, Artificial
  CRISPR gRNA sequence
tcttctgctagattaatgct

SEQ ID NO: 799995 - DNA, 20 bp, Artificial
  CRISPR gRNA sequence
cttctgctagattaatgctt

SEQ ID NO: 799996 - DNA, 20 bp, Artificial
  CRISPR gRNA sequence
ttctgctagattaatgcttg

SEQ ID NO: 799997 - DNA, 20 bp, Artificial
  CRISPR gRNA sequence
ctgctagattaatgcttgaa

SEQ ID NO: 799998 - DNA, 20 bp, Artificial
  CRISPR gRNA sequence
tgctagattaatgcttgaaa

SEQ ID NO: 799999 - DNA, 20 bp, Artificial
  CRISPR gRNA sequence
ctagattaatgcttgaaaaa

SEQ ID NO: 800000 - DNA, 20 bp, Artificial
  CRISPR gRNA sequence
gattaatgcttgaaaaaaat

SEQ ID NO: 800001 - DNA, 20 bp, Artificial
  CRISPR gRNA sequence
atgcttgaaaaaaatgtgtg

SEQ ID NO: 800002 - DNA, 20 bp, Artificial
  CRISPR gRNA sequence
gaaaaaaatgtgtgcctcct

SEQ ID NO: 800003 - DNA, 20 bp, Artificial
  CRISPR gRNA sequence
aaaaaaatgtgtgcctccta

SEQ ID NO: 800004 - DNA, 20 bp, Artificial
  CRISPR gRNA sequence
ctaaagactgtgatgaaagt

SEQ ID NO: 800005 - DNA, 20 bp, Artificial
  CRISPR gRNA sequence
aagactgtgatgaaagttgc

SEQ ID NO: 800006 - DNA, 20 bp, Artificial
  CRISPR gRNA sequence
tgatgaaagttgcctctgaa

SEQ ID NO: 800007 - DNA, 20 bp, Artificial
  CRISPR gRNA sequence
cctctgaataaaactcaaac

SEQ ID NO: 800008 - DNA, 20 bp, Artificial
  CRISPR gRNA sequence
tgaataaaactcaaacaaat

SEQ ID NO: 800009 - DNA, 20 bp, Artificial
  CRISPR gRNA sequence
aataaaactcaaacaaatca

SEQ ID NO: 800010 - DNA, 20 bp, Artificial
  CRISPR gRNA sequence
aaacaaatcattaatcatta

SEQ ID NO: 800011 - DNA, 20 bp, Artificial
  CRISPR gRNA sequence
atcattaactctttccttac

SEQ ID NO: 800012 - DNA, 20 bp, Artificial
  CRISPR gRNA sequence
actctttccttacttgtatg

SEQ ID NO: 800013 - DNA, 20 bp, Artificial
  CRISPR gRNA sequence
tttccttacttgtatgctct

SEQ ID NO: 800014 - DNA, 20 bp, Artificial
  CRISPR gRNA sequence
tccttacttgtatgctcttt

SEQ ID NO: 800015 - DNA, 20 bp, Artificial
  CRISPR gRNA sequence
ccttacttgtatgctctttg

SEQ ID NO: 800016 - DNA, 20 bp, Artificial
  CRISPR gRNA sequence
cttacttgtatgctctttgg

SEQ ID NO: 800017 - DNA, 20 bp, Artificial
  CRISPR gRNA sequence
acttgtatgctctttggatg

SEQ ID NO: 800018 - DNA, 20 bp, Artificial
  CRISPR gRNA sequence
cttgtatgctctttggatgc

SEQ ID NO: 800019 - DNA, 20 bp, Artificial
  CRISPR gRNA sequence
gtatgctctttggatgctct

SEQ ID NO: 800020 - DNA, 20 bp, Artificial
  CRISPR gRNA sequence
tatgctctttggatgctcta

SEQ ID NO: 800021 - DNA, 20 bp, Artificial
  CRISPR gRNA sequence
tttggatgctctactgtgtt

SEQ ID NO: 800022 - DNA, 20 bp, Artificial
  CRISPR gRNA sequence
tggatgctctactgtgttat

SEQ ID NO: 800023 - DNA, 20 bp, Artificial
  CRISPR gRNA sequence
ggatgctctactgtgttatc

SEQ ID NO: 800024 - DNA, 20 bp, Artificial
  CRISPR gRNA sequence
gatgctctactgtgttatct

SEQ ID NO: 800025 - DNA, 20 bp, Artificial
  CRISPR gRNA sequence
tactgtgttatctataaaat

SEQ ID NO: 800026 - DNA, 20 bp, Artificial
  CRISPR gRNA sequence
ctgtgttatctataaaataa

SEQ ID NO: 800027 - DNA, 20 bp, Artificial
  CRISPR gRNA sequence
tgttatctataaaataaagt

SEQ ID NO: 800028 - DNA, 20 bp, Artificial
  CRISPR gRNA sequence
tctataaaataaagtttgaa

SEQ ID NO: 800029 - DNA, 20 bp, Artificial
  CRISPR gRNA sequence
taaaataaagtttgaagtga

SEQ ID NO: 800030 - DNA, 20 bp, Artificial
  CRISPR gRNA sequence
gaagtgaaaaattagggtaa

SEQ ID NO: 800031 - DNA, 20 bp, Artificial
  CRISPR gRNA sequence
aagtgaaaaattagggtaaa

SEQ ID NO: 800032 - DNA, 20 bp, Artificial
  CRISPR gRNA sequence
gggtaaaacattttatatca

SEQ ID NO: 800033 - DNA, 20 bp, Artificial
  CRISPR gRNA sequence
tatatcatttttaaaggata

SEQ ID NO: 800034 - DNA, 20 bp, Artificial
  CRISPR gRNA sequence
atatcatttttaaaggatat

SEQ ID NO: 800035 - DNA, 20 bp, Artificial
  CRISPR gRNA sequence
tatcatttttaaaggatata

SEQ ID NO: 800036 - DNA, 20 bp, Artificial
  CRISPR gRNA sequence
ttaaaggatatatacatgga

SEQ ID NO: 800037 - DNA, 20 bp, Artificial
  CRISPR gRNA sequence
taaaggatatatacatggat

SEQ ID NO: 800038 - DNA, 20 bp, Artificial
  CRISPR gRNA sequence
aaaggatatatacatggatg

SEQ ID NO: 800039 - DNA, 20 bp, Artificial
  CRISPR gRNA sequence
aaggatatatacatggatgt

SEQ ID NO: 800040 - DNA, 20 bp, Artificial
  CRISPR gRNA sequence
acatatgcatgtttaaattt

SEQ ID NO: 800041 - DNA, 20 bp, Artificial
  CRISPR gRNA sequence
catatgcatgtttaaattta

SEQ ID NO: 800042 - DNA, 20 bp, Artificial
  CRISPR gRNA sequence
aaatttatataccataacat

SEQ ID NO: 800043 - DNA, 20 bp, Artificial
  CRISPR gRNA sequence
aatttatataccataacatt

SEQ ID NO: 800044 - DNA, 20 bp, Artificial
  CRISPR gRNA sequence
atataccataacatttattc

SEQ ID NO: 800045 - DNA, 20 bp, Artificial
  CRISPR gRNA sequence
tataccataacatttattct

SEQ ID NO: 800046 - DNA, 20 bp, Artificial
  CRISPR gRNA sequence
attctttttttaaaaaagtc

SEQ ID NO: 800047 - DNA, 20 bp, Artificial
  CRISPR gRNA sequence
ttctttttttaaaaaagtct

SEQ ID NO: 800048 - DNA, 20 bp, Artificial
  CRISPR gRNA sequence
tttttttaaaaaagtcttat

SEQ ID NO: 800049 - DNA, 20 bp, Artificial
  CRISPR gRNA sequence
tttttaaaaaagtcttatga

SEQ ID NO: 800050 - DNA, 20 bp, Artificial
  CRISPR gRNA sequence
ttttaaaaaagtcttatgaa

SEQ ID NO: 800051 - DNA, 20 bp, Artificial
  CRISPR gRNA sequence
tttaaaaaagtcttatgaat

SEQ ID NO: 800052 - DNA, 20 bp, Artificial
  CRISPR gRNA sequence
ttaaaaaagtcttatgaatt

SEQ ID NO: 800053 - DNA, 20 bp, Artificial
  CRISPR gRNA sequence
taaaaaagtcttatgaattt

SEQ ID NO: 800054 - DNA, 20 bp, Artificial
  CRISPR gRNA sequence
aaaaaagtcttatgaatttt

SEQ ID NO: 800055 - DNA, 20 bp, Artificial
  CRISPR gRNA sequence
aaaaagtcttatgaatttta

SEQ ID NO: 800056 - DNA, 20 bp, Artificial
  CRISPR gRNA sequence
atgaattttaacaaatgcat

SEQ ID NO: 800057 - DNA, 20 bp, Artificial
  CRISPR gRNA sequence
tgaattttaacaaatgcata

SEQ ID NO: 800058 - DNA, 20 bp, Artificial
  CRISPR gRNA sequence
taacaaatgcatagtcctat

SEQ ID NO: 800059 - DNA, 20 bp, Artificial
  CRISPR gRNA sequence
aacaaatgcatagtcctata

SEQ ID NO: 800060 - DNA, 20 bp, Artificial
  CRISPR gRNA sequence
acaaatgcatagtcctataa

SEQ ID NO: 800061 - DNA, 20 bp, Artificial
  CRISPR gRNA sequence
taactaccaccaccacagtg

SEQ ID NO: 800062 - DNA, 20 bp, Artificial
  CRISPR gRNA sequence
ccaccaccacagtgaacatc

SEQ ID NO: 800063 - DNA, 20 bp, Artificial
  CRISPR gRNA sequence
catcccttgccaaacaaaca

SEQ ID NO: 800064 - DNA, 20 bp, Artificial
  CRISPR gRNA sequence
gccaaacaaacaaacaaaca

SEQ ID NO: 800065 - DNA, 20 bp, Artificial
  CRISPR gRNA sequence
ccaaacaaacaaacaaacaa

SEQ ID NO: 800066 - DNA, 20 bp, Artificial
  CRISPR gRNA sequence
cacccaagtcttaagtccag

SEQ ID NO: 800067 - DNA, 20 bp, Artificial
  CRISPR gRNA sequence
acccaagtcttaagtccagg

SEQ ID NO: 800068 - DNA, 20 bp, Artificial
  CRISPR gRNA sequence
aagtccaggcacttactgat

SEQ ID NO: 800069 - DNA, 20 bp, Artificial
  CRISPR gRNA sequence
agtccaggcacttactgatc

SEQ ID NO: 800070 - DNA, 20 bp, Artificial
  CRISPR gRNA sequence
actgatctattttctgtcct

SEQ ID NO: 800071 - DNA, 20 bp, Artificial
  CRISPR gRNA sequence
ctgatctattttctgtcctt

SEQ ID NO: 800072 - DNA, 20 bp, Artificial
  CRISPR gRNA sequence
atctattttctgtccttata

SEQ ID NO: 800073 - DNA, 20 bp, Artificial
  CRISPR gRNA sequence
ttttctgtccttatagtaat

SEQ ID NO: 800074 - DNA, 20 bp, Artificial
  CRISPR gRNA sequence
tctgtccttatagtaatgac

SEQ ID NO: 800075 - DNA, 20 bp, Artificial
  CRISPR gRNA sequence
ctgtccttatagtaatgact

SEQ ID NO: 800076 - DNA, 20 bp, Artificial
  CRISPR gRNA sequence
tgtccttatagtaatgactt

SEQ ID NO: 800077 - DNA, 20 bp, Artificial
  CRISPR gRNA sequence
tccttatagtaatgactttt

SEQ ID NO: 800078 - DNA, 20 bp, Artificial
  CRISPR gRNA sequence
atagtaatgacttttccaga

SEQ ID NO: 800079 - DNA, 20 bp, Artificial
  CRISPR gRNA sequence
tagtaatgacttttccagaa

SEQ ID NO: 800080 - DNA, 20 bp, Artificial
  CRISPR gRNA sequence
ttccagaatgtcatataaat

SEQ ID NO: 800081 - DNA, 20 bp, Artificial
  CRISPR gRNA sequence
tccagaatgtcatataaatg

SEQ ID NO: 800082 - DNA, 20 bp, Artificial
  CRISPR gRNA sequence
ccagaatgtcatataaatgg

SEQ ID NO: 800083 - DNA, 20 bp, Artificial
  CRISPR gRNA sequence
cagaatgtcatataaatggg

SEQ ID NO: 800084 - DNA, 20 bp, Artificial
  CRISPR gRNA sequence
attagatatccttttgtatc

SEQ ID NO: 800085 - DNA, 20 bp, Artificial
  CRISPR gRNA sequence
gatatccttttgtatctggc

SEQ ID NO: 800086 - DNA, 20 bp, Artificial
  CRISPR gRNA sequence
ttgtatctggcttctttcac

SEQ ID NO: 800087 - DNA, 20 bp, Artificial
  CRISPR gRNA sequence
tgtatctggcttctttcact

SEQ ID NO: 800088 - DNA, 20 bp, Artificial
  CRISPR gRNA sequence
gtatctggcttctttcactt

SEQ ID NO: 800089 - DNA, 20 bp, Artificial
  CRISPR gRNA sequence
tatctggcttctttcactta

SEQ ID NO: 800090 - DNA, 20 bp, Artificial
  CRISPR gRNA sequence
gcttctttcacttaacataa

SEQ ID NO: 800091 - DNA, 20 bp, Artificial
  CRISPR gRNA sequence
ctttcacttaacataaagca

SEQ ID NO: 800092 - DNA, 20 bp, Artificial
  CRISPR gRNA sequence
tttcacttaacataaagcat

SEQ ID NO: 800093 - DNA, 20 bp, Artificial
  CRISPR gRNA sequence
tcacttaacataaagcattt

SEQ ID NO: 800094 - DNA, 20 bp, Artificial
  CRISPR gRNA sequence
cacttaacataaagcatttg

SEQ ID NO: 800095 - DNA, 20 bp, Artificial
  CRISPR gRNA sequence
acttaacataaagcatttga

SEQ ID NO: 800096 - DNA, 20 bp, Artificial
  CRISPR gRNA sequence
aacataaagcatttgaaatt

SEQ ID NO: 800097 - DNA, 20 bp, Artificial
  CRISPR gRNA sequence
acataaagcatttgaaattc

SEQ ID NO: 800098 - DNA, 20 bp, Artificial
  CRISPR gRNA sequence
gaaattcattcatattgttg

SEQ ID NO: 800099 - DNA, 20 bp, Artificial
  CRISPR gRNA sequence
aaattcattcatattgttgt

SEQ ID NO: 800100 - DNA, 20 bp, Artificial
  CRISPR gRNA sequence
attcatattgttgtgtgaat

SEQ ID NO: 800101 - DNA, 20 bp, Artificial
  CRISPR gRNA sequence
atattgttgtgtgaatcaat

SEQ ID NO: 800102 - DNA, 20 bp, Artificial
  CRISPR gRNA sequence
ttgtgtgaatcaataattta

SEQ ID NO: 800103 - DNA, 20 bp, Artificial
  CRISPR gRNA sequence
tgtgaatcaataatttatac

SEQ ID NO: 800104 - DNA, 20 bp, Artificial
  CRISPR gRNA sequence
atacctgtttgctgttgagt

SEQ ID NO: 800105 - DNA, 20 bp, Artificial
  CRISPR gRNA sequence
tacctgtttgctgttgagta

SEQ ID NO: 800106 - DNA, 20 bp, Artificial
  CRISPR gRNA sequence
tttgctgttgagtatattct

SEQ ID NO: 800107 - DNA, 20 bp, Artificial
  CRISPR gRNA sequence
gctgttgagtatattctagt

SEQ ID NO: 800108 - DNA, 20 bp, Artificial
  CRISPR gRNA sequence
ctgttgagtatattctagtg

SEQ ID NO: 800109 - DNA, 20 bp, Artificial
  CRISPR gRNA sequence
ttgagtatattctagtgtat

SEQ ID NO: 800110 - DNA, 20 bp, Artificial
  CRISPR gRNA sequence
agtatattctagtgtatgta

SEQ ID NO: 800111 - DNA, 20 bp, Artificial
  CRISPR gRNA sequence
tagtgtatgtatactatatt

SEQ ID NO: 800112 - DNA, 20 bp, Artificial
  CRISPR gRNA sequence
gtgtatgtatactatatttt

SEQ ID NO: 800113 - DNA, 20 bp, Artificial
  CRISPR gRNA sequence
tattttgtttataaattccc

SEQ ID NO: 800114 - DNA, 20 bp, Artificial
  CRISPR gRNA sequence
tgtttataaattccccaatt

SEQ ID NO: 800115 - DNA, 20 bp, Artificial
  CRISPR gRNA sequence
gtttataaattccccaattg

SEQ ID NO: 800116 - DNA, 20 bp, Artificial
  CRISPR gRNA sequence
tttataaattccccaattgg

SEQ ID NO: 800117 - DNA, 20 bp, Artificial
  CRISPR gRNA sequence
ataaattccccaattggggc

SEQ ID NO: 800118 - DNA, 20 bp, Artificial
  CRISPR gRNA sequence
taaattccccaattggggca

SEQ ID NO: 800119 - DNA, 20 bp, Artificial
  CRISPR gRNA sequence
cccaattggggcacatttgg

SEQ ID NO: 800120 - DNA, 20 bp, Artificial
  CRISPR gRNA sequence
gggcacatttgggtatttcc

SEQ ID NO: 800121 - DNA, 20 bp, Artificial
  CRISPR gRNA sequence
gggtatttcccattttgggt

SEQ ID NO: 800122 - DNA, 20 bp, Artificial
  CRISPR gRNA sequence
ggtatttcccattttgggtg

SEQ ID NO: 800123 - DNA, 20 bp, Artificial
  CRISPR gRNA sequence
cccattttgggtgattacaa

SEQ ID NO: 800124 - DNA, 20 bp, Artificial
  CRISPR gRNA sequence
ccattttgggtgattacaaa

SEQ ID NO: 800125 - DNA, 20 bp, Artificial
  CRISPR gRNA sequence
tgggtgattacaaataaagt

SEQ ID NO: 800126 - DNA, 20 bp, Artificial
  CRISPR gRNA sequence
gggtgattacaaataaagtt

SEQ ID NO: 800127 - DNA, 20 bp, Artificial
  CRISPR gRNA sequence
ggtgattacaaataaagtta

SEQ ID NO: 800128 - DNA, 20 bp, Artificial
  CRISPR gRNA sequence
caaataaagttattataaat

SEQ ID NO: 800129 - DNA, 20 bp, Artificial
  CRISPR gRNA sequence
ttataaatatttgcatatag

SEQ ID NO: 800130 - DNA, 20 bp, Artificial
  CRISPR gRNA sequence
taaatatttgcatataggtt

SEQ ID NO: 800131 - DNA, 20 bp, Artificial
  CRISPR gRNA sequence
gcatataggtttttttgggc

SEQ ID NO: 800132 - DNA, 20 bp, Artificial
  CRISPR gRNA sequence
catataggtttttttgggca

SEQ ID NO: 800133 - DNA, 20 bp, Artificial
  CRISPR gRNA sequence
ttttgggcaaacctaggttt

SEQ ID NO: 800134 - DNA, 20 bp, Artificial
  CRISPR gRNA sequence
tttgggcaaacctaggtttt

SEQ ID NO: 800135 - DNA, 20 bp, Artificial
  CRISPR gRNA sequence
ttgggcaaacctaggttttc

SEQ ID NO: 800136 - DNA, 20 bp, Artificial
  CRISPR gRNA sequence
tgggcaaacctaggttttca

SEQ ID NO: 800137 - DNA, 20 bp, Artificial
  CRISPR gRNA sequence
gggcaaacctaggttttcat

SEQ ID NO: 800138 - DNA, 20 bp, Artificial
  CRISPR gRNA sequence
ggcaaacctaggttttcatt

SEQ ID NO: 800139 - DNA, 20 bp, Artificial
  CRISPR gRNA sequence
ggttttcatttcacttggat

SEQ ID NO: 800140 - DNA, 20 bp, Artificial
  CRISPR gRNA sequence
tcatttcacttggataaata

SEQ ID NO: 800141 - DNA, 20 bp, Artificial
  CRISPR gRNA sequence
catttcacttggataaatac

SEQ ID NO: 800142 - DNA, 20 bp, Artificial
  CRISPR gRNA sequence
atttcacttggataaatacc

SEQ ID NO: 800143 - DNA, 20 bp, Artificial
  CRISPR gRNA sequence
cacttggataaatacctaga

SEQ ID NO: 800144 - DNA, 20 bp, Artificial
  CRISPR gRNA sequence
acttggataaatacctagaa

SEQ ID NO: 800145 - DNA, 20 bp, Artificial
  CRISPR gRNA sequence
ggataaatacctagaagtgg

SEQ ID NO: 800146 - DNA, 20 bp, Artificial
  CRISPR gRNA sequence
gataaatacctagaagtggg

SEQ ID NO: 800147 - DNA, 20 bp, Artificial
  CRISPR gRNA sequence
gaagtgggattgctaggtca

SEQ ID NO: 800148 - DNA, 20 bp, Artificial
  CRISPR gRNA sequence
ctaggtcacatggtaagtgt

SEQ ID NO: 800149 - DNA, 20 bp, Artificial
  CRISPR gRNA sequence
ggtcacatggtaagtgtatg

SEQ ID NO: 800150 - DNA, 20 bp, Artificial
  CRISPR gRNA sequence
attgtgagaaactgccaaac

SEQ ID NO: 800151 - DNA, 20 bp, Artificial
  CRISPR gRNA sequence
ttgtgagaaactgccaaacc

SEQ ID NO: 800152 - DNA, 20 bp, Artificial
  CRISPR gRNA sequence
tgagaaactgccaaaccttt

SEQ ID NO: 800153 - DNA, 20 bp, Artificial
  CRISPR gRNA sequence
ccaaacctttccatagtggc

SEQ ID NO: 800154 - DNA, 20 bp, Artificial
  CRISPR gRNA sequence
tccatagtggctgtaccatt

SEQ ID NO: 800155 - DNA, 20 bp, Artificial
  CRISPR gRNA sequence
ccatagtggctgtaccattt

SEQ ID NO: 800156 - DNA, 20 bp, Artificial
  CRISPR gRNA sequence
catagtggctgtaccatttt

SEQ ID NO: 800157 - DNA, 20 bp, Artificial
  CRISPR gRNA sequence
taccattttttcattcccac

SEQ ID NO: 800158 - DNA, 20 bp, Artificial
  CRISPR gRNA sequence
tttcattcccaccagcaagt

SEQ ID NO: 800159 - DNA, 20 bp, Artificial
  CRISPR gRNA sequence
ttcattcccaccagcaagta

SEQ ID NO: 800160 - DNA, 20 bp, Artificial
  CRISPR gRNA sequence
tcattcccaccagcaagtat

SEQ ID NO: 800161 - DNA, 20 bp, Artificial
  CRISPR gRNA sequence
cattcccaccagcaagtata

SEQ ID NO: 800162 - DNA, 20 bp, Artificial
  CRISPR gRNA sequence
attcccaccagcaagtatat

SEQ ID NO: 800163 - DNA, 20 bp, Artificial
  CRISPR gRNA sequence
ccaccagcaagtatatgaga

SEQ ID NO: 800164 - DNA, 20 bp, Artificial
  CRISPR gRNA sequence
taattgttcctcatccttcc

SEQ ID NO: 800165 - DNA, 20 bp, Artificial
  CRISPR gRNA sequence
attgttcctcatccttccca

SEQ ID NO: 800166 - DNA, 20 bp, Artificial
  CRISPR gRNA sequence
ttcctcatccttcccagcac

SEQ ID NO: 800167 - DNA, 20 bp, Artificial
  CRISPR gRNA sequence
ctcatccttcccagcactgg

SEQ ID NO: 800168 - DNA, 20 bp, Artificial
  CRISPR gRNA sequence
atccttcccagcactggtat

SEQ ID NO: 800169 - DNA, 20 bp, Artificial
  CRISPR gRNA sequence
cccagcactggtattctttt

SEQ ID NO: 800170 - DNA, 20 bp, Artificial
  CRISPR gRNA sequence
ccagcactggtattcttttc

SEQ ID NO: 800171 - DNA, 20 bp, Artificial
  CRISPR gRNA sequence
gtattcttttctattttttc

SEQ ID NO: 800172 - DNA, 20 bp, Artificial
  CRISPR gRNA sequence
ttttctattttttctttttt

SEQ ID NO: 800173 - DNA, 20 bp, Artificial
  CRISPR gRNA sequence
ttctattttttctttttttt

SEQ ID NO: 800174 - DNA, 20 bp, Artificial
  CRISPR gRNA sequence
tctattttttcttttttttt

SEQ ID NO: 800175 - DNA, 20 bp, Artificial
  CRISPR gRNA sequence
ctattttttctttttttttg

SEQ ID NO: 800176 - DNA, 20 bp, Artificial
  CRISPR gRNA sequence
tattttttctttttttttga

SEQ ID NO: 800177 - DNA, 20 bp, Artificial
  CRISPR gRNA sequence
ttttttctttttttttgaga

SEQ ID NO: 800178 - DNA, 20 bp, Artificial
  CRISPR gRNA sequence
tttctttttttttgagacag

SEQ ID NO: 800179 - DNA, 20 bp, Artificial
  CRISPR gRNA sequence
ttctttttttttgagacaga

SEQ ID NO: 800180 - DNA, 20 bp, Artificial
  CRISPR gRNA sequence
tctttttttttgagacagag

SEQ ID NO: 800181 - DNA, 20 bp, Artificial
  CRISPR gRNA sequence
ctttttttttgagacagagt

SEQ ID NO: 800182 - DNA, 20 bp, Artificial
  CRISPR gRNA sequence
tttttttttgagacagagtt

SEQ ID NO: 800183 - DNA, 20 bp, Artificial
  CRISPR gRNA sequence
tttttttgagacagagtttc

SEQ ID NO: 800184 - DNA, 20 bp, Artificial
  CRISPR gRNA sequence
ttttttgagacagagtttcg

SEQ ID NO: 800185 - DNA, 20 bp, Artificial
  CRISPR gRNA sequence
tttttgagacagagtttcgc

SEQ ID NO: 800186 - DNA, 20 bp, Artificial
  CRISPR gRNA sequence
ttttgagacagagtttcgct

SEQ ID NO: 800187 - DNA, 20 bp, Artificial
  CRISPR gRNA sequence
tttgagacagagtttcgctc

SEQ ID NO: 800188 - DNA, 20 bp, Artificial
  CRISPR gRNA sequence
ttgagacagagtttcgctct

SEQ ID NO: 800189 - DNA, 20 bp, Artificial
  CRISPR gRNA sequence
tgagacagagtttcgctctg

SEQ ID NO: 800190 - DNA, 20 bp, Artificial
  CRISPR gRNA sequence
gagacagagtttcgctctgt

SEQ ID NO: 800191 - DNA, 20 bp, Artificial
  CRISPR gRNA sequence
agacagagtttcgctctgtc

SEQ ID NO: 800192 - DNA, 20 bp, Artificial
  CRISPR gRNA sequence
cgctctgtcacccaggctaa

SEQ ID NO: 800193 - DNA, 20 bp, Artificial
  CRISPR gRNA sequence
gctctgtcacccaggctaaa

SEQ ID NO: 800194 - DNA, 20 bp, Artificial
  CRISPR gRNA sequence
tgtcacccaggctaaagtgc

SEQ ID NO: 800195 - DNA, 20 bp, Artificial
  CRISPR gRNA sequence
tcacccaggctaaagtgcaa

SEQ ID NO: 800196 - DNA, 20 bp, Artificial
  CRISPR gRNA sequence
aagtgcaatgccgtgatctt

SEQ ID NO: 800197 - DNA, 20 bp, Artificial
  CRISPR gRNA sequence
ggcttactgcaacctccgcc

SEQ ID NO: 800198 - DNA, 20 bp, Artificial
  CRISPR gRNA sequence
gcttactgcaacctccgcct

SEQ ID NO: 800199 - DNA, 20 bp, Artificial
  CRISPR gRNA sequence
actgcaacctccgcctcccg

SEQ ID NO: 800200 - DNA, 20 bp, Artificial
  CRISPR gRNA sequence
ctgcaacctccgcctcccgg

SEQ ID NO: 800201 - DNA, 20 bp, Artificial
  CRISPR gRNA sequence
caacctccgcctcccgggtt

SEQ ID NO: 800202 - DNA, 20 bp, Artificial
  CRISPR gRNA sequence
cgcctcccgggttcaggcta

SEQ ID NO: 800203 - DNA, 20 bp, Artificial
  CRISPR gRNA sequence
ccgggttcaggctattctcc

SEQ ID NO: 800204 - DNA, 20 bp, Artificial
  CRISPR gRNA sequence
aggctattctcctgcctcag

SEQ ID NO: 800205 - DNA, 20 bp, Artificial
  CRISPR gRNA sequence
ttctcctgcctcagcctccc

SEQ ID NO: 800206 - DNA, 20 bp, Artificial
  CRISPR gRNA sequence
tcctgcctcagcctcccaag

SEQ ID NO: 800207 - DNA, 20 bp, Artificial
  CRISPR gRNA sequence
ctgcctcagcctcccaagta

SEQ ID NO: 800208 - DNA, 20 bp, Artificial
  CRISPR gRNA sequence
cctcagcctcccaagtagct

SEQ ID NO: 800209 - DNA, 20 bp, Artificial
  CRISPR gRNA sequence
agcctcccaagtagctggga

SEQ ID NO: 800210 - DNA, 20 bp, Artificial
  CRISPR gRNA sequence
ccaagtagctgggattacag

SEQ ID NO: 800211 - DNA, 20 bp, Artificial
  CRISPR gRNA sequence
ggattacaggcacccaccac

SEQ ID NO: 800212 - DNA, 20 bp, Artificial
  CRISPR gRNA sequence
caggcacccaccaccatgcc

SEQ ID NO: 800213 - DNA, 20 bp, Artificial
  CRISPR gRNA sequence
cttttgttttgtatttttaa

SEQ ID NO: 800214 - DNA, 20 bp, Artificial
  CRISPR gRNA sequence
ttttgttttgtatttttaat

SEQ ID NO: 800215 - DNA, 20 bp, Artificial
  CRISPR gRNA sequence
ttgttttgtatttttaatag

SEQ ID NO: 800216 - DNA, 20 bp, Artificial
  CRISPR gRNA sequence
tgttttgtatttttaataga

SEQ ID NO: 800217 - DNA, 20 bp, Artificial
  CRISPR gRNA sequence
gttttgtatttttaatagag

SEQ ID NO: 800218 - DNA, 20 bp, Artificial
  CRISPR gRNA sequence
ttttgtatttttaatagaga

SEQ ID NO: 800219 - DNA, 20 bp, Artificial
  CRISPR gRNA sequence
tgtatttttaatagagacgg

SEQ ID NO: 800220 - DNA, 20 bp, Artificial
  CRISPR gRNA sequence
gtatttttaatagagacggg

SEQ ID NO: 800221 - DNA, 20 bp, Artificial
  CRISPR gRNA sequence
tatttttaatagagacgggg

SEQ ID NO: 800222 - DNA, 20 bp, Artificial
  CRISPR gRNA sequence
ttaatagagacggggttttg

SEQ ID NO: 800223 - DNA, 20 bp, Artificial
  CRISPR gRNA sequence
taatagagacggggttttgc

SEQ ID NO: 800224 - DNA, 20 bp, Artificial
  CRISPR gRNA sequence
aatagagacggggttttgcc

SEQ ID NO: 800225 - DNA, 20 bp, Artificial
  CRISPR gRNA sequence
atagagacggggttttgcca

SEQ ID NO: 800226 - DNA, 20 bp, Artificial
  CRISPR gRNA sequence
tgccatattgaccaggctgg

SEQ ID NO: 800227 - DNA, 20 bp, Artificial
  CRISPR gRNA sequence
gccatattgaccaggctggt

SEQ ID NO: 800228 - DNA, 20 bp, Artificial
  CRISPR gRNA sequence
ccatattgaccaggctggtc

SEQ ID NO: 800229 - DNA, 20 bp, Artificial
  CRISPR gRNA sequence
accaggctggtcttgaactc

SEQ ID NO: 800230 - DNA, 20 bp, Artificial
  CRISPR gRNA sequence
gtcttgaactcctgacctca

SEQ ID NO: 800231 - DNA, 20 bp, Artificial
  CRISPR gRNA sequence
gaactcctgacctcaggtga

SEQ ID NO: 800232 - DNA, 20 bp, Artificial
  CRISPR gRNA sequence
aactcctgacctcaggtgat

SEQ ID NO: 800233 - DNA, 20 bp, Artificial
  CRISPR gRNA sequence
ctgacctcaggtgatccacc

SEQ ID NO: 800234 - DNA, 20 bp, Artificial
  CRISPR gRNA sequence
acctcaggtgatccacccac

SEQ ID NO: 800235 - DNA, 20 bp, Artificial
  CRISPR gRNA sequence
aggtgatccacccaccttgg

SEQ ID NO: 800236 - DNA, 20 bp, Artificial
  CRISPR gRNA sequence
ggcctcccaaaatgctggga

SEQ ID NO: 800237 - DNA, 20 bp, Artificial
  CRISPR gRNA sequence
gcctcccaaaatgctgggat

SEQ ID NO: 800238 - DNA, 20 bp, Artificial
  CRISPR gRNA sequence
ccaaaatgctgggattacag

SEQ ID NO: 800239 - DNA, 20 bp, Artificial
  CRISPR gRNA sequence
ggattacaggcatgagccac

SEQ ID NO: 800240 - DNA, 20 bp, Artificial
  CRISPR gRNA sequence
caggcatgagccaccacgcc

SEQ ID NO: 800241 - DNA, 20 bp, Artificial
  CRISPR gRNA sequence
ctcttttcttaagtcattct

SEQ ID NO: 800242 - DNA, 20 bp, Artificial
  CRISPR gRNA sequence
ttttcttaagtcattctaat

SEQ ID NO: 800243 - DNA, 20 bp, Artificial
  CRISPR gRNA sequence
ttcttaagtcattctaatag

SEQ ID NO: 800244 - DNA, 20 bp, Artificial
  CRISPR gRNA sequence
tcttaagtcattctaatagg

SEQ ID NO: 800245 - DNA, 20 bp, Artificial
  CRISPR gRNA sequence
cttaagtcattctaataggt

SEQ ID NO: 800246 - DNA, 20 bp, Artificial
  CRISPR gRNA sequence
ttaagtcattctaataggtg

SEQ ID NO: 800247 - DNA, 20 bp, Artificial
  CRISPR gRNA sequence
aagtcattctaataggtgtg

SEQ ID NO: 800248 - DNA, 20 bp, Artificial
  CRISPR gRNA sequence
agtcattctaataggtgtgt

SEQ ID NO: 800249 - DNA, 20 bp, Artificial
  CRISPR gRNA sequence
taataggtgtgtagaagtgg

SEQ ID NO: 800250 - DNA, 20 bp, Artificial
  CRISPR gRNA sequence
ataggtgtgtagaagtggtt

SEQ ID NO: 800251 - DNA, 20 bp, Artificial
  CRISPR gRNA sequence
taacttgcattttcctaatg

SEQ ID NO: 800252 - DNA, 20 bp, Artificial
  CRISPR gRNA sequence
acttgcattttcctaatgac

SEQ ID NO: 800253 - DNA, 20 bp, Artificial
  CRISPR gRNA sequence
gcattttcctaatgactaat

SEQ ID NO: 800254 - DNA, 20 bp, Artificial
  CRISPR gRNA sequence
cattttcctaatgactaatg

SEQ ID NO: 800255 - DNA, 20 bp, Artificial
  CRISPR gRNA sequence
tcctaatgactaatgatatt

SEQ ID NO: 800256 - DNA, 20 bp, Artificial
  CRISPR gRNA sequence
cctaatgactaatgatatta

SEQ ID NO: 800257 - DNA, 20 bp, Artificial
  CRISPR gRNA sequence
ctaatgactaatgatattaa

SEQ ID NO: 800258 - DNA, 20 bp, Artificial
  CRISPR gRNA sequence
atgactaatgatattaagta

SEQ ID NO: 800259 - DNA, 20 bp, Artificial
  CRISPR gRNA sequence
atgatattaagtatacatat

SEQ ID NO: 800260 - DNA, 20 bp, Artificial
  CRISPR gRNA sequence
agtatacatatatttatata

SEQ ID NO: 800261 - DNA, 20 bp, Artificial
  CRISPR gRNA sequence
atatattattttataatctt

SEQ ID NO: 800262 - DNA, 20 bp, Artificial
  CRISPR gRNA sequence
tatattattttataatctta

SEQ ID NO: 800263 - DNA, 20 bp, Artificial
  CRISPR gRNA sequence
ttttataatcttatatataa

SEQ ID NO: 800264 - DNA, 20 bp, Artificial
  CRISPR gRNA sequence
tataatcttatatataatat

SEQ ID NO: 800265 - DNA, 20 bp, Artificial
  CRISPR gRNA sequence
ataatcttatatataatata

SEQ ID NO: 800266 - DNA, 20 bp, Artificial
  CRISPR gRNA sequence
taatcttatatataatatac

SEQ ID NO: 800267 - DNA, 20 bp, Artificial
  CRISPR gRNA sequence
atatataatatacatatttt

SEQ ID NO: 800268 - DNA, 20 bp, Artificial
  CRISPR gRNA sequence
tatataatatacatatttta

SEQ ID NO: 800269 - DNA, 20 bp, Artificial
  CRISPR gRNA sequence
tatatattatatatatattt

SEQ ID NO: 800270 - DNA, 20 bp, Artificial
  CRISPR gRNA sequence
atatattatatatatatttt

SEQ ID NO: 800271 - DNA, 20 bp, Artificial
  CRISPR gRNA sequence
tatattatatatatatttta

SEQ ID NO: 800272 - DNA, 20 bp, Artificial
  CRISPR gRNA sequence
tatatatattttatatatat

SEQ ID NO: 800273 - DNA, 20 bp, Artificial
  CRISPR gRNA sequence
tatatatatatacacacaca

SEQ ID NO: 800274 - DNA, 20 bp, Artificial
  CRISPR gRNA sequence
atatatatatacacacacac

SEQ ID NO: 800275 - DNA, 20 bp, Artificial
  CRISPR gRNA sequence
tatatatatacacacacaca

SEQ ID NO: 800276 - DNA, 20 bp, Artificial
  CRISPR gRNA sequence
ttttctttttttgagacagg

SEQ ID NO: 800277 - DNA, 20 bp, Artificial
  CRISPR gRNA sequence
tttctttttttgagacaggg

SEQ ID NO: 800278 - DNA, 20 bp, Artificial
  CRISPR gRNA sequence
ttctttttttgagacagggt

SEQ ID NO: 800279 - DNA, 20 bp, Artificial
  CRISPR gRNA sequence
tctttttttgagacagggta

SEQ ID NO: 800280 - DNA, 20 bp, Artificial
  CRISPR gRNA sequence
ctttttttgagacagggtat

SEQ ID NO: 800281 - DNA, 20 bp, Artificial
  CRISPR gRNA sequence
tttttttgagacagggtatc

SEQ ID NO: 800282 - DNA, 20 bp, Artificial
  CRISPR gRNA sequence
tttttgagacagggtatcac

SEQ ID NO: 800283 - DNA, 20 bp, Artificial
  CRISPR gRNA sequence
ttttgagacagggtatcact

SEQ ID NO: 800284 - DNA, 20 bp, Artificial
  CRISPR gRNA sequence
tttgagacagggtatcactc

SEQ ID NO: 800285 - DNA, 20 bp, Artificial
  CRISPR gRNA sequence
ttgagacagggtatcactct

SEQ ID NO: 800286 - DNA, 20 bp, Artificial
  CRISPR gRNA sequence
tgagacagggtatcactctg

SEQ ID NO: 800287 - DNA, 20 bp, Artificial
  CRISPR gRNA sequence
gagacagggtatcactctgt

SEQ ID NO: 800288 - DNA, 20 bp, Artificial
  CRISPR gRNA sequence
agacagggtatcactctgtt

SEQ ID NO: 800289 - DNA, 20 bp, Artificial
  CRISPR gRNA sequence
tgttgcccagattggaatac

SEQ ID NO: 800290 - DNA, 20 bp, Artificial
  CRISPR gRNA sequence
ttgcccagattggaatacag

SEQ ID NO: 800291 - DNA, 20 bp, Artificial
  CRISPR gRNA sequence
cccagattggaatacagtgg

SEQ ID NO: 800292 - DNA, 20 bp, Artificial
  CRISPR gRNA sequence
gaatacagtggtataatcat

SEQ ID NO: 800293 - DNA, 20 bp, Artificial
  CRISPR gRNA sequence
actgcagcctcgatctctca

SEQ ID NO: 800294 - DNA, 20 bp, Artificial
  CRISPR gRNA sequence
cagcctcgatctctcaggct

SEQ ID NO: 800295 - DNA, 20 bp, Artificial
  CRISPR gRNA sequence
gatctctcaggctcaagcga

SEQ ID NO: 800296 - DNA, 20 bp, Artificial
  CRISPR gRNA sequence
tcaggctcaagcgattctcc

SEQ ID NO: 800297 - DNA, 20 bp, Artificial
  CRISPR gRNA sequence
aggctcaagcgattctccca

SEQ ID NO: 800298 - DNA, 20 bp, Artificial
  CRISPR gRNA sequence
aagcgattctcccacctcag

SEQ ID NO: 800299 - DNA, 20 bp, Artificial
  CRISPR gRNA sequence
tcccacctcagactctgtag

SEQ ID NO: 800300 - DNA, 20 bp, Artificial
  CRISPR gRNA sequence
ccacctcagactctgtagta

SEQ ID NO: 800301 - DNA, 20 bp, Artificial
  CRISPR gRNA sequence
agactctgtagtaactggga

SEQ ID NO: 800302 - DNA, 20 bp, Artificial
  CRISPR gRNA sequence
tgtagtaactgggactacag

SEQ ID NO: 800303 - DNA, 20 bp, Artificial
  CRISPR gRNA sequence
tagtaactgggactacaggc

SEQ ID NO: 800304 - DNA, 20 bp, Artificial
  CRISPR gRNA sequence
ggactacaggccatgccacc

SEQ ID NO: 800305 - DNA, 20 bp, Artificial
  CRISPR gRNA sequence
caggccatgccaccatgcct

SEQ ID NO: 800306 - DNA, 20 bp, Artificial
  CRISPR gRNA sequence
gctaattttttttttttaat

SEQ ID NO: 800307 - DNA, 20 bp, Artificial
  CRISPR gRNA sequence
attttttttttttaattttg

SEQ ID NO: 800308 - DNA, 20 bp, Artificial
  CRISPR gRNA sequence
tttttttttaattttgtaga

SEQ ID NO: 800309 - DNA, 20 bp, Artificial
  CRISPR gRNA sequence
ttttttttaattttgtagac

SEQ ID NO: 800310 - DNA, 20 bp, Artificial
  CRISPR gRNA sequence
tttttttaattttgtagaca

SEQ ID NO: 800311 - DNA, 20 bp, Artificial
  CRISPR gRNA sequence
ttttttaattttgtagacat

SEQ ID NO: 800312 - DNA, 20 bp, Artificial
  CRISPR gRNA sequence
tttttaattttgtagacatg

SEQ ID NO: 800313 - DNA, 20 bp, Artificial
  CRISPR gRNA sequence
ttttaattttgtagacatgg

SEQ ID NO: 800314 - DNA, 20 bp, Artificial
  CRISPR gRNA sequence
tttaattttgtagacatggg

SEQ ID NO: 800315 - DNA, 20 bp, Artificial
  CRISPR gRNA sequence
ttaattttgtagacatgggg

SEQ ID NO: 800316 - DNA, 20 bp, Artificial
  CRISPR gRNA sequence
taattttgtagacatggggt

SEQ ID NO: 800317 - DNA, 20 bp, Artificial
  CRISPR gRNA sequence
aattttgtagacatggggtc

SEQ ID NO: 800318 - DNA, 20 bp, Artificial
  CRISPR gRNA sequence
attttgtagacatggggtct

SEQ ID NO: 800319 - DNA, 20 bp, Artificial
  CRISPR gRNA sequence
tgtagacatggggtctcctt

SEQ ID NO: 800320 - DNA, 20 bp, Artificial
  CRISPR gRNA sequence
gtagacatggggtctccttg

SEQ ID NO: 800321 - DNA, 20 bp, Artificial
  CRISPR gRNA sequence
tagacatggggtctccttgt

SEQ ID NO: 800322 - DNA, 20 bp, Artificial
  CRISPR gRNA sequence
cttgtgtttcccaggccagt

SEQ ID NO: 800323 - DNA, 20 bp, Artificial
  CRISPR gRNA sequence
gtgtttcccaggccagtctc

SEQ ID NO: 800324 - DNA, 20 bp, Artificial
  CRISPR gRNA sequence
tgtttcccaggccagtctca

SEQ ID NO: 800325 - DNA, 20 bp, Artificial
  CRISPR gRNA sequence
cccaggccagtctcaaactc

SEQ ID NO: 800326 - DNA, 20 bp, Artificial
  CRISPR gRNA sequence
ccaggccagtctcaaactcc

SEQ ID NO: 800327 - DNA, 20 bp, Artificial
  CRISPR gRNA sequence
aaactcctggactcaagcca

SEQ ID NO: 800328 - DNA, 20 bp, Artificial
  CRISPR gRNA sequence
ctggactcaagccatcttct

SEQ ID NO: 800329 - DNA, 20 bp, Artificial
  CRISPR gRNA sequence
gactcaagccatcttctcgc

SEQ ID NO: 800330 - DNA, 20 bp, Artificial
  CRISPR gRNA sequence
aagccatcttctcgcctcag

SEQ ID NO: 800331 - DNA, 20 bp, Artificial
  CRISPR gRNA sequence
ctcgcctcagcctcccaaaa

SEQ ID NO: 800332 - DNA, 20 bp, Artificial
  CRISPR gRNA sequence
tcgcctcagcctcccaaaat

SEQ ID NO: 800333 - DNA, 20 bp, Artificial
  CRISPR gRNA sequence
gcctcagcctcccaaaatgc

SEQ ID NO: 800334 - DNA, 20 bp, Artificial
  CRISPR gRNA sequence
agcctcccaaaatgctggga

SEQ ID NO: 800335 - DNA, 20 bp, Artificial
  CRISPR gRNA sequence
ccaaaatgctgggattacag

SEQ ID NO: 800336 - DNA, 20 bp, Artificial
  CRISPR gRNA sequence
ggattacaggcataagccac

SEQ ID NO: 800337 - DNA, 20 bp, Artificial
  CRISPR gRNA sequence
caggcataagccactgcacc

SEQ ID NO: 800338 - DNA, 20 bp, Artificial
  CRISPR gRNA sequence
cacctggccttagttaagtt

SEQ ID NO: 800339 - DNA, 20 bp, Artificial
  CRISPR gRNA sequence
gccttagttaagtttttatg

SEQ ID NO: 800340 - DNA, 20 bp, Artificial
  CRISPR gRNA sequence
agttaagtttttatgtactt

SEQ ID NO: 800341 - DNA, 20 bp, Artificial
  CRISPR gRNA sequence
gttaagtttttatgtactta

SEQ ID NO: 800342 - DNA, 20 bp, Artificial
  CRISPR gRNA sequence
agtttttatgtacttattgt

SEQ ID NO: 800343 - DNA, 20 bp, Artificial
  CRISPR gRNA sequence
ttatgtacttattgtatatc

SEQ ID NO: 800344 - DNA, 20 bp, Artificial
  CRISPR gRNA sequence
tatgtacttattgtatatct

SEQ ID NO: 800345 - DNA, 20 bp, Artificial
  CRISPR gRNA sequence
atgtacttattgtatatctt

SEQ ID NO: 800346 - DNA, 20 bp, Artificial
  CRISPR gRNA sequence
tgtacttattgtatatcttc

SEQ ID NO: 800347 - DNA, 20 bp, Artificial
  CRISPR gRNA sequence
attgtatatcttcattggtg

SEQ ID NO: 800348 - DNA, 20 bp, Artificial
  CRISPR gRNA sequence
ttgtatatcttcattggtga

SEQ ID NO: 800349 - DNA, 20 bp, Artificial
  CRISPR gRNA sequence
tatatcttcattggtgacat

SEQ ID NO: 800350 - DNA, 20 bp, Artificial
  CRISPR gRNA sequence
cattggtgacattcaaatca

SEQ ID NO: 800351 - DNA, 20 bp, Artificial
  CRISPR gRNA sequence
attggtgacattcaaatcat

SEQ ID NO: 800352 - DNA, 20 bp, Artificial
  CRISPR gRNA sequence
gtgacattcaaatcatttca

SEQ ID NO: 800353 - DNA, 20 bp, Artificial
  CRISPR gRNA sequence
aaatcatttcatcctttgta

SEQ ID NO: 800354 - DNA, 20 bp, Artificial
  CRISPR gRNA sequence
catcctttgtaattgtatac

SEQ ID NO: 800355 - DNA, 20 bp, Artificial
  CRISPR gRNA sequence
atcctttgtaattgtatact

SEQ ID NO: 800356 - DNA, 20 bp, Artificial
  CRISPR gRNA sequence
tgtaattgtatactaaggaa

SEQ ID NO: 800357 - DNA, 20 bp, Artificial
  CRISPR gRNA sequence
gtaattgtatactaaggaat

SEQ ID NO: 800358 - DNA, 20 bp, Artificial
  CRISPR gRNA sequence
taattgtatactaaggaatt

SEQ ID NO: 800359 - DNA, 20 bp, Artificial
  CRISPR gRNA sequence
tatactaaggaattaaacga

SEQ ID NO: 800360 - DNA, 20 bp, Artificial
  CRISPR gRNA sequence
aggaattaaacgattgttta

SEQ ID NO: 800361 - DNA, 20 bp, Artificial
  CRISPR gRNA sequence
aacgattgtttaattattgt

SEQ ID NO: 800362 - DNA, 20 bp, Artificial
  CRISPR gRNA sequence
tttaattattgtttattttc

SEQ ID NO: 800363 - DNA, 20 bp, Artificial
  CRISPR gRNA sequence
aattattgtttattttctta

SEQ ID NO: 800364 - DNA, 20 bp, Artificial
  CRISPR gRNA sequence
attattgtttattttcttat

SEQ ID NO: 800365 - DNA, 20 bp, Artificial
  CRISPR gRNA sequence
ttgtttattttcttattgta

SEQ ID NO: 800366 - DNA, 20 bp, Artificial
  CRISPR gRNA sequence
tttattttcttattgtaagg

SEQ ID NO: 800367 - DNA, 20 bp, Artificial
  CRISPR gRNA sequence
attttcttattgtaaggttt

SEQ ID NO: 800368 - DNA, 20 bp, Artificial
  CRISPR gRNA sequence
ttttcttattgtaaggtttt

SEQ ID NO: 800369 - DNA, 20 bp, Artificial
  CRISPR gRNA sequence
tcttattgtaaggttttaaa

SEQ ID NO: 800370 - DNA, 20 bp, Artificial
  CRISPR gRNA sequence
cttattgtaaggttttaaaa

SEQ ID NO: 800371 - DNA, 20 bp, Artificial
  CRISPR gRNA sequence
ttattgtaaggttttaaaaa

SEQ ID NO: 800372 - DNA, 20 bp, Artificial
  CRISPR gRNA sequence
attgtaaggttttaaaaatt

SEQ ID NO: 800373 - DNA, 20 bp, Artificial
  CRISPR gRNA sequence
ttgtaaggttttaaaaattc

SEQ ID NO: 800374 - DNA, 20 bp, Artificial
  CRISPR gRNA sequence
taaggttttaaaaattctct

SEQ ID NO: 800375 - DNA, 20 bp, Artificial
  CRISPR gRNA sequence
taaaaattctctattttttt

SEQ ID NO: 800376 - DNA, 20 bp, Artificial
  CRISPR gRNA sequence
aaaaattctctatttttttg

SEQ ID NO: 800377 - DNA, 20 bp, Artificial
  CRISPR gRNA sequence
aaaattctctatttttttga

SEQ ID NO: 800378 - DNA, 20 bp, Artificial
  CRISPR gRNA sequence
tctatttttttgagacgcag

SEQ ID NO: 800379 - DNA, 20 bp, Artificial
  CRISPR gRNA sequence
tatttttttgagacgcagtc

SEQ ID NO: 800380 - DNA, 20 bp, Artificial
  CRISPR gRNA sequence
tttttttgagacgcagtctc

SEQ ID NO: 800381 - DNA, 20 bp, Artificial
  CRISPR gRNA sequence
ttttgagacgcagtctccat

SEQ ID NO: 800382 - DNA, 20 bp, Artificial
  CRISPR gRNA sequence
tttgagacgcagtctccatc

SEQ ID NO: 800383 - DNA, 20 bp, Artificial
  CRISPR gRNA sequence
ttgagacgcagtctccatca

SEQ ID NO: 800384 - DNA, 20 bp, Artificial
  CRISPR gRNA sequence
tgagacgcagtctccatcag

SEQ ID NO: 800385 - DNA, 20 bp, Artificial
  CRISPR gRNA sequence
gagacgcagtctccatcagt

SEQ ID NO: 800386 - DNA, 20 bp, Artificial
  CRISPR gRNA sequence
agacgcagtctccatcagtc

SEQ ID NO: 800387 - DNA, 20 bp, Artificial
  CRISPR gRNA sequence
catcagtcgcccaggctgga

SEQ ID NO: 800388 - DNA, 20 bp, Artificial
  CRISPR gRNA sequence
gagttcactgtcgtggctca

SEQ ID NO: 800389 - DNA, 20 bp, Artificial
  CRISPR gRNA sequence
actgtcgtggctcactacag

SEQ ID NO: 800390 - DNA, 20 bp, Artificial
  CRISPR gRNA sequence
tcgtggctcactacagcctc

SEQ ID NO: 800391 - DNA, 20 bp, Artificial
  CRISPR gRNA sequence
actacagcctctgcctccca

SEQ ID NO: 800392 - DNA, 20 bp, Artificial
  CRISPR gRNA sequence
cagcctctgcctcccaagtt

SEQ ID NO: 800393 - DNA, 20 bp, Artificial
  CRISPR gRNA sequence
tgcctcccaagtttaagcga

SEQ ID NO: 800394 - DNA, 20 bp, Artificial
  CRISPR gRNA sequence
cctcccaagtttaagcgatt

SEQ ID NO: 800395 - DNA, 20 bp, Artificial
  CRISPR gRNA sequence
ccaagtttaagcgattctcc

SEQ ID NO: 800396 - DNA, 20 bp, Artificial
  CRISPR gRNA sequence
aagcgattctccagcctcag

SEQ ID NO: 800397 - DNA, 20 bp, Artificial
  CRISPR gRNA sequence
agcgattctccagcctcagc

SEQ ID NO: 800398 - DNA, 20 bp, Artificial
  CRISPR gRNA sequence
tccagcctcagcctcttgac

SEQ ID NO: 800399 - DNA, 20 bp, Artificial
  CRISPR gRNA sequence
cagcctcagcctcttgactg

SEQ ID NO: 800400 - DNA, 20 bp, Artificial
  CRISPR gRNA sequence
agcctcttgactggctggaa

SEQ ID NO: 800401 - DNA, 20 bp, Artificial
  CRISPR gRNA sequence
ttgactggctggaattacag

SEQ ID NO: 800402 - DNA, 20 bp, Artificial
  CRISPR gRNA sequence
gactggctggaattacaggc

SEQ ID NO: 800403 - DNA, 20 bp, Artificial
  CRISPR gRNA sequence
actggctggaattacaggca

SEQ ID NO: 800404 - DNA, 20 bp, Artificial
  CRISPR gRNA sequence
gctggaattacaggcatgta

SEQ ID NO: 800405 - DNA, 20 bp, Artificial
  CRISPR gRNA sequence
gaattacaggcatgtaccac

SEQ ID NO: 800406 - DNA, 20 bp, Artificial
  CRISPR gRNA sequence
caggcatgtaccaccatgct

SEQ ID NO: 800407 - DNA, 20 bp, Artificial
  CRISPR gRNA sequence
ggcttatgtttgtattttca

SEQ ID NO: 800408 - DNA, 20 bp, Artificial
  CRISPR gRNA sequence
gcttatgtttgtattttcag

SEQ ID NO: 800409 - DNA, 20 bp, Artificial
  CRISPR gRNA sequence
atgtttgtattttcagtaga

SEQ ID NO: 800410 - DNA, 20 bp, Artificial
  CRISPR gRNA sequence
tgtttgtattttcagtagag

SEQ ID NO: 800411 - DNA, 20 bp, Artificial
  CRISPR gRNA sequence
gtattttcagtagagtcggg

SEQ ID NO: 800412 - DNA, 20 bp, Artificial
  CRISPR gRNA sequence
tattttcagtagagtcgggg

SEQ ID NO: 800413 - DNA, 20 bp, Artificial
  CRISPR gRNA sequence
tcagtagagtcggggtttca

SEQ ID NO: 800414 - DNA, 20 bp, Artificial
  CRISPR gRNA sequence
cagtagagtcggggtttcac

SEQ ID NO: 800415 - DNA, 20 bp, Artificial
  CRISPR gRNA sequence
agtagagtcggggtttcact

SEQ ID NO: 800416 - DNA, 20 bp, Artificial
  CRISPR gRNA sequence
cactatgttggccaggctgt

SEQ ID NO: 800417 - DNA, 20 bp, Artificial
  CRISPR gRNA sequence
actatgttggccaggctgtc

SEQ ID NO: 800418 - DNA, 20 bp, Artificial
  CRISPR gRNA sequence
tgttggccaggctgtctcaa

SEQ ID NO: 800419 - DNA, 20 bp, Artificial
  CRISPR gRNA sequence
gccaggctgtctcaagcttc

SEQ ID NO: 800420 - DNA, 20 bp, Artificial
  CRISPR gRNA sequence
tctcaagcttctgacctcaa

SEQ ID NO: 800421 - DNA, 20 bp, Artificial
  CRISPR gRNA sequence
aagcttctgacctcaagtgg

SEQ ID NO: 800422 - DNA, 20 bp, Artificial
  CRISPR gRNA sequence
ctgacctcaagtggcccacc

SEQ ID NO: 800423 - DNA, 20 bp, Artificial
  CRISPR gRNA sequence
tgacctcaagtggcccaccc

SEQ ID NO: 800424 - DNA, 20 bp, Artificial
  CRISPR gRNA sequence
acctcaagtggcccacccac

SEQ ID NO: 800425 - DNA, 20 bp, Artificial
  CRISPR gRNA sequence
aagtggcccacccaccttgg

SEQ ID NO: 800426 - DNA, 20 bp, Artificial
  CRISPR gRNA sequence
ggcctcccaaagtgctggga

SEQ ID NO: 800427 - DNA, 20 bp, Artificial
  CRISPR gRNA sequence
gcctcccaaagtgctgggat

SEQ ID NO: 800428 - DNA, 20 bp, Artificial
  CRISPR gRNA sequence
ccaaagtgctgggattacag

SEQ ID NO: 800429 - DNA, 20 bp, Artificial
  CRISPR gRNA sequence
ggattacaggtgtgagccac

SEQ ID NO: 800430 - DNA, 20 bp, Artificial
  CRISPR gRNA sequence
caggtgtgagccactgccac

SEQ ID NO: 800431 - DNA, 20 bp, Artificial
  CRISPR gRNA sequence
ccacgaccttaagagttctt

SEQ ID NO: 800432 - DNA, 20 bp, Artificial
  CRISPR gRNA sequence
aagagttctttattctagat

SEQ ID NO: 800433 - DNA, 20 bp, Artificial
  CRISPR gRNA sequence
agagttctttattctagata

SEQ ID NO: 800434 - DNA, 20 bp, Artificial
  CRISPR gRNA sequence
tttattctagatacaagttc

SEQ ID NO: 800435 - DNA, 20 bp, Artificial
  CRISPR gRNA sequence
tattctagatacaagttctt

SEQ ID NO: 800436 - DNA, 20 bp, Artificial
  CRISPR gRNA sequence
attctagatacaagttcttt

SEQ ID NO: 800437 - DNA, 20 bp, Artificial
  CRISPR gRNA sequence
ttctagatacaagttcttta

SEQ ID NO: 800438 - DNA, 20 bp, Artificial
  CRISPR gRNA sequence
tagatacaagttctttatca

SEQ ID NO: 800439 - DNA, 20 bp, Artificial
  CRISPR gRNA sequence
gatacaagttctttatcaga

SEQ ID NO: 800440 - DNA, 20 bp, Artificial
  CRISPR gRNA sequence
tttatcagatattgattttc

SEQ ID NO: 800441 - DNA, 20 bp, Artificial
  CRISPR gRNA sequence
tatcagatattgattttcaa

SEQ ID NO: 800442 - DNA, 20 bp, Artificial
  CRISPR gRNA sequence
atcagatattgattttcaaa

SEQ ID NO: 800443 - DNA, 20 bp, Artificial
  CRISPR gRNA sequence
tcagatattgattttcaaat

SEQ ID NO: 800444 - DNA, 20 bp, Artificial
  CRISPR gRNA sequence
attttcaaatattcttttga

SEQ ID NO: 800445 - DNA, 20 bp, Artificial
  CRISPR gRNA sequence
tcaaatattcttttgaagtc

SEQ ID NO: 800446 - DNA, 20 bp, Artificial
  CRISPR gRNA sequence
caaatattcttttgaagtct

SEQ ID NO: 800447 - DNA, 20 bp, Artificial
  CRISPR gRNA sequence
aaatattcttttgaagtctg

SEQ ID NO: 800448 - DNA, 20 bp, Artificial
  CRISPR gRNA sequence
ttttgaagtctgtagcttgt

SEQ ID NO: 800449 - DNA, 20 bp, Artificial
  CRISPR gRNA sequence
ttgaagtctgtagcttgtct

SEQ ID NO: 800450 - DNA, 20 bp, Artificial
  CRISPR gRNA sequence
tgaagtctgtagcttgtctt

SEQ ID NO: 800451 - DNA, 20 bp, Artificial
  CRISPR gRNA sequence
gaagtctgtagcttgtcttt

SEQ ID NO: 800452 - DNA, 20 bp, Artificial
  CRISPR gRNA sequence
aagtctgtagcttgtctttt

SEQ ID NO: 800453 - DNA, 20 bp, Artificial
  CRISPR gRNA sequence
tagcttgtcttttcattttc

SEQ ID NO: 800454 - DNA, 20 bp, Artificial
  CRISPR gRNA sequence
gtcttttcattttcttaact

SEQ ID NO: 800455 - DNA, 20 bp, Artificial
  CRISPR gRNA sequence
tcttttcattttcttaactg

SEQ ID NO: 800456 - DNA, 20 bp, Artificial
  CRISPR gRNA sequence
ttcattttcttaactgtgtc

SEQ ID NO: 800457 - DNA, 20 bp, Artificial
  CRISPR gRNA sequence
tcattttcttaactgtgtct

SEQ ID NO: 800458 - DNA, 20 bp, Artificial
  CRISPR gRNA sequence
cattttcttaactgtgtctt

SEQ ID NO: 800459 - DNA, 20 bp, Artificial
  CRISPR gRNA sequence
attttcttaactgtgtcttt

SEQ ID NO: 800460 - DNA, 20 bp, Artificial
  CRISPR gRNA sequence
tcttaactgtgtcttttgca

SEQ ID NO: 800461 - DNA, 20 bp, Artificial
  CRISPR gRNA sequence
cttaactgtgtcttttgcag

SEQ ID NO: 800462 - DNA, 20 bp, Artificial
  CRISPR gRNA sequence
ttaactgtgtcttttgcaga

SEQ ID NO: 800463 - DNA, 20 bp, Artificial
  CRISPR gRNA sequence
aactgtgtcttttgcagagc

SEQ ID NO: 800464 - DNA, 20 bp, Artificial
  CRISPR gRNA sequence
actgtgtcttttgcagagca

SEQ ID NO: 800465 - DNA, 20 bp, Artificial
  CRISPR gRNA sequence
tgtcttttgcagagcaaaga

SEQ ID NO: 800466 - DNA, 20 bp, Artificial
  CRISPR gRNA sequence
ttgcagagcaaagattttaa

SEQ ID NO: 800467 - DNA, 20 bp, Artificial
  CRISPR gRNA sequence
tgcagagcaaagattttaat

SEQ ID NO: 800468 - DNA, 20 bp, Artificial
  CRISPR gRNA sequence
gcagagcaaagattttaatt

SEQ ID NO: 800469 - DNA, 20 bp, Artificial
  CRISPR gRNA sequence
cagagcaaagattttaattt

SEQ ID NO: 800470 - DNA, 20 bp, Artificial
  CRISPR gRNA sequence
taattttgatgaagtttgat

SEQ ID NO: 800471 - DNA, 20 bp, Artificial
  CRISPR gRNA sequence
aattttgatgaagtttgatt

SEQ ID NO: 800472 - DNA, 20 bp, Artificial
  CRISPR gRNA sequence
attttgatgaagtttgattt

SEQ ID NO: 800473 - DNA, 20 bp, Artificial
  CRISPR gRNA sequence
tgatgaagtttgatttatca

SEQ ID NO: 800474 - DNA, 20 bp, Artificial
  CRISPR gRNA sequence
gatgaagtttgatttatcaa

SEQ ID NO: 800475 - DNA, 20 bp, Artificial
  CRISPR gRNA sequence
atgaagtttgatttatcaat

SEQ ID NO: 800476 - DNA, 20 bp, Artificial
  CRISPR gRNA sequence
gatttatcaatgttttcttt

SEQ ID NO: 800477 - DNA, 20 bp, Artificial
  CRISPR gRNA sequence
atttatcaatgttttctttt

SEQ ID NO: 800478 - DNA, 20 bp, Artificial
  CRISPR gRNA sequence
atcaatgttttcttttatgg

SEQ ID NO: 800479 - DNA, 20 bp, Artificial
  CRISPR gRNA sequence
tcaatgttttcttttatgga

SEQ ID NO: 800480 - DNA, 20 bp, Artificial
  CRISPR gRNA sequence
tcttttatggatcatgcttt

SEQ ID NO: 800481 - DNA, 20 bp, Artificial
  CRISPR gRNA sequence
cttttatggatcatgctttt

SEQ ID NO: 800482 - DNA, 20 bp, Artificial
  CRISPR gRNA sequence
ttttatggatcatgcttttg

SEQ ID NO: 800483 - DNA, 20 bp, Artificial
  CRISPR gRNA sequence
ttatggatcatgcttttggt

SEQ ID NO: 800484 - DNA, 20 bp, Artificial
  CRISPR gRNA sequence
tatggatcatgcttttggta

SEQ ID NO: 800485 - DNA, 20 bp, Artificial
  CRISPR gRNA sequence
atggatcatgcttttggtat

SEQ ID NO: 800486 - DNA, 20 bp, Artificial
  CRISPR gRNA sequence
tggatcatgcttttggtatc

SEQ ID NO: 800487 - DNA, 20 bp, Artificial
  CRISPR gRNA sequence
ttggtatcatatccaaaaac

SEQ ID NO: 800488 - DNA, 20 bp, Artificial
  CRISPR gRNA sequence
tggtatcatatccaaaaact

SEQ ID NO: 800489 - DNA, 20 bp, Artificial
  CRISPR gRNA sequence
ggtatcatatccaaaaactc

SEQ ID NO: 800490 - DNA, 20 bp, Artificial
  CRISPR gRNA sequence
gtatcatatccaaaaactct

SEQ ID NO: 800491 - DNA, 20 bp, Artificial
  CRISPR gRNA sequence
tttacataacccaagatgta

SEQ ID NO: 800492 - DNA, 20 bp, Artificial
  CRISPR gRNA sequence
tacataacccaagatgtaaa

SEQ ID NO: 800493 - DNA, 20 bp, Artificial
  CRISPR gRNA sequence
acataacccaagatgtaaaa

SEQ ID NO: 800494 - DNA, 20 bp, Artificial
  CRISPR gRNA sequence
cataacccaagatgtaaaag

SEQ ID NO: 800495 - DNA, 20 bp, Artificial
  CRISPR gRNA sequence
tcttctatattttcttctac

SEQ ID NO: 800496 - DNA, 20 bp, Artificial
  CRISPR gRNA sequence
ctatattttcttctacacat

SEQ ID NO: 800497 - DNA, 20 bp, Artificial
  CRISPR gRNA sequence
tatattttcttctacacatt

SEQ ID NO: 800498 - DNA, 20 bp, Artificial
  CRISPR gRNA sequence
tattttcttctacacatttt

SEQ ID NO: 800499 - DNA, 20 bp, Artificial
  CRISPR gRNA sequence
tcttctacacattttgtagt

SEQ ID NO: 800500 - DNA, 20 bp, Artificial
  CRISPR gRNA sequence
cttctacacattttgtagtt

SEQ ID NO: 800501 - DNA, 20 bp, Artificial
  CRISPR gRNA sequence
ttctacacattttgtagttg

SEQ ID NO: 800502 - DNA, 20 bp, Artificial
  CRISPR gRNA sequence
ctacacattttgtagttgta

SEQ ID NO: 800503 - DNA, 20 bp, Artificial
  CRISPR gRNA sequence
tacacattttgtagttgtat

SEQ ID NO: 800504 - DNA, 20 bp, Artificial
  CRISPR gRNA sequence
cacattttgtagttgtatat

SEQ ID NO: 800505 - DNA, 20 bp, Artificial
  CRISPR gRNA sequence
tgtagttgtatattctatat

SEQ ID NO: 800506 - DNA, 20 bp, Artificial
  CRISPR gRNA sequence
gtagttgtatattctatatg

SEQ ID NO: 800507 - DNA, 20 bp, Artificial
  CRISPR gRNA sequence
tagttgtatattctatatgt

SEQ ID NO: 800508 - DNA, 20 bp, Artificial
  CRISPR gRNA sequence
tatattctatatgtaaggtt

SEQ ID NO: 800509 - DNA, 20 bp, Artificial
  CRISPR gRNA sequence
tatatgtaaggtttataatc

SEQ ID NO: 800510 - DNA, 20 bp, Artificial
  CRISPR gRNA sequence
tatgtaaggtttataatcca

SEQ ID NO: 800511 - DNA, 20 bp, Artificial
  CRISPR gRNA sequence
ataatccattttaattttta

SEQ ID NO: 800512 - DNA, 20 bp, Artificial
  CRISPR gRNA sequence
taatccattttaatttttat

SEQ ID NO: 800513 - DNA, 20 bp, Artificial
  CRISPR gRNA sequence
taatttttatataaggtgtg

SEQ ID NO: 800514 - DNA, 20 bp, Artificial
  CRISPR gRNA sequence
aatttttatataaggtgtga

SEQ ID NO: 800515 - DNA, 20 bp, Artificial
  CRISPR gRNA sequence
atttttatataaggtgtgat

SEQ ID NO: 800516 - DNA, 20 bp, Artificial
  CRISPR gRNA sequence
ttatataaggtgtgatgtat

SEQ ID NO: 800517 - DNA, 20 bp, Artificial
  CRISPR gRNA sequence
tatataaggtgtgatgtata

SEQ ID NO: 800518 - DNA, 20 bp, Artificial
  CRISPR gRNA sequence
atataaggtgtgatgtatag

SEQ ID NO: 800519 - DNA, 20 bp, Artificial
  CRISPR gRNA sequence
tataaggtgtgatgtatagg

SEQ ID NO: 800520 - DNA, 20 bp, Artificial
  CRISPR gRNA sequence
agctcattttagttttacat

SEQ ID NO: 800521 - DNA, 20 bp, Artificial
  CRISPR gRNA sequence
attttagttttacatgtaga

SEQ ID NO: 800522 - DNA, 20 bp, Artificial
  CRISPR gRNA sequence
tagttttacatgtagatgtt

SEQ ID NO: 800523 - DNA, 20 bp, Artificial
  CRISPR gRNA sequence
agttttacatgtagatgttc

SEQ ID NO: 800524 - DNA, 20 bp, Artificial
  CRISPR gRNA sequence
gttttacatgtagatgttca

SEQ ID NO: 800525 - DNA, 20 bp, Artificial
  CRISPR gRNA sequence
tacatgtagatgttcagttg

SEQ ID NO: 800526 - DNA, 20 bp, Artificial
  CRISPR gRNA sequence
acatgtagatgttcagttgt

SEQ ID NO: 800527 - DNA, 20 bp, Artificial
  CRISPR gRNA sequence
catgtagatgttcagttgtt

SEQ ID NO: 800528 - DNA, 20 bp, Artificial
  CRISPR gRNA sequence
agttgttccagccccatttg

SEQ ID NO: 800529 - DNA, 20 bp, Artificial
  CRISPR gRNA sequence
ttccagccccatttgttaaa

SEQ ID NO: 800530 - DNA, 20 bp, Artificial
  CRISPR gRNA sequence
cagccccatttgttaaaaaa

SEQ ID NO: 800531 - DNA, 20 bp, Artificial
  CRISPR gRNA sequence
gttaaaaaacacccatcctt

SEQ ID NO: 800532 - DNA, 20 bp, Artificial
  CRISPR gRNA sequence
ttaaaaaacacccatccttt

SEQ ID NO: 800533 - DNA, 20 bp, Artificial
  CRISPR gRNA sequence
aaaaacacccatcctttccc

SEQ ID NO: 800534 - DNA, 20 bp, Artificial
  CRISPR gRNA sequence
tccccattcaatagcctttg

SEQ ID NO: 800535 - DNA, 20 bp, Artificial
  CRISPR gRNA sequence
ccccattcaatagcctttga

SEQ ID NO: 800536 - DNA, 20 bp, Artificial
  CRISPR gRNA sequence
cccattcaatagcctttgaa

SEQ ID NO: 800537 - DNA, 20 bp, Artificial
  CRISPR gRNA sequence
aatagcctttgaatcttcat

SEQ ID NO: 800538 - DNA, 20 bp, Artificial
  CRISPR gRNA sequence
tgaatcttcatcaaaatcaa

SEQ ID NO: 800539 - DNA, 20 bp, Artificial
  CRISPR gRNA sequence
gaatcttcatcaaaatcaat

SEQ ID NO: 800540 - DNA, 20 bp, Artificial
  CRISPR gRNA sequence
aatcttcatcaaaatcaatt

SEQ ID NO: 800541 - DNA, 20 bp, Artificial
  CRISPR gRNA sequence
catcaaaatcaattagtcat

SEQ ID NO: 800542 - DNA, 20 bp, Artificial
  CRISPR gRNA sequence
atcaaaatcaattagtcata

SEQ ID NO: 800543 - DNA, 20 bp, Artificial
  CRISPR gRNA sequence
gtcatatttatgtgggtcta

SEQ ID NO: 800544 - DNA, 20 bp, Artificial
  CRISPR gRNA sequence
atgtgggtctatttctggac

SEQ ID NO: 800545 - DNA, 20 bp, Artificial
  CRISPR gRNA sequence
tgtgggtctatttctggact

SEQ ID NO: 800546 - DNA, 20 bp, Artificial
  CRISPR gRNA sequence
tttctggactttttgttcca

SEQ ID NO: 800547 - DNA, 20 bp, Artificial
  CRISPR gRNA sequence
ctggactttttgttccatta

SEQ ID NO: 800548 - DNA, 20 bp, Artificial
  CRISPR gRNA sequence
tggactttttgttccattaa

SEQ ID NO: 800549 - DNA, 20 bp, Artificial
  CRISPR gRNA sequence
gactttttgttccattaact

SEQ ID NO: 800550 - DNA, 20 bp, Artificial
  CRISPR gRNA sequence
tttgttccattaacttatgt

SEQ ID NO: 800551 - DNA, 20 bp, Artificial
  CRISPR gRNA sequence
ttgttccattaacttatgtg

SEQ ID NO: 800552 - DNA, 20 bp, Artificial
  CRISPR gRNA sequence
tgttccattaacttatgtgt

SEQ ID NO: 800553 - DNA, 20 bp, Artificial
  CRISPR gRNA sequence
gttccattaacttatgtgta

SEQ ID NO: 800554 - DNA, 20 bp, Artificial
  CRISPR gRNA sequence
ttccattaacttatgtgtat

SEQ ID NO: 800555 - DNA, 20 bp, Artificial
  CRISPR gRNA sequence
cattaacttatgtgtatatc

SEQ ID NO: 800556 - DNA, 20 bp, Artificial
  CRISPR gRNA sequence
acttatgtgtatatcctttt

SEQ ID NO: 800557 - DNA, 20 bp, Artificial
  CRISPR gRNA sequence
atgtgtatatccttttgcaa

SEQ ID NO: 800558 - DNA, 20 bp, Artificial
  CRISPR gRNA sequence
tgtgtatatccttttgcaaa

SEQ ID NO: 800559 - DNA, 20 bp, Artificial
  CRISPR gRNA sequence
ttgcaaatatcacacttata

SEQ ID NO: 800560 - DNA, 20 bp, Artificial
  CRISPR gRNA sequence
tgcaaatatcacacttatat

SEQ ID NO: 800561 - DNA, 20 bp, Artificial
  CRISPR gRNA sequence
gcaaatatcacacttatatt

SEQ ID NO: 800562 - DNA, 20 bp, Artificial
  CRISPR gRNA sequence
caaatatcacacttatattt

SEQ ID NO: 800563 - DNA, 20 bp, Artificial
  CRISPR gRNA sequence
atatttgttttttttcttac

SEQ ID NO: 800564 - DNA, 20 bp, Artificial
  CRISPR gRNA sequence
tatttgttttttttcttaca

SEQ ID NO: 800565 - DNA, 20 bp, Artificial
  CRISPR gRNA sequence
gttttttttcttacattttt

SEQ ID NO: 800566 - DNA, 20 bp, Artificial
  CRISPR gRNA sequence
ttttttttcttacattttta

SEQ ID NO: 800567 - DNA, 20 bp, Artificial
  CRISPR gRNA sequence
tttttcttacatttttattt

SEQ ID NO: 800568 - DNA, 20 bp, Artificial
  CRISPR gRNA sequence
ttttcttacatttttatttc

SEQ ID NO: 800569 - DNA, 20 bp, Artificial
  CRISPR gRNA sequence
tttcttacatttttatttca

SEQ ID NO: 800570 - DNA, 20 bp, Artificial
  CRISPR gRNA sequence
ttcttacatttttatttcaa

SEQ ID NO: 800571 - DNA, 20 bp, Artificial
  CRISPR gRNA sequence
tcttacatttttatttcaaa

SEQ ID NO: 800572 - DNA, 20 bp, Artificial
  CRISPR gRNA sequence
cttacatttttatttcaaaa

SEQ ID NO: 800573 - DNA, 20 bp, Artificial
  CRISPR gRNA sequence
ttacatttttatttcaaaat

SEQ ID NO: 800574 - DNA, 20 bp, Artificial
  CRISPR gRNA sequence
acatttttatttcaaaatct

SEQ ID NO: 800575 - DNA, 20 bp, Artificial
  CRISPR gRNA sequence
catttttatttcaaaatcta

SEQ ID NO: 800576 - DNA, 20 bp, Artificial
  CRISPR gRNA sequence
ttatttcaaaatctaaggac

SEQ ID NO: 800577 - DNA, 20 bp, Artificial
  CRISPR gRNA sequence
tatttcaaaatctaaggaca

SEQ ID NO: 800578 - DNA, 20 bp, Artificial
  CRISPR gRNA sequence
atttcaaaatctaaggacat

SEQ ID NO: 800579 - DNA, 20 bp, Artificial
  CRISPR gRNA sequence
tttcaaaatctaaggacatc

SEQ ID NO: 800580 - DNA, 20 bp, Artificial
  CRISPR gRNA sequence
caaaatctaaggacatctta

SEQ ID NO: 800581 - DNA, 20 bp, Artificial
  CRISPR gRNA sequence
aaaatctaaggacatcttat

SEQ ID NO: 800582 - DNA, 20 bp, Artificial
  CRISPR gRNA sequence
aggacatcttataacccaga

SEQ ID NO: 800583 - DNA, 20 bp, Artificial
  CRISPR gRNA sequence
ataacccagaaatatttttt

SEQ ID NO: 800584 - DNA, 20 bp, Artificial
  CRISPR gRNA sequence
taacccagaaatatttttta

SEQ ID NO: 800585 - DNA, 20 bp, Artificial
  CRISPR gRNA sequence
tttataccttgtcatgtctt

SEQ ID NO: 800586 - DNA, 20 bp, Artificial
  CRISPR gRNA sequence
ttataccttgtcatgtctta

SEQ ID NO: 800587 - DNA, 20 bp, Artificial
  CRISPR gRNA sequence
tataccttgtcatgtcttag

SEQ ID NO: 800588 - DNA, 20 bp, Artificial
  CRISPR gRNA sequence
ataccttgtcatgtcttaga

SEQ ID NO: 800589 - DNA, 20 bp, Artificial
  CRISPR gRNA sequence
taccttgtcatgtcttagag

SEQ ID NO: 800590 - DNA, 20 bp, Artificial
  CRISPR gRNA sequence
gtcatgtcttagaggaaaga

SEQ ID NO: 800591 - DNA, 20 bp, Artificial
  CRISPR gRNA sequence
tcatgtcttagaggaaagag

SEQ ID NO: 800592 - DNA, 20 bp, Artificial
  CRISPR gRNA sequence
agaggaaagagccaccccag

SEQ ID NO: 800593 - DNA, 20 bp, Artificial
  CRISPR gRNA sequence
gaggaaagagccaccccagt

SEQ ID NO: 800594 - DNA, 20 bp, Artificial
  CRISPR gRNA sequence
ttttcattgatgtttttctt

SEQ ID NO: 800595 - DNA, 20 bp, Artificial
  CRISPR gRNA sequence
tttcattgatgtttttcttc

SEQ ID NO: 800596 - DNA, 20 bp, Artificial
  CRISPR gRNA sequence
ttcattgatgtttttcttct

SEQ ID NO: 800597 - DNA, 20 bp, Artificial
  CRISPR gRNA sequence
tcattgatgtttttcttctc

SEQ ID NO: 800598 - DNA, 20 bp, Artificial
  CRISPR gRNA sequence
cattgatgtttttcttctct

SEQ ID NO: 800599 - DNA, 20 bp, Artificial
  CRISPR gRNA sequence
attgatgtttttcttctctc

SEQ ID NO: 800600 - DNA, 20 bp, Artificial
  CRISPR gRNA sequence
atgtttttcttctctcttcg

SEQ ID NO: 800601 - DNA, 20 bp, Artificial
  CRISPR gRNA sequence
ttcttctctcttcgtactcc

SEQ ID NO: 800602 - DNA, 20 bp, Artificial
  CRISPR gRNA sequence
tcttctctcttcgtactcca

SEQ ID NO: 800603 - DNA, 20 bp, Artificial
  CRISPR gRNA sequence
cttctctcttcgtactccag

SEQ ID NO: 800604 - DNA, 20 bp, Artificial
  CRISPR gRNA sequence
ttctctcttcgtactccaga

SEQ ID NO: 800605 - DNA, 20 bp, Artificial
  CRISPR gRNA sequence
ctctcttcgtactccagagg

SEQ ID NO: 800606 - DNA, 20 bp, Artificial
  CRISPR gRNA sequence
tctcttcgtactccagaggt

SEQ ID NO: 800607 - DNA, 20 bp, Artificial
  CRISPR gRNA sequence
tcttcgtactccagaggtag

SEQ ID NO: 800608 - DNA, 20 bp, Artificial
  CRISPR gRNA sequence
ttcgtactccagaggtagat

SEQ ID NO: 800609 - DNA, 20 bp, Artificial
  CRISPR gRNA sequence
cgtactccagaggtagatga

SEQ ID NO: 800610 - DNA, 20 bp, Artificial
  CRISPR gRNA sequence
gtactccagaggtagatgaa

SEQ ID NO: 800611 - DNA, 20 bp, Artificial
  CRISPR gRNA sequence
cagaggtagatgaaaaccag

SEQ ID NO: 800612 - DNA, 20 bp, Artificial
  CRISPR gRNA sequence
aggtcattctggggcacaga

SEQ ID NO: 800613 - DNA, 20 bp, Artificial
  CRISPR gRNA sequence
tggggcacagacctcagcct

SEQ ID NO: 800614 - DNA, 20 bp, Artificial
  CRISPR gRNA sequence
gggcacagacctcagcctag

SEQ ID NO: 800615 - DNA, 20 bp, Artificial
  CRISPR gRNA sequence
agcctaggttactccacttc

SEQ ID NO: 800616 - DNA, 20 bp, Artificial
  CRISPR gRNA sequence
ggttactccacttcgcctat

SEQ ID NO: 800617 - DNA, 20 bp, Artificial
  CRISPR gRNA sequence
ctccacttcgcctatcttta

SEQ ID NO: 800618 - DNA, 20 bp, Artificial
  CRISPR gRNA sequence
cacttcgcctatctttagat

SEQ ID NO: 800619 - DNA, 20 bp, Artificial
  CRISPR gRNA sequence
cgcctatctttagatccaaa

SEQ ID NO: 800620 - DNA, 20 bp, Artificial
  CRISPR gRNA sequence
gcctatctttagatccaaaa

SEQ ID NO: 800621 - DNA, 20 bp, Artificial
  CRISPR gRNA sequence
tctttagatccaaaactacc

SEQ ID NO: 800622 - DNA, 20 bp, Artificial
  CRISPR gRNA sequence
tagatccaaaactaccctgc

SEQ ID NO: 800623 - DNA, 20 bp, Artificial
  CRISPR gRNA sequence
agatccaaaactaccctgct

SEQ ID NO: 800624 - DNA, 20 bp, Artificial
  CRISPR gRNA sequence
gatccaaaactaccctgctg

SEQ ID NO: 800625 - DNA, 20 bp, Artificial
  CRISPR gRNA sequence
ccctgctgactgctgagata

SEQ ID NO: 800626 - DNA, 20 bp, Artificial
  CRISPR gRNA sequence
ctgactgctgagataaacaa

SEQ ID NO: 800627 - DNA, 20 bp, Artificial
  CRISPR gRNA sequence
actgctgagataaacaaagg

SEQ ID NO: 800628 - DNA, 20 bp, Artificial
  CRISPR gRNA sequence
ctgagataaacaaaggagaa

SEQ ID NO: 800629 - DNA, 20 bp, Artificial
  CRISPR gRNA sequence
agataaacaaaggagaataa

SEQ ID NO: 800630 - DNA, 20 bp, Artificial
  CRISPR gRNA sequence
gggaaaggatttctatgcga

SEQ ID NO: 800631 - DNA, 20 bp, Artificial
  CRISPR gRNA sequence
ctatgcgaagacatgtctcc

SEQ ID NO: 800632 - DNA, 20 bp, Artificial
  CRISPR gRNA sequence
tatgcgaagacatgtctcca

SEQ ID NO: 800633 - DNA, 20 bp, Artificial
  CRISPR gRNA sequence
tgcgaagacatgtctccatg

SEQ ID NO: 800634 - DNA, 20 bp, Artificial
  CRISPR gRNA sequence
catgcagtcctcctacactg

SEQ ID NO: 800635 - DNA, 20 bp, Artificial
  CRISPR gRNA sequence
ctacactgagcagagcatga

SEQ ID NO: 800636 - DNA, 20 bp, Artificial
  CRISPR gRNA sequence
cactgagcagagcatgagtc

SEQ ID NO: 800637 - DNA, 20 bp, Artificial
  CRISPR gRNA sequence
agcagagcatgagtcaggtg

SEQ ID NO: 800638 - DNA, 20 bp, Artificial
  CRISPR gRNA sequence
agagcaggattttgtcctaa

SEQ ID NO: 800639 - DNA, 20 bp, Artificial
  CRISPR gRNA sequence
gagcaggattttgtcctaaa

SEQ ID NO: 800640 - DNA, 20 bp, Artificial
  CRISPR gRNA sequence
tgtcctaaaccaggaacttc

SEQ ID NO: 800641 - DNA, 20 bp, Artificial
  CRISPR gRNA sequence
gtcctaaaccaggaacttca

SEQ ID NO: 800642 - DNA, 20 bp, Artificial
  CRISPR gRNA sequence
tcctaaaccaggaacttcag

SEQ ID NO: 800643 - DNA, 20 bp, Artificial
  CRISPR gRNA sequence
aaccaggaacttcagagttt

SEQ ID NO: 800644 - DNA, 20 bp, Artificial
  CRISPR gRNA sequence
cagagttttctgaagaatgt

SEQ ID NO: 800645 - DNA, 20 bp, Artificial
  CRISPR gRNA sequence
agagttttctgaagaatgtg

SEQ ID NO: 800646 - DNA, 20 bp, Artificial
  CRISPR gRNA sequence
tctgaagaatgtggctatgt

SEQ ID NO: 800647 - DNA, 20 bp, Artificial
  CRISPR gRNA sequence
ctgaagaatgtggctatgta

SEQ ID NO: 800648 - DNA, 20 bp, Artificial
  CRISPR gRNA sequence
tgaagaatgtggctatgtaa

SEQ ID NO: 800649 - DNA, 20 bp, Artificial
  CRISPR gRNA sequence
aagaatgtggctatgtaaag

SEQ ID NO: 800650 - DNA, 20 bp, Artificial
  CRISPR gRNA sequence
tgtaaagcacccccccaccc

SEQ ID NO: 800651 - DNA, 20 bp, Artificial
  CRISPR gRNA sequence
acttctcaagtacattacgt

SEQ ID NO: 800652 - DNA, 20 bp, Artificial
  CRISPR gRNA sequence
cttctcaagtacattacgtg

SEQ ID NO: 800653 - DNA, 20 bp, Artificial
  CRISPR gRNA sequence
ctcaagtacattacgtggca

SEQ ID NO: 800654 - DNA, 20 bp, Artificial
  CRISPR gRNA sequence
tcaagtacattacgtggcaa

SEQ ID NO: 800655 - DNA, 20 bp, Artificial
  CRISPR gRNA sequence
aagtacattacgtggcaagt

SEQ ID NO: 800656 - DNA, 20 bp, Artificial
  CRISPR gRNA sequence
cgtggcaagtctgaaaaaac

SEQ ID NO: 800657 - DNA, 20 bp, Artificial
  CRISPR gRNA sequence
aaaaaacttacacttctgtt

SEQ ID NO: 800658 - DNA, 20 bp, Artificial
  CRISPR gRNA sequence
acacttctgttgttaaatgt

SEQ ID NO: 800659 - DNA, 20 bp, Artificial
  CRISPR gRNA sequence
cacttctgttgttaaatgtg

SEQ ID NO: 800660 - DNA, 20 bp, Artificial
  CRISPR gRNA sequence
ctgttgttaaatgtggggga

SEQ ID NO: 800661 - DNA, 20 bp, Artificial
  CRISPR gRNA sequence
tgttgttaaatgtgggggat

SEQ ID NO: 800662 - DNA, 20 bp, Artificial
  CRISPR gRNA sequence
ttgttaaatgtgggggataa

SEQ ID NO: 800663 - DNA, 20 bp, Artificial
  CRISPR gRNA sequence
ttaaatgtgggggataaaat

SEQ ID NO: 800664 - DNA, 20 bp, Artificial
  CRISPR gRNA sequence
aatgtgggggataaaatata

SEQ ID NO: 800665 - DNA, 20 bp, Artificial
  CRISPR gRNA sequence
agtttcaagaggaagctatc

SEQ ID NO: 800666 - DNA, 20 bp, Artificial
  CRISPR gRNA sequence
gtttcaagaggaagctatct

SEQ ID NO: 800667 - DNA, 20 bp, Artificial
  CRISPR gRNA sequence
caagaggaagctatcttggg

SEQ ID NO: 800668 - DNA, 20 bp, Artificial
  CRISPR gRNA sequence
aagaggaagctatcttggga

SEQ ID NO: 800669 - DNA, 20 bp, Artificial
  CRISPR gRNA sequence
tcttgggaggtaatgcaaat

SEQ ID NO: 800670 - DNA, 20 bp, Artificial
  CRISPR gRNA sequence
gggaggtaatgcaaataatt

SEQ ID NO: 800671 - DNA, 20 bp, Artificial
  CRISPR gRNA sequence
ggaggtaatgcaaataattc

SEQ ID NO: 800672 - DNA, 20 bp, Artificial
  CRISPR gRNA sequence
gttgtgtgtttcctgaataa

SEQ ID NO: 800673 - DNA, 20 bp, Artificial
  CRISPR gRNA sequence
tgtgtttcctgaataagtga

SEQ ID NO: 800674 - DNA, 20 bp, Artificial
  CRISPR gRNA sequence
cctgaataagtgacaggtgc

SEQ ID NO: 800675 - DNA, 20 bp, Artificial
  CRISPR gRNA sequence
ctgaataagtgacaggtgct

SEQ ID NO: 800676 - DNA, 20 bp, Artificial
  CRISPR gRNA sequence
aataagtgacaggtgctgac

SEQ ID NO: 800677 - DNA, 20 bp, Artificial
  CRISPR gRNA sequence
actaccattgatgcttcatt

SEQ ID NO: 800678 - DNA, 20 bp, Artificial
  CRISPR gRNA sequence
ccattgatgcttcattgcaa

SEQ ID NO: 800679 - DNA, 20 bp, Artificial
  CRISPR gRNA sequence
atgcttcattgcaataaaat

SEQ ID NO: 800680 - DNA, 20 bp, Artificial
  CRISPR gRNA sequence
cattgcaataaaatgcaaag

SEQ ID NO: 800681 - DNA, 20 bp, Artificial
  CRISPR gRNA sequence
attgcaataaaatgcaaagc

SEQ ID NO: 800682 - DNA, 20 bp, Artificial
  CRISPR gRNA sequence
caataaaatgcaaagctccc

SEQ ID NO: 800683 - DNA, 20 bp, Artificial
  CRISPR gRNA sequence
ccccaagaatttttgaaatg

SEQ ID NO: 800684 - DNA, 20 bp, Artificial
  CRISPR gRNA sequence
ttgaaatgcatcaagctagg

SEQ ID NO: 800685 - DNA, 20 bp, Artificial
  CRISPR gRNA sequence
tgaaatgcatcaagctaggt

SEQ ID NO: 800686 - DNA, 20 bp, Artificial
  CRISPR gRNA sequence
gaaatgcatcaagctaggtg

SEQ ID NO: 800687 - DNA, 20 bp, Artificial
  CRISPR gRNA sequence
aaatgcatcaagctaggtgt

SEQ ID NO: 800688 - DNA, 20 bp, Artificial
  CRISPR gRNA sequence
ggtgttctaatctagcaaaa

SEQ ID NO: 800689 - DNA, 20 bp, Artificial
  CRISPR gRNA sequence
taatctagcaaaaggacctg

SEQ ID NO: 800690 - DNA, 20 bp, Artificial
  CRISPR gRNA sequence
atctagcaaaaggacctgca

SEQ ID NO: 800691 - DNA, 20 bp, Artificial
  CRISPR gRNA sequence
gcaaaaggacctgcatacat

SEQ ID NO: 800692 - DNA, 20 bp, Artificial
  CRISPR gRNA sequence
catacatgaatttttcatgc

SEQ ID NO: 800693 - DNA, 20 bp, Artificial
  CRISPR gRNA sequence
ttcatgcttttgccaagtct

SEQ ID NO: 800694 - DNA, 20 bp, Artificial
  CRISPR gRNA sequence
tcatgcttttgccaagtctt

SEQ ID NO: 800695 - DNA, 20 bp, Artificial
  CRISPR gRNA sequence
catgcttttgccaagtcttt

SEQ ID NO: 800696 - DNA, 20 bp, Artificial
  CRISPR gRNA sequence
atgcttttgccaagtctttt

SEQ ID NO: 800697 - DNA, 20 bp, Artificial
  CRISPR gRNA sequence
ttgccaagtcttttgccctt

SEQ ID NO: 800698 - DNA, 20 bp, Artificial
  CRISPR gRNA sequence
tgccaagtcttttgcccttt

SEQ ID NO: 800699 - DNA, 20 bp, Artificial
  CRISPR gRNA sequence
gccaagtcttttgcccttta

SEQ ID NO: 800700 - DNA, 20 bp, Artificial
  CRISPR gRNA sequence
ccaagtcttttgccctttag

SEQ ID NO: 800701 - DNA, 20 bp, Artificial
  CRISPR gRNA sequence
ttgccctttagtttagttaa

SEQ ID NO: 800702 - DNA, 20 bp, Artificial
  CRISPR gRNA sequence
tgccctttagtttagttaag

SEQ ID NO: 800703 - DNA, 20 bp, Artificial
  CRISPR gRNA sequence
gccctttagtttagttaagg

SEQ ID NO: 800704 - DNA, 20 bp, Artificial
  CRISPR gRNA sequence
ccctttagtttagttaaggg

SEQ ID NO: 800705 - DNA, 20 bp, Artificial
  CRISPR gRNA sequence
tagtttagttaagggcccca

SEQ ID NO: 800706 - DNA, 20 bp, Artificial
  CRISPR gRNA sequence
agtttagttaagggccccac

SEQ ID NO: 800707 - DNA, 20 bp, Artificial
  CRISPR gRNA sequence
gtttagttaagggccccaca

SEQ ID NO: 800708 - DNA, 20 bp, Artificial
  CRISPR gRNA sequence
agttaagggccccacatgaa

SEQ ID NO: 800709 - DNA, 20 bp, Artificial
  CRISPR gRNA sequence
gttaagggccccacatgaat

SEQ ID NO: 800710 - DNA, 20 bp, Artificial
  CRISPR gRNA sequence
agggccccacatgaatggaa

SEQ ID NO: 800711 - DNA, 20 bp, Artificial
  CRISPR gRNA sequence
tgttgtcagcttaattttgt

SEQ ID NO: 800712 - DNA, 20 bp, Artificial
  CRISPR gRNA sequence
tcagcttaattttgtagttg

SEQ ID NO: 800713 - DNA, 20 bp, Artificial
  CRISPR gRNA sequence
aattttgtagttgtggaaac

SEQ ID NO: 800714 - DNA, 20 bp, Artificial
  CRISPR gRNA sequence
attttgtagttgtggaaacc

SEQ ID NO: 800715 - DNA, 20 bp, Artificial
  CRISPR gRNA sequence
tgtagttgtggaaaccttcc

SEQ ID NO: 800716 - DNA, 20 bp, Artificial
  CRISPR gRNA sequence
gtagttgtggaaaccttcca

SEQ ID NO: 800717 - DNA, 20 bp, Artificial
  CRISPR gRNA sequence
tagttgtggaaaccttccag

SEQ ID NO: 800718 - DNA, 20 bp, Artificial
  CRISPR gRNA sequence
tggaaaccttccagttttct

SEQ ID NO: 800719 - DNA, 20 bp, Artificial
  CRISPR gRNA sequence
ccagttttctcctttgtcta

SEQ ID NO: 800720 - DNA, 20 bp, Artificial
  CRISPR gRNA sequence
cagttttctcctttgtctaa

SEQ ID NO: 800721 - DNA, 20 bp, Artificial
  CRISPR gRNA sequence
tctcctttgtctaatacctt

SEQ ID NO: 800722 - DNA, 20 bp, Artificial
  CRISPR gRNA sequence
ctcctttgtctaataccttc

SEQ ID NO: 800723 - DNA, 20 bp, Artificial
  CRISPR gRNA sequence
tcctttgtctaataccttca

SEQ ID NO: 800724 - DNA, 20 bp, Artificial
  CRISPR gRNA sequence
ctttgtctaataccttcagg

SEQ ID NO: 800725 - DNA, 20 bp, Artificial
  CRISPR gRNA sequence
tgtctaataccttcaggagt

SEQ ID NO: 800726 - DNA, 20 bp, Artificial
  CRISPR gRNA sequence
gtctaataccttcaggagtt

SEQ ID NO: 800727 - DNA, 20 bp, Artificial
  CRISPR gRNA sequence
tctaataccttcaggagttc

SEQ ID NO: 800728 - DNA, 20 bp, Artificial
  CRISPR gRNA sequence
ataccttcaggagttcaatc

SEQ ID NO: 800729 - DNA, 20 bp, Artificial
  CRISPR gRNA sequence
caggagttcaatcctaggtt

SEQ ID NO: 800730 - DNA, 20 bp, Artificial
  CRISPR gRNA sequence
aggagttcaatcctaggttg

SEQ ID NO: 800731 - DNA, 20 bp, Artificial
  CRISPR gRNA sequence
aatcctaggttgaagcttaa

SEQ ID NO: 800732 - DNA, 20 bp, Artificial
  CRISPR gRNA sequence
ggttgaagcttaatttaata

SEQ ID NO: 800733 - DNA, 20 bp, Artificial
  CRISPR gRNA sequence
aagcttaatttaataaccat

SEQ ID NO: 800734 - DNA, 20 bp, Artificial
  CRISPR gRNA sequence
aatttaataaccatgtggca

SEQ ID NO: 800735 - DNA, 20 bp, Artificial
  CRISPR gRNA sequence
atttaataaccatgtggcat

SEQ ID NO: 800736 - DNA, 20 bp, Artificial
  CRISPR gRNA sequence
aataaccatgtggcatgtaa

SEQ ID NO: 800737 - DNA, 20 bp, Artificial
  CRISPR gRNA sequence
ataaccatgtggcatgtaaa

SEQ ID NO: 800738 - DNA, 20 bp, Artificial
  CRISPR gRNA sequence
ttccttagcatacagcaaaa

SEQ ID NO: 800739 - DNA, 20 bp, Artificial
  CRISPR gRNA sequence
tccttagcatacagcaaaaa

SEQ ID NO: 800740 - DNA, 20 bp, Artificial
  CRISPR gRNA sequence
ccttagcatacagcaaaaaa

SEQ ID NO: 800741 - DNA, 20 bp, Artificial
  CRISPR gRNA sequence
cttagcatacagcaaaaaaa

SEQ ID NO: 800742 - DNA, 20 bp, Artificial
  CRISPR gRNA sequence
agcatacagcaaaaaaaaaa

SEQ ID NO: 800743 - DNA, 20 bp, Artificial
  CRISPR gRNA sequence
gcatacagcaaaaaaaaaaa

SEQ ID NO: 800744 - DNA, 20 bp, Artificial
  CRISPR gRNA sequence
actcatggatgtagtgtaca

SEQ ID NO: 800745 - DNA, 20 bp, Artificial
  CRISPR gRNA sequence
atggatgtagtgtacacatg

SEQ ID NO: 800746 - DNA, 20 bp, Artificial
  CRISPR gRNA sequence
cagtcattggtagcacagaa

SEQ ID NO: 800747 - DNA, 20 bp, Artificial
  CRISPR gRNA sequence
gtagcacagaaataaatgtg

SEQ ID NO: 800748 - DNA, 20 bp, Artificial
  CRISPR gRNA sequence
aagacacagagatgaatttg

SEQ ID NO: 800749 - DNA, 20 bp, Artificial
  CRISPR gRNA sequence
gaattccggttccatgagct

SEQ ID NO: 800750 - DNA, 20 bp, Artificial
  CRISPR gRNA sequence
aattccggttccatgagcta

SEQ ID NO: 800751 - DNA, 20 bp, Artificial
  CRISPR gRNA sequence
cggttccatgagctaccatt

SEQ ID NO: 800752 - DNA, 20 bp, Artificial
  CRISPR gRNA sequence
catgagctaccattctttga

SEQ ID NO: 800753 - DNA, 20 bp, Artificial
  CRISPR gRNA sequence
ccattctttgaccttgggca

SEQ ID NO: 800754 - DNA, 20 bp, Artificial
  CRISPR gRNA sequence
tttgaccttgggcaagttgc

SEQ ID NO: 800755 - DNA, 20 bp, Artificial
  CRISPR gRNA sequence
tgaccttgggcaagttgcat

SEQ ID NO: 800756 - DNA, 20 bp, Artificial
  CRISPR gRNA sequence
gaccttgggcaagttgcatc

SEQ ID NO: 800757 - DNA, 20 bp, Artificial
  CRISPR gRNA sequence
accttgggcaagttgcatca

SEQ ID NO: 800758 - DNA, 20 bp, Artificial
  CRISPR gRNA sequence
gggcaagttgcatcacttct

SEQ ID NO: 800759 - DNA, 20 bp, Artificial
  CRISPR gRNA sequence
ggcaagttgcatcacttctt

SEQ ID NO: 800760 - DNA, 20 bp, Artificial
  CRISPR gRNA sequence
catcacttctttgagcctca

SEQ ID NO: 800761 - DNA, 20 bp, Artificial
  CRISPR gRNA sequence
ctttgagcctcagtttcccc

SEQ ID NO: 800762 - DNA, 20 bp, Artificial
  CRISPR gRNA sequence
tttgagcctcagtttcccca

SEQ ID NO: 800763 - DNA, 20 bp, Artificial
  CRISPR gRNA sequence
tgagcctcagtttccccatc

SEQ ID NO: 800764 - DNA, 20 bp, Artificial
  CRISPR gRNA sequence
gagcctcagtttccccatct

SEQ ID NO: 800765 - DNA, 20 bp, Artificial
  CRISPR gRNA sequence
agcctcagtttccccatctg

SEQ ID NO: 800766 - DNA, 20 bp, Artificial
  CRISPR gRNA sequence
agtttccccatctgtaaaat

SEQ ID NO: 800767 - DNA, 20 bp, Artificial
  CRISPR gRNA sequence
ccccatctgtaaaatgtgga

SEQ ID NO: 800768 - DNA, 20 bp, Artificial
  CRISPR gRNA sequence
cccatctgtaaaatgtggat

SEQ ID NO: 800769 - DNA, 20 bp, Artificial
  CRISPR gRNA sequence
taaaatgtggatagcaacat

SEQ ID NO: 800770 - DNA, 20 bp, Artificial
  CRISPR gRNA sequence
cctcgcagagttgctgggag

SEQ ID NO: 800771 - DNA, 20 bp, Artificial
  CRISPR gRNA sequence
gcagagttgctgggaggatc

SEQ ID NO: 800772 - DNA, 20 bp, Artificial
  CRISPR gRNA sequence
ctgggaggatcagatgaaat

SEQ ID NO: 800773 - DNA, 20 bp, Artificial
  CRISPR gRNA sequence
ggaggatcagatgaaatgat

SEQ ID NO: 800774 - DNA, 20 bp, Artificial
  CRISPR gRNA sequence
gcccagtgtctgacttactg

SEQ ID NO: 800775 - DNA, 20 bp, Artificial
  CRISPR gRNA sequence
acttactgtgtttaagaaat

SEQ ID NO: 800776 - DNA, 20 bp, Artificial
  CRISPR gRNA sequence
actgtgtttaagaaatatca

SEQ ID NO: 800777 - DNA, 20 bp, Artificial
  CRISPR gRNA sequence
ctgtgtttaagaaatatcaa

SEQ ID NO: 800778 - DNA, 20 bp, Artificial
  CRISPR gRNA sequence
tgtttaagaaatatcaacta

SEQ ID NO: 800779 - DNA, 20 bp, Artificial
  CRISPR gRNA sequence
aagaaatatcaactattacg

SEQ ID NO: 800780 - DNA, 20 bp, Artificial
  CRISPR gRNA sequence
agaaatatcaactattacgc

SEQ ID NO: 800781 - DNA, 20 bp, Artificial
  CRISPR gRNA sequence
ttacgctacttcccagtgac

SEQ ID NO: 800782 - DNA, 20 bp, Artificial
  CRISPR gRNA sequence
cgctacttcccagtgacagt

SEQ ID NO: 800783 - DNA, 20 bp, Artificial
  CRISPR gRNA sequence
cttcccagtgacagtccaaa

SEQ ID NO: 800784 - DNA, 20 bp, Artificial
  CRISPR gRNA sequence
cccagtgacagtccaaatgc

SEQ ID NO: 800785 - DNA, 20 bp, Artificial
  CRISPR gRNA sequence
ccagtgacagtccaaatgca

SEQ ID NO: 800786 - DNA, 20 bp, Artificial
  CRISPR gRNA sequence
taactctacttctcaaacat

SEQ ID NO: 800787 - DNA, 20 bp, Artificial
  CRISPR gRNA sequence
tacttctcaaacattaatgt

SEQ ID NO: 800788 - DNA, 20 bp, Artificial
  CRISPR gRNA sequence
cttctcaaacattaatgtgc

SEQ ID NO: 800789 - DNA, 20 bp, Artificial
  CRISPR gRNA sequence
ctcaaacattaatgtgcatg

SEQ ID NO: 800790 - DNA, 20 bp, Artificial
  CRISPR gRNA sequence
tcaaacattaatgtgcatgc

SEQ ID NO: 800791 - DNA, 20 bp, Artificial
  CRISPR gRNA sequence
aaacattaatgtgcatgcaa

SEQ ID NO: 800792 - DNA, 20 bp, Artificial
  CRISPR gRNA sequence
atgtgcatgcaaatcaccgt

SEQ ID NO: 800793 - DNA, 20 bp, Artificial
  CRISPR gRNA sequence
cttaaaatgcagatcctgat

SEQ ID NO: 800794 - DNA, 20 bp, Artificial
  CRISPR gRNA sequence
ttaaaatgcagatcctgatt

SEQ ID NO: 800795 - DNA, 20 bp, Artificial
  CRISPR gRNA sequence
aaaatgcagatcctgattcc

SEQ ID NO: 800796 - DNA, 20 bp, Artificial
  CRISPR gRNA sequence
aaatgcagatcctgattccc

SEQ ID NO: 800797 - DNA, 20 bp, Artificial
  CRISPR gRNA sequence
attccctaggtctggggaag

SEQ ID NO: 800798 - DNA, 20 bp, Artificial
  CRISPR gRNA sequence
cctaggtctggggaaggctt

SEQ ID NO: 800799 - DNA, 20 bp, Artificial
  CRISPR gRNA sequence
ggtctggggaaggcttgaaa

SEQ ID NO: 800800 - DNA, 20 bp, Artificial
  CRISPR gRNA sequence
gggaaggcttgaaattctac

SEQ ID NO: 800801 - DNA, 20 bp, Artificial
  CRISPR gRNA sequence
gaaattctacatttctacct

SEQ ID NO: 800802 - DNA, 20 bp, Artificial
  CRISPR gRNA sequence
aaattctacatttctaccta

SEQ ID NO: 800803 - DNA, 20 bp, Artificial
  CRISPR gRNA sequence
tacatttctacctagcttcc

SEQ ID NO: 800804 - DNA, 20 bp, Artificial
  CRISPR gRNA sequence
catttctacctagcttccag

SEQ ID NO: 800805 - DNA, 20 bp, Artificial
  CRISPR gRNA sequence
ctacctagcttccaggtgaa

SEQ ID NO: 800806 - DNA, 20 bp, Artificial
  CRISPR gRNA sequence
tacctagcttccaggtgaag

SEQ ID NO: 800807 - DNA, 20 bp, Artificial
  CRISPR gRNA sequence
cctagcttccaggtgaagtt

SEQ ID NO: 800808 - DNA, 20 bp, Artificial
  CRISPR gRNA sequence
gcttccaggtgaagttgagg

SEQ ID NO: 800809 - DNA, 20 bp, Artificial
  CRISPR gRNA sequence
ccaggtgaagttgaggacaa

SEQ ID NO: 800810 - DNA, 20 bp, Artificial
  CRISPR gRNA sequence
caggtgaagttgaggacaac

SEQ ID NO: 800811 - DNA, 20 bp, Artificial
  CRISPR gRNA sequence
aggacaacactttgaaggca

SEQ ID NO: 800812 - DNA, 20 bp, Artificial
  CRISPR gRNA sequence
tgaaggcaaggtggtaaaag

SEQ ID NO: 800813 - DNA, 20 bp, Artificial
  CRISPR gRNA sequence
gaaggcaaggtggtaaaaga

SEQ ID NO: 800814 - DNA, 20 bp, Artificial
  CRISPR gRNA sequence
aaggcaaggtggtaaaagac

SEQ ID NO: 800815 - DNA, 20 bp, Artificial
  CRISPR gRNA sequence
gcacgtgcaaatgttacttt

SEQ ID NO: 800816 - DNA, 20 bp, Artificial
  CRISPR gRNA sequence
cacgtgcaaatgttactttg

SEQ ID NO: 800817 - DNA, 20 bp, Artificial
  CRISPR gRNA sequence
ctttgtgtaactaatggttc

SEQ ID NO: 800818 - DNA, 20 bp, Artificial
  CRISPR gRNA sequence
tgtgtaactaatggttcgca

SEQ ID NO: 800819 - DNA, 20 bp, Artificial
  CRISPR gRNA sequence
gtgtaactaatggttcgcaa

SEQ ID NO: 800820 - DNA, 20 bp, Artificial
  CRISPR gRNA sequence
tgtaactaatggttcgcaat

SEQ ID NO: 800821 - DNA, 20 bp, Artificial
  CRISPR gRNA sequence
atggttcgcaatactgtctg

SEQ ID NO: 800822 - DNA, 20 bp, Artificial
  CRISPR gRNA sequence
gcaatactgtctgcacttta

SEQ ID NO: 800823 - DNA, 20 bp, Artificial
  CRISPR gRNA sequence
tctgcactttagaagctccc

SEQ ID NO: 800824 - DNA, 20 bp, Artificial
  CRISPR gRNA sequence
cactttagaagctcccagga

SEQ ID NO: 800825 - DNA, 20 bp, Artificial
  CRISPR gRNA sequence
tagaagctcccaggaaaaga

SEQ ID NO: 800826 - DNA, 20 bp, Artificial
  CRISPR gRNA sequence
agaagctcccaggaaaagaa

SEQ ID NO: 800827 - DNA, 20 bp, Artificial
  CRISPR gRNA sequence
gaagctcccaggaaaagaaa

SEQ ID NO: 800828 - DNA, 20 bp, Artificial
  CRISPR gRNA sequence
ccaggaaaagaaaatcttta

SEQ ID NO: 800829 - DNA, 20 bp, Artificial
  CRISPR gRNA sequence
taatgatgctgacctcatct

SEQ ID NO: 800830 - DNA, 20 bp, Artificial
  CRISPR gRNA sequence
aatgatgctgacctcatctc

SEQ ID NO: 800831 - DNA, 20 bp, Artificial
  CRISPR gRNA sequence
atgatgctgacctcatctcc

SEQ ID NO: 800832 - DNA, 20 bp, Artificial
  CRISPR gRNA sequence
acctcatctccaaaataatg

SEQ ID NO: 800833 - DNA, 20 bp, Artificial
  CRISPR gRNA sequence
atctccaaaataatgtaatt

SEQ ID NO: 800834 - DNA, 20 bp, Artificial
  CRISPR gRNA sequence
caaaataatgtaattttaac

SEQ ID NO: 800835 - DNA, 20 bp, Artificial
  CRISPR gRNA sequence
taacagatccaaagtagtgc

SEQ ID NO: 800836 - DNA, 20 bp, Artificial
  CRISPR gRNA sequence
aacagatccaaagtagtgcc

SEQ ID NO: 800837 - DNA, 20 bp, Artificial
  CRISPR gRNA sequence
acagatccaaagtagtgcct

SEQ ID NO: 800838 - DNA, 20 bp, Artificial
  CRISPR gRNA sequence
ggcattagtgtgttttaaaa

SEQ ID NO: 800839 - DNA, 20 bp, Artificial
  CRISPR gRNA sequence
gtgtgttttaaaagcctccc

SEQ ID NO: 800840 - DNA, 20 bp, Artificial
  CRISPR gRNA sequence
taaaagcctcccaggtgatt

SEQ ID NO: 800841 - DNA, 20 bp, Artificial
  CRISPR gRNA sequence
aaaagcctcccaggtgattc

SEQ ID NO: 800842 - DNA, 20 bp, Artificial
  CRISPR gRNA sequence
aaagcctcccaggtgattcc

SEQ ID NO: 800843 - DNA, 20 bp, Artificial
  CRISPR gRNA sequence
ccaggtgattccaatgttag

SEQ ID NO: 800844 - DNA, 20 bp, Artificial
  CRISPR gRNA sequence
caatgttagccaagattgag

SEQ ID NO: 800845 - DNA, 20 bp, Artificial
  CRISPR gRNA sequence
gccaagattgaggccctctg

SEQ ID NO: 800846 - DNA, 20 bp, Artificial
  CRISPR gRNA sequence
aggccctctgcttagtgaat

SEQ ID NO: 800847 - DNA, 20 bp, Artificial
  CRISPR gRNA sequence
tgcttagtgaatctaatttg

SEQ ID NO: 800848 - DNA, 20 bp, Artificial
  CRISPR gRNA sequence
cttagtgaatctaatttgca

SEQ ID NO: 800849 - DNA, 20 bp, Artificial
  CRISPR gRNA sequence
agtgaatctaatttgcagct

SEQ ID NO: 800850 - DNA, 20 bp, Artificial
  CRISPR gRNA sequence
gtgaatctaatttgcagctg

SEQ ID NO: 800851 - DNA, 20 bp, Artificial
  CRISPR gRNA sequence
atttgcagctgggcttgaga

SEQ ID NO: 800852 - DNA, 20 bp, Artificial
  CRISPR gRNA sequence
gcagctgggcttgagaaaaa

SEQ ID NO: 800853 - DNA, 20 bp, Artificial
  CRISPR gRNA sequence
cagctgggcttgagaaaaaa

SEQ ID NO: 800854 - DNA, 20 bp, Artificial
  CRISPR gRNA sequence
ggcttgagaaaaaacctctt

SEQ ID NO: 800855 - DNA, 20 bp, Artificial
  CRISPR gRNA sequence
gagaaaaaacctcttcatag

SEQ ID NO: 800856 - DNA, 20 bp, Artificial
  CRISPR gRNA sequence
agaaaaaacctcttcataga

SEQ ID NO: 800857 - DNA, 20 bp, Artificial
  CRISPR gRNA sequence
ttcatagaattgtttgcatc

SEQ ID NO: 800858 - DNA, 20 bp, Artificial
  CRISPR gRNA sequence
catagaattgtttgcatcag

SEQ ID NO: 800859 - DNA, 20 bp, Artificial
  CRISPR gRNA sequence
atagaattgtttgcatcagt

SEQ ID NO: 800860 - DNA, 20 bp, Artificial
  CRISPR gRNA sequence
tttgcatcagtgtcttgatt

SEQ ID NO: 800861 - DNA, 20 bp, Artificial
  CRISPR gRNA sequence
gcatcagtgtcttgattgcc

SEQ ID NO: 800862 - DNA, 20 bp, Artificial
  CRISPR gRNA sequence
catcagtgtcttgattgcct

SEQ ID NO: 800863 - DNA, 20 bp, Artificial
  CRISPR gRNA sequence
gattgcctctgtaacttaca

SEQ ID NO: 800864 - DNA, 20 bp, Artificial
  CRISPR gRNA sequence
attgcctctgtaacttacaa

SEQ ID NO: 800865 - DNA, 20 bp, Artificial
  CRISPR gRNA sequence
cctctgtaacttacaataag

SEQ ID NO: 800866 - DNA, 20 bp, Artificial
  CRISPR gRNA sequence
tgtaacttacaataagcaag

SEQ ID NO: 800867 - DNA, 20 bp, Artificial
  CRISPR gRNA sequence
taacttacaataagcaagaa

SEQ ID NO: 800868 - DNA, 20 bp, Artificial
  CRISPR gRNA sequence
acaataagcaagaatgtttc

SEQ ID NO: 800869 - DNA, 20 bp, Artificial
  CRISPR gRNA sequence
caataagcaagaatgtttca

SEQ ID NO: 800870 - DNA, 20 bp, Artificial
  CRISPR gRNA sequence
caggatttcaaaaatctatt

SEQ ID NO: 800871 - DNA, 20 bp, Artificial
  CRISPR gRNA sequence
aggatttcaaaaatctattg

SEQ ID NO: 800872 - DNA, 20 bp, Artificial
  CRISPR gRNA sequence
caaaaatctattgcattgcc

SEQ ID NO: 800873 - DNA, 20 bp, Artificial
  CRISPR gRNA sequence
aaaaatctattgcattgcct

SEQ ID NO: 800874 - DNA, 20 bp, Artificial
  CRISPR gRNA sequence
ttgcattgcctaaacctctt

SEQ ID NO: 800875 - DNA, 20 bp, Artificial
  CRISPR gRNA sequence
cattgcctaaacctcttatt

SEQ ID NO: 800876 - DNA, 20 bp, Artificial
  CRISPR gRNA sequence
cctaaacctcttattttgta

SEQ ID NO: 800877 - DNA, 20 bp, Artificial
  CRISPR gRNA sequence
aacctcttattttgtatgga

SEQ ID NO: 800878 - DNA, 20 bp, Artificial
  CRISPR gRNA sequence
ttattttgtatggagtaatc

SEQ ID NO: 800879 - DNA, 20 bp, Artificial
  CRISPR gRNA sequence
attttgtatggagtaatcaa

SEQ ID NO: 800880 - DNA, 20 bp, Artificial
  CRISPR gRNA sequence
ttttgtatggagtaatcaag

SEQ ID NO: 800881 - DNA, 20 bp, Artificial
  CRISPR gRNA sequence
tgtatggagtaatcaagctc

SEQ ID NO: 800882 - DNA, 20 bp, Artificial
  CRISPR gRNA sequence
gtatggagtaatcaagctca

SEQ ID NO: 800883 - DNA, 20 bp, Artificial
  CRISPR gRNA sequence
tatggagtaatcaagctcaa

SEQ ID NO: 800884 - DNA, 20 bp, Artificial
  CRISPR gRNA sequence
aaagtttgcatgtcttagaa

SEQ ID NO: 800885 - DNA, 20 bp, Artificial
  CRISPR gRNA sequence
gcatgtcttagaaactttac

SEQ ID NO: 800886 - DNA, 20 bp, Artificial
  CRISPR gRNA sequence
catgtcttagaaactttact

SEQ ID NO: 800887 - DNA, 20 bp, Artificial
  CRISPR gRNA sequence
agaaactttacttggggcaa

SEQ ID NO: 800888 - DNA, 20 bp, Artificial
  CRISPR gRNA sequence
gaaactttacttggggcaaa

SEQ ID NO: 800889 - DNA, 20 bp, Artificial
  CRISPR gRNA sequence
tacttggggcaaaattagac

SEQ ID NO: 800890 - DNA, 20 bp, Artificial
  CRISPR gRNA sequence
acttggggcaaaattagacc

SEQ ID NO: 800891 - DNA, 20 bp, Artificial
  CRISPR gRNA sequence
cttggggcaaaattagacca

SEQ ID NO: 800892 - DNA, 20 bp, Artificial
  CRISPR gRNA sequence
ggggcaaaattagaccaagt

SEQ ID NO: 800893 - DNA, 20 bp, Artificial
  CRISPR gRNA sequence
gggcaaaattagaccaagta

SEQ ID NO: 800894 - DNA, 20 bp, Artificial
  CRISPR gRNA sequence
gaccaagtaacaattaatct

SEQ ID NO: 800895 - DNA, 20 bp, Artificial
  CRISPR gRNA sequence
atcttctaggtattctgagc

SEQ ID NO: 800896 - DNA, 20 bp, Artificial
  CRISPR gRNA sequence
ctaggtattctgagctattc

SEQ ID NO: 800897 - DNA, 20 bp, Artificial
  CRISPR gRNA sequence
taggtattctgagctattca

SEQ ID NO: 800898 - DNA, 20 bp, Artificial
  CRISPR gRNA sequence
ggtattctgagctattcaga

SEQ ID NO: 800899 - DNA, 20 bp, Artificial
  CRISPR gRNA sequence
tgagctattcagacatatga

SEQ ID NO: 800900 - DNA, 20 bp, Artificial
  CRISPR gRNA sequence
agctattcagacatatgatt

SEQ ID NO: 800901 - DNA, 20 bp, Artificial
  CRISPR gRNA sequence
ttcagacatatgattcatgt

SEQ ID NO: 800902 - DNA, 20 bp, Artificial
  CRISPR gRNA sequence
agacatatgattcatgtttg

SEQ ID NO: 800903 - DNA, 20 bp, Artificial
  CRISPR gRNA sequence
atgtttgctaattgctcttt

SEQ ID NO: 800904 - DNA, 20 bp, Artificial
  CRISPR gRNA sequence
gctaattgctcttttctctt

SEQ ID NO: 800905 - DNA, 20 bp, Artificial
  CRISPR gRNA sequence
ctaattgctcttttctcttg

SEQ ID NO: 800906 - DNA, 20 bp, Artificial
  CRISPR gRNA sequence
attgctcttttctcttgtaa

SEQ ID NO: 800907 - DNA, 20 bp, Artificial
  CRISPR gRNA sequence
ctcttttctcttgtaaatat

SEQ ID NO: 800908 - DNA, 20 bp, Artificial
  CRISPR gRNA sequence
ttttctcttgtaaatattag

SEQ ID NO: 800909 - DNA, 20 bp, Artificial
  CRISPR gRNA sequence
ttctcttgtaaatattagct

SEQ ID NO: 800910 - DNA, 20 bp, Artificial
  CRISPR gRNA sequence
tctcttgtaaatattagctg

SEQ ID NO: 800911 - DNA, 20 bp, Artificial
  CRISPR gRNA sequence
ctcttgtaaatattagctga

SEQ ID NO: 800912 - DNA, 20 bp, Artificial
  CRISPR gRNA sequence
tcttgtaaatattagctgaa

SEQ ID NO: 800913 - DNA, 20 bp, Artificial
  CRISPR gRNA sequence
ttgtaaatattagctgaaaa

SEQ ID NO: 800914 - DNA, 20 bp, Artificial
  CRISPR gRNA sequence
gtaaatattagctgaaaaat

SEQ ID NO: 800915 - DNA, 20 bp, Artificial
  CRISPR gRNA sequence
taaatattagctgaaaaatg

SEQ ID NO: 800916 - DNA, 20 bp, Artificial
  CRISPR gRNA sequence
gctgaaaaatgtcacctgtc

SEQ ID NO: 800917 - DNA, 20 bp, Artificial
  CRISPR gRNA sequence
aaaaatgtcacctgtctgac

SEQ ID NO: 800918 - DNA, 20 bp, Artificial
  CRISPR gRNA sequence
tctgacaagtagcatatttt

SEQ ID NO: 800919 - DNA, 20 bp, Artificial
  CRISPR gRNA sequence
acaagtagcatattttatgc

SEQ ID NO: 800920 - DNA, 20 bp, Artificial
  CRISPR gRNA sequence
tatgcctatcactcctggca

SEQ ID NO: 800921 - DNA, 20 bp, Artificial
  CRISPR gRNA sequence
atgcctatcactcctggcac

SEQ ID NO: 800922 - DNA, 20 bp, Artificial
  CRISPR gRNA sequence
tgcctatcactcctggcacg

SEQ ID NO: 800923 - DNA, 20 bp, Artificial
  CRISPR gRNA sequence
tcactcctggcacgcattct

SEQ ID NO: 800924 - DNA, 20 bp, Artificial
  CRISPR gRNA sequence
ctggcacgcattcttacaag

SEQ ID NO: 800925 - DNA, 20 bp, Artificial
  CRISPR gRNA sequence
gcacgcattcttacaaggca

SEQ ID NO: 800926 - DNA, 20 bp, Artificial
  CRISPR gRNA sequence
ttacaaggcagacaggaaaa

SEQ ID NO: 800927 - DNA, 20 bp, Artificial
  CRISPR gRNA sequence
acaaggcagacaggaaaaat

SEQ ID NO: 800928 - DNA, 20 bp, Artificial
  CRISPR gRNA sequence
caaggcagacaggaaaaata

SEQ ID NO: 800929 - DNA, 20 bp, Artificial
  CRISPR gRNA sequence
ttatcaaaggcccaggcagt

SEQ ID NO: 800930 - DNA, 20 bp, Artificial
  CRISPR gRNA sequence
tatcaaaggcccaggcagta

SEQ ID NO: 800931 - DNA, 20 bp, Artificial
  CRISPR gRNA sequence
atcaaaggcccaggcagtaa

SEQ ID NO: 800932 - DNA, 20 bp, Artificial
  CRISPR gRNA sequence
tcaaaggcccaggcagtaaa

SEQ ID NO: 800933 - DNA, 20 bp, Artificial
  CRISPR gRNA sequence
tgctgtaagctaaggggagt

SEQ ID NO: 800934 - DNA, 20 bp, Artificial
  CRISPR gRNA sequence
ctgtaagctaaggggagttc

SEQ ID NO: 800935 - DNA, 20 bp, Artificial
  CRISPR gRNA sequence
taagctaaggggagttccag

SEQ ID NO: 800936 - DNA, 20 bp, Artificial
  CRISPR gRNA sequence
aggggagttccagaggaagt

SEQ ID NO: 800937 - DNA, 20 bp, Artificial
  CRISPR gRNA sequence
cagaggaagttataggcgtt

SEQ ID NO: 800938 - DNA, 20 bp, Artificial
  CRISPR gRNA sequence
taggcgttccctttcttatg

SEQ ID NO: 800939 - DNA, 20 bp, Artificial
  CRISPR gRNA sequence
cctttcttatgacaagaaag

SEQ ID NO: 800940 - DNA, 20 bp, Artificial
  CRISPR gRNA sequence
tcttatgacaagaaagcata

SEQ ID NO: 800941 - DNA, 20 bp, Artificial
  CRISPR gRNA sequence
cttatgacaagaaagcatag

SEQ ID NO: 800942 - DNA, 20 bp, Artificial
  CRISPR gRNA sequence
ttatgacaagaaagcatagt

SEQ ID NO: 800943 - DNA, 20 bp, Artificial
  CRISPR gRNA sequence
atgacaagaaagcatagtgc

SEQ ID NO: 800944 - DNA, 20 bp, Artificial
  CRISPR gRNA sequence
tgacaagaaagcatagtgca

SEQ ID NO: 800945 - DNA, 20 bp, Artificial
  CRISPR gRNA sequence
gctaaatagattcaacagtc

SEQ ID NO: 800946 - DNA, 20 bp, Artificial
  CRISPR gRNA sequence
ctaaatagattcaacagtct

SEQ ID NO: 800947 - DNA, 20 bp, Artificial
  CRISPR gRNA sequence
aatagattcaacagtctcta

SEQ ID NO: 800948 - DNA, 20 bp, Artificial
  CRISPR gRNA sequence
aacagtctctacccaaagtc

SEQ ID NO: 800949 - DNA, 20 bp, Artificial
  CRISPR gRNA sequence
tacccaaagtcatctattta

SEQ ID NO: 800950 - DNA, 20 bp, Artificial
  CRISPR gRNA sequence
cccaaagtcatctatttaat

SEQ ID NO: 800951 - DNA, 20 bp, Artificial
  CRISPR gRNA sequence
tttaattcttgttgttatgc

SEQ ID NO: 800952 - DNA, 20 bp, Artificial
  CRISPR gRNA sequence
aattcttgttgttatgcaga

SEQ ID NO: 800953 - DNA, 20 bp, Artificial
  CRISPR gRNA sequence
attcttgttgttatgcagac

SEQ ID NO: 800954 - DNA, 20 bp, Artificial
  CRISPR gRNA sequence
ttgttgttatgcagactcag

SEQ ID NO: 800955 - DNA, 20 bp, Artificial
  CRISPR gRNA sequence
gttgttatgcagactcagca

SEQ ID NO: 800956 - DNA, 20 bp, Artificial
  CRISPR gRNA sequence
ttgttatgcagactcagcaa

SEQ ID NO: 800957 - DNA, 20 bp, Artificial
  CRISPR gRNA sequence
ttatgcagactcagcaacta

SEQ ID NO: 800958 - DNA, 20 bp, Artificial
  CRISPR gRNA sequence
tgcagactcagcaactaacc

SEQ ID NO: 800959 - DNA, 20 bp, Artificial
  CRISPR gRNA sequence
agcaactaaccttccttgta

SEQ ID NO: 800960 - DNA, 20 bp, Artificial
  CRISPR gRNA sequence
accttccttgtaagccccat

SEQ ID NO: 800961 - DNA, 20 bp, Artificial
  CRISPR gRNA sequence
ccttgtaagccccattttct

SEQ ID NO: 800962 - DNA, 20 bp, Artificial
  CRISPR gRNA sequence
cttgtaagccccattttctt

SEQ ID NO: 800963 - DNA, 20 bp, Artificial
  CRISPR gRNA sequence
gtaagccccattttcttccc

SEQ ID NO: 800964 - DNA, 20 bp, Artificial
  CRISPR gRNA sequence
taagccccattttcttccct

SEQ ID NO: 800965 - DNA, 20 bp, Artificial
  CRISPR gRNA sequence
tcttccctgtttcctgttta

SEQ ID NO: 800966 - DNA, 20 bp, Artificial
  CRISPR gRNA sequence
cttccctgtttcctgtttat

SEQ ID NO: 800967 - DNA, 20 bp, Artificial
  CRISPR gRNA sequence
ttccctgtttcctgtttatc

SEQ ID NO: 800968 - DNA, 20 bp, Artificial
  CRISPR gRNA sequence
ccctgtttcctgtttatcaa

SEQ ID NO: 800969 - DNA, 20 bp, Artificial
  CRISPR gRNA sequence
cctgtttcctgtttatcaaa

SEQ ID NO: 800970 - DNA, 20 bp, Artificial
  CRISPR gRNA sequence
tttcctgtttatcaaatgta

SEQ ID NO: 800971 - DNA, 20 bp, Artificial
  CRISPR gRNA sequence
cctgtttatcaaatgtaatt

SEQ ID NO: 800972 - DNA, 20 bp, Artificial
  CRISPR gRNA sequence
ctgtttatcaaatgtaatta

SEQ ID NO: 800973 - DNA, 20 bp, Artificial
  CRISPR gRNA sequence
tttatcaaatgtaattaaac

SEQ ID NO: 800974 - DNA, 20 bp, Artificial
  CRISPR gRNA sequence
atcaaatgtaattaaacaag

SEQ ID NO: 800975 - DNA, 20 bp, Artificial
  CRISPR gRNA sequence
tcaaatgtaattaaacaaga

SEQ ID NO: 800976 - DNA, 20 bp, Artificial
  CRISPR gRNA sequence
aacaagagaagtattataga

SEQ ID NO: 800977 - DNA, 20 bp, Artificial
  CRISPR gRNA sequence
tagaagagtaaaagtagtag

SEQ ID NO: 800978 - DNA, 20 bp, Artificial
  CRISPR gRNA sequence
ttgaacttggcatatgatta

SEQ ID NO: 800979 - DNA, 20 bp, Artificial
  CRISPR gRNA sequence
gaacttggcatatgattact

SEQ ID NO: 800980 - DNA, 20 bp, Artificial
  CRISPR gRNA sequence
aacttggcatatgattacta

SEQ ID NO: 800981 - DNA, 20 bp, Artificial
  CRISPR gRNA sequence
ggcatatgattactacatat

SEQ ID NO: 800982 - DNA, 20 bp, Artificial
  CRISPR gRNA sequence
gcatatgattactacatatt

SEQ ID NO: 800983 - DNA, 20 bp, Artificial
  CRISPR gRNA sequence
ctacatatttgatgaatagt

SEQ ID NO: 800984 - DNA, 20 bp, Artificial
  CRISPR gRNA sequence
catatttgatgaatagttga

SEQ ID NO: 800985 - DNA, 20 bp, Artificial
  CRISPR gRNA sequence
gatgaatagttgaatattat

SEQ ID NO: 800986 - DNA, 20 bp, Artificial
  CRISPR gRNA sequence
atgaatagttgaatattatt

SEQ ID NO: 800987 - DNA, 20 bp, Artificial
  CRISPR gRNA sequence
aatattattcttcaaggaca

SEQ ID NO: 800988 - DNA, 20 bp, Artificial
  CRISPR gRNA sequence
ttcttcaaggacagattgga

SEQ ID NO: 800989 - DNA, 20 bp, Artificial
  CRISPR gRNA sequence
ttcaaggacagattggattt

SEQ ID NO: 800990 - DNA, 20 bp, Artificial
  CRISPR gRNA sequence
caaggacagattggatttgg

SEQ ID NO: 800991 - DNA, 20 bp, Artificial
  CRISPR gRNA sequence
aaggacagattggatttggt

SEQ ID NO: 800992 - DNA, 20 bp, Artificial
  CRISPR gRNA sequence
gatttggtatcaggtggctc

SEQ ID NO: 800993 - DNA, 20 bp, Artificial
  CRISPR gRNA sequence
ggtatcaggtggctctgcat

SEQ ID NO: 800994 - DNA, 20 bp, Artificial
  CRISPR gRNA sequence
gtatcaggtggctctgcatt

SEQ ID NO: 800995 - DNA, 20 bp, Artificial
  CRISPR gRNA sequence
tgcattaagttataagggac

SEQ ID NO: 800996 - DNA, 20 bp, Artificial
  CRISPR gRNA sequence
cattaagttataagggactt

SEQ ID NO: 800997 - DNA, 20 bp, Artificial
  CRISPR gRNA sequence
agttataagggacttaataa

SEQ ID NO: 800998 - DNA, 20 bp, Artificial
  CRISPR gRNA sequence
taagggacttaataactcaa

SEQ ID NO: 800999 - DNA, 20 bp, Artificial
  CRISPR gRNA sequence
aataactcaagtatttaagg

SEQ ID NO: 801000 - DNA, 20 bp, Artificial
  CRISPR gRNA sequence
ataactcaagtatttaagga

SEQ ID NO: 801001 - DNA, 20 bp, Artificial
  CRISPR gRNA sequence
aagtatttaaggacggcttc

SEQ ID NO: 801002 - DNA, 20 bp, Artificial
  CRISPR gRNA sequence
aaggacggcttccatcataa

SEQ ID NO: 801003 - DNA, 20 bp, Artificial
  CRISPR gRNA sequence
aggacggcttccatcataaa

SEQ ID NO: 801004 - DNA, 20 bp, Artificial
  CRISPR gRNA sequence
ccatcataaagggatctgcc

SEQ ID NO: 801005 - DNA, 20 bp, Artificial
  CRISPR gRNA sequence
catcataaagggatctgccc

SEQ ID NO: 801006 - DNA, 20 bp, Artificial
  CRISPR gRNA sequence
cccttaagagggtcccatta

SEQ ID NO: 801007 - DNA, 20 bp, Artificial
  CRISPR gRNA sequence
aagagggtcccattatggag

SEQ ID NO: 801008 - DNA, 20 bp, Artificial
  CRISPR gRNA sequence
agagggtcccattatggaga

SEQ ID NO: 801009 - DNA, 20 bp, Artificial
  CRISPR gRNA sequence
tggagattctgaggtgagag

SEQ ID NO: 801010 - DNA, 20 bp, Artificial
  CRISPR gRNA sequence
tgaggtgagagctattccaa

SEQ ID NO: 801011 - DNA, 20 bp, Artificial
  CRISPR gRNA sequence
aggtgagagctattccaagt

SEQ ID NO: 801012 - DNA, 20 bp, Artificial
  CRISPR gRNA sequence
ttccaagtgtgcagtggatt

SEQ ID NO: 801013 - DNA, 20 bp, Artificial
  CRISPR gRNA sequence
caagtgtgcagtggattaaa

SEQ ID NO: 801014 - DNA, 20 bp, Artificial
  CRISPR gRNA sequence
aaataaaagaatcatacagg

SEQ ID NO: 801015 - DNA, 20 bp, Artificial
  CRISPR gRNA sequence
tttttacatgccttattcca

SEQ ID NO: 801016 - DNA, 20 bp, Artificial
  CRISPR gRNA sequence
tttacatgccttattccagg

SEQ ID NO: 801017 - DNA, 20 bp, Artificial
  CRISPR gRNA sequence
ttacatgccttattccaggg

SEQ ID NO: 801018 - DNA, 20 bp, Artificial
  CRISPR gRNA sequence
tacatgccttattccagggt

SEQ ID NO: 801019 - DNA, 20 bp, Artificial
  CRISPR gRNA sequence
acatgccttattccagggtc

SEQ ID NO: 801020 - DNA, 20 bp, Artificial
  CRISPR gRNA sequence
catgccttattccagggtct

SEQ ID NO: 801021 - DNA, 20 bp, Artificial
  CRISPR gRNA sequence
attccagggtctttgcaacc

SEQ ID NO: 801022 - DNA, 20 bp, Artificial
  CRISPR gRNA sequence
ttccagggtctttgcaacct

SEQ ID NO: 801023 - DNA, 20 bp, Artificial
  CRISPR gRNA sequence
cagggtctttgcaacctggc

SEQ ID NO: 801024 - DNA, 20 bp, Artificial
  CRISPR gRNA sequence
tgcaacctggcacagcaagt

SEQ ID NO: 801025 - DNA, 20 bp, Artificial
  CRISPR gRNA sequence
gcaacctggcacagcaagtg

SEQ ID NO: 801026 - DNA, 20 bp, Artificial
  CRISPR gRNA sequence
caacctggcacagcaagtgc

SEQ ID NO: 801027 - DNA, 20 bp, Artificial
  CRISPR gRNA sequence
gcacagcaagtgcagatatg

SEQ ID NO: 801028 - DNA, 20 bp, Artificial
  CRISPR gRNA sequence
gcattgttttacacatgtac

SEQ ID NO: 801029 - DNA, 20 bp, Artificial
  CRISPR gRNA sequence
ttttacacatgtacactcac

SEQ ID NO: 801030 - DNA, 20 bp, Artificial
  CRISPR gRNA sequence
tacacatgtacactcacctt

SEQ ID NO: 801031 - DNA, 20 bp, Artificial
  CRISPR gRNA sequence
acacatgtacactcacctta

SEQ ID NO: 801032 - DNA, 20 bp, Artificial
  CRISPR gRNA sequence
cacatgtacactcaccttat

SEQ ID NO: 801033 - DNA, 20 bp, Artificial
  CRISPR gRNA sequence
accttatagccctgcccctg

SEQ ID NO: 801034 - DNA, 20 bp, Artificial
  CRISPR gRNA sequence
atagccctgcccctgtgccc

SEQ ID NO: 801035 - DNA, 20 bp, Artificial
  CRISPR gRNA sequence
tagccctgcccctgtgcccc

SEQ ID NO: 801036 - DNA, 20 bp, Artificial
  CRISPR gRNA sequence
cccctgtgcccctcctgcac

SEQ ID NO: 801037 - DNA, 20 bp, Artificial
  CRISPR gRNA sequence
tgcccctcctgcacaaaaga

SEQ ID NO: 801038 - DNA, 20 bp, Artificial
  CRISPR gRNA sequence
ctgcacaaaagaatgctggg

SEQ ID NO: 801039 - DNA, 20 bp, Artificial
  CRISPR gRNA sequence
cacaaaagaatgctgggcac

SEQ ID NO: 801040 - DNA, 20 bp, Artificial
  CRISPR gRNA sequence
ggcacacgtgaactcctctc

SEQ ID NO: 801041 - DNA, 20 bp, Artificial
  CRISPR gRNA sequence
ctctctgtagaaaggcacat

SEQ ID NO: 801042 - DNA, 20 bp, Artificial
  CRISPR gRNA sequence
tctgtagaaaggcacattaa

SEQ ID NO: 801043 - DNA, 20 bp, Artificial
  CRISPR gRNA sequence
tgtagaaaggcacattaatg

SEQ ID NO: 801044 - DNA, 20 bp, Artificial
  CRISPR gRNA sequence
tagaaaggcacattaatgtt

SEQ ID NO: 801045 - DNA, 20 bp, Artificial
  CRISPR gRNA sequence
atgttctagccatggttaaa

SEQ ID NO: 801046 - DNA, 20 bp, Artificial
  CRISPR gRNA sequence
tagccatggttaaaacaggg

SEQ ID NO: 801047 - DNA, 20 bp, Artificial
  CRISPR gRNA sequence
gccatggttaaaacagggat

SEQ ID NO: 801048 - DNA, 20 bp, Artificial
  CRISPR gRNA sequence
aaacagggatagaggcaagc

SEQ ID NO: 801049 - DNA, 20 bp, Artificial
  CRISPR gRNA sequence
gaaataaatctcaagtttgt

SEQ ID NO: 801050 - DNA, 20 bp, Artificial
  CRISPR gRNA sequence
aaataaatctcaagtttgtg

SEQ ID NO: 801051 - DNA, 20 bp, Artificial
  CRISPR gRNA sequence
aagtttgtgcatatcactat

SEQ ID NO: 801052 - DNA, 20 bp, Artificial
  CRISPR gRNA sequence
gtgcatatcactatcaagtg

SEQ ID NO: 801053 - DNA, 20 bp, Artificial
  CRISPR gRNA sequence
tgcatatcactatcaagtgt

SEQ ID NO: 801054 - DNA, 20 bp, Artificial
  CRISPR gRNA sequence
tcaagtgtgctgtgtggcaa

SEQ ID NO: 801055 - DNA, 20 bp, Artificial
  CRISPR gRNA sequence
tgtggcaattaagaatgcca

SEQ ID NO: 801056 - DNA, 20 bp, Artificial
  CRISPR gRNA sequence
agaatgccaatttgtgtgat

SEQ ID NO: 801057 - DNA, 20 bp, Artificial
  CRISPR gRNA sequence
gtgtgatcacaggcaagttg

SEQ ID NO: 801058 - DNA, 20 bp, Artificial
  CRISPR gRNA sequence
tgtgatcacaggcaagttgc

SEQ ID NO: 801059 - DNA, 20 bp, Artificial
  CRISPR gRNA sequence
cagtttgatgaaaggaaagc

SEQ ID NO: 801060 - DNA, 20 bp, Artificial
  CRISPR gRNA sequence
gatgaaaggaaagcagaggt

SEQ ID NO: 801061 - DNA, 20 bp, Artificial
  CRISPR gRNA sequence
atgaaaggaaagcagaggtg

SEQ ID NO: 801062 - DNA, 20 bp, Artificial
  CRISPR gRNA sequence
tctttctccctctctctctt

SEQ ID NO: 801063 - DNA, 20 bp, Artificial
  CRISPR gRNA sequence
ctttctccctctctctcttt

SEQ ID NO: 801064 - DNA, 20 bp, Artificial
  CRISPR gRNA sequence
tttctccctctctctctttc

SEQ ID NO: 801065 - DNA, 20 bp, Artificial
  CRISPR gRNA sequence
tctccctctctctctttctg

SEQ ID NO: 801066 - DNA, 20 bp, Artificial
  CRISPR gRNA sequence
ctccctctctctctttctgt

SEQ ID NO: 801067 - DNA, 20 bp, Artificial
  CRISPR gRNA sequence
tccctctctctctttctgtc

SEQ ID NO: 801068 - DNA, 20 bp, Artificial
  CRISPR gRNA sequence
cctctctctctttctgtcat

SEQ ID NO: 801069 - DNA, 20 bp, Artificial
  CRISPR gRNA sequence
tctctctttctgtcatttat

SEQ ID NO: 801070 - DNA, 20 bp, Artificial
  CRISPR gRNA sequence
tctctttctgtcatttattt

SEQ ID NO: 801071 - DNA, 20 bp, Artificial
  CRISPR gRNA sequence
tctttctgtcatttatttgc

SEQ ID NO: 801072 - DNA, 20 bp, Artificial
  CRISPR gRNA sequence
tttctgtcatttatttgcca

SEQ ID NO: 801073 - DNA, 20 bp, Artificial
  CRISPR gRNA sequence
tctgtcatttatttgccaag

SEQ ID NO: 801074 - DNA, 20 bp, Artificial
  CRISPR gRNA sequence
ctgtcatttatttgccaagc

SEQ ID NO: 801075 - DNA, 20 bp, Artificial
  CRISPR gRNA sequence
tgtcatttatttgccaagct

SEQ ID NO: 801076 - DNA, 20 bp, Artificial
  CRISPR gRNA sequence
tcatttatttgccaagctct

SEQ ID NO: 801077 - DNA, 20 bp, Artificial
  CRISPR gRNA sequence
atttgccaagctcttaacta

SEQ ID NO: 801078 - DNA, 20 bp, Artificial
  CRISPR gRNA sequence
tttgccaagctcttaactag

SEQ ID NO: 801079 - DNA, 20 bp, Artificial
  CRISPR gRNA sequence
gccaagctcttaactagaac

SEQ ID NO: 801080 - DNA, 20 bp, Artificial
  CRISPR gRNA sequence
ccaagctcttaactagaact

SEQ ID NO: 801081 - DNA, 20 bp, Artificial
  CRISPR gRNA sequence
ttaactagaacttgctatgt

SEQ ID NO: 801082 - DNA, 20 bp, Artificial
  CRISPR gRNA sequence
aactagaacttgctatgtgc

SEQ ID NO: 801083 - DNA, 20 bp, Artificial
  CRISPR gRNA sequence
actagaacttgctatgtgct

SEQ ID NO: 801084 - DNA, 20 bp, Artificial
  CRISPR gRNA sequence
gaacttgctatgtgctaggt

SEQ ID NO: 801085 - DNA, 20 bp, Artificial
  CRISPR gRNA sequence
gctatgtgctaggtactgga

SEQ ID NO: 801086 - DNA, 20 bp, Artificial
  CRISPR gRNA sequence
ctatgtgctaggtactggat

SEQ ID NO: 801087 - DNA, 20 bp, Artificial
  CRISPR gRNA sequence
tgtgctaggtactggatata

SEQ ID NO: 801088 - DNA, 20 bp, Artificial
  CRISPR gRNA sequence
ggtactggatatatcaaagc

SEQ ID NO: 801089 - DNA, 20 bp, Artificial
  CRISPR gRNA sequence
gatatatcaaagcaaactca

SEQ ID NO: 801090 - DNA, 20 bp, Artificial
  CRISPR gRNA sequence
agcctggtctttgccttcaa

SEQ ID NO: 801091 - DNA, 20 bp, Artificial
  CRISPR gRNA sequence
gtctttgccttcaaagattt

SEQ ID NO: 801092 - DNA, 20 bp, Artificial
  CRISPR gRNA sequence
tgccttcaaagatttgcagg

SEQ ID NO: 801093 - DNA, 20 bp, Artificial
  CRISPR gRNA sequence
gccttcaaagatttgcagga

SEQ ID NO: 801094 - DNA, 20 bp, Artificial
  CRISPR gRNA sequence
ccttcaaagatttgcaggat

SEQ ID NO: 801095 - DNA, 20 bp, Artificial
  CRISPR gRNA sequence
caaagatttgcaggatagtg

SEQ ID NO: 801096 - DNA, 20 bp, Artificial
  CRISPR gRNA sequence
aaagatttgcaggatagtgg

SEQ ID NO: 801097 - DNA, 20 bp, Artificial
  CRISPR gRNA sequence
gcaggatagtgggaagaaaa

SEQ ID NO: 801098 - DNA, 20 bp, Artificial
  CRISPR gRNA sequence
caggatagtgggaagaaaaa

SEQ ID NO: 801099 - DNA, 20 bp, Artificial
  CRISPR gRNA sequence
gaatcagaggacatctgcag

SEQ ID NO: 801100 - DNA, 20 bp, Artificial
  CRISPR gRNA sequence
aatcagaggacatctgcagt

SEQ ID NO: 801101 - DNA, 20 bp, Artificial
  CRISPR gRNA sequence
cagtgggaatcattcaagca

SEQ ID NO: 801102 - DNA, 20 bp, Artificial
  CRISPR gRNA sequence
aagcagcagaaaacccaaaa

SEQ ID NO: 801103 - DNA, 20 bp, Artificial
  CRISPR gRNA sequence
cttatactgtgaaatctgat

SEQ ID NO: 801104 - DNA, 20 bp, Artificial
  CRISPR gRNA sequence
atactgtgaaatctgatcag

SEQ ID NO: 801105 - DNA, 20 bp, Artificial
  CRISPR gRNA sequence
tactgtgaaatctgatcaga

SEQ ID NO: 801106 - DNA, 20 bp, Artificial
  CRISPR gRNA sequence
tgaaatctgatcagagaatg

SEQ ID NO: 801107 - DNA, 20 bp, Artificial
  CRISPR gRNA sequence
atcagagaatggactgtcct

SEQ ID NO: 801108 - DNA, 20 bp, Artificial
  CRISPR gRNA sequence
tcctggttagtaaaatatcc

SEQ ID NO: 801109 - DNA, 20 bp, Artificial
  CRISPR gRNA sequence
gttagtaaaatatcctggag

SEQ ID NO: 801110 - DNA, 20 bp, Artificial
  CRISPR gRNA sequence
gtaaaatatcctggaggata

SEQ ID NO: 801111 - DNA, 20 bp, Artificial
  CRISPR gRNA sequence
gaggataaagattggccatg

SEQ ID NO: 801112 - DNA, 20 bp, Artificial
  CRISPR gRNA sequence
gccatgcattccacatatga

SEQ ID NO: 801113 - DNA, 20 bp, Artificial
  CRISPR gRNA sequence
cacatatgaattaccacttt

SEQ ID NO: 801114 - DNA, 20 bp, Artificial
  CRISPR gRNA sequence
ccactttcccaagaattaaa

SEQ ID NO: 801115 - DNA, 20 bp, Artificial
  CRISPR gRNA sequence
tcccaagaattaaaacatgg

SEQ ID NO: 801116 - DNA, 20 bp, Artificial
  CRISPR gRNA sequence
cccaagaattaaaacatggt

SEQ ID NO: 801117 - DNA, 20 bp, Artificial
  CRISPR gRNA sequence
ccaagaattaaaacatggta

SEQ ID NO: 801118 - DNA, 20 bp, Artificial
  CRISPR gRNA sequence
aaacatggtacgaaagaaag

SEQ ID NO: 801119 - DNA, 20 bp, Artificial
  CRISPR gRNA sequence
gctgagtgcctactgcctgc

SEQ ID NO: 801120 - DNA, 20 bp, Artificial
  CRISPR gRNA sequence
ctgagtgcctactgcctgcc

SEQ ID NO: 801121 - DNA, 20 bp, Artificial
  CRISPR gRNA sequence
agtgcctactgcctgccaga

SEQ ID NO: 801122 - DNA, 20 bp, Artificial
  CRISPR gRNA sequence
ctgcctgccagatctaggca

SEQ ID NO: 801123 - DNA, 20 bp, Artificial
  CRISPR gRNA sequence
cctgccagatctaggcactt

SEQ ID NO: 801124 - DNA, 20 bp, Artificial
  CRISPR gRNA sequence
ccagatctaggcacttcaca

SEQ ID NO: 801125 - DNA, 20 bp, Artificial
  CRISPR gRNA sequence
ggcacttcacatgtaacacc

SEQ ID NO: 801126 - DNA, 20 bp, Artificial
  CRISPR gRNA sequence
cacatgtaacacctcgtcca

SEQ ID NO: 801127 - DNA, 20 bp, Artificial
  CRISPR gRNA sequence
acatgtaacacctcgtccag

SEQ ID NO: 801128 - DNA, 20 bp, Artificial
  CRISPR gRNA sequence
gtccagcctccaccacaata

SEQ ID NO: 801129 - DNA, 20 bp, Artificial
  CRISPR gRNA sequence
caccacaatactgagaggta

SEQ ID NO: 801130 - DNA, 20 bp, Artificial
  CRISPR gRNA sequence
agaggtagagttcaacctca

SEQ ID NO: 801131 - DNA, 20 bp, Artificial
  CRISPR gRNA sequence
aacctcattttatagataaa

SEQ ID NO: 801132 - DNA, 20 bp, Artificial
  CRISPR gRNA sequence
attttatagataaagaggct

SEQ ID NO: 801133 - DNA, 20 bp, Artificial
  CRISPR gRNA sequence
tatagataaagaggctgaag

SEQ ID NO: 801134 - DNA, 20 bp, Artificial
  CRISPR gRNA sequence
atagataaagaggctgaagc

SEQ ID NO: 801135 - DNA, 20 bp, Artificial
  CRISPR gRNA sequence
tagataaagaggctgaagct

SEQ ID NO: 801136 - DNA, 20 bp, Artificial
  CRISPR gRNA sequence
aagctcataaagattaaagg

SEQ ID NO: 801137 - DNA, 20 bp, Artificial
  CRISPR gRNA sequence
ataaagattaaaggacggac

SEQ ID NO: 801138 - DNA, 20 bp, Artificial
  CRISPR gRNA sequence
aaggacggactcacagtcaa

SEQ ID NO: 801139 - DNA, 20 bp, Artificial
  CRISPR gRNA sequence
acagtcaaaggactcctaat

SEQ ID NO: 801140 - DNA, 20 bp, Artificial
  CRISPR gRNA sequence
ctaatcctgagtcagcattt

SEQ ID NO: 801141 - DNA, 20 bp, Artificial
  CRISPR gRNA sequence
atcctgagtcagcatttgaa

SEQ ID NO: 801142 - DNA, 20 bp, Artificial
  CRISPR gRNA sequence
agtcagcatttgaacccagg

SEQ ID NO: 801143 - DNA, 20 bp, Artificial
  CRISPR gRNA sequence
gaacccaggctcacctgtca

SEQ ID NO: 801144 - DNA, 20 bp, Artificial
  CRISPR gRNA sequence
aacccaggctcacctgtcac

SEQ ID NO: 801145 - DNA, 20 bp, Artificial
  CRISPR gRNA sequence
acctgtcactatatcctatg

SEQ ID NO: 801146 - DNA, 20 bp, Artificial
  CRISPR gRNA sequence
tcactatatcctatgctctt

SEQ ID NO: 801147 - DNA, 20 bp, Artificial
  CRISPR gRNA sequence
tatcctatgctcttccgtat

SEQ ID NO: 801148 - DNA, 20 bp, Artificial
  CRISPR gRNA sequence
tgctcttccgtatcacattt

SEQ ID NO: 801149 - DNA, 20 bp, Artificial
  CRISPR gRNA sequence
ttccgtatcacattttatac

SEQ ID NO: 801150 - DNA, 20 bp, Artificial
  CRISPR gRNA sequence
ccgtatcacattttatactg

SEQ ID NO: 801151 - DNA, 20 bp, Artificial
  CRISPR gRNA sequence
cgtatcacattttatactga

SEQ ID NO: 801152 - DNA, 20 bp, Artificial
  CRISPR gRNA sequence
tatactgaaacaacttctgg

SEQ ID NO: 801153 - DNA, 20 bp, Artificial
  CRISPR gRNA sequence
atactgaaacaacttctgga

SEQ ID NO: 801154 - DNA, 20 bp, Artificial
  CRISPR gRNA sequence
tactgaaacaacttctggaa

SEQ ID NO: 801155 - DNA, 20 bp, Artificial
  CRISPR gRNA sequence
aaacaacttctggaatagct

SEQ ID NO: 801156 - DNA, 20 bp, Artificial
  CRISPR gRNA sequence
ctggaatagctaatgcttag

SEQ ID NO: 801157 - DNA, 20 bp, Artificial
  CRISPR gRNA sequence
tggaatagctaatgcttaga

SEQ ID NO: 801158 - DNA, 20 bp, Artificial
  CRISPR gRNA sequence
gaatagctaatgcttagaag

SEQ ID NO: 801159 - DNA, 20 bp, Artificial
  CRISPR gRNA sequence
atgcttagaagcagctccca

SEQ ID NO: 801160 - DNA, 20 bp, Artificial
  CRISPR gRNA sequence
agaagcagctcccaaatatt

SEQ ID NO: 801161 - DNA, 20 bp, Artificial
  CRISPR gRNA sequence
gaagcagctcccaaatattt

SEQ ID NO: 801162 - DNA, 20 bp, Artificial
  CRISPR gRNA sequence
ccaaatatttgttgaatgaa

SEQ ID NO: 801163 - DNA, 20 bp, Artificial
  CRISPR gRNA sequence
gttgaatgaatgatttgatt

SEQ ID NO: 801164 - DNA, 20 bp, Artificial
  CRISPR gRNA sequence
ttgaatgaatgatttgattg

SEQ ID NO: 801165 - DNA, 20 bp, Artificial
  CRISPR gRNA sequence
aatgaatgatttgattgaat

SEQ ID NO: 801166 - DNA, 20 bp, Artificial
  CRISPR gRNA sequence
gattgaatgaatgaataaat

SEQ ID NO: 801167 - DNA, 20 bp, Artificial
  CRISPR gRNA sequence
attgaatgaatgaataaatg

SEQ ID NO: 801168 - DNA, 20 bp, Artificial
  CRISPR gRNA sequence
aatgaatgaataaatgaatg

SEQ ID NO: 801169 - DNA, 20 bp, Artificial
  CRISPR gRNA sequence
tactgaacataatttgatct

SEQ ID NO: 801170 - DNA, 20 bp, Artificial
  CRISPR gRNA sequence
ctgaacataatttgatctaa

SEQ ID NO: 801171 - DNA, 20 bp, Artificial
  CRISPR gRNA sequence
aacataatttgatctaatct

SEQ ID NO: 801172 - DNA, 20 bp, Artificial
  CRISPR gRNA sequence
gatctaatcttctgtgatta

SEQ ID NO: 801173 - DNA, 20 bp, Artificial
  CRISPR gRNA sequence
atctaatcttctgtgattat

SEQ ID NO: 801174 - DNA, 20 bp, Artificial
  CRISPR gRNA sequence
atcttctgtgattattcaga

SEQ ID NO: 801175 - DNA, 20 bp, Artificial
  CRISPR gRNA sequence
ctgtgattattcagaaacta

SEQ ID NO: 801176 - DNA, 20 bp, Artificial
  CRISPR gRNA sequence
tgtgattattcagaaactac

SEQ ID NO: 801177 - DNA, 20 bp, Artificial
  CRISPR gRNA sequence
tgattattcagaaactactt

SEQ ID NO: 801178 - DNA, 20 bp, Artificial
  CRISPR gRNA sequence
ttcagaaactacttcaagat

SEQ ID NO: 801179 - DNA, 20 bp, Artificial
  CRISPR gRNA sequence
agaaactacttcaagatttt

SEQ ID NO: 801180 - DNA, 20 bp, Artificial
  CRISPR gRNA sequence
cttcaagattttcctatacc

SEQ ID NO: 801181 - DNA, 20 bp, Artificial
  CRISPR gRNA sequence
caagattttcctatacctcc

SEQ ID NO: 801182 - DNA, 20 bp, Artificial
  CRISPR gRNA sequence
aagattttcctatacctcca

SEQ ID NO: 801183 - DNA, 20 bp, Artificial
  CRISPR gRNA sequence
tcctatacctccatcataat

SEQ ID NO: 801184 - DNA, 20 bp, Artificial
  CRISPR gRNA sequence
cctatacctccatcataatg

SEQ ID NO: 801185 - DNA, 20 bp, Artificial
  CRISPR gRNA sequence
ctatacctccatcataatga

SEQ ID NO: 801186 - DNA, 20 bp, Artificial
  CRISPR gRNA sequence
tacctccatcataatgaata

SEQ ID NO: 801187 - DNA, 20 bp, Artificial
  CRISPR gRNA sequence
catcataatgaatacccatt

SEQ ID NO: 801188 - DNA, 20 bp, Artificial
  CRISPR gRNA sequence
attaatgatggaagcagcct

SEQ ID NO: 801189 - DNA, 20 bp, Artificial
  CRISPR gRNA sequence
atgatggaagcagcctaatt

SEQ ID NO: 801190 - DNA, 20 bp, Artificial
  CRISPR gRNA sequence
attttgtcatttttcacact

SEQ ID NO: 801191 - DNA, 20 bp, Artificial
  CRISPR gRNA sequence
tgtcatttttcacactttat

SEQ ID NO: 801192 - DNA, 20 bp, Artificial
  CRISPR gRNA sequence
gtcatttttcacactttatt

SEQ ID NO: 801193 - DNA, 20 bp, Artificial
  CRISPR gRNA sequence
tcatttttcacactttattg

SEQ ID NO: 801194 - DNA, 20 bp, Artificial
  CRISPR gRNA sequence
ttcacactttattgatgtaa

SEQ ID NO: 801195 - DNA, 20 bp, Artificial
  CRISPR gRNA sequence
tcacactttattgatgtaac

SEQ ID NO: 801196 - DNA, 20 bp, Artificial
  CRISPR gRNA sequence
cacactttattgatgtaaca

SEQ ID NO: 801197 - DNA, 20 bp, Artificial
  CRISPR gRNA sequence
acactttattgatgtaacac

SEQ ID NO: 801198 - DNA, 20 bp, Artificial
  CRISPR gRNA sequence
tattgatgtaacactacctt

SEQ ID NO: 801199 - DNA, 20 bp, Artificial
  CRISPR gRNA sequence
attgatgtaacactaccttt

SEQ ID NO: 801200 - DNA, 20 bp, Artificial
  CRISPR gRNA sequence
ttgatgtaacactaccttta

SEQ ID NO: 801201 - DNA, 20 bp, Artificial
  CRISPR gRNA sequence
atgtaacactacctttacta

SEQ ID NO: 801202 - DNA, 20 bp, Artificial
  CRISPR gRNA sequence
cctttactagtttggccact

SEQ ID NO: 801203 - DNA, 20 bp, Artificial
  CRISPR gRNA sequence
tactagtttggccactcctt

SEQ ID NO: 801204 - DNA, 20 bp, Artificial
  CRISPR gRNA sequence
actagtttggccactcctta

SEQ ID NO: 801205 - DNA, 20 bp, Artificial
  CRISPR gRNA sequence
ctagtttggccactccttat

SEQ ID NO: 801206 - DNA, 20 bp, Artificial
  CRISPR gRNA sequence
gtttggccactccttatgct

SEQ ID NO: 801207 - DNA, 20 bp, Artificial
  CRISPR gRNA sequence
ggccactccttatgcttttt

SEQ ID NO: 801208 - DNA, 20 bp, Artificial
  CRISPR gRNA sequence
gccactccttatgctttttt

SEQ ID NO: 801209 - DNA, 20 bp, Artificial
  CRISPR gRNA sequence
cttatgctttttttatagaa

SEQ ID NO: 801210 - DNA, 20 bp, Artificial
  CRISPR gRNA sequence
atgctttttttatagaacta

SEQ ID NO: 801211 - DNA, 20 bp, Artificial
  CRISPR gRNA sequence
tgctttttttatagaactat

SEQ ID NO: 801212 - DNA, 20 bp, Artificial
  CRISPR gRNA sequence
tttttatagaactatttaga

SEQ ID NO: 801213 - DNA, 20 bp, Artificial
  CRISPR gRNA sequence
ttttatagaactatttagat

SEQ ID NO: 801214 - DNA, 20 bp, Artificial
  CRISPR gRNA sequence
tttatagaactatttagatc

SEQ ID NO: 801215 - DNA, 20 bp, Artificial
  CRISPR gRNA sequence
ttatagaactatttagatca

SEQ ID NO: 801216 - DNA, 20 bp, Artificial
  CRISPR gRNA sequence
tatagaactatttagatcaa

SEQ ID NO: 801217 - DNA, 20 bp, Artificial
  CRISPR gRNA sequence
atagaactatttagatcaat

SEQ ID NO: 801218 - DNA, 20 bp, Artificial
  CRISPR gRNA sequence
tagaactatttagatcaatt

SEQ ID NO: 801219 - DNA, 20 bp, Artificial
  CRISPR gRNA sequence
tttagatcaattcaactttt

SEQ ID NO: 801220 - DNA, 20 bp, Artificial
  CRISPR gRNA sequence
agatcaattcaacttttaaa

SEQ ID NO: 801221 - DNA, 20 bp, Artificial
  CRISPR gRNA sequence
gatcaattcaacttttaaaa

SEQ ID NO: 801222 - DNA, 20 bp, Artificial
  CRISPR gRNA sequence
aacttttaaaaaataaagcc

SEQ ID NO: 801223 - DNA, 20 bp, Artificial
  CRISPR gRNA sequence
ttaaaaaataaagccacata

SEQ ID NO: 801224 - DNA, 20 bp, Artificial
  CRISPR gRNA sequence
taaaaaataaagccacatac

SEQ ID NO: 801225 - DNA, 20 bp, Artificial
  CRISPR gRNA sequence
aaaaaataaagccacatacc

SEQ ID NO: 801226 - DNA, 20 bp, Artificial
  CRISPR gRNA sequence
aaaaataaagccacataccc

SEQ ID NO: 801227 - DNA, 20 bp, Artificial
  CRISPR gRNA sequence
tggtagatgaaaaacaagta

SEQ ID NO: 801228 - DNA, 20 bp, Artificial
  CRISPR gRNA sequence
gcactggtaaatagagaata

SEQ ID NO: 801229 - DNA, 20 bp, Artificial
  CRISPR gRNA sequence
cactggtaaatagagaatag

SEQ ID NO: 801230 - DNA, 20 bp, Artificial
  CRISPR gRNA sequence
gtaaatagagaataggaaga

SEQ ID NO: 801231 - DNA, 20 bp, Artificial
  CRISPR gRNA sequence
tcaaatcctacccagatact

SEQ ID NO: 801232 - DNA, 20 bp, Artificial
  CRISPR gRNA sequence
cccagatactgttatctacc

SEQ ID NO: 801233 - DNA, 20 bp, Artificial
  CRISPR gRNA sequence
ttatctacccggaagcttcc

SEQ ID NO: 801234 - DNA, 20 bp, Artificial
  CRISPR gRNA sequence
tctacccggaagcttcctgt

SEQ ID NO: 801235 - DNA, 20 bp, Artificial
  CRISPR gRNA sequence
cccggaagcttcctgtttga

SEQ ID NO: 801236 - DNA, 20 bp, Artificial
  CRISPR gRNA sequence
cctgtttgattaaaaggaaa

SEQ ID NO: 801237 - DNA, 20 bp, Artificial
  CRISPR gRNA sequence
ctgtttgattaaaaggaaaa

SEQ ID NO: 801238 - DNA, 20 bp, Artificial
  CRISPR gRNA sequence
tttgattaaaaggaaaaata

SEQ ID NO: 801239 - DNA, 20 bp, Artificial
  CRISPR gRNA sequence
gattaaaaggaaaaatagcc

SEQ ID NO: 801240 - DNA, 20 bp, Artificial
  CRISPR gRNA sequence
attaaaaggaaaaatagcca

SEQ ID NO: 801241 - DNA, 20 bp, Artificial
  CRISPR gRNA sequence
aaaggaaaaatagccagtgt

SEQ ID NO: 801242 - DNA, 20 bp, Artificial
  CRISPR gRNA sequence
gaggtgtggaagtctagttg

SEQ ID NO: 801243 - DNA, 20 bp, Artificial
  CRISPR gRNA sequence
gttgaaattatatgcaattg

SEQ ID NO: 801244 - DNA, 20 bp, Artificial
  CRISPR gRNA sequence
aaattatatgcaattgaagg

SEQ ID NO: 801245 - DNA, 20 bp, Artificial
  CRISPR gRNA sequence
tatgcaattgaaggattaaa

SEQ ID NO: 801246 - DNA, 20 bp, Artificial
  CRISPR gRNA sequence
aaggattaaaatagaattga

SEQ ID NO: 801247 - DNA, 20 bp, Artificial
  CRISPR gRNA sequence
aaatagaattgaaaagggaa

SEQ ID NO: 801248 - DNA, 20 bp, Artificial
  CRISPR gRNA sequence
aaaagggaataaattcctct

SEQ ID NO: 801249 - DNA, 20 bp, Artificial
  CRISPR gRNA sequence
ctctctgaataatttaactc

SEQ ID NO: 801250 - DNA, 20 bp, Artificial
  CRISPR gRNA sequence
tctgaataatttaactccct

SEQ ID NO: 801251 - DNA, 20 bp, Artificial
  CRISPR gRNA sequence
tgaataatttaactcccttt

SEQ ID NO: 801252 - DNA, 20 bp, Artificial
  CRISPR gRNA sequence
aataatttaactccctttag

SEQ ID NO: 801253 - DNA, 20 bp, Artificial
  CRISPR gRNA sequence
aactccctttaggctttgat

SEQ ID NO: 801254 - DNA, 20 bp, Artificial
  CRISPR gRNA sequence
actccctttaggctttgatt

SEQ ID NO: 801255 - DNA, 20 bp, Artificial
  CRISPR gRNA sequence
cctttaggctttgattctgc

SEQ ID NO: 801256 - DNA, 20 bp, Artificial
  CRISPR gRNA sequence
taggctttgattctgcctca

SEQ ID NO: 801257 - DNA, 20 bp, Artificial
  CRISPR gRNA sequence
aggctttgattctgcctcat

SEQ ID NO: 801258 - DNA, 20 bp, Artificial
  CRISPR gRNA sequence
ggctttgattctgcctcatc

SEQ ID NO: 801259 - DNA, 20 bp, Artificial
  CRISPR gRNA sequence
tgattctgcctcatctaaaa

SEQ ID NO: 801260 - DNA, 20 bp, Artificial
  CRISPR gRNA sequence
gattctgcctcatctaaaat

SEQ ID NO: 801261 - DNA, 20 bp, Artificial
  CRISPR gRNA sequence
attctgcctcatctaaaatc

SEQ ID NO: 801262 - DNA, 20 bp, Artificial
  CRISPR gRNA sequence
tgcctcatctaaaatcatct

SEQ ID NO: 801263 - DNA, 20 bp, Artificial
  CRISPR gRNA sequence
cctcatctaaaatcatctta

SEQ ID NO: 801264 - DNA, 20 bp, Artificial
  CRISPR gRNA sequence
atctaaaatcatcttacata

SEQ ID NO: 801265 - DNA, 20 bp, Artificial
  CRISPR gRNA sequence
aaatcatcttacatacttct

SEQ ID NO: 801266 - DNA, 20 bp, Artificial
  CRISPR gRNA sequence
acatacttctagtggcgtgt

SEQ ID NO: 801267 - DNA, 20 bp, Artificial
  CRISPR gRNA sequence
catacttctagtggcgtgtc

SEQ ID NO: 801268 - DNA, 20 bp, Artificial
  CRISPR gRNA sequence
ctagtggcgtgtccctcaca

SEQ ID NO: 801269 - DNA, 20 bp, Artificial
  CRISPR gRNA sequence
tagtggcgtgtccctcacat

SEQ ID NO: 801270 - DNA, 20 bp, Artificial
  CRISPR gRNA sequence
gtggcgtgtccctcacattt

SEQ ID NO: 801271 - DNA, 20 bp, Artificial
  CRISPR gRNA sequence
acattttggtaaactctgag

SEQ ID NO: 801272 - DNA, 20 bp, Artificial
  CRISPR gRNA sequence
tggtaaactctgagtggaaa

SEQ ID NO: 801273 - DNA, 20 bp, Artificial
  CRISPR gRNA sequence
ggtaaactctgagtggaaac

SEQ ID NO: 801274 - DNA, 20 bp, Artificial
  CRISPR gRNA sequence
gtaaactctgagtggaaact

SEQ ID NO: 801275 - DNA, 20 bp, Artificial
  CRISPR gRNA sequence
tgagtggaaactacggattt

SEQ ID NO: 801276 - DNA, 20 bp, Artificial
  CRISPR gRNA sequence
agtggaaactacggattttg

SEQ ID NO: 801277 - DNA, 20 bp, Artificial
  CRISPR gRNA sequence
cggattttgtagtcaaacat

SEQ ID NO: 801278 - DNA, 20 bp, Artificial
  CRISPR gRNA sequence
tgtagtcaaacatctgactg

SEQ ID NO: 801279 - DNA, 20 bp, Artificial
  CRISPR gRNA sequence
gtagtcaaacatctgactgg

SEQ ID NO: 801280 - DNA, 20 bp, Artificial
  CRISPR gRNA sequence
tagtcaaacatctgactggc

SEQ ID NO: 801281 - DNA, 20 bp, Artificial
  CRISPR gRNA sequence
actggctctggattttaact

SEQ ID NO: 801282 - DNA, 20 bp, Artificial
  CRISPR gRNA sequence
gctctggattttaactttac

SEQ ID NO: 801283 - DNA, 20 bp, Artificial
  CRISPR gRNA sequence
tggattttaactttactaac

SEQ ID NO: 801284 - DNA, 20 bp, Artificial
  CRISPR gRNA sequence
gattttaactttactaacat

SEQ ID NO: 801285 - DNA, 20 bp, Artificial
  CRISPR gRNA sequence
taactttactaacatatgtc

SEQ ID NO: 801286 - DNA, 20 bp, Artificial
  CRISPR gRNA sequence
aactttactaacatatgtcc

SEQ ID NO: 801287 - DNA, 20 bp, Artificial
  CRISPR gRNA sequence
actttactaacatatgtcct

SEQ ID NO: 801288 - DNA, 20 bp, Artificial
  CRISPR gRNA sequence
tactaacatatgtcctgaag

SEQ ID NO: 801289 - DNA, 20 bp, Artificial
  CRISPR gRNA sequence
actaacatatgtcctgaagt

SEQ ID NO: 801290 - DNA, 20 bp, Artificial
  CRISPR gRNA sequence
ctaacatatgtcctgaagtg

SEQ ID NO: 801291 - DNA, 20 bp, Artificial
  CRISPR gRNA sequence
acatatgtcctgaagtgaac

SEQ ID NO: 801292 - DNA, 20 bp, Artificial
  CRISPR gRNA sequence
aagtgaactgcttggagcca

SEQ ID NO: 801293 - DNA, 20 bp, Artificial
  CRISPR gRNA sequence
cttggagccagtttcctcaa

SEQ ID NO: 801294 - DNA, 20 bp, Artificial
  CRISPR gRNA sequence
ggagccagtttcctcaacta

SEQ ID NO: 801295 - DNA, 20 bp, Artificial
  CRISPR gRNA sequence
gagccagtttcctcaactat

SEQ ID NO: 801296 - DNA, 20 bp, Artificial
  CRISPR gRNA sequence
cctcaactatataaccataa

SEQ ID NO: 801297 - DNA, 20 bp, Artificial
  CRISPR gRNA sequence
ctcaactatataaccataat

SEQ ID NO: 801298 - DNA, 20 bp, Artificial
  CRISPR gRNA sequence
aactatataaccataatgac

SEQ ID NO: 801299 - DNA, 20 bp, Artificial
  CRISPR gRNA sequence
tataaccataatgacaaaac

SEQ ID NO: 801300 - DNA, 20 bp, Artificial
  CRISPR gRNA sequence
cacggtcatgttttcagtat

SEQ ID NO: 801301 - DNA, 20 bp, Artificial
  CRISPR gRNA sequence
acggtcatgttttcagtatt

SEQ ID NO: 801302 - DNA, 20 bp, Artificial
  CRISPR gRNA sequence
tcagtattaaacaatatagt

SEQ ID NO: 801303 - DNA, 20 bp, Artificial
  CRISPR gRNA sequence
cagtattaaacaatatagtt

SEQ ID NO: 801304 - DNA, 20 bp, Artificial
  CRISPR gRNA sequence
agtattaaacaatatagtta

SEQ ID NO: 801305 - DNA, 20 bp, Artificial
  CRISPR gRNA sequence
aacaatatagttaaaagtac

SEQ ID NO: 801306 - DNA, 20 bp, Artificial
  CRISPR gRNA sequence
aaagtacctagcacagtgcc

SEQ ID NO: 801307 - DNA, 20 bp, Artificial
  CRISPR gRNA sequence
gcacagtgcctggcatagaa

SEQ ID NO: 801308 - DNA, 20 bp, Artificial
  CRISPR gRNA sequence
gcatagaacatactagatat

SEQ ID NO: 801309 - DNA, 20 bp, Artificial
  CRISPR gRNA sequence
gatatacattaagtatcagt

SEQ ID NO: 801310 - DNA, 20 bp, Artificial
  CRISPR gRNA sequence
agtatcagttccatttttcc

SEQ ID NO: 801311 - DNA, 20 bp, Artificial
  CRISPR gRNA sequence
catttttcctttccctttat

SEQ ID NO: 801312 - DNA, 20 bp, Artificial
  CRISPR gRNA sequence
ttcctttccctttattgtca

SEQ ID NO: 801313 - DNA, 20 bp, Artificial
  CRISPR gRNA sequence
tcctttccctttattgtcag

SEQ ID NO: 801314 - DNA, 20 bp, Artificial
  CRISPR gRNA sequence
cctttccctttattgtcaga

SEQ ID NO: 801315 - DNA, 20 bp, Artificial
  CRISPR gRNA sequence
ctttccctttattgtcagaa

SEQ ID NO: 801316 - DNA, 20 bp, Artificial
  CRISPR gRNA sequence
tccctttattgtcagaaaat

SEQ ID NO: 801317 - DNA, 20 bp, Artificial
  CRISPR gRNA sequence
ccctttattgtcagaaaata

SEQ ID NO: 801318 - DNA, 20 bp, Artificial
  CRISPR gRNA sequence
cctttattgtcagaaaatag

SEQ ID NO: 801319 - DNA, 20 bp, Artificial
  CRISPR gRNA sequence
tattgtcagaaaatagaaag

SEQ ID NO: 801320 - DNA, 20 bp, Artificial
  CRISPR gRNA sequence
attgtcagaaaatagaaagc

SEQ ID NO: 801321 - DNA, 20 bp, Artificial
  CRISPR gRNA sequence
ttgtcagaaaatagaaagca

SEQ ID NO: 801322 - DNA, 20 bp, Artificial
  CRISPR gRNA sequence
tcagaaaatagaaagcatct

SEQ ID NO: 801323 - DNA, 20 bp, Artificial
  CRISPR gRNA sequence
cagtgggcttgtatgatgtg

SEQ ID NO: 801324 - DNA, 20 bp, Artificial
  CRISPR gRNA sequence
gtatgatgtggtggttagaa

SEQ ID NO: 801325 - DNA, 20 bp, Artificial
  CRISPR gRNA sequence
tatgatgtggtggttagaaa

SEQ ID NO: 801326 - DNA, 20 bp, Artificial
  CRISPR gRNA sequence
gaaatacctgatctgattct

SEQ ID NO: 801327 - DNA, 20 bp, Artificial
  CRISPR gRNA sequence
atctgattctggctgtgcaa

SEQ ID NO: 801328 - DNA, 20 bp, Artificial
  CRISPR gRNA sequence
attctggctgtgcaatcttg

SEQ ID NO: 801329 - DNA, 20 bp, Artificial
  CRISPR gRNA sequence
tggctgtgcaatcttgggca

SEQ ID NO: 801330 - DNA, 20 bp, Artificial
  CRISPR gRNA sequence
gctgtgcaatcttgggcaag

SEQ ID NO: 801331 - DNA, 20 bp, Artificial
  CRISPR gRNA sequence
tgcaatcttgggcaagttac

SEQ ID NO: 801332 - DNA, 20 bp, Artificial
  CRISPR gRNA sequence
gggcaagttacttaaccttt

SEQ ID NO: 801333 - DNA, 20 bp, Artificial
  CRISPR gRNA sequence
ggcaagttacttaacctttt

SEQ ID NO: 801334 - DNA, 20 bp, Artificial
  CRISPR gRNA sequence
cttaacctttttgtgcctca

SEQ ID NO: 801335 - DNA, 20 bp, Artificial
  CRISPR gRNA sequence
aacctttttgtgcctcattt

SEQ ID NO: 801336 - DNA, 20 bp, Artificial
  CRISPR gRNA sequence
acctttttgtgcctcatttt

SEQ ID NO: 801337 - DNA, 20 bp, Artificial
  CRISPR gRNA sequence
tttgtgcctcatttttgttt

SEQ ID NO: 801338 - DNA, 20 bp, Artificial
  CRISPR gRNA sequence
ttgtgcctcatttttgtttt

SEQ ID NO: 801339 - DNA, 20 bp, Artificial
  CRISPR gRNA sequence
tgtgcctcatttttgttttc

SEQ ID NO: 801340 - DNA, 20 bp, Artificial
  CRISPR gRNA sequence
gtgcctcatttttgttttct

SEQ ID NO: 801341 - DNA, 20 bp, Artificial
  CRISPR gRNA sequence
tgcctcatttttgttttctg

SEQ ID NO: 801342 - DNA, 20 bp, Artificial
  CRISPR gRNA sequence
atttttgttttctgaaaaaa

SEQ ID NO: 801343 - DNA, 20 bp, Artificial
  CRISPR gRNA sequence
ttgttttctgaaaaaaagga

SEQ ID NO: 801344 - DNA, 20 bp, Artificial
  CRISPR gRNA sequence
tgttttctgaaaaaaaggat

SEQ ID NO: 801345 - DNA, 20 bp, Artificial
  CRISPR gRNA sequence
gttttctgaaaaaaaggata

SEQ ID NO: 801346 - DNA, 20 bp, Artificial
  CRISPR gRNA sequence
ttttctgaaaaaaaggatag

SEQ ID NO: 801347 - DNA, 20 bp, Artificial
  CRISPR gRNA sequence
tctgaaaaaaaggatagaat

SEQ ID NO: 801348 - DNA, 20 bp, Artificial
  CRISPR gRNA sequence
ctgaaaaaaaggatagaata

SEQ ID NO: 801349 - DNA, 20 bp, Artificial
  CRISPR gRNA sequence
tgaaaaaaaggatagaatat

SEQ ID NO: 801350 - DNA, 20 bp, Artificial
  CRISPR gRNA sequence
aaaaaaaggatagaatatta

SEQ ID NO: 801351 - DNA, 20 bp, Artificial
  CRISPR gRNA sequence
ttacctaccttgctggcttc

SEQ ID NO: 801352 - DNA, 20 bp, Artificial
  CRISPR gRNA sequence
cctaccttgctggcttctgg

SEQ ID NO: 801353 - DNA, 20 bp, Artificial
  CRISPR gRNA sequence
ccttgctggcttctgggaag

SEQ ID NO: 801354 - DNA, 20 bp, Artificial
  CRISPR gRNA sequence
gctggcttctgggaagaagc

SEQ ID NO: 801355 - DNA, 20 bp, Artificial
  CRISPR gRNA sequence
ctggcttctgggaagaagct

SEQ ID NO: 801356 - DNA, 20 bp, Artificial
  CRISPR gRNA sequence
gcttctgggaagaagctcag

SEQ ID NO: 801357 - DNA, 20 bp, Artificial
  CRISPR gRNA sequence
ctgggaagaagctcagtgag

SEQ ID NO: 801358 - DNA, 20 bp, Artificial
  CRISPR gRNA sequence
tgggaagaagctcagtgaga

SEQ ID NO: 801359 - DNA, 20 bp, Artificial
  CRISPR gRNA sequence
ggaagaagctcagtgagacg

SEQ ID NO: 801360 - DNA, 20 bp, Artificial
  CRISPR gRNA sequence
agtgagacgatgtgttagca

SEQ ID NO: 801361 - DNA, 20 bp, Artificial
  CRISPR gRNA sequence
gcagagtgtctgacaattgt

SEQ ID NO: 801362 - DNA, 20 bp, Artificial
  CRISPR gRNA sequence
acaattgtaagaattcaaca

SEQ ID NO: 801363 - DNA, 20 bp, Artificial
  CRISPR gRNA sequence
taagaattcaacaagtaata

SEQ ID NO: 801364 - DNA, 20 bp, Artificial
  CRISPR gRNA sequence
aacaagtaatagttattatt

SEQ ID NO: 801365 - DNA, 20 bp, Artificial
  CRISPR gRNA sequence
ttattaccatcactggtgag

SEQ ID NO: 801366 - DNA, 20 bp, Artificial
  CRISPR gRNA sequence
ttaccatcactggtgagagg

SEQ ID NO: 801367 - DNA, 20 bp, Artificial
  CRISPR gRNA sequence
ccatcactggtgagaggaag

SEQ ID NO: 801368 - DNA, 20 bp, Artificial
  CRISPR gRNA sequence
gtgagaggaagtgatacctg

SEQ ID NO: 801369 - DNA, 20 bp, Artificial
  CRISPR gRNA sequence
gcacaaaaatatatggatta

SEQ ID NO: 801370 - DNA, 20 bp, Artificial
  CRISPR gRNA sequence
atcaatatggattgagggaa

SEQ ID NO: 801371 - DNA, 20 bp, Artificial
  CRISPR gRNA sequence
agggaaacaaacctggagaa

SEQ ID NO: 801372 - DNA, 20 bp, Artificial
  CRISPR gRNA sequence
gagaataggatgtgaaggta

SEQ ID NO: 801373 - DNA, 20 bp, Artificial
  CRISPR gRNA sequence
aagtaacatgagctcagacc

SEQ ID NO: 801374 - DNA, 20 bp, Artificial
  CRISPR gRNA sequence
agtaacatgagctcagacct

SEQ ID NO: 801375 - DNA, 20 bp, Artificial
  CRISPR gRNA sequence
agaccttgatggtagggaag

SEQ ID NO: 801376 - DNA, 20 bp, Artificial
  CRISPR gRNA sequence
gatggtagggaagtcgaaag

SEQ ID NO: 801377 - DNA, 20 bp, Artificial
  CRISPR gRNA sequence
atggtagggaagtcgaaagg

SEQ ID NO: 801378 - DNA, 20 bp, Artificial
  CRISPR gRNA sequence
tgttcttatatgacagatga

SEQ ID NO: 801379 - DNA, 20 bp, Artificial
  CRISPR gRNA sequence
gttcttatatgacagatgac

SEQ ID NO: 801380 - DNA, 20 bp, Artificial
  CRISPR gRNA sequence
ttcttatatgacagatgacc

SEQ ID NO: 801381 - DNA, 20 bp, Artificial
  CRISPR gRNA sequence
ttatatgacagatgacctgg

SEQ ID NO: 801382 - DNA, 20 bp, Artificial
  CRISPR gRNA sequence
atatgacagatgacctggaa

SEQ ID NO: 801383 - DNA, 20 bp, Artificial
  CRISPR gRNA sequence
tatgacagatgacctggaat

SEQ ID NO: 801384 - DNA, 20 bp, Artificial
  CRISPR gRNA sequence
gaatgactgcagggcttggg

SEQ ID NO: 801385 - DNA, 20 bp, Artificial
  CRISPR gRNA sequence
cagggcttggggggtcaggg

SEQ ID NO: 801386 - DNA, 20 bp, Artificial
  CRISPR gRNA sequence
ggggggtcagggactggagg

SEQ ID NO: 801387 - DNA, 20 bp, Artificial
  CRISPR gRNA sequence
gggggtcagggactggaggt

SEQ ID NO: 801388 - DNA, 20 bp, Artificial
  CRISPR gRNA sequence
gaggtgggagaggcctctga

SEQ ID NO: 801389 - DNA, 20 bp, Artificial
  CRISPR gRNA sequence
tgagagcaagcagtgctgtc

SEQ ID NO: 801390 - DNA, 20 bp, Artificial
  CRISPR gRNA sequence
agagcaagcagtgctgtcca

SEQ ID NO: 801391 - DNA, 20 bp, Artificial
  CRISPR gRNA sequence
tccaccagaagctcttgctg

SEQ ID NO: 801392 - DNA, 20 bp, Artificial
  CRISPR gRNA sequence
ttgctggggtgcccagagag

SEQ ID NO: 801393 - DNA, 20 bp, Artificial
  CRISPR gRNA sequence
gctggggtgcccagagagga

SEQ ID NO: 801394 - DNA, 20 bp, Artificial
  CRISPR gRNA sequence
ctggggtgcccagagaggag

SEQ ID NO: 801395 - DNA, 20 bp, Artificial
  CRISPR gRNA sequence
gggtgcccagagaggagcaa

SEQ ID NO: 801396 - DNA, 20 bp, Artificial
  CRISPR gRNA sequence
cacaggagggaatgtttgga

SEQ ID NO: 801397 - DNA, 20 bp, Artificial
  CRISPR gRNA sequence
ggaggagagagccacctcag

SEQ ID NO: 801398 - DNA, 20 bp, Artificial
  CRISPR gRNA sequence
gaggagagagccacctcaga

SEQ ID NO: 801399 - DNA, 20 bp, Artificial
  CRISPR gRNA sequence
agatcagcgggtcaagaatc

SEQ ID NO: 801400 - DNA, 20 bp, Artificial
  CRISPR gRNA sequence
ttgcccagatggatggggca

SEQ ID NO: 801401 - DNA, 20 bp, Artificial
  CRISPR gRNA sequence
gcccagatggatggggcaaa

SEQ ID NO: 801402 - DNA, 20 bp, Artificial
  CRISPR gRNA sequence
cccagatggatggggcaaag

SEQ ID NO: 801403 - DNA, 20 bp, Artificial
  CRISPR gRNA sequence
gccacgggaatgtccagata

SEQ ID NO: 801404 - DNA, 20 bp, Artificial
  CRISPR gRNA sequence
ttggaaaatgggggtgagat

SEQ ID NO: 801405 - DNA, 20 bp, Artificial
  CRISPR gRNA sequence
tggaaaatgggggtgagatg

SEQ ID NO: 801406 - DNA, 20 bp, Artificial
  CRISPR gRNA sequence
ggaaaatgggggtgagatgg

SEQ ID NO: 801407 - DNA, 20 bp, Artificial
  CRISPR gRNA sequence
gaaaatgggggtgagatggg

SEQ ID NO: 801408 - DNA, 20 bp, Artificial
  CRISPR gRNA sequence
aggttacacttcgtaagaac

SEQ ID NO: 801409 - DNA, 20 bp, Artificial
  CRISPR gRNA sequence
cacttcgtaagaactggaat

SEQ ID NO: 801410 - DNA, 20 bp, Artificial
  CRISPR gRNA sequence
cgtaagaactggaatgtaaa

SEQ ID NO: 801411 - DNA, 20 bp, Artificial
  CRISPR gRNA sequence
gtaagaactggaatgtaaag

SEQ ID NO: 801412 - DNA, 20 bp, Artificial
  CRISPR gRNA sequence
gaatgtaaagtaaaggcaga

SEQ ID NO: 801413 - DNA, 20 bp, Artificial
  CRISPR gRNA sequence
gttttcttttcagctttatt

SEQ ID NO: 801414 - DNA, 20 bp, Artificial
  CRISPR gRNA sequence
ttttcttttcagctttattc

SEQ ID NO: 801415 - DNA, 20 bp, Artificial
  CRISPR gRNA sequence
tcttttcagctttattcaca

SEQ ID NO: 801416 - DNA, 20 bp, Artificial
  CRISPR gRNA sequence
cttttcagctttattcacag

SEQ ID NO: 801417 - DNA, 20 bp, Artificial
  CRISPR gRNA sequence
ttttcagctttattcacagt

SEQ ID NO: 801418 - DNA, 20 bp, Artificial
  CRISPR gRNA sequence
ttcagctttattcacagtga

SEQ ID NO: 801419 - DNA, 20 bp, Artificial
  CRISPR gRNA sequence
tcagctttattcacagtgac

SEQ ID NO: 801420 - DNA, 20 bp, Artificial
  CRISPR gRNA sequence
cagctttattcacagtgaca

SEQ ID NO: 801421 - DNA, 20 bp, Artificial
  CRISPR gRNA sequence
agctttattcacagtgacag

SEQ ID NO: 801422 - DNA, 20 bp, Artificial
  CRISPR gRNA sequence
tattcacagtgacagtccct

SEQ ID NO: 801423 - DNA, 20 bp, Artificial
  CRISPR gRNA sequence
attcacagtgacagtcccta

SEQ ID NO: 801424 - DNA, 20 bp, Artificial
  CRISPR gRNA sequence
ttcacagtgacagtccctaa

SEQ ID NO: 801425 - DNA, 20 bp, Artificial
  CRISPR gRNA sequence
acagtgacagtccctaagga

SEQ ID NO: 801426 - DNA, 20 bp, Artificial
  CRISPR gRNA sequence
aggaactgtacataatagag

SEQ ID NO: 801427 - DNA, 20 bp, Artificial
  CRISPR gRNA sequence
tacataatagagcatggcag

SEQ ID NO: 801428 - DNA, 20 bp, Artificial
  CRISPR gRNA sequence
gaatgcaactttgacactgg

SEQ ID NO: 801429 - DNA, 20 bp, Artificial
  CRISPR gRNA sequence
tgacactggaagtcatgtga

SEQ ID NO: 801430 - DNA, 20 bp, Artificial
  CRISPR gRNA sequence
gacactggaagtcatgtgaa

SEQ ID NO: 801431 - DNA, 20 bp, Artificial
  CRISPR gRNA sequence
acactggaagtcatgtgaac

SEQ ID NO: 801432 - DNA, 20 bp, Artificial
  CRISPR gRNA sequence
gaagtcatgtgaaccttgga

SEQ ID NO: 801433 - DNA, 20 bp, Artificial
  CRISPR gRNA sequence
ggagcaataacagccagttt

SEQ ID NO: 801434 - DNA, 20 bp, Artificial
  CRISPR gRNA sequence
gagcaataacagccagtttg

SEQ ID NO: 801435 - DNA, 20 bp, Artificial
  CRISPR gRNA sequence
gcaaaaggtggaaaatgata

SEQ ID NO: 801436 - DNA, 20 bp, Artificial
  CRISPR gRNA sequence
caaaaggtggaaaatgatac

SEQ ID NO: 801437 - DNA, 20 bp, Artificial
  CRISPR gRNA sequence
tgctggaggagcagctgccc

SEQ ID NO: 801438 - DNA, 20 bp, Artificial
  CRISPR gRNA sequence
gctggaggagcagctgcccc

SEQ ID NO: 801439 - DNA, 20 bp, Artificial
  CRISPR gRNA sequence
ctggaggagcagctgcccct

SEQ ID NO: 801440 - DNA, 20 bp, Artificial
  CRISPR gRNA sequence
gaggagcagctgcccctagg

SEQ ID NO: 801441 - DNA, 20 bp, Artificial
  CRISPR gRNA sequence
cccctagggaaggcctcgtt

SEQ ID NO: 801442 - DNA, 20 bp, Artificial
  CRISPR gRNA sequence
gggaaggcctcgttccacat

SEQ ID NO: 801443 - DNA, 20 bp, Artificial
  CRISPR gRNA sequence
gttccacatacctcaagtcc

SEQ ID NO: 801444 - DNA, 20 bp, Artificial
  CRISPR gRNA sequence
cacatacctcaagtccaagt

SEQ ID NO: 801445 - DNA, 20 bp, Artificial
  CRISPR gRNA sequence
aagtccaagtgagggacgaa

SEQ ID NO: 801446 - DNA, 20 bp, Artificial
  CRISPR gRNA sequence
tggggtcgcctgggactaca

SEQ ID NO: 801447 - DNA, 20 bp, Artificial
  CRISPR gRNA sequence
ggactacaagtacctgactc

SEQ ID NO: 801448 - DNA, 20 bp, Artificial
  CRISPR gRNA sequence
caagtacctgactctgaaag

SEQ ID NO: 801449 - DNA, 20 bp, Artificial
  CRISPR gRNA sequence
actctgaaagtcaaaggtga

SEQ ID NO: 801450 - DNA, 20 bp, Artificial
  CRISPR gRNA sequence
tgaaagtcaaaggtgagtgg

SEQ ID NO: 801451 - DNA, 20 bp, Artificial
  CRISPR gRNA sequence
aaagtcaaaggtgagtggtg

SEQ ID NO: 801452 - DNA, 20 bp, Artificial
  CRISPR gRNA sequence
gaatccatggaagcatctct

SEQ ID NO: 801453 - DNA, 20 bp, Artificial
  CRISPR gRNA sequence
tccaacagaggatctgcaag

SEQ ID NO: 801454 - DNA, 20 bp, Artificial
  CRISPR gRNA sequence
caacagaggatctgcaagtc

SEQ ID NO: 801455 - DNA, 20 bp, Artificial
  CRISPR gRNA sequence
caagtcacagaaacccatta

SEQ ID NO: 801456 - DNA, 20 bp, Artificial
  CRISPR gRNA sequence
aaggtagctcaagcaaaaac

SEQ ID NO: 801457 - DNA, 20 bp, Artificial
  CRISPR gRNA sequence
aagcaaaaacaagcaggctg

SEQ ID NO: 801458 - DNA, 20 bp, Artificial
  CRISPR gRNA sequence
cttttaaggagacagctatt

SEQ ID NO: 801459 - DNA, 20 bp, Artificial
  CRISPR gRNA sequence
ttaaggagacagctatttca

SEQ ID NO: 801460 - DNA, 20 bp, Artificial
  CRISPR gRNA sequence
taaggagacagctatttcag

SEQ ID NO: 801461 - DNA, 20 bp, Artificial
  CRISPR gRNA sequence
aaggagacagctatttcaga

SEQ ID NO: 801462 - DNA, 20 bp, Artificial
  CRISPR gRNA sequence
aggagacagctatttcagag

SEQ ID NO: 801463 - DNA, 20 bp, Artificial
  CRISPR gRNA sequence
tttcagagaaaatgaaagca

SEQ ID NO: 801464 - DNA, 20 bp, Artificial
  CRISPR gRNA sequence
cagagaaaatgaaagcatct

SEQ ID NO: 801465 - DNA, 20 bp, Artificial
  CRISPR gRNA sequence
agagaaaatgaaagcatctg

SEQ ID NO: 801466 - DNA, 20 bp, Artificial
  CRISPR gRNA sequence
ctcggaaataatttttgaca

SEQ ID NO: 801467 - DNA, 20 bp, Artificial
  CRISPR gRNA sequence
ggaaataatttttgacatct

SEQ ID NO: 801468 - DNA, 20 bp, Artificial
  CRISPR gRNA sequence
ttgacatctgagtacaaagc

SEQ ID NO: 801469 - DNA, 20 bp, Artificial
  CRISPR gRNA sequence
tgacatctgagtacaaagca

SEQ ID NO: 801470 - DNA, 20 bp, Artificial
  CRISPR gRNA sequence
gacatctgagtacaaagcag

SEQ ID NO: 801471 - DNA, 20 bp, Artificial
  CRISPR gRNA sequence
acatctgagtacaaagcagc

SEQ ID NO: 801472 - DNA, 20 bp, Artificial
  CRISPR gRNA sequence
agtacaaagcagccgaagta

SEQ ID NO: 801473 - DNA, 20 bp, Artificial
  CRISPR gRNA sequence
taggaataaaatgggactgg

SEQ ID NO: 801474 - DNA, 20 bp, Artificial
  CRISPR gRNA sequence
gaggaagccaggaaaattag

SEQ ID NO: 801475 - DNA, 20 bp, Artificial
  CRISPR gRNA sequence
gtccctgaaatgtgggaggg

SEQ ID NO: 801476 - DNA, 20 bp, Artificial
  CRISPR gRNA sequence
aaatgtgggagggtatgaaa

SEQ ID NO: 801477 - DNA, 20 bp, Artificial
  CRISPR gRNA sequence
tgcctaattcacaattctcc

SEQ ID NO: 801478 - DNA, 20 bp, Artificial
  CRISPR gRNA sequence
gcctaattcacaattctccc

SEQ ID NO: 801479 - DNA, 20 bp, Artificial
  CRISPR gRNA sequence
cctaattcacaattctccca

SEQ ID NO: 801480 - DNA, 20 bp, Artificial
  CRISPR gRNA sequence
attcacaattctcccatgga

SEQ ID NO: 801481 - DNA, 20 bp, Artificial
  CRISPR gRNA sequence
acaattctcccatggaacat

SEQ ID NO: 801482 - DNA, 20 bp, Artificial
  CRISPR gRNA sequence
tcccatggaacatccctgac

SEQ ID NO: 801483 - DNA, 20 bp, Artificial
  CRISPR gRNA sequence
ccatggaacatccctgactt

SEQ ID NO: 801484 - DNA, 20 bp, Artificial
  CRISPR gRNA sequence
acttgattattaagatactc

SEQ ID NO: 801485 - DNA, 20 bp, Artificial
  CRISPR gRNA sequence
gattattaagatactctttt

SEQ ID NO: 801486 - DNA, 20 bp, Artificial
  CRISPR gRNA sequence
attattaagatactcttttt

SEQ ID NO: 801487 - DNA, 20 bp, Artificial
  CRISPR gRNA sequence
ttaagatactctttttcaat

SEQ ID NO: 801488 - DNA, 20 bp, Artificial
  CRISPR gRNA sequence
agatactctttttcaatagt

SEQ ID NO: 801489 - DNA, 20 bp, Artificial
  CRISPR gRNA sequence
tttttcaatagtttataccc

SEQ ID NO: 801490 - DNA, 20 bp, Artificial
  CRISPR gRNA sequence
tttcaatagtttataccctg

SEQ ID NO: 801491 - DNA, 20 bp, Artificial
  CRISPR gRNA sequence
ttcaatagtttataccctga

SEQ ID NO: 801492 - DNA, 20 bp, Artificial
  CRISPR gRNA sequence
tcaatagtttataccctgaa

SEQ ID NO: 801493 - DNA, 20 bp, Artificial
  CRISPR gRNA sequence
caatagtttataccctgaat

SEQ ID NO: 801494 - DNA, 20 bp, Artificial
  CRISPR gRNA sequence
aatagtttataccctgaatc

SEQ ID NO: 801495 - DNA, 20 bp, Artificial
  CRISPR gRNA sequence
ataccctgaatccagagttt

SEQ ID NO: 801496 - DNA, 20 bp, Artificial
  CRISPR gRNA sequence
taccctgaatccagagtttt

SEQ ID NO: 801497 - DNA, 20 bp, Artificial
  CRISPR gRNA sequence
aatccagagtttttaaaacc

SEQ ID NO: 801498 - DNA, 20 bp, Artificial
  CRISPR gRNA sequence
ttaaaaccatggtttgccgc

SEQ ID NO: 801499 - DNA, 20 bp, Artificial
  CRISPR gRNA sequence
taaaaccatggtttgccgcc

SEQ ID NO: 801500 - DNA, 20 bp, Artificial
  CRISPR gRNA sequence
aaaaccatggtttgccgccc

SEQ ID NO: 801501 - DNA, 20 bp, Artificial
  CRISPR gRNA sequence
aaaccatggtttgccgccca

SEQ ID NO: 801502 - DNA, 20 bp, Artificial
  CRISPR gRNA sequence
gccgcccattcatggattaa

SEQ ID NO: 801503 - DNA, 20 bp, Artificial
  CRISPR gRNA sequence
ccgcccattcatggattaaa

SEQ ID NO: 801504 - DNA, 20 bp, Artificial
  CRISPR gRNA sequence
atggattaaaatatcaattt

SEQ ID NO: 801505 - DNA, 20 bp, Artificial
  CRISPR gRNA sequence
aaatatcaatttagtgagta

SEQ ID NO: 801506 - DNA, 20 bp, Artificial
  CRISPR gRNA sequence
agtgagtagcaaccagatgc

SEQ ID NO: 801507 - DNA, 20 bp, Artificial
  CRISPR gRNA sequence
gtgagtagcaaccagatgca

SEQ ID NO: 801508 - DNA, 20 bp, Artificial
  CRISPR gRNA sequence
cccgccctttaaaaaataat

SEQ ID NO: 801509 - DNA, 20 bp, Artificial
  CRISPR gRNA sequence
ccgccctttaaaaaataatg

SEQ ID NO: 801510 - DNA, 20 bp, Artificial
  CRISPR gRNA sequence
taaaaaataatgtatagaag

SEQ ID NO: 801511 - DNA, 20 bp, Artificial
  CRISPR gRNA sequence
aaaaaataatgtatagaaga

SEQ ID NO: 801512 - DNA, 20 bp, Artificial
  CRISPR gRNA sequence
aaaaataatgtatagaagag

SEQ ID NO: 801513 - DNA, 20 bp, Artificial
  CRISPR gRNA sequence
agtactgtaaaactaatttc

SEQ ID NO: 801514 - DNA, 20 bp, Artificial
  CRISPR gRNA sequence
taaaactaatttctgaggga

SEQ ID NO: 801515 - DNA, 20 bp, Artificial
  CRISPR gRNA sequence
atttctgagggacgtgtgtg

SEQ ID NO: 801516 - DNA, 20 bp, Artificial
  CRISPR gRNA sequence
ctgagggacgtgtgtgtgtg

SEQ ID NO: 801517 - DNA, 20 bp, Artificial
  CRISPR gRNA sequence
tgagggacgtgtgtgtgtgt

SEQ ID NO: 801518 - DNA, 20 bp, Artificial
  CRISPR gRNA sequence
agggacgtgtgtgtgtgtgt

SEQ ID NO: 801519 - DNA, 20 bp, Artificial
  CRISPR gRNA sequence
ggtcatggtataaatttttt

SEQ ID NO: 801520 - DNA, 20 bp, Artificial
  CRISPR gRNA sequence
tttttttcttactttggatc

SEQ ID NO: 801521 - DNA, 20 bp, Artificial
  CRISPR gRNA sequence
ttttttcttactttggatca

SEQ ID NO: 801522 - DNA, 20 bp, Artificial
  CRISPR gRNA sequence
tttttcttactttggatcat

SEQ ID NO: 801523 - DNA, 20 bp, Artificial
  CRISPR gRNA sequence
ttttcttactttggatcata

SEQ ID NO: 801524 - DNA, 20 bp, Artificial
  CRISPR gRNA sequence
tttcttactttggatcataa

SEQ ID NO: 801525 - DNA, 20 bp, Artificial
  CRISPR gRNA sequence
ttcttactttggatcataaa

SEQ ID NO: 801526 - DNA, 20 bp, Artificial
  CRISPR gRNA sequence
tcttactttggatcataaaa

SEQ ID NO: 801527 - DNA, 20 bp, Artificial
  CRISPR gRNA sequence
cttactttggatcataaaaa

SEQ ID NO: 801528 - DNA, 20 bp, Artificial
  CRISPR gRNA sequence
ttactttggatcataaaaag

SEQ ID NO: 801529 - DNA, 20 bp, Artificial
  CRISPR gRNA sequence
actttggatcataaaaagtt

SEQ ID NO: 801530 - DNA, 20 bp, Artificial
  CRISPR gRNA sequence
ctttggatcataaaaagtta

SEQ ID NO: 801531 - DNA, 20 bp, Artificial
  CRISPR gRNA sequence
tggatcataaaaagttacaa

SEQ ID NO: 801532 - DNA, 20 bp, Artificial
  CRISPR gRNA sequence
ggatcataaaaagttacaag

SEQ ID NO: 801533 - DNA, 20 bp, Artificial
  CRISPR gRNA sequence
gatcataaaaagttacaagt

SEQ ID NO: 801534 - DNA, 20 bp, Artificial
  CRISPR gRNA sequence
caagtttggaaaacactgct

SEQ ID NO: 801535 - DNA, 20 bp, Artificial
  CRISPR gRNA sequence
ggaaaacactgctcaaatgc

SEQ ID NO: 801536 - DNA, 20 bp, Artificial
  CRISPR gRNA sequence
gaaaacactgctcaaatgca

SEQ ID NO: 801537 - DNA, 20 bp, Artificial
  CRISPR gRNA sequence
ctcaaatgcaagccctattt

SEQ ID NO: 801538 - DNA, 20 bp, Artificial
  CRISPR gRNA sequence
aaatgcaagccctatttatt

SEQ ID NO: 801539 - DNA, 20 bp, Artificial
  CRISPR gRNA sequence
tttattgcagatgaagtagc

SEQ ID NO: 801540 - DNA, 20 bp, Artificial
  CRISPR gRNA sequence
attgcagatgaagtagctga

SEQ ID NO: 801541 - DNA, 20 bp, Artificial
  CRISPR gRNA sequence
ttgcagatgaagtagctgag

SEQ ID NO: 801542 - DNA, 20 bp, Artificial
  CRISPR gRNA sequence
cagatgaagtagctgagatc

SEQ ID NO: 801543 - DNA, 20 bp, Artificial
  CRISPR gRNA sequence
agatccagagaagggaagtg

SEQ ID NO: 801544 - DNA, 20 bp, Artificial
  CRISPR gRNA sequence
tagctgtccctattcctctg

SEQ ID NO: 801545 - DNA, 20 bp, Artificial
  CRISPR gRNA sequence
tccctattcctctggattca

SEQ ID NO: 801546 - DNA, 20 bp, Artificial
  CRISPR gRNA sequence
ttcctctggattcagggatc

SEQ ID NO: 801547 - DNA, 20 bp, Artificial
  CRISPR gRNA sequence
ctctggattcagggatctct

SEQ ID NO: 801548 - DNA, 20 bp, Artificial
  CRISPR gRNA sequence
tggattcagggatctctcca

SEQ ID NO: 801549 - DNA, 20 bp, Artificial
  CRISPR gRNA sequence
gattcagggatctctccact

SEQ ID NO: 801550 - DNA, 20 bp, Artificial
  CRISPR gRNA sequence
agggatctctccactccagc

SEQ ID NO: 801551 - DNA, 20 bp, Artificial
  CRISPR gRNA sequence
tccactccagcacaattgaa

SEQ ID NO: 801552 - DNA, 20 bp, Artificial
  CRISPR gRNA sequence
cactccagcacaattgaaaa

SEQ ID NO: 801553 - DNA, 20 bp, Artificial
  CRISPR gRNA sequence
cagcacaattgaaaatctaa

SEQ ID NO: 801554 - DNA, 20 bp, Artificial
  CRISPR gRNA sequence
aaaatctaaatataaagaga

SEQ ID NO: 801555 - DNA, 20 bp, Artificial
  CRISPR gRNA sequence
aatataaagagaatcttcac

SEQ ID NO: 801556 - DNA, 20 bp, Artificial
  CRISPR gRNA sequence
cacactcttgtttgttctag

SEQ ID NO: 801557 - DNA, 20 bp, Artificial
  CRISPR gRNA sequence
acactcttgtttgttctaga

SEQ ID NO: 801558 - DNA, 20 bp, Artificial
  CRISPR gRNA sequence
ttgtttgttctagaaaaggt

SEQ ID NO: 801559 - DNA, 20 bp, Artificial
  CRISPR gRNA sequence
gtttgttctagaaaaggtga

SEQ ID NO: 801560 - DNA, 20 bp, Artificial
  CRISPR gRNA sequence
tttgttctagaaaaggtgat

SEQ ID NO: 801561 - DNA, 20 bp, Artificial
  CRISPR gRNA sequence
gttctagaaaaggtgatttg

SEQ ID NO: 801562 - DNA, 20 bp, Artificial
  CRISPR gRNA sequence
ttctagaaaaggtgatttga

SEQ ID NO: 801563 - DNA, 20 bp, Artificial
  CRISPR gRNA sequence
tagaaaaggtgatttgagga

SEQ ID NO: 801564 - DNA, 20 bp, Artificial
  CRISPR gRNA sequence
gaaaaggtgatttgaggaaa

SEQ ID NO: 801565 - DNA, 20 bp, Artificial
  CRISPR gRNA sequence
gaggaaagacatataacaac

SEQ ID NO: 801566 - DNA, 20 bp, Artificial
  CRISPR gRNA sequence
aggaaagacatataacaact

SEQ ID NO: 801567 - DNA, 20 bp, Artificial
  CRISPR gRNA sequence
taaaaaatagattttgcttg

SEQ ID NO: 801568 - DNA, 20 bp, Artificial
  CRISPR gRNA sequence
tgcttgttcattggcttatg

SEQ ID NO: 801569 - DNA, 20 bp, Artificial
  CRISPR gRNA sequence
gcttgttcattggcttatgg

SEQ ID NO: 801570 - DNA, 20 bp, Artificial
  CRISPR gRNA sequence
cttgttcattggcttatggt

SEQ ID NO: 801571 - DNA, 20 bp, Artificial
  CRISPR gRNA sequence
gttcattggcttatggtctc

SEQ ID NO: 801572 - DNA, 20 bp, Artificial
  CRISPR gRNA sequence
ttcattggcttatggtctcc

SEQ ID NO: 801573 - DNA, 20 bp, Artificial
  CRISPR gRNA sequence
attggcttatggtctccagg

SEQ ID NO: 801574 - DNA, 20 bp, Artificial
  CRISPR gRNA sequence
gcttatggtctccaggcttg

SEQ ID NO: 801575 - DNA, 20 bp, Artificial
  CRISPR gRNA sequence
atggtctccaggcttgaatg

SEQ ID NO: 801576 - DNA, 20 bp, Artificial
  CRISPR gRNA sequence
tggtctccaggcttgaatgc

SEQ ID NO: 801577 - DNA, 20 bp, Artificial
  CRISPR gRNA sequence
caggcttgaatgctctgaga

SEQ ID NO: 801578 - DNA, 20 bp, Artificial
  CRISPR gRNA sequence
gaatgctctgagataaatga

SEQ ID NO: 801579 - DNA, 20 bp, Artificial
  CRISPR gRNA sequence
aatgctctgagataaatgat

SEQ ID NO: 801580 - DNA, 20 bp, Artificial
  CRISPR gRNA sequence
tgagataaatgatgccaata

SEQ ID NO: 801581 - DNA, 20 bp, Artificial
  CRISPR gRNA sequence
agataaatgatgccaatatt

SEQ ID NO: 801582 - DNA, 20 bp, Artificial
  CRISPR gRNA sequence
ctctggcctcttcccctccc

SEQ ID NO: 801583 - DNA, 20 bp, Artificial
  CRISPR gRNA sequence
tctggcctcttcccctccca

SEQ ID NO: 801584 - DNA, 20 bp, Artificial
  CRISPR gRNA sequence
tggcctcttcccctcccacg

SEQ ID NO: 801585 - DNA, 20 bp, Artificial
  CRISPR gRNA sequence
gcctcttcccctcccacgca

SEQ ID NO: 801586 - DNA, 20 bp, Artificial
  CRISPR gRNA sequence
ttcccctcccacgcattgga

SEQ ID NO: 801587 - DNA, 20 bp, Artificial
  CRISPR gRNA sequence
cccctcccacgcattggacc

SEQ ID NO: 801588 - DNA, 20 bp, Artificial
  CRISPR gRNA sequence
ccctcccacgcattggacct

SEQ ID NO: 801589 - DNA, 20 bp, Artificial
  CRISPR gRNA sequence
ccacgcattggacctcagat

SEQ ID NO: 801590 - DNA, 20 bp, Artificial
  CRISPR gRNA sequence
gacctcagatggtctgtact

SEQ ID NO: 801591 - DNA, 20 bp, Artificial
  CRISPR gRNA sequence
agatggtctgtactgtcttc

SEQ ID NO: 801592 - DNA, 20 bp, Artificial
  CRISPR gRNA sequence
tactgtcttctagagggttt

SEQ ID NO: 801593 - DNA, 20 bp, Artificial
  CRISPR gRNA sequence
tcttctagagggtttgtggg

SEQ ID NO: 801594 - DNA, 20 bp, Artificial
  CRISPR gRNA sequence
ctagagggtttgtgggtttt

SEQ ID NO: 801595 - DNA, 20 bp, Artificial
  CRISPR gRNA sequence
tagagggtttgtgggttttg

SEQ ID NO: 801596 - DNA, 20 bp, Artificial
  CRISPR gRNA sequence
gagggtttgtgggttttggc

SEQ ID NO: 801597 - DNA, 20 bp, Artificial
  CRISPR gRNA sequence
gtgggttttggccccaaaaa

SEQ ID NO: 801598 - DNA, 20 bp, Artificial
  CRISPR gRNA sequence
tgggttttggccccaaaaaa

SEQ ID NO: 801599 - DNA, 20 bp, Artificial
  CRISPR gRNA sequence
tggccccaaaaaaccattaa

SEQ ID NO: 801600 - DNA, 20 bp, Artificial
  CRISPR gRNA sequence
ggccccaaaaaaccattaac

SEQ ID NO: 801601 - DNA, 20 bp, Artificial
  CRISPR gRNA sequence
gccccaaaaaaccattaacc

SEQ ID NO: 801602 - DNA, 20 bp, Artificial
  CRISPR gRNA sequence
accttggcagaaagtgtgtg

SEQ ID NO: 801603 - DNA, 20 bp, Artificial
  CRISPR gRNA sequence
ggcagaaagtgtgtgacttt

SEQ ID NO: 801604 - DNA, 20 bp, Artificial
  CRISPR gRNA sequence
gcagaaagtgtgtgacttta

SEQ ID NO: 801605 - DNA, 20 bp, Artificial
  CRISPR gRNA sequence
tatgatctggtacaaagaag

SEQ ID NO: 801606 - DNA, 20 bp, Artificial
  CRISPR gRNA sequence
atgatctggtacaaagaagg

SEQ ID NO: 801607 - DNA, 20 bp, Artificial
  CRISPR gRNA sequence
tgatctggtacaaagaagga

SEQ ID NO: 801608 - DNA, 20 bp, Artificial
  CRISPR gRNA sequence
gtacaaagaaggacaaacta

SEQ ID NO: 801609 - DNA, 20 bp, Artificial
  CRISPR gRNA sequence
gagggactggacatgaggat

SEQ ID NO: 801610 - DNA, 20 bp, Artificial
  CRISPR gRNA sequence
gacatgaggatgaatattgt

SEQ ID NO: 801611 - DNA, 20 bp, Artificial
  CRISPR gRNA sequence
tgttcgcccttatccttggg

SEQ ID NO: 801612 - DNA, 20 bp, Artificial
  CRISPR gRNA sequence
gcccttatccttgggcaggt

SEQ ID NO: 801613 - DNA, 20 bp, Artificial
  CRISPR gRNA sequence
atccttgggcaggttatttt

SEQ ID NO: 801614 - DNA, 20 bp, Artificial
  CRISPR gRNA sequence
tccttgggcaggttattttg

SEQ ID NO: 801615 - DNA, 20 bp, Artificial
  CRISPR gRNA sequence
gggcaggttattttgccttt

SEQ ID NO: 801616 - DNA, 20 bp, Artificial
  CRISPR gRNA sequence
ggcaggttattttgcctttc

SEQ ID NO: 801617 - DNA, 20 bp, Artificial
  CRISPR gRNA sequence
ttttgcctttcataacctca

SEQ ID NO: 801618 - DNA, 20 bp, Artificial
  CRISPR gRNA sequence
tgcctttcataacctcacat

SEQ ID NO: 801619 - DNA, 20 bp, Artificial
  CRISPR gRNA sequence
gcctttcataacctcacatt

SEQ ID NO: 801620 - DNA, 20 bp, Artificial
  CRISPR gRNA sequence
cctttcataacctcacattt

SEQ ID NO: 801621 - DNA, 20 bp, Artificial
  CRISPR gRNA sequence
tcataacctcacattttgct

SEQ ID NO: 801622 - DNA, 20 bp, Artificial
  CRISPR gRNA sequence
cataacctcacattttgctt

SEQ ID NO: 801623 - DNA, 20 bp, Artificial
  CRISPR gRNA sequence
ataacctcacattttgctta

SEQ ID NO: 801624 - DNA, 20 bp, Artificial
  CRISPR gRNA sequence
acattttgcttatttgtaga

SEQ ID NO: 801625 - DNA, 20 bp, Artificial
  CRISPR gRNA sequence
tgcttatttgtagaagacga

SEQ ID NO: 801626 - DNA, 20 bp, Artificial
  CRISPR gRNA sequence
gcttatttgtagaagacgaa

SEQ ID NO: 801627 - DNA, 20 bp, Artificial
  CRISPR gRNA sequence
cttatttgtagaagacgaac

SEQ ID NO: 801628 - DNA, 20 bp, Artificial
  CRISPR gRNA sequence
atttgtagaagacgaacaat

SEQ ID NO: 801629 - DNA, 20 bp, Artificial
  CRISPR gRNA sequence
tttgtagaagacgaacaata

SEQ ID NO: 801630 - DNA, 20 bp, Artificial
  CRISPR gRNA sequence
gtagaagacgaacaatagta

SEQ ID NO: 801631 - DNA, 20 bp, Artificial
  CRISPR gRNA sequence
tagaagacgaacaatagtag

SEQ ID NO: 801632 - DNA, 20 bp, Artificial
  CRISPR gRNA sequence
ttgtcaacattgagagagat

SEQ ID NO: 801633 - DNA, 20 bp, Artificial
  CRISPR gRNA sequence
tcaacattgagagagataat

SEQ ID NO: 801634 - DNA, 20 bp, Artificial
  CRISPR gRNA sequence
agagagataatgaacataaa

SEQ ID NO: 801635 - DNA, 20 bp, Artificial
  CRISPR gRNA sequence
agcatggtacccggcatata

SEQ ID NO: 801636 - DNA, 20 bp, Artificial
  CRISPR gRNA sequence
ggttaaaagaccctcagttg

SEQ ID NO: 801637 - DNA, 20 bp, Artificial
  CRISPR gRNA sequence
gttaaaagaccctcagttgt

SEQ ID NO: 801638 - DNA, 20 bp, Artificial
  CRISPR gRNA sequence
aaagaccctcagttgttaca

SEQ ID NO: 801639 - DNA, 20 bp, Artificial
  CRISPR gRNA sequence
agttgttacaggggcagtga

SEQ ID NO: 801640 - DNA, 20 bp, Artificial
  CRISPR gRNA sequence
ttacaggggcagtgacctcc

SEQ ID NO: 801641 - DNA, 20 bp, Artificial
  CRISPR gRNA sequence
caggggcagtgacctcctca

SEQ ID NO: 801642 - DNA, 20 bp, Artificial
  CRISPR gRNA sequence
ctcacacctcaaccatcaat

SEQ ID NO: 801643 - DNA, 20 bp, Artificial
  CRISPR gRNA sequence
acacctcaaccatcaatgag

SEQ ID NO: 801644 - DNA, 20 bp, Artificial
  CRISPR gRNA sequence
aaccatcaatgagtcaccag

SEQ ID NO: 801645 - DNA, 20 bp, Artificial
  CRISPR gRNA sequence
gcctagatgtaactgttttc

SEQ ID NO: 801646 - DNA, 20 bp, Artificial
  CRISPR gRNA sequence
gatgtaactgttttctatct

SEQ ID NO: 801647 - DNA, 20 bp, Artificial
  CRISPR gRNA sequence
ttttctatctttattgcatt

SEQ ID NO: 801648 - DNA, 20 bp, Artificial
  CRISPR gRNA sequence
tctatctttattgcatttcc

SEQ ID NO: 801649 - DNA, 20 bp, Artificial
  CRISPR gRNA sequence
ctatctttattgcatttcct

SEQ ID NO: 801650 - DNA, 20 bp, Artificial
  CRISPR gRNA sequence
tatctttattgcatttccta

SEQ ID NO: 801651 - DNA, 20 bp, Artificial
  CRISPR gRNA sequence
tctttattgcatttcctaca

SEQ ID NO: 801652 - DNA, 20 bp, Artificial
  CRISPR gRNA sequence
tattgcatttcctacatcca

SEQ ID NO: 801653 - DNA, 20 bp, Artificial
  CRISPR gRNA sequence
attgcatttcctacatccag

SEQ ID NO: 801654 - DNA, 20 bp, Artificial
  CRISPR gRNA sequence
ttgcatttcctacatccagg

SEQ ID NO: 801655 - DNA, 20 bp, Artificial
  CRISPR gRNA sequence
catttcctacatccaggcag

SEQ ID NO: 801656 - DNA, 20 bp, Artificial
  CRISPR gRNA sequence
cctacatccaggcagcagct

SEQ ID NO: 801657 - DNA, 20 bp, Artificial
  CRISPR gRNA sequence
ctacatccaggcagcagctg

SEQ ID NO: 801658 - DNA, 20 bp, Artificial
  CRISPR gRNA sequence
catccaggcagcagctggga

SEQ ID NO: 801659 - DNA, 20 bp, Artificial
  CRISPR gRNA sequence
ggaggaactctagaacactg

SEQ ID NO: 801660 - DNA, 20 bp, Artificial
  CRISPR gRNA sequence
tagaacactgaagtttgtct

SEQ ID NO: 801661 - DNA, 20 bp, Artificial
  CRISPR gRNA sequence
gaacactgaagtttgtctga

SEQ ID NO: 801662 - DNA, 20 bp, Artificial
  CRISPR gRNA sequence
aagtttgtctgagttccctt

SEQ ID NO: 801663 - DNA, 20 bp, Artificial
  CRISPR gRNA sequence
gtctgagttcccttaatgta

SEQ ID NO: 801664 - DNA, 20 bp, Artificial
  CRISPR gRNA sequence
tctgagttcccttaatgtaa

SEQ ID NO: 801665 - DNA, 20 bp, Artificial
  CRISPR gRNA sequence
agttcccttaatgtaaggct

SEQ ID NO: 801666 - DNA, 20 bp, Artificial
  CRISPR gRNA sequence
ccttaatgtaaggctgtaca

SEQ ID NO: 801667 - DNA, 20 bp, Artificial
  CRISPR gRNA sequence
aatgtaaggctgtacattct

SEQ ID NO: 801668 - DNA, 20 bp, Artificial
  CRISPR gRNA sequence
atgtaaggctgtacattctc

SEQ ID NO: 801669 - DNA, 20 bp, Artificial
  CRISPR gRNA sequence
tacattctcaggatgccttg

SEQ ID NO: 801670 - DNA, 20 bp, Artificial
  CRISPR gRNA sequence
tcaggatgccttgatgtact

SEQ ID NO: 801671 - DNA, 20 bp, Artificial
  CRISPR gRNA sequence
aggatgccttgatgtactcg

SEQ ID NO: 801672 - DNA, 20 bp, Artificial
  CRISPR gRNA sequence
gatgtactcgaatatctgca

SEQ ID NO: 801673 - DNA, 20 bp, Artificial
  CRISPR gRNA sequence
atgtactcgaatatctgcaa

SEQ ID NO: 801674 - DNA, 20 bp, Artificial
  CRISPR gRNA sequence
gaatatctgcaaccctaaat

SEQ ID NO: 801675 - DNA, 20 bp, Artificial
  CRISPR gRNA sequence
caaccctaaatcaccacctc

SEQ ID NO: 801676 - DNA, 20 bp, Artificial
  CRISPR gRNA sequence
aatcaccacctctgttttta

SEQ ID NO: 801677 - DNA, 20 bp, Artificial
  CRISPR gRNA sequence
tgtttttattgatctctatc

SEQ ID NO: 801678 - DNA, 20 bp, Artificial
  CRISPR gRNA sequence
tttttattgatctctatctg

SEQ ID NO: 801679 - DNA, 20 bp, Artificial
  CRISPR gRNA sequence
ttattgatctctatctgaat

SEQ ID NO: 801680 - DNA, 20 bp, Artificial
  CRISPR gRNA sequence
tattgatctctatctgaatg

SEQ ID NO: 801681 - DNA, 20 bp, Artificial
  CRISPR gRNA sequence
attgatctctatctgaatgc

SEQ ID NO: 801682 - DNA, 20 bp, Artificial
  CRISPR gRNA sequence
ttgatctctatctgaatgct

SEQ ID NO: 801683 - DNA, 20 bp, Artificial
  CRISPR gRNA sequence
atctctatctgaatgctgta

SEQ ID NO: 801684 - DNA, 20 bp, Artificial
  CRISPR gRNA sequence
tatctgaatgctgtattaat

SEQ ID NO: 801685 - DNA, 20 bp, Artificial
  CRISPR gRNA sequence
tctgaatgctgtattaatgg

SEQ ID NO: 801686 - DNA, 20 bp, Artificial
  CRISPR gRNA sequence
aatgctgtattaatgggcca

SEQ ID NO: 801687 - DNA, 20 bp, Artificial
  CRISPR gRNA sequence
tattaatgggccaggccttc

SEQ ID NO: 801688 - DNA, 20 bp, Artificial
  CRISPR gRNA sequence
atgggccaggccttctgccc

SEQ ID NO: 801689 - DNA, 20 bp, Artificial
  CRISPR gRNA sequence
ctgcccattctctcaaactg

SEQ ID NO: 801690 - DNA, 20 bp, Artificial
  CRISPR gRNA sequence
tgcccattctctcaaactga

SEQ ID NO: 801691 - DNA, 20 bp, Artificial
  CRISPR gRNA sequence
cccattctctcaaactgaga

SEQ ID NO: 801692 - DNA, 20 bp, Artificial
  CRISPR gRNA sequence
tctcaaactgagaactgtct

SEQ ID NO: 801693 - DNA, 20 bp, Artificial
  CRISPR gRNA sequence
tcaaactgagaactgtctct

SEQ ID NO: 801694 - DNA, 20 bp, Artificial
  CRISPR gRNA sequence
aaactgagaactgtctctca

SEQ ID NO: 801695 - DNA, 20 bp, Artificial
  CRISPR gRNA sequence
agaactgtctctcattcctg

SEQ ID NO: 801696 - DNA, 20 bp, Artificial
  CRISPR gRNA sequence
tctctcattcctggggaggc

SEQ ID NO: 801697 - DNA, 20 bp, Artificial
  CRISPR gRNA sequence
tcattcctggggaggcaccc

SEQ ID NO: 801698 - DNA, 20 bp, Artificial
  CRISPR gRNA sequence
attcctggggaggcaccctg

SEQ ID NO: 801699 - DNA, 20 bp, Artificial
  CRISPR gRNA sequence
ctggggaggcaccctgccta

SEQ ID NO: 801700 - DNA, 20 bp, Artificial
  CRISPR gRNA sequence
gggaggcaccctgcctactc

SEQ ID NO: 801701 - DNA, 20 bp, Artificial
  CRISPR gRNA sequence
cctactccttacctagatca

SEQ ID NO: 801702 - DNA, 20 bp, Artificial
  CRISPR gRNA sequence
ctccttacctagatcaggga

SEQ ID NO: 801703 - DNA, 20 bp, Artificial
  CRISPR gRNA sequence
cttacctagatcagggattt

SEQ ID NO: 801704 - DNA, 20 bp, Artificial
  CRISPR gRNA sequence
acctagatcagggatttctc

SEQ ID NO: 801705 - DNA, 20 bp, Artificial
  CRISPR gRNA sequence
cctagatcagggatttctca

SEQ ID NO: 801706 - DNA, 20 bp, Artificial
  CRISPR gRNA sequence
gatcagggatttctcagttg

SEQ ID NO: 801707 - DNA, 20 bp, Artificial
  CRISPR gRNA sequence
ctcagttgtggagagatttg

SEQ ID NO: 801708 - DNA, 20 bp, Artificial
  CRISPR gRNA sequence
tcagttgtggagagatttgt

SEQ ID NO: 801709 - DNA, 20 bp, Artificial
  CRISPR gRNA sequence
agttgtggagagatttgttc

SEQ ID NO: 801710 - DNA, 20 bp, Artificial
  CRISPR gRNA sequence
tggagagatttgttccttat

SEQ ID NO: 801711 - DNA, 20 bp, Artificial
  CRISPR gRNA sequence
gttccttatagtgttggtca

SEQ ID NO: 801712 - DNA, 20 bp, Artificial
  CRISPR gRNA sequence
ttccttatagtgttggtcat

SEQ ID NO: 801713 - DNA, 20 bp, Artificial
  CRISPR gRNA sequence
cttatagtgttggtcatcaa

SEQ ID NO: 801714 - DNA, 20 bp, Artificial
  CRISPR gRNA sequence
atagtgttggtcatcaaact

SEQ ID NO: 801715 - DNA, 20 bp, Artificial
  CRISPR gRNA sequence
tagtgttggtcatcaaactg

SEQ ID NO: 801716 - DNA, 20 bp, Artificial
  CRISPR gRNA sequence
gtcatcaaactgggatattt

SEQ ID NO: 801717 - DNA, 20 bp, Artificial
  CRISPR gRNA sequence
ggatatttggggattacaaa

SEQ ID NO: 801718 - DNA, 20 bp, Artificial
  CRISPR gRNA sequence
ggggattacaaagacttttc

SEQ ID NO: 801719 - DNA, 20 bp, Artificial
  CRISPR gRNA sequence
gggattacaaagacttttca

SEQ ID NO: 801720 - DNA, 20 bp, Artificial
  CRISPR gRNA sequence
caaagacttttcaagggatg

SEQ ID NO: 801721 - DNA, 20 bp, Artificial
  CRISPR gRNA sequence
ttcaagggatgtatgggcac

SEQ ID NO: 801722 - DNA, 20 bp, Artificial
  CRISPR gRNA sequence
tcaagggatgtatgggcaca

SEQ ID NO: 801723 - DNA, 20 bp, Artificial
  CRISPR gRNA sequence
caagggatgtatgggcacag

SEQ ID NO: 801724 - DNA, 20 bp, Artificial
  CRISPR gRNA sequence
aagggatgtatgggcacagg

SEQ ID NO: 801725 - DNA, 20 bp, Artificial
  CRISPR gRNA sequence
taggaagtgagttcctagat

SEQ ID NO: 801726 - DNA, 20 bp, Artificial
  CRISPR gRNA sequence
aggaagtgagttcctagatc

SEQ ID NO: 801727 - DNA, 20 bp, Artificial
  CRISPR gRNA sequence
ggaagtgagttcctagatcc

SEQ ID NO: 801728 - DNA, 20 bp, Artificial
  CRISPR gRNA sequence
ctagatcctcatcttcccca

SEQ ID NO: 801729 - DNA, 20 bp, Artificial
  CRISPR gRNA sequence
gatcctcatcttccccaaat

SEQ ID NO: 801730 - DNA, 20 bp, Artificial
  CRISPR gRNA sequence
atcttccccaaatactcgtt

SEQ ID NO: 801731 - DNA, 20 bp, Artificial
  CRISPR gRNA sequence
ccccaaatactcgttcccaa

SEQ ID NO: 801732 - DNA, 20 bp, Artificial
  CRISPR gRNA sequence
cccaaatactcgttcccaaa

SEQ ID NO: 801733 - DNA, 20 bp, Artificial
  CRISPR gRNA sequence
gttcccaaaattgacgagcc

SEQ ID NO: 801734 - DNA, 20 bp, Artificial
  CRISPR gRNA sequence
ccaaaattgacgagcctgac

SEQ ID NO: 801735 - DNA, 20 bp, Artificial
  CRISPR gRNA sequence
acgagcctgacaatgtgcat

SEQ ID NO: 801736 - DNA, 20 bp, Artificial
  CRISPR gRNA sequence
acaatgtgcatgccaggcaa

SEQ ID NO: 801737 - DNA, 20 bp, Artificial
  CRISPR gRNA sequence
ttggggttcccctaaaacac

SEQ ID NO: 801738 - DNA, 20 bp, Artificial
  CRISPR gRNA sequence
ggggttcccctaaaacactt

SEQ ID NO: 801739 - DNA, 20 bp, Artificial
  CRISPR gRNA sequence
gggttcccctaaaacacttc

SEQ ID NO: 801740 - DNA, 20 bp, Artificial
  CRISPR gRNA sequence
ccctaaaacacttcctcttt

SEQ ID NO: 801741 - DNA, 20 bp, Artificial
  CRISPR gRNA sequence
aaacacttcctcttttaagc

SEQ ID NO: 801742 - DNA, 20 bp, Artificial
  CRISPR gRNA sequence
cctcttttaagcctaccact

SEQ ID NO: 801743 - DNA, 20 bp, Artificial
  CRISPR gRNA sequence
ctcttttaagcctaccactc

SEQ ID NO: 801744 - DNA, 20 bp, Artificial
  CRISPR gRNA sequence
ttttaagcctaccactcact

SEQ ID NO: 801745 - DNA, 20 bp, Artificial
  CRISPR gRNA sequence
ttaagcctaccactcactca

SEQ ID NO: 801746 - DNA, 20 bp, Artificial
  CRISPR gRNA sequence
taagcctaccactcactcat

SEQ ID NO: 801747 - DNA, 20 bp, Artificial
  CRISPR gRNA sequence
aagcctaccactcactcatc

SEQ ID NO: 801748 - DNA, 20 bp, Artificial
  CRISPR gRNA sequence
agcctaccactcactcatca

SEQ ID NO: 801749 - DNA, 20 bp, Artificial
  CRISPR gRNA sequence
ccactcactcatcatgaata

SEQ ID NO: 801750 - DNA, 20 bp, Artificial
  CRISPR gRNA sequence
actcatcatgaatatagtcc

SEQ ID NO: 801751 - DNA, 20 bp, Artificial
  CRISPR gRNA sequence
atcatgaatatagtccattg

SEQ ID NO: 801752 - DNA, 20 bp, Artificial
  CRISPR gRNA sequence
tcccagggtgtaaaaccctc

SEQ ID NO: 801753 - DNA, 20 bp, Artificial
  CRISPR gRNA sequence
tatagtgttaaataaaagaa

SEQ ID NO: 801754 - DNA, 20 bp, Artificial
  CRISPR gRNA sequence
tagtgttaaataaaagaatg

SEQ ID NO: 801755 - DNA, 20 bp, Artificial
  CRISPR gRNA sequence
aataaaagaatgattgggaa

SEQ ID NO: 801756 - DNA, 20 bp, Artificial
  CRISPR gRNA sequence
ggaacattgacacctgatgg

SEQ ID NO: 801757 - DNA, 20 bp, Artificial
  CRISPR gRNA sequence
acacctgatggaactgttat

SEQ ID NO: 801758 - DNA, 20 bp, Artificial
  CRISPR gRNA sequence
atggaactgttatgactaaa

SEQ ID NO: 801759 - DNA, 20 bp, Artificial
  CRISPR gRNA sequence
ttatgactaaaaaccctttt

SEQ ID NO: 801760 - DNA, 20 bp, Artificial
  CRISPR gRNA sequence
tgactaaaaacccttttgca

SEQ ID NO: 801761 - DNA, 20 bp, Artificial
  CRISPR gRNA sequence
aaaacccttttgcaaataat

SEQ ID NO: 801762 - DNA, 20 bp, Artificial
  CRISPR gRNA sequence
ttgcaaataatgtggtatct

SEQ ID NO: 801763 - DNA, 20 bp, Artificial
  CRISPR gRNA sequence
tgcaaataatgtggtatcta

SEQ ID NO: 801764 - DNA, 20 bp, Artificial
  CRISPR gRNA sequence
gcaaataatgtggtatctaa

SEQ ID NO: 801765 - DNA, 20 bp, Artificial
  CRISPR gRNA sequence
caaataatgtggtatctaat

SEQ ID NO: 801766 - DNA, 20 bp, Artificial
  CRISPR gRNA sequence
attttctgctttcaacaaaa

SEQ ID NO: 801767 - DNA, 20 bp, Artificial
  CRISPR gRNA sequence
tctgctttcaacaaaattga

SEQ ID NO: 801768 - DNA, 20 bp, Artificial
  CRISPR gRNA sequence
ctgctttcaacaaaattgaa

SEQ ID NO: 801769 - DNA, 20 bp, Artificial
  CRISPR gRNA sequence
tgctttcaacaaaattgaag

SEQ ID NO: 801770 - DNA, 20 bp, Artificial
  CRISPR gRNA sequence
ctttcaacaaaattgaagga

SEQ ID NO: 801771 - DNA, 20 bp, Artificial
  CRISPR gRNA sequence
tcaacaaaattgaaggaggc

SEQ ID NO: 801772 - DNA, 20 bp, Artificial
  CRISPR gRNA sequence
caacaaaattgaaggaggcc

SEQ ID NO: 801773 - DNA, 20 bp, Artificial
  CRISPR gRNA sequence
aacaaaattgaaggaggccc

SEQ ID NO: 801774 - DNA, 20 bp, Artificial
  CRISPR gRNA sequence
aaggaggcccttataaagtt

SEQ ID NO: 801775 - DNA, 20 bp, Artificial
  CRISPR gRNA sequence
ataaagttaataactgataa

SEQ ID NO: 801776 - DNA, 20 bp, Artificial
  CRISPR gRNA sequence
taaagttaataactgataat

SEQ ID NO: 801777 - DNA, 20 bp, Artificial
  CRISPR gRNA sequence
ataactgataatcaaaaatg

SEQ ID NO: 801778 - DNA, 20 bp, Artificial
  CRISPR gRNA sequence
ataatcaaaaatgagtaatt

SEQ ID NO: 801779 - DNA, 20 bp, Artificial
  CRISPR gRNA sequence
ttgccatgtaaatcaggtca

SEQ ID NO: 801780 - DNA, 20 bp, Artificial
  CRISPR gRNA sequence
tgccatgtaaatcaggtcaa

SEQ ID NO: 801781 - DNA, 20 bp, Artificial
  CRISPR gRNA sequence
gccatgtaaatcaggtcaaa

SEQ ID NO: 801782 - DNA, 20 bp, Artificial
  CRISPR gRNA sequence
ccatgtaaatcaggtcaaag

SEQ ID NO: 801783 - DNA, 20 bp, Artificial
  CRISPR gRNA sequence
ctgtaacgaaactgcttcca

SEQ ID NO: 801784 - DNA, 20 bp, Artificial
  CRISPR gRNA sequence
taacgaaactgcttccattc

SEQ ID NO: 801785 - DNA, 20 bp, Artificial
  CRISPR gRNA sequence
cttccattcccattgattta

SEQ ID NO: 801786 - DNA, 20 bp, Artificial
  CRISPR gRNA sequence
ccattcccattgatttactc

SEQ ID NO: 801787 - DNA, 20 bp, Artificial
  CRISPR gRNA sequence
cattcccattgatttactca

SEQ ID NO: 801788 - DNA, 20 bp, Artificial
  CRISPR gRNA sequence
ccattgatttactcatacga

SEQ ID NO: 801789 - DNA, 20 bp, Artificial
  CRISPR gRNA sequence
atttactcatacgaacaaga

SEQ ID NO: 801790 - DNA, 20 bp, Artificial
  CRISPR gRNA sequence
actcatacgaacaagattcc

SEQ ID NO: 801791 - DNA, 20 bp, Artificial
  CRISPR gRNA sequence
ctcatacgaacaagattcct

SEQ ID NO: 801792 - DNA, 20 bp, Artificial
  CRISPR gRNA sequence
atacgaacaagattccttag

SEQ ID NO: 801793 - DNA, 20 bp, Artificial
  CRISPR gRNA sequence
cttagcctttataagctaca

SEQ ID NO: 801794 - DNA, 20 bp, Artificial
  CRISPR gRNA sequence
agcctttataagctacaaaa

SEQ ID NO: 801795 - DNA, 20 bp, Artificial
  CRISPR gRNA sequence
gcctttataagctacaaaaa

SEQ ID NO: 801796 - DNA, 20 bp, Artificial
  CRISPR gRNA sequence
tataagctacaaaaaaatga

SEQ ID NO: 801797 - DNA, 20 bp, Artificial
  CRISPR gRNA sequence
ataagctacaaaaaaatgaa

SEQ ID NO: 801798 - DNA, 20 bp, Artificial
  CRISPR gRNA sequence
taagctacaaaaaaatgaaa

SEQ ID NO: 801799 - DNA, 20 bp, Artificial
  CRISPR gRNA sequence
caaaaaaatgaaaaatagaa

SEQ ID NO: 801800 - DNA, 20 bp, Artificial
  CRISPR gRNA sequence
aggctgaattctattatata

SEQ ID NO: 801801 - DNA, 20 bp, Artificial
  CRISPR gRNA sequence
aattctattatataaaatca

SEQ ID NO: 801802 - DNA, 20 bp, Artificial
  CRISPR gRNA sequence
tattatataaaatcattcca

SEQ ID NO: 801803 - DNA, 20 bp, Artificial
  CRISPR gRNA sequence
ttatataaaatcattccaac

SEQ ID NO: 801804 - DNA, 20 bp, Artificial
  CRISPR gRNA sequence
tataaaatcattccaaccat

SEQ ID NO: 801805 - DNA, 20 bp, Artificial
  CRISPR gRNA sequence
caaccatgtcatatggttct

SEQ ID NO: 801806 - DNA, 20 bp, Artificial
  CRISPR gRNA sequence
ttcggattcatgaataattt

SEQ ID NO: 801807 - DNA, 20 bp, Artificial
  CRISPR gRNA sequence
cggattcatgaataatttgg

SEQ ID NO: 801808 - DNA, 20 bp, Artificial
  CRISPR gRNA sequence
ggattcatgaataatttgga

SEQ ID NO: 801809 - DNA, 20 bp, Artificial
  CRISPR gRNA sequence
atgaataatttggaaaagag

SEQ ID NO: 801810 - DNA, 20 bp, Artificial
  CRISPR gRNA sequence
ggaaaagagagccatatcca

SEQ ID NO: 801811 - DNA, 20 bp, Artificial
  CRISPR gRNA sequence
gaaaagagagccatatccat

SEQ ID NO: 801812 - DNA, 20 bp, Artificial
  CRISPR gRNA sequence
attaagggacacattcccaa

SEQ ID NO: 801813 - DNA, 20 bp, Artificial
  CRISPR gRNA sequence
ttaagggacacattcccaat

SEQ ID NO: 801814 - DNA, 20 bp, Artificial
  CRISPR gRNA sequence
agggacacattcccaataaa

SEQ ID NO: 801815 - DNA, 20 bp, Artificial
  CRISPR gRNA sequence
ccaataaattttcatctttc

SEQ ID NO: 801816 - DNA, 20 bp, Artificial
  CRISPR gRNA sequence
tcatctttcatgtttaataa

SEQ ID NO: 801817 - DNA, 20 bp, Artificial
  CRISPR gRNA sequence
catctttcatgtttaataat

SEQ ID NO: 801818 - DNA, 20 bp, Artificial
  CRISPR gRNA sequence
atctttcatgtttaataatt

SEQ ID NO: 801819 - DNA, 20 bp, Artificial
  CRISPR gRNA sequence
tcatgtttaataattatcaa

SEQ ID NO: 801820 - DNA, 20 bp, Artificial
  CRISPR gRNA sequence
catgtttaataattatcaat

SEQ ID NO: 801821 - DNA, 20 bp, Artificial
  CRISPR gRNA sequence
atgtttaataattatcaata

SEQ ID NO: 801822 - DNA, 20 bp, Artificial
  CRISPR gRNA sequence
aataattatcaatattcata

SEQ ID NO: 801823 - DNA, 20 bp, Artificial
  CRISPR gRNA sequence
ataattatcaatattcataa

SEQ ID NO: 801824 - DNA, 20 bp, Artificial
  CRISPR gRNA sequence
tcaatattcataacatttta

SEQ ID NO: 801825 - DNA, 20 bp, Artificial
  CRISPR gRNA sequence
ataacattttacattttgat

SEQ ID NO: 801826 - DNA, 20 bp, Artificial
  CRISPR gRNA sequence
tacattttgatcaaatatgt

SEQ ID NO: 801827 - DNA, 20 bp, Artificial
  CRISPR gRNA sequence
acattttgatcaaatatgtg

SEQ ID NO: 801828 - DNA, 20 bp, Artificial
  CRISPR gRNA sequence
cattttgatcaaatatgtgt

SEQ ID NO: 801829 - DNA, 20 bp, Artificial
  CRISPR gRNA sequence
tgatcaaatatgtgttaata

SEQ ID NO: 801830 - DNA, 20 bp, Artificial
  CRISPR gRNA sequence
gatcaaatatgtgttaataa

SEQ ID NO: 801831 - DNA, 20 bp, Artificial
  CRISPR gRNA sequence
atcaaatatgtgttaataat

SEQ ID NO: 801832 - DNA, 20 bp, Artificial
  CRISPR gRNA sequence
ataataatagaaataaatgt

SEQ ID NO: 801833 - DNA, 20 bp, Artificial
  CRISPR gRNA sequence
gattaagaaaatgtggcacg

SEQ ID NO: 801834 - DNA, 20 bp, Artificial
  CRISPR gRNA sequence
agaaaatgtggcacgtatac

SEQ ID NO: 801835 - DNA, 20 bp, Artificial
  CRISPR gRNA sequence
tgcagccataaaaaatgatg

SEQ ID NO: 801836 - DNA, 20 bp, Artificial
  CRISPR gRNA sequence
atgtccttcgtagggacatg

SEQ ID NO: 801837 - DNA, 20 bp, Artificial
  CRISPR gRNA sequence
cgtagggacatggatgaagc

SEQ ID NO: 801838 - DNA, 20 bp, Artificial
  CRISPR gRNA sequence
gtagggacatggatgaagct

SEQ ID NO: 801839 - DNA, 20 bp, Artificial
  CRISPR gRNA sequence
gaaaccatcattctcagcaa

SEQ ID NO: 801840 - DNA, 20 bp, Artificial
  CRISPR gRNA sequence
tcagcaaactatcccaagga

SEQ ID NO: 801841 - DNA, 20 bp, Artificial
  CRISPR gRNA sequence
agcaaactatcccaaggaca

SEQ ID NO: 801842 - DNA, 20 bp, Artificial
  CRISPR gRNA sequence
tcccaaggacaaaaaaccaa

SEQ ID NO: 801843 - DNA, 20 bp, Artificial
  CRISPR gRNA sequence
tcactcataggtgggaattg

SEQ ID NO: 801844 - DNA, 20 bp, Artificial
  CRISPR gRNA sequence
actcataggtgggaattgaa

SEQ ID NO: 801845 - DNA, 20 bp, Artificial
  CRISPR gRNA sequence
ataggtgggaattgaacaat

SEQ ID NO: 801846 - DNA, 20 bp, Artificial
  CRISPR gRNA sequence
aacaatgagaacacatggac

SEQ ID NO: 801847 - DNA, 20 bp, Artificial
  CRISPR gRNA sequence
gggactgttgtgtggtcggg

SEQ ID NO: 801848 - DNA, 20 bp, Artificial
  CRISPR gRNA sequence
ttgtgtggtcgggggagggg

SEQ ID NO: 801849 - DNA, 20 bp, Artificial
  CRISPR gRNA sequence
tgtggtcgggggaggggaga

SEQ ID NO: 801850 - DNA, 20 bp, Artificial
  CRISPR gRNA sequence
ggagatatacctaatgttta

SEQ ID NO: 801851 - DNA, 20 bp, Artificial
  CRISPR gRNA sequence
atgtttaatgacaagttaat

SEQ ID NO: 801852 - DNA, 20 bp, Artificial
  CRISPR gRNA sequence
aatgacaagttaatgggtgc

SEQ ID NO: 801853 - DNA, 20 bp, Artificial
  CRISPR gRNA sequence
atgacaagttaatgggtgca

SEQ ID NO: 801854 - DNA, 20 bp, Artificial
  CRISPR gRNA sequence
atgggtgcagcacaccaata

SEQ ID NO: 801855 - DNA, 20 bp, Artificial
  CRISPR gRNA sequence
cacgttgtgcacatgtaccc

SEQ ID NO: 801856 - DNA, 20 bp, Artificial
  CRISPR gRNA sequence
tgcacatgtaccctaaaact

SEQ ID NO: 801857 - DNA, 20 bp, Artificial
  CRISPR gRNA sequence
aaacttactgttaaaaaaaa

SEQ ID NO: 801858 - DNA, 20 bp, Artificial
  CRISPR gRNA sequence
actgttaaaaaaaaaaatta

SEQ ID NO: 801859 - DNA, 20 bp, Artificial
  CRISPR gRNA sequence
ctgttaaaaaaaaaaattag

SEQ ID NO: 801860 - DNA, 20 bp, Artificial
  CRISPR gRNA sequence
ttaaaaaaaaaaattagatc

SEQ ID NO: 801861 - DNA, 20 bp, Artificial
  CRISPR gRNA sequence
aaaaaaaaaattagatctta

SEQ ID NO: 801862 - DNA, 20 bp, Artificial
  CRISPR gRNA sequence
gatcttaatgcagaacaccc

SEQ ID NO: 801863 - DNA, 20 bp, Artificial
  CRISPR gRNA sequence
aatgcagaacaccctgaaca

SEQ ID NO: 801864 - DNA, 20 bp, Artificial
  CRISPR gRNA sequence
atgcagaacaccctgaacat

SEQ ID NO: 801865 - DNA, 20 bp, Artificial
  CRISPR gRNA sequence
aacatttaaagcttcatagt

SEQ ID NO: 801866 - DNA, 20 bp, Artificial
  CRISPR gRNA sequence
aaagcttcatagtcacaaga

SEQ ID NO: 801867 - DNA, 20 bp, Artificial
  CRISPR gRNA sequence
aagcttcatagtcacaagag

SEQ ID NO: 801868 - DNA, 20 bp, Artificial
  CRISPR gRNA sequence
catagtcacaagagaaaagt

SEQ ID NO: 801869 - DNA, 20 bp, Artificial
  CRISPR gRNA sequence
atagtcacaagagaaaagtt

SEQ ID NO: 801870 - DNA, 20 bp, Artificial
  CRISPR gRNA sequence
tcatttcaatagctataaat

SEQ ID NO: 801871 - DNA, 20 bp, Artificial
  CRISPR gRNA sequence
catttcaatagctataaata

SEQ ID NO: 801872 - DNA, 20 bp, Artificial
  CRISPR gRNA sequence
atttcaatagctataaatat

SEQ ID NO: 801873 - DNA, 20 bp, Artificial
  CRISPR gRNA sequence
caatagctataaatattttg

SEQ ID NO: 801874 - DNA, 20 bp, Artificial
  CRISPR gRNA sequence
aatagctataaatattttgt

SEQ ID NO: 801875 - DNA, 20 bp, Artificial
  CRISPR gRNA sequence
taaatattttgttgttgtaa

SEQ ID NO: 801876 - DNA, 20 bp, Artificial
  CRISPR gRNA sequence
tgttgttgtaaagacatata

SEQ ID NO: 801877 - DNA, 20 bp, Artificial
  CRISPR gRNA sequence
gttgttgtaaagacatataa

SEQ ID NO: 801878 - DNA, 20 bp, Artificial
  CRISPR gRNA sequence
ttgttgtaaagacatataac

SEQ ID NO: 801879 - DNA, 20 bp, Artificial
  CRISPR gRNA sequence
ttgtaaagacatataacgat

SEQ ID NO: 801880 - DNA, 20 bp, Artificial
  CRISPR gRNA sequence
taaagacatataacgataat

SEQ ID NO: 801881 - DNA, 20 bp, Artificial
  CRISPR gRNA sequence
tcaaacaaaaatatgttaca

SEQ ID NO: 801882 - DNA, 20 bp, Artificial
  CRISPR gRNA sequence
cattaagataaaattctgta

SEQ ID NO: 801883 - DNA, 20 bp, Artificial
  CRISPR gRNA sequence
agataaaattctgtagggaa

SEQ ID NO: 801884 - DNA, 20 bp, Artificial
  CRISPR gRNA sequence
tgtagggaaggtgaaattgg

SEQ ID NO: 801885 - DNA, 20 bp, Artificial
  CRISPR gRNA sequence
tagggaaggtgaaattggaa

SEQ ID NO: 801886 - DNA, 20 bp, Artificial
  CRISPR gRNA sequence
gaagtgagtttcaatgaatg

SEQ ID NO: 801887 - DNA, 20 bp, Artificial
  CRISPR gRNA sequence
caatgaatgaaaagaaacaa

SEQ ID NO: 801888 - DNA, 20 bp, Artificial
  CRISPR gRNA sequence
aatgaatgaaaagaaacaat

SEQ ID NO: 801889 - DNA, 20 bp, Artificial
  CRISPR gRNA sequence
agacagagaagaattttttc

SEQ ID NO: 801890 - DNA, 20 bp, Artificial
  CRISPR gRNA sequence
gacagagaagaattttttca

SEQ ID NO: 801891 - DNA, 20 bp, Artificial
  CRISPR gRNA sequence
tttcatttaataatttattt

SEQ ID NO: 801892 - DNA, 20 bp, Artificial
  CRISPR gRNA sequence
ttcatttaataatttattta

SEQ ID NO: 801893 - DNA, 20 bp, Artificial
  CRISPR gRNA sequence
tcatttaataatttatttat

SEQ ID NO: 801894 - DNA, 20 bp, Artificial
  CRISPR gRNA sequence
catttaataatttatttatt

SEQ ID NO: 801895 - DNA, 20 bp, Artificial
  CRISPR gRNA sequence
atttaataatttatttattt

SEQ ID NO: 801896 - DNA, 20 bp, Artificial
  CRISPR gRNA sequence
aataatttatttatttttac

SEQ ID NO: 801897 - DNA, 20 bp, Artificial
  CRISPR gRNA sequence
ataatttatttatttttact

SEQ ID NO: 801898 - DNA, 20 bp, Artificial
  CRISPR gRNA sequence
atttatttttacttagaagg

SEQ ID NO: 801899 - DNA, 20 bp, Artificial
  CRISPR gRNA sequence
tttatttttacttagaagga

SEQ ID NO: 801900 - DNA, 20 bp, Artificial
  CRISPR gRNA sequence
atttttacttagaaggaatt

SEQ ID NO: 801901 - DNA, 20 bp, Artificial
  CRISPR gRNA sequence
tttttacttagaaggaattg

SEQ ID NO: 801902 - DNA, 20 bp, Artificial
  CRISPR gRNA sequence
ttacttagaaggaattgaat

SEQ ID NO: 801903 - DNA, 20 bp, Artificial
  CRISPR gRNA sequence
tacttagaaggaattgaata

SEQ ID NO: 801904 - DNA, 20 bp, Artificial
  CRISPR gRNA sequence
acttagaaggaattgaatag

SEQ ID NO: 801905 - DNA, 20 bp, Artificial
  CRISPR gRNA sequence
cttagaaggaattgaataga

SEQ ID NO: 801906 - DNA, 20 bp, Artificial
  CRISPR gRNA sequence
agaaggaattgaatagatta

SEQ ID NO: 801907 - DNA, 20 bp, Artificial
  CRISPR gRNA sequence
gaaggaattgaatagattag

SEQ ID NO: 801908 - DNA, 20 bp, Artificial
  CRISPR gRNA sequence
aatagattaggttccttacc

SEQ ID NO: 801909 - DNA, 20 bp, Artificial
  CRISPR gRNA sequence
ggttccttacccaaaaagcc

SEQ ID NO: 801910 - DNA, 20 bp, Artificial
  CRISPR gRNA sequence
cttacccaaaaagcctctgt

SEQ ID NO: 801911 - DNA, 20 bp, Artificial
  CRISPR gRNA sequence
acccaaaaagcctctgttat

SEQ ID NO: 801912 - DNA, 20 bp, Artificial
  CRISPR gRNA sequence
cccaaaaagcctctgttatt

SEQ ID NO: 801913 - DNA, 20 bp, Artificial
  CRISPR gRNA sequence
tgttatttgtcttatttatt

SEQ ID NO: 801914 - DNA, 20 bp, Artificial
  CRISPR gRNA sequence
ttatttgtcttatttattta

SEQ ID NO: 801915 - DNA, 20 bp, Artificial
  CRISPR gRNA sequence
tttgtcttatttatttattc

SEQ ID NO: 801916 - DNA, 20 bp, Artificial
  CRISPR gRNA sequence
gtcttatttatttattctct

SEQ ID NO: 801917 - DNA, 20 bp, Artificial
  CRISPR gRNA sequence
tcttatttatttattctctt

SEQ ID NO: 801918 - DNA, 20 bp, Artificial
  CRISPR gRNA sequence
atttatttattctctttttt

SEQ ID NO: 801919 - DNA, 20 bp, Artificial
  CRISPR gRNA sequence
tttatttattctcttttttc

SEQ ID NO: 801920 - DNA, 20 bp, Artificial
  CRISPR gRNA sequence
atttattctcttttttccac

SEQ ID NO: 801921 - DNA, 20 bp, Artificial
  CRISPR gRNA sequence
tttattctcttttttccaca

SEQ ID NO: 801922 - DNA, 20 bp, Artificial
  CRISPR gRNA sequence
attctcttttttccacattc

SEQ ID NO: 801923 - DNA, 20 bp, Artificial
  CRISPR gRNA sequence
ttctcttttttccacattct

SEQ ID NO: 801924 - DNA, 20 bp, Artificial
  CRISPR gRNA sequence
tcttttttccacattctcca

SEQ ID NO: 801925 - DNA, 20 bp, Artificial
  CRISPR gRNA sequence
ttttttccacattctccagt

SEQ ID NO: 801926 - DNA, 20 bp, Artificial
  CRISPR gRNA sequence
ttttccacattctccagtct

SEQ ID NO: 801927 - DNA, 20 bp, Artificial
  CRISPR gRNA sequence
tttccacattctccagtctc

SEQ ID NO: 801928 - DNA, 20 bp, Artificial
  CRISPR gRNA sequence
ttccacattctccagtctca

SEQ ID NO: 801929 - DNA, 20 bp, Artificial
  CRISPR gRNA sequence
tccacattctccagtctcat

SEQ ID NO: 801930 - DNA, 20 bp, Artificial
  CRISPR gRNA sequence
ccacattctccagtctcatt

SEQ ID NO: 801931 - DNA, 20 bp, Artificial
  CRISPR gRNA sequence
cacattctccagtctcattc

SEQ ID NO: 801932 - DNA, 20 bp, Artificial
  CRISPR gRNA sequence
tccagtctcattcccctttt

SEQ ID NO: 801933 - DNA, 20 bp, Artificial
  CRISPR gRNA sequence
cagtctcattcccctttttt

SEQ ID NO: 801934 - DNA, 20 bp, Artificial
  CRISPR gRNA sequence
attccccttttttaacacag

SEQ ID NO: 801935 - DNA, 20 bp, Artificial
  CRISPR gRNA sequence
cccttttttaacacaggaaa

SEQ ID NO: 801936 - DNA, 20 bp, Artificial
  CRISPR gRNA sequence
ttttaacacaggaaattatt

SEQ ID NO: 801937 - DNA, 20 bp, Artificial
  CRISPR gRNA sequence
tttaacacaggaaattattc

SEQ ID NO: 801938 - DNA, 20 bp, Artificial
  CRISPR gRNA sequence
ttaacacaggaaattattcc

SEQ ID NO: 801939 - DNA, 20 bp, Artificial
  CRISPR gRNA sequence
taacacaggaaattattcca

SEQ ID NO: 801940 - DNA, 20 bp, Artificial
  CRISPR gRNA sequence
aacacaggaaattattccag

SEQ ID NO: 801941 - DNA, 20 bp, Artificial
  CRISPR gRNA sequence
acacaggaaattattccagc

SEQ ID NO: 801942 - DNA, 20 bp, Artificial
  CRISPR gRNA sequence
ttccagcatgtttcatacat

SEQ ID NO: 801943 - DNA, 20 bp, Artificial
  CRISPR gRNA sequence
cagcatgtttcatacatatt

SEQ ID NO: 801944 - DNA, 20 bp, Artificial
  CRISPR gRNA sequence
catacatattcttttgtttg

SEQ ID NO: 801945 - DNA, 20 bp, Artificial
  CRISPR gRNA sequence
atacatattcttttgtttgt

SEQ ID NO: 801946 - DNA, 20 bp, Artificial
  CRISPR gRNA sequence
ttttgtttgtaagagcttat

SEQ ID NO: 801947 - DNA, 20 bp, Artificial
  CRISPR gRNA sequence
ttgtttgtaagagcttattt

SEQ ID NO: 801948 - DNA, 20 bp, Artificial
  CRISPR gRNA sequence
tgtttgtaagagcttattta

SEQ ID NO: 801949 - DNA, 20 bp, Artificial
  CRISPR gRNA sequence
gtttgtaagagcttatttaa

SEQ ID NO: 801950 - DNA, 20 bp, Artificial
  CRISPR gRNA sequence
tttgtaagagcttatttaaa

SEQ ID NO: 801951 - DNA, 20 bp, Artificial
  CRISPR gRNA sequence
gtaagagcttatttaaaata

SEQ ID NO: 801952 - DNA, 20 bp, Artificial
  CRISPR gRNA sequence
taagagcttatttaaaatat

SEQ ID NO: 801953 - DNA, 20 bp, Artificial
  CRISPR gRNA sequence
atttaaaatatgtaatattg

SEQ ID NO: 801954 - DNA, 20 bp, Artificial
  CRISPR gRNA sequence
tttaaaatatgtaatattgt

SEQ ID NO: 801955 - DNA, 20 bp, Artificial
  CRISPR gRNA sequence
aaaatatgtaatattgtttt

SEQ ID NO: 801956 - DNA, 20 bp, Artificial
  CRISPR gRNA sequence
aaatatgtaatattgtttta

SEQ ID NO: 801957 - DNA, 20 bp, Artificial
  CRISPR gRNA sequence
ttttagatgcatatattttt

SEQ ID NO: 801958 - DNA, 20 bp, Artificial
  CRISPR gRNA sequence
tagatgcatatatttttttt

SEQ ID NO: 801959 - DNA, 20 bp, Artificial
  CRISPR gRNA sequence
agatgcatatattttttttc

SEQ ID NO: 801960 - DNA, 20 bp, Artificial
  CRISPR gRNA sequence
gatgcatatattttttttct

SEQ ID NO: 801961 - DNA, 20 bp, Artificial
  CRISPR gRNA sequence
tttttcttgtggaaactata

SEQ ID NO: 801962 - DNA, 20 bp, Artificial
  CRISPR gRNA sequence
ttttcttgtggaaactatat

SEQ ID NO: 801963 - DNA, 20 bp, Artificial
  CRISPR gRNA sequence
tttcttgtggaaactatatt

SEQ ID NO: 801964 - DNA, 20 bp, Artificial
  CRISPR gRNA sequence
ttcttgtggaaactatattg

SEQ ID NO: 801965 - DNA, 20 bp, Artificial
  CRISPR gRNA sequence
tcttgtggaaactatattgt

SEQ ID NO: 801966 - DNA, 20 bp, Artificial
  CRISPR gRNA sequence
cttgtggaaactatattgta

SEQ ID NO: 801967 - DNA, 20 bp, Artificial
  CRISPR gRNA sequence
ttgtggaaactatattgtac

SEQ ID NO: 801968 - DNA, 20 bp, Artificial
  CRISPR gRNA sequence
gtggaaactatattgtacta

SEQ ID NO: 801969 - DNA, 20 bp, Artificial
  CRISPR gRNA sequence
tggaaactatattgtactat

SEQ ID NO: 801970 - DNA, 20 bp, Artificial
  CRISPR gRNA sequence
tattgtactatatatatata

SEQ ID NO: 801971 - DNA, 20 bp, Artificial
  CRISPR gRNA sequence
tactatatatatatatttta

SEQ ID NO: 801972 - DNA, 20 bp, Artificial
  CRISPR gRNA sequence
tatatatatattttagaaat

SEQ ID NO: 801973 - DNA, 20 bp, Artificial
  CRISPR gRNA sequence
tagaaatggacacattaggc

SEQ ID NO: 801974 - DNA, 20 bp, Artificial
  CRISPR gRNA sequence
agaaatggacacattaggcc

SEQ ID NO: 801975 - DNA, 20 bp, Artificial
  CRISPR gRNA sequence
gaaatggacacattaggccg

SEQ ID NO: 801976 - DNA, 20 bp, Artificial
  CRISPR gRNA sequence
ggccgggcgcggtggctcac

SEQ ID NO: 801977 - DNA, 20 bp, Artificial
  CRISPR gRNA sequence
acgaccgtaatcccagcact

SEQ ID NO: 801978 - DNA, 20 bp, Artificial
  CRISPR gRNA sequence
tgggaggccaaggcgggtgg

SEQ ID NO: 801979 - DNA, 20 bp, Artificial
  CRISPR gRNA sequence
gggaggccaaggcgggtgga

SEQ ID NO: 801980 - DNA, 20 bp, Artificial
  CRISPR gRNA sequence
ggaggccaaggcgggtggat

SEQ ID NO: 801981 - DNA, 20 bp, Artificial
  CRISPR gRNA sequence
gctaacatggtgaaaccctg

SEQ ID NO: 801982 - DNA, 20 bp, Artificial
  CRISPR gRNA sequence
acatggtgaaaccctgtctc

SEQ ID NO: 801983 - DNA, 20 bp, Artificial
  CRISPR gRNA sequence
tctctactaaaaaatacaac

SEQ ID NO: 801984 - DNA, 20 bp, Artificial
  CRISPR gRNA sequence
tactaaaaaatacaacaaaa

SEQ ID NO: 801985 - DNA, 20 bp, Artificial
  CRISPR gRNA sequence
ctaaaaaatacaacaaaaat

SEQ ID NO: 801986 - DNA, 20 bp, Artificial
  CRISPR gRNA sequence
aaaaatacaacaaaaattag

SEQ ID NO: 801987 - DNA, 20 bp, Artificial
  CRISPR gRNA sequence
gccgggcgcggtggcgggcg

SEQ ID NO: 801988 - DNA, 20 bp, Artificial
  CRISPR gRNA sequence
tagtcccagctactggggag

SEQ ID NO: 801989 - DNA, 20 bp, Artificial
  CRISPR gRNA sequence
ctggggaggctgaggcagga

SEQ ID NO: 801990 - DNA, 20 bp, Artificial
  CRISPR gRNA sequence
gggaggctgaggcaggagaa

SEQ ID NO: 801991 - DNA, 20 bp, Artificial
  CRISPR gRNA sequence
aggcaggagaatggcgttaa

SEQ ID NO: 801992 - DNA, 20 bp, Artificial
  CRISPR gRNA sequence
agccgggaggcggagcttgt

SEQ ID NO: 801993 - DNA, 20 bp, Artificial
  CRISPR gRNA sequence
gtagtgagccgagatcgctc

SEQ ID NO: 801994 - DNA, 20 bp, Artificial
  CRISPR gRNA sequence
tagtgagccgagatcgctcc

SEQ ID NO: 801995 - DNA, 20 bp, Artificial
  CRISPR gRNA sequence
cactgcactccagcctgggc

SEQ ID NO: 801996 - DNA, 20 bp, Artificial
  CRISPR gRNA sequence
cactccagcctgggcgacag

SEQ ID NO: 801997 - DNA, 20 bp, Artificial
  CRISPR gRNA sequence
cagcctgggcgacagagcga

SEQ ID NO: 801998 - DNA, 20 bp, Artificial
  CRISPR gRNA sequence
ggcgacagagcgagactctg

SEQ ID NO: 801999 - DNA, 20 bp, Artificial
  CRISPR gRNA sequence
tgtctcaaaaaaagaaaaaa

SEQ ID NO: 802000 - DNA, 20 bp, Artificial
  CRISPR gRNA sequence
tctcaaaaaaagaaaaaaaa

SEQ ID NO: 802001 - DNA, 20 bp, Artificial
  CRISPR gRNA sequence
aaaaaaagaaaaaaaaaaaa

SEQ ID NO: 802002 - DNA, 20 bp, Artificial
  CRISPR gRNA sequence
acacattaagtttattgtga

SEQ ID NO: 802003 - DNA, 20 bp, Artificial
  CRISPR gRNA sequence
agtttattgtgaaaacatga

SEQ ID NO: 802004 - DNA, 20 bp, Artificial
  CRISPR gRNA sequence
attgtgaaaacatgattaca

SEQ ID NO: 802005 - DNA, 20 bp, Artificial
  CRISPR gRNA sequence
ttgtgaaaacatgattacaa

SEQ ID NO: 802006 - DNA, 20 bp, Artificial
  CRISPR gRNA sequence
tgaaaacatgattacaagca

SEQ ID NO: 802007 - DNA, 20 bp, Artificial
  CRISPR gRNA sequence
caagcaataacagatataac

SEQ ID NO: 802008 - DNA, 20 bp, Artificial
  CRISPR gRNA sequence
tgaagttatgtgcaccttct

SEQ ID NO: 802009 - DNA, 20 bp, Artificial
  CRISPR gRNA sequence
tgtgcaccttcttttgagat

SEQ ID NO: 802010 - DNA, 20 bp, Artificial
  CRISPR gRNA sequence
cttttgagatcatttttttg

SEQ ID NO: 802011 - DNA, 20 bp, Artificial
  CRISPR gRNA sequence
ttttgagatcatttttttgg

SEQ ID NO: 802012 - DNA, 20 bp, Artificial
  CRISPR gRNA sequence
ttgagatcatttttttgggt

SEQ ID NO: 802013 - DNA, 20 bp, Artificial
  CRISPR gRNA sequence
tgagatcatttttttgggta

SEQ ID NO: 802014 - DNA, 20 bp, Artificial
  CRISPR gRNA sequence
gagatcatttttttgggtat

SEQ ID NO: 802015 - DNA, 20 bp, Artificial
  CRISPR gRNA sequence
agatcatttttttgggtata

SEQ ID NO: 802016 - DNA, 20 bp, Artificial
  CRISPR gRNA sequence
ttttgggtatatgtgaatgt

SEQ ID NO: 802017 - DNA, 20 bp, Artificial
  CRISPR gRNA sequence
tttgggtatatgtgaatgta

SEQ ID NO: 802018 - DNA, 20 bp, Artificial
  CRISPR gRNA sequence
ttgggtatatgtgaatgtat

SEQ ID NO: 802019 - DNA, 20 bp, Artificial
  CRISPR gRNA sequence
tgggtatatgtgaatgtatt

SEQ ID NO: 802020 - DNA, 20 bp, Artificial
  CRISPR gRNA sequence
gggtatatgtgaatgtattt

SEQ ID NO: 802021 - DNA, 20 bp, Artificial
  CRISPR gRNA sequence
ggtatatgtgaatgtatttt

SEQ ID NO: 802022 - DNA, 20 bp, Artificial
  CRISPR gRNA sequence
tatctttttttaattgacaa

SEQ ID NO: 802023 - DNA, 20 bp, Artificial
  CRISPR gRNA sequence
atctttttttaattgacaat

SEQ ID NO: 802024 - DNA, 20 bp, Artificial
  CRISPR gRNA sequence
tctttttttaattgacaata

SEQ ID NO: 802025 - DNA, 20 bp, Artificial
  CRISPR gRNA sequence
tttttaattgacaataattg

SEQ ID NO: 802026 - DNA, 20 bp, Artificial
  CRISPR gRNA sequence
ttttaattgacaataattgt

SEQ ID NO: 802027 - DNA, 20 bp, Artificial
  CRISPR gRNA sequence
tttaattgacaataattgta

SEQ ID NO: 802028 - DNA, 20 bp, Artificial
  CRISPR gRNA sequence
ttaattgacaataattgtac

SEQ ID NO: 802029 - DNA, 20 bp, Artificial
  CRISPR gRNA sequence
taattgacaataattgtact

SEQ ID NO: 802030 - DNA, 20 bp, Artificial
  CRISPR gRNA sequence
aattgacaataattgtactt

SEQ ID NO: 802031 - DNA, 20 bp, Artificial
  CRISPR gRNA sequence
attgacaataattgtactta

SEQ ID NO: 802032 - DNA, 20 bp, Artificial
  CRISPR gRNA sequence
acaataattgtacttattta

SEQ ID NO: 802033 - DNA, 20 bp, Artificial
  CRISPR gRNA sequence
tacttatttatgggatacat

SEQ ID NO: 802034 - DNA, 20 bp, Artificial
  CRISPR gRNA sequence
atttatgggatacatagtga

SEQ ID NO: 802035 - DNA, 20 bp, Artificial
  CRISPR gRNA sequence
tttatgggatacatagtgat

SEQ ID NO: 802036 - DNA, 20 bp, Artificial
  CRISPR gRNA sequence
atgggatacatagtgatgtt

SEQ ID NO: 802037 - DNA, 20 bp, Artificial
  CRISPR gRNA sequence
tgggatacatagtgatgttt

SEQ ID NO: 802038 - DNA, 20 bp, Artificial
  CRISPR gRNA sequence
caatatatacaatgtatagt

SEQ ID NO: 802039 - DNA, 20 bp, Artificial
  CRISPR gRNA sequence
aatatatacaatgtatagtg

SEQ ID NO: 802040 - DNA, 20 bp, Artificial
  CRISPR gRNA sequence
gcatatttatcatctcaaat

SEQ ID NO: 802041 - DNA, 20 bp, Artificial
  CRISPR gRNA sequence
atcatctcaaatatttatta

SEQ ID NO: 802042 - DNA, 20 bp, Artificial
  CRISPR gRNA sequence
tcatctcaaatatttattat

SEQ ID NO: 802043 - DNA, 20 bp, Artificial
  CRISPR gRNA sequence
aaatatttattatttctttg

SEQ ID NO: 802044 - DNA, 20 bp, Artificial
  CRISPR gRNA sequence
attatttctttgtgttgaga

SEQ ID NO: 802045 - DNA, 20 bp, Artificial
  CRISPR gRNA sequence
ttatttctttgtgttgagaa

SEQ ID NO: 802046 - DNA, 20 bp, Artificial
  CRISPR gRNA sequence
tttctttgtgttgagaacat

SEQ ID NO: 802047 - DNA, 20 bp, Artificial
  CRISPR gRNA sequence
ctttgtgttgagaacattca

SEQ ID NO: 802048 - DNA, 20 bp, Artificial
  CRISPR gRNA sequence
tttgtgttgagaacattcaa

SEQ ID NO: 802049 - DNA, 20 bp, Artificial
  CRISPR gRNA sequence
tgtgttgagaacattcaatg

SEQ ID NO: 802050 - DNA, 20 bp, Artificial
  CRISPR gRNA sequence
gtgttgagaacattcaatgt

SEQ ID NO: 802051 - DNA, 20 bp, Artificial
  CRISPR gRNA sequence
tgttgagaacattcaatgta

SEQ ID NO: 802052 - DNA, 20 bp, Artificial
  CRISPR gRNA sequence
agaacattcaatgtacccct

SEQ ID NO: 802053 - DNA, 20 bp, Artificial
  CRISPR gRNA sequence
aatgtaccccttctggctat

SEQ ID NO: 802054 - DNA, 20 bp, Artificial
  CRISPR gRNA sequence
ctggctatttgaagctatat

SEQ ID NO: 802055 - DNA, 20 bp, Artificial
  CRISPR gRNA sequence
tggctatttgaagctatata

SEQ ID NO: 802056 - DNA, 20 bp, Artificial
  CRISPR gRNA sequence
gctatttgaagctatatact

SEQ ID NO: 802057 - DNA, 20 bp, Artificial
  CRISPR gRNA sequence
tttgaagctatatactgttg

SEQ ID NO: 802058 - DNA, 20 bp, Artificial
  CRISPR gRNA sequence
gaagctatatactgttgtta

SEQ ID NO: 802059 - DNA, 20 bp, Artificial
  CRISPR gRNA sequence
aagctatatactgttgttaa

SEQ ID NO: 802060 - DNA, 20 bp, Artificial
  CRISPR gRNA sequence
tatactgttgttaaatattt

SEQ ID NO: 802061 - DNA, 20 bp, Artificial
  CRISPR gRNA sequence
ttgttaaatatttatatgta

SEQ ID NO: 802062 - DNA, 20 bp, Artificial
  CRISPR gRNA sequence
ttaaatatttatatgtattt

SEQ ID NO: 802063 - DNA, 20 bp, Artificial
  CRISPR gRNA sequence
aatatttatatgtatttttc

SEQ ID NO: 802064 - DNA, 20 bp, Artificial
  CRISPR gRNA sequence
atatgtatttttcaaggata

SEQ ID NO: 802065 - DNA, 20 bp, Artificial
  CRISPR gRNA sequence
tatgtatttttcaaggataa

SEQ ID NO: 802066 - DNA, 20 bp, Artificial
  CRISPR gRNA sequence
ttcaaggataatgttgtata

SEQ ID NO: 802067 - DNA, 20 bp, Artificial
  CRISPR gRNA sequence
tcaaggataatgttgtatat

SEQ ID NO: 802068 - DNA, 20 bp, Artificial
  CRISPR gRNA sequence
caaggataatgttgtatata

SEQ ID NO: 802069 - DNA, 20 bp, Artificial
  CRISPR gRNA sequence
aaggataatgttgtatataa

SEQ ID NO: 802070 - DNA, 20 bp, Artificial
  CRISPR gRNA sequence
tatataaaagataacttctt

SEQ ID NO: 802071 - DNA, 20 bp, Artificial
  CRISPR gRNA sequence
cttttatatttagtcacctt

SEQ ID NO: 802072 - DNA, 20 bp, Artificial
  CRISPR gRNA sequence
ttttatatttagtcaccttt

SEQ ID NO: 802073 - DNA, 20 bp, Artificial
  CRISPR gRNA sequence
ttatatttagtcacctttgg

SEQ ID NO: 802074 - DNA, 20 bp, Artificial
  CRISPR gRNA sequence
tatatttagtcacctttgga

SEQ ID NO: 802075 - DNA, 20 bp, Artificial
  CRISPR gRNA sequence
atatttagtcacctttggat

SEQ ID NO: 802076 - DNA, 20 bp, Artificial
  CRISPR gRNA sequence
tatttagtcacctttggata

SEQ ID NO: 802077 - DNA, 20 bp, Artificial
  CRISPR gRNA sequence
agtcacctttggatacatat

SEQ ID NO: 802078 - DNA, 20 bp, Artificial
  CRISPR gRNA sequence
gtcacctttggatacatatg

SEQ ID NO: 802079 - DNA, 20 bp, Artificial
  CRISPR gRNA sequence
tggatacatatgtaagagta

SEQ ID NO: 802080 - DNA, 20 bp, Artificial
  CRISPR gRNA sequence
ggatacatatgtaagagtaa

SEQ ID NO: 802081 - DNA, 20 bp, Artificial
  CRISPR gRNA sequence
gatacatatgtaagagtaaa

SEQ ID NO: 802082 - DNA, 20 bp, Artificial
  CRISPR gRNA sequence
ttttactaaaaaaattcata

SEQ ID NO: 802083 - DNA, 20 bp, Artificial
  CRISPR gRNA sequence
tactaaaaaaattcataaga

SEQ ID NO: 802084 - DNA, 20 bp, Artificial
  CRISPR gRNA sequence
actaaaaaaattcataagat

SEQ ID NO: 802085 - DNA, 20 bp, Artificial
  CRISPR gRNA sequence
ctaaaaaaattcataagatg

SEQ ID NO: 802086 - DNA, 20 bp, Artificial
  CRISPR gRNA sequence
aaaaaattcataagatgctg

SEQ ID NO: 802087 - DNA, 20 bp, Artificial
  CRISPR gRNA sequence
ataagatgctgaacattata

SEQ ID NO: 802088 - DNA, 20 bp, Artificial
  CRISPR gRNA sequence
aacattatatgtttttccag

SEQ ID NO: 802089 - DNA, 20 bp, Artificial
  CRISPR gRNA sequence
tatgtttttccagtatagaa

SEQ ID NO: 802090 - DNA, 20 bp, Artificial
  CRISPR gRNA sequence
ttccagtatagaaacttatg

SEQ ID NO: 802091 - DNA, 20 bp, Artificial
  CRISPR gRNA sequence
tccagtatagaaacttatga

SEQ ID NO: 802092 - DNA, 20 bp, Artificial
  CRISPR gRNA sequence
ccagtatagaaacttatgaa

SEQ ID NO: 802093 - DNA, 20 bp, Artificial
  CRISPR gRNA sequence
cagtatagaaacttatgaaa

SEQ ID NO: 802094 - DNA, 20 bp, Artificial
  CRISPR gRNA sequence
atgaaaaattataagaatca

SEQ ID NO: 802095 - DNA, 20 bp, Artificial
  CRISPR gRNA sequence
tgaaaaattataagaatcaa

SEQ ID NO: 802096 - DNA, 20 bp, Artificial
  CRISPR gRNA sequence
taagaatcaacttaataggt

SEQ ID NO: 802097 - DNA, 20 bp, Artificial
  CRISPR gRNA sequence
aataggtgagaagagcatac

SEQ ID NO: 802098 - DNA, 20 bp, Artificial
  CRISPR gRNA sequence
ataggtgagaagagcatact

SEQ ID NO: 802099 - DNA, 20 bp, Artificial
  CRISPR gRNA sequence
catcatacttattttaggag

SEQ ID NO: 802100 - DNA, 20 bp, Artificial
  CRISPR gRNA sequence
attttaggaggaatacaagc

SEQ ID NO: 802101 - DNA, 20 bp, Artificial
  CRISPR gRNA sequence
ttttaggaggaatacaagca

SEQ ID NO: 802102 - DNA, 20 bp, Artificial
  CRISPR gRNA sequence
taggaggaatacaagcaaaa

SEQ ID NO: 802103 - DNA, 20 bp, Artificial
  CRISPR gRNA sequence
aggaggaatacaagcaaaaa

SEQ ID NO: 802104 - DNA, 20 bp, Artificial
  CRISPR gRNA sequence
ggaggaatacaagcaaaaaa

SEQ ID NO: 802105 - DNA, 20 bp, Artificial
  CRISPR gRNA sequence
gaccatcacctaagagtagg

SEQ ID NO: 802106 - DNA, 20 bp, Artificial
  CRISPR gRNA sequence
agagtaggctaccctgatcc

SEQ ID NO: 802107 - DNA, 20 bp, Artificial
  CRISPR gRNA sequence
ccctgatccagggtctctaa

SEQ ID NO: 802108 - DNA, 20 bp, Artificial
  CRISPR gRNA sequence
atccagggtctctaaaagaa

SEQ ID NO: 802109 - DNA, 20 bp, Artificial
  CRISPR gRNA sequence
taaaagaagcaagatagatc

SEQ ID NO: 802110 - DNA, 20 bp, Artificial
  CRISPR gRNA sequence
aaagaagcaagatagatctg

SEQ ID NO: 802111 - DNA, 20 bp, Artificial
  CRISPR gRNA sequence
aggccccaatgagggttccc

SEQ ID NO: 802112 - DNA, 20 bp, Artificial
  CRISPR gRNA sequence
ccatgaatgaagtaggacta

SEQ ID NO: 802113 - DNA, 20 bp, Artificial
  CRISPR gRNA sequence
gaagaaggacatgtttttat

SEQ ID NO: 802114 - DNA, 20 bp, Artificial
  CRISPR gRNA sequence
ttatcttaaagtgcctgatc

SEQ ID NO: 802115 - DNA, 20 bp, Artificial
  CRISPR gRNA sequence
tatcttaaagtgcctgatcc

SEQ ID NO: 802116 - DNA, 20 bp, Artificial
  CRISPR gRNA sequence
atcttaaagtgcctgatcca

SEQ ID NO: 802117 - DNA, 20 bp, Artificial
  CRISPR gRNA sequence
tcttaaagtgcctgatccat

SEQ ID NO: 802118 - DNA, 20 bp, Artificial
  CRISPR gRNA sequence
aaagtgcctgatccatggca

SEQ ID NO: 802119 - DNA, 20 bp, Artificial
  CRISPR gRNA sequence
aagtgcctgatccatggcat

SEQ ID NO: 802120 - DNA, 20 bp, Artificial
  CRISPR gRNA sequence
atccatggcataaagcttga

SEQ ID NO: 802121 - DNA, 20 bp, Artificial
  CRISPR gRNA sequence
gaaaatgggtttgtttatag

SEQ ID NO: 802122 - DNA, 20 bp, Artificial
  CRISPR gRNA sequence
aaaatgggtttgtttatagc

SEQ ID NO: 802123 - DNA, 20 bp, Artificial
  CRISPR gRNA sequence
gtttatagcaccttcgttga

SEQ ID NO: 802124 - DNA, 20 bp, Artificial
  CRISPR gRNA sequence
tttatagcaccttcgttgat

SEQ ID NO: 802125 - DNA, 20 bp, Artificial
  CRISPR gRNA sequence
atagcaccttcgttgatgtc

SEQ ID NO: 802126 - DNA, 20 bp, Artificial
  CRISPR gRNA sequence
tagcaccttcgttgatgtct

SEQ ID NO: 802127 - DNA, 20 bp, Artificial
  CRISPR gRNA sequence
cgttgatgtctgggcagaaa

SEQ ID NO: 802128 - DNA, 20 bp, Artificial
  CRISPR gRNA sequence
gttgatgtctgggcagaaat

SEQ ID NO: 802129 - DNA, 20 bp, Artificial
  CRISPR gRNA sequence
atgtctgggcagaaattctt

SEQ ID NO: 802130 - DNA, 20 bp, Artificial
  CRISPR gRNA sequence
ggcagaaattcttatcaaat

SEQ ID NO: 802131 - DNA, 20 bp, Artificial
  CRISPR gRNA sequence
ttatcaaatataatgaaaag

SEQ ID NO: 802132 - DNA, 20 bp, Artificial
  CRISPR gRNA sequence
atcaaatataatgaaaagag

SEQ ID NO: 802133 - DNA, 20 bp, Artificial
  CRISPR gRNA sequence
tcaaatataatgaaaagagt

SEQ ID NO: 802134 - DNA, 20 bp, Artificial
  CRISPR gRNA sequence
atttcaaaaggacagaacaa

SEQ ID NO: 802135 - DNA, 20 bp, Artificial
  CRISPR gRNA sequence
caaaaggacagaacaaatta

SEQ ID NO: 802136 - DNA, 20 bp, Artificial
  CRISPR gRNA sequence
aaaaggacagaacaaattat

SEQ ID NO: 802137 - DNA, 20 bp, Artificial
  CRISPR gRNA sequence
tgaggtggaatgaccggaga

SEQ ID NO: 802138 - DNA, 20 bp, Artificial
  CRISPR gRNA sequence
tggaagagacagtgataaag

SEQ ID NO: 802139 - DNA, 20 bp, Artificial
  CRISPR gRNA sequence
gaagagacagtgataaagga

SEQ ID NO: 802140 - DNA, 20 bp, Artificial
  CRISPR gRNA sequence
tggtttctgaaaagccaggt

SEQ ID NO: 802141 - DNA, 20 bp, Artificial
  CRISPR gRNA sequence
ctgaaaagccaggtggcacc

SEQ ID NO: 802142 - DNA, 20 bp, Artificial
  CRISPR gRNA sequence
tgaaaagccaggtggcacct

SEQ ID NO: 802143 - DNA, 20 bp, Artificial
  CRISPR gRNA sequence
aaaagccaggtggcacctac

SEQ ID NO: 802144 - DNA, 20 bp, Artificial
  CRISPR gRNA sequence
catttctgggggcaatccat

SEQ ID NO: 802145 - DNA, 20 bp, Artificial
  CRISPR gRNA sequence
ctgggggcaatccatctgag

SEQ ID NO: 802146 - DNA, 20 bp, Artificial
  CRISPR gRNA sequence
tgggggcaatccatctgagg

SEQ ID NO: 802147 - DNA, 20 bp, Artificial
  CRISPR gRNA sequence
ggggcaatccatctgaggaa

SEQ ID NO: 802148 - DNA, 20 bp, Artificial
  CRISPR gRNA sequence
aggaaggggcgggagcatgg

SEQ ID NO: 802149 - DNA, 20 bp, Artificial
  CRISPR gRNA sequence
tcagaggagctggggttgag

SEQ ID NO: 802150 - DNA, 20 bp, Artificial
  CRISPR gRNA sequence
agaggagctggggttgagaa

SEQ ID NO: 802151 - DNA, 20 bp, Artificial
  CRISPR gRNA sequence
gggttgagaactggtctgtg

SEQ ID NO: 802152 - DNA, 20 bp, Artificial
  CRISPR gRNA sequence
agaactggtctgtgcaaagg

SEQ ID NO: 802153 - DNA, 20 bp, Artificial
  CRISPR gRNA sequence
gtctgtgcaaaggtttccag

SEQ ID NO: 802154 - DNA, 20 bp, Artificial
  CRISPR gRNA sequence
tgcaaaggtttccagacagg

SEQ ID NO: 802155 - DNA, 20 bp, Artificial
  CRISPR gRNA sequence
ccagacagggttgcagagga

SEQ ID NO: 802156 - DNA, 20 bp, Artificial
  CRISPR gRNA sequence
cagacagggttgcagaggag

SEQ ID NO: 802157 - DNA, 20 bp, Artificial
  CRISPR gRNA sequence
cagaggaggcactaaaaaca

SEQ ID NO: 802158 - DNA, 20 bp, Artificial
  CRISPR gRNA sequence
aaaacaagaacaccaagagc

SEQ ID NO: 802159 - DNA, 20 bp, Artificial
  CRISPR gRNA sequence
aaggcctgggcagggcaggg

SEQ ID NO: 802160 - DNA, 20 bp, Artificial
  CRISPR gRNA sequence
ggcagggcagggggatggga

SEQ ID NO: 802161 - DNA, 20 bp, Artificial
  CRISPR gRNA sequence
aagctgacagaagtacttca

SEQ ID NO: 802162 - DNA, 20 bp, Artificial
  CRISPR gRNA sequence
acagaagtacttcaaaccag

SEQ ID NO: 802163 - DNA, 20 bp, Artificial
  CRISPR gRNA sequence
caaaccagaaacaatgaatt

SEQ ID NO: 802164 - DNA, 20 bp, Artificial
  CRISPR gRNA sequence
aaaccagaaacaatgaattt

SEQ ID NO: 802165 - DNA, 20 bp, Artificial
  CRISPR gRNA sequence
aaactatgccctaccacaaa

SEQ ID NO: 802166 - DNA, 20 bp, Artificial
  CRISPR gRNA sequence
aactatgccctaccacaaat

SEQ ID NO: 802167 - DNA, 20 bp, Artificial
  CRISPR gRNA sequence
tgccctaccacaaatagact

SEQ ID NO: 802168 - DNA, 20 bp, Artificial
  CRISPR gRNA sequence
ccacaaatagacttaacaga

SEQ ID NO: 802169 - DNA, 20 bp, Artificial
  CRISPR gRNA sequence
aacagatatttacagaacat

SEQ ID NO: 802170 - DNA, 20 bp, Artificial
  CRISPR gRNA sequence
acagatatttacagaacatt

SEQ ID NO: 802171 - DNA, 20 bp, Artificial
  CRISPR gRNA sequence
acagaacattctacccaaca

SEQ ID NO: 802172 - DNA, 20 bp, Artificial
  CRISPR gRNA sequence
cagaacattctacccaacaa

SEQ ID NO: 802173 - DNA, 20 bp, Artificial
  CRISPR gRNA sequence
tacccaacaatcgcagaata

SEQ ID NO: 802174 - DNA, 20 bp, Artificial
  CRISPR gRNA sequence
cccaacaatcgcagaatata

SEQ ID NO: 802175 - DNA, 20 bp, Artificial
  CRISPR gRNA sequence
tattcatcagcatatggaac

SEQ ID NO: 802176 - DNA, 20 bp, Artificial
  CRISPR gRNA sequence
ttcatcagcatatggaacat

SEQ ID NO: 802177 - DNA, 20 bp, Artificial
  CRISPR gRNA sequence
atcagcatatggaacattct

SEQ ID NO: 802178 - DNA, 20 bp, Artificial
  CRISPR gRNA sequence
tccaagatagactatatagt

SEQ ID NO: 802179 - DNA, 20 bp, Artificial
  CRISPR gRNA sequence
caagatagactatatagtag

SEQ ID NO: 802180 - DNA, 20 bp, Artificial
  CRISPR gRNA sequence
tatagtaggccacaaaacaa

SEQ ID NO: 802181 - DNA, 20 bp, Artificial
  CRISPR gRNA sequence
cataaatttaagaaaatcaa

SEQ ID NO: 802182 - DNA, 20 bp, Artificial
  CRISPR gRNA sequence
aagaaaatcaaaattatatc

SEQ ID NO: 802183 - DNA, 20 bp, Artificial
  CRISPR gRNA sequence
agaaaatcaaaattatatca

SEQ ID NO: 802184 - DNA, 20 bp, Artificial
  CRISPR gRNA sequence
tatcaagtactctcttagat

SEQ ID NO: 802185 - DNA, 20 bp, Artificial
  CRISPR gRNA sequence
tcttagatcacagtggagta

SEQ ID NO: 802186 - DNA, 20 bp, Artificial
  CRISPR gRNA sequence
ttagatcacagtggagtaaa

SEQ ID NO: 802187 - DNA, 20 bp, Artificial
  CRISPR gRNA sequence
agatcacagtggagtaaaac

SEQ ID NO: 802188 - DNA, 20 bp, Artificial
  CRISPR gRNA sequence
gatcacagtggagtaaaact

SEQ ID NO: 802189 - DNA, 20 bp, Artificial
  CRISPR gRNA sequence
gaaataaactccaaaaggaa

SEQ ID NO: 802190 - DNA, 20 bp, Artificial
  CRISPR gRNA sequence
caaaaggaaccttcaaaacc

SEQ ID NO: 802191 - DNA, 20 bp, Artificial
  CRISPR gRNA sequence
caaaaccatgcaattacatg

SEQ ID NO: 802192 - DNA, 20 bp, Artificial
  CRISPR gRNA sequence
aaaaccatgcaattacatgg

SEQ ID NO: 802193 - DNA, 20 bp, Artificial
  CRISPR gRNA sequence
catggaagttaaataatgag

SEQ ID NO: 802194 - DNA, 20 bp, Artificial
  CRISPR gRNA sequence
aataatgagtgatcattggg

SEQ ID NO: 802195 - DNA, 20 bp, Artificial
  CRISPR gRNA sequence
ggtgaacaatgaaatcaaga

SEQ ID NO: 802196 - DNA, 20 bp, Artificial
  CRISPR gRNA sequence
aaaaactctttgaactgaac

SEQ ID NO: 802197 - DNA, 20 bp, Artificial
  CRISPR gRNA sequence
aaaactctttgaactgaacg

SEQ ID NO: 802198 - DNA, 20 bp, Artificial
  CRISPR gRNA sequence
tttgaactgaacgataatag

SEQ ID NO: 802199 - DNA, 20 bp, Artificial
  CRISPR gRNA sequence
tgaactgaacgataatagtg

SEQ ID NO: 802200 - DNA, 20 bp, Artificial
  CRISPR gRNA sequence
gaactgaacgataatagtga

SEQ ID NO: 802201 - DNA, 20 bp, Artificial
  CRISPR gRNA sequence
aactgaacgataatagtgac

SEQ ID NO: 802202 - DNA, 20 bp, Artificial
  CRISPR gRNA sequence
aacgataatagtgacacaac

SEQ ID NO: 802203 - DNA, 20 bp, Artificial
  CRISPR gRNA sequence
tcaaaactctgggatacagc

SEQ ID NO: 802204 - DNA, 20 bp, Artificial
  CRISPR gRNA sequence
tgggatacagcaaaagcagt

SEQ ID NO: 802205 - DNA, 20 bp, Artificial
  CRISPR gRNA sequence
ggatacagcaaaagcagtgc

SEQ ID NO: 802206 - DNA, 20 bp, Artificial
  CRISPR gRNA sequence
agagaaacattcatagcatt

SEQ ID NO: 802207 - DNA, 20 bp, Artificial
  CRISPR gRNA sequence
atagcattaaatgcctacat

SEQ ID NO: 802208 - DNA, 20 bp, Artificial
  CRISPR gRNA sequence
aatgcctacatcaaaaagtc

SEQ ID NO: 802209 - DNA, 20 bp, Artificial
  CRISPR gRNA sequence
catcaaaaagtctgaaagag

SEQ ID NO: 802210 - DNA, 20 bp, Artificial
  CRISPR gRNA sequence
aaagagcacaaataggcaat

SEQ ID NO: 802211 - DNA, 20 bp, Artificial
  CRISPR gRNA sequence
aggtcacacctcctggagct

SEQ ID NO: 802212 - DNA, 20 bp, Artificial
  CRISPR gRNA sequence
ctggagctggagaaacaaga

SEQ ID NO: 802213 - DNA, 20 bp, Artificial
  CRISPR gRNA sequence
gagctggagaaacaagaaca

SEQ ID NO: 802214 - DNA, 20 bp, Artificial
  CRISPR gRNA sequence
gagaaacaagaacaatccaa

SEQ ID NO: 802215 - DNA, 20 bp, Artificial
  CRISPR gRNA sequence
caaagatcagggcagaacta

SEQ ID NO: 802216 - DNA, 20 bp, Artificial
  CRISPR gRNA sequence
aatgaaattgaaacaaaaaa

SEQ ID NO: 802217 - DNA, 20 bp, Artificial
  CRISPR gRNA sequence
aaacaaaaaaaatacaaaag

SEQ ID NO: 802218 - DNA, 20 bp, Artificial
  CRISPR gRNA sequence
gttatttgaaaagataaata

SEQ ID NO: 802219 - DNA, 20 bp, Artificial
  CRISPR gRNA sequence
tttgaaaagataaataaaat

SEQ ID NO: 802220 - DNA, 20 bp, Artificial
  CRISPR gRNA sequence
gaaaagataaataaaattga

SEQ ID NO: 802221 - DNA, 20 bp, Artificial
  CRISPR gRNA sequence
aaaagataaataaaattgat

SEQ ID NO: 802222 - DNA, 20 bp, Artificial
  CRISPR gRNA sequence
ataaccaagaaaagaagaga

SEQ ID NO: 802223 - DNA, 20 bp, Artificial
  CRISPR gRNA sequence
aattagaaatgaaatggaga

SEQ ID NO: 802224 - DNA, 20 bp, Artificial
  CRISPR gRNA sequence
gaaatgaaatggagatatta

SEQ ID NO: 802225 - DNA, 20 bp, Artificial
  CRISPR gRNA sequence
ctactcatatcacagaaata

SEQ ID NO: 802226 - DNA, 20 bp, Artificial
  CRISPR gRNA sequence
ctcatatcacagaaatacaa

SEQ ID NO: 802227 - DNA, 20 bp, Artificial
  CRISPR gRNA sequence
atatcacagaaatacaaaag

SEQ ID NO: 802228 - DNA, 20 bp, Artificial
  CRISPR gRNA sequence
ttcaaggccactatgaacac

SEQ ID NO: 802229 - DNA, 20 bp, Artificial
  CRISPR gRNA sequence
aaggccactatgaacacctt

SEQ ID NO: 802230 - DNA, 20 bp, Artificial
  CRISPR gRNA sequence
tgaacacctttacacgtaca

SEQ ID NO: 802231 - DNA, 20 bp, Artificial
  CRISPR gRNA sequence
tacacgtacaaactagaaaa

SEQ ID NO: 802232 - DNA, 20 bp, Artificial
  CRISPR gRNA sequence
acacgtacaaactagaaaag

SEQ ID NO: 802233 - DNA, 20 bp, Artificial
  CRISPR gRNA sequence
cacgtacaaactagaaaagc

SEQ ID NO: 802234 - DNA, 20 bp, Artificial
  CRISPR gRNA sequence
gaaaagctagaggagatgga

SEQ ID NO: 802235 - DNA, 20 bp, Artificial
  CRISPR gRNA sequence
gaggagatggatacattcct

SEQ ID NO: 802236 - DNA, 20 bp, Artificial
  CRISPR gRNA sequence
ctggaaatatacaacccttc

SEQ ID NO: 802237 - DNA, 20 bp, Artificial
  CRISPR gRNA sequence
gaaatatacaacccttcgat

SEQ ID NO: 802238 - DNA, 20 bp, Artificial
  CRISPR gRNA sequence
cgattaaaccagaaagatat

SEQ ID NO: 802239 - DNA, 20 bp, Artificial
  CRISPR gRNA sequence
gattaaaccagaaagatata

SEQ ID NO: 802240 - DNA, 20 bp, Artificial
  CRISPR gRNA sequence
aaccagaaagatataggaac

SEQ ID NO: 802241 - DNA, 20 bp, Artificial
  CRISPR gRNA sequence
taaacagatcaataacaagc

SEQ ID NO: 802242 - DNA, 20 bp, Artificial
  CRISPR gRNA sequence
aatggtaacttttaaaattg

SEQ ID NO: 802243 - DNA, 20 bp, Artificial
  CRISPR gRNA sequence
ttaaaattgtcaacaaaaaa

SEQ ID NO: 802244 - DNA, 20 bp, Artificial
  CRISPR gRNA sequence
taaaattgtcaacaaaaaaa

SEQ ID NO: 802245 - DNA, 20 bp, Artificial
  CRISPR gRNA sequence
aaaattgtcaacaaaaaaaa

SEQ ID NO: 802246 - DNA, 20 bp, Artificial
  CRISPR gRNA sequence
aaattgtcaacaaaaaaaaa

SEQ ID NO: 802247 - DNA, 20 bp, Artificial
  CRISPR gRNA sequence
tcaacaaaaaaaaatccagg

SEQ ID NO: 802248 - DNA, 20 bp, Artificial
  CRISPR gRNA sequence
atagctgaattctatcagac

SEQ ID NO: 802249 - DNA, 20 bp, Artificial
  CRISPR gRNA sequence
aattctatcagacattcaaa

SEQ ID NO: 802250 - DNA, 20 bp, Artificial
  CRISPR gRNA sequence
tatcagacattcaaagaaga

SEQ ID NO: 802251 - DNA, 20 bp, Artificial
  CRISPR gRNA sequence
tcagacattcaaagaagaat

SEQ ID NO: 802252 - DNA, 20 bp, Artificial
  CRISPR gRNA sequence
aaagaagaattggtaccaat

SEQ ID NO: 802253 - DNA, 20 bp, Artificial
  CRISPR gRNA sequence
gtaccaattctattgacact

SEQ ID NO: 802254 - DNA, 20 bp, Artificial
  CRISPR gRNA sequence
tattgacactattccatggg

SEQ ID NO: 802255 - DNA, 20 bp, Artificial
  CRISPR gRNA sequence
ttgacactattccatgggat

SEQ ID NO: 802256 - DNA, 20 bp, Artificial
  CRISPR gRNA sequence
acactattccatgggataga

SEQ ID NO: 802257 - DNA, 20 bp, Artificial
  CRISPR gRNA sequence
ttccatgggatagagaaaga

SEQ ID NO: 802258 - DNA, 20 bp, Artificial
  CRISPR gRNA sequence
catgggatagagaaagaggg

SEQ ID NO: 802259 - DNA, 20 bp, Artificial
  CRISPR gRNA sequence
cctaaatcattctatgaagc

SEQ ID NO: 802260 - DNA, 20 bp, Artificial
  CRISPR gRNA sequence
aatcattctatgaagccagt

SEQ ID NO: 802261 - DNA, 20 bp, Artificial
  CRISPR gRNA sequence
tatgaagccagtagcaccct

SEQ ID NO: 802262 - DNA, 20 bp, Artificial
  CRISPR gRNA sequence
tgaagccagtagcaccctaa

SEQ ID NO: 802263 - DNA, 20 bp, Artificial
  CRISPR gRNA sequence
atacaaaaaccagggaagga

SEQ ID NO: 802264 - DNA, 20 bp, Artificial
  CRISPR gRNA sequence
caggccagtatccctgatga

SEQ ID NO: 802265 - DNA, 20 bp, Artificial
  CRISPR gRNA sequence
atgaacatagatgtaaaaat

SEQ ID NO: 802266 - DNA, 20 bp, Artificial
  CRISPR gRNA sequence
aacaaaatactagctaacca

SEQ ID NO: 802267 - DNA, 20 bp, Artificial
  CRISPR gRNA sequence
gctaaccaaatccaacagca

SEQ ID NO: 802268 - DNA, 20 bp, Artificial
  CRISPR gRNA sequence
accaaatccaacagcatatc

SEQ ID NO: 802269 - DNA, 20 bp, Artificial
  CRISPR gRNA sequence
tacaccagggatgcagggat

SEQ ID NO: 802270 - DNA, 20 bp, Artificial
  CRISPR gRNA sequence
acaccagggatgcagggatg

SEQ ID NO: 802271 - DNA, 20 bp, Artificial
  CRISPR gRNA sequence
caccagggatgcagggatgg

SEQ ID NO: 802272 - DNA, 20 bp, Artificial
  CRISPR gRNA sequence
aacatccacaagttaataaa

SEQ ID NO: 802273 - DNA, 20 bp, Artificial
  CRISPR gRNA sequence
acatccacaagttaataaat

SEQ ID NO: 802274 - DNA, 20 bp, Artificial
  CRISPR gRNA sequence
ataaatgtgatacaccacac

SEQ ID NO: 802275 - DNA, 20 bp, Artificial
  CRISPR gRNA sequence
aaaacaaaaatcacatgatc

SEQ ID NO: 802276 - DNA, 20 bp, Artificial
  CRISPR gRNA sequence
aatagattcagaaaaagcat

SEQ ID NO: 802277 - DNA, 20 bp, Artificial
  CRISPR gRNA sequence
agaaaaagcatttgacaaaa

SEQ ID NO: 802278 - DNA, 20 bp, Artificial
  CRISPR gRNA sequence
gacaaaatctaacatccttt

SEQ ID NO: 802279 - DNA, 20 bp, Artificial
  CRISPR gRNA sequence
acaaaatctaacatccttta

SEQ ID NO: 802280 - DNA, 20 bp, Artificial
  CRISPR gRNA sequence
acatcctttatgattaaaac

SEQ ID NO: 802281 - DNA, 20 bp, Artificial
  CRISPR gRNA sequence
tatgattaaaaccctcagca

SEQ ID NO: 802282 - DNA, 20 bp, Artificial
  CRISPR gRNA sequence
atgattaaaaccctcagcaa

SEQ ID NO: 802283 - DNA, 20 bp, Artificial
  CRISPR gRNA sequence
tgattaaaaccctcagcaaa

SEQ ID NO: 802284 - DNA, 20 bp, Artificial
  CRISPR gRNA sequence
aaaccctcagcaaaattagc

SEQ ID NO: 802285 - DNA, 20 bp, Artificial
  CRISPR gRNA sequence
agcaaaattagcacagaagg

SEQ ID NO: 802286 - DNA, 20 bp, Artificial
  CRISPR gRNA sequence
gcacagaaggaacatatctt

SEQ ID NO: 802287 - DNA, 20 bp, Artificial
  CRISPR gRNA sequence
aaggtaataaaagctaacta

SEQ ID NO: 802288 - DNA, 20 bp, Artificial
  CRISPR gRNA sequence
aggtaataaaagctaactac

SEQ ID NO: 802289 - DNA, 20 bp, Artificial
  CRISPR gRNA sequence
actacgacaaacccacagcc

SEQ ID NO: 802290 - DNA, 20 bp, Artificial
  CRISPR gRNA sequence
cgacaaacccacagccaaca

SEQ ID NO: 802291 - DNA, 20 bp, Artificial
  CRISPR gRNA sequence
tgctgaatggggaaaagttg

SEQ ID NO: 802292 - DNA, 20 bp, Artificial
  CRISPR gRNA sequence
aatggggaaaagttgaaagc

SEQ ID NO: 802293 - DNA, 20 bp, Artificial
  CRISPR gRNA sequence
aaagcattttccctgagaat

SEQ ID NO: 802294 - DNA, 20 bp, Artificial
  CRISPR gRNA sequence
tccctgagaattggaacaag

SEQ ID NO: 802295 - DNA, 20 bp, Artificial
  CRISPR gRNA sequence
ccctgagaattggaacaaga

SEQ ID NO: 802296 - DNA, 20 bp, Artificial
  CRISPR gRNA sequence
cctgagaattggaacaagac

SEQ ID NO: 802297 - DNA, 20 bp, Artificial
  CRISPR gRNA sequence
agaattggaacaagacaaga

SEQ ID NO: 802298 - DNA, 20 bp, Artificial
  CRISPR gRNA sequence
gaacaagacaagacactttc

SEQ ID NO: 802299 - DNA, 20 bp, Artificial
  CRISPR gRNA sequence
tcaccacttttattcagcat

SEQ ID NO: 802300 - DNA, 20 bp, Artificial
  CRISPR gRNA sequence
caccacttttattcagcata

SEQ ID NO: 802301 - DNA, 20 bp, Artificial
  CRISPR gRNA sequence
accacttttattcagcatag

SEQ ID NO: 802302 - DNA, 20 bp, Artificial
  CRISPR gRNA sequence
ttattcagcatagtactgga

SEQ ID NO: 802303 - DNA, 20 bp, Artificial
  CRISPR gRNA sequence
tattcagcatagtactggaa

SEQ ID NO: 802304 - DNA, 20 bp, Artificial
  CRISPR gRNA sequence
attcagcatagtactggaag

SEQ ID NO: 802305 - DNA, 20 bp, Artificial
  CRISPR gRNA sequence
ttcagcatagtactggaagt

SEQ ID NO: 802306 - DNA, 20 bp, Artificial
  CRISPR gRNA sequence
agcatagtactggaagtcct

SEQ ID NO: 802307 - DNA, 20 bp, Artificial
  CRISPR gRNA sequence
gaagtcctggccagagcact

SEQ ID NO: 802308 - DNA, 20 bp, Artificial
  CRISPR gRNA sequence
gccagagcactcaaagagaa

SEQ ID NO: 802309 - DNA, 20 bp, Artificial
  CRISPR gRNA sequence
aaagagaaagaaataaaggg

SEQ ID NO: 802310 - DNA, 20 bp, Artificial
  CRISPR gRNA sequence
gtaaagaggaagtcaaactg

SEQ ID NO: 802311 - DNA, 20 bp, Artificial
  CRISPR gRNA sequence
ttgctgtttgctgatgatat

SEQ ID NO: 802312 - DNA, 20 bp, Artificial
  CRISPR gRNA sequence
ctgtttgctgatgatatgat

SEQ ID NO: 802313 - DNA, 20 bp, Artificial
  CRISPR gRNA sequence
tttgctgatgatatgatcat

SEQ ID NO: 802314 - DNA, 20 bp, Artificial
  CRISPR gRNA sequence
gctgatgatatgatcatata

SEQ ID NO: 802315 - DNA, 20 bp, Artificial
  CRISPR gRNA sequence
ctgatgatatgatcatatac

SEQ ID NO: 802316 - DNA, 20 bp, Artificial
  CRISPR gRNA sequence
atgatatgatcatataccta

SEQ ID NO: 802317 - DNA, 20 bp, Artificial
  CRISPR gRNA sequence
gaaaaccctaaggattcatc

SEQ ID NO: 802318 - DNA, 20 bp, Artificial
  CRISPR gRNA sequence
aggattcatcttgaaagctc

SEQ ID NO: 802319 - DNA, 20 bp, Artificial
  CRISPR gRNA sequence
atcttgaaagctcctagaac

SEQ ID NO: 802320 - DNA, 20 bp, Artificial
  CRISPR gRNA sequence
gaaagctcctagaactggta

SEQ ID NO: 802321 - DNA, 20 bp, Artificial
  CRISPR gRNA sequence
aaagctcctagaactggtaa

SEQ ID NO: 802322 - DNA, 20 bp, Artificial
  CRISPR gRNA sequence
ctagaactggtaaacaaatt

SEQ ID NO: 802323 - DNA, 20 bp, Artificial
  CRISPR gRNA sequence
gaactggtaaacaaattcag

SEQ ID NO: 802324 - DNA, 20 bp, Artificial
  CRISPR gRNA sequence
gtaaacaaattcagcaaagt

SEQ ID NO: 802325 - DNA, 20 bp, Artificial
  CRISPR gRNA sequence
agcaaagtttcaggatacaa

SEQ ID NO: 802326 - DNA, 20 bp, Artificial
  CRISPR gRNA sequence
caggatacaaaattaatgta

SEQ ID NO: 802327 - DNA, 20 bp, Artificial
  CRISPR gRNA sequence
aggatacaaaattaatgtac

SEQ ID NO: 802328 - DNA, 20 bp, Artificial
  CRISPR gRNA sequence
atgtacacaaatcagtagct

SEQ ID NO: 802329 - DNA, 20 bp, Artificial
  CRISPR gRNA sequence
tgctatacaccaacatcaac

SEQ ID NO: 802330 - DNA, 20 bp, Artificial
  CRISPR gRNA sequence
ctatacaccaacatcaacca

SEQ ID NO: 802331 - DNA, 20 bp, Artificial
  CRISPR gRNA sequence
tacaccaacatcaaccaata

SEQ ID NO: 802332 - DNA, 20 bp, Artificial
  CRISPR gRNA sequence
caaaaataaaataaaatact

SEQ ID NO: 802333 - DNA, 20 bp, Artificial
  CRISPR gRNA sequence
aggaatatacctaacgaagg

SEQ ID NO: 802334 - DNA, 20 bp, Artificial
  CRISPR gRNA sequence
ggaatatacctaacgaagga

SEQ ID NO: 802335 - DNA, 20 bp, Artificial
  CRISPR gRNA sequence
acgaaggacatgaaagacct

SEQ ID NO: 802336 - DNA, 20 bp, Artificial
  CRISPR gRNA sequence
tacaaggaaaactacaaatc

SEQ ID NO: 802337 - DNA, 20 bp, Artificial
  CRISPR gRNA sequence
caaggaaaactacaaatcac

SEQ ID NO: 802338 - DNA, 20 bp, Artificial
  CRISPR gRNA sequence
caaatcactactgaaagaaa

SEQ ID NO: 802339 - DNA, 20 bp, Artificial
  CRISPR gRNA sequence
ctgaaagaaatcacagatga

SEQ ID NO: 802340 - DNA, 20 bp, Artificial
  CRISPR gRNA sequence
aaagaaatcacagatgacac

SEQ ID NO: 802341 - DNA, 20 bp, Artificial
  CRISPR gRNA sequence
atgaataggtacaatcaata

SEQ ID NO: 802342 - DNA, 20 bp, Artificial
  CRISPR gRNA sequence
tgaaaatgaccatactttgt

SEQ ID NO: 802343 - DNA, 20 bp, Artificial
  CRISPR gRNA sequence
tgtagattgcaaaagcaatc

SEQ ID NO: 802344 - DNA, 20 bp, Artificial
  CRISPR gRNA sequence
gtagattgcaaaagcaatct

SEQ ID NO: 802345 - DNA, 20 bp, Artificial
  CRISPR gRNA sequence
tagattgcaaaagcaatcta

SEQ ID NO: 802346 - DNA, 20 bp, Artificial
  CRISPR gRNA sequence
caaaagcaatctacaaagtc

SEQ ID NO: 802347 - DNA, 20 bp, Artificial
  CRISPR gRNA sequence
caaagtcaatgcaatcccca

SEQ ID NO: 802348 - DNA, 20 bp, Artificial
  CRISPR gRNA sequence
ccatcattcttcacaaaagt

SEQ ID NO: 802349 - DNA, 20 bp, Artificial
  CRISPR gRNA sequence
ttcacaaaagtagaaaaaga

SEQ ID NO: 802350 - DNA, 20 bp, Artificial
  CRISPR gRNA sequence
cacaaaagtagaaaaagaaa

SEQ ID NO: 802351 - DNA, 20 bp, Artificial
  CRISPR gRNA sequence
acaaaagtagaaaaagaaat

SEQ ID NO: 802352 - DNA, 20 bp, Artificial
  CRISPR gRNA sequence
aaattcatatggaaccaaaa

SEQ ID NO: 802353 - DNA, 20 bp, Artificial
  CRISPR gRNA sequence
atatggaaccaaaaaagagc

SEQ ID NO: 802354 - DNA, 20 bp, Artificial
  CRISPR gRNA sequence
agcaaaaagaacaaacctgg

SEQ ID NO: 802355 - DNA, 20 bp, Artificial
  CRISPR gRNA sequence
gaggcatcacattgcctaac

SEQ ID NO: 802356 - DNA, 20 bp, Artificial
  CRISPR gRNA sequence
cctaacttcaaaccatacta

SEQ ID NO: 802357 - DNA, 20 bp, Artificial
  CRISPR gRNA sequence
acttcaaaccatactataac

SEQ ID NO: 802358 - DNA, 20 bp, Artificial
  CRISPR gRNA sequence
caaaccatactataacacca

SEQ ID NO: 802359 - DNA, 20 bp, Artificial
  CRISPR gRNA sequence
aaaccatactataacaccat

SEQ ID NO: 802360 - DNA, 20 bp, Artificial
  CRISPR gRNA sequence
taacaccatagtcaccaaaa

SEQ ID NO: 802361 - DNA, 20 bp, Artificial
  CRISPR gRNA sequence
gtataaaaataggcacatag

SEQ ID NO: 802362 - DNA, 20 bp, Artificial
  CRISPR gRNA sequence
ggaataaagccaaatactta

SEQ ID NO: 802363 - DNA, 20 bp, Artificial
  CRISPR gRNA sequence
atagccaactgatctttgac

SEQ ID NO: 802364 - DNA, 20 bp, Artificial
  CRISPR gRNA sequence
tagccaactgatctttgaca

SEQ ID NO: 802365 - DNA, 20 bp, Artificial
  CRISPR gRNA sequence
atctttgacaaagcaaacaa

SEQ ID NO: 802366 - DNA, 20 bp, Artificial
  CRISPR gRNA sequence
tgacaaagcaaacaaaaaca

SEQ ID NO: 802367 - DNA, 20 bp, Artificial
  CRISPR gRNA sequence
gacaaagcaaacaaaaacat

SEQ ID NO: 802368 - DNA, 20 bp, Artificial
  CRISPR gRNA sequence
acaaagcaaacaaaaacata

SEQ ID NO: 802369 - DNA, 20 bp, Artificial
  CRISPR gRNA sequence
ttcaacaaacggtgctggga

SEQ ID NO: 802370 - DNA, 20 bp, Artificial
  CRISPR gRNA sequence
aacaaacggtgctgggataa

SEQ ID NO: 802371 - DNA, 20 bp, Artificial
  CRISPR gRNA sequence
ggataattggctagccacat

SEQ ID NO: 802372 - DNA, 20 bp, Artificial
  CRISPR gRNA sequence
gctagccacatggagaagaa

SEQ ID NO: 802373 - DNA, 20 bp, Artificial
  CRISPR gRNA sequence
gccacatggagaagaataaa

SEQ ID NO: 802374 - DNA, 20 bp, Artificial
  CRISPR gRNA sequence
gatcctcatatcttacctta

SEQ ID NO: 802375 - DNA, 20 bp, Artificial
  CRISPR gRNA sequence
atatcttaccttataaaaaa

SEQ ID NO: 802376 - DNA, 20 bp, Artificial
  CRISPR gRNA sequence
accttataaaaaatcaactc

SEQ ID NO: 802377 - DNA, 20 bp, Artificial
  CRISPR gRNA sequence
ccttataaaaaatcaactca

SEQ ID NO: 802378 - DNA, 20 bp, Artificial
  CRISPR gRNA sequence
ataaaaaatcaactcaagat

SEQ ID NO: 802379 - DNA, 20 bp, Artificial
  CRISPR gRNA sequence
taaaaaatcaactcaagatg

SEQ ID NO: 802380 - DNA, 20 bp, Artificial
  CRISPR gRNA sequence
aagatggatcaaagacttaa

SEQ ID NO: 802381 - DNA, 20 bp, Artificial
  CRISPR gRNA sequence
aaatctaagacctgaaacca

SEQ ID NO: 802382 - DNA, 20 bp, Artificial
  CRISPR gRNA sequence
aatctaagacctgaaaccat

SEQ ID NO: 802383 - DNA, 20 bp, Artificial
  CRISPR gRNA sequence
agacctgaaaccataacgat

SEQ ID NO: 802384 - DNA, 20 bp, Artificial
  CRISPR gRNA sequence
aaaccataacgattctagaa

SEQ ID NO: 802385 - DNA, 20 bp, Artificial
  CRISPR gRNA sequence
tagaagataacatcgaaaaa

SEQ ID NO: 802386 - DNA, 20 bp, Artificial
  CRISPR gRNA sequence
gaagataacatcgaaaaagc

SEQ ID NO: 802387 - DNA, 20 bp, Artificial
  CRISPR gRNA sequence
ctagacattagcttaggcaa

SEQ ID NO: 802388 - DNA, 20 bp, Artificial
  CRISPR gRNA sequence
tagacattagcttaggcaaa

SEQ ID NO: 802389 - DNA, 20 bp, Artificial
  CRISPR gRNA sequence
gacattagcttaggcaaaga

SEQ ID NO: 802390 - DNA, 20 bp, Artificial
  CRISPR gRNA sequence
gcttaggcaaagacttcgtg

SEQ ID NO: 802391 - DNA, 20 bp, Artificial
  CRISPR gRNA sequence
aggcaaagacttcgtgacca

SEQ ID NO: 802392 - DNA, 20 bp, Artificial
  CRISPR gRNA sequence
ggcaaagacttcgtgaccaa

SEQ ID NO: 802393 - DNA, 20 bp, Artificial
  CRISPR gRNA sequence
cgtgaccaagaacccaaaag

SEQ ID NO: 802394 - DNA, 20 bp, Artificial
  CRISPR gRNA sequence
gtgaccaagaacccaaaagc

SEQ ID NO: 802395 - DNA, 20 bp, Artificial
  CRISPR gRNA sequence
aattaaactaaaaagcttct

SEQ ID NO: 802396 - DNA, 20 bp, Artificial
  CRISPR gRNA sequence
attaaactaaaaagcttctg

SEQ ID NO: 802397 - DNA, 20 bp, Artificial
  CRISPR gRNA sequence
aactaaaaagcttctgcaca

SEQ ID NO: 802398 - DNA, 20 bp, Artificial
  CRISPR gRNA sequence
aaaagcttctgcacagcaaa

SEQ ID NO: 802399 - DNA, 20 bp, Artificial
  CRISPR gRNA sequence
ctgcacagcaaaagaaataa

SEQ ID NO: 802400 - DNA, 20 bp, Artificial
  CRISPR gRNA sequence
tgcacagcaaaagaaataat

SEQ ID NO: 802401 - DNA, 20 bp, Artificial
  CRISPR gRNA sequence
cacagcaaaagaaataatca

SEQ ID NO: 802402 - DNA, 20 bp, Artificial
  CRISPR gRNA sequence
acagacaacccacagagtgg

SEQ ID NO: 802403 - DNA, 20 bp, Artificial
  CRISPR gRNA sequence
cacaatctatacatctgaca

SEQ ID NO: 802404 - DNA, 20 bp, Artificial
  CRISPR gRNA sequence
acaatctatacatctgacaa

SEQ ID NO: 802405 - DNA, 20 bp, Artificial
  CRISPR gRNA sequence
tacatctgacaaaggactaa

SEQ ID NO: 802406 - DNA, 20 bp, Artificial
  CRISPR gRNA sequence
acaaaggactaatatccaga

SEQ ID NO: 802407 - DNA, 20 bp, Artificial
  CRISPR gRNA sequence
atatccagaatctacaaggt

SEQ ID NO: 802408 - DNA, 20 bp, Artificial
  CRISPR gRNA sequence
caaggtatgcaaataaatca

SEQ ID NO: 802409 - DNA, 20 bp, Artificial
  CRISPR gRNA sequence
aggacatgaatagacaattc

SEQ ID NO: 802410 - DNA, 20 bp, Artificial
  CRISPR gRNA sequence
tcacaaggagatacacaaat

SEQ ID NO: 802411 - DNA, 20 bp, Artificial
  CRISPR gRNA sequence
acaaggagatacacaaatga

SEQ ID NO: 802412 - DNA, 20 bp, Artificial
  CRISPR gRNA sequence
aacatcactaattctcaggg

SEQ ID NO: 802413 - DNA, 20 bp, Artificial
  CRISPR gRNA sequence
attctcagggaaatgcaaat

SEQ ID NO: 802414 - DNA, 20 bp, Artificial
  CRISPR gRNA sequence
tcagggaaatgcaaatcaaa

SEQ ID NO: 802415 - DNA, 20 bp, Artificial
  CRISPR gRNA sequence
agggaaatgcaaatcaaaac

SEQ ID NO: 802416 - DNA, 20 bp, Artificial
  CRISPR gRNA sequence
cgataccaccttactcctgc

SEQ ID NO: 802417 - DNA, 20 bp, Artificial
  CRISPR gRNA sequence
actcctgcaagaatggccat

SEQ ID NO: 802418 - DNA, 20 bp, Artificial
  CRISPR gRNA sequence
ctcctgcaagaatggccata

SEQ ID NO: 802419 - DNA, 20 bp, Artificial
  CRISPR gRNA sequence
ctgcaagaatggccataaca

SEQ ID NO: 802420 - DNA, 20 bp, Artificial
  CRISPR gRNA sequence
caagaatggccataacaaaa

SEQ ID NO: 802421 - DNA, 20 bp, Artificial
  CRISPR gRNA sequence
gcatggatgtggtgaaaaga

SEQ ID NO: 802422 - DNA, 20 bp, Artificial
  CRISPR gRNA sequence
ttacactgttggtgggaatg

SEQ ID NO: 802423 - DNA, 20 bp, Artificial
  CRISPR gRNA sequence
acactgttggtgggaatgta

SEQ ID NO: 802424 - DNA, 20 bp, Artificial
  CRISPR gRNA sequence
cactgttggtgggaatgtaa

SEQ ID NO: 802425 - DNA, 20 bp, Artificial
  CRISPR gRNA sequence
ttggtgggaatgtaaactag

SEQ ID NO: 802426 - DNA, 20 bp, Artificial
  CRISPR gRNA sequence
gtgggaatgtaaactagtac

SEQ ID NO: 802427 - DNA, 20 bp, Artificial
  CRISPR gRNA sequence
gtacaaccactatggaaaac

SEQ ID NO: 802428 - DNA, 20 bp, Artificial
  CRISPR gRNA sequence
tggaaaacagtgtggagatt

SEQ ID NO: 802429 - DNA, 20 bp, Artificial
  CRISPR gRNA sequence
ctttaaaaactaaaagtaga

SEQ ID NO: 802430 - DNA, 20 bp, Artificial
  CRISPR gRNA sequence
taaaaactaaaagtagatct

SEQ ID NO: 802431 - DNA, 20 bp, Artificial
  CRISPR gRNA sequence
aaaaactaaaagtagatcta

SEQ ID NO: 802432 - DNA, 20 bp, Artificial
  CRISPR gRNA sequence
aaaactaaaagtagatctac

SEQ ID NO: 802433 - DNA, 20 bp, Artificial
  CRISPR gRNA sequence
aaagtagatctaccatttga

SEQ ID NO: 802434 - DNA, 20 bp, Artificial
  CRISPR gRNA sequence
ccatttgatccagcaatccc

SEQ ID NO: 802435 - DNA, 20 bp, Artificial
  CRISPR gRNA sequence
gatccagcaatcccactact

SEQ ID NO: 802436 - DNA, 20 bp, Artificial
  CRISPR gRNA sequence
atccagcaatcccactacta

SEQ ID NO: 802437 - DNA, 20 bp, Artificial
  CRISPR gRNA sequence
ctaggtatttacccaaagga

SEQ ID NO: 802438 - DNA, 20 bp, Artificial
  CRISPR gRNA sequence
ggtatttacccaaaggaaaa

SEQ ID NO: 802439 - DNA, 20 bp, Artificial
  CRISPR gRNA sequence
acccaaaggaaaagaagtca

SEQ ID NO: 802440 - DNA, 20 bp, Artificial
  CRISPR gRNA sequence
cccaaaggaaaagaagtcat

SEQ ID NO: 802441 - DNA, 20 bp, Artificial
  CRISPR gRNA sequence
tacaaaaaaaagatacttgc

SEQ ID NO: 802442 - DNA, 20 bp, Artificial
  CRISPR gRNA sequence
gcacacgcatttttatagca

SEQ ID NO: 802443 - DNA, 20 bp, Artificial
  CRISPR gRNA sequence
cacacgcatttttatagcag

SEQ ID NO: 802444 - DNA, 20 bp, Artificial
  CRISPR gRNA sequence
ttatagcagcacaatttgca

SEQ ID NO: 802445 - DNA, 20 bp, Artificial
  CRISPR gRNA sequence
tatagcagcacaatttgcaa

SEQ ID NO: 802446 - DNA, 20 bp, Artificial
  CRISPR gRNA sequence
atagcagcacaatttgcaat

SEQ ID NO: 802447 - DNA, 20 bp, Artificial
  CRISPR gRNA sequence
tagcagcacaatttgcaatt

SEQ ID NO: 802448 - DNA, 20 bp, Artificial
  CRISPR gRNA sequence
gcaattgcaaatatatggaa

SEQ ID NO: 802449 - DNA, 20 bp, Artificial
  CRISPR gRNA sequence
caattgcaaatatatggaac

SEQ ID NO: 802450 - DNA, 20 bp, Artificial
  CRISPR gRNA sequence
caaatatatggaaccagccc

SEQ ID NO: 802451 - DNA, 20 bp, Artificial
  CRISPR gRNA sequence
tacatacatatatatatgca

SEQ ID NO: 802452 - DNA, 20 bp, Artificial
  CRISPR gRNA sequence
tatatatacaccatggaata

SEQ ID NO: 802453 - DNA, 20 bp, Artificial
  CRISPR gRNA sequence
cttagctatgaaaaggaatg

SEQ ID NO: 802454 - DNA, 20 bp, Artificial
  CRISPR gRNA sequence
agctatgaaaaggaatgaaa

SEQ ID NO: 802455 - DNA, 20 bp, Artificial
  CRISPR gRNA sequence
gctatgaaaaggaatgaaat

SEQ ID NO: 802456 - DNA, 20 bp, Artificial
  CRISPR gRNA sequence
tgaaaaggaatgaaatcata

SEQ ID NO: 802457 - DNA, 20 bp, Artificial
  CRISPR gRNA sequence
gcagcatcctggatggaatt

SEQ ID NO: 802458 - DNA, 20 bp, Artificial
  CRISPR gRNA sequence
cagcatcctggatggaatta

SEQ ID NO: 802459 - DNA, 20 bp, Artificial
  CRISPR gRNA sequence
gatggaattagagactatta

SEQ ID NO: 802460 - DNA, 20 bp, Artificial
  CRISPR gRNA sequence
gagactattattctaagtga

SEQ ID NO: 802461 - DNA, 20 bp, Artificial
  CRISPR gRNA sequence
ttattctaagtgaagtaact

SEQ ID NO: 802462 - DNA, 20 bp, Artificial
  CRISPR gRNA sequence
ttctaagtgaagtaactcag

SEQ ID NO: 802463 - DNA, 20 bp, Artificial
  CRISPR gRNA sequence
taagtgaagtaactcaggaa

SEQ ID NO: 802464 - DNA, 20 bp, Artificial
  CRISPR gRNA sequence
agtgaagtaactcaggaatg

SEQ ID NO: 802465 - DNA, 20 bp, Artificial
  CRISPR gRNA sequence
aggaatgtaaaaccaaacat

SEQ ID NO: 802466 - DNA, 20 bp, Artificial
  CRISPR gRNA sequence
tatgctctcactcataagtg

SEQ ID NO: 802467 - DNA, 20 bp, Artificial
  CRISPR gRNA sequence
tcactcataagtgcgagcta

SEQ ID NO: 802468 - DNA, 20 bp, Artificial
  CRISPR gRNA sequence
actcataagtgcgagctaag

SEQ ID NO: 802469 - DNA, 20 bp, Artificial
  CRISPR gRNA sequence
ataagtgcgagctaagctat

SEQ ID NO: 802470 - DNA, 20 bp, Artificial
  CRISPR gRNA sequence
agctatgaggatggaaaggc

SEQ ID NO: 802471 - DNA, 20 bp, Artificial
  CRISPR gRNA sequence
tgaggatggaaaggcataag

SEQ ID NO: 802472 - DNA, 20 bp, Artificial
  CRISPR gRNA sequence
tcaggacttaggggaaagga

SEQ ID NO: 802473 - DNA, 20 bp, Artificial
  CRISPR gRNA sequence
caggacttaggggaaaggat

SEQ ID NO: 802474 - DNA, 20 bp, Artificial
  CRISPR gRNA sequence
aggacttaggggaaaggatg

SEQ ID NO: 802475 - DNA, 20 bp, Artificial
  CRISPR gRNA sequence
aggggaaaggatggttgggg

SEQ ID NO: 802476 - DNA, 20 bp, Artificial
  CRISPR gRNA sequence
ggggaaaggatggttggggg

SEQ ID NO: 802477 - DNA, 20 bp, Artificial
  CRISPR gRNA sequence
ggggtgagagataaaaaact

SEQ ID NO: 802478 - DNA, 20 bp, Artificial
  CRISPR gRNA sequence
cacatttgggccaggcgtgg

SEQ ID NO: 802479 - DNA, 20 bp, Artificial
  CRISPR gRNA sequence
gggccaggcgtggttgctca

SEQ ID NO: 802480 - DNA, 20 bp, Artificial
  CRISPR gRNA sequence
ggccaggcgtggttgctcac

SEQ ID NO: 802481 - DNA, 20 bp, Artificial
  CRISPR gRNA sequence
ctcacacctgtaatcccagc

SEQ ID NO: 802482 - DNA, 20 bp, Artificial
  CRISPR gRNA sequence
acacctgtaatcccagcact

SEQ ID NO: 802483 - DNA, 20 bp, Artificial
  CRISPR gRNA sequence
taatcccagcactttgggag

SEQ ID NO: 802484 - DNA, 20 bp, Artificial
  CRISPR gRNA sequence
tgggaggccgaggtgggcag

SEQ ID NO: 802485 - DNA, 20 bp, Artificial
  CRISPR gRNA sequence
gggaggccgaggtgggcaga

SEQ ID NO: 802486 - DNA, 20 bp, Artificial
  CRISPR gRNA sequence
ggaggccgaggtgggcagat

SEQ ID NO: 802487 - DNA, 20 bp, Artificial
  CRISPR gRNA sequence
gctaacacggtgaaaccccg

SEQ ID NO: 802488 - DNA, 20 bp, Artificial
  CRISPR gRNA sequence
acacggtgaaaccccgtctc

SEQ ID NO: 802489 - DNA, 20 bp, Artificial
  CRISPR gRNA sequence
tactaaaaatacaaaaaatt

SEQ ID NO: 802490 - DNA, 20 bp, Artificial
  CRISPR gRNA sequence
ctaaaaatacaaaaaattag

SEQ ID NO: 802491 - DNA, 20 bp, Artificial
  CRISPR gRNA sequence
aaaatacaaaaaattagccg

SEQ ID NO: 802492 - DNA, 20 bp, Artificial
  CRISPR gRNA sequence
gccgggcgtggtggcaggca

SEQ ID NO: 802493 - DNA, 20 bp, Artificial
  CRISPR gRNA sequence
cagtcgcagctactcgggag

SEQ ID NO: 802494 - DNA, 20 bp, Artificial
  CRISPR gRNA sequence
ctcgggaggctgaggcagga

SEQ ID NO: 802495 - DNA, 20 bp, Artificial
  CRISPR gRNA sequence
gggaggctgaggcaggagaa

SEQ ID NO: 802496 - DNA, 20 bp, Artificial
  CRISPR gRNA sequence
aggcaggagaatggcaggaa

SEQ ID NO: 802497 - DNA, 20 bp, Artificial
  CRISPR gRNA sequence
ggaggcggattttgcaatga

SEQ ID NO: 802498 - DNA, 20 bp, Artificial
  CRISPR gRNA sequence
tgcaatgagcagaggtcgca

SEQ ID NO: 802499 - DNA, 20 bp, Artificial
  CRISPR gRNA sequence
gcaatgagcagaggtcgcac

SEQ ID NO: 802500 - DNA, 20 bp, Artificial
  CRISPR gRNA sequence
caatgagcagaggtcgcacc

SEQ ID NO: 802501 - DNA, 20 bp, Artificial
  CRISPR gRNA sequence
cactccagcctgggcgacag

SEQ ID NO: 802502 - DNA, 20 bp, Artificial
  CRISPR gRNA sequence
cagcctgggcgacagagcga

SEQ ID NO: 802503 - DNA, 20 bp, Artificial
  CRISPR gRNA sequence
ggcgacagagcgagactccg

SEQ ID NO: 802504 - DNA, 20 bp, Artificial
  CRISPR gRNA sequence
cgtctcaaaaaaaaaaaaaa

SEQ ID NO: 802505 - DNA, 20 bp, Artificial
  CRISPR gRNA sequence
aaaaaaaaaaaaaaaaaaaa

SEQ ID NO: 802506 - DNA, 20 bp, Artificial
  CRISPR gRNA sequence
caccctaagaaggaagaaac

SEQ ID NO: 802507 - DNA, 20 bp, Artificial
  CRISPR gRNA sequence
accctaagaaggaagaaacc

SEQ ID NO: 802508 - DNA, 20 bp, Artificial
  CRISPR gRNA sequence
agaaggaagaaaccaagggc

SEQ ID NO: 802509 - DNA, 20 bp, Artificial
  CRISPR gRNA sequence
tacgtttaagcctctaaggc

SEQ ID NO: 802510 - DNA, 20 bp, Artificial
  CRISPR gRNA sequence
aagcctctaaggcccaagga

SEQ ID NO: 802511 - DNA, 20 bp, Artificial
  CRISPR gRNA sequence
agcctctaaggcccaaggaa

SEQ ID NO: 802512 - DNA, 20 bp, Artificial
  CRISPR gRNA sequence
taaggcccaaggaaagcatt

SEQ ID NO: 802513 - DNA, 20 bp, Artificial
  CRISPR gRNA sequence
aggcccaaggaaagcatttg

SEQ ID NO: 802514 - DNA, 20 bp, Artificial
  CRISPR gRNA sequence
gctaaaagagccaagtctca

SEQ ID NO: 802515 - DNA, 20 bp, Artificial
  CRISPR gRNA sequence
ctaaaagagccaagtctcag

SEQ ID NO: 802516 - DNA, 20 bp, Artificial
  CRISPR gRNA sequence
aaagagccaagtctcagtgt

SEQ ID NO: 802517 - DNA, 20 bp, Artificial
  CRISPR gRNA sequence
agtgtctttttttcccttgg

SEQ ID NO: 802518 - DNA, 20 bp, Artificial
  CRISPR gRNA sequence
tttttcccttggggaaacag

SEQ ID NO: 802519 - DNA, 20 bp, Artificial
  CRISPR gRNA sequence
ttttcccttggggaaacaga

SEQ ID NO: 802520 - DNA, 20 bp, Artificial
  CRISPR gRNA sequence
tttcccttggggaaacagaa

SEQ ID NO: 802521 - DNA, 20 bp, Artificial
  CRISPR gRNA sequence
ttcccttggggaaacagaag

SEQ ID NO: 802522 - DNA, 20 bp, Artificial
  CRISPR gRNA sequence
tcccttggggaaacagaagg

SEQ ID NO: 802523 - DNA, 20 bp, Artificial
  CRISPR gRNA sequence
cccttggggaaacagaaggg

SEQ ID NO: 802524 - DNA, 20 bp, Artificial
  CRISPR gRNA sequence
ccttggggaaacagaagggt

SEQ ID NO: 802525 - DNA, 20 bp, Artificial
  CRISPR gRNA sequence
ggggaaacagaagggtgtaa

SEQ ID NO: 802526 - DNA, 20 bp, Artificial
  CRISPR gRNA sequence
gggaaacagaagggtgtaag

SEQ ID NO: 802527 - DNA, 20 bp, Artificial
  CRISPR gRNA sequence
agctccgcctgcagtagcgg

SEQ ID NO: 802528 - DNA, 20 bp, Artificial
  CRISPR gRNA sequence
cgcctgcagtagcgggaagc

SEQ ID NO: 802529 - DNA, 20 bp, Artificial
  CRISPR gRNA sequence
cagtagcgggaagcctagga

SEQ ID NO: 802530 - DNA, 20 bp, Artificial
  CRISPR gRNA sequence
ggagtaaaataacacgtttt

SEQ ID NO: 802531 - DNA, 20 bp, Artificial
  CRISPR gRNA sequence
tttaaaaataaagaaagaaa

SEQ ID NO: 802532 - DNA, 20 bp, Artificial
  CRISPR gRNA sequence
ttaaaaataaagaaagaaat

SEQ ID NO: 802533 - DNA, 20 bp, Artificial
  CRISPR gRNA sequence
taaaaataaagaaagaaatt

SEQ ID NO: 802534 - DNA, 20 bp, Artificial
  CRISPR gRNA sequence
aaaaataaagaaagaaatta

SEQ ID NO: 802535 - DNA, 20 bp, Artificial
  CRISPR gRNA sequence
aaaataaagaaagaaattat

SEQ ID NO: 802536 - DNA, 20 bp, Artificial
  CRISPR gRNA sequence
ttttaaaaaagaaaacaatg

SEQ ID NO: 802537 - DNA, 20 bp, Artificial
  CRISPR gRNA sequence
taaaaaagaaaacaatgtcc

SEQ ID NO: 802538 - DNA, 20 bp, Artificial
  CRISPR gRNA sequence
aaaaaagaaaacaatgtcct

SEQ ID NO: 802539 - DNA, 20 bp, Artificial
  CRISPR gRNA sequence
aaaaagaaaacaatgtcctg

SEQ ID NO: 802540 - DNA, 20 bp, Artificial
  CRISPR gRNA sequence
aatttcaatggggtgggggg

SEQ ID NO: 802541 - DNA, 20 bp, Artificial
  CRISPR gRNA sequence
caatggggtgggggggaggg

SEQ ID NO: 802542 - DNA, 20 bp, Artificial
  CRISPR gRNA sequence
aatggggtgggggggagggg

SEQ ID NO: 802543 - DNA, 20 bp, Artificial
  CRISPR gRNA sequence
ctggggattacaaactcgtt

SEQ ID NO: 802544 - DNA, 20 bp, Artificial
  CRISPR gRNA sequence
gggattacaaactcgttaac

SEQ ID NO: 802545 - DNA, 20 bp, Artificial
  CRISPR gRNA sequence
caaactcgttaacctgctat

SEQ ID NO: 802546 - DNA, 20 bp, Artificial
  CRISPR gRNA sequence
gttaacctgctattcctttt

SEQ ID NO: 802547 - DNA, 20 bp, Artificial
  CRISPR gRNA sequence
acctgctattccttttcagg

SEQ ID NO: 802548 - DNA, 20 bp, Artificial
  CRISPR gRNA sequence
ctattccttttcaggcaatt

SEQ ID NO: 802549 - DNA, 20 bp, Artificial
  CRISPR gRNA sequence
ttccttttcaggcaatttaa

SEQ ID NO: 802550 - DNA, 20 bp, Artificial
  CRISPR gRNA sequence
cttttcaggcaatttaacag

SEQ ID NO: 802551 - DNA, 20 bp, Artificial
  CRISPR gRNA sequence
ttcaggcaatttaacagatg

SEQ ID NO: 802552 - DNA, 20 bp, Artificial
  CRISPR gRNA sequence
tcaggcaatttaacagatga

SEQ ID NO: 802553 - DNA, 20 bp, Artificial
  CRISPR gRNA sequence
caggcaatttaacagatgaa

SEQ ID NO: 802554 - DNA, 20 bp, Artificial
  CRISPR gRNA sequence
aggcaatttaacagatgaat

SEQ ID NO: 802555 - DNA, 20 bp, Artificial
  CRISPR gRNA sequence
aacagatgaattgaaagcag

SEQ ID NO: 802556 - DNA, 20 bp, Artificial
  CRISPR gRNA sequence
acagatgaattgaaagcagt

SEQ ID NO: 802557 - DNA, 20 bp, Artificial
  CRISPR gRNA sequence
aaagcagtcctaaaagattt

SEQ ID NO: 802558 - DNA, 20 bp, Artificial
  CRISPR gRNA sequence
aaagatttaactgattacta

SEQ ID NO: 802559 - DNA, 20 bp, Artificial
  CRISPR gRNA sequence
aactgattactagaaacttg

SEQ ID NO: 802560 - DNA, 20 bp, Artificial
  CRISPR gRNA sequence
actgattactagaaacttgc

SEQ ID NO: 802561 - DNA, 20 bp, Artificial
  CRISPR gRNA sequence
attactagaaacttgcatag

SEQ ID NO: 802562 - DNA, 20 bp, Artificial
  CRISPR gRNA sequence
ctagaaacttgcatagatcc

SEQ ID NO: 802563 - DNA, 20 bp, Artificial
  CRISPR gRNA sequence
gaaacttgcatagatcctct

SEQ ID NO: 802564 - DNA, 20 bp, Artificial
  CRISPR gRNA sequence
gcatagatcctctaagacca

SEQ ID NO: 802565 - DNA, 20 bp, Artificial
  CRISPR gRNA sequence
catagatcctctaagaccaa

SEQ ID NO: 802566 - DNA, 20 bp, Artificial
  CRISPR gRNA sequence
taagaccaaggcatgtaaaa

SEQ ID NO: 802567 - DNA, 20 bp, Artificial
  CRISPR gRNA sequence
agaccaaggcatgtaaaact

SEQ ID NO: 802568 - DNA, 20 bp, Artificial
  CRISPR gRNA sequence
catttttccatttatttact

SEQ ID NO: 802569 - DNA, 20 bp, Artificial
  CRISPR gRNA sequence
ttccatttatttactgtcat

SEQ ID NO: 802570 - DNA, 20 bp, Artificial
  CRISPR gRNA sequence
tccatttatttactgtcatt

SEQ ID NO: 802571 - DNA, 20 bp, Artificial
  CRISPR gRNA sequence
ccatttatttactgtcatta

SEQ ID NO: 802572 - DNA, 20 bp, Artificial
  CRISPR gRNA sequence
catttatttactgtcattat

SEQ ID NO: 802573 - DNA, 20 bp, Artificial
  CRISPR gRNA sequence
atttactgtcattatgacta

SEQ ID NO: 802574 - DNA, 20 bp, Artificial
  CRISPR gRNA sequence
tttactgtcattatgactat

SEQ ID NO: 802575 - DNA, 20 bp, Artificial
  CRISPR gRNA sequence
actgtcattatgactataaa

SEQ ID NO: 802576 - DNA, 20 bp, Artificial
  CRISPR gRNA sequence
ctgtcattatgactataaaa

SEQ ID NO: 802577 - DNA, 20 bp, Artificial
  CRISPR gRNA sequence
tcattatgactataaaacag

SEQ ID NO: 802578 - DNA, 20 bp, Artificial
  CRISPR gRNA sequence
tgactataaaacagatacta

SEQ ID NO: 802579 - DNA, 20 bp, Artificial
  CRISPR gRNA sequence
taaaacagatactaccatgt

SEQ ID NO: 802580 - DNA, 20 bp, Artificial
  CRISPR gRNA sequence
ccatgtatacatttcatctt

SEQ ID NO: 802581 - DNA, 20 bp, Artificial
  CRISPR gRNA sequence
catctttatttcagaaatta

SEQ ID NO: 802582 - DNA, 20 bp, Artificial
  CRISPR gRNA sequence
atctttatttcagaaattac

SEQ ID NO: 802583 - DNA, 20 bp, Artificial
  CRISPR gRNA sequence
tatttcagaaattacagcat

SEQ ID NO: 802584 - DNA, 20 bp, Artificial
  CRISPR gRNA sequence
atttcagaaattacagcatt

SEQ ID NO: 802585 - DNA, 20 bp, Artificial
  CRISPR gRNA sequence
tttcagaaattacagcattg

SEQ ID NO: 802586 - DNA, 20 bp, Artificial
  CRISPR gRNA sequence
cagaaattacagcattgctt

SEQ ID NO: 802587 - DNA, 20 bp, Artificial
  CRISPR gRNA sequence
agaaattacagcattgcttg

SEQ ID NO: 802588 - DNA, 20 bp, Artificial
  CRISPR gRNA sequence
cagcattgcttgtaacatat

SEQ ID NO: 802589 - DNA, 20 bp, Artificial
  CRISPR gRNA sequence
cttgtaacatatctgtcaga

SEQ ID NO: 802590 - DNA, 20 bp, Artificial
  CRISPR gRNA sequence
gtaacatatctgtcagacag

SEQ ID NO: 802591 - DNA, 20 bp, Artificial
  CRISPR gRNA sequence
taacatatctgtcagacagc

SEQ ID NO: 802592 - DNA, 20 bp, Artificial
  CRISPR gRNA sequence
tcagacagccagaacaaacc

SEQ ID NO: 802593 - DNA, 20 bp, Artificial
  CRISPR gRNA sequence
aaacctgtggaaatctaaag

SEQ ID NO: 802594 - DNA, 20 bp, Artificial
  CRISPR gRNA sequence
aacctgtggaaatctaaagc

SEQ ID NO: 802595 - DNA, 20 bp, Artificial
  CRISPR gRNA sequence
tggaaatctaaagctgaaac

SEQ ID NO: 802596 - DNA, 20 bp, Artificial
  CRISPR gRNA sequence
aagctgaaactagtaattct

SEQ ID NO: 802597 - DNA, 20 bp, Artificial
  CRISPR gRNA sequence
aaactagtaattcttttaat

SEQ ID NO: 802598 - DNA, 20 bp, Artificial
  CRISPR gRNA sequence
gtaattcttttaatgaggga

SEQ ID NO: 802599 - DNA, 20 bp, Artificial
  CRISPR gRNA sequence
ttttaatgagggagactgag

SEQ ID NO: 802600 - DNA, 20 bp, Artificial
  CRISPR gRNA sequence
ttaatgagggagactgagaa

SEQ ID NO: 802601 - DNA, 20 bp, Artificial
  CRISPR gRNA sequence
taatgagggagactgagaag

SEQ ID NO: 802602 - DNA, 20 bp, Artificial
  CRISPR gRNA sequence
aatgagggagactgagaagc

SEQ ID NO: 802603 - DNA, 20 bp, Artificial
  CRISPR gRNA sequence
atgagggagactgagaagcc

SEQ ID NO: 802604 - DNA, 20 bp, Artificial
  CRISPR gRNA sequence
agaagccaaacagagaacag

SEQ ID NO: 802605 - DNA, 20 bp, Artificial
  CRISPR gRNA sequence
agaaattagcaatagcagaa

SEQ ID NO: 802606 - DNA, 20 bp, Artificial
  CRISPR gRNA sequence
gcaatagcagaaagctgctc

SEQ ID NO: 802607 - DNA, 20 bp, Artificial
  CRISPR gRNA sequence
ctcctaccactaggctatag

SEQ ID NO: 802608 - DNA, 20 bp, Artificial
  CRISPR gRNA sequence
ctaccactaggctatagtga

SEQ ID NO: 802609 - DNA, 20 bp, Artificial
  CRISPR gRNA sequence
ccactaggctatagtgaaaa

SEQ ID NO: 802610 - DNA, 20 bp, Artificial
  CRISPR gRNA sequence
ggctatagtgaaaaggggga

SEQ ID NO: 802611 - DNA, 20 bp, Artificial
  CRISPR gRNA sequence
tagtgaaaagggggaaggca

SEQ ID NO: 802612 - DNA, 20 bp, Artificial
  CRISPR gRNA sequence
atggagcccagggattaaag

SEQ ID NO: 802613 - DNA, 20 bp, Artificial
  CRISPR gRNA sequence
aagtcacttgacagacactg

SEQ ID NO: 802614 - DNA, 20 bp, Artificial
  CRISPR gRNA sequence
gacagacactggaacccagt

SEQ ID NO: 802615 - DNA, 20 bp, Artificial
  CRISPR gRNA sequence
acagacactggaacccagtg

SEQ ID NO: 802616 - DNA, 20 bp, Artificial
  CRISPR gRNA sequence
gaacccagtgggcctgtcca

SEQ ID NO: 802617 - DNA, 20 bp, Artificial
  CRISPR gRNA sequence
tccattggtatctggagcca

SEQ ID NO: 802618 - DNA, 20 bp, Artificial
  CRISPR gRNA sequence
gtatctggagccagggaaga

SEQ ID NO: 802619 - DNA, 20 bp, Artificial
  CRISPR gRNA sequence
gagccagggaagagatacat

SEQ ID NO: 802620 - DNA, 20 bp, Artificial
  CRISPR gRNA sequence
ctgctggagaggccacaaaa

SEQ ID NO: 802621 - DNA, 20 bp, Artificial
  CRISPR gRNA sequence
tgctggagaggccacaaaag

SEQ ID NO: 802622 - DNA, 20 bp, Artificial
  CRISPR gRNA sequence
ctggagaggccacaaaagta

SEQ ID NO: 802623 - DNA, 20 bp, Artificial
  CRISPR gRNA sequence
gagaggccacaaaagtatag

SEQ ID NO: 802624 - DNA, 20 bp, Artificial
  CRISPR gRNA sequence
cccttctccctccagtccac

SEQ ID NO: 802625 - DNA, 20 bp, Artificial
  CRISPR gRNA sequence
ccttctccctccagtccacc

SEQ ID NO: 802626 - DNA, 20 bp, Artificial
  CRISPR gRNA sequence
ctccctccagtccaccctct

SEQ ID NO: 802627 - DNA, 20 bp, Artificial
  CRISPR gRNA sequence
tccctccagtccaccctcta

SEQ ID NO: 802628 - DNA, 20 bp, Artificial
  CRISPR gRNA sequence
cctccagtccaccctctagt

SEQ ID NO: 802629 - DNA, 20 bp, Artificial
  CRISPR gRNA sequence
cagtccaccctctagtgttc

SEQ ID NO: 802630 - DNA, 20 bp, Artificial
  CRISPR gRNA sequence
tagtgttcctgtcttgcttc

SEQ ID NO: 802631 - DNA, 20 bp, Artificial
  CRISPR gRNA sequence
gtgttcctgtcttgcttcct

SEQ ID NO: 802632 - DNA, 20 bp, Artificial
  CRISPR gRNA sequence
ctgtcttgcttcctattggc

SEQ ID NO: 802633 - DNA, 20 bp, Artificial
  CRISPR gRNA sequence
tcttgcttcctattggctgt

SEQ ID NO: 802634 - DNA, 20 bp, Artificial
  CRISPR gRNA sequence
gcttcctattggctgtcacg

SEQ ID NO: 802635 - DNA, 20 bp, Artificial
  CRISPR gRNA sequence
cttcctattggctgtcacgt

SEQ ID NO: 802636 - DNA, 20 bp, Artificial
  CRISPR gRNA sequence
cctattggctgtcacgttcc

SEQ ID NO: 802637 - DNA, 20 bp, Artificial
  CRISPR gRNA sequence
ctattggctgtcacgttcct

SEQ ID NO: 802638 - DNA, 20 bp, Artificial
  CRISPR gRNA sequence
ttggctgtcacgttcctagg

SEQ ID NO: 802639 - DNA, 20 bp, Artificial
  CRISPR gRNA sequence
gctgtcacgttcctaggcta

SEQ ID NO: 802640 - DNA, 20 bp, Artificial
  CRISPR gRNA sequence
tcacgttcctaggctataca

SEQ ID NO: 802641 - DNA, 20 bp, Artificial
  CRISPR gRNA sequence
ctaggctatacaggccacag

SEQ ID NO: 802642 - DNA, 20 bp, Artificial
  CRISPR gRNA sequence
ggctatacaggccacaggag

SEQ ID NO: 802643 - DNA, 20 bp, Artificial
  CRISPR gRNA sequence
tacaggccacaggagtctgc

SEQ ID NO: 802644 - DNA, 20 bp, Artificial
  CRISPR gRNA sequence
ccttcctgcaacacagagca

SEQ ID NO: 802645 - DNA, 20 bp, Artificial
  CRISPR gRNA sequence
cctgcaacacagagcagaga

SEQ ID NO: 802646 - DNA, 20 bp, Artificial
  CRISPR gRNA sequence
ctgcaacacagagcagagaa

SEQ ID NO: 802647 - DNA, 20 bp, Artificial
  CRISPR gRNA sequence
caacacagagcagagaagaa

SEQ ID NO: 802648 - DNA, 20 bp, Artificial
  CRISPR gRNA sequence
aaggcaaacagacccaggac

SEQ ID NO: 802649 - DNA, 20 bp, Artificial
  CRISPR gRNA sequence
gtgtattgggtggtaaaagg

SEQ ID NO: 802650 - DNA, 20 bp, Artificial
  CRISPR gRNA sequence
tgtattgggtggtaaaaggt

SEQ ID NO: 802651 - DNA, 20 bp, Artificial
  CRISPR gRNA sequence
ggtggtaaaaggtgggataa

SEQ ID NO: 802652 - DNA, 20 bp, Artificial
  CRISPR gRNA sequence
actagatctataacagactg

SEQ ID NO: 802653 - DNA, 20 bp, Artificial
  CRISPR gRNA sequence
gatctataacagactgaaaa

SEQ ID NO: 802654 - DNA, 20 bp, Artificial
  CRISPR gRNA sequence
taacagactgaaaagctagt

SEQ ID NO: 802655 - DNA, 20 bp, Artificial
  CRISPR gRNA sequence
aaaagctagtagttgttgag

SEQ ID NO: 802656 - DNA, 20 bp, Artificial
  CRISPR gRNA sequence
gtagttgttgagtcagggac

SEQ ID NO: 802657 - DNA, 20 bp, Artificial
  CRISPR gRNA sequence
ttgagtcagggacaacgaag

SEQ ID NO: 802658 - DNA, 20 bp, Artificial
  CRISPR gRNA sequence
agtcagggacaacgaaggct

SEQ ID NO: 802659 - DNA, 20 bp, Artificial
  CRISPR gRNA sequence
gctgatggcctcagtcaact

SEQ ID NO: 802660 - DNA, 20 bp, Artificial
  CRISPR gRNA sequence
atggcctcagtcaacttgga

SEQ ID NO: 802661 - DNA, 20 bp, Artificial
  CRISPR gRNA sequence
agtcaacttggagacaatct

SEQ ID NO: 802662 - DNA, 20 bp, Artificial
  CRISPR gRNA sequence
ggagacaatctccaagtgct

SEQ ID NO: 802663 - DNA, 20 bp, Artificial
  CRISPR gRNA sequence
gagacaatctccaagtgcta

SEQ ID NO: 802664 - DNA, 20 bp, Artificial
  CRISPR gRNA sequence
caagtgctaaggggtctgtt

SEQ ID NO: 802665 - DNA, 20 bp, Artificial
  CRISPR gRNA sequence
aggggtctgttattcaggtt

SEQ ID NO: 802666 - DNA, 20 bp, Artificial
  CRISPR gRNA sequence
ttattcaggttgtaaggata

SEQ ID NO: 802667 - DNA, 20 bp, Artificial
  CRISPR gRNA sequence
ttcaggttgtaaggatatag

SEQ ID NO: 802668 - DNA, 20 bp, Artificial
  CRISPR gRNA sequence
aggttgtaaggatatagcca

SEQ ID NO: 802669 - DNA, 20 bp, Artificial
  CRISPR gRNA sequence
taaggatatagccaacctaa

SEQ ID NO: 802670 - DNA, 20 bp, Artificial
  CRISPR gRNA sequence
actgagcagcagatcatata

SEQ ID NO: 802671 - DNA, 20 bp, Artificial
  CRISPR gRNA sequence
agcagcagatcatatattta

SEQ ID NO: 802672 - DNA, 20 bp, Artificial
  CRISPR gRNA sequence
agcaaaactgatcttatgac

SEQ ID NO: 802673 - DNA, 20 bp, Artificial
  CRISPR gRNA sequence
gcaaaactgatcttatgacc

SEQ ID NO: 802674 - DNA, 20 bp, Artificial
  CRISPR gRNA sequence
atcttatgaccttaggttac

SEQ ID NO: 802675 - DNA, 20 bp, Artificial
  CRISPR gRNA sequence
atgaccttaggttacattaa

SEQ ID NO: 802676 - DNA, 20 bp, Artificial
  CRISPR gRNA sequence
tgaccttaggttacattaaa

SEQ ID NO: 802677 - DNA, 20 bp, Artificial
  CRISPR gRNA sequence
aggttacattaaaaccctgg

SEQ ID NO: 802678 - DNA, 20 bp, Artificial
  CRISPR gRNA sequence
ggttacattaaaaccctgga

SEQ ID NO: 802679 - DNA, 20 bp, Artificial
  CRISPR gRNA sequence
cattaaaaccctggatattt

SEQ ID NO: 802680 - DNA, 20 bp, Artificial
  CRISPR gRNA sequence
aaaccctggatatttgtgct

SEQ ID NO: 802681 - DNA, 20 bp, Artificial
  CRISPR gRNA sequence
gatatttgtgctgcttagat

SEQ ID NO: 802682 - DNA, 20 bp, Artificial
  CRISPR gRNA sequence
gtgctgcttagataatatct

SEQ ID NO: 802683 - DNA, 20 bp, Artificial
  CRISPR gRNA sequence
tgctgcttagataatatcta

SEQ ID NO: 802684 - DNA, 20 bp, Artificial
  CRISPR gRNA sequence
cttagataatatctagaata

SEQ ID NO: 802685 - DNA, 20 bp, Artificial
  CRISPR gRNA sequence
agataatatctagaatatag

SEQ ID NO: 802686 - DNA, 20 bp, Artificial
  CRISPR gRNA sequence
gataatatctagaatataga

SEQ ID NO: 802687 - DNA, 20 bp, Artificial
  CRISPR gRNA sequence
gaatatagattgtgttacat

SEQ ID NO: 802688 - DNA, 20 bp, Artificial
  CRISPR gRNA sequence
tgttacatatcctttttaaa

SEQ ID NO: 802689 - DNA, 20 bp, Artificial
  CRISPR gRNA sequence
catatcctttttaaagaacg

SEQ ID NO: 802690 - DNA, 20 bp, Artificial
  CRISPR gRNA sequence
tttaaagaacgtggcaaaac

SEQ ID NO: 802691 - DNA, 20 bp, Artificial
  CRISPR gRNA sequence
ttaaagaacgtggcaaaact

SEQ ID NO: 802692 - DNA, 20 bp, Artificial
  CRISPR gRNA sequence
taaagaacgtggcaaaacta

SEQ ID NO: 802693 - DNA, 20 bp, Artificial
  CRISPR gRNA sequence
aaagaacgtggcaaaactaa

SEQ ID NO: 802694 - DNA, 20 bp, Artificial
  CRISPR gRNA sequence
aagaacgtggcaaaactaaa

SEQ ID NO: 802695 - DNA, 20 bp, Artificial
  CRISPR gRNA sequence
aactataaccaaagactact

SEQ ID NO: 802696 - DNA, 20 bp, Artificial
  CRISPR gRNA sequence
taaccaaagactactatctg

SEQ ID NO: 802697 - DNA, 20 bp, Artificial
  CRISPR gRNA sequence
ctatctggaaatgggtctga

SEQ ID NO: 802698 - DNA, 20 bp, Artificial
  CRISPR gRNA sequence
tctggaaatgggtctgaaga

SEQ ID NO: 802699 - DNA, 20 bp, Artificial
  CRISPR gRNA sequence
gaaatgggtctgaagactgt

SEQ ID NO: 802700 - DNA, 20 bp, Artificial
  CRISPR gRNA sequence
aagactgtatcttgtgagat

SEQ ID NO: 802701 - DNA, 20 bp, Artificial
  CRISPR gRNA sequence
tatcttgtgagatatagtta

SEQ ID NO: 802702 - DNA, 20 bp, Artificial
  CRISPR gRNA sequence
gtgagatatagttaaaggag

SEQ ID NO: 802703 - DNA, 20 bp, Artificial
  CRISPR gRNA sequence
tgagatatagttaaaggagg

SEQ ID NO: 802704 - DNA, 20 bp, Artificial
  CRISPR gRNA sequence
aaggaggtaggcatgtttta

SEQ ID NO: 802705 - DNA, 20 bp, Artificial
  CRISPR gRNA sequence
tacttagggttgaaaagact

SEQ ID NO: 802706 - DNA, 20 bp, Artificial
  CRISPR gRNA sequence
acttagggttgaaaagacta

SEQ ID NO: 802707 - DNA, 20 bp, Artificial
  CRISPR gRNA sequence
cttagggttgaaaagactag

SEQ ID NO: 802708 - DNA, 20 bp, Artificial
  CRISPR gRNA sequence
agggttgaaaagactagatg

SEQ ID NO: 802709 - DNA, 20 bp, Artificial
  CRISPR gRNA sequence
gggttgaaaagactagatgg

SEQ ID NO: 802710 - DNA, 20 bp, Artificial
  CRISPR gRNA sequence
aaaagactagatggagtctt

SEQ ID NO: 802711 - DNA, 20 bp, Artificial
  CRISPR gRNA sequence
gatggagtcttcccagttat

SEQ ID NO: 802712 - DNA, 20 bp, Artificial
  CRISPR gRNA sequence
cccagttatattcaaatatc

SEQ ID NO: 802713 - DNA, 20 bp, Artificial
  CRISPR gRNA sequence
ccagttatattcaaatatca

SEQ ID NO: 802714 - DNA, 20 bp, Artificial
  CRISPR gRNA sequence
tattcaaatatcagaagggt

SEQ ID NO: 802715 - DNA, 20 bp, Artificial
  CRISPR gRNA sequence
aaatatcagaagggttacct

SEQ ID NO: 802716 - DNA, 20 bp, Artificial
  CRISPR gRNA sequence
cctgcaataattgctaacac

SEQ ID NO: 802717 - DNA, 20 bp, Artificial
  CRISPR gRNA sequence
caataattgctaacactaat

SEQ ID NO: 802718 - DNA, 20 bp, Artificial
  CRISPR gRNA sequence
ctaacactaattgagtgttt

SEQ ID NO: 802719 - DNA, 20 bp, Artificial
  CRISPR gRNA sequence
acactaattgagtgtttact

SEQ ID NO: 802720 - DNA, 20 bp, Artificial
  CRISPR gRNA sequence
attgagtgtttactacgttc

SEQ ID NO: 802721 - DNA, 20 bp, Artificial
  CRISPR gRNA sequence
agtgtttactacgttctaga

SEQ ID NO: 802722 - DNA, 20 bp, Artificial
  CRISPR gRNA sequence
actacgttctagacatctaa

SEQ ID NO: 802723 - DNA, 20 bp, Artificial
  CRISPR gRNA sequence
ctacgttctagacatctaac

SEQ ID NO: 802724 - DNA, 20 bp, Artificial
  CRISPR gRNA sequence
cgttctagacatctaactaa

SEQ ID NO: 802725 - DNA, 20 bp, Artificial
  CRISPR gRNA sequence
tagacatctaactaattatt

SEQ ID NO: 802726 - DNA, 20 bp, Artificial
  CRISPR gRNA sequence
gacatctaactaattattta

SEQ ID NO: 802727 - DNA, 20 bp, Artificial
  CRISPR gRNA sequence
actaattatttaacaccctt

SEQ ID NO: 802728 - DNA, 20 bp, Artificial
  CRISPR gRNA sequence
attatttaacacccttgtta

SEQ ID NO: 802729 - DNA, 20 bp, Artificial
  CRISPR gRNA sequence
tttaacacccttgttaagga

SEQ ID NO: 802730 - DNA, 20 bp, Artificial
  CRISPR gRNA sequence
aacacccttgttaaggataa

SEQ ID NO: 802731 - DNA, 20 bp, Artificial
  CRISPR gRNA sequence
acacccttgttaaggataag

SEQ ID NO: 802732 - DNA, 20 bp, Artificial
  CRISPR gRNA sequence
gttaaggataagtattgctg

SEQ ID NO: 802733 - DNA, 20 bp, Artificial
  CRISPR gRNA sequence
ttaaggataagtattgctgt

SEQ ID NO: 802734 - DNA, 20 bp, Artificial
  CRISPR gRNA sequence
aggataagtattgctgtatc

SEQ ID NO: 802735 - DNA, 20 bp, Artificial
  CRISPR gRNA sequence
ctgtatccatttcctaaaca

SEQ ID NO: 802736 - DNA, 20 bp, Artificial
  CRISPR gRNA sequence
tatccatttcctaaacaaga

SEQ ID NO: 802737 - DNA, 20 bp, Artificial
  CRISPR gRNA sequence
cctaaacaagaaaactgagg

SEQ ID NO: 802738 - DNA, 20 bp, Artificial
  CRISPR gRNA sequence
ctaaacaagaaaactgaggg

SEQ ID NO: 802739 - DNA, 20 bp, Artificial
  CRISPR gRNA sequence
aacaagaaaactgagggttt

SEQ ID NO: 802740 - DNA, 20 bp, Artificial
  CRISPR gRNA sequence
agggtttaagaggtcatata

SEQ ID NO: 802741 - DNA, 20 bp, Artificial
  CRISPR gRNA sequence
aagaggtcatataactagcc

SEQ ID NO: 802742 - DNA, 20 bp, Artificial
  CRISPR gRNA sequence
agaggtcatataactagccc

SEQ ID NO: 802743 - DNA, 20 bp, Artificial
  CRISPR gRNA sequence
gcccttggctaaagcctact

SEQ ID NO: 802744 - DNA, 20 bp, Artificial
  CRISPR gRNA sequence
ggctaaagcctactcaaact

SEQ ID NO: 802745 - DNA, 20 bp, Artificial
  CRISPR gRNA sequence
gctaaagcctactcaaactg

SEQ ID NO: 802746 - DNA, 20 bp, Artificial
  CRISPR gRNA sequence
aagcctactcaaactgctca

SEQ ID NO: 802747 - DNA, 20 bp, Artificial
  CRISPR gRNA sequence
ctcaaactgctcagattctg

SEQ ID NO: 802748 - DNA, 20 bp, Artificial
  CRISPR gRNA sequence
aaactgctcagattctgaac

SEQ ID NO: 802749 - DNA, 20 bp, Artificial
  CRISPR gRNA sequence
ctcagattctgaactcatgt

SEQ ID NO: 802750 - DNA, 20 bp, Artificial
  CRISPR gRNA sequence
agattctgaactcatgtttt

SEQ ID NO: 802751 - DNA, 20 bp, Artificial
  CRISPR gRNA sequence
tgaactcatgtttttaacta

SEQ ID NO: 802752 - DNA, 20 bp, Artificial
  CRISPR gRNA sequence
aactcatgtttttaactacg

SEQ ID NO: 802753 - DNA, 20 bp, Artificial
  CRISPR gRNA sequence
atgtttttaactacggtgct

SEQ ID NO: 802754 - DNA, 20 bp, Artificial
  CRISPR gRNA sequence
ttaactacggtgcttaccat

SEQ ID NO: 802755 - DNA, 20 bp, Artificial
  CRISPR gRNA sequence
taactacggtgcttaccata

SEQ ID NO: 802756 - DNA, 20 bp, Artificial
  CRISPR gRNA sequence
aactacggtgcttaccatat

SEQ ID NO: 802757 - DNA, 20 bp, Artificial
  CRISPR gRNA sequence
actacggtgcttaccatatg

SEQ ID NO: 802758 - DNA, 20 bp, Artificial
  CRISPR gRNA sequence
cggtgcttaccatatgttgt

SEQ ID NO: 802759 - DNA, 20 bp, Artificial
  CRISPR gRNA sequence
accatatgttgtgttactaa

SEQ ID NO: 802760 - DNA, 20 bp, Artificial
  CRISPR gRNA sequence
ccatatgttgtgttactaaa

SEQ ID NO: 802761 - DNA, 20 bp, Artificial
  CRISPR gRNA sequence
tgttactaaactagacaaat

SEQ ID NO: 802762 - DNA, 20 bp, Artificial
  CRISPR gRNA sequence
ctaaactagacaaataccaa

SEQ ID NO: 802763 - DNA, 20 bp, Artificial
  CRISPR gRNA sequence
aactagacaaataccaatgg

SEQ ID NO: 802764 - DNA, 20 bp, Artificial
  CRISPR gRNA sequence
gacaaataccaatgggtaga

SEQ ID NO: 802765 - DNA, 20 bp, Artificial
  CRISPR gRNA sequence
caaagaggcacaattttgct

SEQ ID NO: 802766 - DNA, 20 bp, Artificial
  CRISPR gRNA sequence
tgcttggcatgaagaaaatc

SEQ ID NO: 802767 - DNA, 20 bp, Artificial
  CRISPR gRNA sequence
gcttggcatgaagaaaatct

SEQ ID NO: 802768 - DNA, 20 bp, Artificial
  CRISPR gRNA sequence
cttggcatgaagaaaatctt

SEQ ID NO: 802769 - DNA, 20 bp, Artificial
  CRISPR gRNA sequence
ggcatgaagaaaatctttcc

SEQ ID NO: 802770 - DNA, 20 bp, Artificial
  CRISPR gRNA sequence
gcatgaagaaaatctttcca

SEQ ID NO: 802771 - DNA, 20 bp, Artificial
  CRISPR gRNA sequence
tccaatggaagtttaacttg

SEQ ID NO: 802772 - DNA, 20 bp, Artificial
  CRISPR gRNA sequence
ccaatggaagtttaacttgc

SEQ ID NO: 802773 - DNA, 20 bp, Artificial
  CRISPR gRNA sequence
caatggaagtttaacttgct

SEQ ID NO: 802774 - DNA, 20 bp, Artificial
  CRISPR gRNA sequence
aacttgcttattgtataatc

SEQ ID NO: 802775 - DNA, 20 bp, Artificial
  CRISPR gRNA sequence
acttgcttattgtataatca

SEQ ID NO: 802776 - DNA, 20 bp, Artificial
  CRISPR gRNA sequence
gcttattgtataatcatggc

SEQ ID NO: 802777 - DNA, 20 bp, Artificial
  CRISPR gRNA sequence
cttattgtataatcatggca

SEQ ID NO: 802778 - DNA, 20 bp, Artificial
  CRISPR gRNA sequence
attgtataatcatggcaaag

SEQ ID NO: 802779 - DNA, 20 bp, Artificial
  CRISPR gRNA sequence
ttgtataatcatggcaaaga

SEQ ID NO: 802780 - DNA, 20 bp, Artificial
  CRISPR gRNA sequence
tataatcatggcaaagactg

SEQ ID NO: 802781 - DNA, 20 bp, Artificial
  CRISPR gRNA sequence
cttctagaggaagtaggagt

SEQ ID NO: 802782 - DNA, 20 bp, Artificial
  CRISPR gRNA sequence
ctagaggaagtaggagtttc

SEQ ID NO: 802783 - DNA, 20 bp, Artificial
  CRISPR gRNA sequence
tagaggaagtaggagtttcc

SEQ ID NO: 802784 - DNA, 20 bp, Artificial
  CRISPR gRNA sequence
gaggaagtaggagtttccat

SEQ ID NO: 802785 - DNA, 20 bp, Artificial
  CRISPR gRNA sequence
ccattcatagatgttttcag

SEQ ID NO: 802786 - DNA, 20 bp, Artificial
  CRISPR gRNA sequence
cattcatagatgttttcagg

SEQ ID NO: 802787 - DNA, 20 bp, Artificial
  CRISPR gRNA sequence
atagatgttttcaggcaaaa

SEQ ID NO: 802788 - DNA, 20 bp, Artificial
  CRISPR gRNA sequence
tcaggcaaaagttatttagc

SEQ ID NO: 802789 - DNA, 20 bp, Artificial
  CRISPR gRNA sequence
caggcaaaagttatttagca

SEQ ID NO: 802790 - DNA, 20 bp, Artificial
  CRISPR gRNA sequence
aggcaaaagttatttagcag

SEQ ID NO: 802791 - DNA, 20 bp, Artificial
  CRISPR gRNA sequence
tttagcagtttactaatatc

SEQ ID NO: 802792 - DNA, 20 bp, Artificial
  CRISPR gRNA sequence
agcagtttactaatatcaga

SEQ ID NO: 802793 - DNA, 20 bp, Artificial
  CRISPR gRNA sequence
gcagtttactaatatcagaa

SEQ ID NO: 802794 - DNA, 20 bp, Artificial
  CRISPR gRNA sequence
actaatatcagaagaaaaat

SEQ ID NO: 802795 - DNA, 20 bp, Artificial
  CRISPR gRNA sequence
ctaatatcagaagaaaaata

SEQ ID NO: 802796 - DNA, 20 bp, Artificial
  CRISPR gRNA sequence
atatcagaagaaaaatatta

SEQ ID NO: 802797 - DNA, 20 bp, Artificial
  CRISPR gRNA sequence
ctaaagataacaagggacac

SEQ ID NO: 802798 - DNA, 20 bp, Artificial
  CRISPR gRNA sequence
aagataacaagggacacttc

SEQ ID NO: 802799 - DNA, 20 bp, Artificial
  CRISPR gRNA sequence
cataatgataaaagagtgag

SEQ ID NO: 802800 - DNA, 20 bp, Artificial
  CRISPR gRNA sequence
ataatgataaaagagtgagt

SEQ ID NO: 802801 - DNA, 20 bp, Artificial
  CRISPR gRNA sequence
taaaggaacacataacaatc

SEQ ID NO: 802802 - DNA, 20 bp, Artificial
  CRISPR gRNA sequence
aaggaacacataacaatcct

SEQ ID NO: 802803 - DNA, 20 bp, Artificial
  CRISPR gRNA sequence
aatgtgtgtccatttaacag

SEQ ID NO: 802804 - DNA, 20 bp, Artificial
  CRISPR gRNA sequence
aacagtatagcttcaaaata

SEQ ID NO: 802805 - DNA, 20 bp, Artificial
  CRISPR gRNA sequence
acagtatagcttcaaaatat

SEQ ID NO: 802806 - DNA, 20 bp, Artificial
  CRISPR gRNA sequence
caaaatattaaacaacaatt

SEQ ID NO: 802807 - DNA, 20 bp, Artificial
  CRISPR gRNA sequence
aaaatattaaacaacaattg

SEQ ID NO: 802808 - DNA, 20 bp, Artificial
  CRISPR gRNA sequence
aacaacaattggcagactta

SEQ ID NO: 802809 - DNA, 20 bp, Artificial
  CRISPR gRNA sequence
gcagacttaggagaaccagt

SEQ ID NO: 802810 - DNA, 20 bp, Artificial
  CRISPR gRNA sequence
aggagaaccagtcaaatcca

SEQ ID NO: 802811 - DNA, 20 bp, Artificial
  CRISPR gRNA sequence
ggagaaccagtcaaatccac

SEQ ID NO: 802812 - DNA, 20 bp, Artificial
  CRISPR gRNA sequence
catttgagatttcaactcat

SEQ ID NO: 802813 - DNA, 20 bp, Artificial
  CRISPR gRNA sequence
gagatttcaactcatctcta

SEQ ID NO: 802814 - DNA, 20 bp, Artificial
  CRISPR gRNA sequence
agatttcaactcatctctat

SEQ ID NO: 802815 - DNA, 20 bp, Artificial
  CRISPR gRNA sequence
caactcatctctattacaac

SEQ ID NO: 802816 - DNA, 20 bp, Artificial
  CRISPR gRNA sequence
aactcatctctattacaact

SEQ ID NO: 802817 - DNA, 20 bp, Artificial
  CRISPR gRNA sequence
atctctattacaactgatag

SEQ ID NO: 802818 - DNA, 20 bp, Artificial
  CRISPR gRNA sequence
tattacaactgatagaacaa

SEQ ID NO: 802819 - DNA, 20 bp, Artificial
  CRISPR gRNA sequence
ttacaactgatagaacaaac

SEQ ID NO: 802820 - DNA, 20 bp, Artificial
  CRISPR gRNA sequence
caactgatagaacaaacaat

SEQ ID NO: 802821 - DNA, 20 bp, Artificial
  CRISPR gRNA sequence
atagaacaaacaattaagaa

SEQ ID NO: 802822 - DNA, 20 bp, Artificial
  CRISPR gRNA sequence
agaaaatagaaaatctgaac

SEQ ID NO: 802823 - DNA, 20 bp, Artificial
  CRISPR gRNA sequence
aacaacacaattagccatct

SEQ ID NO: 802824 - DNA, 20 bp, Artificial
  CRISPR gRNA sequence
gccatcttgacctaatagac

SEQ ID NO: 802825 - DNA, 20 bp, Artificial
  CRISPR gRNA sequence
gacctaatagacatatgata

SEQ ID NO: 802826 - DNA, 20 bp, Artificial
  CRISPR gRNA sequence
acctaatagacatatgatat

SEQ ID NO: 802827 - DNA, 20 bp, Artificial
  CRISPR gRNA sequence
atagacatatgatatataga

SEQ ID NO: 802828 - DNA, 20 bp, Artificial
  CRISPR gRNA sequence
cagaacacacattgttttca

SEQ ID NO: 802829 - DNA, 20 bp, Artificial
  CRISPR gRNA sequence
ttttcaagcgtatgtggaac

SEQ ID NO: 802830 - DNA, 20 bp, Artificial
  CRISPR gRNA sequence
tcaagcgtatgtggaacaat

SEQ ID NO: 802831 - DNA, 20 bp, Artificial
  CRISPR gRNA sequence
caagcgtatgtggaacaatc

SEQ ID NO: 802832 - DNA, 20 bp, Artificial
  CRISPR gRNA sequence
aagcgtatgtggaacaatca

SEQ ID NO: 802833 - DNA, 20 bp, Artificial
  CRISPR gRNA sequence
tctaggagaattgctgtaga

SEQ ID NO: 802834 - DNA, 20 bp, Artificial
  CRISPR gRNA sequence
ggagaattgctgtagaaggt

SEQ ID NO: 802835 - DNA, 20 bp, Artificial
  CRISPR gRNA sequence
ctgtagaaggtgtttttcat

SEQ ID NO: 802836 - DNA, 20 bp, Artificial
  CRISPR gRNA sequence
tagaaggtgtttttcattga

SEQ ID NO: 802837 - DNA, 20 bp, Artificial
  CRISPR gRNA sequence
ttcattgagcaataagtcag

SEQ ID NO: 802838 - DNA, 20 bp, Artificial
  CRISPR gRNA sequence
tcattgagcaataagtcaga

SEQ ID NO: 802839 - DNA, 20 bp, Artificial
  CRISPR gRNA sequence
cattgagcaataagtcagat

SEQ ID NO: 802840 - DNA, 20 bp, Artificial
  CRISPR gRNA sequence
attgagcaataagtcagatg

SEQ ID NO: 802841 - DNA, 20 bp, Artificial
  CRISPR gRNA sequence
agcaataagtcagatgactt

SEQ ID NO: 802842 - DNA, 20 bp, Artificial
  CRISPR gRNA sequence
gaatttttggagtacttccg

SEQ ID NO: 802843 - DNA, 20 bp, Artificial
  CRISPR gRNA sequence
aatttttggagtacttccgc

SEQ ID NO: 802844 - DNA, 20 bp, Artificial
  CRISPR gRNA sequence
ttggagtacttccgcctctt

SEQ ID NO: 802845 - DNA, 20 bp, Artificial
  CRISPR gRNA sequence
tggagtacttccgcctctta

SEQ ID NO: 802846 - DNA, 20 bp, Artificial
  CRISPR gRNA sequence
ggagtacttccgcctcttaa

SEQ ID NO: 802847 - DNA, 20 bp, Artificial
  CRISPR gRNA sequence
gagtacttccgcctcttaaa

SEQ ID NO: 802848 - DNA, 20 bp, Artificial
  CRISPR gRNA sequence
ccgcctcttaaattctaaaa

SEQ ID NO: 802849 - DNA, 20 bp, Artificial
  CRISPR gRNA sequence
cgcctcttaaattctaaaat

SEQ ID NO: 802850 - DNA, 20 bp, Artificial
  CRISPR gRNA sequence
ttaaattctaaaatttactc

SEQ ID NO: 802851 - DNA, 20 bp, Artificial
  CRISPR gRNA sequence
aaattctaaaatttactcat

SEQ ID NO: 802852 - DNA, 20 bp, Artificial
  CRISPR gRNA sequence
aattctaaaatttactcatc

SEQ ID NO: 802853 - DNA, 20 bp, Artificial
  CRISPR gRNA sequence
taaaatttactcatcttttc

SEQ ID NO: 802854 - DNA, 20 bp, Artificial
  CRISPR gRNA sequence
aaatttactcatcttttcct

SEQ ID NO: 802855 - DNA, 20 bp, Artificial
  CRISPR gRNA sequence
actcatcttttcctaagaat

SEQ ID NO: 802856 - DNA, 20 bp, Artificial
  CRISPR gRNA sequence
ctcatcttttcctaagaata

SEQ ID NO: 802857 - DNA, 20 bp, Artificial
  CRISPR gRNA sequence
atcttttcctaagaatatca

SEQ ID NO: 802858 - DNA, 20 bp, Artificial
  CRISPR gRNA sequence
ttcctaagaatatcaccctc

SEQ ID NO: 802859 - DNA, 20 bp, Artificial
  CRISPR gRNA sequence
tcctaagaatatcaccctca

SEQ ID NO: 802860 - DNA, 20 bp, Artificial
  CRISPR gRNA sequence
cctaagaatatcaccctcag

SEQ ID NO: 802861 - DNA, 20 bp, Artificial
  CRISPR gRNA sequence
ctaagaatatcaccctcagt

SEQ ID NO: 802862 - DNA, 20 bp, Artificial
  CRISPR gRNA sequence
agaatatcaccctcagtcca

SEQ ID NO: 802863 - DNA, 20 bp, Artificial
  CRISPR gRNA sequence
agtccagcttccccactgtg

SEQ ID NO: 802864 - DNA, 20 bp, Artificial
  CRISPR gRNA sequence
ccccactgtgggaagcgatt

SEQ ID NO: 802865 - DNA, 20 bp, Artificial
  CRISPR gRNA sequence
cccactgtgggaagcgattc

SEQ ID NO: 802866 - DNA, 20 bp, Artificial
  CRISPR gRNA sequence
tgggaagcgattccttttcc

SEQ ID NO: 802867 - DNA, 20 bp, Artificial
  CRISPR gRNA sequence
cttttccaccaccttccaaa

SEQ ID NO: 802868 - DNA, 20 bp, Artificial
  CRISPR gRNA sequence
ttccaccaccttccaaataa

SEQ ID NO: 802869 - DNA, 20 bp, Artificial
  CRISPR gRNA sequence
tccaccaccttccaaataag

SEQ ID NO: 802870 - DNA, 20 bp, Artificial
  CRISPR gRNA sequence
ccaccaccttccaaataaga

SEQ ID NO: 802871 - DNA, 20 bp, Artificial
  CRISPR gRNA sequence
caccaccttccaaataagaa

SEQ ID NO: 802872 - DNA, 20 bp, Artificial
  CRISPR gRNA sequence
ccaaataagaaagaggctgt

SEQ ID NO: 802873 - DNA, 20 bp, Artificial
  CRISPR gRNA sequence
caaataagaaagaggctgtg

SEQ ID NO: 802874 - DNA, 20 bp, Artificial
  CRISPR gRNA sequence
tggagacatttctgatactg

SEQ ID NO: 802875 - DNA, 20 bp, Artificial
  CRISPR gRNA sequence
ctgatactgcaaaaatgtag

SEQ ID NO: 802876 - DNA, 20 bp, Artificial
  CRISPR gRNA sequence
tgatactgcaaaaatgtagg

SEQ ID NO: 802877 - DNA, 20 bp, Artificial
  CRISPR gRNA sequence
atactgcaaaaatgtaggat

SEQ ID NO: 802878 - DNA, 20 bp, Artificial
  CRISPR gRNA sequence
caaaaatgtaggatgtgggc

SEQ ID NO: 802879 - DNA, 20 bp, Artificial
  CRISPR gRNA sequence
ctgtcccttccccaaacctt

SEQ ID NO: 802880 - DNA, 20 bp, Artificial
  CRISPR gRNA sequence
tcccttccccaaaccttgct

SEQ ID NO: 802881 - DNA, 20 bp, Artificial
  CRISPR gRNA sequence
ccccaaaccttgctgattct

SEQ ID NO: 802882 - DNA, 20 bp, Artificial
  CRISPR gRNA sequence
cccaaaccttgctgattctt

SEQ ID NO: 802883 - DNA, 20 bp, Artificial
  CRISPR gRNA sequence
gctgattcttgtagtggaag

SEQ ID NO: 802884 - DNA, 20 bp, Artificial
  CRISPR gRNA sequence
ctgattcttgtagtggaaga

SEQ ID NO: 802885 - DNA, 20 bp, Artificial
  CRISPR gRNA sequence
attcttgtagtggaagagct

SEQ ID NO: 802886 - DNA, 20 bp, Artificial
  CRISPR gRNA sequence
ttgtagtggaagagctctct

SEQ ID NO: 802887 - DNA, 20 bp, Artificial
  CRISPR gRNA sequence
gtagtggaagagctctctct

SEQ ID NO: 802888 - DNA, 20 bp, Artificial
  CRISPR gRNA sequence
tagtggaagagctctctctc

SEQ ID NO: 802889 - DNA, 20 bp, Artificial
  CRISPR gRNA sequence
tctctctgtctccctatctg

SEQ ID NO: 802890 - DNA, 20 bp, Artificial
  CRISPR gRNA sequence
tctctgtctccctatctgct

SEQ ID NO: 802891 - DNA, 20 bp, Artificial
  CRISPR gRNA sequence
tctgtctccctatctgctcc

SEQ ID NO: 802892 - DNA, 20 bp, Artificial
  CRISPR gRNA sequence
tgtctccctatctgctccct

SEQ ID NO: 802893 - DNA, 20 bp, Artificial
  CRISPR gRNA sequence
tctccctatctgctccctca

SEQ ID NO: 802894 - DNA, 20 bp, Artificial
  CRISPR gRNA sequence
cctatctgctccctcatgta

SEQ ID NO: 802895 - DNA, 20 bp, Artificial
  CRISPR gRNA sequence
tctgctccctcatgtatccc

SEQ ID NO: 802896 - DNA, 20 bp, Artificial
  CRISPR gRNA sequence
ctccctcatgtatcccaagt

SEQ ID NO: 802897 - DNA, 20 bp, Artificial
  CRISPR gRNA sequence
cctcatgtatcccaagtcaa

SEQ ID NO: 802898 - DNA, 20 bp, Artificial
  CRISPR gRNA sequence
atgtatcccaagtcaaagcc

SEQ ID NO: 802899 - DNA, 20 bp, Artificial
  CRISPR gRNA sequence
agccaagctcccaattcctg

SEQ ID NO: 802900 - DNA, 20 bp, Artificial
  CRISPR gRNA sequence
ccaattcctggcatccctac

SEQ ID NO: 802901 - DNA, 20 bp, Artificial
  CRISPR gRNA sequence
ctggcatccctacttctgaa

SEQ ID NO: 802902 - DNA, 20 bp, Artificial
  CRISPR gRNA sequence
gcatccctacttctgaaatc

SEQ ID NO: 802903 - DNA, 20 bp, Artificial
  CRISPR gRNA sequence
cttctgaaatcacttctcaa

SEQ ID NO: 802904 - DNA, 20 bp, Artificial
  CRISPR gRNA sequence
ctgaaatcacttctcaacca

SEQ ID NO: 802905 - DNA, 20 bp, Artificial
  CRISPR gRNA sequence
tgaaatcacttctcaaccag

SEQ ID NO: 802906 - DNA, 20 bp, Artificial
  CRISPR gRNA sequence
aaatcacttctcaaccagga

SEQ ID NO: 802907 - DNA, 20 bp, Artificial
  CRISPR gRNA sequence
ctcaaccaggacaccaagat

SEQ ID NO: 802908 - DNA, 20 bp, Artificial
  CRISPR gRNA sequence
tcaaccaggacaccaagatc

SEQ ID NO: 802909 - DNA, 20 bp, Artificial
  CRISPR gRNA sequence
aaccaggacaccaagatcag

SEQ ID NO: 802910 - DNA, 20 bp, Artificial
  CRISPR gRNA sequence
cttggtccaagccacctgca

SEQ ID NO: 802911 - DNA, 20 bp, Artificial
  CRISPR gRNA sequence
ttggtccaagccacctgcaa

SEQ ID NO: 802912 - DNA, 20 bp, Artificial
  CRISPR gRNA sequence
ggtccaagccacctgcaata

SEQ ID NO: 802913 - DNA, 20 bp, Artificial
  CRISPR gRNA sequence
gtccaagccacctgcaatag

SEQ ID NO: 802914 - DNA, 20 bp, Artificial
  CRISPR gRNA sequence
caatagtgggctggaccctc

SEQ ID NO: 802915 - DNA, 20 bp, Artificial
  CRISPR gRNA sequence
gaccctcacccacagtactc

SEQ ID NO: 802916 - DNA, 20 bp, Artificial
  CRISPR gRNA sequence
acccacagtactctgctcct

SEQ ID NO: 802917 - DNA, 20 bp, Artificial
  CRISPR gRNA sequence
tgctcctgttcttgttctac

SEQ ID NO: 802918 - DNA, 20 bp, Artificial
  CRISPR gRNA sequence
ctcctgttcttgttctactt

SEQ ID NO: 802919 - DNA, 20 bp, Artificial
  CRISPR gRNA sequence
ctgttcttgttctacttcat

SEQ ID NO: 802920 - DNA, 20 bp, Artificial
  CRISPR gRNA sequence
ttcttgttctacttcattcc

SEQ ID NO: 802921 - DNA, 20 bp, Artificial
  CRISPR gRNA sequence
ttgttctacttcattcccca

SEQ ID NO: 802922 - DNA, 20 bp, Artificial
  CRISPR gRNA sequence
gttctacttcattccccaaa

SEQ ID NO: 802923 - DNA, 20 bp, Artificial
  CRISPR gRNA sequence
ttctacttcattccccaaaa

SEQ ID NO: 802924 - DNA, 20 bp, Artificial
  CRISPR gRNA sequence
tacttcattccccaaaagac

SEQ ID NO: 802925 - DNA, 20 bp, Artificial
  CRISPR gRNA sequence
cttcattccccaaaagactt

SEQ ID NO: 802926 - DNA, 20 bp, Artificial
  CRISPR gRNA sequence
cattccccaaaagacttgag

SEQ ID NO: 802927 - DNA, 20 bp, Artificial
  CRISPR gRNA sequence
attccccaaaagacttgaga

SEQ ID NO: 802928 - DNA, 20 bp, Artificial
  CRISPR gRNA sequence
cccaaaagacttgagagctt

SEQ ID NO: 802929 - DNA, 20 bp, Artificial
  CRISPR gRNA sequence
gagagcttacagaaataatc

SEQ ID NO: 802930 - DNA, 20 bp, Artificial
  CRISPR gRNA sequence
agagcttacagaaataatct

SEQ ID NO: 802931 - DNA, 20 bp, Artificial
  CRISPR gRNA sequence
acagaaataatctacagtat

SEQ ID NO: 802932 - DNA, 20 bp, Artificial
  CRISPR gRNA sequence
cagaaataatctacagtatg

SEQ ID NO: 802933 - DNA, 20 bp, Artificial
  CRISPR gRNA sequence
cagtatgatcatataaaatg

SEQ ID NO: 802934 - DNA, 20 bp, Artificial
  CRISPR gRNA sequence
caaaagacattgaaccaagg

SEQ ID NO: 802935 - DNA, 20 bp, Artificial
  CRISPR gRNA sequence
aaccaagggaaaataagtgt

SEQ ID NO: 802936 - DNA, 20 bp, Artificial
  CRISPR gRNA sequence
gaaatacacacttcgggtac

SEQ ID NO: 802937 - DNA, 20 bp, Artificial
  CRISPR gRNA sequence
cgggtactgtttgattatga

SEQ ID NO: 802938 - DNA, 20 bp, Artificial
  CRISPR gRNA sequence
gggtactgtttgattatgaa

SEQ ID NO: 802939 - DNA, 20 bp, Artificial
  CRISPR gRNA sequence
tttgattatgaaagataggc

SEQ ID NO: 802940 - DNA, 20 bp, Artificial
  CRISPR gRNA sequence
gattatgaaagataggccaa

SEQ ID NO: 802941 - DNA, 20 bp, Artificial
  CRISPR gRNA sequence
attatgaaagataggccaaa

SEQ ID NO: 802942 - DNA, 20 bp, Artificial
  CRISPR gRNA sequence
tgaaagataggccaaagttt

SEQ ID NO: 802943 - DNA, 20 bp, Artificial
  CRISPR gRNA sequence
tggcttcaaggagattggtg

SEQ ID NO: 802944 - DNA, 20 bp, Artificial
  CRISPR gRNA sequence
ggcttcaaggagattggtga

SEQ ID NO: 802945 - DNA, 20 bp, Artificial
  CRISPR gRNA sequence
gcttcaaggagattggtgag

SEQ ID NO: 802946 - DNA, 20 bp, Artificial
  CRISPR gRNA sequence
caaggagattggtgagtcta

SEQ ID NO: 802947 - DNA, 20 bp, Artificial
  CRISPR gRNA sequence
aaggagattggtgagtctaa

SEQ ID NO: 802948 - DNA, 20 bp, Artificial
  CRISPR gRNA sequence
gtgagtctaacaggtcaagt

SEQ ID NO: 802949 - DNA, 20 bp, Artificial
  CRISPR gRNA sequence
acaggtcaagtccttcagta

SEQ ID NO: 802950 - DNA, 20 bp, Artificial
  CRISPR gRNA sequence
cagtaggctgcttcagtgtc

SEQ ID NO: 802951 - DNA, 20 bp, Artificial
  CRISPR gRNA sequence
agtaggctgcttcagtgtct

SEQ ID NO: 802952 - DNA, 20 bp, Artificial
  CRISPR gRNA sequence
cttcagtgtctgaattgcct

SEQ ID NO: 802953 - DNA, 20 bp, Artificial
  CRISPR gRNA sequence
cagtgtctgaattgccttat

SEQ ID NO: 802954 - DNA, 20 bp, Artificial
  CRISPR gRNA sequence
agtgtctgaattgccttatc

SEQ ID NO: 802955 - DNA, 20 bp, Artificial
  CRISPR gRNA sequence
aattgccttatcttctacta

SEQ ID NO: 802956 - DNA, 20 bp, Artificial
  CRISPR gRNA sequence
ccttatcttctactactgct

SEQ ID NO: 802957 - DNA, 20 bp, Artificial
  CRISPR gRNA sequence
atcttctactactgctgggt

SEQ ID NO: 802958 - DNA, 20 bp, Artificial
  CRISPR gRNA sequence
tcttctactactgctgggtg

SEQ ID NO: 802959 - DNA, 20 bp, Artificial
  CRISPR gRNA sequence
ctactactgctgggtgctcc

SEQ ID NO: 802960 - DNA, 20 bp, Artificial
  CRISPR gRNA sequence
tactactgctgggtgctcct

SEQ ID NO: 802961 - DNA, 20 bp, Artificial
  CRISPR gRNA sequence
ctactgctgggtgctcctaa

SEQ ID NO: 802962 - DNA, 20 bp, Artificial
  CRISPR gRNA sequence
ctgctgggtgctcctaagaa

SEQ ID NO: 802963 - DNA, 20 bp, Artificial
  CRISPR gRNA sequence
ctgggtgctcctaagaacct

SEQ ID NO: 802964 - DNA, 20 bp, Artificial
  CRISPR gRNA sequence
ggtgctcctaagaacctcag

SEQ ID NO: 802965 - DNA, 20 bp, Artificial
  CRISPR gRNA sequence
ctaagaacctcagagcatat

SEQ ID NO: 802966 - DNA, 20 bp, Artificial
  CRISPR gRNA sequence
agaacctcagagcatattcc

SEQ ID NO: 802967 - DNA, 20 bp, Artificial
  CRISPR gRNA sequence
agagcatattcctctatctg

SEQ ID NO: 802968 - DNA, 20 bp, Artificial
  CRISPR gRNA sequence
ctctatctgcttatgttgca

SEQ ID NO: 802969 - DNA, 20 bp, Artificial
  CRISPR gRNA sequence
tatctgcttatgttgcacca

SEQ ID NO: 802970 - DNA, 20 bp, Artificial
  CRISPR gRNA sequence
tctgcttatgttgcaccatc

SEQ ID NO: 802971 - DNA, 20 bp, Artificial
  CRISPR gRNA sequence
cttatgttgcaccatcccta

SEQ ID NO: 802972 - DNA, 20 bp, Artificial
  CRISPR gRNA sequence
atgttgcaccatccctagac

SEQ ID NO: 802973 - DNA, 20 bp, Artificial
  CRISPR gRNA sequence
tgttgcaccatccctagaca

SEQ ID NO: 802974 - DNA, 20 bp, Artificial
  CRISPR gRNA sequence
caccatccctagacatctgc

SEQ ID NO: 802975 - DNA, 20 bp, Artificial
  CRISPR gRNA sequence
gacatctgcaattacacaga

SEQ ID NO: 802976 - DNA, 20 bp, Artificial
  CRISPR gRNA sequence
caattacacagagacacatc

SEQ ID NO: 802977 - DNA, 20 bp, Artificial
  CRISPR gRNA sequence
cacagagacacatcctctta

SEQ ID NO: 802978 - DNA, 20 bp, Artificial
  CRISPR gRNA sequence
ttatggtgattccaattaag

SEQ ID NO: 802979 - DNA, 20 bp, Artificial
  CRISPR gRNA sequence
atggtgattccaattaagaa

SEQ ID NO: 802980 - DNA, 20 bp, Artificial
  CRISPR gRNA sequence
tggtgattccaattaagaat

SEQ ID NO: 802981 - DNA, 20 bp, Artificial
  CRISPR gRNA sequence
caattaagaatgcattacaa

SEQ ID NO: 802982 - DNA, 20 bp, Artificial
  CRISPR gRNA sequence
agaatgcattacaaaatagt

SEQ ID NO: 802983 - DNA, 20 bp, Artificial
  CRISPR gRNA sequence
caaaatagtaatatgaattt

SEQ ID NO: 802984 - DNA, 20 bp, Artificial
  CRISPR gRNA sequence
tacccacctcatagggtctg

SEQ ID NO: 802985 - DNA, 20 bp, Artificial
  CRISPR gRNA sequence
acccacctcatagggtctgc

SEQ ID NO: 802986 - DNA, 20 bp, Artificial
  CRISPR gRNA sequence
cccacctcatagggtctgca

SEQ ID NO: 802987 - DNA, 20 bp, Artificial
  CRISPR gRNA sequence
atagggtctgcatatcattt

SEQ ID NO: 802988 - DNA, 20 bp, Artificial
  CRISPR gRNA sequence
catatcatttaaatgacata

SEQ ID NO: 802989 - DNA, 20 bp, Artificial
  CRISPR gRNA sequence
aaatgacataatgtattata

SEQ ID NO: 802990 - DNA, 20 bp, Artificial
  CRISPR gRNA sequence
aatgacataatgtattatat

SEQ ID NO: 802991 - DNA, 20 bp, Artificial
  CRISPR gRNA sequence
tatgtattatgtatatttat

SEQ ID NO: 802992 - DNA, 20 bp, Artificial
  CRISPR gRNA sequence
tgtatatttatacattaggg

SEQ ID NO: 802993 - DNA, 20 bp, Artificial
  CRISPR gRNA sequence
atacattagggggaaagatg

SEQ ID NO: 802994 - DNA, 20 bp, Artificial
  CRISPR gRNA sequence
tacattagggggaaagatgt

SEQ ID NO: 802995 - DNA, 20 bp, Artificial
  CRISPR gRNA sequence
gggggaaagatgtcagagct

SEQ ID NO: 802996 - DNA, 20 bp, Artificial
  CRISPR gRNA sequence
tttgggacataccaggaggc

SEQ ID NO: 802997 - DNA, 20 bp, Artificial
  CRISPR gRNA sequence
ttgggacataccaggaggcc

SEQ ID NO: 802998 - DNA, 20 bp, Artificial
  CRISPR gRNA sequence
tgggacataccaggaggccc

SEQ ID NO: 802999 - DNA, 20 bp, Artificial
  CRISPR gRNA sequence
gggacataccaggaggccca

SEQ ID NO: 803000 - DNA, 20 bp, Artificial
  CRISPR gRNA sequence
ggacataccaggaggcccag

SEQ ID NO: 803001 - DNA, 20 bp, Artificial
  CRISPR gRNA sequence
ggtgtgctgaccacatggag

SEQ ID NO: 803002 - DNA, 20 bp, Artificial
  CRISPR gRNA sequence
accacatggagacgagaact

SEQ ID NO: 803003 - DNA, 20 bp, Artificial
  CRISPR gRNA sequence
caagggagagccaaagtgca

SEQ ID NO: 803004 - DNA, 20 bp, Artificial
  CRISPR gRNA sequence
aagggagagccaaagtgcac

SEQ ID NO: 803005 - DNA, 20 bp, Artificial
  CRISPR gRNA sequence
tggtggatgtttcattgtgc

SEQ ID NO: 803006 - DNA, 20 bp, Artificial
  CRISPR gRNA sequence
gtggatgtttcattgtgcag

SEQ ID NO: 803007 - DNA, 20 bp, Artificial
  CRISPR gRNA sequence
cattgtgcagtgaccctgct

SEQ ID NO: 803008 - DNA, 20 bp, Artificial
  CRISPR gRNA sequence
attgtgcagtgaccctgctc

SEQ ID NO: 803009 - DNA, 20 bp, Artificial
  CRISPR gRNA sequence
tgcagtgaccctgctctcta

SEQ ID NO: 803010 - DNA, 20 bp, Artificial
  CRISPR gRNA sequence
ctctctagtgaacccagatc

SEQ ID NO: 803011 - DNA, 20 bp, Artificial
  CRISPR gRNA sequence
tctagtgaacccagatctag

SEQ ID NO: 803012 - DNA, 20 bp, Artificial
  CRISPR gRNA sequence
tagtgaacccagatctagtg

SEQ ID NO: 803013 - DNA, 20 bp, Artificial
  CRISPR gRNA sequence
gtgaacccagatctagtggg

SEQ ID NO: 803014 - DNA, 20 bp, Artificial
  CRISPR gRNA sequence
gtgggtgttgtttgctataa

SEQ ID NO: 803015 - DNA, 20 bp, Artificial
  CRISPR gRNA sequence
tttgctataatgaatcaaat

SEQ ID NO: 803016 - DNA, 20 bp, Artificial
  CRISPR gRNA sequence
gctataatgaatcaaattgt

SEQ ID NO: 803017 - DNA, 20 bp, Artificial
  CRISPR gRNA sequence
ctataatgaatcaaattgtc

SEQ ID NO: 803018 - DNA, 20 bp, Artificial
  CRISPR gRNA sequence
taatgaatcaaattgtcaac

SEQ ID NO: 803019 - DNA, 20 bp, Artificial
  CRISPR gRNA sequence
tcaactcttaacattgagac

SEQ ID NO: 803020 - DNA, 20 bp, Artificial
  CRISPR gRNA sequence
ttaacattgagacccacaac

SEQ ID NO: 803021 - DNA, 20 bp, Artificial
  CRISPR gRNA sequence
aacattgagacccacaacac

SEQ ID NO: 803022 - DNA, 20 bp, Artificial
  CRISPR gRNA sequence
acattgagacccacaacaca

SEQ ID NO: 803023 - DNA, 20 bp, Artificial
  CRISPR gRNA sequence
agacccacaacacaggaggg

SEQ ID NO: 803024 - DNA, 20 bp, Artificial
  CRISPR gRNA sequence
tgaagaacggcatgaacatt

SEQ ID NO: 803025 - DNA, 20 bp, Artificial
  CRISPR gRNA sequence
cttctcttccataggatgta

SEQ ID NO: 803026 - DNA, 20 bp, Artificial
  CRISPR gRNA sequence
ctcttccataggatgtaaaa

SEQ ID NO: 803027 - DNA, 20 bp, Artificial
  CRISPR gRNA sequence
tcttccataggatgtaaaag

SEQ ID NO: 803028 - DNA, 20 bp, Artificial
  CRISPR gRNA sequence
ttccataggatgtaaaagga

SEQ ID NO: 803029 - DNA, 20 bp, Artificial
  CRISPR gRNA sequence
ccataggatgtaaaaggacg

SEQ ID NO: 803030 - DNA, 20 bp, Artificial
  CRISPR gRNA sequence
cataggatgtaaaaggacgt

SEQ ID NO: 803031 - DNA, 20 bp, Artificial
  CRISPR gRNA sequence
aacacatagaaaacaataag

SEQ ID NO: 803032 - DNA, 20 bp, Artificial
  CRISPR gRNA sequence
tcacatggttgttaccatta

SEQ ID NO: 803033 - DNA, 20 bp, Artificial
  CRISPR gRNA sequence
cacatggttgttaccattat

SEQ ID NO: 803034 - DNA, 20 bp, Artificial
  CRISPR gRNA sequence
acatggttgttaccattatt

SEQ ID NO: 803035 - DNA, 20 bp, Artificial
  CRISPR gRNA sequence
ttaccattattttaatgtga

SEQ ID NO: 803036 - DNA, 20 bp, Artificial
  CRISPR gRNA sequence
ccattattttaatgtgaaat

SEQ ID NO: 803037 - DNA, 20 bp, Artificial
  CRISPR gRNA sequence
ttttaatgtgaaattgtttt

SEQ ID NO: 803038 - DNA, 20 bp, Artificial
  CRISPR gRNA sequence
taatgtgaaattgtttttca

SEQ ID NO: 803039 - DNA, 20 bp, Artificial
  CRISPR gRNA sequence
aatgtgaaattgtttttcac

SEQ ID NO: 803040 - DNA, 20 bp, Artificial
  CRISPR gRNA sequence
atgtgaaattgtttttcaca

SEQ ID NO: 803041 - DNA, 20 bp, Artificial
  CRISPR gRNA sequence
tttttcacaaagtttgtacc

SEQ ID NO: 803042 - DNA, 20 bp, Artificial
  CRISPR gRNA sequence
ttcacaaagtttgtacctat

SEQ ID NO: 803043 - DNA, 20 bp, Artificial
  CRISPR gRNA sequence
tcacaaagtttgtacctatt

SEQ ID NO: 803044 - DNA, 20 bp, Artificial
  CRISPR gRNA sequence
cacaaagtttgtacctattt

SEQ ID NO: 803045 - DNA, 20 bp, Artificial
  CRISPR gRNA sequence
acaaagtttgtacctattta

SEQ ID NO: 803046 - DNA, 20 bp, Artificial
  CRISPR gRNA sequence
gtacctatttatacttccaa

SEQ ID NO: 803047 - DNA, 20 bp, Artificial
  CRISPR gRNA sequence
tacctatttatacttccaac

SEQ ID NO: 803048 - DNA, 20 bp, Artificial
  CRISPR gRNA sequence
tttatacttccaacaattta

SEQ ID NO: 803049 - DNA, 20 bp, Artificial
  CRISPR gRNA sequence
atacttccaacaatttagga

SEQ ID NO: 803050 - DNA, 20 bp, Artificial
  CRISPR gRNA sequence
tacttccaacaatttaggag

SEQ ID NO: 803051 - DNA, 20 bp, Artificial
  CRISPR gRNA sequence
ccaacaatttaggagaaaaa

SEQ ID NO: 803052 - DNA, 20 bp, Artificial
  CRISPR gRNA sequence
caacaatttaggagaaaaaa

SEQ ID NO: 803053 - DNA, 20 bp, Artificial
  CRISPR gRNA sequence
aggagaaaaaagttgtatca

SEQ ID NO: 803054 - DNA, 20 bp, Artificial
  CRISPR gRNA sequence
ggagaaaaaagttgtatcac

SEQ ID NO: 803055 - DNA, 20 bp, Artificial
  CRISPR gRNA sequence
tatcacacctctgcctttac

SEQ ID NO: 803056 - DNA, 20 bp, Artificial
  CRISPR gRNA sequence
tgcctttacttcaagactac

SEQ ID NO: 803057 - DNA, 20 bp, Artificial
  CRISPR gRNA sequence
cctttacttcaagactacac

SEQ ID NO: 803058 - DNA, 20 bp, Artificial
  CRISPR gRNA sequence
tacttcaagactacacttac

SEQ ID NO: 803059 - DNA, 20 bp, Artificial
  CRISPR gRNA sequence
acttcaagactacacttact

SEQ ID NO: 803060 - DNA, 20 bp, Artificial
  CRISPR gRNA sequence
cttcaagactacacttactt

SEQ ID NO: 803061 - DNA, 20 bp, Artificial
  CRISPR gRNA sequence
caagactacacttacttcaa

SEQ ID NO: 803062 - DNA, 20 bp, Artificial
  CRISPR gRNA sequence
aagactacacttacttcaaa

SEQ ID NO: 803063 - DNA, 20 bp, Artificial
  CRISPR gRNA sequence
cacttacttcaaaaattgta

SEQ ID NO: 803064 - DNA, 20 bp, Artificial
  CRISPR gRNA sequence
acttcaaaaattgtattgaa

SEQ ID NO: 803065 - DNA, 20 bp, Artificial
  CRISPR gRNA sequence
cttcaaaaattgtattgaaa

SEQ ID NO: 803066 - DNA, 20 bp, Artificial
  CRISPR gRNA sequence
caaaaattgtattgaaattt

SEQ ID NO: 803067 - DNA, 20 bp, Artificial
  CRISPR gRNA sequence
aaaaattgtattgaaattta

SEQ ID NO: 803068 - DNA, 20 bp, Artificial
  CRISPR gRNA sequence
tattgaaatttaatttctta

SEQ ID NO: 803069 - DNA, 20 bp, Artificial
  CRISPR gRNA sequence
aaatttaatttcttaaaaga

SEQ ID NO: 803070 - DNA, 20 bp, Artificial
  CRISPR gRNA sequence
aatttcttaaaagaatattt

SEQ ID NO: 803071 - DNA, 20 bp, Artificial
  CRISPR gRNA sequence
atttcttaaaagaatatttc

SEQ ID NO: 803072 - DNA, 20 bp, Artificial
  CRISPR gRNA sequence
cttaaaagaatatttcctac

SEQ ID NO: 803073 - DNA, 20 bp, Artificial
  CRISPR gRNA sequence
ttaaaagaatatttcctacc

SEQ ID NO: 803074 - DNA, 20 bp, Artificial
  CRISPR gRNA sequence
aaaagaatatttcctaccga

SEQ ID NO: 803075 - DNA, 20 bp, Artificial
  CRISPR gRNA sequence
aaagaatatttcctaccgaa

SEQ ID NO: 803076 - DNA, 20 bp, Artificial
  CRISPR gRNA sequence
cctaccgaatggaagccagt

SEQ ID NO: 803077 - DNA, 20 bp, Artificial
  CRISPR gRNA sequence
ctaccgaatggaagccagtg

SEQ ID NO: 803078 - DNA, 20 bp, Artificial
  CRISPR gRNA sequence
ccgaatggaagccagtgctc

SEQ ID NO: 803079 - DNA, 20 bp, Artificial
  CRISPR gRNA sequence
atcccctcttcctctcacca

SEQ ID NO: 803080 - DNA, 20 bp, Artificial
  CRISPR gRNA sequence
ttcctctcaccaaatatcaa

SEQ ID NO: 803081 - DNA, 20 bp, Artificial
  CRISPR gRNA sequence
cctctcaccaaatatcaaca

SEQ ID NO: 803082 - DNA, 20 bp, Artificial
  CRISPR gRNA sequence
ctctcaccaaatatcaacag

SEQ ID NO: 803083 - DNA, 20 bp, Artificial
  CRISPR gRNA sequence
tcaccaaatatcaacaggtg

SEQ ID NO: 803084 - DNA, 20 bp, Artificial
  CRISPR gRNA sequence
accaaatatcaacaggtgac

SEQ ID NO: 803085 - DNA, 20 bp, Artificial
  CRISPR gRNA sequence
tccacactgcctggtaactg

SEQ ID NO: 803086 - DNA, 20 bp, Artificial
  CRISPR gRNA sequence
ccacactgcctggtaactgc

SEQ ID NO: 803087 - DNA, 20 bp, Artificial
  CRISPR gRNA sequence
cacactgcctggtaactgca

SEQ ID NO: 803088 - DNA, 20 bp, Artificial
  CRISPR gRNA sequence
cctggtaactgcatatggta

SEQ ID NO: 803089 - DNA, 20 bp, Artificial
  CRISPR gRNA sequence
gtaactgcatatggtattga

SEQ ID NO: 803090 - DNA, 20 bp, Artificial
  CRISPR gRNA sequence
catatggtattgatatttgt

SEQ ID NO: 803091 - DNA, 20 bp, Artificial
  CRISPR gRNA sequence
atatttgtttatttttagct

SEQ ID NO: 803092 - DNA, 20 bp, Artificial
  CRISPR gRNA sequence
gtttatttttagctattatc

SEQ ID NO: 803093 - DNA, 20 bp, Artificial
  CRISPR gRNA sequence
tttatttttagctattatct

SEQ ID NO: 803094 - DNA, 20 bp, Artificial
  CRISPR gRNA sequence
atttttagctattatctaag

SEQ ID NO: 803095 - DNA, 20 bp, Artificial
  CRISPR gRNA sequence
tttttagctattatctaaga

SEQ ID NO: 803096 - DNA, 20 bp, Artificial
  CRISPR gRNA sequence
ttagctattatctaagacca

SEQ ID NO: 803097 - DNA, 20 bp, Artificial
  CRISPR gRNA sequence
tagctattatctaagaccac

SEQ ID NO: 803098 - DNA, 20 bp, Artificial
  CRISPR gRNA sequence
agctattatctaagaccact

SEQ ID NO: 803099 - DNA, 20 bp, Artificial
  CRISPR gRNA sequence
gctattatctaagaccactg

SEQ ID NO: 803100 - DNA, 20 bp, Artificial
  CRISPR gRNA sequence
ttatctaagaccactggaag

SEQ ID NO: 803101 - DNA, 20 bp, Artificial
  CRISPR gRNA sequence
tctaagaccactggaaggtt

SEQ ID NO: 803102 - DNA, 20 bp, Artificial
  CRISPR gRNA sequence
agaccactggaaggtttgtt

SEQ ID NO: 803103 - DNA, 20 bp, Artificial
  CRISPR gRNA sequence
gaaggtttgttcttgtgtct

SEQ ID NO: 803104 - DNA, 20 bp, Artificial
  CRISPR gRNA sequence
gttcttgtgtcttctagtct

SEQ ID NO: 803105 - DNA, 20 bp, Artificial
  CRISPR gRNA sequence
ttcttgtgtcttctagtctc

SEQ ID NO: 803106 - DNA, 20 bp, Artificial
  CRISPR gRNA sequence
ttgtgtcttctagtctcttg

SEQ ID NO: 803107 - DNA, 20 bp, Artificial
  CRISPR gRNA sequence
gtgtcttctagtctcttgga

SEQ ID NO: 803108 - DNA, 20 bp, Artificial
  CRISPR gRNA sequence
tgtcttctagtctcttggaa

SEQ ID NO: 803109 - DNA, 20 bp, Artificial
  CRISPR gRNA sequence
ctagtctcttggaatatcat

SEQ ID NO: 803110 - DNA, 20 bp, Artificial
  CRISPR gRNA sequence
tagtctcttggaatatcatg

SEQ ID NO: 803111 - DNA, 20 bp, Artificial
  CRISPR gRNA sequence
gtctcttggaatatcatgcc

SEQ ID NO: 803112 - DNA, 20 bp, Artificial
  CRISPR gRNA sequence
ttggaatatcatgcctattt

SEQ ID NO: 803113 - DNA, 20 bp, Artificial
  CRISPR gRNA sequence
ggaatatcatgcctatttta

SEQ ID NO: 803114 - DNA, 20 bp, Artificial
  CRISPR gRNA sequence
gaatatcatgcctattttac

SEQ ID NO: 803115 - DNA, 20 bp, Artificial
  CRISPR gRNA sequence
ttttacttatttttaaagtt

SEQ ID NO: 803116 - DNA, 20 bp, Artificial
  CRISPR gRNA sequence
tacttatttttaaagttttt

SEQ ID NO: 803117 - DNA, 20 bp, Artificial
  CRISPR gRNA sequence
acttatttttaaagttttta

SEQ ID NO: 803118 - DNA, 20 bp, Artificial
  CRISPR gRNA sequence
cttatttttaaagtttttat

SEQ ID NO: 803119 - DNA, 20 bp, Artificial
  CRISPR gRNA sequence
atttttaaagtttttataag

SEQ ID NO: 803120 - DNA, 20 bp, Artificial
  CRISPR gRNA sequence
tttttaaagtttttataagg

SEQ ID NO: 803121 - DNA, 20 bp, Artificial
  CRISPR gRNA sequence
ttaaagtttttataaggttg

SEQ ID NO: 803122 - DNA, 20 bp, Artificial
  CRISPR gRNA sequence
taaagtttttataaggttgt

SEQ ID NO: 803123 - DNA, 20 bp, Artificial
  CRISPR gRNA sequence
aaagtttttataaggttgta

SEQ ID NO: 803124 - DNA, 20 bp, Artificial
  CRISPR gRNA sequence
aagtttttataaggttgtaa

SEQ ID NO: 803125 - DNA, 20 bp, Artificial
  CRISPR gRNA sequence
ttataaggttgtaatgtttt

SEQ ID NO: 803126 - DNA, 20 bp, Artificial
  CRISPR gRNA sequence
tataaggttgtaatgtttta

SEQ ID NO: 803127 - DNA, 20 bp, Artificial
  CRISPR gRNA sequence
ataaggttgtaatgttttat

SEQ ID NO: 803128 - DNA, 20 bp, Artificial
  CRISPR gRNA sequence
taaggttgtaatgttttatt

SEQ ID NO: 803129 - DNA, 20 bp, Artificial
  CRISPR gRNA sequence
taatgttttattttaatttt

SEQ ID NO: 803130 - DNA, 20 bp, Artificial
  CRISPR gRNA sequence
tattttaattttaaaattta

SEQ ID NO: 803131 - DNA, 20 bp, Artificial
  CRISPR gRNA sequence
attttaattttaaaatttat

SEQ ID NO: 803132 - DNA, 20 bp, Artificial
  CRISPR gRNA sequence
ttttaattttaaaatttatt

SEQ ID NO: 803133 - DNA, 20 bp, Artificial
  CRISPR gRNA sequence
taattttaaaatttattttt

SEQ ID NO: 803134 - DNA, 20 bp, Artificial
  CRISPR gRNA sequence
aattttaaaatttattttta

SEQ ID NO: 803135 - DNA, 20 bp, Artificial
  CRISPR gRNA sequence
attttaaaatttatttttaa

SEQ ID NO: 803136 - DNA, 20 bp, Artificial
  CRISPR gRNA sequence
taaaatttatttttaactgg

SEQ ID NO: 803137 - DNA, 20 bp, Artificial
  CRISPR gRNA sequence
aaaatttatttttaactggc

SEQ ID NO: 803138 - DNA, 20 bp, Artificial
  CRISPR gRNA sequence
aaatttatttttaactggca

SEQ ID NO: 803139 - DNA, 20 bp, Artificial
  CRISPR gRNA sequence
atttttaactggcaataatg

SEQ ID NO: 803140 - DNA, 20 bp, Artificial
  CRISPR gRNA sequence
tttttaactggcaataatgt

SEQ ID NO: 803141 - DNA, 20 bp, Artificial
  CRISPR gRNA sequence
ttaactggcaataatgtata

SEQ ID NO: 803142 - DNA, 20 bp, Artificial
  CRISPR gRNA sequence
taactggcaataatgtatat

SEQ ID NO: 803143 - DNA, 20 bp, Artificial
  CRISPR gRNA sequence
aactggcaataatgtatatt

SEQ ID NO: 803144 - DNA, 20 bp, Artificial
  CRISPR gRNA sequence
actggcaataatgtatattt

SEQ ID NO: 803145 - DNA, 20 bp, Artificial
  CRISPR gRNA sequence
gcaataatgtatatttatgg

SEQ ID NO: 803146 - DNA, 20 bp, Artificial
  CRISPR gRNA sequence
atggggtacaatatgatgtt

SEQ ID NO: 803147 - DNA, 20 bp, Artificial
  CRISPR gRNA sequence
tggggtacaatatgatgttt

SEQ ID NO: 803148 - DNA, 20 bp, Artificial
  CRISPR gRNA sequence
tgatctatgtatagattata

SEQ ID NO: 803149 - DNA, 20 bp, Artificial
  CRISPR gRNA sequence
gatctatgtatagattatag

SEQ ID NO: 803150 - DNA, 20 bp, Artificial
  CRISPR gRNA sequence
atctatgtatagattataga

SEQ ID NO: 803151 - DNA, 20 bp, Artificial
  CRISPR gRNA sequence
tgtatagattatagaaagag

SEQ ID NO: 803152 - DNA, 20 bp, Artificial
  CRISPR gRNA sequence
tagaaagagtcaatcaagcc

SEQ ID NO: 803153 - DNA, 20 bp, Artificial
  CRISPR gRNA sequence
atgcctgtaatcccagcact

SEQ ID NO: 803154 - DNA, 20 bp, Artificial
  CRISPR gRNA sequence
taatcccagcactttgggag

SEQ ID NO: 803155 - DNA, 20 bp, Artificial
  CRISPR gRNA sequence
tgggaggccaaggcaggtgg

SEQ ID NO: 803156 - DNA, 20 bp, Artificial
  CRISPR gRNA sequence
gggaggccaaggcaggtgga

SEQ ID NO: 803157 - DNA, 20 bp, Artificial
  CRISPR gRNA sequence
ggaggccaaggcaggtggat

SEQ ID NO: 803158 - DNA, 20 bp, Artificial
  CRISPR gRNA sequence
aggtcaggagttcaaaacca

SEQ ID NO: 803159 - DNA, 20 bp, Artificial
  CRISPR gRNA sequence
aaaaccaggctgaccaacat

SEQ ID NO: 803160 - DNA, 20 bp, Artificial
  CRISPR gRNA sequence
accaacatggtgaaacccca

SEQ ID NO: 803161 - DNA, 20 bp, Artificial
  CRISPR gRNA sequence
tactgaaaatagaaaaaatt

SEQ ID NO: 803162 - DNA, 20 bp, Artificial
  CRISPR gRNA sequence
ctgaaaatagaaaaaattag

SEQ ID NO: 803163 - DNA, 20 bp, Artificial
  CRISPR gRNA sequence
aaaatagaaaaaattagcca

SEQ ID NO: 803164 - DNA, 20 bp, Artificial
  CRISPR gRNA sequence
gccaggcatggtggcaggtg

SEQ ID NO: 803165 - DNA, 20 bp, Artificial
  CRISPR gRNA sequence
caatcccagctactcaggaa

SEQ ID NO: 803166 - DNA, 20 bp, Artificial
  CRISPR gRNA sequence
ctcaggaagctgaggcagga

SEQ ID NO: 803167 - DNA, 20 bp, Artificial
  CRISPR gRNA sequence
aggaagctgaggcaggagaa

SEQ ID NO: 803168 - DNA, 20 bp, Artificial
  CRISPR gRNA sequence
aggcaggagaattgcttgaa

SEQ ID NO: 803169 - DNA, 20 bp, Artificial
  CRISPR gRNA sequence
cttgaacctgggaggtggag

SEQ ID NO: 803170 - DNA, 20 bp, Artificial
  CRISPR gRNA sequence
gaacctgggaggtggaggtt

SEQ ID NO: 803171 - DNA, 20 bp, Artificial
  CRISPR gRNA sequence
aacctgggaggtggaggttg

SEQ ID NO: 803172 - DNA, 20 bp, Artificial
  CRISPR gRNA sequence
ggaggtggaggttgcagtga

SEQ ID NO: 803173 - DNA, 20 bp, Artificial
  CRISPR gRNA sequence
cagtgagccgagatcacgct

SEQ ID NO: 803174 - DNA, 20 bp, Artificial
  CRISPR gRNA sequence
ttgcactccagcctgggtga

SEQ ID NO: 803175 - DNA, 20 bp, Artificial
  CRISPR gRNA sequence
cactccagcctgggtgacga

SEQ ID NO: 803176 - DNA, 20 bp, Artificial
  CRISPR gRNA sequence
cagcctgggtgacgagcgaa

SEQ ID NO: 803177 - DNA, 20 bp, Artificial
  CRISPR gRNA sequence
ggtgacgagcgaaactctgt

SEQ ID NO: 803178 - DNA, 20 bp, Artificial
  CRISPR gRNA sequence
tgtctcaaaaaaaaaaaaaa

SEQ ID NO: 803179 - DNA, 20 bp, Artificial
  CRISPR gRNA sequence
tctcaaaaaaaaaaaaaaaa

SEQ ID NO: 803180 - DNA, 20 bp, Artificial
  CRISPR gRNA sequence
aaaaaaaaaaaaaaaaaaaa

SEQ ID NO: 803181 - DNA, 20 bp, Artificial
  CRISPR gRNA sequence
gttaacatatcacatcacca

SEQ ID NO: 803182 - DNA, 20 bp, Artificial
  CRISPR gRNA sequence
acatatcacatcaccaagtt

SEQ ID NO: 803183 - DNA, 20 bp, Artificial
  CRISPR gRNA sequence
tttttttgtggtctttattt

SEQ ID NO: 803184 - DNA, 20 bp, Artificial
  CRISPR gRNA sequence
ttttgtggtctttatttttt

SEQ ID NO: 803185 - DNA, 20 bp, Artificial
  CRISPR gRNA sequence
tttgtggtctttattttttt

SEQ ID NO: 803186 - DNA, 20 bp, Artificial
  CRISPR gRNA sequence
ttgtggtctttatttttttc

SEQ ID NO: 803187 - DNA, 20 bp, Artificial
  CRISPR gRNA sequence
tgtggtctttatttttttct

SEQ ID NO: 803188 - DNA, 20 bp, Artificial
  CRISPR gRNA sequence
gtggtctttatttttttctc

SEQ ID NO: 803189 - DNA, 20 bp, Artificial
  CRISPR gRNA sequence
tggtctttatttttttctct

SEQ ID NO: 803190 - DNA, 20 bp, Artificial
  CRISPR gRNA sequence
tatttttttctcttcttaat

SEQ ID NO: 803191 - DNA, 20 bp, Artificial
  CRISPR gRNA sequence
atttttttctcttcttaatc

SEQ ID NO: 803192 - DNA, 20 bp, Artificial
  CRISPR gRNA sequence
tttttttctcttcttaatct

SEQ ID NO: 803193 - DNA, 20 bp, Artificial
  CRISPR gRNA sequence
ttttctcttcttaatctcaa

SEQ ID NO: 803194 - DNA, 20 bp, Artificial
  CRISPR gRNA sequence
tttctcttcttaatctcaaa

SEQ ID NO: 803195 - DNA, 20 bp, Artificial
  CRISPR gRNA sequence
ttctcttcttaatctcaaaa

SEQ ID NO: 803196 - DNA, 20 bp, Artificial
  CRISPR gRNA sequence
tctcttcttaatctcaaaac

SEQ ID NO: 803197 - DNA, 20 bp, Artificial
  CRISPR gRNA sequence
ctcttcttaatctcaaaaca

SEQ ID NO: 803198 - DNA, 20 bp, Artificial
  CRISPR gRNA sequence
tcttcttaatctcaaaacag

SEQ ID NO: 803199 - DNA, 20 bp, Artificial
  CRISPR gRNA sequence
ttcttaatctcaaaacagag

SEQ ID NO: 803200 - DNA, 20 bp, Artificial
  CRISPR gRNA sequence
cttaatctcaaaacagagaa

SEQ ID NO: 803201 - DNA, 20 bp, Artificial
  CRISPR gRNA sequence
ttaatctcaaaacagagaat

SEQ ID NO: 803202 - DNA, 20 bp, Artificial
  CRISPR gRNA sequence
aatctcaaaacagagaatgt

SEQ ID NO: 803203 - DNA, 20 bp, Artificial
  CRISPR gRNA sequence
atctcaaaacagagaatgta

SEQ ID NO: 803204 - DNA, 20 bp, Artificial
  CRISPR gRNA sequence
aaaacagagaatgtaaaaaa

SEQ ID NO: 803205 - DNA, 20 bp, Artificial
  CRISPR gRNA sequence
atgcttttagcaaatttgaa

SEQ ID NO: 803206 - DNA, 20 bp, Artificial
  CRISPR gRNA sequence
ttagcaaatttgaatacaga

SEQ ID NO: 803207 - DNA, 20 bp, Artificial
  CRISPR gRNA sequence
tagcaaatttgaatacagaa

SEQ ID NO: 803208 - DNA, 20 bp, Artificial
  CRISPR gRNA sequence
agcaaatttgaatacagaat

SEQ ID NO: 803209 - DNA, 20 bp, Artificial
  CRISPR gRNA sequence
gcaaatttgaatacagaatg

SEQ ID NO: 803210 - DNA, 20 bp, Artificial
  CRISPR gRNA sequence
gaatacagaatgcattaact

SEQ ID NO: 803211 - DNA, 20 bp, Artificial
  CRISPR gRNA sequence
aatacagaatgcattaactg

SEQ ID NO: 803212 - DNA, 20 bp, Artificial
  CRISPR gRNA sequence
actgtggtcatcacacatgg

SEQ ID NO: 803213 - DNA, 20 bp, Artificial
  CRISPR gRNA sequence
tggtcatcacacatggcaat

SEQ ID NO: 803214 - DNA, 20 bp, Artificial
  CRISPR gRNA sequence
aaacatttcctctactctga

SEQ ID NO: 803215 - DNA, 20 bp, Artificial
  CRISPR gRNA sequence
cctctactctgagactgagc

SEQ ID NO: 803216 - DNA, 20 bp, Artificial
  CRISPR gRNA sequence
ctctactctgagactgagca

SEQ ID NO: 803217 - DNA, 20 bp, Artificial
  CRISPR gRNA sequence
tactctgagactgagcaaca

SEQ ID NO: 803218 - DNA, 20 bp, Artificial
  CRISPR gRNA sequence
ctctgagactgagcaacatc

SEQ ID NO: 803219 - DNA, 20 bp, Artificial
  CRISPR gRNA sequence
tgagactgagcaacatcttc

SEQ ID NO: 803220 - DNA, 20 bp, Artificial
  CRISPR gRNA sequence
agactgagcaacatcttcca

SEQ ID NO: 803221 - DNA, 20 bp, Artificial
  CRISPR gRNA sequence
agcaacatcttccacatccc

SEQ ID NO: 803222 - DNA, 20 bp, Artificial
  CRISPR gRNA sequence
ccacatccccagcctctgat

SEQ ID NO: 803223 - DNA, 20 bp, Artificial
  CRISPR gRNA sequence
cacatccccagcctctgata

SEQ ID NO: 803224 - DNA, 20 bp, Artificial
  CRISPR gRNA sequence
tgataaccacctttctactc

SEQ ID NO: 803225 - DNA, 20 bp, Artificial
  CRISPR gRNA sequence
ataaccacctttctactctg

SEQ ID NO: 803226 - DNA, 20 bp, Artificial
  CRISPR gRNA sequence
tctactctgtttctatggga

SEQ ID NO: 803227 - DNA, 20 bp, Artificial
  CRISPR gRNA sequence
ctactctgtttctatgggat

SEQ ID NO: 803228 - DNA, 20 bp, Artificial
  CRISPR gRNA sequence
tactctgtttctatgggatc

SEQ ID NO: 803229 - DNA, 20 bp, Artificial
  CRISPR gRNA sequence
ctctgtttctatgggatcta

SEQ ID NO: 803230 - DNA, 20 bp, Artificial
  CRISPR gRNA sequence
tgtttctatgggatctactt

SEQ ID NO: 803231 - DNA, 20 bp, Artificial
  CRISPR gRNA sequence
tttctatgggatctactttt

SEQ ID NO: 803232 - DNA, 20 bp, Artificial
  CRISPR gRNA sequence
ctatgggatctactttttta

SEQ ID NO: 803233 - DNA, 20 bp, Artificial
  CRISPR gRNA sequence
tatgggatctacttttttag

SEQ ID NO: 803234 - DNA, 20 bp, Artificial
  CRISPR gRNA sequence
tgggatctacttttttagat

SEQ ID NO: 803235 - DNA, 20 bp, Artificial
  CRISPR gRNA sequence
cttttttagatttcacaaat

SEQ ID NO: 803236 - DNA, 20 bp, Artificial
  CRISPR gRNA sequence
ttttagatttcacaaataaa

SEQ ID NO: 803237 - DNA, 20 bp, Artificial
  CRISPR gRNA sequence
tttagatttcacaaataaat

SEQ ID NO: 803238 - DNA, 20 bp, Artificial
  CRISPR gRNA sequence
ttagatttcacaaataaatg

SEQ ID NO: 803239 - DNA, 20 bp, Artificial
  CRISPR gRNA sequence
tagatttcacaaataaatga

SEQ ID NO: 803240 - DNA, 20 bp, Artificial
  CRISPR gRNA sequence
agatttcacaaataaatgag

SEQ ID NO: 803241 - DNA, 20 bp, Artificial
  CRISPR gRNA sequence
gatttcacaaataaatgaga

SEQ ID NO: 803242 - DNA, 20 bp, Artificial
  CRISPR gRNA sequence
cacaaataaatgagatcata

SEQ ID NO: 803243 - DNA, 20 bp, Artificial
  CRISPR gRNA sequence
acaaataaatgagatcatac

SEQ ID NO: 803244 - DNA, 20 bp, Artificial
  CRISPR gRNA sequence
tctgtctttttgtgcctggc

SEQ ID NO: 803245 - DNA, 20 bp, Artificial
  CRISPR gRNA sequence
tctttttgtgcctggcttac

SEQ ID NO: 803246 - DNA, 20 bp, Artificial
  CRISPR gRNA sequence
tttgtgcctggcttacttaa

SEQ ID NO: 803247 - DNA, 20 bp, Artificial
  CRISPR gRNA sequence
ttgtgcctggcttacttaac

SEQ ID NO: 803248 - DNA, 20 bp, Artificial
  CRISPR gRNA sequence
tgtgcctggcttacttaact

SEQ ID NO: 803249 - DNA, 20 bp, Artificial
  CRISPR gRNA sequence
gtgcctggcttacttaactt

SEQ ID NO: 803250 - DNA, 20 bp, Artificial
  CRISPR gRNA sequence
tgcctggcttacttaactta

SEQ ID NO: 803251 - DNA, 20 bp, Artificial
  CRISPR gRNA sequence
gcttacttaacttagcataa

SEQ ID NO: 803252 - DNA, 20 bp, Artificial
  CRISPR gRNA sequence
acttaacttagcataatacc

SEQ ID NO: 803253 - DNA, 20 bp, Artificial
  CRISPR gRNA sequence
cttaacttagcataataccc

SEQ ID NO: 803254 - DNA, 20 bp, Artificial
  CRISPR gRNA sequence
aacttagcataatacccttc

SEQ ID NO: 803255 - DNA, 20 bp, Artificial
  CRISPR gRNA sequence
acttagcataatacccttca

SEQ ID NO: 803256 - DNA, 20 bp, Artificial
  CRISPR gRNA sequence
agcataatacccttcagttc

SEQ ID NO: 803257 - DNA, 20 bp, Artificial
  CRISPR gRNA sequence
gcataatacccttcagttcc

SEQ ID NO: 803258 - DNA, 20 bp, Artificial
  CRISPR gRNA sequence
cagttccatccatgttgtca

SEQ ID NO: 803259 - DNA, 20 bp, Artificial
  CRISPR gRNA sequence
agttccatccatgttgtcat

SEQ ID NO: 803260 - DNA, 20 bp, Artificial
  CRISPR gRNA sequence
catccatgttgtcatgaatg

SEQ ID NO: 803261 - DNA, 20 bp, Artificial
  CRISPR gRNA sequence
tcatgaatgacagattttac

SEQ ID NO: 803262 - DNA, 20 bp, Artificial
  CRISPR gRNA sequence
tacttctttctaagggctgt

SEQ ID NO: 803263 - DNA, 20 bp, Artificial
  CRISPR gRNA sequence
acttctttctaagggctgta

SEQ ID NO: 803264 - DNA, 20 bp, Artificial
  CRISPR gRNA sequence
cttctttctaagggctgtaa

SEQ ID NO: 803265 - DNA, 20 bp, Artificial
  CRISPR gRNA sequence
ctttctaagggctgtaagta

SEQ ID NO: 803266 - DNA, 20 bp, Artificial
  CRISPR gRNA sequence
tttctaagggctgtaagtat

SEQ ID NO: 803267 - DNA, 20 bp, Artificial
  CRISPR gRNA sequence
tctaagggctgtaagtattc

SEQ ID NO: 803268 - DNA, 20 bp, Artificial
  CRISPR gRNA sequence
ctaagggctgtaagtattcc

SEQ ID NO: 803269 - DNA, 20 bp, Artificial
  CRISPR gRNA sequence
taagggctgtaagtattcca

SEQ ID NO: 803270 - DNA, 20 bp, Artificial
  CRISPR gRNA sequence
agggctgtaagtattccatt

SEQ ID NO: 803271 - DNA, 20 bp, Artificial
  CRISPR gRNA sequence
taagtattccattgtgtata

SEQ ID NO: 803272 - DNA, 20 bp, Artificial
  CRISPR gRNA sequence
cattgtgtatatataccaca

SEQ ID NO: 803273 - DNA, 20 bp, Artificial
  CRISPR gRNA sequence
tgtatatataccacattttc

SEQ ID NO: 803274 - DNA, 20 bp, Artificial
  CRISPR gRNA sequence
tctttattcattctctgttg

SEQ ID NO: 803275 - DNA, 20 bp, Artificial
  CRISPR gRNA sequence
ctttattcattctctgttga

SEQ ID NO: 803276 - DNA, 20 bp, Artificial
  CRISPR gRNA sequence
tttattcattctctgttgat

SEQ ID NO: 803277 - DNA, 20 bp, Artificial
  CRISPR gRNA sequence
tattcattctctgttgatgg

SEQ ID NO: 803278 - DNA, 20 bp, Artificial
  CRISPR gRNA sequence
attcattctctgttgatgga

SEQ ID NO: 803279 - DNA, 20 bp, Artificial
  CRISPR gRNA sequence
ttcattctctgttgatggac

SEQ ID NO: 803280 - DNA, 20 bp, Artificial
  CRISPR gRNA sequence
attctctgttgatggacatt

SEQ ID NO: 803281 - DNA, 20 bp, Artificial
  CRISPR gRNA sequence
tctgttgatggacatttagt

SEQ ID NO: 803282 - DNA, 20 bp, Artificial
  CRISPR gRNA sequence
tgttgatggacatttagttt

SEQ ID NO: 803283 - DNA, 20 bp, Artificial
  CRISPR gRNA sequence
ttgatggacatttagtttgg

SEQ ID NO: 803284 - DNA, 20 bp, Artificial
  CRISPR gRNA sequence
atggacatttagtttggttc

SEQ ID NO: 803285 - DNA, 20 bp, Artificial
  CRISPR gRNA sequence
agtttggttccacatcttgg

SEQ ID NO: 803286 - DNA, 20 bp, Artificial
  CRISPR gRNA sequence
gtttggttccacatcttggt

SEQ ID NO: 803287 - DNA, 20 bp, Artificial
  CRISPR gRNA sequence
ggttccacatcttggttatt

SEQ ID NO: 803288 - DNA, 20 bp, Artificial
  CRISPR gRNA sequence
gttccacatcttggttattg

SEQ ID NO: 803289 - DNA, 20 bp, Artificial
  CRISPR gRNA sequence
cacatcttggttattgtgaa

SEQ ID NO: 803290 - DNA, 20 bp, Artificial
  CRISPR gRNA sequence
ggttattgtgaatcatgctg

SEQ ID NO: 803291 - DNA, 20 bp, Artificial
  CRISPR gRNA sequence
gttattgtgaatcatgctga

SEQ ID NO: 803292 - DNA, 20 bp, Artificial
  CRISPR gRNA sequence
ttgtgaatcatgctgaaatg

SEQ ID NO: 803293 - DNA, 20 bp, Artificial
  CRISPR gRNA sequence
tgaatcatgctgaaatgaat

SEQ ID NO: 803294 - DNA, 20 bp, Artificial
  CRISPR gRNA sequence
aaatgaataaaggaatacag

SEQ ID NO: 803295 - DNA, 20 bp, Artificial
  CRISPR gRNA sequence
ttcaacatactaaattcaat

SEQ ID NO: 803296 - DNA, 20 bp, Artificial
  CRISPR gRNA sequence
caacatactaaattcaattc

SEQ ID NO: 803297 - DNA, 20 bp, Artificial
  CRISPR gRNA sequence
aacatactaaattcaattcc

SEQ ID NO: 803298 - DNA, 20 bp, Artificial
  CRISPR gRNA sequence
aattcaattcctttggatat

SEQ ID NO: 803299 - DNA, 20 bp, Artificial
  CRISPR gRNA sequence
aattcctttggatatatacc

SEQ ID NO: 803300 - DNA, 20 bp, Artificial
  CRISPR gRNA sequence
ctttggatatatacccagaa

SEQ ID NO: 803301 - DNA, 20 bp, Artificial
  CRISPR gRNA sequence
tggatatatacccagaagta

SEQ ID NO: 803302 - DNA, 20 bp, Artificial
  CRISPR gRNA sequence
ggatatatacccagaagtag

SEQ ID NO: 803303 - DNA, 20 bp, Artificial
  CRISPR gRNA sequence
gatatatacccagaagtagg

SEQ ID NO: 803304 - DNA, 20 bp, Artificial
  CRISPR gRNA sequence
ctggatcatgtggtcattct

SEQ ID NO: 803305 - DNA, 20 bp, Artificial
  CRISPR gRNA sequence
gatcatgtggtcattctatt

SEQ ID NO: 803306 - DNA, 20 bp, Artificial
  CRISPR gRNA sequence
tatttttagttttttgagga

SEQ ID NO: 803307 - DNA, 20 bp, Artificial
  CRISPR gRNA sequence
tttttagttttttgaggacc

SEQ ID NO: 803308 - DNA, 20 bp, Artificial
  CRISPR gRNA sequence
ttagttttttgaggacctct

SEQ ID NO: 803309 - DNA, 20 bp, Artificial
  CRISPR gRNA sequence
tagttttttgaggacctcta

SEQ ID NO: 803310 - DNA, 20 bp, Artificial
  CRISPR gRNA sequence
agttttttgaggacctctat

SEQ ID NO: 803311 - DNA, 20 bp, Artificial
  CRISPR gRNA sequence
gttttttgaggacctctata

SEQ ID NO: 803312 - DNA, 20 bp, Artificial
  CRISPR gRNA sequence
tttgaggacctctatactat

SEQ ID NO: 803313 - DNA, 20 bp, Artificial
  CRISPR gRNA sequence
ttgaggacctctatactatt

SEQ ID NO: 803314 - DNA, 20 bp, Artificial
  CRISPR gRNA sequence
tgaggacctctatactattt

SEQ ID NO: 803315 - DNA, 20 bp, Artificial
  CRISPR gRNA sequence
gaggacctctatactatttt

SEQ ID NO: 803316 - DNA, 20 bp, Artificial
  CRISPR gRNA sequence
aggacctctatactattttc

SEQ ID NO: 803317 - DNA, 20 bp, Artificial
  CRISPR gRNA sequence
tatactattttccaaaatga

SEQ ID NO: 803318 - DNA, 20 bp, Artificial
  CRISPR gRNA sequence
tactattttccaaaatgact

SEQ ID NO: 803319 - DNA, 20 bp, Artificial
  CRISPR gRNA sequence
ttttccaaaatgactatact

SEQ ID NO: 803320 - DNA, 20 bp, Artificial
  CRISPR gRNA sequence
tccaaaatgactatacttag

SEQ ID NO: 803321 - DNA, 20 bp, Artificial
  CRISPR gRNA sequence
ccaaaatgactatacttaga

SEQ ID NO: 803322 - DNA, 20 bp, Artificial
  CRISPR gRNA sequence
caaaatgactatacttagat

SEQ ID NO: 803323 - DNA, 20 bp, Artificial
  CRISPR gRNA sequence
tacttagatctcagctttct

SEQ ID NO: 803324 - DNA, 20 bp, Artificial
  CRISPR gRNA sequence
agatctcagctttcttgagg

SEQ ID NO: 803325 - DNA, 20 bp, Artificial
  CRISPR gRNA sequence
gatctcagctttcttgaggc

SEQ ID NO: 803326 - DNA, 20 bp, Artificial
  CRISPR gRNA sequence
agctttcttgaggcagggag

SEQ ID NO: 803327 - DNA, 20 bp, Artificial
  CRISPR gRNA sequence
tcttgaggcagggagccata

SEQ ID NO: 803328 - DNA, 20 bp, Artificial
  CRISPR gRNA sequence
cttgaggcagggagccatat

SEQ ID NO: 803329 - DNA, 20 bp, Artificial
  CRISPR gRNA sequence
ttgaggcagggagccatatc

SEQ ID NO: 803330 - DNA, 20 bp, Artificial
  CRISPR gRNA sequence
gaggcagggagccatatctg

SEQ ID NO: 803331 - DNA, 20 bp, Artificial
  CRISPR gRNA sequence
aggcagggagccatatctgt

SEQ ID NO: 803332 - DNA, 20 bp, Artificial
  CRISPR gRNA sequence
tttaattcactcagcatata

SEQ ID NO: 803333 - DNA, 20 bp, Artificial
  CRISPR gRNA sequence
aattcactcagcatatactg

SEQ ID NO: 803334 - DNA, 20 bp, Artificial
  CRISPR gRNA sequence
attcactcagcatatactgc

SEQ ID NO: 803335 - DNA, 20 bp, Artificial
  CRISPR gRNA sequence
actcagcatatactgcaaag

SEQ ID NO: 803336 - DNA, 20 bp, Artificial
  CRISPR gRNA sequence
agcatatactgcaaagaagc

SEQ ID NO: 803337 - DNA, 20 bp, Artificial
  CRISPR gRNA sequence
caaagaagcaggtgtgtgta

SEQ ID NO: 803338 - DNA, 20 bp, Artificial
  CRISPR gRNA sequence
tgtgtgtttgtgtgtatgta

SEQ ID NO: 803339 - DNA, 20 bp, Artificial
  CRISPR gRNA sequence
gtgtgtatgtatctgcatgt

SEQ ID NO: 803340 - DNA, 20 bp, Artificial
  CRISPR gRNA sequence
tgtgtatgtatctgcatgtg

SEQ ID NO: 803341 - DNA, 20 bp, Artificial
  CRISPR gRNA sequence
catgtgttagggagaagtgc

SEQ ID NO: 803342 - DNA, 20 bp, Artificial
  CRISPR gRNA sequence
gggagaagtgcagaataaat

SEQ ID NO: 803343 - DNA, 20 bp, Artificial
  CRISPR gRNA sequence
tttactatgtatagacatta

SEQ ID NO: 803344 - DNA, 20 bp, Artificial
  CRISPR gRNA sequence
tactatgtatagacattatc

SEQ ID NO: 803345 - DNA, 20 bp, Artificial
  CRISPR gRNA sequence
actatgtatagacattatct

SEQ ID NO: 803346 - DNA, 20 bp, Artificial
  CRISPR gRNA sequence
ctatgtatagacattatcta

SEQ ID NO: 803347 - DNA, 20 bp, Artificial
  CRISPR gRNA sequence
tgtatagacattatctaggt

SEQ ID NO: 803348 - DNA, 20 bp, Artificial
  CRISPR gRNA sequence
tctaggtctttatttttttt

SEQ ID NO: 803349 - DNA, 20 bp, Artificial
  CRISPR gRNA sequence
ggtctttattttttttctct

SEQ ID NO: 803350 - DNA, 20 bp, Artificial
  CRISPR gRNA sequence
tattttttttctcttcttaa

SEQ ID NO: 803351 - DNA, 20 bp, Artificial
  CRISPR gRNA sequence
attttttttctcttcttaat

SEQ ID NO: 803352 - DNA, 20 bp, Artificial
  CRISPR gRNA sequence
ttttttttctcttcttaatc

SEQ ID NO: 803353 - DNA, 20 bp, Artificial
  CRISPR gRNA sequence
tttttctcttcttaatctca

SEQ ID NO: 803354 - DNA, 20 bp, Artificial
  CRISPR gRNA sequence
ttttctcttcttaatctcaa

SEQ ID NO: 803355 - DNA, 20 bp, Artificial
  CRISPR gRNA sequence
tttctcttcttaatctcaaa

SEQ ID NO: 803356 - DNA, 20 bp, Artificial
  CRISPR gRNA sequence
ttctcttcttaatctcaaag

SEQ ID NO: 803357 - DNA, 20 bp, Artificial
  CRISPR gRNA sequence
tctcttcttaatctcaaaga

SEQ ID NO: 803358 - DNA, 20 bp, Artificial
  CRISPR gRNA sequence
ctcttcttaatctcaaagaa

SEQ ID NO: 803359 - DNA, 20 bp, Artificial
  CRISPR gRNA sequence
tcttcttaatctcaaagaaa

SEQ ID NO: 803360 - DNA, 20 bp, Artificial
  CRISPR gRNA sequence
ttcttaatctcaaagaaaac

SEQ ID NO: 803361 - DNA, 20 bp, Artificial
  CRISPR gRNA sequence
cttaatctcaaagaaaacag

SEQ ID NO: 803362 - DNA, 20 bp, Artificial
  CRISPR gRNA sequence
ttaatctcaaagaaaacaga

SEQ ID NO: 803363 - DNA, 20 bp, Artificial
  CRISPR gRNA sequence
aatctcaaagaaaacagagg

SEQ ID NO: 803364 - DNA, 20 bp, Artificial
  CRISPR gRNA sequence
atctcaaagaaaacagagga

SEQ ID NO: 803365 - DNA, 20 bp, Artificial
  CRISPR gRNA sequence
aaagaaaacagaggaaagga

SEQ ID NO: 803366 - DNA, 20 bp, Artificial
  CRISPR gRNA sequence
ttgcctgaagatgtttggaa

SEQ ID NO: 803367 - DNA, 20 bp, Artificial
  CRISPR gRNA sequence
tgcctgaagatgtttggaaa

SEQ ID NO: 803368 - DNA, 20 bp, Artificial
  CRISPR gRNA sequence
gcctgaagatgtttggaaaa

SEQ ID NO: 803369 - DNA, 20 bp, Artificial
  CRISPR gRNA sequence
cctgaagatgtttggaaaaa

SEQ ID NO: 803370 - DNA, 20 bp, Artificial
  CRISPR gRNA sequence
aagatgtttggaaaaaatac

SEQ ID NO: 803371 - DNA, 20 bp, Artificial
  CRISPR gRNA sequence
ggaaaaaataccaaataaag

SEQ ID NO: 803372 - DNA, 20 bp, Artificial
  CRISPR gRNA sequence
gaaaaaataccaaataaagt

SEQ ID NO: 803373 - DNA, 20 bp, Artificial
  CRISPR gRNA sequence
gtgatttttatttttccgtc

SEQ ID NO: 803374 - DNA, 20 bp, Artificial
  CRISPR gRNA sequence
ttatttttccgtcctctttc

SEQ ID NO: 803375 - DNA, 20 bp, Artificial
  CRISPR gRNA sequence
tatttttccgtcctctttct

SEQ ID NO: 803376 - DNA, 20 bp, Artificial
  CRISPR gRNA sequence
atttttccgtcctctttctg

SEQ ID NO: 803377 - DNA, 20 bp, Artificial
  CRISPR gRNA sequence
tttttccgtcctctttctgg

SEQ ID NO: 803378 - DNA, 20 bp, Artificial
  CRISPR gRNA sequence
ttccgtcctctttctggcct

SEQ ID NO: 803379 - DNA, 20 bp, Artificial
  CRISPR gRNA sequence
tccgtcctctttctggcctc

SEQ ID NO: 803380 - DNA, 20 bp, Artificial
  CRISPR gRNA sequence
ccgtcctctttctggcctcc

SEQ ID NO: 803381 - DNA, 20 bp, Artificial
  CRISPR gRNA sequence
cgtcctctttctggcctcca

SEQ ID NO: 803382 - DNA, 20 bp, Artificial
  CRISPR gRNA sequence
tttctggcctccaattgtga

SEQ ID NO: 803383 - DNA, 20 bp, Artificial
  CRISPR gRNA sequence
tctggcctccaattgtgaaa

SEQ ID NO: 803384 - DNA, 20 bp, Artificial
  CRISPR gRNA sequence
ctggcctccaattgtgaaat

SEQ ID NO: 803385 - DNA, 20 bp, Artificial
  CRISPR gRNA sequence
tggcctccaattgtgaaata

SEQ ID NO: 803386 - DNA, 20 bp, Artificial
  CRISPR gRNA sequence
gcctccaattgtgaaataat

SEQ ID NO: 803387 - DNA, 20 bp, Artificial
  CRISPR gRNA sequence
caattgtgaaataatttata

SEQ ID NO: 803388 - DNA, 20 bp, Artificial
  CRISPR gRNA sequence
tgaaataatttatagcactg

SEQ ID NO: 803389 - DNA, 20 bp, Artificial
  CRISPR gRNA sequence
atagcactgtaagaaagaag

SEQ ID NO: 803390 - DNA, 20 bp, Artificial
  CRISPR gRNA sequence
tagcactgtaagaaagaagc

SEQ ID NO: 803391 - DNA, 20 bp, Artificial
  CRISPR gRNA sequence
taagaaagaagccacaaatt

SEQ ID NO: 803392 - DNA, 20 bp, Artificial
  CRISPR gRNA sequence
tggtagcttggaccactgtt

SEQ ID NO: 803393 - DNA, 20 bp, Artificial
  CRISPR gRNA sequence
ggaccactgttgaggtctgg

SEQ ID NO: 803394 - DNA, 20 bp, Artificial
  CRISPR gRNA sequence
gaccactgttgaggtctgga

SEQ ID NO: 803395 - DNA, 20 bp, Artificial
  CRISPR gRNA sequence
ttgaggtctggaatcagaat

SEQ ID NO: 803396 - DNA, 20 bp, Artificial
  CRISPR gRNA sequence
aggtctggaatcagaattcc

SEQ ID NO: 803397 - DNA, 20 bp, Artificial
  CRISPR gRNA sequence
gaatcagaattccaatgttc

SEQ ID NO: 803398 - DNA, 20 bp, Artificial
  CRISPR gRNA sequence
caatgttcaaatattggtcc

SEQ ID NO: 803399 - DNA, 20 bp, Artificial
  CRISPR gRNA sequence
aaatattggtcctaccagtt

SEQ ID NO: 803400 - DNA, 20 bp, Artificial
  CRISPR gRNA sequence
gtcctaccagttataagctc

SEQ ID NO: 803401 - DNA, 20 bp, Artificial
  CRISPR gRNA sequence
ccagttataagctctatgac

SEQ ID NO: 803402 - DNA, 20 bp, Artificial
  CRISPR gRNA sequence
taagctctatgactatgaac

SEQ ID NO: 803403 - DNA, 20 bp, Artificial
  CRISPR gRNA sequence
tatgactatgaacaaaacac

SEQ ID NO: 803404 - DNA, 20 bp, Artificial
  CRISPR gRNA sequence
tgactatgaacaaaacactc

SEQ ID NO: 803405 - DNA, 20 bp, Artificial
  CRISPR gRNA sequence
tgaacaaaacactcaacttc

SEQ ID NO: 803406 - DNA, 20 bp, Artificial
  CRISPR gRNA sequence
aacttctctatcttcagtaa

SEQ ID NO: 803407 - DNA, 20 bp, Artificial
  CRISPR gRNA sequence
ctctatcttcagtaaccgtc

SEQ ID NO: 803408 - DNA, 20 bp, Artificial
  CRISPR gRNA sequence
tctatcttcagtaaccgtcc

SEQ ID NO: 803409 - DNA, 20 bp, Artificial
  CRISPR gRNA sequence
tatcttcagtaaccgtccac

SEQ ID NO: 803410 - DNA, 20 bp, Artificial
  CRISPR gRNA sequence
tcttcagtaaccgtccacaa

SEQ ID NO: 803411 - DNA, 20 bp, Artificial
  CRISPR gRNA sequence
cagtaaccgtccacaagaat

SEQ ID NO: 803412 - DNA, 20 bp, Artificial
  CRISPR gRNA sequence
agtaaccgtccacaagaatt

SEQ ID NO: 803413 - DNA, 20 bp, Artificial
  CRISPR gRNA sequence
ggaatatcaacaatgccatc

SEQ ID NO: 803414 - DNA, 20 bp, Artificial
  CRISPR gRNA sequence
tattgcattgtaagaattaa

SEQ ID NO: 803415 - DNA, 20 bp, Artificial
  CRISPR gRNA sequence
attgcattgtaagaattaaa

SEQ ID NO: 803416 - DNA, 20 bp, Artificial
  CRISPR gRNA sequence
ttgcattgtaagaattaaat

SEQ ID NO: 803417 - DNA, 20 bp, Artificial
  CRISPR gRNA sequence
cattgtaagaattaaataat

SEQ ID NO: 803418 - DNA, 20 bp, Artificial
  CRISPR gRNA sequence
taagaattaaataattcaat

SEQ ID NO: 803419 - DNA, 20 bp, Artificial
  CRISPR gRNA sequence
aataattcaatatatgtgga

SEQ ID NO: 803420 - DNA, 20 bp, Artificial
  CRISPR gRNA sequence
aatatatgtggaaaatagca

SEQ ID NO: 803421 - DNA, 20 bp, Artificial
  CRISPR gRNA sequence
acaaatgataaccattatta

SEQ ID NO: 803422 - DNA, 20 bp, Artificial
  CRISPR gRNA sequence
caaatgataaccattattac

SEQ ID NO: 803423 - DNA, 20 bp, Artificial
  CRISPR gRNA sequence
ttacttaatattgatagtga

SEQ ID NO: 803424 - DNA, 20 bp, Artificial
  CRISPR gRNA sequence
cttaatattgatagtgataa

SEQ ID NO: 803425 - DNA, 20 bp, Artificial
  CRISPR gRNA sequence
aatattgatagtgataattt

SEQ ID NO: 803426 - DNA, 20 bp, Artificial
  CRISPR gRNA sequence
atattgatagtgataatttt

SEQ ID NO: 803427 - DNA, 20 bp, Artificial
  CRISPR gRNA sequence
atagtgataattttattcat

SEQ ID NO: 803428 - DNA, 20 bp, Artificial
  CRISPR gRNA sequence
tattcatttcacatggcatg

SEQ ID NO: 803429 - DNA, 20 bp, Artificial
  CRISPR gRNA sequence
attcatttcacatggcatga

SEQ ID NO: 803430 - DNA, 20 bp, Artificial
  CRISPR gRNA sequence
ttcatttcacatggcatgaa

SEQ ID NO: 803431 - DNA, 20 bp, Artificial
  CRISPR gRNA sequence
atttcacatggcatgaagta

SEQ ID NO: 803432 - DNA, 20 bp, Artificial
  CRISPR gRNA sequence
cacatggcatgaagtaccaa

SEQ ID NO: 803433 - DNA, 20 bp, Artificial
  CRISPR gRNA sequence
acatggcatgaagtaccaag

SEQ ID NO: 803434 - DNA, 20 bp, Artificial
  CRISPR gRNA sequence
tataggaatcagaaaataaa

SEQ ID NO: 803435 - DNA, 20 bp, Artificial
  CRISPR gRNA sequence
taggaatcagaaaataaagt

SEQ ID NO: 803436 - DNA, 20 bp, Artificial
  CRISPR gRNA sequence
atttctttttcttctctatt

SEQ ID NO: 803437 - DNA, 20 bp, Artificial
  CRISPR gRNA sequence
tttctttttcttctctattg

SEQ ID NO: 803438 - DNA, 20 bp, Artificial
  CRISPR gRNA sequence
ctttttcttctctattgtcc

SEQ ID NO: 803439 - DNA, 20 bp, Artificial
  CRISPR gRNA sequence
tttttcttctctattgtcca

SEQ ID NO: 803440 - DNA, 20 bp, Artificial
  CRISPR gRNA sequence
tttcttctctattgtccagc

SEQ ID NO: 803441 - DNA, 20 bp, Artificial
  CRISPR gRNA sequence
ttcttctctattgtccagct

SEQ ID NO: 803442 - DNA, 20 bp, Artificial
  CRISPR gRNA sequence
tcttctctattgtccagctt

SEQ ID NO: 803443 - DNA, 20 bp, Artificial
  CRISPR gRNA sequence
cttctctattgtccagcttc

SEQ ID NO: 803444 - DNA, 20 bp, Artificial
  CRISPR gRNA sequence
ttctctattgtccagcttcc

SEQ ID NO: 803445 - DNA, 20 bp, Artificial
  CRISPR gRNA sequence
ctctattgtccagcttccta

SEQ ID NO: 803446 - DNA, 20 bp, Artificial
  CRISPR gRNA sequence
tctattgtccagcttcctac

SEQ ID NO: 803447 - DNA, 20 bp, Artificial
  CRISPR gRNA sequence
tattgtccagcttcctacag

SEQ ID NO: 803448 - DNA, 20 bp, Artificial
  CRISPR gRNA sequence
ttgtccagcttcctacagga

SEQ ID NO: 803449 - DNA, 20 bp, Artificial
  CRISPR gRNA sequence
tccagcttcctacaggaaaa

SEQ ID NO: 803450 - DNA, 20 bp, Artificial
  CRISPR gRNA sequence
cctacaggaaaataaacact

SEQ ID NO: 803451 - DNA, 20 bp, Artificial
  CRISPR gRNA sequence
ctacaggaaaataaacactc

SEQ ID NO: 803452 - DNA, 20 bp, Artificial
  CRISPR gRNA sequence
caggaaaataaacactcaca

SEQ ID NO: 803453 - DNA, 20 bp, Artificial
  CRISPR gRNA sequence
acatcctaaaggttccagaa

SEQ ID NO: 803454 - DNA, 20 bp, Artificial
  CRISPR gRNA sequence
aaggttccagaaacagatga

SEQ ID NO: 803455 - DNA, 20 bp, Artificial
  CRISPR gRNA sequence
cagaaacagatgaggtagag

SEQ ID NO: 803456 - DNA, 20 bp, Artificial
  CRISPR gRNA sequence
acctgccaggctacaggtta

SEQ ID NO: 803457 - DNA, 20 bp, Artificial
  CRISPR gRNA sequence
ccaggctacaggttatcctc

SEQ ID NO: 803458 - DNA, 20 bp, Artificial
  CRISPR gRNA sequence
caggttatcctctggcagaa

SEQ ID NO: 803459 - DNA, 20 bp, Artificial
  CRISPR gRNA sequence
tcctctggcagaagtatcct

SEQ ID NO: 803460 - DNA, 20 bp, Artificial
  CRISPR gRNA sequence
tggcagaagtatcctggcca

SEQ ID NO: 803461 - DNA, 20 bp, Artificial
  CRISPR gRNA sequence
gcagaagtatcctggccaaa

SEQ ID NO: 803462 - DNA, 20 bp, Artificial
  CRISPR gRNA sequence
gccaaacgtcagcgttcctg

SEQ ID NO: 803463 - DNA, 20 bp, Artificial
  CRISPR gRNA sequence
ctgccaacaccagccactcc

SEQ ID NO: 803464 - DNA, 20 bp, Artificial
  CRISPR gRNA sequence
ccaacaccagccactccagg

SEQ ID NO: 803465 - DNA, 20 bp, Artificial
  CRISPR gRNA sequence
caggacccctgaaggcctct

SEQ ID NO: 803466 - DNA, 20 bp, Artificial
  CRISPR gRNA sequence
aaggcctctaccaggtcacc

SEQ ID NO: 803467 - DNA, 20 bp, Artificial
  CRISPR gRNA sequence
taccaggtcaccagtgttct

SEQ ID NO: 803468 - DNA, 20 bp, Artificial
  CRISPR gRNA sequence
ccaggtcaccagtgttctgc

SEQ ID NO: 803469 - DNA, 20 bp, Artificial
  CRISPR gRNA sequence
tgcgcctaaagccaccccct

SEQ ID NO: 803470 - DNA, 20 bp, Artificial
  CRISPR gRNA sequence
cgcctaaagccaccccctgg

SEQ ID NO: 803471 - DNA, 20 bp, Artificial
  CRISPR gRNA sequence
aagccaccccctggcagaaa

SEQ ID NO: 803472 - DNA, 20 bp, Artificial
  CRISPR gRNA sequence
gcagaaacttcagctgtgtg

SEQ ID NO: 803473 - DNA, 20 bp, Artificial
  CRISPR gRNA sequence
cagctgtgtgttctggaata

SEQ ID NO: 803474 - DNA, 20 bp, Artificial
  CRISPR gRNA sequence
agctgtgtgttctggaatac

SEQ ID NO: 803475 - DNA, 20 bp, Artificial
  CRISPR gRNA sequence
tgtgttctggaatactcacg

SEQ ID NO: 803476 - DNA, 20 bp, Artificial
  CRISPR gRNA sequence
tggaatactcacgtgaggga

SEQ ID NO: 803477 - DNA, 20 bp, Artificial
  CRISPR gRNA sequence
gaatactcacgtgagggaac

SEQ ID NO: 803478 - DNA, 20 bp, Artificial
  CRISPR gRNA sequence
acgtgagggaacttactttg

SEQ ID NO: 803479 - DNA, 20 bp, Artificial
  CRISPR gRNA sequence
actttggccagcattgacct

SEQ ID NO: 803480 - DNA, 20 bp, Artificial
  CRISPR gRNA sequence
ctttggccagcattgacctt

SEQ ID NO: 803481 - DNA, 20 bp, Artificial
  CRISPR gRNA sequence
tggccagcattgaccttcaa

SEQ ID NO: 803482 - DNA, 20 bp, Artificial
  CRISPR gRNA sequence
ggccagcattgaccttcaaa

SEQ ID NO: 803483 - DNA, 20 bp, Artificial
  CRISPR gRNA sequence
gccagcattgaccttcaaag

SEQ ID NO: 803484 - DNA, 20 bp, Artificial
  CRISPR gRNA sequence
accttcaaagtaagagctgc

SEQ ID NO: 803485 - DNA, 20 bp, Artificial
  CRISPR gRNA sequence
caaagtaagagctgccccca

SEQ ID NO: 803486 - DNA, 20 bp, Artificial
  CRISPR gRNA sequence
aaagtaagagctgcccccac

SEQ ID NO: 803487 - DNA, 20 bp, Artificial
  CRISPR gRNA sequence
cccccacttcctaggtctat

SEQ ID NO: 803488 - DNA, 20 bp, Artificial
  CRISPR gRNA sequence
cctaggtctatcagttaggg

SEQ ID NO: 803489 - DNA, 20 bp, Artificial
  CRISPR gRNA sequence
ctaggtctatcagttagggt

SEQ ID NO: 803490 - DNA, 20 bp, Artificial
  CRISPR gRNA sequence
ggtctatcagttagggttca

SEQ ID NO: 803491 - DNA, 20 bp, Artificial
  CRISPR gRNA sequence
tcagttagggttcagacaag

SEQ ID NO: 803492 - DNA, 20 bp, Artificial
  CRISPR gRNA sequence
gggttcagacaagaaacaga

SEQ ID NO: 803493 - DNA, 20 bp, Artificial
  CRISPR gRNA sequence
agacaagaaacagatggcat

SEQ ID NO: 803494 - DNA, 20 bp, Artificial
  CRISPR gRNA sequence
gagtgatttgaggagagtgt

SEQ ID NO: 803495 - DNA, 20 bp, Artificial
  CRISPR gRNA sequence
gaggagagtgtaataaaggg

SEQ ID NO: 803496 - DNA, 20 bp, Artificial
  CRISPR gRNA sequence
aggagagtgtaataaaggga

SEQ ID NO: 803497 - DNA, 20 bp, Artificial
  CRISPR gRNA sequence
tttacaaaggtgtgatcacc

SEQ ID NO: 803498 - DNA, 20 bp, Artificial
  CRISPR gRNA sequence
acaaaggtgtgatcaccatt

SEQ ID NO: 803499 - DNA, 20 bp, Artificial
  CRISPR gRNA sequence
caaaggtgtgatcaccattt

SEQ ID NO: 803500 - DNA, 20 bp, Artificial
  CRISPR gRNA sequence
ggagaaactacaaaggatag

SEQ ID NO: 803501 - DNA, 20 bp, Artificial
  CRISPR gRNA sequence
gagaaactacaaaggatagt

SEQ ID NO: 803502 - DNA, 20 bp, Artificial
  CRISPR gRNA sequence
caaaggatagtgcagaacac

SEQ ID NO: 803503 - DNA, 20 bp, Artificial
  CRISPR gRNA sequence
gggcttcaatgttgggaggg

SEQ ID NO: 803504 - DNA, 20 bp, Artificial
  CRISPR gRNA sequence
caatgttgggagggcaatta

SEQ ID NO: 803505 - DNA, 20 bp, Artificial
  CRISPR gRNA sequence
aatgttgggagggcaattac

SEQ ID NO: 803506 - DNA, 20 bp, Artificial
  CRISPR gRNA sequence
ggagggcaattaccactgtt

SEQ ID NO: 803507 - DNA, 20 bp, Artificial
  CRISPR gRNA sequence
ccactgttggagaagttact

SEQ ID NO: 803508 - DNA, 20 bp, Artificial
  CRISPR gRNA sequence
ttggagaagttactggaatc

SEQ ID NO: 803509 - DNA, 20 bp, Artificial
  CRISPR gRNA sequence
gagaagttactggaatcaga

SEQ ID NO: 803510 - DNA, 20 bp, Artificial
  CRISPR gRNA sequence
ctggaatcagaagggagctg

SEQ ID NO: 803511 - DNA, 20 bp, Artificial
  CRISPR gRNA sequence
gaatcagaagggagctgtag

SEQ ID NO: 803512 - DNA, 20 bp, Artificial
  CRISPR gRNA sequence
tagggaaagccccacttccc

SEQ ID NO: 803513 - DNA, 20 bp, Artificial
  CRISPR gRNA sequence
cccaggagctgtagccacag

SEQ ID NO: 803514 - DNA, 20 bp, Artificial
  CRISPR gRNA sequence
ccaggagctgtagccacaga

SEQ ID NO: 803515 - DNA, 20 bp, Artificial
  CRISPR gRNA sequence
tagccacagaatagggaagc

SEQ ID NO: 803516 - DNA, 20 bp, Artificial
  CRISPR gRNA sequence
ccacatgcagcgactccaaa

SEQ ID NO: 803517 - DNA, 20 bp, Artificial
  CRISPR gRNA sequence
caaagggtggaaactggatg

SEQ ID NO: 803518 - DNA, 20 bp, Artificial
  CRISPR gRNA sequence
gatgaatgaataccccaact

SEQ ID NO: 803519 - DNA, 20 bp, Artificial
  CRISPR gRNA sequence
attctcctcccaccctccaa

SEQ ID NO: 803520 - DNA, 20 bp, Artificial
  CRISPR gRNA sequence
tcctcccaccctccaatctc

SEQ ID NO: 803521 - DNA, 20 bp, Artificial
  CRISPR gRNA sequence
ctcccaccctccaatctcct

SEQ ID NO: 803522 - DNA, 20 bp, Artificial
  CRISPR gRNA sequence
ccaccctccaatctcctgct

SEQ ID NO: 803523 - DNA, 20 bp, Artificial
  CRISPR gRNA sequence
caatctcctgctagcacctc

SEQ ID NO: 803524 - DNA, 20 bp, Artificial
  CRISPR gRNA sequence
ctgctagcacctcccattgg

SEQ ID NO: 803525 - DNA, 20 bp, Artificial
  CRISPR gRNA sequence
ctagcacctcccattggctg

SEQ ID NO: 803526 - DNA, 20 bp, Artificial
  CRISPR gRNA sequence
gcacctcccattggctgaac

SEQ ID NO: 803527 - DNA, 20 bp, Artificial
  CRISPR gRNA sequence
ccattggctgaacccagcta

SEQ ID NO: 803528 - DNA, 20 bp, Artificial
  CRISPR gRNA sequence
gctgaacccagctagaagtc

SEQ ID NO: 803529 - DNA, 20 bp, Artificial
  CRISPR gRNA sequence
aacccagctagaagtcagag

SEQ ID NO: 803530 - DNA, 20 bp, Artificial
  CRISPR gRNA sequence
gaagtcagagaatacaaggg

SEQ ID NO: 803531 - DNA, 20 bp, Artificial
  CRISPR gRNA sequence
ttgtattccataaaagtcaa

SEQ ID NO: 803532 - DNA, 20 bp, Artificial
  CRISPR gRNA sequence
tattccataaaagtcaactt

SEQ ID NO: 803533 - DNA, 20 bp, Artificial
  CRISPR gRNA sequence
cataaaagtcaacttctcag

SEQ ID NO: 803534 - DNA, 20 bp, Artificial
  CRISPR gRNA sequence
ctcagggctcagagcaatat

SEQ ID NO: 803535 - DNA, 20 bp, Artificial
  CRISPR gRNA sequence
tcagggctcagagcaatatt

SEQ ID NO: 803536 - DNA, 20 bp, Artificial
  CRISPR gRNA sequence
agggctcagagcaatattga

SEQ ID NO: 803537 - DNA, 20 bp, Artificial
  CRISPR gRNA sequence
agagcaatattgacatgtac

SEQ ID NO: 803538 - DNA, 20 bp, Artificial
  CRISPR gRNA sequence
acatgtacagaatagatctg

SEQ ID NO: 803539 - DNA, 20 bp, Artificial
  CRISPR gRNA sequence
gagaggaaacagaaaatatc

SEQ ID NO: 803540 - DNA, 20 bp, Artificial
  CRISPR gRNA sequence
gtacaatagctaatcactgt

SEQ ID NO: 803541 - DNA, 20 bp, Artificial
  CRISPR gRNA sequence
atcactgtgattcatgcaca

SEQ ID NO: 803542 - DNA, 20 bp, Artificial
  CRISPR gRNA sequence
tgattcatgcacagtgtcat

SEQ ID NO: 803543 - DNA, 20 bp, Artificial
  CRISPR gRNA sequence
atgcacagtgtcatgagcca

SEQ ID NO: 803544 - DNA, 20 bp, Artificial
  CRISPR gRNA sequence
ctttgctgtacttgctgcca

SEQ ID NO: 803545 - DNA, 20 bp, Artificial
  CRISPR gRNA sequence
tgctgtacttgctgccagtc

SEQ ID NO: 803546 - DNA, 20 bp, Artificial
  CRISPR gRNA sequence
gctgtacttgctgccagtca

SEQ ID NO: 803547 - DNA, 20 bp, Artificial
  CRISPR gRNA sequence
ctgtacttgctgccagtcag

SEQ ID NO: 803548 - DNA, 20 bp, Artificial
  CRISPR gRNA sequence
tacttgctgccagtcagctg

SEQ ID NO: 803549 - DNA, 20 bp, Artificial
  CRISPR gRNA sequence
gctgccagtcagctggttat

SEQ ID NO: 803550 - DNA, 20 bp, Artificial
  CRISPR gRNA sequence
ctgccagtcagctggttatg

SEQ ID NO: 803551 - DNA, 20 bp, Artificial
  CRISPR gRNA sequence
ccagtcagctggttatgggt

SEQ ID NO: 803552 - DNA, 20 bp, Artificial
  CRISPR gRNA sequence
gttatgggtttttccaagaa

SEQ ID NO: 803553 - DNA, 20 bp, Artificial
  CRISPR gRNA sequence
tgggtttttccaagaaattt

SEQ ID NO: 803554 - DNA, 20 bp, Artificial
  CRISPR gRNA sequence
ttccaagaaatttggtctct

SEQ ID NO: 803555 - DNA, 20 bp, Artificial
  CRISPR gRNA sequence
tccaagaaatttggtctcta

SEQ ID NO: 803556 - DNA, 20 bp, Artificial
  CRISPR gRNA sequence
ccaagaaatttggtctctaa

SEQ ID NO: 803557 - DNA, 20 bp, Artificial
  CRISPR gRNA sequence
caagaaatttggtctctaac

SEQ ID NO: 803558 - DNA, 20 bp, Artificial
  CRISPR gRNA sequence
ggtctctaacaaaattcttc

SEQ ID NO: 803559 - DNA, 20 bp, Artificial
  CRISPR gRNA sequence
gtctctaacaaaattcttca

SEQ ID NO: 803560 - DNA, 20 bp, Artificial
  CRISPR gRNA sequence
taacaaaattcttcagagcc

SEQ ID NO: 803561 - DNA, 20 bp, Artificial
  CRISPR gRNA sequence
acaaaattcttcagagcctt

SEQ ID NO: 803562 - DNA, 20 bp, Artificial
  CRISPR gRNA sequence
ttcagagcctttactgacta

SEQ ID NO: 803563 - DNA, 20 bp, Artificial
  CRISPR gRNA sequence
cagagcctttactgactatg

SEQ ID NO: 803564 - DNA, 20 bp, Artificial
  CRISPR gRNA sequence
agagcctttactgactatgc

SEQ ID NO: 803565 - DNA, 20 bp, Artificial
  CRISPR gRNA sequence
tactgactatgctggatatt

SEQ ID NO: 803566 - DNA, 20 bp, Artificial
  CRISPR gRNA sequence
actgactatgctggatattt

SEQ ID NO: 803567 - DNA, 20 bp, Artificial
  CRISPR gRNA sequence
ctgactatgctggatatttt

SEQ ID NO: 803568 - DNA, 20 bp, Artificial
  CRISPR gRNA sequence
actatgctggatatttttgg

SEQ ID NO: 803569 - DNA, 20 bp, Artificial
  CRISPR gRNA sequence
tgctggatatttttggaagg

SEQ ID NO: 803570 - DNA, 20 bp, Artificial
  CRISPR gRNA sequence
gatatttttggaagggatcc

SEQ ID NO: 803571 - DNA, 20 bp, Artificial
  CRISPR gRNA sequence
ttggaagggatcccatactt

SEQ ID NO: 803572 - DNA, 20 bp, Artificial
  CRISPR gRNA sequence
tggaagggatcccatacttt

SEQ ID NO: 803573 - DNA, 20 bp, Artificial
  CRISPR gRNA sequence
ggaagggatcccatactttt

SEQ ID NO: 803574 - DNA, 20 bp, Artificial
  CRISPR gRNA sequence
gaagggatcccatacttttg

SEQ ID NO: 803575 - DNA, 20 bp, Artificial
  CRISPR gRNA sequence
ttgaacttcatacagcagaa

SEQ ID NO: 803576 - DNA, 20 bp, Artificial
  CRISPR gRNA sequence
tgaacttcatacagcagaat

SEQ ID NO: 803577 - DNA, 20 bp, Artificial
  CRISPR gRNA sequence
gaacttcatacagcagaatt

SEQ ID NO: 803578 - DNA, 20 bp, Artificial
  CRISPR gRNA sequence
aacttcatacagcagaattt

SEQ ID NO: 803579 - DNA, 20 bp, Artificial
  CRISPR gRNA sequence
catacagcagaatttcaaac

SEQ ID NO: 803580 - DNA, 20 bp, Artificial
  CRISPR gRNA sequence
atacagcagaatttcaaaca

SEQ ID NO: 803581 - DNA, 20 bp, Artificial
  CRISPR gRNA sequence
caaacaatcttgggaaaata

SEQ ID NO: 803582 - DNA, 20 bp, Artificial
  CRISPR gRNA sequence
aaacaatcttgggaaaataa

SEQ ID NO: 803583 - DNA, 20 bp, Artificial
  CRISPR gRNA sequence
gggaaaataacaacttttat

SEQ ID NO: 803584 - DNA, 20 bp, Artificial
  CRISPR gRNA sequence
ggaaaataacaacttttatc

SEQ ID NO: 803585 - DNA, 20 bp, Artificial
  CRISPR gRNA sequence
ttatctgcccagtaaggaca

SEQ ID NO: 803586 - DNA, 20 bp, Artificial
  CRISPR gRNA sequence
tatctgcccagtaaggacaa

SEQ ID NO: 803587 - DNA, 20 bp, Artificial
  CRISPR gRNA sequence
atctgcccagtaaggacaac

SEQ ID NO: 803588 - DNA, 20 bp, Artificial
  CRISPR gRNA sequence
tctgcccagtaaggacaact

SEQ ID NO: 803589 - DNA, 20 bp, Artificial
  CRISPR gRNA sequence
cccagtaaggacaactaaca

SEQ ID NO: 803590 - DNA, 20 bp, Artificial
  CRISPR gRNA sequence
acacctagtatcataatcat

SEQ ID NO: 803591 - DNA, 20 bp, Artificial
  CRISPR gRNA sequence
gtatcataatcatttcgtaa

SEQ ID NO: 803592 - DNA, 20 bp, Artificial
  CRISPR gRNA sequence
cgtaagagacaggtaatttc

SEQ ID NO: 803593 - DNA, 20 bp, Artificial
  CRISPR gRNA sequence
gtaagagacaggtaatttca

SEQ ID NO: 803594 - DNA, 20 bp, Artificial
  CRISPR gRNA sequence
catcaccgagtgcatatgtt

SEQ ID NO: 803595 - DNA, 20 bp, Artificial
  CRISPR gRNA sequence
atcaccgagtgcatatgttt

SEQ ID NO: 803596 - DNA, 20 bp, Artificial
  CRISPR gRNA sequence
tctaatgctcttatatcaaa

SEQ ID NO: 803597 - DNA, 20 bp, Artificial
  CRISPR gRNA sequence
ctaatgctcttatatcaaat

SEQ ID NO: 803598 - DNA, 20 bp, Artificial
  CRISPR gRNA sequence
taatgctcttatatcaaatt

SEQ ID NO: 803599 - DNA, 20 bp, Artificial
  CRISPR gRNA sequence
atgctcttatatcaaattac

SEQ ID NO: 803600 - DNA, 20 bp, Artificial
  CRISPR gRNA sequence
ttatatcaaattaccacaag

SEQ ID NO: 803601 - DNA, 20 bp, Artificial
  CRISPR gRNA sequence
atatcaaattaccacaagct

SEQ ID NO: 803602 - DNA, 20 bp, Artificial
  CRISPR gRNA sequence
tatcaaattaccacaagctt

SEQ ID NO: 803603 - DNA, 20 bp, Artificial
  CRISPR gRNA sequence
ccacaagcttcacagtttaa

SEQ ID NO: 803604 - DNA, 20 bp, Artificial
  CRISPR gRNA sequence
cacagtttaagacaacacag

SEQ ID NO: 803605 - DNA, 20 bp, Artificial
  CRISPR gRNA sequence
acagtttaagacaacacaga

SEQ ID NO: 803606 - DNA, 20 bp, Artificial
  CRISPR gRNA sequence
aagacaacacagatttatta

SEQ ID NO: 803607 - DNA, 20 bp, Artificial
  CRISPR gRNA sequence
agacaacacagatttattat

SEQ ID NO: 803608 - DNA, 20 bp, Artificial
  CRISPR gRNA sequence
attatctgatacttatggag

SEQ ID NO: 803609 - DNA, 20 bp, Artificial
  CRISPR gRNA sequence
ttatctgatacttatggagg

SEQ ID NO: 803610 - DNA, 20 bp, Artificial
  CRISPR gRNA sequence
tctgatacttatggaggtca

SEQ ID NO: 803611 - DNA, 20 bp, Artificial
  CRISPR gRNA sequence
atacttatggaggtcagaaa

SEQ ID NO: 803612 - DNA, 20 bp, Artificial
  CRISPR gRNA sequence
atggaggtcagaaagccaga

SEQ ID NO: 803613 - DNA, 20 bp, Artificial
  CRISPR gRNA sequence
tggaggtcagaaagccagac

SEQ ID NO: 803614 - DNA, 20 bp, Artificial
  CRISPR gRNA sequence
gagtttcactgggctcaaat

SEQ ID NO: 803615 - DNA, 20 bp, Artificial
  CRISPR gRNA sequence
agtttcactgggctcaaatc

SEQ ID NO: 803616 - DNA, 20 bp, Artificial
  CRISPR gRNA sequence
cactgggctcaaatcaaggt

SEQ ID NO: 803617 - DNA, 20 bp, Artificial
  CRISPR gRNA sequence
actgggctcaaatcaaggtg

SEQ ID NO: 803618 - DNA, 20 bp, Artificial
  CRISPR gRNA sequence
ggctcaaatcaaggtgtcag

SEQ ID NO: 803619 - DNA, 20 bp, Artificial
  CRISPR gRNA sequence
aaatcaaggtgtcagcagga

SEQ ID NO: 803620 - DNA, 20 bp, Artificial
  CRISPR gRNA sequence
cagaggccctaagggaagat

SEQ ID NO: 803621 - DNA, 20 bp, Artificial
  CRISPR gRNA sequence
agggaagattccactttcct

SEQ ID NO: 803622 - DNA, 20 bp, Artificial
  CRISPR gRNA sequence
cactttcctgtcttttccag

SEQ ID NO: 803623 - DNA, 20 bp, Artificial
  CRISPR gRNA sequence
tcctgtcttttccagctgct

SEQ ID NO: 803624 - DNA, 20 bp, Artificial
  CRISPR gRNA sequence
cctgtcttttccagctgcta

SEQ ID NO: 803625 - DNA, 20 bp, Artificial
  CRISPR gRNA sequence
ctgtcttttccagctgctag

SEQ ID NO: 803626 - DNA, 20 bp, Artificial
  CRISPR gRNA sequence
tcttttccagctgctagagg

SEQ ID NO: 803627 - DNA, 20 bp, Artificial
  CRISPR gRNA sequence
ttccagctgctagaggccac

SEQ ID NO: 803628 - DNA, 20 bp, Artificial
  CRISPR gRNA sequence
tccagctgctagaggccacc

SEQ ID NO: 803629 - DNA, 20 bp, Artificial
  CRISPR gRNA sequence
ccagctgctagaggccacct

SEQ ID NO: 803630 - DNA, 20 bp, Artificial
  CRISPR gRNA sequence
cagctgctagaggccacctg

SEQ ID NO: 803631 - DNA, 20 bp, Artificial
  CRISPR gRNA sequence
ctagaggccacctgcattaa

SEQ ID NO: 803632 - DNA, 20 bp, Artificial
  CRISPR gRNA sequence
gaggccacctgcattaattg

SEQ ID NO: 803633 - DNA, 20 bp, Artificial
  CRISPR gRNA sequence
cattaattgcctcatggccc

SEQ ID NO: 803634 - DNA, 20 bp, Artificial
  CRISPR gRNA sequence
attgcctcatggcccctccc

SEQ ID NO: 803635 - DNA, 20 bp, Artificial
  CRISPR gRNA sequence
cctcatggcccctccctcta

SEQ ID NO: 803636 - DNA, 20 bp, Artificial
  CRISPR gRNA sequence
atggcccctccctctatctt

SEQ ID NO: 803637 - DNA, 20 bp, Artificial
  CRISPR gRNA sequence
cctctatcttcagaggcagc

SEQ ID NO: 803638 - DNA, 20 bp, Artificial
  CRISPR gRNA sequence
tatcttcagaggcagcaacc

SEQ ID NO: 803639 - DNA, 20 bp, Artificial
  CRISPR gRNA sequence
tcttcagaggcagcaaccct

SEQ ID NO: 803640 - DNA, 20 bp, Artificial
  CRISPR gRNA sequence
cagaggcagcaaccctatca

SEQ ID NO: 803641 - DNA, 20 bp, Artificial
  CRISPR gRNA sequence
agaggcagcaaccctatcat

SEQ ID NO: 803642 - DNA, 20 bp, Artificial
  CRISPR gRNA sequence
tcattcagccttctgcttct

SEQ ID NO: 803643 - DNA, 20 bp, Artificial
  CRISPR gRNA sequence
agccttctgcttctgtcacc

SEQ ID NO: 803644 - DNA, 20 bp, Artificial
  CRISPR gRNA sequence
ctgcttctgtcaccacatct

SEQ ID NO: 803645 - DNA, 20 bp, Artificial
  CRISPR gRNA sequence
tgcttctgtcaccacatctc

SEQ ID NO: 803646 - DNA, 20 bp, Artificial
  CRISPR gRNA sequence
cttctgtcaccacatctctc

SEQ ID NO: 803647 - DNA, 20 bp, Artificial
  CRISPR gRNA sequence
ctgtcaccacatctctctct

SEQ ID NO: 803648 - DNA, 20 bp, Artificial
  CRISPR gRNA sequence
tgtcaccacatctctctctc

SEQ ID NO: 803649 - DNA, 20 bp, Artificial
  CRISPR gRNA sequence
tcaccacatctctctctctc

SEQ ID NO: 803650 - DNA, 20 bp, Artificial
  CRISPR gRNA sequence
tctctctctctttttttttt

SEQ ID NO: 803651 - DNA, 20 bp, Artificial
  CRISPR gRNA sequence
tctctctctttttttttttt

SEQ ID NO: 803652 - DNA, 20 bp, Artificial
  CRISPR gRNA sequence
tctctcttttttttttttga

SEQ ID NO: 803653 - DNA, 20 bp, Artificial
  CRISPR gRNA sequence
tctcttttttttttttgaga

SEQ ID NO: 803654 - DNA, 20 bp, Artificial
  CRISPR gRNA sequence
tcttttttttttttgagatg

SEQ ID NO: 803655 - DNA, 20 bp, Artificial
  CRISPR gRNA sequence
ttttttttttttgagatgaa

SEQ ID NO: 803656 - DNA, 20 bp, Artificial
  CRISPR gRNA sequence
ttttttttttgagatgaagt

SEQ ID NO: 803657 - DNA, 20 bp, Artificial
  CRISPR gRNA sequence
tttttttttgagatgaagtc

SEQ ID NO: 803658 - DNA, 20 bp, Artificial
  CRISPR gRNA sequence
ttttttttgagatgaagtct

SEQ ID NO: 803659 - DNA, 20 bp, Artificial
  CRISPR gRNA sequence
tttttttgagatgaagtctt

SEQ ID NO: 803660 - DNA, 20 bp, Artificial
  CRISPR gRNA sequence
ttttttgagatgaagtctta

SEQ ID NO: 803661 - DNA, 20 bp, Artificial
  CRISPR gRNA sequence
tttttgagatgaagtcttat

SEQ ID NO: 803662 - DNA, 20 bp, Artificial
  CRISPR gRNA sequence
ttttgagatgaagtcttatt

SEQ ID NO: 803663 - DNA, 20 bp, Artificial
  CRISPR gRNA sequence
tttgagatgaagtcttattc

SEQ ID NO: 803664 - DNA, 20 bp, Artificial
  CRISPR gRNA sequence
ttgagatgaagtcttattct

SEQ ID NO: 803665 - DNA, 20 bp, Artificial
  CRISPR gRNA sequence
tgagatgaagtcttattctg

SEQ ID NO: 803666 - DNA, 20 bp, Artificial
  CRISPR gRNA sequence
gagatgaagtcttattctgc

SEQ ID NO: 803667 - DNA, 20 bp, Artificial
  CRISPR gRNA sequence
agatgaagtcttattctgcc

SEQ ID NO: 803668 - DNA, 20 bp, Artificial
  CRISPR gRNA sequence
attctgccccccaggctgga

SEQ ID NO: 803669 - DNA, 20 bp, Artificial
  CRISPR gRNA sequence
ttctgccccccaggctggaa

SEQ ID NO: 803670 - DNA, 20 bp, Artificial
  CRISPR gRNA sequence
tgccccccaggctggaatgc

SEQ ID NO: 803671 - DNA, 20 bp, Artificial
  CRISPR gRNA sequence
ccccccaggctggaatgcag

SEQ ID NO: 803672 - DNA, 20 bp, Artificial
  CRISPR gRNA sequence
gaatgcagtggcacgatccc

SEQ ID NO: 803673 - DNA, 20 bp, Artificial
  CRISPR gRNA sequence
actgcaacccctgcctcccg

SEQ ID NO: 803674 - DNA, 20 bp, Artificial
  CRISPR gRNA sequence
caacccctgcctcccgggtt

SEQ ID NO: 803675 - DNA, 20 bp, Artificial
  CRISPR gRNA sequence
cctcccgggttcaagctatt

SEQ ID NO: 803676 - DNA, 20 bp, Artificial
  CRISPR gRNA sequence
ccgggttcaagctattctcc

SEQ ID NO: 803677 - DNA, 20 bp, Artificial
  CRISPR gRNA sequence
aagctattctcctgtctcag

SEQ ID NO: 803678 - DNA, 20 bp, Artificial
  CRISPR gRNA sequence
ttctcctgtctcagcctcct

SEQ ID NO: 803679 - DNA, 20 bp, Artificial
  CRISPR gRNA sequence
tcctgtctcagcctcctgag

SEQ ID NO: 803680 - DNA, 20 bp, Artificial
  CRISPR gRNA sequence
ctgtctcagcctcctgagta

SEQ ID NO: 803681 - DNA, 20 bp, Artificial
  CRISPR gRNA sequence
tctcagcctcctgagtagct

SEQ ID NO: 803682 - DNA, 20 bp, Artificial
  CRISPR gRNA sequence
agcctcctgagtagctggga

SEQ ID NO: 803683 - DNA, 20 bp, Artificial
  CRISPR gRNA sequence
ctgagtagctgggattacag

SEQ ID NO: 803684 - DNA, 20 bp, Artificial
  CRISPR gRNA sequence
agtagctgggattacaggca

SEQ ID NO: 803685 - DNA, 20 bp, Artificial
  CRISPR gRNA sequence
ggattacaggcacatgccaa

SEQ ID NO: 803686 - DNA, 20 bp, Artificial
  CRISPR gRNA sequence
caggcacatgccaacatgcc

SEQ ID NO: 803687 - DNA, 20 bp, Artificial
  CRISPR gRNA sequence
gctaatttttgtatttttag

SEQ ID NO: 803688 - DNA, 20 bp, Artificial
  CRISPR gRNA sequence
atttttgtatttttagtaga

SEQ ID NO: 803689 - DNA, 20 bp, Artificial
  CRISPR gRNA sequence
ttgtatttttagtagagatg

SEQ ID NO: 803690 - DNA, 20 bp, Artificial
  CRISPR gRNA sequence
tgtatttttagtagagatgg

SEQ ID NO: 803691 - DNA, 20 bp, Artificial
  CRISPR gRNA sequence
gtatttttagtagagatggg

SEQ ID NO: 803692 - DNA, 20 bp, Artificial
  CRISPR gRNA sequence
tatttttagtagagatgggt

SEQ ID NO: 803693 - DNA, 20 bp, Artificial
  CRISPR gRNA sequence
ttagtagagatgggtttcac

SEQ ID NO: 803694 - DNA, 20 bp, Artificial
  CRISPR gRNA sequence
tagtagagatgggtttcacc

SEQ ID NO: 803695 - DNA, 20 bp, Artificial
  CRISPR gRNA sequence
agtagagatgggtttcacca

SEQ ID NO: 803696 - DNA, 20 bp, Artificial
  CRISPR gRNA sequence
gtagagatgggtttcaccat

SEQ ID NO: 803697 - DNA, 20 bp, Artificial
  CRISPR gRNA sequence
caccatgttggccaggctgg

SEQ ID NO: 803698 - DNA, 20 bp, Artificial
  CRISPR gRNA sequence
accatgttggccaggctggt

SEQ ID NO: 803699 - DNA, 20 bp, Artificial
  CRISPR gRNA sequence
gccaggctggtctcaaactc

SEQ ID NO: 803700 - DNA, 20 bp, Artificial
  CRISPR gRNA sequence
gtctcaaactcctgacctca

SEQ ID NO: 803701 - DNA, 20 bp, Artificial
  CRISPR gRNA sequence
aaactcctgacctcaggtga

SEQ ID NO: 803702 - DNA, 20 bp, Artificial
  CRISPR gRNA sequence
ctgacctcaggtgatccgcc

SEQ ID NO: 803703 - DNA, 20 bp, Artificial
  CRISPR gRNA sequence
acctcaggtgatccgcccgc

SEQ ID NO: 803704 - DNA, 20 bp, Artificial
  CRISPR gRNA sequence
aggtgatccgcccgcctcag

SEQ ID NO: 803705 - DNA, 20 bp, Artificial
  CRISPR gRNA sequence
agcctcccaaattgctagga

SEQ ID NO: 803706 - DNA, 20 bp, Artificial
  CRISPR gRNA sequence
ccaaattgctaggattacag

SEQ ID NO: 803707 - DNA, 20 bp, Artificial
  CRISPR gRNA sequence
ctaggattacaggcgtgagc

SEQ ID NO: 803708 - DNA, 20 bp, Artificial
  CRISPR gRNA sequence
ggattacaggcgtgagccat

SEQ ID NO: 803709 - DNA, 20 bp, Artificial
  CRISPR gRNA sequence
caggcgtgagccatcatgat

SEQ ID NO: 803710 - DNA, 20 bp, Artificial
  CRISPR gRNA sequence
tttccctaactagcttgctt

SEQ ID NO: 803711 - DNA, 20 bp, Artificial
  CRISPR gRNA sequence
tccctaactagcttgcttct

SEQ ID NO: 803712 - DNA, 20 bp, Artificial
  CRISPR gRNA sequence
ccctaactagcttgcttctc

SEQ ID NO: 803713 - DNA, 20 bp, Artificial
  CRISPR gRNA sequence
cctaactagcttgcttctct

SEQ ID NO: 803714 - DNA, 20 bp, Artificial
  CRISPR gRNA sequence
actagcttgcttctctttgc

SEQ ID NO: 803715 - DNA, 20 bp, Artificial
  CRISPR gRNA sequence
gcttgcttctctttgccacc

SEQ ID NO: 803716 - DNA, 20 bp, Artificial
  CRISPR gRNA sequence
gcttctctttgccacctctt

SEQ ID NO: 803717 - DNA, 20 bp, Artificial
  CRISPR gRNA sequence
cttctctttgccacctctta

SEQ ID NO: 803718 - DNA, 20 bp, Artificial
  CRISPR gRNA sequence
ctctttgccacctcttaagg

SEQ ID NO: 803719 - DNA, 20 bp, Artificial
  CRISPR gRNA sequence
tctttgccacctcttaagga

SEQ ID NO: 803720 - DNA, 20 bp, Artificial
  CRISPR gRNA sequence
tttgccacctcttaaggacc

SEQ ID NO: 803721 - DNA, 20 bp, Artificial
  CRISPR gRNA sequence
tgccacctcttaaggaccct

SEQ ID NO: 803722 - DNA, 20 bp, Artificial
  CRISPR gRNA sequence
gccacctcttaaggaccctt

SEQ ID NO: 803723 - DNA, 20 bp, Artificial
  CRISPR gRNA sequence
ccacctcttaaggacccttg

SEQ ID NO: 803724 - DNA, 20 bp, Artificial
  CRISPR gRNA sequence
ttaaggacccttgtgattgc

SEQ ID NO: 803725 - DNA, 20 bp, Artificial
  CRISPR gRNA sequence
aaggacccttgtgattgcat

SEQ ID NO: 803726 - DNA, 20 bp, Artificial
  CRISPR gRNA sequence
aggacccttgtgattgcatt

SEQ ID NO: 803727 - DNA, 20 bp, Artificial
  CRISPR gRNA sequence
gtgattgcattaggtactcc

SEQ ID NO: 803728 - DNA, 20 bp, Artificial
  CRISPR gRNA sequence
tgattgcattaggtactcca

SEQ ID NO: 803729 - DNA, 20 bp, Artificial
  CRISPR gRNA sequence
cattaggtactccatccccc

SEQ ID NO: 803730 - DNA, 20 bp, Artificial
  CRISPR gRNA sequence
ggtactccatccccctggtt

SEQ ID NO: 803731 - DNA, 20 bp, Artificial
  CRISPR gRNA sequence
catccccctggttatttggg

SEQ ID NO: 803732 - DNA, 20 bp, Artificial
  CRISPR gRNA sequence
gttatttggggtgatcttcc

SEQ ID NO: 803733 - DNA, 20 bp, Artificial
  CRISPR gRNA sequence
tttggggtgatcttcccatc

SEQ ID NO: 803734 - DNA, 20 bp, Artificial
  CRISPR gRNA sequence
ggggtgatcttcccatctca

SEQ ID NO: 803735 - DNA, 20 bp, Artificial
  CRISPR gRNA sequence
gggtgatcttcccatctcaa

SEQ ID NO: 803736 - DNA, 20 bp, Artificial
  CRISPR gRNA sequence
cccatctcaaggtccatctt

SEQ ID NO: 803737 - DNA, 20 bp, Artificial
  CRISPR gRNA sequence
ccatctcaaggtccatcttc

SEQ ID NO: 803738 - DNA, 20 bp, Artificial
  CRISPR gRNA sequence
aaggtccatcttcaaaattc

SEQ ID NO: 803739 - DNA, 20 bp, Artificial
  CRISPR gRNA sequence
caaaattccttttgccatgt

SEQ ID NO: 803740 - DNA, 20 bp, Artificial
  CRISPR gRNA sequence
aaaattccttttgccatgta

SEQ ID NO: 803741 - DNA, 20 bp, Artificial
  CRISPR gRNA sequence
cttttgccatgtaaggtgac

SEQ ID NO: 803742 - DNA, 20 bp, Artificial
  CRISPR gRNA sequence
ttgccatgtaaggtgacata

SEQ ID NO: 803743 - DNA, 20 bp, Artificial
  CRISPR gRNA sequence
tgccatgtaaggtgacatat

SEQ ID NO: 803744 - DNA, 20 bp, Artificial
  CRISPR gRNA sequence
gccatgtaaggtgacatatt

SEQ ID NO: 803745 - DNA, 20 bp, Artificial
  CRISPR gRNA sequence
ccatgtaaggtgacatattc

SEQ ID NO: 803746 - DNA, 20 bp, Artificial
  CRISPR gRNA sequence
acatgttccagggattagaa

SEQ ID NO: 803747 - DNA, 20 bp, Artificial
  CRISPR gRNA sequence
cagggattagaatatggaca

SEQ ID NO: 803748 - DNA, 20 bp, Artificial
  CRISPR gRNA sequence
gaatatggacatctttgggg

SEQ ID NO: 803749 - DNA, 20 bp, Artificial
  CRISPR gRNA sequence
tggggagagccataatttta

SEQ ID NO: 803750 - DNA, 20 bp, Artificial
  CRISPR gRNA sequence
ggggagagccataattttat

SEQ ID NO: 803751 - DNA, 20 bp, Artificial
  CRISPR gRNA sequence
gggagagccataattttatt

SEQ ID NO: 803752 - DNA, 20 bp, Artificial
  CRISPR gRNA sequence
tatttatcctactgagaagg

SEQ ID NO: 803753 - DNA, 20 bp, Artificial
  CRISPR gRNA sequence
atttatcctactgagaaggg

SEQ ID NO: 803754 - DNA, 20 bp, Artificial
  CRISPR gRNA sequence
tttatcctactgagaaggga

SEQ ID NO: 803755 - DNA, 20 bp, Artificial
  CRISPR gRNA sequence
atcctactgagaagggatat

SEQ ID NO: 803756 - DNA, 20 bp, Artificial
  CRISPR gRNA sequence
tcctactgagaagggatata

SEQ ID NO: 803757 - DNA, 20 bp, Artificial
  CRISPR gRNA sequence
ctgagaagggatatactctc

SEQ ID NO: 803758 - DNA, 20 bp, Artificial
  CRISPR gRNA sequence
agaagggatatactctcaga

SEQ ID NO: 803759 - DNA, 20 bp, Artificial
  CRISPR gRNA sequence
tcagactaaaggacagtccc

SEQ ID NO: 803760 - DNA, 20 bp, Artificial
  CRISPR gRNA sequence
agactaaaggacagtcccta

SEQ ID NO: 803761 - DNA, 20 bp, Artificial
  CRISPR gRNA sequence
aaggacagtccctagtactg

SEQ ID NO: 803762 - DNA, 20 bp, Artificial
  CRISPR gRNA sequence
gtactgattcaatctggctt

SEQ ID NO: 803763 - DNA, 20 bp, Artificial
  CRISPR gRNA sequence
attcaatctggctttataga

SEQ ID NO: 803764 - DNA, 20 bp, Artificial
  CRISPR gRNA sequence
aatctggctttatagaaaat

SEQ ID NO: 803765 - DNA, 20 bp, Artificial
  CRISPR gRNA sequence
gctttatagaaaattcacta

SEQ ID NO: 803766 - DNA, 20 bp, Artificial
  CRISPR gRNA sequence
tatagaaaattcactatatt

SEQ ID NO: 803767 - DNA, 20 bp, Artificial
  CRISPR gRNA sequence
atagaaaattcactatattg

SEQ ID NO: 803768 - DNA, 20 bp, Artificial
  CRISPR gRNA sequence
tagaaaattcactatattgt

SEQ ID NO: 803769 - DNA, 20 bp, Artificial
  CRISPR gRNA sequence
actatattgtcattgtattt

SEQ ID NO: 803770 - DNA, 20 bp, Artificial
  CRISPR gRNA sequence
tattgtcattgtatttcaca

SEQ ID NO: 803771 - DNA, 20 bp, Artificial
  CRISPR gRNA sequence
tcattgtatttcacagtttg

SEQ ID NO: 803772 - DNA, 20 bp, Artificial
  CRISPR gRNA sequence
tatttcacagtttgcccttt

SEQ ID NO: 803773 - DNA, 20 bp, Artificial
  CRISPR gRNA sequence
cacagtttgccctttgtctt

SEQ ID NO: 803774 - DNA, 20 bp, Artificial
  CRISPR gRNA sequence
acagtttgccctttgtctta

SEQ ID NO: 803775 - DNA, 20 bp, Artificial
  CRISPR gRNA sequence
gccctttgtcttagctggta

SEQ ID NO: 803776 - DNA, 20 bp, Artificial
  CRISPR gRNA sequence
ccctttgtcttagctggtaa

SEQ ID NO: 803777 - DNA, 20 bp, Artificial
  CRISPR gRNA sequence
tgtcttagctggtaagacag

SEQ ID NO: 803778 - DNA, 20 bp, Artificial
  CRISPR gRNA sequence
gtcttagctggtaagacaga

SEQ ID NO: 803779 - DNA, 20 bp, Artificial
  CRISPR gRNA sequence
tcttagctggtaagacagag

SEQ ID NO: 803780 - DNA, 20 bp, Artificial
  CRISPR gRNA sequence
agctggtaagacagagccta

SEQ ID NO: 803781 - DNA, 20 bp, Artificial
  CRISPR gRNA sequence
gctggtaagacagagcctat

SEQ ID NO: 803782 - DNA, 20 bp, Artificial
  CRISPR gRNA sequence
gtaagacagagcctatgata

SEQ ID NO: 803783 - DNA, 20 bp, Artificial
  CRISPR gRNA sequence
tgataaggacttgtgtggca

SEQ ID NO: 803784 - DNA, 20 bp, Artificial
  CRISPR gRNA sequence
gtgtggcatgcaggtattta

SEQ ID NO: 803785 - DNA, 20 bp, Artificial
  CRISPR gRNA sequence
tgtggcatgcaggtatttaa

SEQ ID NO: 803786 - DNA, 20 bp, Artificial
  CRISPR gRNA sequence
aattggcaaccccagagggc

SEQ ID NO: 803787 - DNA, 20 bp, Artificial
  CRISPR gRNA sequence
attggcaaccccagagggca

SEQ ID NO: 803788 - DNA, 20 bp, Artificial
  CRISPR gRNA sequence
gcaaccccagagggcagaag

SEQ ID NO: 803789 - DNA, 20 bp, Artificial
  CRISPR gRNA sequence
aggagtttaagagagggtaa

SEQ ID NO: 803790 - DNA, 20 bp, Artificial
  CRISPR gRNA sequence
ggagtttaagagagggtaat

SEQ ID NO: 803791 - DNA, 20 bp, Artificial
  CRISPR gRNA sequence
aagagagggtaatataagag

SEQ ID NO: 803792 - DNA, 20 bp, Artificial
  CRISPR gRNA sequence
agagagggtaatataagagt

SEQ ID NO: 803793 - DNA, 20 bp, Artificial
  CRISPR gRNA sequence
tcaaagttgtagtgtggaca

SEQ ID NO: 803794 - DNA, 20 bp, Artificial
  CRISPR gRNA sequence
tagtgtggacaacagaaact

SEQ ID NO: 803795 - DNA, 20 bp, Artificial
  CRISPR gRNA sequence
aaatattcaaggaccagcat

SEQ ID NO: 803796 - DNA, 20 bp, Artificial
  CRISPR gRNA sequence
aaggaccagcatgtagacag

SEQ ID NO: 803797 - DNA, 20 bp, Artificial
  CRISPR gRNA sequence
ctaagatgtctactcagaca

SEQ ID NO: 803798 - DNA, 20 bp, Artificial
  CRISPR gRNA sequence
agatgtctactcagacaaag

SEQ ID NO: 803799 - DNA, 20 bp, Artificial
  CRISPR gRNA sequence
ctcagacaaagaatttcagg

SEQ ID NO: 803800 - DNA, 20 bp, Artificial
  CRISPR gRNA sequence
agacaaagaatttcaggtgg

SEQ ID NO: 803801 - DNA, 20 bp, Artificial
  CRISPR gRNA sequence
caggtggaaggacttgttca

SEQ ID NO: 803802 - DNA, 20 bp, Artificial
  CRISPR gRNA sequence
aggtggaaggacttgttcat

SEQ ID NO: 803803 - DNA, 20 bp, Artificial
  CRISPR gRNA sequence
gttcatctgcttcacgccca

SEQ ID NO: 803804 - DNA, 20 bp, Artificial
  CRISPR gRNA sequence
ttcatctgcttcacgcccat

SEQ ID NO: 803805 - DNA, 20 bp, Artificial
  CRISPR gRNA sequence
atctgcttcacgcccattgg

SEQ ID NO: 803806 - DNA, 20 bp, Artificial
  CRISPR gRNA sequence
cttcacgcccattggttgac

SEQ ID NO: 803807 - DNA, 20 bp, Artificial
  CRISPR gRNA sequence
cacgcccattggttgacagg

SEQ ID NO: 803808 - DNA, 20 bp, Artificial
  CRISPR gRNA sequence
acgcccattggttgacagga

SEQ ID NO: 803809 - DNA, 20 bp, Artificial
  CRISPR gRNA sequence
gttgacaggaatatgaactc

SEQ ID NO: 803810 - DNA, 20 bp, Artificial
  CRISPR gRNA sequence
acaggaatatgaactccatt

SEQ ID NO: 803811 - DNA, 20 bp, Artificial
  CRISPR gRNA sequence
cattctgctgctgggctaga

SEQ ID NO: 803812 - DNA, 20 bp, Artificial
  CRISPR gRNA sequence
tgctgctgggctagacatgc

SEQ ID NO: 803813 - DNA, 20 bp, Artificial
  CRISPR gRNA sequence
ctgctgggctagacatgcat

SEQ ID NO: 803814 - DNA, 20 bp, Artificial
  CRISPR gRNA sequence
ctgggctagacatgcatgtg

SEQ ID NO: 803815 - DNA, 20 bp, Artificial
  CRISPR gRNA sequence
ggctagacatgcatgtgggc

SEQ ID NO: 803816 - DNA, 20 bp, Artificial
  CRISPR gRNA sequence
gacatgcatgtgggctgagt

SEQ ID NO: 803817 - DNA, 20 bp, Artificial
  CRISPR gRNA sequence
agtgagctttccccagtatc

SEQ ID NO: 803818 - DNA, 20 bp, Artificial
  CRISPR gRNA sequence
tccccagtatccgtagcatc

SEQ ID NO: 803819 - DNA, 20 bp, Artificial
  CRISPR gRNA sequence
ccccagtatccgtagcatca

SEQ ID NO: 803820 - DNA, 20 bp, Artificial
  CRISPR gRNA sequence
cccagtatccgtagcatcag

SEQ ID NO: 803821 - DNA, 20 bp, Artificial
  CRISPR gRNA sequence
gaggtgaattactgaccttg

SEQ ID NO: 803822 - DNA, 20 bp, Artificial
  CRISPR gRNA sequence
aggtgaattactgaccttga

SEQ ID NO: 803823 - DNA, 20 bp, Artificial
  CRISPR gRNA sequence
ctgaccttgaagtgagtgta

SEQ ID NO: 803824 - DNA, 20 bp, Artificial
  CRISPR gRNA sequence
accttgaagtgagtgtaagc

SEQ ID NO: 803825 - DNA, 20 bp, Artificial
  CRISPR gRNA sequence
gaagtgagtgtaagcctaac

SEQ ID NO: 803826 - DNA, 20 bp, Artificial
  CRISPR gRNA sequence
aagtgagtgtaagcctaact

SEQ ID NO: 803827 - DNA, 20 bp, Artificial
  CRISPR gRNA sequence
actagaattctaccccagct

SEQ ID NO: 803828 - DNA, 20 bp, Artificial
  CRISPR gRNA sequence
gaattctaccccagctggct

SEQ ID NO: 803829 - DNA, 20 bp, Artificial
  CRISPR gRNA sequence
taccccagctggctgaagtg

SEQ ID NO: 803830 - DNA, 20 bp, Artificial
  CRISPR gRNA sequence
ccccagctggctgaagtgaa

SEQ ID NO: 803831 - DNA, 20 bp, Artificial
  CRISPR gRNA sequence
gctgaagtgaaaggtgaggc

SEQ ID NO: 803832 - DNA, 20 bp, Artificial
  CRISPR gRNA sequence
aagtgaaaggtgaggctgag

SEQ ID NO: 803833 - DNA, 20 bp, Artificial
  CRISPR gRNA sequence
agaggaaataaggcaggact

SEQ ID NO: 803834 - DNA, 20 bp, Artificial
  CRISPR gRNA sequence
cacagtccccaattgtactg

SEQ ID NO: 803835 - DNA, 20 bp, Artificial
  CRISPR gRNA sequence
tactgttcaaatccactcat

SEQ ID NO: 803836 - DNA, 20 bp, Artificial
  CRISPR gRNA sequence
ttcaaatccactcatgccct

SEQ ID NO: 803837 - DNA, 20 bp, Artificial
  CRISPR gRNA sequence
aaatccactcatgcccttca

SEQ ID NO: 803838 - DNA, 20 bp, Artificial
  CRISPR gRNA sequence
atgcccttcattaagtcagc

SEQ ID NO: 803839 - DNA, 20 bp, Artificial
  CRISPR gRNA sequence
cattaagtcagctctgccac

SEQ ID NO: 803840 - DNA, 20 bp, Artificial
  CRISPR gRNA sequence
attaagtcagctctgccact

SEQ ID NO: 803841 - DNA, 20 bp, Artificial
  CRISPR gRNA sequence
agtcagctctgccactgagc

SEQ ID NO: 803842 - DNA, 20 bp, Artificial
  CRISPR gRNA sequence
tgccactgagccttccagct

SEQ ID NO: 803843 - DNA, 20 bp, Artificial
  CRISPR gRNA sequence
ccactgagccttccagctgg

SEQ ID NO: 803844 - DNA, 20 bp, Artificial
  CRISPR gRNA sequence
agccttccagctgggaggca

SEQ ID NO: 803845 - DNA, 20 bp, Artificial
  CRISPR gRNA sequence
ccagctgggaggcagccaca

SEQ ID NO: 803846 - DNA, 20 bp, Artificial
  CRISPR gRNA sequence
cagctgggaggcagccacaa

SEQ ID NO: 803847 - DNA, 20 bp, Artificial
  CRISPR gRNA sequence
ggaggcagccacaatctctg

SEQ ID NO: 803848 - DNA, 20 bp, Artificial
  CRISPR gRNA sequence
tgcagaagatttaatataca

SEQ ID NO: 803849 - DNA, 20 bp, Artificial
  CRISPR gRNA sequence
cagaagatttaatatacacc

SEQ ID NO: 803850 - DNA, 20 bp, Artificial
  CRISPR gRNA sequence
aatatacaccagtttgtgga

SEQ ID NO: 803851 - DNA, 20 bp, Artificial
  CRISPR gRNA sequence
atatacaccagtttgtggaa

SEQ ID NO: 803852 - DNA, 20 bp, Artificial
  CRISPR gRNA sequence
gtggaacaagctgtagttcc

SEQ ID NO: 803853 - DNA, 20 bp, Artificial
  CRISPR gRNA sequence
tggaacaagctgtagttcct

SEQ ID NO: 803854 - DNA, 20 bp, Artificial
  CRISPR gRNA sequence
tagttcctgctgctgctgtg

SEQ ID NO: 803855 - DNA, 20 bp, Artificial
  CRISPR gRNA sequence
ctgctgctgctgtggatccc

SEQ ID NO: 803856 - DNA, 20 bp, Artificial
  CRISPR gRNA sequence
ctgctgctgtggatcccaag

SEQ ID NO: 803857 - DNA, 20 bp, Artificial
  CRISPR gRNA sequence
ctgctgtggatcccaagcca

SEQ ID NO: 803858 - DNA, 20 bp, Artificial
  CRISPR gRNA sequence
ctgtggatcccaagccacag

SEQ ID NO: 803859 - DNA, 20 bp, Artificial
  CRISPR gRNA sequence
tggatcccaagccacagttg

SEQ ID NO: 803860 - DNA, 20 bp, Artificial
  CRISPR gRNA sequence
atatttgttgtctcactcat

SEQ ID NO: 803861 - DNA, 20 bp, Artificial
  CRISPR gRNA sequence
gttgtctcactcatccacca

SEQ ID NO: 803862 - DNA, 20 bp, Artificial
  CRISPR gRNA sequence
ttgtctcactcatccaccat

SEQ ID NO: 803863 - DNA, 20 bp, Artificial
  CRISPR gRNA sequence
tctcactcatccaccataca

SEQ ID NO: 803864 - DNA, 20 bp, Artificial
  CRISPR gRNA sequence
actcatccaccatacattcc

SEQ ID NO: 803865 - DNA, 20 bp, Artificial
  CRISPR gRNA sequence
atccaccatacattccagat

SEQ ID NO: 803866 - DNA, 20 bp, Artificial
  CRISPR gRNA sequence
cagatttccctcacctaaca

SEQ ID NO: 803867 - DNA, 20 bp, Artificial
  CRISPR gRNA sequence
ccctcacctaacaccccaga

SEQ ID NO: 803868 - DNA, 20 bp, Artificial
  CRISPR gRNA sequence
cctcacctaacaccccagat

SEQ ID NO: 803869 - DNA, 20 bp, Artificial
  CRISPR gRNA sequence
acctaacaccccagatggaa

SEQ ID NO: 803870 - DNA, 20 bp, Artificial
  CRISPR gRNA sequence
acaccccagatggaatggtt

SEQ ID NO: 803871 - DNA, 20 bp, Artificial
  CRISPR gRNA sequence
ctttgcctgatagggtgacc

SEQ ID NO: 803872 - DNA, 20 bp, Artificial
  CRISPR gRNA sequence
tttgcctgatagggtgaccc

SEQ ID NO: 803873 - DNA, 20 bp, Artificial
  CRISPR gRNA sequence
tgcctgatagggtgacccag

SEQ ID NO: 803874 - DNA, 20 bp, Artificial
  CRISPR gRNA sequence
gcctgatagggtgacccaga

SEQ ID NO: 803875 - DNA, 20 bp, Artificial
  CRISPR gRNA sequence
cctgatagggtgacccagac

SEQ ID NO: 803876 - DNA, 20 bp, Artificial
  CRISPR gRNA sequence
atagggtgacccagacttaa

SEQ ID NO: 803877 - DNA, 20 bp, Artificial
  CRISPR gRNA sequence
aacgaccctaagagatctga

SEQ ID NO: 803878 - DNA, 20 bp, Artificial
  CRISPR gRNA sequence
acgaccctaagagatctgag

SEQ ID NO: 803879 - DNA, 20 bp, Artificial
  CRISPR gRNA sequence
agagatctgagcttttgatc

SEQ ID NO: 803880 - DNA, 20 bp, Artificial
  CRISPR gRNA sequence
agcttttgatcagcatgccc

SEQ ID NO: 803881 - DNA, 20 bp, Artificial
  CRISPR gRNA sequence
ttgatcagcatgcccttaac

SEQ ID NO: 803882 - DNA, 20 bp, Artificial
  CRISPR gRNA sequence
tgatcagcatgcccttaaca

SEQ ID NO: 803883 - DNA, 20 bp, Artificial
  CRISPR gRNA sequence
gatcagcatgcccttaacag

SEQ ID NO: 803884 - DNA, 20 bp, Artificial
  CRISPR gRNA sequence
atcagcatgcccttaacaga

SEQ ID NO: 803885 - DNA, 20 bp, Artificial
  CRISPR gRNA sequence
aacagactggggttgttgca

SEQ ID NO: 803886 - DNA, 20 bp, Artificial
  CRISPR gRNA sequence
acagactggggttgttgcaa

SEQ ID NO: 803887 - DNA, 20 bp, Artificial
  CRISPR gRNA sequence
gggttgttgcaaatatcttt

SEQ ID NO: 803888 - DNA, 20 bp, Artificial
  CRISPR gRNA sequence
ttgcaaatatcttttcatta

SEQ ID NO: 803889 - DNA, 20 bp, Artificial
  CRISPR gRNA sequence
caaatatcttttcattatca

SEQ ID NO: 803890 - DNA, 20 bp, Artificial
  CRISPR gRNA sequence
ttcattatcactggatatgg

SEQ ID NO: 803891 - DNA, 20 bp, Artificial
  CRISPR gRNA sequence
tcattatcactggatatgga

SEQ ID NO: 803892 - DNA, 20 bp, Artificial
  CRISPR gRNA sequence
cattatcactggatatggaa

SEQ ID NO: 803893 - DNA, 20 bp, Artificial
  CRISPR gRNA sequence
attatcactggatatggaag

SEQ ID NO: 803894 - DNA, 20 bp, Artificial
  CRISPR gRNA sequence
tcactggatatggaagtaaa

SEQ ID NO: 803895 - DNA, 20 bp, Artificial
  CRISPR gRNA sequence
gatatggaagtaaaaagaac

SEQ ID NO: 803896 - DNA, 20 bp, Artificial
  CRISPR gRNA sequence
agttccagacatactcttcc

SEQ ID NO: 803897 - DNA, 20 bp, Artificial
  CRISPR gRNA sequence
cagacatactcttccttgtc

SEQ ID NO: 803898 - DNA, 20 bp, Artificial
  CRISPR gRNA sequence
ttccttgtctccattatgta

SEQ ID NO: 803899 - DNA, 20 bp, Artificial
  CRISPR gRNA sequence
ccttgtctccattatgtagc

SEQ ID NO: 803900 - DNA, 20 bp, Artificial
  CRISPR gRNA sequence
cttgtctccattatgtagca

SEQ ID NO: 803901 - DNA, 20 bp, Artificial
  CRISPR gRNA sequence
gtctccattatgtagcagtg

SEQ ID NO: 803902 - DNA, 20 bp, Artificial
  CRISPR gRNA sequence
tctccattatgtagcagtgt

SEQ ID NO: 803903 - DNA, 20 bp, Artificial
  CRISPR gRNA sequence
cattatgtagcagtgttcaa

SEQ ID NO: 803904 - DNA, 20 bp, Artificial
  CRISPR gRNA sequence
tgtagcagtgttcaagattt

SEQ ID NO: 803905 - DNA, 20 bp, Artificial
  CRISPR gRNA sequence
aagattttcatgataatcaa

SEQ ID NO: 803906 - DNA, 20 bp, Artificial
  CRISPR gRNA sequence
tcatgataatcaagattgat

SEQ ID NO: 803907 - DNA, 20 bp, Artificial
  CRISPR gRNA sequence
catgataatcaagattgatt

SEQ ID NO: 803908 - DNA, 20 bp, Artificial
  CRISPR gRNA sequence
atgataatcaagattgattt

SEQ ID NO: 803909 - DNA, 20 bp, Artificial
  CRISPR gRNA sequence
atttctccaccagtatggta

SEQ ID NO: 803910 - DNA, 20 bp, Artificial
  CRISPR gRNA sequence
ctccaccagtatggtaattt

SEQ ID NO: 803911 - DNA, 20 bp, Artificial
  CRISPR gRNA sequence
tccaccagtatggtaatttt

SEQ ID NO: 803912 - DNA, 20 bp, Artificial
  CRISPR gRNA sequence
caccagtatggtaatttttt

SEQ ID NO: 803913 - DNA, 20 bp, Artificial
  CRISPR gRNA sequence
ttttctttgctcactggtct

SEQ ID NO: 803914 - DNA, 20 bp, Artificial
  CRISPR gRNA sequence
tttctttgctcactggtctg

SEQ ID NO: 803915 - DNA, 20 bp, Artificial
  CRISPR gRNA sequence
ttctttgctcactggtctgc

SEQ ID NO: 803916 - DNA, 20 bp, Artificial
  CRISPR gRNA sequence
tctttgctcactggtctgcc

SEQ ID NO: 803917 - DNA, 20 bp, Artificial
  CRISPR gRNA sequence
ctttgctcactggtctgcca

SEQ ID NO: 803918 - DNA, 20 bp, Artificial
  CRISPR gRNA sequence
tttgctcactggtctgccaa

SEQ ID NO: 803919 - DNA, 20 bp, Artificial
  CRISPR gRNA sequence
tgctcactggtctgccaata

SEQ ID NO: 803920 - DNA, 20 bp, Artificial
  CRISPR gRNA sequence
gctcactggtctgccaatat

SEQ ID NO: 803921 - DNA, 20 bp, Artificial
  CRISPR gRNA sequence
ctcactggtctgccaatatt

SEQ ID NO: 803922 - DNA, 20 bp, Artificial
  CRISPR gRNA sequence
actggtctgccaatattaag

SEQ ID NO: 803923 - DNA, 20 bp, Artificial
  CRISPR gRNA sequence
gtctgccaatattaagagct

SEQ ID NO: 803924 - DNA, 20 bp, Artificial
  CRISPR gRNA sequence
ccaatattaagagctcaagg

SEQ ID NO: 803925 - DNA, 20 bp, Artificial
  CRISPR gRNA sequence
agagctcaaggtggccaggc

SEQ ID NO: 803926 - DNA, 20 bp, Artificial
  CRISPR gRNA sequence
aaggtggccaggccagtagc

SEQ ID NO: 803927 - DNA, 20 bp, Artificial
  CRISPR gRNA sequence
tagatgcagtagaacaagca

SEQ ID NO: 803928 - DNA, 20 bp, Artificial
  CRISPR gRNA sequence
agatgcagtagaacaagcag

SEQ ID NO: 803929 - DNA, 20 bp, Artificial
  CRISPR gRNA sequence
gatgcagtagaacaagcaga

SEQ ID NO: 803930 - DNA, 20 bp, Artificial
  CRISPR gRNA sequence
ctagaattccccgtaggaag

SEQ ID NO: 803931 - DNA, 20 bp, Artificial
  CRISPR gRNA sequence
gaattccccgtaggaagcca

SEQ ID NO: 803932 - DNA, 20 bp, Artificial
  CRISPR gRNA sequence
cccgtaggaagccagacctt

SEQ ID NO: 803933 - DNA, 20 bp, Artificial
  CRISPR gRNA sequence
tgattcagcagagcctaaat

SEQ ID NO: 803934 - DNA, 20 bp, Artificial
  CRISPR gRNA sequence
gattcagcagagcctaaatg

SEQ ID NO: 803935 - DNA, 20 bp, Artificial
  CRISPR gRNA sequence
attcagcagagcctaaatgt

SEQ ID NO: 803936 - DNA, 20 bp, Artificial
  CRISPR gRNA sequence
agcagagcctaaatgtgtgg

SEQ ID NO: 803937 - DNA, 20 bp, Artificial
  CRISPR gRNA sequence
aatgtgtggggttgagtgaa

SEQ ID NO: 803938 - DNA, 20 bp, Artificial
  CRISPR gRNA sequence
agtgaacttctatacgtgag

SEQ ID NO: 803939 - DNA, 20 bp, Artificial
  CRISPR gRNA sequence
ctatacgtgagtcattagaa

SEQ ID NO: 803940 - DNA, 20 bp, Artificial
  CRISPR gRNA sequence
tatacgtgagtcattagaag

SEQ ID NO: 803941 - DNA, 20 bp, Artificial
  CRISPR gRNA sequence
tacgtgagtcattagaagta

SEQ ID NO: 803942 - DNA, 20 bp, Artificial
  CRISPR gRNA sequence
gaagtaatggtgagaggggc

SEQ ID NO: 803943 - DNA, 20 bp, Artificial
  CRISPR gRNA sequence
cagcactgggatagccctgg

SEQ ID NO: 803944 - DNA, 20 bp, Artificial
  CRISPR gRNA sequence
ggatagccctggtacagacg

SEQ ID NO: 803945 - DNA, 20 bp, Artificial
  CRISPR gRNA sequence
gtacagacgtagaacatgct

SEQ ID NO: 803946 - DNA, 20 bp, Artificial
  CRISPR gRNA sequence
gaggaggttgtcaggaggaa

SEQ ID NO: 803947 - DNA, 20 bp, Artificial
  CRISPR gRNA sequence
aggaggttgtcaggaggaaa

SEQ ID NO: 803948 - DNA, 20 bp, Artificial
  CRISPR gRNA sequence
tcaggaggaaatgagttaga

SEQ ID NO: 803949 - DNA, 20 bp, Artificial
  CRISPR gRNA sequence
gaccttgcacagaactacca

SEQ ID NO: 803950 - DNA, 20 bp, Artificial
  CRISPR gRNA sequence
gcacagaactaccaccatca

SEQ ID NO: 803951 - DNA, 20 bp, Artificial
  CRISPR gRNA sequence
cacagaactaccaccatcaa

SEQ ID NO: 803952 - DNA, 20 bp, Artificial
  CRISPR gRNA sequence
ccaccatcaagtacagttgg

SEQ ID NO: 803953 - DNA, 20 bp, Artificial
  CRISPR gRNA sequence
gggtgaggcagacatggtat

SEQ ID NO: 803954 - DNA, 20 bp, Artificial
  CRISPR gRNA sequence
aggcatcagagatatctgat

SEQ ID NO: 803955 - DNA, 20 bp, Artificial
  CRISPR gRNA sequence
atgctttatgccaaattaaa

SEQ ID NO: 803956 - DNA, 20 bp, Artificial
  CRISPR gRNA sequence
tatgccaaattaaaattaat

SEQ ID NO: 803957 - DNA, 20 bp, Artificial
  CRISPR gRNA sequence
atgccaaattaaaattaatt

SEQ ID NO: 803958 - DNA, 20 bp, Artificial
  CRISPR gRNA sequence
tgccaaattaaaattaattt

SEQ ID NO: 803959 - DNA, 20 bp, Artificial
  CRISPR gRNA sequence
aaattaattttttcatggag

SEQ ID NO: 803960 - DNA, 20 bp, Artificial
  CRISPR gRNA sequence
attttttcatggagtgacac

SEQ ID NO: 803961 - DNA, 20 bp, Artificial
  CRISPR gRNA sequence
tttcatggagtgacactgat

SEQ ID NO: 803962 - DNA, 20 bp, Artificial
  CRISPR gRNA sequence
ttcatggagtgacactgatc

SEQ ID NO: 803963 - DNA, 20 bp, Artificial
  CRISPR gRNA sequence
tcatggagtgacactgatcc

SEQ ID NO: 803964 - DNA, 20 bp, Artificial
  CRISPR gRNA sequence
catggagtgacactgatcca

SEQ ID NO: 803965 - DNA, 20 bp, Artificial
  CRISPR gRNA sequence
atggagtgacactgatccac

SEQ ID NO: 803966 - DNA, 20 bp, Artificial
  CRISPR gRNA sequence
atccacagaccagactccaa

SEQ ID NO: 803967 - DNA, 20 bp, Artificial
  CRISPR gRNA sequence
caagaactttgcagtgacta

SEQ ID NO: 803968 - DNA, 20 bp, Artificial
  CRISPR gRNA sequence
tgcagtgactaaatacccat

SEQ ID NO: 803969 - DNA, 20 bp, Artificial
  CRISPR gRNA sequence
gcagtgactaaatacccatc

SEQ ID NO: 803970 - DNA, 20 bp, Artificial
  CRISPR gRNA sequence
cagtgactaaatacccatct

SEQ ID NO: 803971 - DNA, 20 bp, Artificial
  CRISPR gRNA sequence
aatacccatctcatcataac

SEQ ID NO: 803972 - DNA, 20 bp, Artificial
  CRISPR gRNA sequence
atcataactttcctggtatt

SEQ ID NO: 803973 - DNA, 20 bp, Artificial
  CRISPR gRNA sequence
tcctggtattttcttctgga

SEQ ID NO: 803974 - DNA, 20 bp, Artificial
  CRISPR gRNA sequence
cctggtattttcttctggaa

SEQ ID NO: 803975 - DNA, 20 bp, Artificial
  CRISPR gRNA sequence
ctggtattttcttctggaaa

SEQ ID NO: 803976 - DNA, 20 bp, Artificial
  CRISPR gRNA sequence
gtattttcttctggaaaaaa

SEQ ID NO: 803977 - DNA, 20 bp, Artificial
  CRISPR gRNA sequence
tcttctggaaaaaattcttc

SEQ ID NO: 803978 - DNA, 20 bp, Artificial
  CRISPR gRNA sequence
cttctggaaaaaattcttcc

SEQ ID NO: 803979 - DNA, 20 bp, Artificial
  CRISPR gRNA sequence
ttctggaaaaaattcttccc

SEQ ID NO: 803980 - DNA, 20 bp, Artificial
  CRISPR gRNA sequence
ctggaaaaaattcttccctg

SEQ ID NO: 803981 - DNA, 20 bp, Artificial
  CRISPR gRNA sequence
tggaaaaaattcttccctga

SEQ ID NO: 803982 - DNA, 20 bp, Artificial
  CRISPR gRNA sequence
gaaaaaattcttccctgata

SEQ ID NO: 803983 - DNA, 20 bp, Artificial
  CRISPR gRNA sequence
ttccctgatacagttttcag

SEQ ID NO: 803984 - DNA, 20 bp, Artificial
  CRISPR gRNA sequence
ccctgatacagttttcagag

SEQ ID NO: 803985 - DNA, 20 bp, Artificial
  CRISPR gRNA sequence
cctgatacagttttcagagg

SEQ ID NO: 803986 - DNA, 20 bp, Artificial
  CRISPR gRNA sequence
atacagttttcagaggcagc

SEQ ID NO: 803987 - DNA, 20 bp, Artificial
  CRISPR gRNA sequence
tcagaggcagctagatgcac

SEQ ID NO: 803988 - DNA, 20 bp, Artificial
  CRISPR gRNA sequence
cagaggcagctagatgcact

SEQ ID NO: 803989 - DNA, 20 bp, Artificial
  CRISPR gRNA sequence
agaggcagctagatgcactg

SEQ ID NO: 803990 - DNA, 20 bp, Artificial
  CRISPR gRNA sequence
gatgcactgtcatctctccc

SEQ ID NO: 803991 - DNA, 20 bp, Artificial
  CRISPR gRNA sequence
tcatctctccccttttccca

SEQ ID NO: 803992 - DNA, 20 bp, Artificial
  CRISPR gRNA sequence
tccccttttcccacttccct

SEQ ID NO: 803993 - DNA, 20 bp, Artificial
  CRISPR gRNA sequence
cccttttcccacttccctac

SEQ ID NO: 803994 - DNA, 20 bp, Artificial
  CRISPR gRNA sequence
ttcccacttccctacctatc

SEQ ID NO: 803995 - DNA, 20 bp, Artificial
  CRISPR gRNA sequence
tcccacttccctacctatcc

SEQ ID NO: 803996 - DNA, 20 bp, Artificial
  CRISPR gRNA sequence
cccacttccctacctatcca

SEQ ID NO: 803997 - DNA, 20 bp, Artificial
  CRISPR gRNA sequence
ccacttccctacctatccac

SEQ ID NO: 803998 - DNA, 20 bp, Artificial
  CRISPR gRNA sequence
ccctacctatccacaattta

SEQ ID NO: 803999 - DNA, 20 bp, Artificial
  CRISPR gRNA sequence
cctacctatccacaatttac

SEQ ID NO: 804000 - DNA, 20 bp, Artificial
  CRISPR gRNA sequence
cctatccacaatttactacc

SEQ ID NO: 804001 - DNA, 20 bp, Artificial
  CRISPR gRNA sequence
tccacaatttactacccaat

SEQ ID NO: 804002 - DNA, 20 bp, Artificial
  CRISPR gRNA sequence
actacccaatgccaacacta

SEQ ID NO: 804003 - DNA, 20 bp, Artificial
  CRISPR gRNA sequence
ctacccaatgccaacactaa

SEQ ID NO: 804004 - DNA, 20 bp, Artificial
  CRISPR gRNA sequence
cccaatgccaacactaaagt

SEQ ID NO: 804005 - DNA, 20 bp, Artificial
  CRISPR gRNA sequence
aagttagcccaacttccttc

SEQ ID NO: 804006 - DNA, 20 bp, Artificial
  CRISPR gRNA sequence
gcccaacttccttctaacta

SEQ ID NO: 804007 - DNA, 20 bp, Artificial
  CRISPR gRNA sequence
ccttctaactaaattattag

SEQ ID NO: 804008 - DNA, 20 bp, Artificial
  CRISPR gRNA sequence
cttctaactaaattattagt

SEQ ID NO: 804009 - DNA, 20 bp, Artificial
  CRISPR gRNA sequence
ctaactaaattattagttta

SEQ ID NO: 804010 - DNA, 20 bp, Artificial
  CRISPR gRNA sequence
taactaaattattagtttag

SEQ ID NO: 804011 - DNA, 20 bp, Artificial
  CRISPR gRNA sequence
actaaattattagtttagaa

SEQ ID NO: 804012 - DNA, 20 bp, Artificial
  CRISPR gRNA sequence
aattattagtttagaaggaa

SEQ ID NO: 804013 - DNA, 20 bp, Artificial
  CRISPR gRNA sequence
ttagtttagaaggaaagaga

SEQ ID NO: 804014 - DNA, 20 bp, Artificial
  CRISPR gRNA sequence
gtttagaaggaaagagagga

SEQ ID NO: 804015 - DNA, 20 bp, Artificial
  CRISPR gRNA sequence
agaaggaaagagaggagtca

SEQ ID NO: 804016 - DNA, 20 bp, Artificial
  CRISPR gRNA sequence
gaaggaaagagaggagtcat

SEQ ID NO: 804017 - DNA, 20 bp, Artificial
  CRISPR gRNA sequence
aggatcttaactgaaatcaa

SEQ ID NO: 804018 - DNA, 20 bp, Artificial
  CRISPR gRNA sequence
aactgaaatcaaaacattag

SEQ ID NO: 804019 - DNA, 20 bp, Artificial
  CRISPR gRNA sequence
actgaaatcaaaacattaga

SEQ ID NO: 804020 - DNA, 20 bp, Artificial
  CRISPR gRNA sequence
aaatcaaaacattagaggct

SEQ ID NO: 804021 - DNA, 20 bp, Artificial
  CRISPR gRNA sequence
gaggctgggcatggtggttc

SEQ ID NO: 804022 - DNA, 20 bp, Artificial
  CRISPR gRNA sequence
ggcatggtggttcttgtctg

SEQ ID NO: 804023 - DNA, 20 bp, Artificial
  CRISPR gRNA sequence
ttgtctgtaatcccagcact

SEQ ID NO: 804024 - DNA, 20 bp, Artificial
  CRISPR gRNA sequence
gtctgtaatcccagcacttt

SEQ ID NO: 804025 - DNA, 20 bp, Artificial
  CRISPR gRNA sequence
tctgtaatcccagcactttg

SEQ ID NO: 804026 - DNA, 20 bp, Artificial
  CRISPR gRNA sequence
taatcccagcactttgggag

SEQ ID NO: 804027 - DNA, 20 bp, Artificial
  CRISPR gRNA sequence
tgggaggccaaggcaggagg

SEQ ID NO: 804028 - DNA, 20 bp, Artificial
  CRISPR gRNA sequence
gggaggccaaggcaggagga

SEQ ID NO: 804029 - DNA, 20 bp, Artificial
  CRISPR gRNA sequence
ggaggccaaggcaggaggat

SEQ ID NO: 804030 - DNA, 20 bp, Artificial
  CRISPR gRNA sequence
gagcccagtagattgaggtt

SEQ ID NO: 804031 - DNA, 20 bp, Artificial
  CRISPR gRNA sequence
agcccagtagattgaggtta

SEQ ID NO: 804032 - DNA, 20 bp, Artificial
  CRISPR gRNA sequence
aggttacagtgagctacaat

SEQ ID NO: 804033 - DNA, 20 bp, Artificial
  CRISPR gRNA sequence
cagtgagctacaattgtgcc

SEQ ID NO: 804034 - DNA, 20 bp, Artificial
  CRISPR gRNA sequence
caattgtgccattgtactcc

SEQ ID NO: 804035 - DNA, 20 bp, Artificial
  CRISPR gRNA sequence
tgccattgtactccactcca

SEQ ID NO: 804036 - DNA, 20 bp, Artificial
  CRISPR gRNA sequence
tactccactccagcctgggc

SEQ ID NO: 804037 - DNA, 20 bp, Artificial
  CRISPR gRNA sequence
cactccagcctgggcaaccg

SEQ ID NO: 804038 - DNA, 20 bp, Artificial
  CRISPR gRNA sequence
cagcctgggcaaccgagtga

SEQ ID NO: 804039 - DNA, 20 bp, Artificial
  CRISPR gRNA sequence
ggcaaccgagtgagactctg

SEQ ID NO: 804040 - DNA, 20 bp, Artificial
  CRISPR gRNA sequence
tgtctccaaaaaagaaaagg

SEQ ID NO: 804041 - DNA, 20 bp, Artificial
  CRISPR gRNA sequence
tctccaaaaaagaaaaggaa

SEQ ID NO: 804042 - DNA, 20 bp, Artificial
  CRISPR gRNA sequence
caaaaaagaaaaggaaaggg

SEQ ID NO: 804043 - DNA, 20 bp, Artificial
  CRISPR gRNA sequence
gaaatccatcaattttagga

SEQ ID NO: 804044 - DNA, 20 bp, Artificial
  CRISPR gRNA sequence
taggaccaacttcaggtaaa

SEQ ID NO: 804045 - DNA, 20 bp, Artificial
  CRISPR gRNA sequence
aggaccaacttcaggtaaaa

SEQ ID NO: 804046 - DNA, 20 bp, Artificial
  CRISPR gRNA sequence
ggaccaacttcaggtaaaaa

SEQ ID NO: 804047 - DNA, 20 bp, Artificial
  CRISPR gRNA sequence
caggtaaaaaaatgaattag

SEQ ID NO: 804048 - DNA, 20 bp, Artificial
  CRISPR gRNA sequence
aggtaaaaaaatgaattagg

SEQ ID NO: 804049 - DNA, 20 bp, Artificial
  CRISPR gRNA sequence
ggcaagttggtctttcaaca

SEQ ID NO: 804050 - DNA, 20 bp, Artificial
  CRISPR gRNA sequence
gtctttcaacattctctacc

SEQ ID NO: 804051 - DNA, 20 bp, Artificial
  CRISPR gRNA sequence
tcaacattctctacctctct

SEQ ID NO: 804052 - DNA, 20 bp, Artificial
  CRISPR gRNA sequence
caacattctctacctctctt

SEQ ID NO: 804053 - DNA, 20 bp, Artificial
  CRISPR gRNA sequence
aacattctctacctctcttt

SEQ ID NO: 804054 - DNA, 20 bp, Artificial
  CRISPR gRNA sequence
tctacctctctttatatcat

SEQ ID NO: 804055 - DNA, 20 bp, Artificial
  CRISPR gRNA sequence
tacctctctttatatcatgg

SEQ ID NO: 804056 - DNA, 20 bp, Artificial
  CRISPR gRNA sequence
cctctctttatatcatggtt

SEQ ID NO: 804057 - DNA, 20 bp, Artificial
  CRISPR gRNA sequence
tctttatatcatggttgaga

SEQ ID NO: 804058 - DNA, 20 bp, Artificial
  CRISPR gRNA sequence
tttatatcatggttgagacc

SEQ ID NO: 804059 - DNA, 20 bp, Artificial
  CRISPR gRNA sequence
tatatcatggttgagaccac

SEQ ID NO: 804060 - DNA, 20 bp, Artificial
  CRISPR gRNA sequence
atatcatggttgagaccaca

SEQ ID NO: 804061 - DNA, 20 bp, Artificial
  CRISPR gRNA sequence
tatcatggttgagaccacag

SEQ ID NO: 804062 - DNA, 20 bp, Artificial
  CRISPR gRNA sequence
agaccacagacttctcacct

SEQ ID NO: 804063 - DNA, 20 bp, Artificial
  CRISPR gRNA sequence
ctcacctcatgaaagatgaa

SEQ ID NO: 804064 - DNA, 20 bp, Artificial
  CRISPR gRNA sequence
tcacctcatgaaagatgaac

SEQ ID NO: 804065 - DNA, 20 bp, Artificial
  CRISPR gRNA sequence
acctcatgaaagatgaactc

SEQ ID NO: 804066 - DNA, 20 bp, Artificial
  CRISPR gRNA sequence
atgaaagatgaactctaact

SEQ ID NO: 804067 - DNA, 20 bp, Artificial
  CRISPR gRNA sequence
taactaattcatactaaagc

SEQ ID NO: 804068 - DNA, 20 bp, Artificial
  CRISPR gRNA sequence
actaattcatactaaagcta

SEQ ID NO: 804069 - DNA, 20 bp, Artificial
  CRISPR gRNA sequence
attcatactaaagctaaagc

SEQ ID NO: 804070 - DNA, 20 bp, Artificial
  CRISPR gRNA sequence
atactaaagctaaagcctct

SEQ ID NO: 804071 - DNA, 20 bp, Artificial
  CRISPR gRNA sequence
aagctaaagcctctaaagag

SEQ ID NO: 804072 - DNA, 20 bp, Artificial
  CRISPR gRNA sequence
aagcctctaaagaggattaa

SEQ ID NO: 804073 - DNA, 20 bp, Artificial
  CRISPR gRNA sequence
taaagaggattaaatatgag

SEQ ID NO: 804074 - DNA, 20 bp, Artificial
  CRISPR gRNA sequence
aagaggattaaatatgagca

SEQ ID NO: 804075 - DNA, 20 bp, Artificial
  CRISPR gRNA sequence
aatatgagcaatcccacgag

SEQ ID NO: 804076 - DNA, 20 bp, Artificial
  CRISPR gRNA sequence
ttttcccctggaattgttta

SEQ ID NO: 804077 - DNA, 20 bp, Artificial
  CRISPR gRNA sequence
tttcccctggaattgtttat

SEQ ID NO: 804078 - DNA, 20 bp, Artificial
  CRISPR gRNA sequence
ttcccctggaattgtttatt

SEQ ID NO: 804079 - DNA, 20 bp, Artificial
  CRISPR gRNA sequence
tcccctggaattgtttattc

SEQ ID NO: 804080 - DNA, 20 bp, Artificial
  CRISPR gRNA sequence
cccctggaattgtttattca

SEQ ID NO: 804081 - DNA, 20 bp, Artificial
  CRISPR gRNA sequence
ccctggaattgtttattcaa

SEQ ID NO: 804082 - DNA, 20 bp, Artificial
  CRISPR gRNA sequence
gaattgtttattcaactgtc

SEQ ID NO: 804083 - DNA, 20 bp, Artificial
  CRISPR gRNA sequence
tttattcaactgtcgttcgt

SEQ ID NO: 804084 - DNA, 20 bp, Artificial
  CRISPR gRNA sequence
attcaactgtcgttcgttat

SEQ ID NO: 804085 - DNA, 20 bp, Artificial
  CRISPR gRNA sequence
ttcaactgtcgttcgttata

SEQ ID NO: 804086 - DNA, 20 bp, Artificial
  CRISPR gRNA sequence
aactgtcgttcgttatatgg

SEQ ID NO: 804087 - DNA, 20 bp, Artificial
  CRISPR gRNA sequence
tcgttcgttatatggaattt

SEQ ID NO: 804088 - DNA, 20 bp, Artificial
  CRISPR gRNA sequence
gttatatggaatttcctgcc

SEQ ID NO: 804089 - DNA, 20 bp, Artificial
  CRISPR gRNA sequence
tatggaatttcctgcctggt

SEQ ID NO: 804090 - DNA, 20 bp, Artificial
  CRISPR gRNA sequence
cctgcctggttaagtgtagg

SEQ ID NO: 804091 - DNA, 20 bp, Artificial
  CRISPR gRNA sequence
ctgcctggttaagtgtaggc

SEQ ID NO: 804092 - DNA, 20 bp, Artificial
  CRISPR gRNA sequence
cctggttaagtgtaggccag

SEQ ID NO: 804093 - DNA, 20 bp, Artificial
  CRISPR gRNA sequence
gttaagtgtaggccagtact

SEQ ID NO: 804094 - DNA, 20 bp, Artificial
  CRISPR gRNA sequence
agtgtaggccagtactttgg

SEQ ID NO: 804095 - DNA, 20 bp, Artificial
  CRISPR gRNA sequence
tggatgaattgtagttttct

SEQ ID NO: 804096 - DNA, 20 bp, Artificial
  CRISPR gRNA sequence
ggatgaattgtagttttcta

SEQ ID NO: 804097 - DNA, 20 bp, Artificial
  CRISPR gRNA sequence
gatgaattgtagttttctag

SEQ ID NO: 804098 - DNA, 20 bp, Artificial
  CRISPR gRNA sequence
tagttttctagaaagacgct

SEQ ID NO: 804099 - DNA, 20 bp, Artificial
  CRISPR gRNA sequence
tctagaaagacgcttcttat

SEQ ID NO: 804100 - DNA, 20 bp, Artificial
  CRISPR gRNA sequence
ctagaaagacgcttcttata

SEQ ID NO: 804101 - DNA, 20 bp, Artificial
  CRISPR gRNA sequence
tagaaagacgcttcttatat

SEQ ID NO: 804102 - DNA, 20 bp, Artificial
  CRISPR gRNA sequence
gaaagacgcttcttatataa

SEQ ID NO: 804103 - DNA, 20 bp, Artificial
  CRISPR gRNA sequence
cttatataagaacctctcca

SEQ ID NO: 804104 - DNA, 20 bp, Artificial
  CRISPR gRNA sequence
ttatataagaacctctccag

SEQ ID NO: 804105 - DNA, 20 bp, Artificial
  CRISPR gRNA sequence
atataagaacctctccaggg

SEQ ID NO: 804106 - DNA, 20 bp, Artificial
  CRISPR gRNA sequence
tataagaacctctccaggga

SEQ ID NO: 804107 - DNA, 20 bp, Artificial
  CRISPR gRNA sequence
tccagggaaacaggggcctg

SEQ ID NO: 804108 - DNA, 20 bp, Artificial
  CRISPR gRNA sequence
cagggaaacaggggcctgta

SEQ ID NO: 804109 - DNA, 20 bp, Artificial
  CRISPR gRNA sequence
tatgagatgaattgagaaat

SEQ ID NO: 804110 - DNA, 20 bp, Artificial
  CRISPR gRNA sequence
agaaataactttacaccact

SEQ ID NO: 804111 - DNA, 20 bp, Artificial
  CRISPR gRNA sequence
tacaccactgattatgtcag

SEQ ID NO: 804112 - DNA, 20 bp, Artificial
  CRISPR gRNA sequence
acaccactgattatgtcagt

SEQ ID NO: 804113 - DNA, 20 bp, Artificial
  CRISPR gRNA sequence
caccactgattatgtcagtg

SEQ ID NO: 804114 - DNA, 20 bp, Artificial
  CRISPR gRNA sequence
attatgtcagtgttctattc

SEQ ID NO: 804115 - DNA, 20 bp, Artificial
  CRISPR gRNA sequence
tgtcagtgttctattctgca

SEQ ID NO: 804116 - DNA, 20 bp, Artificial
  CRISPR gRNA sequence
tattctgcatggtagagatg

SEQ ID NO: 804117 - DNA, 20 bp, Artificial
  CRISPR gRNA sequence
ttctgcatggtagagatgtg

SEQ ID NO: 804118 - DNA, 20 bp, Artificial
  CRISPR gRNA sequence
tgcatggtagagatgtgaaa

SEQ ID NO: 804119 - DNA, 20 bp, Artificial
  CRISPR gRNA sequence
catggtagagatgtgaaagg

SEQ ID NO: 804120 - DNA, 20 bp, Artificial
  CRISPR gRNA sequence
accattgctctggaagcctt

SEQ ID NO: 804121 - DNA, 20 bp, Artificial
  CRISPR gRNA sequence
ctctggaagcctttacgctg

SEQ ID NO: 804122 - DNA, 20 bp, Artificial
  CRISPR gRNA sequence
tggaagcctttacgctgtga

SEQ ID NO: 804123 - DNA, 20 bp, Artificial
  CRISPR gRNA sequence
gaagcctttacgctgtgaga

SEQ ID NO: 804124 - DNA, 20 bp, Artificial
  CRISPR gRNA sequence
tacgctgtgagaagttaaca

SEQ ID NO: 804125 - DNA, 20 bp, Artificial
  CRISPR gRNA sequence
acgctgtgagaagttaacag

SEQ ID NO: 804126 - DNA, 20 bp, Artificial
  CRISPR gRNA sequence
cgctgtgagaagttaacagt

SEQ ID NO: 804127 - DNA, 20 bp, Artificial
  CRISPR gRNA sequence
tgagaagttaacagtggagt

SEQ ID NO: 804128 - DNA, 20 bp, Artificial
  CRISPR gRNA sequence
acagtggagtaaaatggcca

SEQ ID NO: 804129 - DNA, 20 bp, Artificial
  CRISPR gRNA sequence
cactctcttcatggaagcca

SEQ ID NO: 804130 - DNA, 20 bp, Artificial
  CRISPR gRNA sequence
tcttcatggaagccaacatg

SEQ ID NO: 804131 - DNA, 20 bp, Artificial
  CRISPR gRNA sequence
ttcatggaagccaacatggc

SEQ ID NO: 804132 - DNA, 20 bp, Artificial
  CRISPR gRNA sequence
catggaagccaacatggctt

SEQ ID NO: 804133 - DNA, 20 bp, Artificial
  CRISPR gRNA sequence
atggaagccaacatggctta

SEQ ID NO: 804134 - DNA, 20 bp, Artificial
  CRISPR gRNA sequence
actaaatagtcaacaaccat

SEQ ID NO: 804135 - DNA, 20 bp, Artificial
  CRISPR gRNA sequence
ctaaatagtcaacaaccatg

SEQ ID NO: 804136 - DNA, 20 bp, Artificial
  CRISPR gRNA sequence
aatagtcaacaaccatggga

SEQ ID NO: 804137 - DNA, 20 bp, Artificial
  CRISPR gRNA sequence
tggggtcttcatcagagctc

SEQ ID NO: 804138 - DNA, 20 bp, Artificial
  CRISPR gRNA sequence
catcagagctcaggatctcc

SEQ ID NO: 804139 - DNA, 20 bp, Artificial
  CRISPR gRNA sequence
atcagagctcaggatctcct

SEQ ID NO: 804140 - DNA, 20 bp, Artificial
  CRISPR gRNA sequence
aggatctcctagggtatcac

SEQ ID NO: 804141 - DNA, 20 bp, Artificial
  CRISPR gRNA sequence
ctagggtatcactcataaat

SEQ ID NO: 804142 - DNA, 20 bp, Artificial
  CRISPR gRNA sequence
gggtatcactcataaataca

SEQ ID NO: 804143 - DNA, 20 bp, Artificial
  CRISPR gRNA sequence
ataaatacagccatcaggga

SEQ ID NO: 804144 - DNA, 20 bp, Artificial
  CRISPR gRNA sequence
tgtgcagccagaaattctca

SEQ ID NO: 804145 - DNA, 20 bp, Artificial
  CRISPR gRNA sequence
gtgcagccagaaattctcaa

SEQ ID NO: 804146 - DNA, 20 bp, Artificial
  CRISPR gRNA sequence
tgcagccagaaattctcaac

SEQ ID NO: 804147 - DNA, 20 bp, Artificial
  CRISPR gRNA sequence
tcaacctggttttacccatc

SEQ ID NO: 804148 - DNA, 20 bp, Artificial
  CRISPR gRNA sequence
aacctggttttacccatcct

SEQ ID NO: 804149 - DNA, 20 bp, Artificial
  CRISPR gRNA sequence
gttttacccatccttcccaa

SEQ ID NO: 804150 - DNA, 20 bp, Artificial
  CRISPR gRNA sequence
tacccatccttcccaacttt

SEQ ID NO: 804151 - DNA, 20 bp, Artificial
  CRISPR gRNA sequence
acccatccttcccaactttg

SEQ ID NO: 804152 - DNA, 20 bp, Artificial
  CRISPR gRNA sequence
cccatccttcccaactttgt

SEQ ID NO: 804153 - DNA, 20 bp, Artificial
  CRISPR gRNA sequence
cccaactttgtattcgtcct

SEQ ID NO: 804154 - DNA, 20 bp, Artificial
  CRISPR gRNA sequence
ccaactttgtattcgtccta

SEQ ID NO: 804155 - DNA, 20 bp, Artificial
  CRISPR gRNA sequence
tgtattcgtcctactgttta

SEQ ID NO: 804156 - DNA, 20 bp, Artificial
  CRISPR gRNA sequence
gtattcgtcctactgtttac

SEQ ID NO: 804157 - DNA, 20 bp, Artificial
  CRISPR gRNA sequence
tattcgtcctactgtttact

SEQ ID NO: 804158 - DNA, 20 bp, Artificial
  CRISPR gRNA sequence
gtcctactgtttactgacat

SEQ ID NO: 804159 - DNA, 20 bp, Artificial
  CRISPR gRNA sequence
ctgtttactgacatggatcc

SEQ ID NO: 804160 - DNA, 20 bp, Artificial
  CRISPR gRNA sequence
tttactgacatggatcctct

SEQ ID NO: 804161 - DNA, 20 bp, Artificial
  CRISPR gRNA sequence
actgacatggatcctctgct

SEQ ID NO: 804162 - DNA, 20 bp, Artificial
  CRISPR gRNA sequence
ctgacatggatcctctgctt

SEQ ID NO: 804163 - DNA, 20 bp, Artificial
  CRISPR gRNA sequence
acatggatcctctgcttcat

SEQ ID NO: 804164 - DNA, 20 bp, Artificial
  CRISPR gRNA sequence
tgcttcattaaccatccctt

SEQ ID NO: 804165 - DNA, 20 bp, Artificial
  CRISPR gRNA sequence
cttcattaaccatcccttcc

SEQ ID NO: 804166 - DNA, 20 bp, Artificial
  CRISPR gRNA sequence
cattaaccatcccttcctca

SEQ ID NO: 804167 - DNA, 20 bp, Artificial
  CRISPR gRNA sequence
attaaccatcccttcctcac

SEQ ID NO: 804168 - DNA, 20 bp, Artificial
  CRISPR gRNA sequence
accatcccttcctcaccaca

SEQ ID NO: 804169 - DNA, 20 bp, Artificial
  CRISPR gRNA sequence
cctcaccacatgctctctga

SEQ ID NO: 804170 - DNA, 20 bp, Artificial
  CRISPR gRNA sequence
ctcaccacatgctctctgaa

SEQ ID NO: 804171 - DNA, 20 bp, Artificial
  CRISPR gRNA sequence
accacatgctctctgaactt

SEQ ID NO: 804172 - DNA, 20 bp, Artificial
  CRISPR gRNA sequence
tctgaacttggctgcacctt

SEQ ID NO: 804173 - DNA, 20 bp, Artificial
  CRISPR gRNA sequence
tgaacttggctgcacctttt

SEQ ID NO: 804174 - DNA, 20 bp, Artificial
  CRISPR gRNA sequence
aacttggctgcaccttttct

SEQ ID NO: 804175 - DNA, 20 bp, Artificial
  CRISPR gRNA sequence
ggctgcaccttttctacctc

SEQ ID NO: 804176 - DNA, 20 bp, Artificial
  CRISPR gRNA sequence
gctgcaccttttctacctcc

SEQ ID NO: 804177 - DNA, 20 bp, Artificial
  CRISPR gRNA sequence
caccttttctacctccatgc

SEQ ID NO: 804178 - DNA, 20 bp, Artificial
  CRISPR gRNA sequence
ttctacctccatgccttctt

SEQ ID NO: 804179 - DNA, 20 bp, Artificial
  CRISPR gRNA sequence
tctacctccatgccttcttt

SEQ ID NO: 804180 - DNA, 20 bp, Artificial
  CRISPR gRNA sequence
ctacctccatgccttctttg

SEQ ID NO: 804181 - DNA, 20 bp, Artificial
  CRISPR gRNA sequence
tacctccatgccttctttgc

SEQ ID NO: 804182 - DNA, 20 bp, Artificial
  CRISPR gRNA sequence
cctccatgccttctttgctc

SEQ ID NO: 804183 - DNA, 20 bp, Artificial
  CRISPR gRNA sequence
catgccttctttgctcaggt

SEQ ID NO: 804184 - DNA, 20 bp, Artificial
  CRISPR gRNA sequence
ctttgctcaggtttttccac

SEQ ID NO: 804185 - DNA, 20 bp, Artificial
  CRISPR gRNA sequence
tttgctcaggtttttccaca

SEQ ID NO: 804186 - DNA, 20 bp, Artificial
  CRISPR gRNA sequence
tgctcaggtttttccacata

SEQ ID NO: 804187 - DNA, 20 bp, Artificial
  CRISPR gRNA sequence
gctcaggtttttccacataa

SEQ ID NO: 804188 - DNA, 20 bp, Artificial
  CRISPR gRNA sequence
ctcaggtttttccacataaa

SEQ ID NO: 804189 - DNA, 20 bp, Artificial
  CRISPR gRNA sequence
aggtttttccacataaatat

SEQ ID NO: 804190 - DNA, 20 bp, Artificial
  CRISPR gRNA sequence
ttccacataaatatcattat

SEQ ID NO: 804191 - DNA, 20 bp, Artificial
  CRISPR gRNA sequence
tccacataaatatcattatt

SEQ ID NO: 804192 - DNA, 20 bp, Artificial
  CRISPR gRNA sequence
ccacataaatatcattattt

SEQ ID NO: 804193 - DNA, 20 bp, Artificial
  CRISPR gRNA sequence
cacataaatatcattatttc

SEQ ID NO: 804194 - DNA, 20 bp, Artificial
  CRISPR gRNA sequence
tttccctctctactagctcc

SEQ ID NO: 804195 - DNA, 20 bp, Artificial
  CRISPR gRNA sequence
ccctctctactagctccaag

SEQ ID NO: 804196 - DNA, 20 bp, Artificial
  CRISPR gRNA sequence
cctctctactagctccaagc

SEQ ID NO: 804197 - DNA, 20 bp, Artificial
  CRISPR gRNA sequence
tctactagctccaagcccac

SEQ ID NO: 804198 - DNA, 20 bp, Artificial
  CRISPR gRNA sequence
tactagctccaagcccaccc

SEQ ID NO: 804199 - DNA, 20 bp, Artificial
  CRISPR gRNA sequence
ctagctccaagcccaccctc

SEQ ID NO: 804200 - DNA, 20 bp, Artificial
  CRISPR gRNA sequence
gctccaagcccaccctctct

SEQ ID NO: 804201 - DNA, 20 bp, Artificial
  CRISPR gRNA sequence
caagcccaccctctctctgg

SEQ ID NO: 804202 - DNA, 20 bp, Artificial
  CRISPR gRNA sequence
tctctggggcagctcagtca

SEQ ID NO: 804203 - DNA, 20 bp, Artificial
  CRISPR gRNA sequence
tctggggcagctcagtcact

SEQ ID NO: 804204 - DNA, 20 bp, Artificial
  CRISPR gRNA sequence
tggggcagctcagtcactcc

SEQ ID NO: 804205 - DNA, 20 bp, Artificial
  CRISPR gRNA sequence
gggcagctcagtcactccag

SEQ ID NO: 804206 - DNA, 20 bp, Artificial
  CRISPR gRNA sequence
agtcactccagggcacaagg

SEQ ID NO: 804207 - DNA, 20 bp, Artificial
  CRISPR gRNA sequence
cagggcacaagggggtcttt

SEQ ID NO: 804208 - DNA, 20 bp, Artificial
  CRISPR gRNA sequence
tccctcatcccacattttga

SEQ ID NO: 804209 - DNA, 20 bp, Artificial
  CRISPR gRNA sequence
ccctcatcccacattttgag

SEQ ID NO: 804210 - DNA, 20 bp, Artificial
  CRISPR gRNA sequence
cctcatcccacattttgaga

SEQ ID NO: 804211 - DNA, 20 bp, Artificial
  CRISPR gRNA sequence
atcccacattttgagaccta

SEQ ID NO: 804212 - DNA, 20 bp, Artificial
  CRISPR gRNA sequence
tgagacctactacctggacc

SEQ ID NO: 804213 - DNA, 20 bp, Artificial
  CRISPR gRNA sequence
gagacctactacctggacca

SEQ ID NO: 804214 - DNA, 20 bp, Artificial
  CRISPR gRNA sequence
agacctactacctggaccat

SEQ ID NO: 804215 - DNA, 20 bp, Artificial
  CRISPR gRNA sequence
ctacctggaccatttgtttg

SEQ ID NO: 804216 - DNA, 20 bp, Artificial
  CRISPR gRNA sequence
cctggaccatttgtttgcct

SEQ ID NO: 804217 - DNA, 20 bp, Artificial
  CRISPR gRNA sequence
gaccatttgtttgccttgta

SEQ ID NO: 804218 - DNA, 20 bp, Artificial
  CRISPR gRNA sequence
gtttgccttgtaactatgct

SEQ ID NO: 804219 - DNA, 20 bp, Artificial
  CRISPR gRNA sequence
tttgccttgtaactatgctt

SEQ ID NO: 804220 - DNA, 20 bp, Artificial
  CRISPR gRNA sequence
gccttgtaactatgcttgcc

SEQ ID NO: 804221 - DNA, 20 bp, Artificial
  CRISPR gRNA sequence
ccttgtaactatgcttgcct

SEQ ID NO: 804222 - DNA, 20 bp, Artificial
  CRISPR gRNA sequence
gtaactatgcttgccttttt

SEQ ID NO: 804223 - DNA, 20 bp, Artificial
  CRISPR gRNA sequence
taactatgcttgccttttta

SEQ ID NO: 804224 - DNA, 20 bp, Artificial
  CRISPR gRNA sequence
tgcttgcctttttaattgct

SEQ ID NO: 804225 - DNA, 20 bp, Artificial
  CRISPR gRNA sequence
gcctttttaattgctatttt

SEQ ID NO: 804226 - DNA, 20 bp, Artificial
  CRISPR gRNA sequence
cctttttaattgctatttta

SEQ ID NO: 804227 - DNA, 20 bp, Artificial
  CRISPR gRNA sequence
tttaattgctattttatttt

SEQ ID NO: 804228 - DNA, 20 bp, Artificial
  CRISPR gRNA sequence
ttaattgctattttattttc

SEQ ID NO: 804229 - DNA, 20 bp, Artificial
  CRISPR gRNA sequence
taattgctattttattttcc

SEQ ID NO: 804230 - DNA, 20 bp, Artificial
  CRISPR gRNA sequence
aattgctattttattttcca

SEQ ID NO: 804231 - DNA, 20 bp, Artificial
  CRISPR gRNA sequence
attgctattttattttccat

SEQ ID NO: 804232 - DNA, 20 bp, Artificial
  CRISPR gRNA sequence
ctattttattttccatgtat

SEQ ID NO: 804233 - DNA, 20 bp, Artificial
  CRISPR gRNA sequence
ttttattttccatgtatttt

SEQ ID NO: 804234 - DNA, 20 bp, Artificial
  CRISPR gRNA sequence
tattttccatgtattttcat

SEQ ID NO: 804235 - DNA, 20 bp, Artificial
  CRISPR gRNA sequence
attttccatgtattttcatt

SEQ ID NO: 804236 - DNA, 20 bp, Artificial
  CRISPR gRNA sequence
ttttccatgtattttcattg

SEQ ID NO: 804237 - DNA, 20 bp, Artificial
  CRISPR gRNA sequence
tccatgtattttcattgttc

SEQ ID NO: 804238 - DNA, 20 bp, Artificial
  CRISPR gRNA sequence
ccatgtattttcattgttca

SEQ ID NO: 804239 - DNA, 20 bp, Artificial
  CRISPR gRNA sequence
catgtattttcattgttcac

SEQ ID NO: 804240 - DNA, 20 bp, Artificial
  CRISPR gRNA sequence
tcattgttcacacaagtctt

SEQ ID NO: 804241 - DNA, 20 bp, Artificial
  CRISPR gRNA sequence
cattgttcacacaagtcttc

SEQ ID NO: 804242 - DNA, 20 bp, Artificial
  CRISPR gRNA sequence
attgttcacacaagtcttct

SEQ ID NO: 804243 - DNA, 20 bp, Artificial
  CRISPR gRNA sequence
ttcacacaagtcttctttat

SEQ ID NO: 804244 - DNA, 20 bp, Artificial
  CRISPR gRNA sequence
acacaagtcttctttattcc

SEQ ID NO: 804245 - DNA, 20 bp, Artificial
  CRISPR gRNA sequence
ctttattccacactaaggca

SEQ ID NO: 804246 - DNA, 20 bp, Artificial
  CRISPR gRNA sequence
tttattccacactaaggcaa

SEQ ID NO: 804247 - DNA, 20 bp, Artificial
  CRISPR gRNA sequence
tattccacactaaggcaaaa

SEQ ID NO: 804248 - DNA, 20 bp, Artificial
  CRISPR gRNA sequence
attccacactaaggcaaaag

SEQ ID NO: 804249 - DNA, 20 bp, Artificial
  CRISPR gRNA sequence
ttccacactaaggcaaaagc

SEQ ID NO: 804250 - DNA, 20 bp, Artificial
  CRISPR gRNA sequence
cacactaaggcaaaagcaga

SEQ ID NO: 804251 - DNA, 20 bp, Artificial
  CRISPR gRNA sequence
aggcaaaagcagagtcctgt

SEQ ID NO: 804252 - DNA, 20 bp, Artificial
  CRISPR gRNA sequence
tgttcataataagtgctcaa

SEQ ID NO: 804253 - DNA, 20 bp, Artificial
  CRISPR gRNA sequence
ataataagtgctcaacaaat

SEQ ID NO: 804254 - DNA, 20 bp, Artificial
  CRISPR gRNA sequence
aacaaatgttgggttgattg

SEQ ID NO: 804255 - DNA, 20 bp, Artificial
  CRISPR gRNA sequence
ggttgattgggttggagatt

SEQ ID NO: 804256 - DNA, 20 bp, Artificial
  CRISPR gRNA sequence
attgggttggagattccatc

SEQ ID NO: 804257 - DNA, 20 bp, Artificial
  CRISPR gRNA sequence
ggttggagattccatcttag

SEQ ID NO: 804258 - DNA, 20 bp, Artificial
  CRISPR gRNA sequence
gagattccatcttagataat

SEQ ID NO: 804259 - DNA, 20 bp, Artificial
  CRISPR gRNA sequence
catcttagataatcgcagtc

SEQ ID NO: 804260 - DNA, 20 bp, Artificial
  CRISPR gRNA sequence
agataatcgcagtcccatca

SEQ ID NO: 804261 - DNA, 20 bp, Artificial
  CRISPR gRNA sequence
gataatcgcagtcccatcat

SEQ ID NO: 804262 - DNA, 20 bp, Artificial
  CRISPR gRNA sequence
ccagactgtgtggacagcca

SEQ ID NO: 804263 - DNA, 20 bp, Artificial
  CRISPR gRNA sequence
tgtggacagccaggtcagag

SEQ ID NO: 804264 - DNA, 20 bp, Artificial
  CRISPR gRNA sequence
tagcttgtggcacaaatacc

SEQ ID NO: 804265 - DNA, 20 bp, Artificial
  CRISPR gRNA sequence
gcttgtggcacaaataccag

SEQ ID NO: 804266 - DNA, 20 bp, Artificial
  CRISPR gRNA sequence
gtggcacaaataccagcaac

SEQ ID NO: 804267 - DNA, 20 bp, Artificial
  CRISPR gRNA sequence
tggcacaaataccagcaaca

SEQ ID NO: 804268 - DNA, 20 bp, Artificial
  CRISPR gRNA sequence
cctctgagttcctggcttct

SEQ ID NO: 804269 - DNA, 20 bp, Artificial
  CRISPR gRNA sequence
tgagttcctggcttctattt

SEQ ID NO: 804270 - DNA, 20 bp, Artificial
  CRISPR gRNA sequence
agttcctggcttctatttct

SEQ ID NO: 804271 - DNA, 20 bp, Artificial
  CRISPR gRNA sequence
ctggcttctatttctcaagg

SEQ ID NO: 804272 - DNA, 20 bp, Artificial
  CRISPR gRNA sequence
gcttctatttctcaagggca

SEQ ID NO: 804273 - DNA, 20 bp, Artificial
  CRISPR gRNA sequence
ctatttctcaagggcatttt

SEQ ID NO: 804274 - DNA, 20 bp, Artificial
  CRISPR gRNA sequence
tatttctcaagggcattttt

SEQ ID NO: 804275 - DNA, 20 bp, Artificial
  CRISPR gRNA sequence
tttctcaagggcatttttaa

SEQ ID NO: 804276 - DNA, 20 bp, Artificial
  CRISPR gRNA sequence
ctcaagggcatttttaagtt

SEQ ID NO: 804277 - DNA, 20 bp, Artificial
  CRISPR gRNA sequence
tcaagggcatttttaagttg

SEQ ID NO: 804278 - DNA, 20 bp, Artificial
  CRISPR gRNA sequence
aagggcatttttaagttgtc

SEQ ID NO: 804279 - DNA, 20 bp, Artificial
  CRISPR gRNA sequence
ttaagttgtcttatgactgt

SEQ ID NO: 804280 - DNA, 20 bp, Artificial
  CRISPR gRNA sequence
taagttgtcttatgactgtt

SEQ ID NO: 804281 - DNA, 20 bp, Artificial
  CRISPR gRNA sequence
aagttgtcttatgactgttc

SEQ ID NO: 804282 - DNA, 20 bp, Artificial
  CRISPR gRNA sequence
agttgtcttatgactgttcc

SEQ ID NO: 804283 - DNA, 20 bp, Artificial
  CRISPR gRNA sequence
tcttatgactgttccctttc

SEQ ID NO: 804284 - DNA, 20 bp, Artificial
  CRISPR gRNA sequence
atgactgttccctttctact

SEQ ID NO: 804285 - DNA, 20 bp, Artificial
  CRISPR gRNA sequence
tgactgttccctttctactc

SEQ ID NO: 804286 - DNA, 20 bp, Artificial
  CRISPR gRNA sequence
ttccctttctactcattctc

SEQ ID NO: 804287 - DNA, 20 bp, Artificial
  CRISPR gRNA sequence
cctttctactcattctcata

SEQ ID NO: 804288 - DNA, 20 bp, Artificial
  CRISPR gRNA sequence
tctactcattctcataaatt

SEQ ID NO: 804289 - DNA, 20 bp, Artificial
  CRISPR gRNA sequence
ctactcattctcataaattg

SEQ ID NO: 804290 - DNA, 20 bp, Artificial
  CRISPR gRNA sequence
tactcattctcataaattga

SEQ ID NO: 804291 - DNA, 20 bp, Artificial
  CRISPR gRNA sequence
ctcattctcataaattgagc

SEQ ID NO: 804292 - DNA, 20 bp, Artificial
  CRISPR gRNA sequence
attctcataaattgagctgt

SEQ ID NO: 804293 - DNA, 20 bp, Artificial
  CRISPR gRNA sequence
tcataaattgagctgtggac

SEQ ID NO: 804294 - DNA, 20 bp, Artificial
  CRISPR gRNA sequence
ataaattgagctgtggactg

SEQ ID NO: 804295 - DNA, 20 bp, Artificial
  CRISPR gRNA sequence
agctgtggactgctgtgacc

SEQ ID NO: 804296 - DNA, 20 bp, Artificial
  CRISPR gRNA sequence
tggactgctgtgacccacaa

SEQ ID NO: 804297 - DNA, 20 bp, Artificial
  CRISPR gRNA sequence
ctgtgacccacaagcttctc

SEQ ID NO: 804298 - DNA, 20 bp, Artificial
  CRISPR gRNA sequence
tgacccacaagcttctccgg

SEQ ID NO: 804299 - DNA, 20 bp, Artificial
  CRISPR gRNA sequence
ctccggaagtcaatgtataa

SEQ ID NO: 804300 - DNA, 20 bp, Artificial
  CRISPR gRNA sequence
tccggaagtcaatgtataaa

SEQ ID NO: 804301 - DNA, 20 bp, Artificial
  CRISPR gRNA sequence
cggaagtcaatgtataaaac

SEQ ID NO: 804302 - DNA, 20 bp, Artificial
  CRISPR gRNA sequence
cactgactctagaatggatg

SEQ ID NO: 804303 - DNA, 20 bp, Artificial
  CRISPR gRNA sequence
actctagaatggatgactga

SEQ ID NO: 804304 - DNA, 20 bp, Artificial
  CRISPR gRNA sequence
tagaatggatgactgaacat

SEQ ID NO: 804305 - DNA, 20 bp, Artificial
  CRISPR gRNA sequence
gaatggatgactgaacattc

SEQ ID NO: 804306 - DNA, 20 bp, Artificial
  CRISPR gRNA sequence
aacattccaaatttcaagca

SEQ ID NO: 804307 - DNA, 20 bp, Artificial
  CRISPR gRNA sequence
caaatttcaagcacaagtta

SEQ ID NO: 804308 - DNA, 20 bp, Artificial
  CRISPR gRNA sequence
caagcacaagttagggagca

SEQ ID NO: 804309 - DNA, 20 bp, Artificial
  CRISPR gRNA sequence
aagcacaagttagggagcaa

SEQ ID NO: 804310 - DNA, 20 bp, Artificial
  CRISPR gRNA sequence
gggagcaacagatcattttc

SEQ ID NO: 804311 - DNA, 20 bp, Artificial
  CRISPR gRNA sequence
tccttttgaaatagggtttc

SEQ ID NO: 804312 - DNA, 20 bp, Artificial
  CRISPR gRNA sequence
ccttttgaaatagggtttct

SEQ ID NO: 804313 - DNA, 20 bp, Artificial
  CRISPR gRNA sequence
cttttgaaatagggtttctt

SEQ ID NO: 804314 - DNA, 20 bp, Artificial
  CRISPR gRNA sequence
ttgaaatagggtttcttctg

SEQ ID NO: 804315 - DNA, 20 bp, Artificial
  CRISPR gRNA sequence
tgaaatagggtttcttctgc

SEQ ID NO: 804316 - DNA, 20 bp, Artificial
  CRISPR gRNA sequence
gaaatagggtttcttctgct

SEQ ID NO: 804317 - DNA, 20 bp, Artificial
  CRISPR gRNA sequence
aaatagggtttcttctgctc

SEQ ID NO: 804318 - DNA, 20 bp, Artificial
  CRISPR gRNA sequence
cttctgctcagccagttgtt

SEQ ID NO: 804319 - DNA, 20 bp, Artificial
  CRISPR gRNA sequence
ttctgctcagccagttgttg

SEQ ID NO: 804320 - DNA, 20 bp, Artificial
  CRISPR gRNA sequence
ctgctcagccagttgttgta

SEQ ID NO: 804321 - DNA, 20 bp, Artificial
  CRISPR gRNA sequence
tgctcagccagttgttgtat

SEQ ID NO: 804322 - DNA, 20 bp, Artificial
  CRISPR gRNA sequence
ctcagccagttgttgtattt

SEQ ID NO: 804323 - DNA, 20 bp, Artificial
  CRISPR gRNA sequence
agccagttgttgtattttca

SEQ ID NO: 804324 - DNA, 20 bp, Artificial
  CRISPR gRNA sequence
ttgtattttcattaggaaat

SEQ ID NO: 804325 - DNA, 20 bp, Artificial
  CRISPR gRNA sequence
tattttcattaggaaatgga

SEQ ID NO: 804326 - DNA, 20 bp, Artificial
  CRISPR gRNA sequence
tcattaggaaatggaatggg

SEQ ID NO: 804327 - DNA, 20 bp, Artificial
  CRISPR gRNA sequence
cattaggaaatggaatggga

SEQ ID NO: 804328 - DNA, 20 bp, Artificial
  CRISPR gRNA sequence
attaggaaatggaatgggac

SEQ ID NO: 804329 - DNA, 20 bp, Artificial
  CRISPR gRNA sequence
ggaaatggaatgggactaca

SEQ ID NO: 804330 - DNA, 20 bp, Artificial
  CRISPR gRNA sequence
cagcacaaaaaataaatata

SEQ ID NO: 804331 - DNA, 20 bp, Artificial
  CRISPR gRNA sequence
gtagggctggcagaaaagag

SEQ ID NO: 804332 - DNA, 20 bp, Artificial
  CRISPR gRNA sequence
tagggctggcagaaaagaga

SEQ ID NO: 804333 - DNA, 20 bp, Artificial
  CRISPR gRNA sequence
gcagaaaagagaatccttcc

SEQ ID NO: 804334 - DNA, 20 bp, Artificial
  CRISPR gRNA sequence
cctaggagacctggaggtga

SEQ ID NO: 804335 - DNA, 20 bp, Artificial
  CRISPR gRNA sequence
ctaggagacctggaggtgat

SEQ ID NO: 804336 - DNA, 20 bp, Artificial
  CRISPR gRNA sequence
ggagacctggaggtgattcc

SEQ ID NO: 804337 - DNA, 20 bp, Artificial
  CRISPR gRNA sequence
gaggtgattccaggcagtgg

SEQ ID NO: 804338 - DNA, 20 bp, Artificial
  CRISPR gRNA sequence
caggcagtggttgagagcat

SEQ ID NO: 804339 - DNA, 20 bp, Artificial
  CRISPR gRNA sequence
agagcatgggctctgatgtc

SEQ ID NO: 804340 - DNA, 20 bp, Artificial
  CRISPR gRNA sequence
tgatgtcagacaggcttaaa

SEQ ID NO: 804341 - DNA, 20 bp, Artificial
  CRISPR gRNA sequence
atgtcagacaggcttaaatt

SEQ ID NO: 804342 - DNA, 20 bp, Artificial
  CRISPR gRNA sequence
aaatttcaaactctctctct

SEQ ID NO: 804343 - DNA, 20 bp, Artificial
  CRISPR gRNA sequence
aatttcaaactctctctcta

SEQ ID NO: 804344 - DNA, 20 bp, Artificial
  CRISPR gRNA sequence
caaactctctctctattagc

SEQ ID NO: 804345 - DNA, 20 bp, Artificial
  CRISPR gRNA sequence
aaactctctctctattagct

SEQ ID NO: 804346 - DNA, 20 bp, Artificial
  CRISPR gRNA sequence
tctctctattagctttgaga

SEQ ID NO: 804347 - DNA, 20 bp, Artificial
  CRISPR gRNA sequence
tctctattagctttgagaac

SEQ ID NO: 804348 - DNA, 20 bp, Artificial
  CRISPR gRNA sequence
tctattagctttgagaacct

SEQ ID NO: 804349 - DNA, 20 bp, Artificial
  CRISPR gRNA sequence
tattagctttgagaacctaa

SEQ ID NO: 804350 - DNA, 20 bp, Artificial
  CRISPR gRNA sequence
ttagctttgagaacctaaat

SEQ ID NO: 804351 - DNA, 20 bp, Artificial
  CRISPR gRNA sequence
gctttgagaacctaaatatc

SEQ ID NO: 804352 - DNA, 20 bp, Artificial
  CRISPR gRNA sequence
tgagaacctaaatatcctac

SEQ ID NO: 804353 - DNA, 20 bp, Artificial
  CRISPR gRNA sequence
gagaacctaaatatcctact

SEQ ID NO: 804354 - DNA, 20 bp, Artificial
  CRISPR gRNA sequence
agaacctaaatatcctactt

SEQ ID NO: 804355 - DNA, 20 bp, Artificial
  CRISPR gRNA sequence
aatatcctacttagccactc

SEQ ID NO: 804356 - DNA, 20 bp, Artificial
  CRISPR gRNA sequence
cttagccactctagcactca

SEQ ID NO: 804357 - DNA, 20 bp, Artificial
  CRISPR gRNA sequence
agccactctagcactcagtc

SEQ ID NO: 804358 - DNA, 20 bp, Artificial
  CRISPR gRNA sequence
gccactctagcactcagtct

SEQ ID NO: 804359 - DNA, 20 bp, Artificial
  CRISPR gRNA sequence
tagcactcagtctctcatgt

SEQ ID NO: 804360 - DNA, 20 bp, Artificial
  CRISPR gRNA sequence
gcactcagtctctcatgtgt

SEQ ID NO: 804361 - DNA, 20 bp, Artificial
  CRISPR gRNA sequence
agtctctcatgtgtagcatg

SEQ ID NO: 804362 - DNA, 20 bp, Artificial
  CRISPR gRNA sequence
tcatgtgtagcatgagggtg

SEQ ID NO: 804363 - DNA, 20 bp, Artificial
  CRISPR gRNA sequence
atgtgtagcatgagggtgag

SEQ ID NO: 804364 - DNA, 20 bp, Artificial
  CRISPR gRNA sequence
atagggttatagtgaggatt

SEQ ID NO: 804365 - DNA, 20 bp, Artificial
  CRISPR gRNA sequence
tagggttatagtgaggatta

SEQ ID NO: 804366 - DNA, 20 bp, Artificial
  CRISPR gRNA sequence
tagtgaggattaaatgaaat

SEQ ID NO: 804367 - DNA, 20 bp, Artificial
  CRISPR gRNA sequence
aatgaaatgtgcttataaag

SEQ ID NO: 804368 - DNA, 20 bp, Artificial
  CRISPR gRNA sequence
ataaagtgcttagtactcag

SEQ ID NO: 804369 - DNA, 20 bp, Artificial
  CRISPR gRNA sequence
taaagtgcttagtactcaga

SEQ ID NO: 804370 - DNA, 20 bp, Artificial
  CRISPR gRNA sequence
agtactcagaaagtgtgcaa

SEQ ID NO: 804371 - DNA, 20 bp, Artificial
  CRISPR gRNA sequence
gtactcagaaagtgtgcaaa

SEQ ID NO: 804372 - DNA, 20 bp, Artificial
  CRISPR gRNA sequence
agaaagtgtgcaaacagtaa

SEQ ID NO: 804373 - DNA, 20 bp, Artificial
  CRISPR gRNA sequence
gcaagttgcatgccttactt

SEQ ID NO: 804374 - DNA, 20 bp, Artificial
  CRISPR gRNA sequence
catgccttacttgtgagttc

SEQ ID NO: 804375 - DNA, 20 bp, Artificial
  CRISPR gRNA sequence
acttgtgagttcatgaagtt

SEQ ID NO: 804376 - DNA, 20 bp, Artificial
  CRISPR gRNA sequence
cttgtgagttcatgaagttg

SEQ ID NO: 804377 - DNA, 20 bp, Artificial
  CRISPR gRNA sequence
gtgagttcatgaagttgtgg

SEQ ID NO: 804378 - DNA, 20 bp, Artificial
  CRISPR gRNA sequence
tgagttcatgaagttgtggc

SEQ ID NO: 804379 - DNA, 20 bp, Artificial
  CRISPR gRNA sequence
atgaagttgtggcaaggata

SEQ ID NO: 804380 - DNA, 20 bp, Artificial
  CRISPR gRNA sequence
tggcaaggataagacaaata

SEQ ID NO: 804381 - DNA, 20 bp, Artificial
  CRISPR gRNA sequence
tttgccattgcatcattata

SEQ ID NO: 804382 - DNA, 20 bp, Artificial
  CRISPR gRNA sequence
ttgccattgcatcattatat

SEQ ID NO: 804383 - DNA, 20 bp, Artificial
  CRISPR gRNA sequence
tgccattgcatcattatatc

SEQ ID NO: 804384 - DNA, 20 bp, Artificial
  CRISPR gRNA sequence
gccattgcatcattatatca

SEQ ID NO: 804385 - DNA, 20 bp, Artificial
  CRISPR gRNA sequence
ccattgcatcattatatcat

SEQ ID NO: 804386 - DNA, 20 bp, Artificial
  CRISPR gRNA sequence
catcattatatcattgctaa

SEQ ID NO: 804387 - DNA, 20 bp, Artificial
  CRISPR gRNA sequence
tatcattgctaagagtatgc

SEQ ID NO: 804388 - DNA, 20 bp, Artificial
  CRISPR gRNA sequence
ctaagagtatgccattattg

SEQ ID NO: 804389 - DNA, 20 bp, Artificial
  CRISPR gRNA sequence
agagtatgccattattggcc

SEQ ID NO: 804390 - DNA, 20 bp, Artificial
  CRISPR gRNA sequence
ttggccaggtgcggtggctc

SEQ ID NO: 804391 - DNA, 20 bp, Artificial
  CRISPR gRNA sequence
gccaggtgcggtggctcatg

SEQ ID NO: 804392 - DNA, 20 bp, Artificial
  CRISPR gRNA sequence
atgcctgtaatcctagcact

SEQ ID NO: 804393 - DNA, 20 bp, Artificial
  CRISPR gRNA sequence
taatcctagcactttgggag

SEQ ID NO: 804394 - DNA, 20 bp, Artificial
  CRISPR gRNA sequence
gcactttgggaggctgagat

SEQ ID NO: 804395 - DNA, 20 bp, Artificial
  CRISPR gRNA sequence
tgggaggctgagatgggtgg

SEQ ID NO: 804396 - DNA, 20 bp, Artificial
  CRISPR gRNA sequence
gggaggctgagatgggtgga

SEQ ID NO: 804397 - DNA, 20 bp, Artificial
  CRISPR gRNA sequence
ggaggctgagatgggtggat

SEQ ID NO: 804398 - DNA, 20 bp, Artificial
  CRISPR gRNA sequence
agatgggtggattgcttgag

SEQ ID NO: 804399 - DNA, 20 bp, Artificial
  CRISPR gRNA sequence
cttgaggccaggagttcaaa

SEQ ID NO: 804400 - DNA, 20 bp, Artificial
  CRISPR gRNA sequence
gaggccaggagttcaaaaat

SEQ ID NO: 804401 - DNA, 20 bp, Artificial
  CRISPR gRNA sequence
aggccaggagttcaaaaatc

SEQ ID NO: 804402 - DNA, 20 bp, Artificial
  CRISPR gRNA sequence
aaaaatcagcctggctaaca

SEQ ID NO: 804403 - DNA, 20 bp, Artificial
  CRISPR gRNA sequence
gctaacatggtgaaaccccg

SEQ ID NO: 804404 - DNA, 20 bp, Artificial
  CRISPR gRNA sequence
acatggtgaaaccccgtctc

SEQ ID NO: 804405 - DNA, 20 bp, Artificial
  CRISPR gRNA sequence
tactaaaaatacaaaaaatt

SEQ ID NO: 804406 - DNA, 20 bp, Artificial
  CRISPR gRNA sequence
ctaaaaatacaaaaaattag

SEQ ID NO: 804407 - DNA, 20 bp, Artificial
  CRISPR gRNA sequence
aaaatacaaaaaattagcca

SEQ ID NO: 804408 - DNA, 20 bp, Artificial
  CRISPR gRNA sequence
gccaggcatggtggcaggtg

SEQ ID NO: 804409 - DNA, 20 bp, Artificial
  CRISPR gRNA sequence
taatcccagctactcaagag

SEQ ID NO: 804410 - DNA, 20 bp, Artificial
  CRISPR gRNA sequence
ctcaagaggccgaggcagga

SEQ ID NO: 804411 - DNA, 20 bp, Artificial
  CRISPR gRNA sequence
aagaggccgaggcaggagaa

SEQ ID NO: 804412 - DNA, 20 bp, Artificial
  CRISPR gRNA sequence
gaacccaggaggcggaggtt

SEQ ID NO: 804413 - DNA, 20 bp, Artificial
  CRISPR gRNA sequence
aacccaggaggcggaggttg

SEQ ID NO: 804414 - DNA, 20 bp, Artificial
  CRISPR gRNA sequence
cagtgagccaagatcatgcc

SEQ ID NO: 804415 - DNA, 20 bp, Artificial
  CRISPR gRNA sequence
cactccagcctgggcaacaa

SEQ ID NO: 804416 - DNA, 20 bp, Artificial
  CRISPR gRNA sequence
cagcctgggcaacaagaggg

SEQ ID NO: 804417 - DNA, 20 bp, Artificial
  CRISPR gRNA sequence
ggcaacaagagggaaactcc

SEQ ID NO: 804418 - DNA, 20 bp, Artificial
  CRISPR gRNA sequence
cttctcaaataaataaatta

SEQ ID NO: 804419 - DNA, 20 bp, Artificial
  CRISPR gRNA sequence
ctcaaataaataaattaatt

SEQ ID NO: 804420 - DNA, 20 bp, Artificial
  CRISPR gRNA sequence
tcaaataaataaattaatta

SEQ ID NO: 804421 - DNA, 20 bp, Artificial
  CRISPR gRNA sequence
aaataaataaattaattaat

SEQ ID NO: 804422 - DNA, 20 bp, Artificial
  CRISPR gRNA sequence
attaattaaattaaagaaac

SEQ ID NO: 804423 - DNA, 20 bp, Artificial
  CRISPR gRNA sequence
attaaattaaagaaacgaca

SEQ ID NO: 804424 - DNA, 20 bp, Artificial
  CRISPR gRNA sequence
aattaaagaaacgacaaaag

SEQ ID NO: 804425 - DNA, 20 bp, Artificial
  CRISPR gRNA sequence
aagaaacgacaaaagagtat

SEQ ID NO: 804426 - DNA, 20 bp, Artificial
  CRISPR gRNA sequence
taaaacaacttagaggaata

SEQ ID NO: 804427 - DNA, 20 bp, Artificial
  CRISPR gRNA sequence
aaaacaacttagaggaatat

SEQ ID NO: 804428 - DNA, 20 bp, Artificial
  CRISPR gRNA sequence
aaacaacttagaggaatatg

SEQ ID NO: 804429 - DNA, 20 bp, Artificial
  CRISPR gRNA sequence
agaggaatatgtatgaggat

SEQ ID NO: 804430 - DNA, 20 bp, Artificial
  CRISPR gRNA sequence
gaggaatatgtatgaggata

SEQ ID NO: 804431 - DNA, 20 bp, Artificial
  CRISPR gRNA sequence
agctaccataatgaagagac

SEQ ID NO: 804432 - DNA, 20 bp, Artificial
  CRISPR gRNA sequence
ccataatgaagagacctcga

SEQ ID NO: 804433 - DNA, 20 bp, Artificial
  CRISPR gRNA sequence
gaaatacagtgagaagcgag

SEQ ID NO: 804434 - DNA, 20 bp, Artificial
  CRISPR gRNA sequence
tcgttccatgtaacactcag

SEQ ID NO: 804435 - DNA, 20 bp, Artificial
  CRISPR gRNA sequence
cgttccatgtaacactcagg

SEQ ID NO: 804436 - DNA, 20 bp, Artificial
  CRISPR gRNA sequence
gttccatgtaacactcaggt

SEQ ID NO: 804437 - DNA, 20 bp, Artificial
  CRISPR gRNA sequence
catgtaacactcaggtggtt

SEQ ID NO: 804438 - DNA, 20 bp, Artificial
  CRISPR gRNA sequence
aggtggttcagagcagctaa

SEQ ID NO: 804439 - DNA, 20 bp, Artificial
  CRISPR gRNA sequence
agagcagctaagcagctatg

SEQ ID NO: 804440 - DNA, 20 bp, Artificial
  CRISPR gRNA sequence
agcagctatgttccatagag

SEQ ID NO: 804441 - DNA, 20 bp, Artificial
  CRISPR gRNA sequence
tgttccatagagtcattcag

SEQ ID NO: 804442 - DNA, 20 bp, Artificial
  CRISPR gRNA sequence
catagagtcattcagtgatc

SEQ ID NO: 804443 - DNA, 20 bp, Artificial
  CRISPR gRNA sequence
agtgatccagattattttca

SEQ ID NO: 804444 - DNA, 20 bp, Artificial
  CRISPR gRNA sequence
ttttcatctgttgctctgcc

SEQ ID NO: 804445 - DNA, 20 bp, Artificial
  CRISPR gRNA sequence
tcatctgttgctctgccatt

SEQ ID NO: 804446 - DNA, 20 bp, Artificial
  CRISPR gRNA sequence
catctgttgctctgccattc

SEQ ID NO: 804447 - DNA, 20 bp, Artificial
  CRISPR gRNA sequence
atctgttgctctgccattct

SEQ ID NO: 804448 - DNA, 20 bp, Artificial
  CRISPR gRNA sequence
ttgctctgccattctccagg

SEQ ID NO: 804449 - DNA, 20 bp, Artificial
  CRISPR gRNA sequence
ctctgccattctccaggatg

SEQ ID NO: 804450 - DNA, 20 bp, Artificial
  CRISPR gRNA sequence
tgccattctccaggatgttg

SEQ ID NO: 804451 - DNA, 20 bp, Artificial
  CRISPR gRNA sequence
ccattctccaggatgttgtc

SEQ ID NO: 804452 - DNA, 20 bp, Artificial
  CRISPR gRNA sequence
tccaggatgttgtccctata

SEQ ID NO: 804453 - DNA, 20 bp, Artificial
  CRISPR gRNA sequence
caggatgttgtccctataaa

SEQ ID NO: 804454 - DNA, 20 bp, Artificial
  CRISPR gRNA sequence
tccctataaaattgtcaaag

SEQ ID NO: 804455 - DNA, 20 bp, Artificial
  CRISPR gRNA sequence
taaaattgtcaaagctcagt

SEQ ID NO: 804456 - DNA, 20 bp, Artificial
  CRISPR gRNA sequence
tcaaagctcagtcagtgcca

SEQ ID NO: 804457 - DNA, 20 bp, Artificial
  CRISPR gRNA sequence
agtcagtgccaaacccatgt

SEQ ID NO: 804458 - DNA, 20 bp, Artificial
  CRISPR gRNA sequence
caaccttcagaaagtaaacg

SEQ ID NO: 804459 - DNA, 20 bp, Artificial
  CRISPR gRNA sequence
aaccttcagaaagtaaacga

SEQ ID NO: 804460 - DNA, 20 bp, Artificial
  CRISPR gRNA sequence
cagaaagtaaacgagtggtg

SEQ ID NO: 804461 - DNA, 20 bp, Artificial
  CRISPR gRNA sequence
agaaagtaaacgagtggtgg

SEQ ID NO: 804462 - DNA, 20 bp, Artificial
  CRISPR gRNA sequence
aatgttttaaggccaagacc

SEQ ID NO: 804463 - DNA, 20 bp, Artificial
  CRISPR gRNA sequence
taaggccaagaccttgaaaa

SEQ ID NO: 804464 - DNA, 20 bp, Artificial
  CRISPR gRNA sequence
aaggccaagaccttgaaaac

SEQ ID NO: 804465 - DNA, 20 bp, Artificial
  CRISPR gRNA sequence
aggccaagaccttgaaaact

SEQ ID NO: 804466 - DNA, 20 bp, Artificial
  CRISPR gRNA sequence
gaaaactcactctcttagcc

SEQ ID NO: 804467 - DNA, 20 bp, Artificial
  CRISPR gRNA sequence
aaaactcactctcttagcct

SEQ ID NO: 804468 - DNA, 20 bp, Artificial
  CRISPR gRNA sequence
actctcttagcctgaactta

SEQ ID NO: 804469 - DNA, 20 bp, Artificial
  CRISPR gRNA sequence
tcttagcctgaacttagatt

SEQ ID NO: 804470 - DNA, 20 bp, Artificial
  CRISPR gRNA sequence
ttagcctgaacttagattac

SEQ ID NO: 804471 - DNA, 20 bp, Artificial
  CRISPR gRNA sequence
agcctgaacttagattacat

SEQ ID NO: 804472 - DNA, 20 bp, Artificial
  CRISPR gRNA sequence
gcctgaacttagattacatg

SEQ ID NO: 804473 - DNA, 20 bp, Artificial
  CRISPR gRNA sequence
aacttagattacatggctgg

SEQ ID NO: 804474 - DNA, 20 bp, Artificial
  CRISPR gRNA sequence
agattacatggctgggccca

SEQ ID NO: 804475 - DNA, 20 bp, Artificial
  CRISPR gRNA sequence
gattacatggctgggcccac

SEQ ID NO: 804476 - DNA, 20 bp, Artificial
  CRISPR gRNA sequence
catggctgggcccacttaac

SEQ ID NO: 804477 - DNA, 20 bp, Artificial
  CRISPR gRNA sequence
ggcccacttaactatagggg

SEQ ID NO: 804478 - DNA, 20 bp, Artificial
  CRISPR gRNA sequence
aactataggggaggcttgga

SEQ ID NO: 804479 - DNA, 20 bp, Artificial
  CRISPR gRNA sequence
actataggggaggcttggaa

SEQ ID NO: 804480 - DNA, 20 bp, Artificial
  CRISPR gRNA sequence
taggggaggcttggaaacat

SEQ ID NO: 804481 - DNA, 20 bp, Artificial
  CRISPR gRNA sequence
ggaaacatagtctctgagaa

SEQ ID NO: 804482 - DNA, 20 bp, Artificial
  CRISPR gRNA sequence
gaaacatagtctctgagaag

SEQ ID NO: 804483 - DNA, 20 bp, Artificial
  CRISPR gRNA sequence
tgagaagccatgtgtccagc

SEQ ID NO: 804484 - DNA, 20 bp, Artificial
  CRISPR gRNA sequence
agaagccatgtgtccagcta

SEQ ID NO: 804485 - DNA, 20 bp, Artificial
  CRISPR gRNA sequence
attccctaatactaaagttg

SEQ ID NO: 804486 - DNA, 20 bp, Artificial
  CRISPR gRNA sequence
cctaatactaaagttgaaag

SEQ ID NO: 804487 - DNA, 20 bp, Artificial
  CRISPR gRNA sequence
atactaaagttgaaagaaag

SEQ ID NO: 804488 - DNA, 20 bp, Artificial
  CRISPR gRNA sequence
aagttgaaagaaagaatgga

SEQ ID NO: 804489 - DNA, 20 bp, Artificial
  CRISPR gRNA sequence
aaagaaagaatggattaacc

SEQ ID NO: 804490 - DNA, 20 bp, Artificial
  CRISPR gRNA sequence
accagcagtataccacaagg

SEQ ID NO: 804491 - DNA, 20 bp, Artificial
  CRISPR gRNA sequence
ggaggatcaggctaggtgga

SEQ ID NO: 804492 - DNA, 20 bp, Artificial
  CRISPR gRNA sequence
ggtggactagaaaagagaca

SEQ ID NO: 804493 - DNA, 20 bp, Artificial
  CRISPR gRNA sequence
gaaaagagacagtcaattca

SEQ ID NO: 804494 - DNA, 20 bp, Artificial
  CRISPR gRNA sequence
agtgcaacaattccatattg

SEQ ID NO: 804495 - DNA, 20 bp, Artificial
  CRISPR gRNA sequence
catattggcacttttcatgt

SEQ ID NO: 804496 - DNA, 20 bp, Artificial
  CRISPR gRNA sequence
gcacttttcatgtagctgtt

SEQ ID NO: 804497 - DNA, 20 bp, Artificial
  CRISPR gRNA sequence
ttcatgtagctgttgcttgg

SEQ ID NO: 804498 - DNA, 20 bp, Artificial
  CRISPR gRNA sequence
tcatgtagctgttgcttggc

SEQ ID NO: 804499 - DNA, 20 bp, Artificial
  CRISPR gRNA sequence
catgtagctgttgcttggct

SEQ ID NO: 804500 - DNA, 20 bp, Artificial
  CRISPR gRNA sequence
atgtagctgttgcttggctc

SEQ ID NO: 804501 - DNA, 20 bp, Artificial
  CRISPR gRNA sequence
ttgcttggctctatctagag

SEQ ID NO: 804502 - DNA, 20 bp, Artificial
  CRISPR gRNA sequence
cttggctctatctagagagg

SEQ ID NO: 804503 - DNA, 20 bp, Artificial
  CRISPR gRNA sequence
ggctctatctagagaggact

SEQ ID NO: 804504 - DNA, 20 bp, Artificial
  CRISPR gRNA sequence
gctctatctagagaggactc

SEQ ID NO: 804505 - DNA, 20 bp, Artificial
  CRISPR gRNA sequence
tatctagagaggactcagag

SEQ ID NO: 804506 - DNA, 20 bp, Artificial
  CRISPR gRNA sequence
tctagagaggactcagaggt

SEQ ID NO: 804507 - DNA, 20 bp, Artificial
  CRISPR gRNA sequence
gagaggactcagaggtagtt

SEQ ID NO: 804508 - DNA, 20 bp, Artificial
  CRISPR gRNA sequence
agaggtagtttagataaggc

SEQ ID NO: 804509 - DNA, 20 bp, Artificial
  CRISPR gRNA sequence
agataaggcctttgccctcc

SEQ ID NO: 804510 - DNA, 20 bp, Artificial
  CRISPR gRNA sequence
gataaggcctttgccctcca

SEQ ID NO: 804511 - DNA, 20 bp, Artificial
  CRISPR gRNA sequence
tgccctccaaatacagtcta

SEQ ID NO: 804512 - DNA, 20 bp, Artificial
  CRISPR gRNA sequence
gccctccaaatacagtctaa

SEQ ID NO: 804513 - DNA, 20 bp, Artificial
  CRISPR gRNA sequence
ccctccaaatacagtctaag

SEQ ID NO: 804514 - DNA, 20 bp, Artificial
  CRISPR gRNA sequence
caaatacagtctaagcagac

SEQ ID NO: 804515 - DNA, 20 bp, Artificial
  CRISPR gRNA sequence
agcagactgatttcctactg

SEQ ID NO: 804516 - DNA, 20 bp, Artificial
  CRISPR gRNA sequence
atttcctactggatgttcaa

SEQ ID NO: 804517 - DNA, 20 bp, Artificial
  CRISPR gRNA sequence
cctactggatgttcaacttt

SEQ ID NO: 804518 - DNA, 20 bp, Artificial
  CRISPR gRNA sequence
ctactggatgttcaactttg

SEQ ID NO: 804519 - DNA, 20 bp, Artificial
  CRISPR gRNA sequence
ctggatgttcaactttggag

SEQ ID NO: 804520 - DNA, 20 bp, Artificial
  CRISPR gRNA sequence
gatgttcaactttggagtct

SEQ ID NO: 804521 - DNA, 20 bp, Artificial
  CRISPR gRNA sequence
aactttggagtcttcaggga

SEQ ID NO: 804522 - DNA, 20 bp, Artificial
  CRISPR gRNA sequence
tggagtcttcagggatgagt

SEQ ID NO: 804523 - DNA, 20 bp, Artificial
  CRISPR gRNA sequence
ggagtcttcagggatgagta

SEQ ID NO: 804524 - DNA, 20 bp, Artificial
  CRISPR gRNA sequence
gagtcttcagggatgagtag

SEQ ID NO: 804525 - DNA, 20 bp, Artificial
  CRISPR gRNA sequence
cagggatgagtagggcttct

SEQ ID NO: 804526 - DNA, 20 bp, Artificial
  CRISPR gRNA sequence
agggatgagtagggcttctg

SEQ ID NO: 804527 - DNA, 20 bp, Artificial
  CRISPR gRNA sequence
ctgtacgtggaagagactat

SEQ ID NO: 804528 - DNA, 20 bp, Artificial
  CRISPR gRNA sequence
tgtacgtggaagagactatg

SEQ ID NO: 804529 - DNA, 20 bp, Artificial
  CRISPR gRNA sequence
tacgtggaagagactatgag

SEQ ID NO: 804530 - DNA, 20 bp, Artificial
  CRISPR gRNA sequence
tgagggaacctgcacaggac

SEQ ID NO: 804531 - DNA, 20 bp, Artificial
  CRISPR gRNA sequence
cacaggacaagggtttgcat

SEQ ID NO: 804532 - DNA, 20 bp, Artificial
  CRISPR gRNA sequence
gcataaagacactgaggtag

SEQ ID NO: 804533 - DNA, 20 bp, Artificial
  CRISPR gRNA sequence
cataaagacactgaggtagg

SEQ ID NO: 804534 - DNA, 20 bp, Artificial
  CRISPR gRNA sequence
aggtagggacctctcctgtt

SEQ ID NO: 804535 - DNA, 20 bp, Artificial
  CRISPR gRNA sequence
tcctgttgtggggacagtga

SEQ ID NO: 804536 - DNA, 20 bp, Artificial
  CRISPR gRNA sequence
ctgttgtggggacagtgaga

SEQ ID NO: 804537 - DNA, 20 bp, Artificial
  CRISPR gRNA sequence
ttgtggggacagtgagaggc

SEQ ID NO: 804538 - DNA, 20 bp, Artificial
  CRISPR gRNA sequence
tggggacagtgagaggccca

SEQ ID NO: 804539 - DNA, 20 bp, Artificial
  CRISPR gRNA sequence
cttgactcacaaagtgctta

SEQ ID NO: 804540 - DNA, 20 bp, Artificial
  CRISPR gRNA sequence
gactcacaaagtgcttacta

SEQ ID NO: 804541 - DNA, 20 bp, Artificial
  CRISPR gRNA sequence
actcacaaagtgcttactaa

SEQ ID NO: 804542 - DNA, 20 bp, Artificial
  CRISPR gRNA sequence
acaaagtgcttactaagcac

SEQ ID NO: 804543 - DNA, 20 bp, Artificial
  CRISPR gRNA sequence
actaagcacttactagaaat

SEQ ID NO: 804544 - DNA, 20 bp, Artificial
  CRISPR gRNA sequence
ctaagcacttactagaaatt

SEQ ID NO: 804545 - DNA, 20 bp, Artificial
  CRISPR gRNA sequence
agcacttactagaaattaag

SEQ ID NO: 804546 - DNA, 20 bp, Artificial
  CRISPR gRNA sequence
actagaaattaagaagcaga

SEQ ID NO: 804547 - DNA, 20 bp, Artificial
  CRISPR gRNA sequence
ctagaaattaagaagcagat

SEQ ID NO: 804548 - DNA, 20 bp, Artificial
  CRISPR gRNA sequence
gaaattaagaagcagattat

SEQ ID NO: 804549 - DNA, 20 bp, Artificial
  CRISPR gRNA sequence
agaagcagattataatcaat

SEQ ID NO: 804550 - DNA, 20 bp, Artificial
  CRISPR gRNA sequence
taatcaatatgggttatcca

SEQ ID NO: 804551 - DNA, 20 bp, Artificial
  CRISPR gRNA sequence
tccaatgtttggatgagcaa

SEQ ID NO: 804552 - DNA, 20 bp, Artificial
  CRISPR gRNA sequence
ggatgagcaaggctccttat

SEQ ID NO: 804553 - DNA, 20 bp, Artificial
  CRISPR gRNA sequence
gatgagcaaggctccttatc

SEQ ID NO: 804554 - DNA, 20 bp, Artificial
  CRISPR gRNA sequence
cttatcttttcttcgttaat

SEQ ID NO: 804555 - DNA, 20 bp, Artificial
  CRISPR gRNA sequence
atcttttcttcgttaatgtt

SEQ ID NO: 804556 - DNA, 20 bp, Artificial
  CRISPR gRNA sequence
tcttttcttcgttaatgtta

SEQ ID NO: 804557 - DNA, 20 bp, Artificial
  CRISPR gRNA sequence
ttcttcgttaatgttaatca

SEQ ID NO: 804558 - DNA, 20 bp, Artificial
  CRISPR gRNA sequence
tcttcgttaatgttaatcac

SEQ ID NO: 804559 - DNA, 20 bp, Artificial
  CRISPR gRNA sequence
cttcgttaatgttaatcaca

SEQ ID NO: 804560 - DNA, 20 bp, Artificial
  CRISPR gRNA sequence
ttcgttaatgttaatcacac

SEQ ID NO: 804561 - DNA, 20 bp, Artificial
  CRISPR gRNA sequence
cgttaatgttaatcacactc

SEQ ID NO: 804562 - DNA, 20 bp, Artificial
  CRISPR gRNA sequence
gttaatgttaatcacactct

SEQ ID NO: 804563 - DNA, 20 bp, Artificial
  CRISPR gRNA sequence
atgttaatcacactcttttg

SEQ ID NO: 804564 - DNA, 20 bp, Artificial
  CRISPR gRNA sequence
atcacactcttttggatgga

SEQ ID NO: 804565 - DNA, 20 bp, Artificial
  CRISPR gRNA sequence
ttttggatggagacaaatat

SEQ ID NO: 804566 - DNA, 20 bp, Artificial
  CRISPR gRNA sequence
ttggatggagacaaatatct

SEQ ID NO: 804567 - DNA, 20 bp, Artificial
  CRISPR gRNA sequence
tggatggagacaaatatctg

SEQ ID NO: 804568 - DNA, 20 bp, Artificial
  CRISPR gRNA sequence
ggatggagacaaatatctgt

SEQ ID NO: 804569 - DNA, 20 bp, Artificial
  CRISPR gRNA sequence
gatggagacaaatatctgtg

SEQ ID NO: 804570 - DNA, 20 bp, Artificial
  CRISPR gRNA sequence
tgggggctgagctttgggtc

SEQ ID NO: 804571 - DNA, 20 bp, Artificial
  CRISPR gRNA sequence
agctttgggtcagatagatc

SEQ ID NO: 804572 - DNA, 20 bp, Artificial
  CRISPR gRNA sequence
tgggtcagatagatctgggt

SEQ ID NO: 804573 - DNA, 20 bp, Artificial
  CRISPR gRNA sequence
gggtcagatagatctgggtt

SEQ ID NO: 804574 - DNA, 20 bp, Artificial
  CRISPR gRNA sequence
ggtcagatagatctgggttt

SEQ ID NO: 804575 - DNA, 20 bp, Artificial
  CRISPR gRNA sequence
ggtttgcaatcctggcattg

SEQ ID NO: 804576 - DNA, 20 bp, Artificial
  CRISPR gRNA sequence
gcaatcctggcattgacttt

SEQ ID NO: 804577 - DNA, 20 bp, Artificial
  CRISPR gRNA sequence
caatcctggcattgactttt

SEQ ID NO: 804578 - DNA, 20 bp, Artificial
  CRISPR gRNA sequence
gcattgacttttacttagca

SEQ ID NO: 804579 - DNA, 20 bp, Artificial
  CRISPR gRNA sequence
acttttacttagcagtgatg

SEQ ID NO: 804580 - DNA, 20 bp, Artificial
  CRISPR gRNA sequence
ttacttagcagtgatgacct

SEQ ID NO: 804581 - DNA, 20 bp, Artificial
  CRISPR gRNA sequence
tacttagcagtgatgacctc

SEQ ID NO: 804582 - DNA, 20 bp, Artificial
  CRISPR gRNA sequence
acttagcagtgatgacctca

SEQ ID NO: 804583 - DNA, 20 bp, Artificial
  CRISPR gRNA sequence
cttagcagtgatgacctcac

SEQ ID NO: 804584 - DNA, 20 bp, Artificial
  CRISPR gRNA sequence
agcagtgatgacctcacata

SEQ ID NO: 804585 - DNA, 20 bp, Artificial
  CRISPR gRNA sequence
gcagtgatgacctcacatag

SEQ ID NO: 804586 - DNA, 20 bp, Artificial
  CRISPR gRNA sequence
acatagattatttagcaact

SEQ ID NO: 804587 - DNA, 20 bp, Artificial
  CRISPR gRNA sequence
tttagcaactctgagactta

SEQ ID NO: 804588 - DNA, 20 bp, Artificial
  CRISPR gRNA sequence
agcaactctgagacttactt

SEQ ID NO: 804589 - DNA, 20 bp, Artificial
  CRISPR gRNA sequence
gcaactctgagacttacttc

SEQ ID NO: 804590 - DNA, 20 bp, Artificial
  CRISPR gRNA sequence
tgagacttacttcctcaact

SEQ ID NO: 804591 - DNA, 20 bp, Artificial
  CRISPR gRNA sequence
agacttacttcctcaactct

SEQ ID NO: 804592 - DNA, 20 bp, Artificial
  CRISPR gRNA sequence
acttcctcaactctaaaatg

SEQ ID NO: 804593 - DNA, 20 bp, Artificial
  CRISPR gRNA sequence
cttcctcaactctaaaatga

SEQ ID NO: 804594 - DNA, 20 bp, Artificial
  CRISPR gRNA sequence
cctcaactctaaaatgaggg

SEQ ID NO: 804595 - DNA, 20 bp, Artificial
  CRISPR gRNA sequence
ctcaactctaaaatgagggg

SEQ ID NO: 804596 - DNA, 20 bp, Artificial
  CRISPR gRNA sequence
aactctaaaatgaggggctc

SEQ ID NO: 804597 - DNA, 20 bp, Artificial
  CRISPR gRNA sequence
taaaatgaggggctcagact

SEQ ID NO: 804598 - DNA, 20 bp, Artificial
  CRISPR gRNA sequence
aaatgaggggctcagactaa

SEQ ID NO: 804599 - DNA, 20 bp, Artificial
  CRISPR gRNA sequence
agactaaataatgtctaatc

SEQ ID NO: 804600 - DNA, 20 bp, Artificial
  CRISPR gRNA sequence
aataatgtctaatctcttct

SEQ ID NO: 804601 - DNA, 20 bp, Artificial
  CRISPR gRNA sequence
atctcttctccagtaaaaca

SEQ ID NO: 804602 - DNA, 20 bp, Artificial
  CRISPR gRNA sequence
ttctccagtaaaacaatccg

SEQ ID NO: 804603 - DNA, 20 bp, Artificial
  CRISPR gRNA sequence
ctccagtaaaacaatccgtg

SEQ ID NO: 804604 - DNA, 20 bp, Artificial
  CRISPR gRNA sequence
tccagtaaaacaatccgtgg

SEQ ID NO: 804605 - DNA, 20 bp, Artificial
  CRISPR gRNA sequence
cagtaaaacaatccgtggtt

SEQ ID NO: 804606 - DNA, 20 bp, Artificial
  CRISPR gRNA sequence
tcagatagcactgtgctgga

SEQ ID NO: 804607 - DNA, 20 bp, Artificial
  CRISPR gRNA sequence
agatagcactgtgctggagg

SEQ ID NO: 804608 - DNA, 20 bp, Artificial
  CRISPR gRNA sequence
tgctggaggtagtggggttt

SEQ ID NO: 804609 - DNA, 20 bp, Artificial
  CRISPR gRNA sequence
gaggtagtggggtttgaggg

SEQ ID NO: 804610 - DNA, 20 bp, Artificial
  CRISPR gRNA sequence
gagggctgggaagttgggag

SEQ ID NO: 804611 - DNA, 20 bp, Artificial
  CRISPR gRNA sequence
agggctgggaagttgggagg

SEQ ID NO: 804612 - DNA, 20 bp, Artificial
  CRISPR gRNA sequence
ggaagttgggaggactgagc

SEQ ID NO: 804613 - DNA, 20 bp, Artificial
  CRISPR gRNA sequence
ggaggactgagcccttcccg

SEQ ID NO: 804614 - DNA, 20 bp, Artificial
  CRISPR gRNA sequence
agcccttcccgctgagcagt

SEQ ID NO: 804615 - DNA, 20 bp, Artificial
  CRISPR gRNA sequence
cccgctgagcagtttcgtcc

SEQ ID NO: 804616 - DNA, 20 bp, Artificial
  CRISPR gRNA sequence
ccgctgagcagtttcgtcca

SEQ ID NO: 804617 - DNA, 20 bp, Artificial
  CRISPR gRNA sequence
agcagtttcgtccagttttt

SEQ ID NO: 804618 - DNA, 20 bp, Artificial
  CRISPR gRNA sequence
cgtccagtttttcctgtacc

SEQ ID NO: 804619 - DNA, 20 bp, Artificial
  CRISPR gRNA sequence
gtccagtttttcctgtacca

SEQ ID NO: 804620 - DNA, 20 bp, Artificial
  CRISPR gRNA sequence
ttcctgtaccagcctgtcat

SEQ ID NO: 804621 - DNA, 20 bp, Artificial
  CRISPR gRNA sequence
tcctgtaccagcctgtcatg

SEQ ID NO: 804622 - DNA, 20 bp, Artificial
  CRISPR gRNA sequence
cctgtaccagcctgtcatgt

SEQ ID NO: 804623 - DNA, 20 bp, Artificial
  CRISPR gRNA sequence
ctgtaccagcctgtcatgtt

SEQ ID NO: 804624 - DNA, 20 bp, Artificial
  CRISPR gRNA sequence
taccagcctgtcatgtttat

SEQ ID NO: 804625 - DNA, 20 bp, Artificial
  CRISPR gRNA sequence
tcatgtttattccatgtgaa

SEQ ID NO: 804626 - DNA, 20 bp, Artificial
  CRISPR gRNA sequence
attccatgtgaatgactcca

SEQ ID NO: 804627 - DNA, 20 bp, Artificial
  CRISPR gRNA sequence
ttccatgtgaatgactccag

SEQ ID NO: 804628 - DNA, 20 bp, Artificial
  CRISPR gRNA sequence
catgtgaatgactccagagg

SEQ ID NO: 804629 - DNA, 20 bp, Artificial
  CRISPR gRNA sequence
cagaggcaaaattcaagctt

SEQ ID NO: 804630 - DNA, 20 bp, Artificial
  CRISPR gRNA sequence
aagcttttgaatagggcaca

SEQ ID NO: 804631 - DNA, 20 bp, Artificial
  CRISPR gRNA sequence
ttgaatagggcacaaattaa

SEQ ID NO: 804632 - DNA, 20 bp, Artificial
  CRISPR gRNA sequence
tgaatagggcacaaattaac

SEQ ID NO: 804633 - DNA, 20 bp, Artificial
  CRISPR gRNA sequence
gaatagggcacaaattaact

SEQ ID NO: 804634 - DNA, 20 bp, Artificial
  CRISPR gRNA sequence
aatagggcacaaattaactt

SEQ ID NO: 804635 - DNA, 20 bp, Artificial
  CRISPR gRNA sequence
acttgagtaccctttcattt

SEQ ID NO: 804636 - DNA, 20 bp, Artificial
  CRISPR gRNA sequence
gagtaccctttcatttccct

SEQ ID NO: 804637 - DNA, 20 bp, Artificial
  CRISPR gRNA sequence
agtaccctttcatttccctg

SEQ ID NO: 804638 - DNA, 20 bp, Artificial
  CRISPR gRNA sequence
tcatttccctgtaggtgaac

SEQ ID NO: 804639 - DNA, 20 bp, Artificial
  CRISPR gRNA sequence
catttccctgtaggtgaaca

SEQ ID NO: 804640 - DNA, 20 bp, Artificial
  CRISPR gRNA sequence
atttccctgtaggtgaacac

SEQ ID NO: 804641 - DNA, 20 bp, Artificial
  CRISPR gRNA sequence
ccctgtaggtgaacactcct

SEQ ID NO: 804642 - DNA, 20 bp, Artificial
  CRISPR gRNA sequence
cctgtaggtgaacactcctc

SEQ ID NO: 804643 - DNA, 20 bp, Artificial
  CRISPR gRNA sequence
taggtgaacactcctctagc

SEQ ID NO: 804644 - DNA, 20 bp, Artificial
  CRISPR gRNA sequence
ctctagccctgccttttgtc

SEQ ID NO: 804645 - DNA, 20 bp, Artificial
  CRISPR gRNA sequence
tagccctgccttttgtcagt

SEQ ID NO: 804646 - DNA, 20 bp, Artificial
  CRISPR gRNA sequence
gccctgccttttgtcagtct

SEQ ID NO: 804647 - DNA, 20 bp, Artificial
  CRISPR gRNA sequence
ccttttgtcagtctggagcc

SEQ ID NO: 804648 - DNA, 20 bp, Artificial
  CRISPR gRNA sequence
ttgtcagtctggagcccttg

SEQ ID NO: 804649 - DNA, 20 bp, Artificial
  CRISPR gRNA sequence
tgtcagtctggagcccttgt

SEQ ID NO: 804650 - DNA, 20 bp, Artificial
  CRISPR gRNA sequence
gtcagtctggagcccttgtt

SEQ ID NO: 804651 - DNA, 20 bp, Artificial
  CRISPR gRNA sequence
tcagtctggagcccttgttc

SEQ ID NO: 804652 - DNA, 20 bp, Artificial
  CRISPR gRNA sequence
gagcccttgttctaatctgt

SEQ ID NO: 804653 - DNA, 20 bp, Artificial
  CRISPR gRNA sequence
gttctaatctgtacacacca

SEQ ID NO: 804654 - DNA, 20 bp, Artificial
  CRISPR gRNA sequence
ttctaatctgtacacaccag

SEQ ID NO: 804655 - DNA, 20 bp, Artificial
  CRISPR gRNA sequence
taatctgtacacaccagagg

SEQ ID NO: 804656 - DNA, 20 bp, Artificial
  CRISPR gRNA sequence
atctgtacacaccagaggac

SEQ ID NO: 804657 - DNA, 20 bp, Artificial
  CRISPR gRNA sequence
tacacaccagaggactttac

SEQ ID NO: 804658 - DNA, 20 bp, Artificial
  CRISPR gRNA sequence
tacaaggctttccccagcct

SEQ ID NO: 804659 - DNA, 20 bp, Artificial
  CRISPR gRNA sequence
acaaggctttccccagcctc

SEQ ID NO: 804660 - DNA, 20 bp, Artificial
  CRISPR gRNA sequence
caaggctttccccagcctcc

SEQ ID NO: 804661 - DNA, 20 bp, Artificial
  CRISPR gRNA sequence
tccccagcctccagaattat

SEQ ID NO: 804662 - DNA, 20 bp, Artificial
  CRISPR gRNA sequence
ccccagcctccagaattatt

SEQ ID NO: 804663 - DNA, 20 bp, Artificial
  CRISPR gRNA sequence
cccagcctccagaattattc

SEQ ID NO: 804664 - DNA, 20 bp, Artificial
  CRISPR gRNA sequence
cagaattattcttctgatcc

SEQ ID NO: 804665 - DNA, 20 bp, Artificial
  CRISPR gRNA sequence
ttcttctgatccaccctcta

SEQ ID NO: 804666 - DNA, 20 bp, Artificial
  CRISPR gRNA sequence
ttctgatccaccctctacta

SEQ ID NO: 804667 - DNA, 20 bp, Artificial
  CRISPR gRNA sequence
ctgatccaccctctactaaa

SEQ ID NO: 804668 - DNA, 20 bp, Artificial
  CRISPR gRNA sequence
tgatccaccctctactaaac

SEQ ID NO: 804669 - DNA, 20 bp, Artificial
  CRISPR gRNA sequence
atccaccctctactaaactc

SEQ ID NO: 804670 - DNA, 20 bp, Artificial
  CRISPR gRNA sequence
tactaaactcaccctttcct

SEQ ID NO: 804671 - DNA, 20 bp, Artificial
  CRISPR gRNA sequence
ctaaactcaccctttcctca

SEQ ID NO: 804672 - DNA, 20 bp, Artificial
  CRISPR gRNA sequence
aactcaccctttcctcagtg

SEQ ID NO: 804673 - DNA, 20 bp, Artificial
  CRISPR gRNA sequence
accctttcctcagtgctagg

SEQ ID NO: 804674 - DNA, 20 bp, Artificial
  CRISPR gRNA sequence
tcctcagtgctaggacgttg

SEQ ID NO: 804675 - DNA, 20 bp, Artificial
  CRISPR gRNA sequence
cctcagtgctaggacgttga

SEQ ID NO: 804676 - DNA, 20 bp, Artificial
  CRISPR gRNA sequence
ctcagtgctaggacgttgaa

SEQ ID NO: 804677 - DNA, 20 bp, Artificial
  CRISPR gRNA sequence
agtgctaggacgttgaaaaa

SEQ ID NO: 804678 - DNA, 20 bp, Artificial
  CRISPR gRNA sequence
ggacgttgaaaaaccgaaac

SEQ ID NO: 804679 - DNA, 20 bp, Artificial
  CRISPR gRNA sequence
aaaaaccgaaacaaggcaaa

SEQ ID NO: 804680 - DNA, 20 bp, Artificial
  CRISPR gRNA sequence
taataattcacactaaggca

SEQ ID NO: 804681 - DNA, 20 bp, Artificial
  CRISPR gRNA sequence
acactaaggcatgagtgact

SEQ ID NO: 804682 - DNA, 20 bp, Artificial
  CRISPR gRNA sequence
aggcatgagtgactaggttt

SEQ ID NO: 804683 - DNA, 20 bp, Artificial
  CRISPR gRNA sequence
ggtttagtatattaacacta

SEQ ID NO: 804684 - DNA, 20 bp, Artificial
  CRISPR gRNA sequence
agtatattaacactacctag

SEQ ID NO: 804685 - DNA, 20 bp, Artificial
  CRISPR gRNA sequence
gtatattaacactacctagg

SEQ ID NO: 804686 - DNA, 20 bp, Artificial
  CRISPR gRNA sequence
acactacctaggatattcta

SEQ ID NO: 804687 - DNA, 20 bp, Artificial
  CRISPR gRNA sequence
cctaggatattctatttctt

SEQ ID NO: 804688 - DNA, 20 bp, Artificial
  CRISPR gRNA sequence
ggatattctatttcttccaa

SEQ ID NO: 804689 - DNA, 20 bp, Artificial
  CRISPR gRNA sequence
tatttcttccaaaaggatcc

SEQ ID NO: 804690 - DNA, 20 bp, Artificial
  CRISPR gRNA sequence
tttcttccaaaaggatcctg

SEQ ID NO: 804691 - DNA, 20 bp, Artificial
  CRISPR gRNA sequence
cttccaaaaggatcctgtta

SEQ ID NO: 804692 - DNA, 20 bp, Artificial
  CRISPR gRNA sequence
ttccaaaaggatcctgttaa

SEQ ID NO: 804693 - DNA, 20 bp, Artificial
  CRISPR gRNA sequence
ccaaaaggatcctgttaatc

SEQ ID NO: 804694 - DNA, 20 bp, Artificial
  CRISPR gRNA sequence
caaaaggatcctgttaatcc

SEQ ID NO: 804695 - DNA, 20 bp, Artificial
  CRISPR gRNA sequence
ttaatccttgaaatttaaca

SEQ ID NO: 804696 - DNA, 20 bp, Artificial
  CRISPR gRNA sequence
atccttgaaatttaacaact

SEQ ID NO: 804697 - DNA, 20 bp, Artificial
  CRISPR gRNA sequence
gaaatttaacaactaatggt

SEQ ID NO: 804698 - DNA, 20 bp, Artificial
  CRISPR gRNA sequence
aaatttaacaactaatggta

SEQ ID NO: 804699 - DNA, 20 bp, Artificial
  CRISPR gRNA sequence
aacaactaatggtatagatt

SEQ ID NO: 804700 - DNA, 20 bp, Artificial
  CRISPR gRNA sequence
acaactaatggtatagattc

SEQ ID NO: 804701 - DNA, 20 bp, Artificial
  CRISPR gRNA sequence
atggtatagattctaagcac

SEQ ID NO: 804702 - DNA, 20 bp, Artificial
  CRISPR gRNA sequence
taagcactgtgagtacttgt

SEQ ID NO: 804703 - DNA, 20 bp, Artificial
  CRISPR gRNA sequence
agcactgtgagtacttgtca

SEQ ID NO: 804704 - DNA, 20 bp, Artificial
  CRISPR gRNA sequence
tgagtacttgtcagtggggg

SEQ ID NO: 804705 - DNA, 20 bp, Artificial
  CRISPR gRNA sequence
gtcagtgggggaaagacatt

SEQ ID NO: 804706 - DNA, 20 bp, Artificial
  CRISPR gRNA sequence
tcagtgggggaaagacattt

SEQ ID NO: 804707 - DNA, 20 bp, Artificial
  CRISPR gRNA sequence
ttgggctgagagactttgcc

SEQ ID NO: 804708 - DNA, 20 bp, Artificial
  CRISPR gRNA sequence
tgggctgagagactttgcca

SEQ ID NO: 804709 - DNA, 20 bp, Artificial
  CRISPR gRNA sequence
gggctgagagactttgccac

SEQ ID NO: 804710 - DNA, 20 bp, Artificial
  CRISPR gRNA sequence
ggctgagagactttgccact

SEQ ID NO: 804711 - DNA, 20 bp, Artificial
  CRISPR gRNA sequence
agagactttgccactgggaa

SEQ ID NO: 804712 - DNA, 20 bp, Artificial
  CRISPR gRNA sequence
tgccactgggaagagagaga

SEQ ID NO: 804713 - DNA, 20 bp, Artificial
  CRISPR gRNA sequence
gccactgggaagagagagag

SEQ ID NO: 804714 - DNA, 20 bp, Artificial
  CRISPR gRNA sequence
ccactgggaagagagagagg

SEQ ID NO: 804715 - DNA, 20 bp, Artificial
  CRISPR gRNA sequence
ggaagagagagaggatgagg

SEQ ID NO: 804716 - DNA, 20 bp, Artificial
  CRISPR gRNA sequence
gatgatagatggatggattg

SEQ ID NO: 804717 - DNA, 20 bp, Artificial
  CRISPR gRNA sequence
atggatggatggaaaaaaat

SEQ ID NO: 804718 - DNA, 20 bp, Artificial
  CRISPR gRNA sequence
gaaccagactgtatcttagc

SEQ ID NO: 804719 - DNA, 20 bp, Artificial
  CRISPR gRNA sequence
tatcttagctgggtcactta

SEQ ID NO: 804720 - DNA, 20 bp, Artificial
  CRISPR gRNA sequence
agctgggtcacttactatgt

SEQ ID NO: 804721 - DNA, 20 bp, Artificial
  CRISPR gRNA sequence
gctgggtcacttactatgta

SEQ ID NO: 804722 - DNA, 20 bp, Artificial
  CRISPR gRNA sequence
ggtcacttactatgtaactt

SEQ ID NO: 804723 - DNA, 20 bp, Artificial
  CRISPR gRNA sequence
actatgtaacttagggaaag

SEQ ID NO: 804724 - DNA, 20 bp, Artificial
  CRISPR gRNA sequence
ctatgtaacttagggaaagc

SEQ ID NO: 804725 - DNA, 20 bp, Artificial
  CRISPR gRNA sequence
tgtaacttagggaaagcttc

SEQ ID NO: 804726 - DNA, 20 bp, Artificial
  CRISPR gRNA sequence
agggaaagcttcctagtctc

SEQ ID NO: 804727 - DNA, 20 bp, Artificial
  CRISPR gRNA sequence
gggaaagcttcctagtctct

SEQ ID NO: 804728 - DNA, 20 bp, Artificial
  CRISPR gRNA sequence
cctagtctctctgtgcctcc

SEQ ID NO: 804729 - DNA, 20 bp, Artificial
  CRISPR gRNA sequence
ctagtctctctgtgcctccc

SEQ ID NO: 804730 - DNA, 20 bp, Artificial
  CRISPR gRNA sequence
gtctctctgtgcctcccttt

SEQ ID NO: 804731 - DNA, 20 bp, Artificial
  CRISPR gRNA sequence
tctgtgcctccctttcttca

SEQ ID NO: 804732 - DNA, 20 bp, Artificial
  CRISPR gRNA sequence
tgtgcctccctttcttcacc

SEQ ID NO: 804733 - DNA, 20 bp, Artificial
  CRISPR gRNA sequence
tgcctccctttcttcaccag

SEQ ID NO: 804734 - DNA, 20 bp, Artificial
  CRISPR gRNA sequence
cctttcttcaccagtgaaat

SEQ ID NO: 804735 - DNA, 20 bp, Artificial
  CRISPR gRNA sequence
tcttcaccagtgaaatgggg

SEQ ID NO: 804736 - DNA, 20 bp, Artificial
  CRISPR gRNA sequence
cttcaccagtgaaatgggga

SEQ ID NO: 804737 - DNA, 20 bp, Artificial
  CRISPR gRNA sequence
ttcaccagtgaaatggggat

SEQ ID NO: 804738 - DNA, 20 bp, Artificial
  CRISPR gRNA sequence
caccagtgaaatggggatca

SEQ ID NO: 804739 - DNA, 20 bp, Artificial
  CRISPR gRNA sequence
accagtgaaatggggatcat

SEQ ID NO: 804740 - DNA, 20 bp, Artificial
  CRISPR gRNA sequence
cacagagtggttgcgaggag

SEQ ID NO: 804741 - DNA, 20 bp, Artificial
  CRISPR gRNA sequence
acagagtggttgcgaggagt

SEQ ID NO: 804742 - DNA, 20 bp, Artificial
  CRISPR gRNA sequence
cgaggagtggatgagctgat

SEQ ID NO: 804743 - DNA, 20 bp, Artificial
  CRISPR gRNA sequence
ataggtgcagagcacttaga

SEQ ID NO: 804744 - DNA, 20 bp, Artificial
  CRISPR gRNA sequence
agaatagggcctggtgtgga

SEQ ID NO: 804745 - DNA, 20 bp, Artificial
  CRISPR gRNA sequence
gaatagggcctggtgtggag

SEQ ID NO: 804746 - DNA, 20 bp, Artificial
  CRISPR gRNA sequence
gtgtggagtaaatgctccac

SEQ ID NO: 804747 - DNA, 20 bp, Artificial
  CRISPR gRNA sequence
cacagagctagccgtgttgg

SEQ ID NO: 804748 - DNA, 20 bp, Artificial
  CRISPR gRNA sequence
gccgtgttggctgtcaccca

SEQ ID NO: 804749 - DNA, 20 bp, Artificial
  CRISPR gRNA sequence
gctgtcacccactcatgtgg

SEQ ID NO: 804750 - DNA, 20 bp, Artificial
  CRISPR gRNA sequence
tcacccactcatgtggccag

SEQ ID NO: 804751 - DNA, 20 bp, Artificial
  CRISPR gRNA sequence
atgtggccagcctgttggtc

SEQ ID NO: 804752 - DNA, 20 bp, Artificial
  CRISPR gRNA sequence
ttggtctacctcttagttgc

SEQ ID NO: 804753 - DNA, 20 bp, Artificial
  CRISPR gRNA sequence
gtctacctcttagttgccat

SEQ ID NO: 804754 - DNA, 20 bp, Artificial
  CRISPR gRNA sequence
cctcttagttgccatgtaac

SEQ ID NO: 804755 - DNA, 20 bp, Artificial
  CRISPR gRNA sequence
ttagttgccatgtaacagga

SEQ ID NO: 804756 - DNA, 20 bp, Artificial
  CRISPR gRNA sequence
agttgccatgtaacaggatt

SEQ ID NO: 804757 - DNA, 20 bp, Artificial
  CRISPR gRNA sequence
gttgccatgtaacaggattc

SEQ ID NO: 804758 - DNA, 20 bp, Artificial
  CRISPR gRNA sequence
ccatgtaacaggattctggt

SEQ ID NO: 804759 - DNA, 20 bp, Artificial
  CRISPR gRNA sequence
tggtgcttttcctttgccca

SEQ ID NO: 804760 - DNA, 20 bp, Artificial
  CRISPR gRNA sequence
gtgcttttcctttgcccagg

SEQ ID NO: 804761 - DNA, 20 bp, Artificial
  CRISPR gRNA sequence
ttcctttgcccaggtcagat

SEQ ID NO: 804762 - DNA, 20 bp, Artificial
  CRISPR gRNA sequence
tcctttgcccaggtcagatg

SEQ ID NO: 804763 - DNA, 20 bp, Artificial
  CRISPR gRNA sequence
cctttgcccaggtcagatgg

SEQ ID NO: 804764 - DNA, 20 bp, Artificial
  CRISPR gRNA sequence
ctttgcccaggtcagatgga

SEQ ID NO: 804765 - DNA, 20 bp, Artificial
  CRISPR gRNA sequence
tgcccaggtcagatggaacc

SEQ ID NO: 804766 - DNA, 20 bp, Artificial
  CRISPR gRNA sequence
gcccaggtcagatggaaccc

SEQ ID NO: 804767 - DNA, 20 bp, Artificial
  CRISPR gRNA sequence
cccaggtcagatggaaccca

SEQ ID NO: 804768 - DNA, 20 bp, Artificial
  CRISPR gRNA sequence
ggctgcttcacattttcatc

SEQ ID NO: 804769 - DNA, 20 bp, Artificial
  CRISPR gRNA sequence
gctgcttcacattttcatcc

SEQ ID NO: 804770 - DNA, 20 bp, Artificial
  CRISPR gRNA sequence
cttcacattttcatcccctt

SEQ ID NO: 804771 - DNA, 20 bp, Artificial
  CRISPR gRNA sequence
cacattttcatccccttctg

SEQ ID NO: 804772 - DNA, 20 bp, Artificial
  CRISPR gRNA sequence
acattttcatccccttctgc

SEQ ID NO: 804773 - DNA, 20 bp, Artificial
  CRISPR gRNA sequence
tcatccccttctgcatcatt

SEQ ID NO: 804774 - DNA, 20 bp, Artificial
  CRISPR gRNA sequence
catccccttctgcatcattg

SEQ ID NO: 804775 - DNA, 20 bp, Artificial
  CRISPR gRNA sequence
atccccttctgcatcattgc

SEQ ID NO: 804776 - DNA, 20 bp, Artificial
  CRISPR gRNA sequence
ctgcatcattgctttcattt

SEQ ID NO: 804777 - DNA, 20 bp, Artificial
  CRISPR gRNA sequence
tgcatcattgctttcatttt

SEQ ID NO: 804778 - DNA, 20 bp, Artificial
  CRISPR gRNA sequence
catcattgctttcattttca

SEQ ID NO: 804779 - DNA, 20 bp, Artificial
  CRISPR gRNA sequence
ctttcattttcatagccaca

SEQ ID NO: 804780 - DNA, 20 bp, Artificial
  CRISPR gRNA sequence
tcattttcatagccacagtg

SEQ ID NO: 804781 - DNA, 20 bp, Artificial
  CRISPR gRNA sequence
cattttcatagccacagtga

SEQ ID NO: 804782 - DNA, 20 bp, Artificial
  CRISPR gRNA sequence
attttcatagccacagtgat

SEQ ID NO: 804783 - DNA, 20 bp, Artificial
  CRISPR gRNA sequence
tcatagccacagtgatagcc

SEQ ID NO: 804784 - DNA, 20 bp, Artificial
  CRISPR gRNA sequence
catagccacagtgatagccc

SEQ ID NO: 804785 - DNA, 20 bp, Artificial
  CRISPR gRNA sequence
atagccacagtgatagccct

SEQ ID NO: 804786 - DNA, 20 bp, Artificial
  CRISPR gRNA sequence
agaaaacaactctgtcaaaa

SEQ ID NO: 804787 - DNA, 20 bp, Artificial
  CRISPR gRNA sequence
tgtcaaaagctgtattcttc

SEQ ID NO: 804788 - DNA, 20 bp, Artificial
  CRISPR gRNA sequence
tcaaaagctgtattcttcaa

SEQ ID NO: 804789 - DNA, 20 bp, Artificial
  CRISPR gRNA sequence
tattcttcaaaaggtaagtg

SEQ ID NO: 804790 - DNA, 20 bp, Artificial
  CRISPR gRNA sequence
ttcaaaaggtaagtgagttt

SEQ ID NO: 804791 - DNA, 20 bp, Artificial
  CRISPR gRNA sequence
caaaaggtaagtgagtttta

SEQ ID NO: 804792 - DNA, 20 bp, Artificial
  CRISPR gRNA sequence
aaaaggtaagtgagttttat

SEQ ID NO: 804793 - DNA, 20 bp, Artificial
  CRISPR gRNA sequence
tattcatggtaacccaatgc

SEQ ID NO: 804794 - DNA, 20 bp, Artificial
  CRISPR gRNA sequence
attcatggtaacccaatgca

SEQ ID NO: 804795 - DNA, 20 bp, Artificial
  CRISPR gRNA sequence
ttcatggtaacccaatgcac

SEQ ID NO: 804796 - DNA, 20 bp, Artificial
  CRISPR gRNA sequence
atggtaacccaatgcactgg

SEQ ID NO: 804797 - DNA, 20 bp, Artificial
  CRISPR gRNA sequence
ggtgtctgcagcatgagcca

SEQ ID NO: 804798 - DNA, 20 bp, Artificial
  CRISPR gRNA sequence
cagcatgagccactgctttg

SEQ ID NO: 804799 - DNA, 20 bp, Artificial
  CRISPR gRNA sequence
ctttgcactgcaggcctatg

SEQ ID NO: 804800 - DNA, 20 bp, Artificial
  CRISPR gRNA sequence
tgcactgcaggcctatggct

SEQ ID NO: 804801 - DNA, 20 bp, Artificial
  CRISPR gRNA sequence
gcactgcaggcctatggctt

SEQ ID NO: 804802 - DNA, 20 bp, Artificial
  CRISPR gRNA sequence
cactgcaggcctatggcttg

SEQ ID NO: 804803 - DNA, 20 bp, Artificial
  CRISPR gRNA sequence
caggcctatggcttgctgct

SEQ ID NO: 804804 - DNA, 20 bp, Artificial
  CRISPR gRNA sequence
tggcttgctgctttcatgct

SEQ ID NO: 804805 - DNA, 20 bp, Artificial
  CRISPR gRNA sequence
gctgctttcatgctaaaccc

SEQ ID NO: 804806 - DNA, 20 bp, Artificial
  CRISPR gRNA sequence
ctgctttcatgctaaaccca

SEQ ID NO: 804807 - DNA, 20 bp, Artificial
  CRISPR gRNA sequence
ctttcatgctaaacccactc

SEQ ID NO: 804808 - DNA, 20 bp, Artificial
  CRISPR gRNA sequence
tcatgctaaacccactcaga

SEQ ID NO: 804809 - DNA, 20 bp, Artificial
  CRISPR gRNA sequence
catgctaaacccactcagag

SEQ ID NO: 804810 - DNA, 20 bp, Artificial
  CRISPR gRNA sequence
atgctaaacccactcagagc

SEQ ID NO: 804811 - DNA, 20 bp, Artificial
  CRISPR gRNA sequence
aacccactcagagcttatga

SEQ ID NO: 804812 - DNA, 20 bp, Artificial
  CRISPR gRNA sequence
agagcttatgaaccactttg

SEQ ID NO: 804813 - DNA, 20 bp, Artificial
  CRISPR gRNA sequence
atgaaccactttgagcttgt

SEQ ID NO: 804814 - DNA, 20 bp, Artificial
  CRISPR gRNA sequence
tgaaccactttgagcttgtc

SEQ ID NO: 804815 - DNA, 20 bp, Artificial
  CRISPR gRNA sequence
tgagcttgtcttgatgatta

SEQ ID NO: 804816 - DNA, 20 bp, Artificial
  CRISPR gRNA sequence
gagcttgtcttgatgattat

SEQ ID NO: 804817 - DNA, 20 bp, Artificial
  CRISPR gRNA sequence
agcttgtcttgatgattatt

SEQ ID NO: 804818 - DNA, 20 bp, Artificial
  CRISPR gRNA sequence
gtcttgatgattatttttcc

SEQ ID NO: 804819 - DNA, 20 bp, Artificial
  CRISPR gRNA sequence
tcttgatgattatttttccc

SEQ ID NO: 804820 - DNA, 20 bp, Artificial
  CRISPR gRNA sequence
gatgattatttttccccaga

SEQ ID NO: 804821 - DNA, 20 bp, Artificial
  CRISPR gRNA sequence
atgattatttttccccagaa

SEQ ID NO: 804822 - DNA, 20 bp, Artificial
  CRISPR gRNA sequence
tttttccccagaagaaaatg

SEQ ID NO: 804823 - DNA, 20 bp, Artificial
  CRISPR gRNA sequence
ttccccagaagaaaatggct

SEQ ID NO: 804824 - DNA, 20 bp, Artificial
  CRISPR gRNA sequence
tccccagaagaaaatggctc

SEQ ID NO: 804825 - DNA, 20 bp, Artificial
  CRISPR gRNA sequence
ccccagaagaaaatggctct

SEQ ID NO: 804826 - DNA, 20 bp, Artificial
  CRISPR gRNA sequence
cccagaagaaaatggctctc

SEQ ID NO: 804827 - DNA, 20 bp, Artificial
  CRISPR gRNA sequence
tcatcgtcagtgagctgaac

SEQ ID NO: 804828 - DNA, 20 bp, Artificial
  CRISPR gRNA sequence
atcgtcagtgagctgaactt

SEQ ID NO: 804829 - DNA, 20 bp, Artificial
  CRISPR gRNA sequence
aacttcttacactgagtttt

SEQ ID NO: 804830 - DNA, 20 bp, Artificial
  CRISPR gRNA sequence
cttacactgagttttttaaa

SEQ ID NO: 804831 - DNA, 20 bp, Artificial
  CRISPR gRNA sequence
ttacactgagttttttaaag

SEQ ID NO: 804832 - DNA, 20 bp, Artificial
  CRISPR gRNA sequence
acactgagttttttaaaggg

SEQ ID NO: 804833 - DNA, 20 bp, Artificial
  CRISPR gRNA sequence
cactgagttttttaaaggga

SEQ ID NO: 804834 - DNA, 20 bp, Artificial
  CRISPR gRNA sequence
agttttttaaagggaatgtt

SEQ ID NO: 804835 - DNA, 20 bp, Artificial
  CRISPR gRNA sequence
tttaaagggaatgttttgtt

SEQ ID NO: 804836 - DNA, 20 bp, Artificial
  CRISPR gRNA sequence
ttaaagggaatgttttgttc

SEQ ID NO: 804837 - DNA, 20 bp, Artificial
  CRISPR gRNA sequence
taaagggaatgttttgttct

SEQ ID NO: 804838 - DNA, 20 bp, Artificial
  CRISPR gRNA sequence
aaagggaatgttttgttctt

SEQ ID NO: 804839 - DNA, 20 bp, Artificial
  CRISPR gRNA sequence
aagggaatgttttgttctta

SEQ ID NO: 804840 - DNA, 20 bp, Artificial
  CRISPR gRNA sequence
tgttcttatgtctgaaagag

SEQ ID NO: 804841 - DNA, 20 bp, Artificial
  CRISPR gRNA sequence
gttcttatgtctgaaagagt

SEQ ID NO: 804842 - DNA, 20 bp, Artificial
  CRISPR gRNA sequence
ttcttatgtctgaaagagtt

SEQ ID NO: 804843 - DNA, 20 bp, Artificial
  CRISPR gRNA sequence
ttatgtctgaaagagtttgt

SEQ ID NO: 804844 - DNA, 20 bp, Artificial
  CRISPR gRNA sequence
atgtctgaaagagtttgtct

SEQ ID NO: 804845 - DNA, 20 bp, Artificial
  CRISPR gRNA sequence
tgtctgaaagagtttgtctt

SEQ ID NO: 804846 - DNA, 20 bp, Artificial
  CRISPR gRNA sequence
aaagagtttgtcttattctt

SEQ ID NO: 804847 - DNA, 20 bp, Artificial
  CRISPR gRNA sequence
gtcttattctttgagccaag

SEQ ID NO: 804848 - DNA, 20 bp, Artificial
  CRISPR gRNA sequence
tcttattctttgagccaaga

SEQ ID NO: 804849 - DNA, 20 bp, Artificial
  CRISPR gRNA sequence
attctttgagccaagagctt

SEQ ID NO: 804850 - DNA, 20 bp, Artificial
  CRISPR gRNA sequence
ttctttgagccaagagcttt

SEQ ID NO: 804851 - DNA, 20 bp, Artificial
  CRISPR gRNA sequence
tttgagccaagagctttcat

SEQ ID NO: 804852 - DNA, 20 bp, Artificial
  CRISPR gRNA sequence
tgagccaagagctttcatca

SEQ ID NO: 804853 - DNA, 20 bp, Artificial
  CRISPR gRNA sequence
gagccaagagctttcatcag

SEQ ID NO: 804854 - DNA, 20 bp, Artificial
  CRISPR gRNA sequence
agccaagagctttcatcagc

SEQ ID NO: 804855 - DNA, 20 bp, Artificial
  CRISPR gRNA sequence
tcatcagcctcatgagagtg

SEQ ID NO: 804856 - DNA, 20 bp, Artificial
  CRISPR gRNA sequence
catcagcctcatgagagtga

SEQ ID NO: 804857 - DNA, 20 bp, Artificial
  CRISPR gRNA sequence
atcagcctcatgagagtgat

SEQ ID NO: 804858 - DNA, 20 bp, Artificial
  CRISPR gRNA sequence
atgagagtgatgttattttg

SEQ ID NO: 804859 - DNA, 20 bp, Artificial
  CRISPR gRNA sequence
ttttggcaatgcagagagct

SEQ ID NO: 804860 - DNA, 20 bp, Artificial
  CRISPR gRNA sequence
tggcaatgcagagagctacg

SEQ ID NO: 804861 - DNA, 20 bp, Artificial
  CRISPR gRNA sequence
ggcaatgcagagagctacgt

SEQ ID NO: 804862 - DNA, 20 bp, Artificial
  CRISPR gRNA sequence
gcaatgcagagagctacgtg

SEQ ID NO: 804863 - DNA, 20 bp, Artificial
  CRISPR gRNA sequence
cgtgctccgattttgctggt

SEQ ID NO: 804864 - DNA, 20 bp, Artificial
  CRISPR gRNA sequence
cgattttgctggtgggaggt

SEQ ID NO: 804865 - DNA, 20 bp, Artificial
  CRISPR gRNA sequence
tgctggtgggaggttgccag

SEQ ID NO: 804866 - DNA, 20 bp, Artificial
  CRISPR gRNA sequence
gctggtgggaggttgccagg

SEQ ID NO: 804867 - DNA, 20 bp, Artificial
  CRISPR gRNA sequence
ctggtgggaggttgccagga

SEQ ID NO: 804868 - DNA, 20 bp, Artificial
  CRISPR gRNA sequence
gtgggaggttgccaggatcc

SEQ ID NO: 804869 - DNA, 20 bp, Artificial
  CRISPR gRNA sequence
ccaggatcctttctgaggat

SEQ ID NO: 804870 - DNA, 20 bp, Artificial
  CRISPR gRNA sequence
tctgaggattccttccattt

SEQ ID NO: 804871 - DNA, 20 bp, Artificial
  CRISPR gRNA sequence
ctgaggattccttccatttt

SEQ ID NO: 804872 - DNA, 20 bp, Artificial
  CRISPR gRNA sequence
tgaggattccttccattttc

SEQ ID NO: 804873 - DNA, 20 bp, Artificial
  CRISPR gRNA sequence
aggattccttccattttcac

SEQ ID NO: 804874 - DNA, 20 bp, Artificial
  CRISPR gRNA sequence
cttccattttcacccctctt

SEQ ID NO: 804875 - DNA, 20 bp, Artificial
  CRISPR gRNA sequence
ccattttcacccctcttttc

SEQ ID NO: 804876 - DNA, 20 bp, Artificial
  CRISPR gRNA sequence
cattttcacccctcttttcc

SEQ ID NO: 804877 - DNA, 20 bp, Artificial
  CRISPR gRNA sequence
tcacccctcttttccccagt

SEQ ID NO: 804878 - DNA, 20 bp, Artificial
  CRISPR gRNA sequence
cacccctcttttccccagtc

SEQ ID NO: 804879 - DNA, 20 bp, Artificial
  CRISPR gRNA sequence
acccctcttttccccagtct

SEQ ID NO: 804880 - DNA, 20 bp, Artificial
  CRISPR gRNA sequence
ttttccccagtctggatatg

SEQ ID NO: 804881 - DNA, 20 bp, Artificial
  CRISPR gRNA sequence
ttccccagtctggatatgac

SEQ ID NO: 804882 - DNA, 20 bp, Artificial
  CRISPR gRNA sequence
tccccagtctggatatgacc

SEQ ID NO: 804883 - DNA, 20 bp, Artificial
  CRISPR gRNA sequence
ccccagtctggatatgacct

SEQ ID NO: 804884 - DNA, 20 bp, Artificial
  CRISPR gRNA sequence
cccagtctggatatgacctg

SEQ ID NO: 804885 - DNA, 20 bp, Artificial
  CRISPR gRNA sequence
gatatgacctgggttaaacc

SEQ ID NO: 804886 - DNA, 20 bp, Artificial
  CRISPR gRNA sequence
ggttaaacccaccccctctc

SEQ ID NO: 804887 - DNA, 20 bp, Artificial
  CRISPR gRNA sequence
aacccaccccctctcccagg

SEQ ID NO: 804888 - DNA, 20 bp, Artificial
  CRISPR gRNA sequence
tcccaggaatctcaacctca

SEQ ID NO: 804889 - DNA, 20 bp, Artificial
  CRISPR gRNA sequence
ccaggaatctcaacctcacg

SEQ ID NO: 804890 - DNA, 20 bp, Artificial
  CRISPR gRNA sequence
aacctcacggttgggtaagg

SEQ ID NO: 804891 - DNA, 20 bp, Artificial
  CRISPR gRNA sequence
acggttgggtaaggaaagga

SEQ ID NO: 804892 - DNA, 20 bp, Artificial
  CRISPR gRNA sequence
ggtaaggaaaggagaaaggt

SEQ ID NO: 804893 - DNA, 20 bp, Artificial
  CRISPR gRNA sequence
gtgaggccatttggggataa

SEQ ID NO: 804894 - DNA, 20 bp, Artificial
  CRISPR gRNA sequence
tgaggccatttggggataag

SEQ ID NO: 804895 - DNA, 20 bp, Artificial
  CRISPR gRNA sequence
ggggataaggaaacagctgg

SEQ ID NO: 804896 - DNA, 20 bp, Artificial
  CRISPR gRNA sequence
gggataaggaaacagctggt

SEQ ID NO: 804897 - DNA, 20 bp, Artificial
  CRISPR gRNA sequence
gttggtggtgcattaacgtc

SEQ ID NO: 804898 - DNA, 20 bp, Artificial
  CRISPR gRNA sequence
gtggtgcattaacgtctttc

SEQ ID NO: 804899 - DNA, 20 bp, Artificial
  CRISPR gRNA sequence
acgtctttcagcagctccct

SEQ ID NO: 804900 - DNA, 20 bp, Artificial
  CRISPR gRNA sequence
tcagcagctcccttcgagtt

SEQ ID NO: 804901 - DNA, 20 bp, Artificial
  CRISPR gRNA sequence
cagcagctcccttcgagttt

SEQ ID NO: 804902 - DNA, 20 bp, Artificial
  CRISPR gRNA sequence
agcagctcccttcgagtttc

SEQ ID NO: 804903 - DNA, 20 bp, Artificial
  CRISPR gRNA sequence
ccttcgagtttctccttagc

SEQ ID NO: 804904 - DNA, 20 bp, Artificial
  CRISPR gRNA sequence
cgagtttctccttagcctgt

SEQ ID NO: 804905 - DNA, 20 bp, Artificial
  CRISPR gRNA sequence
gagtttctccttagcctgtt

SEQ ID NO: 804906 - DNA, 20 bp, Artificial
  CRISPR gRNA sequence
ctccttagcctgttgtattc

SEQ ID NO: 804907 - DNA, 20 bp, Artificial
  CRISPR gRNA sequence
tccttagcctgttgtattct

SEQ ID NO: 804908 - DNA, 20 bp, Artificial
  CRISPR gRNA sequence
cttagcctgttgtattctta

SEQ ID NO: 804909 - DNA, 20 bp, Artificial
  CRISPR gRNA sequence
agcctgttgtattcttacca

SEQ ID NO: 804910 - DNA, 20 bp, Artificial
  CRISPR gRNA sequence
gcctgttgtattcttaccaa

SEQ ID NO: 804911 - DNA, 20 bp, Artificial
  CRISPR gRNA sequence
ttgtattcttaccaacacac

SEQ ID NO: 804912 - DNA, 20 bp, Artificial
  CRISPR gRNA sequence
tattcttaccaacacactcc

SEQ ID NO: 804913 - DNA, 20 bp, Artificial
  CRISPR gRNA sequence
ttaccaacacactcctgttc

SEQ ID NO: 804914 - DNA, 20 bp, Artificial
  CRISPR gRNA sequence
accaacacactcctgttctg

SEQ ID NO: 804915 - DNA, 20 bp, Artificial
  CRISPR gRNA sequence
ccaacacactcctgttctgt

SEQ ID NO: 804916 - DNA, 20 bp, Artificial
  CRISPR gRNA sequence
ctgttctgttgtaccagctg

SEQ ID NO: 804917 - DNA, 20 bp, Artificial
  CRISPR gRNA sequence
ttctgttgtaccagctggga

SEQ ID NO: 804918 - DNA, 20 bp, Artificial
  CRISPR gRNA sequence
tgttgtaccagctgggacag

SEQ ID NO: 804919 - DNA, 20 bp, Artificial
  CRISPR gRNA sequence
ttgtaccagctgggacagag

SEQ ID NO: 804920 - DNA, 20 bp, Artificial
  CRISPR gRNA sequence
taccagctgggacagagcat

SEQ ID NO: 804921 - DNA, 20 bp, Artificial
  CRISPR gRNA sequence
ggacagagcatgctgaagcc

SEQ ID NO: 804922 - DNA, 20 bp, Artificial
  CRISPR gRNA sequence
aagcctttcagccctgattt

SEQ ID NO: 804923 - DNA, 20 bp, Artificial
  CRISPR gRNA sequence
tcagccctgatttcattgct

SEQ ID NO: 804924 - DNA, 20 bp, Artificial
  CRISPR gRNA sequence
cagccctgatttcattgctt

SEQ ID NO: 804925 - DNA, 20 bp, Artificial
  CRISPR gRNA sequence
agccctgatttcattgcttc

SEQ ID NO: 804926 - DNA, 20 bp, Artificial
  CRISPR gRNA sequence
atttcattgcttcattgttc

SEQ ID NO: 804927 - DNA, 20 bp, Artificial
  CRISPR gRNA sequence
cattgcttcattgttcatgt

SEQ ID NO: 804928 - DNA, 20 bp, Artificial
  CRISPR gRNA sequence
attgcttcattgttcatgtg

SEQ ID NO: 804929 - DNA, 20 bp, Artificial
  CRISPR gRNA sequence
cttcattgttcatgtgtctg

SEQ ID NO: 804930 - DNA, 20 bp, Artificial
  CRISPR gRNA sequence
cattgttcatgtgtctgtct

SEQ ID NO: 804931 - DNA, 20 bp, Artificial
  CRISPR gRNA sequence
attgttcatgtgtctgtctt

SEQ ID NO: 804932 - DNA, 20 bp, Artificial
  CRISPR gRNA sequence
ttcatgtgtctgtctttggt

SEQ ID NO: 804933 - DNA, 20 bp, Artificial
  CRISPR gRNA sequence
atgtgtctgtctttggtttc

SEQ ID NO: 804934 - DNA, 20 bp, Artificial
  CRISPR gRNA sequence
tctttggtttcctgggtgga

SEQ ID NO: 804935 - DNA, 20 bp, Artificial
  CRISPR gRNA sequence
tggtttcctgggtggagcct

SEQ ID NO: 804936 - DNA, 20 bp, Artificial
  CRISPR gRNA sequence
ggtttcctgggtggagcctg

SEQ ID NO: 804937 - DNA, 20 bp, Artificial
  CRISPR gRNA sequence
gtttcctgggtggagcctgc

SEQ ID NO: 804938 - DNA, 20 bp, Artificial
  CRISPR gRNA sequence
cctgggtggagcctgcccac

SEQ ID NO: 804939 - DNA, 20 bp, Artificial
  CRISPR gRNA sequence
ctgggtggagcctgcccaca

SEQ ID NO: 804940 - DNA, 20 bp, Artificial
  CRISPR gRNA sequence
ggtggagcctgcccacaaaa

SEQ ID NO: 804941 - DNA, 20 bp, Artificial
  CRISPR gRNA sequence
cccacaaaacccccagaatg

SEQ ID NO: 804942 - DNA, 20 bp, Artificial
  CRISPR gRNA sequence
gctggtgctttcctaaacgg

SEQ ID NO: 804943 - DNA, 20 bp, Artificial
  CRISPR gRNA sequence
gtgctttcctaaacggctcc

SEQ ID NO: 804944 - DNA, 20 bp, Artificial
  CRISPR gRNA sequence
tcctaaacggctcccttgtc

SEQ ID NO: 804945 - DNA, 20 bp, Artificial
  CRISPR gRNA sequence
cctaaacggctcccttgtct

SEQ ID NO: 804946 - DNA, 20 bp, Artificial
  CRISPR gRNA sequence
ctaaacggctcccttgtctg

SEQ ID NO: 804947 - DNA, 20 bp, Artificial
  CRISPR gRNA sequence
aacggctcccttgtctgcac

SEQ ID NO: 804948 - DNA, 20 bp, Artificial
  CRISPR gRNA sequence
ccttgtctgcactcaatgaa

SEQ ID NO: 804949 - DNA, 20 bp, Artificial
  CRISPR gRNA sequence
gtctgcactcaatgaacttc

SEQ ID NO: 804950 - DNA, 20 bp, Artificial
  CRISPR gRNA sequence
tctgcactcaatgaacttct

SEQ ID NO: 804951 - DNA, 20 bp, Artificial
  CRISPR gRNA sequence
cactcaatgaacttctccaa

SEQ ID NO: 804952 - DNA, 20 bp, Artificial
  CRISPR gRNA sequence
aatgaacttctccaaagatc

SEQ ID NO: 804953 - DNA, 20 bp, Artificial
  CRISPR gRNA sequence
ctccaaagatctatacatgg

SEQ ID NO: 804954 - DNA, 20 bp, Artificial
  CRISPR gRNA sequence
tccaaagatctatacatggc

SEQ ID NO: 804955 - DNA, 20 bp, Artificial
  CRISPR gRNA sequence
caaagatctatacatggcct

SEQ ID NO: 804956 - DNA, 20 bp, Artificial
  CRISPR gRNA sequence
tacatggcctcatctataga

SEQ ID NO: 804957 - DNA, 20 bp, Artificial
  CRISPR gRNA sequence
atctatagaaagagaaatga

SEQ ID NO: 804958 - DNA, 20 bp, Artificial
  CRISPR gRNA sequence
tagaaagagaaatgacatgt

SEQ ID NO: 804959 - DNA, 20 bp, Artificial
  CRISPR gRNA sequence
agtaggagtttgcagcagca

SEQ ID NO: 804960 - DNA, 20 bp, Artificial
  CRISPR gRNA sequence
gcagcagcactatctgagga

SEQ ID NO: 804961 - DNA, 20 bp, Artificial
  CRISPR gRNA sequence
cagcagcactatctgaggac

SEQ ID NO: 804962 - DNA, 20 bp, Artificial
  CRISPR gRNA sequence
tctgaggactaggggaattt

SEQ ID NO: 804963 - DNA, 20 bp, Artificial
  CRISPR gRNA sequence
aggactaggggaattttaag

SEQ ID NO: 804964 - DNA, 20 bp, Artificial
  CRISPR gRNA sequence
ggggaattttaagtggttgt

SEQ ID NO: 804965 - DNA, 20 bp, Artificial
  CRISPR gRNA sequence
taagtggttgttatcttaca

SEQ ID NO: 804966 - DNA, 20 bp, Artificial
  CRISPR gRNA sequence
aagtggttgttatcttacat

SEQ ID NO: 804967 - DNA, 20 bp, Artificial
  CRISPR gRNA sequence
agtggttgttatcttacatt

SEQ ID NO: 804968 - DNA, 20 bp, Artificial
  CRISPR gRNA sequence
ttatcttacatttatactca

SEQ ID NO: 804969 - DNA, 20 bp, Artificial
  CRISPR gRNA sequence
tcttacatttatactcataa

SEQ ID NO: 804970 - DNA, 20 bp, Artificial
  CRISPR gRNA sequence
acatttatactcataacttc

SEQ ID NO: 804971 - DNA, 20 bp, Artificial
  CRISPR gRNA sequence
catttatactcataacttct

SEQ ID NO: 804972 - DNA, 20 bp, Artificial
  CRISPR gRNA sequence
atactcataacttctatatt

SEQ ID NO: 804973 - DNA, 20 bp, Artificial
  CRISPR gRNA sequence
tactcataacttctatattt

SEQ ID NO: 804974 - DNA, 20 bp, Artificial
  CRISPR gRNA sequence
ataacttctatattttcatc

SEQ ID NO: 804975 - DNA, 20 bp, Artificial
  CRISPR gRNA sequence
ctatattttcatctgccata

SEQ ID NO: 804976 - DNA, 20 bp, Artificial
  CRISPR gRNA sequence
tatattttcatctgccataa

SEQ ID NO: 804977 - DNA, 20 bp, Artificial
  CRISPR gRNA sequence
tattttcatctgccataaaa

SEQ ID NO: 804978 - DNA, 20 bp, Artificial
  CRISPR gRNA sequence
tcatctgccataaaatattg

SEQ ID NO: 804979 - DNA, 20 bp, Artificial
  CRISPR gRNA sequence
catctgccataaaatattgt

SEQ ID NO: 804980 - DNA, 20 bp, Artificial
  CRISPR gRNA sequence
atctgccataaaatattgtc

SEQ ID NO: 804981 - DNA, 20 bp, Artificial
  CRISPR gRNA sequence
ccataaaatattgtcatgtt

SEQ ID NO: 804982 - DNA, 20 bp, Artificial
  CRISPR gRNA sequence
tcatgttctatttgtccatt

SEQ ID NO: 804983 - DNA, 20 bp, Artificial
  CRISPR gRNA sequence
tatttgtccattgccctatg

SEQ ID NO: 804984 - DNA, 20 bp, Artificial
  CRISPR gRNA sequence
tttgtccattgccctatgtg

SEQ ID NO: 804985 - DNA, 20 bp, Artificial
  CRISPR gRNA sequence
gtccattgccctatgtgtgt

SEQ ID NO: 804986 - DNA, 20 bp, Artificial
  CRISPR gRNA sequence
tccattgccctatgtgtgta

SEQ ID NO: 804987 - DNA, 20 bp, Artificial
  CRISPR gRNA sequence
ccctatgtgtgtatgtattc

SEQ ID NO: 804988 - DNA, 20 bp, Artificial
  CRISPR gRNA sequence
tgtgtgtatgtattcacttg

SEQ ID NO: 804989 - DNA, 20 bp, Artificial
  CRISPR gRNA sequence
acttgggtgctgaccacaat

SEQ ID NO: 804990 - DNA, 20 bp, Artificial
  CRISPR gRNA sequence
gggtgctgaccacaatattt

SEQ ID NO: 804991 - DNA, 20 bp, Artificial
  CRISPR gRNA sequence
ggtgctgaccacaatatttc

SEQ ID NO: 804992 - DNA, 20 bp, Artificial
  CRISPR gRNA sequence
accacaatatttctaactgt

SEQ ID NO: 804993 - DNA, 20 bp, Artificial
  CRISPR gRNA sequence
ctaactgtagaatgcaagga

SEQ ID NO: 804994 - DNA, 20 bp, Artificial
  CRISPR gRNA sequence
taactgtagaatgcaaggaa

SEQ ID NO: 804995 - DNA, 20 bp, Artificial
  CRISPR gRNA sequence
actgtagaatgcaaggaatt

SEQ ID NO: 804996 - DNA, 20 bp, Artificial
  CRISPR gRNA sequence
tagaatgcaaggaattgttg

SEQ ID NO: 804997 - DNA, 20 bp, Artificial
  CRISPR gRNA sequence
ttgccaaaagaaaaagacag

SEQ ID NO: 804998 - DNA, 20 bp, Artificial
  CRISPR gRNA sequence
ccaaaagaaaaagacagagg

SEQ ID NO: 804999 - DNA, 20 bp, Artificial
  CRISPR gRNA sequence
catggtaaaggaggaggtat

SEQ ID NO: 805000 - DNA, 20 bp, Artificial
  CRISPR gRNA sequence
atggtaaaggaggaggtatg

SEQ ID NO: 805001 - DNA, 20 bp, Artificial
  CRISPR gRNA sequence
cgacttttaaatagaaccac

SEQ ID NO: 805002 - DNA, 20 bp, Artificial
  CRISPR gRNA sequence
gacttttaaatagaaccact

SEQ ID NO: 805003 - DNA, 20 bp, Artificial
  CRISPR gRNA sequence
ttaaatagaaccacttcaga

SEQ ID NO: 805004 - DNA, 20 bp, Artificial
  CRISPR gRNA sequence
taaatagaaccacttcagag

SEQ ID NO: 805005 - DNA, 20 bp, Artificial
  CRISPR gRNA sequence
aaatagaaccacttcagaga

SEQ ID NO: 805006 - DNA, 20 bp, Artificial
  CRISPR gRNA sequence
aatagaaccacttcagagag

SEQ ID NO: 805007 - DNA, 20 bp, Artificial
  CRISPR gRNA sequence
cagagagttgtgtcaggtgc

SEQ ID NO: 805008 - DNA, 20 bp, Artificial
  CRISPR gRNA sequence
agagagttgtgtcaggtgca

SEQ ID NO: 805009 - DNA, 20 bp, Artificial
  CRISPR gRNA sequence
tgtcaggtgcacctcagttg

SEQ ID NO: 805010 - DNA, 20 bp, Artificial
  CRISPR gRNA sequence
agttgtcttatcttctgcca

SEQ ID NO: 805011 - DNA, 20 bp, Artificial
  CRISPR gRNA sequence
tcttatcttctgccattctt

SEQ ID NO: 805012 - DNA, 20 bp, Artificial
  CRISPR gRNA sequence
atcttctgccattcttcttt

SEQ ID NO: 805013 - DNA, 20 bp, Artificial
  CRISPR gRNA sequence
tcttctgccattcttctttt

SEQ ID NO: 805014 - DNA, 20 bp, Artificial
  CRISPR gRNA sequence
ctgccattcttcttttacct

SEQ ID NO: 805015 - DNA, 20 bp, Artificial
  CRISPR gRNA sequence
tgccattcttcttttacctc

SEQ ID NO: 805016 - DNA, 20 bp, Artificial
  CRISPR gRNA sequence
ccattcttcttttacctctc

SEQ ID NO: 805017 - DNA, 20 bp, Artificial
  CRISPR gRNA sequence
ttcttttacctctcacaccc

SEQ ID NO: 805018 - DNA, 20 bp, Artificial
  CRISPR gRNA sequence
cttttacctctcacacccat

SEQ ID NO: 805019 - DNA, 20 bp, Artificial
  CRISPR gRNA sequence
ttttacctctcacacccata

SEQ ID NO: 805020 - DNA, 20 bp, Artificial
  CRISPR gRNA sequence
ttacctctcacacccatacc

SEQ ID NO: 805021 - DNA, 20 bp, Artificial
  CRISPR gRNA sequence
tacctctcacacccatacct

SEQ ID NO: 805022 - DNA, 20 bp, Artificial
  CRISPR gRNA sequence
acctctcacacccatacctc

SEQ ID NO: 805023 - DNA, 20 bp, Artificial
  CRISPR gRNA sequence
cctctcacacccatacctca

SEQ ID NO: 805024 - DNA, 20 bp, Artificial
  CRISPR gRNA sequence
tcacacccatacctcagggt

SEQ ID NO: 805025 - DNA, 20 bp, Artificial
  CRISPR gRNA sequence
acacccatacctcagggttc

SEQ ID NO: 805026 - DNA, 20 bp, Artificial
  CRISPR gRNA sequence
agggttcaaggcctggggcc

SEQ ID NO: 805027 - DNA, 20 bp, Artificial
  CRISPR gRNA sequence
aaggcctggggcctgaggac

SEQ ID NO: 805028 - DNA, 20 bp, Artificial
  CRISPR gRNA sequence
gggcctgaggactccttaat

SEQ ID NO: 805029 - DNA, 20 bp, Artificial
  CRISPR gRNA sequence
aggactccttaataacttca

SEQ ID NO: 805030 - DNA, 20 bp, Artificial
  CRISPR gRNA sequence
cttaataacttcagaaatga

SEQ ID NO: 805031 - DNA, 20 bp, Artificial
  CRISPR gRNA sequence
aataacttcagaaatgagca

SEQ ID NO: 805032 - DNA, 20 bp, Artificial
  CRISPR gRNA sequence
ataacttcagaaatgagcag

SEQ ID NO: 805033 - DNA, 20 bp, Artificial
  CRISPR gRNA sequence
cagaaatgagcagctgagtg

SEQ ID NO: 805034 - DNA, 20 bp, Artificial
  CRISPR gRNA sequence
agaaatgagcagctgagtgt

SEQ ID NO: 805035 - DNA, 20 bp, Artificial
  CRISPR gRNA sequence
agtgttccgttccagctgtc

SEQ ID NO: 805036 - DNA, 20 bp, Artificial
  CRISPR gRNA sequence
cgttccagctgtctttggga

SEQ ID NO: 805037 - DNA, 20 bp, Artificial
  CRISPR gRNA sequence
cagctgtctttgggagaatg

SEQ ID NO: 805038 - DNA, 20 bp, Artificial
  CRISPR gRNA sequence
tctttgggagaatggaatgg

SEQ ID NO: 805039 - DNA, 20 bp, Artificial
  CRISPR gRNA sequence
tgggagaatggaatggagtc

SEQ ID NO: 805040 - DNA, 20 bp, Artificial
  CRISPR gRNA sequence
gggagaatggaatggagtca

SEQ ID NO: 805041 - DNA, 20 bp, Artificial
  CRISPR gRNA sequence
ggagaatggaatggagtcac

SEQ ID NO: 805042 - DNA, 20 bp, Artificial
  CRISPR gRNA sequence
aaagatagagtggaaataaa

SEQ ID NO: 805043 - DNA, 20 bp, Artificial
  CRISPR gRNA sequence
tcctcatccttcaccccaat

SEQ ID NO: 805044 - DNA, 20 bp, Artificial
  CRISPR gRNA sequence
ctcatccttcaccccaatct

SEQ ID NO: 805045 - DNA, 20 bp, Artificial
  CRISPR gRNA sequence
atccttcaccccaatcttaa

SEQ ID NO: 805046 - DNA, 20 bp, Artificial
  CRISPR gRNA sequence
caccccaatcttaagagtga

SEQ ID NO: 805047 - DNA, 20 bp, Artificial
  CRISPR gRNA sequence
accccaatcttaagagtgag

SEQ ID NO: 805048 - DNA, 20 bp, Artificial
  CRISPR gRNA sequence
aagagtgagtgaggatatca

SEQ ID NO: 805049 - DNA, 20 bp, Artificial
  CRISPR gRNA sequence
agagtgagtgaggatatcag

SEQ ID NO: 805050 - DNA, 20 bp, Artificial
  CRISPR gRNA sequence
cgagctgggaggtaaagctc

SEQ ID NO: 805051 - DNA, 20 bp, Artificial
  CRISPR gRNA sequence
ggaggtaaagctcaagttct

SEQ ID NO: 805052 - DNA, 20 bp, Artificial
  CRISPR gRNA sequence
aagttctaactgtgattagg

SEQ ID NO: 805053 - DNA, 20 bp, Artificial
  CRISPR gRNA sequence
taactgtgattaggagacct

SEQ ID NO: 805054 - DNA, 20 bp, Artificial
  CRISPR gRNA sequence
actgtgattaggagaccttt

SEQ ID NO: 805055 - DNA, 20 bp, Artificial
  CRISPR gRNA sequence
tgattaggagacctttctta

SEQ ID NO: 805056 - DNA, 20 bp, Artificial
  CRISPR gRNA sequence
ggagacctttcttacaaata

SEQ ID NO: 805057 - DNA, 20 bp, Artificial
  CRISPR gRNA sequence
tcttacaaataagaattaag

SEQ ID NO: 805058 - DNA, 20 bp, Artificial
  CRISPR gRNA sequence
cttacaaataagaattaagt

SEQ ID NO: 805059 - DNA, 20 bp, Artificial
  CRISPR gRNA sequence
ttacaaataagaattaagtg

SEQ ID NO: 805060 - DNA, 20 bp, Artificial
  CRISPR gRNA sequence
acaaataagaattaagtgaa

SEQ ID NO: 805061 - DNA, 20 bp, Artificial
  CRISPR gRNA sequence
caaataagaattaagtgaat

SEQ ID NO: 805062 - DNA, 20 bp, Artificial
  CRISPR gRNA sequence
agtgaataaatgtgcaaaca

SEQ ID NO: 805063 - DNA, 20 bp, Artificial
  CRISPR gRNA sequence
cttttatatttttaatgaac

SEQ ID NO: 805064 - DNA, 20 bp, Artificial
  CRISPR gRNA sequence
ttttatatttttaatgaacc

SEQ ID NO: 805065 - DNA, 20 bp, Artificial
  CRISPR gRNA sequence
ttatatttttaatgaaccag

SEQ ID NO: 805066 - DNA, 20 bp, Artificial
  CRISPR gRNA sequence
tatatttttaatgaaccaga

SEQ ID NO: 805067 - DNA, 20 bp, Artificial
  CRISPR gRNA sequence
atatttttaatgaaccagag

SEQ ID NO: 805068 - DNA, 20 bp, Artificial
  CRISPR gRNA sequence
tatttttaatgaaccagaga

SEQ ID NO: 805069 - DNA, 20 bp, Artificial
  CRISPR gRNA sequence
ttaatgaaccagagagaaat

SEQ ID NO: 805070 - DNA, 20 bp, Artificial
  CRISPR gRNA sequence
taatgaaccagagagaaatc

SEQ ID NO: 805071 - DNA, 20 bp, Artificial
  CRISPR gRNA sequence
aatgaaccagagagaaatca

SEQ ID NO: 805072 - DNA, 20 bp, Artificial
  CRISPR gRNA sequence
atgaaccagagagaaatcat

SEQ ID NO: 805073 - DNA, 20 bp, Artificial
  CRISPR gRNA sequence
cctatataacccttgtctcc

SEQ ID NO: 805074 - DNA, 20 bp, Artificial
  CRISPR gRNA sequence
tataacccttgtctccaact

SEQ ID NO: 805075 - DNA, 20 bp, Artificial
  CRISPR gRNA sequence
gtctccaactcacttgcatt

SEQ ID NO: 805076 - DNA, 20 bp, Artificial
  CRISPR gRNA sequence
tctccaactcacttgcattc

SEQ ID NO: 805077 - DNA, 20 bp, Artificial
  CRISPR gRNA sequence
caactcacttgcattcagat

SEQ ID NO: 805078 - DNA, 20 bp, Artificial
  CRISPR gRNA sequence
acttgcattcagatctgctt

SEQ ID NO: 805079 - DNA, 20 bp, Artificial
  CRISPR gRNA sequence
gcattcagatctgctttctt

SEQ ID NO: 805080 - DNA, 20 bp, Artificial
  CRISPR gRNA sequence
cattcagatctgctttctta

SEQ ID NO: 805081 - DNA, 20 bp, Artificial
  CRISPR gRNA sequence
agatctgctttcttacatgt

SEQ ID NO: 805082 - DNA, 20 bp, Artificial
  CRISPR gRNA sequence
ctttcttacatgtgtctgcc

SEQ ID NO: 805083 - DNA, 20 bp, Artificial
  CRISPR gRNA sequence
tcttacatgtgtctgccatg

SEQ ID NO: 805084 - DNA, 20 bp, Artificial
  CRISPR gRNA sequence
cttacatgtgtctgccatgc

SEQ ID NO: 805085 - DNA, 20 bp, Artificial
  CRISPR gRNA sequence
ttacatgtgtctgccatgca

SEQ ID NO: 805086 - DNA, 20 bp, Artificial
  CRISPR gRNA sequence
acatgtgtctgccatgcaca

SEQ ID NO: 805087 - DNA, 20 bp, Artificial
  CRISPR gRNA sequence
catgtgtctgccatgcacac

SEQ ID NO: 805088 - DNA, 20 bp, Artificial
  CRISPR gRNA sequence
ccatgcacacaaacttgtgt

SEQ ID NO: 805089 - DNA, 20 bp, Artificial
  CRISPR gRNA sequence
gtgtgccatggaaaagggtt

SEQ ID NO: 805090 - DNA, 20 bp, Artificial
  CRISPR gRNA sequence
tgtgccatggaaaagggttg

SEQ ID NO: 805091 - DNA, 20 bp, Artificial
  CRISPR gRNA sequence
agaactgctggtgatgcaga

SEQ ID NO: 805092 - DNA, 20 bp, Artificial
  CRISPR gRNA sequence
ctggtgatgcagacagagct

SEQ ID NO: 805093 - DNA, 20 bp, Artificial
  CRISPR gRNA sequence
gtgatgcagacagagcttta

SEQ ID NO: 805094 - DNA, 20 bp, Artificial
  CRISPR gRNA sequence
taaaccagggtcagagggct

SEQ ID NO: 805095 - DNA, 20 bp, Artificial
  CRISPR gRNA sequence
aaaccagggtcagagggcta

SEQ ID NO: 805096 - DNA, 20 bp, Artificial
  CRISPR gRNA sequence
aaccagggtcagagggctag

SEQ ID NO: 805097 - DNA, 20 bp, Artificial
  CRISPR gRNA sequence
ggctgggaccttgtgctgcc

SEQ ID NO: 805098 - DNA, 20 bp, Artificial
  CRISPR gRNA sequence
ggaccttgtgctgccatttg

SEQ ID NO: 805099 - DNA, 20 bp, Artificial
  CRISPR gRNA sequence
gtgctgccatttgttggctt

SEQ ID NO: 805100 - DNA, 20 bp, Artificial
  CRISPR gRNA sequence
tgctgccatttgttggcttt

SEQ ID NO: 805101 - DNA, 20 bp, Artificial
  CRISPR gRNA sequence
ccatttgttggctttctgac

SEQ ID NO: 805102 - DNA, 20 bp, Artificial
  CRISPR gRNA sequence
gttggctttctgaccttgta

SEQ ID NO: 805103 - DNA, 20 bp, Artificial
  CRISPR gRNA sequence
ttggctttctgaccttgtac

SEQ ID NO: 805104 - DNA, 20 bp, Artificial
  CRISPR gRNA sequence
gctttctgaccttgtacaaa

SEQ ID NO: 805105 - DNA, 20 bp, Artificial
  CRISPR gRNA sequence
tctgaccttgtacaaattgc

SEQ ID NO: 805106 - DNA, 20 bp, Artificial
  CRISPR gRNA sequence
ctgaccttgtacaaattgcc

SEQ ID NO: 805107 - DNA, 20 bp, Artificial
  CRISPR gRNA sequence
tgaccttgtacaaattgcct

SEQ ID NO: 805108 - DNA, 20 bp, Artificial
  CRISPR gRNA sequence
accttgtacaaattgcctat

SEQ ID NO: 805109 - DNA, 20 bp, Artificial
  CRISPR gRNA sequence
gtacaaattgcctatcttct

SEQ ID NO: 805110 - DNA, 20 bp, Artificial
  CRISPR gRNA sequence
tacaaattgcctatcttctt

SEQ ID NO: 805111 - DNA, 20 bp, Artificial
  CRISPR gRNA sequence
cctatcttctttgagatggt

SEQ ID NO: 805112 - DNA, 20 bp, Artificial
  CRISPR gRNA sequence
tcttctttgagatggtcttt

SEQ ID NO: 805113 - DNA, 20 bp, Artificial
  CRISPR gRNA sequence
ctttgagatggtctttctat

SEQ ID NO: 805114 - DNA, 20 bp, Artificial
  CRISPR gRNA sequence
tttgagatggtctttctatc

SEQ ID NO: 805115 - DNA, 20 bp, Artificial
  CRISPR gRNA sequence
tgagatggtctttctatctg

SEQ ID NO: 805116 - DNA, 20 bp, Artificial
  CRISPR gRNA sequence
gagatggtctttctatctgt

SEQ ID NO: 805117 - DNA, 20 bp, Artificial
  CRISPR gRNA sequence
agatggtctttctatctgta

SEQ ID NO: 805118 - DNA, 20 bp, Artificial
  CRISPR gRNA sequence
tctatctgtaaaaggggaag

SEQ ID NO: 805119 - DNA, 20 bp, Artificial
  CRISPR gRNA sequence
ctatctgtaaaaggggaagc

SEQ ID NO: 805120 - DNA, 20 bp, Artificial
  CRISPR gRNA sequence
tatctgtaaaaggggaagca

SEQ ID NO: 805121 - DNA, 20 bp, Artificial
  CRISPR gRNA sequence
tctgtaaaaggggaagcagc

SEQ ID NO: 805122 - DNA, 20 bp, Artificial
  CRISPR gRNA sequence
taaaaggggaagcagcaaga

SEQ ID NO: 805123 - DNA, 20 bp, Artificial
  CRISPR gRNA sequence
tacagcttattggccgaact

SEQ ID NO: 805124 - DNA, 20 bp, Artificial
  CRISPR gRNA sequence
acagcttattggccgaactt

SEQ ID NO: 805125 - DNA, 20 bp, Artificial
  CRISPR gRNA sequence
cagcttattggccgaacttc

SEQ ID NO: 805126 - DNA, 20 bp, Artificial
  CRISPR gRNA sequence
attggccgaacttcactgcc

SEQ ID NO: 805127 - DNA, 20 bp, Artificial
  CRISPR gRNA sequence
ttggccgaacttcactgccg

SEQ ID NO: 805128 - DNA, 20 bp, Artificial
  CRISPR gRNA sequence
gccgaacttcactgccgcta

SEQ ID NO: 805129 - DNA, 20 bp, Artificial
  CRISPR gRNA sequence
cactgccgctagtgtggttc

SEQ ID NO: 805130 - DNA, 20 bp, Artificial
  CRISPR gRNA sequence
actgccgctagtgtggttca

SEQ ID NO: 805131 - DNA, 20 bp, Artificial
  CRISPR gRNA sequence
ccgctagtgtggttcaactt

SEQ ID NO: 805132 - DNA, 20 bp, Artificial
  CRISPR gRNA sequence
gtgtggttcaacttggacta

SEQ ID NO: 805133 - DNA, 20 bp, Artificial
  CRISPR gRNA sequence
aacttggactacagagaaat

SEQ ID NO: 805134 - DNA, 20 bp, Artificial
  CRISPR gRNA sequence
ggactacagagaaatcttcc

SEQ ID NO: 805135 - DNA, 20 bp, Artificial
  CRISPR gRNA sequence
gactacagagaaatcttcct

SEQ ID NO: 805136 - DNA, 20 bp, Artificial
  CRISPR gRNA sequence
cagagaaatcttcctaactg

SEQ ID NO: 805137 - DNA, 20 bp, Artificial
  CRISPR gRNA sequence
cctaactggtttccctgtat

SEQ ID NO: 805138 - DNA, 20 bp, Artificial
  CRISPR gRNA sequence
ctaactggtttccctgtatt

SEQ ID NO: 805139 - DNA, 20 bp, Artificial
  CRISPR gRNA sequence
actggtttccctgtattcac

SEQ ID NO: 805140 - DNA, 20 bp, Artificial
  CRISPR gRNA sequence
gtttccctgtattcactcct

SEQ ID NO: 805141 - DNA, 20 bp, Artificial
  CRISPR gRNA sequence
ccctgtattcactcctgcta

SEQ ID NO: 805142 - DNA, 20 bp, Artificial
  CRISPR gRNA sequence
cctgtattcactcctgctac

SEQ ID NO: 805143 - DNA, 20 bp, Artificial
  CRISPR gRNA sequence
tattcactcctgctacctcc

SEQ ID NO: 805144 - DNA, 20 bp, Artificial
  CRISPR gRNA sequence
actcctgctacctccaactt

SEQ ID NO: 805145 - DNA, 20 bp, Artificial
  CRISPR gRNA sequence
ctgctacctccaacttggtc

SEQ ID NO: 805146 - DNA, 20 bp, Artificial
  CRISPR gRNA sequence
ctacctccaacttggtctgt

SEQ ID NO: 805147 - DNA, 20 bp, Artificial
  CRISPR gRNA sequence
cctccaacttggtctgttct

SEQ ID NO: 805148 - DNA, 20 bp, Artificial
  CRISPR gRNA sequence
caacttggtctgttctcact

SEQ ID NO: 805149 - DNA, 20 bp, Artificial
  CRISPR gRNA sequence
ggtctgttctcactttttgc

SEQ ID NO: 805150 - DNA, 20 bp, Artificial
  CRISPR gRNA sequence
gtctgttctcactttttgct

SEQ ID NO: 805151 - DNA, 20 bp, Artificial
  CRISPR gRNA sequence
ttctcactttttgctataat

SEQ ID NO: 805152 - DNA, 20 bp, Artificial
  CRISPR gRNA sequence
tcactttttgctataatagg

SEQ ID NO: 805153 - DNA, 20 bp, Artificial
  CRISPR gRNA sequence
actttttgctataataggct

SEQ ID NO: 805154 - DNA, 20 bp, Artificial
  CRISPR gRNA sequence
tttgctataataggctttta

SEQ ID NO: 805155 - DNA, 20 bp, Artificial
  CRISPR gRNA sequence
ttgctataataggcttttaa

SEQ ID NO: 805156 - DNA, 20 bp, Artificial
  CRISPR gRNA sequence
tgctataataggcttttaaa

SEQ ID NO: 805157 - DNA, 20 bp, Artificial
  CRISPR gRNA sequence
gctataataggcttttaaaa

SEQ ID NO: 805158 - DNA, 20 bp, Artificial
  CRISPR gRNA sequence
ctataataggcttttaaaaa

SEQ ID NO: 805159 - DNA, 20 bp, Artificial
  CRISPR gRNA sequence
taataggcttttaaaaatca

SEQ ID NO: 805160 - DNA, 20 bp, Artificial
  CRISPR gRNA sequence
ttaaaaatcataaatctacc

SEQ ID NO: 805161 - DNA, 20 bp, Artificial
  CRISPR gRNA sequence
taaaaatcataaatctacca

SEQ ID NO: 805162 - DNA, 20 bp, Artificial
  CRISPR gRNA sequence
aaaaatcataaatctaccat

SEQ ID NO: 805163 - DNA, 20 bp, Artificial
  CRISPR gRNA sequence
aaaatcataaatctaccatg

SEQ ID NO: 805164 - DNA, 20 bp, Artificial
  CRISPR gRNA sequence
ccatgtgtcctctgtccaga

SEQ ID NO: 805165 - DNA, 20 bp, Artificial
  CRISPR gRNA sequence
tgtccagaccttctccatgg

SEQ ID NO: 805166 - DNA, 20 bp, Artificial
  CRISPR gRNA sequence
tccagaccttctccatggct

SEQ ID NO: 805167 - DNA, 20 bp, Artificial
  CRISPR gRNA sequence
ctccatggcttcttattgct

SEQ ID NO: 805168 - DNA, 20 bp, Artificial
  CRISPR gRNA sequence
tccatggcttcttattgctc

SEQ ID NO: 805169 - DNA, 20 bp, Artificial
  CRISPR gRNA sequence
catggcttcttattgctcac

SEQ ID NO: 805170 - DNA, 20 bp, Artificial
  CRISPR gRNA sequence
cttattgctcactggatgaa

SEQ ID NO: 805171 - DNA, 20 bp, Artificial
  CRISPR gRNA sequence
ttattgctcactggatgaag

SEQ ID NO: 805172 - DNA, 20 bp, Artificial
  CRISPR gRNA sequence
attgctcactggatgaagtt

SEQ ID NO: 805173 - DNA, 20 bp, Artificial
  CRISPR gRNA sequence
ttgctcactggatgaagttc

SEQ ID NO: 805174 - DNA, 20 bp, Artificial
  CRISPR gRNA sequence
ctcactggatgaagttccaa

SEQ ID NO: 805175 - DNA, 20 bp, Artificial
  CRISPR gRNA sequence
actggatgaagttccaacga

SEQ ID NO: 805176 - DNA, 20 bp, Artificial
  CRISPR gRNA sequence
gatgaagttccaacgagccc

SEQ ID NO: 805177 - DNA, 20 bp, Artificial
  CRISPR gRNA sequence
caacgagcccaggatggttt

SEQ ID NO: 805178 - DNA, 20 bp, Artificial
  CRISPR gRNA sequence
gactcatgtctccagcttta

SEQ ID NO: 805179 - DNA, 20 bp, Artificial
  CRISPR gRNA sequence
actcatgtctccagctttaa

SEQ ID NO: 805180 - DNA, 20 bp, Artificial
  CRISPR gRNA sequence
atgtctccagctttaactgc

SEQ ID NO: 805181 - DNA, 20 bp, Artificial
  CRISPR gRNA sequence
cagctttaactgcatcacca

SEQ ID NO: 805182 - DNA, 20 bp, Artificial
  CRISPR gRNA sequence
taactgcatcaccatcacct

SEQ ID NO: 805183 - DNA, 20 bp, Artificial
  CRISPR gRNA sequence
aactgcatcaccatcacctt

SEQ ID NO: 805184 - DNA, 20 bp, Artificial
  CRISPR gRNA sequence
actgcatcaccatcaccttc

SEQ ID NO: 805185 - DNA, 20 bp, Artificial
  CRISPR gRNA sequence
catcaccatcaccttcattg

SEQ ID NO: 805186 - DNA, 20 bp, Artificial
  CRISPR gRNA sequence
cattgtctaaagctctaacc

SEQ ID NO: 805187 - DNA, 20 bp, Artificial
  CRISPR gRNA sequence
attgtctaaagctctaacca

SEQ ID NO: 805188 - DNA, 20 bp, Artificial
  CRISPR gRNA sequence
tctaaagctctaaccacaca

SEQ ID NO: 805189 - DNA, 20 bp, Artificial
  CRISPR gRNA sequence
aagctctaaccacacaggat

SEQ ID NO: 805190 - DNA, 20 bp, Artificial
  CRISPR gRNA sequence
taaccacacaggattttcta

SEQ ID NO: 805191 - DNA, 20 bp, Artificial
  CRISPR gRNA sequence
accacacaggattttctagt

SEQ ID NO: 805192 - DNA, 20 bp, Artificial
  CRISPR gRNA sequence
tctagtcctcagaggcatgg

SEQ ID NO: 805193 - DNA, 20 bp, Artificial
  CRISPR gRNA sequence
ctagtcctcagaggcatggc

SEQ ID NO: 805194 - DNA, 20 bp, Artificial
  CRISPR gRNA sequence
tagtcctcagaggcatggca

SEQ ID NO: 805195 - DNA, 20 bp, Artificial
  CRISPR gRNA sequence
gtcctcagaggcatggcagt

SEQ ID NO: 805196 - DNA, 20 bp, Artificial
  CRISPR gRNA sequence
agaggcatggcagtctttca

SEQ ID NO: 805197 - DNA, 20 bp, Artificial
  CRISPR gRNA sequence
tcaattccgagttttctcat

SEQ ID NO: 805198 - DNA, 20 bp, Artificial
  CRISPR gRNA sequence
caattccgagttttctcata

SEQ ID NO: 805199 - DNA, 20 bp, Artificial
  CRISPR gRNA sequence
aattccgagttttctcatac

SEQ ID NO: 805200 - DNA, 20 bp, Artificial
  CRISPR gRNA sequence
cgagttttctcatacaatat

SEQ ID NO: 805201 - DNA, 20 bp, Artificial
  CRISPR gRNA sequence
tctcatacaatattgtctct

SEQ ID NO: 805202 - DNA, 20 bp, Artificial
  CRISPR gRNA sequence
ctcatacaatattgtctctt

SEQ ID NO: 805203 - DNA, 20 bp, Artificial
  CRISPR gRNA sequence
tcatacaatattgtctcttc

SEQ ID NO: 805204 - DNA, 20 bp, Artificial
  CRISPR gRNA sequence
atacaatattgtctcttctt

SEQ ID NO: 805205 - DNA, 20 bp, Artificial
  CRISPR gRNA sequence
tctcttcttaaaatattttt

SEQ ID NO: 805206 - DNA, 20 bp, Artificial
  CRISPR gRNA sequence
ttcttaaaatattttttctt

SEQ ID NO: 805207 - DNA, 20 bp, Artificial
  CRISPR gRNA sequence
cttaaaatattttttcttgt

SEQ ID NO: 805208 - DNA, 20 bp, Artificial
  CRISPR gRNA sequence
ttaaaatattttttcttgtt

SEQ ID NO: 805209 - DNA, 20 bp, Artificial
  CRISPR gRNA sequence
aaaatattttttcttgttgt

SEQ ID NO: 805210 - DNA, 20 bp, Artificial
  CRISPR gRNA sequence
aaatattttttcttgttgtc

SEQ ID NO: 805211 - DNA, 20 bp, Artificial
  CRISPR gRNA sequence
tttcttgttgtccacctgag

SEQ ID NO: 805212 - DNA, 20 bp, Artificial
  CRISPR gRNA sequence
ttcttgttgtccacctgagt

SEQ ID NO: 805213 - DNA, 20 bp, Artificial
  CRISPR gRNA sequence
tcttgttgtccacctgagtt

SEQ ID NO: 805214 - DNA, 20 bp, Artificial
  CRISPR gRNA sequence
cttgttgtccacctgagttg

SEQ ID NO: 805215 - DNA, 20 bp, Artificial
  CRISPR gRNA sequence
ttgttgtccacctgagttgg

SEQ ID NO: 805216 - DNA, 20 bp, Artificial
  CRISPR gRNA sequence
gttgtccacctgagttggag

SEQ ID NO: 805217 - DNA, 20 bp, Artificial
  CRISPR gRNA sequence
ttgtccacctgagttggagt

SEQ ID NO: 805218 - DNA, 20 bp, Artificial
  CRISPR gRNA sequence
tccacctgagttggagtcat

SEQ ID NO: 805219 - DNA, 20 bp, Artificial
  CRISPR gRNA sequence
agttggagtcatcttttaaa

SEQ ID NO: 805220 - DNA, 20 bp, Artificial
  CRISPR gRNA sequence
gagtcatcttttaaatctca

SEQ ID NO: 805221 - DNA, 20 bp, Artificial
  CRISPR gRNA sequence
ttaaatctcagctaagctta

SEQ ID NO: 805222 - DNA, 20 bp, Artificial
  CRISPR gRNA sequence
taaatctcagctaagcttat

SEQ ID NO: 805223 - DNA, 20 bp, Artificial
  CRISPR gRNA sequence
aaatctcagctaagcttata

SEQ ID NO: 805224 - DNA, 20 bp, Artificial
  CRISPR gRNA sequence
aatctcagctaagcttatac

SEQ ID NO: 805225 - DNA, 20 bp, Artificial
  CRISPR gRNA sequence
agctaagcttatacttcatc

SEQ ID NO: 805226 - DNA, 20 bp, Artificial
  CRISPR gRNA sequence
agcttatacttcatcaagtc

SEQ ID NO: 805227 - DNA, 20 bp, Artificial
  CRISPR gRNA sequence
atacttcatcaagtctttcc

SEQ ID NO: 805228 - DNA, 20 bp, Artificial
  CRISPR gRNA sequence
tacttcatcaagtctttcct

SEQ ID NO: 805229 - DNA, 20 bp, Artificial
  CRISPR gRNA sequence
catcaagtctttcctaattc

SEQ ID NO: 805230 - DNA, 20 bp, Artificial
  CRISPR gRNA sequence
atcaagtctttcctaattct

SEQ ID NO: 805231 - DNA, 20 bp, Artificial
  CRISPR gRNA sequence
tcctaattctacctccacgc

SEQ ID NO: 805232 - DNA, 20 bp, Artificial
  CRISPR gRNA sequence
cctaattctacctccacgca

SEQ ID NO: 805233 - DNA, 20 bp, Artificial
  CRISPR gRNA sequence
ctaattctacctccacgcac

SEQ ID NO: 805234 - DNA, 20 bp, Artificial
  CRISPR gRNA sequence
attctacctccacgcaccac

SEQ ID NO: 805235 - DNA, 20 bp, Artificial
  CRISPR gRNA sequence
tacctccacgcaccacaccc

SEQ ID NO: 805236 - DNA, 20 bp, Artificial
  CRISPR gRNA sequence
cctccacgcaccacacccat

SEQ ID NO: 805237 - DNA, 20 bp, Artificial
  CRISPR gRNA sequence
cacgcaccacacccattaca

SEQ ID NO: 805238 - DNA, 20 bp, Artificial
  CRISPR gRNA sequence
cattaaatccccttattata

SEQ ID NO: 805239 - DNA, 20 bp, Artificial
  CRISPR gRNA sequence
aatccccttattatatgttt

SEQ ID NO: 805240 - DNA, 20 bp, Artificial
  CRISPR gRNA sequence
attatatgtttccatagcac

SEQ ID NO: 805241 - DNA, 20 bp, Artificial
  CRISPR gRNA sequence
ttatatgtttccatagcacc

SEQ ID NO: 805242 - DNA, 20 bp, Artificial
  CRISPR gRNA sequence
tatgtttccatagcacctac

SEQ ID NO: 805243 - DNA, 20 bp, Artificial
  CRISPR gRNA sequence
ccatagcacctacttcttct

SEQ ID NO: 805244 - DNA, 20 bp, Artificial
  CRISPR gRNA sequence
catagcacctacttcttctt

SEQ ID NO: 805245 - DNA, 20 bp, Artificial
  CRISPR gRNA sequence
cttcttctttcagtatactc

SEQ ID NO: 805246 - DNA, 20 bp, Artificial
  CRISPR gRNA sequence
cttctttcagtatactcagc

SEQ ID NO: 805247 - DNA, 20 bp, Artificial
  CRISPR gRNA sequence
ttctttcagtatactcagca

SEQ ID NO: 805248 - DNA, 20 bp, Artificial
  CRISPR gRNA sequence
ctttcagtatactcagcaca

SEQ ID NO: 805249 - DNA, 20 bp, Artificial
  CRISPR gRNA sequence
tttcagtatactcagcacac

SEQ ID NO: 805250 - DNA, 20 bp, Artificial
  CRISPR gRNA sequence
tcagtatactcagcacacaa

SEQ ID NO: 805251 - DNA, 20 bp, Artificial
  CRISPR gRNA sequence
cagtatactcagcacacaat

SEQ ID NO: 805252 - DNA, 20 bp, Artificial
  CRISPR gRNA sequence
agtatactcagcacacaatc

SEQ ID NO: 805253 - DNA, 20 bp, Artificial
  CRISPR gRNA sequence
agcacacaatcacatgtcta

SEQ ID NO: 805254 - DNA, 20 bp, Artificial
  CRISPR gRNA sequence
ggatctgttttaatagcttg

SEQ ID NO: 805255 - DNA, 20 bp, Artificial
  CRISPR gRNA sequence
ttttaatagcttggactacc

SEQ ID NO: 805256 - DNA, 20 bp, Artificial
  CRISPR gRNA sequence
taatagcttggactaccaat

SEQ ID NO: 805257 - DNA, 20 bp, Artificial
  CRISPR gRNA sequence
aatagcttggactaccaatt

SEQ ID NO: 805258 - DNA, 20 bp, Artificial
  CRISPR gRNA sequence
atagcttggactaccaatta

SEQ ID NO: 805259 - DNA, 20 bp, Artificial
  CRISPR gRNA sequence
ggactaccaattaaattgca

SEQ ID NO: 805260 - DNA, 20 bp, Artificial
  CRISPR gRNA sequence
gactaccaattaaattgcat

SEQ ID NO: 805261 - DNA, 20 bp, Artificial
  CRISPR gRNA sequence
ccaattaaattgcatccctt

SEQ ID NO: 805262 - DNA, 20 bp, Artificial
  CRISPR gRNA sequence
aattgcatcccttttaattt

SEQ ID NO: 805263 - DNA, 20 bp, Artificial
  CRISPR gRNA sequence
catcccttttaattttccaa

SEQ ID NO: 805264 - DNA, 20 bp, Artificial
  CRISPR gRNA sequence
ttaattttccaattgattcc

SEQ ID NO: 805265 - DNA, 20 bp, Artificial
  CRISPR gRNA sequence
taattttccaattgattcct

SEQ ID NO: 805266 - DNA, 20 bp, Artificial
  CRISPR gRNA sequence
aattttccaattgattcctc

SEQ ID NO: 805267 - DNA, 20 bp, Artificial
  CRISPR gRNA sequence
attttccaattgattcctca

SEQ ID NO: 805268 - DNA, 20 bp, Artificial
  CRISPR gRNA sequence
tccaattgattcctcaagta

SEQ ID NO: 805269 - DNA, 20 bp, Artificial
  CRISPR gRNA sequence
ccaattgattcctcaagtac

SEQ ID NO: 805270 - DNA, 20 bp, Artificial
  CRISPR gRNA sequence
caattgattcctcaagtacc

SEQ ID NO: 805271 - DNA, 20 bp, Artificial
  CRISPR gRNA sequence
attcctcaagtacccacatg

SEQ ID NO: 805272 - DNA, 20 bp, Artificial
  CRISPR gRNA sequence
ctcaagtacccacatgccca

SEQ ID NO: 805273 - DNA, 20 bp, Artificial
  CRISPR gRNA sequence
aagtacccacatgcccatct

SEQ ID NO: 805274 - DNA, 20 bp, Artificial
  CRISPR gRNA sequence
agcaagaagttcagtgtctc

SEQ ID NO: 805275 - DNA, 20 bp, Artificial
  CRISPR gRNA sequence
gcaagaagttcagtgtctcc

SEQ ID NO: 805276 - DNA, 20 bp, Artificial
  CRISPR gRNA sequence
agtgtctccctcttatagca

SEQ ID NO: 805277 - DNA, 20 bp, Artificial
  CRISPR gRNA sequence
cctcttatagcatgtacttc

SEQ ID NO: 805278 - DNA, 20 bp, Artificial
  CRISPR gRNA sequence
ttatagcatgtacttctcca

SEQ ID NO: 805279 - DNA, 20 bp, Artificial
  CRISPR gRNA sequence
atagcatgtacttctccacc

SEQ ID NO: 805280 - DNA, 20 bp, Artificial
  CRISPR gRNA sequence
tagcatgtacttctccacct

SEQ ID NO: 805281 - DNA, 20 bp, Artificial
  CRISPR gRNA sequence
ctccacctcccacaaactgc

SEQ ID NO: 805282 - DNA, 20 bp, Artificial
  CRISPR gRNA sequence
tccacctcccacaaactgcc

SEQ ID NO: 805283 - DNA, 20 bp, Artificial
  CRISPR gRNA sequence
cacctcccacaaactgccag

SEQ ID NO: 805284 - DNA, 20 bp, Artificial
  CRISPR gRNA sequence
ccacaaactgccagaaagct

SEQ ID NO: 805285 - DNA, 20 bp, Artificial
  CRISPR gRNA sequence
ccagaaagcttacttagccc

SEQ ID NO: 805286 - DNA, 20 bp, Artificial
  CRISPR gRNA sequence
acttagcccacagggccagt

SEQ ID NO: 805287 - DNA, 20 bp, Artificial
  CRISPR gRNA sequence
cttagcccacagggccagtg

SEQ ID NO: 805288 - DNA, 20 bp, Artificial
  CRISPR gRNA sequence
agcccacagggccagtgcta

SEQ ID NO: 805289 - DNA, 20 bp, Artificial
  CRISPR gRNA sequence
gcccacagggccagtgctag

SEQ ID NO: 805290 - DNA, 20 bp, Artificial
  CRISPR gRNA sequence
ggcagctaggttagtcctcc

SEQ ID NO: 805291 - DNA, 20 bp, Artificial
  CRISPR gRNA sequence
ggttagtcctccagagggcc

SEQ ID NO: 805292 - DNA, 20 bp, Artificial
  CRISPR gRNA sequence
gtcctccagagggccctggt

SEQ ID NO: 805293 - DNA, 20 bp, Artificial
  CRISPR gRNA sequence
cagagggccctggttttgag

SEQ ID NO: 805294 - DNA, 20 bp, Artificial
  CRISPR gRNA sequence
gttttgagcagttgctgtct

SEQ ID NO: 805295 - DNA, 20 bp, Artificial
  CRISPR gRNA sequence
tgagcagttgctgtctactc

SEQ ID NO: 805296 - DNA, 20 bp, Artificial
  CRISPR gRNA sequence
gagcagttgctgtctactcc

SEQ ID NO: 805297 - DNA, 20 bp, Artificial
  CRISPR gRNA sequence
agcagttgctgtctactccg

SEQ ID NO: 805298 - DNA, 20 bp, Artificial
  CRISPR gRNA sequence
ctgtctactccggccatgca

SEQ ID NO: 805299 - DNA, 20 bp, Artificial
  CRISPR gRNA sequence
tctactccggccatgcagaa

SEQ ID NO: 805300 - DNA, 20 bp, Artificial
  CRISPR gRNA sequence
ctccggccatgcagaatctc

SEQ ID NO: 805301 - DNA, 20 bp, Artificial
  CRISPR gRNA sequence
cggccatgcagaatctctgg

SEQ ID NO: 805302 - DNA, 20 bp, Artificial
  CRISPR gRNA sequence
tggtccttccagatgtctcc

SEQ ID NO: 805303 - DNA, 20 bp, Artificial
  CRISPR gRNA sequence
gtccttccagatgtctccat

SEQ ID NO: 805304 - DNA, 20 bp, Artificial
  CRISPR gRNA sequence
ccagatgtctccatccactg

SEQ ID NO: 805305 - DNA, 20 bp, Artificial
  CRISPR gRNA sequence
cagatgtctccatccactgt

SEQ ID NO: 805306 - DNA, 20 bp, Artificial
  CRISPR gRNA sequence
catccactgtgcaaaggtaa

SEQ ID NO: 805307 - DNA, 20 bp, Artificial
  CRISPR gRNA sequence
tgcaaaggtaaccttgctgg

SEQ ID NO: 805308 - DNA, 20 bp, Artificial
  CRISPR gRNA sequence
gctggttccgatccccacac

SEQ ID NO: 805309 - DNA, 20 bp, Artificial
  CRISPR gRNA sequence
ctggttccgatccccacaca

SEQ ID NO: 805310 - DNA, 20 bp, Artificial
  CRISPR gRNA sequence
gttccgatccccacacagac

SEQ ID NO: 805311 - DNA, 20 bp, Artificial
  CRISPR gRNA sequence
cgatccccacacagaccaca

SEQ ID NO: 805312 - DNA, 20 bp, Artificial
  CRISPR gRNA sequence
caagattacagttcttatgg

SEQ ID NO: 805313 - DNA, 20 bp, Artificial
  CRISPR gRNA sequence
cagttcttatggttccccaa

SEQ ID NO: 805314 - DNA, 20 bp, Artificial
  CRISPR gRNA sequence
ttatggttccccaacacatg

SEQ ID NO: 805315 - DNA, 20 bp, Artificial
  CRISPR gRNA sequence
atggttccccaacacatgct

SEQ ID NO: 805316 - DNA, 20 bp, Artificial
  CRISPR gRNA sequence
tggttccccaacacatgctc

SEQ ID NO: 805317 - DNA, 20 bp, Artificial
  CRISPR gRNA sequence
cccaacacatgctctgtcat

SEQ ID NO: 805318 - DNA, 20 bp, Artificial
  CRISPR gRNA sequence
tgtcattggtcccaaagcag

SEQ ID NO: 805319 - DNA, 20 bp, Artificial
  CRISPR gRNA sequence
tcattggtcccaaagcagga

SEQ ID NO: 805320 - DNA, 20 bp, Artificial
  CRISPR gRNA sequence
gtcccaaagcaggaccccta

SEQ ID NO: 805321 - DNA, 20 bp, Artificial
  CRISPR gRNA sequence
tgggttgatgaggtaggagg

SEQ ID NO: 805322 - DNA, 20 bp, Artificial
  CRISPR gRNA sequence
atgaggtaggaggaggtccc

SEQ ID NO: 805323 - DNA, 20 bp, Artificial
  CRISPR gRNA sequence
ccttagccacagctgcacac

SEQ ID NO: 805324 - DNA, 20 bp, Artificial
  CRISPR gRNA sequence
agccacagctgcacacagcc

SEQ ID NO: 805325 - DNA, 20 bp, Artificial
  CRISPR gRNA sequence
gccacagctgcacacagcca

SEQ ID NO: 805326 - DNA, 20 bp, Artificial
  CRISPR gRNA sequence
cacacagccagcctcttccc

SEQ ID NO: 805327 - DNA, 20 bp, Artificial
  CRISPR gRNA sequence
ttcccttctaggccctcatg

SEQ ID NO: 805328 - DNA, 20 bp, Artificial
  CRISPR gRNA sequence
cccttctaggccctcatgtt

SEQ ID NO: 805329 - DNA, 20 bp, Artificial
  CRISPR gRNA sequence
ccttctaggccctcatgttg

SEQ ID NO: 805330 - DNA, 20 bp, Artificial
  CRISPR gRNA sequence
ctaggccctcatgttgagcc

SEQ ID NO: 805331 - DNA, 20 bp, Artificial
  CRISPR gRNA sequence
taggccctcatgttgagcct

SEQ ID NO: 805332 - DNA, 20 bp, Artificial
  CRISPR gRNA sequence
ggccctcatgttgagcctgg

SEQ ID NO: 805333 - DNA, 20 bp, Artificial
  CRISPR gRNA sequence
atgttgagcctgggacgcca

SEQ ID NO: 805334 - DNA, 20 bp, Artificial
  CRISPR gRNA sequence
agcctgggacgccagtccta

SEQ ID NO: 805335 - DNA, 20 bp, Artificial
  CRISPR gRNA sequence
ggacgccagtcctaacttcc

SEQ ID NO: 805336 - DNA, 20 bp, Artificial
  CRISPR gRNA sequence
acttccttctcttcagttcc

SEQ ID NO: 805337 - DNA, 20 bp, Artificial
  CRISPR gRNA sequence
ccttctcttcagttcctctt

SEQ ID NO: 805338 - DNA, 20 bp, Artificial
  CRISPR gRNA sequence
cttctcttcagttcctctta

SEQ ID NO: 805339 - DNA, 20 bp, Artificial
  CRISPR gRNA sequence
ctcttcagttcctcttaggg

SEQ ID NO: 805340 - DNA, 20 bp, Artificial
  CRISPR gRNA sequence
tcttcagttcctcttagggc

SEQ ID NO: 805341 - DNA, 20 bp, Artificial
  CRISPR gRNA sequence
ttcagttcctcttagggcca

SEQ ID NO: 805342 - DNA, 20 bp, Artificial
  CRISPR gRNA sequence
cagttcctcttagggccatt

SEQ ID NO: 805343 - DNA, 20 bp, Artificial
  CRISPR gRNA sequence
agttcctcttagggccattg

SEQ ID NO: 805344 - DNA, 20 bp, Artificial
  CRISPR gRNA sequence
ctcttagggccattggtatc

SEQ ID NO: 805345 - DNA, 20 bp, Artificial
  CRISPR gRNA sequence
ttagggccattggtatcctg

SEQ ID NO: 805346 - DNA, 20 bp, Artificial
  CRISPR gRNA sequence
agggccattggtatcctgaa

SEQ ID NO: 805347 - DNA, 20 bp, Artificial
  CRISPR gRNA sequence
gggccattggtatcctgaat

SEQ ID NO: 805348 - DNA, 20 bp, Artificial
  CRISPR gRNA sequence
gtatcctgaatttcttagtc

SEQ ID NO: 805349 - DNA, 20 bp, Artificial
  CRISPR gRNA sequence
aatttcttagtccattgcaa

SEQ ID NO: 805350 - DNA, 20 bp, Artificial
  CRISPR gRNA sequence
cttagtccattgcaaagtta

SEQ ID NO: 805351 - DNA, 20 bp, Artificial
  CRISPR gRNA sequence
ttagtccattgcaaagttaa

SEQ ID NO: 805352 - DNA, 20 bp, Artificial
  CRISPR gRNA sequence
agtccattgcaaagttaagt

SEQ ID NO: 805353 - DNA, 20 bp, Artificial
  CRISPR gRNA sequence
gtccattgcaaagttaagta

SEQ ID NO: 805354 - DNA, 20 bp, Artificial
  CRISPR gRNA sequence
caaagttaagtaaagaagca

SEQ ID NO: 805355 - DNA, 20 bp, Artificial
  CRISPR gRNA sequence
agtaaagaagcagcaggctt

SEQ ID NO: 805356 - DNA, 20 bp, Artificial
  CRISPR gRNA sequence
ggtccctttccttccagatg

SEQ ID NO: 805357 - DNA, 20 bp, Artificial
  CRISPR gRNA sequence
gtccctttccttccagatgg

SEQ ID NO: 805358 - DNA, 20 bp, Artificial
  CRISPR gRNA sequence
tccttccagatggcttctta

SEQ ID NO: 805359 - DNA, 20 bp, Artificial
  CRISPR gRNA sequence
ccttccagatggcttcttag

SEQ ID NO: 805360 - DNA, 20 bp, Artificial
  CRISPR gRNA sequence
cttccagatggcttcttagc

SEQ ID NO: 805361 - DNA, 20 bp, Artificial
  CRISPR gRNA sequence
ccagatggcttcttagctcc

SEQ ID NO: 805362 - DNA, 20 bp, Artificial
  CRISPR gRNA sequence
cagatggcttcttagctcct

SEQ ID NO: 805363 - DNA, 20 bp, Artificial
  CRISPR gRNA sequence
cttagctcctgaacagattt

SEQ ID NO: 805364 - DNA, 20 bp, Artificial
  CRISPR gRNA sequence
ttagctcctgaacagattta

SEQ ID NO: 805365 - DNA, 20 bp, Artificial
  CRISPR gRNA sequence
agctcctgaacagatttacc

SEQ ID NO: 805366 - DNA, 20 bp, Artificial
  CRISPR gRNA sequence
gctcctgaacagatttaccc

SEQ ID NO: 805367 - DNA, 20 bp, Artificial
  CRISPR gRNA sequence
ctgaacagatttacccacct

SEQ ID NO: 805368 - DNA, 20 bp, Artificial
  CRISPR gRNA sequence
aacagatttacccacctata

SEQ ID NO: 805369 - DNA, 20 bp, Artificial
  CRISPR gRNA sequence
acccacctatacctcagtga

SEQ ID NO: 805370 - DNA, 20 bp, Artificial
  CRISPR gRNA sequence
cccacctatacctcagtgac

SEQ ID NO: 805371 - DNA, 20 bp, Artificial
  CRISPR gRNA sequence
tacctcagtgactagctctg

SEQ ID NO: 805372 - DNA, 20 bp, Artificial
  CRISPR gRNA sequence
agtgactagctctgtgtact

SEQ ID NO: 805373 - DNA, 20 bp, Artificial
  CRISPR gRNA sequence
gctctgtgtactaaagtgta

SEQ ID NO: 805374 - DNA, 20 bp, Artificial
  CRISPR gRNA sequence
tgtgtactaaagtgtattgg

SEQ ID NO: 805375 - DNA, 20 bp, Artificial
  CRISPR gRNA sequence
tgtactaaagtgtattggga

SEQ ID NO: 805376 - DNA, 20 bp, Artificial
  CRISPR gRNA sequence
aagtgtattgggagggcagc

SEQ ID NO: 805377 - DNA, 20 bp, Artificial
  CRISPR gRNA sequence
ggagggcagccattattggt

SEQ ID NO: 805378 - DNA, 20 bp, Artificial
  CRISPR gRNA sequence
ttggtccataaaaggtcctg

SEQ ID NO: 805379 - DNA, 20 bp, Artificial
  CRISPR gRNA sequence
gtccataaaaggtcctgctt

SEQ ID NO: 805380 - DNA, 20 bp, Artificial
  CRISPR gRNA sequence
cttaccattttcccctaaga

SEQ ID NO: 805381 - DNA, 20 bp, Artificial
  CRISPR gRNA sequence
accattttcccctaagagga

SEQ ID NO: 805382 - DNA, 20 bp, Artificial
  CRISPR gRNA sequence
ccattttcccctaagaggaa

SEQ ID NO: 805383 - DNA, 20 bp, Artificial
  CRISPR gRNA sequence
tcccctaagaggaaccattc

SEQ ID NO: 805384 - DNA, 20 bp, Artificial
  CRISPR gRNA sequence
cccctaagaggaaccattca

SEQ ID NO: 805385 - DNA, 20 bp, Artificial
  CRISPR gRNA sequence
ccctaagaggaaccattcaa

SEQ ID NO: 805386 - DNA, 20 bp, Artificial
  CRISPR gRNA sequence
agaggaaccattcaacagtt

SEQ ID NO: 805387 - DNA, 20 bp, Artificial
  CRISPR gRNA sequence
aacagtttggggctcgaggg

SEQ ID NO: 805388 - DNA, 20 bp, Artificial
  CRISPR gRNA sequence
ggggctcgagggtgacctgc

SEQ ID NO: 805389 - DNA, 20 bp, Artificial
  CRISPR gRNA sequence
gggctcgagggtgacctgct

SEQ ID NO: 805390 - DNA, 20 bp, Artificial
  CRISPR gRNA sequence
gagggtgacctgctgggctc

SEQ ID NO: 805391 - DNA, 20 bp, Artificial
  CRISPR gRNA sequence
ctgggctctagagaagaagc

SEQ ID NO: 805392 - DNA, 20 bp, Artificial
  CRISPR gRNA sequence
ggctctagagaagaagctgg

SEQ ID NO: 805393 - DNA, 20 bp, Artificial
  CRISPR gRNA sequence
tagagaagaagctggcaact

SEQ ID NO: 805394 - DNA, 20 bp, Artificial
  CRISPR gRNA sequence
gagaagaagctggcaacttc

SEQ ID NO: 805395 - DNA, 20 bp, Artificial
  CRISPR gRNA sequence
gcaacttctgttgcaaaata

SEQ ID NO: 805396 - DNA, 20 bp, Artificial
  CRISPR gRNA sequence
ctgttgcaaaataatgttaa

SEQ ID NO: 805397 - DNA, 20 bp, Artificial
  CRISPR gRNA sequence
tgttgcaaaataatgttaaa

SEQ ID NO: 805398 - DNA, 20 bp, Artificial
  CRISPR gRNA sequence
ttgcaaaataatgttaaatt

SEQ ID NO: 805399 - DNA, 20 bp, Artificial
  CRISPR gRNA sequence
caaaataatgttaaattctg

SEQ ID NO: 805400 - DNA, 20 bp, Artificial
  CRISPR gRNA sequence
aattctgcttcatctgcttg

SEQ ID NO: 805401 - DNA, 20 bp, Artificial
  CRISPR gRNA sequence
tgcttcatctgcttgtcttt

SEQ ID NO: 805402 - DNA, 20 bp, Artificial
  CRISPR gRNA sequence
cttcatctgcttgtctttac

SEQ ID NO: 805403 - DNA, 20 bp, Artificial
  CRISPR gRNA sequence
catctgcttgtctttacgtt

SEQ ID NO: 805404 - DNA, 20 bp, Artificial
  CRISPR gRNA sequence
atctgcttgtctttacgttt

SEQ ID NO: 805405 - DNA, 20 bp, Artificial
  CRISPR gRNA sequence
cttgtctttacgtttcaaga

SEQ ID NO: 805406 - DNA, 20 bp, Artificial
  CRISPR gRNA sequence
gtctttacgtttcaagaata

SEQ ID NO: 805407 - DNA, 20 bp, Artificial
  CRISPR gRNA sequence
tctttacgtttcaagaatac

SEQ ID NO: 805408 - DNA, 20 bp, Artificial
  CRISPR gRNA sequence
tacgtttcaagaatacagta

SEQ ID NO: 805409 - DNA, 20 bp, Artificial
  CRISPR gRNA sequence
acgtttcaagaatacagtaa

SEQ ID NO: 805410 - DNA, 20 bp, Artificial
  CRISPR gRNA sequence
cgtttcaagaatacagtaac

SEQ ID NO: 805411 - DNA, 20 bp, Artificial
  CRISPR gRNA sequence
caagaatacagtaactgtgt

SEQ ID NO: 805412 - DNA, 20 bp, Artificial
  CRISPR gRNA sequence
aagaatacagtaactgtgtt

SEQ ID NO: 805413 - DNA, 20 bp, Artificial
  CRISPR gRNA sequence
tgtttctctgattcaccaat

SEQ ID NO: 805414 - DNA, 20 bp, Artificial
  CRISPR gRNA sequence
ctctgattcaccaatatatg

SEQ ID NO: 805415 - DNA, 20 bp, Artificial
  CRISPR gRNA sequence
tctgattcaccaatatatgc

SEQ ID NO: 805416 - DNA, 20 bp, Artificial
  CRISPR gRNA sequence
tgattcaccaatatatgccc

SEQ ID NO: 805417 - DNA, 20 bp, Artificial
  CRISPR gRNA sequence
attcaccaatatatgcccag

SEQ ID NO: 805418 - DNA, 20 bp, Artificial
  CRISPR gRNA sequence
accaatatatgcccagtgtc

SEQ ID NO: 805419 - DNA, 20 bp, Artificial
  CRISPR gRNA sequence
aaaaattacctggcatataa

SEQ ID NO: 805420 - DNA, 20 bp, Artificial
  CRISPR gRNA sequence
cctggcatataataaatgtt

SEQ ID NO: 805421 - DNA, 20 bp, Artificial
  CRISPR gRNA sequence
gcatataataaatgttcaat

SEQ ID NO: 805422 - DNA, 20 bp, Artificial
  CRISPR gRNA sequence
aatgaaattttaaacattga

SEQ ID NO: 805423 - DNA, 20 bp, Artificial
  CRISPR gRNA sequence
taaacattgaacctactata

SEQ ID NO: 805424 - DNA, 20 bp, Artificial
  CRISPR gRNA sequence
aaacattgaacctactatat

SEQ ID NO: 805425 - DNA, 20 bp, Artificial
  CRISPR gRNA sequence
aacattgaacctactatatg

SEQ ID NO: 805426 - DNA, 20 bp, Artificial
  CRISPR gRNA sequence
aacctactatatgcaggtga

SEQ ID NO: 805427 - DNA, 20 bp, Artificial
  CRISPR gRNA sequence
ctatatgcaggtgagtatgc

SEQ ID NO: 805428 - DNA, 20 bp, Artificial
  CRISPR gRNA sequence
tatgcaggtgagtatgctag

SEQ ID NO: 805429 - DNA, 20 bp, Artificial
  CRISPR gRNA sequence
gatctgctctgtccaatata

SEQ ID NO: 805430 - DNA, 20 bp, Artificial
  CRISPR gRNA sequence
ctctgtccaatataatagcc

SEQ ID NO: 805431 - DNA, 20 bp, Artificial
  CRISPR gRNA sequence
tgtccaatataatagccatc

SEQ ID NO: 805432 - DNA, 20 bp, Artificial
  CRISPR gRNA sequence
tccaatataatagccatctg

SEQ ID NO: 805433 - DNA, 20 bp, Artificial
  CRISPR gRNA sequence
tggctctttttaagttaaat

SEQ ID NO: 805434 - DNA, 20 bp, Artificial
  CRISPR gRNA sequence
tttttaagttaaataaaaat

SEQ ID NO: 805435 - DNA, 20 bp, Artificial
  CRISPR gRNA sequence
tttaagttaaataaaaattc

SEQ ID NO: 805436 - DNA, 20 bp, Artificial
  CRISPR gRNA sequence
ttaagttaaataaaaattca

SEQ ID NO: 805437 - DNA, 20 bp, Artificial
  CRISPR gRNA sequence
taagttaaataaaaattcat

SEQ ID NO: 805438 - DNA, 20 bp, Artificial
  CRISPR gRNA sequence
aagttaaataaaaattcatc

SEQ ID NO: 805439 - DNA, 20 bp, Artificial
  CRISPR gRNA sequence
agttaaataaaaattcatca

SEQ ID NO: 805440 - DNA, 20 bp, Artificial
  CRISPR gRNA sequence
aataaaaattcatcagtcac

SEQ ID NO: 805441 - DNA, 20 bp, Artificial
  CRISPR gRNA sequence
atcagtcacatcttaagtat

SEQ ID NO: 805442 - DNA, 20 bp, Artificial
  CRISPR gRNA sequence
aagtattcacacactgtaag

SEQ ID NO: 805443 - DNA, 20 bp, Artificial
  CRISPR gRNA sequence
agtattcacacactgtaagt

SEQ ID NO: 805444 - DNA, 20 bp, Artificial
  CRISPR gRNA sequence
acacactgtaagtgctcaat

SEQ ID NO: 805445 - DNA, 20 bp, Artificial
  CRISPR gRNA sequence
taagtgctcaatagccatgt

SEQ ID NO: 805446 - DNA, 20 bp, Artificial
  CRISPR gRNA sequence
aatagccatgtacagataat

SEQ ID NO: 805447 - DNA, 20 bp, Artificial
  CRISPR gRNA sequence
ctcctgtattggacagtaca

SEQ ID NO: 805448 - DNA, 20 bp, Artificial
  CRISPR gRNA sequence
ctgtattggacagtacagat

SEQ ID NO: 805449 - DNA, 20 bp, Artificial
  CRISPR gRNA sequence
tattggacagtacagatata

SEQ ID NO: 805450 - DNA, 20 bp, Artificial
  CRISPR gRNA sequence
gacagtacagatatacaaca

SEQ ID NO: 805451 - DNA, 20 bp, Artificial
  CRISPR gRNA sequence
ccatcattgcagaaagttct

SEQ ID NO: 805452 - DNA, 20 bp, Artificial
  CRISPR gRNA sequence
catcattgcagaaagttcta

SEQ ID NO: 805453 - DNA, 20 bp, Artificial
  CRISPR gRNA sequence
cagaaagttctactgaaaac

SEQ ID NO: 805454 - DNA, 20 bp, Artificial
  CRISPR gRNA sequence
tactgaaaaccactgtgcta

SEQ ID NO: 805455 - DNA, 20 bp, Artificial
  CRISPR gRNA sequence
ctgaaaaccactgtgctaga

SEQ ID NO: 805456 - DNA, 20 bp, Artificial
  CRISPR gRNA sequence
aaaaccactgtgctagaccc

SEQ ID NO: 805457 - DNA, 20 bp, Artificial
  CRISPR gRNA sequence
tgctagaccctttacaaact

SEQ ID NO: 805458 - DNA, 20 bp, Artificial
  CRISPR gRNA sequence
gaccctttacaaacttctca

SEQ ID NO: 805459 - DNA, 20 bp, Artificial
  CRISPR gRNA sequence
tacaaacttctcatttaatt

SEQ ID NO: 805460 - DNA, 20 bp, Artificial
  CRISPR gRNA sequence
acaaacttctcatttaattt

SEQ ID NO: 805461 - DNA, 20 bp, Artificial
  CRISPR gRNA sequence
caaacttctcatttaatttc

SEQ ID NO: 805462 - DNA, 20 bp, Artificial
  CRISPR gRNA sequence
ctcatttaatttcacaaaaa

SEQ ID NO: 805463 - DNA, 20 bp, Artificial
  CRISPR gRNA sequence
tcatttaatttcacaaaaat

SEQ ID NO: 805464 - DNA, 20 bp, Artificial
  CRISPR gRNA sequence
atttaatttcacaaaaattg

SEQ ID NO: 805465 - DNA, 20 bp, Artificial
  CRISPR gRNA sequence
aatttcacaaaaattgcttg

SEQ ID NO: 805466 - DNA, 20 bp, Artificial
  CRISPR gRNA sequence
atttcacaaaaattgcttgt

SEQ ID NO: 805467 - DNA, 20 bp, Artificial
  CRISPR gRNA sequence
cacaaaaattgcttgtggca

SEQ ID NO: 805468 - DNA, 20 bp, Artificial
  CRISPR gRNA sequence
acaaaaattgcttgtggcaa

SEQ ID NO: 805469 - DNA, 20 bp, Artificial
  CRISPR gRNA sequence
cttgtggcaaggagaagtgt

SEQ ID NO: 805470 - DNA, 20 bp, Artificial
  CRISPR gRNA sequence
gtggcaaggagaagtgtctt

SEQ ID NO: 805471 - DNA, 20 bp, Artificial
  CRISPR gRNA sequence
tggcaaggagaagtgtcttt

SEQ ID NO: 805472 - DNA, 20 bp, Artificial
  CRISPR gRNA sequence
tatgctggagttaagaaagt

SEQ ID NO: 805473 - DNA, 20 bp, Artificial
  CRISPR gRNA sequence
atgctggagttaagaaagtg

SEQ ID NO: 805474 - DNA, 20 bp, Artificial
  CRISPR gRNA sequence
tgctggagttaagaaagtga

SEQ ID NO: 805475 - DNA, 20 bp, Artificial
  CRISPR gRNA sequence
gagttaagaaagtgaggctc

SEQ ID NO: 805476 - DNA, 20 bp, Artificial
  CRISPR gRNA sequence
agaaagtgaggctcagaaaa

SEQ ID NO: 805477 - DNA, 20 bp, Artificial
  CRISPR gRNA sequence
agaaaagttatatgacttcc

SEQ ID NO: 805478 - DNA, 20 bp, Artificial
  CRISPR gRNA sequence
tatgacttcccaaagtcata

SEQ ID NO: 805479 - DNA, 20 bp, Artificial
  CRISPR gRNA sequence
cccaaagtcatacagctggg

SEQ ID NO: 805480 - DNA, 20 bp, Artificial
  CRISPR gRNA sequence
ccaaagtcatacagctggga

SEQ ID NO: 805481 - DNA, 20 bp, Artificial
  CRISPR gRNA sequence
ggatttgaatacaggtctgt

SEQ ID NO: 805482 - DNA, 20 bp, Artificial
  CRISPR gRNA sequence
gaatacaggtctgtttgact

SEQ ID NO: 805483 - DNA, 20 bp, Artificial
  CRISPR gRNA sequence
aatacaggtctgtttgactc

SEQ ID NO: 805484 - DNA, 20 bp, Artificial
  CRISPR gRNA sequence
tttgactccaaaacttgtgg

SEQ ID NO: 805485 - DNA, 20 bp, Artificial
  CRISPR gRNA sequence
gactccaaaacttgtggcct

SEQ ID NO: 805486 - DNA, 20 bp, Artificial
  CRISPR gRNA sequence
actccaaaacttgtggccta

SEQ ID NO: 805487 - DNA, 20 bp, Artificial
  CRISPR gRNA sequence
caaaacttgtggcctatttg

SEQ ID NO: 805488 - DNA, 20 bp, Artificial
  CRISPR gRNA sequence
gtggcctatttgttgcaaaa

SEQ ID NO: 805489 - DNA, 20 bp, Artificial
  CRISPR gRNA sequence
tggcctatttgttgcaaaag

SEQ ID NO: 805490 - DNA, 20 bp, Artificial
  CRISPR gRNA sequence
tttgttgcaaaagtgcttaa

SEQ ID NO: 805491 - DNA, 20 bp, Artificial
  CRISPR gRNA sequence
gttgcaaaagtgcttaatac

SEQ ID NO: 805492 - DNA, 20 bp, Artificial
  CRISPR gRNA sequence
ttgcaaaagtgcttaataca

SEQ ID NO: 805493 - DNA, 20 bp, Artificial
  CRISPR gRNA sequence
caaaagtgcttaatacaaat

SEQ ID NO: 805494 - DNA, 20 bp, Artificial
  CRISPR gRNA sequence
aatacaaattggttcagtca

SEQ ID NO: 805495 - DNA, 20 bp, Artificial
  CRISPR gRNA sequence
atacaaattggttcagtcaa

SEQ ID NO: 805496 - DNA, 20 bp, Artificial
  CRISPR gRNA sequence
gttcagtcaatattattatc

SEQ ID NO: 805497 - DNA, 20 bp, Artificial
  CRISPR gRNA sequence
agtcaatattattatctttg

SEQ ID NO: 805498 - DNA, 20 bp, Artificial
  CRISPR gRNA sequence
ttatctttgaacaatggaag

SEQ ID NO: 805499 - DNA, 20 bp, Artificial
  CRISPR gRNA sequence
tctttgaacaatggaaggag

SEQ ID NO: 805500 - DNA, 20 bp, Artificial
  CRISPR gRNA sequence
tgaacaatggaaggagaaag

SEQ ID NO: 805501 - DNA, 20 bp, Artificial
  CRISPR gRNA sequence
gaacaatggaaggagaaagt

SEQ ID NO: 805502 - DNA, 20 bp, Artificial
  CRISPR gRNA sequence
aacaatggaaggagaaagta

SEQ ID NO: 805503 - DNA, 20 bp, Artificial
  CRISPR gRNA sequence
caatccaaaataattgagtg

SEQ ID NO: 805504 - DNA, 20 bp, Artificial
  CRISPR gRNA sequence
aatccaaaataattgagtga

SEQ ID NO: 805505 - DNA, 20 bp, Artificial
  CRISPR gRNA sequence
agtgacttatacattgactt

SEQ ID NO: 805506 - DNA, 20 bp, Artificial
  CRISPR gRNA sequence
atacattgacttgctgagcc

SEQ ID NO: 805507 - DNA, 20 bp, Artificial
  CRISPR gRNA sequence
tacattgacttgctgagcca

SEQ ID NO: 805508 - DNA, 20 bp, Artificial
  CRISPR gRNA sequence
acttgctgagccaatggcaa

SEQ ID NO: 805509 - DNA, 20 bp, Artificial
  CRISPR gRNA sequence
gctgagccaatggcaaagtc

SEQ ID NO: 805510 - DNA, 20 bp, Artificial
  CRISPR gRNA sequence
ctgagccaatggcaaagtca

SEQ ID NO: 805511 - DNA, 20 bp, Artificial
  CRISPR gRNA sequence
agccaatggcaaagtcaagt

SEQ ID NO: 805512 - DNA, 20 bp, Artificial
  CRISPR gRNA sequence
gaatccagcagaagtcacca

SEQ ID NO: 805513 - DNA, 20 bp, Artificial
  CRISPR gRNA sequence
cagaatctagatctttagaa

SEQ ID NO: 805514 - DNA, 20 bp, Artificial
  CRISPR gRNA sequence
gatctttagaacatgtcttc

SEQ ID NO: 805515 - DNA, 20 bp, Artificial
  CRISPR gRNA sequence
tagaacatgtcttcagatct

SEQ ID NO: 805516 - DNA, 20 bp, Artificial
  CRISPR gRNA sequence
agaacatgtcttcagatctt

SEQ ID NO: 805517 - DNA, 20 bp, Artificial
  CRISPR gRNA sequence
gaacatgtcttcagatcttc

SEQ ID NO: 805518 - DNA, 20 bp, Artificial
  CRISPR gRNA sequence
cagatcttcagaacagtgtt

SEQ ID NO: 805519 - DNA, 20 bp, Artificial
  CRISPR gRNA sequence
agatcttcagaacagtgttt

SEQ ID NO: 805520 - DNA, 20 bp, Artificial
  CRISPR gRNA sequence
cagaacagtgtttcttaaac

SEQ ID NO: 805521 - DNA, 20 bp, Artificial
  CRISPR gRNA sequence
agaacagtgtttcttaaact

SEQ ID NO: 805522 - DNA, 20 bp, Artificial
  CRISPR gRNA sequence
cttaaactctcttgtgaagg

SEQ ID NO: 805523 - DNA, 20 bp, Artificial
  CRISPR gRNA sequence
ttaaactctcttgtgaagga

SEQ ID NO: 805524 - DNA, 20 bp, Artificial
  CRISPR gRNA sequence
aaactctcttgtgaaggaac

SEQ ID NO: 805525 - DNA, 20 bp, Artificial
  CRISPR gRNA sequence
aactctcttgtgaaggaaca

SEQ ID NO: 805526 - DNA, 20 bp, Artificial
  CRISPR gRNA sequence
tcttgtgaaggaacagttat

SEQ ID NO: 805527 - DNA, 20 bp, Artificial
  CRISPR gRNA sequence
ttgtgaaggaacagttatca

SEQ ID NO: 805528 - DNA, 20 bp, Artificial
  CRISPR gRNA sequence
gtgaaggaacagttatcatc

SEQ ID NO: 805529 - DNA, 20 bp, Artificial
  CRISPR gRNA sequence
tgaaggaacagttatcatca

SEQ ID NO: 805530 - DNA, 20 bp, Artificial
  CRISPR gRNA sequence
tcatcataggctggtaacag

SEQ ID NO: 805531 - DNA, 20 bp, Artificial
  CRISPR gRNA sequence
gtaacagttcacctaccagc

SEQ ID NO: 805532 - DNA, 20 bp, Artificial
  CRISPR gRNA sequence
acctaccagcaccagcccat

SEQ ID NO: 805533 - DNA, 20 bp, Artificial
  CRISPR gRNA sequence
ccagcaccagcccatgaacc

SEQ ID NO: 805534 - DNA, 20 bp, Artificial
  CRISPR gRNA sequence
taagtggcacagccctagaa

SEQ ID NO: 805535 - DNA, 20 bp, Artificial
  CRISPR gRNA sequence
agtggcacagccctagaaga

SEQ ID NO: 805536 - DNA, 20 bp, Artificial
  CRISPR gRNA sequence
gaagattgagccagaatttt

SEQ ID NO: 805537 - DNA, 20 bp, Artificial
  CRISPR gRNA sequence
agccagaattttacagaggt

SEQ ID NO: 805538 - DNA, 20 bp, Artificial
  CRISPR gRNA sequence
tacagaggtttaaagaccaa

SEQ ID NO: 805539 - DNA, 20 bp, Artificial
  CRISPR gRNA sequence
acagaggtttaaagaccaaa

SEQ ID NO: 805540 - DNA, 20 bp, Artificial
  CRISPR gRNA sequence
cagaggtttaaagaccaaat

SEQ ID NO: 805541 - DNA, 20 bp, Artificial
  CRISPR gRNA sequence
aaagaccaaatatgctggtt

SEQ ID NO: 805542 - DNA, 20 bp, Artificial
  CRISPR gRNA sequence
aagaccaaatatgctggttt

SEQ ID NO: 805543 - DNA, 20 bp, Artificial
  CRISPR gRNA sequence
gtttatggttacctgtggcc

SEQ ID NO: 805544 - DNA, 20 bp, Artificial
  CRISPR gRNA sequence
atggttacctgtggcccaca

SEQ ID NO: 805545 - DNA, 20 bp, Artificial
  CRISPR gRNA sequence
tggttacctgtggcccacag

SEQ ID NO: 805546 - DNA, 20 bp, Artificial
  CRISPR gRNA sequence
cctgtggcccacagagaatg

SEQ ID NO: 805547 - DNA, 20 bp, Artificial
  CRISPR gRNA sequence
tggcccacagagaatggcag

SEQ ID NO: 805548 - DNA, 20 bp, Artificial
  CRISPR gRNA sequence
acctcaggcataaatgaggt

SEQ ID NO: 805549 - DNA, 20 bp, Artificial
  CRISPR gRNA sequence
aggcataaatgaggtaccca

SEQ ID NO: 805550 - DNA, 20 bp, Artificial
  CRISPR gRNA sequence
aagccaacattcaagagcaa

SEQ ID NO: 805551 - DNA, 20 bp, Artificial
  CRISPR gRNA sequence
aagagcaattcctatgggtt

SEQ ID NO: 805552 - DNA, 20 bp, Artificial
  CRISPR gRNA sequence
ctatgggttaaccattgggc

SEQ ID NO: 805553 - DNA, 20 bp, Artificial
  CRISPR gRNA sequence
tgggttaaccattgggctcc

SEQ ID NO: 805554 - DNA, 20 bp, Artificial
  CRISPR gRNA sequence
accattgggctcctttcaaa

SEQ ID NO: 805555 - DNA, 20 bp, Artificial
  CRISPR gRNA sequence
ggctcctttcaaatgcaaac

SEQ ID NO: 805556 - DNA, 20 bp, Artificial
  CRISPR gRNA sequence
ctttcaaatgcaaaccctca

SEQ ID NO: 805557 - DNA, 20 bp, Artificial
  CRISPR gRNA sequence
tcaaatgcaaaccctcatga

SEQ ID NO: 805558 - DNA, 20 bp, Artificial
  CRISPR gRNA sequence
caaatgcaaaccctcatgaa

SEQ ID NO: 805559 - DNA, 20 bp, Artificial
  CRISPR gRNA sequence
aaatgcaaaccctcatgaaa

SEQ ID NO: 805560 - DNA, 20 bp, Artificial
  CRISPR gRNA sequence
atgaaagagactacagtgct

SEQ ID NO: 805561 - DNA, 20 bp, Artificial
  CRISPR gRNA sequence
cagtgctgaatagagacctc

SEQ ID NO: 805562 - DNA, 20 bp, Artificial
  CRISPR gRNA sequence
aatagagacctccaaattcc

SEQ ID NO: 805563 - DNA, 20 bp, Artificial
  CRISPR gRNA sequence
caaattccaggccaagctca

SEQ ID NO: 805564 - DNA, 20 bp, Artificial
  CRISPR gRNA sequence
caggccaagctcaggatagt

SEQ ID NO: 805565 - DNA, 20 bp, Artificial
  CRISPR gRNA sequence
aggatagtcatgagggaatt

SEQ ID NO: 805566 - DNA, 20 bp, Artificial
  CRISPR gRNA sequence
ctaaaaacctggtatatagg

SEQ ID NO: 805567 - DNA, 20 bp, Artificial
  CRISPR gRNA sequence
aaaacctggtatatagggca

SEQ ID NO: 805568 - DNA, 20 bp, Artificial
  CRISPR gRNA sequence
gtatatagggcaaaagcaga

SEQ ID NO: 805569 - DNA, 20 bp, Artificial
  CRISPR gRNA sequence
ggaatggactgatttcagga

SEQ ID NO: 805570 - DNA, 20 bp, Artificial
  CRISPR gRNA sequence
atttcaggaacccaggcaat

SEQ ID NO: 805571 - DNA, 20 bp, Artificial
  CRISPR gRNA sequence
caggaacccaggcaatggca

SEQ ID NO: 805572 - DNA, 20 bp, Artificial
  CRISPR gRNA sequence
aggaacccaggcaatggcag

SEQ ID NO: 805573 - DNA, 20 bp, Artificial
  CRISPR gRNA sequence
ggcattaaatcctaaaagag

SEQ ID NO: 805574 - DNA, 20 bp, Artificial
  CRISPR gRNA sequence
aatcctaaaagagaatcaga

SEQ ID NO: 805575 - DNA, 20 bp, Artificial
  CRISPR gRNA sequence
aaagagaatcagagtgggag

SEQ ID NO: 805576 - DNA, 20 bp, Artificial
  CRISPR gRNA sequence
agaaaaaagtgaaaacctat

SEQ ID NO: 805577 - DNA, 20 bp, Artificial
  CRISPR gRNA sequence
ttcatgattgcaaagatatg

SEQ ID NO: 805578 - DNA, 20 bp, Artificial
  CRISPR gRNA sequence
atgattgcaaagatatgaaa

SEQ ID NO: 805579 - DNA, 20 bp, Artificial
  CRISPR gRNA sequence
caaagatatgaaaccaacct

SEQ ID NO: 805580 - DNA, 20 bp, Artificial
  CRISPR gRNA sequence
agatcccattgacgaataag

SEQ ID NO: 805581 - DNA, 20 bp, Artificial
  CRISPR gRNA sequence
acgaataagtggataaagaa

SEQ ID NO: 805582 - DNA, 20 bp, Artificial
  CRISPR gRNA sequence
ctcagccatgaaaaagaatg

SEQ ID NO: 805583 - DNA, 20 bp, Artificial
  CRISPR gRNA sequence
agccatgaaaaagaatgaga

SEQ ID NO: 805584 - DNA, 20 bp, Artificial
  CRISPR gRNA sequence
tgcaacaacttggatggaac

SEQ ID NO: 805585 - DNA, 20 bp, Artificial
  CRISPR gRNA sequence
gcaacaacttggatggaact

SEQ ID NO: 805586 - DNA, 20 bp, Artificial
  CRISPR gRNA sequence
caacaacttggatggaactg

SEQ ID NO: 805587 - DNA, 20 bp, Artificial
  CRISPR gRNA sequence
ggatggaactggaggtcatt

SEQ ID NO: 805588 - DNA, 20 bp, Artificial
  CRISPR gRNA sequence
gatggaactggaggtcatta

SEQ ID NO: 805589 - DNA, 20 bp, Artificial
  CRISPR gRNA sequence
gaggtcattattccaagtga

SEQ ID NO: 805590 - DNA, 20 bp, Artificial
  CRISPR gRNA sequence
ttccaagtgaagtaactcag

SEQ ID NO: 805591 - DNA, 20 bp, Artificial
  CRISPR gRNA sequence
caagtgaagtaactcaggaa

SEQ ID NO: 805592 - DNA, 20 bp, Artificial
  CRISPR gRNA sequence
aggaatggaaaaccaaatac

SEQ ID NO: 805593 - DNA, 20 bp, Artificial
  CRISPR gRNA sequence
tcacttgtaagtgggagcta

SEQ ID NO: 805594 - DNA, 20 bp, Artificial
  CRISPR gRNA sequence
acttgtaagtgggagctaag

SEQ ID NO: 805595 - DNA, 20 bp, Artificial
  CRISPR gRNA sequence
gtaagtgggagctaagctat

SEQ ID NO: 805596 - DNA, 20 bp, Artificial
  CRISPR gRNA sequence
taagtgggagctaagctatg

SEQ ID NO: 805597 - DNA, 20 bp, Artificial
  CRISPR gRNA sequence
agctatggatatgcaaaggc

SEQ ID NO: 805598 - DNA, 20 bp, Artificial
  CRISPR gRNA sequence
tggatatgcaaaggcataca

SEQ ID NO: 805599 - DNA, 20 bp, Artificial
  CRISPR gRNA sequence
agaaggagagagtagggagt

SEQ ID NO: 805600 - DNA, 20 bp, Artificial
  CRISPR gRNA sequence
catattgagttcaatgtaca

SEQ ID NO: 805601 - DNA, 20 bp, Artificial
  CRISPR gRNA sequence
agttcaatgtacactatttg

SEQ ID NO: 805602 - DNA, 20 bp, Artificial
  CRISPR gRNA sequence
aatgtacactatttgggtga

SEQ ID NO: 805603 - DNA, 20 bp, Artificial
  CRISPR gRNA sequence
tttgggtgacgggtgcacta

SEQ ID NO: 805604 - DNA, 20 bp, Artificial
  CRISPR gRNA sequence
gggtgacgggtgcactaaaa

SEQ ID NO: 805605 - DNA, 20 bp, Artificial
  CRISPR gRNA sequence
ggtgacgggtgcactaaaat

SEQ ID NO: 805606 - DNA, 20 bp, Artificial
  CRISPR gRNA sequence
aaattcagacttcaccagta

SEQ ID NO: 805607 - DNA, 20 bp, Artificial
  CRISPR gRNA sequence
agacttcaccagtatacaat

SEQ ID NO: 805608 - DNA, 20 bp, Artificial
  CRISPR gRNA sequence
caccagtatacaattcatcc

SEQ ID NO: 805609 - DNA, 20 bp, Artificial
  CRISPR gRNA sequence
accagtatacaattcatcca

SEQ ID NO: 805610 - DNA, 20 bp, Artificial
  CRISPR gRNA sequence
atccatgtaaccaaaaacca

SEQ ID NO: 805611 - DNA, 20 bp, Artificial
  CRISPR gRNA sequence
tacccctaaacctattgata

SEQ ID NO: 805612 - DNA, 20 bp, Artificial
  CRISPR gRNA sequence
aacctattgatataaaaaaa

SEQ ID NO: 805613 - DNA, 20 bp, Artificial
  CRISPR gRNA sequence
ttgatataaaaaaaaaatta

SEQ ID NO: 805614 - DNA, 20 bp, Artificial
  CRISPR gRNA sequence
atataaaaaaaaaattaaaa

SEQ ID NO: 805615 - DNA, 20 bp, Artificial
  CRISPR gRNA sequence
aaagaaagatgtgaaatcaa

SEQ ID NO: 805616 - DNA, 20 bp, Artificial
  CRISPR gRNA sequence
actggtgagcagcatcccat

SEQ ID NO: 805617 - DNA, 20 bp, Artificial
  CRISPR gRNA sequence
ctggtgagcagcatcccatt

SEQ ID NO: 805618 - DNA, 20 bp, Artificial
  CRISPR gRNA sequence
gtgagcagcatcccattatg

SEQ ID NO: 805619 - DNA, 20 bp, Artificial
  CRISPR gRNA sequence
tgtgaacttgtgcttctgaa

SEQ ID NO: 805620 - DNA, 20 bp, Artificial
  CRISPR gRNA sequence
gtgcttctgaaccagtaact

SEQ ID NO: 805621 - DNA, 20 bp, Artificial
  CRISPR gRNA sequence
tgcttctgaaccagtaactt

SEQ ID NO: 805622 - DNA, 20 bp, Artificial
  CRISPR gRNA sequence
ctgaaccagtaacttgagtt

SEQ ID NO: 805623 - DNA, 20 bp, Artificial
  CRISPR gRNA sequence
tgaaccagtaacttgagtta

SEQ ID NO: 805624 - DNA, 20 bp, Artificial
  CRISPR gRNA sequence
aaccagtaacttgagttact

SEQ ID NO: 805625 - DNA, 20 bp, Artificial
  CRISPR gRNA sequence
gagttactttgagccagtat

SEQ ID NO: 805626 - DNA, 20 bp, Artificial
  CRISPR gRNA sequence
agttactttgagccagtatc

SEQ ID NO: 805627 - DNA, 20 bp, Artificial
  CRISPR gRNA sequence
ctttgagccagtatcagtca

SEQ ID NO: 805628 - DNA, 20 bp, Artificial
  CRISPR gRNA sequence
tgagccagtatcagtcactt

SEQ ID NO: 805629 - DNA, 20 bp, Artificial
  CRISPR gRNA sequence
gagccagtatcagtcactta

SEQ ID NO: 805630 - DNA, 20 bp, Artificial
  CRISPR gRNA sequence
agccagtatcagtcacttat

SEQ ID NO: 805631 - DNA, 20 bp, Artificial
  CRISPR gRNA sequence
ataccttagtgcaaaattaa

SEQ ID NO: 805632 - DNA, 20 bp, Artificial
  CRISPR gRNA sequence
taccttagtgcaaaattaat

SEQ ID NO: 805633 - DNA, 20 bp, Artificial
  CRISPR gRNA sequence
agtgcaaaattaattgatca

SEQ ID NO: 805634 - DNA, 20 bp, Artificial
  CRISPR gRNA sequence
gtgcaaaattaattgatcag

SEQ ID NO: 805635 - DNA, 20 bp, Artificial
  CRISPR gRNA sequence
attgatcagacattctgacc

SEQ ID NO: 805636 - DNA, 20 bp, Artificial
  CRISPR gRNA sequence
atcagacattctgacctgga

SEQ ID NO: 805637 - DNA, 20 bp, Artificial
  CRISPR gRNA sequence
tgacctggaccagggaaggc

SEQ ID NO: 805638 - DNA, 20 bp, Artificial
  CRISPR gRNA sequence
acctggaccagggaaggcag

SEQ ID NO: 805639 - DNA, 20 bp, Artificial
  CRISPR gRNA sequence
gaccagggaaggcaggcaga

SEQ ID NO: 805640 - DNA, 20 bp, Artificial
  CRISPR gRNA sequence
aagcagaaaagggagagcta

SEQ ID NO: 805641 - DNA, 20 bp, Artificial
  CRISPR gRNA sequence
attctgcagccagacatttc

SEQ ID NO: 805642 - DNA, 20 bp, Artificial
  CRISPR gRNA sequence
tgcagccagacatttcctgg

SEQ ID NO: 805643 - DNA, 20 bp, Artificial
  CRISPR gRNA sequence
cagccagacatttcctggat

SEQ ID NO: 805644 - DNA, 20 bp, Artificial
  CRISPR gRNA sequence
cctggattgaatacccaaat

SEQ ID NO: 805645 - DNA, 20 bp, Artificial
  CRISPR gRNA sequence
ctggattgaatacccaaatt

SEQ ID NO: 805646 - DNA, 20 bp, Artificial
  CRISPR gRNA sequence
gattgaatacccaaattagt

SEQ ID NO: 805647 - DNA, 20 bp, Artificial
  CRISPR gRNA sequence
aatacccaaattagtccctc

SEQ ID NO: 805648 - DNA, 20 bp, Artificial
  CRISPR gRNA sequence
gtccctcagcctttaagtgc

SEQ ID NO: 805649 - DNA, 20 bp, Artificial
  CRISPR gRNA sequence
agcctttaagtgcctgaggg

SEQ ID NO: 805650 - DNA, 20 bp, Artificial
  CRISPR gRNA sequence
taagtgcctgagggccagga

SEQ ID NO: 805651 - DNA, 20 bp, Artificial
  CRISPR gRNA sequence
aagtgcctgagggccaggag

SEQ ID NO: 805652 - DNA, 20 bp, Artificial
  CRISPR gRNA sequence
agtgcctgagggccaggagt

SEQ ID NO: 805653 - DNA, 20 bp, Artificial
  CRISPR gRNA sequence
agggccaggagtagacagag

SEQ ID NO: 805654 - DNA, 20 bp, Artificial
  CRISPR gRNA sequence
ctttgttcacactctttgcc

SEQ ID NO: 805655 - DNA, 20 bp, Artificial
  CRISPR gRNA sequence
tttgttcacactctttgcct

SEQ ID NO: 805656 - DNA, 20 bp, Artificial
  CRISPR gRNA sequence
tgttcacactctttgcctag

SEQ ID NO: 805657 - DNA, 20 bp, Artificial
  CRISPR gRNA sequence
gttcacactctttgcctagg

SEQ ID NO: 805658 - DNA, 20 bp, Artificial
  CRISPR gRNA sequence
ttcacactctttgcctaggg

SEQ ID NO: 805659 - DNA, 20 bp, Artificial
  CRISPR gRNA sequence
acactctttgcctaggggcc

SEQ ID NO: 805660 - DNA, 20 bp, Artificial
  CRISPR gRNA sequence
tttgcctaggggccagattt

SEQ ID NO: 805661 - DNA, 20 bp, Artificial
  CRISPR gRNA sequence
tgcctaggggccagattttg

SEQ ID NO: 805662 - DNA, 20 bp, Artificial
  CRISPR gRNA sequence
gcctaggggccagattttgc

SEQ ID NO: 805663 - DNA, 20 bp, Artificial
  CRISPR gRNA sequence
cctaggggccagattttgct

SEQ ID NO: 805664 - DNA, 20 bp, Artificial
  CRISPR gRNA sequence
ggggccagattttgctttat

SEQ ID NO: 805665 - DNA, 20 bp, Artificial
  CRISPR gRNA sequence
tgctttatgcattaccatcc

SEQ ID NO: 805666 - DNA, 20 bp, Artificial
  CRISPR gRNA sequence
gctttatgcattaccatccg

SEQ ID NO: 805667 - DNA, 20 bp, Artificial
  CRISPR gRNA sequence
ctttatgcattaccatccga

SEQ ID NO: 805668 - DNA, 20 bp, Artificial
  CRISPR gRNA sequence
tatgcattaccatccgaagt

SEQ ID NO: 805669 - DNA, 20 bp, Artificial
  CRISPR gRNA sequence
atgcattaccatccgaagtc

SEQ ID NO: 805670 - DNA, 20 bp, Artificial
  CRISPR gRNA sequence
tgcattaccatccgaagtcc

SEQ ID NO: 805671 - DNA, 20 bp, Artificial
  CRISPR gRNA sequence
ccatccgaagtcccaggcca

SEQ ID NO: 805672 - DNA, 20 bp, Artificial
  CRISPR gRNA sequence
gggcttcgctatgtggattt

SEQ ID NO: 805673 - DNA, 20 bp, Artificial
  CRISPR gRNA sequence
ggcttcgctatgtggattta

SEQ ID NO: 805674 - DNA, 20 bp, Artificial
  CRISPR gRNA sequence
cgctatgtggatttatttag

SEQ ID NO: 805675 - DNA, 20 bp, Artificial
  CRISPR gRNA sequence
gctatgtggatttatttaga

SEQ ID NO: 805676 - DNA, 20 bp, Artificial
  CRISPR gRNA sequence
tgtggatttatttagattta

SEQ ID NO: 805677 - DNA, 20 bp, Artificial
  CRISPR gRNA sequence
atttagatttactttttgtc

SEQ ID NO: 805678 - DNA, 20 bp, Artificial
  CRISPR gRNA sequence
tttagatttactttttgtcc

SEQ ID NO: 805679 - DNA, 20 bp, Artificial
  CRISPR gRNA sequence
agatttactttttgtcctgc

SEQ ID NO: 805680 - DNA, 20 bp, Artificial
  CRISPR gRNA sequence
gatttactttttgtcctgcc

SEQ ID NO: 805681 - DNA, 20 bp, Artificial
  CRISPR gRNA sequence
actttttgtcctgccatatt

SEQ ID NO: 805682 - DNA, 20 bp, Artificial
  CRISPR gRNA sequence
ctttttgtcctgccatattt

SEQ ID NO: 805683 - DNA, 20 bp, Artificial
  CRISPR gRNA sequence
tttgtcctgccatattttaa

SEQ ID NO: 805684 - DNA, 20 bp, Artificial
  CRISPR gRNA sequence
ttgtcctgccatattttaat

SEQ ID NO: 805685 - DNA, 20 bp, Artificial
  CRISPR gRNA sequence
tgtcctgccatattttaatc

SEQ ID NO: 805686 - DNA, 20 bp, Artificial
  CRISPR gRNA sequence
gtcctgccatattttaatct

SEQ ID NO: 805687 - DNA, 20 bp, Artificial
  CRISPR gRNA sequence
tcctgccatattttaatcta

SEQ ID NO: 805688 - DNA, 20 bp, Artificial
  CRISPR gRNA sequence
ccatattttaatctataagc

SEQ ID NO: 805689 - DNA, 20 bp, Artificial
  CRISPR gRNA sequence
taatctataagccaaacagt

SEQ ID NO: 805690 - DNA, 20 bp, Artificial
  CRISPR gRNA sequence
aatctataagccaaacagtt

SEQ ID NO: 805691 - DNA, 20 bp, Artificial
  CRISPR gRNA sequence
atctataagccaaacagttt

SEQ ID NO: 805692 - DNA, 20 bp, Artificial
  CRISPR gRNA sequence
taagccaaacagttttctca

SEQ ID NO: 805693 - DNA, 20 bp, Artificial
  CRISPR gRNA sequence
tctcattaatcttattccat

SEQ ID NO: 805694 - DNA, 20 bp, Artificial
  CRISPR gRNA sequence
ctcattaatcttattccatt

SEQ ID NO: 805695 - DNA, 20 bp, Artificial
  CRISPR gRNA sequence
tcattaatcttattccattt

SEQ ID NO: 805696 - DNA, 20 bp, Artificial
  CRISPR gRNA sequence
attaatcttattccatttct

SEQ ID NO: 805697 - DNA, 20 bp, Artificial
  CRISPR gRNA sequence
atcttattccatttctggaa

SEQ ID NO: 805698 - DNA, 20 bp, Artificial
  CRISPR gRNA sequence
attccatttctggaattttt

SEQ ID NO: 805699 - DNA, 20 bp, Artificial
  CRISPR gRNA sequence
ttccatttctggaatttttc

SEQ ID NO: 805700 - DNA, 20 bp, Artificial
  CRISPR gRNA sequence
catttctggaatttttcctt

SEQ ID NO: 805701 - DNA, 20 bp, Artificial
  CRISPR gRNA sequence
ctggaatttttccttttcag

SEQ ID NO: 805702 - DNA, 20 bp, Artificial
  CRISPR gRNA sequence
tggaatttttccttttcaga

SEQ ID NO: 805703 - DNA, 20 bp, Artificial
  CRISPR gRNA sequence
gaatttttccttttcagaca

SEQ ID NO: 805704 - DNA, 20 bp, Artificial
  CRISPR gRNA sequence
ttccttttcagacacaacaa

SEQ ID NO: 805705 - DNA, 20 bp, Artificial
  CRISPR gRNA sequence
tccttttcagacacaacaaa

SEQ ID NO: 805706 - DNA, 20 bp, Artificial
  CRISPR gRNA sequence
ccttttcagacacaacaaaa

SEQ ID NO: 805707 - DNA, 20 bp, Artificial
  CRISPR gRNA sequence
cttttcagacacaacaaaaa

SEQ ID NO: 805708 - DNA, 20 bp, Artificial
  CRISPR gRNA sequence
ttcagacacaacaaaaagac

SEQ ID NO: 805709 - DNA, 20 bp, Artificial
  CRISPR gRNA sequence
tcagacacaacaaaaagacc

SEQ ID NO: 805710 - DNA, 20 bp, Artificial
  CRISPR gRNA sequence
cagacacaacaaaaagacct

SEQ ID NO: 805711 - DNA, 20 bp, Artificial
  CRISPR gRNA sequence
agacacaacaaaaagacctg

SEQ ID NO: 805712 - DNA, 20 bp, Artificial
  CRISPR gRNA sequence
tcaccacaacaaagagggaa

SEQ ID NO: 805713 - DNA, 20 bp, Artificial
  CRISPR gRNA sequence
tgagtaagcatgatttttac

SEQ ID NO: 805714 - DNA, 20 bp, Artificial
  CRISPR gRNA sequence
ttacttttctttcttacttt

SEQ ID NO: 805715 - DNA, 20 bp, Artificial
  CRISPR gRNA sequence
tacttttctttcttactttc

SEQ ID NO: 805716 - DNA, 20 bp, Artificial
  CRISPR gRNA sequence
acttttctttcttactttct

SEQ ID NO: 805717 - DNA, 20 bp, Artificial
  CRISPR gRNA sequence
cttttctttcttactttctt

SEQ ID NO: 805718 - DNA, 20 bp, Artificial
  CRISPR gRNA sequence
ttctttcttactttcttttc

SEQ ID NO: 805719 - DNA, 20 bp, Artificial
  CRISPR gRNA sequence
tctttcttactttcttttct

SEQ ID NO: 805720 - DNA, 20 bp, Artificial
  CRISPR gRNA sequence
ctttcttactttcttttctc

SEQ ID NO: 805721 - DNA, 20 bp, Artificial
  CRISPR gRNA sequence
tttcttactttcttttctct

SEQ ID NO: 805722 - DNA, 20 bp, Artificial
  CRISPR gRNA sequence
tcttactttcttttctctct

SEQ ID NO: 805723 - DNA, 20 bp, Artificial
  CRISPR gRNA sequence
cttactttcttttctctctc

SEQ ID NO: 805724 - DNA, 20 bp, Artificial
  CRISPR gRNA sequence
ttactttcttttctctctca

SEQ ID NO: 805725 - DNA, 20 bp, Artificial
  CRISPR gRNA sequence
actttcttttctctctcagc

SEQ ID NO: 805726 - DNA, 20 bp, Artificial
  CRISPR gRNA sequence
ctttcttttctctctcagct

SEQ ID NO: 805727 - DNA, 20 bp, Artificial
  CRISPR gRNA sequence
tcttttctctctcagcttga

SEQ ID NO: 805728 - DNA, 20 bp, Artificial
  CRISPR gRNA sequence
cttttctctctcagcttgaa

SEQ ID NO: 805729 - DNA, 20 bp, Artificial
  CRISPR gRNA sequence
ttttctctctcagcttgaat

SEQ ID NO: 805730 - DNA, 20 bp, Artificial
  CRISPR gRNA sequence
ttctctctcagcttgaattt

SEQ ID NO: 805731 - DNA, 20 bp, Artificial
  CRISPR gRNA sequence
tctctctcagcttgaatttt

SEQ ID NO: 805732 - DNA, 20 bp, Artificial
  CRISPR gRNA sequence
ctctctcagcttgaatttta

SEQ ID NO: 805733 - DNA, 20 bp, Artificial
  CRISPR gRNA sequence
tctctcagcttgaattttaa

SEQ ID NO: 805734 - DNA, 20 bp, Artificial
  CRISPR gRNA sequence
tctcagcttgaattttaaag

SEQ ID NO: 805735 - DNA, 20 bp, Artificial
  CRISPR gRNA sequence
tcagcttgaattttaaagta

SEQ ID NO: 805736 - DNA, 20 bp, Artificial
  CRISPR gRNA sequence
agcttgaattttaaagtaac

SEQ ID NO: 805737 - DNA, 20 bp, Artificial
  CRISPR gRNA sequence
gaattttaaagtaaccactg

SEQ ID NO: 805738 - DNA, 20 bp, Artificial
  CRISPR gRNA sequence
aattttaaagtaaccactgt

SEQ ID NO: 805739 - DNA, 20 bp, Artificial
  CRISPR gRNA sequence
taaagtaaccactgttctat

SEQ ID NO: 805740 - DNA, 20 bp, Artificial
  CRISPR gRNA sequence
aaagtaaccactgttctatt

SEQ ID NO: 805741 - DNA, 20 bp, Artificial
  CRISPR gRNA sequence
aagtaaccactgttctatta

SEQ ID NO: 805742 - DNA, 20 bp, Artificial
  CRISPR gRNA sequence
ttctattaattcatggaagg

SEQ ID NO: 805743 - DNA, 20 bp, Artificial
  CRISPR gRNA sequence
tattaattcatggaaggcaa

SEQ ID NO: 805744 - DNA, 20 bp, Artificial
  CRISPR gRNA sequence
ttaattcatggaaggcaact

SEQ ID NO: 805745 - DNA, 20 bp, Artificial
  CRISPR gRNA sequence
attcatggaaggcaactgaa

SEQ ID NO: 805746 - DNA, 20 bp, Artificial
  CRISPR gRNA sequence
atggaaggcaactgaatagt

SEQ ID NO: 805747 - DNA, 20 bp, Artificial
  CRISPR gRNA sequence
aatagttccagcttatagaa

SEQ ID NO: 805748 - DNA, 20 bp, Artificial
  CRISPR gRNA sequence
cagcttatagaatcttcctg

SEQ ID NO: 805749 - DNA, 20 bp, Artificial
  CRISPR gRNA sequence
atagaatcttcctgtttggt

SEQ ID NO: 805750 - DNA, 20 bp, Artificial
  CRISPR gRNA sequence
tagaatcttcctgtttggta

SEQ ID NO: 805751 - DNA, 20 bp, Artificial
  CRISPR gRNA sequence
cctgtttggtagcatttcag

SEQ ID NO: 805752 - DNA, 20 bp, Artificial
  CRISPR gRNA sequence
ctgtttggtagcatttcagc

SEQ ID NO: 805753 - DNA, 20 bp, Artificial
  CRISPR gRNA sequence
tttggtagcatttcagcgaa

SEQ ID NO: 805754 - DNA, 20 bp, Artificial
  CRISPR gRNA sequence
ggtagcatttcagcgaagcc

SEQ ID NO: 805755 - DNA, 20 bp, Artificial
  CRISPR gRNA sequence
gtagcatttcagcgaagcct

SEQ ID NO: 805756 - DNA, 20 bp, Artificial
  CRISPR gRNA sequence
cagcgaagcctcgttcttag

SEQ ID NO: 805757 - DNA, 20 bp, Artificial
  CRISPR gRNA sequence
agcgaagcctcgttcttagc

SEQ ID NO: 805758 - DNA, 20 bp, Artificial
  CRISPR gRNA sequence
gttcttagccccagaacaat

SEQ ID NO: 805759 - DNA, 20 bp, Artificial
  CRISPR gRNA sequence
ttagccccagaacaatcatg

SEQ ID NO: 805760 - DNA, 20 bp, Artificial
  CRISPR gRNA sequence
agccccagaacaatcatgcc

SEQ ID NO: 805761 - DNA, 20 bp, Artificial
  CRISPR gRNA sequence
gccccagaacaatcatgcca

SEQ ID NO: 805762 - DNA, 20 bp, Artificial
  CRISPR gRNA sequence
ttgctcggtctatattccta

SEQ ID NO: 805763 - DNA, 20 bp, Artificial
  CRISPR gRNA sequence
tgctcggtctatattcctaa

SEQ ID NO: 805764 - DNA, 20 bp, Artificial
  CRISPR gRNA sequence
gctcggtctatattcctaag

SEQ ID NO: 805765 - DNA, 20 bp, Artificial
  CRISPR gRNA sequence
ctcggtctatattcctaagc

SEQ ID NO: 805766 - DNA, 20 bp, Artificial
  CRISPR gRNA sequence
ggtctatattcctaagcact

SEQ ID NO: 805767 - DNA, 20 bp, Artificial
  CRISPR gRNA sequence
tattcctaagcactcctaga

SEQ ID NO: 805768 - DNA, 20 bp, Artificial
  CRISPR gRNA sequence
ctaagcactcctagatgata

SEQ ID NO: 805769 - DNA, 20 bp, Artificial
  CRISPR gRNA sequence
agcactcctagatgatactg

SEQ ID NO: 805770 - DNA, 20 bp, Artificial
  CRISPR gRNA sequence
ctagatgatactgcactgga

SEQ ID NO: 805771 - DNA, 20 bp, Artificial
  CRISPR gRNA sequence
gatgatactgcactggacct

SEQ ID NO: 805772 - DNA, 20 bp, Artificial
  CRISPR gRNA sequence
cactggacctctggtctcac

SEQ ID NO: 805773 - DNA, 20 bp, Artificial
  CRISPR gRNA sequence
gacctctggtctcacatagt

SEQ ID NO: 805774 - DNA, 20 bp, Artificial
  CRISPR gRNA sequence
tggtctcacatagttagaaa

SEQ ID NO: 805775 - DNA, 20 bp, Artificial
  CRISPR gRNA sequence
gtctcacatagttagaaaca

SEQ ID NO: 805776 - DNA, 20 bp, Artificial
  CRISPR gRNA sequence
acatagttagaaacagagtt

SEQ ID NO: 805777 - DNA, 20 bp, Artificial
  CRISPR gRNA sequence
gaaacagagttaaaatcgaa

SEQ ID NO: 805778 - DNA, 20 bp, Artificial
  CRISPR gRNA sequence
aaatcgaacagcaaagagaa

SEQ ID NO: 805779 - DNA, 20 bp, Artificial
  CRISPR gRNA sequence
aactgcgatgcaattgacaa

SEQ ID NO: 805780 - DNA, 20 bp, Artificial
  CRISPR gRNA sequence
cgatgcaattgacaatggat

SEQ ID NO: 805781 - DNA, 20 bp, Artificial
  CRISPR gRNA sequence
acaatggatgtttttgcaac

SEQ ID NO: 805782 - DNA, 20 bp, Artificial
  CRISPR gRNA sequence
ttgcaacaaacaatgattaa

SEQ ID NO: 805783 - DNA, 20 bp, Artificial
  CRISPR gRNA sequence
tgcaacaaacaatgattaag

SEQ ID NO: 805784 - DNA, 20 bp, Artificial
  CRISPR gRNA sequence
gcaacaaacaatgattaaga

SEQ ID NO: 805785 - DNA, 20 bp, Artificial
  CRISPR gRNA sequence
caacaaacaatgattaagaa

SEQ ID NO: 805786 - DNA, 20 bp, Artificial
  CRISPR gRNA sequence
agaagtacattgttgtgggc

SEQ ID NO: 805787 - DNA, 20 bp, Artificial
  CRISPR gRNA sequence
ttgtgggctctgagtcaaga

SEQ ID NO: 805788 - DNA, 20 bp, Artificial
  CRISPR gRNA sequence
tgggctctgagtcaagagta

SEQ ID NO: 805789 - DNA, 20 bp, Artificial
  CRISPR gRNA sequence
tgagtcaagagtaatatggg

SEQ ID NO: 805790 - DNA, 20 bp, Artificial
  CRISPR gRNA sequence
agtcaagagtaatatgggaa

SEQ ID NO: 805791 - DNA, 20 bp, Artificial
  CRISPR gRNA sequence
ttcatgaggttgacaggttt

SEQ ID NO: 805792 - DNA, 20 bp, Artificial
  CRISPR gRNA sequence
catgaggttgacaggtttgg

SEQ ID NO: 805793 - DNA, 20 bp, Artificial
  CRISPR gRNA sequence
atgaggttgacaggtttgga

SEQ ID NO: 805794 - DNA, 20 bp, Artificial
  CRISPR gRNA sequence
acaggtttggagctggaatc

SEQ ID NO: 805795 - DNA, 20 bp, Artificial
  CRISPR gRNA sequence
ggagctggaatctgtggagg

SEQ ID NO: 805796 - DNA, 20 bp, Artificial
  CRISPR gRNA sequence
gagctggaatctgtggagga

SEQ ID NO: 805797 - DNA, 20 bp, Artificial
  CRISPR gRNA sequence
gaatctgtggaggaggaagg

SEQ ID NO: 805798 - DNA, 20 bp, Artificial
  CRISPR gRNA sequence
tggaggaggaaggatatgat

SEQ ID NO: 805799 - DNA, 20 bp, Artificial
  CRISPR gRNA sequence
ggggtcagaagaagtgggtt

SEQ ID NO: 805800 - DNA, 20 bp, Artificial
  CRISPR gRNA sequence
ctaaaatcattaagcctggt

SEQ ID NO: 805801 - DNA, 20 bp, Artificial
  CRISPR gRNA sequence
aaatcattaagcctggttgg

SEQ ID NO: 805802 - DNA, 20 bp, Artificial
  CRISPR gRNA sequence
agcctggttggatgaaaagc

SEQ ID NO: 805803 - DNA, 20 bp, Artificial
  CRISPR gRNA sequence
gttggatgaaaagcttagac

SEQ ID NO: 805804 - DNA, 20 bp, Artificial
  CRISPR gRNA sequence
gatgaaaagcttagactcag

SEQ ID NO: 805805 - DNA, 20 bp, Artificial
  CRISPR gRNA sequence
agactcaggggaagcagcac

SEQ ID NO: 805806 - DNA, 20 bp, Artificial
  CRISPR gRNA sequence
gactcaggggaagcagcaca

SEQ ID NO: 805807 - DNA, 20 bp, Artificial
  CRISPR gRNA sequence
aggggaagcagcacatgatt

SEQ ID NO: 805808 - DNA, 20 bp, Artificial
  CRISPR gRNA sequence
tgggggctggcaagtttgaa

SEQ ID NO: 805809 - DNA, 20 bp, Artificial
  CRISPR gRNA sequence
gcaagtttgaaatgtgtagg

SEQ ID NO: 805810 - DNA, 20 bp, Artificial
  CRISPR gRNA sequence
gaaatgtgtagggcaggcca

SEQ ID NO: 805811 - DNA, 20 bp, Artificial
  CRISPR gRNA sequence
aaatgtgtagggcaggccag

SEQ ID NO: 805812 - DNA, 20 bp, Artificial
  CRISPR gRNA sequence
gaaacccaggcaggatttct

SEQ ID NO: 805813 - DNA, 20 bp, Artificial
  CRISPR gRNA sequence
ctaccttacagtcttgaggc

SEQ ID NO: 805814 - DNA, 20 bp, Artificial
  CRISPR gRNA sequence
taccttacagtcttgaggca

SEQ ID NO: 805815 - DNA, 20 bp, Artificial
  CRISPR gRNA sequence
ccttacagtcttgaggcaga

SEQ ID NO: 805816 - DNA, 20 bp, Artificial
  CRISPR gRNA sequence
acagtcttgaggcagaattc

SEQ ID NO: 805817 - DNA, 20 bp, Artificial
  CRISPR gRNA sequence
cagtcttgaggcagaattcc

SEQ ID NO: 805818 - DNA, 20 bp, Artificial
  CRISPR gRNA sequence
gaggcagaattccatctttt

SEQ ID NO: 805819 - DNA, 20 bp, Artificial
  CRISPR gRNA sequence
aggcagaattccatcttttc

SEQ ID NO: 805820 - DNA, 20 bp, Artificial
  CRISPR gRNA sequence
catcttttctgggaaacctc

SEQ ID NO: 805821 - DNA, 20 bp, Artificial
  CRISPR gRNA sequence
ttctgggaaacctcagtttt

SEQ ID NO: 805822 - DNA, 20 bp, Artificial
  CRISPR gRNA sequence
tctgggaaacctcagttttt

SEQ ID NO: 805823 - DNA, 20 bp, Artificial
  CRISPR gRNA sequence
ctgggaaacctcagtttttt

SEQ ID NO: 805824 - DNA, 20 bp, Artificial
  CRISPR gRNA sequence
tgggaaacctcagttttttg

SEQ ID NO: 805825 - DNA, 20 bp, Artificial
  CRISPR gRNA sequence
ggaaacctcagttttttgct

SEQ ID NO: 805826 - DNA, 20 bp, Artificial
  CRISPR gRNA sequence
agttttttgctcttaaggcc

SEQ ID NO: 805827 - DNA, 20 bp, Artificial
  CRISPR gRNA sequence
tttgctcttaaggccctcaa

SEQ ID NO: 805828 - DNA, 20 bp, Artificial
  CRISPR gRNA sequence
ttgctcttaaggccctcaac

SEQ ID NO: 805829 - DNA, 20 bp, Artificial
  CRISPR gRNA sequence
tgctcttaaggccctcaact

SEQ ID NO: 805830 - DNA, 20 bp, Artificial
  CRISPR gRNA sequence
gctcttaaggccctcaactg

SEQ ID NO: 805831 - DNA, 20 bp, Artificial
  CRISPR gRNA sequence
ctcttaaggccctcaactga

SEQ ID NO: 805832 - DNA, 20 bp, Artificial
  CRISPR gRNA sequence
ttaaggccctcaactgattg

SEQ ID NO: 805833 - DNA, 20 bp, Artificial
  CRISPR gRNA sequence
aaggccctcaactgattgaa

SEQ ID NO: 805834 - DNA, 20 bp, Artificial
  CRISPR gRNA sequence
aggccctcaactgattgaat

SEQ ID NO: 805835 - DNA, 20 bp, Artificial
  CRISPR gRNA sequence
aactgattgaatgaagccaa

SEQ ID NO: 805836 - DNA, 20 bp, Artificial
  CRISPR gRNA sequence
attgaatgaagccaacctac

SEQ ID NO: 805837 - DNA, 20 bp, Artificial
  CRISPR gRNA sequence
aatgaagccaacctacatca

SEQ ID NO: 805838 - DNA, 20 bp, Artificial
  CRISPR gRNA sequence
catcatgggagataatcagc

SEQ ID NO: 805839 - DNA, 20 bp, Artificial
  CRISPR gRNA sequence
tacttcaagttaactgatag

SEQ ID NO: 805840 - DNA, 20 bp, Artificial
  CRISPR gRNA sequence
acttcaagttaactgatagc

SEQ ID NO: 805841 - DNA, 20 bp, Artificial
  CRISPR gRNA sequence
cttcaagttaactgatagca

SEQ ID NO: 805842 - DNA, 20 bp, Artificial
  CRISPR gRNA sequence
caagttaactgatagcaaat

SEQ ID NO: 805843 - DNA, 20 bp, Artificial
  CRISPR gRNA sequence
aagttaactgatagcaaatg

SEQ ID NO: 805844 - DNA, 20 bp, Artificial
  CRISPR gRNA sequence
actgatagcaaatgataatt

SEQ ID NO: 805845 - DNA, 20 bp, Artificial
  CRISPR gRNA sequence
atagcaaatgataattacat

SEQ ID NO: 805846 - DNA, 20 bp, Artificial
  CRISPR gRNA sequence
catctacaaaatactttcac

SEQ ID NO: 805847 - DNA, 20 bp, Artificial
  CRISPR gRNA sequence
caaaatactttcacagcaac

SEQ ID NO: 805848 - DNA, 20 bp, Artificial
  CRISPR gRNA sequence
tcacagcaacatatagacta

SEQ ID NO: 805849 - DNA, 20 bp, Artificial
  CRISPR gRNA sequence
cacagcaacatatagactag

SEQ ID NO: 805850 - DNA, 20 bp, Artificial
  CRISPR gRNA sequence
acagcaacatatagactagc

SEQ ID NO: 805851 - DNA, 20 bp, Artificial
  CRISPR gRNA sequence
gcatttgactaagcaactga

SEQ ID NO: 805852 - DNA, 20 bp, Artificial
  CRISPR gRNA sequence
gactaagcaactgagcacca

SEQ ID NO: 805853 - DNA, 20 bp, Artificial
  CRISPR gRNA sequence
actaagcaactgagcaccat

SEQ ID NO: 805854 - DNA, 20 bp, Artificial
  CRISPR gRNA sequence
agcaactgagcaccatagcc

SEQ ID NO: 805855 - DNA, 20 bp, Artificial
  CRISPR gRNA sequence
agcaccatagccaagatgac

SEQ ID NO: 805856 - DNA, 20 bp, Artificial
  CRISPR gRNA sequence
atcatcacaggcaccaagag

SEQ ID NO: 805857 - DNA, 20 bp, Artificial
  CRISPR gRNA sequence
ggccatatatttggctgaag

SEQ ID NO: 805858 - DNA, 20 bp, Artificial
  CRISPR gRNA sequence
gccatatatttggctgaagt

SEQ ID NO: 805859 - DNA, 20 bp, Artificial
  CRISPR gRNA sequence
ggctgaagtaagtcaatttg

SEQ ID NO: 805860 - DNA, 20 bp, Artificial
  CRISPR gRNA sequence
gctgaagtaagtcaatttgt

SEQ ID NO: 805861 - DNA, 20 bp, Artificial
  CRISPR gRNA sequence
aagtaagtcaatttgtcatt

SEQ ID NO: 805862 - DNA, 20 bp, Artificial
  CRISPR gRNA sequence
gtcattcctgcatgagcctt

SEQ ID NO: 805863 - DNA, 20 bp, Artificial
  CRISPR gRNA sequence
tcattcctgcatgagccttt

SEQ ID NO: 805864 - DNA, 20 bp, Artificial
  CRISPR gRNA sequence
ctgcatgagcctttataaac

SEQ ID NO: 805865 - DNA, 20 bp, Artificial
  CRISPR gRNA sequence
catgagcctttataaacaga

SEQ ID NO: 805866 - DNA, 20 bp, Artificial
  CRISPR gRNA sequence
tataaacagaagtaagtaac

SEQ ID NO: 805867 - DNA, 20 bp, Artificial
  CRISPR gRNA sequence
ataaacagaagtaagtaacc

SEQ ID NO: 805868 - DNA, 20 bp, Artificial
  CRISPR gRNA sequence
taaacagaagtaagtaacca

SEQ ID NO: 805869 - DNA, 20 bp, Artificial
  CRISPR gRNA sequence
ctatttggtcattggagttg

SEQ ID NO: 805870 - DNA, 20 bp, Artificial
  CRISPR gRNA sequence
tttggtcattggagttgtcc

SEQ ID NO: 805871 - DNA, 20 bp, Artificial
  CRISPR gRNA sequence
ggtcattggagttgtccaag

SEQ ID NO: 805872 - DNA, 20 bp, Artificial
  CRISPR gRNA sequence
gtcattggagttgtccaaga

SEQ ID NO: 805873 - DNA, 20 bp, Artificial
  CRISPR gRNA sequence
gagttgtccaagaggccagg

SEQ ID NO: 805874 - DNA, 20 bp, Artificial
  CRISPR gRNA sequence
tccaagaggccagggttctg

SEQ ID NO: 805875 - DNA, 20 bp, Artificial
  CRISPR gRNA sequence
tgtctaatacctgttcatgc

SEQ ID NO: 805876 - DNA, 20 bp, Artificial
  CRISPR gRNA sequence
tctaatacctgttcatgcat

SEQ ID NO: 805877 - DNA, 20 bp, Artificial
  CRISPR gRNA sequence
atacctgttcatgcatgaac

SEQ ID NO: 805878 - DNA, 20 bp, Artificial
  CRISPR gRNA sequence
ttcatgcatgaacatgccaa

SEQ ID NO: 805879 - DNA, 20 bp, Artificial
  CRISPR gRNA sequence
atgcatgaacatgccaacct

SEQ ID NO: 805880 - DNA, 20 bp, Artificial
  CRISPR gRNA sequence
gattgcatgcagactaccag

SEQ ID NO: 805881 - DNA, 20 bp, Artificial
  CRISPR gRNA sequence
catgcagactaccagttttg

SEQ ID NO: 805882 - DNA, 20 bp, Artificial
  CRISPR gRNA sequence
ccagttttgggtttttgttt

SEQ ID NO: 805883 - DNA, 20 bp, Artificial
  CRISPR gRNA sequence
tgggtttttgtttagttcag

SEQ ID NO: 805884 - DNA, 20 bp, Artificial
  CRISPR gRNA sequence
gggtttttgtttagttcagc

SEQ ID NO: 805885 - DNA, 20 bp, Artificial
  CRISPR gRNA sequence
ggtttttgtttagttcagca

SEQ ID NO: 805886 - DNA, 20 bp, Artificial
  CRISPR gRNA sequence
ttgtttagttcagcaggatt

SEQ ID NO: 805887 - DNA, 20 bp, Artificial
  CRISPR gRNA sequence
tgtttagttcagcaggattt

SEQ ID NO: 805888 - DNA, 20 bp, Artificial
  CRISPR gRNA sequence
gtttagttcagcaggatttt

SEQ ID NO: 805889 - DNA, 20 bp, Artificial
  CRISPR gRNA sequence
tttagttcagcaggattttt

SEQ ID NO: 805890 - DNA, 20 bp, Artificial
  CRISPR gRNA sequence
agttcagcaggatttttctc

SEQ ID NO: 805891 - DNA, 20 bp, Artificial
  CRISPR gRNA sequence
gttcagcaggatttttctca

SEQ ID NO: 805892 - DNA, 20 bp, Artificial
  CRISPR gRNA sequence
agcaggatttttctcagctc

SEQ ID NO: 805893 - DNA, 20 bp, Artificial
  CRISPR gRNA sequence
ttctcagctcactgcctctc

SEQ ID NO: 805894 - DNA, 20 bp, Artificial
  CRISPR gRNA sequence
tctcagctcactgcctctca

SEQ ID NO: 805895 - DNA, 20 bp, Artificial
  CRISPR gRNA sequence
ctcagctcactgcctctcaa

SEQ ID NO: 805896 - DNA, 20 bp, Artificial
  CRISPR gRNA sequence
tcagctcactgcctctcaaa

SEQ ID NO: 805897 - DNA, 20 bp, Artificial
  CRISPR gRNA sequence
agctcactgcctctcaaact

SEQ ID NO: 805898 - DNA, 20 bp, Artificial
  CRISPR gRNA sequence
actgcctctcaaactttcag

SEQ ID NO: 805899 - DNA, 20 bp, Artificial
  CRISPR gRNA sequence
cctctcaaactttcagcaac

SEQ ID NO: 805900 - DNA, 20 bp, Artificial
  CRISPR gRNA sequence
tcaaactttcagcaacaaaa

SEQ ID NO: 805901 - DNA, 20 bp, Artificial
  CRISPR gRNA sequence
aaactttcagcaacaaaagg

SEQ ID NO: 805902 - DNA, 20 bp, Artificial
  CRISPR gRNA sequence
tcagcaacaaaaggacatct

SEQ ID NO: 805903 - DNA, 20 bp, Artificial
  CRISPR gRNA sequence
cagcaacaaaaggacatctg

SEQ ID NO: 805904 - DNA, 20 bp, Artificial
  CRISPR gRNA sequence
agcaacaaaaggacatctgt

SEQ ID NO: 805905 - DNA, 20 bp, Artificial
  CRISPR gRNA sequence
tgatatcagaatctaccact

SEQ ID NO: 805906 - DNA, 20 bp, Artificial
  CRISPR gRNA sequence
ccactctaagtatttggatg

SEQ ID NO: 805907 - DNA, 20 bp, Artificial
  CRISPR gRNA sequence
taagtatttggatgcaatag

SEQ ID NO: 805908 - DNA, 20 bp, Artificial
  CRISPR gRNA sequence
agtatttggatgcaatagca

SEQ ID NO: 805909 - DNA, 20 bp, Artificial
  CRISPR gRNA sequence
ggatgcaatagcaatgaata

SEQ ID NO: 805910 - DNA, 20 bp, Artificial
  CRISPR gRNA sequence
gatgcaatagcaatgaatat

SEQ ID NO: 805911 - DNA, 20 bp, Artificial
  CRISPR gRNA sequence
agtaaatctaggtggggagt

SEQ ID NO: 805912 - DNA, 20 bp, Artificial
  CRISPR gRNA sequence
ggtggggagtgggggcaccc

SEQ ID NO: 805913 - DNA, 20 bp, Artificial
  CRISPR gRNA sequence
tagccaaaatgatttaacaa

SEQ ID NO: 805914 - DNA, 20 bp, Artificial
  CRISPR gRNA sequence
aacaaaatcaaaccaaaatt

SEQ ID NO: 805915 - DNA, 20 bp, Artificial
  CRISPR gRNA sequence
acaaaatcaaaccaaaattt

SEQ ID NO: 805916 - DNA, 20 bp, Artificial
  CRISPR gRNA sequence
tggaaatgatgccttggtac

SEQ ID NO: 805917 - DNA, 20 bp, Artificial
  CRISPR gRNA sequence
ggaaatgatgccttggtaca

SEQ ID NO: 805918 - DNA, 20 bp, Artificial
  CRISPR gRNA sequence
gaaatgatgccttggtacaa

SEQ ID NO: 805919 - DNA, 20 bp, Artificial
  CRISPR gRNA sequence
ggtacaatgaagagactact

SEQ ID NO: 805920 - DNA, 20 bp, Artificial
  CRISPR gRNA sequence
gtacaatgaagagactactt

SEQ ID NO: 805921 - DNA, 20 bp, Artificial
  CRISPR gRNA sequence
cttgaggtaggtttgactta

SEQ ID NO: 805922 - DNA, 20 bp, Artificial
  CRISPR gRNA sequence
gaggtaggtttgacttatct

SEQ ID NO: 805923 - DNA, 20 bp, Artificial
  CRISPR gRNA sequence
aggtaggtttgacttatcta

SEQ ID NO: 805924 - DNA, 20 bp, Artificial
  CRISPR gRNA sequence
gacttatctaatatcttatt

SEQ ID NO: 805925 - DNA, 20 bp, Artificial
  CRISPR gRNA sequence
acttatctaatatcttattt

SEQ ID NO: 805926 - DNA, 20 bp, Artificial
  CRISPR gRNA sequence
atctaatatcttattttctt

SEQ ID NO: 805927 - DNA, 20 bp, Artificial
  CRISPR gRNA sequence
tctaatatcttattttcttt

SEQ ID NO: 805928 - DNA, 20 bp, Artificial
  CRISPR gRNA sequence
atatcttattttctttacca

SEQ ID NO: 805929 - DNA, 20 bp, Artificial
  CRISPR gRNA sequence
attttctttaccaataccta

SEQ ID NO: 805930 - DNA, 20 bp, Artificial
  CRISPR gRNA sequence
ttttctttaccaatacctaa

SEQ ID NO: 805931 - DNA, 20 bp, Artificial
  CRISPR gRNA sequence
tctttaccaatacctaatga

SEQ ID NO: 805932 - DNA, 20 bp, Artificial
  CRISPR gRNA sequence
ctttaccaatacctaatgag

SEQ ID NO: 805933 - DNA, 20 bp, Artificial
  CRISPR gRNA sequence
tttaccaatacctaatgagg

SEQ ID NO: 805934 - DNA, 20 bp, Artificial
  CRISPR gRNA sequence
taccaatacctaatgaggaa

SEQ ID NO: 805935 - DNA, 20 bp, Artificial
  CRISPR gRNA sequence
accaatacctaatgaggaat

SEQ ID NO: 805936 - DNA, 20 bp, Artificial
  CRISPR gRNA sequence
ccaatacctaatgaggaatt

SEQ ID NO: 805937 - DNA, 20 bp, Artificial
  CRISPR gRNA sequence
atgaggaatttaaatatttc

SEQ ID NO: 805938 - DNA, 20 bp, Artificial
  CRISPR gRNA sequence
aaatatttctagatagcttt

SEQ ID NO: 805939 - DNA, 20 bp, Artificial
  CRISPR gRNA sequence
aatatttctagatagctttg

SEQ ID NO: 805940 - DNA, 20 bp, Artificial
  CRISPR gRNA sequence
ctagatagctttggaaaggt

SEQ ID NO: 805941 - DNA, 20 bp, Artificial
  CRISPR gRNA sequence
tagatagctttggaaaggtc

SEQ ID NO: 805942 - DNA, 20 bp, Artificial
  CRISPR gRNA sequence
gatagctttggaaaggtccc

SEQ ID NO: 805943 - DNA, 20 bp, Artificial
  CRISPR gRNA sequence
tggaaaggtcccttaaagag

SEQ ID NO: 805944 - DNA, 20 bp, Artificial
  CRISPR gRNA sequence
ggaaaggtcccttaaagagg

SEQ ID NO: 805945 - DNA, 20 bp, Artificial
  CRISPR gRNA sequence
gaaaggtcccttaaagaggc

SEQ ID NO: 805946 - DNA, 20 bp, Artificial
  CRISPR gRNA sequence
aaagaggcaccagcatacca

SEQ ID NO: 805947 - DNA, 20 bp, Artificial
  CRISPR gRNA sequence
aagaggcaccagcataccac

SEQ ID NO: 805948 - DNA, 20 bp, Artificial
  CRISPR gRNA sequence
ccagatctaatccccccaaa

SEQ ID NO: 805949 - DNA, 20 bp, Artificial
  CRISPR gRNA sequence
atccccccaaacactgtttt

SEQ ID NO: 805950 - DNA, 20 bp, Artificial
  CRISPR gRNA sequence
ttttcatcatcatcatgtca

SEQ ID NO: 805951 - DNA, 20 bp, Artificial
  CRISPR gRNA sequence
tcatcatcatcatgtcatct

SEQ ID NO: 805952 - DNA, 20 bp, Artificial
  CRISPR gRNA sequence
catcatcatcatgtcatctc

SEQ ID NO: 805953 - DNA, 20 bp, Artificial
  CRISPR gRNA sequence
atcatcatcatgtcatctct

SEQ ID NO: 805954 - DNA, 20 bp, Artificial
  CRISPR gRNA sequence
ttgtctctatagatcatatc

SEQ ID NO: 805955 - DNA, 20 bp, Artificial
  CRISPR gRNA sequence
gtctctatagatcatatcaa

SEQ ID NO: 805956 - DNA, 20 bp, Artificial
  CRISPR gRNA sequence
tctctatagatcatatcaaa

SEQ ID NO: 805957 - DNA, 20 bp, Artificial
  CRISPR gRNA sequence
tatagatcatatcaaatcct

SEQ ID NO: 805958 - DNA, 20 bp, Artificial
  CRISPR gRNA sequence
tagatcatatcaaatccttc

SEQ ID NO: 805959 - DNA, 20 bp, Artificial
  CRISPR gRNA sequence
cccagagtttttcaggcctt

SEQ ID NO: 805960 - DNA, 20 bp, Artificial
  CRISPR gRNA sequence
ccagagtttttcaggccttt

SEQ ID NO: 805961 - DNA, 20 bp, Artificial
  CRISPR gRNA sequence
ttcaggccttttgacaacta

SEQ ID NO: 805962 - DNA, 20 bp, Artificial
  CRISPR gRNA sequence
tcaggccttttgacaactag

SEQ ID NO: 805963 - DNA, 20 bp, Artificial
  CRISPR gRNA sequence
caggccttttgacaactagc

SEQ ID NO: 805964 - DNA, 20 bp, Artificial
  CRISPR gRNA sequence
aggccttttgacaactagcc

SEQ ID NO: 805965 - DNA, 20 bp, Artificial
  CRISPR gRNA sequence
ttgacaactagccacatttc

SEQ ID NO: 805966 - DNA, 20 bp, Artificial
  CRISPR gRNA sequence
tgacaactagccacatttca

SEQ ID NO: 805967 - DNA, 20 bp, Artificial
  CRISPR gRNA sequence
gacaactagccacatttcac

SEQ ID NO: 805968 - DNA, 20 bp, Artificial
  CRISPR gRNA sequence
acaactagccacatttcact

SEQ ID NO: 805969 - DNA, 20 bp, Artificial
  CRISPR gRNA sequence
gccacatttcactaagccaa

SEQ ID NO: 805970 - DNA, 20 bp, Artificial
  CRISPR gRNA sequence
cactaagccaactcatctac

SEQ ID NO: 805971 - DNA, 20 bp, Artificial
  CRISPR gRNA sequence
actaagccaactcatctacc

SEQ ID NO: 805972 - DNA, 20 bp, Artificial
  CRISPR gRNA sequence
agccaactcatctaccactc

SEQ ID NO: 805973 - DNA, 20 bp, Artificial
  CRISPR gRNA sequence
atctaccactcttcaacaaa

SEQ ID NO: 805974 - DNA, 20 bp, Artificial
  CRISPR gRNA sequence
ccactcttcaacaaaacttt

SEQ ID NO: 805975 - DNA, 20 bp, Artificial
  CRISPR gRNA sequence
ttcaacaaaacttttcctca

SEQ ID NO: 805976 - DNA, 20 bp, Artificial
  CRISPR gRNA sequence
caacaaaacttttcctcaag

SEQ ID NO: 805977 - DNA, 20 bp, Artificial
  CRISPR gRNA sequence
aacaaaacttttcctcaagt

SEQ ID NO: 805978 - DNA, 20 bp, Artificial
  CRISPR gRNA sequence
ttcctcaagttgagctgctc

SEQ ID NO: 805979 - DNA, 20 bp, Artificial
  CRISPR gRNA sequence
tcctcaagttgagctgctcc

SEQ ID NO: 805980 - DNA, 20 bp, Artificial
  CRISPR gRNA sequence
cctcaagttgagctgctcca

SEQ ID NO: 805981 - DNA, 20 bp, Artificial
  CRISPR gRNA sequence
ctcaagttgagctgctccac

SEQ ID NO: 805982 - DNA, 20 bp, Artificial
  CRISPR gRNA sequence
aagttgagctgctccaccaa

SEQ ID NO: 805983 - DNA, 20 bp, Artificial
  CRISPR gRNA sequence
agctgctccaccaacaccac

SEQ ID NO: 805984 - DNA, 20 bp, Artificial
  CRISPR gRNA sequence
ctccaccaacaccactgcca

SEQ ID NO: 805985 - DNA, 20 bp, Artificial
  CRISPR gRNA sequence
caccaacaccactgccatga

SEQ ID NO: 805986 - DNA, 20 bp, Artificial
  CRISPR gRNA sequence
ccatgagctcattcccactt

SEQ ID NO: 805987 - DNA, 20 bp, Artificial
  CRISPR gRNA sequence
attcccacttctgtggcttt

SEQ ID NO: 805988 - DNA, 20 bp, Artificial
  CRISPR gRNA sequence
ccacttctgtggctttgctc

SEQ ID NO: 805989 - DNA, 20 bp, Artificial
  CRISPR gRNA sequence
ctgtggctttgctcatgttg

SEQ ID NO: 805990 - DNA, 20 bp, Artificial
  CRISPR gRNA sequence
tgtggctttgctcatgttgg

SEQ ID NO: 805991 - DNA, 20 bp, Artificial
  CRISPR gRNA sequence
tggctttgctcatgttggtt

SEQ ID NO: 805992 - DNA, 20 bp, Artificial
  CRISPR gRNA sequence
tgctcatgttggttattttt

SEQ ID NO: 805993 - DNA, 20 bp, Artificial
  CRISPR gRNA sequence
gctcatgttggttatttttt

SEQ ID NO: 805994 - DNA, 20 bp, Artificial
  CRISPR gRNA sequence
ctcatgttggttattttttt

SEQ ID NO: 805995 - DNA, 20 bp, Artificial
  CRISPR gRNA sequence
atgttggttatttttttgga

SEQ ID NO: 805996 - DNA, 20 bp, Artificial
  CRISPR gRNA sequence
gttatttttttggagtgtcc

SEQ ID NO: 805997 - DNA, 20 bp, Artificial
  CRISPR gRNA sequence
tttttttggagtgtcctccc

SEQ ID NO: 805998 - DNA, 20 bp, Artificial
  CRISPR gRNA sequence
ttttggagtgtcctccctat

SEQ ID NO: 805999 - DNA, 20 bp, Artificial
  CRISPR gRNA sequence
tttggagtgtcctccctatt

SEQ ID NO: 806000 - DNA, 20 bp, Artificial
  CRISPR gRNA sequence
ttggagtgtcctccctattc

SEQ ID NO: 806001 - DNA, 20 bp, Artificial
  CRISPR gRNA sequence
tggagtgtcctccctattcc

SEQ ID NO: 806002 - DNA, 20 bp, Artificial
  CRISPR gRNA sequence
ggagtgtcctccctattcct

SEQ ID NO: 806003 - DNA, 20 bp, Artificial
  CRISPR gRNA sequence
gagtgtcctccctattcctt

SEQ ID NO: 806004 - DNA, 20 bp, Artificial
  CRISPR gRNA sequence
cctattccttcttacttgtc

SEQ ID NO: 806005 - DNA, 20 bp, Artificial
  CRISPR gRNA sequence
ttccttcttacttgtcccaa

SEQ ID NO: 806006 - DNA, 20 bp, Artificial
  CRISPR gRNA sequence
cttcttacttgtcccaatcc

SEQ ID NO: 806007 - DNA, 20 bp, Artificial
  CRISPR gRNA sequence
cttacttgtcccaatcccaa

SEQ ID NO: 806008 - DNA, 20 bp, Artificial
  CRISPR gRNA sequence
ttacttgtcccaatcccaac

SEQ ID NO: 806009 - DNA, 20 bp, Artificial
  CRISPR gRNA sequence
acttgtcccaatcccaactt

SEQ ID NO: 806010 - DNA, 20 bp, Artificial
  CRISPR gRNA sequence
cttgtcccaatcccaacttt

SEQ ID NO: 806011 - DNA, 20 bp, Artificial
  CRISPR gRNA sequence
gtcccaatcccaacttttgg

SEQ ID NO: 806012 - DNA, 20 bp, Artificial
  CRISPR gRNA sequence
tcccaatcccaacttttggc

SEQ ID NO: 806013 - DNA, 20 bp, Artificial
  CRISPR gRNA sequence
ttggcatggtctactttaag

SEQ ID NO: 806014 - DNA, 20 bp, Artificial
  CRISPR gRNA sequence
tggcatggtctactttaaga

SEQ ID NO: 806015 - DNA, 20 bp, Artificial
  CRISPR gRNA sequence
ggcatggtctactttaagat

SEQ ID NO: 806016 - DNA, 20 bp, Artificial
  CRISPR gRNA sequence
gcatggtctactttaagata

SEQ ID NO: 806017 - DNA, 20 bp, Artificial
  CRISPR gRNA sequence
ctttaagatacagtaatgag

SEQ ID NO: 806018 - DNA, 20 bp, Artificial
  CRISPR gRNA sequence
taagatacagtaatgagtaa

SEQ ID NO: 806019 - DNA, 20 bp, Artificial
  CRISPR gRNA sequence
aagatacagtaatgagtaac

SEQ ID NO: 806020 - DNA, 20 bp, Artificial
  CRISPR gRNA sequence
agatacagtaatgagtaact

SEQ ID NO: 806021 - DNA, 20 bp, Artificial
  CRISPR gRNA sequence
tattattataacaccaggct

SEQ ID NO: 806022 - DNA, 20 bp, Artificial
  CRISPR gRNA sequence
attattataacaccaggctt

SEQ ID NO: 806023 - DNA, 20 bp, Artificial
  CRISPR gRNA sequence
ttattataacaccaggcttc

SEQ ID NO: 806024 - DNA, 20 bp, Artificial
  CRISPR gRNA sequence
ttataacaccaggcttctgt

SEQ ID NO: 806025 - DNA, 20 bp, Artificial
  CRISPR gRNA sequence
taacaccaggcttctgttct

SEQ ID NO: 806026 - DNA, 20 bp, Artificial
  CRISPR gRNA sequence
ctgttctaagacattagaag

SEQ ID NO: 806027 - DNA, 20 bp, Artificial
  CRISPR gRNA sequence
tgttctaagacattagaagt

SEQ ID NO: 806028 - DNA, 20 bp, Artificial
  CRISPR gRNA sequence
ttctaagacattagaagtgt

SEQ ID NO: 806029 - DNA, 20 bp, Artificial
  CRISPR gRNA sequence
taagacattagaagtgtgtt

SEQ ID NO: 806030 - DNA, 20 bp, Artificial
  CRISPR gRNA sequence
agacattagaagtgtgttta

SEQ ID NO: 806031 - DNA, 20 bp, Artificial
  CRISPR gRNA sequence
gaagtgtgtttagactagct

SEQ ID NO: 806032 - DNA, 20 bp, Artificial
  CRISPR gRNA sequence
agactagctcatttaatcct

SEQ ID NO: 806033 - DNA, 20 bp, Artificial
  CRISPR gRNA sequence
gactagctcatttaatcctc

SEQ ID NO: 806034 - DNA, 20 bp, Artificial
  CRISPR gRNA sequence
gctcatttaatcctcacagt

SEQ ID NO: 806035 - DNA, 20 bp, Artificial
  CRISPR gRNA sequence
atttaatcctcacagtagcc

SEQ ID NO: 806036 - DNA, 20 bp, Artificial
  CRISPR gRNA sequence
aatcctcacagtagccctct

SEQ ID NO: 806037 - DNA, 20 bp, Artificial
  CRISPR gRNA sequence
atcctcacagtagccctctg

SEQ ID NO: 806038 - DNA, 20 bp, Artificial
  CRISPR gRNA sequence
acagtagccctctgaagtac

SEQ ID NO: 806039 - DNA, 20 bp, Artificial
  CRISPR gRNA sequence
tgaagtacttactccctgct

SEQ ID NO: 806040 - DNA, 20 bp, Artificial
  CRISPR gRNA sequence
aagtacttactccctgcttc

SEQ ID NO: 806041 - DNA, 20 bp, Artificial
  CRISPR gRNA sequence
actccctgcttcccatttta

SEQ ID NO: 806042 - DNA, 20 bp, Artificial
  CRISPR gRNA sequence
ctccctgcttcccattttat

SEQ ID NO: 806043 - DNA, 20 bp, Artificial
  CRISPR gRNA sequence
cctgcttcccattttatagg

SEQ ID NO: 806044 - DNA, 20 bp, Artificial
  CRISPR gRNA sequence
cttcccattttataggtgag

SEQ ID NO: 806045 - DNA, 20 bp, Artificial
  CRISPR gRNA sequence
cccattttataggtgaggaa

SEQ ID NO: 806046 - DNA, 20 bp, Artificial
  CRISPR gRNA sequence
ccattttataggtgaggaag

SEQ ID NO: 806047 - DNA, 20 bp, Artificial
  CRISPR gRNA sequence
tataggtgaggaagaaaaac

SEQ ID NO: 806048 - DNA, 20 bp, Artificial
  CRISPR gRNA sequence
ataggtgaggaagaaaaaca

SEQ ID NO: 806049 - DNA, 20 bp, Artificial
  CRISPR gRNA sequence
taggtgaggaagaaaaacat

SEQ ID NO: 806050 - DNA, 20 bp, Artificial
  CRISPR gRNA sequence
actaacttgcccaaggtata

SEQ ID NO: 806051 - DNA, 20 bp, Artificial
  CRISPR gRNA sequence
acttgcccaaggtatatagc

SEQ ID NO: 806052 - DNA, 20 bp, Artificial
  CRISPR gRNA sequence
gcccaaggtatatagctaat

SEQ ID NO: 806053 - DNA, 20 bp, Artificial
  CRISPR gRNA sequence
cccaaggtatatagctaata

SEQ ID NO: 806054 - DNA, 20 bp, Artificial
  CRISPR gRNA sequence
ataatataagggccaataaa

SEQ ID NO: 806055 - DNA, 20 bp, Artificial
  CRISPR gRNA sequence
attcagcaatccaggtgtcc

SEQ ID NO: 806056 - DNA, 20 bp, Artificial
  CRISPR gRNA sequence
agcaatccaggtgtccaagt

SEQ ID NO: 806057 - DNA, 20 bp, Artificial
  CRISPR gRNA sequence
cactctgcttttttaaaatt

SEQ ID NO: 806058 - DNA, 20 bp, Artificial
  CRISPR gRNA sequence
tgcttttttaaaatttaatt

SEQ ID NO: 806059 - DNA, 20 bp, Artificial
  CRISPR gRNA sequence
cttttttaaaatttaattca

SEQ ID NO: 806060 - DNA, 20 bp, Artificial
  CRISPR gRNA sequence
ttttaaaatttaattcaatt

SEQ ID NO: 806061 - DNA, 20 bp, Artificial
  CRISPR gRNA sequence
tttaaaatttaattcaattt

SEQ ID NO: 806062 - DNA, 20 bp, Artificial
  CRISPR gRNA sequence
ttaaaatttaattcaatttt

SEQ ID NO: 806063 - DNA, 20 bp, Artificial
  CRISPR gRNA sequence
taaaatttaattcaattttt

SEQ ID NO: 806064 - DNA, 20 bp, Artificial
  CRISPR gRNA sequence
aaaatttaattcaatttttt

SEQ ID NO: 806065 - DNA, 20 bp, Artificial
  CRISPR gRNA sequence
aaatttaattcaattttttt

SEQ ID NO: 806066 - DNA, 20 bp, Artificial
  CRISPR gRNA sequence
aattcaatttttttttagag

SEQ ID NO: 806067 - DNA, 20 bp, Artificial
  CRISPR gRNA sequence
attcaatttttttttagaga

SEQ ID NO: 806068 - DNA, 20 bp, Artificial
  CRISPR gRNA sequence
aatttttttttagagacaga

SEQ ID NO: 806069 - DNA, 20 bp, Artificial
  CRISPR gRNA sequence
ttttttagagacagagtctt

SEQ ID NO: 806070 - DNA, 20 bp, Artificial
  CRISPR gRNA sequence
tttttagagacagagtcttg

SEQ ID NO: 806071 - DNA, 20 bp, Artificial
  CRISPR gRNA sequence
ttttagagacagagtcttgc

SEQ ID NO: 806072 - DNA, 20 bp, Artificial
  CRISPR gRNA sequence
tttagagacagagtcttgct

SEQ ID NO: 806073 - DNA, 20 bp, Artificial
  CRISPR gRNA sequence
ttagagacagagtcttgctc

SEQ ID NO: 806074 - DNA, 20 bp, Artificial
  CRISPR gRNA sequence
tagagacagagtcttgctct

SEQ ID NO: 806075 - DNA, 20 bp, Artificial
  CRISPR gRNA sequence
agagacagagtcttgctcta

SEQ ID NO: 806076 - DNA, 20 bp, Artificial
  CRISPR gRNA sequence
gagacagagtcttgctctat

SEQ ID NO: 806077 - DNA, 20 bp, Artificial
  CRISPR gRNA sequence
gctctatcacccaggttgga

SEQ ID NO: 806078 - DNA, 20 bp, Artificial
  CRISPR gRNA sequence
ctctatcacccaggttggag

SEQ ID NO: 806079 - DNA, 20 bp, Artificial
  CRISPR gRNA sequence
tatcacccaggttggagtgc

SEQ ID NO: 806080 - DNA, 20 bp, Artificial
  CRISPR gRNA sequence
tcacccaggttggagtgcag

SEQ ID NO: 806081 - DNA, 20 bp, Artificial
  CRISPR gRNA sequence
gagtgcagtggtatgaccgt

SEQ ID NO: 806082 - DNA, 20 bp, Artificial
  CRISPR gRNA sequence
actgcagcctcaacttttgg

SEQ ID NO: 806083 - DNA, 20 bp, Artificial
  CRISPR gRNA sequence
cagcctcaacttttggactc

SEQ ID NO: 806084 - DNA, 20 bp, Artificial
  CRISPR gRNA sequence
aacttttggactcaagctat

SEQ ID NO: 806085 - DNA, 20 bp, Artificial
  CRISPR gRNA sequence
ttggactcaagctatcttcc

SEQ ID NO: 806086 - DNA, 20 bp, Artificial
  CRISPR gRNA sequence
tggactcaagctatcttccc

SEQ ID NO: 806087 - DNA, 20 bp, Artificial
  CRISPR gRNA sequence
ggactcaagctatcttccca

SEQ ID NO: 806088 - DNA, 20 bp, Artificial
  CRISPR gRNA sequence
gactcaagctatcttcccac

SEQ ID NO: 806089 - DNA, 20 bp, Artificial
  CRISPR gRNA sequence
aagctatcttcccacctcag

SEQ ID NO: 806090 - DNA, 20 bp, Artificial
  CRISPR gRNA sequence
tcttcccacctcagcctcct

SEQ ID NO: 806091 - DNA, 20 bp, Artificial
  CRISPR gRNA sequence
cccacctcagcctcctgagt

SEQ ID NO: 806092 - DNA, 20 bp, Artificial
  CRISPR gRNA sequence
ccacctcagcctcctgagta

SEQ ID NO: 806093 - DNA, 20 bp, Artificial
  CRISPR gRNA sequence
agcctcctgagtagctggga

SEQ ID NO: 806094 - DNA, 20 bp, Artificial
  CRISPR gRNA sequence
ctgagtagctgggactacag

SEQ ID NO: 806095 - DNA, 20 bp, Artificial
  CRISPR gRNA sequence
agtagctgggactacaggtg

SEQ ID NO: 806096 - DNA, 20 bp, Artificial
  CRISPR gRNA sequence
ggactacaggtgcatgccac

SEQ ID NO: 806097 - DNA, 20 bp, Artificial
  CRISPR gRNA sequence
caggtgcatgccaccgtacc

SEQ ID NO: 806098 - DNA, 20 bp, Artificial
  CRISPR gRNA sequence
gattttttatttttattttt

SEQ ID NO: 806099 - DNA, 20 bp, Artificial
  CRISPR gRNA sequence
tttatttttattttttgtag

SEQ ID NO: 806100 - DNA, 20 bp, Artificial
  CRISPR gRNA sequence
ttatttttattttttgtaga

SEQ ID NO: 806101 - DNA, 20 bp, Artificial
  CRISPR gRNA sequence
tatttttattttttgtagaa

SEQ ID NO: 806102 - DNA, 20 bp, Artificial
  CRISPR gRNA sequence
atttttattttttgtagaac

SEQ ID NO: 806103 - DNA, 20 bp, Artificial
  CRISPR gRNA sequence
tttttattttttgtagaact

SEQ ID NO: 806104 - DNA, 20 bp, Artificial
  CRISPR gRNA sequence
ttattttttgtagaactggg

SEQ ID NO: 806105 - DNA, 20 bp, Artificial
  CRISPR gRNA sequence
tattttttgtagaactgggg

SEQ ID NO: 806106 - DNA, 20 bp, Artificial
  CRISPR gRNA sequence
attttttgtagaactggggt

SEQ ID NO: 806107 - DNA, 20 bp, Artificial
  CRISPR gRNA sequence
ttttttgtagaactggggtc

SEQ ID NO: 806108 - DNA, 20 bp, Artificial
  CRISPR gRNA sequence
tttgtagaactggggtctca

SEQ ID NO: 806109 - DNA, 20 bp, Artificial
  CRISPR gRNA sequence
ttgtagaactggggtctcac

SEQ ID NO: 806110 - DNA, 20 bp, Artificial
  CRISPR gRNA sequence
tgtagaactggggtctcact

SEQ ID NO: 806111 - DNA, 20 bp, Artificial
  CRISPR gRNA sequence
gtagaactggggtctcacta

SEQ ID NO: 806112 - DNA, 20 bp, Artificial
  CRISPR gRNA sequence
tagaactggggtctcactat

SEQ ID NO: 806113 - DNA, 20 bp, Artificial
  CRISPR gRNA sequence
gggtctcactatgttgccca

SEQ ID NO: 806114 - DNA, 20 bp, Artificial
  CRISPR gRNA sequence
actatgttgcccaggatggt

SEQ ID NO: 806115 - DNA, 20 bp, Artificial
  CRISPR gRNA sequence
tgttgcccaggatggtctca

SEQ ID NO: 806116 - DNA, 20 bp, Artificial
  CRISPR gRNA sequence
cccaggatggtctcaaactc

SEQ ID NO: 806117 - DNA, 20 bp, Artificial
  CRISPR gRNA sequence
aaactcctcggctcaagcaa

SEQ ID NO: 806118 - DNA, 20 bp, Artificial
  CRISPR gRNA sequence
ctcggctcaagcaatcctcc

SEQ ID NO: 806119 - DNA, 20 bp, Artificial
  CRISPR gRNA sequence
ggctcaagcaatcctcctgc

SEQ ID NO: 806120 - DNA, 20 bp, Artificial
  CRISPR gRNA sequence
aagcaatcctcctgccttgg

SEQ ID NO: 806121 - DNA, 20 bp, Artificial
  CRISPR gRNA sequence
ctgccttggcctcccaaagt

SEQ ID NO: 806122 - DNA, 20 bp, Artificial
  CRISPR gRNA sequence
ccttggcctcccaaagtgct

SEQ ID NO: 806123 - DNA, 20 bp, Artificial
  CRISPR gRNA sequence
ggcctcccaaagtgctggga

SEQ ID NO: 806124 - DNA, 20 bp, Artificial
  CRISPR gRNA sequence
gcctcccaaagtgctgggat

SEQ ID NO: 806125 - DNA, 20 bp, Artificial
  CRISPR gRNA sequence
ccaaagtgctgggattccag

SEQ ID NO: 806126 - DNA, 20 bp, Artificial
  CRISPR gRNA sequence
ggattccaggcgtaagccac

SEQ ID NO: 806127 - DNA, 20 bp, Artificial
  CRISPR gRNA sequence
caggcgtaagccactgtgcc

SEQ ID NO: 806128 - DNA, 20 bp, Artificial
  CRISPR gRNA sequence
tgcccagcctacatacacaa

SEQ ID NO: 806129 - DNA, 20 bp, Artificial
  CRISPR gRNA sequence
catacacaacactctcttgc

SEQ ID NO: 806130 - DNA, 20 bp, Artificial
  CRISPR gRNA sequence
tcttgcttaatctgtaagac

SEQ ID NO: 806131 - DNA, 20 bp, Artificial
  CRISPR gRNA sequence
ttgcttaatctgtaagactc

SEQ ID NO: 806132 - DNA, 20 bp, Artificial
  CRISPR gRNA sequence
gcttaatctgtaagactctc

SEQ ID NO: 806133 - DNA, 20 bp, Artificial
  CRISPR gRNA sequence
cttaatctgtaagactctct

SEQ ID NO: 806134 - DNA, 20 bp, Artificial
  CRISPR gRNA sequence
aatctgtaagactctctccc

SEQ ID NO: 806135 - DNA, 20 bp, Artificial
  CRISPR gRNA sequence
atctgtaagactctctcccc

SEQ ID NO: 806136 - DNA, 20 bp, Artificial
  CRISPR gRNA sequence
taagactctctcccccactc

SEQ ID NO: 806137 - DNA, 20 bp, Artificial
  CRISPR gRNA sequence
tctcccccactcataccttt

SEQ ID NO: 806138 - DNA, 20 bp, Artificial
  CRISPR gRNA sequence
tcccccactcataccttttt

SEQ ID NO: 806139 - DNA, 20 bp, Artificial
  CRISPR gRNA sequence
ccccactcatacctttttat

SEQ ID NO: 806140 - DNA, 20 bp, Artificial
  CRISPR gRNA sequence
atacctttttatttttcctc

SEQ ID NO: 806141 - DNA, 20 bp, Artificial
  CRISPR gRNA sequence
tttatttttcctctgcattg

SEQ ID NO: 806142 - DNA, 20 bp, Artificial
  CRISPR gRNA sequence
ttatttttcctctgcattgt

SEQ ID NO: 806143 - DNA, 20 bp, Artificial
  CRISPR gRNA sequence
tatttttcctctgcattgta

SEQ ID NO: 806144 - DNA, 20 bp, Artificial
  CRISPR gRNA sequence
atttttcctctgcattgtac

SEQ ID NO: 806145 - DNA, 20 bp, Artificial
  CRISPR gRNA sequence
tttttcctctgcattgtaca

SEQ ID NO: 806146 - DNA, 20 bp, Artificial
  CRISPR gRNA sequence
ttcctctgcattgtacacac

SEQ ID NO: 806147 - DNA, 20 bp, Artificial
  CRISPR gRNA sequence
tcctctgcattgtacacaca

SEQ ID NO: 806148 - DNA, 20 bp, Artificial
  CRISPR gRNA sequence
cctctgcattgtacacacaa

SEQ ID NO: 806149 - DNA, 20 bp, Artificial
  CRISPR gRNA sequence
ctctgcattgtacacacaat

SEQ ID NO: 806150 - DNA, 20 bp, Artificial
  CRISPR gRNA sequence
tgcattgtacacacaatcta

SEQ ID NO: 806151 - DNA, 20 bp, Artificial
  CRISPR gRNA sequence
cattgtacacacaatctata

SEQ ID NO: 806152 - DNA, 20 bp, Artificial
  CRISPR gRNA sequence
tacacacaatctataccact

SEQ ID NO: 806153 - DNA, 20 bp, Artificial
  CRISPR gRNA sequence
taccactcttaagcacatga

SEQ ID NO: 806154 - DNA, 20 bp, Artificial
  CRISPR gRNA sequence
ttaagcacatgattacagcg

SEQ ID NO: 806155 - DNA, 20 bp, Artificial
  CRISPR gRNA sequence
aagcacatgattacagcgtt

SEQ ID NO: 806156 - DNA, 20 bp, Artificial
  CRISPR gRNA sequence
agcacatgattacagcgtta

SEQ ID NO: 806157 - DNA, 20 bp, Artificial
  CRISPR gRNA sequence
cagcgttattttctggctgc

SEQ ID NO: 806158 - DNA, 20 bp, Artificial
  CRISPR gRNA sequence
ttttctggctgcttctatgt

SEQ ID NO: 806159 - DNA, 20 bp, Artificial
  CRISPR gRNA sequence
tctggctgcttctatgtgtc

SEQ ID NO: 806160 - DNA, 20 bp, Artificial
  CRISPR gRNA sequence
ctggctgcttctatgtgtct

SEQ ID NO: 806161 - DNA, 20 bp, Artificial
  CRISPR gRNA sequence
tggctgcttctatgtgtcta

SEQ ID NO: 806162 - DNA, 20 bp, Artificial
  CRISPR gRNA sequence
gctgcttctatgtgtctata

SEQ ID NO: 806163 - DNA, 20 bp, Artificial
  CRISPR gRNA sequence
cttctatgtgtctatatttt

SEQ ID NO: 806164 - DNA, 20 bp, Artificial
  CRISPR gRNA sequence
ctatgtgtctatattttagg

SEQ ID NO: 806165 - DNA, 20 bp, Artificial
  CRISPR gRNA sequence
tatgtgtctatattttaggt

SEQ ID NO: 806166 - DNA, 20 bp, Artificial
  CRISPR gRNA sequence
tgtgtctatattttaggtcc

SEQ ID NO: 806167 - DNA, 20 bp, Artificial
  CRISPR gRNA sequence
tattttaggtccacctggtc

SEQ ID NO: 806168 - DNA, 20 bp, Artificial
  CRISPR gRNA sequence
taggtccacctggtcaatat

SEQ ID NO: 806169 - DNA, 20 bp, Artificial
  CRISPR gRNA sequence
aggtccacctggtcaatata

SEQ ID NO: 806170 - DNA, 20 bp, Artificial
  CRISPR gRNA sequence
ggtccacctggtcaatataa

SEQ ID NO: 806171 - DNA, 20 bp, Artificial
  CRISPR gRNA sequence
gtcaatataataaagtggga

SEQ ID NO: 806172 - DNA, 20 bp, Artificial
  CRISPR gRNA sequence
gtgttaatgcaactatatgg

SEQ ID NO: 806173 - DNA, 20 bp, Artificial
  CRISPR gRNA sequence
atgcaactatatggtatttg

SEQ ID NO: 806174 - DNA, 20 bp, Artificial
  CRISPR gRNA sequence
tatggtatttgatatttgtc

SEQ ID NO: 806175 - DNA, 20 bp, Artificial
  CRISPR gRNA sequence
gatatttgtctttctgtccg

SEQ ID NO: 806176 - DNA, 20 bp, Artificial
  CRISPR gRNA sequence
atatttgtctttctgtccgt

SEQ ID NO: 806177 - DNA, 20 bp, Artificial
  CRISPR gRNA sequence
gtctttctgtccgtttatca

SEQ ID NO: 806178 - DNA, 20 bp, Artificial
  CRISPR gRNA sequence
tctttctgtccgtttatcaa

SEQ ID NO: 806179 - DNA, 20 bp, Artificial
  CRISPR gRNA sequence
tctgtccgtttatcaatgtt

SEQ ID NO: 806180 - DNA, 20 bp, Artificial
  CRISPR gRNA sequence
ctgtccgtttatcaatgttt

SEQ ID NO: 806181 - DNA, 20 bp, Artificial
  CRISPR gRNA sequence
tgtccgtttatcaatgtttc

SEQ ID NO: 806182 - DNA, 20 bp, Artificial
  CRISPR gRNA sequence
tccgtttatcaatgtttctt

SEQ ID NO: 806183 - DNA, 20 bp, Artificial
  CRISPR gRNA sequence
atcaatgtttcttatagttt

SEQ ID NO: 806184 - DNA, 20 bp, Artificial
  CRISPR gRNA sequence
tcaatgtttcttatagttta

SEQ ID NO: 806185 - DNA, 20 bp, Artificial
  CRISPR gRNA sequence
cttatagtttattatataat

SEQ ID NO: 806186 - DNA, 20 bp, Artificial
  CRISPR gRNA sequence
ttatagtttattatataata

SEQ ID NO: 806187 - DNA, 20 bp, Artificial
  CRISPR gRNA sequence
atagtttattatataataaa

SEQ ID NO: 806188 - DNA, 20 bp, Artificial
  CRISPR gRNA sequence
tagtttattatataataaat

SEQ ID NO: 806189 - DNA, 20 bp, Artificial
  CRISPR gRNA sequence
attatataataaatttaaaa

SEQ ID NO: 806190 - DNA, 20 bp, Artificial
  CRISPR gRNA sequence
ttatataataaatttaaaag

SEQ ID NO: 806191 - DNA, 20 bp, Artificial
  CRISPR gRNA sequence
tataataaatttaaaaggtg

SEQ ID NO: 806192 - DNA, 20 bp, Artificial
  CRISPR gRNA sequence
aaaaggtgtctgattttgac

SEQ ID NO: 806193 - DNA, 20 bp, Artificial
  CRISPR gRNA sequence
aaaggtgtctgattttgacc

SEQ ID NO: 806194 - DNA, 20 bp, Artificial
  CRISPR gRNA sequence
attttgaccaaatttgacta

SEQ ID NO: 806195 - DNA, 20 bp, Artificial
  CRISPR gRNA sequence
tgaccaaatttgactaaata

SEQ ID NO: 806196 - DNA, 20 bp, Artificial
  CRISPR gRNA sequence
gaccaaatttgactaaatac

SEQ ID NO: 806197 - DNA, 20 bp, Artificial
  CRISPR gRNA sequence
accaaatttgactaaatact

SEQ ID NO: 806198 - DNA, 20 bp, Artificial
  CRISPR gRNA sequence
gactaaatactaaaaaacaa

SEQ ID NO: 806199 - DNA, 20 bp, Artificial
  CRISPR gRNA sequence
actaaatactaaaaaacaat

SEQ ID NO: 806200 - DNA, 20 bp, Artificial
  CRISPR gRNA sequence
aatactaaaaaacaatatta

SEQ ID NO: 806201 - DNA, 20 bp, Artificial
  CRISPR gRNA sequence
aaaaacaatattaaaataaa

SEQ ID NO: 806202 - DNA, 20 bp, Artificial
  CRISPR gRNA sequence
aaataaattttgtttaattt

SEQ ID NO: 806203 - DNA, 20 bp, Artificial
  CRISPR gRNA sequence
tgtttaattttagttgagtc

SEQ ID NO: 806204 - DNA, 20 bp, Artificial
  CRISPR gRNA sequence
gtttaattttagttgagtct

SEQ ID NO: 806205 - DNA, 20 bp, Artificial
  CRISPR gRNA sequence
tttaattttagttgagtcta

SEQ ID NO: 806206 - DNA, 20 bp, Artificial
  CRISPR gRNA sequence
aattttagttgagtctatca

SEQ ID NO: 806207 - DNA, 20 bp, Artificial
  CRISPR gRNA sequence
attttagttgagtctatcaa

SEQ ID NO: 806208 - DNA, 20 bp, Artificial
  CRISPR gRNA sequence
tagttgagtctatcaactca

SEQ ID NO: 806209 - DNA, 20 bp, Artificial
  CRISPR gRNA sequence
agttgagtctatcaactcaa

SEQ ID NO: 806210 - DNA, 20 bp, Artificial
  CRISPR gRNA sequence
gttgagtctatcaactcaaa

SEQ ID NO: 806211 - DNA, 20 bp, Artificial
  CRISPR gRNA sequence
agtctatcaactcaaaaaag

SEQ ID NO: 806212 - DNA, 20 bp, Artificial
  CRISPR gRNA sequence
tcaactcaaaaaagaataac

SEQ ID NO: 806213 - DNA, 20 bp, Artificial
  CRISPR gRNA sequence
aaaaaagaataacgtacaac

SEQ ID NO: 806214 - DNA, 20 bp, Artificial
  CRISPR gRNA sequence
cagaacattttttaaattac

SEQ ID NO: 806215 - DNA, 20 bp, Artificial
  CRISPR gRNA sequence
agaacattttttaaattact

SEQ ID NO: 806216 - DNA, 20 bp, Artificial
  CRISPR gRNA sequence
tttaaattactgattttatg

SEQ ID NO: 806217 - DNA, 20 bp, Artificial
  CRISPR gRNA sequence
ttaaattactgattttatga

SEQ ID NO: 806218 - DNA, 20 bp, Artificial
  CRISPR gRNA sequence
taaattactgattttatgag

SEQ ID NO: 806219 - DNA, 20 bp, Artificial
  CRISPR gRNA sequence
aaattactgattttatgagt

SEQ ID NO: 806220 - DNA, 20 bp, Artificial
  CRISPR gRNA sequence
aattactgattttatgagta

SEQ ID NO: 806221 - DNA, 20 bp, Artificial
  CRISPR gRNA sequence
ctgattttatgagtataaaa

SEQ ID NO: 806222 - DNA, 20 bp, Artificial
  CRISPR gRNA sequence
attttatgagtataaaaata

SEQ ID NO: 806223 - DNA, 20 bp, Artificial
  CRISPR gRNA sequence
tatgagtataaaaataaaaa

SEQ ID NO: 806224 - DNA, 20 bp, Artificial
  CRISPR gRNA sequence
atgagtataaaaataaaaaa

SEQ ID NO: 806225 - DNA, 20 bp, Artificial
  CRISPR gRNA sequence
tgagtataaaaataaaaaat

SEQ ID NO: 806226 - DNA, 20 bp, Artificial
  CRISPR gRNA sequence
agaatccattgcctagaaat

SEQ ID NO: 806227 - DNA, 20 bp, Artificial
  CRISPR gRNA sequence
gaatccattgcctagaaatt

SEQ ID NO: 806228 - DNA, 20 bp, Artificial
  CRISPR gRNA sequence
cctagaaattgccatggtta

SEQ ID NO: 806229 - DNA, 20 bp, Artificial
  CRISPR gRNA sequence
gaaattgccatggttaagat

SEQ ID NO: 806230 - DNA, 20 bp, Artificial
  CRISPR gRNA sequence
ccatggttaagattttaata

SEQ ID NO: 806231 - DNA, 20 bp, Artificial
  CRISPR gRNA sequence
agattttaatattgctcagg

SEQ ID NO: 806232 - DNA, 20 bp, Artificial
  CRISPR gRNA sequence
taatattgctcaggcccaga

SEQ ID NO: 806233 - DNA, 20 bp, Artificial
  CRISPR gRNA sequence
aatattgctcaggcccagac

SEQ ID NO: 806234 - DNA, 20 bp, Artificial
  CRISPR gRNA sequence
atattgctcaggcccagaca

SEQ ID NO: 806235 - DNA, 20 bp, Artificial
  CRISPR gRNA sequence
ctcaggcccagacagctcag

SEQ ID NO: 806236 - DNA, 20 bp, Artificial
  CRISPR gRNA sequence
aggcccagacagctcagggc

SEQ ID NO: 806237 - DNA, 20 bp, Artificial
  CRISPR gRNA sequence
agggctttgacattcccaca

SEQ ID NO: 806238 - DNA, 20 bp, Artificial
  CRISPR gRNA sequence
tgacattcccacacccattc

SEQ ID NO: 806239 - DNA, 20 bp, Artificial
  CRISPR gRNA sequence
gacattcccacacccattct

SEQ ID NO: 806240 - DNA, 20 bp, Artificial
  CRISPR gRNA sequence
acattcccacacccattctc

SEQ ID NO: 806241 - DNA, 20 bp, Artificial
  CRISPR gRNA sequence
ccacacccattctctgccat

SEQ ID NO: 806242 - DNA, 20 bp, Artificial
  CRISPR gRNA sequence
tctgccatcccagttctatc

SEQ ID NO: 806243 - DNA, 20 bp, Artificial
  CRISPR gRNA sequence
tgccatcccagttctatctc

SEQ ID NO: 806244 - DNA, 20 bp, Artificial
  CRISPR gRNA sequence
ccatcccagttctatctcat

SEQ ID NO: 806245 - DNA, 20 bp, Artificial
  CRISPR gRNA sequence
tatctcatcccaaaaccatc

SEQ ID NO: 806246 - DNA, 20 bp, Artificial
  CRISPR gRNA sequence
tctcatcccaaaaccatcca

SEQ ID NO: 806247 - DNA, 20 bp, Artificial
  CRISPR gRNA sequence
atcccaaaaccatccattat

SEQ ID NO: 806248 - DNA, 20 bp, Artificial
  CRISPR gRNA sequence
tgaggagagtgtacagctct

SEQ ID NO: 806249 - DNA, 20 bp, Artificial
  CRISPR gRNA sequence
taggctgcccgggagccatc

SEQ ID NO: 806250 - DNA, 20 bp, Artificial
  CRISPR gRNA sequence
ggctgcccgggagccatccc

SEQ ID NO: 806251 - DNA, 20 bp, Artificial
  CRISPR gRNA sequence
cccgggagccatcccgcact

SEQ ID NO: 806252 - DNA, 20 bp, Artificial
  CRISPR gRNA sequence
tcattttgtgactcggcatc

SEQ ID NO: 806253 - DNA, 20 bp, Artificial
  CRISPR gRNA sequence
attttgtgactcggcatctt

SEQ ID NO: 806254 - DNA, 20 bp, Artificial
  CRISPR gRNA sequence
tgtgactcggcatcttggga

SEQ ID NO: 806255 - DNA, 20 bp, Artificial
  CRISPR gRNA sequence
gtgactcggcatcttgggag

SEQ ID NO: 806256 - DNA, 20 bp, Artificial
  CRISPR gRNA sequence
tgactcggcatcttgggaga

SEQ ID NO: 806257 - DNA, 20 bp, Artificial
  CRISPR gRNA sequence
ggcatcttgggagatggagt

SEQ ID NO: 806258 - DNA, 20 bp, Artificial
  CRISPR gRNA sequence
gggagatggagtcttgggac

SEQ ID NO: 806259 - DNA, 20 bp, Artificial
  CRISPR gRNA sequence
ggagatggagtcttgggact

SEQ ID NO: 806260 - DNA, 20 bp, Artificial
  CRISPR gRNA sequence
gggacttagcctggacatgt

SEQ ID NO: 806261 - DNA, 20 bp, Artificial
  CRISPR gRNA sequence
ggacttagcctggacatgtc

SEQ ID NO: 806262 - DNA, 20 bp, Artificial
  CRISPR gRNA sequence
agcctggacatgtcccttgc

SEQ ID NO: 806263 - DNA, 20 bp, Artificial
  CRISPR gRNA sequence
gcctggacatgtcccttgca

SEQ ID NO: 806264 - DNA, 20 bp, Artificial
  CRISPR gRNA sequence
gacatgtcccttgcatgtac

SEQ ID NO: 806265 - DNA, 20 bp, Artificial
  CRISPR gRNA sequence
gcatgtacttcttacaagac

SEQ ID NO: 806266 - DNA, 20 bp, Artificial
  CRISPR gRNA sequence
catgtacttcttacaagact

SEQ ID NO: 806267 - DNA, 20 bp, Artificial
  CRISPR gRNA sequence
cttacaagacttttattcag

SEQ ID NO: 806268 - DNA, 20 bp, Artificial
  CRISPR gRNA sequence
ttacaagacttttattcaga

SEQ ID NO: 806269 - DNA, 20 bp, Artificial
  CRISPR gRNA sequence
acaagacttttattcagatg

SEQ ID NO: 806270 - DNA, 20 bp, Artificial
  CRISPR gRNA sequence
caagacttttattcagatga

SEQ ID NO: 806271 - DNA, 20 bp, Artificial
  CRISPR gRNA sequence
ttattcagatgaatattttc

SEQ ID NO: 806272 - DNA, 20 bp, Artificial
  CRISPR gRNA sequence
tattcagatgaatattttcc

SEQ ID NO: 806273 - DNA, 20 bp, Artificial
  CRISPR gRNA sequence
attcagatgaatattttccc

SEQ ID NO: 806274 - DNA, 20 bp, Artificial
  CRISPR gRNA sequence
ttcagatgaatattttccct

SEQ ID NO: 806275 - DNA, 20 bp, Artificial
  CRISPR gRNA sequence
agatgaatattttcccttcc

SEQ ID NO: 806276 - DNA, 20 bp, Artificial
  CRISPR gRNA sequence
tcccttccaacttaagaagc

SEQ ID NO: 806277 - DNA, 20 bp, Artificial
  CRISPR gRNA sequence
cccttccaacttaagaagca

SEQ ID NO: 806278 - DNA, 20 bp, Artificial
  CRISPR gRNA sequence
ccttccaacttaagaagcac

SEQ ID NO: 806279 - DNA, 20 bp, Artificial
  CRISPR gRNA sequence
ccaacttaagaagcacaggg

SEQ ID NO: 806280 - DNA, 20 bp, Artificial
  CRISPR gRNA sequence
caacttaagaagcacagggc

SEQ ID NO: 806281 - DNA, 20 bp, Artificial
  CRISPR gRNA sequence
aagaagcacagggcttgctg

SEQ ID NO: 806282 - DNA, 20 bp, Artificial
  CRISPR gRNA sequence
agaagcacagggcttgctgg

SEQ ID NO: 806283 - DNA, 20 bp, Artificial
  CRISPR gRNA sequence
gctggttttgcttcactaac

SEQ ID NO: 806284 - DNA, 20 bp, Artificial
  CRISPR gRNA sequence
ctggttttgcttcactaacc

SEQ ID NO: 806285 - DNA, 20 bp, Artificial
  CRISPR gRNA sequence
gttttgcttcactaaccagc

SEQ ID NO: 806286 - DNA, 20 bp, Artificial
  CRISPR gRNA sequence
tgcttcactaaccagcaact

SEQ ID NO: 806287 - DNA, 20 bp, Artificial
  CRISPR gRNA sequence
gcttcactaaccagcaactg

SEQ ID NO: 806288 - DNA, 20 bp, Artificial
  CRISPR gRNA sequence
cttcactaaccagcaactga

SEQ ID NO: 806289 - DNA, 20 bp, Artificial
  CRISPR gRNA sequence
cactaaccagcaactgaagc

SEQ ID NO: 806290 - DNA, 20 bp, Artificial
  CRISPR gRNA sequence
actaaccagcaactgaagca

SEQ ID NO: 806291 - DNA, 20 bp, Artificial
  CRISPR gRNA sequence
accagcaactgaagcaagac

SEQ ID NO: 806292 - DNA, 20 bp, Artificial
  CRISPR gRNA sequence
aagcaagacctgacttgtga

SEQ ID NO: 806293 - DNA, 20 bp, Artificial
  CRISPR gRNA sequence
acttgtgaaaatgcctaata

SEQ ID NO: 806294 - DNA, 20 bp, Artificial
  CRISPR gRNA sequence
gtgaaaatgcctaatagagt

SEQ ID NO: 806295 - DNA, 20 bp, Artificial
  CRISPR gRNA sequence
tgaaaatgcctaatagagtt

SEQ ID NO: 806296 - DNA, 20 bp, Artificial
  CRISPR gRNA sequence
atagagttcagtattagcgc

SEQ ID NO: 806297 - DNA, 20 bp, Artificial
  CRISPR gRNA sequence
agtattagcgctgtttcacc

SEQ ID NO: 806298 - DNA, 20 bp, Artificial
  CRISPR gRNA sequence
gcgctgtttcaccatttcct

SEQ ID NO: 806299 - DNA, 20 bp, Artificial
  CRISPR gRNA sequence
tttcaccatttcctggatct

SEQ ID NO: 806300 - DNA, 20 bp, Artificial
  CRISPR gRNA sequence
caccatttcctggatctctt

SEQ ID NO: 806301 - DNA, 20 bp, Artificial
  CRISPR gRNA sequence
accatttcctggatctcttg

SEQ ID NO: 806302 - DNA, 20 bp, Artificial
  CRISPR gRNA sequence
cctggatctcttgcctttgt

SEQ ID NO: 806303 - DNA, 20 bp, Artificial
  CRISPR gRNA sequence
ctggatctcttgcctttgtg

SEQ ID NO: 806304 - DNA, 20 bp, Artificial
  CRISPR gRNA sequence
gatctcttgcctttgtgcac

SEQ ID NO: 806305 - DNA, 20 bp, Artificial
  CRISPR gRNA sequence
ttgcctttgtgcacatgata

SEQ ID NO: 806306 - DNA, 20 bp, Artificial
  CRISPR gRNA sequence
gcctttgtgcacatgataga

SEQ ID NO: 806307 - DNA, 20 bp, Artificial
  CRISPR gRNA sequence
cctttgtgcacatgatagaa

SEQ ID NO: 806308 - DNA, 20 bp, Artificial
  CRISPR gRNA sequence
tgtgcacatgatagaattgc

SEQ ID NO: 806309 - DNA, 20 bp, Artificial
  CRISPR gRNA sequence
gtgcacatgatagaattgca

SEQ ID NO: 806310 - DNA, 20 bp, Artificial
  CRISPR gRNA sequence
tgcacatgatagaattgcac

SEQ ID NO: 806311 - DNA, 20 bp, Artificial
  CRISPR gRNA sequence
cacttctctgtgattaattt

SEQ ID NO: 806312 - DNA, 20 bp, Artificial
  CRISPR gRNA sequence
ctctgtgattaatttgtagt

SEQ ID NO: 806313 - DNA, 20 bp, Artificial
  CRISPR gRNA sequence
tctgtgattaatttgtagtt

SEQ ID NO: 806314 - DNA, 20 bp, Artificial
  CRISPR gRNA sequence
tgtgattaatttgtagttaa

SEQ ID NO: 806315 - DNA, 20 bp, Artificial
  CRISPR gRNA sequence
tgattaatttgtagttaagt

SEQ ID NO: 806316 - DNA, 20 bp, Artificial
  CRISPR gRNA sequence
atttgtagttaagtgtggtc

SEQ ID NO: 806317 - DNA, 20 bp, Artificial
  CRISPR gRNA sequence
gtagttaagtgtggtcatgt

SEQ ID NO: 806318 - DNA, 20 bp, Artificial
  CRISPR gRNA sequence
tagttaagtgtggtcatgta

SEQ ID NO: 806319 - DNA, 20 bp, Artificial
  CRISPR gRNA sequence
agtgtggtcatgtaactcgc

SEQ ID NO: 806320 - DNA, 20 bp, Artificial
  CRISPR gRNA sequence
gctttggtcaattaaatgta

SEQ ID NO: 806321 - DNA, 20 bp, Artificial
  CRISPR gRNA sequence
tggtcaattaaatgtaagca

SEQ ID NO: 806322 - DNA, 20 bp, Artificial
  CRISPR gRNA sequence
ggtcaattaaatgtaagcat

SEQ ID NO: 806323 - DNA, 20 bp, Artificial
  CRISPR gRNA sequence
gtcaattaaatgtaagcata

SEQ ID NO: 806324 - DNA, 20 bp, Artificial
  CRISPR gRNA sequence
aatgtaagcataagtgatgc

SEQ ID NO: 806325 - DNA, 20 bp, Artificial
  CRISPR gRNA sequence
tttctgggtagaagatgtaa

SEQ ID NO: 806326 - DNA, 20 bp, Artificial
  CRISPR gRNA sequence
ctgggtagaagatgtaagag

SEQ ID NO: 806327 - DNA, 20 bp, Artificial
  CRISPR gRNA sequence
tgggtagaagatgtaagagt

SEQ ID NO: 806328 - DNA, 20 bp, Artificial
  CRISPR gRNA sequence
ggtagaagatgtaagagttg

SEQ ID NO: 806329 - DNA, 20 bp, Artificial
  CRISPR gRNA sequence
gcatatgctttgccatattt

SEQ ID NO: 806330 - DNA, 20 bp, Artificial
  CRISPR gRNA sequence
tgccatattttctttatcca

SEQ ID NO: 806331 - DNA, 20 bp, Artificial
  CRISPR gRNA sequence
gccatattttctttatccat

SEQ ID NO: 806332 - DNA, 20 bp, Artificial
  CRISPR gRNA sequence
ccatattttctttatccatc

SEQ ID NO: 806333 - DNA, 20 bp, Artificial
  CRISPR gRNA sequence
tctttatccatctggcatgg

SEQ ID NO: 806334 - DNA, 20 bp, Artificial
  CRISPR gRNA sequence
ctttatccatctggcatggt

SEQ ID NO: 806335 - DNA, 20 bp, Artificial
  CRISPR gRNA sequence
tttatccatctggcatggta

SEQ ID NO: 806336 - DNA, 20 bp, Artificial
  CRISPR gRNA sequence
tatccatctggcatggtaac

SEQ ID NO: 806337 - DNA, 20 bp, Artificial
  CRISPR gRNA sequence
atccatctggcatggtaacc

SEQ ID NO: 806338 - DNA, 20 bp, Artificial
  CRISPR gRNA sequence
tccatctggcatggtaacca

SEQ ID NO: 806339 - DNA, 20 bp, Artificial
  CRISPR gRNA sequence
gcatggtaaccagtaacatt

SEQ ID NO: 806340 - DNA, 20 bp, Artificial
  CRISPR gRNA sequence
taggtagtaattgctccatc

SEQ ID NO: 806341 - DNA, 20 bp, Artificial
  CRISPR gRNA sequence
ggtagtaattgctccatcag

SEQ ID NO: 806342 - DNA, 20 bp, Artificial
  CRISPR gRNA sequence
ctccatcagtctcagtctct

SEQ ID NO: 806343 - DNA, 20 bp, Artificial
  CRISPR gRNA sequence
catcagtctcagtctctgag

SEQ ID NO: 806344 - DNA, 20 bp, Artificial
  CRISPR gRNA sequence
agtctctgagtgactaaaat

SEQ ID NO: 806345 - DNA, 20 bp, Artificial
  CRISPR gRNA sequence
tgagtgactaaaattgacag

SEQ ID NO: 806346 - DNA, 20 bp, Artificial
  CRISPR gRNA sequence
agtgactaaaattgacagag

SEQ ID NO: 806347 - DNA, 20 bp, Artificial
  CRISPR gRNA sequence
aaattgacagagtcccctgc

SEQ ID NO: 806348 - DNA, 20 bp, Artificial
  CRISPR gRNA sequence
acagagtcccctgctgaccc

SEQ ID NO: 806349 - DNA, 20 bp, Artificial
  CRISPR gRNA sequence
ctgaccctcaatgtacatgg

SEQ ID NO: 806350 - DNA, 20 bp, Artificial
  CRISPR gRNA sequence
accctcaatgtacatggaac

SEQ ID NO: 806351 - DNA, 20 bp, Artificial
  CRISPR gRNA sequence
aatgtacatggaacatgaac

SEQ ID NO: 806352 - DNA, 20 bp, Artificial
  CRISPR gRNA sequence
ttgttttttatattgagatt

SEQ ID NO: 806353 - DNA, 20 bp, Artificial
  CRISPR gRNA sequence
tgttttttatattgagattt

SEQ ID NO: 806354 - DNA, 20 bp, Artificial
  CRISPR gRNA sequence
gttttttatattgagatttt

SEQ ID NO: 806355 - DNA, 20 bp, Artificial
  CRISPR gRNA sequence
ttttttatattgagattttg

SEQ ID NO: 806356 - DNA, 20 bp, Artificial
  CRISPR gRNA sequence
tttatattgagattttggag

SEQ ID NO: 806357 - DNA, 20 bp, Artificial
  CRISPR gRNA sequence
ttatattgagattttggagt

SEQ ID NO: 806358 - DNA, 20 bp, Artificial
  CRISPR gRNA sequence
tatattgagattttggagtt

SEQ ID NO: 806359 - DNA, 20 bp, Artificial
  CRISPR gRNA sequence
atattgagattttggagttg

SEQ ID NO: 806360 - DNA, 20 bp, Artificial
  CRISPR gRNA sequence
tattgagattttggagttgt

SEQ ID NO: 806361 - DNA, 20 bp, Artificial
  CRISPR gRNA sequence
agattttggagttgtttgtt

SEQ ID NO: 806362 - DNA, 20 bp, Artificial
  CRISPR gRNA sequence
tggagttgtttgttcctaca

SEQ ID NO: 806363 - DNA, 20 bp, Artificial
  CRISPR gRNA sequence
ggagttgtttgttcctacag

SEQ ID NO: 806364 - DNA, 20 bp, Artificial
  CRISPR gRNA sequence
gagttgtttgttcctacagc

SEQ ID NO: 806365 - DNA, 20 bp, Artificial
  CRISPR gRNA sequence
tttgttcctacagcattacc

SEQ ID NO: 806366 - DNA, 20 bp, Artificial
  CRISPR gRNA sequence
gttcctacagcattacctag

SEQ ID NO: 806367 - DNA, 20 bp, Artificial
  CRISPR gRNA sequence
ttcctacagcattacctagt

SEQ ID NO: 806368 - DNA, 20 bp, Artificial
  CRISPR gRNA sequence
ctacagcattacctagttta

SEQ ID NO: 806369 - DNA, 20 bp, Artificial
  CRISPR gRNA sequence
cagcattacctagtttactc

SEQ ID NO: 806370 - DNA, 20 bp, Artificial
  CRISPR gRNA sequence
cctagtttactctaatacaa

SEQ ID NO: 806371 - DNA, 20 bp, Artificial
  CRISPR gRNA sequence
gtttactctaatacaacatg

SEQ ID NO: 806372 - DNA, 20 bp, Artificial
  CRISPR gRNA sequence
actctaatacaacatggaaa

SEQ ID NO: 806373 - DNA, 20 bp, Artificial
  CRISPR gRNA sequence
ctctaatacaacatggaaaa

SEQ ID NO: 806374 - DNA, 20 bp, Artificial
  CRISPR gRNA sequence
taatacaacatggaaaaaac

SEQ ID NO: 806375 - DNA, 20 bp, Artificial
  CRISPR gRNA sequence
atacaacatggaaaaaactg

SEQ ID NO: 806376 - DNA, 20 bp, Artificial
  CRISPR gRNA sequence
gaacctataataaatagacc

SEQ ID NO: 806377 - DNA, 20 bp, Artificial
  CRISPR gRNA sequence
taataaatagaccctacgtt

SEQ ID NO: 806378 - DNA, 20 bp, Artificial
  CRISPR gRNA sequence
cgttgccatttaaacttcta

SEQ ID NO: 806379 - DNA, 20 bp, Artificial
  CRISPR gRNA sequence
ccatttaaacttctagttct

SEQ ID NO: 806380 - DNA, 20 bp, Artificial
  CRISPR gRNA sequence
aaacttctagttctgaggaa

SEQ ID NO: 806381 - DNA, 20 bp, Artificial
  CRISPR gRNA sequence
aacttctagttctgaggaat

SEQ ID NO: 806382 - DNA, 20 bp, Artificial
  CRISPR gRNA sequence
ctagttctgaggaataataa

SEQ ID NO: 806383 - DNA, 20 bp, Artificial
  CRISPR gRNA sequence
tagttctgaggaataataat

SEQ ID NO: 806384 - DNA, 20 bp, Artificial
  CRISPR gRNA sequence
gttctgaggaataataatgt

SEQ ID NO: 806385 - DNA, 20 bp, Artificial
  CRISPR gRNA sequence
tgaggaataataatgtgggg

SEQ ID NO: 806386 - DNA, 20 bp, Artificial
  CRISPR gRNA sequence
aggaataataatgtggggaa

SEQ ID NO: 806387 - DNA, 20 bp, Artificial
  CRISPR gRNA sequence
tctatataataaaaaaatag

SEQ ID NO: 806388 - DNA, 20 bp, Artificial
  CRISPR gRNA sequence
ctatataataaaaaaataga

SEQ ID NO: 806389 - DNA, 20 bp, Artificial
  CRISPR gRNA sequence
tatataataaaaaaatagaa

SEQ ID NO: 806390 - DNA, 20 bp, Artificial
  CRISPR gRNA sequence
tataataaaaaaatagaaaa

SEQ ID NO: 806391 - DNA, 20 bp, Artificial
  CRISPR gRNA sequence
caaaataaaaatatacttat

SEQ ID NO: 806392 - DNA, 20 bp, Artificial
  CRISPR gRNA sequence
atgtatcattcatgtcctat

SEQ ID NO: 806393 - DNA, 20 bp, Artificial
  CRISPR gRNA sequence
tgtatcattcatgtcctatt

SEQ ID NO: 806394 - DNA, 20 bp, Artificial
  CRISPR gRNA sequence
atgtcctattaaaaatgtta

SEQ ID NO: 806395 - DNA, 20 bp, Artificial
  CRISPR gRNA sequence
ttaaaaatgttatttataga

SEQ ID NO: 806396 - DNA, 20 bp, Artificial
  CRISPR gRNA sequence
aaaatgttatttatagactc

SEQ ID NO: 806397 - DNA, 20 bp, Artificial
  CRISPR gRNA sequence
tttatagactcaccatattc

SEQ ID NO: 806398 - DNA, 20 bp, Artificial
  CRISPR gRNA sequence
atagactcaccatattccct

SEQ ID NO: 806399 - DNA, 20 bp, Artificial
  CRISPR gRNA sequence
tagactcaccatattccctt

SEQ ID NO: 806400 - DNA, 20 bp, Artificial
  CRISPR gRNA sequence
accatattcccttcctccag

SEQ ID NO: 806401 - DNA, 20 bp, Artificial
  CRISPR gRNA sequence
ccttcctccagaaaaacaga

SEQ ID NO: 806402 - DNA, 20 bp, Artificial
  CRISPR gRNA sequence
cctccagaaaaacagaagta

SEQ ID NO: 806403 - DNA, 20 bp, Artificial
  CRISPR gRNA sequence
ctccagaaaaacagaagtaa

SEQ ID NO: 806404 - DNA, 20 bp, Artificial
  CRISPR gRNA sequence
cagaaaaacagaagtaaaaa

SEQ ID NO: 806405 - DNA, 20 bp, Artificial
  CRISPR gRNA sequence
taatcatgtttttggattat

SEQ ID NO: 806406 - DNA, 20 bp, Artificial
  CRISPR gRNA sequence
ttggattatggaatcaagta

SEQ ID NO: 806407 - DNA, 20 bp, Artificial
  CRISPR gRNA sequence
tggattatggaatcaagtat

SEQ ID NO: 806408 - DNA, 20 bp, Artificial
  CRISPR gRNA sequence
ggattatggaatcaagtatt

SEQ ID NO: 806409 - DNA, 20 bp, Artificial
  CRISPR gRNA sequence
gattatggaatcaagtattg

SEQ ID NO: 806410 - DNA, 20 bp, Artificial
  CRISPR gRNA sequence
tggaatcaagtattgctttt

SEQ ID NO: 806411 - DNA, 20 bp, Artificial
  CRISPR gRNA sequence
ctttttacttttatgttttc

SEQ ID NO: 806412 - DNA, 20 bp, Artificial
  CRISPR gRNA sequence
tttacttttatgttttctga

SEQ ID NO: 806413 - DNA, 20 bp, Artificial
  CRISPR gRNA sequence
ttacttttatgttttctgaa

SEQ ID NO: 806414 - DNA, 20 bp, Artificial
  CRISPR gRNA sequence
tacttttatgttttctgaat

SEQ ID NO: 806415 - DNA, 20 bp, Artificial
  CRISPR gRNA sequence
acttttatgttttctgaatt

SEQ ID NO: 806416 - DNA, 20 bp, Artificial
  CRISPR gRNA sequence
cttttatgttttctgaattt

SEQ ID NO: 806417 - DNA, 20 bp, Artificial
  CRISPR gRNA sequence
ttatgttttctgaatttttg

SEQ ID NO: 806418 - DNA, 20 bp, Artificial
  CRISPR gRNA sequence
tatgttttctgaatttttgt

SEQ ID NO: 806419 - DNA, 20 bp, Artificial
  CRISPR gRNA sequence
atgttttctgaatttttgtt

SEQ ID NO: 806420 - DNA, 20 bp, Artificial
  CRISPR gRNA sequence
tgttttctgaatttttgttg

SEQ ID NO: 806421 - DNA, 20 bp, Artificial
  CRISPR gRNA sequence
tctgaatttttgttgtactt

SEQ ID NO: 806422 - DNA, 20 bp, Artificial
  CRISPR gRNA sequence
ctgaatttttgttgtacttc

SEQ ID NO: 806423 - DNA, 20 bp, Artificial
  CRISPR gRNA sequence
tgaatttttgttgtacttca

SEQ ID NO: 806424 - DNA, 20 bp, Artificial
  CRISPR gRNA sequence
aatttttgttgtacttcact

SEQ ID NO: 806425 - DNA, 20 bp, Artificial
  CRISPR gRNA sequence
ttgttgtacttcactacatt

SEQ ID NO: 806426 - DNA, 20 bp, Artificial
  CRISPR gRNA sequence
tgttgtacttcactacattt

SEQ ID NO: 806427 - DNA, 20 bp, Artificial
  CRISPR gRNA sequence
gttgtacttcactacatttt

SEQ ID NO: 806428 - DNA, 20 bp, Artificial
  CRISPR gRNA sequence
ttgtacttcactacattttt

SEQ ID NO: 806429 - DNA, 20 bp, Artificial
  CRISPR gRNA sequence
tacttcactacatttttgag

SEQ ID NO: 806430 - DNA, 20 bp, Artificial
  CRISPR gRNA sequence
cactacatttttgagtgccc

SEQ ID NO: 806431 - DNA, 20 bp, Artificial
  CRISPR gRNA sequence
actacatttttgagtgccct

SEQ ID NO: 806432 - DNA, 20 bp, Artificial
  CRISPR gRNA sequence
catttttgagtgccctgatg

SEQ ID NO: 806433 - DNA, 20 bp, Artificial
  CRISPR gRNA sequence
ttgagtgccctgatgtatta

SEQ ID NO: 806434 - DNA, 20 bp, Artificial
  CRISPR gRNA sequence
tgagtgccctgatgtattac

SEQ ID NO: 806435 - DNA, 20 bp, Artificial
  CRISPR gRNA sequence
gagtgccctgatgtattact

SEQ ID NO: 806436 - DNA, 20 bp, Artificial
  CRISPR gRNA sequence
agtgccctgatgtattactt

SEQ ID NO: 806437 - DNA, 20 bp, Artificial
  CRISPR gRNA sequence
atgtattactttcaaaaaga

SEQ ID NO: 806438 - DNA, 20 bp, Artificial
  CRISPR gRNA sequence
ctttcaaaaagaagaagaat

SEQ ID NO: 806439 - DNA, 20 bp, Artificial
  CRISPR gRNA sequence
tcaaaaagaagaagaatact

SEQ ID NO: 806440 - DNA, 20 bp, Artificial
  CRISPR gRNA sequence
caaaaagaagaagaatactt

SEQ ID NO: 806441 - DNA, 20 bp, Artificial
  CRISPR gRNA sequence
aaaaagaagaagaatacttt

SEQ ID NO: 806442 - DNA, 20 bp, Artificial
  CRISPR gRNA sequence
tctgaagccatttcaaccat

SEQ ID NO: 806443 - DNA, 20 bp, Artificial
  CRISPR gRNA sequence
ctgaagccatttcaaccatc

SEQ ID NO: 806444 - DNA, 20 bp, Artificial
  CRISPR gRNA sequence
tgaagccatttcaaccatcc

SEQ ID NO: 806445 - DNA, 20 bp, Artificial
  CRISPR gRNA sequence
aagccatttcaaccatcccc

SEQ ID NO: 806446 - DNA, 20 bp, Artificial
  CRISPR gRNA sequence
caaccatccccactcacctc

SEQ ID NO: 806447 - DNA, 20 bp, Artificial
  CRISPR gRNA sequence
aaccatccccactcacctct

SEQ ID NO: 806448 - DNA, 20 bp, Artificial
  CRISPR gRNA sequence
acctctctagatcccagtaa

SEQ ID NO: 806449 - DNA, 20 bp, Artificial
  CRISPR gRNA sequence
tctagatcccagtaaccaaa

SEQ ID NO: 806450 - DNA, 20 bp, Artificial
  CRISPR gRNA sequence
tagatcccagtaaccaaata

SEQ ID NO: 806451 - DNA, 20 bp, Artificial
  CRISPR gRNA sequence
gatcccagtaaccaaataca

SEQ ID NO: 806452 - DNA, 20 bp, Artificial
  CRISPR gRNA sequence
tataggactcttcatcagtc

SEQ ID NO: 806453 - DNA, 20 bp, Artificial
  CRISPR gRNA sequence
ttcatcagtccttatcaagt

SEQ ID NO: 806454 - DNA, 20 bp, Artificial
  CRISPR gRNA sequence
catcagtccttatcaagttt

SEQ ID NO: 806455 - DNA, 20 bp, Artificial
  CRISPR gRNA sequence
atcagtccttatcaagttta

SEQ ID NO: 806456 - DNA, 20 bp, Artificial
  CRISPR gRNA sequence
atcaagtttaggaagggcga

SEQ ID NO: 806457 - DNA, 20 bp, Artificial
  CRISPR gRNA sequence
tcaagtttaggaagggcgat

SEQ ID NO: 806458 - DNA, 20 bp, Artificial
  CRISPR gRNA sequence
aggaagggcgatgctatacc

SEQ ID NO: 806459 - DNA, 20 bp, Artificial
  CRISPR gRNA sequence
ggaagggcgatgctatacct

SEQ ID NO: 806460 - DNA, 20 bp, Artificial
  CRISPR gRNA sequence
taccttctttaaaggacacc

SEQ ID NO: 806461 - DNA, 20 bp, Artificial
  CRISPR gRNA sequence
ctttaaaggacacctaccaa

SEQ ID NO: 806462 - DNA, 20 bp, Artificial
  CRISPR gRNA sequence
tttaaaggacacctaccaat

SEQ ID NO: 806463 - DNA, 20 bp, Artificial
  CRISPR gRNA sequence
taaaggacacctaccaatgt

SEQ ID NO: 806464 - DNA, 20 bp, Artificial
  CRISPR gRNA sequence
aaaggacacctaccaatgtc

SEQ ID NO: 806465 - DNA, 20 bp, Artificial
  CRISPR gRNA sequence
aaggacacctaccaatgtct

SEQ ID NO: 806466 - DNA, 20 bp, Artificial
  CRISPR gRNA sequence
ccaatgtcttagttgccttt

SEQ ID NO: 806467 - DNA, 20 bp, Artificial
  CRISPR gRNA sequence
agttgcctttcaaagactcc

SEQ ID NO: 806468 - DNA, 20 bp, Artificial
  CRISPR gRNA sequence
gttgcctttcaaagactcct

SEQ ID NO: 806469 - DNA, 20 bp, Artificial
  CRISPR gRNA sequence
cctttcaaagactcctagca

SEQ ID NO: 806470 - DNA, 20 bp, Artificial
  CRISPR gRNA sequence
tcaaagactcctagcacagc

SEQ ID NO: 806471 - DNA, 20 bp, Artificial
  CRISPR gRNA sequence
caaagactcctagcacagct

SEQ ID NO: 806472 - DNA, 20 bp, Artificial
  CRISPR gRNA sequence
aaagactcctagcacagcta

SEQ ID NO: 806473 - DNA, 20 bp, Artificial
  CRISPR gRNA sequence
ctagcacagctaaatgtgat

SEQ ID NO: 806474 - DNA, 20 bp, Artificial
  CRISPR gRNA sequence
gcacagctaaatgtgatgga

SEQ ID NO: 806475 - DNA, 20 bp, Artificial
  CRISPR gRNA sequence
aatgtgatggatatgctcta

SEQ ID NO: 806476 - DNA, 20 bp, Artificial
  CRISPR gRNA sequence
taaggatataagagctgaag

SEQ ID NO: 806477 - DNA, 20 bp, Artificial
  CRISPR gRNA sequence
aggatataagagctgaagtg

SEQ ID NO: 806478 - DNA, 20 bp, Artificial
  CRISPR gRNA sequence
aagtgacttgcataaggtca

SEQ ID NO: 806479 - DNA, 20 bp, Artificial
  CRISPR gRNA sequence
gcataaggtcatatcataac

SEQ ID NO: 806480 - DNA, 20 bp, Artificial
  CRISPR gRNA sequence
cataaggtcatatcataact

SEQ ID NO: 806481 - DNA, 20 bp, Artificial
  CRISPR gRNA sequence
actgttagaaatggagctag

SEQ ID NO: 806482 - DNA, 20 bp, Artificial
  CRISPR gRNA sequence
ctgttagaaatggagctaga

SEQ ID NO: 806483 - DNA, 20 bp, Artificial
  CRISPR gRNA sequence
ttagaaatggagctagaact

SEQ ID NO: 806484 - DNA, 20 bp, Artificial
  CRISPR gRNA sequence
gaaatggagctagaactcag

SEQ ID NO: 806485 - DNA, 20 bp, Artificial
  CRISPR gRNA sequence
gaactcagacccactgagtc

SEQ ID NO: 806486 - DNA, 20 bp, Artificial
  CRISPR gRNA sequence
agacccactgagtccttgtc

SEQ ID NO: 806487 - DNA, 20 bp, Artificial
  CRISPR gRNA sequence
agtccttgtctgtgacacac

SEQ ID NO: 806488 - DNA, 20 bp, Artificial
  CRISPR gRNA sequence
gtctgtgacacactgccctt

SEQ ID NO: 806489 - DNA, 20 bp, Artificial
  CRISPR gRNA sequence
tctgtgacacactgcccttt

SEQ ID NO: 806490 - DNA, 20 bp, Artificial
  CRISPR gRNA sequence
tgacacactgccctttccat

SEQ ID NO: 806491 - DNA, 20 bp, Artificial
  CRISPR gRNA sequence
ccctttccatttgtggaagt

SEQ ID NO: 806492 - DNA, 20 bp, Artificial
  CRISPR gRNA sequence
tccatttgtggaagttgttc

SEQ ID NO: 806493 - DNA, 20 bp, Artificial
  CRISPR gRNA sequence
ccatttgtggaagttgttct

SEQ ID NO: 806494 - DNA, 20 bp, Artificial
  CRISPR gRNA sequence
catttgtggaagttgttctt

SEQ ID NO: 806495 - DNA, 20 bp, Artificial
  CRISPR gRNA sequence
gtggaagttgttcttgtatc

SEQ ID NO: 806496 - DNA, 20 bp, Artificial
  CRISPR gRNA sequence
tggaagttgttcttgtatct

SEQ ID NO: 806497 - DNA, 20 bp, Artificial
  CRISPR gRNA sequence
ttcttgtatctaactttatc

SEQ ID NO: 806498 - DNA, 20 bp, Artificial
  CRISPR gRNA sequence
ttgtatctaactttatctgt

SEQ ID NO: 806499 - DNA, 20 bp, Artificial
  CRISPR gRNA sequence
gtatctaactttatctgtgc

SEQ ID NO: 806500 - DNA, 20 bp, Artificial
  CRISPR gRNA sequence
tatctaactttatctgtgct

SEQ ID NO: 806501 - DNA, 20 bp, Artificial
  CRISPR gRNA sequence
actttatctgtgctactatt

SEQ ID NO: 806502 - DNA, 20 bp, Artificial
  CRISPR gRNA sequence
tatctgtgctactatttggg

SEQ ID NO: 806503 - DNA, 20 bp, Artificial
  CRISPR gRNA sequence
atctgtgctactatttgggc

SEQ ID NO: 806504 - DNA, 20 bp, Artificial
  CRISPR gRNA sequence
tctgtgctactatttgggcc

SEQ ID NO: 806505 - DNA, 20 bp, Artificial
  CRISPR gRNA sequence
tgctactatttgggcctagc

SEQ ID NO: 806506 - DNA, 20 bp, Artificial
  CRISPR gRNA sequence
ctatttgggcctagccattc

SEQ ID NO: 806507 - DNA, 20 bp, Artificial
  CRISPR gRNA sequence
tttgggcctagccattctcc

SEQ ID NO: 806508 - DNA, 20 bp, Artificial
  CRISPR gRNA sequence
gggcctagccattctccctc

SEQ ID NO: 806509 - DNA, 20 bp, Artificial
  CRISPR gRNA sequence
ggcctagccattctccctct

SEQ ID NO: 806510 - DNA, 20 bp, Artificial
  CRISPR gRNA sequence
gccattctccctcttatgca

SEQ ID NO: 806511 - DNA, 20 bp, Artificial
  CRISPR gRNA sequence
tccctcttatgcagacaagc

SEQ ID NO: 806512 - DNA, 20 bp, Artificial
  CRISPR gRNA sequence
cctcttatgcagacaagcag

SEQ ID NO: 806513 - DNA, 20 bp, Artificial
  CRISPR gRNA sequence
ttatgcagacaagcagataa

SEQ ID NO: 806514 - DNA, 20 bp, Artificial
  CRISPR gRNA sequence
atgcagacaagcagataaac

SEQ ID NO: 806515 - DNA, 20 bp, Artificial
  CRISPR gRNA sequence
tgcagacaagcagataaaca

SEQ ID NO: 806516 - DNA, 20 bp, Artificial
  CRISPR gRNA sequence
taggagtggattatgatacc

SEQ ID NO: 806517 - DNA, 20 bp, Artificial
  CRISPR gRNA sequence
aggagtggattatgatacca

SEQ ID NO: 806518 - DNA, 20 bp, Artificial
  CRISPR gRNA sequence
ggagtggattatgataccat

SEQ ID NO: 806519 - DNA, 20 bp, Artificial
  CRISPR gRNA sequence
tgataccatagatatatatc

SEQ ID NO: 806520 - DNA, 20 bp, Artificial
  CRISPR gRNA sequence
tcctttacaaaatagttatt

SEQ ID NO: 806521 - DNA, 20 bp, Artificial
  CRISPR gRNA sequence
tacaaaatagttattacagt

SEQ ID NO: 806522 - DNA, 20 bp, Artificial
  CRISPR gRNA sequence
acaaaatagttattacagtc

SEQ ID NO: 806523 - DNA, 20 bp, Artificial
  CRISPR gRNA sequence
caaaatagttattacagtca

SEQ ID NO: 806524 - DNA, 20 bp, Artificial
  CRISPR gRNA sequence
ttacagtcatcaagccttgg

SEQ ID NO: 806525 - DNA, 20 bp, Artificial
  CRISPR gRNA sequence
cagtcatcaagccttggtta

SEQ ID NO: 806526 - DNA, 20 bp, Artificial
  CRISPR gRNA sequence
ggttagagtttacagaccat

SEQ ID NO: 806527 - DNA, 20 bp, Artificial
  CRISPR gRNA sequence
gttagagtttacagaccatg

SEQ ID NO: 806528 - DNA, 20 bp, Artificial
  CRISPR gRNA sequence
gagtttacagaccatgtatc

SEQ ID NO: 806529 - DNA, 20 bp, Artificial
  CRISPR gRNA sequence
acagaccatgtatcctagct

SEQ ID NO: 806530 - DNA, 20 bp, Artificial
  CRISPR gRNA sequence
cagaccatgtatcctagcta

SEQ ID NO: 806531 - DNA, 20 bp, Artificial
  CRISPR gRNA sequence
gctacctcatttcacagatt

SEQ ID NO: 806532 - DNA, 20 bp, Artificial
  CRISPR gRNA sequence
cctcatttcacagattatga

SEQ ID NO: 806533 - DNA, 20 bp, Artificial
  CRISPR gRNA sequence
atttcacagattatgacatt

SEQ ID NO: 806534 - DNA, 20 bp, Artificial
  CRISPR gRNA sequence
cacagattatgacattgggg

SEQ ID NO: 806535 - DNA, 20 bp, Artificial
  CRISPR gRNA sequence
acagattatgacattggggg

SEQ ID NO: 806536 - DNA, 20 bp, Artificial
  CRISPR gRNA sequence
tgacattgggggctaagaga

SEQ ID NO: 806537 - DNA, 20 bp, Artificial
  CRISPR gRNA sequence
ggggctaagagatattaagt

SEQ ID NO: 806538 - DNA, 20 bp, Artificial
  CRISPR gRNA sequence
agagatattaagtgacttcc

SEQ ID NO: 806539 - DNA, 20 bp, Artificial
  CRISPR gRNA sequence
agtgacttccttaagtgaaa

SEQ ID NO: 806540 - DNA, 20 bp, Artificial
  CRISPR gRNA sequence
ccttaagtgaaacagtagca

SEQ ID NO: 806541 - DNA, 20 bp, Artificial
  CRISPR gRNA sequence
cttaagtgaaacagtagcag

SEQ ID NO: 806542 - DNA, 20 bp, Artificial
  CRISPR gRNA sequence
aagtgaaacagtagcagacc

SEQ ID NO: 806543 - DNA, 20 bp, Artificial
  CRISPR gRNA sequence
agtgaaacagtagcagacca

SEQ ID NO: 806544 - DNA, 20 bp, Artificial
  CRISPR gRNA sequence
ccagcatagtgctactcact

SEQ ID NO: 806545 - DNA, 20 bp, Artificial
  CRISPR gRNA sequence
ctcactcatttattcattca

SEQ ID NO: 806546 - DNA, 20 bp, Artificial
  CRISPR gRNA sequence
actcatttattcattcattc

SEQ ID NO: 806547 - DNA, 20 bp, Artificial
  CRISPR gRNA sequence
atttattcattcattcaccc

SEQ ID NO: 806548 - DNA, 20 bp, Artificial
  CRISPR gRNA sequence
attcattcattcacccactc

SEQ ID NO: 806549 - DNA, 20 bp, Artificial
  CRISPR gRNA sequence
ttcattcattcacccactca

SEQ ID NO: 806550 - DNA, 20 bp, Artificial
  CRISPR gRNA sequence
attcattcacccactcacaa

SEQ ID NO: 806551 - DNA, 20 bp, Artificial
  CRISPR gRNA sequence
attcacccactcacaaacct

SEQ ID NO: 806552 - DNA, 20 bp, Artificial
  CRISPR gRNA sequence
acccactcacaaacctgtat

SEQ ID NO: 806553 - DNA, 20 bp, Artificial
  CRISPR gRNA sequence
acaaacctgtattaagtttc

SEQ ID NO: 806554 - DNA, 20 bp, Artificial
  CRISPR gRNA sequence
tattaagtttctgttatttg

SEQ ID NO: 806555 - DNA, 20 bp, Artificial
  CRISPR gRNA sequence
agtttctgttatttgcaaga

SEQ ID NO: 806556 - DNA, 20 bp, Artificial
  CRISPR gRNA sequence
ctgttatttgcaagaccctg

SEQ ID NO: 806557 - DNA, 20 bp, Artificial
  CRISPR gRNA sequence
tgttatttgcaagaccctgt

SEQ ID NO: 806558 - DNA, 20 bp, Artificial
  CRISPR gRNA sequence
ttatttgcaagaccctgtca

SEQ ID NO: 806559 - DNA, 20 bp, Artificial
  CRISPR gRNA sequence
tttgcaagaccctgtcagtt

SEQ ID NO: 806560 - DNA, 20 bp, Artificial
  CRISPR gRNA sequence
gcaagaccctgtcagttagg

SEQ ID NO: 806561 - DNA, 20 bp, Artificial
  CRISPR gRNA sequence
caagaccctgtcagttaggc

SEQ ID NO: 806562 - DNA, 20 bp, Artificial
  CRISPR gRNA sequence
tcagttaggccatgtgggaa

SEQ ID NO: 806563 - DNA, 20 bp, Artificial
  CRISPR gRNA sequence
ggccatgtgggaactagaag

SEQ ID NO: 806564 - DNA, 20 bp, Artificial
  CRISPR gRNA sequence
gaaggatgaatttatcagtc

SEQ ID NO: 806565 - DNA, 20 bp, Artificial
  CRISPR gRNA sequence
atcagtcatccaagattctt

SEQ ID NO: 806566 - DNA, 20 bp, Artificial
  CRISPR gRNA sequence
tcagtcatccaagattctta

SEQ ID NO: 806567 - DNA, 20 bp, Artificial
  CRISPR gRNA sequence
ttacaattaagtattaccga

SEQ ID NO: 806568 - DNA, 20 bp, Artificial
  CRISPR gRNA sequence
acaattaagtattaccgata

SEQ ID NO: 806569 - DNA, 20 bp, Artificial
  CRISPR gRNA sequence
caattaagtattaccgataa

SEQ ID NO: 806570 - DNA, 20 bp, Artificial
  CRISPR gRNA sequence
agtattaccgataaggtact

SEQ ID NO: 806571 - DNA, 20 bp, Artificial
  CRISPR gRNA sequence
ccgataaggtactcaagaaa

SEQ ID NO: 806572 - DNA, 20 bp, Artificial
  CRISPR gRNA sequence
aagaaacagttctcattcac

SEQ ID NO: 806573 - DNA, 20 bp, Artificial
  CRISPR gRNA sequence
tcattcacataatttgggtt

SEQ ID NO: 806574 - DNA, 20 bp, Artificial
  CRISPR gRNA sequence
attcacataatttgggttaa

SEQ ID NO: 806575 - DNA, 20 bp, Artificial
  CRISPR gRNA sequence
acataatttgggttaaaaca

SEQ ID NO: 806576 - DNA, 20 bp, Artificial
  CRISPR gRNA sequence
gggttaaaacaaaaagaagc

SEQ ID NO: 806577 - DNA, 20 bp, Artificial
  CRISPR gRNA sequence
ggttaaaacaaaaagaagcc

SEQ ID NO: 806578 - DNA, 20 bp, Artificial
  CRISPR gRNA sequence
aaacaaaaagaagccagctt

SEQ ID NO: 806579 - DNA, 20 bp, Artificial
  CRISPR gRNA sequence
tctatatacttttggtccag

SEQ ID NO: 806580 - DNA, 20 bp, Artificial
  CRISPR gRNA sequence
ctatatacttttggtccagt

SEQ ID NO: 806581 - DNA, 20 bp, Artificial
  CRISPR gRNA sequence
tatatacttttggtccagtc

SEQ ID NO: 806582 - DNA, 20 bp, Artificial
  CRISPR gRNA sequence
tatacttttggtccagtctt

SEQ ID NO: 806583 - DNA, 20 bp, Artificial
  CRISPR gRNA sequence
ttggtccagtctttacgttt

SEQ ID NO: 806584 - DNA, 20 bp, Artificial
  CRISPR gRNA sequence
tggtccagtctttacgtttt

SEQ ID NO: 806585 - DNA, 20 bp, Artificial
  CRISPR gRNA sequence
ggtccagtctttacgttttt

SEQ ID NO: 806586 - DNA, 20 bp, Artificial
  CRISPR gRNA sequence
gtccagtctttacgtttttt

SEQ ID NO: 806587 - DNA, 20 bp, Artificial
  CRISPR gRNA sequence
tacgttttttgttttgtttt

SEQ ID NO: 806588 - DNA, 20 bp, Artificial
  CRISPR gRNA sequence
acgttttttgttttgttttg

SEQ ID NO: 806589 - DNA, 20 bp, Artificial
  CRISPR gRNA sequence
cgttttttgttttgttttgt

SEQ ID NO: 806590 - DNA, 20 bp, Artificial
  CRISPR gRNA sequence
tttgttttgttttgtttgtt

SEQ ID NO: 806591 - DNA, 20 bp, Artificial
  CRISPR gRNA sequence
ttgttttgttttgtttgttt

SEQ ID NO: 806592 - DNA, 20 bp, Artificial
  CRISPR gRNA sequence
tgttttgttttgtttgtttt

SEQ ID NO: 806593 - DNA, 20 bp, Artificial
  CRISPR gRNA sequence
gttttgttttgtttgttttc

SEQ ID NO: 806594 - DNA, 20 bp, Artificial
  CRISPR gRNA sequence
ttttgttttgtttgttttca

SEQ ID NO: 806595 - DNA, 20 bp, Artificial
  CRISPR gRNA sequence
tgttttgtttgttttcatga

SEQ ID NO: 806596 - DNA, 20 bp, Artificial
  CRISPR gRNA sequence
gttttgtttgttttcatgag

SEQ ID NO: 806597 - DNA, 20 bp, Artificial
  CRISPR gRNA sequence
ttttgtttgttttcatgagt

SEQ ID NO: 806598 - DNA, 20 bp, Artificial
  CRISPR gRNA sequence
tgtttgttttcatgagtatc

SEQ ID NO: 806599 - DNA, 20 bp, Artificial
  CRISPR gRNA sequence
gtttgttttcatgagtatcc

SEQ ID NO: 806600 - DNA, 20 bp, Artificial
  CRISPR gRNA sequence
tttgttttcatgagtatccc

SEQ ID NO: 806601 - DNA, 20 bp, Artificial
  CRISPR gRNA sequence
gttttcatgagtatcccgac

SEQ ID NO: 806602 - DNA, 20 bp, Artificial
  CRISPR gRNA sequence
ttttcatgagtatcccgact

SEQ ID NO: 806603 - DNA, 20 bp, Artificial
  CRISPR gRNA sequence
tcatgagtatcccgacttcc

SEQ ID NO: 806604 - DNA, 20 bp, Artificial
  CRISPR gRNA sequence
catgagtatcccgacttcct

SEQ ID NO: 806605 - DNA, 20 bp, Artificial
  CRISPR gRNA sequence
atgagtatcccgacttcctt

SEQ ID NO: 806606 - DNA, 20 bp, Artificial
  CRISPR gRNA sequence
ccttctaagaacttccacct

SEQ ID NO: 806607 - DNA, 20 bp, Artificial
  CRISPR gRNA sequence
cttctaagaacttccacctg

SEQ ID NO: 806608 - DNA, 20 bp, Artificial
  CRISPR gRNA sequence
ctaagaacttccacctgaga

SEQ ID NO: 806609 - DNA, 20 bp, Artificial
  CRISPR gRNA sequence
taagaacttccacctgagaa

SEQ ID NO: 806610 - DNA, 20 bp, Artificial
  CRISPR gRNA sequence
agaacttccacctgagaact

SEQ ID NO: 806611 - DNA, 20 bp, Artificial
  CRISPR gRNA sequence
ccacctgagaactgaccaca

SEQ ID NO: 806612 - DNA, 20 bp, Artificial
  CRISPR gRNA sequence
cacctgagaactgaccacag

SEQ ID NO: 806613 - DNA, 20 bp, Artificial
  CRISPR gRNA sequence
agaactgaccacagcgtcag

SEQ ID NO: 806614 - DNA, 20 bp, Artificial
  CRISPR gRNA sequence
accacagcgtcagcattcca

SEQ ID NO: 806615 - DNA, 20 bp, Artificial
  CRISPR gRNA sequence
cacatgggtgtgtttccttt

SEQ ID NO: 806616 - DNA, 20 bp, Artificial
  CRISPR gRNA sequence
cctttcccctttcccatttc

SEQ ID NO: 806617 - DNA, 20 bp, Artificial
  CRISPR gRNA sequence
ctttcccctttcccatttca

SEQ ID NO: 806618 - DNA, 20 bp, Artificial
  CRISPR gRNA sequence
tcccctttcccatttcagtg

SEQ ID NO: 806619 - DNA, 20 bp, Artificial
  CRISPR gRNA sequence
cccctttcccatttcagtgg

SEQ ID NO: 806620 - DNA, 20 bp, Artificial
  CRISPR gRNA sequence
ccctttcccatttcagtggt

SEQ ID NO: 806621 - DNA, 20 bp, Artificial
  CRISPR gRNA sequence
tcccatttcagtggtttcca

SEQ ID NO: 806622 - DNA, 20 bp, Artificial
  CRISPR gRNA sequence
cccatttcagtggtttccaa

SEQ ID NO: 806623 - DNA, 20 bp, Artificial
  CRISPR gRNA sequence
ccatttcagtggtttccaat

SEQ ID NO: 806624 - DNA, 20 bp, Artificial
  CRISPR gRNA sequence
cagtggtttccaatttcttt

SEQ ID NO: 806625 - DNA, 20 bp, Artificial
  CRISPR gRNA sequence
agtggtttccaatttctttt

SEQ ID NO: 806626 - DNA, 20 bp, Artificial
  CRISPR gRNA sequence
ccaatttctttttcttttgg

SEQ ID NO: 806627 - DNA, 20 bp, Artificial
  CRISPR gRNA sequence
caatttctttttcttttggc

SEQ ID NO: 806628 - DNA, 20 bp, Artificial
  CRISPR gRNA sequence
ctttttcttttggcactata

SEQ ID NO: 806629 - DNA, 20 bp, Artificial
  CRISPR gRNA sequence
tttttcttttggcactataa

SEQ ID NO: 806630 - DNA, 20 bp, Artificial
  CRISPR gRNA sequence
tttcttttggcactataaac

SEQ ID NO: 806631 - DNA, 20 bp, Artificial
  CRISPR gRNA sequence
ttcttttggcactataaacc

SEQ ID NO: 806632 - DNA, 20 bp, Artificial
  CRISPR gRNA sequence
tcttttggcactataaacct

SEQ ID NO: 806633 - DNA, 20 bp, Artificial
  CRISPR gRNA sequence
cttttggcactataaacctt

SEQ ID NO: 806634 - DNA, 20 bp, Artificial
  CRISPR gRNA sequence
ttttggcactataaaccttt

SEQ ID NO: 806635 - DNA, 20 bp, Artificial
  CRISPR gRNA sequence
ttggcactataaacctttcg

SEQ ID NO: 806636 - DNA, 20 bp, Artificial
  CRISPR gRNA sequence
tggcactataaacctttcgc

SEQ ID NO: 806637 - DNA, 20 bp, Artificial
  CRISPR gRNA sequence
ggcactataaacctttcgca

SEQ ID NO: 806638 - DNA, 20 bp, Artificial
  CRISPR gRNA sequence
gcactataaacctttcgcaa

SEQ ID NO: 806639 - DNA, 20 bp, Artificial
  CRISPR gRNA sequence
taaacctttcgcaaaggaaa

SEQ ID NO: 806640 - DNA, 20 bp, Artificial
  CRISPR gRNA sequence
tcgcaaaggaaatattagac

SEQ ID NO: 806641 - DNA, 20 bp, Artificial
  CRISPR gRNA sequence
cgcaaaggaaatattagaca

SEQ ID NO: 806642 - DNA, 20 bp, Artificial
  CRISPR gRNA sequence
gcaaaggaaatattagacag

SEQ ID NO: 806643 - DNA, 20 bp, Artificial
  CRISPR gRNA sequence
gacagaactcctacatgtca

SEQ ID NO: 806644 - DNA, 20 bp, Artificial
  CRISPR gRNA sequence
ctacatgtcaagcaaattaa

SEQ ID NO: 806645 - DNA, 20 bp, Artificial
  CRISPR gRNA sequence
catgtcaagcaaattaaaat

SEQ ID NO: 806646 - DNA, 20 bp, Artificial
  CRISPR gRNA sequence
aaatagtggtgaaattagag

SEQ ID NO: 806647 - DNA, 20 bp, Artificial
  CRISPR gRNA sequence
gagtggaggacataatcacc

SEQ ID NO: 806648 - DNA, 20 bp, Artificial
  CRISPR gRNA sequence
tcatataggctatttgtcca

SEQ ID NO: 806649 - DNA, 20 bp, Artificial
  CRISPR gRNA sequence
tttgtccatatcatatttgt

SEQ ID NO: 806650 - DNA, 20 bp, Artificial
  CRISPR gRNA sequence
gtccatatcatatttgtccc

SEQ ID NO: 806651 - DNA, 20 bp, Artificial
  CRISPR gRNA sequence
tccatatcatatttgtccct

SEQ ID NO: 806652 - DNA, 20 bp, Artificial
  CRISPR gRNA sequence
gtccctacaaaggcctctaa

SEQ ID NO: 806653 - DNA, 20 bp, Artificial
  CRISPR gRNA sequence
tccctacaaaggcctctaag

SEQ ID NO: 806654 - DNA, 20 bp, Artificial
  CRISPR gRNA sequence
caaaggcctctaaggcaggg

SEQ ID NO: 806655 - DNA, 20 bp, Artificial
  CRISPR gRNA sequence
taaggcaggggtccccaacc

SEQ ID NO: 806656 - DNA, 20 bp, Artificial
  CRISPR gRNA sequence
aggcaggggtccccaacctc

SEQ ID NO: 806657 - DNA, 20 bp, Artificial
  CRISPR gRNA sequence
tgggccgcagaccggtacca

SEQ ID NO: 806658 - DNA, 20 bp, Artificial
  CRISPR gRNA sequence
ggccgcagaccggtaccagt

SEQ ID NO: 806659 - DNA, 20 bp, Artificial
  CRISPR gRNA sequence
ttaggaactgagccacacag

SEQ ID NO: 806660 - DNA, 20 bp, Artificial
  CRISPR gRNA sequence
ggaactgagccacacagcag

SEQ ID NO: 806661 - DNA, 20 bp, Artificial
  CRISPR gRNA sequence
agccacacagcaggaggtga

SEQ ID NO: 806662 - DNA, 20 bp, Artificial
  CRISPR gRNA sequence
ctacctgagctctacctcct

SEQ ID NO: 806663 - DNA, 20 bp, Artificial
  CRISPR gRNA sequence
cctgagctctacctcctgtg

SEQ ID NO: 806664 - DNA, 20 bp, Artificial
  CRISPR gRNA sequence
agctctacctcctgtgagat

SEQ ID NO: 806665 - DNA, 20 bp, Artificial
  CRISPR gRNA sequence
tacctcctgtgagatcagca

SEQ ID NO: 806666 - DNA, 20 bp, Artificial
  CRISPR gRNA sequence
cctcctgtgagatcagcagc

SEQ ID NO: 806667 - DNA, 20 bp, Artificial
  CRISPR gRNA sequence
ctgtgagatcagcagcagca

SEQ ID NO: 806668 - DNA, 20 bp, Artificial
  CRISPR gRNA sequence
tgagatcagcagcagcatta

SEQ ID NO: 806669 - DNA, 20 bp, Artificial
  CRISPR gRNA sequence
gattctcatagaagcgtgaa

SEQ ID NO: 806670 - DNA, 20 bp, Artificial
  CRISPR gRNA sequence
tcatagaagcgtgaatccta

SEQ ID NO: 806671 - DNA, 20 bp, Artificial
  CRISPR gRNA sequence
atagaagcgtgaatcctatt

SEQ ID NO: 806672 - DNA, 20 bp, Artificial
  CRISPR gRNA sequence
ttgtgaactgcacatatgag

SEQ ID NO: 806673 - DNA, 20 bp, Artificial
  CRISPR gRNA sequence
tgaactgcacatatgaggga

SEQ ID NO: 806674 - DNA, 20 bp, Artificial
  CRISPR gRNA sequence
cacatatgagggatctaggt

SEQ ID NO: 806675 - DNA, 20 bp, Artificial
  CRISPR gRNA sequence
ggttgtgtgctccttatgaa

SEQ ID NO: 806676 - DNA, 20 bp, Artificial
  CRISPR gRNA sequence
tgtgctccttatgaaaatct

SEQ ID NO: 806677 - DNA, 20 bp, Artificial
  CRISPR gRNA sequence
cttatgaaaatctaatgtct

SEQ ID NO: 806678 - DNA, 20 bp, Artificial
  CRISPR gRNA sequence
atgaaaatctaatgtctgac

SEQ ID NO: 806679 - DNA, 20 bp, Artificial
  CRISPR gRNA sequence
tgaaaatctaatgtctgacg

SEQ ID NO: 806680 - DNA, 20 bp, Artificial
  CRISPR gRNA sequence
atgtctgacgatctgaggtg

SEQ ID NO: 806681 - DNA, 20 bp, Artificial
  CRISPR gRNA sequence
acgatctgaggtggaacagg

SEQ ID NO: 806682 - DNA, 20 bp, Artificial
  CRISPR gRNA sequence
aggtggaacaggttcatcct

SEQ ID NO: 806683 - DNA, 20 bp, Artificial
  CRISPR gRNA sequence
atcctgaaactatagcctac

SEQ ID NO: 806684 - DNA, 20 bp, Artificial
  CRISPR gRNA sequence
aaactatagcctacccccac

SEQ ID NO: 806685 - DNA, 20 bp, Artificial
  CRISPR gRNA sequence
tagcctacccccactcccac

SEQ ID NO: 806686 - DNA, 20 bp, Artificial
  CRISPR gRNA sequence
cccccactcccacacccaat

SEQ ID NO: 806687 - DNA, 20 bp, Artificial
  CRISPR gRNA sequence
ccacacccaatccatggaaa

SEQ ID NO: 806688 - DNA, 20 bp, Artificial
  CRISPR gRNA sequence
tcttccctgaaaccagtccc

SEQ ID NO: 806689 - DNA, 20 bp, Artificial
  CRISPR gRNA sequence
ccctgaaaccagtccctggt

SEQ ID NO: 806690 - DNA, 20 bp, Artificial
  CRISPR gRNA sequence
cctgaaaccagtccctggtg

SEQ ID NO: 806691 - DNA, 20 bp, Artificial
  CRISPR gRNA sequence
aaaccagtccctggtgccaa

SEQ ID NO: 806692 - DNA, 20 bp, Artificial
  CRISPR gRNA sequence
gtgccaaaaatgttggggac

SEQ ID NO: 806693 - DNA, 20 bp, Artificial
  CRISPR gRNA sequence
gggaccactgctctaagata

SEQ ID NO: 806694 - DNA, 20 bp, Artificial
  CRISPR gRNA sequence
ctctaagataccttgtgctt

SEQ ID NO: 806695 - DNA, 20 bp, Artificial
  CRISPR gRNA sequence
taagataccttgtgcttctt

SEQ ID NO: 806696 - DNA, 20 bp, Artificial
  CRISPR gRNA sequence
agataccttgtgcttcttgg

SEQ ID NO: 806697 - DNA, 20 bp, Artificial
  CRISPR gRNA sequence
gtgcttcttggaacatattt

SEQ ID NO: 806698 - DNA, 20 bp, Artificial
  CRISPR gRNA sequence
tgcttcttggaacatatttg

SEQ ID NO: 806699 - DNA, 20 bp, Artificial
  CRISPR gRNA sequence
cttggaacatatttggaaaa

SEQ ID NO: 806700 - DNA, 20 bp, Artificial
  CRISPR gRNA sequence
ttggaacatatttggaaaat

SEQ ID NO: 806701 - DNA, 20 bp, Artificial
  CRISPR gRNA sequence
ggaacatatttggaaaatca

SEQ ID NO: 806702 - DNA, 20 bp, Artificial
  CRISPR gRNA sequence
gaacatatttggaaaatcat

SEQ ID NO: 806703 - DNA, 20 bp, Artificial
  CRISPR gRNA sequence
ggaaaatcatgtagctctca

SEQ ID NO: 806704 - DNA, 20 bp, Artificial
  CRISPR gRNA sequence
gaaaatcatgtagctctcaa

SEQ ID NO: 806705 - DNA, 20 bp, Artificial
  CRISPR gRNA sequence
tcaaattatccctatgtcct

SEQ ID NO: 806706 - DNA, 20 bp, Artificial
  CRISPR gRNA sequence
aaattatccctatgtcctga

SEQ ID NO: 806707 - DNA, 20 bp, Artificial
  CRISPR gRNA sequence
tccctatgtcctgaagccca

SEQ ID NO: 806708 - DNA, 20 bp, Artificial
  CRISPR gRNA sequence
tgtcctgaagcccaccttac

SEQ ID NO: 806709 - DNA, 20 bp, Artificial
  CRISPR gRNA sequence
aagcccaccttaccatcaat

SEQ ID NO: 806710 - DNA, 20 bp, Artificial
  CRISPR gRNA sequence
accatcaatcctcagaaata

SEQ ID NO: 806711 - DNA, 20 bp, Artificial
  CRISPR gRNA sequence
ccatcaatcctcagaaatac

SEQ ID NO: 806712 - DNA, 20 bp, Artificial
  CRISPR gRNA sequence
agaaatacccaacccatgtc

SEQ ID NO: 806713 - DNA, 20 bp, Artificial
  CRISPR gRNA sequence
cacactttctttcttcaggc

SEQ ID NO: 806714 - DNA, 20 bp, Artificial
  CRISPR gRNA sequence
acactttctttcttcaggca

SEQ ID NO: 806715 - DNA, 20 bp, Artificial
  CRISPR gRNA sequence
tctttcttcaggcagcacag

SEQ ID NO: 806716 - DNA, 20 bp, Artificial
  CRISPR gRNA sequence
ctttcttcaggcagcacagt

SEQ ID NO: 806717 - DNA, 20 bp, Artificial
  CRISPR gRNA sequence
tttcttcaggcagcacagtt

SEQ ID NO: 806718 - DNA, 20 bp, Artificial
  CRISPR gRNA sequence
tcttcaggcagcacagttgt

SEQ ID NO: 806719 - DNA, 20 bp, Artificial
  CRISPR gRNA sequence
cttcaggcagcacagttgtc

SEQ ID NO: 806720 - DNA, 20 bp, Artificial
  CRISPR gRNA sequence
ttcaggcagcacagttgtct

SEQ ID NO: 806721 - DNA, 20 bp, Artificial
  CRISPR gRNA sequence
caggcagcacagttgtctca

SEQ ID NO: 806722 - DNA, 20 bp, Artificial
  CRISPR gRNA sequence
aggcagcacagttgtctcag

SEQ ID NO: 806723 - DNA, 20 bp, Artificial
  CRISPR gRNA sequence
tctcagggagggaggagagt

SEQ ID NO: 806724 - DNA, 20 bp, Artificial
  CRISPR gRNA sequence
agggagggaggagagtgcta

SEQ ID NO: 806725 - DNA, 20 bp, Artificial
  CRISPR gRNA sequence
ttagcaagaggagtcactaa

SEQ ID NO: 806726 - DNA, 20 bp, Artificial
  CRISPR gRNA sequence
gcaagaggagtcactaacag

SEQ ID NO: 806727 - DNA, 20 bp, Artificial
  CRISPR gRNA sequence
acagcttcactcacctgtgc

SEQ ID NO: 806728 - DNA, 20 bp, Artificial
  CRISPR gRNA sequence
cactcacctgtgcccatgaa

SEQ ID NO: 806729 - DNA, 20 bp, Artificial
  CRISPR gRNA sequence
actcacctgtgcccatgaat

SEQ ID NO: 806730 - DNA, 20 bp, Artificial
  CRISPR gRNA sequence
acctgtgcccatgaattttt

SEQ ID NO: 806731 - DNA, 20 bp, Artificial
  CRISPR gRNA sequence
tgcccatgaatttttaatgg

SEQ ID NO: 806732 - DNA, 20 bp, Artificial
  CRISPR gRNA sequence
ttaatggtgtgaaaagtctg

SEQ ID NO: 806733 - DNA, 20 bp, Artificial
  CRISPR gRNA sequence
taatggtgtgaaaagtctgt

SEQ ID NO: 806734 - DNA, 20 bp, Artificial
  CRISPR gRNA sequence
aatggtgtgaaaagtctgtg

SEQ ID NO: 806735 - DNA, 20 bp, Artificial
  CRISPR gRNA sequence
atggtgtgaaaagtctgtgt

SEQ ID NO: 806736 - DNA, 20 bp, Artificial
  CRISPR gRNA sequence
tgtattttttatggttctct

SEQ ID NO: 806737 - DNA, 20 bp, Artificial
  CRISPR gRNA sequence
tttatggttctctatggctc

SEQ ID NO: 806738 - DNA, 20 bp, Artificial
  CRISPR gRNA sequence
ttatggttctctatggctca

SEQ ID NO: 806739 - DNA, 20 bp, Artificial
  CRISPR gRNA sequence
tatggttctctatggctcat

SEQ ID NO: 806740 - DNA, 20 bp, Artificial
  CRISPR gRNA sequence
atggttctctatggctcata

SEQ ID NO: 806741 - DNA, 20 bp, Artificial
  CRISPR gRNA sequence
tggttctctatggctcatat

SEQ ID NO: 806742 - DNA, 20 bp, Artificial
  CRISPR gRNA sequence
tctatggctcatataagagg

SEQ ID NO: 806743 - DNA, 20 bp, Artificial
  CRISPR gRNA sequence
tatggctcatataagaggga

SEQ ID NO: 806744 - DNA, 20 bp, Artificial
  CRISPR gRNA sequence
tggctcatataagagggaca

SEQ ID NO: 806745 - DNA, 20 bp, Artificial
  CRISPR gRNA sequence
atataagagggacaaacaat

SEQ ID NO: 806746 - DNA, 20 bp, Artificial
  CRISPR gRNA sequence
agagatggggacaaatatca

SEQ ID NO: 806747 - DNA, 20 bp, Artificial
  CRISPR gRNA sequence
taagctggggataatcaggg

SEQ ID NO: 806748 - DNA, 20 bp, Artificial
  CRISPR gRNA sequence
aagctggggataatcaggga

SEQ ID NO: 806749 - DNA, 20 bp, Artificial
  CRISPR gRNA sequence
agctggggataatcagggaa

SEQ ID NO: 806750 - DNA, 20 bp, Artificial
  CRISPR gRNA sequence
gggataatcagggaagaaga

SEQ ID NO: 806751 - DNA, 20 bp, Artificial
  CRISPR gRNA sequence
tcatggagaaggtgactttt

SEQ ID NO: 806752 - DNA, 20 bp, Artificial
  CRISPR gRNA sequence
catggagaaggtgacttttg

SEQ ID NO: 806753 - DNA, 20 bp, Artificial
  CRISPR gRNA sequence
atggagaaggtgacttttga

SEQ ID NO: 806754 - DNA, 20 bp, Artificial
  CRISPR gRNA sequence
ttgaatcaggaagaaatgga

SEQ ID NO: 806755 - DNA, 20 bp, Artificial
  CRISPR gRNA sequence
tgaatcaggaagaaatggaa

SEQ ID NO: 806756 - DNA, 20 bp, Artificial
  CRISPR gRNA sequence
gaatcaggaagaaatggaaa

SEQ ID NO: 806757 - DNA, 20 bp, Artificial
  CRISPR gRNA sequence
aatcaggaagaaatggaaac

SEQ ID NO: 806758 - DNA, 20 bp, Artificial
  CRISPR gRNA sequence
ttctagatagaggagacact

SEQ ID NO: 806759 - DNA, 20 bp, Artificial
  CRISPR gRNA sequence
ctagatagaggagacactaa

SEQ ID NO: 806760 - DNA, 20 bp, Artificial
  CRISPR gRNA sequence
tagatagaggagacactaac

SEQ ID NO: 806761 - DNA, 20 bp, Artificial
  CRISPR gRNA sequence
gatagaggagacactaacag

SEQ ID NO: 806762 - DNA, 20 bp, Artificial
  CRISPR gRNA sequence
acaggaaaggcagagaggca

SEQ ID NO: 806763 - DNA, 20 bp, Artificial
  CRISPR gRNA sequence
agagagaaagccaggtgtga

SEQ ID NO: 806764 - DNA, 20 bp, Artificial
  CRISPR gRNA sequence
ttagggcatgtattgtaaac

SEQ ID NO: 806765 - DNA, 20 bp, Artificial
  CRISPR gRNA sequence
gggcatgtattgtaaaccac

SEQ ID NO: 806766 - DNA, 20 bp, Artificial
  CRISPR gRNA sequence
taaaccactaattccaggca

SEQ ID NO: 806767 - DNA, 20 bp, Artificial
  CRISPR gRNA sequence
attccaggcaaaagttagat

SEQ ID NO: 806768 - DNA, 20 bp, Artificial
  CRISPR gRNA sequence
caggcaaaagttagatttta

SEQ ID NO: 806769 - DNA, 20 bp, Artificial
  CRISPR gRNA sequence
gattttacttactaagcaag

SEQ ID NO: 806770 - DNA, 20 bp, Artificial
  CRISPR gRNA sequence
tacttactaagcaagagtgc

SEQ ID NO: 806771 - DNA, 20 bp, Artificial
  CRISPR gRNA sequence
acttactaagcaagagtgct

SEQ ID NO: 806772 - DNA, 20 bp, Artificial
  CRISPR gRNA sequence
cttactaagcaagagtgctt

SEQ ID NO: 806773 - DNA, 20 bp, Artificial
  CRISPR gRNA sequence
actaagcaagagtgcttcag

SEQ ID NO: 806774 - DNA, 20 bp, Artificial
  CRISPR gRNA sequence
ctaagcaagagtgcttcagt

SEQ ID NO: 806775 - DNA, 20 bp, Artificial
  CRISPR gRNA sequence
agcaagagtgcttcagttag

SEQ ID NO: 806776 - DNA, 20 bp, Artificial
  CRISPR gRNA sequence
cagttagatcctagcaggaa

SEQ ID NO: 806777 - DNA, 20 bp, Artificial
  CRISPR gRNA sequence
agttagatcctagcaggaaa

SEQ ID NO: 806778 - DNA, 20 bp, Artificial
  CRISPR gRNA sequence
gatcctagcaggaaatggag

SEQ ID NO: 806779 - DNA, 20 bp, Artificial
  CRISPR gRNA sequence
gcaggaaatggagggtatgc

SEQ ID NO: 806780 - DNA, 20 bp, Artificial
  CRISPR gRNA sequence
agaagaggtaactgaggcaa

SEQ ID NO: 806781 - DNA, 20 bp, Artificial
  CRISPR gRNA sequence
gaagaggtaactgaggcaag

SEQ ID NO: 806782 - DNA, 20 bp, Artificial
  CRISPR gRNA sequence
aggcaagtttaatttataaa

SEQ ID NO: 806783 - DNA, 20 bp, Artificial
  CRISPR gRNA sequence
aatttataaaggtgtgtgca

SEQ ID NO: 806784 - DNA, 20 bp, Artificial
  CRISPR gRNA sequence
atttataaaggtgtgtgcag

SEQ ID NO: 806785 - DNA, 20 bp, Artificial
  CRISPR gRNA sequence
ataaaggtgtgtgcagcatt

SEQ ID NO: 806786 - DNA, 20 bp, Artificial
  CRISPR gRNA sequence
taaaggtgtgtgcagcatta

SEQ ID NO: 806787 - DNA, 20 bp, Artificial
  CRISPR gRNA sequence
agggaaaccagcaagggata

SEQ ID NO: 806788 - DNA, 20 bp, Artificial
  CRISPR gRNA sequence
agcatgccaggatgcaagag

SEQ ID NO: 806789 - DNA, 20 bp, Artificial
  CRISPR gRNA sequence
ttcctaggtctgaaggagaa

SEQ ID NO: 806790 - DNA, 20 bp, Artificial
  CRISPR gRNA sequence
ctaggtctgaaggagaaagg

SEQ ID NO: 806791 - DNA, 20 bp, Artificial
  CRISPR gRNA sequence
ggtctgaaggagaaagggga

SEQ ID NO: 806792 - DNA, 20 bp, Artificial
  CRISPR gRNA sequence
aaggagaaaggggagggagc

SEQ ID NO: 806793 - DNA, 20 bp, Artificial
  CRISPR gRNA sequence
ccagaaccctagtaaaaatg

SEQ ID NO: 806794 - DNA, 20 bp, Artificial
  CRISPR gRNA sequence
gtaaaaatggcaatgagaaa

SEQ ID NO: 806795 - DNA, 20 bp, Artificial
  CRISPR gRNA sequence
gcaggacctatggtctttaa

SEQ ID NO: 806796 - DNA, 20 bp, Artificial
  CRISPR gRNA sequence
tggtctttaacagagggaca

SEQ ID NO: 806797 - DNA, 20 bp, Artificial
  CRISPR gRNA sequence
taacagagggacaaagtcaa

SEQ ID NO: 806798 - DNA, 20 bp, Artificial
  CRISPR gRNA sequence
aacagagggacaaagtcaac

SEQ ID NO: 806799 - DNA, 20 bp, Artificial
  CRISPR gRNA sequence
acagagggacaaagtcaacc

SEQ ID NO: 806800 - DNA, 20 bp, Artificial
  CRISPR gRNA sequence
gtctgggaggttgctgagga

SEQ ID NO: 806801 - DNA, 20 bp, Artificial
  CRISPR gRNA sequence
tctgggaggttgctgaggaa

SEQ ID NO: 806802 - DNA, 20 bp, Artificial
  CRISPR gRNA sequence
ggaggttgctgaggaataga

SEQ ID NO: 806803 - DNA, 20 bp, Artificial
  CRISPR gRNA sequence
ctgaggaatagataccccaa

SEQ ID NO: 806804 - DNA, 20 bp, Artificial
  CRISPR gRNA sequence
aggaatagataccccaacct

SEQ ID NO: 806805 - DNA, 20 bp, Artificial
  CRISPR gRNA sequence
tctctcaacccactgcaaca

SEQ ID NO: 806806 - DNA, 20 bp, Artificial
  CRISPR gRNA sequence
tctcaacccactgcaacact

SEQ ID NO: 806807 - DNA, 20 bp, Artificial
  CRISPR gRNA sequence
tcaacccactgcaacactct

SEQ ID NO: 806808 - DNA, 20 bp, Artificial
  CRISPR gRNA sequence
aacccactgcaacactcttt

SEQ ID NO: 806809 - DNA, 20 bp, Artificial
  CRISPR gRNA sequence
caacactctttttcccctag

SEQ ID NO: 806810 - DNA, 20 bp, Artificial
  CRISPR gRNA sequence
tttttcccctagactgagcc

SEQ ID NO: 806811 - DNA, 20 bp, Artificial
  CRISPR gRNA sequence
tttcccctagactgagccca

SEQ ID NO: 806812 - DNA, 20 bp, Artificial
  CRISPR gRNA sequence
ttcccctagactgagcccag

SEQ ID NO: 806813 - DNA, 20 bp, Artificial
  CRISPR gRNA sequence
tcccctagactgagcccagt

SEQ ID NO: 806814 - DNA, 20 bp, Artificial
  CRISPR gRNA sequence
cccctagactgagcccagtc

SEQ ID NO: 806815 - DNA, 20 bp, Artificial
  CRISPR gRNA sequence
ccctagactgagcccagtca

SEQ ID NO: 806816 - DNA, 20 bp, Artificial
  CRISPR gRNA sequence
gactgagcccagtcaaagac

SEQ ID NO: 806817 - DNA, 20 bp, Artificial
  CRISPR gRNA sequence
agcccagtcaaagacagagg

SEQ ID NO: 806818 - DNA, 20 bp, Artificial
  CRISPR gRNA sequence
caatgtcatcatcctggagc

SEQ ID NO: 806819 - DNA, 20 bp, Artificial
  CRISPR gRNA sequence
gagcatgaatagagtgcagc

SEQ ID NO: 806820 - DNA, 20 bp, Artificial
  CRISPR gRNA sequence
caggaattaatagaaatatc

SEQ ID NO: 806821 - DNA, 20 bp, Artificial
  CRISPR gRNA sequence
atagaaatatctgacacaat

SEQ ID NO: 806822 - DNA, 20 bp, Artificial
  CRISPR gRNA sequence
acacaatagggaactataag

SEQ ID NO: 806823 - DNA, 20 bp, Artificial
  CRISPR gRNA sequence
taagaggttttgaataggag

SEQ ID NO: 806824 - DNA, 20 bp, Artificial
  CRISPR gRNA sequence
tgaataggagaggcccctga

SEQ ID NO: 806825 - DNA, 20 bp, Artificial
  CRISPR gRNA sequence
gaataggagaggcccctgaa

SEQ ID NO: 806826 - DNA, 20 bp, Artificial
  CRISPR gRNA sequence
aataggagaggcccctgaaa

SEQ ID NO: 806827 - DNA, 20 bp, Artificial
  CRISPR gRNA sequence
aaatgtgctccaatattact

SEQ ID NO: 806828 - DNA, 20 bp, Artificial
  CRISPR gRNA sequence
caatattactgaactatgtg

SEQ ID NO: 806829 - DNA, 20 bp, Artificial
  CRISPR gRNA sequence
ctgaactatgtgtggcccaa

SEQ ID NO: 806830 - DNA, 20 bp, Artificial
  CRISPR gRNA sequence
aactatgtgtggcccaaaga

SEQ ID NO: 806831 - DNA, 20 bp, Artificial
  CRISPR gRNA sequence
tgtgtggcccaaagaatgga

SEQ ID NO: 806832 - DNA, 20 bp, Artificial
  CRISPR gRNA sequence
ttgcaataggtctgaggaga

SEQ ID NO: 806833 - DNA, 20 bp, Artificial
  CRISPR gRNA sequence
gcaataggtctgaggagaga

SEQ ID NO: 806834 - DNA, 20 bp, Artificial
  CRISPR gRNA sequence
caataggtctgaggagagaa

SEQ ID NO: 806835 - DNA, 20 bp, Artificial
  CRISPR gRNA sequence
aggagagaagctgaagactt

SEQ ID NO: 806836 - DNA, 20 bp, Artificial
  CRISPR gRNA sequence
aagacttggactagggcaat

SEQ ID NO: 806837 - DNA, 20 bp, Artificial
  CRISPR gRNA sequence
ggactagggcaatggtaaaa

SEQ ID NO: 806838 - DNA, 20 bp, Artificial
  CRISPR gRNA sequence
gactagggcaatggtaaaaa

SEQ ID NO: 806839 - DNA, 20 bp, Artificial
  CRISPR gRNA sequence
gggcaatggtaaaaactgtg

SEQ ID NO: 806840 - DNA, 20 bp, Artificial
  CRISPR gRNA sequence
tggaaagaagttttaaatga

SEQ ID NO: 806841 - DNA, 20 bp, Artificial
  CRISPR gRNA sequence
taaatgaaaagttttaaacc

SEQ ID NO: 806842 - DNA, 20 bp, Artificial
  CRISPR gRNA sequence
aaatgaaaagttttaaacca

SEQ ID NO: 806843 - DNA, 20 bp, Artificial
  CRISPR gRNA sequence
aatgaaaagttttaaaccat

SEQ ID NO: 806844 - DNA, 20 bp, Artificial
  CRISPR gRNA sequence
taaaccatgcggcttccagc

SEQ ID NO: 806845 - DNA, 20 bp, Artificial
  CRISPR gRNA sequence
aaaccatgcggcttccagct

SEQ ID NO: 806846 - DNA, 20 bp, Artificial
  CRISPR gRNA sequence
aaccatgcggcttccagcta

SEQ ID NO: 806847 - DNA, 20 bp, Artificial
  CRISPR gRNA sequence
ccagctagatgaactttttt

SEQ ID NO: 806848 - DNA, 20 bp, Artificial
  CRISPR gRNA sequence
cagctagatgaactttttta

SEQ ID NO: 806849 - DNA, 20 bp, Artificial
  CRISPR gRNA sequence
gatgaacttttttaaaaaaa

SEQ ID NO: 806850 - DNA, 20 bp, Artificial
  CRISPR gRNA sequence
ttttaaaaaaattagttcct

SEQ ID NO: 806851 - DNA, 20 bp, Artificial
  CRISPR gRNA sequence
tttaaaaaaattagttcctc

SEQ ID NO: 806852 - DNA, 20 bp, Artificial
  CRISPR gRNA sequence
ttaaaaaaattagttcctca

SEQ ID NO: 806853 - DNA, 20 bp, Artificial
  CRISPR gRNA sequence
taaaaaaattagttcctcac

SEQ ID NO: 806854 - DNA, 20 bp, Artificial
  CRISPR gRNA sequence
aaaaaaattagttcctcact

SEQ ID NO: 806855 - DNA, 20 bp, Artificial
  CRISPR gRNA sequence
aaaaaattagttcctcactc

SEQ ID NO: 806856 - DNA, 20 bp, Artificial
  CRISPR gRNA sequence
gttcctcactcaaattttgg

SEQ ID NO: 806857 - DNA, 20 bp, Artificial
  CRISPR gRNA sequence
ctcactcaaattttggggag

SEQ ID NO: 806858 - DNA, 20 bp, Artificial
  CRISPR gRNA sequence
actcaaattttggggaggtt

SEQ ID NO: 806859 - DNA, 20 bp, Artificial
  CRISPR gRNA sequence
aaattttggggaggttatat

SEQ ID NO: 806860 - DNA, 20 bp, Artificial
  CRISPR gRNA sequence
tggggaggttatatattttc

SEQ ID NO: 806861 - DNA, 20 bp, Artificial
  CRISPR gRNA sequence
ggggaggttatatattttct

SEQ ID NO: 806862 - DNA, 20 bp, Artificial
  CRISPR gRNA sequence
gggaggttatatattttcta

SEQ ID NO: 806863 - DNA, 20 bp, Artificial
  CRISPR gRNA sequence
tatattttctaatcataaaa

SEQ ID NO: 806864 - DNA, 20 bp, Artificial
  CRISPR gRNA sequence
tctaatcataaaaaatgatt

SEQ ID NO: 806865 - DNA, 20 bp, Artificial
  CRISPR gRNA sequence
ctaatcataaaaaatgattt

SEQ ID NO: 806866 - DNA, 20 bp, Artificial
  CRISPR gRNA sequence
taatcataaaaaatgatttt

SEQ ID NO: 806867 - DNA, 20 bp, Artificial
  CRISPR gRNA sequence
atcataaaaaatgatttttc

SEQ ID NO: 806868 - DNA, 20 bp, Artificial
  CRISPR gRNA sequence
ttcttatttgtgggcttttc

SEQ ID NO: 806869 - DNA, 20 bp, Artificial
  CRISPR gRNA sequence
tcttatttgtgggcttttct

SEQ ID NO: 806870 - DNA, 20 bp, Artificial
  CRISPR gRNA sequence
cttatttgtgggcttttctc

SEQ ID NO: 806871 - DNA, 20 bp, Artificial
  CRISPR gRNA sequence
ttatttgtgggcttttctcc

SEQ ID NO: 806872 - DNA, 20 bp, Artificial
  CRISPR gRNA sequence
atttgtgggcttttctcccc

SEQ ID NO: 806873 - DNA, 20 bp, Artificial
  CRISPR gRNA sequence
tttgtgggcttttctcccca

SEQ ID NO: 806874 - DNA, 20 bp, Artificial
  CRISPR gRNA sequence
gtgggcttttctccccagat

SEQ ID NO: 806875 - DNA, 20 bp, Artificial
  CRISPR gRNA sequence
tgggcttttctccccagatc

SEQ ID NO: 806876 - DNA, 20 bp, Artificial
  CRISPR gRNA sequence
ttctccccagatctgaacct

SEQ ID NO: 806877 - DNA, 20 bp, Artificial
  CRISPR gRNA sequence
tctccccagatctgaacctg

SEQ ID NO: 806878 - DNA, 20 bp, Artificial
  CRISPR gRNA sequence
ctccccagatctgaacctgt

SEQ ID NO: 806879 - DNA, 20 bp, Artificial
  CRISPR gRNA sequence
tccccagatctgaacctgtg

SEQ ID NO: 806880 - DNA, 20 bp, Artificial
  CRISPR gRNA sequence
cccagatctgaacctgtggt

SEQ ID NO: 806881 - DNA, 20 bp, Artificial
  CRISPR gRNA sequence
aacctgtggtcttgggagcc

SEQ ID NO: 806882 - DNA, 20 bp, Artificial
  CRISPR gRNA sequence
tggtcttgggagccagggtg

SEQ ID NO: 806883 - DNA, 20 bp, Artificial
  CRISPR gRNA sequence
gggagccagggtgacctgat

SEQ ID NO: 806884 - DNA, 20 bp, Artificial
  CRISPR gRNA sequence
ggagccagggtgacctgata

SEQ ID NO: 806885 - DNA, 20 bp, Artificial
  CRISPR gRNA sequence
atatgacatctaaagaagct

SEQ ID NO: 806886 - DNA, 20 bp, Artificial
  CRISPR gRNA sequence
aagaagcttctggactctga

SEQ ID NO: 806887 - DNA, 20 bp, Artificial
  CRISPR gRNA sequence
ctggactctgaacaagaatt

SEQ ID NO: 806888 - DNA, 20 bp, Artificial
  CRISPR gRNA sequence
tggactctgaacaagaattc

SEQ ID NO: 806889 - DNA, 20 bp, Artificial
  CRISPR gRNA sequence
gactctgaacaagaattcgg

SEQ ID NO: 806890 - DNA, 20 bp, Artificial
  CRISPR gRNA sequence
tgaacaagaattcggtggcc

SEQ ID NO: 806891 - DNA, 20 bp, Artificial
  CRISPR gRNA sequence
aacaagaattcggtggcctg

SEQ ID NO: 806892 - DNA, 20 bp, Artificial
  CRISPR gRNA sequence
ggtggcctgcagagcttgcc

SEQ ID NO: 806893 - DNA, 20 bp, Artificial
  CRISPR gRNA sequence
cagagcttgccatttgcact

SEQ ID NO: 806894 - DNA, 20 bp, Artificial
  CRISPR gRNA sequence
gccatttgcacttttcaaat

SEQ ID NO: 806895 - DNA, 20 bp, Artificial
  CRISPR gRNA sequence
ccatttgcacttttcaaatg

SEQ ID NO: 806896 - DNA, 20 bp, Artificial
  CRISPR gRNA sequence
gcacttttcaaatgcctttg

SEQ ID NO: 806897 - DNA, 20 bp, Artificial
  CRISPR gRNA sequence
cacttttcaaatgcctttgg

SEQ ID NO: 806898 - DNA, 20 bp, Artificial
  CRISPR gRNA sequence
ttcaaatgcctttggatgac

SEQ ID NO: 806899 - DNA, 20 bp, Artificial
  CRISPR gRNA sequence
tcaaatgcctttggatgacc

SEQ ID NO: 806900 - DNA, 20 bp, Artificial
  CRISPR gRNA sequence
caaatgcctttggatgaccc

SEQ ID NO: 806901 - DNA, 20 bp, Artificial
  CRISPR gRNA sequence
aaatgcctttggatgaccca

SEQ ID NO: 806902 - DNA, 20 bp, Artificial
  CRISPR gRNA sequence
tggatgacccagcactttaa

SEQ ID NO: 806903 - DNA, 20 bp, Artificial
  CRISPR gRNA sequence
ggatgacccagcactttaat

SEQ ID NO: 806904 - DNA, 20 bp, Artificial
  CRISPR gRNA sequence
gatgacccagcactttaatc

SEQ ID NO: 806905 - DNA, 20 bp, Artificial
  CRISPR gRNA sequence
taatctgaaacctgcaacaa

SEQ ID NO: 806906 - DNA, 20 bp, Artificial
  CRISPR gRNA sequence
aatctgaaacctgcaacaag

SEQ ID NO: 806907 - DNA, 20 bp, Artificial
  CRISPR gRNA sequence
atctgaaacctgcaacaaga

SEQ ID NO: 806908 - DNA, 20 bp, Artificial
  CRISPR gRNA sequence
aaacctgcaacaagactagc

SEQ ID NO: 806909 - DNA, 20 bp, Artificial
  CRISPR gRNA sequence
caacaagactagccaacacc

SEQ ID NO: 806910 - DNA, 20 bp, Artificial
  CRISPR gRNA sequence
gccaacacctggccatgaaa

SEQ ID NO: 806911 - DNA, 20 bp, Artificial
  CRISPR gRNA sequence
gccatgaaacttgccccttc

SEQ ID NO: 806912 - DNA, 20 bp, Artificial
  CRISPR gRNA sequence
gccccttcactgatctggac

SEQ ID NO: 806913 - DNA, 20 bp, Artificial
  CRISPR gRNA sequence
ccccttcactgatctggact

SEQ ID NO: 806914 - DNA, 20 bp, Artificial
  CRISPR gRNA sequence
cactgatctggactcacctc

SEQ ID NO: 806915 - DNA, 20 bp, Artificial
  CRISPR gRNA sequence
actgatctggactcacctct

SEQ ID NO: 806916 - DNA, 20 bp, Artificial
  CRISPR gRNA sequence
atctggactcacctctggag

SEQ ID NO: 806917 - DNA, 20 bp, Artificial
  CRISPR gRNA sequence
gactcacctctggagcctat

SEQ ID NO: 806918 - DNA, 20 bp, Artificial
  CRISPR gRNA sequence
acctctggagcctatggctt

SEQ ID NO: 806919 - DNA, 20 bp, Artificial
  CRISPR gRNA sequence
tggagcctatggctttaagc

SEQ ID NO: 806920 - DNA, 20 bp, Artificial
  CRISPR gRNA sequence
gagcctatggctttaagcaa

SEQ ID NO: 806921 - DNA, 20 bp, Artificial
  CRISPR gRNA sequence
tggctttaagcaagcactac

SEQ ID NO: 806922 - DNA, 20 bp, Artificial
  CRISPR gRNA sequence
taagcaagcactactgcact

SEQ ID NO: 806923 - DNA, 20 bp, Artificial
  CRISPR gRNA sequence
aagcaagcactactgcactt

SEQ ID NO: 806924 - DNA, 20 bp, Artificial
  CRISPR gRNA sequence
agcaagcactactgcacttt

SEQ ID NO: 806925 - DNA, 20 bp, Artificial
  CRISPR gRNA sequence
ctgcactttacagaattacc

SEQ ID NO: 806926 - DNA, 20 bp, Artificial
  CRISPR gRNA sequence
cactttacagaattacccca

SEQ ID NO: 806927 - DNA, 20 bp, Artificial
  CRISPR gRNA sequence
tacagaattaccccactgga

SEQ ID NO: 806928 - DNA, 20 bp, Artificial
  CRISPR gRNA sequence
acagaattaccccactggat

SEQ ID NO: 806929 - DNA, 20 bp, Artificial
  CRISPR gRNA sequence
cagaattaccccactggatc

SEQ ID NO: 806930 - DNA, 20 bp, Artificial
  CRISPR gRNA sequence
ccccactggatcctggaccc

SEQ ID NO: 806931 - DNA, 20 bp, Artificial
  CRISPR gRNA sequence
gatcctggacccacagaatt

SEQ ID NO: 806932 - DNA, 20 bp, Artificial
  CRISPR gRNA sequence
gacccacagaattccttcag

SEQ ID NO: 806933 - DNA, 20 bp, Artificial
  CRISPR gRNA sequence
cttcaggatccttcttgctg

SEQ ID NO: 806934 - DNA, 20 bp, Artificial
  CRISPR gRNA sequence
caggatccttcttgctgcca

SEQ ID NO: 806935 - DNA, 20 bp, Artificial
  CRISPR gRNA sequence
aggatccttcttgctgccag

SEQ ID NO: 806936 - DNA, 20 bp, Artificial
  CRISPR gRNA sequence
cttgctgccagactgaaagc

SEQ ID NO: 806937 - DNA, 20 bp, Artificial
  CRISPR gRNA sequence
ttgctgccagactgaaagca

SEQ ID NO: 806938 - DNA, 20 bp, Artificial
  CRISPR gRNA sequence
gctgccagactgaaagcaaa

SEQ ID NO: 806939 - DNA, 20 bp, Artificial
  CRISPR gRNA sequence
ctgccagactgaaagcaaaa

SEQ ID NO: 806940 - DNA, 20 bp, Artificial
  CRISPR gRNA sequence
ccagactgaaagcaaaagga

SEQ ID NO: 806941 - DNA, 20 bp, Artificial
  CRISPR gRNA sequence
aaagcaaaaggaattatttc

SEQ ID NO: 806942 - DNA, 20 bp, Artificial
  CRISPR gRNA sequence
tttcccctcaagttttctaa

SEQ ID NO: 806943 - DNA, 20 bp, Artificial
  CRISPR gRNA sequence
cccctcaagttttctaagtg

SEQ ID NO: 806944 - DNA, 20 bp, Artificial
  CRISPR gRNA sequence
ccctcaagttttctaagtga

SEQ ID NO: 806945 - DNA, 20 bp, Artificial
  CRISPR gRNA sequence
aagttttctaagtgatttcc

SEQ ID NO: 806946 - DNA, 20 bp, Artificial
  CRISPR gRNA sequence
tctaagtgatttccaaaagc

SEQ ID NO: 806947 - DNA, 20 bp, Artificial
  CRISPR gRNA sequence
ctaagtgatttccaaaagca

SEQ ID NO: 806948 - DNA, 20 bp, Artificial
  CRISPR gRNA sequence
taagtgatttccaaaagcag

SEQ ID NO: 806949 - DNA, 20 bp, Artificial
  CRISPR gRNA sequence
agtgatttccaaaagcagag

SEQ ID NO: 806950 - DNA, 20 bp, Artificial
  CRISPR gRNA sequence
ccaaaagcagaggtgtgtgg

SEQ ID NO: 806951 - DNA, 20 bp, Artificial
  CRISPR gRNA sequence
caaaagcagaggtgtgtgga

SEQ ID NO: 806952 - DNA, 20 bp, Artificial
  CRISPR gRNA sequence
ccagtaacagaaacagatgg

SEQ ID NO: 806953 - DNA, 20 bp, Artificial
  CRISPR gRNA sequence
cagtaacagaaacagatggg

SEQ ID NO: 806954 - DNA, 20 bp, Artificial
  CRISPR gRNA sequence
ccaatagagttattttttat

SEQ ID NO: 806955 - DNA, 20 bp, Artificial
  CRISPR gRNA sequence
ttttttatctatagcttcct

SEQ ID NO: 806956 - DNA, 20 bp, Artificial
  CRISPR gRNA sequence
tttatctatagcttcctctg

SEQ ID NO: 806957 - DNA, 20 bp, Artificial
  CRISPR gRNA sequence
ttatctatagcttcctctgg

SEQ ID NO: 806958 - DNA, 20 bp, Artificial
  CRISPR gRNA sequence
tatctatagcttcctctggg

SEQ ID NO: 806959 - DNA, 20 bp, Artificial
  CRISPR gRNA sequence
atctatagcttcctctgggt

SEQ ID NO: 806960 - DNA, 20 bp, Artificial
  CRISPR gRNA sequence
tctatagcttcctctgggta

SEQ ID NO: 806961 - DNA, 20 bp, Artificial
  CRISPR gRNA sequence
tagcttcctctgggtactag

SEQ ID NO: 806962 - DNA, 20 bp, Artificial
  CRISPR gRNA sequence
cctctgggtactagaagagg

SEQ ID NO: 806963 - DNA, 20 bp, Artificial
  CRISPR gRNA sequence
ctctgggtactagaagaggc

SEQ ID NO: 806964 - DNA, 20 bp, Artificial
  CRISPR gRNA sequence
tgggtactagaagaggctat

SEQ ID NO: 806965 - DNA, 20 bp, Artificial
  CRISPR gRNA sequence
ggtactagaagaggctattg

SEQ ID NO: 806966 - DNA, 20 bp, Artificial
  CRISPR gRNA sequence
gaagaggctattgagactat

SEQ ID NO: 806967 - DNA, 20 bp, Artificial
  CRISPR gRNA sequence
ttgagactatgagctcacag

SEQ ID NO: 806968 - DNA, 20 bp, Artificial
  CRISPR gRNA sequence
agactatgagctcacagaca

SEQ ID NO: 806969 - DNA, 20 bp, Artificial
  CRISPR gRNA sequence
tgagctcacagacagggctt

SEQ ID NO: 806970 - DNA, 20 bp, Artificial
  CRISPR gRNA sequence
acagacagggcttcgcacaa

SEQ ID NO: 806971 - DNA, 20 bp, Artificial
  CRISPR gRNA sequence
cgcacaaactcaaatcataa

SEQ ID NO: 806972 - DNA, 20 bp, Artificial
  CRISPR gRNA sequence
gcacaaactcaaatcataat

SEQ ID NO: 806973 - DNA, 20 bp, Artificial
  CRISPR gRNA sequence
aaatcataattgacatgttt

SEQ ID NO: 806974 - DNA, 20 bp, Artificial
  CRISPR gRNA sequence
acatgttttatggattactg

SEQ ID NO: 806975 - DNA, 20 bp, Artificial
  CRISPR gRNA sequence
tatggattactggaatcttg

SEQ ID NO: 806976 - DNA, 20 bp, Artificial
  CRISPR gRNA sequence
atggattactggaatcttga

SEQ ID NO: 806977 - DNA, 20 bp, Artificial
  CRISPR gRNA sequence
tggattactggaatcttgat

SEQ ID NO: 806978 - DNA, 20 bp, Artificial
  CRISPR gRNA sequence
ctggaatcttgatagcataa

SEQ ID NO: 806979 - DNA, 20 bp, Artificial
  CRISPR gRNA sequence
gaatcttgatagcataatga

SEQ ID NO: 806980 - DNA, 20 bp, Artificial
  CRISPR gRNA sequence
gatagcataatgaagttgtt

SEQ ID NO: 806981 - DNA, 20 bp, Artificial
  CRISPR gRNA sequence
atagcataatgaagttgttc

SEQ ID NO: 806982 - DNA, 20 bp, Artificial
  CRISPR gRNA sequence
ttctaattaacagagagcat

SEQ ID NO: 806983 - DNA, 20 bp, Artificial
  CRISPR gRNA sequence
taattaacagagagcattta

SEQ ID NO: 806984 - DNA, 20 bp, Artificial
  CRISPR gRNA sequence
attaacagagagcatttaaa

SEQ ID NO: 806985 - DNA, 20 bp, Artificial
  CRISPR gRNA sequence
acagagagcatttaaatata

SEQ ID NO: 806986 - DNA, 20 bp, Artificial
  CRISPR gRNA sequence
aaatatacactaagtgcaca

SEQ ID NO: 806987 - DNA, 20 bp, Artificial
  CRISPR gRNA sequence
aatatacactaagtgcacaa

SEQ ID NO: 806988 - DNA, 20 bp, Artificial
  CRISPR gRNA sequence
agtgcacaaattgtggagta

SEQ ID NO: 806989 - DNA, 20 bp, Artificial
  CRISPR gRNA sequence
tggagtaaagtcatcaagct

SEQ ID NO: 806990 - DNA, 20 bp, Artificial
  CRISPR gRNA sequence
tgtttttgaggtctaagtca

SEQ ID NO: 806991 - DNA, 20 bp, Artificial
  CRISPR gRNA sequence
tttttgaggtctaagtcaca

SEQ ID NO: 806992 - DNA, 20 bp, Artificial
  CRISPR gRNA sequence
ttgaggtctaagtcacaaag

SEQ ID NO: 806993 - DNA, 20 bp, Artificial
  CRISPR gRNA sequence
tgaggtctaagtcacaaagc

SEQ ID NO: 806994 - DNA, 20 bp, Artificial
  CRISPR gRNA sequence
gaggtctaagtcacaaagca

SEQ ID NO: 806995 - DNA, 20 bp, Artificial
  CRISPR gRNA sequence
aggtctaagtcacaaagcat

SEQ ID NO: 806996 - DNA, 20 bp, Artificial
  CRISPR gRNA sequence
agtcacaaagcatttgtttt

SEQ ID NO: 806997 - DNA, 20 bp, Artificial
  CRISPR gRNA sequence
gttttaacctgtaatggcac

SEQ ID NO: 806998 - DNA, 20 bp, Artificial
  CRISPR gRNA sequence
ttttaacctgtaatggcacc

SEQ ID NO: 806999 - DNA, 20 bp, Artificial
  CRISPR gRNA sequence
taacctgtaatggcaccatg

SEQ ID NO: 807000 - DNA, 20 bp, Artificial
  CRISPR gRNA sequence
aacctgtaatggcaccatgt

SEQ ID NO: 807001 - DNA, 20 bp, Artificial
  CRISPR gRNA sequence
acctgtaatggcaccatgtt

SEQ ID NO: 807002 - DNA, 20 bp, Artificial
  CRISPR gRNA sequence
taatggcaccatgtttaatg

SEQ ID NO: 807003 - DNA, 20 bp, Artificial
  CRISPR gRNA sequence
aatggtggttttttttttga

SEQ ID NO: 807004 - DNA, 20 bp, Artificial
  CRISPR gRNA sequence
atggtggttttttttttgaa

SEQ ID NO: 807005 - DNA, 20 bp, Artificial
  CRISPR gRNA sequence
tttttttgaactacatcttt

SEQ ID NO: 807006 - DNA, 20 bp, Artificial
  CRISPR gRNA sequence
ttttttgaactacatctttc

SEQ ID NO: 807007 - DNA, 20 bp, Artificial
  CRISPR gRNA sequence
tttttgaactacatctttcc

SEQ ID NO: 807008 - DNA, 20 bp, Artificial
  CRISPR gRNA sequence
ttttgaactacatctttcct

SEQ ID NO: 807009 - DNA, 20 bp, Artificial
  CRISPR gRNA sequence
tttgaactacatctttcctt

SEQ ID NO: 807010 - DNA, 20 bp, Artificial
  CRISPR gRNA sequence
ttgaactacatctttccttt

SEQ ID NO: 807011 - DNA, 20 bp, Artificial
  CRISPR gRNA sequence
tgaactacatctttccttta

SEQ ID NO: 807012 - DNA, 20 bp, Artificial
  CRISPR gRNA sequence
gaactacatctttcctttaa

SEQ ID NO: 807013 - DNA, 20 bp, Artificial
  CRISPR gRNA sequence
aactacatctttcctttaaa

SEQ ID NO: 807014 - DNA, 20 bp, Artificial
  CRISPR gRNA sequence
catctttcctttaaaaatta

SEQ ID NO: 807015 - DNA, 20 bp, Artificial
  CRISPR gRNA sequence
tcctttaaaaattattggtt

SEQ ID NO: 807016 - DNA, 20 bp, Artificial
  CRISPR gRNA sequence
cctttaaaaattattggttt

SEQ ID NO: 807017 - DNA, 20 bp, Artificial
  CRISPR gRNA sequence
ctttaaaaattattggtttc

SEQ ID NO: 807018 - DNA, 20 bp, Artificial
  CRISPR gRNA sequence
taaaaattattggtttcttt

SEQ ID NO: 807019 - DNA, 20 bp, Artificial
  CRISPR gRNA sequence
aaaaattattggtttctttt

SEQ ID NO: 807020 - DNA, 20 bp, Artificial
  CRISPR gRNA sequence
aaaattattggtttcttttt

SEQ ID NO: 807021 - DNA, 20 bp, Artificial
  CRISPR gRNA sequence
ttggtttctttttatttgtt

SEQ ID NO: 807022 - DNA, 20 bp, Artificial
  CRISPR gRNA sequence
gtttctttttatttgttttt

SEQ ID NO: 807023 - DNA, 20 bp, Artificial
  CRISPR gRNA sequence
ctttttatttgtttttacct

SEQ ID NO: 807024 - DNA, 20 bp, Artificial
  CRISPR gRNA sequence
tttttatttgtttttacctt

SEQ ID NO: 807025 - DNA, 20 bp, Artificial
  CRISPR gRNA sequence
tttatttgtttttaccttag

SEQ ID NO: 807026 - DNA, 20 bp, Artificial
  CRISPR gRNA sequence
ttatttgtttttaccttaga

SEQ ID NO: 807027 - DNA, 20 bp, Artificial
  CRISPR gRNA sequence
tatttgtttttaccttagaa

SEQ ID NO: 807028 - DNA, 20 bp, Artificial
  CRISPR gRNA sequence
atttgtttttaccttagaaa

SEQ ID NO: 807029 - DNA, 20 bp, Artificial
  CRISPR gRNA sequence
tttgtttttaccttagaaat

SEQ ID NO: 807030 - DNA, 20 bp, Artificial
  CRISPR gRNA sequence
gtttttaccttagaaatcaa

SEQ ID NO: 807031 - DNA, 20 bp, Artificial
  CRISPR gRNA sequence
tttttaccttagaaatcaat

SEQ ID NO: 807032 - DNA, 20 bp, Artificial
  CRISPR gRNA sequence
ttaccttagaaatcaattat

SEQ ID NO: 807033 - DNA, 20 bp, Artificial
  CRISPR gRNA sequence
taccttagaaatcaattata

SEQ ID NO: 807034 - DNA, 20 bp, Artificial
  CRISPR gRNA sequence
accttagaaatcaattatat

SEQ ID NO: 807035 - DNA, 20 bp, Artificial
  CRISPR gRNA sequence
ccttagaaatcaattatata

SEQ ID NO: 807036 - DNA, 20 bp, Artificial
  CRISPR gRNA sequence
agaaatcaattatatacagt

SEQ ID NO: 807037 - DNA, 20 bp, Artificial
  CRISPR gRNA sequence
gaaatcaattatatacagtc

SEQ ID NO: 807038 - DNA, 20 bp, Artificial
  CRISPR gRNA sequence
tatacagtcaaaaatatttg

SEQ ID NO: 807039 - DNA, 20 bp, Artificial
  CRISPR gRNA sequence
gatatgctcatacgttgtat

SEQ ID NO: 807040 - DNA, 20 bp, Artificial
  CRISPR gRNA sequence
atatgctcatacgttgtatc

SEQ ID NO: 807041 - DNA, 20 bp, Artificial
  CRISPR gRNA sequence
atacgttgtatctgcagcaa

SEQ ID NO: 807042 - DNA, 20 bp, Artificial
  CRISPR gRNA sequence
tatctgcagcaatttcagat

SEQ ID NO: 807043 - DNA, 20 bp, Artificial
  CRISPR gRNA sequence
cagcaatttcagataagtag

SEQ ID NO: 807044 - DNA, 20 bp, Artificial
  CRISPR gRNA sequence
cagataagtagctaaaatgg

SEQ ID NO: 807045 - DNA, 20 bp, Artificial
  CRISPR gRNA sequence
agataagtagctaaaatggc

SEQ ID NO: 807046 - DNA, 20 bp, Artificial
  CRISPR gRNA sequence
aaatggccaaagccccaaac

SEQ ID NO: 807047 - DNA, 20 bp, Artificial
  CRISPR gRNA sequence
agcctccttttctggccctc

SEQ ID NO: 807048 - DNA, 20 bp, Artificial
  CRISPR gRNA sequence
cttttctggccctcaatatg

SEQ ID NO: 807049 - DNA, 20 bp, Artificial
  CRISPR gRNA sequence
ttctggccctcaatatgact

SEQ ID NO: 807050 - DNA, 20 bp, Artificial
  CRISPR gRNA sequence
tctggccctcaatatgactt

SEQ ID NO: 807051 - DNA, 20 bp, Artificial
  CRISPR gRNA sequence
ctggccctcaatatgacttt

SEQ ID NO: 807052 - DNA, 20 bp, Artificial
  CRISPR gRNA sequence
tggccctcaatatgacttta

SEQ ID NO: 807053 - DNA, 20 bp, Artificial
  CRISPR gRNA sequence
gccctcaatatgactttaaa

SEQ ID NO: 807054 - DNA, 20 bp, Artificial
  CRISPR gRNA sequence
aatatgactttaaatttgac

SEQ ID NO: 807055 - DNA, 20 bp, Artificial
  CRISPR gRNA sequence
taaatttgacttttcagtgc

SEQ ID NO: 807056 - DNA, 20 bp, Artificial
  CRISPR gRNA sequence
aaatttgacttttcagtgcc

SEQ ID NO: 807057 - DNA, 20 bp, Artificial
  CRISPR gRNA sequence
aatttgacttttcagtgcct

SEQ ID NO: 807058 - DNA, 20 bp, Artificial
  CRISPR gRNA sequence
gacttttcagtgcctcagtt

SEQ ID NO: 807059 - DNA, 20 bp, Artificial
  CRISPR gRNA sequence
acttttcagtgcctcagttt

SEQ ID NO: 807060 - DNA, 20 bp, Artificial
  CRISPR gRNA sequence
ttcagtgcctcagtttgcac

SEQ ID NO: 807061 - DNA, 20 bp, Artificial
  CRISPR gRNA sequence
tcagtgcctcagtttgcaca

SEQ ID NO: 807062 - DNA, 20 bp, Artificial
  CRISPR gRNA sequence
cagtgcctcagtttgcacat

SEQ ID NO: 807063 - DNA, 20 bp, Artificial
  CRISPR gRNA sequence
agtgcctcagtttgcacatc

SEQ ID NO: 807064 - DNA, 20 bp, Artificial
  CRISPR gRNA sequence
agtttgcacatctgtaatac

SEQ ID NO: 807065 - DNA, 20 bp, Artificial
  CRISPR gRNA sequence
gcacatctgtaatacagcaa

SEQ ID NO: 807066 - DNA, 20 bp, Artificial
  CRISPR gRNA sequence
cacatctgtaatacagcaat

SEQ ID NO: 807067 - DNA, 20 bp, Artificial
  CRISPR gRNA sequence
taatacagcaatgctaagta

SEQ ID NO: 807068 - DNA, 20 bp, Artificial
  CRISPR gRNA sequence
agtagtcaaggcctttgata

SEQ ID NO: 807069 - DNA, 20 bp, Artificial
  CRISPR gRNA sequence
tgataattggcactatggaa

SEQ ID NO: 807070 - DNA, 20 bp, Artificial
  CRISPR gRNA sequence
gataattggcactatggaaa

SEQ ID NO: 807071 - DNA, 20 bp, Artificial
  CRISPR gRNA sequence
ataattggcactatggaaat

SEQ ID NO: 807072 - DNA, 20 bp, Artificial
  CRISPR gRNA sequence
gcactatggaaatcctgcaa

SEQ ID NO: 807073 - DNA, 20 bp, Artificial
  CRISPR gRNA sequence
tggaaatcctgcaagatccc

SEQ ID NO: 807074 - DNA, 20 bp, Artificial
  CRISPR gRNA sequence
caagatcccactacatatgt

SEQ ID NO: 807075 - DNA, 20 bp, Artificial
  CRISPR gRNA sequence
catatgtgtggagcagaagg

SEQ ID NO: 807076 - DNA, 20 bp, Artificial
  CRISPR gRNA sequence
ggctacagtaacagcttaat

SEQ ID NO: 807077 - DNA, 20 bp, Artificial
  CRISPR gRNA sequence
cagtaacagcttaattttgt

SEQ ID NO: 807078 - DNA, 20 bp, Artificial
  CRISPR gRNA sequence
aattttgttaaatttgttct

SEQ ID NO: 807079 - DNA, 20 bp, Artificial
  CRISPR gRNA sequence
attttgttaaatttgttctt

SEQ ID NO: 807080 - DNA, 20 bp, Artificial
  CRISPR gRNA sequence
tgttaaatttgttctttata

SEQ ID NO: 807081 - DNA, 20 bp, Artificial
  CRISPR gRNA sequence
gttaaatttgttctttatac

SEQ ID NO: 807082 - DNA, 20 bp, Artificial
  CRISPR gRNA sequence
ttaaatttgttctttatact

SEQ ID NO: 807083 - DNA, 20 bp, Artificial
  CRISPR gRNA sequence
aatttgttctttatactgga

SEQ ID NO: 807084 - DNA, 20 bp, Artificial
  CRISPR gRNA sequence
gttctttatactggagccat

SEQ ID NO: 807085 - DNA, 20 bp, Artificial
  CRISPR gRNA sequence
ttctttatactggagccatg

SEQ ID NO: 807086 - DNA, 20 bp, Artificial
  CRISPR gRNA sequence
tttatactggagccatgaag

SEQ ID NO: 807087 - DNA, 20 bp, Artificial
  CRISPR gRNA sequence
tatactggagccatgaagct

SEQ ID NO: 807088 - DNA, 20 bp, Artificial
  CRISPR gRNA sequence
atactggagccatgaagctc

SEQ ID NO: 807089 - DNA, 20 bp, Artificial
  CRISPR gRNA sequence
tactggagccatgaagctca

SEQ ID NO: 807090 - DNA, 20 bp, Artificial
  CRISPR gRNA sequence
gagccatgaagctcagagca

SEQ ID NO: 807091 - DNA, 20 bp, Artificial
  CRISPR gRNA sequence
agagcattagctgacccttg

SEQ ID NO: 807092 - DNA, 20 bp, Artificial
  CRISPR gRNA sequence
gctgacccttgaactattca

SEQ ID NO: 807093 - DNA, 20 bp, Artificial
  CRISPR gRNA sequence
acccttgaactattcaaatg

SEQ ID NO: 807094 - DNA, 20 bp, Artificial
  CRISPR gRNA sequence
gaactattcaaatgggcaca

SEQ ID NO: 807095 - DNA, 20 bp, Artificial
  CRISPR gRNA sequence
aactattcaaatgggcacat

SEQ ID NO: 807096 - DNA, 20 bp, Artificial
  CRISPR gRNA sequence
ttcaaatgggcacattagct

SEQ ID NO: 807097 - DNA, 20 bp, Artificial
  CRISPR gRNA sequence
aaatgggcacattagctagt

SEQ ID NO: 807098 - DNA, 20 bp, Artificial
  CRISPR gRNA sequence
gctagtataacagacttaca

SEQ ID NO: 807099 - DNA, 20 bp, Artificial
  CRISPR gRNA sequence
gtataacagacttacatagg

SEQ ID NO: 807100 - DNA, 20 bp, Artificial
  CRISPR gRNA sequence
acataggtgggcctaaagca

SEQ ID NO: 807101 - DNA, 20 bp, Artificial
  CRISPR gRNA sequence
cataggtgggcctaaagcaa

SEQ ID NO: 807102 - DNA, 20 bp, Artificial
  CRISPR gRNA sequence
aagcaagctccttaactgag

SEQ ID NO: 807103 - DNA, 20 bp, Artificial
  CRISPR gRNA sequence
cttaactgagcaaaatttgg

SEQ ID NO: 807104 - DNA, 20 bp, Artificial
  CRISPR gRNA sequence
aactgagcaaaatttggggc

SEQ ID NO: 807105 - DNA, 20 bp, Artificial
  CRISPR gRNA sequence
actgagcaaaatttggggct

SEQ ID NO: 807106 - DNA, 20 bp, Artificial
  CRISPR gRNA sequence
agcaaaatttggggcttatg

SEQ ID NO: 807107 - DNA, 20 bp, Artificial
  CRISPR gRNA sequence
ggggcttatgagaatgaaag

SEQ ID NO: 807108 - DNA, 20 bp, Artificial
  CRISPR gRNA sequence
gggcttatgagaatgaaagg

SEQ ID NO: 807109 - DNA, 20 bp, Artificial
  CRISPR gRNA sequence
atgagaatgaaagggtgtga

SEQ ID NO: 807110 - DNA, 20 bp, Artificial
  CRISPR gRNA sequence
tgagaatgaaagggtgtgaa

SEQ ID NO: 807111 - DNA, 20 bp, Artificial
  CRISPR gRNA sequence
actaacagacaaatcataca

SEQ ID NO: 807112 - DNA, 20 bp, Artificial
  CRISPR gRNA sequence
acagacaaatcatacatctc

SEQ ID NO: 807113 - DNA, 20 bp, Artificial
  CRISPR gRNA sequence
agtttctcaattctcatgta

SEQ ID NO: 807114 - DNA, 20 bp, Artificial
  CRISPR gRNA sequence
ctcaattctcatgtaaatca

SEQ ID NO: 807115 - DNA, 20 bp, Artificial
  CRISPR gRNA sequence
tcaattctcatgtaaatcag

SEQ ID NO: 807116 - DNA, 20 bp, Artificial
  CRISPR gRNA sequence
aattctcatgtaaatcagag

SEQ ID NO: 807117 - DNA, 20 bp, Artificial
  CRISPR gRNA sequence
tcatgtaaatcagagaatgc

SEQ ID NO: 807118 - DNA, 20 bp, Artificial
  CRISPR gRNA sequence
atgtaaatcagagaatgcct

SEQ ID NO: 807119 - DNA, 20 bp, Artificial
  CRISPR gRNA sequence
taaagaataaaactcaattg

SEQ ID NO: 807120 - DNA, 20 bp, Artificial
  CRISPR gRNA sequence
aaagaataaaactcaattgt

SEQ ID NO: 807121 - DNA, 20 bp, Artificial
  CRISPR gRNA sequence
aagaataaaactcaattgtt

SEQ ID NO: 807122 - DNA, 20 bp, Artificial
  CRISPR gRNA sequence
aattgttattcttcaacgtt

SEQ ID NO: 807123 - DNA, 20 bp, Artificial
  CRISPR gRNA sequence
ttattcttcaacgttcttta

SEQ ID NO: 807124 - DNA, 20 bp, Artificial
  CRISPR gRNA sequence
ttcttcaacgttctttatat

SEQ ID NO: 807125 - DNA, 20 bp, Artificial
  CRISPR gRNA sequence
ttcaacgttctttatatatt

SEQ ID NO: 807126 - DNA, 20 bp, Artificial
  CRISPR gRNA sequence
caacgttctttatatattct

SEQ ID NO: 807127 - DNA, 20 bp, Artificial
  CRISPR gRNA sequence
aacgttctttatatattcta

SEQ ID NO: 807128 - DNA, 20 bp, Artificial
  CRISPR gRNA sequence
tttatatattctacttttgg

SEQ ID NO: 807129 - DNA, 20 bp, Artificial
  CRISPR gRNA sequence
tatatattctacttttgggt

SEQ ID NO: 807130 - DNA, 20 bp, Artificial
  CRISPR gRNA sequence
atatattctacttttgggta

SEQ ID NO: 807131 - DNA, 20 bp, Artificial
  CRISPR gRNA sequence
tatattctacttttgggtaa

SEQ ID NO: 807132 - DNA, 20 bp, Artificial
  CRISPR gRNA sequence
tacttttgggtaagaggttt

SEQ ID NO: 807133 - DNA, 20 bp, Artificial
  CRISPR gRNA sequence
cttttgggtaagaggtttgc

SEQ ID NO: 807134 - DNA, 20 bp, Artificial
  CRISPR gRNA sequence
ttgggtaagaggtttgctca

SEQ ID NO: 807135 - DNA, 20 bp, Artificial
  CRISPR gRNA sequence
tgggtaagaggtttgctcag

SEQ ID NO: 807136 - DNA, 20 bp, Artificial
  CRISPR gRNA sequence
gggtaagaggtttgctcagg

SEQ ID NO: 807137 - DNA, 20 bp, Artificial
  CRISPR gRNA sequence
ggtaagaggtttgctcaggg

SEQ ID NO: 807138 - DNA, 20 bp, Artificial
  CRISPR gRNA sequence
gctcagggtcttgcaagtca

SEQ ID NO: 807139 - DNA, 20 bp, Artificial
  CRISPR gRNA sequence
ctcagggtcttgcaagtcag

SEQ ID NO: 807140 - DNA, 20 bp, Artificial
  CRISPR gRNA sequence
agggtcttgcaagtcagtaa

SEQ ID NO: 807141 - DNA, 20 bp, Artificial
  CRISPR gRNA sequence
gcaagtcagtaagtttaata

SEQ ID NO: 807142 - DNA, 20 bp, Artificial
  CRISPR gRNA sequence
caagtcagtaagtttaatat

SEQ ID NO: 807143 - DNA, 20 bp, Artificial
  CRISPR gRNA sequence
aatatcctattacgccattt

SEQ ID NO: 807144 - DNA, 20 bp, Artificial
  CRISPR gRNA sequence
atatcctattacgccatttg

SEQ ID NO: 807145 - DNA, 20 bp, Artificial
  CRISPR gRNA sequence
ttacgccatttggctcccaa

SEQ ID NO: 807146 - DNA, 20 bp, Artificial
  CRISPR gRNA sequence
cgccatttggctcccaaaga

SEQ ID NO: 807147 - DNA, 20 bp, Artificial
  CRISPR gRNA sequence
ggctcccaaagatttgaagg

SEQ ID NO: 807148 - DNA, 20 bp, Artificial
  CRISPR gRNA sequence
gctcccaaagatttgaaggc

SEQ ID NO: 807149 - DNA, 20 bp, Artificial
  CRISPR gRNA sequence
ccaaagatttgaaggccttt

SEQ ID NO: 807150 - DNA, 20 bp, Artificial
  CRISPR gRNA sequence
gaaggcctttgaggcaaact

SEQ ID NO: 807151 - DNA, 20 bp, Artificial
  CRISPR gRNA sequence
aaggcctttgaggcaaactt

SEQ ID NO: 807152 - DNA, 20 bp, Artificial
  CRISPR gRNA sequence
tgaggcaaacttggatgtac

SEQ ID NO: 807153 - DNA, 20 bp, Artificial
  CRISPR gRNA sequence
gcctcaaaggccttcaaatc

SEQ ID NO: 807154 - DNA, 20 bp, Artificial
  CRISPR gRNA sequence
cctcaaaggccttcaaatct

SEQ ID NO: 807155 - DNA, 20 bp, Artificial
  CRISPR gRNA sequence
aaaggccttcaaatctttgg

SEQ ID NO: 807156 - DNA, 20 bp, Artificial
  CRISPR gRNA sequence
caaatctttgggagccaaat

SEQ ID NO: 807157 - DNA, 20 bp, Artificial
  CRISPR gRNA sequence
aaatctttgggagccaaatg

SEQ ID NO: 807158 - DNA, 20 bp, Artificial
  CRISPR gRNA sequence
tgggagccaaatggcgtaat

SEQ ID NO: 807159 - DNA, 20 bp, Artificial
  CRISPR gRNA sequence
gggagccaaatggcgtaata

SEQ ID NO: 807160 - DNA, 20 bp, Artificial
  CRISPR gRNA sequence
ggagccaaatggcgtaatag

SEQ ID NO: 807161 - DNA, 20 bp, Artificial
  CRISPR gRNA sequence
aacttactgacttgcaagac

SEQ ID NO: 807162 - DNA, 20 bp, Artificial
  CRISPR gRNA sequence
actgacttgcaagaccctga

SEQ ID NO: 807163 - DNA, 20 bp, Artificial
  CRISPR gRNA sequence
ctgacttgcaagaccctgag

SEQ ID NO: 807164 - DNA, 20 bp, Artificial
  CRISPR gRNA sequence
acttgcaagaccctgagcaa

SEQ ID NO: 807165 - DNA, 20 bp, Artificial
  CRISPR gRNA sequence
gcaagaccctgagcaaacct

SEQ ID NO: 807166 - DNA, 20 bp, Artificial
  CRISPR gRNA sequence
caagaccctgagcaaacctc

SEQ ID NO: 807167 - DNA, 20 bp, Artificial
  CRISPR gRNA sequence
agcaaacctcttacccaaaa

SEQ ID NO: 807168 - DNA, 20 bp, Artificial
  CRISPR gRNA sequence
ttacccaaaagtagaatata

SEQ ID NO: 807169 - DNA, 20 bp, Artificial
  CRISPR gRNA sequence
acccaaaagtagaatatata

SEQ ID NO: 807170 - DNA, 20 bp, Artificial
  CRISPR gRNA sequence
cccaaaagtagaatatataa

SEQ ID NO: 807171 - DNA, 20 bp, Artificial
  CRISPR gRNA sequence
aagaataacaattgagtttt

SEQ ID NO: 807172 - DNA, 20 bp, Artificial
  CRISPR gRNA sequence
agttttattctttaaaggca

SEQ ID NO: 807173 - DNA, 20 bp, Artificial
  CRISPR gRNA sequence
tattctttaaaggcattctc

SEQ ID NO: 807174 - DNA, 20 bp, Artificial
  CRISPR gRNA sequence
attctttaaaggcattctct

SEQ ID NO: 807175 - DNA, 20 bp, Artificial
  CRISPR gRNA sequence
ttctttaaaggcattctctg

SEQ ID NO: 807176 - DNA, 20 bp, Artificial
  CRISPR gRNA sequence
tttaaaggcattctctgatt

SEQ ID NO: 807177 - DNA, 20 bp, Artificial
  CRISPR gRNA sequence
taaaggcattctctgattta

SEQ ID NO: 807178 - DNA, 20 bp, Artificial
  CRISPR gRNA sequence
aaaggcattctctgatttac

SEQ ID NO: 807179 - DNA, 20 bp, Artificial
  CRISPR gRNA sequence
aaggcattctctgatttaca

SEQ ID NO: 807180 - DNA, 20 bp, Artificial
  CRISPR gRNA sequence
tctgatttacatgagaattg

SEQ ID NO: 807181 - DNA, 20 bp, Artificial
  CRISPR gRNA sequence
tgatttacatgagaattgag

SEQ ID NO: 807182 - DNA, 20 bp, Artificial
  CRISPR gRNA sequence
atttacatgagaattgagaa

SEQ ID NO: 807183 - DNA, 20 bp, Artificial
  CRISPR gRNA sequence
acatgagaattgagaaactg

SEQ ID NO: 807184 - DNA, 20 bp, Artificial
  CRISPR gRNA sequence
catgagaattgagaaactga

SEQ ID NO: 807185 - DNA, 20 bp, Artificial
  CRISPR gRNA sequence
agaaactgagatgtatgatt

SEQ ID NO: 807186 - DNA, 20 bp, Artificial
  CRISPR gRNA sequence
agatgtatgatttgtctgtt

SEQ ID NO: 807187 - DNA, 20 bp, Artificial
  CRISPR gRNA sequence
gtctgttagtcaatttcaca

SEQ ID NO: 807188 - DNA, 20 bp, Artificial
  CRISPR gRNA sequence
tctgttagtcaatttcacac

SEQ ID NO: 807189 - DNA, 20 bp, Artificial
  CRISPR gRNA sequence
ttagtcaatttcacaccctt

SEQ ID NO: 807190 - DNA, 20 bp, Artificial
  CRISPR gRNA sequence
gtcaatttcacaccctttca

SEQ ID NO: 807191 - DNA, 20 bp, Artificial
  CRISPR gRNA sequence
cacaccctttcattctcata

SEQ ID NO: 807192 - DNA, 20 bp, Artificial
  CRISPR gRNA sequence
acaccctttcattctcataa

SEQ ID NO: 807193 - DNA, 20 bp, Artificial
  CRISPR gRNA sequence
tcattctcataagccccaaa

SEQ ID NO: 807194 - DNA, 20 bp, Artificial
  CRISPR gRNA sequence
cattctcataagccccaaat

SEQ ID NO: 807195 - DNA, 20 bp, Artificial
  CRISPR gRNA sequence
attctcataagccccaaatt

SEQ ID NO: 807196 - DNA, 20 bp, Artificial
  CRISPR gRNA sequence
tcataagccccaaattttgc

SEQ ID NO: 807197 - DNA, 20 bp, Artificial
  CRISPR gRNA sequence
ataagccccaaattttgctc

SEQ ID NO: 807198 - DNA, 20 bp, Artificial
  CRISPR gRNA sequence
tgctcagttaaggagcttgc

SEQ ID NO: 807199 - DNA, 20 bp, Artificial
  CRISPR gRNA sequence
gctcagttaaggagcttgct

SEQ ID NO: 807200 - DNA, 20 bp, Artificial
  CRISPR gRNA sequence
ctcagttaaggagcttgctt

SEQ ID NO: 807201 - DNA, 20 bp, Artificial
  CRISPR gRNA sequence
agttaaggagcttgctttag

SEQ ID NO: 807202 - DNA, 20 bp, Artificial
  CRISPR gRNA sequence
aggagcttgctttaggccca

SEQ ID NO: 807203 - DNA, 20 bp, Artificial
  CRISPR gRNA sequence
gctttaggcccacctatgta

SEQ ID NO: 807204 - DNA, 20 bp, Artificial
  CRISPR gRNA sequence
ctttaggcccacctatgtaa

SEQ ID NO: 807205 - DNA, 20 bp, Artificial
  CRISPR gRNA sequence
taggcccacctatgtaagtc

SEQ ID NO: 807206 - DNA, 20 bp, Artificial
  CRISPR gRNA sequence
aggcccacctatgtaagtct

SEQ ID NO: 807207 - DNA, 20 bp, Artificial
  CRISPR gRNA sequence
ggcccacctatgtaagtctg

SEQ ID NO: 807208 - DNA, 20 bp, Artificial
  CRISPR gRNA sequence
tgtaagtctgttatactagc

SEQ ID NO: 807209 - DNA, 20 bp, Artificial
  CRISPR gRNA sequence
ttatactagctaatgtgccc

SEQ ID NO: 807210 - DNA, 20 bp, Artificial
  CRISPR gRNA sequence
tactagctaatgtgcccatt

SEQ ID NO: 807211 - DNA, 20 bp, Artificial
  CRISPR gRNA sequence
gctaatgtgcccatttgaat

SEQ ID NO: 807212 - DNA, 20 bp, Artificial
  CRISPR gRNA sequence
atgtgcccatttgaatagtt

SEQ ID NO: 807213 - DNA, 20 bp, Artificial
  CRISPR gRNA sequence
gaatagttcaagggtcagct

SEQ ID NO: 807214 - DNA, 20 bp, Artificial
  CRISPR gRNA sequence
aatagttcaagggtcagcta

SEQ ID NO: 807215 - DNA, 20 bp, Artificial
  CRISPR gRNA sequence
aagggtcagctaatgctctg

SEQ ID NO: 807216 - DNA, 20 bp, Artificial
  CRISPR gRNA sequence
atgctctgagcttcatggct

SEQ ID NO: 807217 - DNA, 20 bp, Artificial
  CRISPR gRNA sequence
tgagcttcatggctccagta

SEQ ID NO: 807218 - DNA, 20 bp, Artificial
  CRISPR gRNA sequence
agcttcatggctccagtata

SEQ ID NO: 807219 - DNA, 20 bp, Artificial
  CRISPR gRNA sequence
catggctccagtataaagaa

SEQ ID NO: 807220 - DNA, 20 bp, Artificial
  CRISPR gRNA sequence
atggctccagtataaagaac

SEQ ID NO: 807221 - DNA, 20 bp, Artificial
  CRISPR gRNA sequence
cagtataaagaacaaattta

SEQ ID NO: 807222 - DNA, 20 bp, Artificial
  CRISPR gRNA sequence
aacaaaattaagctgttact

SEQ ID NO: 807223 - DNA, 20 bp, Artificial
  CRISPR gRNA sequence
acaaaattaagctgttactg

SEQ ID NO: 807224 - DNA, 20 bp, Artificial
  CRISPR gRNA sequence
agctgttactgtagccgagt

SEQ ID NO: 807225 - DNA, 20 bp, Artificial
  CRISPR gRNA sequence
ttactgtagccgagttaccc

SEQ ID NO: 807226 - DNA, 20 bp, Artificial
  CRISPR gRNA sequence
ctgtagccgagttacccttc

SEQ ID NO: 807227 - DNA, 20 bp, Artificial
  CRISPR gRNA sequence
tagccgagttacccttctgc

SEQ ID NO: 807228 - DNA, 20 bp, Artificial
  CRISPR gRNA sequence
cccttctgctccacacatat

SEQ ID NO: 807229 - DNA, 20 bp, Artificial
  CRISPR gRNA sequence
ctgctccacacatatgtagt

SEQ ID NO: 807230 - DNA, 20 bp, Artificial
  CRISPR gRNA sequence
tgctccacacatatgtagtg

SEQ ID NO: 807231 - DNA, 20 bp, Artificial
  CRISPR gRNA sequence
ctccacacatatgtagtggg

SEQ ID NO: 807232 - DNA, 20 bp, Artificial
  CRISPR gRNA sequence
cacacatatgtagtgggatc

SEQ ID NO: 807233 - DNA, 20 bp, Artificial
  CRISPR gRNA sequence
gcaggatttccatagtgcca

SEQ ID NO: 807234 - DNA, 20 bp, Artificial
  CRISPR gRNA sequence
caggatttccatagtgccaa

SEQ ID NO: 807235 - DNA, 20 bp, Artificial
  CRISPR gRNA sequence
ccatagtgccaattatcaaa

SEQ ID NO: 807236 - DNA, 20 bp, Artificial
  CRISPR gRNA sequence
catagtgccaattatcaaag

SEQ ID NO: 807237 - DNA, 20 bp, Artificial
  CRISPR gRNA sequence
tcaaaggccttgactactta

SEQ ID NO: 807238 - DNA, 20 bp, Artificial
  CRISPR gRNA sequence
gactacttagcattgctgta

SEQ ID NO: 807239 - DNA, 20 bp, Artificial
  CRISPR gRNA sequence
actacttagcattgctgtat

SEQ ID NO: 807240 - DNA, 20 bp, Artificial
  CRISPR gRNA sequence
cttagcattgctgtattaca

SEQ ID NO: 807241 - DNA, 20 bp, Artificial
  CRISPR gRNA sequence
agcattgctgtattacagat

SEQ ID NO: 807242 - DNA, 20 bp, Artificial
  CRISPR gRNA sequence
gcattgctgtattacagatg

SEQ ID NO: 807243 - DNA, 20 bp, Artificial
  CRISPR gRNA sequence
ctgtattacagatgtgcaaa

SEQ ID NO: 807244 - DNA, 20 bp, Artificial
  CRISPR gRNA sequence
tattacagatgtgcaaactg

SEQ ID NO: 807245 - DNA, 20 bp, Artificial
  CRISPR gRNA sequence
cagatgtgcaaactgaggca

SEQ ID NO: 807246 - DNA, 20 bp, Artificial
  CRISPR gRNA sequence
aggcactgaaaagtcaaatt

SEQ ID NO: 807247 - DNA, 20 bp, Artificial
  CRISPR gRNA sequence
aaaagtcaaatttaaagtca

SEQ ID NO: 807248 - DNA, 20 bp, Artificial
  CRISPR gRNA sequence
aaagtcatattgagggccag

SEQ ID NO: 807249 - DNA, 20 bp, Artificial
  CRISPR gRNA sequence
aagtcatattgagggccaga

SEQ ID NO: 807250 - DNA, 20 bp, Artificial
  CRISPR gRNA sequence
agggccagaaaaggaggctt

SEQ ID NO: 807251 - DNA, 20 bp, Artificial
  CRISPR gRNA sequence
agtttggggctttggccatt

SEQ ID NO: 807252 - DNA, 20 bp, Artificial
  CRISPR gRNA sequence
gtttggggctttggccattt

SEQ ID NO: 807253 - DNA, 20 bp, Artificial
  CRISPR gRNA sequence
ggggctttggccattttagc

SEQ ID NO: 807254 - DNA, 20 bp, Artificial
  CRISPR gRNA sequence
gggctttggccattttagct

SEQ ID NO: 807255 - DNA, 20 bp, Artificial
  CRISPR gRNA sequence
tggccattttagctacttat

SEQ ID NO: 807256 - DNA, 20 bp, Artificial
  CRISPR gRNA sequence
ggccattttagctacttatc

SEQ ID NO: 807257 - DNA, 20 bp, Artificial
  CRISPR gRNA sequence
gccattttagctacttatct

SEQ ID NO: 807258 - DNA, 20 bp, Artificial
  CRISPR gRNA sequence
tagctacttatctgaaattg

SEQ ID NO: 807259 - DNA, 20 bp, Artificial
  CRISPR gRNA sequence
agctacttatctgaaattgc

SEQ ID NO: 807260 - DNA, 20 bp, Artificial
  CRISPR gRNA sequence
gctacttatctgaaattgct

SEQ ID NO: 807261 - DNA, 20 bp, Artificial
  CRISPR gRNA sequence
cttatctgaaattgctgcag

SEQ ID NO: 807262 - DNA, 20 bp, Artificial
  CRISPR gRNA sequence
atctgaaattgctgcagata

SEQ ID NO: 807263 - DNA, 20 bp, Artificial
  CRISPR gRNA sequence
tctgaaattgctgcagatac

SEQ ID NO: 807264 - DNA, 20 bp, Artificial
  CRISPR gRNA sequence
aaattgctgcagatacaacg

SEQ ID NO: 807265 - DNA, 20 bp, Artificial
  CRISPR gRNA sequence
ctgcagatacaacgtatgag

SEQ ID NO: 807266 - DNA, 20 bp, Artificial
  CRISPR gRNA sequence
cagatacaacgtatgagcat

SEQ ID NO: 807267 - DNA, 20 bp, Artificial
  CRISPR gRNA sequence
ttgactgtatataattgatt

SEQ ID NO: 807268 - DNA, 20 bp, Artificial
  CRISPR gRNA sequence
tgactgtatataattgattt

SEQ ID NO: 807269 - DNA, 20 bp, Artificial
  CRISPR gRNA sequence
gactgtatataattgatttc

SEQ ID NO: 807270 - DNA, 20 bp, Artificial
  CRISPR gRNA sequence
actgtatataattgatttct

SEQ ID NO: 807271 - DNA, 20 bp, Artificial
  CRISPR gRNA sequence
tatataattgatttctaagg

SEQ ID NO: 807272 - DNA, 20 bp, Artificial
  CRISPR gRNA sequence
atttctaaggtaaaaacaaa

SEQ ID NO: 807273 - DNA, 20 bp, Artificial
  CRISPR gRNA sequence
ctaaggtaaaaacaaataaa

SEQ ID NO: 807274 - DNA, 20 bp, Artificial
  CRISPR gRNA sequence
taaggtaaaaacaaataaaa

SEQ ID NO: 807275 - DNA, 20 bp, Artificial
  CRISPR gRNA sequence
aggtaaaaacaaataaaaag

SEQ ID NO: 807276 - DNA, 20 bp, Artificial
  CRISPR gRNA sequence
ttaaaggaaagatgtagttc

SEQ ID NO: 807277 - DNA, 20 bp, Artificial
  CRISPR gRNA sequence
taaaggaaagatgtagttca

SEQ ID NO: 807278 - DNA, 20 bp, Artificial
  CRISPR gRNA sequence
aaaggaaagatgtagttcaa

SEQ ID NO: 807279 - DNA, 20 bp, Artificial
  CRISPR gRNA sequence
aaggaaagatgtagttcaaa

SEQ ID NO: 807280 - DNA, 20 bp, Artificial
  CRISPR gRNA sequence
aaaaaaaaaaccaccattaa

SEQ ID NO: 807281 - DNA, 20 bp, Artificial
  CRISPR gRNA sequence
aacatggtgccattacaggt

SEQ ID NO: 807282 - DNA, 20 bp, Artificial
  CRISPR gRNA sequence
caggttaaaacaaatgcttt

SEQ ID NO: 807283 - DNA, 20 bp, Artificial
  CRISPR gRNA sequence
aaacaaatgctttgtgactt

SEQ ID NO: 807284 - DNA, 20 bp, Artificial
  CRISPR gRNA sequence
tgtgacttagacctcaaaaa

SEQ ID NO: 807285 - DNA, 20 bp, Artificial
  CRISPR gRNA sequence
gtgacttagacctcaaaaac

SEQ ID NO: 807286 - DNA, 20 bp, Artificial
  CRISPR gRNA sequence
tgacttagacctcaaaaaca

SEQ ID NO: 807287 - DNA, 20 bp, Artificial
  CRISPR gRNA sequence
agacctcaaaaacagagctt

SEQ ID NO: 807288 - DNA, 20 bp, Artificial
  CRISPR gRNA sequence
gacctcaaaaacagagcttg

SEQ ID NO: 807289 - DNA, 20 bp, Artificial
  CRISPR gRNA sequence
aaaaacagagcttgatgact

SEQ ID NO: 807290 - DNA, 20 bp, Artificial
  CRISPR gRNA sequence
gatgactttactccacaatt

SEQ ID NO: 807291 - DNA, 20 bp, Artificial
  CRISPR gRNA sequence
atgactttactccacaattt

SEQ ID NO: 807292 - DNA, 20 bp, Artificial
  CRISPR gRNA sequence
tactccacaatttgtgcact

SEQ ID NO: 807293 - DNA, 20 bp, Artificial
  CRISPR gRNA sequence
actccacaatttgtgcactt

SEQ ID NO: 807294 - DNA, 20 bp, Artificial
  CRISPR gRNA sequence
ctccacaatttgtgcactta

SEQ ID NO: 807295 - DNA, 20 bp, Artificial
  CRISPR gRNA sequence
cacaatttgtgcacttagtg

SEQ ID NO: 807296 - DNA, 20 bp, Artificial
  CRISPR gRNA sequence
gtgcacttagtgtatattta

SEQ ID NO: 807297 - DNA, 20 bp, Artificial
  CRISPR gRNA sequence
tgcacttagtgtatatttaa

SEQ ID NO: 807298 - DNA, 20 bp, Artificial
  CRISPR gRNA sequence
agtgtatatttaaatgctct

SEQ ID NO: 807299 - DNA, 20 bp, Artificial
  CRISPR gRNA sequence
gtgtatatttaaatgctctc

SEQ ID NO: 807300 - DNA, 20 bp, Artificial
  CRISPR gRNA sequence
aaatgctctctgttaattag

SEQ ID NO: 807301 - DNA, 20 bp, Artificial
  CRISPR gRNA sequence
aatgctctctgttaattaga

SEQ ID NO: 807302 - DNA, 20 bp, Artificial
  CRISPR gRNA sequence
tctgttaattagaacaactt

SEQ ID NO: 807303 - DNA, 20 bp, Artificial
  CRISPR gRNA sequence
tgttaattagaacaacttca

SEQ ID NO: 807304 - DNA, 20 bp, Artificial
  CRISPR gRNA sequence
ttaattagaacaacttcatt

SEQ ID NO: 807305 - DNA, 20 bp, Artificial
  CRISPR gRNA sequence
attagaacaacttcattatg

SEQ ID NO: 807306 - DNA, 20 bp, Artificial
  CRISPR gRNA sequence
gaacaacttcattatgctat

SEQ ID NO: 807307 - DNA, 20 bp, Artificial
  CRISPR gRNA sequence
cattatgctatcaagattcc

SEQ ID NO: 807308 - DNA, 20 bp, Artificial
  CRISPR gRNA sequence
attatgctatcaagattcca

SEQ ID NO: 807309 - DNA, 20 bp, Artificial
  CRISPR gRNA sequence
tgctatcaagattccagtaa

SEQ ID NO: 807310 - DNA, 20 bp, Artificial
  CRISPR gRNA sequence
tcaagattccagtaatccat

SEQ ID NO: 807311 - DNA, 20 bp, Artificial
  CRISPR gRNA sequence
cagtaatccataaaacatgt

SEQ ID NO: 807312 - DNA, 20 bp, Artificial
  CRISPR gRNA sequence
tgatttgagtttgtgcgaag

SEQ ID NO: 807313 - DNA, 20 bp, Artificial
  CRISPR gRNA sequence
gagtttgtgcgaagccctgt

SEQ ID NO: 807314 - DNA, 20 bp, Artificial
  CRISPR gRNA sequence
agtttgtgcgaagccctgtc

SEQ ID NO: 807315 - DNA, 20 bp, Artificial
  CRISPR gRNA sequence
gtgcgaagccctgtctgtga

SEQ ID NO: 807316 - DNA, 20 bp, Artificial
  CRISPR gRNA sequence
tgcgaagccctgtctgtgag

SEQ ID NO: 807317 - DNA, 20 bp, Artificial
  CRISPR gRNA sequence
tctgtgagctcatagtctca

SEQ ID NO: 807318 - DNA, 20 bp, Artificial
  CRISPR gRNA sequence
tgagctcatagtctcaatag

SEQ ID NO: 807319 - DNA, 20 bp, Artificial
  CRISPR gRNA sequence
atagtctcaatagcctcttc

SEQ ID NO: 807320 - DNA, 20 bp, Artificial
  CRISPR gRNA sequence
aatagcctcttctagtaccc

SEQ ID NO: 807321 - DNA, 20 bp, Artificial
  CRISPR gRNA sequence
ttctagtacccagaggaagc

SEQ ID NO: 807322 - DNA, 20 bp, Artificial
  CRISPR gRNA sequence
ctagtacccagaggaagcta

SEQ ID NO: 807323 - DNA, 20 bp, Artificial
  CRISPR gRNA sequence
tagtacccagaggaagctat

SEQ ID NO: 807324 - DNA, 20 bp, Artificial
  CRISPR gRNA sequence
gtacccagaggaagctatag

SEQ ID NO: 807325 - DNA, 20 bp, Artificial
  CRISPR gRNA sequence
tagataaaaaataactctat

SEQ ID NO: 807326 - DNA, 20 bp, Artificial
  CRISPR gRNA sequence
tattggcaacccatctgttt

SEQ ID NO: 807327 - DNA, 20 bp, Artificial
  CRISPR gRNA sequence
ttggcaacccatctgtttct

SEQ ID NO: 807328 - DNA, 20 bp, Artificial
  CRISPR gRNA sequence
gcaacccatctgtttctgtt

SEQ ID NO: 807329 - DNA, 20 bp, Artificial
  CRISPR gRNA sequence
tttctgttactggaaatttc

SEQ ID NO: 807330 - DNA, 20 bp, Artificial
  CRISPR gRNA sequence
ctgttactggaaatttccac

SEQ ID NO: 807331 - DNA, 20 bp, Artificial
  CRISPR gRNA sequence
tgttactggaaatttccaca

SEQ ID NO: 807332 - DNA, 20 bp, Artificial
  CRISPR gRNA sequence
ttactggaaatttccacaca

SEQ ID NO: 807333 - DNA, 20 bp, Artificial
  CRISPR gRNA sequence
ctggaaatttccacacacct

SEQ ID NO: 807334 - DNA, 20 bp, Artificial
  CRISPR gRNA sequence
gaaatttccacacacctctg

SEQ ID NO: 807335 - DNA, 20 bp, Artificial
  CRISPR gRNA sequence
ccacacacctctgcttttgg

SEQ ID NO: 807336 - DNA, 20 bp, Artificial
  CRISPR gRNA sequence
cacacacctctgcttttgga

SEQ ID NO: 807337 - DNA, 20 bp, Artificial
  CRISPR gRNA sequence
tgcttttggaaatcacttag

SEQ ID NO: 807338 - DNA, 20 bp, Artificial
  CRISPR gRNA sequence
cttttggaaatcacttagaa

SEQ ID NO: 807339 - DNA, 20 bp, Artificial
  CRISPR gRNA sequence
ttggaaatcacttagaaaac

SEQ ID NO: 807340 - DNA, 20 bp, Artificial
  CRISPR gRNA sequence
tggaaatcacttagaaaact

SEQ ID NO: 807341 - DNA, 20 bp, Artificial
  CRISPR gRNA sequence
ggaaatcacttagaaaactt

SEQ ID NO: 807342 - DNA, 20 bp, Artificial
  CRISPR gRNA sequence
gaaatcacttagaaaacttg

SEQ ID NO: 807343 - DNA, 20 bp, Artificial
  CRISPR gRNA sequence
agaaaacttgaggggaaata

SEQ ID NO: 807344 - DNA, 20 bp, Artificial
  CRISPR gRNA sequence
gaaaacttgaggggaaataa

SEQ ID NO: 807345 - DNA, 20 bp, Artificial
  CRISPR gRNA sequence
gaggggaaataattcctttt

SEQ ID NO: 807346 - DNA, 20 bp, Artificial
  CRISPR gRNA sequence
aggggaaataattccttttg

SEQ ID NO: 807347 - DNA, 20 bp, Artificial
  CRISPR gRNA sequence
cttttgctttcagtctggca

SEQ ID NO: 807348 - DNA, 20 bp, Artificial
  CRISPR gRNA sequence
ttgctttcagtctggcagca

SEQ ID NO: 807349 - DNA, 20 bp, Artificial
  CRISPR gRNA sequence
tgctttcagtctggcagcaa

SEQ ID NO: 807350 - DNA, 20 bp, Artificial
  CRISPR gRNA sequence
gctttcagtctggcagcaag

SEQ ID NO: 807351 - DNA, 20 bp, Artificial
  CRISPR gRNA sequence
ctttcagtctggcagcaaga

SEQ ID NO: 807352 - DNA, 20 bp, Artificial
  CRISPR gRNA sequence
tcagtctggcagcaagaagg

SEQ ID NO: 807353 - DNA, 20 bp, Artificial
  CRISPR gRNA sequence
cagtctggcagcaagaagga

SEQ ID NO: 807354 - DNA, 20 bp, Artificial
  CRISPR gRNA sequence
agtctggcagcaagaaggat

SEQ ID NO: 807355 - DNA, 20 bp, Artificial
  CRISPR gRNA sequence
gcagcaagaaggatcctgaa

SEQ ID NO: 807356 - DNA, 20 bp, Artificial
  CRISPR gRNA sequence
aaggaattctgtgggtccag

SEQ ID NO: 807357 - DNA, 20 bp, Artificial
  CRISPR gRNA sequence
tgtgggtccaggatccagtg

SEQ ID NO: 807358 - DNA, 20 bp, Artificial
  CRISPR gRNA sequence
tgggtccaggatccagtggg

SEQ ID NO: 807359 - DNA, 20 bp, Artificial
  CRISPR gRNA sequence
tgtaaagtgcagtagtgctt

SEQ ID NO: 807360 - DNA, 20 bp, Artificial
  CRISPR gRNA sequence
taaagtgcagtagtgcttgc

SEQ ID NO: 807361 - DNA, 20 bp, Artificial
  CRISPR gRNA sequence
gcttaaagccataggctcca

SEQ ID NO: 807362 - DNA, 20 bp, Artificial
  CRISPR gRNA sequence
cttaaagccataggctccag

SEQ ID NO: 807363 - DNA, 20 bp, Artificial
  CRISPR gRNA sequence
aaagccataggctccagagg

SEQ ID NO: 807364 - DNA, 20 bp, Artificial
  CRISPR gRNA sequence
aagccataggctccagaggt

SEQ ID NO: 807365 - DNA, 20 bp, Artificial
  CRISPR gRNA sequence
cagaggtgagtccagatcag

SEQ ID NO: 807366 - DNA, 20 bp, Artificial
  CRISPR gRNA sequence
catggccaggtgttggctag

SEQ ID NO: 807367 - DNA, 20 bp, Artificial
  CRISPR gRNA sequence
atggccaggtgttggctagt

SEQ ID NO: 807368 - DNA, 20 bp, Artificial
  CRISPR gRNA sequence
gctagtcttgttgcaggttt

SEQ ID NO: 807369 - DNA, 20 bp, Artificial
  CRISPR gRNA sequence
gtcttgttgcaggtttcaga

SEQ ID NO: 807370 - DNA, 20 bp, Artificial
  CRISPR gRNA sequence
gttgcaggtttcagattaaa

SEQ ID NO: 807371 - DNA, 20 bp, Artificial
  CRISPR gRNA sequence
ttgcaggtttcagattaaag

SEQ ID NO: 807372 - DNA, 20 bp, Artificial
  CRISPR gRNA sequence
caggtttcagattaaagtgc

SEQ ID NO: 807373 - DNA, 20 bp, Artificial
  CRISPR gRNA sequence
cagattaaagtgctgggtca

SEQ ID NO: 807374 - DNA, 20 bp, Artificial
  CRISPR gRNA sequence
agattaaagtgctgggtcat

SEQ ID NO: 807375 - DNA, 20 bp, Artificial
  CRISPR gRNA sequence
aagtgctgggtcatccaaag

SEQ ID NO: 807376 - DNA, 20 bp, Artificial
  CRISPR gRNA sequence
ggtcatccaaaggcatttga

SEQ ID NO: 807377 - DNA, 20 bp, Artificial
  CRISPR gRNA sequence
gaaaagtgcaaatggcaagc

SEQ ID NO: 807378 - DNA, 20 bp, Artificial
  CRISPR gRNA sequence
aaaagtgcaaatggcaagct

SEQ ID NO: 807379 - DNA, 20 bp, Artificial
  CRISPR gRNA sequence
tgcaggccaccgaattcttg

SEQ ID NO: 807380 - DNA, 20 bp, Artificial
  CRISPR gRNA sequence
caggccaccgaattcttgtt

SEQ ID NO: 807381 - DNA, 20 bp, Artificial
  CRISPR gRNA sequence
ttgttcagagtccagaagct

SEQ ID NO: 807382 - DNA, 20 bp, Artificial
  CRISPR gRNA sequence
gttcagagtccagaagcttc

SEQ ID NO: 807383 - DNA, 20 bp, Artificial
  CRISPR gRNA sequence
ttcagagtccagaagcttct

SEQ ID NO: 807384 - DNA, 20 bp, Artificial
  CRISPR gRNA sequence
agagtccagaagcttcttta

SEQ ID NO: 807385 - DNA, 20 bp, Artificial
  CRISPR gRNA sequence
ctttagatgtcatatcaggt

SEQ ID NO: 807386 - DNA, 20 bp, Artificial
  CRISPR gRNA sequence
tttagatgtcatatcaggtc

SEQ ID NO: 807387 - DNA, 20 bp, Artificial
  CRISPR gRNA sequence
tagatgtcatatcaggtcac

SEQ ID NO: 807388 - DNA, 20 bp, Artificial
  CRISPR gRNA sequence
agatgtcatatcaggtcacc

SEQ ID NO: 807389 - DNA, 20 bp, Artificial
  CRISPR gRNA sequence
gatgtcatatcaggtcaccc

SEQ ID NO: 807390 - DNA, 20 bp, Artificial
  CRISPR gRNA sequence
gctcccaagaccacaggttc

SEQ ID NO: 807391 - DNA, 20 bp, Artificial
  CRISPR gRNA sequence
ccaagaccacaggttcagat

SEQ ID NO: 807392 - DNA, 20 bp, Artificial
  CRISPR gRNA sequence
agatctggggagaaaagccc

SEQ ID NO: 807393 - DNA, 20 bp, Artificial
  CRISPR gRNA sequence
gggagaaaagcccacaaata

SEQ ID NO: 807394 - DNA, 20 bp, Artificial
  CRISPR gRNA sequence
tttatgattagaaaatatat

SEQ ID NO: 807395 - DNA, 20 bp, Artificial
  CRISPR gRNA sequence
ttatgattagaaaatatata

SEQ ID NO: 807396 - DNA, 20 bp, Artificial
  CRISPR gRNA sequence
tatgattagaaaatatataa

SEQ ID NO: 807397 - DNA, 20 bp, Artificial
  CRISPR gRNA sequence
atgattagaaaatatataac

SEQ ID NO: 807398 - DNA, 20 bp, Artificial
  CRISPR gRNA sequence
tgattagaaaatatataacc

SEQ ID NO: 807399 - DNA, 20 bp, Artificial
  CRISPR gRNA sequence
gaaaatatataacctcccca

SEQ ID NO: 807400 - DNA, 20 bp, Artificial
  CRISPR gRNA sequence
cccaaaatttgagtgaggaa

SEQ ID NO: 807401 - DNA, 20 bp, Artificial
  CRISPR gRNA sequence
gagtgaggaactaatttttt

SEQ ID NO: 807402 - DNA, 20 bp, Artificial
  CRISPR gRNA sequence
agtgaggaactaattttttt

SEQ ID NO: 807403 - DNA, 20 bp, Artificial
  CRISPR gRNA sequence
atttttttaaaaaagttcat

SEQ ID NO: 807404 - DNA, 20 bp, Artificial
  CRISPR gRNA sequence
ttttaaaaaagttcatctag

SEQ ID NO: 807405 - DNA, 20 bp, Artificial
  CRISPR gRNA sequence
tttaaaaaagttcatctagc

SEQ ID NO: 807406 - DNA, 20 bp, Artificial
  CRISPR gRNA sequence
ttaaaaaagttcatctagct

SEQ ID NO: 807407 - DNA, 20 bp, Artificial
  CRISPR gRNA sequence
taaaaaagttcatctagctg

SEQ ID NO: 807408 - DNA, 20 bp, Artificial
  CRISPR gRNA sequence
aaaaaagttcatctagctgg

SEQ ID NO: 807409 - DNA, 20 bp, Artificial
  CRISPR gRNA sequence
aaaaagttcatctagctgga

SEQ ID NO: 807410 - DNA, 20 bp, Artificial
  CRISPR gRNA sequence
atctagctggaagccgcatg

SEQ ID NO: 807411 - DNA, 20 bp, Artificial
  CRISPR gRNA sequence
gctggaagccgcatggttta

SEQ ID NO: 807412 - DNA, 20 bp, Artificial
  CRISPR gRNA sequence
gaagccgcatggtttaaaac

SEQ ID NO: 807413 - DNA, 20 bp, Artificial
  CRISPR gRNA sequence
aaaacttttcatttaaaact

SEQ ID NO: 807414 - DNA, 20 bp, Artificial
  CRISPR gRNA sequence
aaacttttcatttaaaactt

SEQ ID NO: 807415 - DNA, 20 bp, Artificial
  CRISPR gRNA sequence
ttcatttaaaacttctttcc

SEQ ID NO: 807416 - DNA, 20 bp, Artificial
  CRISPR gRNA sequence
tcatttaaaacttctttcca

SEQ ID NO: 807417 - DNA, 20 bp, Artificial
  CRISPR gRNA sequence
catttaaaacttctttccac

SEQ ID NO: 807418 - DNA, 20 bp, Artificial
  CRISPR gRNA sequence
atttaaaacttctttccaca

SEQ ID NO: 807419 - DNA, 20 bp, Artificial
  CRISPR gRNA sequence
aaaacttctttccacagttt

SEQ ID NO: 807420 - DNA, 20 bp, Artificial
  CRISPR gRNA sequence
aaacttctttccacagtttt

SEQ ID NO: 807421 - DNA, 20 bp, Artificial
  CRISPR gRNA sequence
ctttccacagtttttaccat

SEQ ID NO: 807422 - DNA, 20 bp, Artificial
  CRISPR gRNA sequence
tttccacagtttttaccatt

SEQ ID NO: 807423 - DNA, 20 bp, Artificial
  CRISPR gRNA sequence
tccacagtttttaccattgc

SEQ ID NO: 807424 - DNA, 20 bp, Artificial
  CRISPR gRNA sequence
ccacagtttttaccattgcc

SEQ ID NO: 807425 - DNA, 20 bp, Artificial
  CRISPR gRNA sequence
cacagtttttaccattgccc

SEQ ID NO: 807426 - DNA, 20 bp, Artificial
  CRISPR gRNA sequence
ttaccattgccctagtccaa

SEQ ID NO: 807427 - DNA, 20 bp, Artificial
  CRISPR gRNA sequence
taccattgccctagtccaag

SEQ ID NO: 807428 - DNA, 20 bp, Artificial
  CRISPR gRNA sequence
accattgccctagtccaagt

SEQ ID NO: 807429 - DNA, 20 bp, Artificial
  CRISPR gRNA sequence
ccattgccctagtccaagtc

SEQ ID NO: 807430 - DNA, 20 bp, Artificial
  CRISPR gRNA sequence
ccctagtccaagtcttcagc

SEQ ID NO: 807431 - DNA, 20 bp, Artificial
  CRISPR gRNA sequence
gtccaagtcttcagcttctc

SEQ ID NO: 807432 - DNA, 20 bp, Artificial
  CRISPR gRNA sequence
cagcttctctcctcagacct

SEQ ID NO: 807433 - DNA, 20 bp, Artificial
  CRISPR gRNA sequence
agcttctctcctcagaccta

SEQ ID NO: 807434 - DNA, 20 bp, Artificial
  CRISPR gRNA sequence
ctctcctcagacctattgca

SEQ ID NO: 807435 - DNA, 20 bp, Artificial
  CRISPR gRNA sequence
tctcctcagacctattgcaa

SEQ ID NO: 807436 - DNA, 20 bp, Artificial
  CRISPR gRNA sequence
tcctcagacctattgcaaga

SEQ ID NO: 807437 - DNA, 20 bp, Artificial
  CRISPR gRNA sequence
ctcagacctattgcaagagc

SEQ ID NO: 807438 - DNA, 20 bp, Artificial
  CRISPR gRNA sequence
agacctattgcaagagctgt

SEQ ID NO: 807439 - DNA, 20 bp, Artificial
  CRISPR gRNA sequence
ttgcaagagctgttcctctt

SEQ ID NO: 807440 - DNA, 20 bp, Artificial
  CRISPR gRNA sequence
caagagctgttcctcttcca

SEQ ID NO: 807441 - DNA, 20 bp, Artificial
  CRISPR gRNA sequence
ttcctcttccattctttggg

SEQ ID NO: 807442 - DNA, 20 bp, Artificial
  CRISPR gRNA sequence
ctcttccattctttgggcca

SEQ ID NO: 807443 - DNA, 20 bp, Artificial
  CRISPR gRNA sequence
ttccattctttgggccacac

SEQ ID NO: 807444 - DNA, 20 bp, Artificial
  CRISPR gRNA sequence
ccattctttgggccacacat

SEQ ID NO: 807445 - DNA, 20 bp, Artificial
  CRISPR gRNA sequence
cattctttgggccacacata

SEQ ID NO: 807446 - DNA, 20 bp, Artificial
  CRISPR gRNA sequence
tttgggccacacatagttca

SEQ ID NO: 807447 - DNA, 20 bp, Artificial
  CRISPR gRNA sequence
tgggccacacatagttcagt

SEQ ID NO: 807448 - DNA, 20 bp, Artificial
  CRISPR gRNA sequence
gggccacacatagttcagta

SEQ ID NO: 807449 - DNA, 20 bp, Artificial
  CRISPR gRNA sequence
ggccacacatagttcagtaa

SEQ ID NO: 807450 - DNA, 20 bp, Artificial
  CRISPR gRNA sequence
agtaatattggagcacattt

SEQ ID NO: 807451 - DNA, 20 bp, Artificial
  CRISPR gRNA sequence
gagcacatttcaggggcctc

SEQ ID NO: 807452 - DNA, 20 bp, Artificial
  CRISPR gRNA sequence
caggggcctctcctattcaa

SEQ ID NO: 807453 - DNA, 20 bp, Artificial
  CRISPR gRNA sequence
aggggcctctcctattcaaa

SEQ ID NO: 807454 - DNA, 20 bp, Artificial
  CRISPR gRNA sequence
tcctattcaaaacctcttat

SEQ ID NO: 807455 - DNA, 20 bp, Artificial
  CRISPR gRNA sequence
ctattcaaaacctcttatag

SEQ ID NO: 807456 - DNA, 20 bp, Artificial
  CRISPR gRNA sequence
ttcaaaacctcttatagttc

SEQ ID NO: 807457 - DNA, 20 bp, Artificial
  CRISPR gRNA sequence
aaaacctcttatagttccct

SEQ ID NO: 807458 - DNA, 20 bp, Artificial
  CRISPR gRNA sequence
ttatagttccctattgtgtc

SEQ ID NO: 807459 - DNA, 20 bp, Artificial
  CRISPR gRNA sequence
atagttccctattgtgtcag

SEQ ID NO: 807460 - DNA, 20 bp, Artificial
  CRISPR gRNA sequence
tagttccctattgtgtcaga

SEQ ID NO: 807461 - DNA, 20 bp, Artificial
  CRISPR gRNA sequence
cctattgtgtcagatatttc

SEQ ID NO: 807462 - DNA, 20 bp, Artificial
  CRISPR gRNA sequence
ttgtgtcagatatttctatt

SEQ ID NO: 807463 - DNA, 20 bp, Artificial
  CRISPR gRNA sequence
tgtcagatatttctattaat

SEQ ID NO: 807464 - DNA, 20 bp, Artificial
  CRISPR gRNA sequence
ctattaattcctgcagactc

SEQ ID NO: 807465 - DNA, 20 bp, Artificial
  CRISPR gRNA sequence
tattaattcctgcagactca

SEQ ID NO: 807466 - DNA, 20 bp, Artificial
  CRISPR gRNA sequence
ttaattcctgcagactcatt

SEQ ID NO: 807467 - DNA, 20 bp, Artificial
  CRISPR gRNA sequence
attcctgcagactcattatt

SEQ ID NO: 807468 - DNA, 20 bp, Artificial
  CRISPR gRNA sequence
ctgcagactcattattcacc

SEQ ID NO: 807469 - DNA, 20 bp, Artificial
  CRISPR gRNA sequence
cagactcattattcaccctg

SEQ ID NO: 807470 - DNA, 20 bp, Artificial
  CRISPR gRNA sequence
attattcaccctgctgcact

SEQ ID NO: 807471 - DNA, 20 bp, Artificial
  CRISPR gRNA sequence
ttcaccctgctgcactctat

SEQ ID NO: 807472 - DNA, 20 bp, Artificial
  CRISPR gRNA sequence
accctgctgcactctattca

SEQ ID NO: 807473 - DNA, 20 bp, Artificial
  CRISPR gRNA sequence
ctgcactctattcatgctcc

SEQ ID NO: 807474 - DNA, 20 bp, Artificial
  CRISPR gRNA sequence
cactctattcatgctccagg

SEQ ID NO: 807475 - DNA, 20 bp, Artificial
  CRISPR gRNA sequence
tattcatgctccaggatgat

SEQ ID NO: 807476 - DNA, 20 bp, Artificial
  CRISPR gRNA sequence
ttcatgctccaggatgatga

SEQ ID NO: 807477 - DNA, 20 bp, Artificial
  CRISPR gRNA sequence
atgctccaggatgatgacat

SEQ ID NO: 807478 - DNA, 20 bp, Artificial
  CRISPR gRNA sequence
caggatgatgacattgcaga

SEQ ID NO: 807479 - DNA, 20 bp, Artificial
  CRISPR gRNA sequence
cagactgcatcactgggctc

SEQ ID NO: 807480 - DNA, 20 bp, Artificial
  CRISPR gRNA sequence
catcactgggctcctccctc

SEQ ID NO: 807481 - DNA, 20 bp, Artificial
  CRISPR gRNA sequence
ggctcctccctctgtctttg

SEQ ID NO: 807482 - DNA, 20 bp, Artificial
  CRISPR gRNA sequence
ctccctctgtctttgactgg

SEQ ID NO: 807483 - DNA, 20 bp, Artificial
  CRISPR gRNA sequence
cctctgtctttgactgggct

SEQ ID NO: 807484 - DNA, 20 bp, Artificial
  CRISPR gRNA sequence
tgtctttgactgggctcagt

SEQ ID NO: 807485 - DNA, 20 bp, Artificial
  CRISPR gRNA sequence
tctttgactgggctcagtct

SEQ ID NO: 807486 - DNA, 20 bp, Artificial
  CRISPR gRNA sequence
tgactgggctcagtctaggg

SEQ ID NO: 807487 - DNA, 20 bp, Artificial
  CRISPR gRNA sequence
gactgggctcagtctagggg

SEQ ID NO: 807488 - DNA, 20 bp, Artificial
  CRISPR gRNA sequence
actgggctcagtctagggga

SEQ ID NO: 807489 - DNA, 20 bp, Artificial
  CRISPR gRNA sequence
ggctcagtctaggggaaaaa

SEQ ID NO: 807490 - DNA, 20 bp, Artificial
  CRISPR gRNA sequence
agtctaggggaaaaagagtg

SEQ ID NO: 807491 - DNA, 20 bp, Artificial
  CRISPR gRNA sequence
ggggaaaaagagtgttgcag

SEQ ID NO: 807492 - DNA, 20 bp, Artificial
  CRISPR gRNA sequence
cagtgggttgagagagaggt

SEQ ID NO: 807493 - DNA, 20 bp, Artificial
  CRISPR gRNA sequence
agagagaggttggggtatct

SEQ ID NO: 807494 - DNA, 20 bp, Artificial
  CRISPR gRNA sequence
gggtatctattcctcagcaa

SEQ ID NO: 807495 - DNA, 20 bp, Artificial
  CRISPR gRNA sequence
ttcctcagcaacctcccaga

SEQ ID NO: 807496 - DNA, 20 bp, Artificial
  CRISPR gRNA sequence
ctcagcaacctcccagacaa

SEQ ID NO: 807497 - DNA, 20 bp, Artificial
  CRISPR gRNA sequence
agcaacctcccagacaagtt

SEQ ID NO: 807498 - DNA, 20 bp, Artificial
  CRISPR gRNA sequence
ccagacaagttgtgggttga

SEQ ID NO: 807499 - DNA, 20 bp, Artificial
  CRISPR gRNA sequence
tgggttgactttgtccctct

SEQ ID NO: 807500 - DNA, 20 bp, Artificial
  CRISPR gRNA sequence
actttgtccctctgttaaag

SEQ ID NO: 807501 - DNA, 20 bp, Artificial
  CRISPR gRNA sequence
tgtccctctgttaaagacca

SEQ ID NO: 807502 - DNA, 20 bp, Artificial
  CRISPR gRNA sequence
gtccctctgttaaagaccat

SEQ ID NO: 807503 - DNA, 20 bp, Artificial
  CRISPR gRNA sequence
tccctctgttaaagaccata

SEQ ID NO: 807504 - DNA, 20 bp, Artificial
  CRISPR gRNA sequence
tgttaaagaccataggtcct

SEQ ID NO: 807505 - DNA, 20 bp, Artificial
  CRISPR gRNA sequence
ttaaagaccataggtcctgc

SEQ ID NO: 807506 - DNA, 20 bp, Artificial
  CRISPR gRNA sequence
aagaccataggtcctgccag

SEQ ID NO: 807507 - DNA, 20 bp, Artificial
  CRISPR gRNA sequence
ccagatggacctttctcatt

SEQ ID NO: 807508 - DNA, 20 bp, Artificial
  CRISPR gRNA sequence
tctcattgccatttttacta

SEQ ID NO: 807509 - DNA, 20 bp, Artificial
  CRISPR gRNA sequence
ctcattgccatttttactag

SEQ ID NO: 807510 - DNA, 20 bp, Artificial
  CRISPR gRNA sequence
tcattgccatttttactagg

SEQ ID NO: 807511 - DNA, 20 bp, Artificial
  CRISPR gRNA sequence
attgccatttttactagggt

SEQ ID NO: 807512 - DNA, 20 bp, Artificial
  CRISPR gRNA sequence
ccatttttactagggttctg

SEQ ID NO: 807513 - DNA, 20 bp, Artificial
  CRISPR gRNA sequence
ttactagggttctgggaact

SEQ ID NO: 807514 - DNA, 20 bp, Artificial
  CRISPR gRNA sequence
tactagggttctgggaactg

SEQ ID NO: 807515 - DNA, 20 bp, Artificial
  CRISPR gRNA sequence
actagggttctgggaactgc

SEQ ID NO: 807516 - DNA, 20 bp, Artificial
  CRISPR gRNA sequence
ctagggttctgggaactgct

SEQ ID NO: 807517 - DNA, 20 bp, Artificial
  CRISPR gRNA sequence
gggttctgggaactgctccc

SEQ ID NO: 807518 - DNA, 20 bp, Artificial
  CRISPR gRNA sequence
tgggaactgctccctcccct

SEQ ID NO: 807519 - DNA, 20 bp, Artificial
  CRISPR gRNA sequence
ggaactgctccctccccttt

SEQ ID NO: 807520 - DNA, 20 bp, Artificial
  CRISPR gRNA sequence
ctccctcccctttctccttc

SEQ ID NO: 807521 - DNA, 20 bp, Artificial
  CRISPR gRNA sequence
cctcccctttctccttcaga

SEQ ID NO: 807522 - DNA, 20 bp, Artificial
  CRISPR gRNA sequence
ccctttctccttcagaccta

SEQ ID NO: 807523 - DNA, 20 bp, Artificial
  CRISPR gRNA sequence
tctccttcagacctaggaat

SEQ ID NO: 807524 - DNA, 20 bp, Artificial
  CRISPR gRNA sequence
ctccttcagacctaggaata

SEQ ID NO: 807525 - DNA, 20 bp, Artificial
  CRISPR gRNA sequence
tccttcagacctaggaatag

SEQ ID NO: 807526 - DNA, 20 bp, Artificial
  CRISPR gRNA sequence
cttcagacctaggaatagtc

SEQ ID NO: 807527 - DNA, 20 bp, Artificial
  CRISPR gRNA sequence
cagacctaggaatagtcacc

SEQ ID NO: 807528 - DNA, 20 bp, Artificial
  CRISPR gRNA sequence
agacctaggaatagtcacct

SEQ ID NO: 807529 - DNA, 20 bp, Artificial
  CRISPR gRNA sequence
ggaatagtcaccttccctgc

SEQ ID NO: 807530 - DNA, 20 bp, Artificial
  CRISPR gRNA sequence
ccctgcctgctcttgcatcc

SEQ ID NO: 807531 - DNA, 20 bp, Artificial
  CRISPR gRNA sequence
cctgcctgctcttgcatcct

SEQ ID NO: 807532 - DNA, 20 bp, Artificial
  CRISPR gRNA sequence
cctgctcttgcatcctggca

SEQ ID NO: 807533 - DNA, 20 bp, Artificial
  CRISPR gRNA sequence
ctcttgcatcctggcatgct

SEQ ID NO: 807534 - DNA, 20 bp, Artificial
  CRISPR gRNA sequence
ttgcatcctggcatgctcag

SEQ ID NO: 807535 - DNA, 20 bp, Artificial
  CRISPR gRNA sequence
gcatcctggcatgctcagta

SEQ ID NO: 807536 - DNA, 20 bp, Artificial
  CRISPR gRNA sequence
catcctggcatgctcagtat

SEQ ID NO: 807537 - DNA, 20 bp, Artificial
  CRISPR gRNA sequence
gcatgctcagtatcccttgc

SEQ ID NO: 807538 - DNA, 20 bp, Artificial
  CRISPR gRNA sequence
agtatcccttgctggtttcc

SEQ ID NO: 807539 - DNA, 20 bp, Artificial
  CRISPR gRNA sequence
gctggtttcccttaatgctg

SEQ ID NO: 807540 - DNA, 20 bp, Artificial
  CRISPR gRNA sequence
ctggtttcccttaatgctgc

SEQ ID NO: 807541 - DNA, 20 bp, Artificial
  CRISPR gRNA sequence
gtttcccttaatgctgcaca

SEQ ID NO: 807542 - DNA, 20 bp, Artificial
  CRISPR gRNA sequence
cccttaatgctgcacacacc

SEQ ID NO: 807543 - DNA, 20 bp, Artificial
  CRISPR gRNA sequence
ccttaatgctgcacacacct

SEQ ID NO: 807544 - DNA, 20 bp, Artificial
  CRISPR gRNA sequence
aatgctgcacacacctttat

SEQ ID NO: 807545 - DNA, 20 bp, Artificial
  CRISPR gRNA sequence
atgctgcacacacctttata

SEQ ID NO: 807546 - DNA, 20 bp, Artificial
  CRISPR gRNA sequence
cacacacctttataaattaa

SEQ ID NO: 807547 - DNA, 20 bp, Artificial
  CRISPR gRNA sequence
tataaattaaacttgcctca

SEQ ID NO: 807548 - DNA, 20 bp, Artificial
  CRISPR gRNA sequence
ataaattaaacttgcctcag

SEQ ID NO: 807549 - DNA, 20 bp, Artificial
  CRISPR gRNA sequence
taaattaaacttgcctcagt

SEQ ID NO: 807550 - DNA, 20 bp, Artificial
  CRISPR gRNA sequence
aacttgcctcagttacctct

SEQ ID NO: 807551 - DNA, 20 bp, Artificial
  CRISPR gRNA sequence
gcctcagttacctcttctaa

SEQ ID NO: 807552 - DNA, 20 bp, Artificial
  CRISPR gRNA sequence
cctcagttacctcttctaag

SEQ ID NO: 807553 - DNA, 20 bp, Artificial
  CRISPR gRNA sequence
agttacctcttctaagcata

SEQ ID NO: 807554 - DNA, 20 bp, Artificial
  CRISPR gRNA sequence
cctcttctaagcataccctc

SEQ ID NO: 807555 - DNA, 20 bp, Artificial
  CRISPR gRNA sequence
ttctaagcataccctccatt

SEQ ID NO: 807556 - DNA, 20 bp, Artificial
  CRISPR gRNA sequence
ctaagcataccctccatttc

SEQ ID NO: 807557 - DNA, 20 bp, Artificial
  CRISPR gRNA sequence
taagcataccctccatttcc

SEQ ID NO: 807558 - DNA, 20 bp, Artificial
  CRISPR gRNA sequence
agcataccctccatttcctg

SEQ ID NO: 807559 - DNA, 20 bp, Artificial
  CRISPR gRNA sequence
catttcctgctaggatctaa

SEQ ID NO: 807560 - DNA, 20 bp, Artificial
  CRISPR gRNA sequence
cctgctaggatctaactgaa

SEQ ID NO: 807561 - DNA, 20 bp, Artificial
  CRISPR gRNA sequence
ctgctaggatctaactgaag

SEQ ID NO: 807562 - DNA, 20 bp, Artificial
  CRISPR gRNA sequence
ctaggatctaactgaagcac

SEQ ID NO: 807563 - DNA, 20 bp, Artificial
  CRISPR gRNA sequence
ggatctaactgaagcactct

SEQ ID NO: 807564 - DNA, 20 bp, Artificial
  CRISPR gRNA sequence
actgaagcactcttgcttag

SEQ ID NO: 807565 - DNA, 20 bp, Artificial
  CRISPR gRNA sequence
aagcactcttgcttagtaag

SEQ ID NO: 807566 - DNA, 20 bp, Artificial
  CRISPR gRNA sequence
ttgcttagtaagtaaaatct

SEQ ID NO: 807567 - DNA, 20 bp, Artificial
  CRISPR gRNA sequence
gcttagtaagtaaaatctaa

SEQ ID NO: 807568 - DNA, 20 bp, Artificial
  CRISPR gRNA sequence
cttagtaagtaaaatctaac

SEQ ID NO: 807569 - DNA, 20 bp, Artificial
  CRISPR gRNA sequence
agtaagtaaaatctaacttt

SEQ ID NO: 807570 - DNA, 20 bp, Artificial
  CRISPR gRNA sequence
gtaagtaaaatctaactttt

SEQ ID NO: 807571 - DNA, 20 bp, Artificial
  CRISPR gRNA sequence
acttttgcctggaattagtg

SEQ ID NO: 807572 - DNA, 20 bp, Artificial
  CRISPR gRNA sequence
ttgcctggaattagtggttt

SEQ ID NO: 807573 - DNA, 20 bp, Artificial
  CRISPR gRNA sequence
tgcctggaattagtggttta

SEQ ID NO: 807574 - DNA, 20 bp, Artificial
  CRISPR gRNA sequence
gcctggaattagtggtttac

SEQ ID NO: 807575 - DNA, 20 bp, Artificial
  CRISPR gRNA sequence
cctggaattagtggtttaca

SEQ ID NO: 807576 - DNA, 20 bp, Artificial
  CRISPR gRNA sequence
gaattagtggtttacaatac

SEQ ID NO: 807577 - DNA, 20 bp, Artificial
  CRISPR gRNA sequence
gtggtttacaatacatgccc

SEQ ID NO: 807578 - DNA, 20 bp, Artificial
  CRISPR gRNA sequence
acaatacatgccctaacagt

SEQ ID NO: 807579 - DNA, 20 bp, Artificial
  CRISPR gRNA sequence
caatacatgccctaacagtc

SEQ ID NO: 807580 - DNA, 20 bp, Artificial
  CRISPR gRNA sequence
acagtctttcccccttatct

SEQ ID NO: 807581 - DNA, 20 bp, Artificial
  CRISPR gRNA sequence
tcccccttatctcacacctg

SEQ ID NO: 807582 - DNA, 20 bp, Artificial
  CRISPR gRNA sequence
cccccttatctcacacctgg

SEQ ID NO: 807583 - DNA, 20 bp, Artificial
  CRISPR gRNA sequence
ccccttatctcacacctggc

SEQ ID NO: 807584 - DNA, 20 bp, Artificial
  CRISPR gRNA sequence
atctcacacctggctttctc

SEQ ID NO: 807585 - DNA, 20 bp, Artificial
  CRISPR gRNA sequence
tctcacacctggctttctct

SEQ ID NO: 807586 - DNA, 20 bp, Artificial
  CRISPR gRNA sequence
acacctggctttctctctga

SEQ ID NO: 807587 - DNA, 20 bp, Artificial
  CRISPR gRNA sequence
gctttctctctgaacggggt

SEQ ID NO: 807588 - DNA, 20 bp, Artificial
  CRISPR gRNA sequence
tctctctgaacggggtcacg

SEQ ID NO: 807589 - DNA, 20 bp, Artificial
  CRISPR gRNA sequence
ctctctgaacggggtcacgt

SEQ ID NO: 807590 - DNA, 20 bp, Artificial
  CRISPR gRNA sequence
tctctgaacggggtcacgtg

SEQ ID NO: 807591 - DNA, 20 bp, Artificial
  CRISPR gRNA sequence
tctgaacggggtcacgtgca

SEQ ID NO: 807592 - DNA, 20 bp, Artificial
  CRISPR gRNA sequence
tgaacggggtcacgtgcact

SEQ ID NO: 807593 - DNA, 20 bp, Artificial
  CRISPR gRNA sequence
aacggggtcacgtgcacttt

SEQ ID NO: 807594 - DNA, 20 bp, Artificial
  CRISPR gRNA sequence
tcccacaccttcctgcctct

SEQ ID NO: 807595 - DNA, 20 bp, Artificial
  CRISPR gRNA sequence
cccacaccttcctgcctctc

SEQ ID NO: 807596 - DNA, 20 bp, Artificial
  CRISPR gRNA sequence
ccacaccttcctgcctctct

SEQ ID NO: 807597 - DNA, 20 bp, Artificial
  CRISPR gRNA sequence
cctgcctctctgcctttcct

SEQ ID NO: 807598 - DNA, 20 bp, Artificial
  CRISPR gRNA sequence
ctgcctctctgcctttcctg

SEQ ID NO: 807599 - DNA, 20 bp, Artificial
  CRISPR gRNA sequence
cctctctgcctttcctgtta

SEQ ID NO: 807600 - DNA, 20 bp, Artificial
  CRISPR gRNA sequence
tctgcctttcctgttagtgt

SEQ ID NO: 807601 - DNA, 20 bp, Artificial
  CRISPR gRNA sequence
tgcctttcctgttagtgtct

SEQ ID NO: 807602 - DNA, 20 bp, Artificial
  CRISPR gRNA sequence
cctttcctgttagtgtctcc

SEQ ID NO: 807603 - DNA, 20 bp, Artificial
  CRISPR gRNA sequence
tcctgttagtgtctcctcta

SEQ ID NO: 807604 - DNA, 20 bp, Artificial
  CRISPR gRNA sequence
cctgttagtgtctcctctat

SEQ ID NO: 807605 - DNA, 20 bp, Artificial
  CRISPR gRNA sequence
ctgttagtgtctcctctatc

SEQ ID NO: 807606 - DNA, 20 bp, Artificial
  CRISPR gRNA sequence
ttagtgtctcctctatctag

SEQ ID NO: 807607 - DNA, 20 bp, Artificial
  CRISPR gRNA sequence
gtgtctcctctatctagaag

SEQ ID NO: 807608 - DNA, 20 bp, Artificial
  CRISPR gRNA sequence
ctctatctagaagagtttgc

SEQ ID NO: 807609 - DNA, 20 bp, Artificial
  CRISPR gRNA sequence
tatctagaagagtttgctgt

SEQ ID NO: 807610 - DNA, 20 bp, Artificial
  CRISPR gRNA sequence
tctagaagagtttgctgttt

SEQ ID NO: 807611 - DNA, 20 bp, Artificial
  CRISPR gRNA sequence
gaagagtttgctgtttccat

SEQ ID NO: 807612 - DNA, 20 bp, Artificial
  CRISPR gRNA sequence
gctgtttccatttcttcctg

SEQ ID NO: 807613 - DNA, 20 bp, Artificial
  CRISPR gRNA sequence
ctgtttccatttcttcctga

SEQ ID NO: 807614 - DNA, 20 bp, Artificial
  CRISPR gRNA sequence
tttccatttcttcctgattc

SEQ ID NO: 807615 - DNA, 20 bp, Artificial
  CRISPR gRNA sequence
ccatttcttcctgattcaaa

SEQ ID NO: 807616 - DNA, 20 bp, Artificial
  CRISPR gRNA sequence
catttcttcctgattcaaaa

SEQ ID NO: 807617 - DNA, 20 bp, Artificial
  CRISPR gRNA sequence
cttcctgattcaaaagtcac

SEQ ID NO: 807618 - DNA, 20 bp, Artificial
  CRISPR gRNA sequence
ttcctgattcaaaagtcacc

SEQ ID NO: 807619 - DNA, 20 bp, Artificial
  CRISPR gRNA sequence
cctgattcaaaagtcacctt

SEQ ID NO: 807620 - DNA, 20 bp, Artificial
  CRISPR gRNA sequence
ctgattcaaaagtcaccttc

SEQ ID NO: 807621 - DNA, 20 bp, Artificial
  CRISPR gRNA sequence
attcaaaagtcaccttctcc

SEQ ID NO: 807622 - DNA, 20 bp, Artificial
  CRISPR gRNA sequence
aaaagtcaccttctccatga

SEQ ID NO: 807623 - DNA, 20 bp, Artificial
  CRISPR gRNA sequence
ctccatgaaaactttcttct

SEQ ID NO: 807624 - DNA, 20 bp, Artificial
  CRISPR gRNA sequence
tccatgaaaactttcttctt

SEQ ID NO: 807625 - DNA, 20 bp, Artificial
  CRISPR gRNA sequence
catgaaaactttcttcttcc

SEQ ID NO: 807626 - DNA, 20 bp, Artificial
  CRISPR gRNA sequence
tcttcttccctgattatccc

SEQ ID NO: 807627 - DNA, 20 bp, Artificial
  CRISPR gRNA sequence
cttcttccctgattatcccc

SEQ ID NO: 807628 - DNA, 20 bp, Artificial
  CRISPR gRNA sequence
ttcttccctgattatcccca

SEQ ID NO: 807629 - DNA, 20 bp, Artificial
  CRISPR gRNA sequence
cttccctgattatccccagc

SEQ ID NO: 807630 - DNA, 20 bp, Artificial
  CRISPR gRNA sequence
ttccctgattatccccagct

SEQ ID NO: 807631 - DNA, 20 bp, Artificial
  CRISPR gRNA sequence
ccctgattatccccagctta

SEQ ID NO: 807632 - DNA, 20 bp, Artificial
  CRISPR gRNA sequence
cctgattatccccagcttaa

SEQ ID NO: 807633 - DNA, 20 bp, Artificial
  CRISPR gRNA sequence
attatccccagcttaaagtg

SEQ ID NO: 807634 - DNA, 20 bp, Artificial
  CRISPR gRNA sequence
tccccagcttaaagtgatat

SEQ ID NO: 807635 - DNA, 20 bp, Artificial
  CRISPR gRNA sequence
aaagtgatatttgtccccat

SEQ ID NO: 807636 - DNA, 20 bp, Artificial
  CRISPR gRNA sequence
aagtgatatttgtccccatc

SEQ ID NO: 807637 - DNA, 20 bp, Artificial
  CRISPR gRNA sequence
gtccccatctctgaactttc

SEQ ID NO: 807638 - DNA, 20 bp, Artificial
  CRISPR gRNA sequence
tccccatctctgaactttca

SEQ ID NO: 807639 - DNA, 20 bp, Artificial
  CRISPR gRNA sequence
tgaactttcatgtattgttt

SEQ ID NO: 807640 - DNA, 20 bp, Artificial
  CRISPR gRNA sequence
aactttcatgtattgtttgt

SEQ ID NO: 807641 - DNA, 20 bp, Artificial
  CRISPR gRNA sequence
tcatgtattgtttgtccctc

SEQ ID NO: 807642 - DNA, 20 bp, Artificial
  CRISPR gRNA sequence
catgtattgtttgtccctct

SEQ ID NO: 807643 - DNA, 20 bp, Artificial
  CRISPR gRNA sequence
atgtattgtttgtccctctt

SEQ ID NO: 807644 - DNA, 20 bp, Artificial
  CRISPR gRNA sequence
tttgtccctcttatatgagc

SEQ ID NO: 807645 - DNA, 20 bp, Artificial
  CRISPR gRNA sequence
gtccctcttatatgagccat

SEQ ID NO: 807646 - DNA, 20 bp, Artificial
  CRISPR gRNA sequence
tccctcttatatgagccata

SEQ ID NO: 807647 - DNA, 20 bp, Artificial
  CRISPR gRNA sequence
ttatatgagccatagagaac

SEQ ID NO: 807648 - DNA, 20 bp, Artificial
  CRISPR gRNA sequence
atatgagccatagagaacca

SEQ ID NO: 807649 - DNA, 20 bp, Artificial
  CRISPR gRNA sequence
tatgagccatagagaaccat

SEQ ID NO: 807650 - DNA, 20 bp, Artificial
  CRISPR gRNA sequence
ttcacaccattaaaaattca

SEQ ID NO: 807651 - DNA, 20 bp, Artificial
  CRISPR gRNA sequence
tcacaccattaaaaattcat

SEQ ID NO: 807652 - DNA, 20 bp, Artificial
  CRISPR gRNA sequence
cacaccattaaaaattcatg

SEQ ID NO: 807653 - DNA, 20 bp, Artificial
  CRISPR gRNA sequence
acaccattaaaaattcatgg

SEQ ID NO: 807654 - DNA, 20 bp, Artificial
  CRISPR gRNA sequence
aaaattcatgggcacaggtg

SEQ ID NO: 807655 - DNA, 20 bp, Artificial
  CRISPR gRNA sequence
atgggcacaggtgagtgaag

SEQ ID NO: 807656 - DNA, 20 bp, Artificial
  CRISPR gRNA sequence
ttagtgactcctcttgctaa

SEQ ID NO: 807657 - DNA, 20 bp, Artificial
  CRISPR gRNA sequence
gtgactcctcttgctaatag

SEQ ID NO: 807658 - DNA, 20 bp, Artificial
  CRISPR gRNA sequence
ctcttgctaatagcactctc

SEQ ID NO: 807659 - DNA, 20 bp, Artificial
  CRISPR gRNA sequence
ttgctaatagcactctcctc

SEQ ID NO: 807660 - DNA, 20 bp, Artificial
  CRISPR gRNA sequence
gctaatagcactctcctccc

SEQ ID NO: 807661 - DNA, 20 bp, Artificial
  CRISPR gRNA sequence
ctaatagcactctcctccct

SEQ ID NO: 807662 - DNA, 20 bp, Artificial
  CRISPR gRNA sequence
atagcactctcctccctccc

SEQ ID NO: 807663 - DNA, 20 bp, Artificial
  CRISPR gRNA sequence
tcctccctccctgagacaac

SEQ ID NO: 807664 - DNA, 20 bp, Artificial
  CRISPR gRNA sequence
ctccctccctgagacaactg

SEQ ID NO: 807665 - DNA, 20 bp, Artificial
  CRISPR gRNA sequence
cctccctgagacaactgtgc

SEQ ID NO: 807666 - DNA, 20 bp, Artificial
  CRISPR gRNA sequence
cctgagacaactgtgctgcc

SEQ ID NO: 807667 - DNA, 20 bp, Artificial
  CRISPR gRNA sequence
agacaactgtgctgcctgaa

SEQ ID NO: 807668 - DNA, 20 bp, Artificial
  CRISPR gRNA sequence
tgctgcctgaagaaagaaag

SEQ ID NO: 807669 - DNA, 20 bp, Artificial
  CRISPR gRNA sequence
cctgaagaaagaaagtgtga

SEQ ID NO: 807670 - DNA, 20 bp, Artificial
  CRISPR gRNA sequence
aagaaagaaagtgtgaagtt

SEQ ID NO: 807671 - DNA, 20 bp, Artificial
  CRISPR gRNA sequence
cctgacatgggttgggtatt

SEQ ID NO: 807672 - DNA, 20 bp, Artificial
  CRISPR gRNA sequence
acatgggttgggtatttctg

SEQ ID NO: 807673 - DNA, 20 bp, Artificial
  CRISPR gRNA sequence
ggtatttctgaggattgatg

SEQ ID NO: 807674 - DNA, 20 bp, Artificial
  CRISPR gRNA sequence
ctgaggattgatggtaaggt

SEQ ID NO: 807675 - DNA, 20 bp, Artificial
  CRISPR gRNA sequence
tgaggattgatggtaaggtg

SEQ ID NO: 807676 - DNA, 20 bp, Artificial
  CRISPR gRNA sequence
aggattgatggtaaggtggg

SEQ ID NO: 807677 - DNA, 20 bp, Artificial
  CRISPR gRNA sequence
atggtaaggtgggcttcagg

SEQ ID NO: 807678 - DNA, 20 bp, Artificial
  CRISPR gRNA sequence
caggacatagggataatttg

SEQ ID NO: 807679 - DNA, 20 bp, Artificial
  CRISPR gRNA sequence
aggacatagggataatttga

SEQ ID NO: 807680 - DNA, 20 bp, Artificial
  CRISPR gRNA sequence
gagagctacatgattttcca

SEQ ID NO: 807681 - DNA, 20 bp, Artificial
  CRISPR gRNA sequence
agagctacatgattttccaa

SEQ ID NO: 807682 - DNA, 20 bp, Artificial
  CRISPR gRNA sequence
catgattttccaaatatgtt

SEQ ID NO: 807683 - DNA, 20 bp, Artificial
  CRISPR gRNA sequence
tccaaatatgttccaagaag

SEQ ID NO: 807684 - DNA, 20 bp, Artificial
  CRISPR gRNA sequence
ccaaatatgttccaagaagc

SEQ ID NO: 807685 - DNA, 20 bp, Artificial
  CRISPR gRNA sequence
caaatatgttccaagaagca

SEQ ID NO: 807686 - DNA, 20 bp, Artificial
  CRISPR gRNA sequence
caagaagcacaaggtatctt

SEQ ID NO: 807687 - DNA, 20 bp, Artificial
  CRISPR gRNA sequence
agagcagtggtccccaacat

SEQ ID NO: 807688 - DNA, 20 bp, Artificial
  CRISPR gRNA sequence
gagcagtggtccccaacatt

SEQ ID NO: 807689 - DNA, 20 bp, Artificial
  CRISPR gRNA sequence
ttggcaccagggactggttt

SEQ ID NO: 807690 - DNA, 20 bp, Artificial
  CRISPR gRNA sequence
tggcaccagggactggtttc

SEQ ID NO: 807691 - DNA, 20 bp, Artificial
  CRISPR gRNA sequence
ggcaccagggactggtttca

SEQ ID NO: 807692 - DNA, 20 bp, Artificial
  CRISPR gRNA sequence
gcaccagggactggtttcag

SEQ ID NO: 807693 - DNA, 20 bp, Artificial
  CRISPR gRNA sequence
gtttcagggaagacaatttt

SEQ ID NO: 807694 - DNA, 20 bp, Artificial
  CRISPR gRNA sequence
cagggaagacaatttttcca

SEQ ID NO: 807695 - DNA, 20 bp, Artificial
  CRISPR gRNA sequence
agggaagacaatttttccat

SEQ ID NO: 807696 - DNA, 20 bp, Artificial
  CRISPR gRNA sequence
ttccatggattgggtgtggg

SEQ ID NO: 807697 - DNA, 20 bp, Artificial
  CRISPR gRNA sequence
tccatggattgggtgtggga

SEQ ID NO: 807698 - DNA, 20 bp, Artificial
  CRISPR gRNA sequence
ccatggattgggtgtgggag

SEQ ID NO: 807699 - DNA, 20 bp, Artificial
  CRISPR gRNA sequence
catggattgggtgtgggagt

SEQ ID NO: 807700 - DNA, 20 bp, Artificial
  CRISPR gRNA sequence
ggtgtgggagtgggggtagg

SEQ ID NO: 807701 - DNA, 20 bp, Artificial
  CRISPR gRNA sequence
tagtttcaggatgaacctgt

SEQ ID NO: 807702 - DNA, 20 bp, Artificial
  CRISPR gRNA sequence
caggatgaacctgttccacc

SEQ ID NO: 807703 - DNA, 20 bp, Artificial
  CRISPR gRNA sequence
aggatgaacctgttccacct

SEQ ID NO: 807704 - DNA, 20 bp, Artificial
  CRISPR gRNA sequence
ttccacctcagatcgtcaga

SEQ ID NO: 807705 - DNA, 20 bp, Artificial
  CRISPR gRNA sequence
cacctcagatcgtcagacat

SEQ ID NO: 807706 - DNA, 20 bp, Artificial
  CRISPR gRNA sequence
agatcgtcagacattagatt

SEQ ID NO: 807707 - DNA, 20 bp, Artificial
  CRISPR gRNA sequence
gattttcataaggagcacac

SEQ ID NO: 807708 - DNA, 20 bp, Artificial
  CRISPR gRNA sequence
tcataaggagcacacaacct

SEQ ID NO: 807709 - DNA, 20 bp, Artificial
  CRISPR gRNA sequence
cataaggagcacacaaccta

SEQ ID NO: 807710 - DNA, 20 bp, Artificial
  CRISPR gRNA sequence
ataaggagcacacaacctag

SEQ ID NO: 807711 - DNA, 20 bp, Artificial
  CRISPR gRNA sequence
gatccctcatatgtgcagtt

SEQ ID NO: 807712 - DNA, 20 bp, Artificial
  CRISPR gRNA sequence
atatgtgcagttcacaatag

SEQ ID NO: 807713 - DNA, 20 bp, Artificial
  CRISPR gRNA sequence
acaataggattcacgcttct

SEQ ID NO: 807714 - DNA, 20 bp, Artificial
  CRISPR gRNA sequence
acgcttctatgagaatctaa

SEQ ID NO: 807715 - DNA, 20 bp, Artificial
  CRISPR gRNA sequence
ctatgagaatctaatgctgc

SEQ ID NO: 807716 - DNA, 20 bp, Artificial
  CRISPR gRNA sequence
tatgagaatctaatgctgct

SEQ ID NO: 807717 - DNA, 20 bp, Artificial
  CRISPR gRNA sequence
tgagaatctaatgctgctgc

SEQ ID NO: 807718 - DNA, 20 bp, Artificial
  CRISPR gRNA sequence
atgctgctgctgatctcaca

SEQ ID NO: 807719 - DNA, 20 bp, Artificial
  CRISPR gRNA sequence
ctgctgatctcacaggaggt

SEQ ID NO: 807720 - DNA, 20 bp, Artificial
  CRISPR gRNA sequence
ctgatctcacaggaggtaga

SEQ ID NO: 807721 - DNA, 20 bp, Artificial
  CRISPR gRNA sequence
atctcacaggaggtagagct

SEQ ID NO: 807722 - DNA, 20 bp, Artificial
  CRISPR gRNA sequence
acaggaggtagagctcaggt

SEQ ID NO: 807723 - DNA, 20 bp, Artificial
  CRISPR gRNA sequence
aggtagtagtgcccgcttgt

SEQ ID NO: 807724 - DNA, 20 bp, Artificial
  CRISPR gRNA sequence
gtctcccgctcacctcctgc

SEQ ID NO: 807725 - DNA, 20 bp, Artificial
  CRISPR gRNA sequence
tctcccgctcacctcctgct

SEQ ID NO: 807726 - DNA, 20 bp, Artificial
  CRISPR gRNA sequence
ccgctcacctcctgctgtgt

SEQ ID NO: 807727 - DNA, 20 bp, Artificial
  CRISPR gRNA sequence
acctcctgctgtgtggctca

SEQ ID NO: 807728 - DNA, 20 bp, Artificial
  CRISPR gRNA sequence
ctgctgtgtggctcagttcc

SEQ ID NO: 807729 - DNA, 20 bp, Artificial
  CRISPR gRNA sequence
ctgtgtggctcagttcctaa

SEQ ID NO: 807730 - DNA, 20 bp, Artificial
  CRISPR gRNA sequence
tgtggctcagttcctaacag

SEQ ID NO: 807731 - DNA, 20 bp, Artificial
  CRISPR gRNA sequence
agttcctaacaggccactgg

SEQ ID NO: 807732 - DNA, 20 bp, Artificial
  CRISPR gRNA sequence
ctaacaggccactggtaccg

SEQ ID NO: 807733 - DNA, 20 bp, Artificial
  CRISPR gRNA sequence
acaggccactggtaccggtc

SEQ ID NO: 807734 - DNA, 20 bp, Artificial
  CRISPR gRNA sequence
gtaccggtctgcggcccaga

SEQ ID NO: 807735 - DNA, 20 bp, Artificial
  CRISPR gRNA sequence
cggcccagaggttggggacc

SEQ ID NO: 807736 - DNA, 20 bp, Artificial
  CRISPR gRNA sequence
gggacccctgccttagaggc

SEQ ID NO: 807737 - DNA, 20 bp, Artificial
  CRISPR gRNA sequence
ccttagaggcctttgtaggg

SEQ ID NO: 807738 - DNA, 20 bp, Artificial
  CRISPR gRNA sequence
agaggcctttgtagggacaa

SEQ ID NO: 807739 - DNA, 20 bp, Artificial
  CRISPR gRNA sequence
gaggcctttgtagggacaaa

SEQ ID NO: 807740 - DNA, 20 bp, Artificial
  CRISPR gRNA sequence
tgtagggacaaatatgatat

SEQ ID NO: 807741 - DNA, 20 bp, Artificial
  CRISPR gRNA sequence
gtagggacaaatatgatatg

SEQ ID NO: 807742 - DNA, 20 bp, Artificial
  CRISPR gRNA sequence
tagggacaaatatgatatgg

SEQ ID NO: 807743 - DNA, 20 bp, Artificial
  CRISPR gRNA sequence
tatgatagggtgattatgtc

SEQ ID NO: 807744 - DNA, 20 bp, Artificial
  CRISPR gRNA sequence
tgtcctccactctaatttca

SEQ ID NO: 807745 - DNA, 20 bp, Artificial
  CRISPR gRNA sequence
cactctaatttcaccactat

SEQ ID NO: 807746 - DNA, 20 bp, Artificial
  CRISPR gRNA sequence
taatttcaccactattttaa

SEQ ID NO: 807747 - DNA, 20 bp, Artificial
  CRISPR gRNA sequence
atttcaccactattttaatt

SEQ ID NO: 807748 - DNA, 20 bp, Artificial
  CRISPR gRNA sequence
caccactattttaatttgct

SEQ ID NO: 807749 - DNA, 20 bp, Artificial
  CRISPR gRNA sequence
accactattttaatttgctt

SEQ ID NO: 807750 - DNA, 20 bp, Artificial
  CRISPR gRNA sequence
ttttaatttgcttgacatgt

SEQ ID NO: 807751 - DNA, 20 bp, Artificial
  CRISPR gRNA sequence
taatttgcttgacatgtagg

SEQ ID NO: 807752 - DNA, 20 bp, Artificial
  CRISPR gRNA sequence
aatttgcttgacatgtagga

SEQ ID NO: 807753 - DNA, 20 bp, Artificial
  CRISPR gRNA sequence
atttgcttgacatgtaggag

SEQ ID NO: 807754 - DNA, 20 bp, Artificial
  CRISPR gRNA sequence
gcttgacatgtaggagttct

SEQ ID NO: 807755 - DNA, 20 bp, Artificial
  CRISPR gRNA sequence
cttgacatgtaggagttctg

SEQ ID NO: 807756 - DNA, 20 bp, Artificial
  CRISPR gRNA sequence
gacatgtaggagttctgtct

SEQ ID NO: 807757 - DNA, 20 bp, Artificial
  CRISPR gRNA sequence
acatgtaggagttctgtcta

SEQ ID NO: 807758 - DNA, 20 bp, Artificial
  CRISPR gRNA sequence
tgtctaatatttcctttgcg

SEQ ID NO: 807759 - DNA, 20 bp, Artificial
  CRISPR gRNA sequence
tctaatatttcctttgcgaa

SEQ ID NO: 807760 - DNA, 20 bp, Artificial
  CRISPR gRNA sequence
atatttcctttgcgaaaggt

SEQ ID NO: 807761 - DNA, 20 bp, Artificial
  CRISPR gRNA sequence
cctttgcgaaaggtttatag

SEQ ID NO: 807762 - DNA, 20 bp, Artificial
  CRISPR gRNA sequence
ctttgcgaaaggtttatagt

SEQ ID NO: 807763 - DNA, 20 bp, Artificial
  CRISPR gRNA sequence
tgcgaaaggtttatagtgcc

SEQ ID NO: 807764 - DNA, 20 bp, Artificial
  CRISPR gRNA sequence
gcgaaaggtttatagtgcca

SEQ ID NO: 807765 - DNA, 20 bp, Artificial
  CRISPR gRNA sequence
cgaaaggtttatagtgccaa

SEQ ID NO: 807766 - DNA, 20 bp, Artificial
  CRISPR gRNA sequence
atagtgccaaaagaaaaaga

SEQ ID NO: 807767 - DNA, 20 bp, Artificial
  CRISPR gRNA sequence
tagtgccaaaagaaaaagaa

SEQ ID NO: 807768 - DNA, 20 bp, Artificial
  CRISPR gRNA sequence
gaaaccactgaaatgggaaa

SEQ ID NO: 807769 - DNA, 20 bp, Artificial
  CRISPR gRNA sequence
aaatgggaaaggggaaagga

SEQ ID NO: 807770 - DNA, 20 bp, Artificial
  CRISPR gRNA sequence
acgctgtggtcagttctcag

SEQ ID NO: 807771 - DNA, 20 bp, Artificial
  CRISPR gRNA sequence
tggtcagttctcaggtggaa

SEQ ID NO: 807772 - DNA, 20 bp, Artificial
  CRISPR gRNA sequence
tcaggtggaagttcttagaa

SEQ ID NO: 807773 - DNA, 20 bp, Artificial
  CRISPR gRNA sequence
aggtggaagttcttagaagg

SEQ ID NO: 807774 - DNA, 20 bp, Artificial
  CRISPR gRNA sequence
ttagaaggaagtcgggatac

SEQ ID NO: 807775 - DNA, 20 bp, Artificial
  CRISPR gRNA sequence
agaaggaagtcgggatactc

SEQ ID NO: 807776 - DNA, 20 bp, Artificial
  CRISPR gRNA sequence
gaaggaagtcgggatactca

SEQ ID NO: 807777 - DNA, 20 bp, Artificial
  CRISPR gRNA sequence
atgaaaacaaacaaaacaaa

SEQ ID NO: 807778 - DNA, 20 bp, Artificial
  CRISPR gRNA sequence
gaccaaaagtatatagaaag

SEQ ID NO: 807779 - DNA, 20 bp, Artificial
  CRISPR gRNA sequence
gcttctttttgttttaaccc

SEQ ID NO: 807780 - DNA, 20 bp, Artificial
  CRISPR gRNA sequence
ctttttgttttaacccaaat

SEQ ID NO: 807781 - DNA, 20 bp, Artificial
  CRISPR gRNA sequence
tttttgttttaacccaaatt

SEQ ID NO: 807782 - DNA, 20 bp, Artificial
  CRISPR gRNA sequence
tttgttttaacccaaattat

SEQ ID NO: 807783 - DNA, 20 bp, Artificial
  CRISPR gRNA sequence
ttgttttaacccaaattatg

SEQ ID NO: 807784 - DNA, 20 bp, Artificial
  CRISPR gRNA sequence
tgttttaacccaaattatgt

SEQ ID NO: 807785 - DNA, 20 bp, Artificial
  CRISPR gRNA sequence
gttttaacccaaattatgtg

SEQ ID NO: 807786 - DNA, 20 bp, Artificial
  CRISPR gRNA sequence
ttttaacccaaattatgtga

SEQ ID NO: 807787 - DNA, 20 bp, Artificial
  CRISPR gRNA sequence
taacccaaattatgtgaatg

SEQ ID NO: 807788 - DNA, 20 bp, Artificial
  CRISPR gRNA sequence
aacccaaattatgtgaatga

SEQ ID NO: 807789 - DNA, 20 bp, Artificial
  CRISPR gRNA sequence
acccaaattatgtgaatgag

SEQ ID NO: 807790 - DNA, 20 bp, Artificial
  CRISPR gRNA sequence
tgtgaatgagaactgtttct

SEQ ID NO: 807791 - DNA, 20 bp, Artificial
  CRISPR gRNA sequence
tttcttgagtaccttatcgg

SEQ ID NO: 807792 - DNA, 20 bp, Artificial
  CRISPR gRNA sequence
cttgagtaccttatcggtaa

SEQ ID NO: 807793 - DNA, 20 bp, Artificial
  CRISPR gRNA sequence
ttgagtaccttatcggtaat

SEQ ID NO: 807794 - DNA, 20 bp, Artificial
  CRISPR gRNA sequence
gagtaccttatcggtaatac

SEQ ID NO: 807795 - DNA, 20 bp, Artificial
  CRISPR gRNA sequence
agtaccttatcggtaatact

SEQ ID NO: 807796 - DNA, 20 bp, Artificial
  CRISPR gRNA sequence
atcggtaatacttaattgta

SEQ ID NO: 807797 - DNA, 20 bp, Artificial
  CRISPR gRNA sequence
tcggtaatacttaattgtaa

SEQ ID NO: 807798 - DNA, 20 bp, Artificial
  CRISPR gRNA sequence
aattgtaagaatcttggatg

SEQ ID NO: 807799 - DNA, 20 bp, Artificial
  CRISPR gRNA sequence
attgtaagaatcttggatga

SEQ ID NO: 807800 - DNA, 20 bp, Artificial
  CRISPR gRNA sequence
taagaatcttggatgactga

SEQ ID NO: 807801 - DNA, 20 bp, Artificial
  CRISPR gRNA sequence
ggatgactgataaattcatc

SEQ ID NO: 807802 - DNA, 20 bp, Artificial
  CRISPR gRNA sequence
gatgactgataaattcatcc

SEQ ID NO: 807803 - DNA, 20 bp, Artificial
  CRISPR gRNA sequence
ataaattcatccttctagtt

SEQ ID NO: 807804 - DNA, 20 bp, Artificial
  CRISPR gRNA sequence
atccttctagttcccacatg

SEQ ID NO: 807805 - DNA, 20 bp, Artificial
  CRISPR gRNA sequence
ctagttcccacatggcctaa

SEQ ID NO: 807806 - DNA, 20 bp, Artificial
  CRISPR gRNA sequence
tagttcccacatggcctaac

SEQ ID NO: 807807 - DNA, 20 bp, Artificial
  CRISPR gRNA sequence
gttcccacatggcctaactg

SEQ ID NO: 807808 - DNA, 20 bp, Artificial
  CRISPR gRNA sequence
ccacatggcctaactgacag

SEQ ID NO: 807809 - DNA, 20 bp, Artificial
  CRISPR gRNA sequence
actgacagggtcttgcaaat

SEQ ID NO: 807810 - DNA, 20 bp, Artificial
  CRISPR gRNA sequence
acagggtcttgcaaataaca

SEQ ID NO: 807811 - DNA, 20 bp, Artificial
  CRISPR gRNA sequence
gcaaataacagaaacttaat

SEQ ID NO: 807812 - DNA, 20 bp, Artificial
  CRISPR gRNA sequence
caaataacagaaacttaata

SEQ ID NO: 807813 - DNA, 20 bp, Artificial
  CRISPR gRNA sequence
aatacaggtttgtgagtggg

SEQ ID NO: 807814 - DNA, 20 bp, Artificial
  CRISPR gRNA sequence
atacaggtttgtgagtgggt

SEQ ID NO: 807815 - DNA, 20 bp, Artificial
  CRISPR gRNA sequence
gtgagtgggtgaatgaatga

SEQ ID NO: 807816 - DNA, 20 bp, Artificial
  CRISPR gRNA sequence
tgagtgggtgaatgaatgaa

SEQ ID NO: 807817 - DNA, 20 bp, Artificial
  CRISPR gRNA sequence
tgctgggaatcatgacttct

SEQ ID NO: 807818 - DNA, 20 bp, Artificial
  CRISPR gRNA sequence
ggaatcatgacttcttttgg

SEQ ID NO: 807819 - DNA, 20 bp, Artificial
  CRISPR gRNA sequence
cttttggtctgctactgttt

SEQ ID NO: 807820 - DNA, 20 bp, Artificial
  CRISPR gRNA sequence
ttttggtctgctactgtttc

SEQ ID NO: 807821 - DNA, 20 bp, Artificial
  CRISPR gRNA sequence
ttggtctgctactgtttcac

SEQ ID NO: 807822 - DNA, 20 bp, Artificial
  CRISPR gRNA sequence
tggtctgctactgtttcact

SEQ ID NO: 807823 - DNA, 20 bp, Artificial
  CRISPR gRNA sequence
ggtctgctactgtttcactt

SEQ ID NO: 807824 - DNA, 20 bp, Artificial
  CRISPR gRNA sequence
gtctgctactgtttcactta

SEQ ID NO: 807825 - DNA, 20 bp, Artificial
  CRISPR gRNA sequence
ctactgtttcacttaaggaa

SEQ ID NO: 807826 - DNA, 20 bp, Artificial
  CRISPR gRNA sequence
ctgtttcacttaaggaagtc

SEQ ID NO: 807827 - DNA, 20 bp, Artificial
  CRISPR gRNA sequence
tttcacttaaggaagtcact

SEQ ID NO: 807828 - DNA, 20 bp, Artificial
  CRISPR gRNA sequence
cacttaaggaagtcacttaa

SEQ ID NO: 807829 - DNA, 20 bp, Artificial
  CRISPR gRNA sequence
acttaaggaagtcacttaat

SEQ ID NO: 807830 - DNA, 20 bp, Artificial
  CRISPR gRNA sequence
aaggaagtcacttaatatct

SEQ ID NO: 807831 - DNA, 20 bp, Artificial
  CRISPR gRNA sequence
aggaagtcacttaatatctc

SEQ ID NO: 807832 - DNA, 20 bp, Artificial
  CRISPR gRNA sequence
aatatctcttagcccccaat

SEQ ID NO: 807833 - DNA, 20 bp, Artificial
  CRISPR gRNA sequence
atatctcttagcccccaatg

SEQ ID NO: 807834 - DNA, 20 bp, Artificial
  CRISPR gRNA sequence
ttagcccccaatgtcataat

SEQ ID NO: 807835 - DNA, 20 bp, Artificial
  CRISPR gRNA sequence
agcccccaatgtcataatct

SEQ ID NO: 807836 - DNA, 20 bp, Artificial
  CRISPR gRNA sequence
gcccccaatgtcataatctg

SEQ ID NO: 807837 - DNA, 20 bp, Artificial
  CRISPR gRNA sequence
tgaaatgaggtagctaggat

SEQ ID NO: 807838 - DNA, 20 bp, Artificial
  CRISPR gRNA sequence
ggatacatggtctgtaaact

SEQ ID NO: 807839 - DNA, 20 bp, Artificial
  CRISPR gRNA sequence
taaactctaaccaaggcttg

SEQ ID NO: 807840 - DNA, 20 bp, Artificial
  CRISPR gRNA sequence
taaccaaggcttgatgactg

SEQ ID NO: 807841 - DNA, 20 bp, Artificial
  CRISPR gRNA sequence
accaaggcttgatgactgta

SEQ ID NO: 807842 - DNA, 20 bp, Artificial
  CRISPR gRNA sequence
gatgactgtaataactattt

SEQ ID NO: 807843 - DNA, 20 bp, Artificial
  CRISPR gRNA sequence
atgactgtaataactatttt

SEQ ID NO: 807844 - DNA, 20 bp, Artificial
  CRISPR gRNA sequence
taataactattttgtaaagg

SEQ ID NO: 807845 - DNA, 20 bp, Artificial
  CRISPR gRNA sequence
ttttgtaaaggatagatgat

SEQ ID NO: 807846 - DNA, 20 bp, Artificial
  CRISPR gRNA sequence
tgtaaaggatagatgatata

SEQ ID NO: 807847 - DNA, 20 bp, Artificial
  CRISPR gRNA sequence
gtaaaggatagatgatatat

SEQ ID NO: 807848 - DNA, 20 bp, Artificial
  CRISPR gRNA sequence
taaaggatagatgatatata

SEQ ID NO: 807849 - DNA, 20 bp, Artificial
  CRISPR gRNA sequence
tggtatcataatccactcct

SEQ ID NO: 807850 - DNA, 20 bp, Artificial
  CRISPR gRNA sequence
ctaaagttttactgtttatc

SEQ ID NO: 807851 - DNA, 20 bp, Artificial
  CRISPR gRNA sequence
aagttttactgtttatctgc

SEQ ID NO: 807852 - DNA, 20 bp, Artificial
  CRISPR gRNA sequence
tactgtttatctgcttgtct

SEQ ID NO: 807853 - DNA, 20 bp, Artificial
  CRISPR gRNA sequence
actgtttatctgcttgtctg

SEQ ID NO: 807854 - DNA, 20 bp, Artificial
  CRISPR gRNA sequence
ctgtttatctgcttgtctgc

SEQ ID NO: 807855 - DNA, 20 bp, Artificial
  CRISPR gRNA sequence
tttatctgcttgtctgcata

SEQ ID NO: 807856 - DNA, 20 bp, Artificial
  CRISPR gRNA sequence
atctgcttgtctgcataaga

SEQ ID NO: 807857 - DNA, 20 bp, Artificial
  CRISPR gRNA sequence
tctgcttgtctgcataagag

SEQ ID NO: 807858 - DNA, 20 bp, Artificial
  CRISPR gRNA sequence
cttgtctgcataagagggag

SEQ ID NO: 807859 - DNA, 20 bp, Artificial
  CRISPR gRNA sequence
gtctgcataagagggagaat

SEQ ID NO: 807860 - DNA, 20 bp, Artificial
  CRISPR gRNA sequence
tctgcataagagggagaatg

SEQ ID NO: 807861 - DNA, 20 bp, Artificial
  CRISPR gRNA sequence
cataagagggagaatggcta

SEQ ID NO: 807862 - DNA, 20 bp, Artificial
  CRISPR gRNA sequence
ggcccaaatagtagcacaga

SEQ ID NO: 807863 - DNA, 20 bp, Artificial
  CRISPR gRNA sequence
gatacaagaacaacttccac

SEQ ID NO: 807864 - DNA, 20 bp, Artificial
  CRISPR gRNA sequence
ccacaaatggaaagggcagt

SEQ ID NO: 807865 - DNA, 20 bp, Artificial
  CRISPR gRNA sequence
cacaaatggaaagggcagtg

SEQ ID NO: 807866 - DNA, 20 bp, Artificial
  CRISPR gRNA sequence
agtgggtctgagttctagct

SEQ ID NO: 807867 - DNA, 20 bp, Artificial
  CRISPR gRNA sequence
agttctagctccatttctaa

SEQ ID NO: 807868 - DNA, 20 bp, Artificial
  CRISPR gRNA sequence
tagctccatttctaacagta

SEQ ID NO: 807869 - DNA, 20 bp, Artificial
  CRISPR gRNA sequence
gctccatttctaacagtaag

SEQ ID NO: 807870 - DNA, 20 bp, Artificial
  CRISPR gRNA sequence
catttctaacagtaagttat

SEQ ID NO: 807871 - DNA, 20 bp, Artificial
  CRISPR gRNA sequence
ctaacagtaagttatgatat

SEQ ID NO: 807872 - DNA, 20 bp, Artificial
  CRISPR gRNA sequence
taacagtaagttatgatatg

SEQ ID NO: 807873 - DNA, 20 bp, Artificial
  CRISPR gRNA sequence
acagtaagttatgatatgac

SEQ ID NO: 807874 - DNA, 20 bp, Artificial
  CRISPR gRNA sequence
tgatatgaccttatgcaagt

SEQ ID NO: 807875 - DNA, 20 bp, Artificial
  CRISPR gRNA sequence
atgcaagtcacttcagctct

SEQ ID NO: 807876 - DNA, 20 bp, Artificial
  CRISPR gRNA sequence
tgcaagtcacttcagctctt

SEQ ID NO: 807877 - DNA, 20 bp, Artificial
  CRISPR gRNA sequence
cagctcttatatccttagag

SEQ ID NO: 807878 - DNA, 20 bp, Artificial
  CRISPR gRNA sequence
agctcttatatccttagagc

SEQ ID NO: 807879 - DNA, 20 bp, Artificial
  CRISPR gRNA sequence
ttatatccttagagcatatc

SEQ ID NO: 807880 - DNA, 20 bp, Artificial
  CRISPR gRNA sequence
atatccttagagcatatcca

SEQ ID NO: 807881 - DNA, 20 bp, Artificial
  CRISPR gRNA sequence
tatccttagagcatatccat

SEQ ID NO: 807882 - DNA, 20 bp, Artificial
  CRISPR gRNA sequence
agagcatatccatcacattt

SEQ ID NO: 807883 - DNA, 20 bp, Artificial
  CRISPR gRNA sequence
gagcatatccatcacattta

SEQ ID NO: 807884 - DNA, 20 bp, Artificial
  CRISPR gRNA sequence
agctgtgctaggagtctttg

SEQ ID NO: 807885 - DNA, 20 bp, Artificial
  CRISPR gRNA sequence
gctgtgctaggagtctttga

SEQ ID NO: 807886 - DNA, 20 bp, Artificial
  CRISPR gRNA sequence
tgctaggagtctttgaaagg

SEQ ID NO: 807887 - DNA, 20 bp, Artificial
  CRISPR gRNA sequence
ggagtctttgaaaggcaact

SEQ ID NO: 807888 - DNA, 20 bp, Artificial
  CRISPR gRNA sequence
tgaaaggcaactaagacatt

SEQ ID NO: 807889 - DNA, 20 bp, Artificial
  CRISPR gRNA sequence
gaaaggcaactaagacattg

SEQ ID NO: 807890 - DNA, 20 bp, Artificial
  CRISPR gRNA sequence
aaaggcaactaagacattgg

SEQ ID NO: 807891 - DNA, 20 bp, Artificial
  CRISPR gRNA sequence
agacattggtaggtgtcctt

SEQ ID NO: 807892 - DNA, 20 bp, Artificial
  CRISPR gRNA sequence
gtaggtgtcctttaaagaag

SEQ ID NO: 807893 - DNA, 20 bp, Artificial
  CRISPR gRNA sequence
taaagaaggtatagcatcgc

SEQ ID NO: 807894 - DNA, 20 bp, Artificial
  CRISPR gRNA sequence
aaagaaggtatagcatcgcc

SEQ ID NO: 807895 - DNA, 20 bp, Artificial
  CRISPR gRNA sequence
aagaaggtatagcatcgccc

SEQ ID NO: 807896 - DNA, 20 bp, Artificial
  CRISPR gRNA sequence
cctaaacttgataaggactg

SEQ ID NO: 807897 - DNA, 20 bp, Artificial
  CRISPR gRNA sequence
ctaaacttgataaggactga

SEQ ID NO: 807898 - DNA, 20 bp, Artificial
  CRISPR gRNA sequence
aacttgataaggactgatga

SEQ ID NO: 807899 - DNA, 20 bp, Artificial
  CRISPR gRNA sequence
gataaggactgatgaagagt

SEQ ID NO: 807900 - DNA, 20 bp, Artificial
  CRISPR gRNA sequence
ataaggactgatgaagagtc

SEQ ID NO: 807901 - DNA, 20 bp, Artificial
  CRISPR gRNA sequence
atgaagagtcctatataatg

SEQ ID NO: 807902 - DNA, 20 bp, Artificial
  CRISPR gRNA sequence
tataatgtatttggttactg

SEQ ID NO: 807903 - DNA, 20 bp, Artificial
  CRISPR gRNA sequence
ggttactgggatctagagag

SEQ ID NO: 807904 - DNA, 20 bp, Artificial
  CRISPR gRNA sequence
gttactgggatctagagagg

SEQ ID NO: 807905 - DNA, 20 bp, Artificial
  CRISPR gRNA sequence
ctgggatctagagaggtgag

SEQ ID NO: 807906 - DNA, 20 bp, Artificial
  CRISPR gRNA sequence
ggatctagagaggtgagtgg

SEQ ID NO: 807907 - DNA, 20 bp, Artificial
  CRISPR gRNA sequence
gagaggtgagtggggatggt

SEQ ID NO: 807908 - DNA, 20 bp, Artificial
  CRISPR gRNA sequence
aaatggcttcagaaagtatt

SEQ ID NO: 807909 - DNA, 20 bp, Artificial
  CRISPR gRNA sequence
cagaaagtattcttcttctt

SEQ ID NO: 807910 - DNA, 20 bp, Artificial
  CRISPR gRNA sequence
agaaagtattcttcttcttt

SEQ ID NO: 807911 - DNA, 20 bp, Artificial
  CRISPR gRNA sequence
ttcttctttttgaaagtaat

SEQ ID NO: 807912 - DNA, 20 bp, Artificial
  CRISPR gRNA sequence
cttctttttgaaagtaatac

SEQ ID NO: 807913 - DNA, 20 bp, Artificial
  CRISPR gRNA sequence
ttctttttgaaagtaataca

SEQ ID NO: 807914 - DNA, 20 bp, Artificial
  CRISPR gRNA sequence
ctttttgaaagtaatacatc

SEQ ID NO: 807915 - DNA, 20 bp, Artificial
  CRISPR gRNA sequence
tttttgaaagtaatacatca

SEQ ID NO: 807916 - DNA, 20 bp, Artificial
  CRISPR gRNA sequence
tttgaaagtaatacatcagg

SEQ ID NO: 807917 - DNA, 20 bp, Artificial
  CRISPR gRNA sequence
ttgaaagtaatacatcaggg

SEQ ID NO: 807918 - DNA, 20 bp, Artificial
  CRISPR gRNA sequence
tgaaagtaatacatcagggc

SEQ ID NO: 807919 - DNA, 20 bp, Artificial
  CRISPR gRNA sequence
gaaagtaatacatcagggca

SEQ ID NO: 807920 - DNA, 20 bp, Artificial
  CRISPR gRNA sequence
aaagtaatacatcagggcac

SEQ ID NO: 807921 - DNA, 20 bp, Artificial
  CRISPR gRNA sequence
aaaaatgtagtgaagtacaa

SEQ ID NO: 807922 - DNA, 20 bp, Artificial
  CRISPR gRNA sequence
agaaaacataaaagtaaaaa

SEQ ID NO: 807923 - DNA, 20 bp, Artificial
  CRISPR gRNA sequence
gattccataatccaaaaaca

SEQ ID NO: 807924 - DNA, 20 bp, Artificial
  CRISPR gRNA sequence
attccataatccaaaaacat

SEQ ID NO: 807925 - DNA, 20 bp, Artificial
  CRISPR gRNA sequence
cataatccaaaaacatgatt

SEQ ID NO: 807926 - DNA, 20 bp, Artificial
  CRISPR gRNA sequence
caggcattttcatattttta

SEQ ID NO: 807927 - DNA, 20 bp, Artificial
  CRISPR gRNA sequence
tcatatttttacttctgttt

SEQ ID NO: 807928 - DNA, 20 bp, Artificial
  CRISPR gRNA sequence
catatttttacttctgtttt

SEQ ID NO: 807929 - DNA, 20 bp, Artificial
  CRISPR gRNA sequence
atatttttacttctgttttt

SEQ ID NO: 807930 - DNA, 20 bp, Artificial
  CRISPR gRNA sequence
ttacttctgtttttctggag

SEQ ID NO: 807931 - DNA, 20 bp, Artificial
  CRISPR gRNA sequence
tacttctgtttttctggagg

SEQ ID NO: 807932 - DNA, 20 bp, Artificial
  CRISPR gRNA sequence
acttctgtttttctggagga

SEQ ID NO: 807933 - DNA, 20 bp, Artificial
  CRISPR gRNA sequence
cttctgtttttctggaggaa

SEQ ID NO: 807934 - DNA, 20 bp, Artificial
  CRISPR gRNA sequence
ctgtttttctggaggaaggg

SEQ ID NO: 807935 - DNA, 20 bp, Artificial
  CRISPR gRNA sequence
tgtttttctggaggaaggga

SEQ ID NO: 807936 - DNA, 20 bp, Artificial
  CRISPR gRNA sequence
tttttctggaggaagggaat

SEQ ID NO: 807937 - DNA, 20 bp, Artificial
  CRISPR gRNA sequence
ttctggaggaagggaatatg

SEQ ID NO: 807938 - DNA, 20 bp, Artificial
  CRISPR gRNA sequence
tctggaggaagggaatatgg

SEQ ID NO: 807939 - DNA, 20 bp, Artificial
  CRISPR gRNA sequence
ctggaggaagggaatatggt

SEQ ID NO: 807940 - DNA, 20 bp, Artificial
  CRISPR gRNA sequence
tggaggaagggaatatggtg

SEQ ID NO: 807941 - DNA, 20 bp, Artificial
  CRISPR gRNA sequence
gaggaagggaatatggtgag

SEQ ID NO: 807942 - DNA, 20 bp, Artificial
  CRISPR gRNA sequence
taaataacatttttaatagg

SEQ ID NO: 807943 - DNA, 20 bp, Artificial
  CRISPR gRNA sequence
ttaataggacatgaatgata

SEQ ID NO: 807944 - DNA, 20 bp, Artificial
  CRISPR gRNA sequence
taataggacatgaatgatac

SEQ ID NO: 807945 - DNA, 20 bp, Artificial
  CRISPR gRNA sequence
aataggacatgaatgataca

SEQ ID NO: 807946 - DNA, 20 bp, Artificial
  CRISPR gRNA sequence
ataggacatgaatgatacat

SEQ ID NO: 807947 - DNA, 20 bp, Artificial
  CRISPR gRNA sequence
ttattttgcaattttctatt

SEQ ID NO: 807948 - DNA, 20 bp, Artificial
  CRISPR gRNA sequence
tattttgcaattttctattt

SEQ ID NO: 807949 - DNA, 20 bp, Artificial
  CRISPR gRNA sequence
attttgcaattttctatttt

SEQ ID NO: 807950 - DNA, 20 bp, Artificial
  CRISPR gRNA sequence
ttttgcaattttctattttt

SEQ ID NO: 807951 - DNA, 20 bp, Artificial
  CRISPR gRNA sequence
tgcaattttctattttttta

SEQ ID NO: 807952 - DNA, 20 bp, Artificial
  CRISPR gRNA sequence
gcaattttctatttttttat

SEQ ID NO: 807953 - DNA, 20 bp, Artificial
  CRISPR gRNA sequence
caattttctatttttttatt

SEQ ID NO: 807954 - DNA, 20 bp, Artificial
  CRISPR gRNA sequence
tctatttttttattatatag

SEQ ID NO: 807955 - DNA, 20 bp, Artificial
  CRISPR gRNA sequence
ctatttttttattatataga

SEQ ID NO: 807956 - DNA, 20 bp, Artificial
  CRISPR gRNA sequence
tatttttttattatatagaa

SEQ ID NO: 807957 - DNA, 20 bp, Artificial
  CRISPR gRNA sequence
tttttttattatatagaaag

SEQ ID NO: 807958 - DNA, 20 bp, Artificial
  CRISPR gRNA sequence
ttttattatatagaaagtat

SEQ ID NO: 807959 - DNA, 20 bp, Artificial
  CRISPR gRNA sequence
tttattatatagaaagtatt

SEQ ID NO: 807960 - DNA, 20 bp, Artificial
  CRISPR gRNA sequence
ttattatatagaaagtattt

SEQ ID NO: 807961 - DNA, 20 bp, Artificial
  CRISPR gRNA sequence
tattatatagaaagtatttc

SEQ ID NO: 807962 - DNA, 20 bp, Artificial
  CRISPR gRNA sequence
attatatagaaagtatttcc

SEQ ID NO: 807963 - DNA, 20 bp, Artificial
  CRISPR gRNA sequence
ttatatagaaagtatttccc

SEQ ID NO: 807964 - DNA, 20 bp, Artificial
  CRISPR gRNA sequence
tatagaaagtatttccccac

SEQ ID NO: 807965 - DNA, 20 bp, Artificial
  CRISPR gRNA sequence
ccccacattattattcctca

SEQ ID NO: 807966 - DNA, 20 bp, Artificial
  CRISPR gRNA sequence
cccacattattattcctcag

SEQ ID NO: 807967 - DNA, 20 bp, Artificial
  CRISPR gRNA sequence
ttattcctcagaactagaag

SEQ ID NO: 807968 - DNA, 20 bp, Artificial
  CRISPR gRNA sequence
ttcctcagaactagaagttt

SEQ ID NO: 807969 - DNA, 20 bp, Artificial
  CRISPR gRNA sequence
ctcagaactagaagtttaaa

SEQ ID NO: 807970 - DNA, 20 bp, Artificial
  CRISPR gRNA sequence
agaactagaagtttaaatgg

SEQ ID NO: 807971 - DNA, 20 bp, Artificial
  CRISPR gRNA sequence
gaagtttaaatggcaacgta

SEQ ID NO: 807972 - DNA, 20 bp, Artificial
  CRISPR gRNA sequence
aaatggcaacgtagggtcta

SEQ ID NO: 807973 - DNA, 20 bp, Artificial
  CRISPR gRNA sequence
aatggcaacgtagggtctat

SEQ ID NO: 807974 - DNA, 20 bp, Artificial
  CRISPR gRNA sequence
tttattataggttccagttt

SEQ ID NO: 807975 - DNA, 20 bp, Artificial
  CRISPR gRNA sequence
attataggttccagtttttt

SEQ ID NO: 807976 - DNA, 20 bp, Artificial
  CRISPR gRNA sequence
ttataggttccagttttttc

SEQ ID NO: 807977 - DNA, 20 bp, Artificial
  CRISPR gRNA sequence
taggttccagttttttccat

SEQ ID NO: 807978 - DNA, 20 bp, Artificial
  CRISPR gRNA sequence
cagttttttccatgttgtat

SEQ ID NO: 807979 - DNA, 20 bp, Artificial
  CRISPR gRNA sequence
tttccatgttgtattagagt

SEQ ID NO: 807980 - DNA, 20 bp, Artificial
  CRISPR gRNA sequence
ttccatgttgtattagagta

SEQ ID NO: 807981 - DNA, 20 bp, Artificial
  CRISPR gRNA sequence
tccatgttgtattagagtaa

SEQ ID NO: 807982 - DNA, 20 bp, Artificial
  CRISPR gRNA sequence
ccatgttgtattagagtaaa

SEQ ID NO: 807983 - DNA, 20 bp, Artificial
  CRISPR gRNA sequence
catgttgtattagagtaaac

SEQ ID NO: 807984 - DNA, 20 bp, Artificial
  CRISPR gRNA sequence
tattagagtaaactaggtaa

SEQ ID NO: 807985 - DNA, 20 bp, Artificial
  CRISPR gRNA sequence
gagtaaactaggtaatgctg

SEQ ID NO: 807986 - DNA, 20 bp, Artificial
  CRISPR gRNA sequence
ggtaatgctgtaggaacaaa

SEQ ID NO: 807987 - DNA, 20 bp, Artificial
  CRISPR gRNA sequence
taggaacaaacaactccaaa

SEQ ID NO: 807988 - DNA, 20 bp, Artificial
  CRISPR gRNA sequence
caaaatctcaatataaaaaa

SEQ ID NO: 807989 - DNA, 20 bp, Artificial
  CRISPR gRNA sequence
aatataaaaaacaaaagctt

SEQ ID NO: 807990 - DNA, 20 bp, Artificial
  CRISPR gRNA sequence
attcttgttcatgttccatg

SEQ ID NO: 807991 - DNA, 20 bp, Artificial
  CRISPR gRNA sequence
ttcttgttcatgttccatgt

SEQ ID NO: 807992 - DNA, 20 bp, Artificial
  CRISPR gRNA sequence
ttgttcatgttccatgtaca

SEQ ID NO: 807993 - DNA, 20 bp, Artificial
  CRISPR gRNA sequence
gttcatgttccatgtacatt

SEQ ID NO: 807994 - DNA, 20 bp, Artificial
  CRISPR gRNA sequence
ttcatgttccatgtacattg

SEQ ID NO: 807995 - DNA, 20 bp, Artificial
  CRISPR gRNA sequence
atgttccatgtacattgagg

SEQ ID NO: 807996 - DNA, 20 bp, Artificial
  CRISPR gRNA sequence
catgtacattgagggtcagc

SEQ ID NO: 807997 - DNA, 20 bp, Artificial
  CRISPR gRNA sequence
agggtcagcaggggactctg

SEQ ID NO: 807998 - DNA, 20 bp, Artificial
  CRISPR gRNA sequence
tgtcaattttagtcactcag

SEQ ID NO: 807999 - DNA, 20 bp, Artificial
  CRISPR gRNA sequence
tcaattttagtcactcagag

SEQ ID NO: 808000 - DNA, 20 bp, Artificial
  CRISPR gRNA sequence
tagtcactcagagactgaga

SEQ ID NO: 808001 - DNA, 20 bp, Artificial
  CRISPR gRNA sequence
agtcactcagagactgagac

SEQ ID NO: 808002 - DNA, 20 bp, Artificial
  CRISPR gRNA sequence
gtcactcagagactgagact

SEQ ID NO: 808003 - DNA, 20 bp, Artificial
  CRISPR gRNA sequence
agagactgagactgatggag

SEQ ID NO: 808004 - DNA, 20 bp, Artificial
  CRISPR gRNA sequence
agactgatggagcaattact

SEQ ID NO: 808005 - DNA, 20 bp, Artificial
  CRISPR gRNA sequence
atggagcaattactacctag

SEQ ID NO: 808006 - DNA, 20 bp, Artificial
  CRISPR gRNA sequence
ctacctagaatgttactggt

SEQ ID NO: 808007 - DNA, 20 bp, Artificial
  CRISPR gRNA sequence
cctagaatgttactggttac

SEQ ID NO: 808008 - DNA, 20 bp, Artificial
  CRISPR gRNA sequence
gaatgttactggttaccatg

SEQ ID NO: 808009 - DNA, 20 bp, Artificial
  CRISPR gRNA sequence
ctggttaccatgccagatgg

SEQ ID NO: 808010 - DNA, 20 bp, Artificial
  CRISPR gRNA sequence
gttaccatgccagatggata

SEQ ID NO: 808011 - DNA, 20 bp, Artificial
  CRISPR gRNA sequence
ccatgccagatggataaaga

SEQ ID NO: 808012 - DNA, 20 bp, Artificial
  CRISPR gRNA sequence
ttacatcttctacccagaaa

SEQ ID NO: 808013 - DNA, 20 bp, Artificial
  CRISPR gRNA sequence
acatcttctacccagaaata

SEQ ID NO: 808014 - DNA, 20 bp, Artificial
  CRISPR gRNA sequence
catcttctacccagaaataa

SEQ ID NO: 808015 - DNA, 20 bp, Artificial
  CRISPR gRNA sequence
ctacccagaaataacacgca

SEQ ID NO: 808016 - DNA, 20 bp, Artificial
  CRISPR gRNA sequence
tacccagaaataacacgcat

SEQ ID NO: 808017 - DNA, 20 bp, Artificial
  CRISPR gRNA sequence
cccagaaataacacgcatca

SEQ ID NO: 808018 - DNA, 20 bp, Artificial
  CRISPR gRNA sequence
atgcttacatttaattgacc

SEQ ID NO: 808019 - DNA, 20 bp, Artificial
  CRISPR gRNA sequence
tgcttacatttaattgacca

SEQ ID NO: 808020 - DNA, 20 bp, Artificial
  CRISPR gRNA sequence
acatttaattgaccaaagcg

SEQ ID NO: 808021 - DNA, 20 bp, Artificial
  CRISPR gRNA sequence
catttaattgaccaaagcga

SEQ ID NO: 808022 - DNA, 20 bp, Artificial
  CRISPR gRNA sequence
aattgaccaaagcgagttac

SEQ ID NO: 808023 - DNA, 20 bp, Artificial
  CRISPR gRNA sequence
attgaccaaagcgagttaca

SEQ ID NO: 808024 - DNA, 20 bp, Artificial
  CRISPR gRNA sequence
accaaagcgagttacatgac

SEQ ID NO: 808025 - DNA, 20 bp, Artificial
  CRISPR gRNA sequence
catgaccacacttaactaca

SEQ ID NO: 808026 - DNA, 20 bp, Artificial
  CRISPR gRNA sequence
aactacaaattaatcacaga

SEQ ID NO: 808027 - DNA, 20 bp, Artificial
  CRISPR gRNA sequence
actacaaattaatcacagag

SEQ ID NO: 808028 - DNA, 20 bp, Artificial
  CRISPR gRNA sequence
caaattaatcacagagaagt

SEQ ID NO: 808029 - DNA, 20 bp, Artificial
  CRISPR gRNA sequence
atcacagagaagtgcaattc

SEQ ID NO: 808030 - DNA, 20 bp, Artificial
  CRISPR gRNA sequence
tatcatgtgcacaaaggcaa

SEQ ID NO: 808031 - DNA, 20 bp, Artificial
  CRISPR gRNA sequence
tcatgtgcacaaaggcaaga

SEQ ID NO: 808032 - DNA, 20 bp, Artificial
  CRISPR gRNA sequence
atactgaactctattaggca

SEQ ID NO: 808033 - DNA, 20 bp, Artificial
  CRISPR gRNA sequence
aactctattaggcattttca

SEQ ID NO: 808034 - DNA, 20 bp, Artificial
  CRISPR gRNA sequence
tattaggcattttcacaagt

SEQ ID NO: 808035 - DNA, 20 bp, Artificial
  CRISPR gRNA sequence
ttaggcattttcacaagtca

SEQ ID NO: 808036 - DNA, 20 bp, Artificial
  CRISPR gRNA sequence
ggcattttcacaagtcaggt

SEQ ID NO: 808037 - DNA, 20 bp, Artificial
  CRISPR gRNA sequence
tcacaagtcaggtcttgctt

SEQ ID NO: 808038 - DNA, 20 bp, Artificial
  CRISPR gRNA sequence
cacaagtcaggtcttgcttc

SEQ ID NO: 808039 - DNA, 20 bp, Artificial
  CRISPR gRNA sequence
acaagtcaggtcttgcttca

SEQ ID NO: 808040 - DNA, 20 bp, Artificial
  CRISPR gRNA sequence
gcttcagttgctggttagtg

SEQ ID NO: 808041 - DNA, 20 bp, Artificial
  CRISPR gRNA sequence
cttcagttgctggttagtga

SEQ ID NO: 808042 - DNA, 20 bp, Artificial
  CRISPR gRNA sequence
cagttgctggttagtgaagc

SEQ ID NO: 808043 - DNA, 20 bp, Artificial
  CRISPR gRNA sequence
agttgctggttagtgaagca

SEQ ID NO: 808044 - DNA, 20 bp, Artificial
  CRISPR gRNA sequence
ctggttagtgaagcaaaacc

SEQ ID NO: 808045 - DNA, 20 bp, Artificial
  CRISPR gRNA sequence
gttagtgaagcaaaaccagc

SEQ ID NO: 808046 - DNA, 20 bp, Artificial
  CRISPR gRNA sequence
gtgaagcaaaaccagcaagc

SEQ ID NO: 808047 - DNA, 20 bp, Artificial
  CRISPR gRNA sequence
tgcttcttaagttggaaggg

SEQ ID NO: 808048 - DNA, 20 bp, Artificial
  CRISPR gRNA sequence
cttaagttggaagggaaaat

SEQ ID NO: 808049 - DNA, 20 bp, Artificial
  CRISPR gRNA sequence
ttaagttggaagggaaaata

SEQ ID NO: 808050 - DNA, 20 bp, Artificial
  CRISPR gRNA sequence
aagttggaagggaaaatatt

SEQ ID NO: 808051 - DNA, 20 bp, Artificial
  CRISPR gRNA sequence
agttggaagggaaaatattc

SEQ ID NO: 808052 - DNA, 20 bp, Artificial
  CRISPR gRNA sequence
gaagggaaaatattcatctg

SEQ ID NO: 808053 - DNA, 20 bp, Artificial
  CRISPR gRNA sequence
atctgaataaaagtcttgta

SEQ ID NO: 808054 - DNA, 20 bp, Artificial
  CRISPR gRNA sequence
aataaaagtcttgtaagaag

SEQ ID NO: 808055 - DNA, 20 bp, Artificial
  CRISPR gRNA sequence
gtaagaagtacatgcaaggg

SEQ ID NO: 808056 - DNA, 20 bp, Artificial
  CRISPR gRNA sequence
taagaagtacatgcaaggga

SEQ ID NO: 808057 - DNA, 20 bp, Artificial
  CRISPR gRNA sequence
agtcccaagactccatctcc

SEQ ID NO: 808058 - DNA, 20 bp, Artificial
  CRISPR gRNA sequence
catctcccaagatgccgagt

SEQ ID NO: 808059 - DNA, 20 bp, Artificial
  CRISPR gRNA sequence
ccaagatgccgagtcacaaa

SEQ ID NO: 808060 - DNA, 20 bp, Artificial
  CRISPR gRNA sequence
ccgggcagcctagagctgta

SEQ ID NO: 808061 - DNA, 20 bp, Artificial
  CRISPR gRNA sequence
gagctgtacactctcctcat

SEQ ID NO: 808062 - DNA, 20 bp, Artificial
  CRISPR gRNA sequence
tacactctcctcataatgga

SEQ ID NO: 808063 - DNA, 20 bp, Artificial
  CRISPR gRNA sequence
tcctcataatggatggtttt

SEQ ID NO: 808064 - DNA, 20 bp, Artificial
  CRISPR gRNA sequence
ctcataatggatggttttgg

SEQ ID NO: 808065 - DNA, 20 bp, Artificial
  CRISPR gRNA sequence
ataatggatggttttgggat

SEQ ID NO: 808066 - DNA, 20 bp, Artificial
  CRISPR gRNA sequence
tgggatgagatagaactggg

SEQ ID NO: 808067 - DNA, 20 bp, Artificial
  CRISPR gRNA sequence
gggatgagatagaactggga

SEQ ID NO: 808068 - DNA, 20 bp, Artificial
  CRISPR gRNA sequence
ggatgagatagaactgggat

SEQ ID NO: 808069 - DNA, 20 bp, Artificial
  CRISPR gRNA sequence
ggatggcagagaatgggtgt

SEQ ID NO: 808070 - DNA, 20 bp, Artificial
  CRISPR gRNA sequence
agctgtctgggcctgagcaa

SEQ ID NO: 808071 - DNA, 20 bp, Artificial
  CRISPR gRNA sequence
tctgggcctgagcaatatta

SEQ ID NO: 808072 - DNA, 20 bp, Artificial
  CRISPR gRNA sequence
ggcctgagcaatattaaaat

SEQ ID NO: 808073 - DNA, 20 bp, Artificial
  CRISPR gRNA sequence
agcaatattaaaatcttaac

SEQ ID NO: 808074 - DNA, 20 bp, Artificial
  CRISPR gRNA sequence
aaatcttaaccatggcaatt

SEQ ID NO: 808075 - DNA, 20 bp, Artificial
  CRISPR gRNA sequence
aaccatggcaatttctaggc

SEQ ID NO: 808076 - DNA, 20 bp, Artificial
  CRISPR gRNA sequence
accatggcaatttctaggca

SEQ ID NO: 808077 - DNA, 20 bp, Artificial
  CRISPR gRNA sequence
ctaggcaatggattctaaat

SEQ ID NO: 808078 - DNA, 20 bp, Artificial
  CRISPR gRNA sequence
taggcaatggattctaaatt

SEQ ID NO: 808079 - DNA, 20 bp, Artificial
  CRISPR gRNA sequence
ggcaatggattctaaattat

SEQ ID NO: 808080 - DNA, 20 bp, Artificial
  CRISPR gRNA sequence
taaattatttttgttttctt

SEQ ID NO: 808081 - DNA, 20 bp, Artificial
  CRISPR gRNA sequence
aattatttttgttttcttta

SEQ ID NO: 808082 - DNA, 20 bp, Artificial
  CRISPR gRNA sequence
tttttgttttctttatactt

SEQ ID NO: 808083 - DNA, 20 bp, Artificial
  CRISPR gRNA sequence
ttgttttctttatacttttt

SEQ ID NO: 808084 - DNA, 20 bp, Artificial
  CRISPR gRNA sequence
tgttttctttatactttttt

SEQ ID NO: 808085 - DNA, 20 bp, Artificial
  CRISPR gRNA sequence
gttttctttatactttttta

SEQ ID NO: 808086 - DNA, 20 bp, Artificial
  CRISPR gRNA sequence
ttttctttatacttttttat

SEQ ID NO: 808087 - DNA, 20 bp, Artificial
  CRISPR gRNA sequence
tctttatacttttttatttt

SEQ ID NO: 808088 - DNA, 20 bp, Artificial
  CRISPR gRNA sequence
ctttatacttttttattttt

SEQ ID NO: 808089 - DNA, 20 bp, Artificial
  CRISPR gRNA sequence
tttatacttttttatttttt

SEQ ID NO: 808090 - DNA, 20 bp, Artificial
  CRISPR gRNA sequence
tatacttttttattttttat

SEQ ID NO: 808091 - DNA, 20 bp, Artificial
  CRISPR gRNA sequence
atacttttttattttttatt

SEQ ID NO: 808092 - DNA, 20 bp, Artificial
  CRISPR gRNA sequence
tacttttttattttttattt

SEQ ID NO: 808093 - DNA, 20 bp, Artificial
  CRISPR gRNA sequence
ttttattttttatttttata

SEQ ID NO: 808094 - DNA, 20 bp, Artificial
  CRISPR gRNA sequence
tttattttttatttttatac

SEQ ID NO: 808095 - DNA, 20 bp, Artificial
  CRISPR gRNA sequence
ttattttttatttttatact

SEQ ID NO: 808096 - DNA, 20 bp, Artificial
  CRISPR gRNA sequence
tattttttatttttatactc

SEQ ID NO: 808097 - DNA, 20 bp, Artificial
  CRISPR gRNA sequence
attttttatttttatactca

SEQ ID NO: 808098 - DNA, 20 bp, Artificial
  CRISPR gRNA sequence
ttttttatttttatactcat

SEQ ID NO: 808099 - DNA, 20 bp, Artificial
  CRISPR gRNA sequence
tttatttttatactcataaa

SEQ ID NO: 808100 - DNA, 20 bp, Artificial
  CRISPR gRNA sequence
ttatttttatactcataaaa

SEQ ID NO: 808101 - DNA, 20 bp, Artificial
  CRISPR gRNA sequence
tatttttatactcataaaat

SEQ ID NO: 808102 - DNA, 20 bp, Artificial
  CRISPR gRNA sequence
atttttatactcataaaatc

SEQ ID NO: 808103 - DNA, 20 bp, Artificial
  CRISPR gRNA sequence
tttttatactcataaaatca

SEQ ID NO: 808104 - DNA, 20 bp, Artificial
  CRISPR gRNA sequence
ttatactcataaaatcagta

SEQ ID NO: 808105 - DNA, 20 bp, Artificial
  CRISPR gRNA sequence
tatactcataaaatcagtaa

SEQ ID NO: 808106 - DNA, 20 bp, Artificial
  CRISPR gRNA sequence
atactcataaaatcagtaat

SEQ ID NO: 808107 - DNA, 20 bp, Artificial
  CRISPR gRNA sequence
tactcataaaatcagtaatt

SEQ ID NO: 808108 - DNA, 20 bp, Artificial
  CRISPR gRNA sequence
ataaaatcagtaatttaaaa

SEQ ID NO: 808109 - DNA, 20 bp, Artificial
  CRISPR gRNA sequence
aaaaaatgttctgaaacttg

SEQ ID NO: 808110 - DNA, 20 bp, Artificial
  CRISPR gRNA sequence
aaaaatgttctgaaacttgt

SEQ ID NO: 808111 - DNA, 20 bp, Artificial
  CRISPR gRNA sequence
tgaaacttgttattgttgta

SEQ ID NO: 808112 - DNA, 20 bp, Artificial
  CRISPR gRNA sequence
aaacttgttattgttgtacg

SEQ ID NO: 808113 - DNA, 20 bp, Artificial
  CRISPR gRNA sequence
gttattgttgtacgttattc

SEQ ID NO: 808114 - DNA, 20 bp, Artificial
  CRISPR gRNA sequence
ttattgttgtacgttattct

SEQ ID NO: 808115 - DNA, 20 bp, Artificial
  CRISPR gRNA sequence
ttgttgtacgttattctttt

SEQ ID NO: 808116 - DNA, 20 bp, Artificial
  CRISPR gRNA sequence
ttgtacgttattcttttttg

SEQ ID NO: 808117 - DNA, 20 bp, Artificial
  CRISPR gRNA sequence
tacgttattcttttttgagt

SEQ ID NO: 808118 - DNA, 20 bp, Artificial
  CRISPR gRNA sequence
ttcttttttgagttgataga

SEQ ID NO: 808119 - DNA, 20 bp, Artificial
  CRISPR gRNA sequence
ttttttgagttgatagactc

SEQ ID NO: 808120 - DNA, 20 bp, Artificial
  CRISPR gRNA sequence
ttttgagttgatagactcaa

SEQ ID NO: 808121 - DNA, 20 bp, Artificial
  CRISPR gRNA sequence
tttgagttgatagactcaac

SEQ ID NO: 808122 - DNA, 20 bp, Artificial
  CRISPR gRNA sequence
ttgagttgatagactcaact

SEQ ID NO: 808123 - DNA, 20 bp, Artificial
  CRISPR gRNA sequence
tgagttgatagactcaacta

SEQ ID NO: 808124 - DNA, 20 bp, Artificial
  CRISPR gRNA sequence
gagttgatagactcaactaa

SEQ ID NO: 808125 - DNA, 20 bp, Artificial
  CRISPR gRNA sequence
agttgatagactcaactaaa

SEQ ID NO: 808126 - DNA, 20 bp, Artificial
  CRISPR gRNA sequence
atagactcaactaaaattaa

SEQ ID NO: 808127 - DNA, 20 bp, Artificial
  CRISPR gRNA sequence
aactaaaattaaacaaaatt

SEQ ID NO: 808128 - DNA, 20 bp, Artificial
  CRISPR gRNA sequence
aaattaaacaaaatttattt

SEQ ID NO: 808129 - DNA, 20 bp, Artificial
  CRISPR gRNA sequence
aacaaaatttattttaatat

SEQ ID NO: 808130 - DNA, 20 bp, Artificial
  CRISPR gRNA sequence
attttaatattgttttttag

SEQ ID NO: 808131 - DNA, 20 bp, Artificial
  CRISPR gRNA sequence
ttttaatattgttttttagt

SEQ ID NO: 808132 - DNA, 20 bp, Artificial
  CRISPR gRNA sequence
taatattgttttttagtatt

SEQ ID NO: 808133 - DNA, 20 bp, Artificial
  CRISPR gRNA sequence
aatattgttttttagtattt

SEQ ID NO: 808134 - DNA, 20 bp, Artificial
  CRISPR gRNA sequence
atattgttttttagtattta

SEQ ID NO: 808135 - DNA, 20 bp, Artificial
  CRISPR gRNA sequence
ttttttagtatttagtcaaa

SEQ ID NO: 808136 - DNA, 20 bp, Artificial
  CRISPR gRNA sequence
tttagtatttagtcaaattt

SEQ ID NO: 808137 - DNA, 20 bp, Artificial
  CRISPR gRNA sequence
ttagtatttagtcaaatttg

SEQ ID NO: 808138 - DNA, 20 bp, Artificial
  CRISPR gRNA sequence
tagtatttagtcaaatttgg

SEQ ID NO: 808139 - DNA, 20 bp, Artificial
  CRISPR gRNA sequence
agtatttagtcaaatttggt

SEQ ID NO: 808140 - DNA, 20 bp, Artificial
  CRISPR gRNA sequence
gtatttagtcaaatttggtc

SEQ ID NO: 808141 - DNA, 20 bp, Artificial
  CRISPR gRNA sequence
agtcaaatttggtcaaaatc

SEQ ID NO: 808142 - DNA, 20 bp, Artificial
  CRISPR gRNA sequence
gtcaaatttggtcaaaatca

SEQ ID NO: 808143 - DNA, 20 bp, Artificial
  CRISPR gRNA sequence
ggtcaaaatcagacaccttt

SEQ ID NO: 808144 - DNA, 20 bp, Artificial
  CRISPR gRNA sequence
gtcaaaatcagacacctttt

SEQ ID NO: 808145 - DNA, 20 bp, Artificial
  CRISPR gRNA sequence
ttaaatttattatataataa

SEQ ID NO: 808146 - DNA, 20 bp, Artificial
  CRISPR gRNA sequence
taaatttattatataataaa

SEQ ID NO: 808147 - DNA, 20 bp, Artificial
  CRISPR gRNA sequence
aaatttattatataataaac

SEQ ID NO: 808148 - DNA, 20 bp, Artificial
  CRISPR gRNA sequence
aatttattatataataaact

SEQ ID NO: 808149 - DNA, 20 bp, Artificial
  CRISPR gRNA sequence
attatataataaactataag

SEQ ID NO: 808150 - DNA, 20 bp, Artificial
  CRISPR gRNA sequence
ttatataataaactataaga

SEQ ID NO: 808151 - DNA, 20 bp, Artificial
  CRISPR gRNA sequence
tataataaactataagaaac

SEQ ID NO: 808152 - DNA, 20 bp, Artificial
  CRISPR gRNA sequence
taagaaacattgataaacgg

SEQ ID NO: 808153 - DNA, 20 bp, Artificial
  CRISPR gRNA sequence
ataaacggacagaaagacaa

SEQ ID NO: 808154 - DNA, 20 bp, Artificial
  CRISPR gRNA sequence
cattaacactaatatcccac

SEQ ID NO: 808155 - DNA, 20 bp, Artificial
  CRISPR gRNA sequence
acactaatatcccactttat

SEQ ID NO: 808156 - DNA, 20 bp, Artificial
  CRISPR gRNA sequence
atatcccactttattatatt

SEQ ID NO: 808157 - DNA, 20 bp, Artificial
  CRISPR gRNA sequence
tattatattgaccaggtgga

SEQ ID NO: 808158 - DNA, 20 bp, Artificial
  CRISPR gRNA sequence
attatattgaccaggtggac

SEQ ID NO: 808159 - DNA, 20 bp, Artificial
  CRISPR gRNA sequence
ttatattgaccaggtggacc

SEQ ID NO: 808160 - DNA, 20 bp, Artificial
  CRISPR gRNA sequence
tattgaccaggtggacctaa

SEQ ID NO: 808161 - DNA, 20 bp, Artificial
  CRISPR gRNA sequence
accaggtggacctaaaatat

SEQ ID NO: 808162 - DNA, 20 bp, Artificial
  CRISPR gRNA sequence
aaatatagacacatagaagc

SEQ ID NO: 808163 - DNA, 20 bp, Artificial
  CRISPR gRNA sequence
taatcatgtgcttaagagtg

SEQ ID NO: 808164 - DNA, 20 bp, Artificial
  CRISPR gRNA sequence
aagagtggtatagattgtgt

SEQ ID NO: 808165 - DNA, 20 bp, Artificial
  CRISPR gRNA sequence
agagtggtatagattgtgtg

SEQ ID NO: 808166 - DNA, 20 bp, Artificial
  CRISPR gRNA sequence
tgtgtacaatgcagaggaaa

SEQ ID NO: 808167 - DNA, 20 bp, Artificial
  CRISPR gRNA sequence
acagattaagcaagagagtg

SEQ ID NO: 808168 - DNA, 20 bp, Artificial
  CRISPR gRNA sequence
cagattaagcaagagagtgt

SEQ ID NO: 808169 - DNA, 20 bp, Artificial
  CRISPR gRNA sequence
agcaagagagtgttgtgtat

SEQ ID NO: 808170 - DNA, 20 bp, Artificial
  CRISPR gRNA sequence
tgtatgtaggctgggcacag

SEQ ID NO: 808171 - DNA, 20 bp, Artificial
  CRISPR gRNA sequence
ggcacagtggcttacgcctg

SEQ ID NO: 808172 - DNA, 20 bp, Artificial
  CRISPR gRNA sequence
acgcctggaatcccagcact

SEQ ID NO: 808173 - DNA, 20 bp, Artificial
  CRISPR gRNA sequence
cgcctggaatcccagcactt

SEQ ID NO: 808174 - DNA, 20 bp, Artificial
  CRISPR gRNA sequence
gaatcccagcactttgggag

SEQ ID NO: 808175 - DNA, 20 bp, Artificial
  CRISPR gRNA sequence
tgggaggccaaggcaggagg

SEQ ID NO: 808176 - DNA, 20 bp, Artificial
  CRISPR gRNA sequence
gggaggccaaggcaggagga

SEQ ID NO: 808177 - DNA, 20 bp, Artificial
  CRISPR gRNA sequence
ggaggccaaggcaggaggat

SEQ ID NO: 808178 - DNA, 20 bp, Artificial
  CRISPR gRNA sequence
cttgagccgaggagtttgag

SEQ ID NO: 808179 - DNA, 20 bp, Artificial
  CRISPR gRNA sequence
gagccgaggagtttgagacc

SEQ ID NO: 808180 - DNA, 20 bp, Artificial
  CRISPR gRNA sequence
agccgaggagtttgagacca

SEQ ID NO: 808181 - DNA, 20 bp, Artificial
  CRISPR gRNA sequence
gagaccatcctgggcaacat

SEQ ID NO: 808182 - DNA, 20 bp, Artificial
  CRISPR gRNA sequence
agaccatcctgggcaacata

SEQ ID NO: 808183 - DNA, 20 bp, Artificial
  CRISPR gRNA sequence
ggcaacatagtgagacccca

SEQ ID NO: 808184 - DNA, 20 bp, Artificial
  CRISPR gRNA sequence
tacaaaaaataaaaataaaa

SEQ ID NO: 808185 - DNA, 20 bp, Artificial
  CRISPR gRNA sequence
caaaaaataaaaataaaaaa

SEQ ID NO: 808186 - DNA, 20 bp, Artificial
  CRISPR gRNA sequence
tagtcccagctactcaggag

SEQ ID NO: 808187 - DNA, 20 bp, Artificial
  CRISPR gRNA sequence
ctcaggaggctgaggtggga

SEQ ID NO: 808188 - DNA, 20 bp, Artificial
  CRISPR gRNA sequence
aggaggctgaggtgggaaga

SEQ ID NO: 808189 - DNA, 20 bp, Artificial
  CRISPR gRNA sequence
aggtgggaagatagcttgag

SEQ ID NO: 808190 - DNA, 20 bp, Artificial
  CRISPR gRNA sequence
gagtccaaaagttgaggctg

SEQ ID NO: 808191 - DNA, 20 bp, Artificial
  CRISPR gRNA sequence
agtccaaaagttgaggctgc

SEQ ID NO: 808192 - DNA, 20 bp, Artificial
  CRISPR gRNA sequence
aggctgcagtgagccacggt

SEQ ID NO: 808193 - DNA, 20 bp, Artificial
  CRISPR gRNA sequence
cagtgagccacggtcatacc

SEQ ID NO: 808194 - DNA, 20 bp, Artificial
  CRISPR gRNA sequence
cactccaacctgggtgatag

SEQ ID NO: 808195 - DNA, 20 bp, Artificial
  CRISPR gRNA sequence
caacctgggtgatagagcaa

SEQ ID NO: 808196 - DNA, 20 bp, Artificial
  CRISPR gRNA sequence
ggtgatagagcaagactctg

SEQ ID NO: 808197 - DNA, 20 bp, Artificial
  CRISPR gRNA sequence
tgtctctaaaaaaaaattga

SEQ ID NO: 808198 - DNA, 20 bp, Artificial
  CRISPR gRNA sequence
tctctaaaaaaaaattgaat

SEQ ID NO: 808199 - DNA, 20 bp, Artificial
  CRISPR gRNA sequence
taaaaaaaaattgaattaaa

SEQ ID NO: 808200 - DNA, 20 bp, Artificial
  CRISPR gRNA sequence
aaaaaaaattgaattaaatt

SEQ ID NO: 808201 - DNA, 20 bp, Artificial
  CRISPR gRNA sequence
aattaaattttaaaaaagca

SEQ ID NO: 808202 - DNA, 20 bp, Artificial
  CRISPR gRNA sequence
aattttaaaaaagcagagtg

SEQ ID NO: 808203 - DNA, 20 bp, Artificial
  CRISPR gRNA sequence
taaaaaagcagagtgtagtg

SEQ ID NO: 808204 - DNA, 20 bp, Artificial
  CRISPR gRNA sequence
aaaaaagcagagtgtagtgt

SEQ ID NO: 808205 - DNA, 20 bp, Artificial
  CRISPR gRNA sequence
aaaaagcagagtgtagtgta

SEQ ID NO: 808206 - DNA, 20 bp, Artificial
  CRISPR gRNA sequence
tggacttggacacctggatt

SEQ ID NO: 808207 - DNA, 20 bp, Artificial
  CRISPR gRNA sequence
gacttggacacctggattgc

SEQ ID NO: 808208 - DNA, 20 bp, Artificial
  CRISPR gRNA sequence
ggacacctggattgctgaat

SEQ ID NO: 808209 - DNA, 20 bp, Artificial
  CRISPR gRNA sequence
gacacctggattgctgaatc

SEQ ID NO: 808210 - DNA, 20 bp, Artificial
  CRISPR gRNA sequence
gattgctgaatcaatttatt

SEQ ID NO: 808211 - DNA, 20 bp, Artificial
  CRISPR gRNA sequence
ctgaatcaatttattggccc

SEQ ID NO: 808212 - DNA, 20 bp, Artificial
  CRISPR gRNA sequence
aatcaatttattggccctta

SEQ ID NO: 808213 - DNA, 20 bp, Artificial
  CRISPR gRNA sequence
attggcccttatattattag

SEQ ID NO: 808214 - DNA, 20 bp, Artificial
  CRISPR gRNA sequence
ttggcccttatattattagc

SEQ ID NO: 808215 - DNA, 20 bp, Artificial
  CRISPR gRNA sequence
gcccttatattattagctat

SEQ ID NO: 808216 - DNA, 20 bp, Artificial
  CRISPR gRNA sequence
atattattagctatatacct

SEQ ID NO: 808217 - DNA, 20 bp, Artificial
  CRISPR gRNA sequence
tattattagctatatacctt

SEQ ID NO: 808218 - DNA, 20 bp, Artificial
  CRISPR gRNA sequence
ttagctatataccttgggca

SEQ ID NO: 808219 - DNA, 20 bp, Artificial
  CRISPR gRNA sequence
gctatataccttgggcaagt

SEQ ID NO: 808220 - DNA, 20 bp, Artificial
  CRISPR gRNA sequence
tataccttgggcaagttagt

SEQ ID NO: 808221 - DNA, 20 bp, Artificial
  CRISPR gRNA sequence
gggcaagttagttaacctct

SEQ ID NO: 808222 - DNA, 20 bp, Artificial
  CRISPR gRNA sequence
ggcaagttagttaacctctt

SEQ ID NO: 808223 - DNA, 20 bp, Artificial
  CRISPR gRNA sequence
gttaacctcttcatgttttt

SEQ ID NO: 808224 - DNA, 20 bp, Artificial
  CRISPR gRNA sequence
acctcttcatgtttttcttc

SEQ ID NO: 808225 - DNA, 20 bp, Artificial
  CRISPR gRNA sequence
ttcatgtttttcttcctcac

SEQ ID NO: 808226 - DNA, 20 bp, Artificial
  CRISPR gRNA sequence
catgtttttcttcctcacct

SEQ ID NO: 808227 - DNA, 20 bp, Artificial
  CRISPR gRNA sequence
atgtttttcttcctcaccta

SEQ ID NO: 808228 - DNA, 20 bp, Artificial
  CRISPR gRNA sequence
ttcttcctcacctataaaat

SEQ ID NO: 808229 - DNA, 20 bp, Artificial
  CRISPR gRNA sequence
tcttcctcacctataaaatg

SEQ ID NO: 808230 - DNA, 20 bp, Artificial
  CRISPR gRNA sequence
cttcctcacctataaaatgg

SEQ ID NO: 808231 - DNA, 20 bp, Artificial
  CRISPR gRNA sequence
ttcctcacctataaaatggg

SEQ ID NO: 808232 - DNA, 20 bp, Artificial
  CRISPR gRNA sequence
cctcacctataaaatgggaa

SEQ ID NO: 808233 - DNA, 20 bp, Artificial
  CRISPR gRNA sequence
ctcacctataaaatgggaag

SEQ ID NO: 808234 - DNA, 20 bp, Artificial
  CRISPR gRNA sequence
acctataaaatgggaagcag

SEQ ID NO: 808235 - DNA, 20 bp, Artificial
  CRISPR gRNA sequence
taaaatgggaagcagggagt

SEQ ID NO: 808236 - DNA, 20 bp, Artificial
  CRISPR gRNA sequence
cagagggctactgtgaggat

SEQ ID NO: 808237 - DNA, 20 bp, Artificial
  CRISPR gRNA sequence
agagggctactgtgaggatt

SEQ ID NO: 808238 - DNA, 20 bp, Artificial
  CRISPR gRNA sequence
ctgtgaggattaaatgagct

SEQ ID NO: 808239 - DNA, 20 bp, Artificial
  CRISPR gRNA sequence
tgaggattaaatgagctagt

SEQ ID NO: 808240 - DNA, 20 bp, Artificial
  CRISPR gRNA sequence
aatgagctagtctaaacaca

SEQ ID NO: 808241 - DNA, 20 bp, Artificial
  CRISPR gRNA sequence
gtctaaacacacttctaatg

SEQ ID NO: 808242 - DNA, 20 bp, Artificial
  CRISPR gRNA sequence
aacacacttctaatgtctta

SEQ ID NO: 808243 - DNA, 20 bp, Artificial
  CRISPR gRNA sequence
ctaatgtcttagaacagaag

SEQ ID NO: 808244 - DNA, 20 bp, Artificial
  CRISPR gRNA sequence
taatgtcttagaacagaagc

SEQ ID NO: 808245 - DNA, 20 bp, Artificial
  CRISPR gRNA sequence
atgtcttagaacagaagcct

SEQ ID NO: 808246 - DNA, 20 bp, Artificial
  CRISPR gRNA sequence
agaacagaagcctggtgtta

SEQ ID NO: 808247 - DNA, 20 bp, Artificial
  CRISPR gRNA sequence
gaacagaagcctggtgttat

SEQ ID NO: 808248 - DNA, 20 bp, Artificial
  CRISPR gRNA sequence
gtgttataataataaagtta

SEQ ID NO: 808249 - DNA, 20 bp, Artificial
  CRISPR gRNA sequence
taataataaagttactcatt

SEQ ID NO: 808250 - DNA, 20 bp, Artificial
  CRISPR gRNA sequence
ctcattactgtatcttaaag

SEQ ID NO: 808251 - DNA, 20 bp, Artificial
  CRISPR gRNA sequence
attactgtatcttaaagtag

SEQ ID NO: 808252 - DNA, 20 bp, Artificial
  CRISPR gRNA sequence
ctgtatcttaaagtagacca

SEQ ID NO: 808253 - DNA, 20 bp, Artificial
  CRISPR gRNA sequence
tatcttaaagtagaccatgc

SEQ ID NO: 808254 - DNA, 20 bp, Artificial
  CRISPR gRNA sequence
aaagtagaccatgccaaaag

SEQ ID NO: 808255 - DNA, 20 bp, Artificial
  CRISPR gRNA sequence
aagtagaccatgccaaaagt

SEQ ID NO: 808256 - DNA, 20 bp, Artificial
  CRISPR gRNA sequence
ggattgggacaagtaagaag

SEQ ID NO: 808257 - DNA, 20 bp, Artificial
  CRISPR gRNA sequence
ggacaagtaagaaggaatag

SEQ ID NO: 808258 - DNA, 20 bp, Artificial
  CRISPR gRNA sequence
caaaaaaataaccaacatga

SEQ ID NO: 808259 - DNA, 20 bp, Artificial
  CRISPR gRNA sequence
atggcagtggtgttggtgga

SEQ ID NO: 808260 - DNA, 20 bp, Artificial
  CRISPR gRNA sequence
gtggagcagctcaacttgag

SEQ ID NO: 808261 - DNA, 20 bp, Artificial
  CRISPR gRNA sequence
aacttgaggaaaagttttgt

SEQ ID NO: 808262 - DNA, 20 bp, Artificial
  CRISPR gRNA sequence
gaggaaaagttttgttgaag

SEQ ID NO: 808263 - DNA, 20 bp, Artificial
  CRISPR gRNA sequence
aggaaaagttttgttgaaga

SEQ ID NO: 808264 - DNA, 20 bp, Artificial
  CRISPR gRNA sequence
tgttgaagagtggtagatga

SEQ ID NO: 808265 - DNA, 20 bp, Artificial
  CRISPR gRNA sequence
gttgaagagtggtagatgag

SEQ ID NO: 808266 - DNA, 20 bp, Artificial
  CRISPR gRNA sequence
ttgaagagtggtagatgagt

SEQ ID NO: 808267 - DNA, 20 bp, Artificial
  CRISPR gRNA sequence
aagagtggtagatgagttgg

SEQ ID NO: 808268 - DNA, 20 bp, Artificial
  CRISPR gRNA sequence
gcttagtgaaatgtggctag

SEQ ID NO: 808269 - DNA, 20 bp, Artificial
  CRISPR gRNA sequence
agtgaaatgtggctagttgt

SEQ ID NO: 808270 - DNA, 20 bp, Artificial
  CRISPR gRNA sequence
gtgaaatgtggctagttgtc

SEQ ID NO: 808271 - DNA, 20 bp, Artificial
  CRISPR gRNA sequence
gttgtcaaaaggcctgaaaa

SEQ ID NO: 808272 - DNA, 20 bp, Artificial
  CRISPR gRNA sequence
tcaaaaggcctgaaaaactc

SEQ ID NO: 808273 - DNA, 20 bp, Artificial
  CRISPR gRNA sequence
aaaaactctgggaaggattt

SEQ ID NO: 808274 - DNA, 20 bp, Artificial
  CRISPR gRNA sequence
tgggaaggatttgatatgat

SEQ ID NO: 808275 - DNA, 20 bp, Artificial
  CRISPR gRNA sequence
ggaaggatttgatatgatct

SEQ ID NO: 808276 - DNA, 20 bp, Artificial
  CRISPR gRNA sequence
gatatgatctatagagacaa

SEQ ID NO: 808277 - DNA, 20 bp, Artificial
  CRISPR gRNA sequence
atatgatctatagagacaag

SEQ ID NO: 808278 - DNA, 20 bp, Artificial
  CRISPR gRNA sequence
tagagacaagagatgacatg

SEQ ID NO: 808279 - DNA, 20 bp, Artificial
  CRISPR gRNA sequence
ggggggattagatctggcag

SEQ ID NO: 808280 - DNA, 20 bp, Artificial
  CRISPR gRNA sequence
gggggattagatctggcagt

SEQ ID NO: 808281 - DNA, 20 bp, Artificial
  CRISPR gRNA sequence
gatctggcagtggtatgctg

SEQ ID NO: 808282 - DNA, 20 bp, Artificial
  CRISPR gRNA sequence
gcagtggtatgctggtgcct

SEQ ID NO: 808283 - DNA, 20 bp, Artificial
  CRISPR gRNA sequence
gtgcctctttaagggacctt

SEQ ID NO: 808284 - DNA, 20 bp, Artificial
  CRISPR gRNA sequence
tttaagggacctttccaaag

SEQ ID NO: 808285 - DNA, 20 bp, Artificial
  CRISPR gRNA sequence
taagggacctttccaaagct

SEQ ID NO: 808286 - DNA, 20 bp, Artificial
  CRISPR gRNA sequence
aagggacctttccaaagcta

SEQ ID NO: 808287 - DNA, 20 bp, Artificial
  CRISPR gRNA sequence
agggacctttccaaagctat

SEQ ID NO: 808288 - DNA, 20 bp, Artificial
  CRISPR gRNA sequence
tccaaagctatctagaaata

SEQ ID NO: 808289 - DNA, 20 bp, Artificial
  CRISPR gRNA sequence
ccaaagctatctagaaatat

SEQ ID NO: 808290 - DNA, 20 bp, Artificial
  CRISPR gRNA sequence
caaagctatctagaaatatt

SEQ ID NO: 808291 - DNA, 20 bp, Artificial
  CRISPR gRNA sequence
tctagaaatatttaaattcc

SEQ ID NO: 808292 - DNA, 20 bp, Artificial
  CRISPR gRNA sequence
gaaatatttaaattcctcat

SEQ ID NO: 808293 - DNA, 20 bp, Artificial
  CRISPR gRNA sequence
aaattcctcattaggtattg

SEQ ID NO: 808294 - DNA, 20 bp, Artificial
  CRISPR gRNA sequence
aattcctcattaggtattgg

SEQ ID NO: 808295 - DNA, 20 bp, Artificial
  CRISPR gRNA sequence
ctcattaggtattggtaaag

SEQ ID NO: 808296 - DNA, 20 bp, Artificial
  CRISPR gRNA sequence
attaggtattggtaaagaaa

SEQ ID NO: 808297 - DNA, 20 bp, Artificial
  CRISPR gRNA sequence
ggtattggtaaagaaaataa

SEQ ID NO: 808298 - DNA, 20 bp, Artificial
  CRISPR gRNA sequence
gtaaagaaaataagatatta

SEQ ID NO: 808299 - DNA, 20 bp, Artificial
  CRISPR gRNA sequence
gataagtcaaacctacctca

SEQ ID NO: 808300 - DNA, 20 bp, Artificial
  CRISPR gRNA sequence
cctcaagtagtctcttcatt

SEQ ID NO: 808301 - DNA, 20 bp, Artificial
  CRISPR gRNA sequence
aagtagtctcttcattgtac

SEQ ID NO: 808302 - DNA, 20 bp, Artificial
  CRISPR gRNA sequence
ttcattgtaccaaggcatca

SEQ ID NO: 808303 - DNA, 20 bp, Artificial
  CRISPR gRNA sequence
cattgtaccaaggcatcatt

SEQ ID NO: 808304 - DNA, 20 bp, Artificial
  CRISPR gRNA sequence
attgtaccaaggcatcattt

SEQ ID NO: 808305 - DNA, 20 bp, Artificial
  CRISPR gRNA sequence
taccaaggcatcatttccaa

SEQ ID NO: 808306 - DNA, 20 bp, Artificial
  CRISPR gRNA sequence
ccaaaattttggtttgattt

SEQ ID NO: 808307 - DNA, 20 bp, Artificial
  CRISPR gRNA sequence
caaaattttggtttgatttt

SEQ ID NO: 808308 - DNA, 20 bp, Artificial
  CRISPR gRNA sequence
tggtttgattttgttaaatc

SEQ ID NO: 808309 - DNA, 20 bp, Artificial
  CRISPR gRNA sequence
ggtttgattttgttaaatca

SEQ ID NO: 808310 - DNA, 20 bp, Artificial
  CRISPR gRNA sequence
gtttgattttgttaaatcat

SEQ ID NO: 808311 - DNA, 20 bp, Artificial
  CRISPR gRNA sequence
gattttgttaaatcattttg

SEQ ID NO: 808312 - DNA, 20 bp, Artificial
  CRISPR gRNA sequence
attttgttaaatcattttgg

SEQ ID NO: 808313 - DNA, 20 bp, Artificial
  CRISPR gRNA sequence
tgttaaatcattttggctac

SEQ ID NO: 808314 - DNA, 20 bp, Artificial
  CRISPR gRNA sequence
gttaaatcattttggctaca

SEQ ID NO: 808315 - DNA, 20 bp, Artificial
  CRISPR gRNA sequence
ttaaatcattttggctacag

SEQ ID NO: 808316 - DNA, 20 bp, Artificial
  CRISPR gRNA sequence
aatcattttggctacagggt

SEQ ID NO: 808317 - DNA, 20 bp, Artificial
  CRISPR gRNA sequence
tggctacagggtgcccccac

SEQ ID NO: 808318 - DNA, 20 bp, Artificial
  CRISPR gRNA sequence
ggctacagggtgcccccact

SEQ ID NO: 808319 - DNA, 20 bp, Artificial
  CRISPR gRNA sequence
gctacagggtgcccccactc

SEQ ID NO: 808320 - DNA, 20 bp, Artificial
  CRISPR gRNA sequence
cagggtgcccccactcccca

SEQ ID NO: 808321 - DNA, 20 bp, Artificial
  CRISPR gRNA sequence
cccacctagatttactcaga

SEQ ID NO: 808322 - DNA, 20 bp, Artificial
  CRISPR gRNA sequence
gatttactcagatattcatt

SEQ ID NO: 808323 - DNA, 20 bp, Artificial
  CRISPR gRNA sequence
actcagatattcattgctat

SEQ ID NO: 808324 - DNA, 20 bp, Artificial
  CRISPR gRNA sequence
ctcagatattcattgctatt

SEQ ID NO: 808325 - DNA, 20 bp, Artificial
  CRISPR gRNA sequence
agatattcattgctattgca

SEQ ID NO: 808326 - DNA, 20 bp, Artificial
  CRISPR gRNA sequence
attgctattgcatccaaata

SEQ ID NO: 808327 - DNA, 20 bp, Artificial
  CRISPR gRNA sequence
ctattgcatccaaatactta

SEQ ID NO: 808328 - DNA, 20 bp, Artificial
  CRISPR gRNA sequence
ttgcatccaaatacttagag

SEQ ID NO: 808329 - DNA, 20 bp, Artificial
  CRISPR gRNA sequence
catccaaatacttagagtgg

SEQ ID NO: 808330 - DNA, 20 bp, Artificial
  CRISPR gRNA sequence
agagtggtagattctgatat

SEQ ID NO: 808331 - DNA, 20 bp, Artificial
  CRISPR gRNA sequence
gagtggtagattctgatatc

SEQ ID NO: 808332 - DNA, 20 bp, Artificial
  CRISPR gRNA sequence
tgatatcacagatgtccttt

SEQ ID NO: 808333 - DNA, 20 bp, Artificial
  CRISPR gRNA sequence
atatcacagatgtccttttg

SEQ ID NO: 808334 - DNA, 20 bp, Artificial
  CRISPR gRNA sequence
ttgttgctgaaagtttgaga

SEQ ID NO: 808335 - DNA, 20 bp, Artificial
  CRISPR gRNA sequence
tgttgctgaaagtttgagag

SEQ ID NO: 808336 - DNA, 20 bp, Artificial
  CRISPR gRNA sequence
gttgctgaaagtttgagagg

SEQ ID NO: 808337 - DNA, 20 bp, Artificial
  CRISPR gRNA sequence
ttgctgaaagtttgagaggc

SEQ ID NO: 808338 - DNA, 20 bp, Artificial
  CRISPR gRNA sequence
ctgaaagtttgagaggcagt

SEQ ID NO: 808339 - DNA, 20 bp, Artificial
  CRISPR gRNA sequence
aaagtttgagaggcagtgag

SEQ ID NO: 808340 - DNA, 20 bp, Artificial
  CRISPR gRNA sequence
gagaggcagtgagctgagaa

SEQ ID NO: 808341 - DNA, 20 bp, Artificial
  CRISPR gRNA sequence
agaggcagtgagctgagaaa

SEQ ID NO: 808342 - DNA, 20 bp, Artificial
  CRISPR gRNA sequence
agaaaaatcctgctgaacta

SEQ ID NO: 808343 - DNA, 20 bp, Artificial
  CRISPR gRNA sequence
ctgaactaaacaaaaaccca

SEQ ID NO: 808344 - DNA, 20 bp, Artificial
  CRISPR gRNA sequence
aactaaacaaaaacccaaaa

SEQ ID NO: 808345 - DNA, 20 bp, Artificial
  CRISPR gRNA sequence
aacaaaaacccaaaactggt

SEQ ID NO: 808346 - DNA, 20 bp, Artificial
  CRISPR gRNA sequence
gtagtctgcatgcaatctag

SEQ ID NO: 808347 - DNA, 20 bp, Artificial
  CRISPR gRNA sequence
catgcaatctaggttggcat

SEQ ID NO: 808348 - DNA, 20 bp, Artificial
  CRISPR gRNA sequence
ggttggcatgttcatgcatg

SEQ ID NO: 808349 - DNA, 20 bp, Artificial
  CRISPR gRNA sequence
gcatgttcatgcatgaacag

SEQ ID NO: 808350 - DNA, 20 bp, Artificial
  CRISPR gRNA sequence
atgcatgaacaggtattaga

SEQ ID NO: 808351 - DNA, 20 bp, Artificial
  CRISPR gRNA sequence
gacagaaccctggcctcttg

SEQ ID NO: 808352 - DNA, 20 bp, Artificial
  CRISPR gRNA sequence
gcctcttggacaactccaat

SEQ ID NO: 808353 - DNA, 20 bp, Artificial
  CRISPR gRNA sequence
ttggacaactccaatgacca

SEQ ID NO: 808354 - DNA, 20 bp, Artificial
  CRISPR gRNA sequence
ggacaactccaatgaccaaa

SEQ ID NO: 808355 - DNA, 20 bp, Artificial
  CRISPR gRNA sequence
gacaactccaatgaccaaat

SEQ ID NO: 808356 - DNA, 20 bp, Artificial
  CRISPR gRNA sequence
caatgaccaaatagtagttg

SEQ ID NO: 808357 - DNA, 20 bp, Artificial
  CRISPR gRNA sequence
gttacttacttctgtttata

SEQ ID NO: 808358 - DNA, 20 bp, Artificial
  CRISPR gRNA sequence
cttacttctgtttataaagg

SEQ ID NO: 808359 - DNA, 20 bp, Artificial
  CRISPR gRNA sequence
acttctgtttataaaggctc

SEQ ID NO: 808360 - DNA, 20 bp, Artificial
  CRISPR gRNA sequence
cttctgtttataaaggctca

SEQ ID NO: 808361 - DNA, 20 bp, Artificial
  CRISPR gRNA sequence
ctgtttataaaggctcatgc

SEQ ID NO: 808362 - DNA, 20 bp, Artificial
  CRISPR gRNA sequence
tgtttataaaggctcatgca

SEQ ID NO: 808363 - DNA, 20 bp, Artificial
  CRISPR gRNA sequence
tttataaaggctcatgcagg

SEQ ID NO: 808364 - DNA, 20 bp, Artificial
  CRISPR gRNA sequence
ataaaggctcatgcaggaat

SEQ ID NO: 808365 - DNA, 20 bp, Artificial
  CRISPR gRNA sequence
taaaggctcatgcaggaatg

SEQ ID NO: 808366 - DNA, 20 bp, Artificial
  CRISPR gRNA sequence
atgcaggaatgacaaattga

SEQ ID NO: 808367 - DNA, 20 bp, Artificial
  CRISPR gRNA sequence
acttacttcagccaaatata

SEQ ID NO: 808368 - DNA, 20 bp, Artificial
  CRISPR gRNA sequence
acttcagccaaatatatggc

SEQ ID NO: 808369 - DNA, 20 bp, Artificial
  CRISPR gRNA sequence
cttcagccaaatatatggcc

SEQ ID NO: 808370 - DNA, 20 bp, Artificial
  CRISPR gRNA sequence
cagccaaatatatggccaag

SEQ ID NO: 808371 - DNA, 20 bp, Artificial
  CRISPR gRNA sequence
agccaaatatatggccaaga

SEQ ID NO: 808372 - DNA, 20 bp, Artificial
  CRISPR gRNA sequence
cccccctcatctcttggtgc

SEQ ID NO: 808373 - DNA, 20 bp, Artificial
  CRISPR gRNA sequence
atctcttggtgcctgtgatg

SEQ ID NO: 808374 - DNA, 20 bp, Artificial
  CRISPR gRNA sequence
ttggtgcctgtgatgattaa

SEQ ID NO: 808375 - DNA, 20 bp, Artificial
  CRISPR gRNA sequence
ggtgcctgtgatgattaatt

SEQ ID NO: 808376 - DNA, 20 bp, Artificial
  CRISPR gRNA sequence
gtgcctgtgatgattaattt

SEQ ID NO: 808377 - DNA, 20 bp, Artificial
  CRISPR gRNA sequence
tgatgattaattttatgtgt

SEQ ID NO: 808378 - DNA, 20 bp, Artificial
  CRISPR gRNA sequence
attttatgtgtcatcttggc

SEQ ID NO: 808379 - DNA, 20 bp, Artificial
  CRISPR gRNA sequence
tatgtgtcatcttggctatg

SEQ ID NO: 808380 - DNA, 20 bp, Artificial
  CRISPR gRNA sequence
atgtgtcatcttggctatgg

SEQ ID NO: 808381 - DNA, 20 bp, Artificial
  CRISPR gRNA sequence
tgtgtcatcttggctatggt

SEQ ID NO: 808382 - DNA, 20 bp, Artificial
  CRISPR gRNA sequence
ggctatggtgctcagttgct

SEQ ID NO: 808383 - DNA, 20 bp, Artificial
  CRISPR gRNA sequence
gctatggtgctcagttgctt

SEQ ID NO: 808384 - DNA, 20 bp, Artificial
  CRISPR gRNA sequence
tggtgctcagttgcttagtc

SEQ ID NO: 808385 - DNA, 20 bp, Artificial
  CRISPR gRNA sequence
agttgcttagtcaaatgcta

SEQ ID NO: 808386 - DNA, 20 bp, Artificial
  CRISPR gRNA sequence
cttagtcaaatgctagtcta

SEQ ID NO: 808387 - DNA, 20 bp, Artificial
  CRISPR gRNA sequence
agtcaaatgctagtctatat

SEQ ID NO: 808388 - DNA, 20 bp, Artificial
  CRISPR gRNA sequence
gtcaaatgctagtctatatg

SEQ ID NO: 808389 - DNA, 20 bp, Artificial
  CRISPR gRNA sequence
gtctatatgttgctgtgaaa

SEQ ID NO: 808390 - DNA, 20 bp, Artificial
  CRISPR gRNA sequence
tatgttgctgtgaaagtatt

SEQ ID NO: 808391 - DNA, 20 bp, Artificial
  CRISPR gRNA sequence
ctgtgaaagtattttgtaga

SEQ ID NO: 808392 - DNA, 20 bp, Artificial
  CRISPR gRNA sequence
tgaaagtattttgtagatgt

SEQ ID NO: 808393 - DNA, 20 bp, Artificial
  CRISPR gRNA sequence
tgtagatgtaattatcattt

SEQ ID NO: 808394 - DNA, 20 bp, Artificial
  CRISPR gRNA sequence
gtagatgtaattatcatttg

SEQ ID NO: 808395 - DNA, 20 bp, Artificial
  CRISPR gRNA sequence
tagatgtaattatcatttgc

SEQ ID NO: 808396 - DNA, 20 bp, Artificial
  CRISPR gRNA sequence
tcatttgctatcagttaact

SEQ ID NO: 808397 - DNA, 20 bp, Artificial
  CRISPR gRNA sequence
gctatcagttaacttgaagt

SEQ ID NO: 808398 - DNA, 20 bp, Artificial
  CRISPR gRNA sequence
ctatcagttaacttgaagta

SEQ ID NO: 808399 - DNA, 20 bp, Artificial
  CRISPR gRNA sequence
tcagttaacttgaagtaaag

SEQ ID NO: 808400 - DNA, 20 bp, Artificial
  CRISPR gRNA sequence
acttgaagtaaagctgatta

SEQ ID NO: 808401 - DNA, 20 bp, Artificial
  CRISPR gRNA sequence
gaagtaaagctgattatctc

SEQ ID NO: 808402 - DNA, 20 bp, Artificial
  CRISPR gRNA sequence
aagtaaagctgattatctcc

SEQ ID NO: 808403 - DNA, 20 bp, Artificial
  CRISPR gRNA sequence
attatctcccatgatgtagg

SEQ ID NO: 808404 - DNA, 20 bp, Artificial
  CRISPR gRNA sequence
tctcccatgatgtaggttgg

SEQ ID NO: 808405 - DNA, 20 bp, Artificial
  CRISPR gRNA sequence
ccatgatgtaggttggcttc

SEQ ID NO: 808406 - DNA, 20 bp, Artificial
  CRISPR gRNA sequence
gcttcattcaatcagttgag

SEQ ID NO: 808407 - DNA, 20 bp, Artificial
  CRISPR gRNA sequence
cattcaatcagttgagggcc

SEQ ID NO: 808408 - DNA, 20 bp, Artificial
  CRISPR gRNA sequence
attcaatcagttgagggcct

SEQ ID NO: 808409 - DNA, 20 bp, Artificial
  CRISPR gRNA sequence
aatcagttgagggccttaag

SEQ ID NO: 808410 - DNA, 20 bp, Artificial
  CRISPR gRNA sequence
agggccttaagagcaaaaaa

SEQ ID NO: 808411 - DNA, 20 bp, Artificial
  CRISPR gRNA sequence
aagagcaaaaaactgaggtt

SEQ ID NO: 808412 - DNA, 20 bp, Artificial
  CRISPR gRNA sequence
agagcaaaaaactgaggttt

SEQ ID NO: 808413 - DNA, 20 bp, Artificial
  CRISPR gRNA sequence
aggtttcccagaaaagatgg

SEQ ID NO: 808414 - DNA, 20 bp, Artificial
  CRISPR gRNA sequence
cccagaaaagatggaattct

SEQ ID NO: 808415 - DNA, 20 bp, Artificial
  CRISPR gRNA sequence
ccagaaaagatggaattctg

SEQ ID NO: 808416 - DNA, 20 bp, Artificial
  CRISPR gRNA sequence
tgcctcaagactgtaaggta

SEQ ID NO: 808417 - DNA, 20 bp, Artificial
  CRISPR gRNA sequence
cctcaagactgtaaggtaga

SEQ ID NO: 808418 - DNA, 20 bp, Artificial
  CRISPR gRNA sequence
aagactgtaaggtagaaatc

SEQ ID NO: 808419 - DNA, 20 bp, Artificial
  CRISPR gRNA sequence
taaggtagaaatcctgcctg

SEQ ID NO: 808420 - DNA, 20 bp, Artificial
  CRISPR gRNA sequence
cctgggtttccagactgctg

SEQ ID NO: 808421 - DNA, 20 bp, Artificial
  CRISPR gRNA sequence
ggtttccagactgctggcct

SEQ ID NO: 808422 - DNA, 20 bp, Artificial
  CRISPR gRNA sequence
ccagactgctggcctgccct

SEQ ID NO: 808423 - DNA, 20 bp, Artificial
  CRISPR gRNA sequence
cagactgctggcctgcccta

SEQ ID NO: 808424 - DNA, 20 bp, Artificial
  CRISPR gRNA sequence
ctggcctgccctacacattt

SEQ ID NO: 808425 - DNA, 20 bp, Artificial
  CRISPR gRNA sequence
gcctgccctacacatttcaa

SEQ ID NO: 808426 - DNA, 20 bp, Artificial
  CRISPR gRNA sequence
ccctacacatttcaaacttg

SEQ ID NO: 808427 - DNA, 20 bp, Artificial
  CRISPR gRNA sequence
cacatttcaaacttgccagc

SEQ ID NO: 808428 - DNA, 20 bp, Artificial
  CRISPR gRNA sequence
caaacttgccagcccccaca

SEQ ID NO: 808429 - DNA, 20 bp, Artificial
  CRISPR gRNA sequence
aaacttgccagcccccacaa

SEQ ID NO: 808430 - DNA, 20 bp, Artificial
  CRISPR gRNA sequence
gccagcccccacaatcatgt

SEQ ID NO: 808431 - DNA, 20 bp, Artificial
  CRISPR gRNA sequence
ccagcccccacaatcatgtg

SEQ ID NO: 808432 - DNA, 20 bp, Artificial
  CRISPR gRNA sequence
cttcccctgagtctaagctt

SEQ ID NO: 808433 - DNA, 20 bp, Artificial
  CRISPR gRNA sequence
cccctgagtctaagcttttc

SEQ ID NO: 808434 - DNA, 20 bp, Artificial
  CRISPR gRNA sequence
ccctgagtctaagcttttca

SEQ ID NO: 808435 - DNA, 20 bp, Artificial
  CRISPR gRNA sequence
agtctaagcttttcatccaa

SEQ ID NO: 808436 - DNA, 20 bp, Artificial
  CRISPR gRNA sequence
agcttttcatccaaccaggc

SEQ ID NO: 808437 - DNA, 20 bp, Artificial
  CRISPR gRNA sequence
ttcatccaaccaggcttaat

SEQ ID NO: 808438 - DNA, 20 bp, Artificial
  CRISPR gRNA sequence
tcatccaaccaggcttaatg

SEQ ID NO: 808439 - DNA, 20 bp, Artificial
  CRISPR gRNA sequence
catccaaccaggcttaatga

SEQ ID NO: 808440 - DNA, 20 bp, Artificial
  CRISPR gRNA sequence
atccaaccaggcttaatgat

SEQ ID NO: 808441 - DNA, 20 bp, Artificial
  CRISPR gRNA sequence
aatgattttagtaacccact

SEQ ID NO: 808442 - DNA, 20 bp, Artificial
  CRISPR gRNA sequence
atgattttagtaacccactt

SEQ ID NO: 808443 - DNA, 20 bp, Artificial
  CRISPR gRNA sequence
tagtaacccacttcttctga

SEQ ID NO: 808444 - DNA, 20 bp, Artificial
  CRISPR gRNA sequence
agtaacccacttcttctgac

SEQ ID NO: 808445 - DNA, 20 bp, Artificial
  CRISPR gRNA sequence
gtaacccacttcttctgacc

SEQ ID NO: 808446 - DNA, 20 bp, Artificial
  CRISPR gRNA sequence
cttctgacccctagatcata

SEQ ID NO: 808447 - DNA, 20 bp, Artificial
  CRISPR gRNA sequence
ttctgacccctagatcatat

SEQ ID NO: 808448 - DNA, 20 bp, Artificial
  CRISPR gRNA sequence
ctgacccctagatcatatcc

SEQ ID NO: 808449 - DNA, 20 bp, Artificial
  CRISPR gRNA sequence
tgacccctagatcatatcct

SEQ ID NO: 808450 - DNA, 20 bp, Artificial
  CRISPR gRNA sequence
acccctagatcatatccttc

SEQ ID NO: 808451 - DNA, 20 bp, Artificial
  CRISPR gRNA sequence
gatcatatccttcctcctcc

SEQ ID NO: 808452 - DNA, 20 bp, Artificial
  CRISPR gRNA sequence
cctcctccacagattccagc

SEQ ID NO: 808453 - DNA, 20 bp, Artificial
  CRISPR gRNA sequence
ctcctccacagattccagct

SEQ ID NO: 808454 - DNA, 20 bp, Artificial
  CRISPR gRNA sequence
ctccacagattccagctcca

SEQ ID NO: 808455 - DNA, 20 bp, Artificial
  CRISPR gRNA sequence
cacagattccagctccaaac

SEQ ID NO: 808456 - DNA, 20 bp, Artificial
  CRISPR gRNA sequence
cagctccaaacctgtcaacc

SEQ ID NO: 808457 - DNA, 20 bp, Artificial
  CRISPR gRNA sequence
caaacctgtcaacctcatga

SEQ ID NO: 808458 - DNA, 20 bp, Artificial
  CRISPR gRNA sequence
tcaacctcatgaagagactt

SEQ ID NO: 808459 - DNA, 20 bp, Artificial
  CRISPR gRNA sequence
atgaagagacttgtgttttt

SEQ ID NO: 808460 - DNA, 20 bp, Artificial
  CRISPR gRNA sequence
gtgtttttcccatattactc

SEQ ID NO: 808461 - DNA, 20 bp, Artificial
  CRISPR gRNA sequence
tgtttttcccatattactct

SEQ ID NO: 808462 - DNA, 20 bp, Artificial
  CRISPR gRNA sequence
ttcccatattactcttgact

SEQ ID NO: 808463 - DNA, 20 bp, Artificial
  CRISPR gRNA sequence
tcccatattactcttgactc

SEQ ID NO: 808464 - DNA, 20 bp, Artificial
  CRISPR gRNA sequence
cccatattactcttgactca

SEQ ID NO: 808465 - DNA, 20 bp, Artificial
  CRISPR gRNA sequence
ccatattactcttgactcag

SEQ ID NO: 808466 - DNA, 20 bp, Artificial
  CRISPR gRNA sequence
ctcttgactcagagcccaca

SEQ ID NO: 808467 - DNA, 20 bp, Artificial
  CRISPR gRNA sequence
ttgactcagagcccacaaca

SEQ ID NO: 808468 - DNA, 20 bp, Artificial
  CRISPR gRNA sequence
gactcagagcccacaacaat

SEQ ID NO: 808469 - DNA, 20 bp, Artificial
  CRISPR gRNA sequence
actcagagcccacaacaatg

SEQ ID NO: 808470 - DNA, 20 bp, Artificial
  CRISPR gRNA sequence
agagcccacaacaatgtact

SEQ ID NO: 808471 - DNA, 20 bp, Artificial
  CRISPR gRNA sequence
cttaatcattgtttgttgca

SEQ ID NO: 808472 - DNA, 20 bp, Artificial
  CRISPR gRNA sequence
ttaatcattgtttgttgcaa

SEQ ID NO: 808473 - DNA, 20 bp, Artificial
  CRISPR gRNA sequence
aatcattgtttgttgcaaaa

SEQ ID NO: 808474 - DNA, 20 bp, Artificial
  CRISPR gRNA sequence
atcattgtttgttgcaaaaa

SEQ ID NO: 808475 - DNA, 20 bp, Artificial
  CRISPR gRNA sequence
tttgttgcaaaaacatccat

SEQ ID NO: 808476 - DNA, 20 bp, Artificial
  CRISPR gRNA sequence
gttgcaaaaacatccattgt

SEQ ID NO: 808477 - DNA, 20 bp, Artificial
  CRISPR gRNA sequence
ttgcaaaaacatccattgtc

SEQ ID NO: 808478 - DNA, 20 bp, Artificial
  CRISPR gRNA sequence
caaaaacatccattgtcaat

SEQ ID NO: 808479 - DNA, 20 bp, Artificial
  CRISPR gRNA sequence
tcaattgcatcgcagttgaa

SEQ ID NO: 808480 - DNA, 20 bp, Artificial
  CRISPR gRNA sequence
catcgcagttgaatatcttc

SEQ ID NO: 808481 - DNA, 20 bp, Artificial
  CRISPR gRNA sequence
aatatcttctctttgctgtt

SEQ ID NO: 808482 - DNA, 20 bp, Artificial
  CRISPR gRNA sequence
ctctttgctgttcgatttta

SEQ ID NO: 808483 - DNA, 20 bp, Artificial
  CRISPR gRNA sequence
tctttgctgttcgattttaa

SEQ ID NO: 808484 - DNA, 20 bp, Artificial
  CRISPR gRNA sequence
tttgctgttcgattttaact

SEQ ID NO: 808485 - DNA, 20 bp, Artificial
  CRISPR gRNA sequence
tgctgttcgattttaactct

SEQ ID NO: 808486 - DNA, 20 bp, Artificial
  CRISPR gRNA sequence
gctgttcgattttaactctg

SEQ ID NO: 808487 - DNA, 20 bp, Artificial
  CRISPR gRNA sequence
ctgttcgattttaactctgt

SEQ ID NO: 808488 - DNA, 20 bp, Artificial
  CRISPR gRNA sequence
ttcgattttaactctgtttc

SEQ ID NO: 808489 - DNA, 20 bp, Artificial
  CRISPR gRNA sequence
gattttaactctgtttctaa

SEQ ID NO: 808490 - DNA, 20 bp, Artificial
  CRISPR gRNA sequence
taactctgtttctaactatg

SEQ ID NO: 808491 - DNA, 20 bp, Artificial
  CRISPR gRNA sequence
aactctgtttctaactatgt

SEQ ID NO: 808492 - DNA, 20 bp, Artificial
  CRISPR gRNA sequence
actctgtttctaactatgtg

SEQ ID NO: 808493 - DNA, 20 bp, Artificial
  CRISPR gRNA sequence
tgtttctaactatgtgagac

SEQ ID NO: 808494 - DNA, 20 bp, Artificial
  CRISPR gRNA sequence
tttctaactatgtgagacca

SEQ ID NO: 808495 - DNA, 20 bp, Artificial
  CRISPR gRNA sequence
ctaactatgtgagaccagag

SEQ ID NO: 808496 - DNA, 20 bp, Artificial
  CRISPR gRNA sequence
taactatgtgagaccagagg

SEQ ID NO: 808497 - DNA, 20 bp, Artificial
  CRISPR gRNA sequence
actatgtgagaccagaggtc

SEQ ID NO: 808498 - DNA, 20 bp, Artificial
  CRISPR gRNA sequence
tgtgagaccagaggtccagt

SEQ ID NO: 808499 - DNA, 20 bp, Artificial
  CRISPR gRNA sequence
ggagtgcttaggaatataga

SEQ ID NO: 808500 - DNA, 20 bp, Artificial
  CRISPR gRNA sequence
aggaatatagaccgagcaaa

SEQ ID NO: 808501 - DNA, 20 bp, Artificial
  CRISPR gRNA sequence
ggaatatagaccgagcaaaa

SEQ ID NO: 808502 - DNA, 20 bp, Artificial
  CRISPR gRNA sequence
ttctggggctaagaacgagg

SEQ ID NO: 808503 - DNA, 20 bp, Artificial
  CRISPR gRNA sequence
tggggctaagaacgaggctt

SEQ ID NO: 808504 - DNA, 20 bp, Artificial
  CRISPR gRNA sequence
gggctaagaacgaggcttcg

SEQ ID NO: 808505 - DNA, 20 bp, Artificial
  CRISPR gRNA sequence
agaacgaggcttcgctgaaa

SEQ ID NO: 808506 - DNA, 20 bp, Artificial
  CRISPR gRNA sequence
cgctgaaatgctaccaaaca

SEQ ID NO: 808507 - DNA, 20 bp, Artificial
  CRISPR gRNA sequence
gctgaaatgctaccaaacag

SEQ ID NO: 808508 - DNA, 20 bp, Artificial
  CRISPR gRNA sequence
aaatgctaccaaacaggaag

SEQ ID NO: 808509 - DNA, 20 bp, Artificial
  CRISPR gRNA sequence
ccaaacaggaagattctata

SEQ ID NO: 808510 - DNA, 20 bp, Artificial
  CRISPR gRNA sequence
tataagctggaactattcag

SEQ ID NO: 808511 - DNA, 20 bp, Artificial
  CRISPR gRNA sequence
taagctggaactattcagtt

SEQ ID NO: 808512 - DNA, 20 bp, Artificial
  CRISPR gRNA sequence
gaactattcagttgccttcc

SEQ ID NO: 808513 - DNA, 20 bp, Artificial
  CRISPR gRNA sequence
ttcagttgccttccatgaat

SEQ ID NO: 808514 - DNA, 20 bp, Artificial
  CRISPR gRNA sequence
agttgccttccatgaattaa

SEQ ID NO: 808515 - DNA, 20 bp, Artificial
  CRISPR gRNA sequence
ccttccatgaattaatagaa

SEQ ID NO: 808516 - DNA, 20 bp, Artificial
  CRISPR gRNA sequence
ccatgaattaatagaacagt

SEQ ID NO: 808517 - DNA, 20 bp, Artificial
  CRISPR gRNA sequence
catgaattaatagaacagtg

SEQ ID NO: 808518 - DNA, 20 bp, Artificial
  CRISPR gRNA sequence
atagaacagtggttacttta

SEQ ID NO: 808519 - DNA, 20 bp, Artificial
  CRISPR gRNA sequence
ctttaaaattcaagctgaga

SEQ ID NO: 808520 - DNA, 20 bp, Artificial
  CRISPR gRNA sequence
taaaattcaagctgagagag

SEQ ID NO: 808521 - DNA, 20 bp, Artificial
  CRISPR gRNA sequence
aaaattcaagctgagagaga

SEQ ID NO: 808522 - DNA, 20 bp, Artificial
  CRISPR gRNA sequence
aaattcaagctgagagagaa

SEQ ID NO: 808523 - DNA, 20 bp, Artificial
  CRISPR gRNA sequence
aagctgagagagaaaagaaa

SEQ ID NO: 808524 - DNA, 20 bp, Artificial
  CRISPR gRNA sequence
agagagaaaagaaagtaaga

SEQ ID NO: 808525 - DNA, 20 bp, Artificial
  CRISPR gRNA sequence
actcacagcactgttcactt

SEQ ID NO: 808526 - DNA, 20 bp, Artificial
  CRISPR gRNA sequence
ctcacagcactgttcacttc

SEQ ID NO: 808527 - DNA, 20 bp, Artificial
  CRISPR gRNA sequence
acagcactgttcacttccct

SEQ ID NO: 808528 - DNA, 20 bp, Artificial
  CRISPR gRNA sequence
ttcacttccctctttgttgt

SEQ ID NO: 808529 - DNA, 20 bp, Artificial
  CRISPR gRNA sequence
acttccctctttgttgtggt

SEQ ID NO: 808530 - DNA, 20 bp, Artificial
  CRISPR gRNA sequence
ccctctttgttgtggtgaca

SEQ ID NO: 808531 - DNA, 20 bp, Artificial
  CRISPR gRNA sequence
cctctttgttgtggtgacag

SEQ ID NO: 808532 - DNA, 20 bp, Artificial
  CRISPR gRNA sequence
tttgttgtggtgacaggtct

SEQ ID NO: 808533 - DNA, 20 bp, Artificial
  CRISPR gRNA sequence
tgttgtggtgacaggtcttt

SEQ ID NO: 808534 - DNA, 20 bp, Artificial
  CRISPR gRNA sequence
gttgtggtgacaggtctttt

SEQ ID NO: 808535 - DNA, 20 bp, Artificial
  CRISPR gRNA sequence
ttgtggtgacaggtcttttt

SEQ ID NO: 808536 - DNA, 20 bp, Artificial
  CRISPR gRNA sequence
tggtgacaggtctttttgtt

SEQ ID NO: 808537 - DNA, 20 bp, Artificial
  CRISPR gRNA sequence
tttgttgtgtctgaaaagga

SEQ ID NO: 808538 - DNA, 20 bp, Artificial
  CRISPR gRNA sequence
ttgttgtgtctgaaaaggaa

SEQ ID NO: 808539 - DNA, 20 bp, Artificial
  CRISPR gRNA sequence
tgttgtgtctgaaaaggaaa

SEQ ID NO: 808540 - DNA, 20 bp, Artificial
  CRISPR gRNA sequence
gttgtgtctgaaaaggaaaa

SEQ ID NO: 808541 - DNA, 20 bp, Artificial
  CRISPR gRNA sequence
ttgtgtctgaaaaggaaaaa

SEQ ID NO: 808542 - DNA, 20 bp, Artificial
  CRISPR gRNA sequence
tgtctgaaaaggaaaaattc

SEQ ID NO: 808543 - DNA, 20 bp, Artificial
  CRISPR gRNA sequence
aaaaggaaaaattccagaaa

SEQ ID NO: 808544 - DNA, 20 bp, Artificial
  CRISPR gRNA sequence
cagaaatggaataagattaa

SEQ ID NO: 808545 - DNA, 20 bp, Artificial
  CRISPR gRNA sequence
atgagaaaactgtttggctt

SEQ ID NO: 808546 - DNA, 20 bp, Artificial
  CRISPR gRNA sequence
tttggcttatagattaaaat

SEQ ID NO: 808547 - DNA, 20 bp, Artificial
  CRISPR gRNA sequence
ggcttatagattaaaatatg

SEQ ID NO: 808548 - DNA, 20 bp, Artificial
  CRISPR gRNA sequence
gcttatagattaaaatatgg

SEQ ID NO: 808549 - DNA, 20 bp, Artificial
  CRISPR gRNA sequence
atagattaaaatatggcagg

SEQ ID NO: 808550 - DNA, 20 bp, Artificial
  CRISPR gRNA sequence
tagattaaaatatggcagga

SEQ ID NO: 808551 - DNA, 20 bp, Artificial
  CRISPR gRNA sequence
aaatatggcaggacaaaaag

SEQ ID NO: 808552 - DNA, 20 bp, Artificial
  CRISPR gRNA sequence
aataaatccacatagcgaag

SEQ ID NO: 808553 - DNA, 20 bp, Artificial
  CRISPR gRNA sequence
actgtggcctgggacttcgg

SEQ ID NO: 808554 - DNA, 20 bp, Artificial
  CRISPR gRNA sequence
tggcctgggacttcggatgg

SEQ ID NO: 808555 - DNA, 20 bp, Artificial
  CRISPR gRNA sequence
ggacttcggatggtaatgca

SEQ ID NO: 808556 - DNA, 20 bp, Artificial
  CRISPR gRNA sequence
cggatggtaatgcataaagc

SEQ ID NO: 808557 - DNA, 20 bp, Artificial
  CRISPR gRNA sequence
ggatggtaatgcataaagca

SEQ ID NO: 808558 - DNA, 20 bp, Artificial
  CRISPR gRNA sequence
gcccctaggcaaagagtgtg

SEQ ID NO: 808559 - DNA, 20 bp, Artificial
  CRISPR gRNA sequence
ggcaaagagtgtgaacaaag

SEQ ID NO: 808560 - DNA, 20 bp, Artificial
  CRISPR gRNA sequence
acactttccattcctctgtc

SEQ ID NO: 808561 - DNA, 20 bp, Artificial
  CRISPR gRNA sequence
tccattcctctgtctactcc

SEQ ID NO: 808562 - DNA, 20 bp, Artificial
  CRISPR gRNA sequence
ccattcctctgtctactcct

SEQ ID NO: 808563 - DNA, 20 bp, Artificial
  CRISPR gRNA sequence
cattcctctgtctactcctg

SEQ ID NO: 808564 - DNA, 20 bp, Artificial
  CRISPR gRNA sequence
ctctgtctactcctggccct

SEQ ID NO: 808565 - DNA, 20 bp, Artificial
  CRISPR gRNA sequence
tgtctactcctggccctcag

SEQ ID NO: 808566 - DNA, 20 bp, Artificial
  CRISPR gRNA sequence
tctactcctggccctcaggc

SEQ ID NO: 808567 - DNA, 20 bp, Artificial
  CRISPR gRNA sequence
ctcctggccctcaggcactt

SEQ ID NO: 808568 - DNA, 20 bp, Artificial
  CRISPR gRNA sequence
ctggccctcaggcacttaaa

SEQ ID NO: 808569 - DNA, 20 bp, Artificial
  CRISPR gRNA sequence
gccctcaggcacttaaaggc

SEQ ID NO: 808570 - DNA, 20 bp, Artificial
  CRISPR gRNA sequence
aggcacttaaaggctgaggg

SEQ ID NO: 808571 - DNA, 20 bp, Artificial
  CRISPR gRNA sequence
aaaggctgagggactaattt

SEQ ID NO: 808572 - DNA, 20 bp, Artificial
  CRISPR gRNA sequence
aaggctgagggactaatttg

SEQ ID NO: 808573 - DNA, 20 bp, Artificial
  CRISPR gRNA sequence
agggactaatttgggtattc

SEQ ID NO: 808574 - DNA, 20 bp, Artificial
  CRISPR gRNA sequence
atttgggtattcaatccagg

SEQ ID NO: 808575 - DNA, 20 bp, Artificial
  CRISPR gRNA sequence
gggtattcaatccaggaaat

SEQ ID NO: 808576 - DNA, 20 bp, Artificial
  CRISPR gRNA sequence
ggtattcaatccaggaaatg

SEQ ID NO: 808577 - DNA, 20 bp, Artificial
  CRISPR gRNA sequence
aatccaggaaatgtctggct

SEQ ID NO: 808578 - DNA, 20 bp, Artificial
  CRISPR gRNA sequence
gctgcagaattagctctccc

SEQ ID NO: 808579 - DNA, 20 bp, Artificial
  CRISPR gRNA sequence
cagaattagctctccctttt

SEQ ID NO: 808580 - DNA, 20 bp, Artificial
  CRISPR gRNA sequence
gctctcccttttctgcttta

SEQ ID NO: 808581 - DNA, 20 bp, Artificial
  CRISPR gRNA sequence
tcccttttctgctttagtct

SEQ ID NO: 808582 - DNA, 20 bp, Artificial
  CRISPR gRNA sequence
ccttttctgctttagtcttg

SEQ ID NO: 808583 - DNA, 20 bp, Artificial
  CRISPR gRNA sequence
ttctgctttagtcttgactg

SEQ ID NO: 808584 - DNA, 20 bp, Artificial
  CRISPR gRNA sequence
tctgctttagtcttgactgc

SEQ ID NO: 808585 - DNA, 20 bp, Artificial
  CRISPR gRNA sequence
ctgctttagtcttgactgct

SEQ ID NO: 808586 - DNA, 20 bp, Artificial
  CRISPR gRNA sequence
tgctttagtcttgactgcta

SEQ ID NO: 808587 - DNA, 20 bp, Artificial
  CRISPR gRNA sequence
ctttagtcttgactgctact

SEQ ID NO: 808588 - DNA, 20 bp, Artificial
  CRISPR gRNA sequence
tagtcttgactgctacttct

SEQ ID NO: 808589 - DNA, 20 bp, Artificial
  CRISPR gRNA sequence
agtcttgactgctacttctg

SEQ ID NO: 808590 - DNA, 20 bp, Artificial
  CRISPR gRNA sequence
gtcttgactgctacttctgc

SEQ ID NO: 808591 - DNA, 20 bp, Artificial
  CRISPR gRNA sequence
gactgctacttctgcctgcc

SEQ ID NO: 808592 - DNA, 20 bp, Artificial
  CRISPR gRNA sequence
actgctacttctgcctgcct

SEQ ID NO: 808593 - DNA, 20 bp, Artificial
  CRISPR gRNA sequence
ctacttctgcctgccttccc

SEQ ID NO: 808594 - DNA, 20 bp, Artificial
  CRISPR gRNA sequence
cttctgcctgccttccctgg

SEQ ID NO: 808595 - DNA, 20 bp, Artificial
  CRISPR gRNA sequence
ctgcctgccttccctggtcc

SEQ ID NO: 808596 - DNA, 20 bp, Artificial
  CRISPR gRNA sequence
tgcctgccttccctggtcca

SEQ ID NO: 808597 - DNA, 20 bp, Artificial
  CRISPR gRNA sequence
cctgccttccctggtccagg

SEQ ID NO: 808598 - DNA, 20 bp, Artificial
  CRISPR gRNA sequence
ccttccctggtccaggtcag

SEQ ID NO: 808599 - DNA, 20 bp, Artificial
  CRISPR gRNA sequence
ccctggtccaggtcagaatg

SEQ ID NO: 808600 - DNA, 20 bp, Artificial
  CRISPR gRNA sequence
cctggtccaggtcagaatgt

SEQ ID NO: 808601 - DNA, 20 bp, Artificial
  CRISPR gRNA sequence
gtccaggtcagaatgtctga

SEQ ID NO: 808602 - DNA, 20 bp, Artificial
  CRISPR gRNA sequence
atcaattaattttgcactaa

SEQ ID NO: 808603 - DNA, 20 bp, Artificial
  CRISPR gRNA sequence
attttgcactaaggtataag

SEQ ID NO: 808604 - DNA, 20 bp, Artificial
  CRISPR gRNA sequence
tgcactaaggtataagtgac

SEQ ID NO: 808605 - DNA, 20 bp, Artificial
  CRISPR gRNA sequence
gcactaaggtataagtgact

SEQ ID NO: 808606 - DNA, 20 bp, Artificial
  CRISPR gRNA sequence
cactaaggtataagtgactg

SEQ ID NO: 808607 - DNA, 20 bp, Artificial
  CRISPR gRNA sequence
aggtataagtgactgatact

SEQ ID NO: 808608 - DNA, 20 bp, Artificial
  CRISPR gRNA sequence
atactggctcaaagtaactc

SEQ ID NO: 808609 - DNA, 20 bp, Artificial
  CRISPR gRNA sequence
gctcaaagtaactcaagtta

SEQ ID NO: 808610 - DNA, 20 bp, Artificial
  CRISPR gRNA sequence
aaagtaactcaagttactgg

SEQ ID NO: 808611 - DNA, 20 bp, Artificial
  CRISPR gRNA sequence
aagttactggttcagaagca

SEQ ID NO: 808612 - DNA, 20 bp, Artificial
  CRISPR gRNA sequence
ctggttcagaagcacaagtt

SEQ ID NO: 808613 - DNA, 20 bp, Artificial
  CRISPR gRNA sequence
gttcagaagcacaagttcac

SEQ ID NO: 808614 - DNA, 20 bp, Artificial
  CRISPR gRNA sequence
agaagcacaagttcacataa

SEQ ID NO: 808615 - DNA, 20 bp, Artificial
  CRISPR gRNA sequence
acataatgggatgctgctca

SEQ ID NO: 808616 - DNA, 20 bp, Artificial
  CRISPR gRNA sequence
ctcaccagtaagtttccttg

SEQ ID NO: 808617 - DNA, 20 bp, Artificial
  CRISPR gRNA sequence
accagtaagtttccttgatt

SEQ ID NO: 808618 - DNA, 20 bp, Artificial
  CRISPR gRNA sequence
ccttgatttcacatctttct

SEQ ID NO: 808619 - DNA, 20 bp, Artificial
  CRISPR gRNA sequence
cttgatttcacatctttctt

SEQ ID NO: 808620 - DNA, 20 bp, Artificial
  CRISPR gRNA sequence
gatttcacatctttctttta

SEQ ID NO: 808621 - DNA, 20 bp, Artificial
  CRISPR gRNA sequence
atttcacatctttcttttaa

SEQ ID NO: 808622 - DNA, 20 bp, Artificial
  CRISPR gRNA sequence
cacatctttcttttaatttt

SEQ ID NO: 808623 - DNA, 20 bp, Artificial
  CRISPR gRNA sequence
acatctttcttttaattttt

SEQ ID NO: 808624 - DNA, 20 bp, Artificial
  CRISPR gRNA sequence
tcttttaattttttttttat

SEQ ID NO: 808625 - DNA, 20 bp, Artificial
  CRISPR gRNA sequence
cttttaattttttttttata

SEQ ID NO: 808626 - DNA, 20 bp, Artificial
  CRISPR gRNA sequence
ttttaattttttttttatat

SEQ ID NO: 808627 - DNA, 20 bp, Artificial
  CRISPR gRNA sequence
ttaattttttttttatatca

SEQ ID NO: 808628 - DNA, 20 bp, Artificial
  CRISPR gRNA sequence
taattttttttttatatcaa

SEQ ID NO: 808629 - DNA, 20 bp, Artificial
  CRISPR gRNA sequence
aattttttttttatatcaat

SEQ ID NO: 808630 - DNA, 20 bp, Artificial
  CRISPR gRNA sequence
attttttttttatatcaata

SEQ ID NO: 808631 - DNA, 20 bp, Artificial
  CRISPR gRNA sequence
tttttttatatcaataggtt

SEQ ID NO: 808632 - DNA, 20 bp, Artificial
  CRISPR gRNA sequence
ttttttatatcaataggttt

SEQ ID NO: 808633 - DNA, 20 bp, Artificial
  CRISPR gRNA sequence
tttttatatcaataggttta

SEQ ID NO: 808634 - DNA, 20 bp, Artificial
  CRISPR gRNA sequence
ttttatatcaataggtttag

SEQ ID NO: 808635 - DNA, 20 bp, Artificial
  CRISPR gRNA sequence
tttatatcaataggtttagg

SEQ ID NO: 808636 - DNA, 20 bp, Artificial
  CRISPR gRNA sequence
ttatatcaataggtttaggg

SEQ ID NO: 808637 - DNA, 20 bp, Artificial
  CRISPR gRNA sequence
tatatcaataggtttagggg

SEQ ID NO: 808638 - DNA, 20 bp, Artificial
  CRISPR gRNA sequence
atatcaataggtttaggggt

SEQ ID NO: 808639 - DNA, 20 bp, Artificial
  CRISPR gRNA sequence
tatcaataggtttaggggta

SEQ ID NO: 808640 - DNA, 20 bp, Artificial
  CRISPR gRNA sequence
aggggtacaggtggtttttg

SEQ ID NO: 808641 - DNA, 20 bp, Artificial
  CRISPR gRNA sequence
ggggtacaggtggtttttgg

SEQ ID NO: 808642 - DNA, 20 bp, Artificial
  CRISPR gRNA sequence
ttggttacatggatgaattg

SEQ ID NO: 808643 - DNA, 20 bp, Artificial
  CRISPR gRNA sequence
tggttacatggatgaattgt

SEQ ID NO: 808644 - DNA, 20 bp, Artificial
  CRISPR gRNA sequence
ggttacatggatgaattgta

SEQ ID NO: 808645 - DNA, 20 bp, Artificial
  CRISPR gRNA sequence
gttacatggatgaattgtat

SEQ ID NO: 808646 - DNA, 20 bp, Artificial
  CRISPR gRNA sequence
catggatgaattgtatactg

SEQ ID NO: 808647 - DNA, 20 bp, Artificial
  CRISPR gRNA sequence
tatactggtgaagtctgaat

SEQ ID NO: 808648 - DNA, 20 bp, Artificial
  CRISPR gRNA sequence
gtgaagtctgaattttagtg

SEQ ID NO: 808649 - DNA, 20 bp, Artificial
  CRISPR gRNA sequence
aattttagtgcacccgtcac

SEQ ID NO: 808650 - DNA, 20 bp, Artificial
  CRISPR gRNA sequence
tagtgcacccgtcacccaaa

SEQ ID NO: 808651 - DNA, 20 bp, Artificial
  CRISPR gRNA sequence
agtgcacccgtcacccaaat
